United States Patent 7,795,419 (VIRAL AND VIRAL ASSOCIATED MIRNAS AND USES THEREOF) - sequence listing, part 13

SEQ ID NO: 365622 - RNA, 64 nt, Human
ggaccagguacaguagcugaaacccaauucagauccaccauaggauucuuugacuacauaccuc

SEQ ID NO: 365623 - RNA, 64 nt, Human
uuuggcuuuuuacuuguuuuuuuggauagccaucccaccauaggauguguacauagauacugaa

SEQ ID NO: 365624 - RNA, 64 nt, Human
uaauguucaauauuaaaaggauaauucacauuugccaccauaauguucuuuuuuauguaaaaag

SEQ ID NO: 365625 - RNA, 64 nt, Human
auucauguuuagccaguguuuuccagccuuguacccaccauacagaucuguuuauucuguuuca

SEQ ID NO: 365626 - RNA, 64 nt, Human
agauagcuauuaagauacuuagauuagaccuaacccaccauagucaauccaagacuagacuacu

SEQ ID NO: 365627 - RNA, 64 nt, Human
cagccucccaaguagcugggaauacaggugucugccaccauacccaguuucauuuuuguuuuuu

SEQ ID NO: 365628 - RNA, 64 nt, Human
uuuguaucuaauugauacauuuuauguuaauuuaccaccauacauuuuauuaaucaaaauugua

SEQ ID NO: 365629 - RNA, 64 nt, Human
cagccucccaaguagcugggauuacagacgugugccaccauaccuggguaauuuuugcauuuuu

SEQ ID NO: 365630 - RNA, 64 nt, Human
uaaauuuggaaaggagcuaguagcuuuaaggccaccaccauauuuuacuuuuuuaggauuuuuc

SEQ ID NO: 365631 - RNA, 64 nt, Human
ugccagaugucaacauuaagcugcaacauccuaaccaccauaagccggaggugguuacagcuua

SEQ ID NO: 365632 - RNA, 64 nt, Human
auaccuuugccuuggaaguugcauggcaucaccuccaccauacuccaucaguuagagcugacac

SEQ ID NO: 365633 - RNA, 64 nt, Human
cuccguuguugcgugagaacccgugugccccuucccaccauauccacccucgcuccaucuuuga

SEQ ID NO: 365634 - RNA, 64 nt, Human
ugacuugggggaaaaauuagugaugaaacagccaccaccauauugccauuaguggaaaaaaaga

SEQ ID NO: 365635 - RNA, 64 nt, Human
ggguucuacagccuugucccccucccccucaaccccaccauaugaauuguacagaauauuucua

SEQ ID NO: 365636 - RNA, 64 nt, Human
cccaguggaaaaaucgguugugccucccugcuucccaccauagcugccugaaaacaugacgcuc

SEQ ID NO: 365637 - RNA, 64 nt, Human
aaaugauugccacauugcaagcuauuauuuucucccaccauauuuuuuaauuaaaaaaaagucu

SEQ ID NO: 365638 - RNA, 64 nt, Human
gacucugcagggcagccauccuggaugauggaagccaccauauugacuugggguauaggcccaa

SEQ ID NO: 365639 - RNA, 64 nt, Human
uccugggacaaccagacucuguaacucacccccaccaccauacacacacacaaaaacagaaaca

SEQ ID NO: 365640 - RNA, 64 nt, Human
gagccugggguuggauagggccauggcuggucccccaccauaccuccccuccacaucacugaca

SEQ ID NO: 365641 - RNA, 64 nt, Human
uagaccaaccagugggaaacugccccagcuucucccaccauagggggccggacccccaucacca

SEQ ID NO: 365642 - RNA, 64 nt, Human
uuuccaggagagaaugggagacaauccuagacuuccaccauaaugcaguuaccuguaggcauaa

SEQ ID NO: 365643 - RNA, 64 nt, Human
cucucucucuccucucucucucucucuuuuuaaaccaccauagacucucacuuauuuuggagga

SEQ ID NO: 365644 - RNA, 64 nt, Human
cguagggaugguggaccacagaaggcuauaaaggccaccauagaaagcugaagagccauuuaau

SEQ ID NO: 365645 - RNA, 64 nt, Human
aggaaaaaaaacuauugauaaguuuauaggcaaaccaccauaaggggugagucagacaggucug

SEQ ID NO: 365646 - RNA, 64 nt, Human
gugcuaaaacuuggauauuugugaaaacuccuuaccaccauacaagcaucagaagagcucucuu

SEQ ID NO: 365647 - RNA, 64 nt, Human
ggagaagcaggucuaggacuccccugcaccuuugccaccauaauggcccacacucccugggucc

SEQ ID NO: 365648 - RNA, 64 nt, Human
cagccucccuaguagcugggauuacaggcaugcaccaccauacccagcuaauuucuguauuuuu

SEQ ID NO: 365649 - RNA, 64 nt, Human
aucccagucuccuggcccccaggccagggucuguccaccauagaaugucuuccucuacuggggu

SEQ ID NO: 365650 - RNA, 59 nt, Human
ucauuuuacaacagaacugagacagacgaccaccauauucacugaggucuaaauuugca

SEQ ID NO: 365651 - RNA, 64 nt, Human
ggaacagaaaauggaggccuguuuuuuauugcuaccaccauagaucuggagaucuucgccagua

SEQ ID NO: 365652 - RNA, 64 nt, Human
auacaucaagccaauaccguguggcccaagacccccaccauaaaucacaucauuagcaugaacc

SEQ ID NO: 365653 - RNA, 64 nt, Human
gggggcuccgugaguggccugcuaucugcaaugaccaccauagcuuaaccccauccccacccuc

SEQ ID NO: 365654 - RNA, 64 nt, Human
uuacuggguguauaccuaaaggaauauaaucauuccaccauaaagacaaacacuuguauguuca

SEQ ID NO: 365655 - RNA, 64 nt, Human
cagccucccaaguagcugggauuacaggcguguaccaccauacccagcuaauuuuuguauuuuu

SEQ ID NO: 365656 - RNA, 64 nt, Human
acaacucauucccacauucuucagucccuggcgaccaccauauuuuuaagucauuaugacucug

SEQ ID NO: 365657 - RNA, 64 nt, Human
cuuggcucuuccagguuguccuacccucuggcauccaccauagacguuuuucaaacagaaaaug

SEQ ID NO: 365658 - RNA, 64 nt, Human
caaagacccuuguucuuaucccucaagaagaaacccaccauaaccagcccacugucaccccuaa

SEQ ID NO: 365659 - RNA, 64 nt, Human
agcugcccucguuuacucacaguuugcuuauuugccaccauaagaaaugguacaauaaaaauuc

SEQ ID NO: 365660 - RNA, 64 nt, Human
ccaaaaaaacacauacauaggaacugguuauauuccaccauaacacacacacacacacacacac

SEQ ID NO: 365661 - RNA, 64 nt, Human
gagccaggaucgaauggaaggggggaauugggguccaccauagucuucugcucugguccuccac

SEQ ID NO: 365662 - RNA, 64 nt, Human
cauguugccccuuucucuuuuccccuuuccugucccaccauacgagcaccuccagccugaacag

SEQ ID NO: 365663 - RNA, 64 nt, Human
ggagcaagagagggcaaguguucccaaauugacgccaccauaauaaucaucaccacaccgugag

SEQ ID NO: 365664 - RNA, 64 nt, Human
agcaugcacaggaugguaaauuggauugguggauccaccauaucaugggauuuaaauuuaucau

SEQ ID NO: 365665 - RNA, 64 nt, Human
aaagugaaacguaauuguacaagcaguuaaucacccaccauagggcaugauuaacaaagcaacc

SEQ ID NO: 365666 - RNA, 64 nt, Human
auuuucagaaaaucuacaagucucguugagaccaccaccauaccucagaagguaggacuguggc

SEQ ID NO: 365667 - RNA, 64 nt, Human
cagccucccgaguagcugagacuacaggcaccugccaccauacccagcuaaguuauguauuuuu

SEQ ID NO: 365668 - RNA, 64 nt, Human
cugcccagaugcccuuuggaaagccauugaccacccaccauauuguuugaucuacuucauagcu

SEQ ID NO: 365669 - RNA, 64 nt, Human
uccuggccccaccagggccuugggcaaguccugcccaccauaggccucugcuaccugccaguca

SEQ ID NO: 365670 - RNA, 64 nt, Human
uggggucugugguccauccuccaggcauccauguccaccauagaauuugguuacuugguaagug

SEQ ID NO: 365671 - RNA, 64 nt, Human
uuucugcgggaaggaauuaagcuauguauuagguccaccauacgaucuguguaaguaagauuau

SEQ ID NO: 365672 - RNA, 64 nt, Human
ugcugcuacgguuuuaaucauccagggugccauuccaccauagaagagcaauccuuuuaggaaa

SEQ ID NO: 365673 - RNA, 64 nt, Human
cuuccagccugccaaucaacccuccuggguguggccaccauaugugugugccuagguccuccuu

SEQ ID NO: 365674 - RNA, 64 nt, Human
ucccacaacuacuagugugacuccuuaucucuuuccaccauaccuuagagacuuugauacuacc

SEQ ID NO: 365675 - RNA, 64 nt, Human
uuucaauuugaucauauuuuaaaauauguuuucaccaccauauaagauuuugguucuacuugcu

SEQ ID NO: 365676 - RNA, 64 nt, Human
ccucccugcgugcacggccuaggaggugcacgggccaccauagucacacuggcacugaaaagaa

SEQ ID NO: 365677 - RNA, 64 nt, Human; identical to SEQ ID NO: 272999

SEQ ID NO: 365678 - RNA, 64 nt, Human; identical to SEQ ID NO: 273000

SEQ ID NO: 365679 - RNA, 64 nt, Human; identical to SEQ ID NO: 273001

SEQ ID NO: 365680 - RNA, 64 nt, Human; identical to SEQ ID NO: 273002

SEQ ID NO: 365681 - RNA, 64 nt, Human; identical to SEQ ID NO: 273003

SEQ ID NO: 365682 - RNA, 64 nt, Human; identical to SEQ ID NO: 273004

SEQ ID NO: 365683 - RNA, 64 nt, Human; identical to SEQ ID NO: 273005

SEQ ID NO: 365684 - RNA, 64 nt, Human; identical to SEQ ID NO: 273006

SEQ ID NO: 365685 - RNA, 64 nt, Human; identical to SEQ ID NO: 273007

SEQ ID NO: 365686 - RNA, 64 nt, Human; identical to SEQ ID NO: 273008

SEQ ID NO: 365687 - RNA, 64 nt, Human; identical to SEQ ID NO: 273009

SEQ ID NO: 365688 - RNA, 64 nt, Human; identical to SEQ ID NO: 273010

SEQ ID NO: 365689 - RNA, 64 nt, Human; identical to SEQ ID NO: 273011

SEQ ID NO: 365690 - RNA, 64 nt, Human; identical to SEQ ID NO: 365515

SEQ ID NO: 365691 - RNA, 64 nt, Human; identical to SEQ ID NO: 365516

SEQ ID NO: 365692 - RNA, 64 nt, Human; identical to SEQ ID NO: 365517

SEQ ID NO: 365693 - RNA, 64 nt, Human; identical to SEQ ID NO: 365518

SEQ ID NO: 365694 - RNA, 64 nt, Human; identical to SEQ ID NO: 365519

SEQ ID NO: 365695 - RNA, 64 nt, Human; identical to SEQ ID NO: 365520

SEQ ID NO: 365696 - RNA, 64 nt, Human; identical to SEQ ID NO: 365521

SEQ ID NO: 365697 - RNA, 64 nt, Human; identical to SEQ ID NO: 365522

SEQ ID NO: 365698 - RNA, 64 nt, Human; identical to SEQ ID NO: 365523

SEQ ID NO: 365699 - RNA, 64 nt, Human; identical to SEQ ID NO: 365524

SEQ ID NO: 365700 - RNA, 64 nt, Human; identical to SEQ ID NO: 365525

SEQ ID NO: 365701 - RNA, 64 nt, Human; identical to SEQ ID NO: 365526

SEQ ID NO: 365702 - RNA, 64 nt, Human; identical to SEQ ID NO: 365527

SEQ ID NO: 365703 - RNA, 64 nt, Human; identical to SEQ ID NO: 365528

SEQ ID NO: 365704 - RNA, 64 nt, Human; identical to SEQ ID NO: 365529

SEQ ID NO: 365705 - RNA, 64 nt, Human; identical to SEQ ID NO: 365530

SEQ ID NO: 365706 - RNA, 64 nt, Human; identical to SEQ ID NO: 365531

SEQ ID NO: 365707 - RNA, 64 nt, Human; identical to SEQ ID NO: 365532

SEQ ID NO: 365708 - RNA, 64 nt, Human; identical to SEQ ID NO: 365533

SEQ ID NO: 365709 - RNA, 64 nt, Human; identical to SEQ ID NO: 365534

SEQ ID NO: 365710 - RNA, 64 nt, Human; identical to SEQ ID NO: 365535

SEQ ID NO: 365711 - RNA, 64 nt, Human; identical to SEQ ID NO: 365536

SEQ ID NO: 365712 - RNA, 64 nt, Human; identical to SEQ ID NO: 365537

SEQ ID NO: 365713 - RNA, 64 nt, Human; identical to SEQ ID NO: 365538

SEQ ID NO: 365714 - RNA, 64 nt, Human; identical to SEQ ID NO: 365539

SEQ ID NO: 365715 - RNA, 64 nt, Human; identical to SEQ ID NO: 365540

SEQ ID NO: 365716 - RNA, 64 nt, Human; identical to SEQ ID NO: 365541

SEQ ID NO: 365717 - RNA, 64 nt, Human; identical to SEQ ID NO: 365542

SEQ ID NO: 365718 - RNA, 50 nt, Human; identical to SEQ ID NO: 365543

SEQ ID NO: 365719 - RNA, 64 nt, Human; identical to SEQ ID NO: 365544

SEQ ID NO: 365720 - RNA, 64 nt, Human; identical to SEQ ID NO: 365545

SEQ ID NO: 365721 - RNA, 64 nt, Human; identical to SEQ ID NO: 365546

SEQ ID NO: 365722 - RNA, 64 nt, Human; identical to SEQ ID NO: 365547

SEQ ID NO: 365723 - RNA, 64 nt, Human; identical to SEQ ID NO: 365548

SEQ ID NO: 365724 - RNA, 64 nt, Human; identical to SEQ ID NO: 365549

SEQ ID NO: 365725 - RNA, 63 nt, Human; identical to SEQ ID NO: 365550

SEQ ID NO: 365726 - RNA, 64 nt, Human; identical to SEQ ID NO: 365551

SEQ ID NO: 365727 - RNA, 64 nt, Human; identical to SEQ ID NO: 365552

SEQ ID NO: 365728 - RNA, 64 nt, Human; identical to SEQ ID NO: 365553

SEQ ID NO: 365729 - RNA, 64 nt, Human; identical to SEQ ID NO: 365554

SEQ ID NO: 365730 - RNA, 64 nt, Human; identical to SEQ ID NO: 365555

SEQ ID NO: 365731 - RNA, 64 nt, Human; identical to SEQ ID NO: 365556

SEQ ID NO: 365732 - RNA, 64 nt, Human; identical to SEQ ID NO: 365557

SEQ ID NO: 365733 - RNA, 64 nt, Human; identical to SEQ ID NO: 365558

SEQ ID NO: 365734 - RNA, 64 nt, Human; identical to SEQ ID NO: 365559

SEQ ID NO: 365735 - RNA, 64 nt, Human; identical to SEQ ID NO: 365560

SEQ ID NO: 365736 - RNA, 64 nt, Human; identical to SEQ ID NO: 365561

SEQ ID NO: 365737 - RNA, 64 nt, Human; identical to SEQ ID NO: 365562

SEQ ID NO: 365738 - RNA, 64 nt, Human; identical to SEQ ID NO: 365563

SEQ ID NO: 365739 - RNA, 64 nt, Human; identical to SEQ ID NO: 365564

SEQ ID NO: 365740 - RNA, 64 nt, Human; identical to SEQ ID NO: 365565

SEQ ID NO: 365741 - RNA, 64 nt, Human; identical to SEQ ID NO: 365566

SEQ ID NO: 365742 - RNA, 64 nt, Human; identical to SEQ ID NO: 365567

SEQ ID NO: 365743 - RNA, 64 nt, Human; identical to SEQ ID NO: 365568

SEQ ID NO: 365744 - RNA, 64 nt, Human; identical to SEQ ID NO: 365569

SEQ ID NO: 365745 - RNA, 64 nt, Human; identical to SEQ ID NO: 365570

SEQ ID NO: 365746 - RNA, 64 nt, Human; identical to SEQ ID NO: 365571

SEQ ID NO: 365747 - RNA, 64 nt, Human; identical to SEQ ID NO: 365572

SEQ ID NO: 365748 - RNA, 64 nt, Human; identical to SEQ ID NO: 365573

SEQ ID NO: 365749 - RNA, 64 nt, Human; identical to SEQ ID NO: 365574

SEQ ID NO: 365750 - RNA, 64 nt, Human; identical to SEQ ID NO: 365575

SEQ ID NO: 365751 - RNA, 64 nt, Human; identical to SEQ ID NO: 365576

SEQ ID NO: 365752 - RNA, 64 nt, Human; identical to SEQ ID NO: 365577

SEQ ID NO: 365753 - RNA, 64 nt, Human; identical to SEQ ID NO: 365578

SEQ ID NO: 365754 - RNA, 64 nt, Human; identical to SEQ ID NO: 365579

SEQ ID NO: 365755 - RNA, 64 nt, Human; identical to SEQ ID NO: 365580

SEQ ID NO: 365756 - RNA, 64 nt, Human; identical to SEQ ID NO: 365581

SEQ ID NO: 365757 - RNA, 64 nt, Human; identical to SEQ ID NO: 365582

SEQ ID NO: 365758 - RNA, 64 nt, Human; identical to SEQ ID NO: 365583

SEQ ID NO: 365759 - RNA, 64 nt, Human; identical to SEQ ID NO: 365584

SEQ ID NO: 365760 - RNA, 64 nt, Human; identical to SEQ ID NO: 365585

SEQ ID NO: 365761 - RNA, 64 nt, Human; identical to SEQ ID NO: 365586

SEQ ID NO: 365762 - RNA, 64 nt, Human; identical to SEQ ID NO: 365587

SEQ ID NO: 365763 - RNA, 64 nt, Human; identical to SEQ ID NO: 365588

SEQ ID NO: 365764 - RNA, 64 nt, Human; identical to SEQ ID NO: 365589

SEQ ID NO: 365765 - RNA, 64 nt, Human; identical to SEQ ID NO: 365590

SEQ ID NO: 365766 - RNA, 64 nt, Human; identical to SEQ ID NO: 365591

SEQ ID NO: 365767 - RNA, 64 nt, Human; identical to SEQ ID NO: 365592

SEQ ID NO: 365768 - RNA, 64 nt, Human; identical to SEQ ID NO: 365593

SEQ ID NO: 365769 - RNA, 64 nt, Human; identical to SEQ ID NO: 365594

SEQ ID NO: 365770 - RNA, 64 nt, Human; identical to SEQ ID NO: 365595

SEQ ID NO: 365771 - RNA, 64 nt, Human; identical to SEQ ID NO: 365596

SEQ ID NO: 365772 - RNA, 64 nt, Human; identical to SEQ ID NO: 365597

SEQ ID NO: 365773 - RNA, 64 nt, Human; identical to SEQ ID NO: 365598

SEQ ID NO: 365774 - RNA, 64 nt, Human; identical to SEQ ID NO: 365599

SEQ ID NO: 365775 - RNA, 64 nt, Human; identical to SEQ ID NO: 365600

SEQ ID NO: 365776 - RNA, 64 nt, Human; identical to SEQ ID NO: 365601

SEQ ID NO: 365777 - RNA, 64 nt, Human; identical to SEQ ID NO: 365602

SEQ ID NO: 365778 - RNA, 64 nt, Human; identical to SEQ ID NO: 365603

SEQ ID NO: 365779 - RNA, 64 nt, Human; identical to SEQ ID NO: 365604

SEQ ID NO: 365780 - RNA, 64 nt, Human; identical to SEQ ID NO: 365605

SEQ ID NO: 365781 - RNA, 64 nt, Human; identical to SEQ ID NO: 365606

SEQ ID NO: 365782 - RNA, 64 nt, Human; identical to SEQ ID NO: 365607

SEQ ID NO: 365783 - RNA, 64 nt, Human; identical to SEQ ID NO: 365608

SEQ ID NO: 365784 - RNA, 64 nt, Human; identical to SEQ ID NO: 365609

SEQ ID NO: 365785 - RNA, 64 nt, Human; identical to SEQ ID NO: 365610

SEQ ID NO: 365786 - RNA, 64 nt, Human; identical to SEQ ID NO: 365611

SEQ ID NO: 365787 - RNA, 64 nt, Human; identical to SEQ ID NO: 365612

SEQ ID NO: 365788 - RNA, 64 nt, Human; identical to SEQ ID NO: 365613

SEQ ID NO: 365789 - RNA, 64 nt, Human; identical to SEQ ID NO: 365614

SEQ ID NO: 365790 - RNA, 64 nt, Human; identical to SEQ ID NO: 365615

SEQ ID NO: 365791 - RNA, 64 nt, Human; identical to SEQ ID NO: 365616

SEQ ID NO: 365792 - RNA, 64 nt, Human; identical to SEQ ID NO: 365617

SEQ ID NO: 365793 - RNA, 64 nt, Human; identical to SEQ ID NO: 365618

SEQ ID NO: 365794 - RNA, 64 nt, Human; identical to SEQ ID NO: 365619

SEQ ID NO: 365795 - RNA, 64 nt, Human; identical to SEQ ID NO: 365620

SEQ ID NO: 365796 - RNA, 64 nt, Human; identical to SEQ ID NO: 365621

SEQ ID NO: 365797 - RNA, 64 nt, Human; identical to SEQ ID NO: 365622

SEQ ID NO: 365798 - RNA, 64 nt, Human; identical to SEQ ID NO: 365623

SEQ ID NO: 365799 - RNA, 64 nt, Human; identical to SEQ ID NO: 365624

SEQ ID NO: 365800 - RNA, 64 nt, Human; identical to SEQ ID NO: 365625

SEQ ID NO: 365801 - RNA, 64 nt, Human; identical to SEQ ID NO: 365626

SEQ ID NO: 365802 - RNA, 64 nt, Human; identical to SEQ ID NO: 365627

SEQ ID NO: 365803 - RNA, 64 nt, Human; identical to SEQ ID NO: 365628

SEQ ID NO: 365804 - RNA, 64 nt, Human; identical to SEQ ID NO: 365629

SEQ ID NO: 365805 - RNA, 64 nt, Human; identical to SEQ ID NO: 365630

SEQ ID NO: 365806 - RNA, 64 nt, Human; identical to SEQ ID NO: 365631

SEQ ID NO: 365807 - RNA, 64 nt, Human; identical to SEQ ID NO: 365632

SEQ ID NO: 365808 - RNA, 64 nt, Human; identical to SEQ ID NO: 365633

SEQ ID NO: 365809 - RNA, 64 nt, Human; identical to SEQ ID NO: 365634

SEQ ID NO: 365810 - RNA, 64 nt, Human; identical to SEQ ID NO: 365635

SEQ ID NO: 365811 - RNA, 64 nt, Human; identical to SEQ ID NO: 365636

SEQ ID NO: 365812 - RNA, 64 nt, Human; identical to SEQ ID NO: 365637

SEQ ID NO: 365813 - RNA, 64 nt, Human; identical to SEQ ID NO: 365638

SEQ ID NO: 365814 - RNA, 64 nt, Human; identical to SEQ ID NO: 365639

SEQ ID NO: 365815 - RNA, 64 nt, Human; identical to SEQ ID NO: 365640

SEQ ID NO: 365816 - RNA, 64 nt, Human; identical to SEQ ID NO: 365641

SEQ ID NO: 365817 - RNA, 64 nt, Human; identical to SEQ ID NO: 365642

SEQ ID NO: 365818 - RNA, 64 nt, Human; identical to SEQ ID NO: 365643

SEQ ID NO: 365819 - RNA, 64 nt, Human; identical to SEQ ID NO: 365644

SEQ ID NO: 365820 - RNA, 64 nt, Human; identical to SEQ ID NO: 365645

SEQ ID NO: 365821 - RNA, 64 nt, Human; identical to SEQ ID NO: 365646

SEQ ID NO: 365822 - RNA, 64 nt, Human; identical to SEQ ID NO: 365647

SEQ ID NO: 365823 - RNA, 64 nt, Human; identical to SEQ ID NO: 365648

SEQ ID NO: 365824 - RNA, 64 nt, Human; identical to SEQ ID NO: 365649

SEQ ID NO: 365825 - RNA, 59 nt, Human; identical to SEQ ID NO: 365650

SEQ ID NO: 365826 - RNA, 64 nt, Human; identical to SEQ ID NO: 365651

SEQ ID NO: 365827 - RNA, 64 nt, Human; identical to SEQ ID NO: 365652

SEQ ID NO: 365828 - RNA, 64 nt, Human; identical to SEQ ID NO: 365653

SEQ ID NO: 365829 - RNA, 64 nt, Human; identical to SEQ ID NO: 365654

SEQ ID NO: 365830 - RNA, 64 nt, Human; identical to SEQ ID NO: 365655

SEQ ID NO: 365831 - RNA, 64 nt, Human; identical to SEQ ID NO: 365656

SEQ ID NO: 365832 - RNA, 64 nt, Human; identical to SEQ ID NO: 365657

SEQ ID NO: 365833 - RNA, 64 nt, Human; identical to SEQ ID NO: 365658

SEQ ID NO: 365834 - RNA, 64 nt, Human; identical to SEQ ID NO: 365659

SEQ ID NO: 365835 - RNA, 64 nt, Human; identical to SEQ ID NO: 365660

SEQ ID NO: 365836 - RNA, 64 nt, Human; identical to SEQ ID NO: 365661

SEQ ID NO: 365837 - RNA, 64 nt, Human; identical to SEQ ID NO: 365662

SEQ ID NO: 365838 - RNA, 64 nt, Human; identical to SEQ ID NO: 365663

SEQ ID NO: 365839 - RNA, 64 nt, Human; identical to SEQ ID NO: 365664

SEQ ID NO: 365840 - RNA, 64 nt, Human; identical to SEQ ID NO: 365665

SEQ ID NO: 365841 - RNA, 64 nt, Human; identical to SEQ ID NO: 365666

SEQ ID NO: 365842 - RNA, 64 nt, Human; identical to SEQ ID NO: 365667

SEQ ID NO: 365843 - RNA, 64 nt, Human; identical to SEQ ID NO: 365668

SEQ ID NO: 365844 - RNA, 64 nt, Human; identical to SEQ ID NO: 365669

SEQ ID NO: 365845 - RNA, 64 nt, Human; identical to SEQ ID NO: 365670

SEQ ID NO: 365846 - RNA, 64 nt, Human; identical to SEQ ID NO: 365671

SEQ ID NO: 365847 - RNA, 64 nt, Human; identical to SEQ ID NO: 365672

SEQ ID NO: 365848 - RNA, 64 nt, Human; identical to SEQ ID NO: 365673

SEQ ID NO: 365849 - RNA, 64 nt, Human; identical to SEQ ID NO: 365674

SEQ ID NO: 365850 - RNA, 64 nt, Human; identical to SEQ ID NO: 365675

SEQ ID NO: 365851 - RNA, 64 nt, Human; identical to SEQ ID NO: 365676

SEQ ID NO: 365852 - RNA, 64 nt, Human
uucaggaccuugaggacacgugaccccacccgcccaccgccacuaucaggccccgggaccgcac

SEQ ID NO: 365853 - RNA, 64 nt, Human
augaggaggugugugagcagggaacucagugugacaccgccagguccagcacccaugggggcgg

SEQ ID NO: 365854 - RNA, 64 nt, Human
ggaauaaaauguugccuuccccacuucucaccaccaccgccaucaugacgcucauacuggcuuu

SEQ ID NO: 365855 - RNA, 64 nt, Human
gcgccagagacuggcggugucuuaagacuccgggcaccgccacgcgcugucaagcaacacucug

SEQ ID NO: 365856 - RNA, 64 nt, Human
caggcggggcgccccaagagcccaaaagagggcacaccgccauccucugccucaaauucugcgu

SEQ ID NO: 365857 - RNA, 64 nt, Human
ccugcgagacgcacacagcugagcacuuagcaggcaccgccacgucccagcaucccuggagcag

SEQ ID NO: 365858 - RNA, 64 nt, Human
cugagccaccaacuggaccccucuccagcaacaccaccgccaccaccucccacaucccugaggu

SEQ ID NO: 365859 - RNA, 64 nt, Human
gcacagcaguauagccacccggccuggccgccaccaccgccaccgagagccccgccuccagcag

SEQ ID NO: 365860 - RNA, 64 nt, Human
cucagccucccgaguagcugggagugcaggugcacaccgccaugccuggcugauuuuuuguauu

SEQ ID NO: 365861 - RNA, 64 nt, Human
ccccugggaccaaaauuuaggggccucagucccucaccgccaugcccuggccuauucugucucu

SEQ ID NO: 365862 - RNA, 64 nt, Human
cugccucagccucccgaguagcugggacugcaggcaccgccaccacgccuggcuaauuuuuugu

SEQ ID NO: 365863 - RNA, 64 nt, Human
ggaucaggcccgaaggaaaaugcuggaaaaccaccaccgccacccagcagucagagaggaccuu

SEQ ID NO: 365864 - RNA, 64 nt, Human
ccugggcuccaggcucccccgcgcgggcgccgcccaccgccauacuaaacgaucgaggaauaaa

SEQ ID NO: 365865 - RNA, 64 nt, Human
ggcguggucuuccaggcuggcccuuccuucuccucaccgccaccuucccugccccagccccagc

SEQ ID NO: 365866 - RNA, 64 nt, Human
ugguauuaaccuggaagccccccuggcuggaggccaccgccacccuaggaagggggcagggacg

SEQ ID NO: 365867 - RNA, 64 nt, Human
cgcauuuucuaccugaaauuggaagacuuggugccaccgccagcaauaauugacaaacuuuucc

SEQ ID NO: 365868 - RNA, 64 nt, Human
augucccuugaugucacccugaucugucaugccccaccgccaccccuacucccuucaacccucc

SEQ ID NO: 365869 - RNA, 64 nt, Human
agacacaucgacaaugagcaccaccaucaaugaccaccgccauucacaagaacuuugacuguuu

SEQ ID NO: 365870 - RNA, 64 nt, Human
gccuuuucguaccugggcucaggugcgguguggccaccgccacccucauccccugccugggagg

SEQ ID NO: 365871 - RNA, 64 nt, Human
agcuuagcuucucaaaggccuaaccaagccuuggcaccgccagauccuuucuguaggcuaauuc

SEQ ID NO: 365872 - RNA, 64 nt, Human
gccaucccccuagccaucgugagcaucccagcggcaccgccauugucucaaccagccggcuccu

SEQ ID NO: 365873 - RNA, 64 nt, Human
cagugggcacacggcagccugcaaagcacagggccaccgccacagcccggcagaggggcacacu

SEQ ID NO: 365874 - RNA, 64 nt, Human
ucucuaucuaauucaaacauaucuccccaugauacaccgccagagugacauugcagacagucug

SEQ ID NO: 365875 - RNA, 64 nt, Human
uuauacagaaggaacagcaggagguuuuccuggacaccgccaacuucacauugcucaguggacu

SEQ ID NO: 365876 - RNA, 64 nt, Human
ugucugggugccccauagucacagaacaccuggacaccgccacaugcagucaucaucauguuac

SEQ ID NO: 365877 - RNA, 64 nt, Human
uggugcuguacccccgacgugcuccccugcucggcaccgccagccgccuucccuuuaacccuca

SEQ ID NO: 365878 - RNA, 64 nt, Human
ccuggagagaaacuuccagaccagccccucacaccaccgccaggagaggccuuucccaccggga

SEQ ID NO: 365879 - RNA, 64 nt, Human
gccaacugccccgcgucuucagcuguuucgcauccaccgccaccccacugagagcugcuccuuu

SEQ ID NO: 365880 - RNA, 64 nt, Human
ucuguuuaaaaaaauaaaaaggaaaggaagcguucaccgccacaaaucauaaaauggacaugac

SEQ ID NO: 365881 - RNA, 64 nt, Human
augucuguuuagcccacaucacgucaguuaucaacaccgccacugugcuuacuguuccuacagc

SEQ ID NO: 365882 - RNA, 64 nt, Human
uugcggagagacgcggccccucccgcguggacaucaccgccaugagccucuuugcgagugaccu

SEQ ID NO: 365883 - RNA, 64 nt, Human
gcauggaugugcugaacgaggccauugguacccucaccgccaggggggaccggaaugccugggu

SEQ ID NO: 365884 - RNA, 64 nt, Human
cuguucagagacuucguggaucacagcugcagcucaccgccacaucacaggauccguuaacguu

SEQ ID NO: 365885 - RNA, 64 nt, Human
acauagacgugggggcauaggcucccacugccaccaccgccaucgccucaccugcagcucugaa

SEQ ID NO: 365886 - RNA, 64 nt, Human
uucaagaugucaggauacccuuccaucaccccaccaccgccaccccaacuugacuuucaagaac

SEQ ID NO: 365887 - RNA, 64 nt, Human
gguguaggcaccacccacccagcaguaccguccgcaccgccaggcucagccccugcccacccca

SEQ ID NO: 365888 - RNA, 64 nt, Human
aauuuuucccccuucauuucugaaauuuuuugcucaccgccauguuuaaaugggguugaaucau

SEQ ID NO: 365889 - RNA, 64 nt, Human
aguuggcacugacaucacagcuucauaaccccaccaccgccagcuuccccugccuccuacaucc

SEQ ID NO: 365890 - RNA, 64 nt, Human
guugggaggagucgggggcgagccuuagcagcugcaccgccauccccaugcugguuggugcugc

SEQ ID NO: 365891 - RNA, 51 nt, Human
ggccugccgggcacucaugaucaccgccauccuccugggcuuccucggccu

SEQ ID NO: 365892 - RNA, 64 nt, Human
caaucagaaaccuccguuguggcagaggggccuucaccgccaccagggugucccgccagacagg

SEQ ID NO: 365893 - RNA, 64 nt, Human
gcauccaggcgcgugucaucuaccagaugcccuccaccgccauuucuuggucugucuaugaguu

SEQ ID NO: 365894 - RNA, 64 nt, Human
uauuugccugccugauucucuguguuuccuguuucaccgccacccuuucaggagagaacuacac

SEQ ID NO: 365895 - RNA, 64 nt, Human
acaccuguguaaccaccaccaccuguguaaccaccaccgccagaaccaaaaacguuucugucac

SEQ ID NO: 365896 - RNA, 64 nt, Human
ccccaauacacagaaccaccgccaccaccaccaacaccgccacaccaacaccaccacuacaaaa

SEQ ID NO: 365897 - RNA, 64 nt, Human
aaauauaacccucccuucccccaauacacagaaccaccgccaccaccaccaacaccgccacacc

SEQ ID NO: 365898 - RNA, 64 nt, Human
gcaugcgccacgccguggcucccaccagcagugccaccgccaccacaccccagaucccacccac

SEQ ID NO: 365899 - RNA, 64 nt, Human
gauauuccaugacccagugcacgcuguggccugucaccgccaccguggccccgccagcuggccu

SEQ ID NO: 365900 - RNA, 64 nt, Human
gccuuguggguggaggcggggcagggcuguguggcaccgccagggagcgggcccaccugaguca

SEQ ID NO: 365901 - RNA, 64 nt, Human
cuaauucugccguuguaaugagacuugauuaaaacaccgccacuuuuuugcauugcugcucuuu

SEQ ID NO: 365902 - RNA, 64 nt, Human
cucagugacucccccacaaaacagcaacagccuccaccgccaacucaacaaacuucagaguagc

SEQ ID NO: 365903 - RNA, 64 nt, Human
guuuccucuuuucaggucagcuccaugugccaugcaccgccaugcacccuguucccugacaagu

SEQ ID NO: 365904 - RNA, 64 nt, Human
acccggcuggccccuugggucagacuggagccaacaccgccagccacccccucuggccugcugg

SEQ ID NO: 365905 - RNA, 64 nt, Human
caggauguggcacugcuugaggaggggcaccugccaccgccagaggacaaggaagugggggccg

SEQ ID NO: 365906 - RNA, 64 nt, Human
gauggggagggucucggugguaccaggucuccuccaccgccauggcuuccaagguggucugcuc

SEQ ID NO: 365907 - RNA, 64 nt, Human
cguggacaucugagggcgccaggcaggcgggcgccaccgccacccgcagcgagggcggagccgg

SEQ ID NO: 365908 - RNA, 64 nt, Human
cuccgggggagaauguggaacccagccacacugccaccgccacacuagugcugaacguggugcc

SEQ ID NO: 365909 - RNA, 64 nt, Human
uggaggccagugcgcacuagcugggccugguggccaccgccagagcuccuggcgacaucuuggc

SEQ ID NO: 365910 - RNA, 64 nt, Human
acagaggcugguggucgccgggauaauuaaugaccaccgccaauucaucccucacgugucuccu

SEQ ID NO: 365911 - RNA, 64 nt, Human
ggagacacguccuccuccccaacccaccucaugccaccgccaacccccugccccaggagcgggc

SEQ ID NO: 365912 - RNA, 64 nt, Human
auuuuccaagaguccuccauuuuuugcacccccucaccgccaacucuguuauucaguagagaga

SEQ ID NO: 365913 - RNA, 64 nt, Human
agguggauauggacaucugccgccgcaucgacaucaccgccaagcucugcgauguggcucagca

SEQ ID NO: 365914 - RNA, 64 nt, Human
ugaucagacuaggccccacucagccuggccuggacaccgccaugagcacagggcagggcugggg

SEQ ID NO: 365915 - RNA, 64 nt, Human
gcccugccugcugcaucuuuucuguugccccauccaccgccagcuucccuucacuccccuaucc

SEQ ID NO: 365916 - RNA, 64 nt, Human
gauuuggaaguuuagucaccucugagccacccaucaccgccaaagugugggggaaggauagcug

SEQ ID NO: 365917 - RNA, 64 nt, Human
ucuccaccccgcgggcucuccaggagccucagcccaccgccaguacucucccagcaaccgcgag

SEQ ID NO: 365918 - RNA, 64 nt, Human
uuaacauggaaaccauggcccucugccacugacccaccgccaccuccgcggagaaacugcacuu

SEQ ID NO: 365919 - RNA, 64 nt, Human
uaaagacguucccuuuuguauucucuuccucauccaccgccacugggccugucacugauggugg

SEQ ID NO: 365920 - RNA, 64 nt, Human
cgcugggguuucccucucccagaaccgcugccaccaccgccacgcccuccgcagaaagcccacc

SEQ ID NO: 365921 - RNA, 64 nt, Human
caggggcuuuuaggguccuguggcgagcugugagcaccgccagcauuagacgucacauccaggu

SEQ ID NO: 365922 - RNA, 64 nt, Human
acgugugccagagcccccucccucaccuucccuccaccgccagccccagaguuagauuuuaugc

SEQ ID NO: 365923 - RNA, 64 nt, Human
uucugaucagguuauuggugacuuacuggacuggcaccgccaggagaaaauucuccugcuaacu

SEQ ID NO: 365924 - RNA, 64 nt, Human
gcuucgccgucuccauccucaucauuggcaugcucaccgccaucauuggggaccuggccucgca

SEQ ID NO: 365925 - RNA, 64 nt, Human
accgagagaaugcugaccugacuugccuccgugucaccgccaccccgcaccccgcguguccccg

SEQ ID NO: 365926 - RNA, 64 nt, Human
agcugacggacaacugagucuccggcccaccuaccaccgccagccaggaucccccaaagugugc

SEQ ID NO: 365927 - RNA, 64 nt, Human
caguaauguaucaauaaucccagcccagucaaagcaccgccaccuguaggcuucugucucaugg

SEQ ID NO: 365928 - RNA, 64 nt, Human
caccgucugccuugcuccucucuucccaaaucaucaccgccaugggcccagccccaaagggcag

SEQ ID NO: 365929 - RNA, 64 nt, Human
gccccggcgggaggggcgggugggaggccgcggccaccgccaccugccggccucgagaggggcc

SEQ ID NO: 365930 - RNA, 64 nt, Human
cccauccagagaaugaaugaguuccuuuaagugccaccgccagcaagcccagaggcacacaguc

SEQ ID NO: 365931 - RNA, 64 nt, Human
gcaagaacagcaggacgcugguuuaaaaauaacucaccgccaaaccuguggagcaguguggggc

SEQ ID NO: 365932 - RNA, 64 nt, Human
acccagacaaccaaaacauauucaaagcagcagccaccgccauccgguccccugccuggaacug

SEQ ID NO: 365933 - RNA, 64 nt, Human
cuugaucccgcugacgacgcccacgucgaggccccaccgccauccuugcgccggcucauguucc

SEQ ID NO: 365934 - RNA, 64 nt, Human
ucacaccacagcuucccugguccacagaggcucucaccgccauugccaccaguauggugguaug

SEQ ID NO: 365935 - RNA, 64 nt, Human
aagaugggcuucaauuagauggcaaaggagaggacaccgccagugguccaaaaaggcugcucuc

SEQ ID NO: 365936 - RNA, 64 nt, Human
gcuggccugcgccugcaccugcgccuggcucugucaccgccaugcaacuccaugccuauuuacu

SEQ ID NO: 365937 - RNA, 64 nt, Human
uggagcccuccgaggggugucaggggaaacaggccaccgccaaagccauggcccgccgccgaga

SEQ ID NO: 365938 - RNA, 64 nt, Human
gcaggagcauggagcucuacaggaaugcaccccccaccgccauuggcauccccaccaagcuccu

SEQ ID NO: 365939 - RNA, 64 nt, Human
cuuguuuuuuuuuuaaaaauacacuccccucccccaccgccacacaccuuacaguucaaaaggu

SEQ ID NO: 365940 - RNA, 64 nt, Human
cuccccggccaggcacguggcaccgucgccuugacaccgccaucucuuuucuuuaaggcuucag

SEQ ID NO: 365941 - RNA, 64 nt, Human
aggucgggggagggugaugccagggauuccaaggcaccgccauguacugcacugcccuggucga

SEQ ID NO: 365942 - RNA, 64 nt, Human
ccugaaccugcacaccuacgugcgcagggcccuccaccgccacuaugggcccgagcucaucgac

SEQ ID NO: 365943 - RNA, 64 nt, Human
ggggccggggcaguggggagcccccaucccuucacaccgccaccaacuaaccaagcuuggccuc

SEQ ID NO: 365944 - RNA, 64 nt, Human
uguggcagaaucgcaccgccccggcuccccagcccaccgccaugcagggcucgcgugcgggaaa

SEQ ID NO: 365945 - RNA, 64 nt, Human
ggcuuauauugccuaugaacuuaacagcguacaacaccgccagcuuaaggacaacaccugugug

SEQ ID NO: 365946 - RNA, 64 nt, Human
cgccaaugccuccuaagccaggagcuggguuaugcaccgccauggcccacauuaacgcuccacc

SEQ ID NO: 365947 - RNA, 64 nt, Human
ccuacugcaggacacugagggcuuggcugccugccaccgccaucuggagcccaccacagcucuu

SEQ ID NO: 365948 - RNA, 64 nt, Human
ucgggggcuuagaggcugggauggcuccuggccccaccgccagggggcagcgcaggccgggcug

SEQ ID NO: 365949 - RNA, 64 nt, Human
ugucuaacugauaagaaucaacaaggucacccaucaccgccaccugcaccugggccuuuucccc

SEQ ID NO: 365950 - RNA, 64 nt, Human
gguuuucacgugcuucagagaagaggggcugccccaccgccacucacgucacucggggcucggu

SEQ ID NO: 365951 - RNA, 64 nt, Human
gcaccagggcucacgugggaaccccccucccacccaccgccacaauaaagaucgcccccaccuc

SEQ ID NO: 365952 - RNA, 64 nt, Human
uugucacccgcuccagguuggagccacagacacccaccgccaccccggcugggucugcguccuu

SEQ ID NO: 365953 - RNA, 64 nt, Human
uaggauacgggggugguauggaagggagcguucacaccgccagccucgggccugggauuugagg

SEQ ID NO: 365954 - RNA, 64 nt, Human
gggcggggcuggugaggguuuguccuaagaggaccaccgccaucucugggucuccagggggaga

SEQ ID NO: 365955 - RNA, 64 nt, Human
uucgccuccuccagcuccugccccgccggccgcgcaccgccaugcaugauggguaaagcaauac

SEQ ID NO: 365956 - RNA, 64 nt, Human
gcgggggccagggaaguccccgaguuuccccagacaccgccacauggcuuccuccugcgcgcau

SEQ ID NO: 365957 - RNA, 64 nt, Human
gggcuguuggcagugucacaucacugaguuuauccaccgccauccaccucuauccaccccauaa

SEQ ID NO: 365958 - RNA, 64 nt, Human
aaaaaaacaaauuuuuuuuuucucacuuguaagucaccgccaguaccuaaguuaggcuaacgga

SEQ ID NO: 365959 - RNA, 64 nt, Human
uaugaugagagauuccagcccaagccuggccccccaccgccaggccauagggcauaauuugcau

SEQ ID NO: 365960 - RNA, 64 nt, Human
agaaggaugucagugugugaccugccccagcuaccaccgccaccugcuuccaggccccuaugug

SEQ ID NO: 365961 - RNA, 64 nt, Human
ccacuuguggguccuggggucgucuuagcagagccaccgccaagguuugcacucagggaggggc

SEQ ID NO: 365962 - RNA, 64 nt, Human
uccaccucaacuucuggcugucccuacccugacucaccgccauggagaucacccuccccgaagc

SEQ ID NO: 365963 - RNA, 64 nt, Human
gggguugagguuauuguagacguuagauugcgggcaccgccagggauuuugcagcgcuucagug

SEQ ID NO: 365964 - RNA, 64 nt, Human
ugugagggagugcuggccgcaggcagccucgagucaccgccaggcucacaggcugugccacccg

SEQ ID NO: 365965 - RNA, 64 nt, Human
ucuggcccacugugguaauuccacauccagguaccaccgccauucagaguugucucaccccuuc

SEQ ID NO: 365966 - RNA, 64 nt, Human
guacugagaggagagaauguacguuugcuuuacccaccgccaccaagaaagcaguccgaugaga

SEQ ID NO: 365967 - RNA, 64 nt, Human
gacugugagaccuggccucgcacaggcgcgcacacaccgccaagcagcucagcauucucccccg

SEQ ID NO: 365968 - RNA, 64 nt, Human
gcuuggcccacugccaucacccagcaccccagaucaccgccaggccagcccccaaugguccccu

SEQ ID NO: 365969 - RNA, 64 nt, Human
gacuacauggacauuugaggggccacugcagccccaccgccacgccccaggggaccagccaggc

SEQ ID NO: 365970 - RNA, 64 nt, Human
aaagccagugcuaacaugcaaccauuccucacgccaccgccacaucagagcugguugggaaccc

SEQ ID NO: 365971 - RNA, 64 nt, Human
cugcaucuaucuccuuaaaguccacuccuuacaucaccgccacuacugcagcucagugcccagc

SEQ ID NO: 365972 - RNA, 64 nt, Human
aagccuagagaggccgcaaggggaccgccccaggcaccgccagaguguccugcuaccuuugucu

SEQ ID NO: 365973 - RNA, 64 nt, Human
cacggggccuucagcuuccccuguccucuggccacaccgccagcccuugguccuuaucugugug

SEQ ID NO: 365974 - RNA, 64 nt, Human
ccgccagaacggccuuuugcuuccagccaaagaacaccgccaacacgcacaccuccaaccuggg

SEQ ID NO: 365975 - RNA, 64 nt, Human
cagcccucggagugcugccaagugccuaccuguccaccgccaccggggucugcgauggcacgcc

SEQ ID NO: 365976 - RNA, 64 nt, Human
cucccuacuuagacccagucauucuagagggauccaccgccacacuggccggcccacguccugg

SEQ ID NO: 365977 - RNA, 58 nt, Human
cuacuucuguuuucuuuuagcgaccccccaccgccaggcugaucagaagcugaugacu

SEQ ID NO: 365978 - RNA, 64 nt, Human
gucugcggagccagcgccugcccgagagagaccccaccgccaccgugugccuuucccgggcccu

SEQ ID NO: 365979 - RNA, 64 nt, Human
agcaagcggggcaaggggcccuuccagaugccaccaccgccaacaggccaggccucugccuccu

SEQ ID NO: 365980 - RNA, 64 nt, Human
acagcuucccaaguagcugggauuuacaggugugcaccgccaugccaggcuaauuuuuguguuu

SEQ ID NO: 365981 - RNA, 64 nt, Human
gccccucacauuuagccgacugacugcugcagaccaccgccaacugcagcucuccaucagcucc

SEQ ID NO: 365982 - RNA, 62 nt, Human
augucaaucuuuuuuuccuaagaaaaaaaguccgcgaguauuaaauauuuagaucaauguuu

SEQ ID NO: 365983 - RNA, 62 nt, Human
ccuuggggucugccugcccacccacaugagcccgcgaguauggcagcaggacaagccagcgg

SEQ ID NO: 365984 - RNA, 62 nt, Human
ucccaguucaagugauuccccugccucagccucgcgaguagcuaggacuacaggcgcauguc

SEQ ID NO: 365985 - RNA, 62 nt, Human
ccagagaagcgcccacaucugaaggaccugcucgcgaguaucaguucuuccuuguugaauuc

SEQ ID NO: 365986 - RNA, 62 nt, Human
gaugagccaggguccaggagacagaugcccaucgcgaguacagacuuuguccuauuggcaac

SEQ ID NO: 365987 - RNA, 62 nt, Human
cccggguucaggcaauucucuugcaucagccucgcgaguaguuggaauuauaggcaugugcc

SEQ ID NO: 365988 - RNA, 62 nt, Human
gagagcggauggacuacaugaaacgcaagagccgcgaguaugagcagcucaagagcgagugg

SEQ ID NO: 365989 - RNA, 64 nt, Human
ggaugugauaaacagggcuauuagggguaucagccacgucgagcccccagacucugugcacuuc

SEQ ID NO: 365990 - RNA, 64 nt, Human
caaaaugugaauuacuuuguacgauuacagucuccacgucgaccuaacccaauauuauugguau

SEQ ID NO: 365991 - RNA, 64 nt, Human
guauuauaauuuuuuagaaaaaccaccaucgugucacgucgacgaugccaaauuauguuagcgu

SEQ ID NO: 365992 - RNA, 64 nt, Human
gucauguuguucccuuugcucgggaugcccacuucacgucgacggcauucauugguaguacuuc

SEQ ID NO: 365993 - RNA, 64 nt, Human
uaguuuacaaaacagagauuccuucaacacuggacacgucgagcauuuuguagcuuaauuaaac

SEQ ID NO: 365994 - RNA, 64 nt, Human
ccugguuagaugcacuuccugguguugagaugaacacgucgauuuuucaccaaucgaugaagcc

SEQ ID NO: 365995 - RNA, 64 nt, Human
cugagcgccugcccagauucucccauggguauuucacgucgaaaggacgcuguuacauauguau

SEQ ID NO: 365996 - RNA, 64 nt, Human
uugaugcacagaauuuaccucaucucacagagcccacgucgacgagcaccauuuggccagacau

SEQ ID NO: 365997 - RNA, 64 nt, Human
uccuguugaagcccuugaucccgcugacgacgcccacgucgaggccccaccgccauccuugcgc

SEQ ID NO: 365998 - RNA, 64 nt, Human
uuccuucccggcagcgcccgcagcgggccauuuacacgucgaggcuggcaccuggcgcgcucgg

SEQ ID NO: 365999 - RNA, 60 nt, Human
cguuuccccagugucauucaauaugcucuaaacgacgagguaaugcugaggcuauugcug

SEQ ID NO: 366000 - RNA, 60 nt, Human
uugcccaucucuccggccaccccgccaggaaacgacgagaaggccgaggaauccucagag

SEQ ID NO: 366001 - RNA, 60 nt, Human
cgaccaagauugacuaguuuguuggacuuaaacgacgauuugcugcugugaacccagcag

SEQ ID NO: 366002 - RNA, 60 nt, Human
ggcacucccugagacccaaagacccaccucaacgacgaguggcguugagccacuucccuu

SEQ ID NO: 366003 - RNA, 60 nt, Human
gagcuccuuccccaucauuucuccuuggccaacgacgaggccagccagaauggcaauaag

SEQ ID NO: 366004 - RNA, 60 nt, Human
gcucugcgugcgcaccgcgccuacacgcccaacgacgagugcuucuucaucuuccuggac

SEQ ID NO: 366005 - RNA, 60 nt, Human
ugauuauuucaacaguauugguuaagucacaacgacgaagugcugagaagguuaugggua

SEQ ID NO: 366006 - RNA, 60 nt, Human
uaguauaauuccucucacuuacugaaauacaacgacgacgacugcaaaguguaugcacac

SEQ ID NO: 366007 - RNA, 60 nt, Human
gauuuucuugacuguagguuuaagacgcuaaacgacgaaaacuccagucaccuccucuac

SEQ ID NO: 366008 - RNA, 60 nt, Human
uauuuuucuuccuuuuuuuguaauauugaaaacgacgauauaauuauuauaaguagacua

SEQ ID NO: 366009 - RNA, 60 nt, Human
gaauacacguggcuauaacaucuauaacaaaacgacgauuccucuacaagaggcuguuuc

SEQ ID NO: 366010 - RNA, 60 nt, Human
agcauccugaagccccauucuccgacuuacaacgacgagggacuuugaugggcugggccc

SEQ ID NO: 366011 - RNA, 64 nt, Human
gugcgagaugagcucgaacacugcccgccuuacugccgccuaccccgcccgccacgccgccguc

SEQ ID NO: 366012 - RNA, 64 nt, Human
gauggucuguguggaagaaaagaaaaaucugucugccgccuauuucccauuggugucgauugaa

SEQ ID NO: 366013 - RNA, 64 nt, Human
uuuguaugaguuuggagcagugcugaaggccaaagccgccuacugguuuguaguuaaccuagag

SEQ ID NO: 366014 - RNA, 64 nt, Human
ccauccccugcugaaccaggcccuguuacacacagccgccuaaggcccgcggcucaugugcugc

SEQ ID NO: 366015 - RNA, 64 nt, Human
uggggccgccuuggggcgcggcagcgcaggcagagccgccuagagcugugcagccggcucgaac

SEQ ID NO: 366016 - RNA, 64 nt, Human
agacgcgacguccauuugucgaaagaacaggagagccgccuacccucucacuggcugaaaagca

SEQ ID NO: 366017 - RNA, 64 nt, Human
ggcugcgggggaaccggcgccgagaggggaaggggccgccuagcccgaguaggccccagggcgc

SEQ ID NO: 366018 - RNA, 64 nt, Human
ucucugcagaggaacaacccuaaaaccagaccacuccacgcaggacaggcaggagagauucuuc

SEQ ID NO: 366019 - RNA, 64 nt, Human
cgcccuccgucgggccccugccugccuucuccccuccacgcaaggcugugcucuuccucugguu

SEQ ID NO: 366020 - RNA, 64 nt, Human
cuugggccggcacgcgugacacggcacuucaggcuccacgcacagaaucucgcagauaguuggg

SEQ ID NO: 366021 - RNA, 62 nt, Human
uaauucuauccaacuuaaaaaggcucuuuuaagagccgccuacuuucacccgaaaauagcug

SEQ ID NO: 366022 - RNA, 64 nt, Human
cccacgcuugacuucuuaucacuuuggcuguggugccgccuaguggaaaaaggaagucccugca

SEQ ID NO: 366023 - RNA, 64 nt, Human
ggcccuuugacuuugugaaugagcacaaugaaaugccgccuacugaugcuucuuaugaucagaa

SEQ ID NO: 366024 - RNA, 64 nt, Human
cagacccaucucgcggcggggguuuuguucuguugccgccuaacuuucucauccucggucucug

SEQ ID NO: 366025 - RNA, 64 nt, Human
ggcuuccccagaagccugggcuuaggguggagaugccgccuacacacgauccuggcccuccacc

SEQ ID NO: 366026 - RNA, 64 nt, Human
acuuccacacauggcacaguucugccugugaccugccgccuaagcuuuacuggaauucagguuu

SEQ ID NO: 366027 - RNA, 64 nt, Human
cuucccucuccugcgcuuccuccuggaguccggagccgccuacaacugcucccugcacggugcg

SEQ ID NO: 366028 - RNA, 64 nt, Human
gagugcagaggagggucuggcaggggcugcucaggccgccuagcugccccuuugccagguuaau

SEQ ID NO: 366029 - RNA, 64 nt, Human
aacuggugaaaaccauggggguggugcugacucagccgccuauuccccaaggagcuucagggca

SEQ ID NO: 366030 - RNA, 64 nt, Human
ggagggguccugcaggggcaagcaggagcuagcagccgccuacuuggugcuaaccccucgaugu

SEQ ID NO: 366031 - RNA, 64 nt, Human
gcagcaguuacuggcaagagggagaaaggacgcugccgccuaagagugcaaggcugcucagguc

SEQ ID NO: 366032 - RNA, 64 nt, Human
cacaaaggaagugcccccuccccggcacccucuggccgccuaggcucagcggcgaccgcccucc

SEQ ID NO: 366033 - RNA, 64 nt, Human
acuguauagaacccagggcucugaaacagcucuagccgccuaaugcacuucacagguaacuccc

SEQ ID NO: 366034 - RNA, 64 nt, Human
gagcuggacacuccuggcuggacgccaggccagugccgccuacguggagacuguccacacagcu

SEQ ID NO: 366035 - RNA, 64 nt, Human
agaauaucauuggcccugaucacauagaugcugcgccgccuagcaaaugcuuggugguucgacu

SEQ ID NO: 366036 - RNA, 64 nt, Human
cgauccuugauccgggucccggaucguggauccggccgccuagggcucagacuugcggccccgg

SEQ ID NO: 366037 - RNA, 64 nt, Human
uuuuaaggcaaagcagagagcagagguucuucaguccacgcaacgguucuucucugaacagcaa

SEQ ID NO: 366038 - RNA, 64 nt, Human
ucuguuguaggaagagagcgaggcaucccugaauuccacgcaucugcuggaaacgagccguguc

SEQ ID NO: 366039 - RNA, 64 nt, Human
guccuugaacacuacugggguauauucaggcucauccacgcagcugcuggguucuugcccuaac

SEQ ID NO: 366040 - RNA, 64 nt, Human
ucuuuguugcguuuugugcuuugaugccaggaaugccgccuaguuuauguccccgguggggcac

SEQ ID NO: 366041 - RNA, 64 nt, Human
uggacagggucuguccacgcaccaccuggggucugccgccuauuaaaagugccguauucuuacc

SEQ ID NO: 366042 - RNA, 64 nt, Human
cacagacacugagccacgcagccccgccucuggggccgccuaccuuugcuggucccacuucaga

SEQ ID NO: 366043 - RNA, 64 nt, Human
accugcgagggccgcccgcucccuuccugccacugccgccuacuggacgcugcccugcaugcug

SEQ ID NO: 366044 - RNA, 64 nt, Human
gccagcuugagccagacagcgcugcccagggguggccgccuaguacacacccaccuggccgagc

SEQ ID NO: 366045 - RNA, 64 nt, Human
caggacagaaagguguccaaguaccuguaucacagccgccuacgcccaccuaguggccaguccc

SEQ ID NO: 366046 - RNA, 64 nt, Human
cccgucccugucugggugggccucaggccaucuggccgccuagcgaggguccugcuuucuuccu

SEQ ID NO: 366047 - RNA, 64 nt, Human
uugaaccggaaccugagugacagccuggcccgcggccgccuacacccggaccugcaguccaacc

SEQ ID NO: 366048 - RNA, 64 nt, Human
aggcgagggcgacaugaagaugcacugcugcguggccgccuauaucuccgacuaugccuucuug

SEQ ID NO: 366049 - RNA, 64 nt, Human
guugcuaaacgccacggagcucacgcaggacccggccgccuacucccagcugguggccgugcug

SEQ ID NO: 366050 - RNA, 64 nt, Human
cacucucuacugguaggaagagguaccacaggaagccgccuagugcagagagguugugaaaaca

SEQ ID NO: 366051 - RNA, 64 nt, Human
cucagguuggggauggggacauggagaggaaggggccgccuacuccugcaaaugcuugugacag

SEQ ID NO: 366052 - RNA, 64 nt, Human
uaugccagccuguuccugccacagggcagucacugccgccuacccugaaauaaacccucgagug

SEQ ID NO: 366053 - RNA, 64 nt, Human
aguguggcccggagcgucuuggcugccgcccugcuccacgcagucugcuucagugcagugaagg

SEQ ID NO: 366054 - RNA, 64 nt, Human
uggaggggugacaguggaggaaaauccauggauauccacgcagcagccccucuuuaaccucauc

SEQ ID NO: 366055 - RNA, 64 nt, Human
ugaucaaauugcacuuguucuccuacaagcaaccuccacgcagacaccucguacugcuacaggu

SEQ ID NO: 366056 - RNA, 64 nt, Human
ucaguuccuggaggggggaaagggugaaagagaaaccacguauuuuguuauuauuuuggauuau

SEQ ID NO: 366057 - RNA, 64 nt, Human
cauacugaauacgcugugguucauuaauauuaacaccacguacuauaguauucuuaauacagug

SEQ ID NO: 366058 - RNA, 64 nt, Human
uucaguuuucucuucugugaaacaggaagacugaaccacguaauuaauauccaaggucccuucc

SEQ ID NO: 366059 - RNA, 64 nt, Human
ugauuugguucccaggacagugaaacauaguaauaccacguaaaucaagccauucauuuugggg

SEQ ID NO: 366060 - RNA, 64 nt, Human
gggcaggagucaccaugcaagggugacaucgacaaccacguaccaagccaccgcagcugcugcc

SEQ ID NO: 366061 - RNA, 64 nt, Human
ccaggccggggcauugccagggaggacccucacaaccacguacaugacccuuucuccuucaugc

SEQ ID NO: 366062 - RNA, 64 nt, Human
ugccgggagugaucagucggacauuuuaauuugaaccacguaucucuggguagcuacaaaauuc

SEQ ID NO: 366063 - RNA, 64 nt, Human
guucagagcaggaaaaccuucaaggagcugacugaccacguagcaugggggcaagaggcguggg

SEQ ID NO: 366064 - RNA, 64 nt, Human
uuauugcaucuguuauucaccauguaauucagguaccacguauuccagggagccuuucuuggcc

SEQ ID NO: 366065 - RNA, 64 nt, Human
uggaauuuuccuucuuaacaaguauagucauggcaccacguaacauuuuggucaaugacauugu

SEQ ID NO: 366066 - RNA, 64 nt, Human
uuugagugccggcuuucugaguagaguuaggaaaaccacguaacguagcauaugauguauaaua

SEQ ID NO: 366067 - RNA, 64 nt, Human
aacaaauggugcuuacccuuugaacagcagagugaccacguagaaggaaggaaaagggcaaaau

SEQ ID NO: 366068 - RNA, 64 nt, Human
uguuaaaaauuggcagauaaaauuuuauguauuuaccacguacaacaugaaauuuugaaacaug

SEQ ID NO: 366069 - RNA, 64 nt, Human
uuuacuaaaccaguacuucguuaugaaaaugccuuccacgcaaauaagaaaccaagggauaaaa

SEQ ID NO: 366070 - RNA, 64 nt, Human
gguuaucagggcauguguucaacaacccccaaaguccacgcagguggcuuguagaaaccuuugg

SEQ ID NO: 366071 - RNA, 64 nt, Human
accaacugaugaaugggaaauaaaauguggucuguccacgcaauggaacauuauuagacucuaa

SEQ ID NO: 366072 - RNA, 64 nt, Human
cugcugucuugugauuaaaaucaucucuguagugaccacguauauuuucaaggacucacucuua

SEQ ID NO: 366073 - RNA, 64 nt, Human
ugagguuugaggaaaaauaaauguugaucagcagaccacguauuuaaaauucugaaucuucugg

SEQ ID NO: 366074 - RNA, 64 nt, Human
ccuacccccagcuucggaaaauacagagaccaccaccacguacccuguauuccccaaggugaug

SEQ ID NO: 366075 - RNA, 64 nt, Human
ugaccagguuggacuguuuaaugucuuucaacuuaccacguaauccucuuguagggaucacauc

SEQ ID NO: 366076 - RNA, 64 nt, Human
ggccacuggaggaugggugggggccucugugagcaccacguaugccugugugaagacaagcgac

SEQ ID NO: 366077 - RNA, 64 nt, Human
augugguacaaauuuauauugaagaucuaaauaaaccacguauuuuccagucuucguuguguga

SEQ ID NO: 366078 - RNA, 64 nt, Human
ucucucucugagaacacggugugucucgacacguaccacguacguggaaacacaagagcccacc

SEQ ID NO: 366079 - RNA, 64 nt, Human
cccaggagugagggaguggcaagcaccacagauuaccacguauguguggaagacauucguacuc

SEQ ID NO: 366080 - RNA, 64 nt, Human
ugcgcccccugugccuaccucuagcauuguaacgaccacguaguauugaaauggccaguuuacu

SEQ ID NO: 366081 - RNA, 53 nt, Human
ggcaucucuauccccuaugaggcaccacguaagaccuccugcccuuagcucuc

SEQ ID NO: 366082 - RNA, 64 nt, Human
uaaccugaagaucuauaccaaacgucgucugcuuaccacguaacacagcugcaucuugagcagu

SEQ ID NO: 366083 - RNA, 64 nt, Human
gacaacccacauucuuauccuggcucuagcaguaaccacguagccuuggauaagccauuuuccu

SEQ ID NO: 366084 - RNA, 64 nt, Human
uuaagacaccccugauggaaugaaagccaacugaaccacguaaagcucgaaccacguggcaagu

SEQ ID NO: 366085 - RNA, 64 nt, Human
cagaauuuagaauauuuagagcuaagcuucuggaaccacguaguuucuacacguggcaggccaa

SEQ ID NO: 366086 - RNA, 64 nt, Human
acucucccaaggaaaauauugccaccauuuguagaccacguaaccuucaaguaugugcuacuuu

SEQ ID NO: 366087 - RNA, 64 nt, Human
aaaacagugaaacugugagucaauaugaauuuaaaccacguaguuaucuuuucacuucaggugg

SEQ ID NO: 366088 - RNA, 64 nt, Human
aauuucucaaagccagucuaccugacuaggucuauccacgcacgguucccaaccccaaggggga

SEQ ID NO: 366089 - RNA, 64 nt, Human
agagagacaaacucuaggaacaaugccgauucauuccacgcagcaguauugggggugguucggg

SEQ ID NO: 366090 - RNA, 64 nt, Human
uuuccauugccgucagcaugacagaccuccagcauccacgcaucucuuggucccaauaacugcc

SEQ ID NO: 366091 - RNA, 64 nt, Human
gaaucaguagcagagcaaagccucuuugaaaaaaaccacguagcugauuggguuuuacaagagu

SEQ ID NO: 366092 - RNA, 64 nt, Human
aaaauguuguccugcaaaaggagguaaguuucucaccacguagcgcugaucaucccguguugcc

SEQ ID NO: 366093 - RNA, 64 nt, Human
uguguguguuuaugugcacgcauguauaugcaucaccacguagccaggaggggccuguuggggu

SEQ ID NO: 366094 - RNA, 64 nt, Human
auggacugccucucuugagcacuucccuggagcuaccacguaucuagcuaauauguauguguca

SEQ ID NO: 366095 - RNA, 64 nt, Human
aaaaauguuuucaaaguuccauucuguuaaaguaaccacguagaaugcugagucuauucugcau

SEQ ID NO: 366096 - RNA, 64 nt, Human
cacaucccaagauguaaaacggcaguaauuuaugaccacguauggaagaaauucuucaaauagc

SEQ ID NO: 366097 - RNA, 64 nt, Human
ccuguccucugaaggauuguauauauaccucucgaccacguaggaaccauguaggggucucuag

SEQ ID NO: 366098 - RNA, 64 nt, Human
cccucccugagugguccccaccuuucuggacggaaccacguacuuuuuacauacauugauucau

SEQ ID NO: 366099 - RNA, 64 nt, Human
aggucaggauccucugagagaaaaucaacauugcaccacguaggggugggcuaugggcuguauu

SEQ ID NO: 366100 - RNA, 64 nt, Human
uacaaaaaccaauuaucuuugacugcuguucucaaccacguagugcgccagucaucacugguag

SEQ ID NO: 366101 - RNA, 64 nt, Human
ggccagccaguacucagagaggaggaccuucucaaccacguacagaacacggguuuucauggcu

SEQ ID NO: 366102 - RNA, 64 nt, Human
aucacugagacacaguggauuuuuauugaaaggaaccacguacagcaaugcggagugggauagg

SEQ ID NO: 366103 - RNA, 64 nt, Human
ccacacacacacacacaccaggggaaccaagagaaccacguagaauccucaaccgugcggacca

SEQ ID NO: 366104 - RNA, 64 nt, Human
uccccuaucgcaucuuggacucggaaagccagacuccacgcaggaccagggaucucacgaggca

SEQ ID NO: 366105 - RNA, 64 nt, Human
gggcagcacgugagguagaacgagugugagcgucuccacgcaguggcuggccccguggccgggg

SEQ ID NO: 366106 - RNA, 64 nt, Human
cagauguuuugggggaacgccgggacugagagacuccacgcaggcgaauucccguuuggggcuu

SEQ ID NO: 366107 - RNA, 64 nt, Human
cccuucccugccuaguuuccuuuuguuccuugaguccacgcagaauuccauucucuggucagca

SEQ ID NO: 366108 - RNA, 64 nt, Human
agcacacagauacccacagcauacacugacgaucuccacgcaguagacagguuuugucuucacu

SEQ ID NO: 366109 - RNA, 64 nt, Human
ucucgcacacacagugauucccuccucccgucacuccacgcagcuggcagagagcacagugauc

SEQ ID NO: 366110 - RNA, 64 nt, Human
agccuauucagcgcuuugcuaggggauugggugguccacgcacucgcuaauacaguucuccagg

SEQ ID NO: 366111 - RNA, 64 nt, Human
uucgcaccuccccuccucgugccugcccugccucuccacgcacaguguuaaggagccaagagga

SEQ ID NO: 366112 - RNA, 64 nt, Human
ugucguggagcuggggugcgugaucuggugcucguccacgcaggugugugguguaaacauguau

SEQ ID NO: 366113 - RNA, 64 nt, Human
auacugguugggggcaggaucauucugccccuuguccacgcacccccaccagcccucucgcuuc

SEQ ID NO: 366114 - RNA, 64 nt, Human
cggaggccaggucugucccggcuggagaacagcguccacgcaguccugccuggggucaggcccu

SEQ ID NO: 366115 - RNA, 64 nt, Human
gaauuuggagggagggagcaguaccuucccggaguccacgcaugugaguugggucaagugcauu

SEQ ID NO: 366116 - RNA, 64 nt, Human
ggucacgcugcugugggcccgaguguguugcauguccacgcaccacccguucagggcccugaau

SEQ ID NO: 366117 - RNA, 64 nt, Human
uaauaggaaguugacucccagcauguaaaagugauccacgcagccggaguguaugccgggagcu

SEQ ID NO: 366118 - RNA, 64 nt, Human
aucuaccuuuccauccuuuacuccaaguccccacuccacgcauccuuccucaccaacucagagc

SEQ ID NO: 366119 - RNA, 64 nt, Human
ccgccccacagggcaaggacacagcgcgguuuuuuccacgcagcacccuucucggagacccauu

SEQ ID NO: 366120 - RNA, 64 nt, Human
aagccuccuucccugccugcccaccccuccaugcuccacgcaggcacucacgcuaggacagcau

SEQ ID NO: 366121 - RNA, 64 nt, Human
acaucaaccuggcaaaaaugcaacaaaugaauuuuccacgcaguucuuuccaugggcauaggua

SEQ ID NO: 366122 - RNA, 64 nt, Human
gagagcgaacccacucccaagauaacggccugaguccacgcaggagggcagagcccucguggcc

SEQ ID NO: 366123 - RNA, 64 nt, Human
ccgaaaccaguuaagaauggaagaaaacggugcauccacgcacacauggacacagacccacaca

SEQ ID NO: 366124 - RNA, 64 nt, Human
ccauaagccaccauucuguggaaccaaggcccccuccacgcaaacacccucccuccuggggacc

SEQ ID NO: 366125 - RNA, 64 nt, Human
uggagaaguaacugagccugcgcuugagaccuucuccacgcagcaggaagaucccaccgacccu

SEQ ID NO: 366126 - RNA, 64 nt, Human
auccuggcgcagaaccuaccugaugcgguuccucuccacgcaucucgaggcggcguuaccucca

SEQ ID NO: 366127 - RNA, 64 nt, Human
gcagcccugcacuccacgcuggccaagaaggccuuccacgcagaaugacaagacugcaaaaauc

SEQ ID NO: 366128 - RNA, 64 nt, Human
ccacagguugacuuugaauguggaccucugagcauccacgcaggauggcucucaggucccaguc

SEQ ID NO: 366129 - RNA, 64 nt, Human
aggacagaggcccccaagcugaucugguggugcauccacgcacccccacccugggacuuuggau

SEQ ID NO: 366130 - RNA, 64 nt, Human
ggacaucucaugaagccauguucaggguaggagcuccacgcacaucaccacccauugucaggug

SEQ ID NO: 366131 - RNA, 64 nt, Human
gaauaagaacugaucuggcugccugaugaguguuuccacgcagcccugcauauuuagugaccaa

SEQ ID NO: 366132 - RNA, 64 nt, Human
gaaggcugccuucugacaugcgcuggggcuucucuccacgcauuuagacaaaaaaagcacagga

SEQ ID NO: 366133 - RNA, 64 nt, Human
ggaauaagauccugugauuuuucucaccugcuuuuccacgcacuguggucaucacugugcaauc

SEQ ID NO: 366134 - RNA, 64 nt, Human
cuuccugucucugaaguuuggaucauuuuauagauccacgcaauagagagcuuccuuccuauga

SEQ ID NO: 366135 - RNA, 64 nt, Human
ccccgccucuggcugcgcacucccgaccgcgacguccacgcagcagagggacaugggccauucc

SEQ ID NO: 366136 - RNA, 64 nt, Human
ugcccaucauuuucaggucugcagaaccauagcuuccacgcaccugaacgagcacagaaugaac

SEQ ID NO: 366137 - RNA, 64 nt, Human
cuugccuaacucauacuuucccguugacacuugauccacgcagcguggcacugggacguaagug

SEQ ID NO: 366138 - RNA, 64 nt, Human
ugucugcccccucuuuaaaaucgaucuacacacauccacgcacaugcgaccccgaggaaacgaa

SEQ ID NO: 366139 - RNA, 64 nt, Human
aacuccuggguucuuaagggagcgaggcuuuggguccacgcacaggaucgcgcgcgggaucgca

SEQ ID NO: 366140 - RNA, 64 nt, Human
ugguagcaggacccuucauccugaacugccuuccuccacgcaggacaagucuuagcuuuuuugg

SEQ ID NO: 366141 - RNA, 64 nt, Human
acagacacagauuuccugcugggggagggaggaguccacgcauccugaugcugccuggaagcuu

SEQ ID NO: 366142 - RNA, 64 nt, Human
ggggcuggggggcggggcuggaggggaaggaguguccacgcaucaauaaagauuuaacgaacug

SEQ ID NO: 366143 - RNA, 64 nt, Human
uuugccggguaaggggcuaccgcgacgccacuuguccacgcagccaccaccggcccgggccagu

SEQ ID NO: 366144 - RNA, 64 nt, Human
gagaaaccgucugccuggcucccugucuucauucuccacgcagccuggugauggcaggccuggg

SEQ ID NO: 366145 - RNA, 64 nt, Human
cagcacgggagccaggcgcuguggacagggucuguccacgcaccaccuggggucugccgccuau

SEQ ID NO: 366146 - RNA, 64 nt, Human
cacucccgccccucccccaucgugcugcaugaccuccacgcacgcacguccagggacagacugg

SEQ ID NO: 366147 - RNA, 64 nt, Human
gcuccucgcagccgccucucccgcuccggaucccuccacgcagcggccggagccagacuagccc

SEQ ID NO: 366148 - RNA, 64 nt, Human
gacuucaccaaagucacccucgcgggcugggccuuccacgcaucccccccaccccccauggaac

SEQ ID NO: 366149 - RNA, 64 nt, Human
caaccuuugguugcugcauuccccuugguucgauuccacgcaaggagccacaagugagaacucc

SEQ ID NO: 366150 - RNA, 64 nt, Human
gucaaccaauggcacccagagagggcauggaggcuccacgcaaccccuuccacccccacaucuu

SEQ ID NO: 366151 - RNA, 64 nt, Human
ccuuggcccaggaaugcgugaccccugagauggguccacgcaucucucuacacuuccuucucuc

SEQ ID NO: 366152 - RNA, 64 nt, Human
caccugguucacauguggcacugaccgcgucacauccacgcacucccaaaggccagaaguaucu

SEQ ID NO: 366153 - RNA, 64 nt, Human
gagggguugauggcauuccuuucccauucuaaacuccacgcagccaaucgcuuuccuggaggag

SEQ ID NO: 366154 - RNA, 64 nt, Human
gagcucccagcacacucggagcuugugcuuugucuccacgcaaagcgauaaauaaaagcauugg

SEQ ID NO: 366155 - RNA, 64 nt, Human
gaaggcagcaagccgggccguccguguuccauccuccacgcacccccaccuaucguugguucgc

SEQ ID NO: 366156 - RNA, 64 nt, Human
agagccaagcccaguucucuggguugugcuuuacuccacgcaucaauaaauaauuuugaaggcc

SEQ ID NO: 366157 - RNA, 64 nt, Human
acacuccucucuuuuccuguagcguguggaccgguccacgcaauucuuuauccugugaacucau

SEQ ID NO: 366158 - RNA, 64 nt, Human
cccugucacuuuggacccuaugggagugggcaucuccacgcaccuguguaugugaaagucauuu

SEQ ID NO: 366159 - RNA, 64 nt, Human
cugaccuggggccccagcauccuggagcacacgcuccacgcacacacaccccagcccuguccca

SEQ ID NO: 366160 - RNA, 64 nt, Human
cuaucugugcacuuaccguagguagggacacguguccacgcaccacagacacacccacgacacc

SEQ ID NO: 366161 - RNA, 64 nt, Human
ggggcuggaugguaggaagggaugugcccgccucuccacgcacucagcuauaccucauucacag

SEQ ID NO: 366162 - RNA, 64 nt, Human
gcccaccuccuccaugccucggcgcucgaucuccuccacgcacuggcgcacgauguagggcacc

SEQ ID NO: 366163 - RNA, 64 nt, Human
gugccucagugugcccuguugaaacuuagguuuuuccacgcaaucgauggauuguguccuagga

SEQ ID NO: 366164 - RNA, 64 nt, Human
uuucccauagcuggugaaggacaccuccauccauuccacgcaguugcucaaagcagaaauuuuc

SEQ ID NO: 366165 - RNA, 64 nt, Human
ucuauugcaauaauguuagggacauuauaugauuuccacgcaggucacaccaucugggccugag

SEQ ID NO: 366166 - RNA, 64 nt, Human
ucauuuucuuuuaggauauuuagaccacccuuguuccacgcaaaccagagugugucaguguuug

SEQ ID NO: 366167 - RNA, 64 nt, Human
aggccaggccucugccuccucuucaucugcuucuuccacgcaccaccaccaccaccaccaccau

SEQ ID NO: 366168 - RNA, 64 nt, Human
gcaagaggccugaggagggaggcucccgggaccguccacgcacgacccagccagacccucgcgg

SEQ ID NO: 366169 - RNA, 64 nt, Human
aaacaaaaauggaacauuuauucgcaacucaaauacuacgcauauacgguaagagauuaaauau

SEQ ID NO: 366170 - RNA, 64 nt, Human
gaaggggggaauauuguaacacaaauuuaaacccacuacgcagggaugaggugcuauaauauga

SEQ ID NO: 366171 - RNA, 64 nt, Human
cugcugaguuugugaagacaguggaguucacaagacuacgcauucaagaggaaaggacuuuggc

SEQ ID NO: 366172 - RNA, 64 nt, Human
acuauaaacaggcccaauuaaaaacuguuccauuacuacgcaaacacauauuagaggccuuugc

SEQ ID NO: 366173 - RNA, 64 nt, Human
auuuaaaaagagcuagugugauaauccuaacucuacuacgcauuauauauuuaaauccauugcu

SEQ ID NO: 366174 - RNA, 64 nt, Human
cacugcaugcggcaaaccgcaugcucuuacccacacuacgcagaagagaaaguacaaccacuau

SEQ ID NO: 366175 - RNA, 64 nt, Human
ucucaagcagcauucuagagcuuggaauuuaagaacuacgcauugccuauaaagugaaacauag

SEQ ID NO: 366176 - RNA, 64 nt, Human
uugauauacaucauaaaauagucuuuugcaggguacuacgcaagccuuaaaauuuuucuuaaga

SEQ ID NO: 366177 - RNA, 64 nt, Human
aagaaaaaaaaaaagccuacaaacucagugaccuacuacgcagagggaauuuuucccugcugcu

SEQ ID NO: 366178 - RNA, 64 nt, Human
cgcguguugucucaaaccagucagggccgucaugacuacgcagcagcagcaguuuccaagacgg

SEQ ID NO: 366179 - RNA, 64 nt, Human
augcacccacaccaugugcccgugcacaccagugacuacgcaguccccccuuucugguuuagcu

SEQ ID NO: 366180 - RNA, 64 nt, Human
ucccucucuccacacggagcuccuggcagcgagaacuacgcacagcugccgcguugagcguacg

SEQ ID NO: 366181 - RNA, 64 nt, Human
cgagucauaccccaugaucaaaguuucaucgaaaacuacgcagggaucuuccacuuccagguga

SEQ ID NO: 366182 - RNA, 64 nt, Human
uuuuauuccuucuuuuuuccuccuuucauuucccacuacgcacaaagaguuuauaaacacuguu

SEQ ID NO: 366183 - RNA, 64 nt, Human
ugcuuuugaaugcuggugguucuauuccuuugacacuacgcacuuuuauaauacauguuaaugc

SEQ ID NO: 366184 - RNA, 64 nt, Human
ggggccugggcaugcgcaggaggagccaucggguacuacgcagcaacacucacaacuguccagg

SEQ ID NO: 366185 - RNA, 64 nt, Human
gccucccaaguagcugggaccacaggcaugcaccacuacgcaugacuaauuuuuuaaauauuug

SEQ ID NO: 366186 - RNA, 64 nt, Human
gccuacauucuuuucuaugagcagcaggggauagacuacgcacaauuucugccaaagauugaug

SEQ ID NO: 366187 - RNA, 64 nt, Human
guuuauuucauguggugaauaugcaaggcgguacacuacgcacuggacagcaucagaaauccuc

SEQ ID NO: 366188 - RNA, 64 nt, Human
aggugaugguuacaugaacagcccagacuucaccacuacgcaauauauccauguaacaaaaccg

SEQ ID NO: 366189 - RNA, 64 nt, Human
cagaggccugugacugcguuccagcggccaguucacuacgcaguaucucuggggccugggacca

SEQ ID NO: 366190 - RNA, 64 nt, Human
ccucacguucucuuggggacacccgagccaggacacuacgcaucccugcugagugugcagaggc

SEQ ID NO: 366191 - RNA, 64 nt, Human
acacauugaccaagcuccugaaagauguaaguuuacuacgcauagacuuuuaaacuucaaccaa

SEQ ID NO: 366192 - RNA, 64 nt, Human; identical to SEQ ID NO: 10635

SEQ ID NO: 366193 - RNA, 54 nt, Human; identical to SEQ ID NO: 10636

SEQ ID NO: 366194 - RNA, 64 nt, Human; identical to SEQ ID NO: 10637

SEQ ID NO: 366195 - RNA, 64 nt, Human; identical to SEQ ID NO: 10638

SEQ ID NO: 366196 - RNA, 63 nt, Human; identical to SEQ ID NO: 10639

SEQ ID NO: 366197 - RNA, 64 nt, Human; identical to SEQ ID NO: 10640

SEQ ID NO: 366198 - RNA, 64 nt, Human; identical to SEQ ID NO: 10641

SEQ ID NO: 366199 - RNA, 64 nt, Human; identical to SEQ ID NO: 10642

SEQ ID NO: 366200 - RNA, 64 nt, Human; identical to SEQ ID NO: 10643

SEQ ID NO: 366201 - RNA, 64 nt, Human; identical to SEQ ID NO: 10644

SEQ ID NO: 366202 - RNA, 62 nt, Human; identical to SEQ ID NO: 10645

SEQ ID NO: 366203 - RNA, 64 nt, Human; identical to SEQ ID NO: 10646

SEQ ID NO: 366204 - RNA, 64 nt, Human; identical to SEQ ID NO: 10647

SEQ ID NO: 366205 - RNA, 64 nt, Human; identical to SEQ ID NO: 10648

SEQ ID NO: 366206 - RNA, 64 nt, Human; identical to SEQ ID NO: 10649

SEQ ID NO: 366207 - RNA, 64 nt, Human; identical to SEQ ID NO: 10650

SEQ ID NO: 366208 - RNA, 64 nt, Human; identical to SEQ ID NO: 10651

SEQ ID NO: 366209 - RNA, 64 nt, Human; identical to SEQ ID NO: 10652

SEQ ID NO: 366210 - RNA, 64 nt, Human; identical to SEQ ID NO: 10653

SEQ ID NO: 366211 - RNA, 64 nt, Human; identical to SEQ ID NO: 10654

SEQ ID NO: 366212 - RNA, 64 nt, Human; identical to SEQ ID NO: 10655

SEQ ID NO: 366213 - RNA, 64 nt, Human; identical to SEQ ID NO: 10656

SEQ ID NO: 366214 - RNA, 64 nt, Human; identical to SEQ ID NO: 10657

SEQ ID NO: 366215 - RNA, 64 nt, Human; identical to SEQ ID NO: 10658

SEQ ID NO: 366216 - RNA, 64 nt, Human; identical to SEQ ID NO: 10659

SEQ ID NO: 366217 - RNA, 64 nt, Human; identical to SEQ ID NO: 10660

SEQ ID NO: 366218 - RNA, 64 nt, Human; identical to SEQ ID NO: 10661

SEQ ID NO: 366219 - RNA, 64 nt, Human; identical to SEQ ID NO: 10662

SEQ ID NO: 366220 - RNA, 64 nt, Human; identical to SEQ ID NO: 10663

SEQ ID NO: 366221 - RNA, 64 nt, Human; identical to SEQ ID NO: 10664

SEQ ID NO: 366222 - RNA, 64 nt, Human; identical to SEQ ID NO: 10665

SEQ ID NO: 366223 - RNA, 64 nt, Human; identical to SEQ ID NO: 10666

SEQ ID NO: 366224 - RNA, 64 nt, Human; identical to SEQ ID NO: 10667

SEQ ID NO: 366225 - RNA, 64 nt, Human; identical to SEQ ID NO: 10668

SEQ ID NO: 366226 - RNA, 64 nt, Human; identical to SEQ ID NO: 10669

SEQ ID NO: 366227 - RNA, 64 nt, Human; identical to SEQ ID NO: 10670

SEQ ID NO: 366228 - RNA, 63 nt, Human; identical to SEQ ID NO: 10671

SEQ ID NO: 366229 - RNA, 64 nt, Human; identical to SEQ ID NO: 10672

SEQ ID NO: 366230 - RNA, 64 nt, Human; identical to SEQ ID NO: 10673

SEQ ID NO: 366231 - RNA, 64 nt, Human; identical to SEQ ID NO: 10674

SEQ ID NO: 366232 - RNA, 64 nt, Human; identical to SEQ ID NO: 10675

SEQ ID NO: 366233 - RNA, 64 nt, Human; identical to SEQ ID NO: 10676

SEQ ID NO: 366234 - RNA, 64 nt, Human; identical to SEQ ID NO: 10677

SEQ ID NO: 366235 - RNA, 64 nt, Human; identical to SEQ ID NO: 10678

SEQ ID NO: 366236 - RNA, 64 nt, Human; identical to SEQ ID NO: 10679

SEQ ID NO: 366237 - RNA, 64 nt, Human; identical to SEQ ID NO: 10680

SEQ ID NO: 366238 - RNA, 64 nt, Human; identical to SEQ ID NO: 10681

SEQ ID NO: 366239 - RNA, 64 nt, Human; identical to SEQ ID NO: 10682

SEQ ID NO: 366240 - RNA, 64 nt, Human; identical to SEQ ID NO: 10683

SEQ ID NO: 366241 - RNA, 64 nt, Human; identical to SEQ ID NO: 10684

SEQ ID NO: 366242 - RNA, 64 nt, Human; identical to SEQ ID NO: 10685

SEQ ID NO: 366243 - RNA, 64 nt, Human; identical to SEQ ID NO: 10686

SEQ ID NO: 366244 - RNA, 64 nt, Human; identical to SEQ ID NO: 10687

SEQ ID NO: 366245 - RNA, 64 nt, Human; identical to SEQ ID NO: 10688

SEQ ID NO: 366246 - RNA, 64 nt, Human; identical to SEQ ID NO: 10689

SEQ ID NO: 366247 - RNA, 64 nt, Human; identical to SEQ ID NO: 10690

SEQ ID NO: 366248 - RNA, 64 nt, Human; identical to SEQ ID NO: 10691

SEQ ID NO: 366249 - RNA, 64 nt, Human; identical to SEQ ID NO: 10692

SEQ ID NO: 366250 - RNA, 64 nt, Human; identical to SEQ ID NO: 10693

SEQ ID NO: 366251 - RNA, 64 nt, Human; identical to SEQ ID NO: 10694

SEQ ID NO: 366252 - RNA, 64 nt, Human; identical to SEQ ID NO: 10695

SEQ ID NO: 366253 - RNA, 64 nt, Human; identical to SEQ ID NO: 10696

SEQ ID NO: 366254 - RNA, 64 nt, Human; identical to SEQ ID NO: 10697

SEQ ID NO: 366255 - RNA, 64 nt, Human; identical to SEQ ID NO: 10698

SEQ ID NO: 366256 - RNA, 64 nt, Human; identical to SEQ ID NO: 10699

SEQ ID NO: 366257 - RNA, 64 nt, Human; identical to SEQ ID NO: 10700

SEQ ID NO: 366258 - RNA, 64 nt, Human; identical to SEQ ID NO: 10701

SEQ ID NO: 366259 - RNA, 64 nt, Human; identical to SEQ ID NO: 10702

SEQ ID NO: 366260 - RNA, 64 nt, Human; identical to SEQ ID NO: 10703

SEQ ID NO: 366261 - RNA, 64 nt, Human; identical to SEQ ID NO: 10704

SEQ ID NO: 366262 - RNA, 64 nt, Human; identical to SEQ ID NO: 10705

SEQ ID NO: 366263 - RNA, 64 nt, Human; identical to SEQ ID NO: 10706

SEQ ID NO: 366264 - RNA, 64 nt, Human; identical to SEQ ID NO: 10707

SEQ ID NO: 366265 - RNA, 64 nt, Human; identical to SEQ ID NO: 10708

SEQ ID NO: 366266 - RNA, 64 nt, Human; identical to SEQ ID NO: 10709

SEQ ID NO: 366267 - RNA, 53 nt, Human; identical to SEQ ID NO: 10710

SEQ ID NO: 366268 - RNA, 64 nt, Human; identical to SEQ ID NO: 10711

SEQ ID NO: 366269 - RNA, 64 nt, Human; identical to SEQ ID NO: 10712

SEQ ID NO: 366270 - RNA, 64 nt, Human; identical to SEQ ID NO: 10713

SEQ ID NO: 366271 - RNA, 64 nt, Human; identical to SEQ ID NO: 10714

SEQ ID NO: 366272 - RNA, 64 nt, Human; identical to SEQ ID NO: 10715

SEQ ID NO: 366273 - RNA, 64 nt, Human; identical to SEQ ID NO: 10716

SEQ ID NO: 366274 - RNA, 64 nt, Human
ggcguggcagccucacagggaacacgggacagacgccggcgacgcgcagacacacggacacgcg

SEQ ID NO: 366275 - RNA, 64 nt, Human
gcuggacauuuguggcagugcugaagggggcauugccggcgaguaaaguauuauguuucuucuu

SEQ ID NO: 366276 - RNA, 64 nt, Human
uccgggcccagccucgcagcggccaggagcgcgggccggcgaugcggcugccggcgcccccccg

SEQ ID NO: 366277 - RNA, 64 nt, Human
agacaccauccaaggaugggcagccugcaguguggccggcgacugccauccagagaaaaggcac

SEQ ID NO: 366278 - RNA, 64 nt, Human
agggggucccccagcaggugcggccccugcaccugccggcgacacuccugccgguaguuuaggg

SEQ ID NO: 366279 - RNA, 64 nt, Human
gcucgcuggcccugcacuccgccuuaguccuggggccggcgacacagugggggcuccucacuug

SEQ ID NO: 366280 - RNA, 64 nt, Human
ugacuugccgacggucggcagguaauggcucucagccggcgaggcggucccacagcucuccucc

SEQ ID NO: 366281 - RNA, 64 nt, Human
cuccugagaacugugcugguggagagguccuagagccggcgagcguuugagaagagggcauggc

SEQ ID NO: 366282 - RNA, 64 nt, Human
gucccuugagggagcguggagcugcggugcccuggccggcgauggggaggagccggcuccggca

SEQ ID NO: 366283 - RNA, 64 nt, Human; identical to SEQ ID NO: 354048

SEQ ID NO: 366284 - RNA, 64 nt, Human; identical to SEQ ID NO: 354049

SEQ ID NO: 366285 - RNA, 64 nt, Human; identical to SEQ ID NO: 354050

SEQ ID NO: 366286 - RNA, 64 nt, Human
cagccuguggcugcccugcuguggggguccuggggccggcgaggccccuucagucuuguucugg

SEQ ID NO: 366287 - RNA, 64 nt, Human
aguauuucucugaagugccugaagguaggaaugggccggcgauugggaccagcugggccccacc

SEQ ID NO: 366288 - RNA, 64 nt, Human
gucaaaugugaccggaugcgcucccagaagcuccgccggcgaccagacuccugccacgccuucc

SEQ ID NO: 366289 - RNA, 64 nt, Human
ugaggacuacacuagugaaagcgccuggcgggcagccggcgaugcccaauaaauguguguuuug

SEQ ID NO: 366290 - RNA, 64 nt, Human
cacgacagggcagaaggaguuucuccggagaugagccggcgaggccaggugcggggcgcgcugc

SEQ ID NO: 366291 - RNA, 64 nt, Human
gugguccacaucccgggacgcagcaggaggccaggccggcgagcccuguggaugagcccucaga

SEQ ID NO: 366292 - RNA, 64 nt, Human
ugacucugggccccgaggguccgcugggcccgccgccggcgagauggacaccugagaugcugug

SEQ ID NO: 366293 - RNA, 64 nt, Human
ucugccuuucugggaugggagagaaggugagggagccggcgagcagguucuacccucucugcua

SEQ ID NO: 366294 - RNA, 64 nt, Human
ggaagggcgcaagucaaagagcacuggaggcaccgccggcgauggacguccaggucccggcucc

SEQ ID NO: 366295 - RNA, 64 nt, Human
gaagauggcuucacggaggucagaagagaaggaggccggcgagaucugaacccgucucccgggu

SEQ ID NO: 366296 - RNA, 64 nt, Human
aagcucacacugaugggcuggggcaggggccugggccggcgagggggccggggggaggggacag

SEQ ID NO: 366297 - RNA, 64 nt, Human
cucugcguaacagguuccuccuuugggcccagcggccggcgaggccgccagacauacacacguu

SEQ ID NO: 366298 - RNA, 64 nt, Human
cucacggccuacagcagcccacaagcugccacuggccggcgacacugacaccugagcagugucc

SEQ ID NO: 366299 - RNA, 64 nt, Human
gacccuccaccuggaggagguggugcaggaggccgccggcgaguggcaggcccucacccacguc

SEQ ID NO: 366300 - RNA, 64 nt, Human
uucauauuuuguagcgaaagucguuuuugucccagccggcgaucggagugggccuuuucuuucu

SEQ ID NO: 366301 - RNA, 64 nt, Human
gguuuagaagaugcuugggcuuggagggaggagggccggcgaggcuagcgaggggacaggagac

SEQ ID NO: 366302 - RNA, 64 nt, Human; identical to SEQ ID NO: 354051

SEQ ID NO: 366303 - RNA, 64 nt, Human; identical to SEQ ID NO: 354052

SEQ ID NO: 366304 - RNA, 64 nt, Human; identical to SEQ ID NO: 354053

SEQ ID NO: 366305 - RNA, 64 nt, Human
ucgggcccggccugcgccucgccuucucggcacggccggcgacuccccaacggcuacuacccgg

SEQ ID NO: 366306 - RNA, 64 nt, Human
ccuagcggccggggagggaggggccggguccgcggccggcgaacggggcucgaaggguccuugu

SEQ ID NO: 366307 - RNA, 64 nt, Human
gggaugcuagagggucaccugcaggaggccuggggccggcgagaaaucuccugugaugcccugu

SEQ ID NO: 366308 - RNA, 64 nt, Human
ggcaccaaggaacuguccggaacuaacagcaggggccggcgaugggagucaaacccaggcacgc

SEQ ID NO: 366309 - RNA, 64 nt, Human; identical to SEQ ID NO: 354054

SEQ ID NO: 366310 - RNA, 64 nt, Human; identical to SEQ ID NO: 354055

SEQ ID NO: 366311 - RNA, 64 nt, Human; identical to SEQ ID NO: 354056

SEQ ID NO: 366312 - RNA, 64 nt, Human; identical to SEQ ID NO: 354057

SEQ ID NO: 366313 - RNA, 64 nt, Human; identical to SEQ ID NO: 354058

SEQ ID NO: 366314 - RNA, 64 nt, Human; identical to SEQ ID NO: 354059

SEQ ID NO: 366315 - RNA, 64 nt, Human; identical to SEQ ID NO: 141728

SEQ ID NO: 366316 - RNA, 64 nt, Human; identical to SEQ ID NO: 141729

SEQ ID NO: 366317 - RNA, 64 nt, Human; identical to SEQ ID NO: 141730

SEQ ID NO: 366318 - RNA, 64 nt, Human; identical to SEQ ID NO: 116584

SEQ ID NO: 366319 - RNA, 64 nt, Human; identical to SEQ ID NO: 116590

SEQ ID NO: 366320 - RNA, 64 nt, Human; identical to SEQ ID NO: 116595

SEQ ID NO: 366321 - RNA, 64 nt, Human; identical to SEQ ID NO: 116598

SEQ ID NO: 366322 - RNA, 64 nt, Human; identical to SEQ ID NO: 141731

SEQ ID NO: 366323 - RNA, 55 nt, Human; identical to SEQ ID NO: 141732

SEQ ID NO: 366324 - RNA, 64 nt, Human; identical to SEQ ID NO: 141733

SEQ ID NO: 366325 - RNA, 64 nt, Human; identical to SEQ ID NO: 141734

SEQ ID NO: 366326 - RNA, 64 nt, Human; identical to SEQ ID NO: 141735

SEQ ID NO: 366327 - RNA, 64 nt, Human; identical to SEQ ID NO: 141736

SEQ ID NO: 366328 - RNA, 64 nt, Human; identical to SEQ ID NO: 141737

SEQ ID NO: 366329 - RNA, 64 nt, Human; identical to SEQ ID NO: 141738

SEQ ID NO: 366330 - RNA, 64 nt, Human; identical to SEQ ID NO: 141739

SEQ ID NO: 366331 - RNA, 64 nt, Human; identical to SEQ ID NO: 141740

SEQ ID NO: 366332 - RNA, 60 nt, Human; identical to SEQ ID NO: 141741

SEQ ID NO: 366333 - RNA, 64 nt, Human; identical to SEQ ID NO: 141742

SEQ ID NO: 366334 - RNA, 64 nt, Human; identical to SEQ ID NO: 141743

SEQ ID NO: 366335 - RNA, 64 nt, Human; identical to SEQ ID NO: 141744

SEQ ID NO: 366336 - RNA, 64 nt, Human; identical to SEQ ID NO: 141745

SEQ ID NO: 366337 - RNA, 62 nt, Human
uccuguguaugcugagguacagaagccccauguguaccuacagagcagccagguggagguua

SEQ ID NO: 366338 - RNA, 62 nt, Human
ugucagagcuaauucauguucagggugagcguuguaccuaccaacaaauuuccugguugggu

SEQ ID NO: 366339 - RNA, 62 nt, Human
aaacaguacucaaugagacuggaaauaccuuuuguaccuaaauguuuuuuaaauuaaucaaa

SEQ ID NO: 366340 - RNA, 64 nt, Human; identical to SEQ ID NO: 141746

SEQ ID NO: 366341 - RNA, 64 nt, Human; identical to SEQ ID NO: 141747

SEQ ID NO: 366342 - RNA, 64 nt, Human; identical to SEQ ID NO: 141748

SEQ ID NO: 366343 - RNA, 64 nt, Human; identical to SEQ ID NO: 141749

SEQ ID NO: 366344 - RNA, 64 nt, Human; identical to SEQ ID NO: 141750

SEQ ID NO: 366345 - RNA, 64 nt, Human; identical to SEQ ID NO: 141751

SEQ ID NO: 366346 - RNA, 64 nt, Human; identical to SEQ ID NO: 141752

SEQ ID NO: 366347 - RNA, 64 nt, Human; identical to SEQ ID NO: 141753

SEQ ID NO: 366348 - RNA, 64 nt, Human; identical to SEQ ID NO: 141754

SEQ ID NO: 366349 - RNA, 64 nt, Human; identical to SEQ ID NO: 141755

SEQ ID NO: 366350 - RNA, 64 nt, Human; identical to SEQ ID NO: 141756

SEQ ID NO: 366351 - RNA, 64 nt, Human; identical to SEQ ID NO: 141757

SEQ ID NO: 366352 - RNA, 64 nt, Human; identical to SEQ ID NO: 141758

SEQ ID NO: 366353 - RNA, 64 nt, Human; identical to SEQ ID NO: 141759

SEQ ID NO: 366354 - RNA, 64 nt, Human; identical to SEQ ID NO: 141760

SEQ ID NO: 366355 - RNA, 62 nt, Human
uaaaauaguuuugcuuuguugaauaauacguguguaccuaaaagagguaagagcaaaaagug

SEQ ID NO: 366356 - RNA, 62 nt, Human
ugaacugaaacaauucucaagaaugcaucagcuguaccuacaauagccccucccucuuccuu

SEQ ID NO: 366357 - RNA, 62 nt, Human
ccacaccauaguaugcauuguuauacauacuguguaccuaauuauguauagcaguguagucu

SEQ ID NO: 366358 - RNA, 64 nt, Human; identical to SEQ ID NO: 141761

SEQ ID NO: 366359 - RNA, 64 nt, Human; identical to SEQ ID NO: 141762

SEQ ID NO: 366360 - RNA, 64 nt, Human; identical to SEQ ID NO: 141763

SEQ ID NO: 366361 - RNA, 64 nt, Human; identical to SEQ ID NO: 141764

SEQ ID NO: 366362 - RNA, 64 nt, Human; identical to SEQ ID NO: 141765

SEQ ID NO: 366363 - RNA, 64 nt, Human; identical to SEQ ID NO: 141766

SEQ ID NO: 366364 - RNA, 64 nt, Human; identical to SEQ ID NO: 141767

SEQ ID NO: 366365 - RNA, 64 nt, Human; identical to SEQ ID NO: 141768

SEQ ID NO: 366366 - RNA, 64 nt, Human; identical to SEQ ID NO: 141769

SEQ ID NO: 366367 - RNA, 64 nt, Human; identical to SEQ ID NO: 141770

SEQ ID NO: 366368 - RNA, 64 nt, Human; identical to SEQ ID NO: 141771

SEQ ID NO: 366369 - RNA, 52 nt, Human; identical to SEQ ID NO: 141772

SEQ ID NO: 366370 - RNA, 64 nt, Human; identical to SEQ ID NO: 141773

SEQ ID NO: 366371 - RNA, 64 nt, Human; identical to SEQ ID NO: 141774

SEQ ID NO: 366372 - RNA, 64 nt, Human; identical to SEQ ID NO: 141775

SEQ ID NO: 366373 - RNA, 62 nt, Human
accgcucccgucuccaagccuucaugcacauauguaccuaaugaguuuuuauagcaaagaau

SEQ ID NO: 366374 - RNA, 62 nt, Human
aauaaaaagguauuaaauguguauuucugccauguaccuaaugauuauucagugcguauaua

SEQ ID NO: 366375 - RNA, 62 nt, Human
uuuaucuaaucuauuuuuguguuuaaaaaagcuguaccuaccaaauaaauaaauaguuuaua

SEQ ID NO: 366376 - RNA, 64 nt, Human; identical to SEQ ID NO: 141776

SEQ ID NO: 366377 - RNA, 64 nt, Human; identical to SEQ ID NO: 141777

SEQ ID NO: 366378 - RNA, 64 nt, Human; identical to SEQ ID NO: 141778

SEQ ID NO: 366379 - RNA, 64 nt, Human; identical to SEQ ID NO: 141779

SEQ ID NO: 366380 - RNA, 64 nt, Human; identical to SEQ ID NO: 141780

SEQ ID NO: 366381 - RNA, 64 nt, Human; identical to SEQ ID NO: 141781

SEQ ID NO: 366382 - RNA, 64 nt, Human; identical to SEQ ID NO: 141782

SEQ ID NO: 366383 - RNA, 64 nt, Human; identical to SEQ ID NO: 141783

SEQ ID NO: 366384 - RNA, 64 nt, Human; identical to SEQ ID NO: 141784

SEQ ID NO: 366385 - RNA, 64 nt, Human; identical to SEQ ID NO: 141785

SEQ ID NO: 366386 - RNA, 54 nt, Human; identical to SEQ ID NO: 141786

SEQ ID NO: 366387 - RNA, 64 nt, Human; identical to SEQ ID NO: 141787

SEQ ID NO: 366388 - RNA, 64 nt, Human; identical to SEQ ID NO: 141788

SEQ ID NO: 366389 - RNA, 64 nt, Human; identical to SEQ ID NO: 141789

SEQ ID NO: 366390 - RNA, 64 nt, Human; identical to SEQ ID NO: 141790

SEQ ID NO: 366391 - RNA, 62 nt, Human
ucccuagcauuuuggauaagggauacucagcuuguaccuauauauucauauauauucacugu

SEQ ID NO: 366392 - RNA, 62 nt, Human
gccuguuggaggcaaauagaucagauuuuuuuuguaccuacguaagaguacuugaaguuuua

SEQ ID NO: 366393 - RNA, 62 nt, Human
augaaauuacuuuaaauaugaauuguacuaacuguaccuaaauagcaaagcccuguguagau

SEQ ID NO: 366394 - RNA, 64 nt, Human; identical to SEQ ID NO: 141791

SEQ ID NO: 366395 - RNA, 62 nt, Human; identical to SEQ ID NO: 141792

SEQ ID NO: 366396 - RNA, 64 nt, Human; identical to SEQ ID NO: 141793

SEQ ID NO: 366397 - RNA, 64 nt, Human; identical to SEQ ID NO: 141794

SEQ ID NO: 366398 - RNA, 64 nt, Human; identical to SEQ ID NO: 141795

SEQ ID NO: 366399 - RNA, 64 nt, Human; identical to SEQ ID NO: 141796

SEQ ID NO: 366400 - RNA, 64 nt, Human; identical to SEQ ID NO: 141797

SEQ ID NO: 366401 - RNA, 64 nt, Human; identical to SEQ ID NO: 141798

SEQ ID NO: 366402 - RNA, 64 nt, Human; identical to SEQ ID NO: 141799

SEQ ID NO: 366403 - RNA, 64 nt, Human; identical to SEQ ID NO: 141800

SEQ ID NO: 366404 - RNA, 52 nt, Human; identical to SEQ ID NO: 141801

SEQ ID NO: 366405 - RNA, 64 nt, Human; identical to SEQ ID NO: 141802

SEQ ID NO: 366406 - RNA, 59 nt, Human; identical to SEQ ID NO: 141803

SEQ ID NO: 366407 - RNA, 64 nt, Human; identical to SEQ ID NO: 141804

SEQ ID NO: 366408 - RNA, 64 nt, Human; identical to SEQ ID NO: 141805

SEQ ID NO: 366409 - RNA, 62 nt, Human
aauuuggcuaggacuucaauuuuaaaaaucaguguaccuaggcagugcacagcacgaaauaa

SEQ ID NO: 366410 - RNA, 62 nt, Human
agcucugcugacccuuggccgaaacucuaaaauguaccuauuaaagauaaaugcuucuacca

SEQ ID NO: 366411 - RNA, 62 nt, Human
gcuuaguauacccucacccaaauaguauacauuguaccuaguaaauacuuucccaucucuca

SEQ ID NO: 366412 - RNA, 54 nt, Human; identical to SEQ ID NO: 141806

SEQ ID NO: 366413 - RNA, 64 nt, Human; identical to SEQ ID NO: 141807

SEQ ID NO: 366414 - RNA, 64 nt, Human; identical to SEQ ID NO: 141808

SEQ ID NO: 366415 - RNA, 55 nt, Human; identical to SEQ ID NO: 141809

SEQ ID NO: 366416 - RNA, 64 nt, Human; identical to SEQ ID NO: 141810

SEQ ID NO: 366417 - RNA, 64 nt, Human; identical to SEQ ID NO: 141811

SEQ ID NO: 366418 - RNA, 64 nt, Human; identical to SEQ ID NO: 141812

SEQ ID NO: 366419 - RNA, 64 nt, Human; identical to SEQ ID NO: 141813

SEQ ID NO: 366420 - RNA, 64 nt, Human; identical to SEQ ID NO: 141814

SEQ ID NO: 366421 - RNA, 61 nt, Human; identical to SEQ ID NO: 141815

SEQ ID NO: 366422 - RNA, 64 nt, Human; identical to SEQ ID NO: 141816

SEQ ID NO: 366423 - RNA, 64 nt, Human; identical to SEQ ID NO: 141817

SEQ ID NO: 366424 - RNA, 64 nt, Human; identical to SEQ ID NO: 141818

SEQ ID NO: 366425 - RNA, 64 nt, Human; identical to SEQ ID NO: 141819

SEQ ID NO: 366426 - RNA, 64 nt, Human; identical to SEQ ID NO: 141820

SEQ ID NO: 366427 - RNA, 62 nt, Human
gauugcgcagacugaaacuagcuaaaccugaauguaccuacuagggcaccauaauacugcag

SEQ ID NO: 366428 - RNA, 62 nt, Human
gcuggcucccucccccucagacccucacuuccuguaccuagaggccauucuggaugcugcca

SEQ ID NO: 366429 - RNA, 62 nt, Human
gcguuuguauauagauuuggugacauuucccauguaccuauuaugaucuuucucccuugagu

SEQ ID NO: 366430 - RNA, 64 nt, Human; identical to SEQ ID NO: 141821

SEQ ID NO: 366431 - RNA, 64 nt, Human; identical to SEQ ID NO: 141822

SEQ ID NO: 366432 - RNA, 64 nt, Human; identical to SEQ ID NO: 141823

SEQ ID NO: 366433 - RNA, 64 nt, Human; identical to SEQ ID NO: 141824

SEQ ID NO: 366434 - RNA, 64 nt, Human; identical to SEQ ID NO: 141825

SEQ ID NO: 366435 - RNA, 64 nt, Human; identical to SEQ ID NO: 141826

SEQ ID NO: 366436 - RNA, 64 nt, Human; identical to SEQ ID NO: 141827

SEQ ID NO: 366437 - RNA, 64 nt, Human; identical to SEQ ID NO: 141828

SEQ ID NO: 366438 - RNA, 64 nt, Human; identical to SEQ ID NO: 141829

SEQ ID NO: 366439 - RNA, 64 nt, Human; identical to SEQ ID NO: 141830

SEQ ID NO: 366440 - RNA, 64 nt, Human; identical to SEQ ID NO: 141831

SEQ ID NO: 366441 - RNA, 64 nt, Human; identical to SEQ ID NO: 141832

SEQ ID NO: 366442 - RNA, 56 nt, Human; identical to SEQ ID NO: 141833

SEQ ID NO: 366443 - RNA, 64 nt, Human; identical to SEQ ID NO: 141834

SEQ ID NO: 366444 - RNA, 64 nt, Human; identical to SEQ ID NO: 141835

SEQ ID NO: 366445 - RNA, 62 nt, Human
agucauuuuucuauuugugguauauguauauauguaccuauauguauuugcauuugaaauuu

SEQ ID NO: 366446 - RNA, 62 nt, Human
gggaacaaguuaccuaccacauuucacuuuaguguaccuauuuacagaaagauuaaacugcc

SEQ ID NO: 366447 - RNA, 62 nt, Human
uaguaaaugguaguguguccuguguaaauuaguguaccuauuaaaaguugcaaaguggaauu

SEQ ID NO: 366448 - RNA, 64 nt, Human; identical to SEQ ID NO: 141850

SEQ ID NO: 366449 - RNA, 64 nt, Human
ccgacccccgagaggccaccuccaagccgcgggugcccccuagggcgacaggagccagcgggac

SEQ ID NO: 366450 - RNA, 64 nt, Human
gguucugcagcuggaccgaccucauucaucgccugcccccuacccaauucugagcacacgguac

SEQ ID NO: 366451 - RNA, 64 nt, Human
uucccccugguggggcugguggggagcuguaguugcccccuaccucucccaccucuugcucuuc

SEQ ID NO: 366452 - RNA, 64 nt, Human
aggaggagaaucuggccugagaucuuagagcccagcccccuaaggacagggaaccaggucccug

SEQ ID NO: 366453 - RNA, 64 nt, Human
uacugacagcuccucuuucuggagagccccaagggcccccuagccagccccgcacgugaguagg

SEQ ID NO: 366454 - RNA, 64 nt, Human
ugaacucccucuguccccagggccucccuucugggcccccuacagcccacccuaccccuccucc

SEQ ID NO: 366455 - RNA, 64 nt, Human
cccacauccuaagguggaucccacgcuucccugugcccccuacuggauccuggaccucuacguc

SEQ ID NO: 366456 - RNA, 60 nt, Human
ucgacuacgcguuggugugaggggcgcggcgcccccuagccggcccugcgccggggucuc

SEQ ID NO: 366457 - RNA, 64 nt, Human
cucugccucccaggucaaagcaauccugccucaggcccccuaguagcuggcauuacaggcacau

SEQ ID NO: 366458 - RNA, 64 nt, Human
ccccgcaccccccaugcuucuuuugcugccuuaagcccccuaugcccuggaggugagggcagcu

SEQ ID NO: 366459 - RNA, 64 nt, Human
guucaagaccagccugggcaacauagugagaccugcccccuaucucuacaaaaaauaaaaaauu

SEQ ID NO: 366460 - RNA, 64 nt, Human
ucuccgcccagcuccaguccugugauccgggcccgcccccuagcggccggggagggaggggccg

SEQ ID NO: 366461 - RNA, 64 nt, Human
aggggugcugccggggauuuggggucagcaucuggcccccuaucuccugaccagcugagucaug

SEQ ID NO: 366462 - RNA, 64 nt, Human
uccugguccccauacccagcaucuaaucauccaugcccccuacuccuggccccuccauccuuuc

SEQ ID NO: 366463 - RNA, 64 nt, Human
cuuuggucaugggaucugcucuuugucauucuuagcccccuacuguggcccccauagccccaua

SEQ ID NO: 366464 - RNA, 64 nt, Human; identical to SEQ ID NO: 116604

SEQ ID NO: 366465 - RNA, 64 nt, Human; identical to SEQ ID NO: 116610

SEQ ID NO: 366466 - RNA, 64 nt, Human; identical to SEQ ID NO: 116616

SEQ ID NO: 366467 - RNA, 64 nt, Human; identical to SEQ ID NO: 141851

SEQ ID NO: 366468 - RNA, 64 nt, Human; identical to SEQ ID NO: 141852

SEQ ID NO: 366469 - RNA, 64 nt, Human; identical to SEQ ID NO: 141853

SEQ ID NO: 366470 - RNA, 64 nt, Human; identical to SEQ ID NO: 141854

SEQ ID NO: 366471 - RNA, 64 nt, Human; identical to SEQ ID NO: 141855

SEQ ID NO: 366472 - RNA, 64 nt, Human; identical to SEQ ID NO: 141856

SEQ ID NO: 366473 - RNA, 64 nt, Human; identical to SEQ ID NO: 141857

SEQ ID NO: 366474 - RNA, 64 nt, Human; identical to SEQ ID NO: 141858

SEQ ID NO: 366475 - RNA, 64 nt, Human; identical to SEQ ID NO: 141859

SEQ ID NO: 366476 - RNA, 64 nt, Human; identical to SEQ ID NO: 141860

SEQ ID NO: 366477 - RNA, 64 nt, Human; identical to SEQ ID NO: 141861

SEQ ID NO: 366478 - RNA, 61 nt, Human; identical to SEQ ID NO: 141862

SEQ ID NO: 366479 - RNA, 64 nt, Human; identical to SEQ ID NO: 141863

SEQ ID NO: 366480 - RNA, 64 nt, Human; identical to SEQ ID NO: 141864

SEQ ID NO: 366481 - RNA, 64 nt, Human; identical to SEQ ID NO: 141865

SEQ ID NO: 366482 - RNA, 62 nt, Human
uggucauuggauauuucugauccuuauugcauuguaccuaaaggagaguaacuaaugguaac

SEQ ID NO: 366483 - RNA, 62 nt, Human
agccauguacuauaaugugaugauucuaaauuuguaccuaugugacagacauuuucaauaau

SEQ ID NO: 366484 - RNA, 62 nt, Human
caacaucccuuauaccacuguguauguucuuguguaccuacagcuaagcuuccacuuauaag

SEQ ID NO: 366485 - RNA, 64 nt, Human; identical to SEQ ID NO: 141866

SEQ ID NO: 366486 - RNA, 56 nt, Human; identical to SEQ ID NO: 141867

SEQ ID NO: 366487 - RNA, 64 nt, Human; identical to SEQ ID NO: 141868

SEQ ID NO: 366488 - RNA, 64 nt, Human; identical to SEQ ID NO: 141869

SEQ ID NO: 366489 - RNA, 64 nt, Human; identical to SEQ ID NO: 141870

SEQ ID NO: 366490 - RNA, 64 nt, Human; identical to SEQ ID NO: 141871

SEQ ID NO: 366491 - RNA, 64 nt, Human; identical to SEQ ID NO: 141872

SEQ ID NO: 366492 - RNA, 64 nt, Human; identical to SEQ ID NO: 141873

SEQ ID NO: 366493 - RNA, 64 nt, Human; identical to SEQ ID NO: 141874

SEQ ID NO: 366494 - RNA, 64 nt, Human; identical to SEQ ID NO: 141875

SEQ ID NO: 366495 - RNA, 64 nt, Human; identical to SEQ ID NO: 141876

SEQ ID NO: 366496 - RNA, 64 nt, Human; identical to SEQ ID NO: 141877

SEQ ID NO: 366497 - RNA, 64 nt, Human; identical to SEQ ID NO: 141878

SEQ ID NO: 366498 - RNA, 64 nt, Human; identical to SEQ ID NO: 141879

SEQ ID NO: 366499 - RNA, 64 nt, Human; identical to SEQ ID NO: 141880

SEQ ID NO: 366500 - RNA, 62 nt, Human
cugaaucauuaaugaugucucacaaauuacuguguaccuaaguggugugauguaaauacugg

SEQ ID NO: 366501 - RNA, 62 nt, Human
uagaguccagccuaaucaaaugucauaauuguuguaccuauugaaaguuuuuaaauaauaga

SEQ ID NO: 366502 - RNA, 62 nt, Human
ugugaccuuagauuuuagaaggacaguggggcuguaccuagaauagugguucucgaagaaug

SEQ ID NO: 366503 - RNA, 64 nt, Human; identical to SEQ ID NO: 141881

SEQ ID NO: 366504 - RNA, 64 nt, Human; identical to SEQ ID NO: 141882

SEQ ID NO: 366505 - RNA, 64 nt, Human; identical to SEQ ID NO: 141883

SEQ ID NO: 366506 - RNA, 64 nt, Human; identical to SEQ ID NO: 141884

SEQ ID NO: 366507 - RNA, 64 nt, Human; identical to SEQ ID NO: 141885

SEQ ID NO: 366508 - RNA, 64 nt, Human; identical to SEQ ID NO: 141886

SEQ ID NO: 366509 - RNA, 64 nt, Human; identical to SEQ ID NO: 141887

SEQ ID NO: 366510 - RNA, 64 nt, Human; identical to SEQ ID NO: 141888

SEQ ID NO: 366511 - RNA, 64 nt, Human; identical to SEQ ID NO: 141889

SEQ ID NO: 366512 - RNA, 64 nt, Human; identical to SEQ ID NO: 141890

SEQ ID NO: 366513 - RNA, 64 nt, Human; identical to SEQ ID NO: 141891

SEQ ID NO: 366514 - RNA, 62 nt, Human
ugaaugaaugaauggcuaagcaaaaugugauauguaccuaacgaaguauccuucagccugaa

SEQ ID NO: 366515 - RNA, 62 nt, Human
cuucuguggcaaaugccaguuuuguuuaauaauguaccuauuccuucagaaagaugauaccc

SEQ ID NO: 366516 - RNA, 62 nt, Human
uguuucauuguuuaaggaaaaaaaaaaaugccuguaccuacaaugugauugcuuuguauugu

SEQ ID NO: 366517 - RNA, 64 nt, Human
cagagacccgagggcugcuuugggggaggggggaacucgagaauguauggauuuaccugaaaac

SEQ ID NO: 366518 - RNA, 64 nt, Human
cugagcgugguggugugcaccuguaaucccagcuacucgagaggccaaggcaugagaaucgcuu

SEQ ID NO: 366519 - RNA, 64 nt, Human
gggugccacagggaaagcuguagaaggcaagaagacucgagaaucccccagaguuauuuuucuc

SEQ ID NO: 366520 - RNA, 64 nt, Human
cugggcgugguggugggugccuguaaucccagcuacucgagaggccaaggcaggagaauugcua

SEQ ID NO: 366521 - RNA, 64 nt, Human
guauuuccccuuaauuaggaugcauguugauuaaacucgagauacagcuuuuugcaguauggug

SEQ ID NO: 366522 - RNA, 64 nt, Human
ucucagaugaggagggagagaaggaggccgccagacucgagaggugggaggaacuccuugcaca

SEQ ID NO: 366523 - RNA, 64 nt, Human
aacccuucucuguuggucugccuucugcugaaagacucgagaaccaaccagggaagcuguccug

SEQ ID NO: 366524 - RNA, 64 nt, Human
uuggcugguuucgcgccugaguugggcucuagugacucgagacucaaugacugggacuuagacu

SEQ ID NO: 366525 - RNA, 64 nt, Human
cugggcaugacggccagagcccauggucccagcuacucgagaggcugagguaagagcaucccuu

SEQ ID NO: 366526 - RNA, 64 nt, Human
guauuuauuaccaaugcugcagguacauuaaugaacucgagauggcucuguaagccugacuggc

SEQ ID NO: 366527 - RNA, 64 nt, Human
uauaaauuuuaauaguuauaaauauaauacuauaacucgagaaaaggcauuucuagagaacaga

SEQ ID NO: 366528 - RNA, 64 nt, Human
uuucaccccuuaccccaaagagaaagaguuugaaacucgagaccauaaagauauucuuuagugg

SEQ ID NO: 366529 - RNA, 62 nt, Human
cucgugucuuucuuuaggauacagagaguaacuguaccuauuauuuguuucuucagacaagc

SEQ ID NO: 366530 - RNA, 62 nt, Human
aauaugugaaauaguguaaauaugaaagaacuuguaccuaucacuucaaccccugccuugua

SEQ ID NO: 366531 - RNA, 62 nt, Human
ugcauacauguaaguauauaaacauuuagaaguguaccuaucuaacaaacuauuaugaaaua

SEQ ID NO: 366532 - RNA, 64 nt, Human
agagagccggcccgccugaaucauucucgauuuaacucgagaccuuuucaacuuggcuuccuuu

SEQ ID NO: 366533 - RNA, 64 nt, Human
accaagacagaacucaagaaagccacuggggaaaacucgagaagaaagggaguauacuaguagg

SEQ ID NO: 366534 - RNA, 64 nt, Human
cugggugugguggcgcgugccuguagucccagcuacucgagaggcuaaggcaggaaaaucgcuu

SEQ ID NO: 366535 - RNA, 64 nt, Human
cccgguauguuggcauaugccuguaaucccagcuacucgagaggcugagacacgaaaauugcuu

SEQ ID NO: 366536 - RNA, 64 nt, Human
cucucgcagcccggggagcacgucgccucuugaaacucgagauuucuuaaaucccaauauaaaa

SEQ ID NO: 366537 - RNA, 64 nt, Human
agcaccauuuuauuugguuugucccacuaaaaugacucgagaaguguuuagacaaacuccccuu

SEQ ID NO: 366538 - RNA, 64 nt, Human
uuucccccacgucucccucuauacccccucgaagacucgagagggggaggggguaaggagcgca

SEQ ID NO: 366539 - RNA, 64 nt, Human
ccaggugugguagcaggcaccuguagucuuagcuacucgagaggccaaagaaggaggauggcuu

SEQ ID NO: 366540 - RNA, 64 nt, Human
cuguuggagcaagaggaacaugcuuguuuugaaaacucgagaugaugagggugguacaugcagu

SEQ ID NO: 366541 - RNA, 52 nt, Human
gauccugugcuuuacucugaagacucgagagaaguuugcugaggaaugccuu

SEQ ID NO: 366542 - RNA, 64 nt, Human
gugaugugugguccccauauguggcucagcaaagacucgagagaucaucccuuugucugcauug

SEQ ID NO: 366543 - RNA, 64 nt, Human
agcgccucccgccgccucgggccgccuccuccagacucgagagggcugagccccuccucuccuc

SEQ ID NO: 366544 - RNA, 64 nt, Human
cccagaugccugagccuuuguccaaagugaggucacucgagaauucauggacacggcccccagu

SEQ ID NO: 366545 - RNA, 64 nt, Human
gugucuggugcgucagccugcugcuucgugucucacucgagaguugcuucugguuucacacuuu

SEQ ID NO: 366546 - RNA, 64 nt, Human
ccaggcgugguggugggugccuguaauuccagccacucgagaggcugaggcaggagaauugcuu

SEQ ID NO: 366547 - RNA, 64 nt, Human
uuagguucaaaaccuaauucccccagauuaguauacucgagaauucaaagggacauuuaaggug

SEQ ID NO: 366548 - RNA, 62 nt, Human
guauuuggggcuuuccuaccccuuuagccuucuguaccuaguaccauauuccaguuuuaaag

SEQ ID NO: 366549 - RNA, 62 nt, Human
aaaccagcaucacaccaacucugacacauggauguaccuaucuuggugaugggugggggcca

SEQ ID NO: 366550 - RNA, 64 nt, Human; identical to SEQ ID NO: 116622

SEQ ID NO: 366551 - RNA, 64 nt, Human
acagaggucuggugguuuucccuacuauccucccacucgagaguucacuucugguugggagaca

SEQ ID NO: 366552 - RNA, 64 nt, Human
agggccuucucgugagguacugacaacaccagcaacucgagagcugggaaacucaaggaggagg

SEQ ID NO: 366553 - RNA, 64 nt, Human
uaaaucauauuguaguauucaauaguuaauaaaaacucgagaaauguguuguuucugaugugaa

SEQ ID NO: 366554 - RNA, 64 nt, Human
ccggguguaguggugggcaccuguaguccuagcuacucgagaggcugaggcaggagaauggcgu

SEQ ID NO: 366555 - RNA, 64 nt, Human
cgaucaaggcucuggcauucagagaacccuugcaacucgagaagcuguuuuuauuucguuuuug

SEQ ID NO: 366556 - RNA, 64 nt, Human
ugacucagaccaggucccacacugagcugcccacacucgagagccagauauuuuuguaguuuuu

SEQ ID NO: 366557 - RNA, 53 nt, Human
gaggcggcgaggacgacuaggggacucgagagaggcgggccccagacccaugu

SEQ ID NO: 366558 - RNA, 64 nt, Human
aucaugcaagcgcucuaauuccuauaaauacgaaacucgagaagauucaaucacuguauagaau

SEQ ID NO: 366559 - RNA, 64 nt, Human
ugaaaaugcagaugguucugaggaggaaacggacacucgagacgcagacuucaauggaaccaag

SEQ ID NO: 366560 - RNA, 64 nt, Human
ccgggcaugguggaaugugccuguaaucccaccuacucgagaggcugaggcagcagaauugcuu

SEQ ID NO: 366561 - RNA, 64 nt, Human
uauugccuugcauucuaaugcaguuuguucuguaacucgagagccaguagcauuggauugaugg

SEQ ID NO: 366562 - RNA, 64 nt, Human
ccgagcaugguggcacaugccuguagucccaccuacucgagaagcugagauagggucaccugag

SEQ ID NO: 366563 - RNA, 64 nt, Human
aagucuguuucugcugcaggugaccaaccacauaacucgagacagggacagcgggaggcucaaa

SEQ ID NO: 366564 - RNA, 64 nt, Human
gugugcauagaucugagaggagucgggagucgagacucgagauuccaucauagcguaggugugu

SEQ ID NO: 366565 - RNA, 64 nt, Human
agucuguucuagggaaggccucccagcaucugggacucgagagugggcagccccucuaccuccu

SEQ ID NO: 366566 - RNA, 64 nt, Human
gugaccccacccagccaccucucccuuuuauggaacucgagaggguggcccuacugugcacccc

SEQ ID NO: 366567 - RNA, 62 nt, Human
uaaauuauuucauauagggaagaguucugaucuguaccuaugguucuuauugaaaacaacau

SEQ ID NO: 366568 - RNA, 62 nt, Human
cuuuucuguucaucaccagucuguaaaauacauguaccuauagaaauagaacacugccucug

SEQ ID NO: 366569 - RNA, 62 nt, Human
ggauuguaaccaugugaugaaguuaucuauguuguaccuaacauugcaaauuaaucaauaaa

SEQ ID NO: 366570 - RNA, 64 nt, Human
cagaaccuggugaaacuucagagagcugucuagaacucgagaaucauggcaccacagacgugaa

SEQ ID NO: 366571 - RNA, 64 nt, Human
cagagcuggccgcgccaaauaaugucucugugagacucgagaacuuucauuuuuuuccaggcug

SEQ ID NO: 366572 - RNA, 64 nt, Human
gaaguacugccaauacugccaaccagagcagcucacucgagaucuuuguguccagaguuuuuug

SEQ ID NO: 366573 - RNA, 64 nt, Human
gcuuucagcccugugcucuggccccagaacggccacucgagaccccgggcuucauccacaucca

SEQ ID NO: 366574 - RNA, 64 nt, Human
gcucacuugccuucuacaacaugaaagaauucacacucgagagaaaccuuaugaagguaaacaa

SEQ ID NO: 366575 - RNA, 64 nt, Human
caggcccguggcgccggcucaugugucugcugcgacucgagauggccugaaacgccacucauuc

SEQ ID NO: 366576 - RNA, 64 nt, Human
cccucuucagagccugcacucgcuaaggaaggggacucgagaaugggggggcagcuugcugacc

SEQ ID NO: 366577 - RNA, 64 nt, Human
ucgggcguaguggugcaugccuguaaucccaguuacucgagaggcugaggcaggaaaaucgcuu

SEQ ID NO: 366578 - RNA, 64 nt, Human
uaaauccuggggguuucuuagaaagcaacuuagaacucgagauucaccuuucguuucccuuucc

SEQ ID NO: 366579 - RNA, 64 nt, Human
uguugccgcuggccagaccaccagguggcccauuacucgagaugaucaucacaaccagaugaug

SEQ ID NO: 366580 - RNA, 64 nt, Human
aaguugacccaguuugucuuuuagguuaaguaagacucgagaguaaaggcaaggaggggggcca

SEQ ID NO: 366581 - RNA, 64 nt, Human
acccgagcccagcuacauuccucagcugccaagcacucgagaccauccuggccccuccagaccc

SEQ ID NO: 366582 - RNA, 62 nt, Human
auuuauuaaacaacuaaaugcuacuuaacugauguaccuaaauaauaaucuauucaauuuau

SEQ ID NO: 366583 - RNA, 62 nt, Human
ccucaucuugaaaugaggauaauaauaccugcuguaccuaccucacagggcuguugugagga

SEQ ID NO: 366584 - RNA, 62 nt, Human
uggcuggagcuggaauagcagggaggacuggguguaccuaggcaguauuuucucuacuucuc

SEQ ID NO: 366585 - RNA, 62 nt, Human
cgggcaguacacaggaagaggagccaggcccuuguaccuaugggauuggacaggacugcagu

SEQ ID NO: 366586 - RNA, 62 nt, Human
gcuguaccagugaaaacgaggcuuugcaagcuuguaccuacuauauaacaugugcuugguug

SEQ ID NO: 366587 - RNA, 62 nt, Human
cuuuuuuauuaaaagaaaaauuuuaaaaaucuuguaccuagcacaguauuguuauagaauau

SEQ ID NO: 366588 - RNA, 62 nt, Human
guaaaagagaccaguagauuuucaaugggaaauguaccuagcaagcugguucuugcuuauau

SEQ ID NO: 366589 - RNA, 62 nt, Human
aaugauuuauaagaugcuaaaugaauuguuuuuguaccuaaccauuguaauccaaaagauaa

SEQ ID NO: 366590 - RNA, 62 nt, Human
uuauguagagaguuuauaugcacauaauaaccuguaccuauaaaucgugcaauaaccauaug

SEQ ID NO: 366591 - RNA, 62 nt, Human
ucuugaugugucaucuaauuaagggaaucccuuguaccuauggcugccugcaucuauucuuu

SEQ ID NO: 366592 - RNA, 62 nt, Human
gacuuccugaguugauuagaaagcuguaugaguguaccuacccuagucucagaagcauagac

SEQ ID NO: 366593 - RNA, 62 nt, Human
uagccuguauucacaauucugcgguaccuuauuguaccuaagggauucuaaagguguuguca

SEQ ID NO: 366594 - RNA, 62 nt, Human
ugcuacuagugacagggcugccaucgcucaccuguaccuauuuacacccagaacuuuccagc

SEQ ID NO: 366595 - RNA, 62 nt, Human
uccccaagagaaaaugcuucuuuugagcacacuguaccuaccaucugcauugagcagaaaga

SEQ ID NO: 366596 - RNA, 62 nt, Human
ucaagaccagccuggucaacaugucaaaacccuguaccuacaaaaaaauacaaaaguuaacc

SEQ ID NO: 366597 - RNA, 62 nt, Human
cuuaaacauccuuccccagcaccagcuauugguguaccuauaauuuaagaaauagucuaugu

SEQ ID NO: 366598 - RNA, 62 nt, Human
uucagcugagcuggauggacagugaggaagccuguaccuacaggccauauugcucaggcuca

SEQ ID NO: 366599 - RNA, 62 nt, Human
aauguguuauguuauccacccaaguguacauauguaccuauuuuuuuuuaaaaagcagaaau

SEQ ID NO: 366600 - RNA, 62 nt, Human
cuggaauguacagggugggcugguuggcccuauguaccuaaucugaaaaacuaaauaucguu

SEQ ID NO: 366601 - RNA, 62 nt, Human
aauuuaaaaaauaacuaccaagaggcccugucuguaccuaacgcccuauuuuugcaauggcu

SEQ ID NO: 366602 - RNA, 62 nt, Human
agguguacuuuauacuuugaugaaggcuaagguguaccuaacagcuuuuuauaguauauuca

SEQ ID NO: 366603 - RNA, 60 nt, Human
gaagaaagcaaaaaauauaaaugaaguacuuguaccuauauuaauuaugcuuacgccaug

SEQ ID NO: 366604 - RNA, 62 nt, Human
uacuuuauucauaaauaucaguuuuauucucauguaccuaaguuguggagaaaauaauugca

SEQ ID NO: 366605 - RNA, 62 nt, Human
auuauacuuuuaaauauuuguuuugaaauuacuguaccuagucuuuuuugcauuacuuugua

SEQ ID NO: 366606 - RNA, 62 nt, Human
guaucaaaacuugucuauaauuaugucaucuauguaccuagaaaaaaguaaauaaauuucuu

SEQ ID NO: 366607 - RNA, 62 nt, Human
ugugauucagaugaagccaagaguaucagagauguaccuacccuucugggagccaaacugga

SEQ ID NO: 366608 - RNA, 62 nt, Human
aaucuguuuacuuuuuauauuaagaauuaaacuguaccuaaaaaaacucugacuauucccau

SEQ ID NO: 366609 - RNA, 62 nt, Human
uaagacaccaacagaaaugauauaccuguaacuguaccuaucaggacuauaccucauuuaca

SEQ ID NO: 366610 - RNA, 62 nt, Human
uaacgugccgggcacacacuaaacucaguuacuguaccuacagguaagucuacauccucucu

SEQ ID NO: 366611 - RNA, 62 nt, Human
aguuuuucuagagcaauaaucaguggugcuuuuguaccuagguuuuaugugauuuuaaugaa

SEQ ID NO: 366612 - RNA, 62 nt, Human
ucgaugugaucuuauugcauguuuccaugggguguaccuauacuuuaagccaauccugcugc

SEQ ID NO: 366613 - RNA, 62 nt, Human
guucauuguuuuaggguuuuuaaaaaacguguuguaccuaaggccauacuuacucuucuaug

SEQ ID NO: 366614 - RNA, 62 nt, Human
caacaaugugaauauaaucaacacuauugaacuguaccuaagaauaguuaauaaaaaacuga

SEQ ID NO: 366615 - RNA, 62 nt, Human
ggugaggcuuuuauuucccuugaggagucucuuguaccuagcauacaugauagcuccuuguu

SEQ ID NO: 366616 - RNA, 62 nt, Human
cuuuguuucuugggcaagcagaaaaauuaaauuguaccuauuuuguauaugugagauguuua

SEQ ID NO: 366617 - RNA, 62 nt, Human
ucuucaccccccaaucucuugguggggagggguguaccuaaauauuuaucauauccuugccc

SEQ ID NO: 366618 - RNA, 62 nt, Human
ucccuccugcuggaauauggaggaagcggaaauguaccuaaccgagcaggacaucuuccuau

SEQ ID NO: 366619 - RNA, 62 nt, Human
uuaccugaaugucagaccauuuuuucaugugauguaccuagugaguggaguuugcuuuguuu

SEQ ID NO: 366620 - RNA, 62 nt, Human
uugguacuuucucaaaacagggaauuuauguguguaccuaggugcuauuuaagccuguaaau

SEQ ID NO: 366621 - RNA, 62 nt, Human
gaauuuggaaauuuugagcacccaagcucuucuguaccuauuuaaaguccaccaaggggacu

SEQ ID NO: 366622 - RNA, 62 nt, Human
caugcuuccagguaaaaacagauauuguaccauguaccuaauccaaauaucauauaaacauu

SEQ ID NO: 366623 - RNA, 62 nt, Human
aaauuuccacaagcauugcuucagaaugaauuuguaccuauaaagcauaaggcauuaaauga

SEQ ID NO: 366624 - RNA, 62 nt, Human
caauaaaaguguuaucuuucuuacaaaaguuuuguaccuaaguggauauagauaacugcaua

SEQ ID NO: 366625 - RNA, 62 nt, Human
aggaaaacacuauuuucauacccuacuuuuucuguaccuaaauuuucuuaaaaaaaaaucua

SEQ ID NO: 366626 - RNA, 62 nt, Human
guauucuuuccaggccgagauugagcaccucauguaccuacgccacagacagccagagggaa

SEQ ID NO: 366627 - RNA, 62 nt, Human
aaggaaacucauucagacuggugauaucgugauguaccuaaaagucagaaaccacauuuucu

SEQ ID NO: 366628 - RNA, 62 nt, Human
uuagaugugauauagcuaguucccaaagugauuguaccuaggauuguaacuuaaauuaacga

SEQ ID NO: 366629 - RNA, 62 nt, Human
uuugccuuaccuggggcuaguuuuuuaugcuuuguaccuagaaaacaaaaaauuacauucgu

SEQ ID NO: 366630 - RNA, 62 nt, Human
uguacucuguucguugauuaguugcuacaggcuguaccuauaagauguacaggauaauaguu

SEQ ID NO: 366631 - RNA, 62 nt, Human
ccuuagugcugaugccuguguacugccuuaaauguaccuauggcaauuuagcucucuugggu

SEQ ID NO: 366632 - RNA, 62 nt, Human
uuuuaacuuuauuuaaaaauagguaaaauuauuguaccuaauuaugucuaaaguuuauucag

SEQ ID NO: 366633 - RNA, 62 nt, Human
gugugauucugugacuugucccaggaccagaauguaccuaagucagauccauagacgcaugu

SEQ ID NO: 366634 - RNA, 62 nt, Human
gaagcuacuacuaaaaaaagucacuaacuuuguguaccuauaaucccuaaauuaaaauuaaa

SEQ ID NO: 366635 - RNA, 62 nt, Human
ucaagcaaaauuucuguauauucccuguggaauguaccuaugugaguuucagaaauucucaa

SEQ ID NO: 366636 - RNA, 62 nt, Human
uaaacgguaaaacaagcugccuggagagcagcuguaccuaacaauacuguaauguacauuaa

SEQ ID NO: 366637 - RNA, 62 nt, Human
cauacaugaauaugcauaucuauaugcauagauguaccuauccugcacccaaaaaggugccu

SEQ ID NO: 366638 - RNA, 62 nt, Human
gcaaaaagagaauuaucuguaauguuguaauuuguaccuaaguuuuuuaaugagugaaauuu

SEQ ID NO: 366639 - RNA, 62 nt, Human
guaagaagaaauacuaccgaaguaaaauauaauguaccuagauuguaggagaugacagacau

SEQ ID NO: 366640 - RNA, 62 nt, Human
agaaagacaguagaugagaauagaagaguaccuguaccuacaaggggaaaaaugaaugcaau

SEQ ID NO: 366641 - RNA, 62 nt, Human
ucuaguuucuauuuaucaacguguugugaagauguaccuaaugaaguuuugagaaagcacag

SEQ ID NO: 366642 - RNA, 62 nt, Human
guaaauauguauauuuaacuuuguauagcccauguaccuaccuuguauagaaaaauaauuuu

SEQ ID NO: 366643 - RNA, 62 nt, Human
cauccaucccaaaggaaaauguagacaucaccuguaccuauauaaggauaaaggcaugugua

SEQ ID NO: 366644 - RNA, 62 nt, Human
ccauugugggcuuugagagagcccuaaagcauuguaccuagugguaccuagugacuuccaac

SEQ ID NO: 366645 - RNA, 62 nt, Human
ccagccucucuugggcuuucuuacacuaacucuguaccuaccaucuccugccucccuuaggc

SEQ ID NO: 366646 - RNA, 62 nt, Human
uuuuuccugaaauauaaauugggauuuaagacuguaccuaacuauuaagaucacuguguaaa

SEQ ID NO: 366647 - RNA, 62 nt, Human
ccuccuggguccagguucagaaccaagacuucuguaccuagugcugccugauuggugaacau

SEQ ID NO: 366648 - RNA, 62 nt, Human
uaugggccgaggcuguucugagccugggaagauguaccuaugucaagagaagggaugaggcc

SEQ ID NO: 366649 - RNA, 62 nt, Human
caccugauguaaguuuauauaauguaauauuauguaccuaccacuaagaaauacaugaaccg

SEQ ID NO: 366650 - RNA, 62 nt, Human
guuuugcuaaaagcuguacagacuuuuucuuuuguaccuagcaguacuuuauauaguauagc

SEQ ID NO: 366651 - RNA, 62 nt, Human
uuuauguuuggugaacuauauuaguauguauguguaccuaagggaguagugucacugcuugu

SEQ ID NO: 366652 - RNA, 62 nt, Human
gaagaauugccucuggacuaucaucaauauguuguaccuaaaauccaggaccaagacucccc

SEQ ID NO: 366653 - RNA, 62 nt, Human
ggccccaaaucccugacucaauaaaguaagcguguaccuagcaccuccucgaugcccugugu

SEQ ID NO: 366654 - RNA, 62 nt, Human
aguggagcuuggugcaauuagaagcaaaagacuguaccuaacuggaaugagguuacuuuuua

SEQ ID NO: 366655 - RNA, 62 nt, Human
cauucuauugacuuucuuaaaaauauuuuuucuguaccuaacuugagcauaaggguuauuug

SEQ ID NO: 366656 - RNA, 62 nt, Human
ccucuucccucgcaugucucccuccaguccucuguaccuagaauagucucacugucccccgu

SEQ ID NO: 366657 - RNA, 62 nt, Human
uguugaauuacgccagaagaccugaaaugccuuguaccuacaacaaugcuuaggcuuuucua

SEQ ID NO: 366658 - RNA, 62 nt, Human
agugugggaacuuccccuacucccuggauguguguaccuagcacacuuccuucucccacccc

SEQ ID NO: 366659 - RNA, 62 nt, Human
aucacggaacaucauugugugcagaagaauacuguaccuaguacuaaguucuuuucaucuuu

SEQ ID NO: 366660 - RNA, 62 nt, Human
gucucuugggcauuuuauauuuugcauucugauguaccuaggaguuuuguuaaacagaugau

SEQ ID NO: 366661 - RNA, 62 nt, Human
agacugaucuuauauguguauaauguuuauuuuguaccuagaguacauuuaaaaggguggag

SEQ ID NO: 366662 - RNA, 62 nt, Human
auguccaccagcuaguugcacagagaaucauguguaccuaacuaaggaugaucuaggauaag

SEQ ID NO: 366663 - RNA, 62 nt, Human
ccugaauuuguuggugccucaguuucucugucuguaccuauuuaagccaaaggcacuagccu

SEQ ID NO: 366664 - RNA, 62 nt, Human
agauucuucguguauagcugugugaacguguauguaccuaggauauguuaaauguauagcug

SEQ ID NO: 366665 - RNA, 62 nt, Human
agcaucacuccccggugccuauggggucccgguguaccuaaagggagaaggaccccaugugc

SEQ ID NO: 366666 - RNA, 62 nt, Human
guuaacuaugauuccaauuacuacuuuguuauuguaccuaaguaaauuuucuuuaagucaga

SEQ ID NO: 366667 - RNA, 62 nt, Human
cuaccuguucaugauucacaucucuucuugcauguaccuaagaggggcggugccauuguuug

SEQ ID NO: 366668 - RNA, 62 nt, Human
uuuguuacucuuucaaagcauucacaaacuuuuguaccuagcucuagccuguaccaguuagu

SEQ ID NO: 366669 - RNA, 62 nt, Human
uuggcgcucacacacucaauaaacuguaacacuguaccuacuagguuccuccugaggguuca

SEQ ID NO: 366670 - RNA, 62 nt, Human
cuuuucacagauugggguaguggcuuccaaguuguaccuauuuuggaguuagacuugaaaag

SEQ ID NO: 366671 - RNA, 62 nt, Human
cuuuauauugcucuuaggucuggaguuggccauguaccuauguauccuaagcauucacggca

SEQ ID NO: 366672 - RNA, 62 nt, Human
gcugaaaaugcagauuaccgcacaaaucucuuuguaccuacaguugaagcuaauguugagac

SEQ ID NO: 366673 - RNA, 62 nt, Human
aaauaucuauggcuuuguuuuuguuuuucuuuuguaccuagucucauuggaaaugacuagua

SEQ ID NO: 366674 - RNA, 62 nt, Human
gugggcacaacuccaggggcuggcauucacacuguaccuaugaauuacugugggauagugcu

SEQ ID NO: 366675 - RNA, 62 nt, Human
aggaaugaagcaaugacugugggcugggaaacuguaccuaccucucuucccacugcaaauuu

SEQ ID NO: 366676 - RNA, 62 nt, Human
gugacaugaacaccgugucuccuucucuuguguguaccuaaagccauauuuccaagucugug

SEQ ID NO: 366677 - RNA, 62 nt, Human
uuucuaucaguuacaaucuuuuucuaguuaaguguaccuaauuuauggaaugggugcuaucc

SEQ ID NO: 366678 - RNA, 62 nt, Human
uauaaguggucaugaaauuuuaauguuaaguuuguaccuaauagaaauaugucuaucacaaa

SEQ ID NO: 366679 - RNA, 62 nt, Human
uuccugcuacuuaaauuugaaucugagugaauuguaccuauuucugaugaugucggucuugc

SEQ ID NO: 366680 - RNA, 62 nt, Human
aaaauaauuuaaaaguaggcgagaggcuaggauguaccuauauuuaccauguuuacuuacca

SEQ ID NO: 366681 - RNA, 62 nt, Human
aagccaagaaaaccauaguauaaaucuuuuuguguaccuaugcuaguguuuaaauggcaguu

SEQ ID NO: 366682 - RNA, 62 nt, Human
ggucauauaaagccaaccauuuuugaggaccauguaccuagugcuuugaaaacucuaaguca

SEQ ID NO: 366683 - RNA, 62 nt, Human
uucuagggauggggcagaguggcagcauccuuuguaccuacagguggaucccacaacucauu

SEQ ID NO: 366684 - RNA, 62 nt, Human
uucauagcagcuagugcggggcauccucauccuguaccuauagaguucgugcacucccccau

SEQ ID NO: 366685 - RNA, 62 nt, Human
auguuuuauuguuuacaaacgguauguugcuguguaccuaagaguauaguaaggucaagaag

SEQ ID NO: 366686 - RNA, 62 nt, Human
uaauagaacacagaguguguuuuugcacugucuguaccuaaagcaauaauccuauuguacgc

SEQ ID NO: 366687 - RNA, 62 nt, Human
gauauauauauauauauaaguucuuuuuuagcuguaccuacguacuuauaucagcaccaugu

SEQ ID NO: 366688 - RNA, 62 nt, Human
ucuguguaauauaaaugguuuauaacugcuuuuguaccuagcuaggcugcuauuauuacuau

SEQ ID NO: 366689 - RNA, 62 nt, Human
ucccccuaggggugggaggaagcaaaagacucuguaccuauuuuguauguguauaauaauuu

SEQ ID NO: 366690 - RNA, 62 nt, Human
uggaagaaaaauguaaucguaaauauuaauuuuguaccuauauugugcaauacuugaaaaaa

SEQ ID NO: 366691 - RNA, 62 nt, Human
acucuucaaauaucaugaacaagauacuaaauuguaccuaaggauuuguauuucuuuacaau

SEQ ID NO: 366692 - RNA, 62 nt, Human
gugaugaagaaucuuuaccaagauuuucaggguguaccuaugaaauugcuuuaaaugcacug

SEQ ID NO: 366693 - RNA, 62 nt, Human
gcugaaguguucuuccucaaucuugauugcccuguaccuacccaaaagcuguagucacacau

SEQ ID NO: 366694 - RNA, 62 nt, Human
gguguggggcgguguggcgggcgcacacuguauguaccuauaauaaacccuuuggcuuugac

SEQ ID NO: 366695 - RNA, 62 nt, Human
augguuugaugaaggggagugacaggauccgauguaccuauuuaagaauuuaagagggucgg

SEQ ID NO: 366696 - RNA, 62 nt, Human
gcauguaggaaaaccugguauagcacuuauuuuguaccuaaaaauucagaguaggagagaaa

SEQ ID NO: 366697 - RNA, 62 nt, Human
aggcagaccucugagcccacaaggaccaaagcuguaccuagaggaaccagcacccgggccuc

SEQ ID NO: 366698 - RNA, 62 nt, Human
ucugugggcccauucggccaagcuggauucuguguaccuaguacacaggcaugacugggauc

SEQ ID NO: 366699 - RNA, 62 nt, Human
gcuggauggaaccugaauuuggacauggccuauguaccuaacguggccuucuucccgcacca

SEQ ID NO: 366700 - RNA, 62 nt, Human
acaggcuuucaggacagacuuguaaccuggcauguaccuauugacuguauccucaugcauuu

SEQ ID NO: 366701 - RNA, 62 nt, Human
aaggcugcauguauuguagcuguggcuguacuuguaccuaaggcccuggguucaagagaguu

SEQ ID NO: 366702 - RNA, 62 nt, Human
acuagauguuugugucuacauguucuaccuguuguaccuauuagcaucuuccugcagggacu

SEQ ID NO: 366703 - RNA, 61 nt, Human
uaagauguguaauaaaaaucaaucagauuuauuguaccuacaaaaagguguccucauaaau

SEQ ID NO: 366704 - RNA, 61 nt, Human
guauaccaugcaccaaaauaaacuuuacuguguguaccuaacugcuccuggaauggaugga

SEQ ID NO: 366705 - RNA, 62 nt, Human
cuuuacagacguccagagcaaagccccuucuuuguaccuauuuuuuuauuacaaauauacua

SEQ ID NO: 366706 - RNA, 62 nt, Human
uaugcauuugaagccagugugauacagccaucuguaccuacuggagcugcagaagggaaguc

SEQ ID NO: 366707 - RNA, 62 nt, Human
cugaagggauuaguacaauuucuccaaaguacuguaccuaucuucagcaagaaugcaaaaga

SEQ ID NO: 366708 - RNA, 62 nt, Human
accuugccgugcuuccucuuacgugcuagcuuuguaccuaucgcucacugcaugcucgccuc

SEQ ID NO: 366709 - RNA, 62 nt, Human
guguuuauugugguuaggaagcaauuucccaauguaccuauaagaaaugugcaucaagccag

SEQ ID NO: 366710 - RNA, 62 nt, Human
uagcuuuccucaaguuaguuauguuguaggaguguaccuaagcaguaagcguauuuagguua

SEQ ID NO: 366711 - RNA, 62 nt, Human
aucugcuugacuauguagcuuggauucuccuuuguaccuaucccuuucgauuuggcuuuacc

SEQ ID NO: 366712 - RNA, 62 nt, Human
agauuaaagcauugaaguguuucauuguuaccuguaccuaaugguuuuaaauauauguuaau

SEQ ID NO: 366713 - RNA, 62 nt, Human
cuuauauuuacaccagcuuuucacuaauauuuuguaccuaaggugauggggaacuccauuca

SEQ ID NO: 366714 - RNA, 62 nt, Human
caacuaucaaauucuaguuucaaguaucucacuguaccuauaucauaucuguucucaacuuu

SEQ ID NO: 366715 - RNA, 62 nt, Human
ucuacaaauuagaguuugucacuuauuccauuuguaccuaagagaaaaauaggcucaguuag

SEQ ID NO: 366716 - RNA, 62 nt, Human
uuucccuaaugauaccacuuuucuuuucccccuguaccuaugggacuuccagaaagaaguua

SEQ ID NO: 366717 - RNA, 64 nt, Human
ucucccaccuccuuccccccaccagaccuuugcugggccuaaaggucuuggccauggggacgcc

SEQ ID NO: 366718 - RNA, 64 nt, Human
ucugacuagcugaaguaauugcagguuucuaacugggccuaaggugagcugagggcuugagccc

SEQ ID NO: 366719 - RNA, 64 nt, Human
guggcagcuuucacagcacaggaccguucaucgggggccuaaacguuucccucagcucugucac

SEQ ID NO: 366720 - RNA, 64 nt, Human
auguguuugaaacuugcaauaguauugggagauggggccuaaugaggugauuaggugaagucuc

SEQ ID NO: 366721 - RNA, 64 nt, Human
cagcuccugggccagcucuggaagggcuguauuugggccuaauccucagcaaauguucuaccac

SEQ ID NO: 366722 - RNA, 64 nt, Human
auaggagaccuggggccuggccaggccaggguuugggccuaauggcuuugacuaaauuaccccc

SEQ ID NO: 366723 - RNA, 64 nt, Human
cacccgaggaauuuuaaaacagccuauaugcccagggccuaacuuacacuaauuaaaucugaau

SEQ ID NO: 366724 - RNA, 64 nt, Human
accugcgucggguggugaccguggcuggcggucacgcccucagccccuccgggcacacgugccg

SEQ ID NO: 366725 - RNA, 64 nt, Human
ccuuugcugggccuaaaggucuuggccauggggacgcccucagucuagggaucuggccacagac

SEQ ID NO: 366726 - RNA, 64 nt, Human
acaacaggggggcguggccuuaccuucuccugcucgcccucagccgcggagccucugcggaggc

SEQ ID NO: 366727 - RNA, 64 nt, Human
caaaugucuuaggugauuuaaauaaaugaguauugggccuaauugcaacaccagucuguuuuua

SEQ ID NO: 366728 - RNA, 64 nt, Human
ugcgcaagggaugggccugggggaacucaagggagggccuaaagcacuuguaacuuugaaccgu

SEQ ID NO: 366729 - RNA, 64 nt, Human
gccaggccccagugcugacgaggagcccagauuugggccuaaucagguggggacgcaucucagc

SEQ ID NO: 366730 - RNA, 64 nt, Human
gccucuggacucaccuugagaagggggagcugcugggccuaaagcccacuccugggggucuccu

SEQ ID NO: 366731 - RNA, 64 nt, Human
ugacuuauuaugagaugaaaaaccaaaggagagugggccuaacucaugugagcuugauaacuga

SEQ ID NO: 366732 - RNA, 64 nt, Human
cacucuaggguuugaggggcuggaaucagggccagggccuaacaguguuucuuccccucggccc

SEQ ID NO: 366733 - RNA, 64 nt, Human
aaaguggaacgaaaaugaaagcuacucauagcgggggccuaaaaaaaaaaagcuucacaguacc

SEQ ID NO: 366734 - RNA, 64 nt, Human
uuuuucuauuuuguuauauaauuuuaagccaccagggccuaaauuaaaguauaaucauuuguau

SEQ ID NO: 366735 - RNA, 64 nt, Human
cagcagagggcagaaggcuugcacuugggccaaagggccuaagguccacuggacaguugggaaa

SEQ ID NO: 366736 - RNA, 64 nt, Human
auuauuuguuuacuugcuauggucuguucauucugggccuaaccuuaaaggcucaauaacaaau

SEQ ID NO: 366737 - RNA, 64 nt, Human
uggauccccucugucuacaaauauaagauuuucugggccuaaaggauagaucaaagucaaaaau

SEQ ID NO: 366738 - RNA, 64 nt, Human
ugauuaggguaguaauuaggauaacuaaaauucugggccuaauuuuuuaaagaauccaagacaa

SEQ ID NO: 366739 - RNA, 64 nt, Human
ggcucuucgccuucaguguuguggcccuagcuaugggccuaaauugggcucuaggucucugucc

SEQ ID NO: 366740 - RNA, 64 nt, Human
aaauaccaauggaauuguuguccuuuaagaagaagggccuaaaauggcaggauucuuaguaaau

SEQ ID NO: 366741 - RNA, 64 nt, Human
auuuuucuuccuagauuuuguuguuuaaauuauggggccuaaccugccacuuauuuuuugucaa

SEQ ID NO: 366742 - RNA, 64 nt, Human
ugucuuaaugaucuaaggcugguguagaaacaaagggccuaaugagaaccaaucaucauggaag

SEQ ID NO: 366743 - RNA, 64 nt, Human
gacaugggacacuccuuuucuguuccucaguugucgcccucacgagaggaaggagcucuuaguu

SEQ ID NO: 366744 - RNA, 64 nt, Human
cccccugaaaccugagaccuguagugcacucgaccgcccucagguguuggugaaacagagcugc

SEQ ID NO: 366745 - RNA, 64 nt, Human
ccagcccgucuucucucucugcucccaccccugccgcccucacccugcccuuguugucucuguc

SEQ ID NO: 366746 - RNA, 64 nt, Human
auugucgucgcugcugccauggcuuuuucauugagggccuaaaguaaucgcgcuaagaauaaag

SEQ ID NO: 366747 - RNA, 64 nt, Human
cguugccuugcuuaacucuaaagcuccauguccugggccuaaaaucguauaaaaucuggauuuu

SEQ ID NO: 366748 - RNA, 64 nt, Human
ccaggcaccucagagcaccagcuccccugucccagggccuaaccacagauccuggaguucugca

SEQ ID NO: 366749 - RNA, 64 nt, Human
guccguccaugccaugaaugagugggcuguaguugggccuaaauaaaugagcuguuggaagaaa

SEQ ID NO: 366750 - RNA, 64 nt, Human
ucagccugaauucuaagcaacaacuucagguugggggccuaaacuuguuccugccucccucacc

SEQ ID NO: 366751 - RNA, 64 nt, Human
gcccucuccagucuccuuuccuaggcuuuuuugggggccuaacccacgcagugaccccagaggg

SEQ ID NO: 366752 - RNA, 64 nt, Human
gugccuaaugcuacuggaaguggaacuugagauagggccuaauuuguuauacauauuagccaac

SEQ ID NO: 366753 - RNA, 64 nt, Human
agccugugaucccugaggccagaauugacucuuugggccuaaauagcagcuauaaacaucuuca

SEQ ID NO: 366754 - RNA, 64 nt, Human
agucauggcaacaggcuggagcagcccaggagaugggccuaaaauguucuggaucccuuggguc

SEQ ID NO: 366755 - RNA, 64 nt, Human
gcaucugagucugcuccuaaguggcuuugcaacugggccuaaguucuguuuccuuuauggaucu

SEQ ID NO: 366756 - RNA, 64 nt, Human
uguaaauacagcagcuagugggagagcaccaguugggccuaauccugccucaucauucuuggca

SEQ ID NO: 366757 - RNA, 64 nt, Human
uugagauggggagauuauccugaauuacuuuggagggccuaauauaauuguagggaucuuuaaa

SEQ ID NO: 366758 - RNA, 64 nt, Human
guuuaggaaucaacuuaucucaaauuguaacucggggccuaacuauaugagauggcugaaaaaa

SEQ ID NO: 366759 - RNA, 64 nt, Human
auucucugauaccuucauuuaauauaucaauauugggccuaaaacaguauucuguaaagcuuaa

SEQ ID NO: 366760 - RNA, 64 nt, Human
ccgggccaggagaaucuccgcuuguccaagacaggggccuaaggagggucuccacacugcugcu

SEQ ID NO: 366761 - RNA, 64 nt, Human
aggacccaccacugaggagaggaucuagacaggugggccuaauuccaaggggcccuuccuggcc

SEQ ID NO: 366762 - RNA, 64 nt, Human
guaagggcuggguuuggccauacaagguuggcuacgcccucaaucccugaccguuccaggcacu

SEQ ID NO: 366763 - RNA, 64 nt, Human
auuugaagauacaauuuuauuugauaucaaugaacgcccucaagacugagcugcuuuuaucaua

SEQ ID NO: 366764 - RNA, 64 nt, Human
ccaagaccaugguccugggguuccugcuggucuucgcccucagucuggcgcccaaccaccugcu

SEQ ID NO: 366765 - RNA, 64 nt, Human
cacuugguuuuucuguuuuauauacuaauaaucagggccuaaguuaaauaaaaauaugugugca

SEQ ID NO: 366766 - RNA, 64 nt, Human
accuggaagacuccggucaccuccuucuugcucagggccuaaaagaugcugguccucccaaccu

SEQ ID NO: 366767 - RNA, 64 nt, Human
gaggacagaugugccugcuuguggagaccaggcugggccuaagcgaagggucaucgcagcccca

SEQ ID NO: 366768 - RNA, 64 nt, Human
cugggaagucuggggaagggauacagagcuuggugggccuaacaccauucauauuccuuacccu

SEQ ID NO: 366769 - RNA, 64 nt, Human
uugccauuuugagauuugaccugugguagcaucugggccuaauguuggcuucuaagucaaagac

SEQ ID NO: 366770 - RNA, 64 nt, Human
gugguccugagcugugugcccuucucagucugaggggccuaaccuagagcagguuuccauagug

SEQ ID NO: 366771 - RNA, 64 nt, Human
aaaaggugucucugagccgagggcaugugagcuggggccuaaacaacuagaaggagagagccac

SEQ ID NO: 366772 - RNA, 64 nt, Human
agucucuucucacuaaaauuuacuuuccaacguagggccuaaaggaaaccuuucuuaaagacag

SEQ ID NO: 366773 - RNA, 64 nt, Human
uaaccccagaccagagagaacugcagaucugacugggccuaaauuaaguagcuuaaugaaacca

SEQ ID NO: 366774 - RNA, 64 nt, Human
ucauguugagauuugauccccaguguuggagguggggccuaauggaaggucauggggguggguc

SEQ ID NO: 366775 - RNA, 64 nt, Human
ucacagugguucuguuugcuccagacuggggcuagggccuaaucuuugaaguuuguucuuuggu

SEQ ID NO: 366776 - RNA, 64 nt, Human
cccuguggcugaucccauccgucccucggagcaagggccuaagagaaaagccagccaagugcuu

SEQ ID NO: 366777 - RNA, 64 nt, Human
gggccgcauguggcccaggauauggcuuugaauggggccuaacacaaauucauaaacuuucuua

SEQ ID NO: 366778 - RNA, 64 nt, Human
ccagcuugcccuguucuaggugguggcuaaaucugggccuaaucuggguggcucagcuaaccuc

SEQ ID NO: 366779 - RNA, 64 nt, Human
ucaauguguucuaugaaguccaguggaguucuuagggccuaaauugggggccagaguuucaaag

SEQ ID NO: 366780 - RNA, 64 nt, Human
uucgcgcacacacugguucuccucuuuugggugugggccuaacaaaaagggcucaaggggcugg

SEQ ID NO: 366781 - RNA, 64 nt, Human
cugucaagucccccagcagaaccagccucaaaaacgcccucaagaacaugaugggccugaacuc

SEQ ID NO: 366782 - RNA, 64 nt, Human
guaagguuaacccaccccccagcaagggacuggacgcccucauucagcugccuccuuagaggag

SEQ ID NO: 366783 - RNA, 64 nt, Human
ucggaucggagcacgccugccucccucuccccuccgcccucacccagccaauccgaggcugcuu

SEQ ID NO: 366784 - RNA, 64 nt, Human
aaagaacgaucagguuggagacuugggaaacccagggccuaaagagaaguauccaugaggguca

SEQ ID NO: 366785 - RNA, 64 nt, Human
ccugccccagggagcucacgccaggcaggccagugggccuaagccagaaacagaaagacagcag

SEQ ID NO: 366786 - RNA, 64 nt, Human
ccaacaggcacccagcccugcauggggggagccugggccuaauaggcacccccuguaccucagg

SEQ ID NO: 366787 - RNA, 64 nt, Human
uccacccugccucugcaucccuuaauggagaaacgggccuaaaaccaaacggguaaaaagcccu

SEQ ID NO: 366788 - RNA, 64 nt, Human
acuaauuuucuggucuauaugacuucuuccaggagggccuaauacacaggaagaagaaggcuuc

SEQ ID NO: 366789 - RNA, 64 nt, Human
guagccaccaguaaggugauucucugcccuguuggggccuaaauuugggggcuuuugggcaacc

SEQ ID NO: 366790 - RNA, 64 nt, Human
uuauugugcaaguggcuuuuggauauccugauuggggccuaagaagggcauucagacuugaauu

SEQ ID NO: 366791 - RNA, 64 nt, Human
augcucagggaagugaugcccgcagaaggcgucugggccuaaggauccauggaagucaggagca

SEQ ID NO: 366792 - RNA, 64 nt, Human
gugucauacucagugacuucaauuugcaaauguggggccuaaagaaagcucugcagcucugaac

SEQ ID NO: 366793 - RNA, 64 nt, Human
cgugcuugaaaccuuggccagguuccaugaccaugggccuaacuuaaagaugugaaugaguguu

SEQ ID NO: 366794 - RNA, 64 nt, Human
acagcuggcccugggcccaccccacgaagggccugggccuaaccccuuggccuggcccagcuuc

SEQ ID NO: 366795 - RNA, 64 nt, Human
ugagggagcaaguugcccacaugcccgccagccagggccuaaagcagauggcaugcucagugcc

SEQ ID NO: 366796 - RNA, 64 nt, Human
uuauuuuuaagaguacagucaggaaaccaacaaggggccuaagaguggcugccccugcuuggga

SEQ ID NO: 366797 - RNA, 64 nt, Human
aaaaaaaaaaaaaaaagcucaagaaccugcacgagggccuaaaacagugggcucagcuuuggcu

SEQ ID NO: 366798 - RNA, 64 nt, Human
ugaccugagcuauguggaggauggcacagccugcgggccuaacauguugugccuggaccaucgc

SEQ ID NO: 366799 - RNA, 64 nt, Human
cccugcagaaacauucgccgaggaagguccggaggggccuaagugccacccuccucccuccaag

SEQ ID NO: 366800 - RNA, 64 nt, Human
auuacagcagaguccagcugcagcauccagcucacgcccucaugggaauuggcacaggccuggg

SEQ ID NO: 366801 - RNA, 63 nt, Human
cuggaaaccccuuauuuugagagcuccaggaagcgcccucaccccagccccacucacccaccc

SEQ ID NO: 366802 - RNA, 64 nt, Human
ugcccaguacugccauuugacaugaggguaccuucgcccucaggagaugugacgaaggaacaag

SEQ ID NO: 366803 - RNA, 64 nt, Human
cauucuaaaugaguuaacgacuuaacuugaaauugggccuaaggagugagaacuacaaaaauac

SEQ ID NO: 366804 - RNA, 64 nt, Human
ucacuagaugucucacucaucagaccaggccauugggccuaagugguaaaugugauuaggaauu

SEQ ID NO: 366805 - RNA, 62 nt, Human
cugucaagaauaaaaguauguagacccagagugugggccuaauggguugucucugagcaaaa

SEQ ID NO: 366806 - RNA, 64 nt, Human
aaaugucagcagcuuuuauuaccuuaaucuuucagggccuaaauuuaggagagugucccgagag

SEQ ID NO: 366807 - RNA, 64 nt, Human
guggguggugugcaaagggaaugaagagcguccugggccuaaacacagcagccuccucucuucc

SEQ ID NO: 366808 - RNA, 64 nt, Human
caacgauucuccugccucagccucccgaguagcugggccuaaaggugcccaccacuauacccgg

SEQ ID NO: 366809 - RNA, 64 nt, Human
cccauccuguguuagcguugccuggugcggggcagggccuaacaaggaaaccugggcccuccaa

SEQ ID NO: 366810 - RNA, 64 nt, Human
uggccugagacgcucgucaguucuuagaucuugggggccuaaagagacccccguccugccuccu

SEQ ID NO: 366811 - RNA, 64 nt, Human
agaaaaauggacuauccauuagagcaacuuucuggggccuaauaaaacugaugugaaacuacua

SEQ ID NO: 366812 - RNA, 64 nt, Human
ggacucucgcucuaauaaaggacuguaggccauggggccuaaaccacgaagcugugagcaccug

SEQ ID NO: 366813 - RNA, 64 nt, Human
guccucucucucccuucacccuuucuccauaccagggccuaaguccgccuuacuccucuccucc

SEQ ID NO: 366814 - RNA, 64 nt, Human
gaagaaaaguaaaccgagaacauaauuaggcaucgggccuaaguguccuggggagauuggaggg

SEQ ID NO: 366815 - RNA, 64 nt, Human
gcuagagaggcccaauccaggggcagaaaacagggggccuaaagaaugucccccaccccuuggc

SEQ ID NO: 366816 - RNA, 64 nt, Human
cccaccacacuuccagagaccggagaacugugcagggccuaaggccguuuggaugaauugucaa

SEQ ID NO: 366817 - RNA, 64 nt, Human
cagccagccaagacugggcccaugaacacagagagggccuaaccgagaucaguauuuaacuaau

SEQ ID NO: 366818 - RNA, 64 nt, Human
auguauacauauacacauccaccuacauguugaagggccuaaccagccuugggaguauugacug

SEQ ID NO: 366819 - RNA, 64 nt, Human
ugacuccuuggaguguccaggaccaucuuaaagccgcccucagcacaucugcaugaagauagau

SEQ ID NO: 366820 - RNA, 64 nt, Human
ggagcagugaggggcaacgaggcggcugggaugccgcccucaguaagcagcuugccaaucacuc

SEQ ID NO: 366821 - RNA, 64 nt, Human
guuuaaagugaucucagaggggcccauggauuaacgcccucaucccaagguccgucccaugaca

SEQ ID NO: 366822 - RNA, 64 nt, Human
ugugugugugagagagagcuauguuucuaaccaagggccuaauguuuguuacagaaaugauccc

SEQ ID NO: 366823 - RNA, 64 nt, Human
ugauugggauaguaguuaggauaacuaaaauucugggccuaauuuuuuaaagaauccaagacaa

SEQ ID NO: 366824 - RNA, 64 nt, Human; identical to SEQ ID NO: 366823

SEQ ID NO: 366825 - RNA, 64 nt, Human
guuuggcucccuugaaaagcauuucucucaugugcgcccucagggcuuccagcaggauugaguc

SEQ ID NO: 366826 - RNA, 64 nt, Human
ucgcuuuagcugaggacccucucgccugcccgcccgcccucauggaccccgcugccacccgcuu

SEQ ID NO: 366827 - RNA, 64 nt, Human
auggacagaugcagucccucgggcagguguucaucgcccucauccuagguacuagcccuggaug

SEQ ID NO: 366828 - RNA, 64 nt, Human
cacuggccaugcccugugaauccucaggcugugacgcccucagguacuccugggaaaaggaggu

SEQ ID NO: 366829 - RNA, 64 nt, Human
uccugggacacaccucaguaaagagcaaaggcaacgcccucagggucccuuccuccaagauggc

SEQ ID NO: 366830 - RNA, 64 nt, Human
acagugccacgacauggcugggcuacgugaauagcgcccucaacccugugaucuauaccaccuu

SEQ ID NO: 366831 - RNA, 64 nt, Human
gaccacagcaucuucccagugacggagcgggacccgcccucaucccauuggugacacauguugg

SEQ ID NO: 366832 - RNA, 64 nt, Human
aguaaucgcgcuaagaauaaagggaaaacggcgucgcccucauuucaaccccacuccuaccccc

SEQ ID NO: 366833 - RNA, 64 nt, Human
uaauugaugaaagaagaauggcccaaguuucauucgcccucagccacgcacaagggaaagggaa

SEQ ID NO: 366834 - RNA, 64 nt, Human
ccccaucugagugccuggcccagggccugaaacccgcccucaggggccucucuccugccugccc

SEQ ID NO: 366835 - RNA, 64 nt, Human
uggagauggaggcccugaccucugcugcaguggccgcccucacccuguaugacaugugcaaggc

SEQ ID NO: 366836 - RNA, 64 nt, Human
ggacacgugugcaauucauaggaacggcccagaucgcccucaugagugccaccugguacaggua

SEQ ID NO: 366837 - RNA, 64 nt, Human
gguccgaggcugcuccccuggagcggcgccccugcgcccucagcccgagcagcgacauccacuc

SEQ ID NO: 366838 - RNA, 64 nt, Human
gggggaccgcgaggagccgagcguccucgggcaccgcccucacaccuccucgagugcccuggga

SEQ ID NO: 366839 - RNA, 64 nt, Human
ggcaccacuuuggcgagcguccugcuuccgcccucgcccucaucuacgcugcuccgcuuuccuc

SEQ ID NO: 366840 - RNA, 64 nt, Human
cuccguccucaggauguccugcacguuaccauugcgcccucagggucucacaccuugggguugu

SEQ ID NO: 366841 - RNA, 64 nt, Human
uucuaauaaugcagagauaauuagacaugguucccgcccucaagaagcucacaaaaguauucag

SEQ ID NO: 366842 - RNA, 64 nt, Human
ucaagggcugcagcacugcccgauagaacacgcccgcccucacugcuguucuugccuuacagcc

SEQ ID NO: 366843 - RNA, 64 nt, Human
uccuguggguguucuuuccugcccuguccaaaagcgcccucacuauucuuggaccaugccagau

SEQ ID NO: 366844 - RNA, 64 nt, Human
guagggguggggagaugcuucucuccuugccccccgcccucauggguccuagcccuucccugag

SEQ ID NO: 366845 - RNA, 64 nt, Human
aaagagaggggcaaauagagagucuccaagagaacgcccucaugcucagcacauauuugcaugg

SEQ ID NO: 366846 - RNA, 64 nt, Human
guacuuuacugacuucucuuuauucaauucuccacgcccucaccaaaaaaaacugucucaaaau

SEQ ID NO: 366847 - RNA, 64 nt, Human
agcaacaacuaaaugacuccucugucaucaucagcgcccucaagaccuaccuggugucggggua

SEQ ID NO: 366848 - RNA, 64 nt, Human
ucuguccucuaacuucugucaaccugcaggaccacgcccucacugugagacuucuguagccugc

SEQ ID NO: 366849 - RNA, 64 nt, Human
agagcaucuacuuagaagaaaccaaauagucuaucgcccucauaucauaguguuuuuuaacaaa

SEQ ID NO: 366850 - RNA, 51 nt, Human
acgggggcuacaucugguagacgcccucaggagccggcugccgggggggac

SEQ ID NO: 366851 - RNA, 64 nt, Human
ggaaugcaucuaccugagaggcuccugcuguccacgcccucagccaauuccuucuccccgccuu

SEQ ID NO: 366852 - RNA, 64 nt, Human
ggaucucacccucuccauguccuggggacagccucgcccucagccggacugcaucccuccuggg

SEQ ID NO: 366853 - RNA, 64 nt, Human
ugaauacuucuugauggguacaggcugaguggggcgcccucaccuccagccagccucuuccugc

SEQ ID NO: 366854 - RNA, 64 nt, Human
auucggugaugacuuguucauccccccuucccuucgcccucauguggaaagaggagcugggacc

SEQ ID NO: 366855 - RNA, 64 nt, Human
ugggcugaggccaggcugcuccaggggccuccugcgcccucaccugccacagagcaacccaggu

SEQ ID NO: 366856 - RNA, 64 nt, Human
ccgcccacagccgccggaaguggcuccguggccccgcccucaggcuccgggcuuucccccaggc

SEQ ID NO: 366857 - RNA, 64 nt, Human
ggcacugggaaugcugggaaaugagauacauucccgcccucaagaaucucccagucugguagga

SEQ ID NO: 366858 - RNA, 64 nt, Human
augccaccacaaaggcccuuuuaagggccaccaccgcccucauggaaagagcugagccgcuuca

SEQ ID NO: 366859 - RNA, 64 nt, Human
cgccuccgcggggagagcaccccggcuucccgcgcgcccucaccaaaaggacccuacagcaaac

SEQ ID NO: 366860 - RNA, 64 nt, Human
gacacccaggaggcucucggauggggcgcgccugcgcccucagaacgugugggaaggagggggc

SEQ ID NO: 366861 - RNA, 64 nt, Human
ggggaaaauauuuuacgaagcucuguguucucaacgcccucaugaacuuuucaguaggcugucu

SEQ ID NO: 366862 - RNA, 64 nt, Human
uagcaccuggucucaaaauccuaaaagcuuuccucgcccucacugccuugcuccacaaggucca

SEQ ID NO: 366863 - RNA, 64 nt, Human
guuuuuuucggcuccucucccuccuccuaccuuccgcccucaaguagacuccagugucuguuau

SEQ ID NO: 366864 - RNA, 64 nt, Human
cgccgggacacccgcgccgggcagccccgccggccgcccucacgcacgcgcugugccccgcggg

SEQ ID NO: 366865 - RNA, 64 nt, Human
gaauagaccucuccgccaccgagcugcugugucacgcccucagccugcuagggagugacaagcc

SEQ ID NO: 366866 - RNA, 64 nt, Human
augucugcacgugcauccaaacgcugugcucugucgcccucaaccuuugcaggguccuuccuac

SEQ ID NO: 366867 - RNA, 64 nt, Human
cgcccgccccucaguuugguagugccccaccucccgcccucaccugcagagaaacgcgcuccuu

SEQ ID NO: 366868 - RNA, 64 nt, Human
guguuauuuaugcucccuucgugggugauggccacgcccucaccaugucccuggcagagggcuu

SEQ ID NO: 366869 - RNA, 64 nt, Human
agccccaucuccuugggcgccagggucccuggcgcgcccucaucagccgucgcgcaagcacaca

SEQ ID NO: 366870 - RNA, 64 nt, Human
gggacgccugcccugcccagguggccuccuggcccgcccucaccucugauagacuuugugaauc

SEQ ID NO: 366871 - RNA, 64 nt, Human
gcuggagagaagagaaggcagcagcagaggcccccgcccucaccccagccaucugcacuuguac

SEQ ID NO: 366872 - RNA, 64 nt, Human
gcauagggcagccuaccaccuccaagggggcaggcgcccucaucugggguugggucugugcuga

SEQ ID NO: 366873 - RNA, 64 nt, Human
uucacucacagucugaguucuuguccgccugucacgcccucaccacccuccccuuccagccacc

SEQ ID NO: 366874 - RNA, 64 nt, Human
uggguuccuguugcugagacuuccuggauggagccgcccucaccgccgggcccguggcccugcg

SEQ ID NO: 366875 - RNA, 64 nt, Human
ggccccucucagcccucacacacccugucugccccgcccucauuauuuauguccagguguuugu

SEQ ID NO: 366876 - RNA, 64 nt, Human
uacuuuuuucaucuuuacccugccagaaaugacccgcccucaaugcuggcugcugcuaacauua

SEQ ID NO: 366877 - RNA, 64 nt, Human
uccucugccccucacugcucugugcagauccugucgcccucagcugccuccucccgagaccuaa

SEQ ID NO: 366878 - RNA, 63 nt, Human
accgagccuacauacacuaagcugucgacaccccgcccucaccccuccaauccccccucugac

SEQ ID NO: 366879 - RNA, 64 nt, Human
uccaggugucccagucuggccacagcccugccuccgcccucaccuacaugcccucccagccccu

SEQ ID NO: 366880 - RNA, 64 nt, Human
gcguggcuagaucugaccgcgcccuuccaggccccgcccucagguaugggaaacuaggccgccc

SEQ ID NO: 366881 - RNA, 64 nt, Human
uuccguucguggaaaaaagacaaggccacccucucgcccucagagagguccaccugguuuguca

SEQ ID NO: 366882 - RNA, 64 nt, Human
gggccagaggagcucuccagcccugccuagugggcgcccucagccccuugucgugugcugagca

SEQ ID NO: 366883 - RNA, 64 nt, Human
cuaggccucaggacgcggggggagccauccccgccgcccucacaggacccaccaggcagcggag

SEQ ID NO: 366884 - RNA, 64 nt, Human
ccuccucacucuccccgucaugcucccucugccccgcccucaaaaaaaaaaaaaaaaaaaaaaa

SEQ ID NO: 366885 - RNA, 64 nt, Human
guagaaguuagggcgccggagcccgggccuggaacgcccucacccccaaccuccagucuccgcg

SEQ ID NO: 366886 - RNA, 64 nt, Human
gcccaaggguggugagaaccggagaaccccaggacgcccucacugcaggcuccccuccucggcu

SEQ ID NO: 366887 - RNA, 52 nt, Human
ccaccaaguaccgcuacugaggcgcccucagucugcgcggauaaaugucgug

SEQ ID NO: 366888 - RNA, 64 nt, Human
acugacggggaccagggcuugugugggucgagagcgcccucauggugcuggugcuguugugugu

SEQ ID NO: 366889 - RNA, 52 nt, Human
gccgcccggccucgcccugacccgcccucaugggcaccgggcaggcgccuca

SEQ ID NO: 366890 - RNA, 64 nt, Human
cccguucggccccgccccccgcacugaacacacccgcccucaaccccgcacccuccgcacucac

SEQ ID NO: 366891 - RNA, 64 nt, Human
ccuccgcacucaccucccccucgccgcucgaccccgcccucaccacacugaccacccucaaccc

SEQ ID NO: 366892 - RNA, 64 nt, Human
ccuucccagcugccccucccugccagcacccccacgcccucauuacggcuccucucuaaccucc

SEQ ID NO: 366893 - RNA, 64 nt, Human
ccuccucccgaagacgccgggacagucggguguccgcccucagccuccuggggacucgagccgg

SEQ ID NO: 366894 - RNA, 64 nt, Human
gggguuggggagacuaugucgccagaugccaggacgcccucaccccguuugcauaugcaaugcu

SEQ ID NO: 366895 - RNA, 64 nt, Human
cauggucuccugcagggcccugccucccaagccccgcccucagaaagccaaguaccuuuucagc

SEQ ID NO: 366896 - RNA, 64 nt, Human
cccaggaccccugccccuccggggacaccggccccgcccucagcccacuggucccgggccgccg

SEQ ID NO: 366897 - RNA, 64 nt, Human
ggccacagccccgaugauucguaacaccaccuuucgcccucaccccagaaaucacugaaauuuc

SEQ ID NO: 366898 - RNA, 64 nt, Human
cggaggccaggaaacccugaucgccaguuucuaacgcccucaccauuuuuauuuuuauuuuuau

SEQ ID NO: 366899 - RNA, 64 nt, Human
auuguuuuuguuuuuuauucuccuccucccuccccgcccucacccgccccacucccuccuaacc

SEQ ID NO: 366900 - RNA, 64 nt, Human
ugauaccaucccagugccaugagcccacacugcccgcccucaggcucucaggugaacguggccg

SEQ ID NO: 366901 - RNA, 64 nt, Human
cagaagcagcccccaccccacacaugacccacaccgcccucacgugaagcugggcugagagccc

SEQ ID NO: 366902 - RNA, 64 nt, Human
ucacuucuuaaacuuccaguuaagaaucuagguccgcccucaagcccauacugaccaugccuca

SEQ ID NO: 366903 - RNA, 64 nt, Human
uugggaaaaucuugcuuuuauggucuuccccccucgcccucaagaacaagggccuugugcgugg

SEQ ID NO: 366904 - RNA, 64 nt, Human
auuuggcuuucgacuugcuuguucuaagucacagcgcccucaucuuuuuagcaagguaaaaaaa

SEQ ID NO: 366905 - RNA, 64 nt, Human
augucaccaauuaaccagaaauccaguuauuuuccgcccucaaaaugacagccauggccggccg

SEQ ID NO: 366906 - RNA, 64 nt, Human
gagcaggcucugcacccacucuuuuuuugccccccgcccucauccuggagugugagggugcucg

SEQ ID NO: 366907 - RNA, 64 nt, Human
guguggagacuggagcccaagcucugcagcgugucgcccucaagcuguaggcccauguuccagu

SEQ ID NO: 366908 - RNA, 64 nt, Human
ccagggccugcccuccuguccucccacuucucuacgcccucaagguuggagaccccgcucccau

SEQ ID NO: 366909 - RNA, 64 nt, Human
agaagggucagggcaggccagggggguggggggccgcccucaucaggcagcccccagcccccug

SEQ ID NO: 366910 - RNA, 64 nt, Human
cacagugggagcugccacagugccccuugcuggccgcccucaggagggggccucuggaccguca

SEQ ID NO: 366911 - RNA, 57 nt, Human
uuccaggggucuguuauuagcaguccacgcccucaccagaggaugccaccuccgccc

SEQ ID NO: 366912 - RNA, 64 nt, Human
ccgcccgguaauuauuugcauuacaaaccggaggcgcccucauuugcauuuguguacagauuaa

SEQ ID NO: 366913 - RNA, 64 nt, Human
aaccaaaaaaaaccacccugaguuucucuggugacgcccucauucuccuaacguucaauaaucu

SEQ ID NO: 366914 - RNA, 64 nt, Human
ccuggugaaugaugaauguugcugucaaagggcugcccccuaccuuauaaggguugcugggcau

SEQ ID NO: 366915 - RNA, 64 nt, Human
uaccagccugugagauccaagcccccccacccaggcccccuaaaaaucagggccucagcaagca

SEQ ID NO: 366916 - RNA, 64 nt, Human
guguauauaggaaccauguacagagcccagagaagcccccuacauccccccgggaaaaaaaaga

SEQ ID NO: 366917 - RNA, 64 nt, Human
agacugggcucuguuuuccaagggucuucacuaggcccccuagcuacaccuggaaguuucagaa

SEQ ID NO: 366918 - RNA, 64 nt, Human
ugcccauucccccagucuauuaaacccuugauaugcccccuaggccuaguggugaucccagugc

SEQ ID NO: 366919 - RNA, 64 nt, Human; identical to SEQ ID NO: 116627

SEQ ID NO: 366920 - RNA, 64 nt, Human; identical to SEQ ID NO: 116633

SEQ ID NO: 366921 - RNA, 64 nt, Human; identical to SEQ ID NO: 116637

SEQ ID NO: 366922 - RNA, 64 nt, Human
aauagcaccuccucccuuuucucccuauccuucugcccccuaguaagucuacguguggaaugug

SEQ ID NO: 366923 - RNA, 64 nt, Human
ucuuaccauacccucauaguaccaagaauggacugcccccuaagaaaccuguuugagaaucacu

SEQ ID NO: 366924 - RNA, 64 nt, Human
gguuuuguuuuuuugaaaggucugaaaaggugaagcccccuacccaauggcaauaugaaaccuu

SEQ ID NO: 366925 - RNA, 64 nt, Human
ggaaggaauggugggguggcguuugggaacuugugcccccuaaacacauuuacuggccuccucu

SEQ ID NO: 366926 - RNA, 64 nt, Human
uuggcuucccccaggggcaggcuggacuuucccugcccccuaugauugaaguccuccugcuuuu

SEQ ID NO: 366927 - RNA, 64 nt, Human
uugagaaaugcuugugguauguguuuuccaaacugcccccuauauguaaaguucaguuuaacca

SEQ ID NO: 366928 - RNA, 64 nt, Human
accuuggggauggaccuucagcugaaaccauauggcccccuaggugcacagccuugauucuucc

SEQ ID NO: 366929 - RNA, 64 nt, Human
ccugcuccccucaacccccucccaccccauccacgcccccuaccuuucccaauuuuaguuucau

SEQ ID NO: 366930 - RNA, 64 nt, Human
uccuauuaaugcgaucuggcaucuucucccacaagcccccuacagggaacaacuacccccuacc

SEQ ID NO: 366931 - RNA, 64 nt, Human
cauuaggaggaccaugugguuggaaggauagacugcccccuaccucccaccaccaccaugaagu

SEQ ID NO: 366932 - RNA, 64 nt, Human
caggaugccuuauuugucuucuacaccccacagggcccccuacuucuucggauguguuuuuaau

SEQ ID NO: 366933 - RNA, 64 nt, Human
aggggacccuaccagaugagcccugccucugggagcccccuaggaagcaccagccuggaccuac

SEQ ID NO: 366934 - RNA, 64 nt, Human
aaguccccaccgccucuucuuccucacuguccccgcccccuauuuguggacuaaagaugaacuc

SEQ ID NO: 366935 - RNA, 64 nt, Human
gauguguuccugaccgaccccgggucccaccugugcccccuaaaccaggcgguggaucaggccc

SEQ ID NO: 366936 - RNA, 64 nt, Human
aaacuuuuuuuuuuuuuuuuuuaccuccugucuugcccccuaaaagaaauaaauagagcaaaca

SEQ ID NO: 366937 - RNA, 64 nt, Human
cuaacaucugaacuccuguaaaccuucaucccuggcccccuaucuugggcccauuaguuuuggg

SEQ ID NO: 366938 - RNA, 64 nt, Human; identical to SEQ ID NO: 44318

SEQ ID NO: 366939 - RNA, 64 nt, Human; identical to SEQ ID NO: 44319

SEQ ID NO: 366940 - RNA, 64 nt, Human; identical to SEQ ID NO: 44321

SEQ ID NO: 366941 - RNA, 64 nt, Human
gugcugagauuacaggugugagccaccaggcucagcccccuaagauuugaaacacuuuaaaugg

SEQ ID NO: 366942 - RNA, 64 nt, Human
cuugccccaagucacagccacucagauguucgacgcccccuaagguccauuccagcacccaccu

SEQ ID NO: 366943 - RNA, 64 nt, Human
accaccucacugggagggcgccgagcccaccgucgcccccuagacccugacagcugcagcugcc

SEQ ID NO: 366944 - RNA, 64 nt, Human
cacguucagagaaacucaagcuauugcaugauuagcccccuaucuggcaaggaaaccccauaca

SEQ ID NO: 366945 - RNA, 64 nt, Human
ggcugugugaagggaucuggcagggcaccacagcgcccccuacugaaccaucagcaugucagug

SEQ ID NO: 366946 - RNA, 64 nt, Human
gguggaacucagucauuagacuccuccuccaaaggcccccuacgccaaucaagggcaaaaaguc

SEQ ID NO: 366947 - RNA, 64 nt, Human
aguagaauuccaucccaguaccaaagccagauaggcccccuaggaaacugagguaagagcaguc

SEQ ID NO: 366948 - RNA, 64 nt, Human
cgaggguggggugcaccuaccgauuggcucugcagcccccuaaccugccucuggccccaguucg

SEQ ID NO: 366949 - RNA, 64 nt, Human
augugagcucuuccuaucccucuccuaacugccagcccccuaaaagcacuccugcuuaaucuuc

SEQ ID NO: 366950 - RNA, 64 nt, Human
acuuaauguaguuacugugagccauauuacuagugcccccuagggucuauaauuccuuaaaauu

SEQ ID NO: 366951 - RNA, 64 nt, Human
aaggaugggguucuuguccacggggcucacucuggcccccuauugucuccaaggucccauuuuc

SEQ ID NO: 366952 - RNA, 64 nt, Human
gaggucaggguuuuagagagcaguggcagagguagcccccuaaaugggcaagcaaggagccccc

SEQ ID NO: 366953 - RNA, 64 nt, Human
uuucagaacaauaaaugucacaaucccuucuauagcccccuacagugaucucuucaaggucaac

SEQ ID NO: 366954 - RNA, 64 nt, Human
cuuccgugaaggccacugcccagguccccagugcgcccccuaguggccauagccugguuaaagu

SEQ ID NO: 366955 - RNA, 64 nt, Human
gaagacuaaagauuuuacucucuccccuauccaugcccccuaccucugacucucucugugugaa

SEQ ID NO: 366956 - RNA, 64 nt, Human
agcaugaaauguaaaacaucugauaaaacuuacagcccccuacaccaagaguguaucugugaaa

SEQ ID NO: 366957 - RNA, 64 nt, Human; identical to SEQ ID NO: 44325

SEQ ID NO: 366958 - RNA, 64 nt, Human; identical to SEQ ID NO: 44326

SEQ ID NO: 366959 - RNA, 64 nt, Human; identical to SEQ ID NO: 44327

SEQ ID NO: 366960 - RNA, 64 nt, Human
ggcccacuuuugggaucaggugccugaucacugggcccccuaccucagccccccuuucccugga

SEQ ID NO: 366961 - RNA, 50 nt, Human
agcgcgagaucuaccugugagcccccuacuggccggccggccccccuccc

SEQ ID NO: 366962 - RNA, 63 nt, Human
gguugcccccaccccgcugagggaguuccucuugcccccuacccccggggcuuguauauagau

SEQ ID NO: 366963 - RNA, 64 nt, Human
ucaaucaucgauaagaagccucuacagcaccccugcccccuaauuuauacagaaaccggaccca

SEQ ID NO: 366964 - RNA, 64 nt, Human
aagcccccagacuccuuagcccucagagccggcagcccccuacccucagacaaggaacucucuc

SEQ ID NO: 366965 - RNA, 64 nt, Human
cagggaaggcuaagcauggccuggacugacugcagcccccuauagucauggggucccugcugca

SEQ ID NO: 366966 - RNA, 64 nt, Human
uuacucauacuauuaggcacacuuuccccuuagagcccccuaaguuuuucccagacgaaucuuu

SEQ ID NO: 366967 - RNA, 64 nt, Human
aucaggaaguaaauuuuacagggcaccaagcuuugcccccuaaaaucccuuagguguucuuugu

SEQ ID NO: 366968 - RNA, 64 nt, Human
cagguuuuaguugaauugaaaauuugacugcucugcccccuagaauguguguauuuuaagcaua

SEQ ID NO: 366969 - RNA, 64 nt, Human
ugcaggcacagcaggccuagguccucccacaccugcccccuaauaaagugggcgcgagaggagg

SEQ ID NO: 366970 - RNA, 64 nt, Human
auacauccuguccagccacgacauugagcagcacgcccccuaucgccaccugccagccagcagg

SEQ ID NO: 366971 - RNA, 64 nt, Human
uaugucauagccuuaugaguuagcuuucuugcuagcccccuagucggucaccaaacuaguaacu

SEQ ID NO: 366972 - RNA, 64 nt, Human
cccggcgggacccccauguccuccgcuccgcccggcccccuagcuguauauacuauuuauuuca

SEQ ID NO: 366973 - RNA, 64 nt, Human
accuaggagcagggccauuccuacugaaggacgggcccccuacggagaugaaauuuguuuccug

SEQ ID NO: 366974 - RNA, 64 nt, Human
auuccccucuguuccucuguuccucucuucuccugcccccuagcaaccacugguguuuucuguc

SEQ ID NO: 366975 - RNA, 64 nt, Human
aaguggaacugugcccuauguguggggacuggcugcccccuagagccugccaggagcagaagcc

SEQ ID NO: 366976 - RNA, 64 nt, Human; identical to SEQ ID NO: 44328

SEQ ID NO: 366977 - RNA, 64 nt, Human; identical to SEQ ID NO: 44329

SEQ ID NO: 366978 - RNA, 64 nt, Human; identical to SEQ ID NO: 44330

SEQ ID NO: 366979 - RNA, 64 nt, Human
caacaaggaccucaagaacugccuguggaccgaggcccccuaccagugcaugagacacacaccu

SEQ ID NO: 366980 - RNA, 64 nt, Human
guugagaaauggacauucuuaccuacuccuccuagcccccuauccccaguaacagugaucccuu

SEQ ID NO: 366981 - RNA, 64 nt, Human
ccggauaccguagcccaugggcaccagcuuggaggcccccuagaccagcucuuccagcuggaug

SEQ ID NO: 366982 - RNA, 64 nt, Human
ugcccaggacucuuuagugcacucacucuugucugcccccuaccuucccuccuggaaccacacu

SEQ ID NO: 366983 - RNA, 64 nt, Human
aaccccagcguccccccugaggcguucauuggcagcccccuaggacugcacgcuggccccacgg

SEQ ID NO: 366984 - RNA, 52 nt, Human
uggaccugacagggcucuaacugcccccuacuggugucuggggguugggggc

SEQ ID NO: 366985 - RNA, 64 nt, Human
gacgggucccagcaccucggagcccccuucacacgcccccuaccggcccauguuucuauuugca

SEQ ID NO: 366986 - RNA, 64 nt, Human
cagggcaggugggcucucggggaaggugucgggggcccccuaggagggagcgcuggggacauug

SEQ ID NO: 366987 - RNA, 64 nt, Human
ggugugcuuucccaguggggagcagucuggcccugcccccuacuaaagccucugcucucagcac

SEQ ID NO: 366988 - RNA, 64 nt, Human
augucuaacuuauugauggcaggcagcccccugugcccccuaagccuggcccugguuauugcug

SEQ ID NO: 366989 - RNA, 64 nt, Human
gccccucugcuggcguccccggagcccagugcuggcccccuacagguggcagccccugcccacu

SEQ ID NO: 366990 - RNA, 64 nt, Human
caucggcucuaauagagaacaugcccucagcuaagcccccuacugagaaacuuccuuugagaau

SEQ ID NO: 366991 - RNA, 64 nt, Human
uuucuguagguggucuggagcuguccggcugguggcccccuauuuugccauuuagcgaacaacc

SEQ ID NO: 366992 - RNA, 64 nt, Human
agaaagagccagauggaccugagugucggucacagcccccuacacucaaggcugagaggccuca

SEQ ID NO: 366993 - RNA, 64 nt, Human
cauuuguuauaaaccuauagugcacauuuuaacugcccccuaaauuacccuucccuggguuugu

SEQ ID NO: 366994 - RNA, 64 nt, Human
caaguauuucuuuaggcuuauguucagcaccucagcccccuacugagaaguuaauuaauucagu

SEQ ID NO: 366995 - RNA, 64 nt, Human; identical to SEQ ID NO: 44331

SEQ ID NO: 366996 - RNA, 64 nt, Human; identical to SEQ ID NO: 44332

SEQ ID NO: 366997 - RNA, 64 nt, Human; identical to SEQ ID NO: 44333

SEQ ID NO: 366998 - RNA, 64 nt, Human
aucuuccuggaugccaacgugaaggaaagcuacugcccccuagugccccacaccauguacugcc

SEQ ID NO: 366999 - RNA, 64 nt, Human
gagggaugcaggagcccuauaccccuacacaggggcccccuaacuccugucccccuucucuacu

SEQ ID NO: 367000 - RNA, 64 nt, Human
gggaggggucauuggaaaccauaaugcagagugggcccccuacuccauuucccagcaaaaggcu

SEQ ID NO: 367001 - RNA, 64 nt, Human
gaagagaaagacagccaccaaaaagggcacggcggcccccuacuucaaugaggccuucaccuuc

SEQ ID NO: 367002 - RNA, 64 nt, Human
gccccgcagcucuggccacagggaccucugcagugcccccuaagugacccggacacuuccgagg

SEQ ID NO: 367003 - RNA, 64 nt, Human
uugauagaagaaagcaacacaaaagcuccaaagggcccccuaacccucuuguggcuccaguuau

SEQ ID NO: 367004 - RNA, 64 nt, Human
ggggaccuaggccccagggaaagagccccaugccgcccccuaaggagccgcccagaccuagggc

SEQ ID NO: 367005 - RNA, 64 nt, Human
gcaaaagcccauugaagaagaaccagcccagccugcccccuaucuuguccuggaauauuuuugg

SEQ ID NO: 367006 - RNA, 64 nt, Human
acugcaaaaaggaggaaaaaaaaccuucaaaaacgcccccuaagucaacgcuccauugacugaa

SEQ ID NO: 367007 - RNA, 64 nt, Human
gaucuccccagaagccucuuguggugguggcugugcccccuaugcccuguggcauuucugcguc

SEQ ID NO: 367008 - RNA, 64 nt, Human
ccuauucugguaacuaccaggaggcuuccuuccagcccccuauucugguaacuaccaaaauccc

SEQ ID NO: 367009 - RNA, 64 nt, Human
guucaaaucgaaucucccaggaggcuuccuuccagcccccuauucugguaacuaccaggaggcu

SEQ ID NO: 367010 - RNA, 64 nt, Human
ucacucugcccagcccugaaugugugccuuaaaggcccccuacaaggggccccauacgacagag

SEQ ID NO: 367011 - RNA, 64 nt, Human
ccaaggugaagccugucaccacgcagacagaacugcccccuauuguagacaguggugggaaggg

SEQ ID NO: 367012 - RNA, 64 nt, Human
ggugccuuggaacuggcuuuggaaauagcuaucugcccccuagcuauggacucuucacaguuau

SEQ ID NO: 367013 - RNA, 64 nt, Human
caucauuucuuuuugggagagacuuguuuuggaugcccccuaauccccuucuccccugcacugu

SEQ ID NO: 367014 - RNA, 64 nt, Human; identical to SEQ ID NO: 44334

SEQ ID NO: 367015 - RNA, 64 nt, Human; identical to SEQ ID NO: 44335

SEQ ID NO: 367016 - RNA, 64 nt, Human; identical to SEQ ID NO: 44336

SEQ ID NO: 367017 - RNA, 64 nt, Human
aaacccagcucacaggagcuuaaacagcuggucagcccccuaagcccccacuacaagugauccu

SEQ ID NO: 367018 - RNA, 64 nt, Human
cacuugaguuuuccuaggagggacaucaauaacagcccccuaaagaagauucuuagagccagcu

SEQ ID NO: 367019 - RNA, 64 nt, Human
acgggcuccuaggcgcuuggacaugcccgcuugugcccccuaggggcggaaagaagacccgguc

SEQ ID NO: 367020 - RNA, 64 nt, Human
uuugaacgcuugcuuuuagagagaaaacaauauagcccccuacccuuuucccaauccuuugccc

SEQ ID NO: 367021 - RNA, 64 nt, Human
gccuccagccugcccaagcccaggccacccuaucgcccccuacgcgccuugucuccuacuccug

SEQ ID NO: 367022 - RNA, 64 nt, Human
uguccagccccauggccacccccaccccugccucgcccccuacaggccucugggcccagcuccu

SEQ ID NO: 367023 - RNA, 64 nt, Human
ugagcuuggaaauuacugugcuuacaaggggauggcccccuaaggaauuuuucuucccuccuca

SEQ ID NO: 367024 - RNA, 58 nt, Human
uuagcagcguccucaccuaagaggcccugcccccuacccuugcccuuuaacuuauugg

SEQ ID NO: 367025 - RNA, 64 nt, Human
uuuucugauuuaaagcacuuuuaaaucuuauccugcccccuaaaaacaaaagguuuugaucaca

SEQ ID NO: 367026 - RNA, 64 nt, Human
ccuccuucccugugugcuggggagucucaucaccgcccccuaaaaaugacguuauuaaauguug

SEQ ID NO: 367027 - RNA, 64 nt, Human
aauucucccacacuagcuugcagaaaccuagagggcccccuacuuguuuuauuuaacugugcag

SEQ ID NO: 367028 - RNA, 64 nt, Human
uucuauuuuaaaaaacaagacuuuacuuucuucugcccccuaagugauagguuuaaacacacag

SEQ ID NO: 367029 - RNA, 64 nt, Human
cucagguuggcccuggccuuugccaucccgggaggcccccuagccagcaagagugggauugccu

SEQ ID NO: 367030 - RNA, 64 nt, Human
cgguggaaaaaucauccuuuuuugggacauacuugcccccuacuuccucuucucucuggaacgg

SEQ ID NO: 367031 - RNA, 64 nt, Human
ugggucgcugucaucuguguuuagcucggggagugcccccuaagggggcgaacugaccucaggc

SEQ ID NO: 367032 - RNA, 64 nt, Human
gccucgcacaaaaggucuuccccacccacccccagcccccuagucuaauacccacccugauacg

SEQ ID NO: 367033 - RNA, 64 nt, Human; identical to SEQ ID NO: 44337

SEQ ID NO: 367034 - RNA, 64 nt, Human; identical to SEQ ID NO: 44338

SEQ ID NO: 367035 - RNA, 64 nt, Human; identical to SEQ ID NO: 44339

SEQ ID NO: 367036 - RNA, 64 nt, Human
cuaugcagugugcuccggccacacauccugcugggcccccuacccugccccaauucaauccugc

SEQ ID NO: 367037 - RNA, 64 nt, Human
uucugaguugcagagggggcugcggacacagcaggcccccuacagccucagguucugccugagc

SEQ ID NO: 367038 - RNA, 64 nt, Human
guccgccgcugcacauccuucuuggcuuccuggcgcccccuaucgggggugagcgaagccccca

SEQ ID NO: 367039 - RNA, 64 nt, Human
gaguccaggcugcacccuggagaucccaaaccuagcccccuagugggacaaggaccugacccuc

SEQ ID NO: 367040 - RNA, 64 nt, Human
uucccccgacccgcggauggcagucuggaauaaagcccccuaguugccuuuggccccaccuuug

SEQ ID NO: 367041 - RNA, 64 nt, Human
gcuugaaacuuccugagaaacuguagcauauccagcccccuaaaauguacaauguaacuuguuc

SEQ ID NO: 367042 - RNA, 64 nt, Human
cccugaccccacauggucucagggcccccuuagggcccccuaccccacugauagcuuccuccuu

SEQ ID NO: 367043 - RNA, 64 nt, Human
gcccccaccccaaguuuauuuuuguuuucccccggcccccuaccucugaagccauuuuaugauc

SEQ ID NO: 367044 - RNA, 64 nt, Human
uuccugcccccaggcaccgugccaaagacuggaugcccccuacuccucaggggacuguccaggg

SEQ ID NO: 367045 - RNA, 64 nt, Human
ggugggauggccccagugcuggaaagaagcaagagcccccuaugcacacauugcagacuagcug

SEQ ID NO: 367046 - RNA, 64 nt, Human
ugaauccuaaaggggaucccugcccccaugggaggcccccuacuagaaggacgugaaagcagcu

SEQ ID NO: 367047 - RNA, 64 nt, Human
gauucugcauggaggaaaaaugacuaaggacugagcccccuacccaacuacccccaccccaauc

SEQ ID NO: 367048 - RNA, 64 nt, Human
ccugucuccacgccuccgggagcugugucccugagcccccuaguccuggcuccugcuuuuuccc

SEQ ID NO: 367049 - RNA, 64 nt, Human
cuaacuggacuacucuggaugcauuuuguggugggcccccuagaggggaagaugggccuuuauc

SEQ ID NO: 367050 - RNA, 64 nt, Human
guuuaauuauauaacuguucuuacugauuuuauugcccccuagcaauaagcccuuuccuuugaa

SEQ ID NO: 367051 - RNA, 57 nt, Human
ucuugguguuuccucuauaaacacagagcccccuagauggugggggaauggcaaacu

SEQ ID NO: 367052 - RNA, 64 nt, Human; identical to SEQ ID NO: 44340

SEQ ID NO: 367053 - RNA, 64 nt, Human; identical to SEQ ID NO: 44341

SEQ ID NO: 367054 - RNA, 64 nt, Human; identical to SEQ ID NO: 44342

SEQ ID NO: 367055 - RNA, 64 nt, Human
cgcuggggcuugggggcuccacuggcuccccccagcccccuaagagagcaccuggugaucacgu

SEQ ID NO: 367056 - RNA, 64 nt, Human
cucccgucggcaggggcagcagggggcagggugcaggguccacauagguggugcacacgcaagc

SEQ ID NO: 367057 - RNA, 64 nt, Human
cuguccuucauuguugagccccaaaucauugcucaggguccauucccugcuguagaacgaugcc

SEQ ID NO: 367058 - RNA, 64 nt, Human
uuaucuuaaauaauuuauucauuccagaaugucaaggguccacuugcuauuuauuuuuuuucaa

SEQ ID NO: 367059 - RNA, 64 nt, Human
caggcuggagucaugaggguagugggcuaagucgaggguccagccucuucugccaggaagcccu

SEQ ID NO: 367060 - RNA, 64 nt, Human
gggcacagagaaucagcuaggagaccaguuauucaggguccauuucucuuggauguaaaggagu

SEQ ID NO: 367061 - RNA, 64 nt, Human
uccugcccucagcacuagauuuaauggggccaagaggguccaaaccccuugcuaacauaccacu

SEQ ID NO: 367062 - RNA, 64 nt, Human
ggguucucagcuauuuccagagccagcucaaaucaggguccagugggaacugaagagggcccaa

SEQ ID NO: 367063 - RNA, 64 nt, Human
cgcggagggccagccagauccggacccuucccuuaggguccagucuccccacaccccagcaggg

SEQ ID NO: 367064 - RNA, 64 nt, Human
acaacaggccccugacucaccccggucaccucccaggguccauggccagggccucuguguuugg

SEQ ID NO: 367065 - RNA, 64 nt, Human
ccuauuccucacuccaagacuuguucuacaggaaaggguccaugcuccuuuggccaagaucauc

SEQ ID NO: 367066 - RNA, 64 nt, Human
gggcauuucucuaccucccagguggaaguccuucaggguccagcagcaaccuguaucagaagaa

SEQ ID NO: 367067 - RNA, 64 nt, Human
cuuuuggguucacagaagcacagcacccaugggaaggguccaucucagagaauuuacgagcagg

SEQ ID NO: 367068 - RNA, 64 nt, Human
gugggaggagcaccacucacuucugcagggagcaaggguccagagcagauauggaccccucugc

SEQ ID NO: 367069 - RNA, 64 nt, Human
uccaucaccgccucaaugugaugagccuaaagcuaggguccaagggcagagccugugcccuuca

SEQ ID NO: 367070 - RNA, 64 nt, Human
aacuaaaaguuaggauuuuauggaguauggagauaggguccaguaucuauuuacccuguaaugu

SEQ ID NO: 367071 - RNA, 64 nt, Human; identical to SEQ ID NO: 116642

SEQ ID NO: 367072 - RNA, 64 nt, Human; identical to SEQ ID NO: 116647

SEQ ID NO: 367073 - RNA, 64 nt, Human; identical to SEQ ID NO: 116651

SEQ ID NO: 367074 - RNA, 64 nt, Human
cuaacugagcaccuuuuaaaccccucccucuucugcccccuaccacuuuucugcuguugccucu

SEQ ID NO: 367075 - RNA, 64 nt, Human
gccugagaugcccucauguugggaagcauuccgugcccccuaccccgccugcccuccguauuuc

SEQ ID NO: 367076 - RNA, 64 nt, Human
ccuggagggggcuugaggggcacuucagggcccugcccccuaauguaaccccucucucaccccg

SEQ ID NO: 367077 - RNA, 64 nt, Human
cucgcgcccggaacucgcucuccacgcgccccgggcccccuaccugcgcccgcagcgcccucgc

SEQ ID NO: 367078 - RNA, 64 nt, Human
acacagcuuucuagcagcugcaaaaugguuuaaugcccccuacauauuuccaucaccuugaaca

SEQ ID NO: 367079 - RNA, 64 nt, Human
gcauaagugaaagacaccuccccucacccuucuagcccccuacaaggugccagguugggguaaa

SEQ ID NO: 367080 - RNA, 64 nt, Human
gugugugucauacacagggccuaguacauagugggcccccuacauacgcauggauucugggucu

SEQ ID NO: 367081 - RNA, 64 nt, Human
cucagcccaggucuccugggcaucuggcccugcugcccccuacccggcucguucccccaggggu

SEQ ID NO: 367082 - RNA, 64 nt, Human
ucucauacgcguguauguuugguuccaugucacagcccccuaggagccagugaugcucggccuu

SEQ ID NO: 367083 - RNA, 64 nt, Human
uguguuccguguguguccaguuuacagcgucucugcccccuagcguguuuugugacaaucuccc

SEQ ID NO: 367084 - RNA, 64 nt, Human
cccuguguggcugcacugagguggguguugaagagcccccuaggggacacacagcuuccaggag

SEQ ID NO: 367085 - RNA, 64 nt, Human
ugguaacggguuucaaggggacucuugaggaagugcccccuaaaauagaacacagcaauaacug

SEQ ID NO: 367086 - RNA, 64 nt, Human
uagcaaugggggccuccgcuuauccugcuagcaggcccccuaggauucccccugcccugugccg

SEQ ID NO: 367087 - RNA, 64 nt, Human
aguccagcguucugccgugucugucccccaccaugcccccuacaggcgguacugauggcgcuuu

SEQ ID NO: 367088 - RNA, 64 nt, Human
gcucugucgacucugguggguccccacuccuggggcccccuaaccccaccccaggcagcggaag

SEQ ID NO: 367089 - RNA, 64 nt, Human
ccuuagagcagacaagggcucucagcccuggcaugcccccuaaagggaccaagguccuccuauu

SEQ ID NO: 367090 - RNA, 64 nt, Human; identical to SEQ ID NO: 116655

SEQ ID NO: 367091 - RNA, 64 nt, Human; identical to SEQ ID NO: 116659

SEQ ID NO: 367092 - RNA, 64 nt, Human; identical to SEQ ID NO: 116663

SEQ ID NO: 367093 - RNA, 64 nt, Human
ccuuugcaauggguaggagaucuggggaggcccugcccccuacaccauacuuaucaccacccuc

SEQ ID NO: 367094 - RNA, 64 nt, Human
ggagccagugacaugaggugcagaggcccacccagcccccuaccuacugcccccauucauccug

SEQ ID NO: 367095 - RNA, 64 nt, Human
ggcuccaggacucucccuggggggcccaccucuugcccccuaaccucuuucccccuuuucugcc

SEQ ID NO: 367096 - RNA, 64 nt, Human
uccuccugaggagaggcuguaggcugugccugucgcccccuaccuuccuaauggcuccuccucu

SEQ ID NO: 367097 - RNA, 64 nt, Human
gggaggggggugugagggguugugcccagguguugcccccuaucuccuggggagggugaggcag

SEQ ID NO: 367098 - RNA, 64 nt, Human
gagaagccagugucuaggcacugagcagggaucugcccccuaguucagguccaaauucaccuuc

SEQ ID NO: 367099 - RNA, 64 nt, Human
ccaguggguguuucuacucugccagugagaggcagcccccuagaaacucuucaggcguaaugga

SEQ ID NO: 367100 - RNA, 64 nt, Human
uagacaagaaaaaaaaauauuauuugucuuuccugcccccuaucuguuugcugugauagugcaa

SEQ ID NO: 367101 - RNA, 64 nt, Human
cuggaaacaugaucacacucucaaucugucacgugcccccuagccuuacugggaaccuucuguc

SEQ ID NO: 367102 - RNA, 64 nt, Human
uugagauucugccucccaggagagggauuuaccugcccccuaguaccagauagguuuagggcag

SEQ ID NO: 367103 - RNA, 64 nt, Human; identical to SEQ ID NO: 44312

SEQ ID NO: 367104 - RNA, 64 nt, Human; identical to SEQ ID NO: 44313

SEQ ID NO: 367105 - RNA, 64 nt, Human; identical to SEQ ID NO: 44314

SEQ ID NO: 367106 - RNA, 64 nt, Human; identical to SEQ ID NO: 44315

SEQ ID NO: 367107 - RNA, 64 nt, Human; identical to SEQ ID NO: 44316

SEQ ID NO: 367108 - RNA, 64 nt, Human; identical to SEQ ID NO: 44317

SEQ ID NO: 367109 - RNA, 64 nt, Human; identical to SEQ ID NO: 44343

SEQ ID NO: 367110 - RNA, 64 nt, Human; identical to SEQ ID NO: 44344

SEQ ID NO: 367111 - RNA, 64 nt, Human; identical to SEQ ID NO: 44345

SEQ ID NO: 367112 - RNA, 64 nt, Human; identical to SEQ ID NO: 44346

SEQ ID NO: 367113 - RNA, 64 nt, Human; identical to SEQ ID NO: 44347

SEQ ID NO: 367114 - RNA, 64 nt, Human; identical to SEQ ID NO: 44348

SEQ ID NO: 367115 - RNA, 64 nt, Human; identical to SEQ ID NO: 44349

SEQ ID NO: 367116 - RNA, 64 nt, Human; identical to SEQ ID NO: 44350

SEQ ID NO: 367117 - RNA, 64 nt, Human; identical to SEQ ID NO: 44351

SEQ ID NO: 367118 - RNA, 64 nt, Human; identical to SEQ ID NO: 44352

SEQ ID NO: 367119 - RNA, 64 nt, Human; identical to SEQ ID NO: 44353

SEQ ID NO: 367120 - RNA, 64 nt, Human; identical to SEQ ID NO: 44354

SEQ ID NO: 367121 - RNA, 64 nt, Human; identical to SEQ ID NO: 44355

SEQ ID NO: 367122 - RNA, 64 nt, Human; identical to SEQ ID NO: 44356

SEQ ID NO: 367123 - RNA, 60 nt, Human; identical to SEQ ID NO: 44357

SEQ ID NO: 367124 - RNA, 64 nt, Human; identical to SEQ ID NO: 44358

SEQ ID NO: 367125 - RNA, 64 nt, Human; identical to SEQ ID NO: 44359

SEQ ID NO: 367126 - RNA, 64 nt, Human; identical to SEQ ID NO: 44360

SEQ ID NO: 367127 - RNA, 64 nt, Human; identical to SEQ ID NO: 44361

SEQ ID NO: 367128 - RNA, 64 nt, Human; identical to SEQ ID NO: 44362

SEQ ID NO: 367129 - RNA, 64 nt, Human; identical to SEQ ID NO: 44363

SEQ ID NO: 367130 - RNA, 64 nt, Human; identical to SEQ ID NO: 44364

SEQ ID NO: 367131 - RNA, 64 nt, Human; identical to SEQ ID NO: 44365

SEQ ID NO: 367132 - RNA, 64 nt, Human; identical to SEQ ID NO: 44366

SEQ ID NO: 367133 - RNA, 64 nt, Human; identical to SEQ ID NO: 44367

SEQ ID NO: 367134 - RNA, 64 nt, Human; identical to SEQ ID NO: 44368

SEQ ID NO: 367135 - RNA, 64 nt, Human; identical to SEQ ID NO: 44369

SEQ ID NO: 367136 - RNA, 64 nt, Human; identical to SEQ ID NO: 44370

SEQ ID NO: 367137 - RNA, 64 nt, Human; identical to SEQ ID NO: 44371

SEQ ID NO: 367138 - RNA, 64 nt, Human; identical to SEQ ID NO: 44372

SEQ ID NO: 367139 - RNA, 64 nt, Human; identical to SEQ ID NO: 44373

SEQ ID NO: 367140 - RNA, 64 nt, Human; identical to SEQ ID NO: 44374

SEQ ID NO: 367141 - RNA, 64 nt, Human; identical to SEQ ID NO: 44375

SEQ ID NO: 367142 - RNA, 64 nt, Human; identical to SEQ ID NO: 44376

SEQ ID NO: 367143 - RNA, 64 nt, Human; identical to SEQ ID NO: 44377

SEQ ID NO: 367144 - RNA, 64 nt, Human; identical to SEQ ID NO: 44378

SEQ ID NO: 367145 - RNA, 64 nt, Human; identical to SEQ ID NO: 44379

SEQ ID NO: 367146 - RNA, 64 nt, Human; identical to SEQ ID NO: 44380

SEQ ID NO: 367147 - RNA, 64 nt, Human; identical to SEQ ID NO: 44381

SEQ ID NO: 367148 - RNA, 64 nt, Human; identical to SEQ ID NO: 44382

SEQ ID NO: 367149 - RNA, 64 nt, Human; identical to SEQ ID NO: 44383

SEQ ID NO: 367150 - RNA, 64 nt, Human; identical to SEQ ID NO: 44384

SEQ ID NO: 367151 - RNA, 64 nt, Human; identical to SEQ ID NO: 44385

SEQ ID NO: 367152 - RNA, 64 nt, Human; identical to SEQ ID NO: 44386

SEQ ID NO: 367153 - RNA, 64 nt, Human; identical to SEQ ID NO: 44387

SEQ ID NO: 367154 - RNA, 64 nt, Human; identical to SEQ ID NO: 44388

SEQ ID NO: 367155 - RNA, 64 nt, Human; identical to SEQ ID NO: 44389

SEQ ID NO: 367156 - RNA, 64 nt, Human; identical to SEQ ID NO: 44390

SEQ ID NO: 367157 - RNA, 64 nt, Human; identical to SEQ ID NO: 44391

SEQ ID NO: 367158 - RNA, 64 nt, Human; identical to SEQ ID NO: 44392

SEQ ID NO: 367159 - RNA, 61 nt, Human; identical to SEQ ID NO: 44393

SEQ ID NO: 367160 - RNA, 64 nt, Human; identical to SEQ ID NO: 44394

SEQ ID NO: 367161 - RNA, 64 nt, Human; identical to SEQ ID NO: 44395

SEQ ID NO: 367162 - RNA, 64 nt, Human; identical to SEQ ID NO: 44396

SEQ ID NO: 367163 - RNA, 64 nt, Human; identical to SEQ ID NO: 44397

SEQ ID NO: 367164 - RNA, 64 nt, Human; identical to SEQ ID NO: 44398

SEQ ID NO: 367165 - RNA, 64 nt, Human; identical to SEQ ID NO: 44399

SEQ ID NO: 367166 - RNA, 64 nt, Human; identical to SEQ ID NO: 44400

SEQ ID NO: 367167 - RNA, 64 nt, Human; identical to SEQ ID NO: 44401

SEQ ID NO: 367168 - RNA, 64 nt, Human; identical to SEQ ID NO: 44402

SEQ ID NO: 367169 - RNA, 64 nt, Human; identical to SEQ ID NO: 44403

SEQ ID NO: 367170 - RNA, 64 nt, Human; identical to SEQ ID NO: 44404

SEQ ID NO: 367171 - RNA, 64 nt, Human; identical to SEQ ID NO: 44405

SEQ ID NO: 367172 - RNA, 64 nt, Human; identical to SEQ ID NO: 44406

SEQ ID NO: 367173 - RNA, 64 nt, Human; identical to SEQ ID NO: 44407

SEQ ID NO: 367174 - RNA, 64 nt, Human; identical to SEQ ID NO: 44408

SEQ ID NO: 367175 - RNA, 64 nt, Human; identical to SEQ ID NO: 44409

SEQ ID NO: 367176 - RNA, 64 nt, Human; identical to SEQ ID NO: 44410

SEQ ID NO: 367177 - RNA, 64 nt, Human; identical to SEQ ID NO: 44411

SEQ ID NO: 367178 - RNA, 64 nt, Human; identical to SEQ ID NO: 44412

SEQ ID NO: 367179 - RNA, 64 nt, Human; identical to SEQ ID NO: 44413

SEQ ID NO: 367180 - RNA, 64 nt, Human; identical to SEQ ID NO: 44414

SEQ ID NO: 367181 - RNA, 64 nt, Human; identical to SEQ ID NO: 44415

SEQ ID NO: 367182 - RNA, 64 nt, Human; identical to SEQ ID NO: 44416

SEQ ID NO: 367183 - RNA, 64 nt, Human; identical to SEQ ID NO: 44417

SEQ ID NO: 367184 - RNA, 64 nt, Human; identical to SEQ ID NO: 44418

SEQ ID NO: 367185 - RNA, 64 nt, Human; identical to SEQ ID NO: 44419

SEQ ID NO: 367186 - RNA, 64 nt, Human; identical to SEQ ID NO: 44420

SEQ ID NO: 367187 - RNA, 64 nt, Human; identical to SEQ ID NO: 44421

SEQ ID NO: 367188 - RNA, 64 nt, Human; identical to SEQ ID NO: 44422

SEQ ID NO: 367189 - RNA, 64 nt, Human; identical to SEQ ID NO: 44423

SEQ ID NO: 367190 - RNA, 64 nt, Human; identical to SEQ ID NO: 44424

SEQ ID NO: 367191 - RNA, 64 nt, Human; identical to SEQ ID NO: 44425

SEQ ID NO: 367192 - RNA, 64 nt, Human; identical to SEQ ID NO: 44426

SEQ ID NO: 367193 - RNA, 64 nt, Human; identical to SEQ ID NO: 44427

SEQ ID NO: 367194 - RNA, 64 nt, Human; identical to SEQ ID NO: 44428

SEQ ID NO: 367195 - RNA, 64 nt, Human; identical to SEQ ID NO: 44429

SEQ ID NO: 367196 - RNA, 64 nt, Human; identical to SEQ ID NO: 44430

SEQ ID NO: 367197 - RNA, 64 nt, Human; identical to SEQ ID NO: 44431

SEQ ID NO: 367198 - RNA, 64 nt, Human; identical to SEQ ID NO: 44432

SEQ ID NO: 367199 - RNA, 64 nt, Human; identical to SEQ ID NO: 44433

SEQ ID NO: 367200 - RNA, 64 nt, Human; identical to SEQ ID NO: 44434

SEQ ID NO: 367201 - RNA, 64 nt, Human; identical to SEQ ID NO: 44435

SEQ ID NO: 367202 - RNA, 64 nt, Human; identical to SEQ ID NO: 44436

SEQ ID NO: 367203 - RNA, 64 nt, Human; identical to SEQ ID NO: 44437

SEQ ID NO: 367204 - RNA, 52 nt, Human; identical to SEQ ID NO: 44438

SEQ ID NO: 367205 - RNA, 64 nt, Human; identical to SEQ ID NO: 44439

SEQ ID NO: 367206 - RNA, 64 nt, Human; identical to SEQ ID NO: 44440

SEQ ID NO: 367207 - RNA, 64 nt, Human; identical to SEQ ID NO: 44441

SEQ ID NO: 367208 - RNA, 64 nt, Human; identical to SEQ ID NO: 44442

SEQ ID NO: 367209 - RNA, 64 nt, Human; identical to SEQ ID NO: 44443

SEQ ID NO: 367210 - RNA, 64 nt, Human; identical to SEQ ID NO: 44444

SEQ ID NO: 367211 - RNA, 64 nt, Human; identical to SEQ ID NO: 44445

SEQ ID NO: 367212 - RNA, 64 nt, Human; identical to SEQ ID NO: 44446

SEQ ID NO: 367213 - RNA, 64 nt, Human; identical to SEQ ID NO: 44447

SEQ ID NO: 367214 - RNA, 64 nt, Human; identical to SEQ ID NO: 44448

SEQ ID NO: 367215 - RNA, 64 nt, Human; identical to SEQ ID NO: 44449

SEQ ID NO: 367216 - RNA, 64 nt, Human; identical to SEQ ID NO: 44450

SEQ ID NO: 367217 - RNA, 64 nt, Human; identical to SEQ ID NO: 44451

SEQ ID NO: 367218 - RNA, 64 nt, Human; identical to SEQ ID NO: 44452

SEQ ID NO: 367219 - RNA, 64 nt, Human; identical to SEQ ID NO: 44453

SEQ ID NO: 367220 - RNA, 64 nt, Human; identical to SEQ ID NO: 44454

SEQ ID NO: 367221 - RNA, 64 nt, Human; identical to SEQ ID NO: 44455

SEQ ID NO: 367222 - RNA, 64 nt, Human; identical to SEQ ID NO: 44456

SEQ ID NO: 367223 - RNA, 64 nt, Human; identical to SEQ ID NO: 44457

SEQ ID NO: 367224 - RNA, 64 nt, Human; identical to SEQ ID NO: 44458

SEQ ID NO: 367225 - RNA, 64 nt, Human; identical to SEQ ID NO: 44459

SEQ ID NO: 367226 - RNA, 64 nt, Human; identical to SEQ ID NO: 44460

SEQ ID NO: 367227 - RNA, 64 nt, Human; identical to SEQ ID NO: 44461

SEQ ID NO: 367228 - RNA, 64 nt, Human; identical to SEQ ID NO: 44462

SEQ ID NO: 367229 - RNA, 64 nt, Human; identical to SEQ ID NO: 44463

SEQ ID NO: 367230 - RNA, 64 nt, Human; identical to SEQ ID NO: 44464

SEQ ID NO: 367231 - RNA, 64 nt, Human; identical to SEQ ID NO: 44465

SEQ ID NO: 367232 - RNA, 64 nt, Human; identical to SEQ ID NO: 44466

SEQ ID NO: 367233 - RNA, 64 nt, Human; identical to SEQ ID NO: 44467

SEQ ID NO: 367234 - RNA, 64 nt, Human; identical to SEQ ID NO: 44468

SEQ ID NO: 367235 - RNA, 64 nt, Human; identical to SEQ ID NO: 44469

SEQ ID NO: 367236 - RNA, 64 nt, Human; identical to SEQ ID NO: 44470

SEQ ID NO: 367237 - RNA, 64 nt, Human; identical to SEQ ID NO: 44471

SEQ ID NO: 367238 - RNA, 64 nt, Human; identical to SEQ ID NO: 44472

SEQ ID NO: 367239 - RNA, 64 nt, Human; identical to SEQ ID NO: 44473

SEQ ID NO: 367240 - RNA, 64 nt, Human; identical to SEQ ID NO: 44474

SEQ ID NO: 367241 - RNA, 64 nt, Human; identical to SEQ ID NO: 44475

SEQ ID NO: 367242 - RNA, 64 nt, Human; identical to SEQ ID NO: 44476

SEQ ID NO: 367243 - RNA, 64 nt, Human; identical to SEQ ID NO: 44477

SEQ ID NO: 367244 - RNA, 64 nt, Human; identical to SEQ ID NO: 44478

SEQ ID NO: 367245 - RNA, 64 nt, Human; identical to SEQ ID NO: 44479

SEQ ID NO: 367246 - RNA, 64 nt, Human; identical to SEQ ID NO: 44480

SEQ ID NO: 367247 - RNA, 64 nt, Human; identical to SEQ ID NO: 44481

SEQ ID NO: 367248 - RNA, 64 nt, Human; identical to SEQ ID NO: 44482

SEQ ID NO: 367249 - RNA, 64 nt, Human; identical to SEQ ID NO: 44483

SEQ ID NO: 367250 - RNA, 64 nt, Human; identical to SEQ ID NO: 44484

SEQ ID NO: 367251 - RNA, 64 nt, Human; identical to SEQ ID NO: 44485

SEQ ID NO: 367252 - RNA, 64 nt, Human; identical to SEQ ID NO: 44486

SEQ ID NO: 367253 - RNA, 64 nt, Human; identical to SEQ ID NO: 44487

SEQ ID NO: 367254 - RNA, 64 nt, Human; identical to SEQ ID NO: 44488

SEQ ID NO: 367255 - RNA, 64 nt, Human; identical to SEQ ID NO: 44489

SEQ ID NO: 367256 - RNA, 64 nt, Human; identical to SEQ ID NO: 44490

SEQ ID NO: 367257 - RNA, 64 nt, Human; identical to SEQ ID NO: 44491

SEQ ID NO: 367258 - RNA, 54 nt, Human; identical to SEQ ID NO: 44492

SEQ ID NO: 367259 - RNA, 64 nt, Human; identical to SEQ ID NO: 44493

SEQ ID NO: 367260 - RNA, 64 nt, Human; identical to SEQ ID NO: 44494

SEQ ID NO: 367261 - RNA, 64 nt, Human; identical to SEQ ID NO: 44495

SEQ ID NO: 367262 - RNA, 64 nt, Human; identical to SEQ ID NO: 44496

SEQ ID NO: 367263 - RNA, 64 nt, Human; identical to SEQ ID NO: 44497

SEQ ID NO: 367264 - RNA, 64 nt, Human; identical to SEQ ID NO: 44498

SEQ ID NO: 367265 - RNA, 64 nt, Human; identical to SEQ ID NO: 44499

SEQ ID NO: 367266 - RNA, 64 nt, Human; identical to SEQ ID NO: 44500

SEQ ID NO: 367267 - RNA, 64 nt, Human; identical to SEQ ID NO: 44501

SEQ ID NO: 367268 - RNA, 64 nt, Human; identical to SEQ ID NO: 44502

SEQ ID NO: 367269 - RNA, 64 nt, Human; identical to SEQ ID NO: 44503

SEQ ID NO: 367270 - RNA, 64 nt, Human; identical to SEQ ID NO: 44504

SEQ ID NO: 367271 - RNA, 64 nt, Human; identical to SEQ ID NO: 44505

SEQ ID NO: 367272 - RNA, 64 nt, Human; identical to SEQ ID NO: 44506

SEQ ID NO: 367273 - RNA, 64 nt, Human; identical to SEQ ID NO: 44507

SEQ ID NO: 367274 - RNA, 64 nt, Human; identical to SEQ ID NO: 44508

SEQ ID NO: 367275 - RNA, 64 nt, Human; identical to SEQ ID NO: 44509

SEQ ID NO: 367276 - RNA, 64 nt, Human; identical to SEQ ID NO: 44510

SEQ ID NO: 367277 - RNA, 64 nt, Human; identical to SEQ ID NO: 44511

SEQ ID NO: 367278 - RNA, 64 nt, Human; identical to SEQ ID NO: 44512

SEQ ID NO: 367279 - RNA, 64 nt, Human; identical to SEQ ID NO: 44513

SEQ ID NO: 367280 - RNA, 64 nt, Human; identical to SEQ ID NO: 44514

SEQ ID NO: 367281 - RNA, 64 nt, Human; identical to SEQ ID NO: 44515

SEQ ID NO: 367282 - RNA, 64 nt, Human; identical to SEQ ID NO: 44516

SEQ ID NO: 367283 - RNA, 64 nt, Human; identical to SEQ ID NO: 44517

SEQ ID NO: 367284 - RNA, 64 nt, Human; identical to SEQ ID NO: 44518

SEQ ID NO: 367285 - RNA, 64 nt, Human; identical to SEQ ID NO: 44519

SEQ ID NO: 367286 - RNA, 58 nt, Human; identical to SEQ ID NO: 44520

SEQ ID NO: 367287 - RNA, 64 nt, Human; identical to SEQ ID NO: 44521

SEQ ID NO: 367288 - RNA, 64 nt, Human; identical to SEQ ID NO: 44522

SEQ ID NO: 367289 - RNA, 64 nt, Human; identical to SEQ ID NO: 44523

SEQ ID NO: 367290 - RNA, 64 nt, Human; identical to SEQ ID NO: 44524

SEQ ID NO: 367291 - RNA, 64 nt, Human; identical to SEQ ID NO: 44525

SEQ ID NO: 367292 - RNA, 64 nt, Human; identical to SEQ ID NO: 44526

SEQ ID NO: 367293 - RNA, 64 nt, Human; identical to SEQ ID NO: 44527

SEQ ID NO: 367294 - RNA, 64 nt, Human; identical to SEQ ID NO: 44528

SEQ ID NO: 367295 - RNA, 50 nt, Human; identical to SEQ ID NO: 44529

SEQ ID NO: 367296 - RNA, 64 nt, Human; identical to SEQ ID NO: 44530

SEQ ID NO: 367297 - RNA, 64 nt, Human; identical to SEQ ID NO: 44531

SEQ ID NO: 367298 - RNA, 64 nt, Human; identical to SEQ ID NO: 44532

SEQ ID NO: 367299 - RNA, 64 nt, Human; identical to SEQ ID NO: 44533

SEQ ID NO: 367300 - RNA, 64 nt, Human; identical to SEQ ID NO: 44534

SEQ ID NO: 367301 - RNA, 64 nt, Human; identical to SEQ ID NO: 44535

SEQ ID NO: 367302 - RNA, 64 nt, Human; identical to SEQ ID NO: 44536

SEQ ID NO: 367303 - RNA, 64 nt, Human; identical to SEQ ID NO: 44537

SEQ ID NO: 367304 - RNA, 64 nt, Human; identical to SEQ ID NO: 44538

SEQ ID NO: 367305 - RNA, 64 nt, Human; identical to SEQ ID NO: 44539

SEQ ID NO: 367306 - RNA, 64 nt, Human; identical to SEQ ID NO: 44540

SEQ ID NO: 367307 - RNA, 64 nt, Human; identical to SEQ ID NO: 44541

SEQ ID NO: 367308 - RNA, 64 nt, Human; identical to SEQ ID NO: 44542

SEQ ID NO: 367309 - RNA, 64 nt, Human; identical to SEQ ID NO: 44543

SEQ ID NO: 367310 - RNA, 64 nt, Human; identical to SEQ ID NO: 44544

SEQ ID NO: 367311 - RNA, 64 nt, Human; identical to SEQ ID NO: 44545

SEQ ID NO: 367312 - RNA, 64 nt, Human; identical to SEQ ID NO: 44546

SEQ ID NO: 367313 - RNA, 64 nt, Human; identical to SEQ ID NO: 44547

SEQ ID NO: 367314 - RNA, 64 nt, Human; identical to SEQ ID NO: 44548

SEQ ID NO: 367315 - RNA, 64 nt, Human; identical to SEQ ID NO: 44549

SEQ ID NO: 367316 - RNA, 64 nt, Human; identical to SEQ ID NO: 44550

SEQ ID NO: 367317 - RNA, 64 nt, Human; identical to SEQ ID NO: 44551

SEQ ID NO: 367318 - RNA, 64 nt, Human; identical to SEQ ID NO: 44552

SEQ ID NO: 367319 - RNA, 64 nt, Human; identical to SEQ ID NO: 44553

SEQ ID NO: 367320 - RNA, 64 nt, Human; identical to SEQ ID NO: 44554

SEQ ID NO: 367321 - RNA, 64 nt, Human; identical to SEQ ID NO: 44555

SEQ ID NO: 367322 - RNA, 64 nt, Human; identical to SEQ ID NO: 44556

SEQ ID NO: 367323 - RNA, 64 nt, Human; identical to SEQ ID NO: 44557

SEQ ID NO: 367324 - RNA, 64 nt, Human; identical to SEQ ID NO: 44558

SEQ ID NO: 367325 - RNA, 64 nt, Human; identical to SEQ ID NO: 44559

SEQ ID NO: 367326 - RNA, 64 nt, Human; identical to SEQ ID NO: 44560

SEQ ID NO: 367327 - RNA, 64 nt, Human; identical to SEQ ID NO: 44561

SEQ ID NO: 367328 - RNA, 64 nt, Human; identical to SEQ ID NO: 44562

SEQ ID NO: 367329 - RNA, 64 nt, Human; identical to SEQ ID NO: 44563

SEQ ID NO: 367330 - RNA, 64 nt, Human; identical to SEQ ID NO: 44564

SEQ ID NO: 367331 - RNA, 64 nt, Human; identical to SEQ ID NO: 44565

SEQ ID NO: 367332 - RNA, 64 nt, Human; identical to SEQ ID NO: 44566

SEQ ID NO: 367333 - RNA, 64 nt, Human; identical to SEQ ID NO: 44567

SEQ ID NO: 367334 - RNA, 64 nt, Human; identical to SEQ ID NO: 44568

SEQ ID NO: 367335 - RNA, 64 nt, Human; identical to SEQ ID NO: 44569

SEQ ID NO: 367336 - RNA, 64 nt, Human; identical to SEQ ID NO: 44570

SEQ ID NO: 367337 - RNA, 64 nt, Human; identical to SEQ ID NO: 44571

SEQ ID NO: 367338 - RNA, 64 nt, Human; identical to SEQ ID NO: 44572

SEQ ID NO: 367339 - RNA, 64 nt, Human; identical to SEQ ID NO: 44573

SEQ ID NO: 367340 - RNA, 64 nt, Human; identical to SEQ ID NO: 44574

SEQ ID NO: 367341 - RNA, 64 nt, Human; identical to SEQ ID NO: 44575

SEQ ID NO: 367342 - RNA, 64 nt, Human; identical to SEQ ID NO: 44576

SEQ ID NO: 367343 - RNA, 64 nt, Human; identical to SEQ ID NO: 44577

SEQ ID NO: 367344 - RNA, 64 nt, Human; identical to SEQ ID NO: 44578

SEQ ID NO: 367345 - RNA, 64 nt, Human; identical to SEQ ID NO: 44579

SEQ ID NO: 367346 - RNA, 64 nt, Human; identical to SEQ ID NO: 44580

SEQ ID NO: 367347 - RNA, 64 nt, Human; identical to SEQ ID NO: 44581

SEQ ID NO: 367348 - RNA, 64 nt, Human; identical to SEQ ID NO: 44582

SEQ ID NO: 367349 - RNA, 64 nt, Human; identical to SEQ ID NO: 44583

SEQ ID NO: 367350 - RNA, 64 nt, Human; identical to SEQ ID NO: 44584

SEQ ID NO: 367351 - RNA, 64 nt, Human; identical to SEQ ID NO: 44585

SEQ ID NO: 367352 - RNA, 64 nt, Human; identical to SEQ ID NO: 44586

SEQ ID NO: 367353 - RNA, 64 nt, Human; identical to SEQ ID NO: 44587

SEQ ID NO: 367354 - RNA, 64 nt, Human; identical to SEQ ID NO: 44588

SEQ ID NO: 367355 - RNA, 64 nt, Human; identical to SEQ ID NO: 44589

SEQ ID NO: 367356 - RNA, 64 nt, Human; identical to SEQ ID NO: 44590

SEQ ID NO: 367357 - RNA, 64 nt, Human; identical to SEQ ID NO: 44591

SEQ ID NO: 367358 - RNA, 64 nt, Human; identical to SEQ ID NO: 44592

SEQ ID NO: 367359 - RNA, 64 nt, Human; identical to SEQ ID NO: 44593

SEQ ID NO: 367360 - RNA, 64 nt, Human; identical to SEQ ID NO: 44594

SEQ ID NO: 367361 - RNA, 64 nt, Human; identical to SEQ ID NO: 44595

SEQ ID NO: 367362 - RNA, 64 nt, Human; identical to SEQ ID NO: 44596

SEQ ID NO: 367363 - RNA, 64 nt, Human; identical to SEQ ID NO: 44597

SEQ ID NO: 367364 - RNA, 64 nt, Human; identical to SEQ ID NO: 44598

SEQ ID NO: 367365 - RNA, 64 nt, Human; identical to SEQ ID NO: 44599

SEQ ID NO: 367366 - RNA, 64 nt, Human; identical to SEQ ID NO: 44600

SEQ ID NO: 367367 - RNA, 64 nt, Human; identical to SEQ ID NO: 44601

SEQ ID NO: 367368 - RNA, 64 nt, Human; identical to SEQ ID NO: 44602

SEQ ID NO: 367369 - RNA, 64 nt, Human; identical to SEQ ID NO: 44603

SEQ ID NO: 367370 - RNA, 64 nt, Human; identical to SEQ ID NO: 44604

SEQ ID NO: 367371 - RNA, 64 nt, Human; identical to SEQ ID NO: 44605

SEQ ID NO: 367372 - RNA, 64 nt, Human; identical to SEQ ID NO: 44606

SEQ ID NO: 367373 - RNA, 64 nt, Human; identical to SEQ ID NO: 44607

SEQ ID NO: 367374 - RNA, 64 nt, Human; identical to SEQ ID NO: 44608

SEQ ID NO: 367375 - RNA, 64 nt, Human; identical to SEQ ID NO: 44609

SEQ ID NO: 367376 - RNA, 64 nt, Human; identical to SEQ ID NO: 44610

SEQ ID NO: 367377 - RNA, 64 nt, Human; identical to SEQ ID NO: 44611

SEQ ID NO: 367378 - RNA, 64 nt, Human; identical to SEQ ID NO: 44612

SEQ ID NO: 367379 - RNA, 64 nt, Human; identical to SEQ ID NO: 44613

SEQ ID NO: 367380 - RNA, 64 nt, Human; identical to SEQ ID NO: 44614

SEQ ID NO: 367381 - RNA, 64 nt, Human; identical to SEQ ID NO: 44615

SEQ ID NO: 367382 - RNA, 64 nt, Human; identical to SEQ ID NO: 44616

SEQ ID NO: 367383 - RNA, 64 nt, Human; identical to SEQ ID NO: 44617

SEQ ID NO: 367384 - RNA, 64 nt, Human; identical to SEQ ID NO: 44618

SEQ ID NO: 367385 - RNA, 64 nt, Human; identical to SEQ ID NO: 44619

SEQ ID NO: 367386 - RNA, 64 nt, Human; identical to SEQ ID NO: 44620

SEQ ID NO: 367387 - RNA, 64 nt, Human; identical to SEQ ID NO: 44621

SEQ ID NO: 367388 - RNA, 64 nt, Human; identical to SEQ ID NO: 44622

SEQ ID NO: 367389 - RNA, 64 nt, Human; identical to SEQ ID NO: 44623

SEQ ID NO: 367390 - RNA, 64 nt, Human; identical to SEQ ID NO: 44624

SEQ ID NO: 367391 - RNA, 64 nt, Human; identical to SEQ ID NO: 44625

SEQ ID NO: 367392 - RNA, 64 nt, Human; identical to SEQ ID NO: 44626

SEQ ID NO: 367393 - RNA, 64 nt, Human; identical to SEQ ID NO: 44627

SEQ ID NO: 367394 - RNA, 64 nt, Human; identical to SEQ ID NO: 44628

SEQ ID NO: 367395 - RNA, 64 nt, Human; identical to SEQ ID NO: 44629

SEQ ID NO: 367396 - RNA, 64 nt, Human; identical to SEQ ID NO: 44630

SEQ ID NO: 367397 - RNA, 64 nt, Human; identical to SEQ ID NO: 44631

SEQ ID NO: 367398 - RNA, 64 nt, Human; identical to SEQ ID NO: 44632

SEQ ID NO: 367399 - RNA, 64 nt, Human; identical to SEQ ID NO: 44633

SEQ ID NO: 367400 - RNA, 64 nt, Human; identical to SEQ ID NO: 44634

SEQ ID NO: 367401 - RNA, 64 nt, Human; identical to SEQ ID NO: 44635

SEQ ID NO: 367402 - RNA, 64 nt, Human; identical to SEQ ID NO: 44636

SEQ ID NO: 367403 - RNA, 64 nt, Human; identical to SEQ ID NO: 44637

SEQ ID NO: 367404 - RNA, 64 nt, Human; identical to SEQ ID NO: 44638

SEQ ID NO: 367405 - RNA, 64 nt, Human; identical to SEQ ID NO: 44639

SEQ ID NO: 367406 - RNA, 64 nt, Human; identical to SEQ ID NO: 44640

SEQ ID NO: 367407 - RNA, 64 nt, Human; identical to SEQ ID NO: 44641

SEQ ID NO: 367408 - RNA, 64 nt, Human; identical to SEQ ID NO: 44642

SEQ ID NO: 367409 - RNA, 64 nt, Human; identical to SEQ ID NO: 44643

SEQ ID NO: 367410 - RNA, 64 nt, Human; identical to SEQ ID NO: 44644

SEQ ID NO: 367411 - RNA, 64 nt, Human; identical to SEQ ID NO: 44645

SEQ ID NO: 367412 - RNA, 64 nt, Human; identical to SEQ ID NO: 44646

SEQ ID NO: 367413 - RNA, 64 nt, Human; identical to SEQ ID NO: 44647

SEQ ID NO: 367414 - RNA, 64 nt, Human; identical to SEQ ID NO: 44648

SEQ ID NO: 367415 - RNA, 64 nt, Human; identical to SEQ ID NO: 44649

SEQ ID NO: 367416 - RNA, 64 nt, Human; identical to SEQ ID NO: 44650

SEQ ID NO: 367417 - RNA, 64 nt, Human; identical to SEQ ID NO: 44651

SEQ ID NO: 367418 - RNA, 64 nt, Human; identical to SEQ ID NO: 44652

SEQ ID NO: 367419 - RNA, 64 nt, Human; identical to SEQ ID NO: 44653

SEQ ID NO: 367420 - RNA, 64 nt, Human; identical to SEQ ID NO: 44654

SEQ ID NO: 367421 - RNA, 64 nt, Human; identical to SEQ ID NO: 44655

SEQ ID NO: 367422 - RNA, 64 nt, Human; identical to SEQ ID NO: 44656

SEQ ID NO: 367423 - RNA, 60 nt, Human
ccugcuauauuaucaagcuuaccuacuguuaucucuaaaauuuuuuuuguguuaauguaa

SEQ ID NO: 367424 - RNA, 60 nt, Human
uuaccuaguggcccuucacacaacuuuugaaucucuaaaaauccauaaaauccuuaaaga

SEQ ID NO: 367425 - RNA, 60 nt, Human
ccagggucuccaauuuaggcuuucaacauuaucucuaaagaagguuauacauuaugucgg

SEQ ID NO: 367426 - RNA, 60 nt, Human
uuucuugcaguuaauguaagaauacuuuaaaucucuaagcuucugaaguguuagagguag

SEQ ID NO: 367427 - RNA, 60 nt, Human
cuuuaucuucuaugaagggucuguaaugaaaucucuaaauaauuuuuaaaaauuguucau

SEQ ID NO: 367428 - RNA, 60 nt, Human
guuucuucaucugugaaauguuucuaaacaaucucuaagucccuuccuucucuaauauac

SEQ ID NO: 367429 - RNA, 60 nt, Human
acccaccuaucccugcagcuaauuuagcugaucucuaauuuaacugagcucuaauuuagc

SEQ ID NO: 367430 - RNA, 60 nt, Human
aaguaaaaccucuggagaccuaucuuuaagaucucuaauuggaauuauaaauuauuuuug

SEQ ID NO: 367431 - RNA, 60 nt, Human
uuauaguugcucuauguuuguaaacagacaaucucuaaugucugauuauuuguaucacag

SEQ ID NO: 367432 - RNA, 60 nt, Human
aagguuugcuauuuguaaaaaauuucauuuaucucuaauaugcuuaugugauugccccua

SEQ ID NO: 367433 - RNA, 60 nt, Human
gucuguaaaaugaguucuuugaaauggaugaucucuaagggcaccaaaucugguauucua

SEQ ID NO: 367434 - RNA, 60 nt, Human
uucauucaucucagacuuguuauuucacucaucucuaauaaaggauuggggggucaguuu

SEQ ID NO: 367435 - RNA, 60 nt, Human
aaugaguagcuagguaggggcaggugggugaucucuaagcugcaaaaacugugcuguccu

SEQ ID NO: 367436 - RNA, 60 nt, Human
uugggcuaauugaugagcaucuuauuucuuaucucuaaaaauuaucagcaaaggcuacuu

SEQ ID NO: 367437 - RNA, 60 nt, Human
uuuuaugaaaaagagugccagucuuuggucaucucuaaacaaggcuuaucaccaauggag

SEQ ID NO: 367438 - RNA, 60 nt, Human
aaacauucuauaucgguauguagcagaccaaucucuaaaauagcuaauucuucaauaaaa

SEQ ID NO: 367439 - RNA, 60 nt, Human
aaccagagugaucaaguuaaaccauacacuaucucuaaguaacgaaggagcuauuggacu

SEQ ID NO: 367440 - RNA, 60 nt, Human
guugaaacagggugugucauaaagucaguuaucucuaauaacuuaagauggucugaguug

SEQ ID NO: 367441 - RNA, 60 nt, Human
cucugaacagauuacuaaggccaucuccucaucucuaagggagaaaaauagucuguagau

SEQ ID NO: 367442 - RNA, 60 nt, Human
uuuccuaugguauaucuccuuaccagaaaaaucucuaaauaaaaaaagguuuaaagaaaa

SEQ ID NO: 367443 - RNA, 60 nt, Human
uugaucauaagccgcuuauuuauaucauguaucucuaaggaccuaaaagcacuuuaugua

SEQ ID NO: 367444 - RNA, 60 nt, Human
uuauuucaguaaaaccaucuuucuggccaaaucucuaacacguuuuuuacuucaguagug

SEQ ID NO: 367445 - RNA, 60 nt, Human
aagggagaguagauggugcaaagcaagcccaucucuaaguagaaaaaucacccagagcac

SEQ ID NO: 367446 - RNA, 60 nt, Human
auauuuugacauuuauugugauuuuuuucuaucucuaaucuauugagauagucacauucc

SEQ ID NO: 367447 - RNA, 60 nt, Human
uuuucuccacuuuguuggaaagcagguggcaucucuaauuggaagaaauuccuguagcau

SEQ ID NO: 367448 - RNA, 60 nt, Human
ccaguacaguuguuuggccuaccugaugcuaucucuaaacuacuuuuaaaaugaagacau

SEQ ID NO: 367449 - RNA, 60 nt, Human
accacuaaccagaaacauuacuuuggaugcaucucuaauaccauguuugagcaccucugc

SEQ ID NO: 367450 - RNA, 60 nt, Human
agcugaauaaacucagucaccugguuucccaucucuaagccccuuaaccugcagcuucgu

SEQ ID NO: 367451 - RNA, 60 nt, Human
agacauuuuucuuaauauccuuuuugucccaucucuaaaauguauaaauauuuugauuug

SEQ ID NO: 367452 - RNA, 60 nt, Human
auucugguucugacagggccacaagcuaggaucucuaacaaacgcagaaggcuuuggcuc

SEQ ID NO: 367453 - RNA, 60 nt, Human
gcuuuucauguaaagauaagaucuuuagcuaucucuaacccuguccuuuuuucacugcau

SEQ ID NO: 367454 - RNA, 60 nt, Human
uccacauucaaacugaagaggaaaauugaaaucucuaaugaagcugcuguguguauuuau

SEQ ID NO: 367455 - RNA, 60 nt, Human
acauucacuucuguaguaugguuuccaccuaucucuaacaccacuauuaagguacaccag

SEQ ID NO: 367456 - RNA, 60 nt, Human
cacuaggaauucuguguuaguuuaaaagagaucucuaaaacuuccccaucccuuugggcc

SEQ ID NO: 367457 - RNA, 60 nt, Human
cccacaaauagaggauuacucuuccccugaaucucuaaacucagaaacaauuaccaaaaa

SEQ ID NO: 367458 - RNA, 60 nt, Human
guugaguuguuaacaguguucuuugaaagaaucucuaaaaggcuuauaaauguuugaaau

SEQ ID NO: 367459 - RNA, 60 nt, Human
uaucaaaaaauugcccuaugaaaacuuuaaaucucuaaaacauuugaaauacuaccauau

SEQ ID NO: 367460 - RNA, 60 nt, Human
cacaccagccuggggauagagugagaucccaucucuaaaaaaugaaaaaaagaagagagg

SEQ ID NO: 367461 - RNA, 60 nt, Human
uuucucauucaguuggauccagaaaccaguaucucuaaaaacaaccucucauaccuugug

SEQ ID NO: 367462 - RNA, 60 nt, Human
guuuucagacaaagcacugaauuugaaauaaucucuaacucaguacaauuuggacuauug

SEQ ID NO: 367463 - RNA, 60 nt, Human
ugagcuuaacccuggaaaaugaaucccucuaucucuaaagaaaaucucugugaaaccccu

SEQ ID NO: 367464 - RNA, 60 nt, Human
agccagagugaaugauacuacaaguugagcaucucuaauucaaaaaucugaaauccagaa

SEQ ID NO: 367465 - RNA, 60 nt, Human
uuugucuuucaagugaaaccagcuuccuucaucucuaaggcuaaggauagggaaagggug

SEQ ID NO: 367466 - RNA, 60 nt, Human
uuuuaauguugauaauucuguuauuuacauaucucuaauuuacuuugaaauucaaaggug

SEQ ID NO: 367467 - RNA, 60 nt, Human
aagguacagaacaaaucauagggguuuuuaaucucuaaaauuucuacaguaguacaggaa

SEQ ID NO: 367468 - RNA, 60 nt, Human
uuuucugaaucuugccuagguguuucauuuaucucuaaaauucuaaaaagcauaaaucau

SEQ ID NO: 367469 - RNA, 60 nt, Human
ggaaauuucauuucaaauauguuuuaauguaucucuaaugcauuugaagacuuauuacau

SEQ ID NO: 367470 - RNA, 60 nt, Human
caguaagcagaacaaucagaauggaauuaaaucucuaaaaacguguuacaguggaaucug

SEQ ID NO: 367471 - RNA, 60 nt, Human
aagccccagggacugcaaguggccauuaccaucucuaaggagagcucugauugcagguga

SEQ ID NO: 367472 - RNA, 60 nt, Human
auaaacaaggagaguuuuugugugugcgagaucucuaagccagcgugggagggagcgccu

SEQ ID NO: 367473 - RNA, 60 nt, Human
ccuuucaucuggggcacagccacaagucucaucucuaacguucuaugcaaugaaauauaa

SEQ ID NO: 367474 - RNA, 60 nt, Human
gccucagcuuucccaucugcacccugcagcaucucuaagggccccuccagcauagguggu

SEQ ID NO: 367475 - RNA, 60 nt, Human
agcuauuuaaaacuauggcaauacuuaagcaucucuaaauuuaggugcuaaauaucuauu

SEQ ID NO: 367476 - RNA, 60 nt, Human
uuguagacacguuaguuauaaucaccuuguaucucuaaauauggugugauaugaaccagu

SEQ ID NO: 367477 - RNA, 60 nt, Human
uucuacacauauauguauauguauaucuauaucucuaaacugcuguuaauugauuaaaau

SEQ ID NO: 367478 - RNA, 60 nt, Human
ucccaaauacuuuauaagaguuuaucagacaucucuaauuuggccauguccaguuuauac

SEQ ID NO: 367479 - RNA, 60 nt, Human
ucuuuggaguugucacaucagauaagacauaucucuaauuccauccauaaauccaguucu

SEQ ID NO: 367480 - RNA, 60 nt, Human
ccuuucccuccaacggggaaagccaacuccaucucuaagugccgaacucaucccuguucc

SEQ ID NO: 367481 - RNA, 60 nt, Human
uauuguaaugaaaaagaaagacugggauuaaucucuaaucaggugaguagaccaugagac

SEQ ID NO: 367482 - RNA, 60 nt, Human
caaugucgaaaccuacaagauuuccuuaaaaucucuaauagaggcauuacuugcuuucaa

SEQ ID NO: 367483 - RNA, 60 nt, Human
gaagcacuggcaaaaauguuuaaaaugcuuaucucuaagaugucuauuauaugcucuguc

SEQ ID NO: 367484 - RNA, 60 nt, Human
uagagugcuuuuuguagugagcuaaccuugaucucuaaggacuaacuacccagguccagg

SEQ ID NO: 367485 - RNA, 60 nt, Human
agguaucucuguauguacugauaucaaaacaucucuaagauacaguauuuaguaaaagag

SEQ ID NO: 367486 - RNA, 60 nt, Human
agaugccuuauauauaaaauaaguugccagaucucuaagauugccuaguacaccuuugua

SEQ ID NO: 367487 - RNA, 60 nt, Human
guaugauguuucccauucauacaccuauaaaucucuaacaagaggcccuuugaacugccu

SEQ ID NO: 367488 - RNA, 60 nt, Human
auggaauauauuuuaauaaaaacaaauaauaucucuaauauauccacacauuuguugcca

SEQ ID NO: 367489 - RNA, 60 nt, Human
gauuggcauuugaaguauugaguguaugggaucucuaaggauuucuuagauuuuauauuu

SEQ ID NO: 367490 - RNA, 60 nt, Human
ucauuauguugauacuagcauacuuaaaauaucucuaaaauagguaaauguauuuaauuc

SEQ ID NO: 367491 - RNA, 60 nt, Human
aaggaacauaguugaaugacauuucuaguaaucucuaauuccagugucuuuacacagcaa

SEQ ID NO: 367492 - RNA, 60 nt, Human
cauuaauuaaugagacacacuuaacuacuuaucucuaaaccaucuaugugaauauuugua

SEQ ID NO: 367493 - RNA, 60 nt, Human
uugcauaucuaugaauguuaaauucagaauaucucuaaaacauggaaaauugauguuuca

SEQ ID NO: 367494 - RNA, 60 nt, Human
caccaaagaucaguuauaggauaaaauggcaucucuaaccauaacacaggagaauuggaa

SEQ ID NO: 367495 - RNA, 60 nt, Human
uauuguuguuguuguuauauccauacuuuuaucucuaaugaaauguaguuggguucuucc

SEQ ID NO: 367496 - RNA, 60 nt, Human
ugagaacugcccgauacacggcaucaucccaucucuaauuuccccucuguccuccaucca

SEQ ID NO: 367497 - RNA, 60 nt, Human
gauggucaaaugccuuacaucuuuucugauaucucuaaaaugcuguuaaguucuggagaa

SEQ ID NO: 367498 - RNA, 60 nt, Human
acuagaguugaugcuuaaugugauagagacaucucuaaaguauuuugaauuuuaaaaaaa

SEQ ID NO: 367499 - RNA, 60 nt, Human
ugggucagcuccucagaaccaacccccagcaucucuaaagcaaaagccucaccucaaggg

SEQ ID NO: 367500 - RNA, 60 nt, Human
cucauuuuaaaggacuagcuaagaugcucaaucucuaaaaaaaaaaggaucuguauucgu

SEQ ID NO: 367501 - RNA, 60 nt, Human
cugggcuuauaucuaauaauacagagcacuaucucuaaccucaacaguugacauuuuaaa

SEQ ID NO: 367502 - RNA, 60 nt, Human
cucaggggaaggauuugcauuuugagcuuuaucucuaaaugugacaugcaaagauuauuc

SEQ ID NO: 367503 - RNA, 60 nt, Human
aacaucugaaauucugcugucaagauucccaucucuaaggacuccaagugcuagagacaa

SEQ ID NO: 367504 - RNA, 60 nt, Human
uacuuuaagaaagaagagaagaaaacuaguaucucuaagcgguaacuauggcaauuuugc

SEQ ID NO: 367505 - RNA, 60 nt, Human
aaaucaucuaauuucucagaacuuuuucuuaucucuaacacaguuauuaccauaauaaua

SEQ ID NO: 367506 - RNA, 60 nt, Human
aucaauuaaugacaauuacaaaccuacuguaucucuaauacagugugacuggucagguau

SEQ ID NO: 367507 - RNA, 60 nt, Human
auuuuuguuuauggaucugauaaaaucuagaucucuaauauuuuuaagcccaagccccuu

SEQ ID NO: 367508 - RNA, 60 nt, Human
uuuuuuagaauagcugauauuuugauaacaaucucuaauuugcaugggcaccacauuucu

SEQ ID NO: 367509 - RNA, 60 nt, Human
aaauaagagucaaauaccuugauguuugugaucucuaacucaaaaaauuugaaguguuuu

SEQ ID NO: 367510 - RNA, 60 nt, Human
cacuguuuauauaagauccaaucucucaccaucucuaaagcagccguuggccugucauca

SEQ ID NO: 367511 - RNA, 60 nt, Human
gucuuuuuaggacuggacacaaggaaaauaaucucuaaacuauugacuaaauuccaguga

SEQ ID NO: 367512 - RNA, 60 nt, Human
aucaccuuuaaauuaccagaaucuucacucaucucuaaguaaaccuuucccgggacuuuu

SEQ ID NO: 367513 - RNA, 60 nt, Human
cuucuuuaaggagccacggaagaaaugauaaucucuaaauaugauccuaucuuuugaaaa

SEQ ID NO: 367514 - RNA, 60 nt, Human
gaagaaugaagaccacuggacucuccguuaaucucuaaggggucugcuccccaggaacgu

SEQ ID NO: 367515 - RNA, 60 nt, Human
cuucauagcagccuaggaaaccuuaaccauaucucuaacaccacacagaaagaggcugga

SEQ ID NO: 367516 - RNA, 60 nt, Human
uguuaauaaaugagauugaaauuuuuuaugaucucuaaaccauaaaagaaaacaccgaca

SEQ ID NO: 367517 - RNA, 60 nt, Human
aucugugaaaugaaaggguugaauugauggaucucuaaaggcuuuuguccucuaugagga

SEQ ID NO: 367518 - RNA, 60 nt, Human
cagguggcuagcaaauuagaaacaccauucaucucuaacauaugauacugaugccaugua

SEQ ID NO: 367519 - RNA, 60 nt, Human
uccucucacuaaacuuuacccaaaaacuaaaucucuaauauggcaaaaauggcuagacac

SEQ ID NO: 367520 - RNA, 60 nt, Human
gaccagacuggccaacacagcgagacccccaucucuaaaaaaaaaaaaauuaauaagaca

SEQ ID NO: 367521 - RNA, 60 nt, Human
augugaugcaguguaagaaggaaaauacucaucucuaacauuaugguaauaacauuuagc

SEQ ID NO: 367522 - RNA, 60 nt, Human
caagaauuuuuuuuuaagggccuuggagccaucucuaaaacaaaccucaagggauuuagu

SEQ ID NO: 367523 - RNA, 60 nt, Human
acuggaauagggcugaauaaauguguuugaaucucuaauuuuauacuuucuuuuccugag

SEQ ID NO: 367524 - RNA, 60 nt, Human
uuuuacauaaaaucaaggagacugcugaaaaucucuaagggacaggauuuuccagauccu

SEQ ID NO: 367525 - RNA, 60 nt, Human
aagcgguugcauuuuuuucuguuuguuucaaucucuaaucuuuaagucagaaccuaauug

SEQ ID NO: 367526 - RNA, 60 nt, Human
gccuccuugugucuugguuuugguuucuucaucucuaaguaauuauaucugucauuauug

SEQ ID NO: 367527 - RNA, 60 nt, Human
ugcuucauguuauuuaaccagaaaugucuuaucucuaaaaauuuuuaguaguaauuauuu

SEQ ID NO: 367528 - RNA, 60 nt, Human
auuuuauaauucaccacuuaauugguuagaaucucuaacugagcaccuuuuaaaccugcu

SEQ ID NO: 367529 - RNA, 60 nt, Human
accccacaucucugggcuuugugccagaccaucucuaacuuaauccucucaucccuguuc

SEQ ID NO: 367530 - RNA, 60 nt, Human
gaguuuuuaaaaaucaaagugauuuugaaaaucucuaauggcucagaaaauaaaaacauc

SEQ ID NO: 367531 - RNA, 60 nt, Human
acuacuaacaaacaggccugcugcuagaugaucucuaaugaccaauggggcuuccuuucu

SEQ ID NO: 367532 - RNA, 60 nt, Human
cuucccuauacaauuguuaaugcacaaaugaucucuaauauauacuuacauacguaaaau

SEQ ID NO: 367533 - RNA, 60 nt, Human
auucaguaacauuuggcuuccaaaacugcuaucucuaauacgguaccaauccuaggaacu

SEQ ID NO: 367534 - RNA, 60 nt, Human
cucaggguucccagagcucauuccccaggaaucucuaagaccagggcuggggcagugucu

SEQ ID NO: 367535 - RNA, 60 nt, Human
acuccagccugggcaacagagcgagacuccaucucuaaauaaauaaauaaauaaauaaau

SEQ ID NO: 367536 - RNA, 60 nt, Human
uagaaaaaaaggaguugacccauauaaauuaucucuaacgucuuuguuguuuauggaaaa

SEQ ID NO: 367537 - RNA, 60 nt, Human
cucucaggaguaucuuaccuguaaagucuaaucucuaaaucaaguauuuauuauugaaga

SEQ ID NO: 367538 - RNA, 60 nt, Human
ucaaggcaggcagcccaggcccugggccugaucucuaaccccgucaugcugcugcugacc

SEQ ID NO: 367539 - RNA, 60 nt, Human
cuuuuauuuuuaaacgauuuaucaaaauucaucucuaaauuuuacauguagaaacauaaa

SEQ ID NO: 367540 - RNA, 60 nt, Human
cacaaauggugaaaucaguagucucgcuccaucucuaauagacuaaaccuaaaugccucu

SEQ ID NO: 367541 - RNA, 60 nt, Human
ucauagugguggguuuuuaagucuuaaccaaucucuaagguuuguuucuccugcaaggga

SEQ ID NO: 367542 - RNA, 60 nt, Human
ugguugcugcucacuaaaguuguuccccugaucucuaaauauggaggucauuaccaagaa

SEQ ID NO: 367543 - RNA, 60 nt, Human
gucuaacuacagcaguaguuuuucauauauaucucuaaaacauuuuguuauauugaaaaa

SEQ ID NO: 367544 - RNA, 60 nt, Human
auuaauuaauuaacucaaauacugugaacuaucucuaaaacacuagaaaaaagaaauguu

SEQ ID NO: 367545 - RNA, 60 nt, Human
gagaaguacuguaagcaguaccuagaaauaaucucuaaaauugcuauccugauaauuuug

SEQ ID NO: 367546 - RNA, 60 nt, Human
ggcugaaaccaccauuacuuuggcuguuucaucucuaagagaguguagaaugcuuucaca

SEQ ID NO: 367547 - RNA, 60 nt, Human
aaauaaaaugguguaaauaaagaccuugcuaucucuaaauuauggauguuaaagauuuga

SEQ ID NO: 367548 - RNA, 60 nt, Human
augaguguauauauauaucuguguguguguaucucuaacgucaguguauaaguaaguugg

SEQ ID NO: 367549 - RNA, 60 nt, Human
aaauuggccauuagugcauuuauugagaugaucucuaaagagcuaugcccugaccuaccc

SEQ ID NO: 367550 - RNA, 60 nt, Human
gcagauuauaauuuugucagcaaugcuauuaucucuaauuagugccaccagacuagaccu

SEQ ID NO: 367551 - RNA, 60 nt, Human
uuauuccaauggcggaugguaauauucaccaucucuaauucauuggucacugguagguaa

SEQ ID NO: 367552 - RNA, 60 nt, Human
acacacaauauguauuccuagcaaaauaaaaucucuaagguacuugguuauccagugcag

SEQ ID NO: 367553 - RNA, 60 nt, Human
acgaauaugaaugucacauuugaauucuugaucucuaaugagcuagugucuuauggucuu

SEQ ID NO: 367554 - RNA, 60 nt, Human
ggcagauuuuggucaucuuucugugaaaguaucucuaacugaauccacuucuuaaacaaa

SEQ ID NO: 367555 - RNA, 60 nt, Human
acuuaucaaaaaggcaggaaaguagguaugaucucuaaaguaaaaaaaaaaaaaaaaaaa

SEQ ID NO: 367556 - RNA, 60 nt, Human
uaguugaguuuuuaauguuuacauguuuacaucucuaaauaaaauuugcuuauuugaaau

SEQ ID NO: 367557 - RNA, 60 nt, Human
aagauuucccuaaaaauuccaccaggauuaaucucuaaaauucuagucucugauuugcaa

SEQ ID NO: 367558 - RNA, 60 nt, Human
cauggcuaucgucaggccuguugccuggagaucucuaaguuaaggcaacaagacuuaaag

SEQ ID NO: 367559 - RNA, 60 nt, Human
cuuuggaaugguguaggaaaaaugcaagccaucucuaauaauaagucaguguuaaaauuu

SEQ ID NO: 367560 - RNA, 60 nt, Human
gauauacauucauccuaguauaaauaaauaaucucuaaguuuucugaaauggaauauuua

SEQ ID NO: 367561 - RNA, 60 nt, Human
uuuuuuaaauucacauuuuauacuuauaugaucucuaaagcucuugcuauguugcuauaa

SEQ ID NO: 367562 - RNA, 60 nt, Human
auuaucuucauuuaucaauuacagcuucguaucucuaauuuauggucuauauaccaauuu

SEQ ID NO: 367563 - RNA, 60 nt, Human
cgugggagggcucuuccuaaagggacccccaucucuaagucacucugaaagggaguugug

SEQ ID NO: 367564 - RNA, 60 nt, Human
acuuccuuagucucugagcaucaggucuucaucucuaagauagagcaagaugagcaccua

SEQ ID NO: 367565 - RNA, 60 nt, Human
uuaaucucaaggguuuuuuguaccacuauaaucucuaauacuuacucagaauuacugugu

SEQ ID NO: 367566 - RNA, 60 nt, Human
aauggcagucagaauguuaacccuggauccaucucuaaguagagagagggugcccauugc

SEQ ID NO: 367567 - RNA, 60 nt, Human
aacagaagcaaaaauaagaaaauuaaaauaaucucuaauccuacuaccuagaauaaaaca

SEQ ID NO: 367568 - RNA, 60 nt, Human
gauuuccuuuuucaacuguuccaggaaagaaucucuaagacuggguagcucacagccagc

SEQ ID NO: 367569 - RNA, 60 nt, Human
gcauagcccgagggcuggaaaaacgcuuucaucucuaaaacugagaaaucaucauaauug

SEQ ID NO: 367570 - RNA, 60 nt, Human
guuuuuccuuuuaagaaguauguccuuuguaucucuaaguuacaugaccuauaucuuuuc

SEQ ID NO: 367571 - RNA, 60 nt, Human
acuccagccugggcaacauagcaagacuccaucucuaaguaaaaaaauacaacaguagaa

SEQ ID NO: 367572 - RNA, 60 nt, Human
acaaaggcuugcaaagauaggagaggcuccaucucuaaugcauguagaagcuccuuacgg

SEQ ID NO: 367573 - RNA, 60 nt, Human
aaauaguuagauaaugagaaguuguuaauuaucucuaaaauuggaauuaggaagcauauc

SEQ ID NO: 367574 - RNA, 60 nt, Human
uccugauuucucuugcuuaauccagucuuuaucucuaacugccccuuauuugaucaccau

SEQ ID NO: 367575 - RNA, 60 nt, Human
uaaauuuuucuuaacauuccaagauuucagaucucuaaaucacaaagagaaaucuuggca

SEQ ID NO: 367576 - RNA, 60 nt, Human
uuuguucgcaguguagcugaaauacugucuaucucuaauaaaaacaggaggaaacaagau

SEQ ID NO: 367577 - RNA, 60 nt, Human
aucaucucucucaaguucgaaguuccacaaaucucuaaggcaagggaaagaugcugccag

SEQ ID NO: 367578 - RNA, 60 nt, Human
uuagacaggcaucuauuuggaccuguuucuaucucuaaaugaauuuuuggaaacauuaau

SEQ ID NO: 367579 - RNA, 60 nt, Human
gauauuaaagguguuagcugauuguauuuuaucucuaaagauuuagaacuuuagaaaaug

SEQ ID NO: 367580 - RNA, 60 nt, Human
aauccaucguggacaacauagcaagauuccaucucuaaaaaaaaugaaaauaaacauaag

SEQ ID NO: 367581 - RNA, 60 nt, Human
ucauuuugauaauuggccuuuaauauuuguaucucuaauuuuauuuucucucuguuacug

SEQ ID NO: 367582 - RNA, 60 nt, Human
cggggaguaaaugucacuucagcuugccgcaucucuaaauaggcaaauuuucagugcuca

SEQ ID NO: 367583 - RNA, 60 nt, Human
acuuaugcagaacuggcaacuuacuacugaaucucuaaucaauguucaucauguaucgcu

SEQ ID NO: 367584 - RNA, 60 nt, Human
auuuuuaagaguccauguuuugugacaaccaucucuaauagccaacucuuuauuaaacac

SEQ ID NO: 367585 - RNA, 60 nt, Human
uuagacauucaucacuggcauauuuagaauaucucuaaaaggacuuguuuguagaauaag

SEQ ID NO: 367586 - RNA, 60 nt, Human
caauaacuuguuucccaggccuauuaggccaucucuaaaauugaucuagcuguuuuauuu

SEQ ID NO: 367587 - RNA, 60 nt, Human
acccugaggguggccaggaucuggagcugcaucucuaaggggccaggcuuuggggaccau

SEQ ID NO: 367588 - RNA, 60 nt, Human
ggucagcuuggcuauggagugguggcaauaaucucuaaacauuccaaaagaccaugagcu

SEQ ID NO: 367589 - RNA, 60 nt, Human
ucauuucauuuaagagaucauuucauuaagaucucuaaucuguuuugagucuuuacaaaa

SEQ ID NO: 367590 - RNA, 60 nt, Human
ggaaccagaaugcuuagaguucauaaaauaaucucuaaaccauguuagguuaaaacaaaa

SEQ ID NO: 367591 - RNA, 60 nt, Human
guaauaaauuguuauuuucgcacaaugggaaucucuaaugugaaaauguauucuaugaaa

SEQ ID NO: 367592 - RNA, 60 nt, Human
ggugccgccucagguuaggggcucucagccaucucuaaccucugcccucgcugcucuugg

SEQ ID NO: 367593 - RNA, 60 nt, Human
uuuauuauuauuucagaacuagcucagcccaucucuaauuauaaaacaugguuuuguuuu

SEQ ID NO: 367594 - RNA, 60 nt, Human
cuuuuaguuaugggcucaaagaauuuauucaucucuaacaugauauuggaaaauaaugga

SEQ ID NO: 367595 - RNA, 60 nt, Human
aauggaccuuaagaaacuauuuacucuguaaucucuaauaaaauauggaauuccauauua

SEQ ID NO: 367596 - RNA, 60 nt, Human
uugaagaauguuagaguaaugaaauggaggaucucuaaagagcaucugauucuuguugcu

SEQ ID NO: 367597 - RNA, 60 nt, Human
uuuuguguuguacaauuaaguuacaauuacaucucuaauuuuggauaauauucauugguu

SEQ ID NO: 367598 - RNA, 60 nt, Human
agaugggguuucaccauauuggccaggcugaucucuaacuccuggccucaagugaucuau

SEQ ID NO: 367599 - RNA, 60 nt, Human
acuacucacuaucaauucauccccauaugaaucucuaaccauauuguaucucucccacug

SEQ ID NO: 367600 - RNA, 60 nt, Human
acguuaucauacugagguguuagaucaaauaucucuaauugaagaacaugugagguugaa

SEQ ID NO: 367601 - RNA, 60 nt, Human
acuccagccugggagauagagcaagacuccaucucuaaaaaaaaaaaaaaaugcuaaugu

SEQ ID NO: 367602 - RNA, 60 nt, Human
agacuuaagggacuauguacuacuguuaauaucucuaagaacaaaacacauugaacaucc

SEQ ID NO: 367603 - RNA, 60 nt, Human
uuuuuuaaacaccugcauauuuuuauguaaaucucuaaauuuaaaauauuuuaaguacau

SEQ ID NO: 367604 - RNA, 60 nt, Human
aauuugcaaauacaguaguaauuaagguacaucucuaaaguggagcacuuacaccaggcu

SEQ ID NO: 367605 - RNA, 60 nt, Human
ggaguugugagugauaggaucccaaaauucaucucuaaugugguuuuuaaaugcuggagg

SEQ ID NO: 367606 - RNA, 60 nt, Human
uucuuuagcuucaucaguccuuccuuccuaaucucuaauccccugaagccuaacacaguu

SEQ ID NO: 367607 - RNA, 60 nt, Human
uuacacaaaagaggugcacugccaauaaguaucucuaauucaauaguugaaagcaaccug

SEQ ID NO: 367608 - RNA, 60 nt, Human
agaccagacucgccaacauggugaaaccguaucucuaauaaaaauacaaaaauuagcugg

SEQ ID NO: 367609 - RNA, 60 nt, Human
uguacaauucaguucagcguaugaacuuguaucucuaaucugauguccauuuuuauauuu

SEQ ID NO: 367610 - RNA, 60 nt, Human
caaguugcuauauggucaaagguuaaauuuaucucuaaaaaauggcaggauucaaaguug

SEQ ID NO: 367611 - RNA, 60 nt, Human
auuaaauagcucagagaguacaucugccauaucucuaauagaaucuuuuuuuuuuuuuuu

SEQ ID NO: 367612 - RNA, 60 nt, Human
auaggcucugugccucucagacaaauucugaucucuaagagauccccagaccucacuugc

SEQ ID NO: 367613 - RNA, 60 nt, Human
guugaggacccaggcccauccagggauuucaucucuaagccuggcagugcuggggggaaa

SEQ ID NO: 367614 - RNA, 60 nt, Human
cuaagcuucaccaugcaaaucagaaauuuuaucucuaaguacaggcugugccgugucuca

SEQ ID NO: 367615 - RNA, 60 nt, Human
uuucccuggaggaucaggacagaggaaggaaucucuaaucgucccucuccuccaaaacca

SEQ ID NO: 367616 - RNA, 60 nt, Human
uaaucccccucugcccuccugugugggaggaucucuaaccccucugaucguggcgcaugg

SEQ ID NO: 367617 - RNA, 60 nt, Human
aaaaaaaaaaaaaaaaaaaaaguaaaggggaucucuaauacugccuaaaaguaugcuuuc

SEQ ID NO: 367618 - RNA, 60 nt, Human
ccugcuuagcuucuguguuguauuuaaguuaucucuaaauagauaaauucugacucaugu

SEQ ID NO: 367619 - RNA, 60 nt, Human
cauccuaacuccuacaggccagagaaugacaucucuaacuggcucauaaucccuuggcag

SEQ ID NO: 367620 - RNA, 60 nt, Human
caauaagugaauuuccuggccuacuucauaaucucuaaguuugggguaucuccaagcaug

SEQ ID NO: 367621 - RNA, 60 nt, Human
ugcuaccauucguuguggauaauucauguaaucucuaaccugugggcaagucuuuacccu

SEQ ID NO: 367622 - RNA, 60 nt, Human
acuaugcaagcuauaagacaauggaguauuaucucuaaauuccuuaaugaaauaaacaac

SEQ ID NO: 367623 - RNA, 60 nt, Human
uugguucuuucauuugcuuuggaaguuuuaaucucuaacaguggacaaaguuaccagugc

SEQ ID NO: 367624 - RNA, 60 nt, Human
aguuauuuaacauaaaccugauuugcagugaucucuaaguaauucugcaaaauccgguau

SEQ ID NO: 367625 - RNA, 60 nt, Human
guaggguaguugggggaaauaaagggauaaaucucuaauuauugcuguuuaacuguuugu

SEQ ID NO: 367626 - RNA, 60 nt, Human
uuugccauuucauucaaaccugacaagucuaucucuaagagccgccagauuuccaugugu

SEQ ID NO: 367627 - RNA, 60 nt, Human
uaacagcucugguuuuauaauaucuuggguaucucuaaggccaauaaggauaacauuauc

SEQ ID NO: 367628 - RNA, 60 nt, Human
aacaugauaucuaucugggauggccauuugaucucuaaaaggaauuuuguacacuccaca

SEQ ID NO: 367629 - RNA, 60 nt, Human
gcacaggagccccacugcugaugacgaacuaucucuaacuggucuugaccacgagcuagu

SEQ ID NO: 367630 - RNA, 60 nt, Human
aaccuacccuacugccaugaccuuccgcacaucucuaaguuuuaucuuugcaauacucaa

SEQ ID NO: 367631 - RNA, 60 nt, Human
auuggacuguuauuucauuuagaguucucuaucucuaaauauuuauuuagagaaugauuu

SEQ ID NO: 367632 - RNA, 60 nt, Human
ucauuauuucucaucuggauuaccagcucgaucucuaaucugcuucaguucauccuucuu

SEQ ID NO: 367633 - RNA, 60 nt, Human
aaccagaaaccgaaucugccucuugcugggaucucuaaaagugucugauaagcaucuuaa

SEQ ID NO: 367634 - RNA, 60 nt, Human
gacaggaguuuaucuaucggaagaacaugaaucucuaacagcuccauacuucuuucacua

SEQ ID NO: 367635 - RNA, 60 nt, Human
cgggggcggggggcggggguacaaagagaaaucucuaaaagaauaugaucuuccauccaa

SEQ ID NO: 367636 - RNA, 60 nt, Human
ccacaucguccucccuuucucuaagaggccaucucuaagaugucagauguagaggagaga

SEQ ID NO: 367637 - RNA, 60 nt, Human
aggaucucaggaccagccuagagagaucccaucucuaaaaaauaaaauauaagaaaauaa

SEQ ID NO: 367638 - RNA, 60 nt, Human
uuuauuuucucuuuguggguguuauauuugaucucuaaaucugaacaguuuauggucaca

SEQ ID NO: 367639 - RNA, 60 nt, Human
caugugagacugguuccauggccucuucagaucucuaacuucaccauauuaccacagaca

SEQ ID NO: 367640 - RNA, 60 nt, Human
caauagugcuugucuccgauagcuccccacaucucuaauugacuuccacaaaaucgaugc

SEQ ID NO: 367641 - RNA, 60 nt, Human
cucauuggugauguuuggaaaauagaagacaucucuaauggaaucaugggggaaacgggu

SEQ ID NO: 367642 - RNA, 60 nt, Human
cuacaaacuaaugauuaaugauauucauauaucucuaagaucuauaucugguauaacuau

SEQ ID NO: 367643 - RNA, 60 nt, Human
aacaaauauuuugguacucuucauucauuuaucucuaaaaccaggaguugaauuuuccuc

SEQ ID NO: 367644 - RNA, 60 nt, Human
ucuucaguccagcacugggugcccauccccaucucuaaaaccaguaaaucagccagcgaa

SEQ ID NO: 367645 - RNA, 60 nt, Human
aggccagacugggcaauauagcaagaccccaucucuaaaaaauuaggcaugguggugcau

SEQ ID NO: 367646 - RNA, 60 nt, Human
uguugaugcaaugccucagugaugcauuagaucucuaauaaagucuguauauacauguac

SEQ ID NO: 367647 - RNA, 60 nt, Human
guuagguaguaauaaaaguccucacuguagaucucuaaauuucaacccacggaaaugaaa

SEQ ID NO: 367648 - RNA, 60 nt, Human
ccuuuuugcuuuugcaauuucaguaucuucaucucuaaacuagggaaacacugggauucu

SEQ ID NO: 367649 - RNA, 60 nt, Human
ugagcugaugcuggugguuaaggguagcaaaucucuaaagcacgaagcccucacaaaucu

SEQ ID NO: 367650 - RNA, 60 nt, Human
ccaagccuaagaaacaauuaagugguucucaucucuaauuaacugugaaaccauuuaauc

SEQ ID NO: 367651 - RNA, 60 nt, Human
gucccuuugguuaauucuuacuuccuguucaucucuaaaguguuaaauuauaaaaaugau

SEQ ID NO: 367652 - RNA, 60 nt, Human
uucucuuugccugaagaaacaaggcauugaaucucuaaaaugcuguucucaaucauuguc

SEQ ID NO: 367653 - RNA, 60 nt, Human
uccaauuacagucucagcucuaguuuuaguaucucuaauucuuugguucccuucucuucc

SEQ ID NO: 367654 - RNA, 60 nt, Human
guguaaaaucagcauuucuauguaacauauaucucuaauuaucuguguaauuuuauaaca

SEQ ID NO: 367655 - RNA, 60 nt, Human
gucaacgugcuagaaaccgaugacuuauuaaucucuaauuuuuuggcgccucuuucauug

SEQ ID NO: 367656 - RNA, 60 nt, Human
gaagaucaggucauacuaucuacucuccucaucucuaacagcucaggaucucuuagcauu

SEQ ID NO: 367657 - RNA, 60 nt, Human
uguaauugcuuuaaaaaaaaaguugaauucaucucuaacuuaggccauuggaaaguguuu

SEQ ID NO: 367658 - RNA, 60 nt, Human
acuaaaccagccuagucauagcucauccccaucucuaaauguguccacacaaccacaucu

SEQ ID NO: 367659 - RNA, 60 nt, Human
gugaaggaaauaaagguaaaaucacuucagaucucuaauuagucuaucaaaugaaacucu

SEQ ID NO: 367660 - RNA, 60 nt, Human
uaaacaguugaacuguguaaauguuucuugaucucuaagguauuauguuugccuucucuu

SEQ ID NO: 367661 - RNA, 60 nt, Human
cacuuggaaauaugauucuuggagucaaugaucucuaaacaaacuggauuaucaacuauu

SEQ ID NO: 367662 - RNA, 60 nt, Human
uaagaaaucugcuccaaugcucuuguucuaaucucuaauagguuaacguuaauaaucuug

SEQ ID NO: 367663 - RNA, 60 nt, Human
ggguggacgauguuugaugauuagacggucaucucuaacuacuaaacuaauaucugcauu

SEQ ID NO: 367664 - RNA, 60 nt, Human
ugauuuuagcauuaaaugucaucucaggacaucucuaaaagggguuguuuaauuccuaau

SEQ ID NO: 367665 - RNA, 60 nt, Human
acaguaggaauuggaaauaauuuaguuucuaucucuaagcuguucuauuuuaaaauuauu

SEQ ID NO: 367666 - RNA, 60 nt, Human
aaaccaguccgggccacacagcaagaccccaucucuaaaaaauuaauauaaauauaaaau

SEQ ID NO: 367667 - RNA, 60 nt, Human
cgggacccccuggcccugccucauccaccaaucucuaagccaaaccccuaaacucaggag

SEQ ID NO: 367668 - RNA, 60 nt, Human
cauaucagcaauagucugcucuccccgggaaucucuaacaugcucuguuuacaucgauaa

SEQ ID NO: 367669 - RNA, 60 nt, Human
uuccuuuacuccuuaaaaaagaaaggaaagaucucuaaauucaaagcuagauuguaaaua

SEQ ID NO: 367670 - RNA, 60 nt, Human
uccuucaaaucugcugagaauuaaauaaacaucucuaaagccugaccuccccacgucaag

SEQ ID NO: 367671 - RNA, 60 nt, Human
ucauccccuuuguguguuuuacauauauauaucucuaaguccagagccaggagaguugga

SEQ ID NO: 367672 - RNA, 60 nt, Human
ccuaagggaaccccaaauccuaaagccuccaucucuaauaaauggaaggccccaaggccc

SEQ ID NO: 367673 - RNA, 60 nt, Human
gugaaggaaguaaagguaaaaucacuucagaucucuaaaaaacaaagaauuacaugaguu

SEQ ID NO: 367674 - RNA, 60 nt, Human
ccacuccugggcuaaggaguaaccucccucaucucuaacugcccccacggggccagggcu

SEQ ID NO: 367675 - RNA, 60 nt, Human
cccagcaacccuggcccccaaccccagcaaaucucuaacaccuccuagaggccaaggcuu

SEQ ID NO: 367676 - RNA, 60 nt, Human
uucaaccucucuaauaugggcuccagacggaucucuaagguucccagcucucaggguuga

SEQ ID NO: 367677 - RNA, 60 nt, Human
aaccuuaguguguuacacaccugacuuaacaucucuaaacucagauugaaaagagaccga

SEQ ID NO: 367678 - RNA, 60 nt, Human
uaugacugugaauuguggaaagggcaguagaucucuaauguggaggugggaacauuauug

SEQ ID NO: 367679 - RNA, 60 nt, Human
ugucucacagggacccacauccaaacauguaucucuaaugaaauugugaaagcuccaugu

SEQ ID NO: 367680 - RNA, 60 nt, Human
gacgagcaauuccauuuguucuucuccagcaucucuaaggcccacuugaaugcaaaggaa

SEQ ID NO: 367681 - RNA, 60 nt, Human
uaagaugaaauguauaucagaaaaaaaucuaucucuaauuuagagugcgguacauaauua

SEQ ID NO: 367682 - RNA, 60 nt, Human
aggacugauggaaaugauuucaucucugccaucucuaaagcacuuuucauugaacauguu

SEQ ID NO: 367683 - RNA, 60 nt, Human
gucaccuuggauaucuauugaauguuaaacaucucuaauaaagauggccaccacuuaaug

SEQ ID NO: 367684 - RNA, 60 nt, Human
uuagccaagcagugcauugucaguuacgucaucucuaaaaaugaccugugucuguucucu

SEQ ID NO: 367685 - RNA, 60 nt, Human
cagcuccuuugaaaacucuguguuuggaauaucucuaaaaacauagaaaacacuacagug

SEQ ID NO: 367686 - RNA, 60 nt, Human
acuccagccuagaugacagaacgagaccccaucucuaaugaauaaauaaauauggcuggg

SEQ ID NO: 367687 - RNA, 60 nt, Human
uaaucugaauaauuguacauaaaauuuuguaucucuaacauuccaaauuacugucaauaa

SEQ ID NO: 367688 - RNA, 60 nt, Human
acuccagacuggacaacagagugagaccccaucucuaaauaauaaucauuauuguuacau

SEQ ID NO: 367689 - RNA, 60 nt, Human
cuuguaagcccaucccagcuacuuguaaccaucucuaagggcaauggcauugcucccuac

SEQ ID NO: 367690 - RNA, 60 nt, Human
cacauuaaaaaaguagaaguuagaugagugaucucuaagguugaagguaauuucagcucu

SEQ ID NO: 367691 - RNA, 60 nt, Human
uuauaauuuccuaugccugucuuuaccgcaaucucuaaacacaaauugugaagauuucau

SEQ ID NO: 367692 - RNA, 60 nt, Human
gaccagccuggacaacauagugagacccccaucucuaaauaaaaauagaccaacgcuaaa

SEQ ID NO: 367693 - RNA, 60 nt, Human
uauuuuaauccuauuuaaauguucuuucaaaucucuaauaauuuaaacuuuccucagugc

SEQ ID NO: 367694 - RNA, 60 nt, Human
uuaaaauauaguagaaauguuuauccugguaucucuaaguauacauuuaauuguacagaa

SEQ ID NO: 367695 - RNA, 60 nt, Human
auagagugagacucugucucaaaaaaaaguaucucuaaauacaggauuauaauuucugcu

SEQ ID NO: 367696 - RNA, 60 nt, Human
agacaaaauuguucgcuuagugauccacugaucucuaaucagaaauauuuuuaaaaaaua

SEQ ID NO: 367697 - RNA, 60 nt, Human
uguaauuuuucuagguggauggcuacuuuaaucucuaaaaaagccaagugaaguaaaagu

SEQ ID NO: 367698 - RNA, 60 nt, Human
ccuaucaguagagcuaguaaggcagcaccaaucucuaaauauagaagaaauuuccccaaa

SEQ ID NO: 367699 - RNA, 60 nt, Human
acuauuuacauuucuuuauagccucuucugaucucuaacacauaugcaguuuuaacuguu

SEQ ID NO: 367700 - RNA, 64 nt, Human; identical to SEQ ID NO: 44312

SEQ ID NO: 367701 - RNA, 64 nt, Human; identical to SEQ ID NO: 44313

SEQ ID NO: 367702 - RNA, 64 nt, Human; identical to SEQ ID NO: 44314

SEQ ID NO: 367703 - RNA, 64 nt, Human; identical to SEQ ID NO: 44315

SEQ ID NO: 367704 - RNA, 64 nt, Human; identical to SEQ ID NO: 44316

SEQ ID NO: 367705 - RNA, 64 nt, Human; identical to SEQ ID NO: 44317

SEQ ID NO: 367706 - RNA, 64 nt, Human; identical to SEQ ID NO: 44318

SEQ ID NO: 367707 - RNA, 64 nt, Human; identical to SEQ ID NO: 44319

SEQ ID NO: 367708 - RNA, 64 nt, Human; identical to SEQ ID NO: 44320

SEQ ID NO: 367709 - RNA, 64 nt, Human; identical to SEQ ID NO: 44321

SEQ ID NO: 367710 - RNA, 64 nt, Human; identical to SEQ ID NO: 44322

SEQ ID NO: 367711 - RNA, 64 nt, Human; identical to SEQ ID NO: 44323

SEQ ID NO: 367712 - RNA, 64 nt, Human; identical to SEQ ID NO: 44324

SEQ ID NO: 367713 - RNA, 64 nt, Human; identical to SEQ ID NO: 44325

SEQ ID NO: 367714 - RNA, 64 nt, Human; identical to SEQ ID NO: 44326

SEQ ID NO: 367715 - RNA, 64 nt, Human; identical to SEQ ID NO: 44327

SEQ ID NO: 367716 - RNA, 64 nt, Human; identical to SEQ ID NO: 44328

SEQ ID NO: 367717 - RNA, 64 nt, Human; identical to SEQ ID NO: 44329

SEQ ID NO: 367718 - RNA, 64 nt, Human; identical to SEQ ID NO: 44330

SEQ ID NO: 367719 - RNA, 64 nt, Human; identical to SEQ ID NO: 44331

SEQ ID NO: 367720 - RNA, 64 nt, Human; identical to SEQ ID NO: 44332

SEQ ID NO: 367721 - RNA, 64 nt, Human; identical to SEQ ID NO: 44333

SEQ ID NO: 367722 - RNA, 64 nt, Human; identical to SEQ ID NO: 44334

SEQ ID NO: 367723 - RNA, 64 nt, Human; identical to SEQ ID NO: 44335

SEQ ID NO: 367724 - RNA, 64 nt, Human; identical to SEQ ID NO: 44336

SEQ ID NO: 367725 - RNA, 64 nt, Human; identical to SEQ ID NO: 44337

SEQ ID NO: 367726 - RNA, 64 nt, Human; identical to SEQ ID NO: 44338

SEQ ID NO: 367727 - RNA, 64 nt, Human; identical to SEQ ID NO: 44339

SEQ ID NO: 367728 - RNA, 64 nt, Human; identical to SEQ ID NO: 44340

SEQ ID NO: 367729 - RNA, 64 nt, Human; identical to SEQ ID NO: 44341

SEQ ID NO: 367730 - RNA, 64 nt, Human; identical to SEQ ID NO: 44342

SEQ ID NO: 367731 - RNA, 64 nt, Human; identical to SEQ ID NO: 44343

SEQ ID NO: 367732 - RNA, 64 nt, Human; identical to SEQ ID NO: 44344

SEQ ID NO: 367733 - RNA, 64 nt, Human; identical to SEQ ID NO: 44345

SEQ ID NO: 367734 - RNA, 64 nt, Human; identical to SEQ ID NO: 44346

SEQ ID NO: 367735 - RNA, 64 nt, Human; identical to SEQ ID NO: 44347

SEQ ID NO: 367736 - RNA, 64 nt, Human; identical to SEQ ID NO: 44348

SEQ ID NO: 367737 - RNA, 64 nt, Human; identical to SEQ ID NO: 44349

SEQ ID NO: 367738 - RNA, 64 nt, Human; identical to SEQ ID NO: 44350

SEQ ID NO: 367739 - RNA, 64 nt, Human; identical to SEQ ID NO: 44351

SEQ ID NO: 367740 - RNA, 64 nt, Human; identical to SEQ ID NO: 44352

SEQ ID NO: 367741 - RNA, 64 nt, Human; identical to SEQ ID NO: 44353

SEQ ID NO: 367742 - RNA, 64 nt, Human; identical to SEQ ID NO: 44354

SEQ ID NO: 367743 - RNA, 64 nt, Human; identical to SEQ ID NO: 44355

SEQ ID NO: 367744 - RNA, 64 nt, Human; identical to SEQ ID NO: 44356

SEQ ID NO: 367745 - RNA, 60 nt, Human; identical to SEQ ID NO: 44357

SEQ ID NO: 367746 - RNA, 64 nt, Human; identical to SEQ ID NO: 44358

SEQ ID NO: 367747 - RNA, 64 nt, Human; identical to SEQ ID NO: 44359

SEQ ID NO: 367748 - RNA, 64 nt, Human; identical to SEQ ID NO: 44360

SEQ ID NO: 367749 - RNA, 64 nt, Human; identical to SEQ ID NO: 44361

SEQ ID NO: 367750 - RNA, 64 nt, Human; identical to SEQ ID NO: 44362

SEQ ID NO: 367751 - RNA, 64 nt, Human; identical to SEQ ID NO: 44363

SEQ ID NO: 367752 - RNA, 64 nt, Human; identical to SEQ ID NO: 44364

SEQ ID NO: 367753 - RNA, 64 nt, Human; identical to SEQ ID NO: 44365

SEQ ID NO: 367754 - RNA, 64 nt, Human; identical to SEQ ID NO: 44366

SEQ ID NO: 367755 - RNA, 64 nt, Human; identical to SEQ ID NO: 44367

SEQ ID NO: 367756 - RNA, 64 nt, Human; identical to SEQ ID NO: 44368

SEQ ID NO: 367757 - RNA, 64 nt, Human; identical to SEQ ID NO: 44369

SEQ ID NO: 367758 - RNA, 64 nt, Human; identical to SEQ ID NO: 44370

SEQ ID NO: 367759 - RNA, 64 nt, Human; identical to SEQ ID NO: 44371

SEQ ID NO: 367760 - RNA, 64 nt, Human; identical to SEQ ID NO: 44372

SEQ ID NO: 367761 - RNA, 64 nt, Human; identical to SEQ ID NO: 44373

SEQ ID NO: 367762 - RNA, 64 nt, Human; identical to SEQ ID NO: 44374

SEQ ID NO: 367763 - RNA, 64 nt, Human; identical to SEQ ID NO: 44375

SEQ ID NO: 367764 - RNA, 64 nt, Human; identical to SEQ ID NO: 44376

SEQ ID NO: 367765 - RNA, 64 nt, Human; identical to SEQ ID NO: 44377

SEQ ID NO: 367766 - RNA, 64 nt, Human; identical to SEQ ID NO: 44378

SEQ ID NO: 367767 - RNA, 64 nt, Human; identical to SEQ ID NO: 44379

SEQ ID NO: 367768 - RNA, 64 nt, Human; identical to SEQ ID NO: 44380

SEQ ID NO: 367769 - RNA, 64 nt, Human; identical to SEQ ID NO: 44381

SEQ ID NO: 367770 - RNA, 64 nt, Human; identical to SEQ ID NO: 44382

SEQ ID NO: 367771 - RNA, 64 nt, Human; identical to SEQ ID NO: 44383

SEQ ID NO: 367772 - RNA, 64 nt, Human; identical to SEQ ID NO: 44384

SEQ ID NO: 367773 - RNA, 64 nt, Human; identical to SEQ ID NO: 44385

SEQ ID NO: 367774 - RNA, 64 nt, Human; identical to SEQ ID NO: 44386

SEQ ID NO: 367775 - RNA, 64 nt, Human; identical to SEQ ID NO: 44387

SEQ ID NO: 367776 - RNA, 64 nt, Human; identical to SEQ ID NO: 44388

SEQ ID NO: 367777 - RNA, 64 nt, Human; identical to SEQ ID NO: 44389

SEQ ID NO: 367778 - RNA, 64 nt, Human; identical to SEQ ID NO: 44390

SEQ ID NO: 367779 - RNA, 64 nt, Human; identical to SEQ ID NO: 44391

SEQ ID NO: 367780 - RNA, 64 nt, Human; identical to SEQ ID NO: 44392

SEQ ID NO: 367781 - RNA, 61 nt, Human; identical to SEQ ID NO: 44393

SEQ ID NO: 367782 - RNA, 64 nt, Human; identical to SEQ ID NO: 44394

SEQ ID NO: 367783 - RNA, 64 nt, Human; identical to SEQ ID NO: 44395

SEQ ID NO: 367784 - RNA, 64 nt, Human; identical to SEQ ID NO: 44396

SEQ ID NO: 367785 - RNA, 64 nt, Human; identical to SEQ ID NO: 44397

SEQ ID NO: 367786 - RNA, 64 nt, Human; identical to SEQ ID NO: 44398

SEQ ID NO: 367787 - RNA, 64 nt, Human; identical to SEQ ID NO: 44399

SEQ ID NO: 367788 - RNA, 64 nt, Human; identical to SEQ ID NO: 44400

SEQ ID NO: 367789 - RNA, 64 nt, Human; identical to SEQ ID NO: 44401

SEQ ID NO: 367790 - RNA, 64 nt, Human; identical to SEQ ID NO: 44402

SEQ ID NO: 367791 - RNA, 64 nt, Human; identical to SEQ ID NO: 44403

SEQ ID NO: 367792 - RNA, 64 nt, Human; identical to SEQ ID NO: 44404

SEQ ID NO: 367793 - RNA, 64 nt, Human; identical to SEQ ID NO: 44405

SEQ ID NO: 367794 - RNA, 64 nt, Human; identical to SEQ ID NO: 44406

SEQ ID NO: 367795 - RNA, 64 nt, Human; identical to SEQ ID NO: 44407

SEQ ID NO: 367796 - RNA, 64 nt, Human; identical to SEQ ID NO: 44408

SEQ ID NO: 367797 - RNA, 64 nt, Human; identical to SEQ ID NO: 44409

SEQ ID NO: 367798 - RNA, 64 nt, Human; identical to SEQ ID NO: 44410

SEQ ID NO: 367799 - RNA, 64 nt, Human; identical to SEQ ID NO: 44411

SEQ ID NO: 367800 - RNA, 64 nt, Human; identical to SEQ ID NO: 44412

SEQ ID NO: 367801 - RNA, 64 nt, Human; identical to SEQ ID NO: 44413

SEQ ID NO: 367802 - RNA, 64 nt, Human; identical to SEQ ID NO: 44414

SEQ ID NO: 367803 - RNA, 64 nt, Human; identical to SEQ ID NO: 44415

SEQ ID NO: 367804 - RNA, 64 nt, Human; identical to SEQ ID NO: 44416

SEQ ID NO: 367805 - RNA, 64 nt, Human; identical to SEQ ID NO: 44417

SEQ ID NO: 367806 - RNA, 64 nt, Human; identical to SEQ ID NO: 44418

SEQ ID NO: 367807 - RNA, 64 nt, Human; identical to SEQ ID NO: 44419

SEQ ID NO: 367808 - RNA, 64 nt, Human; identical to SEQ ID NO: 44420

SEQ ID NO: 367809 - RNA, 64 nt, Human; identical to SEQ ID NO: 44421

SEQ ID NO: 367810 - RNA, 64 nt, Human; identical to SEQ ID NO: 44422

SEQ ID NO: 367811 - RNA, 64 nt, Human; identical to SEQ ID NO: 44423

SEQ ID NO: 367812 - RNA, 64 nt, Human; identical to SEQ ID NO: 44424

SEQ ID NO: 367813 - RNA, 64 nt, Human; identical to SEQ ID NO: 44425

SEQ ID NO: 367814 - RNA, 64 nt, Human; identical to SEQ ID NO: 44426

SEQ ID NO: 367815 - RNA, 64 nt, Human; identical to SEQ ID NO: 44427

SEQ ID NO: 367816 - RNA, 64 nt, Human; identical to SEQ ID NO: 44428

SEQ ID NO: 367817 - RNA, 64 nt, Human; identical to SEQ ID NO: 44429

SEQ ID NO: 367818 - RNA, 64 nt, Human; identical to SEQ ID NO: 44430

SEQ ID NO: 367819 - RNA, 64 nt, Human; identical to SEQ ID NO: 44431

SEQ ID NO: 367820 - RNA, 64 nt, Human; identical to SEQ ID NO: 44432

SEQ ID NO: 367821 - RNA, 64 nt, Human; identical to SEQ ID NO: 44433

SEQ ID NO: 367822 - RNA, 64 nt, Human; identical to SEQ ID NO: 44434

SEQ ID NO: 367823 - RNA, 64 nt, Human; identical to SEQ ID NO: 44435

SEQ ID NO: 367824 - RNA, 64 nt, Human; identical to SEQ ID NO: 44436

SEQ ID NO: 367825 - RNA, 64 nt, Human; identical to SEQ ID NO: 44437

SEQ ID NO: 367826 - RNA, 52 nt, Human; identical to SEQ ID NO: 44438

SEQ ID NO: 367827 - RNA, 64 nt, Human; identical to SEQ ID NO: 44439

SEQ ID NO: 367828 - RNA, 64 nt, Human; identical to SEQ ID NO: 44440

SEQ ID NO: 367829 - RNA, 64 nt, Human; identical to SEQ ID NO: 44441

SEQ ID NO: 367830 - RNA, 64 nt, Human; identical to SEQ ID NO: 44442

SEQ ID NO: 367831 - RNA, 64 nt, Human; identical to SEQ ID NO: 44443

SEQ ID NO: 367832 - RNA, 64 nt, Human; identical to SEQ ID NO: 44444

SEQ ID NO: 367833 - RNA, 64 nt, Human; identical to SEQ ID NO: 44445

SEQ ID NO: 367834 - RNA, 64 nt, Human; identical to SEQ ID NO: 44446

SEQ ID NO: 367835 - RNA, 64 nt, Human; identical to SEQ ID NO: 44447

SEQ ID NO: 367836 - RNA, 64 nt, Human; identical to SEQ ID NO: 44448

SEQ ID NO: 367837 - RNA, 64 nt, Human; identical to SEQ ID NO: 44449

SEQ ID NO: 367838 - RNA, 64 nt, Human; identical to SEQ ID NO: 44450

SEQ ID NO: 367839 - RNA, 64 nt, Human; identical to SEQ ID NO: 44451

SEQ ID NO: 367840 - RNA, 64 nt, Human; identical to SEQ ID NO: 44452

SEQ ID NO: 367841 - RNA, 64 nt, Human; identical to SEQ ID NO: 44453

SEQ ID NO: 367842 - RNA, 64 nt, Human; identical to SEQ ID NO: 44454

SEQ ID NO: 367843 - RNA, 64 nt, Human; identical to SEQ ID NO: 44455

SEQ ID NO: 367844 - RNA, 64 nt, Human; identical to SEQ ID NO: 44456

SEQ ID NO: 367845 - RNA, 64 nt, Human; identical to SEQ ID NO: 44457

SEQ ID NO: 367846 - RNA, 64 nt, Human; identical to SEQ ID NO: 44458

SEQ ID NO: 367847 - RNA, 64 nt, Human; identical to SEQ ID NO: 44459

SEQ ID NO: 367848 - RNA, 64 nt, Human; identical to SEQ ID NO: 44460

SEQ ID NO: 367849 - RNA, 64 nt, Human; identical to SEQ ID NO: 44461

SEQ ID NO: 367850 - RNA, 64 nt, Human; identical to SEQ ID NO: 44462

SEQ ID NO: 367851 - RNA, 64 nt, Human; identical to SEQ ID NO: 44463

SEQ ID NO: 367852 - RNA, 64 nt, Human; identical to SEQ ID NO: 44464

SEQ ID NO: 367853 - RNA, 64 nt, Human; identical to SEQ ID NO: 44465

SEQ ID NO: 367854 - RNA, 64 nt, Human; identical to SEQ ID NO: 44466

SEQ ID NO: 367855 - RNA, 64 nt, Human; identical to SEQ ID NO: 44467

SEQ ID NO: 367856 - RNA, 64 nt, Human; identical to SEQ ID NO: 44468

SEQ ID NO: 367857 - RNA, 64 nt, Human; identical to SEQ ID NO: 44469

SEQ ID NO: 367858 - RNA, 64 nt, Human; identical to SEQ ID NO: 44470

SEQ ID NO: 367859 - RNA, 64 nt, Human; identical to SEQ ID NO: 44471

SEQ ID NO: 367860 - RNA, 64 nt, Human; identical to SEQ ID NO: 44472

SEQ ID NO: 367861 - RNA, 64 nt, Human; identical to SEQ ID NO: 44473

SEQ ID NO: 367862 - RNA, 64 nt, Human; identical to SEQ ID NO: 44474

SEQ ID NO: 367863 - RNA, 64 nt, Human; identical to SEQ ID NO: 44475

SEQ ID NO: 367864 - RNA, 64 nt, Human; identical to SEQ ID NO: 44476

SEQ ID NO: 367865 - RNA, 64 nt, Human; identical to SEQ ID NO: 44477

SEQ ID NO: 367866 - RNA, 64 nt, Human; identical to SEQ ID NO: 44478

SEQ ID NO: 367867 - RNA, 64 nt, Human; identical to SEQ ID NO: 44479

SEQ ID NO: 367868 - RNA, 64 nt, Human; identical to SEQ ID NO: 44480

SEQ ID NO: 367869 - RNA, 64 nt, Human; identical to SEQ ID NO: 44481

SEQ ID NO: 367870 - RNA, 64 nt, Human; identical to SEQ ID NO: 44482

SEQ ID NO: 367871 - RNA, 64 nt, Human; identical to SEQ ID NO: 44483

SEQ ID NO: 367872 - RNA, 64 nt, Human; identical to SEQ ID NO: 44484

SEQ ID NO: 367873 - RNA, 64 nt, Human; identical to SEQ ID NO: 44485

SEQ ID NO: 367874 - RNA, 64 nt, Human; identical to SEQ ID NO: 44486

SEQ ID NO: 367875 - RNA, 64 nt, Human; identical to SEQ ID NO: 44487

SEQ ID NO: 367876 - RNA, 64 nt, Human; identical to SEQ ID NO: 44488

SEQ ID NO: 367877 - RNA, 64 nt, Human; identical to SEQ ID NO: 44489

SEQ ID NO: 367878 - RNA, 64 nt, Human; identical to SEQ ID NO: 44490

SEQ ID NO: 367879 - RNA, 64 nt, Human; identical to SEQ ID NO: 44491

SEQ ID NO: 367880 - RNA, 54 nt, Human; identical to SEQ ID NO: 44492

SEQ ID NO: 367881 - RNA, 64 nt, Human; identical to SEQ ID NO: 44493

SEQ ID NO: 367882 - RNA, 64 nt, Human; identical to SEQ ID NO: 44494

SEQ ID NO: 367883 - RNA, 64 nt, Human; identical to SEQ ID NO: 44495

SEQ ID NO: 367884 - RNA, 64 nt, Human; identical to SEQ ID NO: 44496

SEQ ID NO: 367885 - RNA, 64 nt, Human; identical to SEQ ID NO: 44497

SEQ ID NO: 367886 - RNA, 64 nt, Human; identical to SEQ ID NO: 44498

SEQ ID NO: 367887 - RNA, 64 nt, Human; identical to SEQ ID NO: 44499

SEQ ID NO: 367888 - RNA, 64 nt, Human; identical to SEQ ID NO: 44500

SEQ ID NO: 367889 - RNA, 64 nt, Human; identical to SEQ ID NO: 44501

SEQ ID NO: 367890 - RNA, 64 nt, Human; identical to SEQ ID NO: 44502

SEQ ID NO: 367891 - RNA, 64 nt, Human; identical to SEQ ID NO: 44503

SEQ ID NO: 367892 - RNA, 64 nt, Human; identical to SEQ ID NO: 44504

SEQ ID NO: 367893 - RNA, 64 nt, Human; identical to SEQ ID NO: 44505

SEQ ID NO: 367894 - RNA, 64 nt, Human; identical to SEQ ID NO: 44506

SEQ ID NO: 367895 - RNA, 64 nt, Human; identical to SEQ ID NO: 44507

SEQ ID NO: 367896 - RNA, 64 nt, Human; identical to SEQ ID NO: 44508

SEQ ID NO: 367897 - RNA, 64 nt, Human; identical to SEQ ID NO: 44509

SEQ ID NO: 367898 - RNA, 64 nt, Human; identical to SEQ ID NO: 44510

SEQ ID NO: 367899 - RNA, 64 nt, Human; identical to SEQ ID NO: 44511

SEQ ID NO: 367900 - RNA, 64 nt, Human; identical to SEQ ID NO: 44512

SEQ ID NO: 367901 - RNA, 64 nt, Human; identical to SEQ ID NO: 44513

SEQ ID NO: 367902 - RNA, 64 nt, Human; identical to SEQ ID NO: 44514

SEQ ID NO: 367903 - RNA, 64 nt, Human; identical to SEQ ID NO: 44515

SEQ ID NO: 367904 - RNA, 64 nt, Human; identical to SEQ ID NO: 44516

SEQ ID NO: 367905 - RNA, 64 nt, Human; identical to SEQ ID NO: 44517

SEQ ID NO: 367906 - RNA, 64 nt, Human; identical to SEQ ID NO: 44518

SEQ ID NO: 367907 - RNA, 64 nt, Human; identical to SEQ ID NO: 44519

SEQ ID NO: 367908 - RNA, 58 nt, Human; identical to SEQ ID NO: 44520

SEQ ID NO: 367909 - RNA, 64 nt, Human; identical to SEQ ID NO: 44521

SEQ ID NO: 367910 - RNA, 64 nt, Human; identical to SEQ ID NO: 44522

SEQ ID NO: 367911 - RNA, 64 nt, Human; identical to SEQ ID NO: 44523

SEQ ID NO: 367912 - RNA, 64 nt, Human; identical to SEQ ID NO: 44524

SEQ ID NO: 367913 - RNA, 64 nt, Human; identical to SEQ ID NO: 44525

SEQ ID NO: 367914 - RNA, 64 nt, Human; identical to SEQ ID NO: 44526

SEQ ID NO: 367915 - RNA, 64 nt, Human; identical to SEQ ID NO: 44527

SEQ ID NO: 367916 - RNA, 64 nt, Human; identical to SEQ ID NO: 44528

SEQ ID NO: 367917 - RNA, 50 nt, Human; identical to SEQ ID NO: 44529

SEQ ID NO: 367918 - RNA, 64 nt, Human; identical to SEQ ID NO: 44530

SEQ ID NO: 367919 - RNA, 64 nt, Human; identical to SEQ ID NO: 44531

SEQ ID NO: 367920 - RNA, 64 nt, Human; identical to SEQ ID NO: 44532

SEQ ID NO: 367921 - RNA, 64 nt, Human; identical to SEQ ID NO: 44533

SEQ ID NO: 367922 - RNA, 64 nt, Human; identical to SEQ ID NO: 44534

SEQ ID NO: 367923 - RNA, 64 nt, Human; identical to SEQ ID NO: 44535

SEQ ID NO: 367924 - RNA, 64 nt, Human; identical to SEQ ID NO: 44536

SEQ ID NO: 367925 - RNA, 64 nt, Human; identical to SEQ ID NO: 44537

SEQ ID NO: 367926 - RNA, 64 nt, Human; identical to SEQ ID NO: 44538

SEQ ID NO: 367927 - RNA, 64 nt, Human; identical to SEQ ID NO: 44539

SEQ ID NO: 367928 - RNA, 64 nt, Human; identical to SEQ ID NO: 44540

SEQ ID NO: 367929 - RNA, 64 nt, Human; identical to SEQ ID NO: 44541

SEQ ID NO: 367930 - RNA, 64 nt, Human; identical to SEQ ID NO: 44542

SEQ ID NO: 367931 - RNA, 64 nt, Human; identical to SEQ ID NO: 44543

SEQ ID NO: 367932 - RNA, 64 nt, Human; identical to SEQ ID NO: 44544

SEQ ID NO: 367933 - RNA, 64 nt, Human; identical to SEQ ID NO: 44545

SEQ ID NO: 367934 - RNA, 64 nt, Human; identical to SEQ ID NO: 44546

SEQ ID NO: 367935 - RNA, 64 nt, Human; identical to SEQ ID NO: 44547

SEQ ID NO: 367936 - RNA, 64 nt, Human; identical to SEQ ID NO: 44548

SEQ ID NO: 367937 - RNA, 64 nt, Human; identical to SEQ ID NO: 44549

SEQ ID NO: 367938 - RNA, 64 nt, Human; identical to SEQ ID NO: 44550

SEQ ID NO: 367939 - RNA, 64 nt, Human; identical to SEQ ID NO: 44551

SEQ ID NO: 367940 - RNA, 64 nt, Human; identical to SEQ ID NO: 44552

SEQ ID NO: 367941 - RNA, 64 nt, Human; identical to SEQ ID NO: 44553

SEQ ID NO: 367942 - RNA, 64 nt, Human; identical to SEQ ID NO: 44554

SEQ ID NO: 367943 - RNA, 64 nt, Human; identical to SEQ ID NO: 44555

SEQ ID NO: 367944 - RNA, 64 nt, Human; identical to SEQ ID NO: 44556

SEQ ID NO: 367945 - RNA, 64 nt, Human; identical to SEQ ID NO: 44557

SEQ ID NO: 367946 - RNA, 64 nt, Human; identical to SEQ ID NO: 44558

SEQ ID NO: 367947 - RNA, 64 nt, Human; identical to SEQ ID NO: 44559

SEQ ID NO: 367948 - RNA, 64 nt, Human; identical to SEQ ID NO: 44560

SEQ ID NO: 367949 - RNA, 64 nt, Human; identical to SEQ ID NO: 44561

SEQ ID NO: 367950 - RNA, 64 nt, Human; identical to SEQ ID NO: 44562

SEQ ID NO: 367951 - RNA, 64 nt, Human; identical to SEQ ID NO: 44563

SEQ ID NO: 367952 - RNA, 64 nt, Human; identical to SEQ ID NO: 44564

SEQ ID NO: 367953 - RNA, 64 nt, Human; identical to SEQ ID NO: 44565

SEQ ID NO: 367954 - RNA, 64 nt, Human; identical to SEQ ID NO: 44566

SEQ ID NO: 367955 - RNA, 64 nt, Human; identical to SEQ ID NO: 44567

SEQ ID NO: 367956 - RNA, 64 nt, Human; identical to SEQ ID NO: 44568

SEQ ID NO: 367957 - RNA, 64 nt, Human; identical to SEQ ID NO: 44569

SEQ ID NO: 367958 - RNA, 64 nt, Human; identical to SEQ ID NO: 44570

SEQ ID NO: 367959 - RNA, 64 nt, Human; identical to SEQ ID NO: 44571

SEQ ID NO: 367960 - RNA, 64 nt, Human; identical to SEQ ID NO: 44572

SEQ ID NO: 367961 - RNA, 64 nt, Human; identical to SEQ ID NO: 44573

SEQ ID NO: 367962 - RNA, 64 nt, Human; identical to SEQ ID NO: 44574

SEQ ID NO: 367963 - RNA, 64 nt, Human; identical to SEQ ID NO: 44575

SEQ ID NO: 367964 - RNA, 64 nt, Human; identical to SEQ ID NO: 44576

SEQ ID NO: 367965 - RNA, 64 nt, Human; identical to SEQ ID NO: 44577

SEQ ID NO: 367966 - RNA, 64 nt, Human; identical to SEQ ID NO: 44578

SEQ ID NO: 367967 - RNA, 64 nt, Human; identical to SEQ ID NO: 44579

SEQ ID NO: 367968 - RNA, 64 nt, Human; identical to SEQ ID NO: 44580

SEQ ID NO: 367969 - RNA, 64 nt, Human; identical to SEQ ID NO: 44581

SEQ ID NO: 367970 - RNA, 64 nt, Human; identical to SEQ ID NO: 44582

SEQ ID NO: 367971 - RNA, 64 nt, Human; identical to SEQ ID NO: 44583

SEQ ID NO: 367972 - RNA, 64 nt, Human; identical to SEQ ID NO: 44584

SEQ ID NO: 367973 - RNA, 64 nt, Human; identical to SEQ ID NO: 44585

SEQ ID NO: 367974 - RNA, 64 nt, Human; identical to SEQ ID NO: 44586

SEQ ID NO: 367975 - RNA, 64 nt, Human; identical to SEQ ID NO: 44587

SEQ ID NO: 367976 - RNA, 64 nt, Human; identical to SEQ ID NO: 44588

SEQ ID NO: 367977 - RNA, 64 nt, Human; identical to SEQ ID NO: 44589

SEQ ID NO: 367978 - RNA, 64 nt, Human; identical to SEQ ID NO: 44590

SEQ ID NO: 367979 - RNA, 64 nt, Human; identical to SEQ ID NO: 44591

SEQ ID NO: 367980 - RNA, 64 nt, Human; identical to SEQ ID NO: 44592

SEQ ID NO: 367981 - RNA, 64 nt, Human; identical to SEQ ID NO: 44593

SEQ ID NO: 367982 - RNA, 64 nt, Human; identical to SEQ ID NO: 44594

SEQ ID NO: 367983 - RNA, 64 nt, Human; identical to SEQ ID NO: 44595

SEQ ID NO: 367984 - RNA, 64 nt, Human; identical to SEQ ID NO: 44596

SEQ ID NO: 367985 - RNA, 64 nt, Human; identical to SEQ ID NO: 44597

SEQ ID NO: 367986 - RNA, 64 nt, Human; identical to SEQ ID NO: 44598

SEQ ID NO: 367987 - RNA, 64 nt, Human; identical to SEQ ID NO: 44599

SEQ ID NO: 367988 - RNA, 64 nt, Human; identical to SEQ ID NO: 44600

SEQ ID NO: 367989 - RNA, 64 nt, Human; identical to SEQ ID NO: 44601

SEQ ID NO: 367990 - RNA, 64 nt, Human; identical to SEQ ID NO: 44602

SEQ ID NO: 367991 - RNA, 64 nt, Human; identical to SEQ ID NO: 44603

SEQ ID NO: 367992 - RNA, 64 nt, Human; identical to SEQ ID NO: 44604

SEQ ID NO: 367993 - RNA, 64 nt, Human; identical to SEQ ID NO: 44605

SEQ ID NO: 367994 - RNA, 64 nt, Human; identical to SEQ ID NO: 44606

SEQ ID NO: 367995 - RNA, 64 nt, Human; identical to SEQ ID NO: 44607

SEQ ID NO: 367996 - RNA, 64 nt, Human; identical to SEQ ID NO: 44608

SEQ ID NO: 367997 - RNA, 64 nt, Human; identical to SEQ ID NO: 44609

SEQ ID NO: 367998 - RNA, 64 nt, Human; identical to SEQ ID NO: 44610

SEQ ID NO: 367999 - RNA, 64 nt, Human; identical to SEQ ID NO: 44611

SEQ ID NO: 368000 - RNA, 64 nt, Human; identical to SEQ ID NO: 44612

SEQ ID NO: 368001 - RNA, 64 nt, Human; identical to SEQ ID NO: 44613

SEQ ID NO: 368002 - RNA, 64 nt, Human; identical to SEQ ID NO: 44614

SEQ ID NO: 368003 - RNA, 64 nt, Human; identical to SEQ ID NO: 44615

SEQ ID NO: 368004 - RNA, 64 nt, Human; identical to SEQ ID NO: 44616

SEQ ID NO: 368005 - RNA, 64 nt, Human; identical to SEQ ID NO: 44617

SEQ ID NO: 368006 - RNA, 64 nt, Human; identical to SEQ ID NO: 44618

SEQ ID NO: 368007 - RNA, 64 nt, Human; identical to SEQ ID NO: 44619

SEQ ID NO: 368008 - RNA, 64 nt, Human; identical to SEQ ID NO: 44620

SEQ ID NO: 368009 - RNA, 64 nt, Human; identical to SEQ ID NO: 44621

SEQ ID NO: 368010 - RNA, 64 nt, Human; identical to SEQ ID NO: 44622

SEQ ID NO: 368011 - RNA, 64 nt, Human; identical to SEQ ID NO: 44623

SEQ ID NO: 368012 - RNA, 64 nt, Human; identical to SEQ ID NO: 44624

SEQ ID NO: 368013 - RNA, 64 nt, Human; identical to SEQ ID NO: 44625

SEQ ID NO: 368014 - RNA, 64 nt, Human; identical to SEQ ID NO: 44626

SEQ ID NO: 368015 - RNA, 64 nt, Human; identical to SEQ ID NO: 44627

SEQ ID NO: 368016 - RNA, 64 nt, Human; identical to SEQ ID NO: 44628

SEQ ID NO: 368017 - RNA, 64 nt, Human; identical to SEQ ID NO: 44629

SEQ ID NO: 368018 - RNA, 64 nt, Human; identical to SEQ ID NO: 44630

SEQ ID NO: 368019 - RNA, 64 nt, Human; identical to SEQ ID NO: 44631

SEQ ID NO: 368020 - RNA, 64 nt, Human; identical to SEQ ID NO: 44632

SEQ ID NO: 368021 - RNA, 64 nt, Human; identical to SEQ ID NO: 44633

SEQ ID NO: 368022 - RNA, 64 nt, Human; identical to SEQ ID NO: 44634

SEQ ID NO: 368023 - RNA, 64 nt, Human; identical to SEQ ID NO: 44635

SEQ ID NO: 368024 - RNA, 64 nt, Human; identical to SEQ ID NO: 44636

SEQ ID NO: 368025 - RNA, 64 nt, Human; identical to SEQ ID NO: 44637

SEQ ID NO: 368026 - RNA, 64 nt, Human; identical to SEQ ID NO: 44638

SEQ ID NO: 368027 - RNA, 64 nt, Human; identical to SEQ ID NO: 44639

SEQ ID NO: 368028 - RNA, 64 nt, Human; identical to SEQ ID NO: 44640

SEQ ID NO: 368029 - RNA, 64 nt, Human; identical to SEQ ID NO: 44641

SEQ ID NO: 368030 - RNA, 64 nt, Human; identical to SEQ ID NO: 44642

SEQ ID NO: 368031 - RNA, 64 nt, Human; identical to SEQ ID NO: 44643

SEQ ID NO: 368032 - RNA, 64 nt, Human; identical to SEQ ID NO: 44644

SEQ ID NO: 368033 - RNA, 64 nt, Human; identical to SEQ ID NO: 44645

SEQ ID NO: 368034 - RNA, 64 nt, Human; identical to SEQ ID NO: 44646

SEQ ID NO: 368035 - RNA, 64 nt, Human; identical to SEQ ID NO: 44647

SEQ ID NO: 368036 - RNA, 64 nt, Human; identical to SEQ ID NO: 44648

SEQ ID NO: 368037 - RNA, 64 nt, Human; identical to SEQ ID NO: 44649

SEQ ID NO: 368038 - RNA, 64 nt, Human; identical to SEQ ID NO: 44650

SEQ ID NO: 368039 - RNA, 64 nt, Human; identical to SEQ ID NO: 44651

SEQ ID NO: 368040 - RNA, 64 nt, Human; identical to SEQ ID NO: 44652

SEQ ID NO: 368041 - RNA, 64 nt, Human; identical to SEQ ID NO: 44653

SEQ ID NO: 368042 - RNA, 64 nt, Human; identical to SEQ ID NO: 44654

SEQ ID NO: 368043 - RNA, 64 nt, Human; identical to SEQ ID NO: 44655

SEQ ID NO: 368044 - RNA, 64 nt, Human; identical to SEQ ID NO: 44656

SEQ ID NO: 368045 - RNA, 60 nt, Human; identical to SEQ ID NO: 367423

SEQ ID NO: 368046 - RNA, 60 nt, Human; identical to SEQ ID NO: 367424

SEQ ID NO: 368047 - RNA, 60 nt, Human; identical to SEQ ID NO: 367425

SEQ ID NO: 368048 - RNA, 60 nt, Human; identical to SEQ ID NO: 367426

SEQ ID NO: 368049 - RNA, 60 nt, Human; identical to SEQ ID NO: 367427

SEQ ID NO: 368050 - RNA, 60 nt, Human; identical to SEQ ID NO: 367428

SEQ ID NO: 368051 - RNA, 60 nt, Human; identical to SEQ ID NO: 367429

SEQ ID NO: 368052 - RNA, 60 nt, Human; identical to SEQ ID NO: 367430

SEQ ID NO: 368053 - RNA, 60 nt, Human; identical to SEQ ID NO: 367431

SEQ ID NO: 368054 - RNA, 60 nt, Human; identical to SEQ ID NO: 367432

SEQ ID NO: 368055 - RNA, 60 nt, Human; identical to SEQ ID NO: 367433

SEQ ID NO: 368056 - RNA, 60 nt, Human; identical to SEQ ID NO: 367434

SEQ ID NO: 368057 - RNA, 60 nt, Human; identical to SEQ ID NO: 367435

SEQ ID NO: 368058 - RNA, 60 nt, Human; identical to SEQ ID NO: 367436

SEQ ID NO: 368059 - RNA, 60 nt, Human; identical to SEQ ID NO: 367437

SEQ ID NO: 368060 - RNA, 60 nt, Human; identical to SEQ ID NO: 367438

SEQ ID NO: 368061 - RNA, 60 nt, Human; identical to SEQ ID NO: 367439

SEQ ID NO: 368062 - RNA, 60 nt, Human; identical to SEQ ID NO: 367440

SEQ ID NO: 368063 - RNA, 60 nt, Human; identical to SEQ ID NO: 367441

SEQ ID NO: 368064 - RNA, 60 nt, Human; identical to SEQ ID NO: 367442

SEQ ID NO: 368065 - RNA, 60 nt, Human; identical to SEQ ID NO: 367443

SEQ ID NO: 368066 - RNA, 60 nt, Human; identical to SEQ ID NO: 367444

SEQ ID NO: 368067 - RNA, 60 nt, Human; identical to SEQ ID NO: 367445

SEQ ID NO: 368068 - RNA, 60 nt, Human; identical to SEQ ID NO: 367446

SEQ ID NO: 368069 - RNA, 60 nt, Human; identical to SEQ ID NO: 367447

SEQ ID NO: 368070 - RNA, 60 nt, Human; identical to SEQ ID NO: 367448

SEQ ID NO: 368071 - RNA, 60 nt, Human; identical to SEQ ID NO: 367449

SEQ ID NO: 368072 - RNA, 60 nt, Human; identical to SEQ ID NO: 367450

SEQ ID NO: 368073 - RNA, 60 nt, Human; identical to SEQ ID NO: 367451

SEQ ID NO: 368074 - RNA, 60 nt, Human; identical to SEQ ID NO: 367452

SEQ ID NO: 368075 - RNA, 60 nt, Human; identical to SEQ ID NO: 367453

SEQ ID NO: 368076 - RNA, 60 nt, Human; identical to SEQ ID NO: 367454

SEQ ID NO: 368077 - RNA, 60 nt, Human; identical to SEQ ID NO: 367455

SEQ ID NO: 368078 - RNA, 60 nt, Human; identical to SEQ ID NO: 367456

SEQ ID NO: 368079 - RNA, 60 nt, Human; identical to SEQ ID NO: 367457

SEQ ID NO: 368080 - RNA, 60 nt, Human; identical to SEQ ID NO: 367458

SEQ ID NO: 368081 - RNA, 60 nt, Human; identical to SEQ ID NO: 367459

SEQ ID NO: 368082 - RNA, 60 nt, Human; identical to SEQ ID NO: 367460

SEQ ID NO: 368083 - RNA, 60 nt, Human; identical to SEQ ID NO: 367461

SEQ ID NO: 368084 - RNA, 60 nt, Human; identical to SEQ ID NO: 367462

SEQ ID NO: 368085 - RNA, 60 nt, Human; identical to SEQ ID NO: 367463

SEQ ID NO: 368086 - RNA, 60 nt, Human; identical to SEQ ID NO: 367464

SEQ ID NO: 368087 - RNA, 60 nt, Human; identical to SEQ ID NO: 367465

SEQ ID NO: 368088 - RNA, 60 nt, Human; identical to SEQ ID NO: 367466

SEQ ID NO: 368089 - RNA, 60 nt, Human; identical to SEQ ID NO: 367467

SEQ ID NO: 368090 - RNA, 60 nt, Human; identical to SEQ ID NO: 367468

SEQ ID NO: 368091 - RNA, 60 nt, Human; identical to SEQ ID NO: 367469

SEQ ID NO: 368092 - RNA, 60 nt, Human; identical to SEQ ID NO: 367470

SEQ ID NO: 368093 - RNA, 60 nt, Human; identical to SEQ ID NO: 367471

SEQ ID NO: 368094 - RNA, 60 nt, Human; identical to SEQ ID NO: 367472

SEQ ID NO: 368095 - RNA, 60 nt, Human; identical to SEQ ID NO: 367473

SEQ ID NO: 368096 - RNA, 60 nt, Human; identical to SEQ ID NO: 367474

SEQ ID NO: 368097 - RNA, 60 nt, Human; identical to SEQ ID NO: 367475

SEQ ID NO: 368098 - RNA, 60 nt, Human; identical to SEQ ID NO: 367476

SEQ ID NO: 368099 - RNA, 60 nt, Human; identical to SEQ ID NO: 367477

SEQ ID NO: 368100 - RNA, 60 nt, Human; identical to SEQ ID NO: 367478

SEQ ID NO: 368101 - RNA, 60 nt, Human; identical to SEQ ID NO: 367479

SEQ ID NO: 368102 - RNA, 60 nt, Human; identical to SEQ ID NO: 367480

SEQ ID NO: 368103 - RNA, 60 nt, Human; identical to SEQ ID NO: 367481

SEQ ID NO: 368104 - RNA, 60 nt, Human; identical to SEQ ID NO: 367482

SEQ ID NO: 368105 - RNA, 60 nt, Human; identical to SEQ ID NO: 367483

SEQ ID NO: 368106 - RNA, 60 nt, Human; identical to SEQ ID NO: 367484

SEQ ID NO: 368107 - RNA, 60 nt, Human; identical to SEQ ID NO: 367485

SEQ ID NO: 368108 - RNA, 60 nt, Human; identical to SEQ ID NO: 367486

SEQ ID NO: 368109 - RNA, 60 nt, Human; identical to SEQ ID NO: 367487

SEQ ID NO: 368110 - RNA, 60 nt, Human; identical to SEQ ID NO: 367488

SEQ ID NO: 368111 - RNA, 60 nt, Human; identical to SEQ ID NO: 367489

SEQ ID NO: 368112 - RNA, 60 nt, Human; identical to SEQ ID NO: 367490

SEQ ID NO: 368113 - RNA, 60 nt, Human; identical to SEQ ID NO: 367491

SEQ ID NO: 368114 - RNA, 60 nt, Human; identical to SEQ ID NO: 367492

SEQ ID NO: 368115 - RNA, 60 nt, Human; identical to SEQ ID NO: 367493

SEQ ID NO: 368116 - RNA, 60 nt, Human; identical to SEQ ID NO: 367494

SEQ ID NO: 368117 - RNA, 60 nt, Human; identical to SEQ ID NO: 367495

SEQ ID NO: 368118 - RNA, 60 nt, Human; identical to SEQ ID NO: 367496

SEQ ID NO: 368119 - RNA, 60 nt, Human; identical to SEQ ID NO: 367497

SEQ ID NO: 368120 - RNA, 60 nt, Human; identical to SEQ ID NO: 367498

SEQ ID NO: 368121 - RNA, 60 nt, Human; identical to SEQ ID NO: 367499

SEQ ID NO: 368122 - RNA, 60 nt, Human; identical to SEQ ID NO: 367500

SEQ ID NO: 368123 - RNA, 60 nt, Human; identical to SEQ ID NO: 367501

SEQ ID NO: 368124 - RNA, 60 nt, Human; identical to SEQ ID NO: 367502

SEQ ID NO: 368125 - RNA, 60 nt, Human; identical to SEQ ID NO: 367503

SEQ ID NO: 368126 - RNA, 60 nt, Human; identical to SEQ ID NO: 367504

SEQ ID NO: 368127 - RNA, 60 nt, Human; identical to SEQ ID NO: 367505

SEQ ID NO: 368128 - RNA, 60 nt, Human; identical to SEQ ID NO: 367506

SEQ ID NO: 368129 - RNA, 60 nt, Human; identical to SEQ ID NO: 367507

SEQ ID NO: 368130 - RNA, 60 nt, Human; identical to SEQ ID NO: 367508

SEQ ID NO: 368131 - RNA, 60 nt, Human; identical to SEQ ID NO: 367509

SEQ ID NO: 368132 - RNA, 60 nt, Human; identical to SEQ ID NO: 367510

SEQ ID NO: 368133 - RNA, 60 nt, Human; identical to SEQ ID NO: 367511

SEQ ID NO: 368134 - RNA, 60 nt, Human; identical to SEQ ID NO: 367512

SEQ ID NO: 368135 - RNA, 60 nt, Human; identical to SEQ ID NO: 367513

SEQ ID NO: 368136 - RNA, 60 nt, Human; identical to SEQ ID NO: 367514

SEQ ID NO: 368137 - RNA, 60 nt, Human; identical to SEQ ID NO: 367515

SEQ ID NO: 368138 - RNA, 60 nt, Human; identical to SEQ ID NO: 367516

SEQ ID NO: 368139 - RNA, 60 nt, Human; identical to SEQ ID NO: 367517

SEQ ID NO: 368140 - RNA, 60 nt, Human; identical to SEQ ID NO: 367518

SEQ ID NO: 368141 - RNA, 60 nt, Human; identical to SEQ ID NO: 367519

SEQ ID NO: 368142 - RNA, 60 nt, Human; identical to SEQ ID NO: 367520

SEQ ID NO: 368143 - RNA, 60 nt, Human; identical to SEQ ID NO: 367521

SEQ ID NO: 368144 - RNA, 60 nt, Human; identical to SEQ ID NO: 367522

SEQ ID NO: 368145 - RNA, 60 nt, Human; identical to SEQ ID NO: 367523

SEQ ID NO: 368146 - RNA, 60 nt, Human; identical to SEQ ID NO: 367524

SEQ ID NO: 368147 - RNA, 60 nt, Human; identical to SEQ ID NO: 367525

SEQ ID NO: 368148 - RNA, 60 nt, Human; identical to SEQ ID NO: 367526

SEQ ID NO: 368149 - RNA, 60 nt, Human; identical to SEQ ID NO: 367527

SEQ ID NO: 368150 - RNA, 60 nt, Human; identical to SEQ ID NO: 367528

SEQ ID NO: 368151 - RNA, 60 nt, Human; identical to SEQ ID NO: 367529

SEQ ID NO: 368152 - RNA, 60 nt, Human; identical to SEQ ID NO: 367530

SEQ ID NO: 368153 - RNA, 60 nt, Human; identical to SEQ ID NO: 367531

SEQ ID NO: 368154 - RNA, 60 nt, Human; identical to SEQ ID NO: 367532

SEQ ID NO: 368155 - RNA, 60 nt, Human; identical to SEQ ID NO: 367533

SEQ ID NO: 368156 - RNA, 60 nt, Human; identical to SEQ ID NO: 367534

SEQ ID NO: 368157 - RNA, 60 nt, Human; identical to SEQ ID NO: 367535

SEQ ID NO: 368158 - RNA, 60 nt, Human; identical to SEQ ID NO: 367536

SEQ ID NO: 368159 - RNA, 60 nt, Human; identical to SEQ ID NO: 367537

SEQ ID NO: 368160 - RNA, 60 nt, Human; identical to SEQ ID NO: 367538

SEQ ID NO: 368161 - RNA, 60 nt, Human; identical to SEQ ID NO: 367539

SEQ ID NO: 368162 - RNA, 60 nt, Human; identical to SEQ ID NO: 367540

SEQ ID NO: 368163 - RNA, 60 nt, Human; identical to SEQ ID NO: 367541

SEQ ID NO: 368164 - RNA, 60 nt, Human; identical to SEQ ID NO: 367542

SEQ ID NO: 368165 - RNA, 60 nt, Human; identical to SEQ ID NO: 367543

SEQ ID NO: 368166 - RNA, 60 nt, Human; identical to SEQ ID NO: 367544

SEQ ID NO: 368167 - RNA, 60 nt, Human; identical to SEQ ID NO: 367545

SEQ ID NO: 368168 - RNA, 60 nt, Human; identical to SEQ ID NO: 367546

SEQ ID NO: 368169 - RNA, 60 nt, Human; identical to SEQ ID NO: 367547

SEQ ID NO: 368170 - RNA, 60 nt, Human; identical to SEQ ID NO: 367548

SEQ ID NO: 368171 - RNA, 60 nt, Human; identical to SEQ ID NO: 367549

SEQ ID NO: 368172 - RNA, 60 nt, Human; identical to SEQ ID NO: 367550

SEQ ID NO: 368173 - RNA, 60 nt, Human; identical to SEQ ID NO: 367551

SEQ ID NO: 368174 - RNA, 60 nt, Human; identical to SEQ ID NO: 367552

SEQ ID NO: 368175 - RNA, 60 nt, Human; identical to SEQ ID NO: 367553

SEQ ID NO: 368176 - RNA, 60 nt, Human; identical to SEQ ID NO: 367554

SEQ ID NO: 368177 - RNA, 60 nt, Human; identical to SEQ ID NO: 367555

SEQ ID NO: 368178 - RNA, 60 nt, Human; identical to SEQ ID NO: 367556

SEQ ID NO: 368179 - RNA, 60 nt, Human; identical to SEQ ID NO: 367557

SEQ ID NO: 368180 - RNA, 60 nt, Human; identical to SEQ ID NO: 367558

SEQ ID NO: 368181 - RNA, 60 nt, Human; identical to SEQ ID NO: 367559

SEQ ID NO: 368182 - RNA, 60 nt, Human; identical to SEQ ID NO: 367560

SEQ ID NO: 368183 - RNA, 60 nt, Human; identical to SEQ ID NO: 367561

SEQ ID NO: 368184 - RNA, 60 nt, Human; identical to SEQ ID NO: 367562

SEQ ID NO: 368185 - RNA, 60 nt, Human; identical to SEQ ID NO: 367563

SEQ ID NO: 368186 - RNA, 60 nt, Human; identical to SEQ ID NO: 367564

SEQ ID NO: 368187 - RNA, 60 nt, Human; identical to SEQ ID NO: 367565

SEQ ID NO: 368188 - RNA, 60 nt, Human; identical to SEQ ID NO: 367566

SEQ ID NO: 368189 - RNA, 60 nt, Human; identical to SEQ ID NO: 367567

SEQ ID NO: 368190 - RNA, 60 nt, Human; identical to SEQ ID NO: 367568

SEQ ID NO: 368191 - RNA, 60 nt, Human; identical to SEQ ID NO: 367569

SEQ ID NO: 368192 - RNA, 60 nt, Human; identical to SEQ ID NO: 367570

SEQ ID NO: 368193 - RNA, 60 nt, Human; identical to SEQ ID NO: 367571

SEQ ID NO: 368194 - RNA, 60 nt, Human; identical to SEQ ID NO: 367572

SEQ ID NO: 368195 - RNA, 60 nt, Human; identical to SEQ ID NO: 367573

SEQ ID NO: 368196 - RNA, 60 nt, Human; identical to SEQ ID NO: 367574

SEQ ID NO: 368197 - RNA, 60 nt, Human; identical to SEQ ID NO: 367575

SEQ ID NO: 368198 - RNA, 60 nt, Human; identical to SEQ ID NO: 367576

SEQ ID NO: 368199 - RNA, 60 nt, Human; identical to SEQ ID NO: 367577

SEQ ID NO: 368200 - RNA, 60 nt, Human; identical to SEQ ID NO: 367578

SEQ ID NO: 368201 - RNA, 60 nt, Human; identical to SEQ ID NO: 367579

SEQ ID NO: 368202 - RNA, 60 nt, Human; identical to SEQ ID NO: 367580

SEQ ID NO: 368203 - RNA, 60 nt, Human; identical to SEQ ID NO: 367581

SEQ ID NO: 368204 - RNA, 60 nt, Human; identical to SEQ ID NO: 367582

SEQ ID NO: 368205 - RNA, 60 nt, Human; identical to SEQ ID NO: 367583

SEQ ID NO: 368206 - RNA, 60 nt, Human; identical to SEQ ID NO: 367584

SEQ ID NO: 368207 - RNA, 60 nt, Human; identical to SEQ ID NO: 367585

SEQ ID NO: 368208 - RNA, 60 nt, Human; identical to SEQ ID NO: 367586

SEQ ID NO: 368209 - RNA, 60 nt, Human; identical to SEQ ID NO: 367587

SEQ ID NO: 368210 - RNA, 60 nt, Human; identical to SEQ ID NO: 367588

SEQ ID NO: 368211 - RNA, 60 nt, Human; identical to SEQ ID NO: 367589

SEQ ID NO: 368212 - RNA, 60 nt, Human; identical to SEQ ID NO: 367590

SEQ ID NO: 368213 - RNA, 60 nt, Human; identical to SEQ ID NO: 367591

SEQ ID NO: 368214 - RNA, 60 nt, Human; identical to SEQ ID NO: 367592

SEQ ID NO: 368215 - RNA, 60 nt, Human; identical to SEQ ID NO: 367593

SEQ ID NO: 368216 - RNA, 60 nt, Human; identical to SEQ ID NO: 367594

SEQ ID NO: 368217 - RNA, 60 nt, Human; identical to SEQ ID NO: 367595

SEQ ID NO: 368218 - RNA, 60 nt, Human; identical to SEQ ID NO: 367596

SEQ ID NO: 368219 - RNA, 60 nt, Human; identical to SEQ ID NO: 367597

SEQ ID NO: 368220 - RNA, 60 nt, Human; identical to SEQ ID NO: 367598

SEQ ID NO: 368221 - RNA, 60 nt, Human; identical to SEQ ID NO: 367599

SEQ ID NO: 368222 - RNA, 60 nt, Human; identical to SEQ ID NO: 367600

SEQ ID NO: 368223 - RNA, 60 nt, Human; identical to SEQ ID NO: 367601

SEQ ID NO: 368224 - RNA, 60 nt, Human; identical to SEQ ID NO: 367602

SEQ ID NO: 368225 - RNA, 60 nt, Human; identical to SEQ ID NO: 367603

SEQ ID NO: 368226 - RNA, 60 nt, Human; identical to SEQ ID NO: 367604

SEQ ID NO: 368227 - RNA, 60 nt, Human; identical to SEQ ID NO: 367605

SEQ ID NO: 368228 - RNA, 60 nt, Human; identical to SEQ ID NO: 367606

SEQ ID NO: 368229 - RNA, 60 nt, Human; identical to SEQ ID NO: 367607

SEQ ID NO: 368230 - RNA, 60 nt, Human; identical to SEQ ID NO: 367608

SEQ ID NO: 368231 - RNA, 60 nt, Human; identical to SEQ ID NO: 367609

SEQ ID NO: 368232 - RNA, 60 nt, Human; identical to SEQ ID NO: 367610

SEQ ID NO: 368233 - RNA, 60 nt, Human; identical to SEQ ID NO: 367611

SEQ ID NO: 368234 - RNA, 60 nt, Human; identical to SEQ ID NO: 367612

SEQ ID NO: 368235 - RNA, 60 nt, Human; identical to SEQ ID NO: 367613

SEQ ID NO: 368236 - RNA, 60 nt, Human; identical to SEQ ID NO: 367614

SEQ ID NO: 368237 - RNA, 60 nt, Human; identical to SEQ ID NO: 367615

SEQ ID NO: 368238 - RNA, 60 nt, Human; identical to SEQ ID NO: 367616

SEQ ID NO: 368239 - RNA, 60 nt, Human; identical to SEQ ID NO: 367617

SEQ ID NO: 368240 - RNA, 60 nt, Human; identical to SEQ ID NO: 367618

SEQ ID NO: 368241 - RNA, 60 nt, Human; identical to SEQ ID NO: 367619

SEQ ID NO: 368242 - RNA, 60 nt, Human; identical to SEQ ID NO: 367620

SEQ ID NO: 368243 - RNA, 60 nt, Human; identical to SEQ ID NO: 367621

SEQ ID NO: 368244 - RNA, 60 nt, Human; identical to SEQ ID NO: 367622

SEQ ID NO: 368245 - RNA, 60 nt, Human; identical to SEQ ID NO: 367623

SEQ ID NO: 368246 - RNA, 60 nt, Human; identical to SEQ ID NO: 367624

SEQ ID NO: 368247 - RNA, 60 nt, Human; identical to SEQ ID NO: 367625

SEQ ID NO: 368248 - RNA, 60 nt, Human; identical to SEQ ID NO: 367626

SEQ ID NO: 368249 - RNA, 60 nt, Human; identical to SEQ ID NO: 367627

SEQ ID NO: 368250 - RNA, 60 nt, Human; identical to SEQ ID NO: 367628

SEQ ID NO: 368251 - RNA, 60 nt, Human; identical to SEQ ID NO: 367629

SEQ ID NO: 368252 - RNA, 60 nt, Human; identical to SEQ ID NO: 367630

SEQ ID NO: 368253 - RNA, 60 nt, Human; identical to SEQ ID NO: 367631

SEQ ID NO: 368254 - RNA, 60 nt, Human; identical to SEQ ID NO: 367632

SEQ ID NO: 368255 - RNA, 60 nt, Human; identical to SEQ ID NO: 367633

SEQ ID NO: 368256 - RNA, 60 nt, Human; identical to SEQ ID NO: 367634

SEQ ID NO: 368257 - RNA, 60 nt, Human; identical to SEQ ID NO: 367635

SEQ ID NO: 368258 - RNA, 60 nt, Human; identical to SEQ ID NO: 367636

SEQ ID NO: 368259 - RNA, 60 nt, Human; identical to SEQ ID NO: 367637

SEQ ID NO: 368260 - RNA, 60 nt, Human; identical to SEQ ID NO: 367638

SEQ ID NO: 368261 - RNA, 60 nt, Human; identical to SEQ ID NO: 367639

SEQ ID NO: 368262 - RNA, 60 nt, Human; identical to SEQ ID NO: 367640

SEQ ID NO: 368263 - RNA, 60 nt, Human; identical to SEQ ID NO: 367641

SEQ ID NO: 368264 - RNA, 60 nt, Human; identical to SEQ ID NO: 367642

SEQ ID NO: 368265 - RNA, 60 nt, Human; identical to SEQ ID NO: 367643

SEQ ID NO: 368266 - RNA, 60 nt, Human; identical to SEQ ID NO: 367644

SEQ ID NO: 368267 - RNA, 60 nt, Human; identical to SEQ ID NO: 367645

SEQ ID NO: 368268 - RNA, 60 nt, Human; identical to SEQ ID NO: 367646

SEQ ID NO: 368269 - RNA, 60 nt, Human; identical to SEQ ID NO: 367647

SEQ ID NO: 368270 - RNA, 60 nt, Human; identical to SEQ ID NO: 367648

SEQ ID NO: 368271 - RNA, 60 nt, Human; identical to SEQ ID NO: 367649

SEQ ID NO: 368272 - RNA, 60 nt, Human; identical to SEQ ID NO: 367650

SEQ ID NO: 368273 - RNA, 60 nt, Human; identical to SEQ ID NO: 367651

SEQ ID NO: 368274 - RNA, 60 nt, Human; identical to SEQ ID NO: 367652

SEQ ID NO: 368275 - RNA, 60 nt, Human; identical to SEQ ID NO: 367653

SEQ ID NO: 368276 - RNA, 60 nt, Human; identical to SEQ ID NO: 367654

SEQ ID NO: 368277 - RNA, 60 nt, Human; identical to SEQ ID NO: 367655

SEQ ID NO: 368278 - RNA, 60 nt, Human; identical to SEQ ID NO: 367656

SEQ ID NO: 368279 - RNA, 60 nt, Human; identical to SEQ ID NO: 367657

SEQ ID NO: 368280 - RNA, 60 nt, Human; identical to SEQ ID NO: 367658

SEQ ID NO: 368281 - RNA, 60 nt, Human; identical to SEQ ID NO: 367659

SEQ ID NO: 368282 - RNA, 60 nt, Human; identical to SEQ ID NO: 367660

SEQ ID NO: 368283 - RNA, 60 nt, Human; identical to SEQ ID NO: 367661

SEQ ID NO: 368284 - RNA, 60 nt, Human; identical to SEQ ID NO: 367662

SEQ ID NO: 368285 - RNA, 60 nt, Human; identical to SEQ ID NO: 367663

SEQ ID NO: 368286 - RNA, 60 nt, Human; identical to SEQ ID NO: 367664

SEQ ID NO: 368287 - RNA, 60 nt, Human; identical to SEQ ID NO: 367665

SEQ ID NO: 368288 - RNA, 60 nt, Human; identical to SEQ ID NO: 367666

SEQ ID NO: 368289 - RNA, 60 nt, Human; identical to SEQ ID NO: 367667

SEQ ID NO: 368290 - RNA, 60 nt, Human; identical to SEQ ID NO: 367668

SEQ ID NO: 368291 - RNA, 60 nt, Human; identical to SEQ ID NO: 367669

SEQ ID NO: 368292 - RNA, 60 nt, Human; identical to SEQ ID NO: 367670

SEQ ID NO: 368293 - RNA, 60 nt, Human; identical to SEQ ID NO: 367671

SEQ ID NO: 368294 - RNA, 60 nt, Human; identical to SEQ ID NO: 367672

SEQ ID NO: 368295 - RNA, 60 nt, Human; identical to SEQ ID NO: 367673

SEQ ID NO: 368296 - RNA, 60 nt, Human; identical to SEQ ID NO: 367674

SEQ ID NO: 368297 - RNA, 60 nt, Human; identical to SEQ ID NO: 367675

SEQ ID NO: 368298 - RNA, 60 nt, Human; identical to SEQ ID NO: 367676

SEQ ID NO: 368299 - RNA, 60 nt, Human; identical to SEQ ID NO: 367677

SEQ ID NO: 368300 - RNA, 60 nt, Human; identical to SEQ ID NO: 367678

SEQ ID NO: 368301 - RNA, 60 nt, Human; identical to SEQ ID NO: 367679

SEQ ID NO: 368302 - RNA, 60 nt, Human; identical to SEQ ID NO: 367680

SEQ ID NO: 368303 - RNA, 60 nt, Human; identical to SEQ ID NO: 367681

SEQ ID NO: 368304 - RNA, 60 nt, Human; identical to SEQ ID NO: 367682

SEQ ID NO: 368305 - RNA, 60 nt, Human; identical to SEQ ID NO: 367683

SEQ ID NO: 368306 - RNA, 60 nt, Human; identical to SEQ ID NO: 367684

SEQ ID NO: 368307 - RNA, 60 nt, Human; identical to SEQ ID NO: 367685

SEQ ID NO: 368308 - RNA, 60 nt, Human; identical to SEQ ID NO: 367686

SEQ ID NO: 368309 - RNA, 60 nt, Human; identical to SEQ ID NO: 367687

SEQ ID NO: 368310 - RNA, 60 nt, Human; identical to SEQ ID NO: 367688

SEQ ID NO: 368311 - RNA, 60 nt, Human; identical to SEQ ID NO: 367689

SEQ ID NO: 368312 - RNA, 60 nt, Human; identical to SEQ ID NO: 367690

SEQ ID NO: 368313 - RNA, 60 nt, Human; identical to SEQ ID NO: 367691

SEQ ID NO: 368314 - RNA, 60 nt, Human; identical to SEQ ID NO: 367692

SEQ ID NO: 368315 - RNA, 60 nt, Human; identical to SEQ ID NO: 367693

SEQ ID NO: 368316 - RNA, 60 nt, Human; identical to SEQ ID NO: 367694

SEQ ID NO: 368317 - RNA, 60 nt, Human; identical to SEQ ID NO: 367695

SEQ ID NO: 368318 - RNA, 60 nt, Human; identical to SEQ ID NO: 367696

SEQ ID NO: 368319 - RNA, 60 nt, Human; identical to SEQ ID NO: 367697

SEQ ID NO: 368320 - RNA, 60 nt, Human; identical to SEQ ID NO: 367698

SEQ ID NO: 368321 - RNA, 60 nt, Human; identical to SEQ ID NO: 367699

SEQ ID NO: 368322 - RNA, 64 nt, Human
uccaauuuccuggcucauuucauugugcucuauggguacguauaaaaagcaagaauucuguuuc

SEQ ID NO: 368323 - RNA, 64 nt, Human
guuauuugcaaaagguagauuauguaaccaaucagguacguaccaggcagugaugugcuaauac

SEQ ID NO: 368324 - RNA, 64 nt, Human
uaugaaacuuuaauggggccccuccugugccaaggguacguauauugugaaguaaagccucaca

SEQ ID NO: 368325 - RNA, 64 nt, Human
uguugaacuaaguaacuguguaaaucugugcaaagguacguauguuuaucuuacucuuccuaua

SEQ ID NO: 368326 - RNA, 64 nt, Human
agccugugacacagaguacccagugaaaguggcugguacguagauugucaagagacauaagacc

SEQ ID NO: 368327 - RNA, 64 nt, Human
uuuucuccauauucuucaagacgauugugaguaugguacguaacaggaauuacaucugguaagu

SEQ ID NO: 368328 - RNA, 64 nt, Human
aucugguaguagaugauuuccuuaauuuuuauuagguacguaacuauuuccaaauccucuaauu

SEQ ID NO: 368329 - RNA, 64 nt, Human
ccuuugauaugcugcauagcuaguucuaggcauagguacguagugugacacuucugacuucacu

SEQ ID NO: 368330 - RNA, 64 nt, Human
auuggucccuugaaaauaugcuuccuguaucaaagguacguauguggugcaaacaaggcagaaa

SEQ ID NO: 368331 - RNA, 64 nt, Human
uaugaagccucugauacuuaaacagcauggcgcugguacguaaauagaccaaugcaguuaggug

SEQ ID NO: 368332 - RNA, 64 nt, Human
ugagccugcuggcugcagagcacuaugaaaucaugguacguaguccccggcaccugucguuauu

SEQ ID NO: 368333 - RNA, 64 nt, Human
acuuuaacaguuauuaaacaguguuuucuuuuuggguacguauuguuucuggauaucaagaugu

SEQ ID NO: 368334 - RNA, 64 nt, Human
ggcacugcgacuuugugaagcugaggacaaugcugguacguacccacaugcaggaccugaagga

SEQ ID NO: 368335 - RNA, 64 nt, Human
aaaaacaaaaaacaacacuuugguguggugguaugguacguagcuauuuuccuaagcaugucug

SEQ ID NO: 368336 - RNA, 64 nt, Human
auagaggagaauauguaaaggguauacauuaauugguacguagcauuuaaaaucaggucuuaua

SEQ ID NO: 368337 - RNA, 64 nt, Human
auuucuccuguuucuuggugggggugggggggaagguacguauucugcaauauggcuaaacccu

SEQ ID NO: 368338 - RNA, 64 nt, Human
ugucuccauccuguucgugucuuucugcaguuuucggcaauaagaaguagaagauuugcugucc

SEQ ID NO: 368339 - RNA, 64 nt, Human
auaaucugaaucaccagcauucaaacaaauauuucggcaauaaaguuuacaaaaucuggauuuu

SEQ ID NO: 368340 - RNA, 64 nt, Human
agugaacugaggcaacaguccacuucagggcagacggcaauaaucucuuacaagaaugaagcca

SEQ ID NO: 368341 - RNA, 64 nt, Human
ccacagccugucucuucucuuguuuaguuacuuacggcaauaaaucaucuaugaguuagugcac

SEQ ID NO: 368342 - RNA, 64 nt, Human
cuuaacccuagguaagaguaaaugagaaauauuacggcaauaauggaacugcuucacuguuucu

SEQ ID NO: 368343 - RNA, 64 nt, Human; identical to SEQ ID NO: 116669

SEQ ID NO: 368344 - RNA, 64 nt, Human; identical to SEQ ID NO: 116676

SEQ ID NO: 368345 - RNA, 64 nt, Human; identical to SEQ ID NO: 116679

SEQ ID NO: 368346 - RNA, 64 nt, Human
ucagacuaaugauagugucugcuuucugcaugaacggcaauaugggacucccuccaagcuaggg

SEQ ID NO: 368347 - RNA, 64 nt, Human
aacuugguucaagauggugggggcauuuuuagagcggcaauaauugaaaaaaaaggcgaacucu

SEQ ID NO: 368348 - RNA, 64 nt, Human
agaaguaccugaaaacagcugugcauggcaggcccggcaauagcuucugacccacagcacccgc

SEQ ID NO: 368349 - RNA, 64 nt, Human
cugugaacgagcagggcaaggaggugaccgaguucggcaauaaguacuggcucaugcucaacga

SEQ ID NO: 368350 - RNA, 64 nt, Human
gggcaggaccagcccacgcugacuacagggccgccggcaauaaaagcccaggagcccauuugga

SEQ ID NO: 368351 - RNA, 64 nt, Human
aaaaauuucuggcuucucuuaccccuauugcccccggcaauaaauuguuucuauaugccagagc

SEQ ID NO: 368352 - RNA, 64 nt, Human
uauucaagaugaaucaaaaugauggcugguaauacggcaauaagguagcaaaggcaggugcuuu

SEQ ID NO: 368353 - RNA, 64 nt, Human
gugccaaaagcuugggggaggagggacagguccucggcaauaaacagugucacacacgcaucac

SEQ ID NO: 368354 - RNA, 64 nt, Human
auuauuguacagagguauuaaugagacuaugaaacggcaauacuuuuuuaaaucacagauuugu

SEQ ID NO: 368355 - RNA, 64 nt, Human
ccacccagagcaggagcuggcgggugucuuccugcggcaauagacuggaacgauuaaggaccau

SEQ ID NO: 368356 - RNA, 64 nt, Human
ucaguccagcuucccaaugccuggcaccccccuucggcaauagcucaccguuuacacccucccu

SEQ ID NO: 368357 - RNA, 64 nt, Human
uccagcuccccuucccgcugagagccacuuucaucggcaauaaaaucccccacauuuaccaucu

SEQ ID NO: 368358 - RNA, 64 nt, Human
uuggauacccgacguucucccuggacacuuggcccggcaauaguuggggucuccugggaagcug

SEQ ID NO: 368359 - RNA, 64 nt, Human; identical to SEQ ID NO: 116547

SEQ ID NO: 368360 - RNA, 64 nt, Human; identical to SEQ ID NO: 116548

SEQ ID NO: 368361 - RNA, 64 nt, Human; identical to SEQ ID NO: 116685

SEQ ID NO: 368362 - RNA, 64 nt, Human
ugcccauuuauuuccaaccccaacagacacugacaggguccauggaauucuucgggaaauccuc

SEQ ID NO: 368363 - RNA, 64 nt, Human
cauuuuggggcuaggaucagggcacuauuccuggaggguccagucauucaccagcauuugcaaa

SEQ ID NO: 368364 - RNA, 64 nt, Human
uaaaacccucucauauauagacagcuuugacuggaggguccauuuuucuuccaggaugguguua

SEQ ID NO: 368365 - RNA, 58 nt, Human
accgggccaucauggaguaggugcuuccaggguccaagggauucucagccauccaggc

SEQ ID NO: 368366 - RNA, 64 nt, Human
ggggaagaacacggaugaaaaugucaguuuuugaaggguccaugcacaucccugacaccucaca

SEQ ID NO: 368367 - RNA, 64 nt, Human
cucuccuaucaccuucccccaagauuaccugaacaggguccauggccacucaaccugucagcuu

SEQ ID NO: 368368 - RNA, 64 nt, Human
aaaauaauccagucuucacuggguucccauucugaggguccacuacucaaaaauuugcuucacu

SEQ ID NO: 368369 - RNA, 64 nt, Human
gacagagagcuccuuugacacaaaagacaggagcaggguccagguuccccugcugugcagggag

SEQ ID NO: 368370 - RNA, 64 nt, Human
gugcugagaguuaggacaggucaggaagucccccaggguccacaaaggugccugaggcucuggu

SEQ ID NO: 368371 - RNA, 64 nt, Human
gagguguggagaccugcccucgggggccucucccaggguccagccugagcccccaccagggguc

SEQ ID NO: 368372 - RNA, 64 nt, Human
gaagacucugcugccauccguucucccagucccaaggguccacgauguacaaagucauuucggc

SEQ ID NO: 368373 - RNA, 64 nt, Human
cuccaccagcaaggggaccccgagaacccugagcaggguccacagcuggaaaguugggccccug

SEQ ID NO: 368374 - RNA, 64 nt, Human
gauucaccccccucugcugccggcucugggccugaggguccaccuggagaguacauuugcuuua

SEQ ID NO: 368375 - RNA, 64 nt, Human
caggaggccgaggucucuaacucuuaucuuccacaggguccaagaguucaucaggacccccaag

SEQ ID NO: 368376 - RNA, 64 nt, Human
cuuucccgcgcacugaaagggcagaguaggccgaaggguccaagggccagacugccucacccuc

SEQ ID NO: 368377 - RNA, 64 nt, Human
acccucuucauuuggccaugucagcuugucaggaaggguccaucaaucagccaccaugucuuac

SEQ ID NO: 368378 - RNA, 64 nt, Human; identical to SEQ ID NO: 116691

SEQ ID NO: 368379 - RNA, 64 nt, Human; identical to SEQ ID NO: 116695

SEQ ID NO: 368380 - RNA, 64 nt, Human; identical to SEQ ID NO: 116699

SEQ ID NO: 368381 - RNA, 64 nt, Human
cucuuaaaggccugagcuagcuggagaagaggggaggguccauaagcccaugacuaaaaacuac

SEQ ID NO: 368382 - RNA, 64 nt, Human
gccucugugaggcuucaguggccucagaaaccagaggguccagauagggggccugcuugggccc

SEQ ID NO: 368383 - RNA, 64 nt, Human
gccuccugcucucuggguauagacaggggugggaaggguccaucugggcaaggggaauggggcc

SEQ ID NO: 368384 - RNA, 64 nt, Human
ccccugcagguggccccugacccugcguugcagcaggguccaccugugagcaggcccgcccugg

SEQ ID NO: 368385 - RNA, 64 nt, Human
gggggaaaggaaagaauucacuagaaauuuguuuaggguccaguugauuuguguauuuuuguua

SEQ ID NO: 368386 - RNA, 64 nt, Human
gacaagcauauauucugaucaaaaauugggagccaggguccaauaguuggacuauucaaaguug

SEQ ID NO: 368387 - RNA, 64 nt, Human
guguuuugugucugaguccccucccucaucccuuaggguccagaagagcaauggaggaagugac

SEQ ID NO: 368388 - RNA, 64 nt, Human
ucaccaagaaggggcucgagugccccugcaggggaggguccaaucuccggugugagcccaccuc

SEQ ID NO: 368389 - RNA, 64 nt, Human
uuugggagcagcuuuugaugaaguuccacccaugaggguccauguggcaaguagggccacaggg

SEQ ID NO: 368390 - RNA, 64 nt, Human
ccuucaauugauaauaaaccuuucugagaugcagaggguccaggucagauguugucuaccguuu

SEQ ID NO: 368391 - RNA, 64 nt, Human
ugucuuugguggggcaggggaguugacagggaugaggguccaaggaauaagcaugaaugacaag

SEQ ID NO: 368392 - RNA, 64 nt, Human
caggaggccucaucucacuguagcccuggaacccaggguccaucuugcccuucccccauccaug

SEQ ID NO: 368393 - RNA, 64 nt, Human
uguuuuacuuuuuuaacauguguuaaacagagaaaggguccaugaaggaaaguguaugaguugc

SEQ ID NO: 368394 - RNA, 64 nt, Human
gcuuuagauguguauacagaaaaugaaagaaacuaggguccauaugagggaaaacccaauguca

SEQ ID NO: 368395 - RNA, 64 nt, Human
caugugcaagguccuggaacuacagggauaagacaggguccaugccgucucaaggcauuuacgg

SEQ ID NO: 368396 - RNA, 64 nt, Human
ugcuucaguucucagcuguuuaccacagcccuccaggguccaaagauugaggagcuuucucuuu

SEQ ID NO: 368397 - RNA, 64 nt, Human; identical to SEQ ID NO: 116705

SEQ ID NO: 368398 - RNA, 64 nt, Human; identical to SEQ ID NO: 116711

SEQ ID NO: 368399 - RNA, 64 nt, Human; identical to SEQ ID NO: 116718

SEQ ID NO: 368400 - RNA, 64 nt, Human
uuaauguaaacaguaaguccuaagcuuugauggaaggguccauacauuuuuuuuuuuuuuuugc

SEQ ID NO: 368401 - RNA, 64 nt, Human
agagccagugacugucccucccagcagccuccaaaggguccaaaguccaagcuagcucuggccu

SEQ ID NO: 368402 - RNA, 64 nt, Human
agcuaagccuuaugugagccccuucagggacucaaggguccagaagucccucccaucucuaccc

SEQ ID NO: 368403 - RNA, 64 nt, Human
agacaaguaugacuuuuauaugaaccccuucuuuaggguccagaaggaauuguggacugaauca

SEQ ID NO: 368404 - RNA, 64 nt, Human
cuuuagaaauguucauguuagugcuugggucuuaaggguccauaggauaaaugauuaaaauuuc

SEQ ID NO: 368405 - RNA, 64 nt, Human
aauguuugagaauuacuggguuaaauugugggaaaggguccagauuuuaaaggugcuuuaaggu

SEQ ID NO: 368406 - RNA, 64 nt, Human
uuuuuggauaguuaccacugggagaccuuugaaaaggguccaugaacucugaaaucacugagaa

SEQ ID NO: 368407 - RNA, 64 nt, Human
auaaaacccaaaccacauaugaaaaaauccauuaaggguccaagaagucuguccauaugaaaau

SEQ ID NO: 368408 - RNA, 64 nt, Human
ggaaaggaaugccucugucuugugaaguaggacaaggguccaggagaacugagacgcaggaugg

SEQ ID NO: 368409 - RNA, 64 nt, Human
ugcugucacaaggagagcaggcugaguuuggagcaggguccauccggcaguccugggacggcuu

SEQ ID NO: 368410 - RNA, 64 nt, Human
uuccuaucuaaaugggugggccauuugauuguagaggguccaccacagaauuaugggaugccuu

SEQ ID NO: 368411 - RNA, 64 nt, Human
ugaaguuagcucagauguggagauucauagaaugaggguccaggagaagaaaguuaggggaaau

SEQ ID NO: 368412 - RNA, 64 nt, Human
cagaugggaauucaaauaugaauccucucuggagaggguccaacugggaauccugcuaaaggag

SEQ ID NO: 368413 - RNA, 64 nt, Human
aggcucacucacagagucaaggccugcucccuguaggguccaaccagaccuggaagaacaggcc

SEQ ID NO: 368414 - RNA, 64 nt, Human
ggaaacuggccagggguccuguuaacgucaucucaggguccagacccugaagauuucagaggcu

SEQ ID NO: 368415 - RNA, 64 nt, Human
acaaccaaacucugccaggggucccagaaagcccaggguccagcagucucagcacuuggccccu

SEQ ID NO: 368416 - RNA, 64 nt, Human; identical to SEQ ID NO: 116725

SEQ ID NO: 368417 - RNA, 64 nt, Human; identical to SEQ ID NO: 116732

SEQ ID NO: 368418 - RNA, 64 nt, Human; identical to SEQ ID NO: 116739

SEQ ID NO: 368419 - RNA, 64 nt, Human
gccugucaagccaggggcccacacaccuggugccaggguccaccuugguauaccagcucggcag

SEQ ID NO: 368420 - RNA, 64 nt, Human
cuuucuaaagauucaaguggacuugacuaagcugaggguccacgaaauagaauaugacauguga

SEQ ID NO: 368421 - RNA, 64 nt, Human
cuccccaguuuuuuuccccacuguguguggggggaggguccauaaacccgagugugccuuugcu

SEQ ID NO: 368422 - RNA, 64 nt, Human
uugcacaguagaugcuauggaucauucugagcucaggguccagacuuuauucuuauucccagaa

SEQ ID NO: 368423 - RNA, 64 nt, Human
guggugaggggccuugcccucccgcucccagcccaggguccaaccugacccagugaucuuccau

SEQ ID NO: 368424 - RNA, 64 nt, Human
acuuagccagcccuggcuguuguauuaccaaagcaggguccauguuugcugccuuaacccuguc

SEQ ID NO: 368425 - RNA, 64 nt, Human
ugaccucaugaccacgcuggcccuucucccaugcaggguccagguccucuccccucauuuccau

SEQ ID NO: 368426 - RNA, 64 nt, Human
ucaagcuggaagggauggggcuguugguggggucaggguccaagaggaauggguguucuguggc

SEQ ID NO: 368427 - RNA, 56 nt, Human
gaagaaggagaaaauucugaauuucuaggguccaaaaguugacaaaaccauuagua

SEQ ID NO: 368428 - RNA, 64 nt, Human
uaaggagccucuuggcaguccuuaagcagucuugaggguccauccuuuuucucuaauuggucgc

SEQ ID NO: 368429 - RNA, 64 nt, Human
cauuuuuuuuuuuuuuaggcauagaagccaguucaggguccauaauauuuagugaccaacauuu

SEQ ID NO: 368430 - RNA, 64 nt, Human
aucuaaugaacucagaggcuuagcucgccucuuuaggguccaugguggcagcagagaggcagaa

SEQ ID NO: 368431 - RNA, 64 nt, Human
aaauuccagaaguggaggcuccagccuccccgcgaggguccagccccacagucuucugggagcc

SEQ ID NO: 368432 - RNA, 56 nt, Human
aaagcucuuccacccuguaagggggaaggguccacauagaaaagcaagacaagcca

SEQ ID NO: 368433 - RNA, 64 nt, Human
gaacuugaagggaugcuuggagugaguagauuugaggguccaguuauggagugcuacuaaaaca

SEQ ID NO: 368434 - RNA, 64 nt, Human
gcccaaccucacugacggugaaaaaauguuugccaggguccagaaacuuuuuuugguuuauuuc

SEQ ID NO: 368435 - RNA, 64 nt, Human; identical to SEQ ID NO: 116746

SEQ ID NO: 368436 - RNA, 64 nt, Human; identical to SEQ ID NO: 116751

SEQ ID NO: 368437 - RNA, 64 nt, Human; identical to SEQ ID NO: 116758

SEQ ID NO: 368438 - RNA, 64 nt, Human
cagaauugcuacaaucccaaagcgcucgccccgcaggguccaaaggccagcggugaccagccug

SEQ ID NO: 368439 - RNA, 64 nt, Human
gagccucccccugugccagcagccccacucccucaggguccagccaugccccacccuggacuga

SEQ ID NO: 368440 - RNA, 64 nt, Human
ccaucgagggcuccugagcucauccugaggacccaggguccaucugagcuggcugugggcugag

SEQ ID NO: 368441 - RNA, 64 nt, Human
accuuuccccgagaccgucgucgcuggagggggcaggguccagcccgccuggaucgguggugug

SEQ ID NO: 368442 - RNA, 64 nt, Human
cuucugccauacuucauaccuacuugaacaucagaggguccaucaugaagagaaagccuaugag

SEQ ID NO: 368443 - RNA, 64 nt, Human
aguaaaacagguugaaugguuaaaaacaaccucaaggguccaugaacaauaucugccaacugaa

SEQ ID NO: 368444 - RNA, 64 nt, Human
uaucuccccaucccuacucccagccccuucucccaggguccagagccaggaccccuuaaucuag

SEQ ID NO: 368445 - RNA, 64 nt, Human
ggcccuggcucugcccuucccugggggguggagcaggguccagguuucacacuugccaccuccu

SEQ ID NO: 368446 - RNA, 64 nt, Human
cugguguaggaagaggggcauggggcuugaggacaggguccagcaugcccagaucacauuccag

SEQ ID NO: 368447 - RNA, 64 nt, Human
cagagaucaguagagagcagcugaagaagaaaauaggguccaggagaggaaucugcagaaacau

SEQ ID NO: 368448 - RNA, 64 nt, Human
ggcaucggucagcggggcagcggggcuggccaugaggguccaccuucagcccuuuggcuucaag

SEQ ID NO: 368449 - RNA, 64 nt, Human
uuccucagcaacacuccuuguaaggggcagagacaggguccaccaacuccccaagaugaagaag

SEQ ID NO: 368450 - RNA, 64 nt, Human
gccgugucauccgaaagugaggaaauguuuuggaaggguccacccuagccuagaacaagccaga

SEQ ID NO: 368451 - RNA, 64 nt, Human
cuguugguuccagcgaagaccacaggcauuccuuaggguccagggucagcaggcuccgggcuca

SEQ ID NO: 368452 - RNA, 64 nt, Human
ugacucagugcagggacagccugcacagugguccaggguccagcccuccgccagcccuguuccg

SEQ ID NO: 368453 - RNA, 64 nt, Human
ucuguucuguuucccaaugcagaaaagaagggguaggguccaccauacugguaauugggguacu

SEQ ID NO: 368454 - RNA, 64 nt, Human; identical to SEQ ID NO: 116761

SEQ ID NO: 368455 - RNA, 64 nt, Human; identical to SEQ ID NO: 116768

SEQ ID NO: 368456 - RNA, 64 nt, Human; identical to SEQ ID NO: 116773

SEQ ID NO: 368457 - RNA, 64 nt, Human
ccacucugaucucuuagcacauuucuuaggauuaaggguccaaaaaugcugaucuaagggguug

SEQ ID NO: 368458 - RNA, 64 nt, Human
gauggcaggacgugggcugggcccacaaaggcaaaggguccagaaggagacaggcagagcugcu

SEQ ID NO: 368459 - RNA, 64 nt, Human
ccauguuccuaugucagguggcagcggggaagcgaggguccaauccugcccugcgcuaguccuc

SEQ ID NO: 368460 - RNA, 64 nt, Human
uccuggucacugccugcugugcagucagaggcccaggguccagcagcccggcgggaacgggugc

SEQ ID NO: 368461 - RNA, 64 nt, Human
ccgccugggacccaccagggugcagcugggcuccaggguccagcccacaagcugcaucaggcuc

SEQ ID NO: 368462 - RNA, 64 nt, Human
cugcaagaaacacggucauucaaucacauugaggaggguccacauggcauugagagggugcugc

SEQ ID NO: 368463 - RNA, 64 nt, Human
gauaaaauggucaggaaccaacuuuacuggcaaaaggguccauguaccaccaugugcuggagca

SEQ ID NO: 368464 - RNA, 61 nt, Human
accagaccuugagcaagugagaagagaggccaggguccaaccaggcacccguccuugggac

SEQ ID NO: 368465 - RNA, 64 nt, Human
agaggggcagcagcugcagauccacuuaggccccaggguccacggauggccccaaaggcugagg

SEQ ID NO: 368466 - RNA, 64 nt, Human
agaaaauaaaugugccuugagagaccacucagagaggguccaagggugauggagaaggaagcau

SEQ ID NO: 368467 - RNA, 64 nt, Human
ugacccaucaucuugggagguggggaggaaugagaggguccaggcaggguguaggggaauguau

SEQ ID NO: 368468 - RNA, 64 nt, Human
gaggaagaaagugcuucagaaucugaacuuuggaaggguccacuaccagagacagaugaaaaau

SEQ ID NO: 368469 - RNA, 64 nt, Human
gaagccuuccuccccagguggggcugauggagcaaggguccagacuaggagccuuccaccccag

SEQ ID NO: 368470 - RNA, 64 nt, Human
cuguccuucaucguugagccccaaaccacugcucaggguccauuccucacuauaagaugaagcc

SEQ ID NO: 368471 - RNA, 64 nt, Human
aguuuguguaauugcaaguucauaaagagaauugaggguccaguugggagaacuauuagucagu

SEQ ID NO: 368472 - RNA, 64 nt, Human
uggcauggagagggcagacugugcacauuucacuaggguccaaauacagaagggcccagggccc

SEQ ID NO: 368473 - RNA, 64 nt, Human; identical to SEQ ID NO: 116778

SEQ ID NO: 368474 - RNA, 64 nt, Human; identical to SEQ ID NO: 116785

SEQ ID NO: 368475 - RNA, 64 nt, Human; identical to SEQ ID NO: 116790

SEQ ID NO: 368476 - RNA, 64 nt, Human
uuuuguuuccucugaggggcuguucgccccaggcaggguccaucuuucugaucuguccaaccuc

SEQ ID NO: 368477 - RNA, 64 nt, Human; identical to SEQ ID NO: 116797

SEQ ID NO: 368478 - RNA, 64 nt, Human; identical to SEQ ID NO: 116804

SEQ ID NO: 368479 - RNA, 64 nt, Human; identical to SEQ ID NO: 116809

SEQ ID NO: 368480 - RNA, 64 nt, Human; identical to SEQ ID NO: 116814

SEQ ID NO: 368481 - RNA, 64 nt, Human; identical to SEQ ID NO: 116820

SEQ ID NO: 368482 - RNA, 64 nt, Human; identical to SEQ ID NO: 116826

SEQ ID NO: 368483 - RNA, 64 nt, Human; identical to SEQ ID NO: 116832

SEQ ID NO: 368484 - RNA, 64 nt, Human; identical to SEQ ID NO: 116836

SEQ ID NO: 368485 - RNA, 64 nt, Human; identical to SEQ ID NO: 116842

SEQ ID NO: 368486 - RNA, 64 nt, Human; identical to SEQ ID NO: 116847

SEQ ID NO: 368487 - RNA, 64 nt, Human; identical to SEQ ID NO: 116853

SEQ ID NO: 368488 - RNA, 64 nt, Human; identical to SEQ ID NO: 116858

SEQ ID NO: 368489 - RNA, 64 nt, Human; identical to SEQ ID NO: 116865

SEQ ID NO: 368490 - RNA, 64 nt, Human; identical to SEQ ID NO: 116872

SEQ ID NO: 368491 - RNA, 64 nt, Human; identical to SEQ ID NO: 116877

SEQ ID NO: 368492 - RNA, 64 nt, Human; identical to SEQ ID NO: 116884

SEQ ID NO: 368493 - RNA, 64 nt, Human; identical to SEQ ID NO: 116890

SEQ ID NO: 368494 - RNA, 64 nt, Human; identical to SEQ ID NO: 116896

SEQ ID NO: 368495 - RNA, 64 nt, Human; identical to SEQ ID NO: 116901

SEQ ID NO: 368496 - RNA, 64 nt, Human; identical to SEQ ID NO: 116905

SEQ ID NO: 368497 - RNA, 64 nt, Human
ucccuucccaucucaggcucuccuguuuucccucaggguccaguaugccuuugagcuuuagcug

SEQ ID NO: 368498 - RNA, 64 nt, Human
uuggaacuugugggaacauuccaacuugcuaagcaggguccacugggagggaagcucuaucugg

SEQ ID NO: 368499 - RNA, 64 nt, Human
uuuaaauaacuuaucauuccagcuauguuggacuaggguccaaagcauuuuauaauauuuuuuu

SEQ ID NO: 368500 - RNA, 64 nt, Human
aucauacauucacaugcuucucaccuaaguccccaggguccaagggagaagccccagacccccu

SEQ ID NO: 368501 - RNA, 64 nt, Human
gggacggucaaggcugaaggcuccucuggguuugaggguccaagggacaaggaggagaagccua

SEQ ID NO: 368502 - RNA, 64 nt, Human
uccugggugcauugucaccguggguggccacucaaggguccaagccucuagggccauccuuggg

SEQ ID NO: 368503 - RNA, 64 nt, Human
uucucucuucaucuuugagaugcuuggccauaacaggguccauacacaucuucugguuuacuau

SEQ ID NO: 368504 - RNA, 64 nt, Human
gagaugucuaacccuugaggugaagggcucugggaggguccaagaagacguaggcuucauuuuc

SEQ ID NO: 368505 - RNA, 64 nt, Human
ucgcauuuugcuucacugugaguagcaugggaaaaggguccacgucuccaaaagacucuuccac

SEQ ID NO: 368506 - RNA, 64 nt, Human
cuggcccauauuaaucccucguguguccauaauuaggguccacgcccauguaccugaaacauuu

SEQ ID NO: 368507 - RNA, 64 nt, Human
auaaugcuuguucuguuaacucaccgggaccuugaggguccaaugggaccuugaggguuuucuc

SEQ ID NO: 368508 - RNA, 64 nt, Human
acucaaaucaaccuuuuaauaauuuucugugcuaaggguccaguauuuauuugauuauuuagua

SEQ ID NO: 368509 - RNA, 64 nt, Human
ggagaggcuuuguucuguaacggugccuuuucuuaggguccaggcaggaaugaagccaauaauu

SEQ ID NO: 368510 - RNA, 64 nt, Human
uucaacacuggagaacugagccuugcaucucuccaggguccaaggccacgcuuggugcacaggc

SEQ ID NO: 368511 - RNA, 64 nt, Human
cgguggcugcccucaggucccgucacaugucucaaggguccagcguucgaggaagcacuguugu

SEQ ID NO: 368512 - RNA, 64 nt, Human
gacauucauacccaaagaaccagccucucaccccaggguccaugucccaggccccacuccagug

SEQ ID NO: 368513 - RNA, 64 nt, Human; identical to SEQ ID NO: 116909

SEQ ID NO: 368514 - RNA, 64 nt, Human; identical to SEQ ID NO: 116915

SEQ ID NO: 368515 - RNA, 64 nt, Human; identical to SEQ ID NO: 116919

SEQ ID NO: 368516 - RNA, 64 nt, Human
gugggccugccccuuguccuagcccugccacgugaggguccagccuccagggacaggcacugcc

SEQ ID NO: 368517 - RNA, 64 nt, Human
uauuccacauuuggugaaauuaauacuuuuuuaaaggguccaaauaaaauaauuuucuaaugug

SEQ ID NO: 368518 - RNA, 64 nt, Human
ugguugucucuucuugaaacuguaauguaaaucuaggguccagucauauccuagguaucaucau

SEQ ID NO: 368519 - RNA, 64 nt, Human
uacuuuccaacauuauccugugugauuacagcauaggguccacuuugguaaugugucaaagaga

SEQ ID NO: 368520 - RNA, 64 nt, Human
guggagaaagcauaucccaccaaccuccagugucaggguccaggagagccugggggugggggga

SEQ ID NO: 368521 - RNA, 64 nt, Human
gcuucagagccucgggcucagguggcacggucccaggguccaggcugagggcugggagcucccu

SEQ ID NO: 368522 - RNA, 64 nt, Human
cccugcccccucaucacucccccugccaagacaaaggguccagaaggcuaggacuuacuuaaua

SEQ ID NO: 368523 - RNA, 64 nt, Human
uggagccauguuaauguaaucugauggcuucuccaggguccacaggaagugaagaaucuguuuc

SEQ ID NO: 368524 - RNA, 64 nt, Human
ucccuacagggaaagcucaggucgggucuuucugaggguccaccagccauccuacccucucccu

SEQ ID NO: 368525 - RNA, 64 nt, Human
cuugaaugggaggggccucacagagggcagggccaggguccagcaggggugggggguuccugcu

SEQ ID NO: 368526 - RNA, 64 nt, Human
acuuacauggagcugggcacugcccugccucaacaggguccauugccuccucgccuccagaacu

SEQ ID NO: 368527 - RNA, 64 nt, Human
gcugcccuggggacaggaaggacaggagcuaagcaggguccaagccuggggcugccucugcucu

SEQ ID NO: 368528 - RNA, 64 nt, Human
ggcccagaagccugaucuuugggcaucagaaaacaggguccaggaauggugcuuuaugugagau

SEQ ID NO: 368529 - RNA, 64 nt, Human
uuagaucgcccugugggguuugcagaauuagugaaggguccaggacgaucccagugggcucgcu

SEQ ID NO: 368530 - RNA, 64 nt, Human
gguguucguggggcuggcuccugaagggccugggaggguccaucagcugccuccagcauccagu

SEQ ID NO: 368531 - RNA, 64 nt, Human
ugagagcuggacagagcagagaacuacagggccaaggguccagagaagugauaacuuggcccag

SEQ ID NO: 368532 - RNA, 64 nt, Human; identical to SEQ ID NO: 116924

SEQ ID NO: 368533 - RNA, 64 nt, Human; identical to SEQ ID NO: 116929

SEQ ID NO: 368534 - RNA, 63 nt, Human; identical to SEQ ID NO: 116934

SEQ ID NO: 368535 - RNA, 64 nt, Human
ugguaccuucaauguaugacuccugggagaaucaaggguccaucugagccucugaguaaagauc

SEQ ID NO: 368536 - RNA, 64 nt, Human
ugugaacccaaucuuaaaggagguucucaugcccaggguccacagugaccagccagcaagucuc

SEQ ID NO: 368537 - RNA, 64 nt, Human
caagcugguuggcagugcccagauucgucaagugaggguccaggaaagcucuugcccucuugcc

SEQ ID NO: 368538 - RNA, 64 nt, Human
uagaaauaguuuacucgcaacaacuuaauuucuaaggguccaagucccagagaauccauagucg

SEQ ID NO: 368539 - RNA, 64 nt, Human
uuccuaccccuuccucccuucagucaguguccccaggguccagccuggcuagaguuagaaggca

SEQ ID NO: 368540 - RNA, 64 nt, Human
uguucaagcucagagaggaugaaggggcaucuggaggguccaugagauggggcccucaccaaau

SEQ ID NO: 368541 - RNA, 64 nt, Human
gggcacuuguugcauugccuggcacccaauauucaggguccaugacuaagacuggucuucucag

SEQ ID NO: 368542 - RNA, 64 nt, Human
uuccaagucaccacuucucucaccggcuucuaccaggguccaggacuaaggcguuuuucuccau

SEQ ID NO: 368543 - RNA, 64 nt, Human
uuguggauucugaggcccugcccaaugagacucuaggguccaguggaugccacagcccagcuug

SEQ ID NO: 368544 - RNA, 64 nt, Human
cagugugacucucuccaccgccucaguguagggaaggguccaggccagggaaggagcacccucu

SEQ ID NO: 368545 - RNA, 64 nt, Human
aggaacagggaccaggcugccccacggucccugaaggguccaaggaggggcccuccccauggcc

SEQ ID NO: 368546 - RNA, 64 nt, Human
uuuugguuggugaccccagacucugugaucccccaggguccauggugcugcuccauccgccccc

SEQ ID NO: 368547 - RNA, 62 nt, Human
cucugggugggguuucuuagugagccccccggaggguccaggccacguccuuggucaccucc

SEQ ID NO: 368548 - RNA, 64 nt, Human
uaaaauaaauuuuugugugugugugcagaaauuaaggguccaauugagauugggugauguuagu

SEQ ID NO: 368549 - RNA, 64 nt, Human
agacacaagggaaucucaacaaccagggaucaggaggguccaaagccgacauucccaguccugu

SEQ ID NO: 368550 - RNA, 64 nt, Human
ucagaaggccaccgcgcccgcauuccacucagccaggguccagcugcagcccccgccacccuuc

SEQ ID NO: 368551 - RNA, 64 nt, Human; identical to SEQ ID NO: 116940

SEQ ID NO: 368552 - RNA, 64 nt, Human; identical to SEQ ID NO: 116946

SEQ ID NO: 368553 - RNA, 64 nt, Human; identical to SEQ ID NO: 116952

SEQ ID NO: 368554 - RNA, 64 nt, Human
aggcccugccccaccucuggacagugcccaagucaggguccagaacugccccccaacacagguc

SEQ ID NO: 368555 - RNA, 64 nt, Human
cccaggggcuuaucucuucaaguguggagagggcaggguccacgccucugcuguagcuuaugaa

SEQ ID NO: 368556 - RNA, 64 nt, Human
acuuuugugccagagcuugugagggugacagaagaggguccaggcuggaaaccugaacuuucug

SEQ ID NO: 368557 - RNA, 64 nt, Human
cucagcuucaagaaauuacuggaaggcuuccacuaggguccaccaggaguucucccaccaccuc

SEQ ID NO: 368558 - RNA, 64 nt, Human
gagaaaccucuccuucccgugugagaagggccagaggguccaggcaucccaaguccagcgugaa

SEQ ID NO: 368559 - RNA, 64 nt, Human
cacagccggccgcccugagggucgggccggagccaggguccaagaggggcgcguuugugucucg

SEQ ID NO: 368560 - RNA, 64 nt, Human
aacuucggggucgucugccagagcagggucugggaggguccaugcaguucccgcugguguggag

SEQ ID NO: 368561 - RNA, 64 nt, Human
cgggcagccuggagcuuccugcagccuccuacgcaggguccacgccacguggccugggcugcca

SEQ ID NO: 368562 - RNA, 64 nt, Human
uaauguaccaaugaugaauuuaucagcguauuucaggguccaaacaaaauagagcuaagauacu

SEQ ID NO: 368563 - RNA, 64 nt, Human
cgcugcagcugggguucccugcuuuuugguagcaaggguccagagaugagguguuuuuuucggg

SEQ ID NO: 368564 - RNA, 64 nt, Human
guacauauggacaaaucacugaaguucaauuuaaaggguccacugcagucccuuauaaacaauu

SEQ ID NO: 368565 - RNA, 51 nt, Human
aucacaugggacagauguaaaaggguccaaguugccacauugcuucauuaa

SEQ ID NO: 368566 - RNA, 64 nt, Human
guggcggggcacgcugccgccuuccccaucacggaggguccagacuguccacucggggguggag

SEQ ID NO: 368567 - RNA, 64 nt, Human
uggccugggggcuggggggagccccaggcugaaaaggguccaauuaaaacaaauggagccaaau

SEQ ID NO: 368568 - RNA, 64 nt, Human
cgugggccaucaggauggucccugguccuuagagaggguccaguucaggcuucuagacauuuua

SEQ ID NO: 368569 - RNA, 64 nt, Human
ggggggaaggggacccuccgcucuguagugcuacaggguccaacauagagccggguguccccaa

SEQ ID NO: 368570 - RNA, 64 nt, Human; identical to SEQ ID NO: 116958

SEQ ID NO: 368571 - RNA, 64 nt, Human; identical to SEQ ID NO: 116963

SEQ ID NO: 368572 - RNA, 64 nt, Human; identical to SEQ ID NO: 116967

SEQ ID NO: 368573 - RNA, 64 nt, Human
gggccugagcgugggcgcgccccugcggcucccgaggguccaggccccgcccccaaaggaccag

SEQ ID NO: 368574 - RNA, 64 nt, Human
gugagagacgccagccucagacuuuuucccacugaggguccagagagcggggccacgugucacc

SEQ ID NO: 368575 - RNA, 64 nt, Human
ggaacacgcguguccugggagcugcaucuuguguaggguccagcugcuuuuggggacugcagga

SEQ ID NO: 368576 - RNA, 64 nt, Human
cccuauagagccaggagacaggauagggguuucuaggguccaacaccagcuuaccuuggaguau

SEQ ID NO: 368577 - RNA, 64 nt, Human
uuggccgugggcaugagaccgagggugaggcuggaggguccaaagcuggcccagcgagcaccag

SEQ ID NO: 368578 - RNA, 64 nt, Human
aggacuccacaugcuuuucuuuuucuaauaaaccaggguccaucugaccccagcgcuaauucag

SEQ ID NO: 368579 - RNA, 64 nt, Human
gagugcggcgugggggcacugaccaggcccaaggaggguccaggcgggcaagucauccuccugg

SEQ ID NO: 368580 - RNA, 64 nt, Human
ugcaggguggcugaagcccuggggcagagaacagaggguccagggcccuccuggcucccaacag

SEQ ID NO: 368581 - RNA, 64 nt, Human
uccagggugcugggggcugggguucccuggcccaaggguccagccuccucucaccccauuccag

SEQ ID NO: 368582 - RNA, 64 nt, Human
agguggcagcauccaaaaccacggugaagauacuaggguccagaggccgacuggagcaagguuu

SEQ ID NO: 368583 - RNA, 64 nt, Human
gccucauccuccccaggaccccuguccaggauggaggguccaauccuaggacagccuuguuccu

SEQ ID NO: 368584 - RNA, 64 nt, Human
cacagaccccuggagguccaggggggcccgaggcaggguccaaaccugagugagggccagccau

SEQ ID NO: 368585 - RNA, 64 nt, Human
ggaagagucuguggauggaaauaggaagcgugggaggguccaguugccacccccaaaaauucca

SEQ ID NO: 368586 - RNA, 64 nt, Human
auaaaguguuuuugaguguccuaugggccggggcaggguccaagaucuuuucccuuccccaggc

SEQ ID NO: 368587 - RNA, 64 nt, Human
gucccgccagccucagccaggugggccuguauauaggguccaugugcaauagggagggacgucu

SEQ ID NO: 368588 - RNA, 64 nt, Human
uaguucuugucuaacucaagacuguucuggaaugaggguccaggccugucaaccauggggcuuc

SEQ ID NO: 368589 - RNA, 64 nt, Human; identical to SEQ ID NO: 116970

SEQ ID NO: 368590 - RNA, 64 nt, Human; identical to SEQ ID NO: 116975

SEQ ID NO: 368591 - RNA, 64 nt, Human; identical to SEQ ID NO: 116981

SEQ ID NO: 368592 - RNA, 64 nt, Human
caacccucuuccucccuugccccaacccugagaaaggguccagccacuacccuguuggcaaaca

SEQ ID NO: 368593 - RNA, 64 nt, Human
ccucuccaguccuuuuccgagaugaggugagacaaggguccaacuuuuccuggauucgccuccc

SEQ ID NO: 368594 - RNA, 64 nt, Human
uauaaauugcuacuguuuucuuaaaguuaacuucaggguccaccuuauguugcacacauaucac

SEQ ID NO: 368595 - RNA, 64 nt, Human
uugccuuauauuggaucaggaacccuuacaguagaggguccagucuucuaguggguuuaauguu

SEQ ID NO: 368596 - RNA, 64 nt, Human
ccacccagggcuggcuuuccuauaagccaccuccaggguccaggggcuuucucucucucuccga

SEQ ID NO: 368597 - RNA, 64 nt, Human
guucaccucuguguccuuuugaaacaucagcaguaggguccauuccaagauugucaguugccgu

SEQ ID NO: 368598 - RNA, 64 nt, Human
acagcacaacacggggagcagcaagagaugagccaggguccaggagacagaugcccaucgcgag

SEQ ID NO: 368599 - RNA, 64 nt, Human
ccacaagauaagaaaucccuuucagagccagggaaggguccagacaggagauuuggauauagga

SEQ ID NO: 368600 - RNA, 64 nt, Human
gugccucacucaccugggacugguauccccucccaggguccaccaagggcuccugcuuuucaga

SEQ ID NO: 368601 - RNA, 64 nt, Human
gcuccccuggggugcaggcgccucaacucugcugaggguccagaaggagggggugaccuccggc

SEQ ID NO: 368602 - RNA, 64 nt, Human
aguuauuuugagaguuuggaagauaauuaccaaaaggguccauuauuucauaagaguuacuuug

SEQ ID NO: 368603 - RNA, 64 nt, Human
ugcugugacggacccaaggggcaaauagggucccaggguccagggaggggcgccugcugagcac

SEQ ID NO: 368604 - RNA, 64 nt, Human
ugcagcccaagcagggccuggcauggggcaggacaggguccagccuuuuccuaacaucugccug

SEQ ID NO: 368605 - RNA, 64 nt, Human
ucuaggcaaagggaugggcaugagcgaaggcuccaggguccacagagcagggaguguggagaag

SEQ ID NO: 368606 - RNA, 64 nt, Human
aaaaauaauucauccaagauuccuuuguaguuaaaggguccaguucugacuggagccucuagag

SEQ ID NO: 368607 - RNA, 64 nt, Human
cuagcacuaccggucacggccaugucguccuagaaggguccagaagauuauuuuacguugaguc

SEQ ID NO: 368608 - RNA, 64 nt, Human; identical to SEQ ID NO: 116985

SEQ ID NO: 368609 - RNA, 64 nt, Human; identical to SEQ ID NO: 116991

SEQ ID NO: 368610 - RNA, 64 nt, Human; identical to SEQ ID NO: 116997

SEQ ID NO: 368611 - RNA, 64 nt, Human
gcagggaggccccaggaggggaucuggccagucaaggguccacagggugccagccucucacccu

SEQ ID NO: 368612 - RNA, 64 nt, Human
ccaugcuggggugcugcucagcuguuacaaaggcaggguccagccugcagggaggccccaggag

SEQ ID NO: 368613 - RNA, 64 nt, Human
ccccauccccuacugugacuugcuuuagggugucaggguccaggcugcaggggcugggccaauu

SEQ ID NO: 368614 - RNA, 64 nt, Human
auucugugguugguuaccuuaccuuccaagauacaggguccacuagaaauuggcuguaauacuc

SEQ ID NO: 368615 - RNA, 64 nt, Human
uggaaaaucagcucaaaugagaucaggcccccccaggguccacccacagagcacuacagagccu

SEQ ID NO: 368616 - RNA, 64 nt, Human
gugccuucuagaauacauauuacaagaaaacuacaggguccacacggcaaucagaagaaaggag

SEQ ID NO: 368617 - RNA, 64 nt, Human
gggggcagagguaaagcccugcaggggaggccacaggguccaucccgucuucaggaucaucuac

SEQ ID NO: 368618 - RNA, 64 nt, Human
gaucaucagcuaccuucaaauuauugaccuggacaggguccaagucugauaguaaccuuuuaca

SEQ ID NO: 368619 - RNA, 64 nt, Human
uccuguggccuuccacagcagaaaccagggcaaaaggguccaaacacaugguuuuccuugcugc

SEQ ID NO: 368620 - RNA, 64 nt, Human
gcccagcaggcggggguuugagcccuggaccccaggcucuuagagacuaaggggcagcuccuga

SEQ ID NO: 368621 - RNA, 64 nt, Human
accacucaccaggccucuccuccccucugcccccggcucuuagcuccagcugcuccagguaguu

SEQ ID NO: 368622 - RNA, 64 nt, Human
guaaauuggaugaaaagagcucuaaugccuuucaggcucuuagaagccauagauuuggacaagc

SEQ ID NO: 368623 - RNA, 64 nt, Human
uccccuuccucccucccuucaccggcccccucccggcucuuagcuuccacucccuuguguguau

SEQ ID NO: 368624 - RNA, 64 nt, Human
uuugcugcugggccucuccugggacuaccaguguggcucuuacguguuuucuuugcuaaaauaa

SEQ ID NO: 368625 - RNA, 64 nt, Human
cacucagugcccugagaagccuggaagacuuucuggcucuuaacuggggaguaguggagaccau

SEQ ID NO: 368626 - RNA, 64 nt, Human
ugauggugccugacugaauccaaauauccuagcuggcucuuacuauuuuucacaaaugaguauu

SEQ ID NO: 368627 - RNA, 64 nt, Human; identical to SEQ ID NO: 117000

SEQ ID NO: 368628 - RNA, 51 nt, Human; identical to SEQ ID NO: 117006

SEQ ID NO: 368629 - RNA, 64 nt, Human; identical to SEQ ID NO: 117010

SEQ ID NO: 368630 - RNA, 64 nt, Human
gcuuccuccuggaugugauggggauugccagagaggcucuuagcauaaaaggcauuaggugggc

SEQ ID NO: 368631 - RNA, 64 nt, Human
gagguucuuuauauuccugccucuucauagucaaggcucuuaguacaggaauauugacuuagga

SEQ ID NO: 368632 - RNA, 64 nt, Human
acagggucugcucuuucucugccagugacagacaggcucuuagcagcuuccagauugacgacaa

SEQ ID NO: 368633 - RNA, 64 nt, Human
aacccacuuuuaugacaguuuucuuccgcagcuuggcucuuaaauuuuacuggcagguguaugg

SEQ ID NO: 368634 - RNA, 64 nt, Human
guccaaccccucccccacgucucucugccugcugggcucuuaacuguugcucgaagacugugac

SEQ ID NO: 368635 - RNA, 64 nt, Human
aacugguacucccugacccagggccccaaaccugggcucuuacagagccuccaugagucaagcc

SEQ ID NO: 368636 - RNA, 64 nt, Human
augcaaggggacagcaaggcagcgugguggucauggcucuuagcuaaccuauucaaagaccuuu

SEQ ID NO: 368637 - RNA, 64 nt, Human
uuuugggcuggaaugcugcccugaggguggggcuggcucuuacucaggaaacugcugugcccaa

SEQ ID NO: 368638 - RNA, 64 nt, Human
gggccaaggagaaaggcaugaaucuucccugucaggcucuuacagccacaggcacugugucuac

SEQ ID NO: 368639 - RNA, 64 nt, Human
cagagagagcucaauguacaaaugaaugccucauggcucuuagcugugguuucuuggaccagcg

SEQ ID NO: 368640 - RNA, 64 nt, Human
auuacuuggguuaaagcuucugugaggaccuuuuggcucuuaagauauccuaaauauuuaaaau

SEQ ID NO: 368641 - RNA, 64 nt, Human
caaauauuccuguuucugaaccauuacuguaauuggcucuuaaggcuugaaguaaccuuauagg

SEQ ID NO: 368642 - RNA, 64 nt, Human
ggaucccuggauguuccaaccccauaaaucucacggcucuuaaguucuucccaaugaucugagg

SEQ ID NO: 368643 - RNA, 64 nt, Human
agauugacuuccacucccacuccuucacuaaaagggcucuuaccaagaucaaaucuaaugggua

SEQ ID NO: 368644 - RNA, 64 nt, Human
uccaugauuuagcagugagugauuuucuagcuuuggcucuuauuagguauuguaaauaguaggg

SEQ ID NO: 368645 - RNA, 64 nt, Human
ucuggguaacuauugaaguuuguaauuaaaugggggcucuuacugacuuuaaauuagcgcuuau

SEQ ID NO: 368646 - RNA, 64 nt, Human; identical to SEQ ID NO: 117013

SEQ ID NO: 368647 - RNA, 64 nt, Human; identical to SEQ ID NO: 117018

SEQ ID NO: 368648 - RNA, 64 nt, Human; identical to SEQ ID NO: 117024

SEQ ID NO: 368649 - RNA, 64 nt, Human
gggaaggauguuggcagcgacaccaucccauacaggcucuuaccucuucuccugagggcugcuc

SEQ ID NO: 368650 - RNA, 64 nt, Human
auacguuggggugccccacgauagcuguggggggggcucuuagugcaagauccuguggauuaga

SEQ ID NO: 368651 - RNA, 64 nt, Human
agggauuguuucuggaccaguuugucuaaguccuggcucuuauugguucauaugaaauaauguu

SEQ ID NO: 368652 - RNA, 64 nt, Human
agcaaaccauauugugccucuucaucuugacccaggcucuuauagauagguccuaaacauugcu

SEQ ID NO: 368653 - RNA, 64 nt, Human
aagcccugcaaccaaugagaugcacgucaucauuggcucuuacagacaagaaaacuagacucag

SEQ ID NO: 368654 - RNA, 64 nt, Human
guuacuaacaucaacuugugacaucuagaacuagggcucuuaguguuuagugggccacuucucu

SEQ ID NO: 368655 - RNA, 64 nt, Human
cacuugaggcucuguccaauuaagaaauaaauguggcucuuacucaacacagucccaugggcuc

SEQ ID NO: 368656 - RNA, 64 nt, Human
acuguuuggauugauugcuuuaaaaaacaaaccuggcucuuaccuuugaucuuuucuuccccag

SEQ ID NO: 368657 - RNA, 64 nt, Human
caaccacugacuggucuuaagcuguucuugcauaggcucuuaagcagcauggaaaaaugguuga

SEQ ID NO: 368658 - RNA, 64 nt, Human
ucacuccucaugagcuuuaucuuggcagucuuacggcucuuaugccuagcaaaucuccagccua

SEQ ID NO: 368659 - RNA, 64 nt, Human
aagaagaaagaauuuucacuugguuggacauuggggcucuuaagaaaguugacauuugucgugg

SEQ ID NO: 368660 - RNA, 64 nt, Human
ucucuuuccuggcccucaaccacuuccuuccuuuggcucuuaagaccuagcagguucugugaac

SEQ ID NO: 368661 - RNA, 64 nt, Human
auuugcauucuuguaaccuucuaugguguuuuguggcucuuaucuuguggaccauaaauaacac

SEQ ID NO: 368662 - RNA, 64 nt, Human
cuugcucuugucuugaguggugaccaaagcaguuggcucuuaaaaggugggagagcagcccaac

SEQ ID NO: 368663 - RNA, 64 nt, Human
cagaacugauccagagcuggagaaagaagccgaaggcucuuagggagcagccagagggccaagu

SEQ ID NO: 368664 - RNA, 64 nt, Human
gauuugacacuggcuaggagcagaggcugcgucaggcucuuaaagucauguguuugcaugcugg

SEQ ID NO: 368665 - RNA, 64 nt, Human; identical to SEQ ID NO: 117022

SEQ ID NO: 368666 - RNA, 64 nt, Human; identical to SEQ ID NO: 117007

SEQ ID NO: 368667 - RNA, 64 nt, Human; identical to SEQ ID NO: 117025

SEQ ID NO: 368668 - RNA, 64 nt, Human
auuugggagaggugggauucauuacaagacuuugggcucuuaugucacaucacaugauuuggag

SEQ ID NO: 368669 - RNA, 64 nt, Human
gcagguuggcuuucauaucaccucagccaacuguggcucuuaauuuauugcauaaugauauuca

SEQ ID NO: 368670 - RNA, 64 nt, Human
ggucccuugccucuuccaccucaaagaauuucaaggcucuuaccuuacuuuauuuuuguccauu

SEQ ID NO: 368671 - RNA, 64 nt, Human
gccaaccuggucucccugccccaugcccuccccuggcucuuagcaaccugcccuuuuauucaug

SEQ ID NO: 368672 - RNA, 64 nt, Human
cuuuuuaaugauguaagaaaauugucaggagaauggcucuuauuuauguguguuuuaacuuaug

SEQ ID NO: 368673 - RNA, 54 nt, Human
uuucuaaaccuucugaguaaauuuggcucuuagaauuaaguuaauuucuucucu

SEQ ID NO: 368674 - RNA, 64 nt, Human
augaacuaggaacgcauuuacuaugagaaaauauggcucuuaagcaguguaagagugaaaauau

SEQ ID NO: 368675 - RNA, 64 nt, Human
cacuaucucagaaauaccuuaauucucuaagacuggcucuuagaccucucccaucaugccuuga

SEQ ID NO: 368676 - RNA, 64 nt, Human
acuuccuuuuaucgguucauuuaaccuggugacuggcucuuaucacuucuaguuuacaggugag

SEQ ID NO: 368677 - RNA, 64 nt, Human
ccugugaucuggaaaucuaccaccaaucccgaucggcucuuauuagcuccccgcuccacaagac

SEQ ID NO: 368678 - RNA, 64 nt, Human
ccugugcuuuggaaauccaccaccaaucccgaucggcucuuauuagcuccccgcuccacaagac

SEQ ID NO: 368679 - RNA, 64 nt, Human
acggggaucuggaaauccacgaccaaucccgaucggcucuuauuagcuccccgcuccacaagac

SEQ ID NO: 368680 - RNA, 64 nt, Human
gcuuuaaauuaaauuaauaguuacaagguagguuggcucuuaggugaauuuagccaugucaacu

SEQ ID NO: 368681 - RNA, 64 nt, Human
aggggccugcuccucucccuacugugacccuggaggcucuuaagaugaugaugguuuuuuuuau

SEQ ID NO: 368682 - RNA, 64 nt, Human
gagauuucuguuaaggcagaaauaauuaggcuagggcucuuaguuuucauuccuauugcccaag

SEQ ID NO: 368683 - RNA, 53 nt, Human
aaaauaacaaaaaucauuaauaaggcucuuaaguauuucaguguaucugcauc

SEQ ID NO: 368684 - RNA, 64 nt, Human; identical to SEQ ID NO: 117026

SEQ ID NO: 368685 - RNA, 64 nt, Human; identical to SEQ ID NO: 117027

SEQ ID NO: 368686 - RNA, 64 nt, Human; identical to SEQ ID NO: 117028

SEQ ID NO: 368687 - RNA, 64 nt, Human
acugcacuccagccuggugacagagcaagacuccggcucuuaaaaaaaaaaaaaaaaaaaaaaa

SEQ ID NO: 368688 - RNA, 64 nt, Human
cacucccauuuuuacuuaacaaccaacuuguuguggcucuuauuucugaauucaaagcuuguga

SEQ ID NO: 368689 - RNA, 64 nt, Human
ucagguucagaccaguaggaaccaggcugggucaggcucuuaauuucacuauggugggggacaa

SEQ ID NO: 368690 - RNA, 64 nt, Human
ugguuuuuuuuuccauauuuuuuuuaaauuuguuggcucuuaagaugaauaaaguuuauaggug

SEQ ID NO: 368691 - RNA, 64 nt, Human
uuuggcauggccagacucugaccccacugcccuaggcucuuaaauacucauugggaggguccga

SEQ ID NO: 368692 - RNA, 64 nt, Human
ggaaggggcagggguggggggagggguuggguugggcucuuaucuucaguggagcuuaggaaac

SEQ ID NO: 368693 - RNA, 64 nt, Human
uaugccuucucauaugauauuagagagguagaauggcucuuacaacucauguacccauugcuag

SEQ ID NO: 368694 - RNA, 64 nt, Human
ucuugauaucuugaaugucuuuucuguuuggccuggcucuuaauuugcuuuuguuuugcccagu

SEQ ID NO: 368695 - RNA, 64 nt, Human
aaaaaaaaaaaaaagucuguacuaauuucaauauggcucuuaaaaggaaugacagagaaauagg

SEQ ID NO: 368696 - RNA, 64 nt, Human
guaucuagacaaaauuuuucuaaaacuccaucaaggcucuuauucaauaccacguuccgaguug

SEQ ID NO: 368697 - RNA, 64 nt, Human
acauuuauuuacaaaugaguuuaugcauuuucauggcucuuaauaaacauauuguuuucccuug

SEQ ID NO: 368698 - RNA, 64 nt, Human
aggaguuaugacucuugacuuccugcagggcuggggcucuuagccaccagcugcuguuccagca

SEQ ID NO: 368699 - RNA, 64 nt, Human
uaccacaucugucacaaaaagccaggucuuagcgggcucuuagaaacucugagaauuuucuuca

SEQ ID NO: 368700 - RNA, 64 nt, Human
ugggaaaaaucagugagugaauucauauuagagaggcucuuauaaaugagaggauuguggaaac

SEQ ID NO: 368701 - RNA, 64 nt, Human
ccccagcuuugcaugaugaaaagcuuuccugcuuggcucuuauucuuccacaagagaggacuuu

SEQ ID NO: 368702 - RNA, 64 nt, Human
ugcagugugacuuuucccacacacuggauugugaggcucuuaacuucuuaaaaguauaauggca

SEQ ID NO: 368703 - RNA, 64 nt, Human; identical to SEQ ID NO: 117029

SEQ ID NO: 368704 - RNA, 64 nt, Human; identical to SEQ ID NO: 117030

SEQ ID NO: 368705 - RNA, 64 nt, Human; identical to SEQ ID NO: 117031

SEQ ID NO: 368706 - RNA, 64 nt, Human
ccagugugaaauaucuucuaauaaaaauauauuuggcucuuaucccugcacauguagaggcaua

SEQ ID NO: 368707 - RNA, 64 nt, Human
ucaaagcauugucagauguagagugcucagauguggcucuuaaagacuauauacaucugaauuu

SEQ ID NO: 368708 - RNA, 64 nt, Human
agcugaugcuuucucuccuaaucccugggcacuaggcucuuaucagugugcuugggccagcucu

SEQ ID NO: 368709 - RNA, 64 nt, Human
uguccccucccuuucuuuccuggcuugagguaggggcucuuaagguacagaacuccacaaaccu

SEQ ID NO: 368710 - RNA, 64 nt, Human
uugggaggaagaauccagaggugaagagggagacggcucuuagcugcguucaaggcggggcccu

SEQ ID NO: 368711 - RNA, 64 nt, Human
cagauucauauuaagaagugucggucgauccaguggcucuuaagagugaauagcuuuauggaau

SEQ ID NO: 368712 - RNA, 64 nt, Human
auauuccuuaacuauacuggcuugauuugaaacaggcucuuauugccauuuaaacugccagaaa

SEQ ID NO: 368713 - RNA, 64 nt, Human
ucuugggaugggagaguggggaucaggugcaguuggcucuuaacccucaaggguucuuuaacuc

SEQ ID NO: 368714 - RNA, 64 nt, Human
uuauucauccauguguuaauggguuuccagucucggcucuuaaaacuaugagcauuuguguaaa

SEQ ID NO: 368715 - RNA, 64 nt, Human
acgaaccucuucuguacuuugauuguaauagguuggcucuuacacccauuccaaaugcaguuua

SEQ ID NO: 368716 - RNA, 64 nt, Human
ggaugagcugccuugacccagaagggaugagacgggcucuuaccucucuacaaccuucccuccc

SEQ ID NO: 368717 - RNA, 64 nt, Human
aaauuuauuccuuauucccucuuggcagcuaaugggcucuuaccaaguuuaaacacaaaauuua

SEQ ID NO: 368718 - RNA, 64 nt, Human
uccacaacccccaaguaauuagccuucuggagcuggcucuuagcugaggcuccugcuaccuccu

SEQ ID NO: 368719 - RNA, 50 nt, Human
ucuccuggugcagccugugaggcucuuaagacaggggccacuccucccuc

SEQ ID NO: 368720 - RNA, 64 nt, Human
uucucuguuuuaguugcugaggccugaguuuucuggcucuuaaagcauagaucauuucaccuga

SEQ ID NO: 368721 - RNA, 64 nt, Human
ggucugguaugaaaugggacuguuuaacaagcaaggcucuuaggggacacuguugagccugguc

SEQ ID NO: 368722 - RNA, 64 nt, Human
guggcaccaggugaugcccuucuguaagugcccaccgcgggaugccgggaaggggcauuauuug

SEQ ID NO: 368723 - RNA, 64 nt, Human
ccaccucuggagaauccacccccaccagauuccuccgcgggagguggcccucagcugggacagu

SEQ ID NO: 368724 - RNA, 64 nt, Human
cacuuccagggaaaaggaaagaugcgaacauacuggcucuuaggagagcggaaaggaccuccug

SEQ ID NO: 368725 - RNA, 64 nt, Human
cgccgagguuucuccuagggcuguuccugggccuggcucuuacaggcucgucccccaggccugc

SEQ ID NO: 368726 - RNA, 64 nt, Human
augccuuuggguucgaggcuuccagcugcccaguggcucuuaaacaguuuagcaacuaauaacc

SEQ ID NO: 368727 - RNA, 64 nt, Human
cauuuccagaauacugaauuugugugacuuauuuggcucuuaacagaguggcacauccuacuga

SEQ ID NO: 368728 - RNA, 64 nt, Human
guaucuugaaaaaauguaauuuauuuuugauaacggcucuuaaacuuuaaaauaccugcuuuau

SEQ ID NO: 368729 - RNA, 64 nt, Human
uugaguugguucuuaguauuauuuaugguaaauaggcucuuaccacuugcaaauaacuggccac

SEQ ID NO: 368730 - RNA, 64 nt, Human
guugcuccagcuccugaacagaaacuagcuucagggcucuuauaggaaaugcuaagccuggacu

SEQ ID NO: 368731 - RNA, 64 nt, Human
uuuucuuagccccucagccagcugccauuagcuuggcucuuaaagggccaggccuccuuuucug

SEQ ID NO: 368732 - RNA, 64 nt, Human
uggauacagaguuuccacccucaguuccuggaggggcucuuauuauuuucucucuuuuuaaaaa

SEQ ID NO: 368733 - RNA, 64 nt, Human
ugauuacaauucugaugugaaaaagaugguguuuggcucuuauagagccugugugaaaggccca

SEQ ID NO: 368734 - RNA, 64 nt, Human
uuuuaauauccaccuugaggggucgcugcuugagggcucuuaucccaggggacuuuuuaauucg

SEQ ID NO: 368735 - RNA, 64 nt, Human
ugugccugucugcgccucucacacacagauaaguggcucuuacccagcucucagugacuccccc

SEQ ID NO: 368736 - RNA, 64 nt, Human
aagaaagcauuaguaaaaaucuaacaauaugaagggcucuuaugagucauuuuuuucaaaagau

SEQ ID NO: 368737 - RNA, 64 nt, Human
gaauaggaagacaggacaaaguuaacagcuuaagggcucuuaauucugugaguugaggacuuaa

SEQ ID NO: 368738 - RNA, 64 nt, Human
caaacccaggguaguuuacacuuaaugcuagggaggcucuuaaaacauuauuagauuuugagga

SEQ ID NO: 368739 - RNA, 64 nt, Human
uuaucuucagaucauuacuauaauaagauaccguggcucuuaugcagauauugcagcaagccuu

SEQ ID NO: 368740 - RNA, 64 nt, Human
uuccggaauucaccgcccagucgccagggggcgcccgcgggagcccggcgggggcacgcgccac

SEQ ID NO: 368741 - RNA, 64 nt, Human
gauggaccugccccggaccuaccucccucccucuccgcgggagaccccuuguugcacugccccc

SEQ ID NO: 368742 - RNA, 64 nt, Human
gagaggaugacuugcggccaccaaguuucugucuccgcgggagucccgugcaagccaucagaau

SEQ ID NO: 368743 - RNA, 64 nt, Human
agggcagaacaggggaggguguucaaggaagaguggcucuuagcagaggcacuuuggaaggugu

SEQ ID NO: 368744 - RNA, 64 nt, Human
uccccuggccaggagagccacagccaugauacagggcucuuauggagcccuggaguuguugggc

SEQ ID NO: 368745 - RNA, 64 nt, Human
cuucagcccagcacagaagcaagacaaaaucaguggcucuuagaguuuagaaaacaagacagac

SEQ ID NO: 368746 - RNA, 64 nt, Human
agagaauuauacaaggcaaaguccuucucuuuagggcucuuacaaucuaucacuuccaaaaagu

SEQ ID NO: 368747 - RNA, 52 nt, Human
aacaaaccaccauugccugacuggcucuuaucaguguuaauagcaucucagc

SEQ ID NO: 368748 - RNA, 64 nt, Human
cugagggucaccucaaagguaugcuaugccguguggcucuuaugugcccaggugguguggucag

SEQ ID NO: 368749 - RNA, 64 nt, Human
acucagcauagauuguauaaaauaccuuuguaacggcucuuagcacacucacagauguuugagg

SEQ ID NO: 368750 - RNA, 64 nt, Human
aggagacuugggaaggaccaaugguaauuuaaguggcucuuaaaaagucaugcaacauguuucu

SEQ ID NO: 368751 - RNA, 64 nt, Human
uuuuuaaacauaauuuucucugaaaauuaauuguggcucuuauuugcauuuacgaaugaucuuc

SEQ ID NO: 368752 - RNA, 64 nt, Human
gcacaccugcaucuccaguuuucggccccucccuggcucuuaccaggucacgugaucccuccag

SEQ ID NO: 368753 - RNA, 64 nt, Human
cccuuccucucaggcucuugacuacuuggaacuaggcucuuaugugugccuuuguuucccauca

SEQ ID NO: 368754 - RNA, 64 nt, Human
cuggauuccauuuucuaagaguuucugagggugaggcucuuauuuuuuuuuuuaagggauccug

SEQ ID NO: 368755 - RNA, 64 nt, Human
uuucauuaagggaguagaauagucacuuaacuggggcucuuaacauugcuaauaaccuguggcu

SEQ ID NO: 368756 - RNA, 64 nt, Human
acugugugaaaauguggagcagccaacaagcaggggcucuuaggcaaucacauagugaaaguuu

SEQ ID NO: 368757 - RNA, 64 nt, Human
gcuucuguucacaacaguggcccauggagaaagaggcucuuauuaaacuuagaugaaagagcug

SEQ ID NO: 368758 - RNA, 64 nt, Human
guuuaaacaacguuaaacucuuagccuacaagguggcucuuauguacauaguuguuaauacauc

SEQ ID NO: 368759 - RNA, 64 nt, Human
guccccacacagcgccgcggccgccccuccacccccgcgggagccccugccccacgcuaauaaa

SEQ ID NO: 368760 - RNA, 64 nt, Human
gacaggcagggagggaggccaggccucgcuugcaccgcgggacgaggcugaccgggcuguucug

SEQ ID NO: 368761 - RNA, 64 nt, Human
gauaaggaaugaauauaaagauugcuauuuggguggcucuuauuaaacuguguauuuuguacuu

SEQ ID NO: 368762 - RNA, 64 nt, Human
aucccagaagaggacagugaauuacuccuaggucggcucuuauagaguggccauaguguucugu

SEQ ID NO: 368763 - RNA, 64 nt, Human
ccugcugcgaugcaaugcuuuucuaaucugcaguggcucuuacaaaacucuguucccacucccu

SEQ ID NO: 368764 - RNA, 64 nt, Human
uguggacucgccuccgugcgccgcugccccagaaggcucuuaucaauguuauuuauuugauugu

SEQ ID NO: 368765 - RNA, 64 nt, Human
uuacugcuuaauuccuuguuaggucuucucuugaggcucuuagaaaagcguuuuccagagagau

SEQ ID NO: 368766 - RNA, 64 nt, Human
ucucauggcaaauuugguauccuguuacagccuuggcucuuaaacaacucaaaauauugggaua

SEQ ID NO: 368767 - RNA, 64 nt, Human
gaaauucuuaaccaugucaaaugauuuaguuucuggcucuuagacucaucuggcaguucuacac

SEQ ID NO: 368768 - RNA, 64 nt, Human
augcaagcuauuucuggaggggaaaaauguguguggcucuuacguuuucugggaauuuuguaac

SEQ ID NO: 368769 - RNA, 64 nt, Human
uuggagugcuugccuuuccacgugacuuuuaaaaggcucuuaaagagcaaauguccucuucucc

SEQ ID NO: 368770 - RNA, 64 nt, Human
uacaaaauagaauucaauaaccauauuggaugcaggcucuuaacucagcagggauaucguacau

SEQ ID NO: 368771 - RNA, 64 nt, Human
uuuguuaaaaacacugcugaggcuucauaaucauggcucuuagaaacucaggaaagaggagaua

SEQ ID NO: 368772 - RNA, 64 nt, Human
aauugaaauggugaagaaacaaguauacacuagaggcucuuaaaaguauugaaagacaauacug

SEQ ID NO: 368773 - RNA, 64 nt, Human
aagaaaccacaaaacgcauggaacaacuauccauggcucuuagccagaaaugucuugccucugg

SEQ ID NO: 368774 - RNA, 64 nt, Human
cucuccugcagggagaaugcaggggucugugcuuggcucuuagcaaagcagguggcccacagug

SEQ ID NO: 368775 - RNA, 64 nt, Human
aacugcccugaauuaaauggcuguuuuaacaguaggcucuuagcauuauaccacauagucauuu

SEQ ID NO: 368776 - RNA, 64 nt, Human
cagcaucucugagcacccaagccaggugggugguggcucuuaaggagguguuccuaaaauggug

SEQ ID NO: 368777 - RNA, 64 nt, Human
gugucccagccacgcagggccauccacugugacgucggccgaccaggcuggacacccucugccg

SEQ ID NO: 368778 - RNA, 61 nt, Human
aggcugaugcagaagaauggcgugaacccggaaggcagagcuugcagugagccgagaucac

SEQ ID NO: 368779 - RNA, 64 nt, Human
uguacuuagagcuaauucgcauauauacaggaagggcucuuagaaucaguuugugggcacagag

SEQ ID NO: 368780 - RNA, 64 nt, Human
aagguuuucaagguggcaauuggggcggagccccggcucuuauagaagcuucagcaggaggcaa

SEQ ID NO: 368781 - RNA, 64 nt, Human
ucaaaaaugaauggcuaguuuacgugauagauuaggcucuuacuacauauguguguguauauau

SEQ ID NO: 368782 - RNA, 64 nt, Human
cccuggcccccacucucccgggccgcccaccacaggcucuuaauggggccgggucaguccuaca

SEQ ID NO: 368783 - RNA, 64 nt, Human
gagagggaggccagugucagggucggaguggccuggcucuuagcacugaccgaccauugccauu

SEQ ID NO: 368784 - RNA, 64 nt, Human
ugugaucagcauguaaagugucuggcguguaguaggcucuuaauaaacacuggcugaauaugaa

SEQ ID NO: 368785 - RNA, 64 nt, Human
aaggucccaggcacacacccugcccauugcagguggcucuuacagcucucuggugccagcacgg

SEQ ID NO: 368786 - RNA, 64 nt, Human
gugaaccuucuccagucugcaggcuggcauagaaggcucuuagauuauauugggcagcuugcaa

SEQ ID NO: 368787 - RNA, 64 nt, Human
gucccaccgacacucaccugggagcacggcgccuggcucuuaccagcgucuggccuagaggaag

SEQ ID NO: 368788 - RNA, 64 nt, Human
ugcguuccucuguggcguggccaggccggggccuggcucuuacccggggaguggugggcaucuc

SEQ ID NO: 368789 - RNA, 64 nt, Human
aggaagauaugaaaagagaggugucaacagcaagggcucuuaggggucaggcaccagcauggag

SEQ ID NO: 368790 - RNA, 64 nt, Human
uacaauagaaaaaagagagagcuuccuaggccugggcucuuaaaugcugcauuauaacugaguc

SEQ ID NO: 368791 - RNA, 64 nt, Human
caagaugucaaaacaagacuccucaucaugauaaggcucuuacccccuuuuaauuuguccuugc

SEQ ID NO: 368792 - RNA, 64 nt, Human
gaaggauuugcuucccuccccugggaaggcagagggcucuuaauaaagaggacccagaagauuc

SEQ ID NO: 368793 - RNA, 64 nt, Human
acuguguccuuuacagcaacauagauggagcugaggcucuuauccuaagugaauuaaugcagga

SEQ ID NO: 368794 - RNA, 64 nt, Human
uacaaaugugauaaauguggcaaagccuuuaacuggcucuuaauccuuaugaaacaaaagauaa

SEQ ID NO: 368795 - RNA, 64 nt, Human; identical to SEQ ID NO: 117008

SEQ ID NO: 368796 - RNA, 64 nt, Human; identical to SEQ ID NO: 117007

SEQ ID NO: 368797 - RNA, 61 nt, Human
uccagaccuguggaacgaagaggauggggaaaaggcagagggcacugagugucccuuuaaa

SEQ ID NO: 368798 - RNA, 64 nt, Human
uuuucccaagaugucccaagccucaucgugacgaggcucuuaucccacuccauuuuucccugcu

SEQ ID NO: 368799 - RNA, 64 nt, Human
ggauacuccauaacacaauagcaguacaccacuaggcucuuaaacgaucaagaacaauuuuuuu

SEQ ID NO: 368800 - RNA, 64 nt, Human
uuuaaguguaaucagaaagagaggcuuuggcaggggcucuuacuguguuuucuguaacaacaaa

SEQ ID NO: 368801 - RNA, 64 nt, Human
ugggguggcuccugagguagaggaguggagaacuggcucuuaagagcacaguuuucuuuucuuu

SEQ ID NO: 368802 - RNA, 64 nt, Human
ggccacccaggccugucuggggacauguaggaugggcucuuaccccagggagggcggcaggcuc

SEQ ID NO: 368803 - RNA, 64 nt, Human
gcggcugcagagacgcgagcaaccucuucucaucggcucuuaugcaaguuggggccaggauagg

SEQ ID NO: 368804 - RNA, 64 nt, Human
guccugugcagggcaccugcguggcugacagccaggcucuuacuccagccggggcugccagcgc

SEQ ID NO: 368805 - RNA, 64 nt, Human
acacucugggccuccaggacaauugcugcuugccggcucuuauuuuucuaagcaauauugugau

SEQ ID NO: 368806 - RNA, 64 nt, Human
caaagugucuucccgggagcccagcgcagcccccggcucuuacccaggaccccgccccgugcug

SEQ ID NO: 368807 - RNA, 64 nt, Human
cucuguguuggggucauggaugagcggcucucuuggcucuuaaaggcaggccucucucuucuug

SEQ ID NO: 368808 - RNA, 64 nt, Human
ucccaaagcccuaacagaccaguggccgagguguggcucuuauugcauccaucccugaagaugu

SEQ ID NO: 368809 - RNA, 64 nt, Human
uguuugacacuuccuuugguucauugagcuucaaggcucuuaaaaugccacugacaaugagauc

SEQ ID NO: 368810 - RNA, 64 nt, Human
guugcugccacaacuuguguaccuucagggauggggcucuuacucccuccugaggccagcugcu

SEQ ID NO: 368811 - RNA, 64 nt, Human
accuggaaaaaaaauguaucuuauuuuugauaauggcucuuaaaucuuuaaacacacacacaaa

SEQ ID NO: 368812 - RNA, 64 nt, Human
cuguaggaccucuuuuguugcuuaagaugcagauggcucuuaagaaucaggcagucgcccacuu

SEQ ID NO: 368813 - RNA, 64 nt, Human
ucugugaucaaagacccucucucuggcugagguuggcucuuagcucauugcuggggaugggaag

SEQ ID NO: 368814 - RNA, 64 nt, Human
aacugcaaugcaacguggcccugcuucaggugauccgcgggaggggccuccacgccagcgccgg

SEQ ID NO: 368815 - RNA, 64 nt, Human
ggugugcgugugucucccgccucgccgccccuggccgcgggacagcuucuguccaaucauguug

SEQ ID NO: 368816 - RNA, 64 nt, Human
uugaacaccaaagaauuugcuggcuuccaaauugggcucuuaaacaagguaaauugugacauaa

SEQ ID NO: 368817 - RNA, 64 nt, Human
uggggcaggauuggguuuacaacccacaucuccuggcucuuauuccagggccuuuucccacuaa

SEQ ID NO: 368818 - RNA, 64 nt, Human
gguaucaagugcucaacagacauaugauagucaaggcucuuagucucauuuuuuacucuuuguc

SEQ ID NO: 368819 - RNA, 61 nt, Human
agugcuacgugauccucugccgcccagaccucaacagcacagagcacuuccaggccuccau

SEQ ID NO: 368820 - RNA, 61 nt, Human
ccuucccucucccggcaacaucucugggaaucaacagcauauugacacguuggagccgagc

SEQ ID NO: 368821 - RNA, 61 nt, Human
uguugcugggagcggcggcagcgagucccugcaacagcaauaaacuuccuucuccucgggc

SEQ ID NO: 368822 - RNA, 61 nt, Human
acagauggaagcuucguuguucucauagaaccaacagcaucugagcccucaacaccaacag

SEQ ID NO: 368823 - RNA, 61 nt, Human
auagaaccaacagcaucugagcccucaacaccaacagcaccauccucuguagcagacaggc

SEQ ID NO: 368824 - RNA, 61 nt, Human
uagauaccaucaacauccugcuguaugaugacaacagcaucaugaccuucaaccucaguca

SEQ ID NO: 368825 - RNA, 61 nt, Human
cccugcccaccagccccucggaagcaugugacaacagcagaggguacaccagggacaacag

SEQ ID NO: 368826 - RNA, 61 nt, Human
agcugccccugggauucucaggccaaccugccaacagcaagcggauuuucuugcaagauca

SEQ ID NO: 368827 - RNA, 61 nt, Human
aagagaggugagaagugcucccaagcagacacaacagcagcacagaggucuggaggccaca

SEQ ID NO: 368828 - RNA, 61 nt, Human
uuauuuaaauggaaugaaccauuaaaugaaacaacagcaaaacauguucaggaauuuuaua

SEQ ID NO: 368829 - RNA, 61 nt, Human
agacuucauuuuuuucuguucagacuuguugcaacagcagucauacccaaaucauuugcac

SEQ ID NO: 368830 - RNA, 61 nt, Human
cuccuggccagcagaguggggcacuggggggcaacagcaacaguuuucuugucuucauuca

SEQ ID NO: 368831 - RNA, 64 nt, Human
uggcuggacugugaccaucccugauggggccugaccgcgggagcugaggaagcgccgcuccacc

SEQ ID NO: 368832 - RNA, 64 nt, Human
caaauucaagucggucugcagaccucucagcuacccgcgggaccucuuguaacccaucggcauc

SEQ ID NO: 368833 - RNA, 61 nt, Human
uuuaauguagccauuugggguuaucucuaguaaggcagauacccacguugguaaauuuuua

SEQ ID NO: 368834 - RNA, 61 nt, Human
aagagcuuauagccggaagcccugggacaaccaacagcagacaguggccaaaauuugcaag

SEQ ID NO: 368835 - RNA, 61 nt, Human
auuucugucugcugagaucucagagccugcccaacagcagggaagccaagcacccauucau

SEQ ID NO: 368836 - RNA, 61 nt, Human
uucaaggggaggggacaaagaccccacagcccaacagcaggacuguagaggucacucugac

SEQ ID NO: 368837 - RNA, 61 nt, Human
acaauagcccugcacagggcaucaacauggccaacagcauugccaaccugagacugaaggc

SEQ ID NO: 368838 - RNA, 61 nt, Human
uucccauuguggucccuucagagcuccuuuccaacagcaucucucugucgaagaaagaagc

SEQ ID NO: 368839 - RNA, 61 nt, Human
agccgaagcgaaaggggucagggugcugaggcaacagcagcaagggcuggucuggacaaga

SEQ ID NO: 368840 - RNA, 61 nt, Human
aaugugugcaacaucacaucuccccaagaagcaacagcaugggguccagcaguuggggccc

SEQ ID NO: 368841 - RNA, 61 nt, Human
auuagcaacaaaaucccguaauucuuuuggccaacagcagcuauuuuggggagcagcugug

SEQ ID NO: 368842 - RNA, 61 nt, Human
aggguucauauaaacacucacucugugucuucaacagcaucuuucuuuccccaucuuucua

SEQ ID NO: 368843 - RNA, 61 nt, Human
ggggugcgggggugcguguccccauucccugcaacagcaaauggggcuccuucuucagccc

SEQ ID NO: 368844 - RNA, 61 nt, Human
uucggcagggaggugaauacucuugaaaggccaacagcaaguguuugugggacacaacaca

SEQ ID NO: 368845 - RNA, 61 nt, Human
gccuuuucuuuaaaagacacaauaggacucgcaacagcauugacucaacaccuaggacuaa

SEQ ID NO: 368846 - RNA, 61 nt, Human
gguuugguaaugaucugcaagucccggagagcaacagcacagcucugccugacgcucucau

SEQ ID NO: 368847 - RNA, 61 nt, Human
uccauucucaaauccugugacugggaucacucaacagcacugugauguauuauuuucaaug

SEQ ID NO: 368848 - RNA, 61 nt, Human
gcuggugaggggcucagaggaauacuuggaacaacagcaguguuauuguaguguggcaguu

SEQ ID NO: 368849 - RNA, 61 nt, Human
cuggaauuugaaucagauuucauuugggcaacaacagcagggcaggguuucuaaagcaggu

SEQ ID NO: 368850 - RNA, 60 nt, Human
uggucccucagugugccuaauucucaccugaaggcagagggaugaaaugccaagacucua

SEQ ID NO: 368851 - RNA, 61 nt, Human
cugcucucuguaggguucagguacacuggcuaaggcagaaccccaaauuucaaggcucuuu

SEQ ID NO: 368852 - RNA, 61 nt, Human
acccuggagaggacuccugccguguccugaaaaggcagaaaaggaagaggggcugcagaca

SEQ ID NO: 368853 - RNA, 61 nt, Human
ccaaaauagguaguguuugccuauguggaaacaacagcaaacuaacaccaagugccagagu

SEQ ID NO: 368854 - RNA, 61 nt, Human
ggcaucugaacuuuuaaugaacuuugaaggacaacagcaucuucccaaaaccauugauguu

SEQ ID NO: 368855 - RNA, 61 nt, Human
gcuccaauugauugguaacagaagaugaagacaacagcauaacuaaauuauuuuaaaaacu

SEQ ID NO: 368856 - RNA, 61 nt, Human
auggugacucagugaucagcagaugguacuucaacagcaauccccugucaaaccucagaac

SEQ ID NO: 368857 - RNA, 61 nt, Human
uauccauacacaggugaaacacauacagacucaacagcaaucaugcaguuccagagacaca

SEQ ID NO: 368858 - RNA, 61 nt, Human
gucucccugcucuugguggcagugguagcagcaacagcagcagcagcagcagcagcagcag

SEQ ID NO: 368859 - RNA, 61 nt, Human
aaagucuguguccaauuaugcacuggccacccaacagcaccaauuguacauucccugcauc

SEQ ID NO: 368860 - RNA, 61 nt, Human
accucaguggaacacaccauucucccccccucaacagcacacucagugcagcaagacugac

SEQ ID NO: 368861 - RNA, 61 nt, Human
aucagggguaggaauggaaaggauggagcaucaacagcagggugggcuuguggggccuggg

SEQ ID NO: 368862 - RNA, 61 nt, Human
guuugcagugaaaagcagugucuuugaucugcaacagcaaauccucagagaaaaagauucu

SEQ ID NO: 368863 - RNA, 61 nt, Human
cauaacacuuggaggaaucagaagggaagaucaacagcaaggauggggcaucauuaagacu

SEQ ID NO: 368864 - RNA, 61 nt, Human
uugcuuaauuccacuuaugcaucagucauuucaacagcaugaaugugguucuguacaguga

SEQ ID NO: 368865 - RNA, 61 nt, Human
acuuguagguuucucugccuccagguugccucaacagcaggaggcacagcaguuucaccau

SEQ ID NO: 368866 - RNA, 61 nt, Human
ucuaauaacaugaaaacaggcuaguuucaagcaacagcaaugucgguuggaaagcaggcgu

SEQ ID NO: 368867 - RNA, 61 nt, Human
ggaaaaauauccuacaaacaacaacuguucacaacagcaaaccccuacauuuaugagcugu

SEQ ID NO: 368868 - RNA, 61 nt, Human
uucuuuuuuuuuaaauuuuguauuuuccauccaacagcaguguguagagagaauauuaugc

SEQ ID NO: 368869 - RNA, 64 nt, Human
cgcccugccuggcacccacgcuggcucucuccugccgcgggagaaagcaccagcagguucugag

SEQ ID NO: 368870 - RNA, 64 nt, Human
uugcuaccguguucggagucucgcugccucccucccgcgggagguuucuccucuuuuugaaaau

SEQ ID NO: 368871 - RNA, 61 nt, Human
ccugguccugccccuuccugguucuuaucucaaggcagagcuucugaauuucaggccuuca

SEQ ID NO: 368872 - RNA, 61 nt, Human
uccuuucuccaccauggacucaaucugagaacaacagcauucauuuccauucauuuccaua

SEQ ID NO: 368873 - RNA, 61 nt, Human
uuccacuugagucacuuugaaauaguuaauucaacagcaccauguuagaaauauauuggca

SEQ ID NO: 368874 - RNA, 61 nt, Human
ugcgccccauauucccagcaucauagacauccaacagcaccagcaggagagugggcuagcc

SEQ ID NO: 368875 - RNA, 61 nt, Human
uguggguaacagucacagcaguuuuuuuuaccaacagcauacuuaacagacuugcugugua

SEQ ID NO: 368876 - RNA, 61 nt, Human
acucuggacuguucuguaaaguggcugguaacaacagcacuuuacaguuuguagauguaac

SEQ ID NO: 368877 - RNA, 61 nt, Human
gucucauggcuucauuuagagaccacaguaacaacagcagcccaccaaucagagaagcugg

SEQ ID NO: 368878 - RNA, 61 nt, Human
ugagacuccaucucaaaacaaaacaaaacaacaacagcaaaaaacaacaaaacaaaacaca

SEQ ID NO: 368879 - RNA, 61 nt, Human
ccucuauuucuguuucaacucucgucuaauccaacagcaaauccccuugaugcuaccuuug

SEQ ID NO: 368880 - RNA, 61 nt, Human
aauauaaaugugugaaucagggcugugaagacaacagcagaaaugcuaacaagcgugcaga

SEQ ID NO: 368881 - RNA, 61 nt, Human
caugcuucacaauguuaaguuauauggggagcaacagcaaacaggugcuaauuuguuuugg

SEQ ID NO: 368882 - RNA, 61 nt, Human
uauuugaaggaaaaauacccugauuugaaaccaacagcagauguugcaaacuuucauacca

SEQ ID NO: 368883 - RNA, 61 nt, Human
ucaauuuugguuauuacaaaacagaaaagaacaacagcaacaaaaacauugugugaaugua

SEQ ID NO: 368884 - RNA, 61 nt, Human
ugacugccuuccuugggaccaaggaccguuccaacagcauucacugccaguucuaauaggc

SEQ ID NO: 368885 - RNA, 61 nt, Human
ccugccaccaccagcuggaccugagcuugggcaacagcauuagguaugcccuuuacuuuuu

SEQ ID NO: 368886 - RNA, 61 nt, Human
cggccaccgaaaccacgugagugagaugagccaacagcaccggauccacagaauguuucuu

SEQ ID NO: 368887 - RNA, 61 nt, Human
uaaugaagacaaaggaaucuaguguaaaaaacaacagcaaacaaaaaggugaagucuaaau

SEQ ID NO: 368888 - RNA, 64 nt, Human; identical to SEQ ID NO: 116976

SEQ ID NO: 368889 - RNA, 64 nt, Human; identical to SEQ ID NO: 116977

SEQ ID NO: 368890 - RNA, 64 nt, Human; identical to SEQ ID NO: 116978

SEQ ID NO: 368891 - RNA, 61 nt, Human
augcaugcagaccuguacuccacaugcaacccaacagcagugcagugugauaacugagcgg

SEQ ID NO: 368892 - RNA, 61 nt, Human
ugauuuuugacacauacaccccuaauucccucaacagcagaaccuaccugcagccaccagg

SEQ ID NO: 368893 - RNA, 61 nt, Human
gcaagguuccaggcuugggccugggccacagcaacagcaguggucaaauaucuagauuuau

SEQ ID NO: 368894 - RNA, 61 nt, Human
gcagggaacuaggaacauggaggggaaccaacaacagcaucuuagaagaaauguagccaaa

SEQ ID NO: 368895 - RNA, 61 nt, Human
guaaugaagccagcugccaauuacauccucccaacagcacuuuggucuguggacugcugug

SEQ ID NO: 368896 - RNA, 61 nt, Human
uaaaugugaagaaggcuuuuaagauguggaacaacagcaagucacccaucagauaccugug

SEQ ID NO: 368897 - RNA, 61 nt, Human
caagagguuaaagauaauggcccauuagauacaacagcaagcccaagauuccgaagaagac

SEQ ID NO: 368898 - RNA, 61 nt, Human
auccaagacagaaaaugaagacacuggcuuccaacagcagcgcuccauguuuaagauacau

SEQ ID NO: 368899 - RNA, 61 nt, Human
guugagcaagacuaucagugccauuuuuuuucaacagcaugugcucauuucauuuuucugu

SEQ ID NO: 368900 - RNA, 61 nt, Human
aaucaugggaucacaugguuacuguuuaccccaacagcaugcucugucuagacuggaccuc

SEQ ID NO: 368901 - RNA, 61 nt, Human
acuggaggcgauggggcagugaacagaauaacaacagcaacaaugccuuugcaggcagccu

SEQ ID NO: 368902 - RNA, 61 nt, Human
uaugaucaguguuacugccuauaaucuuauacaacagcaaacccugaugugacauuccaug

SEQ ID NO: 368903 - RNA, 61 nt, Human
uccuagguguuggaaaacagguugauuaaggcaacagcagaagggcagggcaaggcugagc

SEQ ID NO: 368904 - RNA, 61 nt, Human
gcccauucccucugaauauuaggugugaugucaacagcauguuagaaggaucaaugggaag

SEQ ID NO: 368905 - RNA, 61 nt, Human
auuucaguguugucagaguauuaccacacagcaacagcaacauacagaagauauguucacu

SEQ ID NO: 368906 - RNA, 61 nt, Human
gugagaaaaggugguuauuuuuuccccaagacaacagcacuaguaaucccacuuaauaaga

SEQ ID NO: 368907 - RNA, 64 nt, Human; identical to SEQ ID NO: 116979

SEQ ID NO: 368908 - RNA, 64 nt, Human; identical to SEQ ID NO: 116980

SEQ ID NO: 368909 - RNA, 64 nt, Human; identical to SEQ ID NO: 116982

SEQ ID NO: 368910 - RNA, 61 nt, Human
gcaagagguggcucaacgggaggcucagaaacaacagcaacagaugcagaaccugggaaug

SEQ ID NO: 368911 - RNA, 61 nt, Human
agcagaagaucaaggaguacaaugcccagaucaacagcaaccucuucaugagcuuggugag

SEQ ID NO: 368912 - RNA, 61 nt, Human
ugaaauacauugaaggacucagugcggaguccaacagcauuagcaagugggaucagacacu

SEQ ID NO: 368913 - RNA, 61 nt, Human
gacuauucauaacggaaaacgauuucuaaagcaacagcagguauuuuuguacagggaaguu

SEQ ID NO: 368914 - RNA, 61 nt, Human
aauggauaguguacauucuucuuaaaguccacaacagcagauuuucuugcaguaaauuaug

SEQ ID NO: 368915 - RNA, 61 nt, Human
uauuuuucugaguaaauaugauuggauuaugcaacagcauauguaauaugggaauguuuug

SEQ ID NO: 368916 - RNA, 61 nt, Human
cuccauagucucaaacugucccccuuaugaccaacagcacauuugugaagagguucgcagg

SEQ ID NO: 368917 - RNA, 61 nt, Human
gaagaaauaaaagccuacguguugguaaauccaacagcaagggagauuuuugaaucauaau

SEQ ID NO: 368918 - RNA, 61 nt, Human
gacaaugccagguuggacugccagaaugagccaacagcacuugcuucccccuguagagagc

SEQ ID NO: 368919 - RNA, 61 nt, Human
cauuguauuuaauuucccaccuuaugaaacacaacagcagcucccugacugguucgccuuu

SEQ ID NO: 368920 - RNA, 61 nt, Human
aaugcuguuaaaucaccuuaugcgucguuuucaacagcaguggggcuaauuacccggaaua

SEQ ID NO: 368921 - RNA, 61 nt, Human
ugagcuguguuuugucugagccucucucggucaacagcaaagcuuggugucuuggcacugu

SEQ ID NO: 368922 - RNA, 61 nt, Human
cuuugcacccucaaugcaugauugguauucucaacagcaaaggggugaaaaaucuagagac

SEQ ID NO: 368923 - RNA, 61 nt, Human
aaaauauuugucuccaccuuuuccccaaaagcaacagcaagacauauuuuguuagauauuu

SEQ ID NO: 368924 - RNA, 61 nt, Human
cucaaugaaauacauuuccccuauauaauuccaacagcaguuucucuaguucuaaauuuua

SEQ ID NO: 368925 - RNA, 61 nt, Human
ccaaacauucuaccaugcacagcacaaccuacaacagcaaagaaucauccaccccaaaaua

SEQ ID NO: 368926 - RNA, 64 nt, Human; identical to SEQ ID NO: 116983

SEQ ID NO: 368927 - RNA, 64 nt, Human; identical to SEQ ID NO: 116984

SEQ ID NO: 368928 - RNA, 61 nt, Human
ccaaaauuguauguacuauuguacauuuuuacaacagcauuuucuuaaacauaaucugugu

SEQ ID NO: 368929 - RNA, 61 nt, Human
aauuucaaaguuuaauuaauauaauuaaaagcaacagcaagcagcagccugugaagauuuu

SEQ ID NO: 368930 - RNA, 61 nt, Human
uuguuugaauguguagaagaggaaaaagcaacaacagcaacaacacgaagaugauaccaaa

SEQ ID NO: 368931 - RNA, 61 nt, Human
guauuugauagcacaacagggagacuauagucaacagcaauuuaauuguauauuuuaauau

SEQ ID NO: 368932 - RNA, 61 nt, Human
caaauuaaauuaucauuugcagcaaacuguacaacagcaggaaggauauggaauggaacau

SEQ ID NO: 368933 - RNA, 61 nt, Human
gaggaacauauuaugcuacacguuggagaugcaacagcaaaucuagaucauggaaaauguc

SEQ ID NO: 368934 - RNA, 61 nt, Human
uuacacaugaagccugacuuaacuguaugugcaacagcaaugaaauuaacuccagaagccu

SEQ ID NO: 368935 - RNA, 61 nt, Human
cauagcuuuuggauagaaauuuugaguggaucaacagcaauggaaugaggagugaggcuuu

SEQ ID NO: 368936 - RNA, 61 nt, Human
uguaggguuauggaaucuaguaauaaaauuucaacagcacuuaaacugaaguuuggguugc

SEQ ID NO: 368937 - RNA, 61 nt, Human
ccuacaauggccuuguaacagccauuguucccaacagcaucacuuaggggugugaaaagaa

SEQ ID NO: 368938 - RNA, 61 nt, Human
auaaaugagcugccagaaucagguuuccaaucaacagcagugaguugggauuggacaguag

SEQ ID NO: 368939 - RNA, 61 nt, Human
augaauuauucuuccucagagugaagauacacaacagcaaaucaucagggagacuuuccau

SEQ ID NO: 368940 - RNA, 61 nt, Human
auuaauaaauugaaagcuugcuguacaaaggcaacagcaacuuaaaaaagaaaaucuggac

SEQ ID NO: 368941 - RNA, 61 nt, Human
gagaauguuuauacaaaaaaugaaauucuuccaacagcagagaaacucuaaaaaguuugau

SEQ ID NO: 368942 - RNA, 61 nt, Human
cuaauagcccagugccauccaguugaaaaaacaacagcaaucacaaaguagagguuuauau

SEQ ID NO: 368943 - RNA, 61 nt, Human
uaugggaauuuggcuucauacucuuucuuugcaacagcaguguucugggugauaauuuuga

SEQ ID NO: 368944 - RNA, 64 nt, Human; identical to SEQ ID NO: 116986

SEQ ID NO: 368945 - RNA, 64 nt, Human; identical to SEQ ID NO: 116987

SEQ ID NO: 368946 - RNA, 64 nt, Human; identical to SEQ ID NO: 116988

SEQ ID NO: 368947 - RNA, 61 nt, Human
gcuggaauagaaaaccuguuuaaaaccaucacaacagcaauauuuuuauucugggccaccu

SEQ ID NO: 368948 - RNA, 61 nt, Human
aucccaugguaaaauauucaaguaacuaagacaacagcauggcauuuauuugugugagugu

SEQ ID NO: 368949 - RNA, 61 nt, Human
ccaggggaauguauuuuucaaaacauacaagcaacagcaaaagcccuaacuucuuauacgu

SEQ ID NO: 368950 - RNA, 61 nt, Human
agucccuaaaagaaauggggaaaaaagaaaacaacagcaagucagaaaaaaaaaacaagag

SEQ ID NO: 368951 - RNA, 54 nt, Human
ugaucaccaucuacuccuaaugcccaacagcaucacggcacucugggacaggca

SEQ ID NO: 368952 - RNA, 61 nt, Human
uccgauuucauccucagcacguaaugcucaccaacagcacuugcacugaguugacucuugc

SEQ ID NO: 368953 - RNA, 61 nt, Human
ccauucacccucaccucucccugcauggaggcaacagcauuucaagauguaccuugggaag

SEQ ID NO: 368954 - RNA, 61 nt, Human
uuaaaaauauuuacuguacuuuaucucacuacaacagcaccacaauuuaaauuauaaaacg

SEQ ID NO: 368955 - RNA, 61 nt, Human
cagagcauaaggcccauuuuguuguucaggucaacagcaaaaugccugcaccaugacugug

SEQ ID NO: 368956 - RNA, 61 nt, Human
cagaauggugacuucauuugugcuaacaguacaacagcagauuugggucaggcuuaaucua

SEQ ID NO: 368957 - RNA, 61 nt, Human
ucccuucuuuguuugaauucucuaauaagagcaacagcagcucccauuucuagaacacauu

SEQ ID NO: 368958 - RNA, 61 nt, Human
caccaccuuucaucugauuccagaccugucccaacagcagggaugcuacaugggaagagaa

SEQ ID NO: 368959 - RNA, 61 nt, Human
aaauaugcuccugacggacucaggaaaaugccaacagcagagcacccuggugccaaggccu

SEQ ID NO: 368960 - RNA, 61 nt, Human
ucaucaguaggguuugucccugaugccuuuacaacagcaucugagcaccucucaaguuuuu

SEQ ID NO: 368961 - RNA, 61 nt, Human
aacaccaaagaaguuucugauagugucugcacaacagcaaaccaacauuuggugaggaauu

SEQ ID NO: 368962 - RNA, 61 nt, Human
gguuaucugggaaguaucagguucugggaggcaacagcauuaagugauaagaaaaggagac

SEQ ID NO: 368963 - RNA, 64 nt, Human; identical to SEQ ID NO: 116992

SEQ ID NO: 368964 - RNA, 64 nt, Human; identical to SEQ ID NO: 116993

SEQ ID NO: 368965 - RNA, 64 nt, Human; identical to SEQ ID NO: 116994

SEQ ID NO: 368966 - RNA, 61 nt, Human
uguuauugggaaaguacagucucaaaaccagcaacagcagcaguaccuacagcccuuuuuu

SEQ ID NO: 368967 - RNA, 61 nt, Human
auuuuuugccuauacauuuuucccacguuuccaacagcacuucucaccuauucaauaacug

SEQ ID NO: 368968 - RNA, 61 nt, Human
uagggguccgaugccugggaggaccagaagccaacagcaaaacuggaaaagcccggcaggc

SEQ ID NO: 368969 - RNA, 61 nt, Human
cuuugaaccuugaauuuuggagauguauucccaacagcagaaugcaacugugggcauuucu

SEQ ID NO: 368970 - RNA, 61 nt, Human
uucuaaaacugggucccauuauuuucuuaaacaacagcauuuuguauauauggauuauguu

SEQ ID NO: 368971 - RNA, 61 nt, Human
caaaacaaaaagacugaacuuuuguaauuaacaacagcaacaauaacaagauuacgaaugc

SEQ ID NO: 368972 - RNA, 61 nt, Human
cuuaccaccuccucuuggaccuaugcuuggccaacagcaugcagucuuccaucugcuuucu

SEQ ID NO: 368973 - RNA, 61 nt, Human
gucuauacauggguuguauuuuucugguucacaacagcacaaagugucuuucauuuuuuug

SEQ ID NO: 368974 - RNA, 61 nt, Human
cgugauuuguauaucgauggcuuaacauauacaacagcauuucuucucccugcaccuuuuc

SEQ ID NO: 368975 - RNA, 61 nt, Human
acggugcaaauaugacacuucuaacgauuaacaacagcaagaaaacaccugcugcugaugc

SEQ ID NO: 368976 - RNA, 61 nt, Human
gcucccucuggcaggaaauccccguggugcgcaacagcaccgugcugcucuccaugaccca

SEQ ID NO: 368977 - RNA, 61 nt, Human
aggaacgcaccuuccagagccugaugaauagcaacagcaauuuccgggaggucuuggagaa

SEQ ID NO: 368978 - RNA, 61 nt, Human
ugaaauaacacaaaauuucacucucuaaaagcaacagcauguaaacuagaaugaaagaagg

SEQ ID NO: 368979 - RNA, 61 nt, Human
cuacucuuaaugauguauugacaucuuuccccaacagcacagcuaaauuuccaagucgcau

SEQ ID NO: 368980 - RNA, 61 nt, Human
cacaugaacagcuugccagggaugggcagcccaacagcacuuuuccucuucuagauggacc

SEQ ID NO: 368981 - RNA, 61 nt, Human
agcaguuagagcggucgucggccaaccuccccaacagcacuuagguuuuccuguugagaug

SEQ ID NO: 368982 - RNA, 64 nt, Human; identical to SEQ ID NO: 116989

SEQ ID NO: 368983 - RNA, 64 nt, Human; identical to SEQ ID NO: 116990

SEQ ID NO: 368984 - RNA, 64 nt, Human; identical to SEQ ID NO: 116998

SEQ ID NO: 368985 - RNA, 61 nt, Human
cucccagcguccacuggcuccaggcuccucacaacagcagcucauagacacggggcgucuc

SEQ ID NO: 368986 - RNA, 61 nt, Human
aaaacuaaguuauuccaacacuaaaagcauacaacagcaugccaacaguaauauauuauuc

SEQ ID NO: 368987 - RNA, 61 nt, Human
cuguccagagcuauucucugauggauuugagcaacagcaguggagauaaauguccuagagu

SEQ ID NO: 368988 - RNA, 61 nt, Human
agaacaucuggguccucccuccucugugccccaacagcacgcugucuuccuauuggaccuu

SEQ ID NO: 368989 - RNA, 61 nt, Human
cuauagcuacugcuagaagucuuaaaaaaaccaacagcagcacaggauguauuaagaauua

SEQ ID NO: 368990 - RNA, 61 nt, Human
ccugagccuaggaguucaagaccagccucagcaacagcaggagccccaccccccgucucua

SEQ ID NO: 368991 - RNA, 61 nt, Human
uuuucauuaccuguagcuuugggcagauuugcaacagcaaauuaauguguaaaauuggauu

SEQ ID NO: 368992 - RNA, 61 nt, Human
aguguccagcaaaaguaggcguuagagcauucaacagcaugaauucacuaacgagcggggc

SEQ ID NO: 368993 - RNA, 61 nt, Human
gaaacgacgcugagaggaugacgacaacgugcaacagcagaaagaugcuugcaagcagagu

SEQ ID NO: 368994 - RNA, 61 nt, Human
gggggcaaagccccucugcccgaagcaauaacaacagcagcagaagcaaucccggggagcu

SEQ ID NO: 368995 - RNA, 61 nt, Human
cacugcacaggaggaggugacaaaccauuuccaacagcaacacagccacuaaaacacaaaa

SEQ ID NO: 368996 - RNA, 61 nt, Human
gaucacagcgcugccgggcaacagaaguuaccaacagcaguaaacuccagauggaucuguu

SEQ ID NO: 368997 - RNA, 61 nt, Human
gagaauaagagagucauaaaccuuaaguaagcaacagcauaacaagguccaagauaccuaa

SEQ ID NO: 368998 - RNA, 61 nt, Human
aacagucucauuacagauuuaguuuaccaaucaacagcaugucuacugcuuggauccauac

SEQ ID NO: 368999 - RNA, 61 nt, Human
ggcacuacauuugcuuaaauugcuauuuuggcaacagcacagaaaacuaauauuuuuaagc

SEQ ID NO: 369000 - RNA, 61 nt, Human
agaagcaauugaggcuuuucaacuaacuccucaacagcaacaucucaucagagaagauugu

SEQ ID NO: 369001 - RNA, 61 nt, Human
cauguauccuuacuugauauuuuguuccuaucaacagcauuagaaaggaaaggagacagaa

SEQ ID NO: 369002 - RNA, 61 nt, Human
guuuauugcagauucuucuuuuuugaaagaacaacagcaaaacauccacaacucuguaaag

SEQ ID NO: 369003 - RNA, 61 nt, Human
gagguugccauggagggccauuccugcccggcaacagcaccguccugcagggagccacuug

SEQ ID NO: 369004 - RNA, 61 nt, Human
acaguuuuuuuuuuuuacuacauauucuuuacaacagcaaccaaagaaaacauaccucaau

SEQ ID NO: 369005 - RNA, 61 nt, Human
cuccccuauugcgcucucaagaccagagacccaacagcagugaucucagggcagacagccc

SEQ ID NO: 369006 - RNA, 61 nt, Human
cuccucggguggugcccugugugacaaagcccaacagcaagggugacuccuggcagguggg

SEQ ID NO: 369007 - RNA, 61 nt, Human
uaugggacaggugccaggugugugguggggacaacagcacgugcagcccacggaagggcuc

SEQ ID NO: 369008 - RNA, 61 nt, Human
guuuuuaaaaaugcagcagcauaggagugaacaacagcaacacaaaacgggcauugguuuc

SEQ ID NO: 369009 - RNA, 61 nt, Human
auccccaguucuuagccaguugagccagcgacaacagcaccagagccaggcagucacuguu

SEQ ID NO: 369010 - RNA, 61 nt, Human
agccucagaagccaacuccuuugaaacuucccaacagcagggcuuuggccaagcccuuguc

SEQ ID NO: 369011 - RNA, 61 nt, Human
uaaaaacuugaaaaacaguuuguaagccuuucaacagcagcaucaaccuacgugguggaaa

SEQ ID NO: 369012 - RNA, 61 nt, Human
uaaccacugugccauaccaccucccaauaaucaacagcaaaauuauaggucuaacaauguu

SEQ ID NO: 369013 - RNA, 61 nt, Human
aaagcugaccauggaucccuggggccaacggcaacagcaugggccucaccuccucugugau

SEQ ID NO: 369014 - RNA, 61 nt, Human
uugaaacagauucaggccagcccagccaggccaacagcaccuccccgcugggaagagaaga

SEQ ID NO: 369015 - RNA, 61 nt, Human
aaacuccagacucuugggccguccccauuugcaacagcacacauaguuucugguauauuug

SEQ ID NO: 369016 - RNA, 61 nt, Human
ggagaucccagcucgcucuccccacugucagcaacagcacuuccuucguggaggaagugga

SEQ ID NO: 369017 - RNA, 64 nt, Human; identical to SEQ ID NO: 117001

SEQ ID NO: 369018 - RNA, 64 nt, Human; identical to SEQ ID NO: 117002

SEQ ID NO: 369019 - RNA, 64 nt, Human; identical to SEQ ID NO: 117003

SEQ ID NO: 369020 - RNA, 61 nt, Human
cagccuauggauccgugaccaaugugagggucaacagcaccaugacaacccugcaggugcu

SEQ ID NO: 369021 - RNA, 61 nt, Human
acacccagcucagcauuuccacaccaagcagcaacagcaaaucacgaccacugauagaugu

SEQ ID NO: 369022 - RNA, 61 nt, Human
gaaagcaaaaacaccaacauacaagucuugacaacagcaucuggucuacuagacuuucuua

SEQ ID NO: 369023 - RNA, 61 nt, Human
ucgggccugacccguccacacagggccgugucaacagcagcgacucaagggacguguguac

SEQ ID NO: 369024 - RNA, 61 nt, Human
cugguuauuucuccuuuguguaagugauaaacaacagcaaauauacuugaauaaaauguuu

SEQ ID NO: 369025 - RNA, 61 nt, Human
gccucucaggaaucaggguggacauggcucacaacagcagggccuucuucuuuuugacgug

SEQ ID NO: 369026 - RNA, 53 nt, Human
uuuuuuucugcagcgcaugauaccaacagcacaacuuugaaaacuguuaagua

SEQ ID NO: 369027 - RNA, 61 nt, Human
aaaaaaauuuuagccuuaucuuaaucugucccaacagcaaugugacggauuuuugcagauu

SEQ ID NO: 369028 - RNA, 61 nt, Human
uguaaagcauagauaaauugaauaaucagggcaacagcauuaagcacaucugugaauuauc

SEQ ID NO: 369029 - RNA, 61 nt, Human
gggggaaaaauaauccauagucagcagaaaacaacagcagugagccagaggagcacaggcg

SEQ ID NO: 369030 - RNA, 61 nt, Human
uccaaauaaaacaguuuccauaaggugucagcaacagcacuaaaaaucucaaaucacacug

SEQ ID NO: 369031 - RNA, 61 nt, Human
cgcccucaggagccggcugccgggggggacucaacagcagagcucugagcagcagcaggca

SEQ ID NO: 369032 - RNA, 61 nt, Human
aagucuguaaagcucagacauuugucagccucaacagcaccacccauucaagcauccugug

SEQ ID NO: 369033 - RNA, 61 nt, Human
gguaccugcuuacucagauacuuacacacaacaacagcagcagcagcugcuacugcaacaa

SEQ ID NO: 369034 - RNA, 61 nt, Human
guucuuuuuugacuuuuuuuuuuucccaauccaacagcauccuuuuuuuuaaaagagagaa

SEQ ID NO: 369035 - RNA, 61 nt, Human
uuuuuuaacaauacauuuuuguggucaguuccaacagcacuguccguacuuuuaaaacugg

SEQ ID NO: 369036 - RNA, 64 nt, Human; identical to SEQ ID NO: 117004

SEQ ID NO: 369037 - RNA, 64 nt, Human; identical to SEQ ID NO: 117005

SEQ ID NO: 369038 - RNA, 64 nt, Human; identical to SEQ ID NO: 117007

SEQ ID NO: 369039 - RNA, 61 nt, Human
auuagugugauaaugugcugcaaaaaauauccaacagcacuacacauaaguacagaguauu

SEQ ID NO: 369040 - RNA, 61 nt, Human
gccaugauuucagucauagcaagcuuuugcucaacagcauaugggugggauuuugcaaaaa

SEQ ID NO: 369041 - RNA, 61 nt, Human
guuaaauuaauaaauaaugcauuuaaugaggcaacagcacuugaaaguuuuucauucauca

SEQ ID NO: 369042 - RNA, 61 nt, Human
uuuaacuucuacuucaugugauccaaaagaucaacagcaaucugaagacucugacuaacau

SEQ ID NO: 369043 - RNA, 61 nt, Human
gugguagagggacugaagguaccuuugggggcaacagcacccuaguuucauucucaacucu

SEQ ID NO: 369044 - RNA, 61 nt, Human
uucaacaaauauuuauuaaauauccacuuugcaacagcacugaaauggcuguaaggacucc

SEQ ID NO: 369045 - RNA, 61 nt, Human
ggaaaggcugccgccaccaccaccaccaacacaacagcaauggcaacaccgacagcaacca

SEQ ID NO: 369046 - RNA, 61 nt, Human
aaacuuugucaugguuuccauuuacuaacagcaacagcaagaaauaaaucagagagcaagg

SEQ ID NO: 369047 - RNA, 61 nt, Human
uguuuggacucuggggaagcagugugauguucaacagcaucgccauggucccugcauucac

SEQ ID NO: 369048 - RNA, 61 nt, Human
acaggacaaucgcugccccccaaccucguagcaacagcaauaccgggggacccugcggcca

SEQ ID NO: 369049 - RNA, 61 nt, Human
agauugcaccauugcgcucuagccugggcaacaacagcaaaacuccaucucaaaaaauaaa

SEQ ID NO: 369050 - RNA, 61 nt, Human
uccugcugguuuuauccauggacugaacacccaacagcagugcacuaugcuuucuauggca

SEQ ID NO: 369051 - RNA, 61 nt, Human
gguauuggcauuguuaaggacguagcguagacaacagcagucauaaauaauuaggcaggaa

SEQ ID NO: 369052 - RNA, 61 nt, Human
uuggacagaagcccacuuaguuucuugggagcaacagcacguaucagaagccagacuugcu

SEQ ID NO: 369053 - RNA, 61 nt, Human
uaucaaugcaauuuuuaauuuuuguuaauaucaacagcaaaagccuagugcauugggagau

SEQ ID NO: 369054 - RNA, 61 nt, Human
cuuacucuugauuuucaacaguucuaaacagcaacagcauccaccuaauauaccuucagaa

SEQ ID NO: 369055 - RNA, 64 nt, Human; identical to SEQ ID NO: 116995

SEQ ID NO: 369056 - RNA, 64 nt, Human; identical to SEQ ID NO: 116996

SEQ ID NO: 369057 - RNA, 64 nt, Human; identical to SEQ ID NO: 117011

SEQ ID NO: 369058 - RNA, 61 nt, Human
ggcuugugggugaguuucaaguuugugguggcaacagcagcaggacagggcacggagggag

SEQ ID NO: 369059 - RNA, 55 nt, Human
agaaggaaagaggcaaguagaggcccaacagcagaaccccaaagugaaguuacag

SEQ ID NO: 369060 - RNA, 61 nt, Human
gcugaucagugaaacagacaagcagcugguacaacagcacauaggcagcuugguuguggaa

SEQ ID NO: 369061 - RNA, 61 nt, Human
cuuaggagagugguuuaacaugagaaggcgccaacagcacacagggucagggucacuucua

SEQ ID NO: 369062 - RNA, 61 nt, Human
uuuauuacacuaaaugauauucauauucaagcaacagcacuuucuguaguaauaaaaagua

SEQ ID NO: 369063 - RNA, 61 nt, Human
ggucaaacaccagucuagagcaucuuauugucaacagcaaaauaauauuuugcccacccug

SEQ ID NO: 369064 - RNA, 61 nt, Human
gcccuagaccccaucccagcggaacaaguggcaacagcaggaguuaauagcagaguugagg

SEQ ID NO: 369065 - RNA, 61 nt, Human
uguuuuggggugcagagaaagaaaagagcagcaacagcagaggcuggacucccugguucag

SEQ ID NO: 369066 - RNA, 61 nt, Human
uggggcucucuggggucugggggaauacgggcaacagcagucaggagggguaccccccaua

SEQ ID NO: 369067 - RNA, 61 nt, Human
ucuccuuggaggcaguggugugaaucuucuucaacagcaauuaaagaggaagugauuuugu

SEQ ID NO: 369068 - RNA, 54 nt, Human
uuuggaguuuugagaaauagagcacaacagcacuuucgucaugagcugacagua

SEQ ID NO: 369069 - RNA, 61 nt, Human
cgaagucuaauuuugguuccuaacaugccuccaacagcaucuaucaauccuguuagcuuuc

SEQ ID NO: 369070 - RNA, 61 nt, Human
cugugacaguuguaugccuucauuuuguauccaacagcaaagucuacaauaaaacuuuaaa

SEQ ID NO: 369071 - RNA, 61 nt, Human
gcccacuuguugaacagaacaaucuggguagcaacagcaucuuccacaguuuuccaaacug

SEQ ID NO: 369072 - RNA, 61 nt, Human
gaaccauaauuuaaaaaucuuucuagaauaacaacagcagacuccacucuuguuugucuaa

SEQ ID NO: 369073 - RNA, 61 nt, Human
uuaguaacuugaguguaugcacaaguuugaucaacagcaaaauagaguucugaauuucuuu

SEQ ID NO: 369074 - RNA, 64 nt, Human; identical to SEQ ID NO: 116956

SEQ ID NO: 369075 - RNA, 64 nt, Human; identical to SEQ ID NO: 116957

SEQ ID NO: 369076 - RNA, 64 nt, Human; identical to SEQ ID NO: 116969

SEQ ID NO: 369077 - RNA, 61 nt, Human
acucagaagggcaagcuaggcagggcccauacaacagcaggggucugcagguuagacguuc

SEQ ID NO: 369078 - RNA, 61 nt, Human
ccgucaaguaagauaauaacagcugaccugccaacagcauuacagggagauucuuugcuca

SEQ ID NO: 369079 - RNA, 61 nt, Human
caacucccuucucggggugggacagacgagacaacagcacacaggcagccagccguggcca

SEQ ID NO: 369080 - RNA, 61 nt, Human
uuauaauauuuaacccaccaaaaagucccuccaacagcaauaucuuaugaaagucuggcug

SEQ ID NO: 369081 - RNA, 61 nt, Human
gcaccaccagauggcuaccaaaugauaagaacaacagcaacaaaaggcuccaaaacacaca

SEQ ID NO: 369082 - RNA, 61 nt, Human
aacucuuuuuucacaagaagggucacugccacaacagcacagucagcgggugaauuacagg

SEQ ID NO: 369083 - RNA, 61 nt, Human
guuauuccaagcuaucaugcuuaagcuaugucaacagcauuuauuuguacuaaugcuaaua

SEQ ID NO: 369084 - RNA, 61 nt, Human
aacucacgcacagccaaggacuccaaaaucacaacagcauuacuguucuuauuugcugcca

SEQ ID NO: 369085 - RNA, 61 nt, Human
aaacugcagcgccuuuaagcauaaaguaacacaacagcauugcacggggccggcacugccg

SEQ ID NO: 369086 - RNA, 61 nt, Human
acagcaaacaaaaccacacaaaccaaaccgucaacagcauaauaaaaucccaacaacuauu

SEQ ID NO: 369087 - RNA, 61 nt, Human
auagccaugcugguagcaagagagaaaaaaucaacagcaaacaaaaccacacaaaccaaac

SEQ ID NO: 369088 - RNA, 61 nt, Human
acagcaguuugcacagcagaggggaauguagcaacagcagggccuccuaggccccaucuuc

SEQ ID NO: 369089 - RNA, 61 nt, Human
aaagaugaaaaaccacuuaaaugugaaggaacaacagcaacaagaccaguaugauauacca

SEQ ID NO: 369090 - RNA, 61 nt, Human
ggggccaggaacacguggccugagagcugggcaacagcagugauggcgaugcccuccaccu

SEQ ID NO: 369091 - RNA, 61 nt, Human
uuuacacaguauuuaauugaauacaaacaagcaacagcaacaaauccaccuccaccccauc

SEQ ID NO: 369092 - RNA, 61 nt, Human
uucuaaaaaaauagucuauauuagggaacaacaacagcaaauuagacaaaacccagaaagc

SEQ ID NO: 369093 - RNA, 61 nt, Human
gcccuggcuuugucaucagugacugccauagcaacagcagcucuguaccucaucuguugau

SEQ ID NO: 369094 - RNA, 61 nt, Human
gcugggacgugccuggccuaaggcauccuaccaacagcaccaucaaggcacguuggagcuu

SEQ ID NO: 369095 - RNA, 61 nt, Human
caaauuuccuucuaccauucaaauguuuuaucaacagcaaacuucagccguuucacuuuuu

SEQ ID NO: 369096 - RNA, 61 nt, Human
cccgaggagugucccgcgcagccacaccuggcaacagcagugugggcugcagggcuccguc

SEQ ID NO: 369097 - RNA, 61 nt, Human
ugcaguacggccugacauugcuuuugcucugcaacagcagagucgagucauugcaacaaag

SEQ ID NO: 369098 - RNA, 61 nt, Human
ugcuguugguuuuacacugccuuccacauugcaacagcaaguugauuucuugugaucccag

SEQ ID NO: 369099 - RNA, 61 nt, Human
ucacugauuagacagcacaagggucucaguucaacagcauacagccaacaucuaugguguc

SEQ ID NO: 369100 - RNA, 61 nt, Human
uaguccccaaccuuguggucacaucagaggucaacagcagaacagaggcaggucaggguug

SEQ ID NO: 369101 - RNA, 61 nt, Human
cguuggagugaacccucacugcccucaaggacaacagcagggugucacccagagcccgaug

SEQ ID NO: 369102 - RNA, 61 nt, Human
ugccuguuuucuuuauuaguccaaaggaaaacaacagcaacaaaaucuguuuuuaaaaugu

SEQ ID NO: 369103 - RNA, 61 nt, Human
cuuuccucauuggaagcaaagaccuagccaacaacagcaccucaaucugauacacucccga

SEQ ID NO: 369104 - RNA, 61 nt, Human
ggguaacagcccagcaucagggucacuguggcaacagcaggcucuaggggaauccuguggu

SEQ ID NO: 369105 - RNA, 61 nt, Human
uugcugcuaaagauccaaucuucuaacgccacaacagcauagcaaauccuaggauaauuca

SEQ ID NO: 369106 - RNA, 61 nt, Human
aggaacguuguccacaggggauuuauggauacaacagcaaacauuuuauaaacuaugcaca

SEQ ID NO: 369107 - RNA, 61 nt, Human
ugcucgagaaagagaggaacucagaaggcaacaacagcagcuucguuaugaacaagaaaaa

SEQ ID NO: 369108 - RNA, 61 nt, Human
cuuccugagaguucaggaaaguucucuugugcaacagcaaguagcuaagccuauagcaugg

SEQ ID NO: 369109 - RNA, 64 nt, Human; identical to SEQ ID NO: 117014

SEQ ID NO: 369110 - RNA, 64 nt, Human; identical to SEQ ID NO: 117015

SEQ ID NO: 369111 - RNA, 64 nt, Human; identical to SEQ ID NO: 117016

SEQ ID NO: 369112 - RNA, 61 nt, Human
ggcagcagugacccccauggcacacaccugccaacagcacugggggcuucuccccaggaga

SEQ ID NO: 369113 - RNA, 61 nt, Human
ucccacaggcuagaccagagaugccaagucccaacagcacugagcugugugcacugugcca

SEQ ID NO: 369114 - RNA, 61 nt, Human
ucccacccgcagagccucuggacggccuuggcaacagcaaaaucaugggacaacaccucuc

SEQ ID NO: 369115 - RNA, 61 nt, Human
cgggucuuccuguuuuguauuuaaauaaaaacaacagcagcaggcugucccugaguaguuu

SEQ ID NO: 369116 - RNA, 61 nt, Human
aaaugcaaagcacccaaaccacuaacacauccaacagcaccaacaaaucucaggugugugg

SEQ ID NO: 369117 - RNA, 61 nt, Human
uuuauuucagguuaagagagaagagagucagcaacagcaaguuuuacucauagaagcuggg

SEQ ID NO: 369118 - RNA, 61 nt, Human
ggugaggugacaucucauccccucacugaagcaacagcaucccaaggugcucagccggacu

SEQ ID NO: 369119 - RNA, 61 nt, Human
caguacaguggggucaccuguuguuucuauacaacagcagggaaggggccauggagcuuuu

SEQ ID NO: 369120 - RNA, 61 nt, Human
gcgaugcugagaggggaaacaguccagaguccaacagcagaacuugggggaagcggucggg

SEQ ID NO: 369121 - RNA, 61 nt, Human
gaauuuuguguuucaguguuugaaccuaaugcaacagcaacaaagccacugauaccugagc

SEQ ID NO: 369122 - RNA, 61 nt, Human
ccagccccacgcgcgcaccagucgcguaagacaacagcagugucuccaccucggggaccaa

SEQ ID NO: 369123 - RNA, 61 nt, Human
uuguccuugugcaggaagggcugacggagcucaacagcacagccaucaagccacaggugca

SEQ ID NO: 369124 - RNA, 61 nt, Human
gaccgggacuggagccagggucuggggagagcaacagcaccaggcuuuuccugguaguugg

SEQ ID NO: 369125 - RNA, 61 nt, Human
cgugccauuccacucucuucagcucuccccucaacagcaugcgagcccauaccuucugcau

SEQ ID NO: 369126 - RNA, 61 nt, Human
cauagaugaugauguuuauuuaaaaaaaaaacaacagcaacaaaaaauccuagccuccagu

SEQ ID NO: 369127 - RNA, 61 nt, Human
ccuuuccucucaagcccccaaagagcaaaggcaacagcaagaccagcggguucuugcaaca

SEQ ID NO: 369128 - RNA, 64 nt, Human; identical to SEQ ID NO: 116930

SEQ ID NO: 369129 - RNA, 64 nt, Human; identical to SEQ ID NO: 116931

SEQ ID NO: 369130 - RNA, 64 nt, Human; identical to SEQ ID NO: 116932

SEQ ID NO: 369131 - RNA, 61 nt, Human
aaaauccugccacagcagcagccgcagccgccaacagcagcgcuguuagugagcuaaguaa

SEQ ID NO: 369132 - RNA, 61 nt, Human
gggcacuuggaggaccuggcgugcucagacccaacagcaaaggaacuagaaagaaggaccc

SEQ ID NO: 369133 - RNA, 60 nt, Human
augacugggucuaugaauaagagguggacacaacagcagucuccuucagcacggcguggu

SEQ ID NO: 369134 - RNA, 61 nt, Human
cacgaaugucuuaguguuacccuccccuagucaacagcagaccagccuggccaaugccuau

SEQ ID NO: 369135 - RNA, 61 nt, Human
ucucucugguuguuucuguuucugaguggaccaacagcagaacccacgaggauuuguuuug

SEQ ID NO: 369136 - RNA, 61 nt, Human
uuugcuuagccaguauuagaacagaucuuuacaacagcagcugggcuggguucccagucgg

SEQ ID NO: 369137 - RNA, 61 nt, Human
caggauuuagcagggagguggcuggcuacagcaacagcagcugggcaagccagauaggccg

SEQ ID NO: 369138 - RNA, 61 nt, Human
gcccucaaaaaaaaaaaaaaaaaaaaaaaaacaacagcaccuguccaggcuuccuuaggua

SEQ ID NO: 369139 - RNA, 61 nt, Human
gguagauggugugugugaaacagugaagucucaacagcagaaaagaacaaaauguaaauuc

SEQ ID NO: 369140 - RNA, 61 nt, Human
gucucuucugcugcuagcaacucaaaaaucccaacagcacucccuauccuuucccugaccc

SEQ ID NO: 369141 - RNA, 61 nt, Human
ggaggggcagcaaccccccgcacacgucagccaacagcagugccucugcaggcaccaagag

SEQ ID NO: 369142 - RNA, 61 nt, Human
uuccuaccucuggugaugguuuccacaggaacaacagcaucuuucaccaagauggguggca

SEQ ID NO: 369143 - RNA, 61 nt, Human
agcugcucaucgaccuggagcggccccagagcaacagcagcgcugucacagggaccucggg

SEQ ID NO: 369144 - RNA, 61 nt, Human
gaaagguaggaagauaugaaaagagaggugucaacagcaagggcucuuaggggucaggcac

SEQ ID NO: 369145 - RNA, 61 nt, Human
uggucuuguaagcgcugcauggcgcucccuucaacagcaagccugacuguucucgagaacu

SEQ ID NO: 369146 - RNA, 61 nt, Human
ccucuuaccacagcacagaacauacauucuucaacagcauuaacggaguuugccaagugca

SEQ ID NO: 369147 - RNA, 64 nt, Human; identical to SEQ ID NO: 116927

SEQ ID NO: 369148 - RNA, 64 nt, Human; identical to SEQ ID NO: 116928

SEQ ID NO: 369149 - RNA, 64 nt, Human; identical to SEQ ID NO: 116933

SEQ ID NO: 369150 - RNA, 61 nt, Human
accguuuuuccaaagguauuuuacaauauuucaacagcagaccuucugcucuucgaguagu

SEQ ID NO: 369151 - RNA, 61 nt, Human
caggccuccacagagucuucagcgcaucccccaacagcagccccugccagucccucggguc

SEQ ID NO: 369152 - RNA, 61 nt, Human
cggaggacagggcauuguccucagucagauacaacagcauuuggggccaugguaccugcac

SEQ ID NO: 369153 - RNA, 61 nt, Human
aggcccagagaagcaaguggcuuucaacacacaacagcagauggcaccaacgggacccccu

SEQ ID NO: 369154 - RNA, 61 nt, Human
uuaauguaacaguuguggaaaaguguucuagcaacagcauauacuuaucaucauugccuuu

SEQ ID NO: 369155 - RNA, 61 nt, Human
cuuaaggccaggaguucgagaccagccugggcaacagcaagaccucaucucuacaaaacuu

SEQ ID NO: 369156 - RNA, 61 nt, Human
ggugguuuucaaaauguuguucuucaaccagcaacagcaacagcuagggacugauuagaaa

SEQ ID NO: 369157 - RNA, 61 nt, Human
uuuccuuaucuuguuuuccacaauucacaagcaacagcaagcauuuucuauaauuuuauaa

SEQ ID NO: 369158 - RNA, 61 nt, Human
aacagcacccucuccagaugagaguacaccccaacagcacccucuccagaugcagccccau

SEQ ID NO: 369159 - RNA, 61 nt, Human
aacagcacccucuccagaugagaguacaccccaacagcacccucuccagaugagaguacac

SEQ ID NO: 369160 - RNA, 61 nt, Human; identical to SEQ ID NO: 369159

SEQ ID NO: 369161 - RNA, 61 nt, Human
caacagcacccucuccagaugggagugcccccaacagcacccucuccagaugagaguacac

SEQ ID NO: 369162 - RNA, 61 nt, Human
cuauggccccugccuucccaggaguacaccccaacagcacccucuccagaugggagugccc

SEQ ID NO: 369163 - RNA, 61 nt, Human
acucuuuaggccucuggccuccacccucccccaacagcagggaugggucagguggcagcau

SEQ ID NO: 369164 - RNA, 61 nt, Human
ugccucgguucccucaaccauauaauggagacaacagcauuaccuauaucaggguuuuccu

SEQ ID NO: 369165 - RNA, 61 nt, Human
ggacaugcagcugcugugggagaaggcaguccaacagcaccagcacggcuaugacagugau

SEQ ID NO: 369166 - RNA, 64 nt, Human; identical to SEQ ID NO: 116935

SEQ ID NO: 369167 - RNA, 64 nt, Human; identical to SEQ ID NO: 116936

SEQ ID NO: 369168 - RNA, 64 nt, Human; identical to SEQ ID NO: 116937

SEQ ID NO: 369169 - RNA, 61 nt, Human
agauugagccauugcacuccagccugggcaacaacagcaaaacuccaucucaaaaaaaaaa

SEQ ID NO: 369170 - RNA, 61 nt, Human
cuccgcugcccucuuugucuaagagcuguggcaacagcaccugaauuucagaaacaaaagg

SEQ ID NO: 369171 - RNA, 61 nt, Human
gugguguuuuguuuuguuuuuuuucuuaaaacaacagcaacgugaucuuggcugucuguca

SEQ ID NO: 369172 - RNA, 61 nt, Human
uuucacuuccucgcucuccuaaguuuaauuacaacagcacgugcagccacgucagccaaau

SEQ ID NO: 369173 - RNA, 61 nt, Human
uacugaugagacaacacacacacacacaaaacaacagcaacaacaacagaacaacaacaaa

SEQ ID NO: 369174 - RNA, 61 nt, Human
gaaacacuuaagauacaaguucuuuugaauucaacagcagaugcuugcgaugcagugcguc

SEQ ID NO: 369175 - RNA, 61 nt, Human
cauugccuaaaguaaggugugaccagugaaacaacagcagagaaucauguuccuuugcugu

SEQ ID NO: 369176 - RNA, 61 nt, Human
aggugagagagaugcaucugcacguuuucuucaacagcaccaggugauucagcauauuccu

SEQ ID NO: 369177 - RNA, 61 nt, Human
caucuaggggagccuugauucccuuguuauucaacagcaagugugaauacugcuugaauaa

SEQ ID NO: 369178 - RNA, 61 nt, Human
cacugguagucaucugguguuuguacuauaacaacagcaagaaaaucucauuuaucuuuau

SEQ ID NO: 369179 - RNA, 61 nt, Human
aaaaaaaaucaggaaagguacccuaaucguucaacagcaaucaucuuuggggaaugggcau

SEQ ID NO: 369180 - RNA, 61 nt, Human
gaacaccagucuauuuuuacugagagcuggacaacagcaaacacuugacaaauaaacuuau

SEQ ID NO: 369181 - RNA, 61 nt, Human
cugggaaggguucagaaggugggcacccagccaacagcaugaacucagagcauuguuuuag

SEQ ID NO: 369182 - RNA, 61 nt, Human
gccagccuaguagaaaguucucguucauuggcaacagcagaaccugccucuccgugaaguc

SEQ ID NO: 369183 - RNA, 61 nt, Human
uuucccagauucucggauucucgacucuuugcaacagcacuugcuugcggaacucuuccug

SEQ ID NO: 369184 - RNA, 61 nt, Human
gaauacccggacuucagauacguuaagcaagcaacagcagacccugcgaaugcacaucgac

SEQ ID NO: 369185 - RNA, 64 nt, Human; identical to SEQ ID NO: 116938

SEQ ID NO: 369186 - RNA, 64 nt, Human; identical to SEQ ID NO: 116939

SEQ ID NO: 369187 - RNA, 64 nt, Human; identical to SEQ ID NO: 117012

SEQ ID NO: 369188 - RNA, 61 nt, Human
uauauaauuuaauaacagaagccuccaccagcaacagcauguggaagauacagauuuguca

SEQ ID NO: 369189 - RNA, 61 nt, Human
gugcggcccggaguuguccaucuguccaucccaacagcaagacgaggauguggcuguugag

SEQ ID NO: 369190 - RNA, 61 nt, Human
uguucagagcuggcaauggcagcgacagcagcaacagcagcagauccaagaagcggguccc

SEQ ID NO: 369191 - RNA, 61 nt, Human
ugcgggaaggugguauggccggcugugaagacaacagcagcugaggccgaugcuaaggaga

SEQ ID NO: 369192 - RNA, 61 nt, Human
gaagucaucauucucaacacaaagcccugaacaacagcauuugacaguguccuuuagauuu

SEQ ID NO: 369193 - RNA, 61 nt, Human
uccaggaauucuugcaguguagagguauucacaacagcaagcagggauuuggccugccauc

SEQ ID NO: 369194 - RNA, 61 nt, Human
agagagaaggucauggccaccgugauggggccaacagcaagggagggguaggggcccauac

SEQ ID NO: 369195 - RNA, 61 nt, Human
agccugcagggugaccugcuuccccaaaggccaacagcauuggccuggccagaccagguga

SEQ ID NO: 369196 - RNA, 61 nt, Human
aaauaugauuuuuaaaagcaguucaaguugacaacagcagaaacaguaacaaaaaaaucug

SEQ ID NO: 369197 - RNA, 61 nt, Human
uugaguccuucaaguuuaaacuaacauuuggcaacagcaaauuaaacguuuuuaagaugua

SEQ ID NO: 369198 - RNA, 61 nt, Human
guuguucucucuggacucuguuccuauaccacaacagcagcaggggccugaaaugugaugu

SEQ ID NO: 369199 - RNA, 61 nt, Human
guucaaacaucauaaaauggggaucgccucccaacagcagauuucgacauuaccugagagu

SEQ ID NO: 369200 - RNA, 61 nt, Human
uuuuccuuguuuuuccucguuaccaauauuacaacagcauuguuuucaguuauuuuucauu

SEQ ID NO: 369201 - RNA, 61 nt, Human; identical to SEQ ID NO: 369196

SEQ ID NO: 369202 - RNA, 61 nt, Human
guggauccagagcuuuucuccuucgaguccccaacagcaaagcauaggccucaucuuugga

SEQ ID NO: 369203 - RNA, 64 nt, Human; identical to SEQ ID NO: 116941

SEQ ID NO: 369204 - RNA, 64 nt, Human; identical to SEQ ID NO: 116942

SEQ ID NO: 369205 - RNA, 64 nt, Human; identical to SEQ ID NO: 116943

SEQ ID NO: 369206 - RNA, 64 nt, Human
cuuggccugguccuugcagcuguggcagcagcaggcuccccagcggcccagggugggccagacc

SEQ ID NO: 369207 - RNA, 64 nt, Human
cguggacagucaggguucacuugggcucucucuagcuccccaauucugccugccuccucccucc

SEQ ID NO: 369208 - RNA, 64 nt, Human
ugucucuuccucuucagaacucuuguccccccaggcuccccaccucugcaagaugggauacacu

SEQ ID NO: 369209 - RNA, 64 nt, Human
gcuuucccugaacuguuccguggcugugcccucugcuccccaaacccagguucccacagccuug

SEQ ID NO: 369210 - RNA, 64 nt, Human
accugacuccugagcaggaccugggcccgguucagcuccccacaaggacuucucugucuggaga

SEQ ID NO: 369211 - RNA, 64 nt, Human
ugccugcaacccugccuggccaccuccaggccuggcuccccaccucacacauuaugcggacuua

SEQ ID NO: 369212 - RNA, 64 nt, Human
ugcccugcuccugucuugugcuuuauccugccccgcuccccaucgccugcccgcagcagcgacg

SEQ ID NO: 369213 - RNA, 64 nt, Human
cagggccccuggacugucguggcuccccucaucagcuccccacaccagucaaggcuucucagcu

SEQ ID NO: 369214 - RNA, 64 nt, Human
aucccuccccgcaucgaggcucuuuaaagcuucagcuccccacuguccuccaucaaaguccccc

SEQ ID NO: 369215 - RNA, 64 nt, Human
cagacccuugacugaaugagagaggccagaggaugcuccccaugcugccacuauuuauugugag

SEQ ID NO: 369216 - RNA, 64 nt, Human
cugugcuggcagcuuugcccacacauacccagcagcuccccaggcugaaagcagcccuggccca

SEQ ID NO: 369217 - RNA, 64 nt, Human
uuccuccauccucagaccgugacaucuccccuaggcuccccagcagccaagaggagaggaaugu

SEQ ID NO: 369218 - RNA, 64 nt, Human
uggugagaugcacucuuuuguuguaccaaauagggcuccccaccccaccccugcgacaagugcu

SEQ ID NO: 369219 - RNA, 64 nt, Human
uccaauuccaagcuaagaagguauuggggcagaggcuccccaaauuggggugaucccccaagga

SEQ ID NO: 369220 - RNA, 64 nt, Human; identical to SEQ ID NO: 116947

SEQ ID NO: 369221 - RNA, 64 nt, Human; identical to SEQ ID NO: 116948

SEQ ID NO: 369222 - RNA, 64 nt, Human; identical to SEQ ID NO: 116949

SEQ ID NO: 369223 - RNA, 64 nt, Human
guacagagcaaccgcagggccgccccucccgcuugcuccccagcccacccaccccccuguacag

SEQ ID NO: 369224 - RNA, 64 nt, Human
uggaaaucucugcugaaauccacaguuuucauaagcuccccagaugauuccuguguacauuaaa

SEQ ID NO: 369225 - RNA, 64 nt, Human
uaaaaucuauguucucuuauuuuaaagauacagugcuccccacugaaaauuaaaccuaaaaaau

SEQ ID NO: 369226 - RNA, 64 nt, Human
acucauccagacuucucugaagcagaaaaccugagcuccccacucacugcccuagaauuuaugg

SEQ ID NO: 369227 - RNA, 64 nt, Human
gucguugccugcccaucugcaugaaugacaggcagcuccccaugguggucugccugugagcucu

SEQ ID NO: 369228 - RNA, 64 nt, Human
ggggccaccgaccgcagccagccccuccccaggagcuccccaggccgcaggggcucugcguucu

SEQ ID NO: 369229 - RNA, 64 nt, Human
gagggccuggggccucuguucugcuguggccugagcuccccagaguccugaggaggagcgccag

SEQ ID NO: 369230 - RNA, 64 nt, Human
cucguccugucccagagguuaucugccuggccuggcuccccacgagucaccugcaagccccagg

SEQ ID NO: 369231 - RNA, 64 nt, Human
uucagccuguggccaccucuggggcacaaugggggcuccccacugcccagucugccccucgggu

SEQ ID NO: 369232 - RNA, 64 nt, Human
cugucccccauuuuccaggggguauauggucagggcuccccaaccugaguuggguuacuucaag

SEQ ID NO: 369233 - RNA, 64 nt, Human
gucaugggcccugaggccccuccugccuggcccugcuccccaguggggaggugacuguguuucc

SEQ ID NO: 369234 - RNA, 64 nt, Human
cuuccccagcggccaccaacugaccuggggcgcugcuccccacaguccaaauaagcugaaagug

SEQ ID NO: 369235 - RNA, 64 nt, Human
acagggugugguguguguagucagggucugguuggcuccccauugccugcccgaggugcaaggu

SEQ ID NO: 369236 - RNA, 64 nt, Human
ggaucagcgauaggugaggggacacaguguaggagcuccccauguagaaaagggaaugugggga

SEQ ID NO: 369237 - RNA, 64 nt, Human
cuuuguagcacucaggcucuccauucaauuucaggcuccccagaucauguuuuggugaaaauua

SEQ ID NO: 369238 - RNA, 64 nt, Human
ugauuacuuccacugaggugggagcaucuccagugcuccccaauuauaucucccccacuccacu

SEQ ID NO: 369239 - RNA, 64 nt, Human; identical to SEQ ID NO: 116907

SEQ ID NO: 369240 - RNA, 64 nt, Human; identical to SEQ ID NO: 116908

SEQ ID NO: 369241 - RNA, 64 nt, Human; identical to SEQ ID NO: 116923

SEQ ID NO: 369242 - RNA, 64 nt, Human
cucguggagacacccgagaugagccacuucuggggcuccccaaggguugugguuuuaacccacu

SEQ ID NO: 369243 - RNA, 64 nt, Human
uuauggcuaacaagaauaaauacaugggaagagugcuccccauugauugaagagucacugucug

SEQ ID NO: 369244 - RNA, 64 nt, Human
uguuugucaaccaggcagagucccuuucuuuucugcuccccaccccaacccugccccuauguac

SEQ ID NO: 369245 - RNA, 64 nt, Human
guucucagccccuuguucugggcaagaacccagagcuccccaguguggauacuaauaaaccucu

SEQ ID NO: 369246 - RNA, 64 nt, Human
uccccaguuuuucucuaagauauacagugcaauagcuccccaccccucaguugacgccagcccu

SEQ ID NO: 369247 - RNA, 64 nt, Human
ccuucucucugcacucccacaaagccagggccaggcuccccaucccuaccucccacugcaucag

SEQ ID NO: 369248 - RNA, 64 nt, Human
guguuccugucccugugagugggaaggucuucuggcuccccaucccaccuggcuccagagccug

SEQ ID NO: 369249 - RNA, 64 nt, Human
cucuugacuuuccugguuauagcuuuccaucacagcuccccacauucucucuugauguugaaag

SEQ ID NO: 369250 - RNA, 64 nt, Human
gccuccuuaaacacccccauuucuugcggaagaugcuccccaucccacugacugcuugaccuuu

SEQ ID NO: 369251 - RNA, 64 nt, Human
agaaguuuaccaaaaugcucaagagcucugccgugcuccccaugaaaagucuauuaaguaggca

SEQ ID NO: 369252 - RNA, 64 nt, Human
gugccagaaauugguacaaagugcagugccagcugcuccccagggcauggucuggcucucuggg

SEQ ID NO: 369253 - RNA, 64 nt, Human
ugggggucugccugaggucccaccccacuaaagggcuccccaggccugggaucugacaccauca

SEQ ID NO: 369254 - RNA, 64 nt, Human
ccagauccaaucaaaccucagcccgaggaaacaugcuccccaacgugcucuccugugcuucugu

SEQ ID NO: 369255 - RNA, 64 nt, Human
uucugaagccguccucugcccaccugagguccuggcuccccacccuggcccccugccccugcac

SEQ ID NO: 369256 - RNA, 64 nt, Human
ccccacaccucccaccugcauugcucucccucgugcuccccaaaucaccacaaccaaccaauac

SEQ ID NO: 369257 - RNA, 64 nt, Human
uuuguguggauggccuggagggcaggugcccucugcuccccagugcuaccucucucuucccuag

SEQ ID NO: 369258 - RNA, 64 nt, Human; identical to SEQ ID NO: 116953

SEQ ID NO: 369259 - RNA, 64 nt, Human; identical to SEQ ID NO: 116954

SEQ ID NO: 369260 - RNA, 64 nt, Human; identical to SEQ ID NO: 116955

SEQ ID NO: 369261 - RNA, 64 nt, Human
uguucuuucucucugcccucccuuuccaucuccagcuccccauuuccuuucucaccuccuccuc

SEQ ID NO: 369262 - RNA, 64 nt, Human
ucgcugaaccccguuugccuguccacacccccucgcuccccaccauuuuuccugaccggccugu

SEQ ID NO: 369263 - RNA, 64 nt, Human
acccugacggagaucuaaaggccugcgggccacagcuccccaggaguucagugcagguguuucu

SEQ ID NO: 369264 - RNA, 64 nt, Human
ucugugugcguccagcuguguugcacaggccugggcuccccacugagugccaaggguccccuga

SEQ ID NO: 369265 - RNA, 64 nt, Human
acaaggcuucuggcaauuguagauuuaguuugacgcuccccaaagugcaugagacacaugcuaa

SEQ ID NO: 369266 - RNA, 64 nt, Human
uggccugaggcuuaccucucggcacuggcauugggcuccccagccggaacugguuaccaaggac

SEQ ID NO: 369267 - RNA, 64 nt, Human
cacuguuucugccacccuguaacaggccauuaaagcuccccaguguucagccuccuucacuccc

SEQ ID NO: 369268 - RNA, 64 nt, Human
gcccccacuuuuagacauaccccagagcccuguggcuccccacacccugccauaggggcagucc

SEQ ID NO: 369269 - RNA, 64 nt, Human
cuguugugucacccagagcccccucaagccuucugcuccccaauucucucuguugcagaguugg

SEQ ID NO: 369270 - RNA, 64 nt, Human
aggcagggucucaggccuuugauugcucaccccugcuccccaggcccugcccucacuuuuacca

SEQ ID NO: 369271 - RNA, 64 nt, Human
cuugugcucccugaagcuuuccuaauauugcugugcuccccaccacccccauggcagucccucc

SEQ ID NO: 369272 - RNA, 64 nt, Human
ggaaguaggucccagacaucaggaccuuuuuaaagcuccccaagugauucuacguuccccaagu

SEQ ID NO: 369273 - RNA, 64 nt, Human
ucuccgguauccucagcacuacccacccccgccagcuccccagcacaaaggacccuuucgacaa

SEQ ID NO: 369274 - RNA, 64 nt, Human
gaaaaaagccagucuaaaggccucuggauacugggcuccccagaacugcuggccacaggauggu

SEQ ID NO: 369275 - RNA, 64 nt, Human
guaggggauuugcacacaaaugcagcagagucuggcuccccagugccuugcuagagucaccguc

SEQ ID NO: 369276 - RNA, 64 nt, Human
uggggcuccugcuuccccaucccggaguucuccugcuccccaccuccugucguccugccuggcc

SEQ ID NO: 369277 - RNA, 64 nt, Human; identical to SEQ ID NO: 116944

SEQ ID NO: 369278 - RNA, 64 nt, Human; identical to SEQ ID NO: 116945

SEQ ID NO: 369279 - RNA, 64 nt, Human; identical to SEQ ID NO: 117017

SEQ ID NO: 369280 - RNA, 64 nt, Human
uggggcuccugcuuccccaucccggaguuccccugcuccccaccuccagucguccugccggacc

SEQ ID NO: 369281 - RNA, 64 nt, Human
cugcucccugagugccccacuccggaguuauccugcuccccaccuccgggcguccugcccuguu

SEQ ID NO: 369282 - RNA, 64 nt, Human
cuuggggcaugaaggccgccagcucccgccagccgcuccccagcccugccgcauuuccuuucag

SEQ ID NO: 369283 - RNA, 64 nt, Human
ucagcccagaugccaugccccugggcgggcagcagcuccccaucuucucuggcagacucagccc

SEQ ID NO: 369284 - RNA, 64 nt, Human
uuucugugguagcggccagcagaagacauggccugcuccccacucccuuuccccacuccuucuu

SEQ ID NO: 369285 - RNA, 64 nt, Human
gcuucauaaacaucuucagcauuuuguaccaucugcuccccaauggccaaaaucacaucaccag

SEQ ID NO: 369286 - RNA, 64 nt, Human
gucauuaaagagaaaggaguagcuuugacauuaagcuccccagaucccugcugcucauacuucu

SEQ ID NO: 369287 - RNA, 64 nt, Human
acccccugaagccagcgauagagggucccucucugcuccccagcagcuccugcccccaaggccu

SEQ ID NO: 369288 - RNA, 64 nt, Human
gcuauaagacagagcaggccacauguggccaucugcuccccauucuugaaagcugcuggggccu

SEQ ID NO: 369289 - RNA, 64 nt, Human
accaccuagggaccacguuagcugccuuccuugagcuccccaggagucgguuuccacaucugug

SEQ ID NO: 369290 - RNA, 64 nt, Human
ucccaaaauaaaauucagaagccagguggccugugcuccccaugggugaccucuggaggcagug

SEQ ID NO: 369291 - RNA, 64 nt, Human
ccugugggcuacaugcaggacacggcaugggccugcuccccagaggcaccuguuuggggucuuc

SEQ ID NO: 369292 - RNA, 64 nt, Human
cacgguagugguuuggggagguuuccgcaggucugcuccccaccccugccucggaagaauaaag

SEQ ID NO: 369293 - RNA, 64 nt, Human
cucuccuuccuuguuggagaugucuuaccucucagcuccccaaaaugcacuugccuauaagaaa

SEQ ID NO: 369294 - RNA, 64 nt, Human
acccgugugacucgccagcucauucucaccaaucgcuccccaauacggacccguuucucccuca

SEQ ID NO: 369295 - RNA, 64 nt, Human
ucagugcuuuugccuuaugcauuucagcauccuggcuccccaggguggcaggagcugagggagg

SEQ ID NO: 369296 - RNA, 64 nt, Human; identical to SEQ ID NO: 116959

SEQ ID NO: 369297 - RNA, 64 nt, Human; identical to SEQ ID NO: 116960

SEQ ID NO: 369298 - RNA, 64 nt, Human; identical to SEQ ID NO: 116961

SEQ ID NO: 369299 - RNA, 64 nt, Human
gggccagcuguucacagaaggccuuccaucugaugcuccccaucgccugcuugcucuccagccg

SEQ ID NO: 369300 - RNA, 64 nt, Human
ggggguccgugguagaggccuggggccgguagaggcuccccagggcucccuuauguccaccacu

SEQ ID NO: 369301 - RNA, 64 nt, Human
ggggagggcgaagggggugcacaaccagggcaaggcuccccacuuccuuagucccccaugcuca

SEQ ID NO: 369302 - RNA, 64 nt, Human
gcugcucccaauccuugccccaaacacuuagcuggcuccccaugacuuaaguguguucucuugu

SEQ ID NO: 369303 - RNA, 64 nt, Human
ucaggcuagcccugcccuccacccacaccugcccgcuccccacgauaagcaccagugggacugu

SEQ ID NO: 369304 - RNA, 64 nt, Human
gcugcccuggcagcugucuucaaggguaggcugagcuccccacccuggagccccugagggcggc

SEQ ID NO: 369305 - RNA, 64 nt, Human
ccuggccucuugauauaccucgagcuuccccugugcuccccagccccaggaccacuggccccuu

SEQ ID NO: 369306 - RNA, 64 nt, Human
uuuauguuuagugaguggucaucugaauuuuccagcuccccagaaaauguaugcacugguauag

SEQ ID NO: 369307 - RNA, 64 nt, Human
uggcacauaggggaaaggaucuacccuucuccuggcuccccaggacacucaguucuuucaaaga

SEQ ID NO: 369308 - RNA, 64 nt, Human
gcagaacgagcagugacaagacagguggggccuggcuccccacccgccagcuccaggacugccc

SEQ ID NO: 369309 - RNA, 64 nt, Human
acucaucaauucucgggucuuuuuuaaaagccaggcuccccaaagcacucugucucgcaauuuu

SEQ ID NO: 369310 - RNA, 64 nt, Human
agagaucucuguacuucaaggacagccuuggcuggcuccccauccagguacccccaggccauua

SEQ ID NO: 369311 - RNA, 64 nt, Human
aagagaccuguugcugcuuucuuguaauuauggggcuccccagagucugcguaacagucuccca

SEQ ID NO: 369312 - RNA, 64 nt, Human
agcccucuuccaucauguccccaaaccugcaagggcuccccacugccuacugcaucgagucaaa

SEQ ID NO: 369313 - RNA, 64 nt, Human
uuccucaggaaguaaaaccgaagaagauggcccagcuccccaagaaagccucagccauucacug

SEQ ID NO: 369314 - RNA, 64 nt, Human
ccaggagugggggcagaucccaaggcagccuccugcuccccaguggugggugccccagcucuac

SEQ ID NO: 369315 - RNA, 64 nt, Human; identical to SEQ ID NO: 116917

SEQ ID NO: 369316 - RNA, 64 nt, Human; identical to SEQ ID NO: 116918

SEQ ID NO: 369317 - RNA, 64 nt, Human; identical to SEQ ID NO: 116964

SEQ ID NO: 369318 - RNA, 64 nt, Human
ggaaaagcugcuuucaaggccaccacaugucugugcuccccaaccagcucuaucugccuugugu

SEQ ID NO: 369319 - RNA, 64 nt, Human
uucugcccaggccuucccaccaggaaucuccgaggcuccccagggccccgcuucuccguacacc

SEQ ID NO: 369320 - RNA, 64 nt, Human
ggcugugcagggguuuggagggcacacgaugugugcuccccaugccacuggucggcacuuugcc

SEQ ID NO: 369321 - RNA, 64 nt, Human
gugacugguucagcuagcucuccugagcagggacgcuccccagaaccaacagaaaucagugcca

SEQ ID NO: 369322 - RNA, 64 nt, Human
agggcaacaagaaccauuuccaaucuagaggaaagcuccccagcauugcuugcuccugggcaaa

SEQ ID NO: 369323 - RNA, 64 nt, Human
ugugaugaggugguugcugucuccauaggggccagcuccccagggcagacucacgugccccucu

SEQ ID NO: 369324 - RNA, 64 nt, Human
gcgcggggacgcggaggccgcgcauccuuucccagcuccccacccuccuugccuuugggugcgc

SEQ ID NO: 369325 - RNA, 64 nt, Human
cuugcgcagaggacccggggaggggucccgagaggcuccccaugcaacacuggaaaugacuguu

SEQ ID NO: 369326 - RNA, 64 nt, Human
aaugauggcgacgugggaggccugccaagcacaagcuccccacugcccacacugaguggucuac

SEQ ID NO: 369327 - RNA, 64 nt, Human
acccauaaugagaguugaaaggggauggauagcugcuccccaugcccuucccacuuuuuggaau

SEQ ID NO: 369328 - RNA, 64 nt, Human
cagggaggacgguggccccugcaucuggccugcugcuccccaguuccacacgggcccagugcug

SEQ ID NO: 369329 - RNA, 64 nt, Human
uucuccaacugggguccuggcugcagagcugucugcuccccacguugggcaacuccagccaaga

SEQ ID NO: 369330 - RNA, 64 nt, Human
gggaacgaggggaaaguucucagaacuguuggcugcuccccacccgccucccgccucccccgca

SEQ ID NO: 369331 - RNA, 64 nt, Human
uucuuuacuucauguccccaucaacaaccguccugcuccccaccucccccaggaaauaaggggc

SEQ ID NO: 369332 - RNA, 64 nt, Human
cacuuggaggguugcauggcggcugggcaaaggugcuccccacuucccagauggugcggcggcu

SEQ ID NO: 369333 - RNA, 64 nt, Human
acuucugcacccuuucaccaccucgaggagauuugcuccccauuagcgaaugaaauugaugcag

SEQ ID NO: 369334 - RNA, 64 nt, Human; identical to SEQ ID NO: 116965

SEQ ID NO: 369335 - RNA, 64 nt, Human; identical to SEQ ID NO: 116966

SEQ ID NO: 369336 - RNA, 64 nt, Human; identical to SEQ ID NO: 116968

SEQ ID NO: 369337 - RNA, 64 nt, Human
gcggcgggcucagccauucggcuuggggcaccaggcuccccagagacaaugcucaguauucauu

SEQ ID NO: 369338 - RNA, 64 nt, Human
ccagcagggcaucccggagcaggaggcuggccgggcuccccaagcgaaggcguuggugucuguc

SEQ ID NO: 369339 - RNA, 64 nt, Human
ugagcagauuuugaaguaggaaauaaaaugaauugcuccccagauuauuuuuuuaauauuguau

SEQ ID NO: 369340 - RNA, 64 nt, Human
aaauagaaggaaaaacaauggugaauuuuggagagcuccccagcucucagcaacuucauauaag

SEQ ID NO: 369341 - RNA, 64 nt, Human
gggggaacacuguguuucugcaucaucugcauuugcuccccaagcaauguagagguguuuaaag

SEQ ID NO: 369342 - RNA, 64 nt, Human
ggacaccucuccucugcugccauacucucccuuggcuccccagucuccucuccugaucuccucc

SEQ ID NO: 369343 - RNA, 64 nt, Human
ucccaaacugaaacuauaccauucaaacaacagcgcuccccauuucccccucccccgagcccau

SEQ ID NO: 369344 - RNA, 64 nt, Human
ugccuguuuauggugguguguuccuguagucccagcuccccaggaggcugaggugggagguugg

SEQ ID NO: 369345 - RNA, 64 nt, Human
cgaugacagugcucuaggcugccccggguccccagcuccccaggacucacccucauaccaucug

SEQ ID NO: 369346 - RNA, 64 nt, Human
cuagagacaugcucccugcccucuccacagugcugcuccccacaccuagccuuuguucuggaaa

SEQ ID NO: 369347 - RNA, 64 nt, Human
acucuagacaaacuacaaaccgauggaccgucaagcuccccaggagccccuuggauggcagcgu

SEQ ID NO: 369348 - RNA, 64 nt, Human
gguuuguucuuguaguuuucuauccccagucuuugcuccccagauggcaguaguuuuuaguagg

SEQ ID NO: 369349 - RNA, 64 nt, Human
gagcagauggagaccccuuggggagcaggcucgggcuccccagccccaucccaaacccuucagu

SEQ ID NO: 369350 - RNA, 64 nt, Human
caugugcgaugcauccccauggagagacagcauugcuccccagcccuccagaaaccuugagcag

SEQ ID NO: 369351 - RNA, 64 nt, Human
gugcuaguguggugacccccauacauuccucccugcuccccacugccaggaggaccacuguccc

SEQ ID NO: 369352 - RNA, 64 nt, Human
aaaggccgaggacgaguggucaccaaacaggguggcuccccaggucccgaagccugagacccgg

SEQ ID NO: 369353 - RNA, 64 nt, Human; identical to SEQ ID NO: 116885

SEQ ID NO: 369354 - RNA, 64 nt, Human; identical to SEQ ID NO: 116886

SEQ ID NO: 369355 - RNA, 64 nt, Human; identical to SEQ ID NO: 116887

SEQ ID NO: 369356 - RNA, 64 nt, Human
accacuggacucuccguuaaucucuaaggggucugcuccccaggaacguuucugaacaaugggg

SEQ ID NO: 369357 - RNA, 64 nt, Human
uuguugggacaggugccauuuaaauugccuccaugcuccccauuugcaccuagcuggaucaagu

SEQ ID NO: 369358 - RNA, 64 nt, Human
gagcgaguagaggucaguggugaugccucuugcugcuccccagaccccaucucuccugaagacc

SEQ ID NO: 369359 - RNA, 64 nt, Human
uuggaauagaauuaaaaggaguccaacauucccagcuccccaguucuaagaaacuuuugucaaa

SEQ ID NO: 369360 - RNA, 64 nt, Human
auuuaaauuuaaauuaguuaacauucaaaacgcagcuccccaaucacacuagcaacauuucaag

SEQ ID NO: 369361 - RNA, 64 nt, Human
ugugaagucauugccugcucaagaauguacaguggcuccccaaugccuuggaggccauaaggcc

SEQ ID NO: 369362 - RNA, 64 nt, Human
cagggcacaggggacuggcugggcccccagggcugcuccccacuugcagcacaaugccuucucc

SEQ ID NO: 369363 - RNA, 64 nt, Human
aauggacuaaaaggacccuugugugggaacaggugcuccccaaacacccugcugcuggcugcca

SEQ ID NO: 369364 - RNA, 64 nt, Human
cugagauuccauuuuugccaugugucaucgagucgcuccccaacagauguuugugauguuuuug

SEQ ID NO: 369365 - RNA, 64 nt, Human
agaaccagcacuggguuuacagaaugaggcccuggcuccccaccacagccccagcugccucaga

SEQ ID NO: 369366 - RNA, 64 nt, Human
uuggugaccaacugucacucauugcugagccucugcuccccaggggaguugugucuguaaucgc

SEQ ID NO: 369367 - RNA, 64 nt, Human
ccucaguagccucuugagggaagugggacuccuggcuccccagggccuggccuacucaaucucu

SEQ ID NO: 369368 - RNA, 64 nt, Human
agggggcaucuucugaacagccugccucugcccagcuccccauucacacacaccggcacuuuca

SEQ ID NO: 369369 - RNA, 64 nt, Human
cccaggaucacucucugcuggcaggauucuucccgcuccccaccuacccagcugauggggguug

SEQ ID NO: 369370 - RNA, 64 nt, Human
ccuguaacauacuggccuggacuguuuucucucggcuccccauguguccugguucccguuucuc

SEQ ID NO: 369371 - RNA, 64 nt, Human
cucaggccagguaaccccaggcugaaggggcccugcuccccauccccuaccaugggcacccaug

SEQ ID NO: 369372 - RNA, 64 nt, Human; identical to SEQ ID NO: 116888

SEQ ID NO: 369373 - RNA, 64 nt, Human; identical to SEQ ID NO: 116889

SEQ ID NO: 369374 - RNA, 64 nt, Human; identical to SEQ ID NO: 116962

SEQ ID NO: 369375 - RNA, 64 nt, Human
cccugcccagcuauugggagcuggccuaaguauugcuccccaccuccuugugaggaaaggcuag

SEQ ID NO: 369376 - RNA, 64 nt, Human
gagaauugugagacuuugcccuaagcugccaagugcuccccaaggagaucggucaccaggagag

SEQ ID NO: 369377 - RNA, 64 nt, Human
cugcccaaacuccccuucccuggggagcccucaggcuccccagaacuggcugggccccugggga

SEQ ID NO: 369378 - RNA, 64 nt, Human
gggggcacaggagaggagaggggcugugccccaggcuccccauuucccagcuccucacagaggc

SEQ ID NO: 369379 - RNA, 64 nt, Human
ucucugggagcccccucuucucugucaucgucaggcuccccacuugcaguggccgugguggcug

SEQ ID NO: 369380 - RNA, 64 nt, Human
uggugucaucagcaaagagaaaaagcacagguuagcuccccauuagauggaaaaguguagggac

SEQ ID NO: 369381 - RNA, 64 nt, Human
ugucgcccaacuagaguguaguggcacaaucucggcuccccacaaccucugacuccaggguuca

SEQ ID NO: 369382 - RNA, 64 nt, Human
cuuccuuccaggaccuccauuggcuccuagaagggcuccccacuuugcuuccuauacucugcug

SEQ ID NO: 369383 - RNA, 64 nt, Human
gcugcuccccuggaggacagagggagacagggcugcuccccaacaccugccucugaccccagca

SEQ ID NO: 369384 - RNA, 60 nt, Human
acagccccaagggcacaugaggcagggccggcuccccaccccaccuuugauggccucuuc

SEQ ID NO: 369385 - RNA, 64 nt, Human
cuaggagagaacuuaacccaccugggggaaaauagcuccccaagagcuggcaccaguaccacug

SEQ ID NO: 369386 - RNA, 64 nt, Human
cccuccccauuagcuuucaauuccguagccagcugcuccccagcagcggaaccgcccaggauca

SEQ ID NO: 369387 - RNA, 64 nt, Human
uggguguggaagggggaaaaggagauggagaccugcuccccagcucuuccugucagccgguuua

SEQ ID NO: 369388 - RNA, 64 nt, Human
gccccagagggcuggggugaccuggcaucccggggcuccccacgggcuggaugacgggguuggc

SEQ ID NO: 369389 - RNA, 64 nt, Human
uggagagacagcucugcaguuucccacacugucagcuccccaagagacaguccugaugggcaca

SEQ ID NO: 369390 - RNA, 64 nt, Human
ucugguggacgcagagcacuuaguuacccuggacgcuccccacauccuuccagaaggagacgag

SEQ ID NO: 369391 - RNA, 64 nt, Human; identical to SEQ ID NO: 116950

SEQ ID NO: 369392 - RNA, 64 nt, Human; identical to SEQ ID NO: 116951

SEQ ID NO: 369393 - RNA, 64 nt, Human; identical to SEQ ID NO: 116999

SEQ ID NO: 369394 - RNA, 64 nt, Human
ggccucggucuccuccccaugaagugggagcgaggcuccccaauggugcuuuuggcuuuagugu

SEQ ID NO: 369395 - RNA, 64 nt, Human
ccaugggccuggggccccaagccggggcgucugagcuccccaggcaugaccaaaccucagugga

SEQ ID NO: 369396 - RNA, 64 nt, Human
agggaggagcccaggggcuuaccucacugagagugcuccccagcaggcauccacuaccccaggg

SEQ ID NO: 369397 - RNA, 64 nt, Human
agcagggaauuugucuuguuggagccugcucugugcuccccacuccauuucucugucccucugc

SEQ ID NO: 369398 - RNA, 51 nt, Human
ccuaugucauucggaucugaggcuccccaaacgaggacacgacggccaagg

SEQ ID NO: 369399 - RNA, 64 nt, Human
cucccucccuauccuacuugcccauaugagcacggcuccccauggccacauacuccugcaaagc

SEQ ID NO: 369400 - RNA, 64 nt, Human
ucucugcccugcagggcuugccgcagggcgugaggcuccccagccacagcccccucuuacuugc

SEQ ID NO: 369401 - RNA, 64 nt, Human
uuccccgguacuuccuccuuuauuguagcacucagcuccccagccaaucuguacaucccucaga

SEQ ID NO: 369402 - RNA, 64 nt, Human
cuccugagcucaagcaauccguccacuugccuuggcuccccaaagugcugggauuacaggcgug

SEQ ID NO: 369403 - RNA, 64 nt, Human
acagccccacagcacccaggcuccauggggaagugcuccccacacgugcucgcagccuggcggg

SEQ ID NO: 369404 - RNA, 64 nt, Human
aagcccggccaccacgcauggcaugcugugcuuggcuccccauaagacguccucuuugggugca

SEQ ID NO: 369405 - RNA, 64 nt, Human
accuucucauuuaggcccuaagaaaaaauuuaaagcuccccagagcaaggccuuggcagccagc

SEQ ID NO: 369406 - RNA, 64 nt, Human
ccccuagaaaguaguaagcugugaggcuauucuggcuccccagggcuuacgugggaagagccag

SEQ ID NO: 369407 - RNA, 64 nt, Human
auuugggaagauaauaggaggcauuggggaaacugcuccccaauauauuccucuuuuccuuucu

SEQ ID NO: 369408 - RNA, 64 nt, Human
uuuuuuuuugcagggugcugccuaugggcccucugcuccccaaugccuuagagagaggagggga

SEQ ID NO: 369409 - RNA, 64 nt, Human
cagacagcugugguccucugauuccaaugagggggcuccccagggcugacccugcagcuuuggg

SEQ ID NO: 369410 - RNA, 64 nt, Human; identical to SEQ ID NO: 116897

SEQ ID NO: 369411 - RNA, 64 nt, Human; identical to SEQ ID NO: 116898

SEQ ID NO: 369412 - RNA, 64 nt, Human; identical to SEQ ID NO: 116899

SEQ ID NO: 369413 - RNA, 64 nt, Human
gaccgacccaaaaucuagaggaaagcgaaaagcugcuccccacccccuuuauuuugguccucuc

SEQ ID NO: 369414 - RNA, 64 nt, Human
uuaccucacugagucaucaguacccuccuauucagcuccccaagaugauguguuuuugcuuacc

SEQ ID NO: 369415 - RNA, 61 nt, Human
cuaagaccuacagcaagugaccagcccuugagcuccccaaaaaccucacccgaggcugccc

SEQ ID NO: 369416 - RNA, 64 nt, Human
uuuuuaaacacccccaucccucgggaagcagccagcuccccacaccuuccagggcccuaggccc

SEQ ID NO: 369417 - RNA, 64 nt, Human
ggaggcauuugcugacagaggacggggcacccgggcuccccacugcagucggccuugccuccuc

SEQ ID NO: 369418 - RNA, 64 nt, Human
agaggugagggugcacgucuucccuccugucccagcuccccagccuggcguagagcaccccucc

SEQ ID NO: 369419 - RNA, 64 nt, Human
cugugacuccugagccugggcagguggggaccccgcuccccaacaccugucuuucccucaaugc

SEQ ID NO: 369420 - RNA, 64 nt, Human
uugaaauccaguugccauugaguagcaaagccacgcuccccacaggacuuggacagagggccca

SEQ ID NO: 369421 - RNA, 64 nt, Human
ggggugcuccugugggagaucuucacucugggcggcuccccauaccccggugugccuguggagg

SEQ ID NO: 369422 - RNA, 64 nt, Human
gggaaaccagggucccgggcaggcccggcgcuuugcuccccacaccagcccccugcgcgugucc

SEQ ID NO: 369423 - RNA, 64 nt, Human
gcccccuccacucccccaggccccuggccccggcgcuccccacgucuucugccuggucugaggg

SEQ ID NO: 369424 - RNA, 64 nt, Human
ggauauguggggggucucagcaggagccuggggggcuccccaucuguguccaaauaaaaagcgg

SEQ ID NO: 369425 - RNA, 64 nt, Human
ugcacgggggccaccuugcccggggccacugguggcuccccagagccucagacccacacagccc

SEQ ID NO: 369426 - RNA, 64 nt, Human
guggcaccagcaacccugggucucccucucugcugcuccccagaaccccggggcccuccugcuc

SEQ ID NO: 369427 - RNA, 64 nt, Human
gggagacccuccccacagugccacccaugcagcugcuccccaggccaccccgcugauggagccc

SEQ ID NO: 369428 - RNA, 64 nt, Human
acacugugccgugcuccuucugccgccacgcccagcuccccaccugcccugcacucugcccucu

SEQ ID NO: 369429 - RNA, 64 nt, Human; identical to SEQ ID NO: 116891

SEQ ID NO: 369430 - RNA, 64 nt, Human; identical to SEQ ID NO: 116892

SEQ ID NO: 369431 - RNA, 64 nt, Human; identical to SEQ ID NO: 116893

SEQ ID NO: 369432 - RNA, 64 nt, Human
ccagacuggugucuggccuaaugagggagccggggcuccccauugccacccacagugcccggaa

SEQ ID NO: 369433 - RNA, 64 nt, Human
cagcaccuccgucauucacagggacauggaaaaagcuccccaccccugcagaacgcggcuggcu

SEQ ID NO: 369434 - RNA, 64 nt, Human
ccuuccuccucuuccuccuccccuuccucgggaggcuccccagacccuggcaugggaugggcug

SEQ ID NO: 369435 - RNA, 64 nt, Human
uuuaaacccagccgucauucucuccccacuccacgcuccccacuccucugccacguuauguuac

SEQ ID NO: 369436 - RNA, 64 nt, Human
ccacgcaagugaagccagcagaggagugauagcugcuccccaucccaaagugggccugggcagu

SEQ ID NO: 369437 - RNA, 64 nt, Human
gaaggagaaucaucaggacccuggaccugauacggcuccccaguacaccccaccucuuccuugu

SEQ ID NO: 369438 - RNA, 64 nt, Human
cuuguuagcagucauguugacaugguguuaggaggcuccccauccacccuuuacaugauguagg

SEQ ID NO: 369439 - RNA, 64 nt, Human
agaccagcacaugucagggaagcacccagugucggcuccccauccaaauccacaccagcaccuu

SEQ ID NO: 369440 - RNA, 64 nt, Human
aauuucacacagcaguuuccuugcaacacuuucagcuccccaugcuccagaauacccacccaag

SEQ ID NO: 369441 - RNA, 64 nt, Human
cuccugcuuccuuucucucuccugccucuccucugcuccccaucccacuuucucaucugccucc

SEQ ID NO: 369442 - RNA, 64 nt, Human
cugaaaaccaaaggaggagcagcagaagccauaggcuccccagcuuucuccaggcugggguggg

SEQ ID NO: 369443 - RNA, 64 nt, Human
ccucccagcccugcauccuccgugcccuagaccugcuccccagaggaggggccuugacccacag

SEQ ID NO: 369444 - RNA, 64 nt, Human
gugcccuccccaggcugggaggguuccuucccuagcuccccaucugcccccgcuggugagaguu

SEQ ID NO: 369445 - RNA, 64 nt, Human
acggccagcgacgacgccaccaucaaagccuggcgcuccccacgcaccaugcgcguccuccagg

SEQ ID NO: 369446 - RNA, 64 nt, Human
uccccuccuucagaggaggcucuggguggggccugcuccccauccccccaagcccacccagcac

SEQ ID NO: 369447 - RNA, 64 nt, Human
agccccuggcacagagcagacccggccacugguagcuccccacuuccuuacuccugcugcucug

SEQ ID NO: 369448 - RNA, 64 nt, Human; identical to SEQ ID NO: 116894

SEQ ID NO: 369449 - RNA, 64 nt, Human; identical to SEQ ID NO: 116895

SEQ ID NO: 369450 - RNA, 64 nt, Human; identical to SEQ ID NO: 116902

SEQ ID NO: 369451 - RNA, 64 nt, Human
caagggcuaggcuugaugguggccaggcuugccugcuccccaccugggaugccccugcucugga

SEQ ID NO: 369452 - RNA, 64 nt, Human
ucaaagggugauacaguggguaccaagcuccucugcuccccacuuuguagagccuagcaugagg

SEQ ID NO: 369453 - RNA, 64 nt, Human
aagcgggcugaauccuucagguuucugauaccuagcuccccaagcugacugggcuggcagagga

SEQ ID NO: 369454 - RNA, 64 nt, Human
cugggcccugcaguggccagcagggagcccagcugcuccccagugacuuccaguguaacaguug

SEQ ID NO: 369455 - RNA, 64 nt, Human
ccuuuauuucagaaaaaaaucagggugguucccagcuccccaguccaggacaaccauuaguccu

SEQ ID NO: 369456 - RNA, 64 nt, Human
augguccaucccagcucacugcauacauccaucggcuccccauggugucuucacaccugacgau

SEQ ID NO: 369457 - RNA, 64 nt, Human
uuucuauagaggaggaaaggcccucccucacccugcuccccacccaggcagggcagcaugggac

SEQ ID NO: 369458 - RNA, 64 nt, Human
cuggcggggcgaaguuugggggguguuuuguggggcuccccagacacacucucugccugguggu

SEQ ID NO: 369459 - RNA, 64 nt, Human
aggaggauuugucucuaagaggugcugccccaaagcuccccaagcaucaauacuccuagggcuc

SEQ ID NO: 369460 - RNA, 64 nt, Human
gacaaguaaaaggcucaucaguuuuagcaucucugcuccccagaaaauuguaagcauccucacc

SEQ ID NO: 369461 - RNA, 64 nt, Human
ccaucaggguucucuuagcaacucagagaaaaaugcuccccacagcgucccuggcgcagguggg

SEQ ID NO: 369462 - RNA, 64 nt, Human
cacugguaccugggggccugaauucuggcccccggcuccccacacagcugggacuggccuggau

SEQ ID NO: 369463 - RNA, 64 nt, Human
gaggguuggggcagucccaugaccccaugucccagcuccccacacagcgcugggccagagaggc

SEQ ID NO: 369464 - RNA, 64 nt, Human
gggcauuugagucuguggcuuugggguguccugggcuccccaucuccuucuggcccaucugccu

SEQ ID NO: 369465 - RNA, 64 nt, Human
ccuaugcuccuggauacgcuaugaacucucaccggcuccccagcccuccccaccaagggguacu

SEQ ID NO: 369466 - RNA, 64 nt, Human
aagcaggaaacagcacccuuggcguccccagcaggcuccccacugucagccacacaccugcccc

SEQ ID NO: 369467 - RNA, 64 nt, Human; identical to SEQ ID NO: 116903

SEQ ID NO: 369468 - RNA, 64 nt, Human; identical to SEQ ID NO: 116904

SEQ ID NO: 369469 - RNA, 64 nt, Human; identical to SEQ ID NO: 116906

SEQ ID NO: 369470 - RNA, 64 nt, Human
uaugacucaauucacguaaagaugcacucuugcagcuccccagucucuaccugucaggaugacu

SEQ ID NO: 369471 - RNA, 64 nt, Human
agcagcuucuccaggaagcccagggcaccauccagcuccccagcccaccugcucccaggcccca

SEQ ID NO: 369472 - RNA, 64 nt, Human
gcagcauggagggucccaguuggguccccaacgugcuccccaugggcaagacaauggaaacuuc

SEQ ID NO: 369473 - RNA, 64 nt, Human
cccuccaucauugccaccuugguagagagggauggcuccccacccucagcguuggggauucacg

SEQ ID NO: 369474 - RNA, 64 nt, Human
gagcugguggaauuccgggcacggcagcgccguggcuccccacgcuauaccaucuaccugggcu

SEQ ID NO: 369475 - RNA, 64 nt, Human
uuuugcccccgcucuuuggacacgccgacccggcgcuccccaaggaaugcugucccaacaagau

SEQ ID NO: 369476 - RNA, 64 nt, Human
cccuucuuacacaccuccccaccccugucagucugcuccccaucccccagccuggggccagaac

SEQ ID NO: 369477 - RNA, 64 nt, Human
acuaccccacaccagccuuggugccaccaaaagugcuccccaaaaggaaggagaaugggauuuu

SEQ ID NO: 369478 - RNA, 64 nt, Human
auggaagaggccaggacagagcugacaaaauuuugcuccccagugaaggccacagcaaccuucu

SEQ ID NO: 369479 - RNA, 64 nt, Human
gaggugggcugggcccucgcuccugacuguugcugcuccccagcccauggacaggagauccugg

SEQ ID NO: 369480 - RNA, 64 nt, Human
gggauguccuccaggcaccugggucccaugaccagcuccccaucuccauagggguaggcauuuc

SEQ ID NO: 369481 - RNA, 64 nt, Human
uccaaccaacuuguaucgagugggcggggcaacggcuccccauuuuucccgagccccgcccaca

SEQ ID NO: 369482 - RNA, 64 nt, Human
aggccuggcccagccagcagguucucuccugugagcuccccaauccaacccaugcauggccucc

SEQ ID NO: 369483 - RNA, 64 nt, Human
caugggggcugcccagcuggacagauggcuuccugcuccccaggcccagccaggguccucucuc

SEQ ID NO: 369484 - RNA, 64 nt, Human
gaugacuagggaaaagagggugcagggcacggcugcuccccaccaccaggucugcauuuguuca

SEQ ID NO: 369485 - RNA, 64 nt, Human
acaaugcaguagcauuuugggguguaggguggcagcuccccaaggcccugccccccagccccac

SEQ ID NO: 369486 - RNA, 64 nt, Human; identical to SEQ ID NO: 117019

SEQ ID NO: 369487 - RNA, 64 nt, Human; identical to SEQ ID NO: 117020

SEQ ID NO: 369488 - RNA, 64 nt, Human; identical to SEQ ID NO: 117021

SEQ ID NO: 369489 - RNA, 64 nt, Human
ccaggcuaguccggacccaccucaccccguuacagcuccccaagugguuuccacaugcucugag

SEQ ID NO: 369490 - RNA, 64 nt, Human
ccugcccagccugcccauccccuucccagucagggcuccccagggacaagggauggccagggga

SEQ ID NO: 369491 - RNA, 64 nt, Human
ccucuuccaggaagaccccccuauugcugcuggggcuccccauuugcuuacuuugcauuugugc

SEQ ID NO: 369492 - RNA, 64 nt, Human
uaauuuugucccacagcguugcuaggguggcauggcuccccaucucggguccauccuauacuuc

SEQ ID NO: 369493 - RNA, 64 nt, Human
aaucuacacuggaagccaacuugcuggcacccccgcuccccaacccuucuugccuggguaggag

SEQ ID NO: 369494 - RNA, 64 nt, Human
ucucucuagugcugccucacauugggccucagcagcuccccagcaccaauucacaggucacccc

SEQ ID NO: 369495 - RNA, 64 nt, Human
uuuugucagagugucugaugcggccacucauucggcuccccagaauuccuagacuggguuaaua

SEQ ID NO: 369496 - RNA, 64 nt, Human
uguggaggagggagagcccugucccugcccucaggcuccccagugcuccuggcccuucuauuua

SEQ ID NO: 369497 - RNA, 64 nt, Human
augccauguuguacugggggaauguagcccuugugcuccccacccccuaccuccaccugagccu

SEQ ID NO: 369498 - RNA, 64 nt, Human
cugucccugccaccccucucucccuuucucccucgcuccccaccaacucuccccuaaucacaca

SEQ ID NO: 369499 - RNA, 64 nt, Human
aaccucugaaggcccagaugaucuuccugccucagcuccccaaguagcugggacuagaggcaug

SEQ ID NO: 369500 - RNA, 64 nt, Human
agcaaccguggcccuuccuggacagcugugccucgcuccccacucugcucugaugcaucagaaa

SEQ ID NO: 369501 - RNA, 64 nt, Human
ccccagccuucagccugagucuagcauguuucuagcuccccagucccuugugaagccuugaggg

SEQ ID NO: 369502 - RNA, 64 nt, Human
ucaugccaggcuaugggggcagccaguuggcauugcuccccagacugaacagaaaccuggccgc

SEQ ID NO: 369503 - RNA, 64 nt, Human
cacuccuaucccagucucccagguuugguugagggcuccccaaggcagggcaagauagcggccc

SEQ ID NO: 369504 - RNA, 64 nt, Human
cugaagacccucuuggcuuucccgugcucuuugggcuccccagagaccugacaguauuagggag

SEQ ID NO: 369505 - RNA, 64 nt, Human; identical to SEQ ID NO: 116910

SEQ ID NO: 369506 - RNA, 64 nt, Human; identical to SEQ ID NO: 116911

SEQ ID NO: 369507 - RNA, 64 nt, Human; identical to SEQ ID NO: 116912

SEQ ID NO: 369508 - RNA, 64 nt, Human
ccccauauuggcaacacccccagcgccaccccaugcuccccaagaacgcggcucugcgcuggaa

SEQ ID NO: 369509 - RNA, 64 nt, Human
aucagcaucgcagccacuccagcgccuccccuccgcuccccacgcccccauauuggcaacaccc

SEQ ID NO: 369510 - RNA, 64 nt, Human
ugcacaccucacccagcaaaacaaaagcuguguggcuccccagcuuccucuccucggaaggcaa

SEQ ID NO: 369511 - RNA, 64 nt, Human
gcaggcagucugggguuagggacccuuucucuuugcuccccaaaauaaacugguuaucucuacu

SEQ ID NO: 369512 - RNA, 64 nt, Human
cuuauaaaagaacugcggcuggaacucaucuggugcuccccaugagagugcucugcuuguagac

SEQ ID NO: 369513 - RNA, 64 nt, Human
ugaggaggcugcagaagcaauggagugaaccucugcuccccacacagcuggcuacacugcucag

SEQ ID NO: 369514 - RNA, 64 nt, Human
cuccaaggugaaacacugcagucccggugugguggcuccccaugcaggacgggccaggcuggga

SEQ ID NO: 369515 - RNA, 64 nt, Human
acgagagccucacaggagggagggggccccacaggcuccccaggaggcucgugucuuuggccca

SEQ ID NO: 369516 - RNA, 64 nt, Human
uacaaagucaagugcuguggcuucaguucccccggcuccccaccccugacauccauacuuaugu

SEQ ID NO: 369517 - RNA, 64 nt, Human
auauucuaauugacauggaacaaguuuuuucccugcuccccaaauagaauuuuguaaccaacuu

SEQ ID NO: 369518 - RNA, 64 nt, Human
cagaugaguaccacaaaacaguguguccccagcagcuccccaccccagagccaaaugacaguag

SEQ ID NO: 369519 - RNA, 50 nt, Human
acgucuucugcagggagugagcuccccagacccccucgccacuccagcgc

SEQ ID NO: 369520 - RNA, 64 nt, Human
auggccagacaccccagucccuucaccaccaccugcuccccacgccaccaccauuuggguggcu

SEQ ID NO: 369521 - RNA, 64 nt, Human
uucccuguuuccuuguccagggccugaggaaauggcuccccaggucugucucuggaugcucuga

SEQ ID NO: 369522 - RNA, 64 nt, Human
ugguucuaucuuccuuuuccucacugaauucccagcuccccauccccauaaaugcauacacaua

SEQ ID NO: 369523 - RNA, 64 nt, Human
acauugccccaagauaggggcacacuacagagcagcuccccaggagcucagguggggaguccag

SEQ ID NO: 369524 - RNA, 64 nt, Human; identical to SEQ ID NO: 116856

SEQ ID NO: 369525 - RNA, 64 nt, Human; identical to SEQ ID NO: 116857

SEQ ID NO: 369526 - RNA, 64 nt, Human; identical to SEQ ID NO: 116882

SEQ ID NO: 369527 - RNA, 64 nt, Human; identical to SEQ ID NO: 116883

SEQ ID NO: 369528 - RNA, 64 nt, Human
gucugucuguuggccuguaucuguuguagcccaggcuccccaagcuucccugcaucuugguccu

SEQ ID NO: 369529 - RNA, 64 nt, Human
uccagccacaaagaagccaaaggucagucccucugcuccccagcaaacggugccucccaggcau

SEQ ID NO: 369530 - RNA, 64 nt, Human
ugaccccgacgccacagcccagccacggacgcuggcuccccaaagggugugcccucaccaccca

SEQ ID NO: 369531 - RNA, 64 nt, Human
cuuuacaucagccauauuaggggaacgguugucagcuccccaaaugccuacuggauccuacagc

SEQ ID NO: 369532 - RNA, 64 nt, Human
ccauuagcccacugccuggaaagcccuucggagagcuccccauggcuccucaccaccgagacag

SEQ ID NO: 369533 - RNA, 64 nt, Human
cuguugcccagaggcccuguucucaccucaugcugcuccccagaguagacuaacaggcucaguc

SEQ ID NO: 369534 - RNA, 64 nt, Human
acccucccuacucccauaccuccuccucuucugggcuccccacugucagacgggcuggcaaaug

SEQ ID NO: 369535 - RNA, 64 nt, Human
aguucuagccaugagguuuccagguaggacagcugcuccccaagccuccugaggacacaggaag

SEQ ID NO: 369536 - RNA, 64 nt, Human
ggaccauucucugaccgcccccgccaaaccucaugcuccccacuugcccuuauuggccugcuuu

SEQ ID NO: 369537 - RNA, 64 nt, Human
ucaacuggcuuuccuuaggucaggcaagcagacagcuccccacugaagaggucuguacagugac

SEQ ID NO: 369538 - RNA, 64 nt, Human
gucaguguccaaagcagggucugggcaggacucagcuccccagaguccucuaugaacuauggac

SEQ ID NO: 369539 - RNA, 64 nt, Human
cuucauggcucugcacauggcccuuugcuugagggcuccccacucccugcccaccaauacccag

SEQ ID NO: 369540 - RNA, 64 nt, Human; identical to SEQ ID NO: 369532

SEQ ID NO: 369541 - RNA, 64 nt, Human
agauuguauaccuguuguccacagucuucaggcagcuccccaggucucugaaccccagaguguc

SEQ ID NO: 369542 - RNA, 64 nt, Human
uggccuuaggaauccuggcugccaccaccacaaggcuccccauuuggacauuacuggcuaucuu

SEQ ID NO: 369543 - RNA, 64 nt, Human
aggugaaaagguacaauagugcuugucuccgauagcuccccacaucucuaauugacuuccacaa

SEQ ID NO: 369544 - RNA, 64 nt, Human; identical to SEQ ID NO: 116913

SEQ ID NO: 369545 - RNA, 64 nt, Human; identical to SEQ ID NO: 116914

SEQ ID NO: 369546 - RNA, 64 nt, Human; identical to SEQ ID NO: 116916

SEQ ID NO: 369547 - RNA, 64 nt, Human
ucuacugucaugugggauuuggaugguccugggggcuccccagcauuucuauccugacugccuc

SEQ ID NO: 369548 - RNA, 64 nt, Human
gccccaugccccaguccuuuccuacuccagaaaugcuccccacccccccaaagagggaaaagca

SEQ ID NO: 369549 - RNA, 64 nt, Human
uccugcccugcagucacauggguguggccuccaagcuccccaggaaagcaguggcagccucugg

SEQ ID NO: 369550 - RNA, 64 nt, Human
uguuuaucucgcccccuccagcucuccucauccugcuccccauugcuccaugucaggcuguucc

SEQ ID NO: 369551 - RNA, 64 nt, Human
agcagccccagguggagggcuggucucccugggggcuccccaguggcucugcccuggcuguggg

SEQ ID NO: 369552 - RNA, 64 nt, Human
aaaggaggugcaccuggcagcccacauuuuuguugcuccccaaaucccuccccacguggggaug

SEQ ID NO: 369553 - RNA, 64 nt, Human
gucagcgcauggucgugcggcaugcccgccgccugcuccccacacggacuccaggcggucccca

SEQ ID NO: 369554 - RNA, 64 nt, Human
accugggugugcaccugcuccgggggguggaggugcuccccacaguccgggccaggacagccuc

SEQ ID NO: 369555 - RNA, 64 nt, Human
cgugugaggcggagguuuccccugggagcccacugcuccccacugccccgcccuuucgaccuug

SEQ ID NO: 369556 - RNA, 64 nt, Human
agagccuggccgagcuggcagcauggagcccucggcuccccagacuuugccgaggggcugcucc

SEQ ID NO: 369557 - RNA, 64 nt, Human
gcuuaaaaucaguccguuucgucucuuggaaacagcuccccaccaaccaagauuucuuuuucua

SEQ ID NO: 369558 - RNA, 64 nt, Human
aggaucgcagggagaggccguauuaauuagccuggcuccccagguucuggaacagcuuuuuguc

SEQ ID NO: 369559 - RNA, 64 nt, Human
ugaauaugcugcucauccccaccugucuucaacagcuccccauuacccucaggacaaugucuga

SEQ ID NO: 369560 - RNA, 52 nt, Human
uugguucagcacuguccugacugcuccccaccagcacgcugaccugugaacc

SEQ ID NO: 369561 - RNA, 64 nt, Human
gccucacaggaagugggggugaggagccugcggugcuccccagaaaaggggaaggggcaguggg

SEQ ID NO: 369562 - RNA, 64 nt, Human
cuggcccugacugcuguuaauaauuggcagcagugcuccccagaucccagaaggucccugcugg

SEQ ID NO: 369563 - RNA, 64 nt, Human; identical to SEQ ID NO: 116875

SEQ ID NO: 369564 - RNA, 64 nt, Human; identical to SEQ ID NO: 116876

SEQ ID NO: 369565 - RNA, 64 nt, Human; identical to SEQ ID NO: 116900

SEQ ID NO: 369566 - RNA, 64 nt, Human
cacagaccgccgucuaacucaaagacuuccucuggcuccccaaggcugcaaagcaaaacagacu

SEQ ID NO: 369567 - RNA, 64 nt, Human
ugggauuacagacaugagccacugcaccugcccagcuccccaacucccugccauuuuuuaagag

SEQ ID NO: 369568 - RNA, 64 nt, Human
aggugugggcccagccccccuccuuccagccuuugcuccccaucccacguuccacucgcccugc

SEQ ID NO: 369569 - RNA, 64 nt, Human
agcugcccugcaggucuuggcacaugcacagcaggcuccccauagcuuugucaccacaaagggc

SEQ ID NO: 369570 - RNA, 64 nt, Human
gauuugucaccagugagcccuuggcacggucucugcuccccaccagggcagcacgggacagaaa

SEQ ID NO: 369571 - RNA, 64 nt, Human
gcugccaacugagcccgcggcucccuccgacccugcuccccacagagccucaguaaacccaugg

SEQ ID NO: 369572 - RNA, 64 nt, Human
ccgaggccguggggccccuagacuggacacgugugcuccccagagggcacccccuauuuaugug

SEQ ID NO: 369573 - RNA, 64 nt, Human
gagagcccugggcuggaggcugagcugcaucccugcuccccacauggaggacccaacaggaggc

SEQ ID NO: 369574 - RNA, 64 nt, Human
ucccugcccaagucuuccuucgugagcuggccuugcuccccaucccccaagugccucaccaguc

SEQ ID NO: 369575 - RNA, 64 nt, Human
cucccggagucacugguuucucggcccaaaccaugcuccccagcaguggcaauggcgagcaccc

SEQ ID NO: 369576 - RNA, 64 nt, Human
agugguaucaguucucugauccacuuccauuuaagcuccccaggaaaucccaugacaaacuggc

SEQ ID NO: 369577 - RNA, 64 nt, Human
cccaccugcccugggagucuugcugugccacacagcuccccacccccugcuaggaggucccagu

SEQ ID NO: 369578 - RNA, 64 nt, Human
uccacucuaccaggaagcccuaugacauccucaggcuccccagaccugcagcuugcauggggcc

SEQ ID NO: 369579 - RNA, 64 nt, Human
agccacagcugaggaguggccgggcaggcagcaggcuccccagccagggcuugacacgcccaca

SEQ ID NO: 369580 - RNA, 64 nt, Human
caccucuggacagcucaaauccaguccccuuccugcuccccaguccuggcagugccguggaugg

SEQ ID NO: 369581 - RNA, 64 nt, Human
aggugaggaauuugaagcucagaaagguugaggggcuccccagaggucacacagccugugugca

SEQ ID NO: 369582 - RNA, 64 nt, Human; identical to SEQ ID NO: 116920

SEQ ID NO: 369583 - RNA, 64 nt, Human; identical to SEQ ID NO: 116921

SEQ ID NO: 369584 - RNA, 64 nt, Human; identical to SEQ ID NO: 116922

SEQ ID NO: 369585 - RNA, 64 nt, Human
cagcagaguuugcaaguugcuuuaucucccacgggcuccccaagaaccuccaaccccgaggcuu

SEQ ID NO: 369586 - RNA, 64 nt, Human
ggugcuucuaguucugccaggagacagguuagcugcuccccacgucagcugggacaccccgacu

SEQ ID NO: 369587 - RNA, 64 nt, Human
cccgcugagugacgcaaucgcaccacggggcugcgcuccccacucugaugcucaggcccguggc

SEQ ID NO: 369588 - RNA, 64 nt, Human
acaacucccccaccgcccacucuccaccucacuagcuccccaaucccugacccuuugaggcccc

SEQ ID NO: 369589 - RNA, 64 nt, Human
acaguuuuuuuuuuuuuuaaauauuacccaaaaugcuccccaaauaagaaaugcaucagcucag

SEQ ID NO: 369590 - RNA, 64 nt, Human
gcccucuugagguccuuuaacacucaaauucccagcuccccacugagguguugugaugcuugcc

SEQ ID NO: 369591 - RNA, 64 nt, Human
ucgugucuccugagugagguagcgccucccaucugcuccccaauucuugaucucucccacccca

SEQ ID NO: 369592 - RNA, 64 nt, Human
cugcacccucucccccuuaucuaucuccuucucggcuccccagcccagucuuggcuucuugucc

SEQ ID NO: 369593 - RNA, 64 nt, Human
gauagguaaauaccaaguauuuauuacuaugacugcuccccagcccuggcucugcaaugggcac

SEQ ID NO: 369594 - RNA, 64 nt, Human
uuggcucccccauccucagaacucacaagccauugcuccccagcuggggaaccucaaccucccc

SEQ ID NO: 369595 - RNA, 64 nt, Human
agagcugccucccgucagggcccacaucaucuaggcuccccagcccccacugugaaggggcugg

SEQ ID NO: 369596 - RNA, 64 nt, Human
ucuacuuucuauucuccguguuuuuaucacaccugcuccccagauucccacccccucaauguuc

SEQ ID NO: 369597 - RNA, 64 nt, Human
ccccuaaccaaauucucccuggaccccauucugagcuccccaucaccaugggagguggggccuc

SEQ ID NO: 369598 - RNA, 64 nt, Human
caagccccaggcaggcugugcgcugacaaccaccgcuccccagcccaggguucccccagcccug

SEQ ID NO: 369599 - RNA, 64 nt, Human
cuaaagaccuuauccuuguaaccaaaagccaucugcuccccaaaaacuauugaaauaaaauaaa

SEQ ID NO: 369600 - RNA, 64 nt, Human
caucucagggaccaugaugucucagucacuccacgcuccccacaggccaacccuggcacagguc

SEQ ID NO: 369601 - RNA, 64 nt, Human; identical to SEQ ID NO: 116971

SEQ ID NO: 369602 - RNA, 64 nt, Human; identical to SEQ ID NO: 116972

SEQ ID NO: 369603 - RNA, 64 nt, Human; identical to SEQ ID NO: 116973

SEQ ID NO: 369604 - RNA, 64 nt, Human
guggaaggguugggggaagagcuccagccugucugcuccccagcucuguaguggcagaccagcg

SEQ ID NO: 369605 - RNA, 64 nt, Human
ucgauggggcuuuaaagcucuggggagaagagcugcuccccacucaugccccagagggacugug

SEQ ID NO: 369606 - RNA, 64 nt, Human
agagcguggcguguggcagaaucgcaccgccccggcuccccagcccaccgccaugcagggcucg

SEQ ID NO: 369607 - RNA, 64 nt, Human
ucaaggagagcccaggagccagucucuggcuguggcuccccagaacaggauccccagaagcagg

SEQ ID NO: 369608 - RNA, 64 nt, Human
uuuauuacaaguggcuuugugucagacacgcucggcuccccaccuggacacacacucaccagug

SEQ ID NO: 369609 - RNA, 64 nt, Human
cccgucaggaagaucagcuguaaauaaacgcugggcuccccagagcaccuguccgcccacugcc

SEQ ID NO: 369610 - RNA, 64 nt, Human
gacaagucccagaagaacuaccugaagcaccaaagcuccccaccccagccugguggcagaggaa

SEQ ID NO: 369611 - RNA, 64 nt, Human
caguacugaccucgucugucccuuccccuucaccgcuccccacagcuuugcaccccuuuccucc

SEQ ID NO: 369612 - RNA, 64 nt, Human
uuccgcugugaccuccggagcccugccugccccugcuccccagcuccuccugccugcacccgac

SEQ ID NO: 369613 - RNA, 64 nt, Human
aauucugccacuucggguuucucccuacauuccugcuccccaguuuucaugugggguacucaac

SEQ ID NO: 369614 - RNA, 64 nt, Human
aggcagugcagccacagcucccccggccuucagggcuccccagccuguggggcuggcuuccuug

SEQ ID NO: 369615 - RNA, 64 nt, Human
aucccccagccucaagucuuauuuccucaacguugcuccccaucaagcccuuuacuugaccucc

SEQ ID NO: 369616 - RNA, 64 nt, Human
uuggcaggggugcugugaauguccaguggucccagcuccccacccuggcccugccccagccugu

SEQ ID NO: 369617 - RNA, 64 nt, Human
cccagaacccugaggagugagcggccgagacgcugcuccccaccccccaccuccaugccucagc

SEQ ID NO: 369618 - RNA, 64 nt, Human
cugggguggaugacuuaugcgugauuucgugucggcuccccaggcuguggccucaggaaucaac

SEQ ID NO: 369619 - RNA, 64 nt, Human
uucauacuggcaggagggugaggagguucacugagcuccccagaucucccacugcggggagaca

SEQ ID NO: 369620 - RNA, 64 nt, Human; identical to SEQ ID NO: 116870

SEQ ID NO: 369621 - RNA, 64 nt, Human; identical to SEQ ID NO: 116871

SEQ ID NO: 369622 - RNA, 64 nt, Human; identical to SEQ ID NO: 116974

SEQ ID NO: 369623 - RNA, 64 nt, Human
gcacauaaagaagcuugccaaggggggcguccuugcuccccaguuguccuguuucuguaacuua

SEQ ID NO: 369624 - RNA, 64 nt, Human
agauuucuccaauguguccugacaggucagcccugcuccccacagggccaggcuggcaggggcc

SEQ ID NO: 369625 - RNA, 64 nt, Human
cucaggggccaggaggaguaacagaaccaggucugcuccccaccuuacucggauggccucccug

SEQ ID NO: 369626 - RNA, 64 nt, Human
cuccgccucugcuggcacauuuccccagaccugagcuccccaccaccccagcugcuccccuccc

SEQ ID NO: 369627 - RNA, 50 nt, Human
ucaucaucuacuccgacugagcuccccacgucucccuccacccacguccc

SEQ ID NO: 369628 - RNA, 64 nt, Human
cagugccuuccuaggacacaggggacuccuugacgcuccccaggcuuucugugcccaggccucu

SEQ ID NO: 369629 - RNA, 64 nt, Human
gccugggggcggggaugggggcaggguggaagcggcuccccauuuuauaccaaaggugcuacau

SEQ ID NO: 369630 - RNA, 64 nt, Human
gugccucccuucccagugggcuguguugacugcugcuccccaccccuaccgauggucccaggaa

SEQ ID NO: 369631 - RNA, 64 nt, Human
gcuuggcggcaaagcccagccccuucucagaccagcuccccacauuccugaauuccacuuccag

SEQ ID NO: 369632 - RNA, 64 nt, Human
gcuuuauccgggcuugugugcagggcccggcugggcuccccaucugcacauccugaggacagaa

SEQ ID NO: 369633 - RNA, 64 nt, Human
acccacccccccacccccccccccccgcccacaugcuccccagcuugcaggaggaaucggugag

SEQ ID NO: 369634 - RNA, 64 nt, Human
agugacccagggacacguggggugugcugcugcugcuccccagcccaccagugccuggccagcc

SEQ ID NO: 369635 - RNA, 64 nt, Human
ccagaaacacucagcauuauggaugaccucaucagcuccccaggcaaaaacaaaagugggaggg

SEQ ID NO: 369636 - RNA, 64 nt, Human
ucuuuuaguuuuaaacuuuuuuaaggcaaagcaagcuccccaaucccuguucuccaauaugugu

SEQ ID NO: 369637 - RNA, 64 nt, Human
uccagcaggugaagggagaguucaucuaggcggggcuccccaggcccagggcucaacuucaugg

SEQ ID NO: 369638 - RNA, 64 nt, Human
gaccauacugcuuacgucuuagccauuccguccugcuccccagcucacucucugaagcacacau

SEQ ID NO: 369639 - RNA, 64 nt, Human; identical to SEQ ID NO: 116821

SEQ ID NO: 369640 - RNA, 64 nt, Human; identical to SEQ ID NO: 116822

SEQ ID NO: 369641 - RNA, 64 nt, Human; identical to SEQ ID NO: 116823

SEQ ID NO: 369642 - RNA, 64 nt, Human
uuuguuucuccuagucaccaagcauacuuuccuggcuccccaaguacuuaaauguucucaucug

SEQ ID NO: 369643 - RNA, 64 nt, Human
agucggggacccaggccaggucgggagcacagccgcuccccaaacccagcaaaccggcagagag

SEQ ID NO: 369644 - RNA, 64 nt, Human
ggggaaggcagggguggggccguggcugaagccggcuccccaaccaaaaugcugcaccaaagcu

SEQ ID NO: 369645 - RNA, 64 nt, Human
ccggaggacguggacuuuugugagacaagaggcggcuccccagccuggguuuccaugugacccc

SEQ ID NO: 369646 - RNA, 59 nt, Human
agaaggcagcggaguccugaaggccccgugcuccccaccucucaaggagucucaugccg

SEQ ID NO: 369647 - RNA, 64 nt, Human
ggugcagggguauaucaacuucccauuagcaggagcuccccagcggcaagccuggcccaguggg

SEQ ID NO: 369648 - RNA, 64 nt, Human
gguuaggcagacagguccccagaguccucacccugcuccccagacaguagacacagugcccguc

SEQ ID NO: 369649 - RNA, 64 nt, Human
cuuuaacacacacucgugcagugggggaguucuggcuccccaaccuaaccccuagccgucaucu

SEQ ID NO: 369650 - RNA, 64 nt, Human
gcugggcgauuccgaugcugacccguccuccugggcuccccacccccgcuccccaagugucaca

SEQ ID NO: 369651 - RNA, 64 nt, Human
gaugcugacccguccuccugggcuccccacccccgcuccccaagugucacacaggcacuuugua

SEQ ID NO: 369652 - RNA, 64 nt, Human
ucucuugagcaaccagaauagcacccccaacucugcuccccaaaacccaucacuagcacggcuc

SEQ ID NO: 369653 - RNA, 64 nt, Human
ggcccaaagauggacccccccuggccuugugacagcuccccaaguguucuccgguggagaaacu

SEQ ID NO: 369654 - RNA, 64 nt, Human
ccgguggagaaacugcagaggacuggugggcggggcuccccagccaucaccauccuguguacaa

SEQ ID NO: 369655 - RNA, 64 nt, Human
ccaccucccgaguucaagugauuuuccugccucagcuccccaguagcugggacuacaggcgccc

SEQ ID NO: 369656 - RNA, 64 nt, Human
guccacacagcuacccacguacgacaucguccuggcuccccagaguaucuucccacugagacac

SEQ ID NO: 369657 - RNA, 64 nt, Human
aacuggcucugauuggaauuucuggccuccuaaggcuccccaccccgaaaucagcccccagccu

SEQ ID NO: 369658 - RNA, 64 nt, Human; identical to SEQ ID NO: 116827

SEQ ID NO: 369659 - RNA, 64 nt, Human; identical to SEQ ID NO: 116828

SEQ ID NO: 369660 - RNA, 64 nt, Human; identical to SEQ ID NO: 116829

SEQ ID NO: 369661 - RNA, 64 nt, Human
agugagccggccccccucccauggcccugcuguggcuccccagcuccagucggcugcacgcaca

SEQ ID NO: 369662 - RNA, 64 nt, Human
caguuccagaaguucugaggcuggacaucggcccgcuccccacaaugaaauaaaguuauuuucu

SEQ ID NO: 369663 - RNA, 64 nt, Human
agcugggagcagccagaggcggugcaagcgcccagcuccccagagcuccccaaccucggaccuc

SEQ ID NO: 369664 - RNA, 64 nt, Human
agccagaggcggugcaagcgcccagcuccccagagcuccccaaccucggaccucaccgcagggg

SEQ ID NO: 369665 - RNA, 64 nt, Human
ucaaccucgggcagcucccacaggccacagccgggcuccccacccccggcacccagcucucuac

SEQ ID NO: 369666 - RNA, 64 nt, Human
ccuuccccacuccauggcgccagccuccucccccgcuccccaacuucucgcccagcuggccgag

SEQ ID NO: 369667 - RNA, 64 nt, Human
gugggggguggggggauggugagcaaauaggagugcuccccagaaccagaggaggguggggcac

SEQ ID NO: 369668 - RNA, 64 nt, Human
guggggagcagccagcccucugccccugcccagggcuccccaacuauaggccugggacccccgc

SEQ ID NO: 369669 - RNA, 64 nt, Human
ggaaucccccccgucaauaucuuggccucagauggcuccccaaggucauucauaucucgguuug

SEQ ID NO: 369670 - RNA, 64 nt, Human
ggggagucuggaggccucauuaugucucuggcuugcuccccacgcugaaacccugcagccuuaa

SEQ ID NO: 369671 - RNA, 64 nt, Human
gccacaggccggagccccugggagcccucgcaccgcuccccaccccacucagcggccccaucgg

SEQ ID NO: 369672 - RNA, 58 nt, Human
agcagguucuuccaauauagcuaucugagcuccccaaggacugaccagggaccuuucc

SEQ ID NO: 369673 - RNA, 64 nt, Human
cuaagaccaagucuccaucugagacucccaaauugcuccccaccucccaucccuguuuuuuuuu

SEQ ID NO: 369674 - RNA, 64 nt, Human
ccugcgcuuccugagcagucccugcuuaugaugggcuccccaggaagcccacugccuccucccu

SEQ ID NO: 369675 - RNA, 64 nt, Human
ccacccccucugcacaccauggacccugcccugcgcuccccaacucccccaggcucccugucca

SEQ ID NO: 369676 - RNA, 64 nt, Human
gacccacagagugccaucccugagagaccagaccgcuccccaauacucuccuaaaauaaacaug

SEQ ID NO: 369677 - RNA, 64 nt, Human; identical to SEQ ID NO: 116830

SEQ ID NO: 369678 - RNA, 64 nt, Human; identical to SEQ ID NO: 116831

SEQ ID NO: 369679 - RNA, 64 nt, Human; identical to SEQ ID NO: 116833

SEQ ID NO: 369680 - RNA, 64 nt, Human
aggaccccccggagcuccugucccauccacaccagcuccccaugccagcugugguaagaccuag

SEQ ID NO: 369681 - RNA, 64 nt, Human
cagcccuuccagagguucgacucccagagguggagcuccccaaggugucagagaugaaacuccc

SEQ ID NO: 369682 - RNA, 64 nt, Human
ccgaggucaaggugcccaagggaccugaagugaagcuccccaaggcuccugaggucaagcuucc

SEQ ID NO: 369683 - RNA, 64 nt, Human
ucagcggagaggaccccauucugggacugcucaggcuccccaagacuugacgcagccccccacg

SEQ ID NO: 369684 - RNA, 64 nt, Human
cuggacuuuggagcguggggugggugggacaauggcuccccacucuaagcacugccuccccuac

SEQ ID NO: 369685 - RNA, 64 nt, Human
ccaggggugacuuuuuuaagaacccaccucuugugcuccccaucccgccuccugccggguuuca

SEQ ID NO: 369686 - RNA, 64 nt, Human
caguggcgagggcucugggaggugugccgagcuggcuccccagcucgcuguagggggcgggacu

SEQ ID NO: 369687 - RNA, 64 nt, Human
cgaugggcuuuucuucuugucaguggagggagcagcuccccacucagcccugggacaggcccug

SEQ ID NO: 369688 - RNA, 64 nt, Human
uaggacaaggcugugccaggcugggaggcucggggcuccccacgcccccaugcagugaccgcuu

SEQ ID NO: 369689 - RNA, 64 nt, Human
ugaaugcaguuuggugcuguuuuagaguaugccugcuccccagcccccugccuggaacccucug

SEQ ID NO: 369690 - RNA, 64 nt, Human
acuuucugggaagaucccugaagccaucacagaggcuccccaacuucugagucgcccaucuguu

SEQ ID NO: 369691 - RNA, 64 nt, Human
ccaugucccagauaaaccaggccagacugagaaggcuccccagaggccucuguggccuccacuc

SEQ ID NO: 369692 - RNA, 64 nt, Human
cauucucaaagaccaccauguccaaggucugacagcuccccacuggcugcccccacaggggcuu

SEQ ID NO: 369693 - RNA, 64 nt, Human
caagggcggcaagugaggaugcaguccagccguggcuccccacuuccgacuggcucccuucggg

SEQ ID NO: 369694 - RNA, 64 nt, Human
gacugacagcaaggccuauggggaagaacugggagcuccccaacuuggacccccaccuuguggc

SEQ ID NO: 369695 - RNA, 64 nt, Human
agaauuucagauauauuuuaguaacacauucccagcuccccaggaaagccagucucaucuaauu

SEQ ID NO: 369696 - RNA, 64 nt, Human; identical to SEQ ID NO: 116837

SEQ ID NO: 369697 - RNA, 64 nt, Human; identical to SEQ ID NO: 116838

SEQ ID NO: 369698 - RNA, 64 nt, Human; identical to SEQ ID NO: 116839

SEQ ID NO: 369699 - RNA, 64 nt, Human
gcggagaacgaucuuagugcuggaauggggaggggcuccccaagauggccuggagaccacccag

SEQ ID NO: 369700 - RNA, 64 nt, Human
gcuacaguaccugcugucuuuccagggggaaggggcuccccaugagggaggggcgacgggggag

SEQ ID NO: 369701 - RNA, 64 nt, Human
uacuuguaauuagaaccauccccacuguuuuucugcuccccagcauuggcccuaaucauccuga

SEQ ID NO: 369702 - RNA, 64 nt, Human
ccagccgagucacugccugaccggcuccauggcagcuccccaucuucccuagaggcugccugcg

SEQ ID NO: 369703 - RNA, 64 nt, Human
uauagauggcccucagauugcggggccccgagcagcuccccacucugcccguccaccuucccug

SEQ ID NO: 369704 - RNA, 64 nt, Human
gcucuucccugaggcaggugucacagccaugugugcuccccacuguugcacucaggcacagcag

SEQ ID NO: 369705 - RNA, 64 nt, Human
ggaccuuggaaacaguuggcacuguaaggugcuugcuccccaagacacauccuaaaagguguug

SEQ ID NO: 369706 - RNA, 55 nt, Human
cagaggggcccagugcaugagggcggcuccccagggaccgcccagaucccagcuu

SEQ ID NO: 369707 - RNA, 64 nt, Human
ccugugccccucccuccuuguuguccagugcugggcuccccaccccgaggucaggcugcccaau

SEQ ID NO: 369708 - RNA, 64 nt, Human
cucagccucauguguugguccucugcuccuccuagcuccccagggauguuggggacccagcuug

SEQ ID NO: 369709 - RNA, 64 nt, Human
aggacacaucuagcugccauugcaaccucacugggcuccccagacucugugugugagaaauuaa

SEQ ID NO: 369710 - RNA, 64 nt, Human
ucucacggcugaguugcugcgccugcagacggaagcuccccacaggcagagcugcuuggaugug

SEQ ID NO: 369711 - RNA, 64 nt, Human
gaaacccuuuccccaggcuugucccagcacugccgcuccccaccccugagccaggaccccagag

SEQ ID NO: 369712 - RNA, 64 nt, Human
aguucagucagccccagugguggcauguuuuaaagcuccccaggugauuauaacuuccuagugu

SEQ ID NO: 369713 - RNA, 64 nt, Human
ccucagaaaccccugaaguuuuaaaaacuuucucgcuccccacgaccccagaaugaaacagcuu

SEQ ID NO: 369714 - RNA, 64 nt, Human
gaccaggcagaagcucccagagccccugucucgggcuccccaccgacuggcagcugcacuaucc

SEQ ID NO: 369715 - RNA, 64 nt, Human; identical to SEQ ID NO: 116843

SEQ ID NO: 369716 - RNA, 64 nt, Human; identical to SEQ ID NO: 116844

SEQ ID NO: 369717 - RNA, 64 nt, Human; identical to SEQ ID NO: 116845

SEQ ID NO: 369718 - RNA, 64 nt, Human
uggggccuccuucagcccccuccuccugggggaugcuccccaggguuagggugcuggugugagg

SEQ ID NO: 369719 - RNA, 64 nt, Human
cucagaggcaagguaauaaagcacuucagggcuugcuccccaagugggccugauuuagcaggug

SEQ ID NO: 369720 - RNA, 64 nt, Human
ggcucuccgcagcuaucccgggcauccaguggcagcuccccaaaccaggccuccaagccaggug

SEQ ID NO: 369721 - RNA, 64 nt, Human
guguucaggugcugcugguccuccauuacccacugcuccccaaggcuggugggacggggucccg

SEQ ID NO: 369722 - RNA, 64 nt, Human
gcuguuguugccaaccagucucccaaagcuccuugcuccccaccccuugcgaacaggaccagau

SEQ ID NO: 369723 - RNA, 64 nt, Human
uggaacauggcuggcagcuuccagcagaagucacgcuccccaucccccaggggacauaggaccu

SEQ ID NO: 369724 - RNA, 64 nt, Human
cuuggcaugcccagggcaaguggggagguucucugcuccccaggccugcucggugacugacccc

SEQ ID NO: 369725 - RNA, 64 nt, Human
cugaggcagaagcucaagccccauggggacaguggcuccccagugccuggcccugagccauuuc

SEQ ID NO: 369726 - RNA, 64 nt, Human
gaagcaagagcagacuguugggccaacaggagaagcuccccagaguaggggagaagguuggggu

SEQ ID NO: 369727 - RNA, 64 nt, Human
gcuccuacucugcccucuccaagcuccccuggcggcuccccaccugguugcccaguuccuauug

SEQ ID NO: 369728 - RNA, 64 nt, Human
ugccggggguuccugcagcaccccccuacuccaggcuccccaucucccugaagcuuccagggua

SEQ ID NO: 369729 - RNA, 62 nt, Human
cugcuguguguguguauauauaaagcaccagucugcuccccacucagcagugugguuuuuuc

SEQ ID NO: 369730 - RNA, 64 nt, Human
augggcgauaaguguugagguaggcucgagaacugcuccccaaaucagugagaauugcauuagg

SEQ ID NO: 369731 - RNA, 64 nt, Human
cauuuccaggacacuuuccaugaauuguugagaagcuccccaucccccgccuuuuuuuuuuuuu

SEQ ID NO: 369732 - RNA, 64 nt, Human
agguggccuuuccucccaaaagaaaaggcaucaggcuccccaagccccacagcucuccuuucca

SEQ ID NO: 369733 - RNA, 64 nt, Human
ggcugagaagaaaaucaccacuauuaaaaaagcugcuccccaagcagauuagcucucuguuagg

SEQ ID NO: 369734 - RNA, 64 nt, Human; identical to SEQ ID NO: 116834

SEQ ID NO: 369735 - RNA, 64 nt, Human; identical to SEQ ID NO: 116835

SEQ ID NO: 369736 - RNA, 64 nt, Human; identical to SEQ ID NO: 116846

SEQ ID NO: 369737 - RNA, 64 nt, Human
cuuguuuuaccuaguucuuuccaguuuguuuuuggcuccccaagcaucaucucacgaggagaac

SEQ ID NO: 369738 - RNA, 64 nt, Human
uuuuagaaugucauguguucuuuuaaaaaaauuagcuccccauccucccuccucacucccuccc

SEQ ID NO: 369739 - RNA, 64 nt, Human
gaaugguggaggacccuggaaggacagcaaggcagcuccccagccucacucuucacuccugauu

SEQ ID NO: 369740 - RNA, 64 nt, Human
uuugcuagcagcuuguauaccucaggccaggugagcuccccaaauuucuuuuuucauuuacucc

SEQ ID NO: 369741 - RNA, 64 nt, Human
gguccuuagugagccuggacagagcaaggagagggcuccccacucccuaagccccacagccagc

SEQ ID NO: 369742 - RNA, 64 nt, Human
ggacugacagggccagcaacguggagguuuaggggcuccccaauguaauaccucucgaugcagg

SEQ ID NO: 369743 - RNA, 64 nt, Human
gugacgccgcccgcgagaacgccgccgcggggccgcuccccacgugccaccaccgggccaccgc

SEQ ID NO: 369744 - RNA, 64 nt, Human
ucucggcucccacagcagagccaggugagggggggccugccaggacuagacagaaguggggcgg

SEQ ID NO: 369745 - RNA, 64 nt, Human
ucucggcucccacagcagagccaggugagggggcgccugccagggccagacccagguggggcag

SEQ ID NO: 369746 - RNA, 64 nt, Human
cagccgcagcuguaaggcacgcuggaaggcacacgccugccaggcagggcagucuggcgcccau

SEQ ID NO: 369747 - RNA, 64 nt, Human; identical to SEQ ID NO: 116848

SEQ ID NO: 369748 - RNA, 64 nt, Human; identical to SEQ ID NO: 116849

SEQ ID NO: 369749 - RNA, 64 nt, Human; identical to SEQ ID NO: 116850

SEQ ID NO: 369750 - RNA, 64 nt, Human
gccaccugcugcgggggagccaguucuggggcccgccugccaccucucccagcccucagcauug

SEQ ID NO: 369751 - RNA, 62 nt, Human
gcaaccgcgacuucagcugaggcagccucacagccugccaucuggugccuccugccaccugg

SEQ ID NO: 369752 - RNA, 64 nt, Human
cacuaauggacagaggcucucggugccgaagauugccugccagaggacugaccacagccuggcu

SEQ ID NO: 369753 - RNA, 64 nt, Human
uccggggggcaggugugacuuccauuucaucagugccugccagaagcugugucucucauugggc

SEQ ID NO: 369754 - RNA, 64 nt, Human
aagacacaaggguauccaugcucuguggccaggugccugccacccucuggaacucacaaaagcu

SEQ ID NO: 369755 - RNA, 64 nt, Human
cacagaggaagaaaccuggaaccagagggggcgugccugccaagcucacacagcaggaacugag

SEQ ID NO: 369756 - RNA, 64 nt, Human
cuuccccacugagcaccuugugacccccgccccugccugccauagaacaacccccuuugauugu

SEQ ID NO: 369757 - RNA, 64 nt, Human
agcuccgugugaugcccaguaaagccugaaccaugccugccaugucuugucuuauucccugagg

SEQ ID NO: 369758 - RNA, 64 nt, Human
ccuggaauguggucugcccuccaccagagcuccugccugccaggacuggaccagagcagccagg

SEQ ID NO: 369759 - RNA, 64 nt, Human
uaaaacuucuuucaaauuacucuuccucaguccugccugccaagaacucaaguguaacugugau

SEQ ID NO: 369760 - RNA, 64 nt, Human
ugcuuuauccacauuguagccuaauauucaugcugccugccaugugugagucacuucuacgcau

SEQ ID NO: 369761 - RNA, 64 nt, Human
cagcccuccugccuagacugaccuuggacucccagccugccagagaaugaagaaauacaacgca

SEQ ID NO: 369762 - RNA, 64 nt, Human
ggcaggcccauucagagcuauggugcuugcuggugccugccaccuucaaguucuggaccugggc

SEQ ID NO: 369763 - RNA, 64 nt, Human
ccagcucagcaggaaaguggaauugcccaguacugccugccagcugggucucccaagcaacuac

SEQ ID NO: 369764 - RNA, 64 nt, Human
ggagagaggaauccccuagagcagggaaagcagugccugccagcuguugugcaccuuccugaga

SEQ ID NO: 369765 - RNA, 64 nt, Human; identical to SEQ ID NO: 116851

SEQ ID NO: 369766 - RNA, 64 nt, Human; identical to SEQ ID NO: 116852

SEQ ID NO: 369767 - RNA, 64 nt, Human; identical to SEQ ID NO: 116854

SEQ ID NO: 369768 - RNA, 64 nt, Human; identical to SEQ ID NO: 116855

SEQ ID NO: 369769 - RNA, 64 nt, Human
guguccagagguggccugggaccgccaguugcacgccugccaccucagccagcccccgcccagc

SEQ ID NO: 369770 - RNA, 64 nt, Human
uucucccuucuugggucugcccugcccauacugagccugccaaagugccugggaagcccaccca

SEQ ID NO: 369771 - RNA, 64 nt, Human
ugcuggagcggcaaugacccaccccucuccccccgccugccaccuccccccacaagugcccucc

SEQ ID NO: 369772 - RNA, 64 nt, Human
gccucggcaggagucccacuccuccuggggugcugccugccaccgagagcucccccaccuguac

SEQ ID NO: 369773 - RNA, 64 nt, Human
uguacgucccgccccggccaaccaugccaagccugccugccaggccucugcgccuggccuaggg

SEQ ID NO: 369774 - RNA, 64 nt, Human
aaauaacucagcacacaagugacccaggacauaugccugccaaagggauguguuagaaggcugc

SEQ ID NO: 369775 - RNA, 64 nt, Human
ugccucagccuccugaguaccugggauuacaggugccugccaccacgccuggcuaauuuuugua

SEQ ID NO: 369776 - RNA, 64 nt, Human
cucucccuucccuuucccuguccccccgccccacgccugccagcaaagccucgcuaaccccauu

SEQ ID NO: 369777 - RNA, 64 nt, Human
cuucuggagagaggcucagggguuggucugagaggccugccauccaccccucagggagcuaggu

SEQ ID NO: 369778 - RNA, 64 nt, Human
ggcuucugcccucugcagcugggaccccucacuugccugccaugcucugcucggcuucagucuc

SEQ ID NO: 369779 - RNA, 64 nt, Human
ucagaccaaggaacaucagagaagcuguggggcugccugccaggcaggaucauggcugccauca

SEQ ID NO: 369780 - RNA, 64 nt, Human
gaaaagcgggugagcaggaggcaugagguacaaugccugccaucaugggucagaaauuugaagg

SEQ ID NO: 369781 - RNA, 64 nt, Human
cucauuccucugguggggagcugccugcagagaggccugccacuggggguuccaggccguggug

SEQ ID NO: 369782 - RNA, 64 nt, Human
acgggccuuuugcuacauucuauccagagagcaggccugccagccccucuccacugagaaguug

SEQ ID NO: 369783 - RNA, 64 nt, Human
gcacauugacuuuauuuuuucauuggaagaaaaugccugccaaguauaaaugacucucaucuua

SEQ ID NO: 369784 - RNA, 64 nt, Human; identical to SEQ ID NO: 116859

SEQ ID NO: 369785 - RNA, 64 nt, Human; identical to SEQ ID NO: 116860

SEQ ID NO: 369786 - RNA, 64 nt, Human; identical to SEQ ID NO: 116861

SEQ ID NO: 369787 - RNA, 64 nt, Human; identical to SEQ ID NO: 116862

SEQ ID NO: 369788 - RNA, 64 nt, Human
gauuaauggcuugccuagagcugugcaagaaacagccugccagucugucauugucagggaccag

SEQ ID NO: 369789 - RNA, 64 nt, Human
uucuacccgugcaggccccaggagagccgcaggggccugccacacacucccagcucacccucac

SEQ ID NO: 369790 - RNA, 64 nt, Human
cugcucccucacugcugaaucccuguagggagaagccugccaacagugaccuuccgaaacagcc

SEQ ID NO: 369791 - RNA, 64 nt, Human
aaccagcacuugcccccuuggaaugcagagccuggccugccaaacuacaaugugguaggcugaa

SEQ ID NO: 369792 - RNA, 64 nt, Human
ggcuuuauuugucuuuuuuuauuuuuuaagcacugccugccagagaugggccuggggccugaug

SEQ ID NO: 369793 - RNA, 64 nt, Human
uaggaaggauggggcauaaugugacuguaaaggggccugccauagaaaagucacaugccugagg

SEQ ID NO: 369794 - RNA, 64 nt, Human
cauggagacaacaccaguagagcugggagcuggggccugccacugaguaacagcucacacaugu

SEQ ID NO: 369795 - RNA, 64 nt, Human
cuccacaggaaacagauuuuucagggccuuccaugccugccacuuuguccgucucuuuuuuuuu

SEQ ID NO: 369796 - RNA, 64 nt, Human
ugccucacccucccaaguagcugggacuacaggcgccugccagcacgccuggcuaauuuuuugu

SEQ ID NO: 369797 - RNA, 64 nt, Human
cugcuggggaagggaagugacuaaccccgggucagccugccauuuagggaaagagcugagguuc

SEQ ID NO: 369798 - RNA, 64 nt, Human
ucucgagaacugucuugucucuguguguuuauuugccugccagugcucuccagcgccauccugc

SEQ ID NO: 369799 - RNA, 64 nt, Human
agaaggaaggugggaagaaggaauuagacacucugccugccacucugcgugugugugcucucgc

SEQ ID NO: 369800 - RNA, 64 nt, Human
cagaaggcucgcccucggcgcucugucugccucugccugccagcucaucacgaucugcagggca

SEQ ID NO: 369801 - RNA, 64 nt, Human
gcagaggcuggaggacucugggggcuagggaagagccugccagauuuucacauuuuuaaaaugu

SEQ ID NO: 369802 - RNA, 64 nt, Human
uuugacacacuuguaauaagagaaucuuucauuugccugccauguguacuguauuaugagaauc

SEQ ID NO: 369803 - RNA, 64 nt, Human; identical to SEQ ID NO: 116818

SEQ ID NO: 369804 - RNA, 64 nt, Human; identical to SEQ ID NO: 116819

SEQ ID NO: 369805 - RNA, 64 nt, Human; identical to SEQ ID NO: 116824

SEQ ID NO: 369806 - RNA, 64 nt, Human; identical to SEQ ID NO: 116825

SEQ ID NO: 369807 - RNA, 64 nt, Human
agucgguucugugauggggcugggcuuugggcuugccugccagcagugaugucccacccuguuc

SEQ ID NO: 369808 - RNA, 64 nt, Human
ccucccaacccccgcauuuaaagggacucaaggugccugccacuuccucagcgaagaagucugu

SEQ ID NO: 369809 - RNA, 64 nt, Human
ccuccuccuccuccuccggaggugggaucccagagccugccaguggaggcuuaucuguugggag

SEQ ID NO: 369810 - RNA, 64 nt, Human
ugccccagccucccauauagcugggauuauaggugccugccaccaugcccagcuaauuuuugug

SEQ ID NO: 369811 - RNA, 64 nt, Human
uaagaaaaauauuuuuauccuagggccaaguguugccugccaccaaucaguaaguuagucuaua

SEQ ID NO: 369812 - RNA, 64 nt, Human
acuggcugaaaaaccuaaacucuuuuucauccaggccugccaaggugaagagauacagccuucc

SEQ ID NO: 369813 - RNA, 64 nt, Human
cugucucagccucccaaguagcugggauuacagugccugccaccaugcccagcuaauuuuuugc

SEQ ID NO: 369814 - RNA, 64 nt, Human
aaguguuuucugugucccacugucuugaagcugggccugccaaagccugggcccacagcugcac

SEQ ID NO: 369815 - RNA, 64 nt, Human
cccagacaccacaauugugccuucugugggccaggccugccaugacugcgucucggcucuggcc

SEQ ID NO: 369816 - RNA, 64 nt, Human
ugugggccaggucucgggggcuccgggaggugcugccugccaggggaagcuggaaccaguagca

SEQ ID NO: 369817 - RNA, 64 nt, Human
gacgcuuuugucugacacgugaugaugugguccugccugccacugugcaccaucccagguauug

SEQ ID NO: 369818 - RNA, 64 nt, Human
accuuugccuuuggaauuacuccugcagaagguugccugccaccaccagcuggaccugagcuug

SEQ ID NO: 369819 - RNA, 64 nt, Human
aucaaggugaaucaaucugaaauugagcacaccugccugccaucgcuguuccuucaacugagug

SEQ ID NO: 369820 - RNA, 64 nt, Human
caccagcuggcucugcagcacauugcccugaggggccugccacucuccugaggagcagcccacc

SEQ ID NO: 369821 - RNA, 64 nt, Human
ggauggaggccaccgcugcccugccaucccgucugccugccaugggacggcuccucugaguguu

SEQ ID NO: 369822 - RNA, 64 nt, Human; identical to SEQ ID NO: 116812

SEQ ID NO: 369823 - RNA, 64 nt, Human; identical to SEQ ID NO: 116813

SEQ ID NO: 369824 - RNA, 64 nt, Human; identical to SEQ ID NO: 116840

SEQ ID NO: 369825 - RNA, 64 nt, Human; identical to SEQ ID NO: 116841

SEQ ID NO: 369826 - RNA, 64 nt, Human
ucuggcugcacggucaggcccugccccauggcaggccugccagagcuuggcuggggaccccucc

SEQ ID NO: 369827 - RNA, 64 nt, Human
cacguaauccuccugaguagcugggauuacaggcgccugccaccacgcuggccaauuuuuguac

SEQ ID NO: 369828 - RNA, 64 nt, Human
ucugucucaucccaggaauccagucccaagugcugccugccaaucguccagcacccuccaccuu

SEQ ID NO: 369829 - RNA, 64 nt, Human
accacccuccggacacaugaggccagcugccugugccugccaugggccagccuagcccuugucc

SEQ ID NO: 369830 - RNA, 64 nt, Human
caagcagcaggugucagcaggaaaaagaucacaagccugccacgauggcugcugcuccuuguag

SEQ ID NO: 369831 - RNA, 64 nt, Human
cauguuuuuauaaauagguaauaaaaaauguuuugccugccaauugaaugauuucguagcugaa

SEQ ID NO: 369832 - RNA, 64 nt, Human
ugccucagccucccgaguagcugggauuacaggugccugccaccaugccuggcuaauuuuugua

SEQ ID NO: 369833 - RNA, 64 nt, Human
uucacuggcagcucagaauuauucuggaaagaaagccugccaggaaauaaauucaaauacagua

SEQ ID NO: 369834 - RNA, 64 nt, Human
gccugacugccuagggucucauggacuguaggcagccugccagugaaggucacuggacucuagc

SEQ ID NO: 369835 - RNA, 64 nt, Human
cuucgugggccuuugauuuaccaacacuggaaaugccugccaacuaaucuuggauagauucuuu

SEQ ID NO: 369836 - RNA, 64 nt, Human
uaccaucgugugacauagcauggcuguccccagagccugccauucacguuugccaaggaagaug

SEQ ID NO: 369837 - RNA, 64 nt, Human
ugccacuccagaaccucagcagaucugagccaccgccugccagugugagaggcggccacuuuca

SEQ ID NO: 369838 - RNA, 64 nt, Human
auuccagccugggugacggagugaggcccuaucugccugccagugaguucugucaugcaucaga

SEQ ID NO: 369839 - RNA, 64 nt, Human
ugccucagccuccucaguagcugggacuacaagugccugccaccacgccuggguuauuuuuuau

SEQ ID NO: 369840 - RNA, 64 nt, Human
cuuuaggcaagugccuguuuggcuuuaaagguaagccugccagcugugagaagccuugguaacu

SEQ ID NO: 369841 - RNA, 64 nt, Human; identical to SEQ ID NO: 116866

SEQ ID NO: 369842 - RNA, 64 nt, Human; identical to SEQ ID NO: 116867

SEQ ID NO: 369843 - RNA, 64 nt, Human; identical to SEQ ID NO: 116868

SEQ ID NO: 369844 - RNA, 64 nt, Human; identical to SEQ ID NO: 116869

SEQ ID NO: 369845 - RNA, 64 nt, Human
aaacaucagaauagaacccaaagggcuuaggaaggccugccaggauaacaagaaggcccuguau

SEQ ID NO: 369846 - RNA, 64 nt, Human
ugccucagccuccugaguagcugggacuacaggugccugccaccacacccagcuaauuuuuuuu

SEQ ID NO: 369847 - RNA, 64 nt, Human
aacccuuuuguuuguuuccaauugagucauuacugccugccacuaagaaacgugcuugaaucua

SEQ ID NO: 369848 - RNA, 64 nt, Human
gcccagcacccccucuccuggagggcgcccagcagccugccagcaguuacugugaauguucccc

SEQ ID NO: 369849 - RNA, 64 nt, Human
agacuggggguuccccaccuccuugcucuccccagccugccaagcccagcccuccagagccagc

SEQ ID NO: 369850 - RNA, 64 nt, Human
gcagaaucuggcaggacugauauuugugcagugggccugccacacacccucugccuaggaggcu

SEQ ID NO: 369851 - RNA, 64 nt, Human
aaguguucaaaaagaaaugauggcgacgugggaggccugccaagcacaagcuccccacugccca

SEQ ID NO: 369852 - RNA, 64 nt, Human
cggagugcuuaucuuaaaauugcagauuuagggagccugccaauuuaacagucucaucagguga

SEQ ID NO: 369853 - RNA, 64 nt, Human
auauuuccuauuguucacuuuauucuguagagcagccugccaagaauuuuauuucugcuguuuu

SEQ ID NO: 369854 - RNA, 64 nt, Human
cuuuugucccaagugucugccggucgaccaaucugccugccacacauugaccaagccagacccg

SEQ ID NO: 369855 - RNA, 64 nt, Human
ugccucacccucccauguagcugggauuacagcugccugccaaauuuuuguauuuuuaguggaa

SEQ ID NO: 369856 - RNA, 64 nt, Human
agccgagcuggcauucguucucuggacuuuuuaugccugccauacccgcuaaugcuccucgagg

SEQ ID NO: 369857 - RNA, 64 nt, Human
cuaggacuuaccaagcuguagggccagggcugcugccugccagccuggggucccuggaggacag

SEQ ID NO: 369858 - RNA, 64 nt, Human
auuuuuaauguuuucuauaauuuaaaaauguauagccugccaaauguuguuuucauaaccauga

SEQ ID NO: 369859 - RNA, 64 nt, Human
ugccucagccucccaaguagcugggauuacaggugccugccaccaugccuggcuaauuuuuuug

SEQ ID NO: 369860 - RNA, 64 nt, Human; identical to SEQ ID NO: 116807

SEQ ID NO: 369861 - RNA, 64 nt, Human; identical to SEQ ID NO: 116808

SEQ ID NO: 369862 - RNA, 64 nt, Human; identical to SEQ ID NO: 116873

SEQ ID NO: 369863 - RNA, 64 nt, Human; identical to SEQ ID NO: 116874

SEQ ID NO: 369864 - RNA, 64 nt, Human
ugccucagccuccugaguagcugggacuacaggcgccugccaccacgcccagcuaauuuuugua

SEQ ID NO: 369865 - RNA, 64 nt, Human
uacuuugcuuuguuaaaacaucaugagaguggaggccugccacccagaaaggcacauacuagug

SEQ ID NO: 369866 - RNA, 64 nt, Human
auauuuuuaggccucaucucagugccuaugaggggccugccagaaaagucacuaaccugucuca

SEQ ID NO: 369867 - RNA, 64 nt, Human
uucaucuggggaacugagcuaggcggugagguuagccugccaguuagagacagcccagucucuu

SEQ ID NO: 369868 - RNA, 64 nt, Human
ggcaucucucucaucagauaagacagcuacaucagccugccagauaauccacaugcucccuccc

SEQ ID NO: 369869 - RNA, 64 nt, Human
gcugugaauugcgcucccuccuucuguagaggccgccugccagccaugcaccugcgucaacgcg

SEQ ID NO: 369870 - RNA, 64 nt, Human
ggagaguuauagagcaaagggauggguccuugaggccugccaguguguaaagguguucaaauaa

SEQ ID NO: 369871 - RNA, 64 nt, Human
agccucagcuuccugaguagaugggauuacaggcgccugccaccacgcccagcuaauuuuuugu

SEQ ID NO: 369872 - RNA, 64 nt, Human
cugccacccagauucaacagauucuccugccucagccugccaaguagcugggacuacaggcaug

SEQ ID NO: 369873 - RNA, 64 nt, Human
uacauauaauuuaaucaaauuaauuuauuuuuuugccugccaaacauccaauguggugcuuguu

SEQ ID NO: 369874 - RNA, 64 nt, Human
aagcuccucugcuccaccuugaaccugucaccuggccugccacccuccugcgcaggccaugcau

SEQ ID NO: 369875 - RNA, 64 nt, Human
ugccucagccucccgaguagcugggacuacaggcgccugccaccaugcccgccuaauuuuuuug

SEQ ID NO: 369876 - RNA, 64 nt, Human
ccuccaacuccugggcccaagcaauccugccucagccugccaaguagcuaggacuacaggcguu

SEQ ID NO: 369877 - RNA, 64 nt, Human
ugugcccucugggauucugagaggcuaugggggggccugccauagggaugccagucccccagug

SEQ ID NO: 369878 - RNA, 64 nt, Human
aggaagagaagcaggagagagaaagccacagccagccugccauaggauccaacuggacaacgug

SEQ ID NO: 369879 - RNA, 64 nt, Human; identical to SEQ ID NO: 116762

SEQ ID NO: 369880 - RNA, 64 nt, Human; identical to SEQ ID NO: 116763

SEQ ID NO: 369881 - RNA, 64 nt, Human; identical to SEQ ID NO: 116764

SEQ ID NO: 369882 - RNA, 64 nt, Human; identical to SEQ ID NO: 116765

SEQ ID NO: 369883 - RNA, 64 nt, Human
aagaccucccugccuuucccugagcccaggccuggccugccagccucucuugacuacagaauaa

SEQ ID NO: 369884 - RNA, 64 nt, Human
gcaccgggcgggccuccgugcacacucagcacacgccugccacacagcgugcgcuugcguguca

SEQ ID NO: 369885 - RNA, 64 nt, Human
ugccucagccuccggaguagcugggacugcaggcgccugccaccacgccuggcuaauuuuuugu

SEQ ID NO: 369886 - RNA, 64 nt, Human
uauacuaauaaaacaugaacugcccacucuucaugccugccaaacuuggggcaauugaugcuaa

SEQ ID NO: 369887 - RNA, 64 nt, Human
aaggcugcuuacccuuggggguguuccucuauuugccugccaccucucuugucucucccucuga

SEQ ID NO: 369888 - RNA, 64 nt, Human
uugcuucccagcccuggaguuuuuacccggcuuugccugccaccucugcccaggacacucuucc

SEQ ID NO: 369889 - RNA, 64 nt, Human
uguuuucccgugcugcuccuggacuggcccaccugccugccacaugcccacgccuagucccauc

SEQ ID NO: 369890 - RNA, 64 nt, Human
ugccucagccucccaaguagcuaggauuacaagugccugccacuaugccuggcuaauuuuuguu

SEQ ID NO: 369891 - RNA, 64 nt, Human
caccucagagucacaccacuggcugccagucagggccugccaggagucuacacagcucugaacc

SEQ ID NO: 369892 - RNA, 64 nt, Human
gcugccucgcguguuccuaagccccugcccgccugccugccaccucucggacuccagcuugaug

SEQ ID NO: 369893 - RNA, 64 nt, Human
cucagggcugguucccagcuggccugagcagggggccugccaccagacccacccacgcucugac

SEQ ID NO: 369894 - RNA, 64 nt, Human
agcucuaccacauucaggaggccucaggaggccagccugccaugagagcacauguccucuggcc

SEQ ID NO: 369895 - RNA, 55 nt, Human
acaaguacaccauccgcuaacacccgccugccagagcggaaaccggggguggggg

SEQ ID NO: 369896 - RNA, 64 nt, Human
uuugaaagugccuccguguccagacuuugaacuugccugccagccuucagcaucaggaaaggcc

SEQ ID NO: 369897 - RNA, 64 nt, Human
caggagagcgacaucuuccugagcuccuguccaugccugccauaccugccagcuucagacauuu

SEQ ID NO: 369898 - RNA, 64 nt, Human; identical to SEQ ID NO: 116766

SEQ ID NO: 369899 - RNA, 64 nt, Human; identical to SEQ ID NO: 116767

SEQ ID NO: 369900 - RNA, 64 nt, Human; identical to SEQ ID NO: 116769

SEQ ID NO: 369901 - RNA, 64 nt, Human; identical to SEQ ID NO: 116770

SEQ ID NO: 369902 - RNA, 64 nt, Human
ggguuggcaaacuauggcccacgaaucaaaccuggccugccaccuguuuuuauacaaccuguga

SEQ ID NO: 369903 - RNA, 64 nt, Human
gcucacugaagccucaagugauccucuugugucagccugccagguagcuagaucugcaggcgug

SEQ ID NO: 369904 - RNA, 64 nt, Human
gccugcaggaccuccucuuggccacuuggccugggccugccaccaccacguccugcagaacgag

SEQ ID NO: 369905 - RNA, 64 nt, Human
uaagcuucacucuccaccaccuggauggcauggcgccugccaccaaacaucuuccuggccugcg

SEQ ID NO: 369906 - RNA, 64 nt, Human
gugggucccacagaugugagaacaugcugcaagagccugccagccacagcaaucaggacucaca

SEQ ID NO: 369907 - RNA, 64 nt, Human
uaugcaaaaucuuccuuguacaggguggugagccgccugccaguggaggacagcaccccucagc

SEQ ID NO: 369908 - RNA, 64 nt, Human
agaucuuucauuuugcaccugcagccaagcaaaugccugccaaauuuuagauuuaccuuguuag

SEQ ID NO: 369909 - RNA, 64 nt, Human
gggcugagcuccuagccuggaagcauucaggagagccugccauuccugggaugaucccugcugg

SEQ ID NO: 369910 - RNA, 64 nt, Human
cuucccucuucgugcgacaggcauuuaggggcgugccugccaugggcaaagccauggugugugu

SEQ ID NO: 369911 - RNA, 64 nt, Human
cuccugcccaagugaggcccugggaauuuacagagccugccagcugggcuuggaaggaaaacac

SEQ ID NO: 369912 - RNA, 64 nt, Human
caggggcuucaugggccaccgucagugggucugggccugccagagucgucuugcucuuccucuu

SEQ ID NO: 369913 - RNA, 64 nt, Human
cgcaggagcccaggagauggccucagcguggccagccugccaaacugaccaggggacggccacg

SEQ ID NO: 369914 - RNA, 64 nt, Human
gguuuuucggucuuguucaaaaggaagaauucuugccugccauacagaaacucucuagcacucc

SEQ ID NO: 369915 - RNA, 64 nt, Human
accccucucugcaacuccuguuugcaagcgcugggccugccagacagaggccccucuuguggug

SEQ ID NO: 369916 - RNA, 64 nt, Human
cugcgugggguggugucugugugugugcacgcacgccugccaucaaagcagcagggcugagggg

SEQ ID NO: 369917 - RNA, 51 nt, Human; identical to SEQ ID NO: 116771

SEQ ID NO: 369918 - RNA, 64 nt, Human; identical to SEQ ID NO: 116772

SEQ ID NO: 369919 - RNA, 64 nt, Human; identical to SEQ ID NO: 116774

SEQ ID NO: 369920 - RNA, 64 nt, Human; identical to SEQ ID NO: 116775

SEQ ID NO: 369921 - RNA, 64 nt, Human
cagaagcacaaaugcuguccauggccgugaggcugccugccaggugaauggacauagcgugaga

SEQ ID NO: 369922 - RNA, 64 nt, Human
gguucaaaccccaccucaguagguggaggggagcgccugccauugguuguauuuuuguucugag

SEQ ID NO: 369923 - RNA, 64 nt, Human
ggagagagguuguggggaggaagcgaggaugcgugccugccacuaggcaucugcauccccgagc

SEQ ID NO: 369924 - RNA, 54 nt, Human
caugcugugccaucaugugaugcagccugccagaggcccaaugcuggaauggca

SEQ ID NO: 369925 - RNA, 64 nt, Human
ccccgggcagccguccugcagccgccacuccugcgccugccauuggccuccucacagcggaaac

SEQ ID NO: 369926 - RNA, 64 nt, Human
ucuguuccagucacauugccaucacucuuguacugccugccaccgcggaggaggcuggugacag

SEQ ID NO: 369927 - RNA, 64 nt, Human
uacccagagacuaugauuuauauugauugcacuugccugccaugauuuagauaagauuuuuuuu

SEQ ID NO: 369928 - RNA, 64 nt, Human
aagaaauaacaggaaagaucccuuaugccaggaggccugccauacucaggauaagauccuugaa

SEQ ID NO: 369929 - RNA, 64 nt, Human
cgacagccucacuucuguauggacugcugauguggccugccauccuguucagcgggcauugucu

SEQ ID NO: 369930 - RNA, 64 nt, Human
uuuccugggcuccaggcggcuggcugcacacccugccugccaucacccuugccccugcuugucc

SEQ ID NO: 369931 - RNA, 64 nt, Human
cugcuuuacagauuugauugcuuggaagacucaagccugccacugcuguuuucucacuugaaag

SEQ ID NO: 369932 - RNA, 64 nt, Human
cuuuucuuucuaccaaaugagggucuugguuccagccugccacucaggcccaaagccucgacac

SEQ ID NO: 369933 - RNA, 64 nt, Human
gggcaggaggccuggccuugucaggacccaggccgccugccauaccgcuggggaacagagcggg

SEQ ID NO: 369934 - RNA, 64 nt, Human
agagcaaacuagggucucaguauugagaaacgcagccugccagggaaucacagagacaucgggg

SEQ ID NO: 369935 - RNA, 64 nt, Human
ccauugcuauacuguaccagugucaaaugcugcagccugccaagcugugauuuugugaggcuug

SEQ ID NO: 369936 - RNA, 64 nt, Human; identical to SEQ ID NO: 116878

SEQ ID NO: 369937 - RNA, 64 nt, Human; identical to SEQ ID NO: 116879

SEQ ID NO: 369938 - RNA, 64 nt, Human; identical to SEQ ID NO: 116880

SEQ ID NO: 369939 - RNA, 64 nt, Human; identical to SEQ ID NO: 116881

SEQ ID NO: 369940 - RNA, 64 nt, Human
augucauccugucucaggccucggauaggaagcugccugccagcaagaggagacugaugugccc

SEQ ID NO: 369941 - RNA, 64 nt, Human
cagcccacaguccacagucuuuuugggaaaauuggccugccaccuucuuuaagcucaguuuauu

SEQ ID NO: 369942 - RNA, 64 nt, Human
gggugggggccaccugccugcgucuuccgccccugccugccauguaccuccccugccuugcugu

SEQ ID NO: 369943 - RNA, 64 nt, Human
gagggcagaggaagacccccucuccugugacugagccugccagggaggcagcuaccucgggagg

SEQ ID NO: 369944 - RNA, 64 nt, Human
uuccucuccucagcugcgucauuuccugcauguugccugccacuuacucaccacuggggucuuu

SEQ ID NO: 369945 - RNA, 64 nt, Human
cuaaagcaaaugaaaguuugcugguaucaacacagccugccauauuuuucacagcaugcaacaa

SEQ ID NO: 369946 - RNA, 64 nt, Human
auaaugaacuggcuaauaauugacaagaugcagugccugccaguuuaugacauuaacuugguuu

SEQ ID NO: 369947 - RNA, 64 nt, Human
gcuuucucuggcaucuauaaaaguaaauucuagugccugccaagugauggauuauaauggucuc

SEQ ID NO: 369948 - RNA, 64 nt, Human
gaauuuggaacaauagaauaaucuauuauuuggagccugccaagagguacuguaauggguaauu

SEQ ID NO: 369949 - RNA, 64 nt, Human
gugcccuauguguggggacuggcugcccccuagagccugccaggagcagaagccuggaggggug

SEQ ID NO: 369950 - RNA, 64 nt, Human
acuccauuaacugggaagcccagaguccuguccggccugccaaguucauccugguggacagcgg

SEQ ID NO: 369951 - RNA, 64 nt, Human
cugggcagcaccucuggucaggagggucacccuggccugccagucugccuucccccaaccccgu

SEQ ID NO: 369952 - RNA, 64 nt, Human
ucggcucucagaagaaguuuagccgcccacuucugccugccacuacaacaaaacugucucaggu

SEQ ID NO: 369953 - RNA, 64 nt, Human
agacuucucuuacauuuucguccuguagcacgcugccugccaaaguaguccuggcagcuggacc

SEQ ID NO: 369954 - RNA, 64 nt, Human
ucggagcggcgggccccaggcaaacuugcacgacgccugccagggcgauucgggaggcccccug

SEQ ID NO: 369955 - RNA, 64 nt, Human; identical to SEQ ID NO: 116756

SEQ ID NO: 369956 - RNA, 64 nt, Human; identical to SEQ ID NO: 116757

SEQ ID NO: 369957 - RNA, 64 nt, Human; identical to SEQ ID NO: 116776

SEQ ID NO: 369958 - RNA, 64 nt, Human; identical to SEQ ID NO: 116777

SEQ ID NO: 369959 - RNA, 64 nt, Human
agguacggacuaggcugcaccugagugugccccugccugccagauggacagguacacccaagca

SEQ ID NO: 369960 - RNA, 64 nt, Human
acuuccagaauguauagaaauagucccuguccuggccugccacugacccugucuguauuuucuc

SEQ ID NO: 369961 - RNA, 64 nt, Human
ugaaaaagagaauauacaugaagaauagaaacaagccugccauaauccuuuggaaaagauguau

SEQ ID NO: 369962 - RNA, 64 nt, Human
uggcccccuccuccccggccccuuuucgcccccugccugccauacugcgccuaacucgguauua

SEQ ID NO: 369963 - RNA, 64 nt, Human
cagcuuagcccugagcgccagcgcgaggaccagggccugccacuaagcccgccccgcuggccgc

SEQ ID NO: 369964 - RNA, 64 nt, Human
cccagcccacccuccugucuucccaggguagcccgccugccaguccuagcugcacagggcagcu

SEQ ID NO: 369965 - RNA, 64 nt, Human
cauguacuaggaaguuuguagccauuuuucugacgccugccaaggacgcgacgaccagggagga

SEQ ID NO: 369966 - RNA, 64 nt, Human
cugcuccuguacugcuauccgccagaccccaagggccugccagggacccggcgcguccucgguu

SEQ ID NO: 369967 - RNA, 64 nt, Human
caguguacuggugugggguggaggcccuggcucugccugccauccuagggcccuguucuggcug

SEQ ID NO: 369968 - RNA, 64 nt, Human
accaucaucauuaacugagcaccagcugugcuaagccugccacgggcguauccuugcagccuca

SEQ ID NO: 369969 - RNA, 64 nt, Human
cucacauguguaaggacaggacauuuucugcagugccugccaauagcgagcuuggagccuggag

SEQ ID NO: 369970 - RNA, 64 nt, Human
aaauuggccuuuuaccuggauauaaauuaauugugccugccaccaccauccaacagaccuggug

SEQ ID NO: 369971 - RNA, 64 nt, Human
aacccuuggagggguugggccggaagguggaagagccugccaaggaccucauuuaguuugugua

SEQ ID NO: 369972 - RNA, 64 nt, Human
cggcccacaugucuucacggaggcuuccagcggugccugccacugaggcaggugcggccccagg

SEQ ID NO: 369973 - RNA, 64 nt, Human
agccccugaaagccucacguauuucacagagcacgccugccaucuucuccccgaggcugcccca

SEQ ID NO: 369974 - RNA, 64 nt, Human; identical to SEQ ID NO: 116779

SEQ ID NO: 369975 - RNA, 64 nt, Human; identical to SEQ ID NO: 116780

SEQ ID NO: 369976 - RNA, 64 nt, Human; identical to SEQ ID NO: 116781

SEQ ID NO: 369977 - RNA, 64 nt, Human; identical to SEQ ID NO: 116782

SEQ ID NO: 369978 - RNA, 64 nt, Human
uccccuaggcugcgucgggcaugcuuggaagcuggccugccaggaccuuccacccuggggccug

SEQ ID NO: 369979 - RNA, 64 nt, Human
gcccaaccugcccaaccccagcacuccccaaagugccugccaaaccccagggccuggccccgcc

SEQ ID NO: 369980 - RNA, 64 nt, Human
ccagggccagcccacgucauuaagguuaugcacugccugccauguaguuggggcaccauacauu

SEQ ID NO: 369981 - RNA, 64 nt, Human
aagggaggagcaagaagaucccagugcuugcccugccugccaggaacucugugauaacauagau

SEQ ID NO: 369982 - RNA, 64 nt, Human
cccagaggcagaugggugggugggugggcagguggccugccaggccaggagugggcuggagcug

SEQ ID NO: 369983 - RNA, 64 nt, Human
gcugcaagugccuggcagaaugcccugccugccugccugccaggccaaggccugcgucucucug

SEQ ID NO: 369984 - RNA, 64 nt, Human
uagaggagccacgugccgcccagccaccuucaaugccugccacccugcccgaggauguacagag

SEQ ID NO: 369985 - RNA, 64 nt, Human
cuccagccucaaucuguuccguagcucagagccugccugccagggccaagugcccuagagucca

SEQ ID NO: 369986 - RNA, 64 nt, Human
cuccuccagaccaggaaccccagaaggagacagagccugccacauccucccacgccaggcccug

SEQ ID NO: 369987 - RNA, 64 nt, Human
agaaguggggccggaggcuccgcccccaucaugugccugccaccccuucccagucaucccuuua

SEQ ID NO: 369988 - RNA, 64 nt, Human
cccccgggccaagcucugagccccuaggacucaggccugccaaugccacagccaagcccacccu

SEQ ID NO: 369989 - RNA, 64 nt, Human
cgcgcccagccccauuuuauuuuuuacuuuaaaugccugccaaggagcagccucaagcccagag

SEQ ID NO: 369990 - RNA, 64 nt, Human
ggccagcccucagcggggccgggcgggagcuggagccugccagccgcuuccugccuccuuccuc

SEQ ID NO: 369991 - RNA, 64 nt, Human
uucauccugaaccucucccgcugcugggauugacgccugccauuggucaggcugaccuggccuc

SEQ ID NO: 369992 - RNA, 64 nt, Human
guggcucucaccacuggccgccucuccuugccaggccugccaacucaggggacagauggagcag

SEQ ID NO: 369993 - RNA, 64 nt, Human; identical to SEQ ID NO: 116783

SEQ ID NO: 369994 - RNA, 64 nt, Human; identical to SEQ ID NO: 116784

SEQ ID NO: 369995 - RNA, 64 nt, Human; identical to SEQ ID NO: 116786

SEQ ID NO: 369996 - RNA, 64 nt, Human; identical to SEQ ID NO: 116787

SEQ ID NO: 369997 - RNA, 64 nt, Human
cguggcacgguuccccuccacuuggcugcaagucgccugccauggggcgaggaggccugcaccc

SEQ ID NO: 369998 - RNA, 64 nt, Human
agggacucaacaauggggacagaagucccccagugccugccagggccuggaguggagguucagg

SEQ ID NO: 369999 - RNA, 64 nt, Human
gcugccccacaggaaugcugcugggaaaagcagggccugccagcagguaugagaucuagccugc

SEQ ID NO: 370000 - RNA, 56 nt, Human
gcuugugcuaccccaauuagggcccagccugccauggcagcuccaacaaggaccgu

SEQ ID NO: 370001 - RNA, 64 nt, Human
gcuccucuuguggccauguacccagggcuggcuggccugccauuugccucuccccggagacagc

SEQ ID NO: 370002 - RNA, 50 nt, Human
agaaggaccgaaccaagugagccugccacccuggagugagccccaggcca

SEQ ID NO: 370003 - RNA, 64 nt, Human
auagagccauagaaggaagcugucagcccggagugccugccaccuagacacugaugccauugug

SEQ ID NO: 370004 - RNA, 64 nt, Human
caucuggcuucccuucucagccucauguccaccugccugccagccaggcuacaggugugacuuc

SEQ ID NO: 370005 - RNA, 64 nt, Human
aagaagggagggggcugcccuguggugcacacaggccugccauggggcgugggagcccaucccg

SEQ ID NO: 370006 - RNA, 64 nt, Human
ccugggcugccaccagagaaggugcuugguguucgccugccagcccagagcccuggaggagccg

SEQ ID NO: 370007 - RNA, 64 nt, Human
gucugagacagcacauuugugaaugaugcuugcugccugccauuuucaaccuauucucucuuaa

SEQ ID NO: 370008 - RNA, 64 nt, Human
uugcccaagguaaacaguuugaaaagacaaaugggccugccaaacuguacaguuucuuccccaa

SEQ ID NO: 370009 - RNA, 64 nt, Human
ucuguaaugaccuucuaucccuccguuuuugccugccugccauucuccuauuagguuggugguu

SEQ ID NO: 370010 - RNA, 64 nt, Human
ugucuggcggagaacuagccaucagccuccugaagccugccaucauuguuaauuugaggacugg

SEQ ID NO: 370011 - RNA, 64 nt, Human
gcugcagugugcaugcggggggaacccagguggagccugccagccucccugcaguaggaaaaca

SEQ ID NO: 370012 - RNA, 64 nt, Human; identical to SEQ ID NO: 116791

SEQ ID NO: 370013 - RNA, 64 nt, Human; identical to SEQ ID NO: 116792

SEQ ID NO: 370014 - RNA, 64 nt, Human; identical to SEQ ID NO: 116793

SEQ ID NO: 370015 - RNA, 64 nt, Human; identical to SEQ ID NO: 116794

SEQ ID NO: 370016 - RNA, 64 nt, Human
gucgcguuaacacagggggcaacugccuugaucggccugccaugggucaucagacugcuuccua

SEQ ID NO: 370017 - RNA, 64 nt, Human
agggugacccagaaagacgauucagcuguguccagccugccacccauacguaggccaaccaagc

SEQ ID NO: 370018 - RNA, 64 nt, Human
aggagcccagcucugaaaccaguguuagggaagggccugccacagccuccccugccagggcagg

SEQ ID NO: 370019 - RNA, 64 nt, Human
uuacacggcuagcagggguugagacugcagccuggccugccagccauuggagguguuuaaggaa

SEQ ID NO: 370020 - RNA, 64 nt, Human
ccucagcuccuugauuugugaccuugaccaaggggccugccacccagccccuccagugcccucu

SEQ ID NO: 370021 - RNA, 64 nt, Human
cagugggguccaggugguguucagcugugcugaugccugccauuggguccuccuuaggcucugu

SEQ ID NO: 370022 - RNA, 64 nt, Human
gacaggaccacaggaaugggccaaggagcaacgugccugccauucagccagcuugggacaggcu

SEQ ID NO: 370023 - RNA, 64 nt, Human
ucuugaacuggccucaagugauucucuuaccacagccugccagagugcugagauuguaggcaug

SEQ ID NO: 370024 - RNA, 64 nt, Human
ugggggaauguggaugggggauguccuggcugaugccugccaaaauuucaucccacccuccuug

SEQ ID NO: 370025 - RNA, 64 nt, Human
gguuuccacuguguggacugugcuggagcuuggcgccugccagaaaaauuuggggcuaggcaag

SEQ ID NO: 370026 - RNA, 64 nt, Human
cucccuggcuuugggaagagcugcugagcucuuugccugccacucagggagugcaauuguucuu

SEQ ID NO: 370027 - RNA, 64 nt, Human
cagaauagguuccguucugggcggugguucucgagccugccauucaaaaccaaagcaaauugga

SEQ ID NO: 370028 - RNA, 64 nt, Human
ggacuggggugugggugaccugcccucaaaccuugccugccaccuccccauucaggccuggugg

SEQ ID NO: 370029 - RNA, 64 nt, Human
ucuacaaaagagcucacauggacgcacugagaacgccugccagcuuccccaugcccucacuugg

SEQ ID NO: 370030 - RNA, 64 nt, Human
acccgccauccaccguccugcccacgccgccucagccugccaccucccaccuagaggagaccau

SEQ ID NO: 370031 - RNA, 64 nt, Human; identical to SEQ ID NO: 116749

SEQ ID NO: 370032 - RNA, 64 nt, Human; identical to SEQ ID NO: 116750

SEQ ID NO: 370033 - RNA, 64 nt, Human; identical to SEQ ID NO: 116795

SEQ ID NO: 370034 - RNA, 64 nt, Human; identical to SEQ ID NO: 116796

SEQ ID NO: 370035 - RNA, 64 nt, Human
ucccagcagaacauacuagggagaugcacccagagccugccagggagggcuggccucaccacca

SEQ ID NO: 370036 - RNA, 64 nt, Human
uuuuucaaaugagguucaaggugcugcuuugcaugccugccaacccauggaaguuguuucuuac

SEQ ID NO: 370037 - RNA, 64 nt, Human
cagcuacugcccagggcccgcaguguuggcugcugccugccacagccucugugacugcagugga

SEQ ID NO: 370038 - RNA, 64 nt, Human
ucugugacugcaguggagcggcgaauucccuguggccugccaugccuucggcaucagaggaugg

SEQ ID NO: 370039 - RNA, 64 nt, Human
gcaucuagggaauugucaggcacccuacaggaaggccugccaugcuguggccaacuguuucacu

SEQ ID NO: 370040 - RNA, 64 nt, Human
cccuaccugcccugccugccugcugccccucccagccugccaagaaaacgguaggggagcauga

SEQ ID NO: 370041 - RNA, 64 nt, Human
ggccaaagggaaaaacaggcaggggucagagccagccugccagaggcaaaugcaaaagaggucc

SEQ ID NO: 370042 - RNA, 64 nt, Human
ugacacaaccccuuccauuugucagcacuuuccagccugccaauugcuuccccucugugaucuc

SEQ ID NO: 370043 - RNA, 64 nt, Human
aggcugugcugucgaggcgccugcucgcuuacucgccugccaggaggccgggcucucaguuugg

SEQ ID NO: 370044 - RNA, 64 nt, Human
ugccucagccucccgagcagcugagacuacaggcgccugccaccacgccuggccaauuuuuugu

SEQ ID NO: 370045 - RNA, 64 nt, Human
aaucaccgacuucuuacuguguucacugggauuugccugccacuugguuaucauuacuguuggg

SEQ ID NO: 370046 - RNA, 64 nt, Human
cuucugcagagaaguucccuucaccgcauccgucgccugccaaacugaaggcuacugcagguca

SEQ ID NO: 370047 - RNA, 64 nt, Human
ugccaaacugaaggcuacugcaggucacugaguugccugccauccaaaggggaugggcgggauu

SEQ ID NO: 370048 - RNA, 64 nt, Human
aagcuguggcagcucuuuucccuguucaccucccgccugccagggaaggcaggacccgcucugc

SEQ ID NO: 370049 - RNA, 58 nt, Human
agccucccucggacaccugagcugcuuggccugccacguguggggccaccucuccuca

SEQ ID NO: 370050 - RNA, 64 nt, Human; identical to SEQ ID NO: 116863

SEQ ID NO: 370051 - RNA, 64 nt, Human; identical to SEQ ID NO: 116864

SEQ ID NO: 370052 - RNA, 64 nt, Human; identical to SEQ ID NO: 116925

SEQ ID NO: 370053 - RNA, 64 nt, Human; identical to SEQ ID NO: 116926

SEQ ID NO: 370054 - RNA, 64 nt, Human
auugucuacacacccuaacuaaaggaaguccagagccugccacuccccuaauuccaaaaaaaag

SEQ ID NO: 370055 - RNA, 64 nt, Human
cagucccggggcugacugucccucucagcucugcgccugccaggcagggcacgugcucacagcc

SEQ ID NO: 370056 - RNA, 64 nt, Human
gcagugggugggcagccugagcucccucgggcucgccugccagccuggaguucuuccugugcuc

SEQ ID NO: 370057 - RNA, 64 nt, Human
gaccaggcaaggcugcugucuccaucccugagccgccugccaccucccacuccugaagauccau

SEQ ID NO: 370058 - RNA, 64 nt, Human
ucagguugcuggagcugucacaugacugcauccugccugccagggcugcaaagcaaggucuugc

SEQ ID NO: 370059 - RNA, 64 nt, Human
gggggaccccuucccacauauaaguugagaaggugccugccauagccaggagcgcaucucaaug

SEQ ID NO: 370060 - RNA, 64 nt, Human
cugaccugggcgcuagcaagggcaaagaacccgagccugccagcuuggccuccucccacagccu

SEQ ID NO: 370061 - RNA, 64 nt, Human
ucccacccacguggacuuucucaucaggugcagcgccugccacucucagccacuggguguguca

SEQ ID NO: 370062 - RNA, 64 nt, Human
uuucuccaucagugggggccgaguuguucccccagccugccaaauuuugauccuuccccucuuu

SEQ ID NO: 370063 - RNA, 64 nt, Human
ggagcacccccacccuccccccaccgugcccuuggccugccacccagagccaagagggugcugc

SEQ ID NO: 370064 - RNA, 64 nt, Human
ugccucagccucccaaguagcugggauuacaggcgccugccaccacgcccagcuaauuuuuugu

SEQ ID NO: 370065 - RNA, 52 nt, Human
gggccuuccaccuaaacugaaugccugccaguacccacugaagagcccuuug

SEQ ID NO: 370066 - RNA, 64 nt, Human
auuuauuucugcccccacccugguacugccuggugccugccacaaaauaagcacuaacaaaagu

SEQ ID NO: 370067 - RNA, 64 nt, Human
gccuaaaaaccucggccuguccucccaccauucugccugccauaugccuguccccuuuuccucc

SEQ ID NO: 370068 - RNA, 64 nt, Human
acaauaaaugccacagcgcaaaagcguguagcgagccugccacgcuugugacuggggaggggcu

SEQ ID NO: 370069 - RNA, 64 nt, Human; identical to SEQ ID NO: 116798

SEQ ID NO: 370070 - RNA, 64 nt, Human; identical to SEQ ID NO: 116799

SEQ ID NO: 370071 - RNA, 64 nt, Human; identical to SEQ ID NO: 116800

SEQ ID NO: 370072 - RNA, 64 nt, Human; identical to SEQ ID NO: 116801

SEQ ID NO: 370073 - RNA, 64 nt, Human
ugcaaacuggaggaugcggggcaagcccuuaggggccugccagggcucggggggcaaagaggga

SEQ ID NO: 370074 - RNA, 64 nt, Human
gcgccagccagucuggccuuacccuccgguuggcgccugccagcccccuccccucugcccaggc

SEQ ID NO: 370075 - RNA, 64 nt, Human
uuucucccaacugcaggaagcccaggaggcugaugccugccaggaggagcuggcacugaaggug

SEQ ID NO: 370076 - RNA, 64 nt, Human
gcuaggugggcucuagccacacaaagggaagcaggccugccaugagacacuagugcccucugcu

SEQ ID NO: 370077 - RNA, 64 nt, Human
aguggcccaaaagagagccaggggagccccuucugccugccagacgugccacugccccaccacc

SEQ ID NO: 370078 - RNA, 64 nt, Human
gcccacuguccugggccugcagaauuuggguucugccugccagcugcacugaugcugccccuca

SEQ ID NO: 370079 - RNA, 64 nt, Human
uaugacuucucuggccaguuugccuuccacgugggccugccagccaagucagcuguaucaggag

SEQ ID NO: 370080 - RNA, 64 nt, Human
ugccucagccucccaaguagcugagauuacaggcgccugccaccccaccuggcugauuuuugua

SEQ ID NO: 370081 - RNA, 64 nt, Human
guuuaaguaauugccuacaauaaaaagaaauuuugccugccauuuucagaaucaucuuuugaag

SEQ ID NO: 370082 - RNA, 64 nt, Human
agcaggaggcccggaagugcugacgcagccaucagccugccaagauuguuuuuuaaucuucaca

SEQ ID NO: 370083 - RNA, 64 nt, Human
ccuuugugcagcucuggagcuccaccaacucucggccugccaguucucaagcgagcuaaucuug

SEQ ID NO: 370084 - RNA, 64 nt, Human
guagaccuggcacuguuccacgcgggcgccccaagccugccacuccugugucccugccucccug

SEQ ID NO: 370085 - RNA, 64 nt, Human
aaguguccuggugccaggugugggcccaggcgcagccugccaccuccccauccacuggccaccc

SEQ ID NO: 370086 - RNA, 64 nt, Human
gaaagcugcacaaaacguagaaagaagacauagcgccugccagggaauaggaaaugagggcacu

SEQ ID NO: 370087 - RNA, 64 nt, Human
gcuuuuagcaccgaagugugguccucagaccagugccugccaaccagauguuacuggucuguga

SEQ ID NO: 370088 - RNA, 64 nt, Human; identical to SEQ ID NO: 116802

SEQ ID NO: 370089 - RNA, 64 nt, Human; identical to SEQ ID NO: 116803

SEQ ID NO: 370090 - RNA, 57 nt, Human; identical to SEQ ID NO: 116805

SEQ ID NO: 370091 - RNA, 64 nt, Human; identical to SEQ ID NO: 116806

SEQ ID NO: 370092 - RNA, 64 nt, Human
aaugccucacauugcuggcacggggaugugcccugccugccagcaccuaggacuucgaguuggg

SEQ ID NO: 370093 - RNA, 64 nt, Human
auaaacggcugcgucuccuccgcacaccuguggugccugccacccacuggguugcccaugauuc

SEQ ID NO: 370094 - RNA, 64 nt, Human
cugccuucaaggagcuugcaguauagugagaaaagccugccaaguaaaucagcagguauacuaa

SEQ ID NO: 370095 - RNA, 64 nt, Human
cucgaucucuugaccuggugaucugcccaccucggccugccaaagugcugggauuacaggcuug

SEQ ID NO: 370096 - RNA, 64 nt, Human
cauugggagguucagagcauuacucucccacugugccugccauccaggcagccaugggaggcgg

SEQ ID NO: 370097 - RNA, 64 nt, Human
augaggauguguaacaaguauuuucuucuaucgugccugccagggcugaagcugccugguaucc

SEQ ID NO: 370098 - RNA, 64 nt, Human
gccuggauggguggaggcuuagguagccggaccugccugccacccuccucucccacucaggcac

SEQ ID NO: 370099 - RNA, 64 nt, Human
ccugaggccacaucugaacagaccugucagccaggccugccaggucuucacguugaggauucaa

SEQ ID NO: 370100 - RNA, 64 nt, Human
aaaaauaagcugauuaauaagugaagguuaagcagccugccauauuugucauaauuuuuccucu

SEQ ID NO: 370101 - RNA, 64 nt, Human
aacagcuccuuuggcacgugccucucugaauccagccugccauuccaucaaauggagcaggaga

SEQ ID NO: 370102 - RNA, 64 nt, Human
ccuaaagcccauugcugcaaaugcauugugaauugccugccauggcugugacacagacggagga

SEQ ID NO: 370103 - RNA, 64 nt, Human
ugccacagccucccaaguagcugggauuacaggugccugccaccaugcccagcuaauuuuugua

SEQ ID NO: 370104 - RNA, 64 nt, Human
ucugccaucauuucaccugaugagcauucuuggagccugccagauauuguuagguccuggggcu

SEQ ID NO: 370105 - RNA, 64 nt, Human
ugaagguccuuuggcacagcucugcuccuccccugccugccaaagccccccuuuaggccuuggg

SEQ ID NO: 370106 - RNA, 64 nt, Human
uuccucccuccccugcaugaggcagaggcaagcugccugccaacccccucccucaaggaauggc

SEQ ID NO: 370107 - RNA, 64 nt, Human; identical to SEQ ID NO: 116712

SEQ ID NO: 370108 - RNA, 64 nt, Human; identical to SEQ ID NO: 116713

SEQ ID NO: 370109 - RNA, 64 nt, Human; identical to SEQ ID NO: 116714

SEQ ID NO: 370110 - RNA, 64 nt, Human; identical to SEQ ID NO: 116715

SEQ ID NO: 370111 - RNA, 64 nt, Human
uauuugucagagguguuucuaguguaagauuuaagccugccauuuuaccagcauuauuguaguu

SEQ ID NO: 370112 - RNA, 64 nt, Human
ugaauaguuugcuuguuaccauggaaaccuaauggccugccaacaaaaaccucacuguaaacag

SEQ ID NO: 370113 - RNA, 64 nt, Human
gauauguaaauauugcauguccagcuggauucuggccugccaaagaagaugaugauuaaaaaca

SEQ ID NO: 370114 - RNA, 64 nt, Human
guuuuuccucugaaggaaaaugaacccaucuuuugccugccaugaaucauugcagggcaggcug

SEQ ID NO: 370115 - RNA, 56 nt, Human
ucaucccccgcgugcucugagcaggcgccugccagccucaccugccgcucaggccu

SEQ ID NO: 370116 - RNA, 64 nt, Human
gcagaccuccaccugcugagcccaccccaaguaugccugccaccuacgcccacaggcagggcac

SEQ ID NO: 370117 - RNA, 64 nt, Human
uauggagaguggguggacgugguuauagaugacugccugccaacguacaacaaucaacugguuu

SEQ ID NO: 370118 - RNA, 64 nt, Human
cuuccaggacgcacccaggacgcugagcccaggagccugccaggcugacgugcaucccacccag

SEQ ID NO: 370119 - RNA, 64 nt, Human
gcuugcuucaggguccuuagagaaagucacuggggccugccaagcugccaccuaaagacaagag

SEQ ID NO: 370120 - RNA, 64 nt, Human
ugccucagccuccugaguagcugggauuacaggugccugccaucacgccuggcuaauuuuugua

SEQ ID NO: 370121 - RNA, 64 nt, Human
agcugcagcaccagagaaaagaguagcagagauggccugccaagaguugcaggagacccaggaa

SEQ ID NO: 370122 - RNA, 64 nt, Human
aggcacuguggccacugccagcacugggguggcagccugccacaucgggggcaccacccuccau

SEQ ID NO: 370123 - RNA, 64 nt, Human
gugcccuuccuguauccgcggcugccgcgcacucgccugccauccuccugccuccucuucacuc

SEQ ID NO: 370124 - RNA, 64 nt, Human
augagaguucugaaacccuugauagaaacuggaagccugccauggaacacaauacuuugggcaa

SEQ ID NO: 370125 - RNA, 64 nt, Human
ucacacucagagccggcuggcccgggagcuccuugccugccacuucuuccaggggacagaauaa

SEQ ID NO: 370126 - RNA, 64 nt, Human; identical to SEQ ID NO: 116719

SEQ ID NO: 370127 - RNA, 64 nt, Human; identical to SEQ ID NO: 116720

SEQ ID NO: 370128 - RNA, 64 nt, Human; identical to SEQ ID NO: 116721

SEQ ID NO: 370129 - RNA, 64 nt, Human; identical to SEQ ID NO: 116722

SEQ ID NO: 370130 - RNA, 64 nt, Human
augugacaaagggccagcagucuaccugcucguugccugccacugagcagucuggggacgguuu

SEQ ID NO: 370131 - RNA, 64 nt, Human
cuggggagggggccguggcacugaggccgaaagugccugccagacggcacggucugggugcggg

SEQ ID NO: 370132 - RNA, 64 nt, Human
ugccucagccuccccaguagcugggacuacaggcgccugccaacaugccuggcuaauuuuuuuu

SEQ ID NO: 370133 - RNA, 64 nt, Human
gcaccaccuaccuggcuuccugcaaggccuucacgccugccagggucagcugcagcccccacuc

SEQ ID NO: 370134 - RNA, 64 nt, Human
augcugccucacugcuuaagugccugcaggagccgccugccaagcuccccuuccuacaccuggc

SEQ ID NO: 370135 - RNA, 64 nt, Human
acugaccucaggcauguuuuguaacuguagaggcgccugccauuaaacguguccgcugcugugg

SEQ ID NO: 370136 - RNA, 64 nt, Human
accagccauccuacccucucccugccuggcacaugccugccagcguugugucaugccuguccac

SEQ ID NO: 370137 - RNA, 64 nt, Human
ugauaguguuuuuuuagaugaagaacugaugucagccugccagguacuguaauuuauucuauca

SEQ ID NO: 370138 - RNA, 54 nt, Human
gcccaggccuguguucgugagucggccugccauguuuccaugugccauuucuua

SEQ ID NO: 370139 - RNA, 64 nt, Human
aggacugucuuugagucugucuguaugaccuugggccugccacuucucacagacccuagguauc

SEQ ID NO: 370140 - RNA, 64 nt, Human
gcuccugaccuuggguccugaagugaccucacuggccugccaugccaguaacugugcuguacug

SEQ ID NO: 370141 - RNA, 64 nt, Human
auagaagaagcuacugcaugauguuaguuaccaagccugccauggguccucucuugcuagacac

SEQ ID NO: 370142 - RNA, 64 nt, Human
ccucuccaauaaagcaccugugcccucagcaauggccugccaugugcuguugcugggauguuug

SEQ ID NO: 370143 - RNA, 64 nt, Human
cgggugacccuucccacacaccagccacagauaggccugccacuggucauggguagcuagagcu

SEQ ID NO: 370144 - RNA, 64 nt, Human
gggaagacgcuaaucugugacaucuuuucuucaagccugccaucaaggacauuucuuaagaccc

SEQ ID NO: 370145 - RNA, 64 nt, Human; identical to SEQ ID NO: 116723

SEQ ID NO: 370146 - RNA, 64 nt, Human; identical to SEQ ID NO: 116724

SEQ ID NO: 370147 - RNA, 64 nt, Human; identical to SEQ ID NO: 116788

SEQ ID NO: 370148 - RNA, 64 nt, Human; identical to SEQ ID NO: 116789

SEQ ID NO: 370149 - RNA, 64 nt, Human
uauguuuuuauuacuuuaacuauuguuauaaaaagccugccauuuuuaauaugugguuuggggg

SEQ ID NO: 370150 - RNA, 64 nt, Human
gccgcacgcguaggcaucuccacgcuggaggggggccugccaggacuccugucucugggugagg

SEQ ID NO: 370151 - RNA, 64 nt, Human
cgccaccgagugccuucaacacagcuugucucuugccugccacugugugaaucggcgacggagc

SEQ ID NO: 370152 - RNA, 64 nt, Human
gaauacuuaugcauggggagccuguuagcacagugccugccacaaaaacaagugcccccgacaa

SEQ ID NO: 370153 - RNA, 64 nt, Human
ugaaauucaaagaaaacuuuuucuauugcuaggagccugccagaacaaaggccaauauauaaug

SEQ ID NO: 370154 - RNA, 64 nt, Human
gaaggaguuuuuacaugccacagcucagcugucugccugccacuuuguuguaaacauugcaaaa

SEQ ID NO: 370155 - RNA, 64 nt, Human
gaccccugugggcguccccucccucccagccaccgccugccacaccacuccugccuggugcucg

SEQ ID NO: 370156 - RNA, 64 nt, Human
gggcagaucaccugaggccaggaguucgagaccagccugccaacauggugaaacccugucucug

SEQ ID NO: 370157 - RNA, 64 nt, Human
agcccacucucuugcugagaguccaggccugccugccugccagccagaggugccccuuaugcac

SEQ ID NO: 370158 - RNA, 64 nt, Human
ugccucagccucccuaguagcugggaugacaggcgccugccaucaugccugacuaauuuuugua

SEQ ID NO: 370159 - RNA, 64 nt, Human
gucccauggccugugagcaccggagcgccuggcugccugccaaggaagugcaauugcauaaaaa

SEQ ID NO: 370160 - RNA, 64 nt, Human
agcucaaggaccugccugucaggaccagggcugggccugccaacccagggcaguguuggggccg

SEQ ID NO: 370161 - RNA, 64 nt, Human
guucuaaagaaaagucauuuugaugcaagguccugccugccaucagauccgaggugccuccugc

SEQ ID NO: 370162 - RNA, 64 nt, Human
gcaaaacauuaaaacagaaacuuuucaacuuggagccugccauucagcguugagguagaugagu

SEQ ID NO: 370163 - RNA, 64 nt, Human
cccaccggaugcugugccuggccuccgaugccuggccugccagacacugcgccccgccugaccu

SEQ ID NO: 370164 - RNA, 64 nt, Human; identical to SEQ ID NO: 116726

SEQ ID NO: 370165 - RNA, 64 nt, Human; identical to SEQ ID NO: 116727

SEQ ID NO: 370166 - RNA, 64 nt, Human; identical to SEQ ID NO: 116728

SEQ ID NO: 370167 - RNA, 64 nt, Human; identical to SEQ ID NO: 116729

SEQ ID NO: 370168 - RNA, 64 nt, Human
aggcccugggucccacgcccugggugcccacauggccugccaacuagggccugcaaauggagug

SEQ ID NO: 370169 - RNA, 64 nt, Human
ggaguccuggccccugaaucaccagagccaccaagccugccagaggggucucauucauggcuug

SEQ ID NO: 370170 - RNA, 64 nt, Human
ggagcagggggaaaaggugcacuuggccaguggcgccugccaggagugaguccaugcguugucu

SEQ ID NO: 370171 - RNA, 64 nt, Human
ccugcuaccagucugugccuuagaggucuguuaggccugccaaacggcgaccagcuccccugga

SEQ ID NO: 370172 - RNA, 64 nt, Human
gugcuggggguggugggcggacaauaggaucacugccugccagaucuucaaacuuuuauauaua

SEQ ID NO: 370173 - RNA, 64 nt, Human
aaccugcgcugaccaguuuaggggcuuagcagaugccugccagcugaccucguuggcaggaggg

SEQ ID NO: 370174 - RNA, 64 nt, Human
ugcaaagcuagugaguagcugucagguucccugggccugccaucagggaucacuaaauuuaagg

SEQ ID NO: 370175 - RNA, 64 nt, Human
agauugcagauguucugucuuccaucccaaacaagccugccaugagguaggauccuagggguuu

SEQ ID NO: 370176 - RNA, 64 nt, Human
cgagcugcugaccucaagugauccucccaccucagccugccaaagcacugggauuacaggcaug

SEQ ID NO: 370177 - RNA, 64 nt, Human
ucaggcuugugucuuuaguugcguggcugcgcaggccugccauaugauuuaagccaucucuuuu

SEQ ID NO: 370178 - RNA, 51 nt, Human
cugacagcuuucgagagugaggccugccagcaggccagggacucagcgucc

SEQ ID NO: 370179 - RNA, 64 nt, Human
ucuaccacggcuggagaguugauaccugcagucagccugccagugacucuuagugucuguuucu

SEQ ID NO: 370180 - RNA, 64 nt, Human
ugcgggccuaacauguugugccuggaccaucgcugccugccagcuucugccuucaacuucagca

SEQ ID NO: 370181 - RNA, 64 nt, Human
ccagggcugagguggggagccuucuacggcgaaagccugccaccccacaaugaauccacccugc

SEQ ID NO: 370182 - RNA, 64 nt, Human
ugacugucgccgugugcuggggaucugaaaugaggccugccagggccccugugugcugugcucc

SEQ ID NO: 370183 - RNA, 64 nt, Human; identical to SEQ ID NO: 116733

SEQ ID NO: 370184 - RNA, 64 nt, Human; identical to SEQ ID NO: 116734

SEQ ID NO: 370185 - RNA, 64 nt, Human; identical to SEQ ID NO: 116735

SEQ ID NO: 370186 - RNA, 64 nt, Human; identical to SEQ ID NO: 116736

SEQ ID NO: 370187 - RNA, 64 nt, Human
aggcuggugaaccccggugggaacagaggugaaagccugccacauuccgccugucucccuaacc

SEQ ID NO: 370188 - RNA, 64 nt, Human
ggugcagcuuccagagagcgagcgcccuuuagcggccugccaccacagcacgcggccuccugau

SEQ ID NO: 370189 - RNA, 64 nt, Human
ugccucagccuccugagcagcugggacuacaggcgccugccaucaugccuggcuaauuuuugua

SEQ ID NO: 370190 - RNA, 64 nt, Human
uuaaaauauugucaguuuuucaucgucgucccuagccugccaacagccaucugcccagacagcc

SEQ ID NO: 370191 - RNA, 64 nt, Human
ggcagggcugagcuggagccgccccucucagcccgccugccacggccuuuccuuaaaggccauc

SEQ ID NO: 370192 - RNA, 64 nt, Human
gugccaccccagagcccugggggguggucuccaugccugccacccuggcaucggcuuucugugc

SEQ ID NO: 370193 - RNA, 64 nt, Human
ccucuugccaaagcagagggggcugccauccccugccugccaccugccccucggcugcaugccc

SEQ ID NO: 370194 - RNA, 64 nt, Human
gugcuggcugcaggcaggugugaccaucucucgugccugccaccucuuugcccccaggcuuuuu

SEQ ID NO: 370195 - RNA, 64 nt, Human
ugccucagccucccgaguagcugggauuacaggugccugccaccacacccagcuaauguuuugu

SEQ ID NO: 370196 - RNA, 64 nt, Human
guggcuuccugcagguguuccaccugccuucggagccugccacccaggcccucagaacugagcc

SEQ ID NO: 370197 - RNA, 64 nt, Human
agggcaaggauccugugcugcugucugguugagagccugccaccgugugucgggagugugggcc

SEQ ID NO: 370198 - RNA, 64 nt, Human
gaagcuuggggaagacccauuccuucccagaggggccugccaccuggaccccugcauuggaacu

SEQ ID NO: 370199 - RNA, 64 nt, Human
gucagcuugcugcccuaggcuccgucaguaucaggccugccagacggcacccacccagcaccca

SEQ ID NO: 370200 - RNA, 64 nt, Human
auuuguacaauaggacuguuuacugcccaccuccgccugccagcccaccccagccuggggagag

SEQ ID NO: 370201 - RNA, 64 nt, Human
guugcuuuuaagucuuccaccccuuguuccaucugccugccaacccaucggaaaggaauccaca

SEQ ID NO: 370202 - RNA, 64 nt, Human; identical to SEQ ID NO: 116689

SEQ ID NO: 370203 - RNA, 64 nt, Human; identical to SEQ ID NO: 116690

SEQ ID NO: 370204 - RNA, 64 nt, Human; identical to SEQ ID NO: 116737

SEQ ID NO: 370205 - RNA, 64 nt, Human; identical to SEQ ID NO: 116738

SEQ ID NO: 370206 - RNA, 64 nt, Human
acuugaaggauugcauccugcuggggcugaacaugccugccaaagacguguccgaccuacguuc

SEQ ID NO: 370207 - RNA, 64 nt, Human
gcuacuguuucuuaaaggacugcuucugcccucugccugccagugcccauuccacugugaggug

SEQ ID NO: 370208 - RNA, 64 nt, Human
uagcaaugaccuguccacuucaaacacagauaaggccugccauccucauugguuaaaggcacac

SEQ ID NO: 370209 - RNA, 64 nt, Human
ggcaccaaacuccuccuucaccccuccucucacugccugccagaaaacaaaaacaccaagaaac

SEQ ID NO: 370210 - RNA, 64 nt, Human
cagccacucaggcuccgagccagcuggauucucugccugccacugucaggguuaagcggcaggc

SEQ ID NO: 370211 - RNA, 64 nt, Human
cccuguccuacugcaggacacugagggcuuggcugccugccaccgccaucuggagcccaccaca

SEQ ID NO: 370212 - RNA, 64 nt, Human
aggaaacagacgccauccuacaccuaucagcccugccugccaggagaacagaacacacuccugg

SEQ ID NO: 370213 - RNA, 64 nt, Human
aggguuaacucugccuguccccagggucugcuccgccugccaggcaagggaacagguccuccca

SEQ ID NO: 370214 - RNA, 64 nt, Human
gcagcccaggcccugccccuuuacagucuaggccgccugccauggggugcagccucuccagggg

SEQ ID NO: 370215 - RNA, 64 nt, Human
uggcacuugauggggguuaguugcuuggcagccugccugccacugagggaagucccauuagaga

SEQ ID NO: 370216 - RNA, 64 nt, Human
ccaucaugagguuaacuucccgccgucgccucuugccugccagggguuuuucgggagccccucu

SEQ ID NO: 370217 - RNA, 64 nt, Human
caagaagauuacuuuucuauguugcucaagcugugccugccaacuuguaacuuaauaaauacag

SEQ ID NO: 370218 - RNA, 62 nt, Human
ugagcgugcgggagggcuaggcccgugcccccgccugccaccggaggucacuccaccauccc

SEQ ID NO: 370219 - RNA, 64 nt, Human
caugaucauggcucacugcagccuugaccuuccagccugccaaguagcugggauuacagacagg

SEQ ID NO: 370220 - RNA, 64 nt, Human
gggaaggcuaugcugguuuuggaguguuuggggugccugccauugccucugccuucaccuaagu

SEQ ID NO: 370221 - RNA, 64 nt, Human; identical to SEQ ID NO: 116709

SEQ ID NO: 370222 - RNA, 64 nt, Human; identical to SEQ ID NO: 116710

SEQ ID NO: 370223 - RNA, 64 nt, Human; identical to SEQ ID NO: 116716

SEQ ID NO: 370224 - RNA, 64 nt, Human; identical to SEQ ID NO: 116717

SEQ ID NO: 370225 - RNA, 64 nt, Human
ggugggacccgcagccuccacgcggcccaggccagccugccacccucugggccuccuaccugug

SEQ ID NO: 370226 - RNA, 64 nt, Human
agcuccuggggucccggccaccuggggaagccgcgccugccaaggaggccaccagagggcagug

SEQ ID NO: 370227 - RNA, 64 nt, Human
ggggcgaggcugggggagggcggcgccgcggcgggccugccagcugggggccuuugcggcgcgc

SEQ ID NO: 370228 - RNA, 64 nt, Human
cggggaaaaugcaggcugaguggggcgaccuccugccugccaggagcccccuuucaggacacag

SEQ ID NO: 370229 - RNA, 64 nt, Human
ccagcggacagcgccagaaggaaucgucgaaacagccugccagcagcgccucagugcccgagcu

SEQ ID NO: 370230 - RNA, 64 nt, Human
ugccucagccucccaaauagcugggauuacaguugccugccaccacgcccagcuaauuuuuaua

SEQ ID NO: 370231 - RNA, 64 nt, Human
ucccuggcagacaggcagggcucugcccagggcagccugccacuugcauagcuuucgguugguu

SEQ ID NO: 370232 - RNA, 64 nt, Human
gccuccucuccagaaucauguggaggggccagaggccugccagacccccagcugggcccugcuc

SEQ ID NO: 370233 - RNA, 64 nt, Human
uaacucccagcggaacuggcacgacuccgucaccgccugccaggaagugagggcccagcucguc

SEQ ID NO: 370234 - RNA, 64 nt, Human
ccacaggccccccuccccacuuggccacccagcugccugccaggggagaccugggaccuggacg

SEQ ID NO: 370235 - RNA, 64 nt, Human
ugggcuugucaucugcuggaacaggcgccauggggccugccagcccugccugccaggucccuua

SEQ ID NO: 370236 - RNA, 64 nt, Human
ugcuggaacaggcgccauggggccugccagcccugccugccaggucccuuagcaccuguccccc

SEQ ID NO: 370237 - RNA, 64 nt, Human
uguuuuauucaaagacagagaagaccaaagcauugccugccagagcuuuguuuuauauauuuau

SEQ ID NO: 370238 - RNA, 64 nt, Human
accuuagucaccccuccucuccccccgccuccuggccugccaccccaccccagcguuuacccca

SEQ ID NO: 370239 - RNA, 64 nt, Human
cagagccuccguggcugcggguguugggaaccaugccugccagccaguaugugccccucaccca

SEQ ID NO: 370240 - RNA, 64 nt, Human; identical to SEQ ID NO: 116703

SEQ ID NO: 370241 - RNA, 64 nt, Human; identical to SEQ ID NO: 116704

SEQ ID NO: 370242 - RNA, 64 nt, Human; identical to SEQ ID NO: 116730

SEQ ID NO: 370243 - RNA, 64 nt, Human; identical to SEQ ID NO: 116731

SEQ ID NO: 370244 - RNA, 64 nt, Human
caaaggaaaauacaugaaauugagaguggcagcugccugccaaaaucuguuccgcuguaacaga

SEQ ID NO: 370245 - RNA, 64 nt, Human
gugccccagugccuuugucuauauucugcucccagccugccaggcccaggaggaaauaaacaug

SEQ ID NO: 370246 - RNA, 64 nt, Human
guuccagcacuguucaggcugccugucaucccgggccugccagcuccccugagugaugagcacu

SEQ ID NO: 370247 - RNA, 64 nt, Human
ggccucgccagcccucuggggcauugugggagaugccugccaggaaugagcaagcucuguugcu

SEQ ID NO: 370248 - RNA, 64 nt, Human
uaaaugaaauguaugugacacaggcuuuaucaaggccugccaaaucacuggacaucaccacauc

SEQ ID NO: 370249 - RNA, 64 nt, Human
ugucuggcucggacccaccccaacucuccccagugccugccacucucugggacucuccuccucc

SEQ ID NO: 370250 - RNA, 64 nt, Human
ugugggcacagcuucagcagacuuaaacauuccugccugccagcucugaagagagcagcaguuc

SEQ ID NO: 370251 - RNA, 64 nt, Human
ugccucacccucccgaguagcugggacuacaggugccugccaccacgccuggcuaauuuuuuug

SEQ ID NO: 370252 - RNA, 64 nt, Human
ggaucucacagaguucuuaagauggaauuuuccagccugccagucaugaaucucagacagccug

SEQ ID NO: 370253 - RNA, 64 nt, Human
aauuuuccagccugccagucaugaaucucagacagccugccaccuauugcccugauuuguguua

SEQ ID NO: 370254 - RNA, 64 nt, Human
ugccucagccucccaaguagcugggacuacaggcgccugccaccacgcccagcuaguuuuuuuu

SEQ ID NO: 370255 - RNA, 64 nt, Human
auuccaugaucuacuucuuccaccacuacgagcugccugccauccugcagcagguccgcaucca

SEQ ID NO: 370256 - RNA, 64 nt, Human
ccccagaggagcgagcaccagcacccgacgccuggccugccagggaugggccccguggaacccc

SEQ ID NO: 370257 - RNA, 64 nt, Human
cuccacagcccucaguccccaccccaggagaggcgccugccaccuccuccucaucuccgguggu

SEQ ID NO: 370258 - RNA, 64 nt, Human
agcagcccguguaccugugaccaccucaucccuugccugccacugugccuucgccuccauggcc

SEQ ID NO: 370259 - RNA, 64 nt, Human; identical to SEQ ID NO: 116740

SEQ ID NO: 370260 - RNA, 64 nt, Human; identical to SEQ ID NO: 116741

SEQ ID NO: 370261 - RNA, 64 nt, Human; identical to SEQ ID NO: 116742

SEQ ID NO: 370262 - RNA, 64 nt, Human; identical to SEQ ID NO: 116743

SEQ ID NO: 370263 - RNA, 64 nt, Human
ucaggggccgugcagggcuucagcagcaccuccugccugccagcuggcgucuuguauccaaauc

SEQ ID NO: 370264 - RNA, 64 nt, Human
ccugcaccgccugucccggagacggagcccgaaggccugccauggcggcugugucgaggaugcg

SEQ ID NO: 370265 - RNA, 64 nt, Human
guuucccuguguggaccauggggaucagagucuggccugccaggcuccucuccccguuuucucu

SEQ ID NO: 370266 - RNA, 64 nt, Human
aaagcaggcugaucgggcaaugggagguggccaggccugccagccccucggcucugccgcggug

SEQ ID NO: 370267 - RNA, 64 nt, Human
gagacaggaccacuggggggccuguuuagagucagccugccacacuguggaauaggauuguugc

SEQ ID NO: 370268 - RNA, 64 nt, Human
ccaccucccagguucaagcgauuccccugccucagccugccaaguagcugggauuacaggcaug

SEQ ID NO: 370269 - RNA, 64 nt, Human
ugaccuccuaggcucaagcuauccuccaaccucagccugccaaguagcugucaccauagcuguu

SEQ ID NO: 370270 - RNA, 64 nt, Human
aaguguuacugccaccaccagccacgccaucgccgccugccacgcaacgucucugccuggugag

SEQ ID NO: 370271 - RNA, 64 nt, Human
ggacuuugagcgacucucgggcaauuuucccuucgccugccaugggcuucacccacccccacgc

SEQ ID NO: 370272 - RNA, 64 nt, Human
cuuucuuaugcccgggagccgcguugucccaagagccugccacccucccccuucaaugcaccuc

SEQ ID NO: 370273 - RNA, 64 nt, Human
ugccucagccuccugaguagcugggacuacaggcgccugccacaacgcccggcuaauuuuuugu

SEQ ID NO: 370274 - RNA, 64 nt, Human
gugcccggggcacggcacagaagccgcgcccaccgccugccaguucacaaccgcuccgagcgug

SEQ ID NO: 370275 - RNA, 64 nt, Human
cccccuuucauugguuccauccauccccacaacagccugccaaucgaagcccgucccugcaucc

SEQ ID NO: 370276 - RNA, 64 nt, Human
uuguaaguggugguuuccccugcucuucucucuugccugccaccauguaagaugugccugguuc

SEQ ID NO: 370277 - RNA, 64 nt, Human
cacaguggcucacgccuguaaugccagcaccuuggccugccaaagugcugggauuacgggcugg

SEQ ID NO: 370278 - RNA, 64 nt, Human; identical to SEQ ID NO: 116744

SEQ ID NO: 370279 - RNA, 64 nt, Human; identical to SEQ ID NO: 116745

SEQ ID NO: 370280 - RNA, 64 nt, Human; identical to SEQ ID NO: 116810

SEQ ID NO: 370281 - RNA, 64 nt, Human; identical to SEQ ID NO: 116811

SEQ ID NO: 370282 - RNA, 64 nt, Human
ccccaucacauggaaugggcuggucuaggcuguggccugccaccuuccuuagagugaauagggc

SEQ ID NO: 370283 - RNA, 64 nt, Human
caggacccaaagauccaggaggcacuugugacuagccugccaauggacccaugacaaaaguuua

SEQ ID NO: 370284 - RNA, 64 nt, Human
ugccucagccuccaaaguagcuaggauuacaggugccugccaccaugccuggcuaauuuuuucu

SEQ ID NO: 370285 - RNA, 60 nt, Human
ccggcguggccgggcacuaaacacccgccugccugccagggugaacacacagccagcuua

SEQ ID NO: 370286 - RNA, 64 nt, Human
ugggagguugguuugggauugggguuguugggcagccugccauucaccuggccuauccuggccc

SEQ ID NO: 370287 - RNA, 64 nt, Human
cuacccuguuggcaaacauucccuuccauggucagccugccaggaggaggggagucaccuuggg

SEQ ID NO: 370288 - RNA, 64 nt, Human
ucuggguagccucuagucugcuguucuucaggaggccugccauaaacucuucggaguuuacgug

SEQ ID NO: 370289 - RNA, 64 nt, Human
cauuuuggcugcgggaggacacucugaucucgaagccugccauaaagguagcaaauagacucuu

SEQ ID NO: 370290 - RNA, 64 nt, Human
uccaaagaggagcgaugggccccuggccccgccugccugccacccugccccuugccauccauuc

SEQ ID NO: 370291 - RNA, 64 nt, Human
cggccaccuaugaccaguacccauacgccgccucgccugccacggcugccagcuucgugggcua

SEQ ID NO: 370292 - RNA, 64 nt, Human
ugagcaaacacugacuggcauccugcuuuccagugccugccagccuccagaagagccaggugcc

SEQ ID NO: 370293 - RNA, 64 nt, Human
aagaauagagguuauucuguaauggaaaaguguugccugccaccacccucuguagagcugagca

SEQ ID NO: 370294 - RNA, 64 nt, Human
ugggcaauccuccccaacaggaaggggagacauugccugccacugaggaaacaggucaugaagg

SEQ ID NO: 370295 - RNA, 64 nt, Human
cuuuuguaucucuucauuuaagaauuauuugaaugccugccaggagccagauuuguucugggua

SEQ ID NO: 370296 - RNA, 64 nt, Human
gauuaaugugaaggacuggccagucugggaaaccgccugccacguggaagagccaaacccgacu

SEQ ID NO: 370297 - RNA, 64 nt, Human; identical to SEQ ID NO: 116697

SEQ ID NO: 370298 - RNA, 64 nt, Human; identical to SEQ ID NO: 116698

SEQ ID NO: 370299 - RNA, 64 nt, Human; identical to SEQ ID NO: 116747

SEQ ID NO: 370300 - RNA, 64 nt, Human; identical to SEQ ID NO: 116748

SEQ ID NO: 370301 - RNA, 64 nt, Human
guuuuuuuuuggcuggugcuggggacaagccugugccugccaaagcucccaggccaaguuuggg

SEQ ID NO: 370302 - RNA, 64 nt, Human
cauuucugccaccuccccugggaggcacccagaagccugccacucuuuaccuagucccugcugu

SEQ ID NO: 370303 - RNA, 64 nt, Human
gcugauuggcccugggccggcccauucuucacacgccugccagaagcuggaggggugcuggaga

SEQ ID NO: 370304 - RNA, 64 nt, Human
ugaaguuauaccagaaaaguuaauuauuugaugggccugccaugugaaaaccagaaaauaaccu

SEQ ID NO: 370305 - RNA, 64 nt, Human
ucagccucccucgcaaguagcugggauuacaggcgccugccaccaugccuagcaaauuuuugua

SEQ ID NO: 370306 - RNA, 64 nt, Human
gucuuugaagaggcgaugggagcauaucaugacugccugccaccauugcuuuucagacuaccac

SEQ ID NO: 370307 - RNA, 64 nt, Human
gccaggccucccucgggcuggugucuugagaccagccugccaggcccuccagcaggaggacaga

SEQ ID NO: 370308 - RNA, 64 nt, Human
cucaggaugaaagaggagcugagagaagugcucugccugccagugcagugcccagcuccaaggc

SEQ ID NO: 370309 - RNA, 64 nt, Human
guccaggauucaugaccaguagcagcccagcuaugccugccacgucucauggccccuguguaag

SEQ ID NO: 370310 - RNA, 64 nt, Human
gggccgggccaugcagggagcgccucccuauguugccugccacucugggcaccggccagcaccc

SEQ ID NO: 370311 - RNA, 64 nt, Human
auggacucgcccacgccucgccccuccugccgcugccugccauugacaauguugcugggaccuc

SEQ ID NO: 370312 - RNA, 64 nt, Human
cauggcggggugucucuacaggggagaggcgggagccugccacccucuuccugcccuaccuccu

SEQ ID NO: 370313 - RNA, 64 nt, Human
ugccuccgccucccgaguagcuggaauuacagacgccugccaccacgcacagcuaacuuuuuuu

SEQ ID NO: 370314 - RNA, 64 nt, Human
cuuaacuccaucuuggguguuugugacaggcccugccugccacccuaggcagggaaagcuguca

SEQ ID NO: 370315 - RNA, 64 nt, Human
caucccugggccuugggcuccgugugggagaccggccugccaggaggacccagggcucuguaag

SEQ ID NO: 370316 - RNA, 64 nt, Human; identical to SEQ ID NO: 116664

SEQ ID NO: 370317 - RNA, 64 nt, Human; identical to SEQ ID NO: 116665

SEQ ID NO: 370318 - RNA, 64 nt, Human; identical to SEQ ID NO: 116666

SEQ ID NO: 370319 - RNA, 64 nt, Human; identical to SEQ ID NO: 116667

SEQ ID NO: 370320 - RNA, 64 nt, Human
cuuugcuaagacccccuccgagggcuucaggggggccugccaagggggggccuuguucuuguuc

SEQ ID NO: 370321 - RNA, 64 nt, Human
uguccuucccuggggggacgggggacucacaugugccugccacuggagccucucaaccguccag

SEQ ID NO: 370322 - RNA, 64 nt, Human
uaggggaaacaguuggagguucgugccguccccagccugccacgggugcgaggacagccaaguc

SEQ ID NO: 370323 - RNA, 64 nt, Human
cauucugcacuuccacauucugucugucuuccccgccugccaacuaggaguucacguggggcuu

SEQ ID NO: 370324 - RNA, 64 nt, Human
gaaguccugacuccaggguccuugccccaccccugccugccaccugggcccucacagcccagac

SEQ ID NO: 370325 - RNA, 64 nt, Human
guuucccaagacagcaggugccacggcccgccccgccugccagcccgaauucccguucuccugu

SEQ ID NO: 370326 - RNA, 64 nt, Human
guuggggcccacccugcucccuguuccugcuagggccugccagugccccugagcuugcuuucca

SEQ ID NO: 370327 - RNA, 64 nt, Human
aagggacuacucucuucaccccuuuauuccagcugccugccaccccagacccccaccucccacc

SEQ ID NO: 370328 - RNA, 64 nt, Human
caugaggggccaccucauccagggccccucccuugccugccacuuuggggacuugagggggguc

SEQ ID NO: 370329 - RNA, 64 nt, Human
aacgugccggaacuuuuuguccauucccuaguaggccugccacagccuagaugggcaguuuuug

SEQ ID NO: 370330 - RNA, 64 nt, Human
agcacuuccaugggccauagccgguaugcccccagccugccauaagcgugcuuucauuuucaag

SEQ ID NO: 370331 - RNA, 64 nt, Human
uguagagguauucacaacagcaagcagggauuuggccugccaucaauuuuauuuaaaaagcaau

SEQ ID NO: 370332 - RNA, 64 nt, Human
uuuaggagaauucaucuacuuagacuuuuuaaaugccugccauaaaugaaauugaaaugguaga

SEQ ID NO: 370333 - RNA, 64 nt, Human
ccaggcucgaacacuggccgaggaggagcucucugccugccagaagagucuaguccugcuccca

SEQ ID NO: 370334 - RNA, 64 nt, Human
gagggccaacacaugagaccccaccucccucccugccugccagcccuagacuuguuggagcaua

SEQ ID NO: 370335 - RNA, 64 nt, Human; identical to SEQ ID NO: 116752

SEQ ID NO: 370336 - RNA, 64 nt, Human; identical to SEQ ID NO: 116753

SEQ ID NO: 370337 - RNA, 64 nt, Human; identical to SEQ ID NO: 116754

SEQ ID NO: 370338 - RNA, 64 nt, Human; identical to SEQ ID NO: 116755

SEQ ID NO: 370339 - RNA, 64 nt, Human
uaugggaugacgaggcgagagggaagcccuugcugccugccauucccagaccccagcccuuugu

SEQ ID NO: 370340 - RNA, 64 nt, Human
aaaagugccuuuauugggagacuuuugucuuccagccugccaaucaacccuccuggguguggcc

SEQ ID NO: 370341 - RNA, 64 nt, Human
ugccucagccuccugaguagcuaggauuacaggugccugccaccacacccggcuaauuuucaua

SEQ ID NO: 370342 - RNA, 64 nt, Human
caguaucauuugaugcugugccauuucuccuuuugccugccaguuuguccuacccgcaagcugg

SEQ ID NO: 370343 - RNA, 64 nt, Human
gcuuugcauauccauguucuaccacaggaagguggccugccaagagucugcucaaaguuuucaa

SEQ ID NO: 370344 - RNA, 64 nt, Human
uugcaaggacccaaauccauucaacaagggugcagccugccacaggcuccucauccggacugag

SEQ ID NO: 370345 - RNA, 64 nt, Human
ucccacgggagaggggagagggacgcacagcacugccugccaagcgagaaugcaggccccgccc

SEQ ID NO: 370346 - RNA, 64 nt, Human
aaagccaggcacugugcccagcagugggcucccugccugccaccuccccugccagcccacccac

SEQ ID NO: 370347 - RNA, 64 nt, Human
cagcaagugugccugaugccugccucagcucggcgccugccagggggugacuggcacagagcgg

SEQ ID NO: 370348 - RNA, 64 nt, Human
uggggcucaagaagcaccgccuuccccacccccugccugccauucugaccucuucucagagcac

SEQ ID NO: 370349 - RNA, 64 nt, Human
cacagggaccaagaagugagguuuccacugucuugccugccagggccccuguucccccgcuggc

SEQ ID NO: 370350 - RNA, 64 nt, Human
gguaucagcugugggcuaauugccaccaauuucagccugccacgauucuuggaaauaugucuuc

SEQ ID NO: 370351 - RNA, 64 nt, Human
uucccccuuccuuucugugucuccugccucaucggccugccaugaccugcagccaagcccagcc

SEQ ID NO: 370352 - RNA, 64 nt, Human
ugccucagucucccaaguaccugggaugacaggcgccugccaccacgcccggcuaauuuuuaau

SEQ ID NO: 370353 - RNA, 64 nt, Human
uuuucuacugcaagcacauguaacuagauuuagugccugccauggugugaaaucuggcuuuuga

SEQ ID NO: 370354 - RNA, 64 nt, Human; identical to SEQ ID NO: 116670

SEQ ID NO: 370355 - RNA, 64 nt, Human; identical to SEQ ID NO: 116671

SEQ ID NO: 370356 - RNA, 64 nt, Human; identical to SEQ ID NO: 116672

SEQ ID NO: 370357 - RNA, 64 nt, Human; identical to SEQ ID NO: 116673

SEQ ID NO: 370358 - RNA, 64 nt, Human
uugguaguugaggaaagcacagaggccuccuguggccugccagucaucgaguggcccaacaggg

SEQ ID NO: 370359 - RNA, 63 nt, Human
gugggugcuggcugagcccccggggcagcaggagccaggcaggugaugucuuuguucucggcu

SEQ ID NO: 370360 - RNA, 63 nt, Human
agauggagucucuacuaaaaauacaaaaaauuagccaggcauggugccgcauaacuauaaucc

SEQ ID NO: 370361 - RNA, 63 nt, Human
cauggcgagaugggggcucacuccggaggaggagccaggcagcagggccuuccugaccaacag

SEQ ID NO: 370362 - RNA, 63 nt, Human
gcagcuguaaggcacgcuggaaggcacacgccugccaggcagggcagucuggcgcccaugaug

SEQ ID NO: 370363 - RNA, 63 nt, Human
cugacuuggagaaccccagaucucuggggcccagccaggcagggugugggggcagcugugcca

SEQ ID NO: 370364 - RNA, 63 nt, Human
gaaacccugucucuacuaaaaauacaaaaauuagccaggcaugguagcaggugccuguaaucc

SEQ ID NO: 370365 - RNA, 63 nt, Human
ggaacggggccugggggaccuggggucuggugugccaggcaccaggcugccucugcucuugga

SEQ ID NO: 370366 - RNA, 63 nt, Human
uguguccaauaccauucgaagccugucauuugugccaggcaaugacuuugagauguccaaaca

SEQ ID NO: 370367 - RNA, 63 nt, Human
ggcagccuguaucagacaaagguaaaucagccagccaggcacccacagccucagcuccugugc

SEQ ID NO: 370368 - RNA, 63 nt, Human
cucugguggccauuuggggaaaacugcagcccggccaggcagcugggaccagaaugcaacccc

SEQ ID NO: 370369 - RNA, 63 nt, Human
aaaaauauguuuuaaaugucccauuucaccauugccaggcaggcauucuuccuucagggagag

SEQ ID NO: 370370 - RNA, 63 nt, Human
uugcacagcacagagguggucaccccagggacagccaggcaccugcuccucuugcccuuccug

SEQ ID NO: 370371 - RNA, 63 nt, Human
gaaaccucgucucuacuaaaaauacaaaaauuagccaggcaugguggcacacgccuauagucc

SEQ ID NO: 370372 - RNA, 63 nt, Human
ucucgcuaugaaguuacaaaaucuucagcuucagccaggcaacgcuaagcucugaagaacucc

SEQ ID NO: 370373 - RNA, 64 nt, Human; identical to SEQ ID NO: 116674

SEQ ID NO: 370374 - RNA, 64 nt, Human; identical to SEQ ID NO: 116675

SEQ ID NO: 370375 - RNA, 64 nt, Human; identical to SEQ ID NO: 116677

SEQ ID NO: 370376 - RNA, 63 nt, Human
ggcagaaugacuuuuauugagcucuuguuccgugccaggcauucaauccucaggucuccacca

SEQ ID NO: 370377 - RNA, 63 nt, Human
agaggcuccuucuaccugccgcaggguaggagggccaggcaaaguucaccagcuugcucuaag

SEQ ID NO: 370378 - RNA, 63 nt, Human
cccugucuuauacaaccagagaaguggguguuggccaggcacaucccaucucaggcagcaaga

SEQ ID NO: 370379 - RNA, 63 nt, Human
cuccacuagaggggcuaagcuugacugcccuuagccaggcaagcacaguaauguguguuuugu

SEQ ID NO: 370380 - RNA, 63 nt, Human
auggaguaguuuguuauugguagucuacuccaggccaggcaguguguuaugggcugaggaugc

SEQ ID NO: 370381 - RNA, 63 nt, Human
gugaaaaaggaggaagagaaaaaauauuuuccugccaggcaugguggcccacgcacuucggga

SEQ ID NO: 370382 - RNA, 63 nt, Human
uggacaaggauggcaaggggugggcauuggggugccaggcaggcauguacagacucuauaucu

SEQ ID NO: 370383 - RNA, 63 nt, Human
ugaaaccccaucucuacuaaaaauacaaaauuagccaggcaugauggcacaugccuguaaucc

SEQ ID NO: 370384 - RNA, 63 nt, Human
cccagcugagucuggguguucccauuggguugggccaggcaaggccucuggugcccgcugccg

SEQ ID NO: 370385 - RNA, 63 nt, Human
uauugucaugguuuauaaacaauaaacugugaugccaggcacaucucugccuucccugagcgc

SEQ ID NO: 370386 - RNA, 63 nt, Human
ccggucugguuaucuuccuguuccuguagcauagccaggcacugccagucaccugugccccca

SEQ ID NO: 370387 - RNA, 60 nt, Human
agaacugcagcaucauguaaucugggaccugccaggcagggguggggguggaggcuuccu

SEQ ID NO: 370388 - RNA, 63 nt, Human
caacgccagcccuucauccuuccucccucagcagccaggcagacauaacaacaaaacuacuaa

SEQ ID NO: 370389 - RNA, 63 nt, Human
gccaacacaguuagaucagagaaagcaauugaagccaggcaugaaggcuggcgcccguaaucc

SEQ ID NO: 370390 - RNA, 63 nt, Human
gaaacacugggucccauagcuaaauucucaaccgccaggcaccuucagaagaauccagccuaa

SEQ ID NO: 370391 - RNA, 63 nt, Human
aacccccgucucuacuaaaauacaaaaaaauuagccaggcauaguggcgcgcgccuauaaucc

SEQ ID NO: 370392 - RNA, 64 nt, Human; identical to SEQ ID NO: 116680

SEQ ID NO: 370393 - RNA, 64 nt, Human; identical to SEQ ID NO: 116681

SEQ ID NO: 370394 - RNA, 64 nt, Human; identical to SEQ ID NO: 116682

SEQ ID NO: 370395 - RNA, 63 nt, Human
cugcacaagauauuuauugagugcccacuacgugccaggcacuguugcugaguuccugugggu

SEQ ID NO: 370396 - RNA, 63 nt, Human
auaucauuuaaaaagcuucuaaaaagcuauuucgccaggcacgguggcucaugccuauaaucc

SEQ ID NO: 370397 - RNA, 63 nt, Human
cgcugcccccuggcgacagggcagaccaaugaugccaggcagcugucacacgcuaguauuggc

SEQ ID NO: 370398 - RNA, 63 nt, Human
aguccugcacaccugcuggccuggggagcuccagccaggcagcgaguccugccccgcccgcag

SEQ ID NO: 370399 - RNA, 63 nt, Human
uuccauuuucccguggaaccuguuucacucaaugccaggcagugcagcauuuaggaaagcagu

SEQ ID NO: 370400 - RNA, 63 nt, Human
acgcggacgccaagggcaucaugcagcuggugggccaggcagagccggagagcgugcugcugg

SEQ ID NO: 370401 - RNA, 63 nt, Human
gcguccuaggaccgccggcgccuccccacggacgccaggcaggccaggccgcucuccggggcc

SEQ ID NO: 370402 - RNA, 63 nt, Human
ccuugggcauccacccagugcugccaugccacugccaggcaccuggccugcugggaaccccgc

SEQ ID NO: 370403 - RNA, 63 nt, Human
ccaugcagaaagcaucccucacccauccuagaggccaggcaggagcccuucuauacccaccca

SEQ ID NO: 370404 - RNA, 63 nt, Human
aaaaccucgucucuacuaaaaauacaaaaauuagccaggcaucguggugggugccuguaaucc

SEQ ID NO: 370405 - RNA, 63 nt, Human
aaccuaaaacugccauauaaagauaaagucuaggccaggcaugguggcucaugccuguaaucc

SEQ ID NO: 370406 - RNA, 63 nt, Human
agucacuccucucauuucuaaaauagggacguggccaggcacgguggcucaugccuguaaucc

SEQ ID NO: 370407 - RNA, 63 nt, Human
gaaacccggucucuacuaaaaauacaaaaauuagccaggcaugguggcaggugccuguaaucc

SEQ ID NO: 370408 - RNA, 63 nt, Human
aaaaccgcguguuuacaaaaaauacaaaaauuagccaggcaugguggugcaugccuguagucc

SEQ ID NO: 370409 - RNA, 57 nt, Human
gccagggccccucagacugacugcucagccaggcaccaacuggggcaugaacaggac

SEQ ID NO: 370410 - RNA, 63 nt, Human
ccaaggaacaucagagaagcuguggggcugccugccaggcaggaucauggcugccaucaagcc

SEQ ID NO: 370411 - RNA, 64 nt, Human; identical to SEQ ID NO: 116683

SEQ ID NO: 370412 - RNA, 64 nt, Human; identical to SEQ ID NO: 116684

SEQ ID NO: 370413 - RNA, 64 nt, Human; identical to SEQ ID NO: 116759

SEQ ID NO: 370414 - RNA, 63 nt, Human
ucucuacaguagcacuguggccaggucuggaaagccaggcaagacaccuguguguccuaucug

SEQ ID NO: 370415 - RNA, 63 nt, Human
gacauaauuuauggacgaaaugccuaaaaaugugccaggcaugcucuguuugagaggcuuuuu

SEQ ID NO: 370416 - RNA, 63 nt, Human
acgaagcagaguuggcacauaacauggaaccuggccaggcaugguggcucacaccuauaaccc

SEQ ID NO: 370417 - RNA, 63 nt, Human
cuucaugccaggcuccuaugcuccccuugcccugccaggcauuugugugacuguccuguuucc

SEQ ID NO: 370418 - RNA, 63 nt, Human
uauacacacgaggcuuucucaggaaguggcucugccaggcaggacuaugugggaaaggguuuu

SEQ ID NO: 370419 - RNA, 63 nt, Human
ugcuccagucacaccuuauaggcccuaggccuggccaggcauuguccccuggaaaccugugug

SEQ ID NO: 370420 - RNA, 63 nt, Human
aucuacaagaaguuuugcaaacagacccucagggccaggcaauguuuguuuuuguuuuuuguu

SEQ ID NO: 370421 - RNA, 63 nt, Human
auuuccuuguugagaacaggaaaguggccaguagccaggcaagucauagaauugauuacccgc

SEQ ID NO: 370422 - RNA, 63 nt, Human
cccgcccuaaggggccuggccuggggugacguggccaggcagacugucugccccacuccuuca

SEQ ID NO: 370423 - RNA, 63 nt, Human
aacccaggaccaugaacucaggugccuagagaagccaggcagcuaaaggacaaggaaugcugg

SEQ ID NO: 370424 - RNA, 63 nt, Human
acauggagaaacccuacuaaaaauacaaaguuagccaggcauaguggugcaugccuguaaucc

SEQ ID NO: 370425 - RNA, 59 nt, Human
ugcccaaacugcuucaguaggaccaggcugccaggcaccaucugccaaugccaugacug

SEQ ID NO: 370426 - RNA, 63 nt, Human
guaccagcucuggcugggguccgugaagcccaggccaggcagccaaaucuugccugugcuggg

SEQ ID NO: 370427 - RNA, 63 nt, Human
ggcccugaaaagaggaaaaaaaaaaaaaaagaggccaggcaugguggcucacgccuguaaucu

SEQ ID NO: 370428 - RNA, 63 nt, Human
agucacucgccccuuccucaucucuggaauuuggccaggcagucccagaagacucuggaguga

SEQ ID NO: 370429 - RNA, 63 nt, Human
uuuauugagugccuacuauguguuagguacugugccaggcacugauaagccagugguaaggga

SEQ ID NO: 370430 - RNA, 64 nt, Human; identical to SEQ ID NO: 116686

SEQ ID NO: 370431 - RNA, 64 nt, Human; identical to SEQ ID NO: 116687

SEQ ID NO: 370432 - RNA, 64 nt, Human; identical to SEQ ID NO: 116688

SEQ ID NO: 370433 - RNA, 63 nt, Human
agauauagaaauaggggaggagcucaggucugcgccaggcaggaagaaggcaggcuucuggcu

SEQ ID NO: 370434 - RNA, 63 nt, Human
ggccuuauuuugcuucuugauacaggggccaaagccaggcacccucccaguuacguuguguau

SEQ ID NO: 370435 - RNA, 63 nt, Human
ucagcagaagguaacuguucuugucuugcacaagccaggcagaucauuucuccuaagcugaua

SEQ ID NO: 370436 - RNA, 63 nt, Human
aaugagcgugggccuggaccuuccccagaugcugccaggcagccccuccccaagccucaaaga

SEQ ID NO: 370437 - RNA, 63 nt, Human
accccaucucuacaaaaaauuuuuaaaaaguuggccaggcaugguaaugcgcgccuguggucc

SEQ ID NO: 370438 - RNA, 63 nt, Human
gaaacccugucuuuacuaaaaauacaaaaauuagccaggcaugguggcgugugccaguaaucc

SEQ ID NO: 370439 - RNA, 63 nt, Human
ccaggaaauagccuauuaaaaaaugcuguccaggccaggcacaguggcucacaccuguaaucc

SEQ ID NO: 370440 - RNA, 63 nt, Human
gaaacccccaucucuacugaaaauacagaauuagccaggcaugguggcacaugccuguaaccc

SEQ ID NO: 370441 - RNA, 63 nt, Human
uggucauugaauuuguuuaaagauggaugaaaggccaggcaugguggcucaugccuguaaucc

SEQ ID NO: 370442 - RNA, 63 nt, Human
gccccugggagcacacacugggugcagcccugggccaggcacgggaggcccugcccugugcug

SEQ ID NO: 370443 - RNA, 63 nt, Human
agcauagugaaauaagauucauccauuuuggaagccaggcauggugcugugcaucuauagucc

SEQ ID NO: 370444 - RNA, 63 nt, Human
uggauggacacuucgccauccaggcagaacuaagccaggcauaaccacagccaagcagauuaa

SEQ ID NO: 370445 - RNA, 63 nt, Human
cuaguucuccaaguccccagcccggccaguggugccaggcagcuugccacuugggagggcaga

SEQ ID NO: 370446 - RNA, 63 nt, Human
uguuuuuaguagagauggagucucaccacauaggccaggcagucucgaacuccugaccucagg

SEQ ID NO: 370447 - RNA, 63 nt, Human
uggggguugcuccacacccuaaaacaagccucagccaggcaacccgucagucugucuccaucc

SEQ ID NO: 370448 - RNA, 63 nt, Human
gaccuccccagccccuagcccaggagagagaaagccaggcagguagccagggggacuagcccc

SEQ ID NO: 370449 - RNA, 64 nt, Human; identical to SEQ ID NO: 116661

SEQ ID NO: 370450 - RNA, 64 nt, Human; identical to SEQ ID NO: 116662

SEQ ID NO: 370451 - RNA, 64 nt, Human; identical to SEQ ID NO: 116668

SEQ ID NO: 370452 - RNA, 63 nt, Human
cugcccgcgggugcacccaggcugcagggugaggccaggcaggccuggguaggggcagcuucu

SEQ ID NO: 370453 - RNA, 63 nt, Human
gugugggugggaguggauccuccgggcgcaggugccaggcaggugcaggcgggcggucggcca

SEQ ID NO: 370454 - RNA, 63 nt, Human
acaggagcugaaagcagaagagugggauuugaugccaggcaguggaguggccucagccccaga

SEQ ID NO: 370455 - RNA, 63 nt, Human
agaguuugguaugauauuuaaauacaucaucuggccaggcaugguggcuuacgccuguaaucc

SEQ ID NO: 370456 - RNA, 63 nt, Human
gaaccuaaaaauaauggcauaaaguuuggggaugccaggcauacuuuuucauguuugguguug

SEQ ID NO: 370457 - RNA, 63 nt, Human
ugcagggucagaaccuccccacccccaggggaggccaggcagaagccugggucacagcaccca

SEQ ID NO: 370458 - RNA, 63 nt, Human
ucccuuuaugaaagacaucacauggcauccagggccaggcaggcagcuugaggugccuuuacg

SEQ ID NO: 370459 - RNA, 63 nt, Human
cuucauuugcuggguguggaaagaguugcuauggccaggcauaugggauuuggaagcucagca

SEQ ID NO: 370460 - RNA, 63 nt, Human
aacccugucucuccuaaaaauacaaaaaaauuagccaggcaugguggcgggcgccuguagucc

SEQ ID NO: 370461 - RNA, 63 nt, Human
uaaugaugauaaacauuugcauucuuauucugugccaggcaacaugcuaacugcuguauauau

SEQ ID NO: 370462 - RNA, 63 nt, Human
aagccuuaagucuuaauauuaaauauaugauuagccaggcacgguggcugacaccuguaaucc

SEQ ID NO: 370463 - RNA, 63 nt, Human
gauuccccacguguguucaucugcacccaccgagccaggcagaggccagcccuccguggugca

SEQ ID NO: 370464 - RNA, 63 nt, Human
gaaaugccaucuccacuaaaaauauaaaaauuagccaggcaugguggugugggccugcagucc

SEQ ID NO: 370465 - RNA, 63 nt, Human
aacaaggaaauagaggacgaaggccuguguguugccaggcaggcaccugggcuuucuggaauc

SEQ ID NO: 370466 - RNA, 63 nt, Human
gaaguaaugccccaguugucccccacuccuaaugccaggcagagaaggacagccuuuauagac

SEQ ID NO: 370467 - RNA, 63 nt, Human
cgucucuccugaaaaaaaaaaacacaaaaauuagccaggcaugguggcgcaugccuguaaucc

SEQ ID NO: 370468 - RNA, 64 nt, Human; identical to SEQ ID NO: 116657

SEQ ID NO: 370469 - RNA, 64 nt, Human; identical to SEQ ID NO: 116658

SEQ ID NO: 370470 - RNA, 64 nt, Human; identical to SEQ ID NO: 116678

SEQ ID NO: 370471 - RNA, 63 nt, Human
agaugugaccccauaaaaauuuuuccugaguuggccaggcaugguggcucacgccuguaaucc

SEQ ID NO: 370472 - RNA, 63 nt, Human
cacauaccuggcccaaccagacuucucccgugagccaggcaaaggaaauugucaucugccaac

SEQ ID NO: 370473 - RNA, 63 nt, Human
ggaaugugcaugcuggcaucugaauguccauucgccaggcauggagagcaagagaagguaugu

SEQ ID NO: 370474 - RNA, 63 nt, Human
cuuuccuucugggagucuggaauuuugguaugugccaggcagagacuaccuuugugaccagcu

SEQ ID NO: 370475 - RNA, 63 nt, Human
aauucacugaucacauccauuuuaucuguucuagccaggcauuccaaacaauuucuuauacug

SEQ ID NO: 370476 - RNA, 63 nt, Human
cuacuaaaaauacaaaaaaaaaaaaaaaaaaaagccaggcaugguggcacacaccuguaaucc

SEQ ID NO: 370477 - RNA, 63 nt, Human
gauaagagauguugacucuaaaguugauuuaaggccaggcauggugguuuacgccuauaaucc

SEQ ID NO: 370478 - RNA, 63 nt, Human
uaaaaacaaaguugauuaagaaaggaaguauaggccaggcacaguggcucacaccuguaaucc

SEQ ID NO: 370479 - RNA, 63 nt, Human
cgugucaggagaggcuaacggacaucagcugcagccaggcaugucccguaugccaaaagaggg

SEQ ID NO: 370480 - RNA, 63 nt, Human
uugagaaaaccguuauaaauaagaauaaaauaggccaggcacaguggcucacaccuguaaucc

SEQ ID NO: 370481 - RNA, 63 nt, Human
ggcaggaaaaugaucaucagaaacuaaauggcagccaggcaugggggcucacaacuguaaucc

SEQ ID NO: 370482 - RNA, 63 nt, Human
ccauaacacaagagagcgcugcauuguuugggggccaggcauuacuacuaucaugaagaaaaa

SEQ ID NO: 370483 - RNA, 63 nt, Human
aggaggccaacccaaaauaagcaggcgugaccugccaggcacacugagccagcagccuggcuc

SEQ ID NO: 370484 - RNA, 63 nt, Human
gaaaccccaucucuacuaaaaauacaacaauuagccaggcaugguggugcaugccuguaaucc

SEQ ID NO: 370485 - RNA, 63 nt, Human
acuuggauugaagacuagccuauugaagcugcugccaggcaacaccacuuaacaguaacuuaa

SEQ ID NO: 370486 - RNA, 63 nt, Human
cccccgcucaguuagcagcuguuggccaauggugccaggcagccuggccuccagaggcaugga

SEQ ID NO: 370487 - RNA, 64 nt, Human; identical to SEQ ID NO: 116815

SEQ ID NO: 370488 - RNA, 64 nt, Human; identical to SEQ ID NO: 116816

SEQ ID NO: 370489 - RNA, 64 nt, Human; identical to SEQ ID NO: 116817

SEQ ID NO: 370490 - RNA, 63 nt, Human
ugcgucgguuuguggucuagcucccaggggcaggccaggcauggcucagugcagucccugggc

SEQ ID NO: 370491 - RNA, 63 nt, Human
aagacaaggaguucaaaaauuccaugaaucuuggccaggcaugguggcucaugccuguaaucc

SEQ ID NO: 370492 - RNA, 63 nt, Human
aacagagagagaaaaaggguaucugcccuucuugccaggcagcuccacucucccgcugacugc

SEQ ID NO: 370493 - RNA, 63 nt, Human
gcacauaaaguuuuguccgaaaccauccagaaggccaggcaccaugcagaggacauucaagaa

SEQ ID NO: 370494 - RNA, 63 nt, Human
uccuuuggcauggaccccagagauaguuuuggagccaggcauugauguagagguucaccaaac

SEQ ID NO: 370495 - RNA, 63 nt, Human
uucaggacccacccacccuaugccggcuucugugccaggcacuuccuuuuaucgguucauuua

SEQ ID NO: 370496 - RNA, 63 nt, Human
gggcgggggcugcagggccgugccgccgccgccgccaggcacuccggagcuguccgcuucagc

SEQ ID NO: 370497 - RNA, 63 nt, Human
acuauauuauucagccauaaaaagaaauaaagggccaggcacaguggcucacaccuguaaucc

SEQ ID NO: 370498 - RNA, 63 nt, Human
uuucuuuccaguccaggagaucaucaacuaagagccaggcaccccuuuuaagucgauaagaaa

SEQ ID NO: 370499 - RNA, 63 nt, Human
uuugcaugagauagccuaauaaauggagguggggccaggcaugguggcucacacguguaaucc

SEQ ID NO: 370500 - RNA, 63 nt, Human
cccccaucacacucaccccuaagugggcugggagccaggcagggccagggcagcugggugggg

SEQ ID NO: 370501 - RNA, 63 nt, Human
ggucccuaugggcuuccgcacaugccgcgggcggccaggcaacgugcgugucucugccaugug

SEQ ID NO: 370502 - RNA, 63 nt, Human
ugccauguggcagaagugcucuuuguggcaguggccaggcagggagugucugcaguccuggug

SEQ ID NO: 370503 - RNA, 63 nt, Human
gcaggggcucugcuuccucagcccuagaggcgagccaggcaagguuggcgacugucauguggc

SEQ ID NO: 370504 - RNA, 63 nt, Human
cagccugcacaguagagugaggcugccucucccgccaggcauugggaucccauuuagaaacgg

SEQ ID NO: 370505 - RNA, 63 nt, Human
ccaccucuuugcuuaaaaaaaaaaaugucaauagccaggcauaguggcucacgccuguaaucc

SEQ ID NO: 370506 - RNA, 64 nt, Human; identical to SEQ ID NO: 116653

SEQ ID NO: 370507 - RNA, 64 nt, Human; identical to SEQ ID NO: 116654

SEQ ID NO: 370508 - RNA, 64 nt, Human; identical to SEQ ID NO: 116692

SEQ ID NO: 370509 - RNA, 63 nt, Human
agaauugguaucucauggcuggagagcugaucagccaggcacagaaucuccagaacaaccuag

SEQ ID NO: 370510 - RNA, 63 nt, Human
caguucuucacaauaaggcaaugguuuugagaggccaggcaaauaaucuuucucaccguagaa

SEQ ID NO: 370511 - RNA, 63 nt, Human
aaaccccgucucuacaaaaaaacacaaaaaauagccaggcaugguggcguguacauguggucu

SEQ ID NO: 370512 - RNA, 63 nt, Human
ucaauuccuuguucauuugaguguucauuauaugccaggcauugaccaguugcaauuuuaugg

SEQ ID NO: 370513 - RNA, 63 nt, Human
aaaacccugucuccacuaaaaauacaaaaauuagccaggcaugguggcgggcaccuguaaucc

SEQ ID NO: 370514 - RNA, 63 nt, Human
uucuuagcuuuugccuuuuaaauuuauacuucagccaggcauagugacugaugccuguaaucc

SEQ ID NO: 370515 - RNA, 63 nt, Human
gaaacagcuccuccccgacuagguggaaggcuggccaggcaccaagcaugugugugcacuugu

SEQ ID NO: 370516 - RNA, 63 nt, Human
gcaggugucagaaccuagggcugggcucucggggccaggcaggccagcccagcccacgccgag

SEQ ID NO: 370517 - RNA, 63 nt, Human
uggggaggccauagacccaaacaaguucuuugggccaggcauggccuaguaaguacaccaugc

SEQ ID NO: 370518 - RNA, 63 nt, Human
aaggaccugacagcaguaugaaaagauaaauaggccaggcaugguggcucacgccugugaucc

SEQ ID NO: 370519 - RNA, 63 nt, Human
ggugaaagcaaccaugcaaaagaaauuaauuuggccaggcacaguggcucaugccuguaaucc

SEQ ID NO: 370520 - RNA, 63 nt, Human
cuuuuccauucaauuuguuuauuaaacuccuaugccaggcauuguugaaaauacaaaauuaaa

SEQ ID NO: 370521 - RNA, 63 nt, Human
cucuacaaaacauaaaagauuuuuaaaaaauuagccaggcaugguggcacaugccuguggucu

SEQ ID NO: 370522 - RNA, 63 nt, Human
ugggcagcuaaaagcaucccugugagcaaaaaugccaggcagaaaacuggcagugcaccucuc

SEQ ID NO: 370523 - RNA, 63 nt, Human
gguccugugagcaaagugcagguuaugcaagucgccaggcaggaggccauuccaggaguggga

SEQ ID NO: 370524 - RNA, 63 nt, Human
aaaacuccaucucuauuaaaaauacaaaaauuagccaggcauaguggugcaugccuguagucc

SEQ ID NO: 370525 - RNA, 64 nt, Human; identical to SEQ ID NO: 116693

SEQ ID NO: 370526 - RNA, 64 nt, Human; identical to SEQ ID NO: 116694

SEQ ID NO: 370527 - RNA, 64 nt, Human; identical to SEQ ID NO: 116696

SEQ ID NO: 370528 - RNA, 63 nt, Human
ucaaugaguucuucucaaaaaauaauuaguuaggccaggcacaauggcucacaccuguaaugc

SEQ ID NO: 370529 - RNA, 63 nt, Human
aacauaagaauuuuuuauaaguagaaagaauuggccaggcaugguggcucaugccuguaaucc

SEQ ID NO: 370530 - RNA, 63 nt, Human
uuuagaagaaacacuucaaagggauacaucauggccaggcaugguggcucacaccuguaaucc

SEQ ID NO: 370531 - RNA, 63 nt, Human
ccaaagccgcggggacaccgggaagugcagcgggccaggcaggcugggugggagggaggaggg

SEQ ID NO: 370532 - RNA, 63 nt, Human
cucaggcaauuuuaaggauaaaaacuaacauuggccaggcacgguggcucacgccuguaaucc

SEQ ID NO: 370533 - RNA, 63 nt, Human
uaggaaguauugcagaagucaauacacaaaugugccaggcagaggugguuuucucuguuugac

SEQ ID NO: 370534 - RNA, 63 nt, Human
auggcucccgaguacaguaguaucugcuuaggugccaggcauguccuaggcucugggugcagu

SEQ ID NO: 370535 - RNA, 63 nt, Human
aguaaccccgucuuuacuaaaaauacaaaauuagccaggcaugguggcacaugcuuguaaucc

SEQ ID NO: 370536 - RNA, 63 nt, Human
uccuccucuagccccaagcucccagaagcuucugccaggcaccucagagcaccagcuccccug

SEQ ID NO: 370537 - RNA, 63 nt, Human
uggcacaaauggaugcauacaguucuguguacugccaggcaugugggugugggugcauguggg

SEQ ID NO: 370538 - RNA, 63 nt, Human
augucccccaccucauguuuucaccuuuucugggccaggcauagauuaaguaacugggaacgc

SEQ ID NO: 370539 - RNA, 63 nt, Human
agguagugaaggccgcuccaaauagugacuggggccaggcaggcggaaaagagaacagaagag

SEQ ID NO: 370540 - RNA, 63 nt, Human
ggaagauucagaauguccggucccugugguguugccaggcaagagacacgaagugccgagaca

SEQ ID NO: 370541 - RNA, 63 nt, Human
uaaugcucggugggagccgucagccugugaacugccaggcagcugcaguuagcacagaggaug

SEQ ID NO: 370542 - RNA, 63 nt, Human
ggagccuccuggggacuggaaaguaagucaucagccaggcaaaugacucaugcugaagagagu

SEQ ID NO: 370543 - RNA, 63 nt, Human
aucauuguaacacuugauggagugaaauuccacgccaggcacagaauuuuuuugacauagaua

SEQ ID NO: 370544 - RNA, 64 nt, Human; identical to SEQ ID NO: 116623

SEQ ID NO: 370545 - RNA, 64 nt, Human; identical to SEQ ID NO: 116624

SEQ ID NO: 370546 - RNA, 64 nt, Human; identical to SEQ ID NO: 116625

SEQ ID NO: 370547 - RNA, 63 nt, Human; identical to SEQ ID NO: 370524

SEQ ID NO: 370548 - RNA, 63 nt, Human
gaaugaaguagagagaaaauaaaagaaaaaccagccaggcacaguggcucacaccuguaaucc

SEQ ID NO: 370549 - RNA, 63 nt, Human
cuuucaaauccuucucuuuccuggguugggaaggccaggcagggacagagcaaaugacacuuc

SEQ ID NO: 370550 - RNA, 63 nt, Human
agggggucucugaaggcccuuggggcugacagggccaggcagccuccccagcugaggcaucau

SEQ ID NO: 370551 - RNA, 63 nt, Human
uuuauaaaagugaaauauccaguauuucagagggccaggcaagagcacuucagaugaggcagu

SEQ ID NO: 370552 - RNA, 63 nt, Human
aacaggugcuccccaaacacccugcugcuggcugccaggcaggcccucuggaagggaaggggc

SEQ ID NO: 370553 - RNA, 63 nt, Human
ggccucugcccucuacucgugccaggcccacuugccaggcaggagcccuccccaagccuucag

SEQ ID NO: 370554 - RNA, 63 nt, Human
cucuguguacucccuuaaaucaccccaaccuuggccaggcaugguggcucacaccuguaaucc

SEQ ID NO: 370555 - RNA, 63 nt, Human
uguuauaauuuagaguugacauaaaaauugauggccaggcaugguggcucacgccuguaaucc

SEQ ID NO: 370556 - RNA, 63 nt, Human
cugaagggaaugggggcccugcucaagaagggggccaggcagcuggaaucaggggagugcauc

SEQ ID NO: 370557 - RNA, 63 nt, Human
guauuuaugcuacuuaaauacaaaacuggacaggccaggcaugguggcucaugccuguaaucc

SEQ ID NO: 370558 - RNA, 52 nt, Human
ucggggaggggugcuccugaaggccaggcauggccaccacgugacgcuguuc

SEQ ID NO: 370559 - RNA, 63 nt, Human
gcaaaaccaucucuacuaaaaauagaaaaauuagccaggcacguuccaggcaccugugauccc

SEQ ID NO: 370560 - RNA, 63 nt, Human
gcgagacuucaucucagaaaauaaaaaauaggggccaggcacaguggcucauaccuguaaugc

SEQ ID NO: 370561 - RNA, 63 nt, Human
augucauauucaucugguaaauaucuacuguuugccaggcauuuaagaauauggcaaagaaca

SEQ ID NO: 370562 - RNA, 63 nt, Human
gcuuuuuuuuuuuuuuuuuuuuuuugggaguaagccaggcauuaaaagcaaccguuugaaucc

SEQ ID NO: 370563 - RNA, 64 nt, Human; identical to SEQ ID NO: 116700

SEQ ID NO: 370564 - RNA, 64 nt, Human; identical to SEQ ID NO: 116701

SEQ ID NO: 370565 - RNA, 64 nt, Human; identical to SEQ ID NO: 116702

SEQ ID NO: 370566 - RNA, 63 nt, Human
uuuguucuuucuucuucuuuuuuaauaccauaggccaggcaaccuugucaaaggaauugaugg

SEQ ID NO: 370567 - RNA, 63 nt, Human
aagcugaacgcacccgcugguuguggaccgucugccaggcaccacagugagcauuguguucuu

SEQ ID NO: 370568 - RNA, 63 nt, Human
ucaggccaaaagggcuguuggcuguaauccuacgccaggcacaaggcaucuuguugccuugcc

SEQ ID NO: 370569 - RNA, 63 nt, Human
ggcugacaaauauuuauugggcaccuacuaugugccaggcacuguguaggugcugaaaagugg

SEQ ID NO: 370570 - RNA, 63 nt, Human
cuaggaggaggggguaggugaugggggacgagggccaggcacccacauccccaauaaagccgc

SEQ ID NO: 370571 - RNA, 63 nt, Human
ggacucuccccuacugcaccccugggagaggaagccaggcaccgauagagcacccagccccac

SEQ ID NO: 370572 - RNA, 63 nt, Human
ggcugcaaggaugagcagagaacaaggacagaggccaggcacugaggcccuggagacagcugu

SEQ ID NO: 370573 - RNA, 63 nt, Human
auccuuccugugguugcuggagcugcuggcagggccaggcaaggccagagugcuaggggcagg

SEQ ID NO: 370574 - RNA, 63 nt, Human
gaaauaauggcuuuugaaaaucgcacaaagcaggccaggcacgguggcucacgccuguaaucc

SEQ ID NO: 370575 - RNA, 51 nt, Human
ugcugcuguguaccgacugaagccaggcagggucugggauccucagggcuc

SEQ ID NO: 370576 - RNA, 63 nt, Human
ucauugccaugaguguucggacaggcucugcgugccaggcaacagugggcagacaaagggcuc

SEQ ID NO: 370577 - RNA, 63 nt, Human
uuuacuaggcguuuguuauauaaaaauaccccggccaggcacgguggcucacgccuguaaucc

SEQ ID NO: 370578 - RNA, 63 nt, Human
uaucauccaaccuauacuuaaaaacauaugguggccaggcaugguggcucacgccuguaaugc

SEQ ID NO: 370579 - RNA, 63 nt, Human
uucaaacgcugaaaagaaucagcauuuagucuugccaggcacacccaauaaucagucaugugu

SEQ ID NO: 370580 - RNA, 63 nt, Human
acaaccaggauuugcucgaucucagcccagcaggccaggcagacacaccccgcugugccuuag

SEQ ID NO: 370581 - RNA, 63 nt, Human
gcugcuggggacuggggacugggcagagacugagccaggcaggaaggcagcagccuucagccu

SEQ ID NO: 370582 - RNA, 64 nt, Human; identical to SEQ ID NO: 116628

SEQ ID NO: 370583 - RNA, 64 nt, Human; identical to SEQ ID NO: 116629

SEQ ID NO: 370584 - RNA, 64 nt, Human; identical to SEQ ID NO: 116630

SEQ ID NO: 370585 - RNA, 63 nt, Human
cuagaggugcguauacacacccaaguacacgcagccaggcauucagggguguguuugccacau

SEQ ID NO: 370586 - RNA, 63 nt, Human
uguuugccacauggagcaucccuuccuggucuugccaggcaccugcacagagcgucuccagcc

SEQ ID NO: 370587 - RNA, 63 nt, Human
gauuucuaagacaccugugaagggucccacaaggccaggcacaguggcucuugucuguaaucc

SEQ ID NO: 370588 - RNA, 63 nt, Human
uggccaccccgcugccccauggcuggcuggguggccaggcaggaagugcccagcccgagaggc

SEQ ID NO: 370589 - RNA, 63 nt, Human
auuaaguaugucaacaguaaaaaauaaccaguggccaggcaugguggcucaugccuguaaucc

SEQ ID NO: 370590 - RNA, 63 nt, Human
aaaccccgucucuacuaaaaauauaaaaaauuagccaggcauaguggcgcaugccuguuguag

SEQ ID NO: 370591 - RNA, 63 nt, Human
uuacuggucacuuagaaaauuaaaagggauagggccaggcacaguggcuuaugccuguaauug

SEQ ID NO: 370592 - RNA, 63 nt, Human
ucccauaaccuaccuccacccucccccuagccagccaggcagcuucucugccugggaggggag

SEQ ID NO: 370593 - RNA, 63 nt, Human
guaucuauucaugauugaaaggaagcagucuuggccaggcacgguggcuuacaccuguaaccc

SEQ ID NO: 370594 - RNA, 63 nt, Human
aaaauagcucuuucagggggguugugaggccuggccaggcacccccuggagagaaguuucugg

SEQ ID NO: 370595 - RNA, 63 nt, Human
gaggggcuacccugggaagcugccguagcuucagccaggcaagaaagcuuccuucaaccugca

SEQ ID NO: 370596 - RNA, 63 nt, Human
aaaacccugucucuacuaaaaauauaaaaauuagccaggcaugauggcacaugcugguaauag

SEQ ID NO: 370597 - RNA, 63 nt, Human
caagcccucauaggcagggaggggguuuccgaggccaggcauccgccgccccgugucgcaucc

SEQ ID NO: 370598 - RNA, 63 nt, Human
uauuuugaauggcuauggcguuagguugaaauggccaggcacaaauuuagucuggucauuuug

SEQ ID NO: 370599 - RNA, 63 nt, Human
ggagggucccugauuccugaggauccuccccgagccaggcacgggggaccacagggcugccgu

SEQ ID NO: 370600 - RNA, 63 nt, Human
ugugcaaugcugaaguuagaaacaagguuaauagccaggcaugguggcucaugccuguaaucc

SEQ ID NO: 370601 - RNA, 64 nt, Human; identical to SEQ ID NO: 116631

SEQ ID NO: 370602 - RNA, 64 nt, Human; identical to SEQ ID NO: 116632

SEQ ID NO: 370603 - RNA, 64 nt, Human; identical to SEQ ID NO: 116634

SEQ ID NO: 370604 - RNA, 63 nt, Human
cagggcuccccugcccuacucauggagccagcagccaggcaaugguguggcccugcacuggcc

SEQ ID NO: 370605 - RNA, 63 nt, Human
gagaucccaucacuacaaaaauucaaaaaauuagccaggcaugguggugcacacuuguagucc

SEQ ID NO: 370606 - RNA, 63 nt, Human
ccaacaugacuguccuuuaaacuccaguggcuggccaggcacgguagcucacgccuguaaucc

SEQ ID NO: 370607 - RNA, 63 nt, Human
cccaugccaaugaaaucauuucugggcgucagcgccaggcaguuguauuuuuuuuuuuuuuuu

SEQ ID NO: 370608 - RNA, 63 nt, Human
cuauucuggcuccccagggcuuacgugggaagagccaggcauggcauagagguuguggcccuu

SEQ ID NO: 370609 - RNA, 63 nt, Human
gagcaaaacccugucucaaaaaaaugcagacuggccaggcacaguggcucacaccuguaaucc

SEQ ID NO: 370610 - RNA, 63 nt, Human
agacuggguaguuuauaaagaacagacauucaggccaggcacggugacucacgccuguaaucc

SEQ ID NO: 370611 - RNA, 63 nt, Human
gugcuuacagguaguuguuaaaaaaauuuuaaggccaggcaugguggcucgcucacaccuaua

SEQ ID NO: 370612 - RNA, 63 nt, Human
acagcuggagggaagaugcaggggugggaagcggccaggcagaaagagcuccaggcucuugug

SEQ ID NO: 370613 - RNA, 63 nt, Human
cuccaggccacgaaaugggaauuccagcacuaagccaggcaccgggcagaagcugggccuucc

SEQ ID NO: 370614 - RNA, 63 nt, Human
aucugucuugaccugcaggaauacacgggcggcgccaggcauuaccucacagcgggacuacac

SEQ ID NO: 370615 - RNA, 63 nt, Human
ugcuuccuuuucuugcccaugccgcuucuagaagccaggcacagguugccaagaggugacacg

SEQ ID NO: 370616 - RNA, 63 nt, Human
cccuggcccuggcauaucaccccgcacuguggggccaggcaccacuagccuggcucaaauauu

SEQ ID NO: 370617 - RNA, 63 nt, Human
gggcagggccaguuccucccaucuucaggcccagccaggcagggggcagucggcuccucaacu

SEQ ID NO: 370618 - RNA, 63 nt, Human
ucagguuaauucucaaaacacaaauuguugcuggccaggcauggugacucaugccuguaaucc

SEQ ID NO: 370619 - RNA, 63 nt, Human
gcuguccagcuaauuuaaaacuaggcauaaacagccaggcauggugacucaagccuguaaucc

SEQ ID NO: 370620 - RNA, 64 nt, Human; identical to SEQ ID NO: 116620

SEQ ID NO: 370621 - RNA, 64 nt, Human; identical to SEQ ID NO: 116621

SEQ ID NO: 370622 - RNA, 64 nt, Human; identical to SEQ ID NO: 116626

SEQ ID NO: 370623 - RNA, 63 nt, Human
ugccuaauugggaauuaaaaaguaaaauaauaggccaggcaugguggcucaugccuauaagca

SEQ ID NO: 370624 - RNA, 63 nt, Human
gagucaugugcauacauagaaucagugauggaggccaggcacgguaucucaugccuauaaucc

SEQ ID NO: 370625 - RNA, 63 nt, Human
gaacccauuacuuaauagaagucaguuacuccagccaggcagcucucccaauguuucuccucu

SEQ ID NO: 370626 - RNA, 63 nt, Human
cccgcaccccggccucagggcgcucagacggcggccaggcacagggcccgcagugcugggacc

SEQ ID NO: 370627 - RNA, 63 nt, Human
agugggcacuccugaagggucagagcggcaucugccaggcagccccucuggcuuccgcugagg

SEQ ID NO: 370628 - RNA, 63 nt, Human
cccucaugggggcuggggauccccaucagcacagccaggcagagaugauacccaccacacacc

SEQ ID NO: 370629 - RNA, 63 nt, Human
cgagagagaagggcccggagggugucuccccaagccaggcacaccugcacaaacccagagccg

SEQ ID NO: 370630 - RNA, 63 nt, Human
gggguucccuccuagcucucccagugaacuccugccaggcacacacagccccuauagcacuga

SEQ ID NO: 370631 - RNA, 63 nt, Human
cuucccacacaaauccgccccggugcacccccggccaggcaggccccggggcggccuaggcgc

SEQ ID NO: 370632 - RNA, 54 nt, Human
aguuucaugaagacuacuagcccugccaggcacaaugacucacgccuguaaucc

SEQ ID NO: 370633 - RNA, 63 nt, Human
gucucuacaaaaauaaaagauuuaaaaaaauuagccaggcacgguggcacacacuuguagccc

SEQ ID NO: 370634 - RNA, 63 nt, Human
ggccccuguccccaccccaccaccuuccagggugccaggcagggcuggccuccaggccugucc

SEQ ID NO: 370635 - RNA, 62 nt, Human
agcgccuccagugggagugacaguuggauacagccaggcaggguuucugcccugccgaacac

SEQ ID NO: 370636 - RNA, 63 nt, Human
uuuucccuauggggcccagaguuugccuuuucugccaggcagucaccaugcuucccuacccca

SEQ ID NO: 370637 - RNA, 63 nt, Human
gaaaucacauucacaaauuagaagucaaacauggccaggcacaguggcucacaccuguaaucu

SEQ ID NO: 370638 - RNA, 63 nt, Human
gacccugaaagagagaugaaauucaagcugugagccaggcaggagcucaguauggcaaagguu

SEQ ID NO: 370639 - RNA, 64 nt, Human; identical to SEQ ID NO: 116638

SEQ ID NO: 370640 - RNA, 64 nt, Human; identical to SEQ ID NO: 116639

SEQ ID NO: 370641 - RNA, 64 nt, Human; identical to SEQ ID NO: 116640

SEQ ID NO: 370642 - RNA, 63 nt, Human
gucacucuccaauaaagguucuggcacuucaaugccaggcaggucuccuaaaugaacagaaug

SEQ ID NO: 370643 - RNA, 63 nt, Human
uggaaaaggaggcccuuaugugaagugaaauaagccaggcacagaaagacaaacaucacaugu

SEQ ID NO: 370644 - RNA, 63 nt, Human
cuuggugcuucucuuucccagaggcuggucccagccaggcacacacaaaaggcagauucucgu

SEQ ID NO: 370645 - RNA, 63 nt, Human
gaaaccccgucuauacuaaaaauacaaaaaauagccaggcaugguggcgcacgccuguggucc

SEQ ID NO: 370646 - RNA, 63 nt, Human
ugagauccuaucucuauaaaaaaucaaaaauuagccaggcaugguggugcauaccuauagucc

SEQ ID NO: 370647 - RNA, 63 nt, Human
augcuaccacugguacuuccuuucucccugcgggccaggcacugcccuuuucaggaagcucuc

SEQ ID NO: 370648 - RNA, 63 nt, Human
ugguuugaacccugugagccugagacagagagggccaggcaccaaccacaaggcgggaaaguc

SEQ ID NO: 370649 - RNA, 63 nt, Human
gucacuauccuagaggcugcuuggcccagaagagccaggcacagagcugcaguugggcacgcc

SEQ ID NO: 370650 - RNA, 63 nt, Human
ggagcccccauccuaagcuccaagcaugucugggccaggcagaggugcuccucauccaugaca

SEQ ID NO: 370651 - RNA, 63 nt, Human
gguaaaguuggaagaauaaaguuaaccaagcaggccaggcacgguggcucacgccuauaaucc

SEQ ID NO: 370652 - RNA, 63 nt, Human
uagugagucagcaccuuggcccaggagcucugcgccaggcagagcugagggcccuguggaguc

SEQ ID NO: 370653 - RNA, 63 nt, Human
uccagaaaccaccucggggugacugagcggaaggccaggcagggccuuccuccucuuccuccu

SEQ ID NO: 370654 - RNA, 63 nt, Human
gcucccugcuggagccugggacccauggcacaggccaggcagcccggaggcuggguggggccu

SEQ ID NO: 370655 - RNA, 63 nt, Human
cugcccccuacuggugucuggggguugggggcagccaggcacagccggcucacggaggggcca

SEQ ID NO: 370656 - RNA, 63 nt, Human
ccuaauccucacccuugcugcuccugaugcaaagccaggcacaacaagggaaauccaugucca

SEQ ID NO: 370657 - RNA, 63 nt, Human
uuagccaguugagccagcgacaacagcaccagagccaggcagucacuguuccuccuccugguu

SEQ ID NO: 370658 - RNA, 64 nt, Human; identical to SEQ ID NO: 116614

SEQ ID NO: 370659 - RNA, 64 nt, Human; identical to SEQ ID NO: 116615

SEQ ID NO: 370660 - RNA, 64 nt, Human; identical to SEQ ID NO: 116760

SEQ ID NO: 370661 - RNA, 63 nt, Human
acgggcugagcggauaggggcggcccggagccagccaggcaguuuuauugaaaucuuuuuaaa

SEQ ID NO: 370662 - RNA, 63 nt, Human
agggcagagagagacuggacuugggaucagcaggccaggcaggucuuguccugguccuggcca

SEQ ID NO: 370663 - RNA, 63 nt, Human
caccucucuggaaggccccuucccuggcagguggccaggcaggcgggggcugcucagccucau

SEQ ID NO: 370664 - RNA, 63 nt, Human
acacagagagcugcccugccuaggagcacccaagccaggcagggggucuggcagcacggcguc

SEQ ID NO: 370665 - RNA, 63 nt, Human
caaaacccugucucuacuaaaaauauaaaaucagccaggcaugguggcgcacaccuauaaucu

SEQ ID NO: 370666 - RNA, 63 nt, Human
gugaauauucuccucugaaccacuagagggcaggccaggcaggccaggcgggcccgugcagcu

SEQ ID NO: 370667 - RNA, 63 nt, Human
gaaacugugucucuacuaaaaauacaaaaauuagccaggcaugguggcacgugccuguaaucc

SEQ ID NO: 370668 - RNA, 63 nt, Human
ccccucucucagcgcucaucucacgcagaggaugccaggcagggugaggaugggggaguagau

SEQ ID NO: 370669 - RNA, 63 nt, Human
cagguggcaggaauggagaagcugacccugcuggccaggcaaggggccagaccccccccaacc

SEQ ID NO: 370670 - RNA, 63 nt, Human
ggaucccgcccuguggcccguggaugcucagcggccaggcacugaccugccaugccucgccug

SEQ ID NO: 370671 - RNA, 63 nt, Human
gcacaauugucucuacaaaaaauacaaaaauuagccaggcaugguggcaugcaccuguagucc

SEQ ID NO: 370672 - RNA, 63 nt, Human
aagaaugagguggagcuguaaauacuguacaaagccaggcaugguggcauaugccuguagucc

SEQ ID NO: 370673 - RNA, 63 nt, Human
uaauugcaagcacucauuucacucucccugugugccaggcaauagcauaagcacuggaagaau

SEQ ID NO: 370674 - RNA, 63 nt, Human
uuggggucccucagguuccuuuuucaaaaaccagccaggcagagguuuuaaugucuguuuauu

SEQ ID NO: 370675 - RNA, 63 nt, Human
agaaacccugucucuauuaaaaauacaaaaguagccaggcaugguggcgcaugcguguaaucc

SEQ ID NO: 370676 - RNA, 61 nt, Human
gcagauccucaccagggugaaugacagaguugccaggcacuuugagucucagucugaugac

SEQ ID NO: 370677 - RNA, 64 nt, Human; identical to SEQ ID NO: 116643

SEQ ID NO: 370678 - RNA, 64 nt, Human; identical to SEQ ID NO: 116644

SEQ ID NO: 370679 - RNA, 64 nt, Human; identical to SEQ ID NO: 116645

SEQ ID NO: 370680 - RNA, 63 nt, Human
agcauccccuccucagagaucaauuucagcagggccaggcaggaccuggguuuccgcacuuuu

SEQ ID NO: 370681 - RNA, 63 nt, Human
accccgucucuuacuaaaaauacaaaaaaauuagccaggcaugguggugggcgccuguagucc

SEQ ID NO: 370682 - RNA, 63 nt, Human
gacagagcaagacccuguuuaaaaaagaaaaaggccaggcacgguggcucaugccuguaaucc

SEQ ID NO: 370683 - RNA, 63 nt, Human
ucucuacuuacaaaaaaaaaaaaaaaaaaaaaagccaggcaugguggugggcuacucuggagg

SEQ ID NO: 370684 - RNA, 63 nt, Human
ggcuuuuaugacauuaaaaauuguugaacaacggccaggcacaguggcucaugccuguaaucc

SEQ ID NO: 370685 - RNA, 63 nt, Human
auuuugugaggccaggauuacccuaauaccaaagccaggcaaaaacauuacaagaaaggaaaa

SEQ ID NO: 370686 - RNA, 63 nt, Human
cccuccuuagucuccuagaaaaccuuccugugggccaggcaugccuggguccugccucugccu

SEQ ID NO: 370687 - RNA, 63 nt, Human
uuuuccuguuacaggagagaaagaauugcaaaugccaggcaucuguccacuuuagcccuccuc

SEQ ID NO: 370688 - RNA, 63 nt, Human
gcaugggagggaccccuugcuauggccccuuuagccaggcagugggaucuaccuguggcccgg

SEQ ID NO: 370689 - RNA, 63 nt, Human
gaaaccccgucucuacagagaauacaaaaauuagccaggcaugguggcccaugccuguaguac

SEQ ID NO: 370690 - RNA, 63 nt, Human
ccugagccagggucuccagaaagccccacccaggccaggcauguggcagggguuagagcagga

SEQ ID NO: 370691 - RNA, 63 nt, Human
acauuucuccaaucagagcauguggaccuuggagccaggcaugcucagagaagccuagguggg

SEQ ID NO: 370692 - RNA, 60 nt, Human
ugcagagaggcccugccugaaacccacagugccaggcaacccuucagaaaggcuuugcuc

SEQ ID NO: 370693 - RNA, 63 nt, Human
cagcuuuaccaugaaccugcuccacugagaaaagccaggcagaucgauuuuuagaucaauuuu

SEQ ID NO: 370694 - RNA, 63 nt, Human
gugaauaaauucacuucagaaucucaagucaaggccaggcacggcggcucacgccuguaaucc

SEQ ID NO: 370695 - RNA, 63 nt, Human
cagccucccugggcugggcuggcucuggauggagccaggcaucggcaagggcucucgggagcu

SEQ ID NO: 370696 - RNA, 64 nt, Human; identical to SEQ ID NO: 116635

SEQ ID NO: 370697 - RNA, 64 nt, Human; identical to SEQ ID NO: 116636

SEQ ID NO: 370698 - RNA, 64 nt, Human; identical to SEQ ID NO: 116646

SEQ ID NO: 370699 - RNA, 63 nt, Human
agggucuuaggugauacgggagagaaagaacgugccaggcaggaggcccccugaagucugugu

SEQ ID NO: 370700 - RNA, 51 nt, Human
cgcagggggccgagggcugaggccaggcaaucacgggcuaugcccggggag

SEQ ID NO: 370701 - RNA, 63 nt, Human
accccuggaccccagccucaaauccaggacccugccaggcacaggcagggcaggaccagccca

SEQ ID NO: 370702 - RNA, 63 nt, Human
uugaaagacagauuuccauguaaaugugcacaagccaggcauggcuuaaaauaucaugcaguc

SEQ ID NO: 370703 - RNA, 63 nt, Human
cacgccuguaaucccagcacugugggaggccaagccaggcaaaucgcuugaggcugaggaguu

SEQ ID NO: 370704 - RNA, 63 nt, Human
gagacggcagugcaauccugaugagugaugucugccaggcaccguaaguuugauuagugaugu

SEQ ID NO: 370705 - RNA, 63 nt, Human
aucaauaauaauaauauugaccauuuccuaucugccaggcauuuuucuaagcacaugaagaaa

SEQ ID NO: 370706 - RNA, 63 nt, Human
aaacccugucucuacuaaaaauacaaaaaauuagccaggcaugguggugcgcaccuguaguuc

SEQ ID NO: 370707 - RNA, 63 nt, Human
guugggcgacuucaagggccuggcauggcagaggccaggcagccguggccgaguggacagcgu

SEQ ID NO: 370708 - RNA, 63 nt, Human
cacaccucccugguugaaucaggaauggagggagccaggcagggcccuaccugggguccugug

SEQ ID NO: 370709 - RNA, 63 nt, Human
gccuuccccccuaccgccucaccucacaggagggccaggcauguauuccucagaggcgaaacu

SEQ ID NO: 370710 - RNA, 63 nt, Human
cccaggccuccucugaagcagggaccagagggagccaggcagcuguguacagugagaagggau

SEQ ID NO: 370711 - RNA, 63 nt, Human
agggucccuaagggaggacacucagggccuguggccaggcagggcggaggccugcugugcugu

SEQ ID NO: 370712 - RNA, 63 nt, Human
gggcuauguucuggaacccagugaaucuugggggccaggcacugugcuaggcaccagcagggg

SEQ ID NO: 370713 - RNA, 63 nt, Human
guggggaggagaagguuguaggcauggaagagagccaggcagccccgaaagaagagccugggc

SEQ ID NO: 370714 - RNA, 63 nt, Human
guccucucccaguucauuccuggaaccagccaggccaggcaaccaguggcccccaaaggcagg

SEQ ID NO: 370715 - RNA, 64 nt, Human; identical to SEQ ID NO: 116608

SEQ ID NO: 370716 - RNA, 64 nt, Human; identical to SEQ ID NO: 116609

SEQ ID NO: 370717 - RNA, 64 nt, Human; identical to SEQ ID NO: 116648

SEQ ID NO: 370718 - RNA, 63 nt, Human
cgagacucccaagcggcucugugcagaagagcugccaggcagugucuuagaugugagacggag

SEQ ID NO: 370719 - RNA, 63 nt, Human
cccgucauggaagaggcggccaugcuguggccagccaggcaggaagagaccuuuccucugacg

SEQ ID NO: 370720 - RNA, 54 nt, Human
ugcgggacguggacaucugagggcgccaggcaggcgggcgccaccgccacccgc

SEQ ID NO: 370721 - RNA, 63 nt, Human
uggaaggagcaugccuggguuagugggccaggggccaggcagcugggggccuuuggggaccag

SEQ ID NO: 370722 - RNA, 63 nt, Human
cagaccauuucuuccccagguccugaaguuugagccaggcaaguggcagugccccuagugggc

SEQ ID NO: 370723 - RNA, 63 nt, Human
ugugaggacacaccugggucugugccugagauugccaggcaagauuaaggaaaguuuucaugu

SEQ ID NO: 370724 - RNA, 63 nt, Human
gagagccaggagcauuuaaaaaucagcaucugggccaggcaagauggcucacgccugugaucc

SEQ ID NO: 370725 - RNA, 63 nt, Human
aaaccccgucucuacugaaaauacaaaaaauuagccaggcaugguggcaggugccuguagucc

SEQ ID NO: 370726 - RNA, 63 nt, Human
ccagccccuccccccucccccaggugcuagagagccaggcagagcuggggccacagcgugucu

SEQ ID NO: 370727 - RNA, 63 nt, Human
cagccagcugggcagggccgguguggggcuggagccaggcagcuagcccaggacggagcaagg

SEQ ID NO: 370728 - RNA, 63 nt, Human
ugcagaugcucccugggcgcuacccugcagggugccaggcaggaguggucucagaacgugcgc

SEQ ID NO: 370729 - RNA, 63 nt, Human
ucugauuucuggcuuugcaggacucuuaccauggccaggcauuccugcccagccuuuaccucc

SEQ ID NO: 370730 - RNA, 63 nt, Human
acaccagaacccuaucaagucaaaagagcuggggccaggcagcugaagucacagguuucagag

SEQ ID NO: 370731 - RNA, 55 nt, Human
aucuuggcucaguauguuaggaggggccaggcagcggggcagggacagggagccg

SEQ ID NO: 370732 - RNA, 63 nt, Human
aggcugcuaaccuggaaagcaggauguaguucugccaggcaacuuuuaaagcucaugcauuuc

SEQ ID NO: 370733 - RNA, 63 nt, Human
gaugccagcaguuccugcuccucugucagggaagccaggcagagcccacagagcaugguccau

SEQ ID NO: 370734 - RNA, 64 nt, Human; identical to SEQ ID NO: 116649

SEQ ID NO: 370735 - RNA, 64 nt, Human; identical to SEQ ID NO: 116650

SEQ ID NO: 370736 - RNA, 64 nt, Human; identical to SEQ ID NO: 116652

SEQ ID NO: 370737 - RNA, 63 nt, Human
uuaaugugaauagaggaacaaguggguaucucugccaggcaccccacuuucuccuaguaacau

SEQ ID NO: 370738 - RNA, 63 nt, Human
aguaccugcagugacccugcccccaugaccuuggccaggcaggaugauuccagagcccguacu

SEQ ID NO: 370739 - RNA, 63 nt, Human
gaggacuauacagagaaggcagguuuugugaaggccaggcaggguuggaggccggggguguga

SEQ ID NO: 370740 - RNA, 63 nt, Human
cccccuuucccugcccuccagagacugauccuagccaggcaccuuaggaguauagggaggccc

SEQ ID NO: 370741 - RNA, 63 nt, Human
ccggggcugacugucccucucagcucugcgccugccaggcagggcacgugcucacagcccugg

SEQ ID NO: 370742 - RNA, 63 nt, Human
cugaggauugagcuguguggggucagcugugcugccaggcacauguacguugccucauuucau

SEQ ID NO: 370743 - RNA, 63 nt, Human
agguuugcaagcucccugccccagggagcucacgccaggcaggccagugggccuaagccagaa

SEQ ID NO: 370744 - RNA, 63 nt, Human
gggccuacaguugguauuaccucugugcucagugccaggcaaaacacuagcucaaaggagagu

SEQ ID NO: 370745 - RNA, 63 nt, Human
gaaccaagucacagggcacuucccagccacauugccaggcaacaggacuaaacuaccuccaaa

SEQ ID NO: 370746 - RNA, 63 nt, Human
uuuauuuagcauucccuugcuagaagcccgugugccaggcacugugcuaggcguggugggcag

SEQ ID NO: 370747 - RNA, 63 nt, Human
cacuccauggagcucugcuugugaauuccagaugccaggcaugggaggcggcuugugcuuugc

SEQ ID NO: 370748 - RNA, 63 nt, Human
ugauugugugaccaaggcagcaucuagcagaaagccaggcauggaguaggugaucgauacuug

SEQ ID NO: 370749 - RNA, 63 nt, Human
gaaaccccgucucuacuaaaaauacaaaaauuagccaggcaugguggcauuugccuguaaucc

SEQ ID NO: 370750 - RNA, 63 nt, Human
ccacaggaggcaagcaagcucucuugccgaggagccaggcaacuucaguccugggagacccau

SEQ ID NO: 370751 - RNA, 63 nt, Human
gaggggcaauacaacagggucaagggugcagaggccaggcagagugggugcagagugggggau

SEQ ID NO: 370752 - RNA, 63 nt, Human
auucagcaaccauuuauugagcaucuauuaugugccaggcacugugccgggcacuggggauau

SEQ ID NO: 370753 - RNA, 64 nt, Human; identical to SEQ ID NO: 116706

SEQ ID NO: 370754 - RNA, 64 nt, Human; identical to SEQ ID NO: 116707

SEQ ID NO: 370755 - RNA, 64 nt, Human; identical to SEQ ID NO: 116708

SEQ ID NO: 370756 - RNA, 63 nt, Human
cucccuucguggggacaaaagugacaauuguaggccaggcacaguggcucacgccuguaaucc

SEQ ID NO: 370757 - RNA, 63 nt, Human
cuuaauaugucaaggaagguagccgggcauggugccaggcaccuguaggaaaauccagcaggu

SEQ ID NO: 370758 - RNA, 63 nt, Human
ggcucucauugccaauauggaacagagcccagggccaggcagacuggggcagugacuggaaaa

SEQ ID NO: 370759 - RNA, 58 nt, Human
agacauguagccccauuugaggcacgaggccaggcagaucccacuugcagccucccca

SEQ ID NO: 370760 - RNA, 63 nt, Human
ugugccuauuugaaugacaaaggugccaguagugccaggcacuacacagagaggaaguggauu

SEQ ID NO: 370761 - RNA, 63 nt, Human
gucuugaaguucucauuccuacaucucaagcuagccaggcagucuccucucuaucagaagaaa

SEQ ID NO: 370762 - RNA, 63 nt, Human
gucuuccccuucacucccagcccagagcccccggccaggcacccccagggaaggcucuggugg

SEQ ID NO: 370763 - RNA, 63 nt, Human
cuuugaaaaaacuuuuaaaagacuuuuuuuuaggccaggcauaauggguuaucccuguaauuc

SEQ ID NO: 370764 - RNA, 63 nt, Human
ccaaaccacagugggagcuggggcagggggagagccaggcaaucgggggccaaagaugggggu

SEQ ID NO: 370765 - RNA, 63 nt, Human
cccucccaggggccuguaacuaagucggguccugccaggcagggggccuguguucugugcccc

SEQ ID NO: 370766 - RNA, 63 nt, Human
ugauuacuaucauaauucagcacuuaacuaugagccaggcaucauacuaaacuucaccuacau

SEQ ID NO: 370767 - RNA, 63 nt, Human
cgggaugaggaugaaaaugucaacaucuauagggccaggcacagggaaccaagaccugcuuga

SEQ ID NO: 370768 - RNA, 63 nt, Human
uaagugugcaaguuauuaaaaaaaaaaaauugggccaggcacgguggcucacgccuguaaucc

SEQ ID NO: 370769 - RNA, 63 nt, Human
aaugggaagaaccaguuuuauccaucuuaaaacgccaggcaccucuucacaggugguaaacau

SEQ ID NO: 370770 - RNA, 63 nt, Human
ggcaguacaguggcuucaagaguccuuacugaagccaggcaccguggcucacgucuguaaucc

SEQ ID NO: 370771 - RNA, 63 nt, Human
uucuugcacaccgcuuucuguuuuggcaguucugccaggcaagcccuguguuccuugggacug

SEQ ID NO: 370772 - RNA, 64 nt, Human; identical to SEQ ID NO: 116574

SEQ ID NO: 370773 - RNA, 64 nt, Human; identical to SEQ ID NO: 116575

SEQ ID NO: 370774 - RNA, 64 nt, Human; identical to SEQ ID NO: 116576

SEQ ID NO: 370775 - RNA, 63 nt, Human
cgauugggaccagcugggccccaccacggccacgccaggcaaagcgccagcagcccugcacuc

SEQ ID NO: 370776 - RNA, 63 nt, Human
aagacccugucccuauaaaaaauacaaaaauuagccaggcaugguggcgugcgccugcagucc

SEQ ID NO: 370777 - RNA, 63 nt, Human
auucaacaaauauguauugaacaccuccuauaugccaggcacugugcuaggugcugggaauac

SEQ ID NO: 370778 - RNA, 63 nt, Human
cagcaccccuaagucaagucacggguuuccauagccaggcaguugguauguacaauucaguuc

SEQ ID NO: 370779 - RNA, 63 nt, Human
ggcuguggcccuucuguggaugugggagcccaggccaggcagggagcagaugcagggacucug

SEQ ID NO: 370780 - RNA, 63 nt, Human
agaccccaucucuacaaaaaaauuaaaaaauuagccaggcaugguggcacaugccuacuccca

SEQ ID NO: 370781 - RNA, 63 nt, Human
accugacgcugagagagaaccaucauaccccaagccaggcacuagauuuuggagggggcgacu

SEQ ID NO: 370782 - RNA, 63 nt, Human
aauuucucccaucuuggccucuuccagaaaccggccaggcaaggaaagaggccggucaccaga

SEQ ID NO: 370783 - RNA, 63 nt, Human
gagacccacauccucucacucacuucuccacccgccaggcagcugccacaggccuaaggcuga

SEQ ID NO: 370784 - RNA, 63 nt, Human
guguauucagcaaguaacuaaagguugguguuggccaggcaugguggcucaugccuguaaucc

SEQ ID NO: 370785 - RNA, 63 nt, Human
ugaaacccuaucucuacuaaaaauauagaauuagccaggcaugguagcgcacgccuguaaucc

SEQ ID NO: 370786 - RNA, 63 nt, Human
gccuugaagggugugcaggaguucgccagcaaagccaggcaggccaagacuugaguuggcaac

SEQ ID NO: 370787 - RNA, 63 nt, Human
cuccuuugugcuggaaccugggcuccuccagcugccaggcaggagucgguaggacugugccug

SEQ ID NO: 370788 - RNA, 63 nt, Human
ggccacgagcuuuggccuuggucuaccugccaggccaggcaaagcgccuuuacacaggccucg

SEQ ID NO: 370789 - RNA, 63 nt, Human
aaccuugagcuaauguuaaaaaucaagcucuuggccaggcaugguggcucaugccuguaauuc

SEQ ID NO: 370790 - RNA, 63 nt, Human
cacagccuuccuccccaagcacguggucucugcgccaggcagcccgggcgucagagcucaagc

SEQ ID NO: 370791 - RNA, 64 nt, Human; identical to SEQ ID NO: 116579

SEQ ID NO: 370792 - RNA, 64 nt, Human; identical to SEQ ID NO: 116580

SEQ ID NO: 370793 - RNA, 64 nt, Human; identical to SEQ ID NO: 116581

SEQ ID NO: 370794 - RNA, 63 nt, Human
auggccccgaaccaaggacugccgcgccuccuggccaggcagggcgccugggagaaccccuac

SEQ ID NO: 370795 - RNA, 63 nt, Human
aauugaaugcagucucccugcagggcagauuaugccaggcacuuuacauuuguugaucccauu

SEQ ID NO: 370796 - RNA, 63 nt, Human
gacuaugaaaagcugaguuagugcgcccgggacgccaggcaagcagcuuuuacaguuuggcau

SEQ ID NO: 370797 - RNA, 56 nt, Human
gccagccuguguacguguagaugggggccaggcacccccaccacucgcugccuccc

SEQ ID NO: 370798 - RNA, 63 nt, Human
aacaaaauccuugccuucaaacgaaauggcucggccaggcacggaggcucgugcauguaaucc

SEQ ID NO: 370799 - RNA, 63 nt, Human
cucuguccuuuccucaccaacuaacaugugccagccaggcagagucuugugcuguucccagaa

SEQ ID NO: 370800 - RNA, 63 nt, Human
cgugaaaaggggacagcaguuuucccaguuuuggccaggcagucaagccuuuaacagcucaug

SEQ ID NO: 370801 - RNA, 63 nt, Human
uguguugugggcuuugguucggcuuuaucaggggccaggcauauggguucuagaguaccuacc

SEQ ID NO: 370802 - RNA, 63 nt, Human
gcaaggaaacuccagcuggcuaugccggccugugccaggcacacuacaaagaguaucuuguga

SEQ ID NO: 370803 - RNA, 63 nt, Human
gggagacccagucucuacaaaaaaauuuaaaaagccaggcauugguggugugugccuauaguc

SEQ ID NO: 370804 - RNA, 63 nt, Human
aaagaaguaaguuuauccaaaucuugaauuucugccaggcaugguagcucaugccuguaaccc

SEQ ID NO: 370805 - RNA, 63 nt, Human
ggcuccucucagaugggcagcagcuuggagcaggccaggcagggccugggccauuggaggggc

SEQ ID NO: 370806 - RNA, 63 nt, Human
ucuauugaauggcauggcccagacccucggagggccaggcaacaggcuagcaaggcccacagg

SEQ ID NO: 370807 - RNA, 63 nt, Human
acuugggauauuuuuuacuucacauugaauauagccaggcacccaagaagucugauggccacc

SEQ ID NO: 370808 - RNA, 63 nt, Human
uugcaggugcccccuccaggccugacuggcuccgccaggcacuaaccugccauaacccuuugu

SEQ ID NO: 370809 - RNA, 63 nt, Human
cuaaccugccauaacccuuugugcuggccugcggccaggcagaggaagagaggucgacugugg

SEQ ID NO: 370810 - RNA, 64 nt, Human; identical to SEQ ID NO: 116582

SEQ ID NO: 370811 - RNA, 64 nt, Human; identical to SEQ ID NO: 116583

SEQ ID NO: 370812 - RNA, 64 nt, Human; identical to SEQ ID NO: 116656

SEQ ID NO: 370813 - RNA, 63 nt, Human
auucacuggacaaguucucugcucccaugacgcgccaggcacaguucugcaaguauauuguga

SEQ ID NO: 370814 - RNA, 63 nt, Human
augacuagcacgcugagcucugcagggaccagugccaggcacugggggguggaagugugguga

SEQ ID NO: 370815 - RNA, 63 nt, Human
uuuaaauauacugggcuggacauuccaguuuuagccaggcauugguuaaaagaguuagauggg

SEQ ID NO: 370816 - RNA, 63 nt, Human
uauccugucucuacuaaaaauacaaaaaaauuagccaggcaugguggcacgugccuguaaucc

SEQ ID NO: 370817 - RNA, 63 nt, Human
gccaucacauaacuuauugaaugcuugccaugugccaggcacugugcugagugccauacauac

SEQ ID NO: 370818 - RNA, 63 nt, Human
ggagguauuccagcagagucuaggcagucgucugccaggcaugcuguggaagggauuucugua

SEQ ID NO: 370819 - RNA, 63 nt, Human
aggcccgucccacucaccuccccccuguggagcgccaggcagaggcuguucuggaaggcuucu

SEQ ID NO: 370820 - RNA, 63 nt, Human
uccaagccaaguuuucucaacagagagcaaagggccaggcaguaagguagaaauagagauaaa

SEQ ID NO: 370821 - RNA, 63 nt, Human
cccugguucucucucuuagcauccugccuuagagccaggcacacacugugcuuucuauuguac

SEQ ID NO: 370822 - RNA, 63 nt, Human
cucuugcacacccuuuucccauucaauuugugagccaggcaggguagggauuagugucccccu

SEQ ID NO: 370823 - RNA, 63 nt, Human
cacaccacugccaggggucagccucgcacccaggccaggcagaagcugugcucugaagcuagg

SEQ ID NO: 370824 - RNA, 63 nt, Human
uaaugaugguggcccagcugugcccagaggacagccaggcaggcccugggagggaguuuagaa

SEQ ID NO: 370825 - RNA, 63 nt, Human
ccacccucaaccgcggccccuguaggccaaggcgccaggcaggacgacagcagcagcagcgcg

SEQ ID NO: 370826 - RNA, 63 nt, Human
auggggaaacguccucgugagaugagagccugagccaggcagcagagcgcucgcugcugugua

SEQ ID NO: 370827 - RNA, 63 nt, Human
acccugcugccacagcuuugcaugcugagcugugccaggcaggauccagccaaggccucuccc

SEQ ID NO: 370828 - RNA, 63 nt, Human
ggccggagucgaaugaucagccaggaagaguuugccaggcagcuacagcucucugauccucag

SEQ ID NO: 370829 - RNA, 64 nt, Human; identical to SEQ ID NO: 116585

SEQ ID NO: 370830 - RNA, 64 nt, Human; identical to SEQ ID NO: 116586

SEQ ID NO: 370831 - RNA, 64 nt, Human; identical to SEQ ID NO: 116587

SEQ ID NO: 370832 - RNA, 63 nt, Human
uuggugaaguaaggaaggagaaagugguuacuagccaggcauaccccuagcauaagucugggc

SEQ ID NO: 370833 - RNA, 63 nt, Human
cuggaaauguucaacuguaguuuuauuaaggaagccaggcaugcaacagauuuugugcaugaa

SEQ ID NO: 370834 - RNA, 63 nt, Human
uuguccuuaacauuuaccucuuguauaguaucugccaggcaguuuuuucuuaaacuacugaga

SEQ ID NO: 370835 - RNA, 63 nt, Human
caugcugucuuuagaguuaggugccugccuaaagccaggcaccaccacaccuggcuuuagagu

SEQ ID NO: 370836 - RNA, 63 nt, Human
uccuuacuuaaagauugaaaagauaacauguaggccaggcaggucacugcacaacuaaagcaa

SEQ ID NO: 370837 - RNA, 63 nt, Human
aacccugucucuacuaaaaauacaaaaaaauuagccaggcaugguggcaagcgccuguagucc

SEQ ID NO: 370838 - RNA, 63 nt, Human
augaagaaagacucugagauguggagacugauggccaggcaagugggaccaggauacuggacg

SEQ ID NO: 370839 - RNA, 63 nt, Human
cuccugggcccucacucugccuaggggagcugggccaggcacuagccuuugcccagggaggug

SEQ ID NO: 370840 - RNA, 63 nt, Human
gaggguggucagccagagcucaugggacagcuagccaggcaugguuggauaggggcagggcac

SEQ ID NO: 370841 - RNA, 63 nt, Human
gaccuugccaggagaggagaaggaugccugggugccaggcaagacaagccccucagcaggaga

SEQ ID NO: 370842 - RNA, 63 nt, Human
aucucccccaacacaugugcccccaaaaagugagccaggcaccucuguuuccugcuguuuauu

SEQ ID NO: 370843 - RNA, 63 nt, Human
ggaugggcugccugcacagccccuggagagggggccaggcacacccucagaggagcugcaagc

SEQ ID NO: 370844 - RNA, 63 nt, Human
cucccaagguucaaauacuuuuuauuagacacggccaggcagagaagaccaugggaguucccg

SEQ ID NO: 370845 - RNA, 63 nt, Human
ccugucccugacuauugaguccuguuguuguaagccaggcauggagggcuccugcccuucugc

SEQ ID NO: 370846 - RNA, 63 nt, Human
cccagggcuggauccaccccugcggagcccugggccaggcaggugucugcugcucaccuggcu

SEQ ID NO: 370847 - RNA, 63 nt, Human
ccacccgcagccuaggcaggcucugcaugcuaugccaggcaugugcagucuggacuuccaccu

SEQ ID NO: 370848 - RNA, 64 nt, Human; identical to SEQ ID NO: 116591

SEQ ID NO: 370849 - RNA, 64 nt, Human; identical to SEQ ID NO: 116592

SEQ ID NO: 370850 - RNA, 64 nt, Human; identical to SEQ ID NO: 116593

SEQ ID NO: 370851 - RNA, 63 nt, Human
ccccuucucuacguauaaaaaaauacaaaauuagccaggcaugguggugcaugccuguaacuc

SEQ ID NO: 370852 - RNA, 63 nt, Human
cuugacccuccucucuccuggcuugggucaccagccaggcaccugugacacgagugcugcucu

SEQ ID NO: 370853 - RNA, 63 nt, Human
caucacuaacauauccauuaaaaguaucaacuggccaggcaggguggcucacgccuguacucc

SEQ ID NO: 370854 - RNA, 63 nt, Human
ccauaacagugcagugauagucagcugguccaggccaggcaaggggcugguccaugaugucau

SEQ ID NO: 370855 - RNA, 63 nt, Human
aaaacccugucucuacuaaaaauacaaaaauuagccaggcaugauggugcaugccuuuaaacc

SEQ ID NO: 370856 - RNA, 63 nt, Human
ggggcugacuuugagaucuuuguucccugaggugccaggcaggcaacuuuagcacaugaugaa

SEQ ID NO: 370857 - RNA, 63 nt, Human
aggagacaccuugaucagcgucccaguuucacagccaggcaaaccgacacagggcuuggaagg

SEQ ID NO: 370858 - RNA, 63 nt, Human
acccaaacccccugcagcccaggccagucagacgccaggcaccacagccuccaaaaauggcag

SEQ ID NO: 370859 - RNA, 63 nt, Human
augagaaaaauaaaaauaaaaagagaauaauaggccaggcacuguggcucaugccccuaaucc

SEQ ID NO: 370860 - RNA, 63 nt, Human
gggaaauggucauuugcugagcgccuccuaguugccaggcacuggagggcgcaucaaagaaga

SEQ ID NO: 370861 - RNA, 63 nt, Human
cgugucucuggaauuuuuuuuuuuuuuuaauuagccaggcacaguggcaugcgccugugaucc

SEQ ID NO: 370862 - RNA, 63 nt, Human
cugucccguucagucugaaugcugccacaaccagccaggcagguccacagagagggagagcag

SEQ ID NO: 370863 - RNA, 63 nt, Human
ggcucuggcagaaauagucgaguuguauugccagccaggcaggcacauggcccaggcagcugu

SEQ ID NO: 370864 - RNA, 63 nt, Human
ugaaccuagaaaauacugaucuaaaugcaagaagccaggcacaaaaggccacauaguauaugu

SEQ ID NO: 370865 - RNA, 63 nt, Human
aagagccagggggucaggaaauauggccuaucugccaggcaggguggaugaagucaugaaugu

SEQ ID NO: 370866 - RNA, 63 nt, Human
caggcgaggcccuuggcgggcacgggugucacggccaggcagaugaccucguacucaggagcc

SEQ ID NO: 370867 - RNA, 64 nt, Human; identical to SEQ ID NO: 116553

SEQ ID NO: 370868 - RNA, 64 nt, Human; identical to SEQ ID NO: 116554

SEQ ID NO: 370869 - RNA, 64 nt, Human; identical to SEQ ID NO: 116596

SEQ ID NO: 370870 - RNA, 63 nt, Human
cgaggaagggcugagguggggccggcagggggcgccaggcagccgugaucacaggugacgacc

SEQ ID NO: 370871 - RNA, 63 nt, Human
agcgucugcucacuggcucuggggccucgaggugccaggcagcaucaggcccacuggguugcc

SEQ ID NO: 370872 - RNA, 63 nt, Human
ccgugagcguccuuccuccuuccucuccgggcugccaggcagccagguaaggccuggugaggc

SEQ ID NO: 370873 - RNA, 63 nt, Human
ggccuugggccggugcugggggcacagcugucugccaggcacucucaucaccccagaggccuu

SEQ ID NO: 370874 - RNA, 63 nt, Human
caguauuacuuucugccgcugucaaggccgagggccaggcagaauggcugcacguagguuccc

SEQ ID NO: 370875 - RNA, 63 nt, Human
gcuauggaaaccacuggguucuggaacguuccagccaggcagugguuguuccucauagguagg

SEQ ID NO: 370876 - RNA, 63 nt, Human
gaaacuccgucucuacuaaaaauacaaaaauuagccaggcaugguggcaggcgccuguaaucc

SEQ ID NO: 370877 - RNA, 63 nt, Human
uuuuaaaagcuaguuguugaccagcuacccugagccaggcaccacccugaaggagcuucuuuu

SEQ ID NO: 370878 - RNA, 63 nt, Human
acaccccauuucuacaaaaaauuuguaaaauuagccaggcaugguggcgcacgccuguagucc

SEQ ID NO: 370879 - RNA, 63 nt, Human
gaaacccugucucugcuaaaaauacaaaaauuagccaggcaugguggcaaacgccuguaaucc

SEQ ID NO: 370880 - RNA, 63 nt, Human
auucaacaaauguuuauuaaucacucacugugugccaggcaccgugcuggacaucagaaaugc

SEQ ID NO: 370881 - RNA, 63 nt, Human
uugcucacaacucagguaugcacccauguggcagccaggcagcggagcccuacuagacugcca

SEQ ID NO: 370882 - RNA, 63 nt, Human
uggaauggggcuaaccagcuccugauggccugagccaggcaucuugacuggcaccuggagagc

SEQ ID NO: 370883 - RNA, 63 nt, Human
ugcuuuuggcucauacaggagagagggaaggcugccaggcacugcuuguaucccugcugauaa

SEQ ID NO: 370884 - RNA, 63 nt, Human
cgccauucagaccccauuaagaagguuggcuuggccaggcaggaugggcuguguccggcccug

SEQ ID NO: 370885 - RNA, 63 nt, Human
gaggagagaaggcuggggagggcugggcagcaagccaggcacagugaguggcagagcaagagg

SEQ ID NO: 370886 - RNA, 64 nt, Human; identical to SEQ ID NO: 116588

SEQ ID NO: 370887 - RNA, 64 nt, Human; identical to SEQ ID NO: 116589

SEQ ID NO: 370888 - RNA, 64 nt, Human; identical to SEQ ID NO: 116597

SEQ ID NO: 370889 - RNA, 63 nt, Human
cacauccugucucuacaaaaaauacaaaaauuagccaggcaggguggugcaugccuguagucc

SEQ ID NO: 370890 - RNA, 63 nt, Human
cgcaugugcuccaccccacuccuuuugggggaagccaggcaacaguggccucugggagggggu

SEQ ID NO: 370891 - RNA, 63 nt, Human
agaaacagagacaagaaaggcagacacaccgcggccaggcacccaugugggcgcccacccugg

SEQ ID NO: 370892 - RNA, 63 nt, Human
gggcugcgcuagcagcccuugugugugcccugggccaggcaggcgauccccgcuuccccuugc

SEQ ID NO: 370893 - RNA, 63 nt, Human
ugccuucguccgggccccuccugggccuccccggccaggcacguggcaccgucgccuugacac

SEQ ID NO: 370894 - RNA, 63 nt, Human
ucuugaugcagagaagccacccacguggggugugccaggcacccccagauacaaaugcagcca

SEQ ID NO: 370895 - RNA, 53 nt, Human
ggccagaugagaacgacugaggggccaggcaggggugggagagccagcucucu

SEQ ID NO: 370896 - RNA, 63 nt, Human
ugcguguguguagaugaggggcgggggacgggcgccaggcauuguccagaccuggucggggcc

SEQ ID NO: 370897 - RNA, 63 nt, Human
aacuacgcuuugggggcuucagccuagagcccugccaggcagccccuggcuccagguucccug

SEQ ID NO: 370898 - RNA, 63 nt, Human
gacuuuauuucugaccuauuaaaacaugaacaggccaggcaugguggcucacgccuguaaucc

SEQ ID NO: 370899 - RNA, 63 nt, Human
agggaagaacuugucaugagaaucucugagcgugccaggcagacucggauauuuuuauaaauu

SEQ ID NO: 370900 - RNA, 63 nt, Human
cccacgagggucaggacugugacucuuuuuagggccaggcaggugccuggacauuugccuugc

SEQ ID NO: 370901 - RNA, 63 nt, Human
aaggugcacaccuagccuaggugagacacugcagccaggcaaccaccgacacacgccccuucu

SEQ ID NO: 370902 - RNA, 63 nt, Human
ccaccacagaucccuggauugcugggaauggaagccaggcauggcacaaguucuguaaucuuc

SEQ ID NO: 370903 - RNA, 63 nt, Human
gaugccagcuguacugaguucucauccacagaggccaggcauggcccagccuggagccguggc

SEQ ID NO: 370904 - RNA, 63 nt, Human
cacuugugcuugagccuguauuaaaggaaucaggccaggcacaguggcucacgccuguaaucu

SEQ ID NO: 370905 - RNA, 64 nt, Human; identical to SEQ ID NO: 116599

SEQ ID NO: 370906 - RNA, 64 nt, Human; identical to SEQ ID NO: 116600

SEQ ID NO: 370907 - RNA, 64 nt, Human; identical to SEQ ID NO: 116601

SEQ ID NO: 370908 - RNA, 63 nt, Human
agagcagcuccgguggcgggaggaguggcagcggccaggcagcccagcuucgcgaaggcugua

SEQ ID NO: 370909 - RNA, 63 nt, Human
ugcagcaagaauacagccgcaaggaggaggagugccaggcaggggcugccgagaugcgggagc

SEQ ID NO: 370910 - RNA, 63 nt, Human
acucagcaaacacuuccugagcaccugcuacaugccaggcaaaaugugaaauuugcaugcuau

SEQ ID NO: 370911 - RNA, 63 nt, Human
auugaucguggucuucgcuuuaaucuuaguuccgccaggcacgguggcucacaccuguaaucc

SEQ ID NO: 370912 - RNA, 63 nt, Human
gggaugggcaucuccagggagcuggggauuagugccaggcagcccugccagccaugccuacau

SEQ ID NO: 370913 - RNA, 63 nt, Human
ucuauaaauugacuucuuuuucuuaguuguauggccaggcaguccccauuuuaggaguuggcu

SEQ ID NO: 370914 - RNA, 63 nt, Human
aaacugggggcucgcccuucuccugugaggggagccaggcacacagggcccauugguguuugg

SEQ ID NO: 370915 - RNA, 63 nt, Human
auccugugugucccagccuuuugagcagaaacugccaggcaggaccugcugggccgugcgggg

SEQ ID NO: 370916 - RNA, 63 nt, Human
aaggaaggggcuuugggaucuggaaaccagcaggccaggcagcauccacaguguuaguccaaa

SEQ ID NO: 370917 - RNA, 63 nt, Human
cacauuccagaagcccucaugggaagggaugcagccaggcagacuccugccagauggggcagg

SEQ ID NO: 370918 - RNA, 63 nt, Human
aggggccuccccaggaagucuccuacccucucagccaggcagagagcaguuugccagaagcuc

SEQ ID NO: 370919 - RNA, 63 nt, Human
aaucugcauucauucagcgaaugcucaagacaagccaggcaugcugagaagcggcgcucuagu

SEQ ID NO: 370920 - RNA, 63 nt, Human
uauuuuuaguagagaugggguuucaccauguuggccaggcagaucucaaacuccugaccucgu

SEQ ID NO: 370921 - RNA, 63 nt, Human
ccuuccaaagcaggugagucagccccaccgagagccaggcagcuuugaguggcagcguggugc

SEQ ID NO: 370922 - RNA, 63 nt, Human
ugggacagcccuagccccugcugucaugaaggggccaggcauuggucaccugugggaccuucu

SEQ ID NO: 370923 - RNA, 58 nt, Human
ugguggacggcacggacuagccccgcgcgccaggcaggcggagcggggcggggcgcac

SEQ ID NO: 370924 - RNA, 64 nt, Human; identical to SEQ ID NO: 116602

SEQ ID NO: 370925 - RNA, 64 nt, Human; identical to SEQ ID NO: 116603

SEQ ID NO: 370926 - RNA, 64 nt, Human; identical to SEQ ID NO: 116641

SEQ ID NO: 370927 - RNA, 63 nt, Human
ucugccuucgcauagcacacugcuugaggcccugccaggcaccaagcacugcccugggcccau

SEQ ID NO: 370928 - RNA, 63 nt, Human
gaaaccguguaucuacuaaaaauacaaaaauuagccaggcaugauggugugcaccuguagucc

SEQ ID NO: 370929 - RNA, 63 nt, Human
gaaaccccgucucuacuaaaaguacgaaacuuagccaggcaugaugggggucugccuguaaug

SEQ ID NO: 370930 - RNA, 63 nt, Human
aaaccccaucucuacuaaaaaauacaaaaauuagccaggcaugguggcacacaccuguaaucg

SEQ ID NO: 370931 - RNA, 63 nt, Human
ggcuugguuucauacacugauuuauuuuucuaugccaggcaguagagucucucugccucugag

SEQ ID NO: 370932 - RNA, 63 nt, Human
cuggugccagcacgggaucccugaagugacucagccaggcagacaugagacauggcggagugu

SEQ ID NO: 370933 - RNA, 63 nt, Human
cgugugaccaggggaauguguggcccgcuggcagccaggcaggcccgggugguggugccagcc

SEQ ID NO: 370934 - RNA, 63 nt, Human
aaggagggaggggagaagcccagcagaagcugagccaggcagaggggaaagaagcugauauga

SEQ ID NO: 370935 - RNA, 58 nt, Human
ccaagugccacugcaauuaaugaggcaggccaggcaagcagucaggggugccaagacc

SEQ ID NO: 370936 - RNA, 63 nt, Human
cugugagcuucagaccaggaaaugugucaucuugccaggcaccuggcugagugugcuggagug

SEQ ID NO: 370937 - RNA, 63 nt, Human
uguauauuacauacuuagagagagacucuuuuagccaggcaaagucuuuuuuggcuguggcug

SEQ ID NO: 370938 - RNA, 63 nt, Human
gagagagggagcggaggcuaaggacuggaggccgccaggcaggcguggccgagggaagaaaaa

SEQ ID NO: 370939 - RNA, 63 nt, Human
ggcuggugguggaccuggagaguggaggcaccggccaggcaggggggcaggggagcucaggcc

SEQ ID NO: 370940 - RNA, 63 nt, Human
gaccccagaggacgcugugaucuccaccuugaagccaggcaggcugcccugagacgaggaggg

SEQ ID NO: 370941 - RNA, 63 nt, Human
ccugagccccuuuccccaccacaacccaccacggccaggcagagaagggcaacucccaagagc

SEQ ID NO: 370942 - RNA, 63 nt, Human
cagcugauaaauauugacugaugccagcucugugccaggcacauuggacaugggggauacacu

SEQ ID NO: 370943 - RNA, 64 nt, Human; identical to SEQ ID NO: 116605

SEQ ID NO: 370944 - RNA, 64 nt, Human; identical to SEQ ID NO: 116606

SEQ ID NO: 370945 - RNA, 64 nt, Human; identical to SEQ ID NO: 116607

SEQ ID NO: 370946 - RNA, 63 nt, Human
uaacucugccuguccccagggucugcuccgccugccaggcaagggaacagguccucccaaggg

SEQ ID NO: 370947 - RNA, 63 nt, Human
cuggcccccagccucagugccucuuggcccagggccaggcagucgugguugcagaaggagcaa

SEQ ID NO: 370948 - RNA, 52 nt, Human
agugcacagaggacaaguagcugccaggcacagaggaaagagcaucaccgug

SEQ ID NO: 370949 - RNA, 63 nt, Human
guggguccaagguccucaucccauccucccucugccaggcacuaugugucuggggcuucgauc

SEQ ID NO: 370950 - RNA, 63 nt, Human
uugcuccacccucgagggcagccagacagcgucgccaggcaaugaggaaagcagagacaggag

SEQ ID NO: 370951 - RNA, 63 nt, Human
ccacccaagccugcuggcugcggcccccucucggccaggcauuggcucagcccgcugaguggg

SEQ ID NO: 370952 - RNA, 63 nt, Human
auuacgguuaugaugcucaguaucuuuccaagugccaggcacgggcuuccuuuucugaucaaa

SEQ ID NO: 370953 - RNA, 63 nt, Human
aaggaugaaagguauauauaaaacaauuugggggccaggcacgauggcucaaaccuguaaucc

SEQ ID NO: 370954 - RNA, 63 nt, Human
agaccccaucucuacuaaaaauacaaaaaauuagccaggcaugguggcgggcaccuguagucc

SEQ ID NO: 370955 - RNA, 63 nt, Human
gaaacccuguaucuacaaaaaauacaaaaauuagccaggcaugguggugggugccuguaguuc

SEQ ID NO: 370956 - RNA, 63 nt, Human
acucugccuuccuuuuagaauaauauuuuaauugccaggcaaaauggguuucaguuuuugaau

SEQ ID NO: 370957 - RNA, 63 nt, Human
gccucuccuucucagugcagggacgucaccccugccaggcaagcccagggcacagaugccagg

SEQ ID NO: 370958 - RNA, 63 nt, Human
ggcuucucccucucagugcgaggcuucaccccugccaggcaagcccagggcauagaugcugag

SEQ ID NO: 370959 - RNA, 63 nt, Human
gccucucccucucagugcagggacgucaccccugccaggcaagcccagggcacagaggccggg

SEQ ID NO: 370960 - RNA, 63 nt, Human
gccccucccucucagugcgggaacgucaccccugccaggcaagcccagggcacagaugcugcg

SEQ ID NO: 370961 - RNA, 63 nt, Human
gugaccuuuucacugugcaaagggagauuucuagccaggcauugacuauuacaauuucauuuu

SEQ ID NO: 370962 - RNA, 64 nt, Human; identical to SEQ ID NO: 116611

SEQ ID NO: 370963 - RNA, 64 nt, Human; identical to SEQ ID NO: 116612

SEQ ID NO: 370964 - RNA, 64 nt, Human; identical to SEQ ID NO: 116613

SEQ ID NO: 370965 - RNA, 63 nt, Human
ugccccuagguuggugggucuacaggagccucagccaggcagcccaccccacccuggggcccu

SEQ ID NO: 370966 - RNA, 63 nt, Human
gaggugcccaaugcucccuccuaggaccucgcagccaggcaaggcugucagguuguuuugggg

SEQ ID NO: 370967 - RNA, 63 nt, Human
cuugcguguggauggugcagccaccgggugcgugccaggcaggcccuccugggguacaggaag

SEQ ID NO: 370968 - RNA, 63 nt, Human
cccugucucuggaaguauuuaagaaaaggcugggccaggcacgauggcucacgccuguaaucc

SEQ ID NO: 370969 - RNA, 63 nt, Human
ugggggagucgccgccaagcccaggcugcuggagccaggcacccuccucugucacuugcugcu

SEQ ID NO: 370970 - RNA, 63 nt, Human
agguucaccaugaaccucagggucagggaaugagccaggcacgggggcaugggcagagagggc

SEQ ID NO: 370971 - RNA, 63 nt, Human
aacugcgaucauugcacuugguguucacagugggccaggcacacaguagacacucaguucaac

SEQ ID NO: 370972 - RNA, 63 nt, Human
uugagguccuagacccuuugagaaacugaugaagccaggcaccuccuuccucaggaaaaugcu

SEQ ID NO: 370973 - RNA, 63 nt, Human
gucucccauggcgcaaugagucaguggcccccagccaggcagugugggcauugccacugcggc

SEQ ID NO: 370974 - RNA, 63 nt, Human
ucucccccaccagaaugggagccaggagucccagccaggcacaggaccgagccuggcucucgg

SEQ ID NO: 370975 - RNA, 63 nt, Human
gcuccuuggccagaggcuuacaggcaacaagcggccaggcagggucuggccccgggcugcugg

SEQ ID NO: 370976 - RNA, 63 nt, Human
caugcauggugcaucagcagcccauggccucuggccaggcauggcgaggcugaggugggagga

SEQ ID NO: 370977 - RNA, 63 nt, Human
agagaggcugagucacuuaccugaggacacccagccaggcagagcugggauugaaggaccccu

SEQ ID NO: 370978 - RNA, 63 nt, Human
cacccacccccgaaaaaauaauuaaacucgcaggccaggcacgguggcucaugccuguaaucc

SEQ ID NO: 370979 - RNA, 63 nt, Human
uauaaaauuauuauuaggaauuauuuaaguggggccaggcaucuugcaacauuuucugauuuu

SEQ ID NO: 370980 - RNA, 63 nt, Human
ggagacccugucucuacaagaaauuaaaaauuagccaggcauaguuggcacgugccuguagca

SEQ ID NO: 370981 - RNA, 64 nt, Human; identical to SEQ ID NO: 116571

SEQ ID NO: 370982 - RNA, 64 nt, Human; identical to SEQ ID NO: 116572

SEQ ID NO: 370983 - RNA, 64 nt, Human; identical to SEQ ID NO: 116577

SEQ ID NO: 370984 - RNA, 63 nt, Human
cagaaaaaugagaucagaaguggagauguuggggccaggcacaguggcccaggccuguaaucc

SEQ ID NO: 370985 - RNA, 63 nt, Human
gauccugucucuaaauaaauaaauaaaaugcgggccaggcacaguggcucacaccuguaaucc

SEQ ID NO: 370986 - RNA, 63 nt, Human
uccccucugaggggcuuccuuccccuccauagggccaggcauuuuuuucuggauucaaacagg

SEQ ID NO: 370987 - RNA, 63 nt, Human
cagacccccuucugcuccgcuuccuccugcccagccaggcaacacccucaaccggcuccauca

SEQ ID NO: 370988 - RNA, 54 nt, Human
acgagggcgccgacuccuaaccccgccaggcagccucguucugcacaggcacuu

SEQ ID NO: 370989 - RNA, 63 nt, Human
gcagccucguucugcacaggcacuuuagcccgagccaggcacaccugcgagggggcaggugug

SEQ ID NO: 370990 - RNA, 63 nt, Human
guauuuuuaguagagacaguguuuaccauguuggccaggcaggucuccaacuccugaccucaa

SEQ ID NO: 370991 - RNA, 63 nt, Human
gcaaaacccugucuacuaaaaauacaaaaauuagccaggcaugguggcgugugccuguaaucc

SEQ ID NO: 370992 - RNA, 63 nt, Human
uugggaucucaggaggcugcaaucaaagcauucgccaggcagaggucucaucugaaggccuga

SEQ ID NO: 370993 - RNA, 63 nt, Human
ugccuggggccucaccugcuggagucuuugguggccaggcaugugacuuaccugggauuucac

SEQ ID NO: 370994 - RNA, 63 nt, Human
augaaauccuggcacaaaaaaaaaaaaaaaguagccaggcaugguggcgggagccuguugucc

SEQ ID NO: 370995 - RNA, 63 nt, Human
aaugggucuugaguccugugcuguuggcaaagugccaggcacaguuggggagggggggguccu

SEQ ID NO: 370996 - RNA, 63 nt, Human
guacuaucugcugcagagauccucucaucuguggccaggcacgccuguaaucccagcacuuug

SEQ ID NO: 370997 - RNA, 63 nt, Human
gaaacccugucucuacuaaaauacaaaaacuuagccaggcaugguggugcgcaccuguagucc

SEQ ID NO: 370998 - RNA, 63 nt, Human
gaccacaucucuacuagaacuuaaaaaaaguuagccaggcacggugauaaaugccuguagucc

SEQ ID NO: 370999 - RNA, 63 nt, Human
cucuuucuuuugccuauuaaaccucugcuccuggccaggcacaguggcucacgccuauaaucc

SEQ ID NO: 371000 - RNA, 64 nt, Human; identical to SEQ ID NO: 116565

SEQ ID NO: 371001 - RNA, 64 nt, Human; identical to SEQ ID NO: 116566

SEQ ID NO: 371002 - RNA, 64 nt, Human; identical to SEQ ID NO: 116594

SEQ ID NO: 371003 - RNA, 63 nt, Human
cuaccacucaaauguauuuacaaagagaauuuggccaggcacggugaugcauaccuauaaucc

SEQ ID NO: 371004 - RNA, 63 nt, Human
ggugaaaccccaucucuacuaaaacaaaaauuagccaggcaugguggcaccugccuguaaucc

SEQ ID NO: 371005 - RNA, 63 nt, Human
uuguuuguaaacguuuaaaaacaaaguuccccggccaggcacaguggcucacaccuguaaucc

SEQ ID NO: 371006 - RNA, 63 nt, Human
ggcugcuccagugggcagggguagcuagcgugugccaggcagauccucuggacacguaaccua

SEQ ID NO: 371007 - RNA, 63 nt, Human
ugcacauggguguccagggccugaugggguguggccaggcaaugaagaaagacucaggugucu

SEQ ID NO: 371008 - RNA, 63 nt, Human
caagacccccaccaucucugaaaaaaaaaauuagccaggcaugguggugugcaccugagaauc

SEQ ID NO: 371009 - RNA, 63 nt, Human
cagacugggccuugguguuugcuggaggcaucggccaggcacaguucucgcacaugggggcuu

SEQ ID NO: 371010 - RNA, 63 nt, Human
agaaaccccaucucuauuaaagauacaaaauuagccaggcaugguggugcaugccuguaaucc

SEQ ID NO: 371011 - RNA, 63 nt, Human
gaaacccugucuguacuaaaaauacaaaauuuagccaggcaugguggcacacaccuguagucc

SEQ ID NO: 371012 - RNA, 63 nt, Human
aaaccgucuccacaaauaauuuuuaaaaaauuagccaggcaugguggugccgccuguaguccc

SEQ ID NO: 371013 - RNA, 63 nt, Human
gcugaaagucuacguuaaaaaaaaaaaguuugggccaggcacaguggcucaugccuguaaucc

SEQ ID NO: 371014 - RNA, 63 nt, Human
caucgauaaugucagccugcagcacugaagugugccaggcaaggacuguggauuucaagaacu

SEQ ID NO: 371015 - RNA, 63 nt, Human
accccaaacucccuguacagaagggaaacaaacgccaggcacgguggcucaugccuguaaucc

SEQ ID NO: 371016 - RNA, 63 nt, Human
ugaucccuuccuuguuaaaaguuaccaggguuggccaggcacggugguucaugccuguaaucc

SEQ ID NO: 371017 - RNA, 63 nt, Human
ggcuucccaaggucucacagcuuguccccaggggccaggcaggcugucugucugcuucacaug

SEQ ID NO: 371018 - RNA, 63 nt, Human
agcauggcagucccuacccccaauuuuucccaggccaggcacugaguaggaguuaucuccucu

SEQ ID NO: 371019 - RNA, 64 nt, Human; identical to SEQ ID NO: 116550

SEQ ID NO: 371020 - RNA, 64 nt, Human; identical to SEQ ID NO: 116551

SEQ ID NO: 371021 - RNA, 64 nt, Human; identical to SEQ ID NO: 116552

SEQ ID NO: 371022 - RNA, 63 nt, Human
ucuauucugaaauuauauaaauuaaccuaccuggccaggcacaguggcucacaccuguaaucu

SEQ ID NO: 371023 - RNA, 63 nt, Human
uuuugauauaguacuuuauaaaagggagaucaggccaggcacggaggcucauguaaguaaucc

SEQ ID NO: 371024 - RNA, 63 nt, Human
ucauuucuauuaaagaugggucucauucuguuggccaggcaugagagcggugacaggaucagc

SEQ ID NO: 371025 - RNA, 63 nt, Human
auacauaguaagaaugcgagaaauauaaaucaggccaggcacgguggcucacaccuguaaucc

SEQ ID NO: 371026 - RNA, 63 nt, Human
aacccugucucuacuaaaaauaaaaaaaaauuagccaggcaugguggcgggcaccuguagucc

SEQ ID NO: 371027 - RNA, 63 nt, Human
uuccuguuggauuccucuucaucuagaaagccagccaggcagcuguccuggagacaagagcug

SEQ ID NO: 371028 - RNA, 63 nt, Human
uugcuugggauauagaaagauauccugacauuggccaggcaugguggcucacgccuguaaucc

SEQ ID NO: 371029 - RNA, 63 nt, Human
gaaacccugucucuaccaaaaauacaaaaauuagccaggcauaguugugggcaccuguaaucc

SEQ ID NO: 371030 - RNA, 63 nt, Human
uucacucaucgaccgacucagccccaaccgggagccaggcagaaaaacccugugccguaggaa

SEQ ID NO: 371031 - RNA, 63 nt, Human
gauucuagaaaaacuggcugcuaacuggccugagccaggcaacacugauuccaaucccuccuc

SEQ ID NO: 371032 - RNA, 63 nt, Human
gccccaguuaaacaaacuacccauccaugagcugccaggcagucaaaaacagaagcuuccccg

SEQ ID NO: 371033 - RNA, 63 nt, Human
ggcccagagauuacagauccccuccuguaaguggccaggcauucucucccugcccucucuggc

SEQ ID NO: 371034 - RNA, 63 nt, Human
auuugacugcuucucguugcucgucaccuccaugccaggcacugugcuugcuaauugcuuuau

SEQ ID NO: 371035 - RNA, 63 nt, Human
uuugucuccagguagagacaacauccugugacugccaggcagaaaggacagggcccaggucag

SEQ ID NO: 371036 - RNA, 63 nt, Human
gaccugcuccucccgagacucucucugacugcagccaggcauaguaccuuugccuguguuugc

SEQ ID NO: 371037 - RNA, 63 nt, Human
augccacgguugagauugagagagaucagcgcagccaggcaagggaacuuuaaagaauuauua

SEQ ID NO: 371038 - RNA, 64 nt, Human; identical to SEQ ID NO: 116617

SEQ ID NO: 371039 - RNA, 64 nt, Human; identical to SEQ ID NO: 116618

SEQ ID NO: 371040 - RNA, 64 nt, Human; identical to SEQ ID NO: 116619

SEQ ID NO: 371041 - RNA, 63 nt, Human
auuguaaagugcucccuuuguuucaaaguguuugccaggcauccagacuacacguguggauuu

SEQ ID NO: 371042 - RNA, 63 nt, Human
uugcuggggauuuaaagagaacccuugugcuacgccaggcaguuaccgagccgaagggagaug

SEQ ID NO: 371043 - RNA, 63 nt, Human
ugccaaacuuugcccccacaagccuggucaucagccaggcagcccucccagugcccaagggcc

SEQ ID NO: 371044 - RNA, 63 nt, Human
gcccugaugcaggagggugcgauagcggacguggccaggcaggaggggccggguucaggagcu

SEQ ID NO: 371045 - RNA, 63 nt, Human
cuggcuuccccagcuggacugggaggucaggaagccaggcaaggagagggacagcacaggcca

SEQ ID NO: 371046 - RNA, 63 nt, Human
gguagggcugacuagaagggccaguccugccuggccaggcagaucugugccccaugccugucc

SEQ ID NO: 371047 - RNA, 63 nt, Human
guggugguggugagugucagcaucuacaguacagccaggcaggcaggaccuugaggaaucaga

SEQ ID NO: 371048 - RNA, 57 nt, Human
ugaaugucuugagaaccugauauauaugccaggcaccuauuuuggcagguggugagu

SEQ ID NO: 371049 - RNA, 63 nt, Human
cagcugggcacuauuuacauaaaccagagcugagccaggcaggaauuugcugauuaauuuauu

SEQ ID NO: 371050 - RNA, 63 nt, Human
uaacaccucuuaagucuagcacacugcagugaggccaggcaccucagugcugggcaggggcau

SEQ ID NO: 371051 - RNA, 63 nt, Human
aucucucucuugccugaggggaaagagagaugggccaggcagagaacagaacuggaggcaguc

SEQ ID NO: 371052 - RNA, 63 nt, Human
cagagcccuggcuggguucaggucccacgucuggccaggcacugccuucuccucucugggccu

SEQ ID NO: 371053 - RNA, 63 nt, Human
ugcugaggacaugaggacccgucuuuuugcagugccaggcaggguggccaaagaggacuggac

SEQ ID NO: 371054 - RNA, 63 nt, Human
acggugccccuugcgcgccaucggugcgccggggccaggcagaaccugggcccguccggcuug

SEQ ID NO: 371055 - RNA, 63 nt, Human
aggaaaaauaauauaauugccugcuuacugcaugccaggcauugggcugggaauuuuuauauu

SEQ ID NO: 371056 - RNA, 63 nt, Human
gaaaccccgucucuacuaaaaauacaaaaauuagccaggcaugguggcacacaccuguagucc

SEQ ID NO: 371057 - RNA, 64 nt, Human; identical to SEQ ID NO: 116556

SEQ ID NO: 371058 - RNA, 64 nt, Human; identical to SEQ ID NO: 116557

SEQ ID NO: 371059 - RNA, 64 nt, Human; identical to SEQ ID NO: 116558

SEQ ID NO: 371060 - RNA, 63 nt, Human
acuguccgggcuccugguccgcaguggcagagcgccaggcagagcccaaucagggucucgugc

SEQ ID NO: 371061 - RNA, 63 nt, Human
cuggccgggaagguggauucgccuuggcuaggugccaggcagguccgccugugcgggugcccc

SEQ ID NO: 371062 - RNA, 63 nt, Human
gaaacccugucucuaccaaaaauacaaaaauuagccaggcaggguggcaugugccuuuaaucc

SEQ ID NO: 371063 - RNA, 63 nt, Human
acaguaucuacccuuacaugguuuaggauuaaagccaggcaaucuuuuacuaugcauuaagac

SEQ ID NO: 371064 - RNA, 63 nt, Human
cuuuccccaaaggaacuuaaaaagacaagcguggccaggcacaguggcucacaccuguaaucc

SEQ ID NO: 371065 - RNA, 63 nt, Human
gaggccucugcucaggccagaaguccagcugcugccaggcaugucccccagggccacugggca

SEQ ID NO: 371066 - RNA, 63 nt, Human
gucucuacaaaaaaaaaaagaaaaaaaaaauuagccaggcaugcgaaacgcugaggugggagg

SEQ ID NO: 371067 - RNA, 63 nt, Human
cuugugguuuuuaguauagucugucuaccuuuagccaggcacaggacagcccuaugaaaaaau

SEQ ID NO: 371068 - RNA, 63 nt, Human
ggcucggagcacccuugcccggcugugauugcugccaggcacuguucaucucagcuuuucugu

SEQ ID NO: 371069 - RNA, 63 nt, Human
aggcugggccagccugcugcugucugcuucagggccaggcagagagugaggcuggggguucuc

SEQ ID NO: 371070 - RNA, 63 nt, Human
cagggaugcauguguccccgugggggugccugugccaggcaggccucaggugcaugccaugcu

SEQ ID NO: 371071 - RNA, 63 nt, Human
guauaggugaggggugugaggccccagccuggagccaggcacugggugcugacaggggaacca

SEQ ID NO: 371072 - RNA, 63 nt, Human
cuagagugacuuuugacgcccuccaucccucccgccaggcacuguccuccgcaaggccuggug

SEQ ID NO: 371073 - RNA, 63 nt, Human
ccagagcucgugacgagcaagugcuggguccccgccaggcaccccgaggcggcgcucuggcug

SEQ ID NO: 371074 - RNA, 63 nt, Human
gcucaccuaggcugucacaggacccaccuccaugccaggcaacagagggccacagaaccaccc

SEQ ID NO: 371075 - RNA, 63 nt, Human
ucauaggauggagaauuuuaaagaacuguuugggccaggcacagucgcucauacuuguaaucc

SEQ ID NO: 371076 - RNA, 64 nt, Human; identical to SEQ ID NO: 116562

SEQ ID NO: 371077 - RNA, 64 nt, Human; identical to SEQ ID NO: 116563

SEQ ID NO: 371078 - RNA, 64 nt, Human; identical to SEQ ID NO: 116564

SEQ ID NO: 371079 - RNA, 63 nt, Human
ggcggggagguggugccccgcggaccccggggugccaggcacggaaggcgggacucugggaga

SEQ ID NO: 371080 - RNA, 63 nt, Human
uccguggcuccuguggccugcccuugucucgcagccaggcagggucguguguggguguggggc

SEQ ID NO: 371081 - RNA, 63 nt, Human
gugcucgacaggggaacccgcccggacggcaucgccaggcacuggcugggguggggaaaggug

SEQ ID NO: 371082 - RNA, 63 nt, Human
ccuccacaagcacucaggccacuggcacguugggccaggcagaagguccacauggcagggcug

SEQ ID NO: 371083 - RNA, 63 nt, Human
ugguugccuggcagagcuuugagcucacagguugccaggcagagcuuuugagcucacagguga

SEQ ID NO: 371084 - RNA, 63 nt, Human
ccaggagagggcuuguuccuccaacucuaggaggccaggcaagcauggacaggagccaaggga

SEQ ID NO: 371085 - RNA, 63 nt, Human
cuaccuacccagcugggccagaggcacgaggcagccaggcagggugggagcaggggcuggcgu

SEQ ID NO: 371086 - RNA, 63 nt, Human
caucuuggggccuuugcccaggcuguuccuucugccaggcaggcccuuccucccuuggcccaa

SEQ ID NO: 371087 - RNA, 63 nt, Human
ugaaccucagggcacccccagguggugcggaaagccaggcaguugggacagaggugcccacga

SEQ ID NO: 371088 - RNA, 63 nt, Human
cuuguguuuuuguuuguaauggggagaagcguggccaggcagguggcacguggcaucgcaugg

SEQ ID NO: 371089 - RNA, 63 nt, Human
uuggauucugaggguagucgggaggccucgguagccaggcagaacaggauaucugccaaaggg

SEQ ID NO: 371090 - RNA, 63 nt, Human
gccccgcuucucuuauucguguuaggugcccccgccaggcauugcaggcuuagucguggcuac

SEQ ID NO: 371091 - RNA, 63 nt, Human
caagaaugugcauugaugggguggugaugaggugccaggcacuggguagagcaccugguccac

SEQ ID NO: 371092 - RNA, 63 nt, Human
uauacuacacuaucuguaaaauauauuugcaaagccaggcacaguguuacgcgucugccucag

SEQ ID NO: 371093 - RNA, 63 nt, Human
ggcuggaaguacuuggcccccuucaggagccuggccaggcagggagagaguagcugcagccuu

SEQ ID NO: 371094 - RNA, 63 nt, Human
agugagacuccgucucaaaaaaaugaaaaauuagccaggcagguuggcgggggccuguaaucc

SEQ ID NO: 371095 - RNA, 64 nt, Human; identical to SEQ ID NO: 116559

SEQ ID NO: 371096 - RNA, 64 nt, Human; identical to SEQ ID NO: 116560

SEQ ID NO: 371097 - RNA, 64 nt, Human; identical to SEQ ID NO: 116660

SEQ ID NO: 371098 - RNA, 63 nt, Human
uguuccugucacccacccuuucaucaucuuuuugccaggcauuccuggcugucacuuggagcc

SEQ ID NO: 371099 - RNA, 63 nt, Human
ggagucuccugucccaaucauuuucaaaaucuagccaggcaaauuucuguuauauuucaaggc

SEQ ID NO: 371100 - RNA, 63 nt, Human
ccucucuguaucccccagacuaucuguaacagugccaggcacacaguaggugaucaauaaaca

SEQ ID NO: 371101 - RNA, 63 nt, Human
gaauacaugacaagacagaacguuccuugccaggccaggcaaaagccaaggcccauuagccag

SEQ ID NO: 371102 - RNA, 63 nt, Human
gagcuggcagagccugggggcacagggugcaaagccaggcacugugcccagcagugggcuccc

SEQ ID NO: 371103 - RNA, 63 nt, Human
cgggacuccaggcacccgcuccccugcgaccaugccaggcacgcugggaggaggacggcagcu

SEQ ID NO: 371104 - RNA, 63 nt, Human
caaucacuguauaauuuuaaaauaguuuaccuggccaggcaugguggcucacgccuguaaucc

SEQ ID NO: 371105 - RNA, 63 nt, Human
cgguggaaagcauuuuuaacaaaaaauuuuuaggccaggcacagugguggcucaugccuguaa

SEQ ID NO: 371106 - RNA, 63 nt, Human
agucccagggccccaacacuauaccuugggccggccaggcagggcacccagacggggggcugg

SEQ ID NO: 371107 - RNA, 63 nt, Human
caaaugcuagaaaaauuguuaagguggauugaggccaggcagcugucacugcugcuucauguu

SEQ ID NO: 371108 - RNA, 63 nt, Human
uccagggcucaauccaggaccacacucuuauuggccaggcaggggcucccacagagcuuugag

SEQ ID NO: 371109 - RNA, 63 nt, Human
uuccuauuuuaacugacagcuuuccuuuggggugccaggcagcgaggccccccaccccuaucc

SEQ ID NO: 371110 - RNA, 63 nt, Human
ggcugacuuggugauggagggaaaaagccuugagccaggcagaaguuuguggccaggguuugu

SEQ ID NO: 371111 - RNA, 63 nt, Human
auucaaccaguauuuauugagcaccuaauaugugccaggcacugccacugcaaucuuauaaau

SEQ ID NO: 371112 - RNA, 63 nt, Human
uuuugcaaauauuguuuaaaaaccaaacuugaagccaggcaugguggcccacaccuguggucc

SEQ ID NO: 371113 - RNA, 63 nt, Human
ugaccaagggacugaauugcugacaugggccaggccaggcacuguuuuguggcccaugcuagg

SEQ ID NO: 371114 - RNA, 64 nt, Human; identical to SEQ ID NO: 116568

SEQ ID NO: 371115 - RNA, 64 nt, Human; identical to SEQ ID NO: 116569

SEQ ID NO: 371116 - RNA, 64 nt, Human; identical to SEQ ID NO: 116570

SEQ ID NO: 371117 - RNA, 64 nt, Human; identical to SEQ ID NO: 116536

SEQ ID NO: 371118 - RNA, 61 nt, Human; identical to SEQ ID NO: 116537

SEQ ID NO: 371119 - RNA, 64 nt, Human; identical to SEQ ID NO: 116538

SEQ ID NO: 371120 - RNA, 64 nt, Human; identical to SEQ ID NO: 116539

SEQ ID NO: 371121 - RNA, 64 nt, Human; identical to SEQ ID NO: 116540

SEQ ID NO: 371122 - RNA, 64 nt, Human; identical to SEQ ID NO: 116541

SEQ ID NO: 371123 - RNA, 64 nt, Human; identical to SEQ ID NO: 116542

SEQ ID NO: 371124 - RNA, 64 nt, Human; identical to SEQ ID NO: 116543

SEQ ID NO: 371125 - RNA, 64 nt, Human; identical to SEQ ID NO: 116544

SEQ ID NO: 371126 - RNA, 64 nt, Human; identical to SEQ ID NO: 116545

SEQ ID NO: 371127 - RNA, 64 nt, Human; identical to SEQ ID NO: 116546

SEQ ID NO: 371128 - RNA, 64 nt, Human
ucggauaauucgggcuauuuguauucaggugugagcuggcaaauccgagaccuguuuugcguag

SEQ ID NO: 371129 - RNA, 64 nt, Human
aauuccauccuguaaagaacaggagucaggagccgcuggcaagagacagcaugucaccugggac

SEQ ID NO: 371130 - RNA, 64 nt, Human
aagccaggucccggcauggguggguuaugcucaugcuggcaauacuugaaacggguuuauuaau

SEQ ID NO: 371131 - RNA, 64 nt, Human
aaugguguagaacguuccucuuuuuauagugguggcuggcaagaaggaagcaguucuccacguu

SEQ ID NO: 371132 - RNA, 58 nt, Human
cccaggugaccggcgacugagggccugagcuggcaaggccaaggacacccaacacaau

SEQ ID NO: 371133 - RNA, 64 nt, Human
caucuguccaggccuggaaccgucucaagacagugcuggcaaagcugcaguauugagaugcuaa

SEQ ID NO: 371134 - RNA, 64 nt, Human
ggcacuggcccacuugcggaaccugacucaggcugcuggcaagcguagcuauguguuggcccug

SEQ ID NO: 371135 - RNA, 64 nt, Human
ccucccucuacagccucauuccuuaguucccggagcuggcaagggcuggagccccgccuggguc

SEQ ID NO: 371136 - RNA, 64 nt, Human
ucuuugguccaagagggggcugaguuuggugccagcuggcaaaugagggcuggacucucuuccc

SEQ ID NO: 371137 - RNA, 51 nt, Human
ccaagaaaccaaagaaaugaagcuggcaagcuacuuuucagccucaagcuu

SEQ ID NO: 371138 - RNA, 64 nt, Human
aguagcuggaacgaacuauaguugcaccacugcagcuggcaagaaucaccuucuuuauaaagcg

SEQ ID NO: 371139 - RNA, 51 nt, Human
aguacugcuguuucguaugaugcuggcaagacacccagaaaggcuauuuuc

SEQ ID NO: 371140 - RNA, 64 nt, Human
cggaggcgccauugaaagcauggucuugccaguggcuggcaaggcgguuuuguucugcucaguu

SEQ ID NO: 371141 - RNA, 64 nt, Human
gggggccgaccccuuuccccaggcacagccccaggcuggcaaagggagggcccugggcugggug

SEQ ID NO: 371142 - RNA, 64 nt, Human
cguuaggcgggauuuaugugcacugccugcaugagcuggcaaccagccagcgucccuuggugag

SEQ ID NO: 371143 - RNA, 64 nt, Human
ugacccccuccccugaaaacgaaggggccccggggcuggcaagcagggaaagcuccacggugcg

SEQ ID NO: 371144 - RNA, 64 nt, Human
aaaggcuggaggcuguuucucugggcuucaaauggcuggcaaggcuggcucucaaaucccaaag

SEQ ID NO: 371145 - RNA, 55 nt, Human
ugcaucccuaccagcggugaguguggcuggcaaccucgacucccuggugcucuuu

SEQ ID NO: 371146 - RNA, 52 nt, Human
uugagaucaucaacuccuaagggcuggcaagaagggcacugugucuacuguc

SEQ ID NO: 371147 - RNA, 51 nt, Human
ugaccaagaaagauuccugaggcuggcaaguggggcaacguguggaggaag

SEQ ID NO: 371148 - RNA, 64 nt, Human
ucuaaaguaacuccuuauagggaagccuuucuuggcuggcaacacacacacacacacacacaca

SEQ ID NO: 371149 - RNA, 64 nt, Human
acuuuuaagugugugcacacaggagugcugccaggcuggcaagagcaggucggggcuggauggc

SEQ ID NO: 371150 - RNA, 64 nt, Human
uuaucuggaagaucugcaaacauuaccuaaauaggcuggcaagauaaacacuuucuggaacccg

SEQ ID NO: 371151 - RNA, 64 nt, Human
cucugaugccccacugaggugcuguugguuuauugcuggcaacgugaauucucucaggggucua

SEQ ID NO: 371152 - RNA, 64 nt, Human
guauccagagagccauacuucugagggaagacuggcuggcaauaaagucaaauuaagugaccac

SEQ ID NO: 371153 - RNA, 64 nt, Human
cacugagaagauggcacuguccagggcccauguagcuggcaagcugcaaaaggccugugaucca

SEQ ID NO: 371154 - RNA, 64 nt, Human
acauucgugaaaugauuuuuuuuagcugaaaaaugcuggcaagaagaauuuuaaagcuuaaaau

SEQ ID NO: 371155 - RNA, 64 nt, Human
aaguaugcaggcccccugcagccucccaggacaggcuggcaagggaggagggccggccagcauu

SEQ ID NO: 371156 - RNA, 64 nt, Human
uacuaauacgcaggaagcguuccagcuauuuaaugcuggcaacuacuguuuaauggucaguuaa

SEQ ID NO: 371157 - RNA, 64 nt, Human
acggaagcagguucuuuauguccucuccucuguggcuggcaaggcucaccuggccuuauccacc

SEQ ID NO: 371158 - RNA, 64 nt, Human
gggauuacuagaaaaccugacuaauggugucacugcuggcaauggugauaauggauuaauuccu

SEQ ID NO: 371159 - RNA, 64 nt, Human
cggauucccagaaaaccugacuaauggugccacugcuggcaauggugaugauggauuaauuccu

SEQ ID NO: 371160 - RNA, 64 nt, Human
agagccugagacguaucugcagauccugucaucagcuggcaaguccaggagacugugucauuua

SEQ ID NO: 371161 - RNA, 64 nt, Human
aucccgcuaaucuugggaauaagaggaggaagcggcuggcaacugaaggcuggaacacuugcua

SEQ ID NO: 371162 - RNA, 64 nt, Human
uucagcccugaguggagaccuaucagauuggauugcuggcaaagcacagaaugccuguauauga

SEQ ID NO: 371163 - RNA, 64 nt, Human
uauucuuggguguggcuauauuacaaaaugggaugcuggcaaugaaacaauacauuuaacacua

SEQ ID NO: 371164 - RNA, 63 nt, Human
ccgcccuggacugguggugaggcgcccucguggccgcgggacuggccccggggggcccccugg

SEQ ID NO: 371165 - RNA, 64 nt, Human
ucugacuccgcagugccugcaggggagcacggagccgcgggacagccaagcaccuccaaccaaa

SEQ ID NO: 371166 - RNA, 64 nt, Human
uaaacacucucggaugccgcuguccugggggagcccgcgggagccugugaauguugauacgagc

SEQ ID NO: 371167 - RNA, 64 nt, Human
ccccggacagcccacucucuaucacgagccuaacccgcgggaggcggaagagacauccauucga

SEQ ID NO: 371168 - RNA, 64 nt, Human
aaacauucuucacgcaggggcuugggauauggcugcuggcaacacauuuuguugugggcuccuu

SEQ ID NO: 371169 - RNA, 64 nt, Human
uauagaaaaagauuauagaggaggagaaucuacugcuggcaauugggaaccgcaagguauacua

SEQ ID NO: 371170 - RNA, 64 nt, Human
ucugagaaaggacaccugugcuguucuaggcaucgcuggcaaguuugugggaagggaugggcaa

SEQ ID NO: 371171 - RNA, 64 nt, Human
auaugaucgcuguguccaggauggcauagagaaagcuggcaauuagguuaacacuuacauauua

SEQ ID NO: 371172 - RNA, 64 nt, Human
ggcaguggcgccaguucccuuccauggucucccggcuggcaauguggugaagcugaguuucugu

SEQ ID NO: 371173 - RNA, 64 nt, Human
acugacaagcagaggucagagacacugguggggagcuggcaaugaaacccuguccugggacaug

SEQ ID NO: 371174 - RNA, 64 nt, Human
cgugugcuggcccugccccagccuagcugagugugcuggcaaaguuccccacaggacucagccu

SEQ ID NO: 371175 - RNA, 64 nt, Human
uaaaugagaaggaauuugaguuggaucaucuauugcuggcaaagacagaagccucacugcaagc

SEQ ID NO: 371176 - RNA, 64 nt, Human
ggaguccagcaaucauuggggaagagagccugaggcuggcaauccuugcccagaacuuugguca

SEQ ID NO: 371177 - RNA, 64 nt, Human
guggcaggcgaggcugcaggaggcccacagauaagcuggcaagaggaaggaucccaggcacaug

SEQ ID NO: 371178 - RNA, 64 nt, Human
ggagaaggacaaggcauacagcuuauugauuagagcuggcaagcaucugcucauuauguuugga

SEQ ID NO: 371179 - RNA, 64 nt, Human
cucagguauuguaaccacugggccuuccaacuuugcuggcaagcucugguaaccucccugacug

SEQ ID NO: 371180 - RNA, 64 nt, Human
acuuugaauguuaauuaguuugggacuuugauuggcuggcaaacauuuuaucauugucagaauu

SEQ ID NO: 371181 - RNA, 64 nt, Human
ugcgacuucuucgauaguuaccugcacguccauugcuggcaacugacuugucauuaaaaccugg

SEQ ID NO: 371182 - RNA, 64 nt, Human
uugcugacaggagcaggagacgcugagggaaacagcuggcaaugugacaaaagucuuuucuggg

SEQ ID NO: 371183 - RNA, 64 nt, Human
cagugaccuuugagaaccugaacauuauagaaaagcuggcaauaaucaaggacuuacugaagua

SEQ ID NO: 371184 - RNA, 64 nt, Human
uaccucaguggaucuucagaacugcccuugcugcccgcgggagacagcuucucugcaguaaaac

SEQ ID NO: 371185 - RNA, 64 nt, Human
gguuuccgaguaccgcugaacuguggguggguggccgcgggauccccaggcgaccuuccccgug

SEQ ID NO: 371186 - RNA, 64 nt, Human
cugggcagucuguuuacagcuggcaaacagacuggcuggcaaguuguggggcugggucagaaag

SEQ ID NO: 371187 - RNA, 64 nt, Human
gucccagagaggcagccugggcagucuguuuacagcuggcaaacagacuggcuggcaaguugug

SEQ ID NO: 371188 - RNA, 64 nt, Human
cccuuuaucuguacauagugacugaguggggggugcuggcaaguguggcagcugccucugggcu

SEQ ID NO: 371189 - RNA, 64 nt, Human
uuuuaaauaaguauuuuguugagguugaagaauugcuggcaauuaaaagaauagagcuaauuau

SEQ ID NO: 371190 - RNA, 64 nt, Human
uacuguagcccuuugauuccagagagggagcuuugcuggcaaaagcaguuuuugcacuagaaau

SEQ ID NO: 371191 - RNA, 64 nt, Human
gaaggaagccauggcugugguucagagagggugggcuggcaagccacuuccggggaaaacuccu

SEQ ID NO: 371192 - RNA, 64 nt, Human
cugcgugccacguguuuucauagacucaucccaugcuggcaacagcccugcaaggggcuuggcu

SEQ ID NO: 371193 - RNA, 64 nt, Human
gucaaaacugagucaccaccacaaccaaguuccagcuggcaagaagaggaaaaauaacacagag

SEQ ID NO: 371194 - RNA, 64 nt, Human
ggcuauugccaucugggauucucucccuacuacagcuggcaaaguugguuugcagcaagaagau

SEQ ID NO: 371195 - RNA, 64 nt, Human
ccuguaggauccacuggcgucaucaagucaccaagcuggcaacggccaaaccaaggagguagcc

SEQ ID NO: 371196 - RNA, 64 nt, Human
guaguauggcaguacagugcucuguucauugcaagcuggcaaauuuauguagcuauguggaaug

SEQ ID NO: 371197 - RNA, 64 nt, Human
cuucagaguuucaccugcccacacaggguccguugcuggcaacuggacuuccccauaagccuug

SEQ ID NO: 371198 - RNA, 64 nt, Human
caauccugcugauguggcagucaauggcugcagggcuggcaaaccuccccuuagccagucagca

SEQ ID NO: 371199 - RNA, 64 nt, Human
uuguugccuguugaaagaaggaaaaagacacggcgcuggcaagugauaggaacauucuggccag

SEQ ID NO: 371200 - RNA, 64 nt, Human
ugaacaaucagacggaucaccuuaucucuacacagcuggcaaacaccaggcugcggcuuggauu

SEQ ID NO: 371201 - RNA, 64 nt, Human
gucuggaccacccagggccuccacugccaccuuggcuggcaagggagaaauguguuguguuguc

SEQ ID NO: 371202 - RNA, 64 nt, Human
guccagccaagagccaucucgugccaagacuucugcuggcaagggaauggauaaagcuguuuug

SEQ ID NO: 371203 - RNA, 64 nt, Human
auuuucaugguaacaagcucugguauaagcuaaggcuggcaaguucagauacuaaaauauuauu

SEQ ID NO: 371204 - RNA, 64 nt, Human
cuucaguuacuguuuccugaguuacuguuuauccgcuggcaauggugugauuugucuggaucag

SEQ ID NO: 371205 - RNA, 64 nt, Human
ggccuggagucguggcccugcauuucuggguagggcuggcaaugguugccuuaacccuggcucc

SEQ ID NO: 371206 - RNA, 64 nt, Human
cccugggguggccaccaguaugacaguauuauacgcuggcaacacagaggcagcccgcacaccu

SEQ ID NO: 371207 - RNA, 64 nt, Human
cuguuauuugccuacugcuggaagaaggacaaccgcuggcaagguagcguuccccaaucugaau

SEQ ID NO: 371208 - RNA, 64 nt, Human
gggauucaggaauguguggccugcacagugaagugcuggcaaccacuaagaauucaaacugggg

SEQ ID NO: 371209 - RNA, 64 nt, Human
acugaagaaacuucugcuuuaauggcuuuacaaagcuggcaauauuacaauccuugaccucagu

SEQ ID NO: 371210 - RNA, 64 nt, Human
cugucccucaucgcuuaccuuggaaaggugggaagcuggcaaucugcaccuuggggccugggcu

SEQ ID NO: 371211 - RNA, 64 nt, Human
ugcagauagccagacacauggcuauccuagagaggcuggcaaggaguucguggcugcaaaagaa

SEQ ID NO: 371212 - RNA, 64 nt, Human
aaggaagaaggcugugccuagaacaaagaaucaggcuggcaaagaaaucacaggucuuuccuca

SEQ ID NO: 371213 - RNA, 64 nt, Human
ccugaggcaugaagccuccucagcucuuggaauugcuggcaaggggugacugccucugagucau

SEQ ID NO: 371214 - RNA, 64 nt, Human
uaggagaugaacuagaaauaaggggucagauaaugcuggcaaauccuccuacccaaaaaggggu

SEQ ID NO: 371215 - RNA, 64 nt, Human
cccugugguggauuucacuuacaagaaaauugaagcuggcaagacccuguuuucucugcaauuu

SEQ ID NO: 371216 - RNA, 64 nt, Human
gagugacucgaggguuggguucaucugagcaagagcuggcaaagguggcucuccaguuaguucu

SEQ ID NO: 371217 - RNA, 64 nt, Human
uuucagaaacauuccucuucuggggcuucagaaagcuggcaaggccacuagcagagcuuuuguu

SEQ ID NO: 371218 - RNA, 64 nt, Human
ggcuuuuaauuuuaauccuggagucucacugucugcuggcaaagauagagaaugcccucagcuc

SEQ ID NO: 371219 - RNA, 64 nt, Human
ccaggccuuggcagcugugacauugggggccuaggcuggcaacuccgggggcucaacgguggaa

SEQ ID NO: 371220 - RNA, 64 nt, Human
uagcugccauccgaggcuuccuggucuaagaguugcuggcaagaagauggccgggcgugguggc

SEQ ID NO: 371221 - RNA, 64 nt, Human
ccagguugacucucucuggaaugcgguaauaagagcuggcaaguaaggcucagagagaagcaac

SEQ ID NO: 371222 - RNA, 64 nt, Human
uuaacccaccacagcacagccucaucaaaaugcagcuggcaacuucucccccaggugccuuccc

SEQ ID NO: 371223 - RNA, 50 nt, Human
ggggaggucuuuuuaguuaagcuggcaauuaccagaacaauuauguuucu

SEQ ID NO: 371224 - RNA, 64 nt, Human
gauugacucaggauuguuuuucccauauugauaugcuggcaauauaggaugguauguaauggac

SEQ ID NO: 371225 - RNA, 64 nt, Human
uaagauaauuccacagcugucaacuuuguuuggggcuggcaacuucucugcuuaaacaggcuaa

SEQ ID NO: 371226 - RNA, 64 nt, Human
auuugaaagagguuucuuugauguuuuaacuuuugcuggcaaaaaaaaauucacgcuuggugug

SEQ ID NO: 371227 - RNA, 64 nt, Human
cauguuuuaaagguguuuauacugauuugauugugcuggcaaauauacuguauuguuaauauug

SEQ ID NO: 371228 - RNA, 64 nt, Human
aguggcaauagugaugaaaggaccgccuuaucaugcuggcaauguuaauuacccagguguagga

SEQ ID NO: 371229 - RNA, 64 nt, Human
gagaguugaggaaaccagaaggccaaguggaucugcuggcaaacccugaaccugucuccugcgc

SEQ ID NO: 371230 - RNA, 64 nt, Human
ugggccgguggguggcucucagaaaauacuugcugcuggcaaaaggccuguacucaggcauuug

SEQ ID NO: 371231 - RNA, 64 nt, Human
gaauggguaauggggugaguuaacccaccgcccagcuggcaagggaaaccuucugacugguugu

SEQ ID NO: 371232 - RNA, 64 nt, Human
acagauggauggugggcacagauggguccuccaugcuggcaaugcguuacagguuuuaugauaa

SEQ ID NO: 371233 - RNA, 64 nt, Human
ucaaggagauuuacugcuauuuuauuuggaagaagcuggcaacuggucuugaccaaaauagaaa

SEQ ID NO: 371234 - RNA, 61 nt, Human
cacacauucacauauaaauuguuaaaaacugaaggcagaauggaacuaauauauguaacag

SEQ ID NO: 371235 - RNA, 61 nt, Human
aagcuaauguagaaaaguuuagacuuauaaaaaggcagauaguauauauauauuuauauac

SEQ ID NO: 371236 - RNA, 61 nt, Human
aggcugaagcagaagaaucucuugagcccggaaggcagagguugcagugagcugagaucgu

SEQ ID NO: 371237 - RNA, 61 nt, Human
uuuucuuacuguugcuucagaucuaauguaaaaggcagauguccccuccucuccacccccg

SEQ ID NO: 371238 - RNA, 64 nt, Human
cccaggagacugguuucccggugacacauccauugcuggcaaugagugugccagaguuauuagu

SEQ ID NO: 371239 - RNA, 64 nt, Human
caggcgggcccgugcagcuugugggcaagaaggagcuggcaaggaccggcgcugcuggagacug

SEQ ID NO: 371240 - RNA, 64 nt, Human
gcagcucacugaucucuugccucugcugaugggggcuggcaaacuugacgaccccaacuccugc

SEQ ID NO: 371241 - RNA, 64 nt, Human
auggcagagcagucuaaacagaguccgggagaaugcuggcaaaggcuggcuguguauacccacu

SEQ ID NO: 371242 - RNA, 64 nt, Human
auguauaguugcuuuugaaggaauacaauauauagcuggcaagaaugguggcuucuuuucuuug

SEQ ID NO: 371243 - RNA, 64 nt, Human
ccccagcauuccuggcuuucugggguccagauaggcuggcaagagcuguuuuugcauccauuug

SEQ ID NO: 371244 - RNA, 64 nt, Human
ccuguauccacuugggagagagccucuacaacaugcuggcaacuucccccucacugauucaaau

SEQ ID NO: 371245 - RNA, 64 nt, Human
ugacuuuuucuaaccucuuauagacaugccaaaugcuggcaaaaagaagugcuuuuuggauaug

SEQ ID NO: 371246 - RNA, 64 nt, Human
caggacguucauguggaugguuucaugucaucgugcuggcaacuuguccucccugccuuagaga

SEQ ID NO: 371247 - RNA, 64 nt, Human
auacauuaaauauauuuaugcgaguugcaacuaugcuggcaacuggaggcaacagaaagaaaug

SEQ ID NO: 371248 - RNA, 64 nt, Human
gccugugcugacgaggcccggagcugcuccugcugcuggcaacaaaggauucgggaggcugaug

SEQ ID NO: 371249 - RNA, 64 nt, Human
ucacaccgaccgcucucagggcccgcugcccugggcuggcaacaccauucuggccuuggccugc

SEQ ID NO: 371250 - RNA, 64 nt, Human
uggauucuggagcuguucuccauccaugagaguggcuggcaauggcugcucucaaucccuugag

SEQ ID NO: 371251 - RNA, 64 nt, Human
gugcuccccugccacacugauggcucaagacaaggcuggcaaacccucccagaaacaucucugg

SEQ ID NO: 371252 - RNA, 64 nt, Human
guuccaccuagaauacaaguagagaagagcacuggcuggcaagcaucaacaggagucuucuucc

SEQ ID NO: 371253 - RNA, 64 nt, Human
uccagcggcucacaaagaauaagccugccuuagggcuggcaacaucuaagccucuaacagcaca

SEQ ID NO: 371254 - RNA, 61 nt, Human
aaauucuguuccguguuuguguagguaaauaaaggcagacaugguuugcaaaccacaagaa

SEQ ID NO: 371255 - RNA, 61 nt, Human
uuucuuuuuccugaaauucgugauugcaacaaaggcagagggggcggggcgggggagggga

SEQ ID NO: 371256 - RNA, 61 nt, Human
gagggcacccgggcgguaguccgggacgcgcaaggcagagcccugacgcuccggguccccg

SEQ ID NO: 371257 - RNA, 61 nt, Human
uuguaaaggccuuggauauugaaaaaauaccaaggcagaacaguuggacaaucuauuucuu

SEQ ID NO: 371258 - RNA, 64 nt, Human
caggcagaucgauuuuuagaucaauuuuuacagugcuggcaacuugguggugugggaugcuccu

SEQ ID NO: 371259 - RNA, 64 nt, Human
uggagccaacaccgccagccacccccucuggccugcuggcaaugccacaggugcccaagaagau

SEQ ID NO: 371260 - RNA, 64 nt, Human
guaaucaaauaguuaacaucaggaaguuaauuuggcuggcaaaauucuagggaaacuuggccag

SEQ ID NO: 371261 - RNA, 64 nt, Human
gaguuuuguggugcuguagguaacguguggcacugcuggcaaaugaaggucaugagaugaguuc

SEQ ID NO: 371262 - RNA, 64 nt, Human
aguauaucaaucaacucuaacucggagacgucuagcuggcaauguuucuaaaacuuucacugga

SEQ ID NO: 371263 - RNA, 64 nt, Human
aagcuccuuguucucuacuguucaccgggaccuggcuggcaaaugacuuagcuauuaguauauu

SEQ ID NO: 371264 - RNA, 64 nt, Human
uuguccaacaacagugcugacuguccggauaagagcuggcaagugcccuuaggaugccgcaugg

SEQ ID NO: 371265 - RNA, 64 nt, Human
aucugcauccuuaggaaucugggauuugccaguugcuggcaauguagagcaggcauggaauuuu

SEQ ID NO: 371266 - RNA, 64 nt, Human
uucacugucucuuccuacauuaccacuacuacaugcuggcaaaggugaaggaucagaggacuga

SEQ ID NO: 371267 - RNA, 64 nt, Human
guucucuagauccuuuccucuguuucccucucucgcuggcaaaaguaugaucuaauugaaacaa

SEQ ID NO: 371268 - RNA, 64 nt, Human
uuucagucuauccaaaguagcaacuuaacuaguugcuggcaacugaauacccagaguaguggaa

SEQ ID NO: 371269 - RNA, 64 nt, Human
ucuacacauuaacuugagcugcuggagggacacugcuggcaaacggagaccuauuuuuguacaa

SEQ ID NO: 371270 - RNA, 64 nt, Human
accaaaugccucugccuugauggagaaggaaaaggcuggcaagguggguuccagggacuguacc

SEQ ID NO: 371271 - RNA, 64 nt, Human
uaggagauacucagggaagcaaauccuuguuugggcuggcaagcaaauccgacacgacgagguc

SEQ ID NO: 371272 - RNA, 64 nt, Human
agggagggagggagcaagugugaagggcacagcugcuggcaaaugccccauucccugccccagc

SEQ ID NO: 371273 - RNA, 64 nt, Human
uggauuucugcccaagaccagaggagugugcugugcuggcaaguguaagucccccaguugcucu

SEQ ID NO: 371274 - RNA, 64 nt, Human
aggcgaccugggcugcugcccgaagguuuggccgccgcgggacaccuguuuccuucccgcagug

SEQ ID NO: 371275 - RNA, 64 nt, Human
gguggcgccggugcccgacaugguggugccaccuccgcgggagcacuggugcgcggggccugcg

SEQ ID NO: 371276 - RNA, 64 nt, Human
caggagcaagggaggaagccaggggcgaggcaggccgcgggaaagccagggccccugccugcag

SEQ ID NO: 371277 - RNA, 64 nt, Human
ggucacgcggcgggcaccccagcgcagccuggcgccgcgggacugaagcucgagaagggccuga

SEQ ID NO: 371278 - RNA, 64 nt, Human
uagggaggugggguagagcacucuccguccugcugcuggcaaggaaugggaacaguggcugucu

SEQ ID NO: 371279 - RNA, 64 nt, Human
aagaccaaauuauggaaaauaagaaaaagcuguugcuggcaagaccaucaagacuguucugaca

SEQ ID NO: 371280 - RNA, 64 nt, Human
uguuuuccaaacccagucuguucccugcucccucgcuggcaagccccaccacacaggagugagg

SEQ ID NO: 371281 - RNA, 64 nt, Human
guuggugguaggaggauggggagaggaaaaaagagcuggcaaagaaauggauagggaauauuuu

SEQ ID NO: 371282 - RNA, 64 nt, Human
gaaagacauguuuucuagauggcucacucacauggcuggcaacuugguguuggcuauuaaugua

SEQ ID NO: 371283 - RNA, 64 nt, Human
ugaacaacacugggguuaagucucugguauuuaggcuggcaauauauauauuaaccauauuuua

SEQ ID NO: 371284 - RNA, 64 nt, Human
uccccucagguuugccaaguacuacagagaccuggcuggcaacgagcagcgcacgcucaucaag

SEQ ID NO: 371285 - RNA, 64 nt, Human
ucacuaaauuccugggauggaaguaaaagacaaugcuggcaacugggcucuaaucuccuaaaga

SEQ ID NO: 371286 - RNA, 64 nt, Human
ccuuguauuagcaagcuaggucuggcugcguggagcuggcaaguagauuucagcaacuugagcu

SEQ ID NO: 371287 - RNA, 64 nt, Human
cucgggacagcuggucuuuccggccaucuuucuugcuggcaagucagcaaacauuaccuucuua

SEQ ID NO: 371288 - RNA, 64 nt, Human
uauuauggauuuagccuuaggcuuuaaguuuuaggcuggcaaaagaaauguuauucaguggguu

SEQ ID NO: 371289 - RNA, 64 nt, Human
uggggugaagagaucuugugauuuuuaagaaccugcuggcaagaguuuaacuugucuucagcau

SEQ ID NO: 371290 - RNA, 58 nt, Human
auaaaaaugcuuaugucuaaaagagcucgcuggcaagcugccucuugaguuuguuaua

SEQ ID NO: 371291 - RNA, 64 nt, Human
aauucauauccaucugguaugaauauauaacucagcuggcaaaugaauguguuuguugagauau

SEQ ID NO: 371292 - RNA, 64 nt, Human
ggaacacucaugucuggaguccccuccuccagccgcuggcaacaacagcuucaguccaugggua

SEQ ID NO: 371293 - RNA, 64 nt, Human
uuuaauacgcuuagaaucaguuuuacuccaaucagcuggcaauuuugagcugccgguuauacac

SEQ ID NO: 371294 - RNA, 64 nt, Human
gcccccaaaggcaggcaggauccucaggccccagccgcgggaggcuggaagggcuggcagaucg

SEQ ID NO: 371295 - RNA, 64 nt, Human
aagcugccggcugcaggagccagagaagugacccccgcgggagcagcggcagguggaucuccac

SEQ ID NO: 371296 - RNA, 64 nt, Human
gccccgccggccgcccucacgcacgcgcugugccccgcgggagcuccaggccgccccuccugcc

SEQ ID NO: 371297 - RNA, 53 nt, Human
auuuggacucggacagcugacggccgcgggacacuugcccguauuacuuaccu

SEQ ID NO: 371298 - RNA, 64 nt, Human
gucuguugaggcaucaaaaaaacaaguuuagaaagcuggcaacaugaagaaugcauucaaaaua

SEQ ID NO: 371299 - RNA, 64 nt, Human
gaaaggaagauggacucuuggcuuccucucucuggcuggcaaagggaguuaucuucuggaauac

SEQ ID NO: 371300 - RNA, 64 nt, Human
gaagguacccaaagggaaaaagagaaaagcugaugcuggcaaggagcgggaaggugcuggagau

SEQ ID NO: 371301 - RNA, 64 nt, Human
agcagguuccuugcauuugcugccuggaugugcagcuggcaacagugaugaauuggucacugcu

SEQ ID NO: 371302 - RNA, 64 nt, Human
uuggcaaagaucaaaaagcuuguuaagacuccuagcuggcaagcaugugggaaauagguacucu

SEQ ID NO: 371303 - RNA, 64 nt, Human
uugcugcugguaugagacucccugggaccuagaggcuggcaaauguuuaaaaucaccacgugua

SEQ ID NO: 371304 - RNA, 64 nt, Human
aaggcagggagagggaguggcccgucccugggaggcuggcaaagugcucuccagggagggguca

SEQ ID NO: 371305 - RNA, 64 nt, Human
cugagcagguugcuccacagguagcucuaggagggcuggcaacuuagagguggggagcagagaa

SEQ ID NO: 371306 - RNA, 64 nt, Human
ucaccacucaguacggcgccgccuucugggucacgcuggcaaccggugaggaccgagagaaugg

SEQ ID NO: 371307 - RNA, 64 nt, Human
cuccuccucuucugggcuccccacugucagacgggcuggcaaaugccuugcaggagguagaggc

SEQ ID NO: 371308 - RNA, 64 nt, Human
ucagugguggaauuccaggcacugugacugucaagcuggcaagggccaggauugggggaaugga

SEQ ID NO: 371309 - RNA, 64 nt, Human
ccuucucuucugugcaccuaaguugcccagcccugcuggcaaucucuccaucagaauccaccuu

SEQ ID NO: 371310 - RNA, 64 nt, Human
gauuggggaugacaggaaucucacccucuggggugcuggcaaggaggucuuugcacaggaaaag

SEQ ID NO: 371311 - RNA, 64 nt, Human
uagugggaaccaacagcugggcuggagaguuggugcuggcaaaacaguccuugcccuggggccg

SEQ ID NO: 371312 - RNA, 64 nt, Human
uccucacagggacuaggaggcucaguccccaacggcuggcaagacucaggguccucaguggaca

SEQ ID NO: 371313 - RNA, 64 nt, Human
accucuucuuccccucuuccagagcuuccacggugcuggcaaaguccugcagcuucuucuucga

SEQ ID NO: 371314 - RNA, 52 nt, Human
uuguauuguugccggcaugacaccgcgggacggccgcaggacgcaggcgagg

SEQ ID NO: 371315 - RNA, 64 nt, Human
ggcccuggccaucgggagagcucugaccugcacaccgcgggaggccagggugcugacugucaag

SEQ ID NO: 371316 - RNA, 64 nt, Human
cuggggccuugagcgcaggccucaucuuucugugccgcgggacucugcaccuaccucacagggu

SEQ ID NO: 371317 - RNA, 64 nt, Human
gggccggggccuggaagaaugauuggcugggaggccgcgggagggaggccaggaggcccggacc

SEQ ID NO: 371318 - RNA, 64 nt, Human
auaccccaccgugaugacuugaaauauaaucagcgcuggcaauuuuugacagucucuacggaga

SEQ ID NO: 371319 - RNA, 64 nt, Human
caggaauauaugucagugaugacuauucucaaaugcuggcaaauccaggcugguguucugucug

SEQ ID NO: 371320 - RNA, 64 nt, Human
uguggaguuacagccucaagguuguagcaugugugcuggcaaucagggccgcaguguguucugc

SEQ ID NO: 371321 - RNA, 64 nt, Human
ugucggcccgagacauuuggaaguccugggggaugcuggcaaaucucagcuguugcugaggagg

SEQ ID NO: 371322 - RNA, 64 nt, Human
ggagggaagggcugggaugcugggaccuguuguugcuggcaaagccagaggucacaguggccug

SEQ ID NO: 371323 - RNA, 64 nt, Human
guaauuugagaacuuuaagguugucuuuuuaacugcuggcaaaauguugauuuuuuaauauuag

SEQ ID NO: 371324 - RNA, 64 nt, Human
caaucaaaggaacucugggaaggagguugugauugcuggcaagucccccccaacuguaccacgg

SEQ ID NO: 371325 - RNA, 64 nt, Human
ugucuccuggauugugucaucaugggguaucagggcuggcaaaaccccugcucugcuuuuggcc

SEQ ID NO: 371326 - RNA, 64 nt, Human
cuccgcccagguggggaucgugggccgcacuggggcuggcaagucuuccaugacccuuugccug

SEQ ID NO: 371327 - RNA, 64 nt, Human
ccugggcccccaccauucacuuuuuguccuugcugcuggcaaacaguaaagaaacucacuuucc

SEQ ID NO: 371328 - RNA, 64 nt, Human
agcccaggcucaggcaggccuggcccagagucacgcuggcaaccacgaguuugggaagcagucg

SEQ ID NO: 371329 - RNA, 64 nt, Human
ggccuaacagcaucucagggaauguccaucuggagcuggcaagaccccugcagaccucauagag

SEQ ID NO: 371330 - RNA, 64 nt, Human
ccagagcuggcccaagacccuuagaacccugagugcuggcaaaucucacugcuccugacccagc

SEQ ID NO: 371331 - RNA, 64 nt, Human
gagcaugccugucuucccagggguguaccucuuggcuggcaaagcccaaggccagugggaacuu

SEQ ID NO: 371332 - RNA, 64 nt, Human
aaaugaaauccagugaagaaaugaucaaaagugagcuggcaaccuuugaccuuucuguucaagg

SEQ ID NO: 371333 - RNA, 57 nt, Human
gccagucucuaugcugcuagcccaucugcuggcaaaccaccugcuacaggaccaccu

SEQ ID NO: 371334 - RNA, 64 nt, Human; identical to SEQ ID NO: 136763

SEQ ID NO: 371335 - RNA, 64 nt, Human; identical to SEQ ID NO: 136764

SEQ ID NO: 371336 - RNA, 64 nt, Human; identical to SEQ ID NO: 136765

SEQ ID NO: 371337 - RNA, 64 nt, Human; identical to SEQ ID NO: 136766

SEQ ID NO: 371338 - RNA, 64 nt, Human
gaagccugcuuauuggauccugacaucaggaauagcuggcaacaagccccugugcccguuuggg

SEQ ID NO: 371339 - RNA, 64 nt, Human
cucaauuaauccuguuuuacauuucagaccuaaagcuggcaaucaggagaagaagcacuuuguu

SEQ ID NO: 371340 - RNA, 64 nt, Human
ugucagggcugaguguucugggauuucucuagaggcuggcaagaaccaguuguuuugucuugcg

SEQ ID NO: 371341 - RNA, 64 nt, Human
guccugucggucucaguacguucacuuuauagcugcuggcaauaucgaagguuccuuuuuuguu

SEQ ID NO: 371342 - RNA, 64 nt, Human
aagaaagguucugugauucacuuuugcuucuggggcuggcaaaaaccuucucugaacccacaca

SEQ ID NO: 371343 - RNA, 64 nt, Human
ucuuucauucuuucugcugagacuggccugaaaggcuggcaagugggagggagucaguggggag

SEQ ID NO: 371344 - RNA, 64 nt, Human
aauguucaccuagagguguucugguaaacugauugcuggcaacaacagauucucuuggcucaua

SEQ ID NO: 371345 - RNA, 64 nt, Human
aauguucaccugcagauguucugguaaacugauugcuggcaacaacagauucucuuggcucaua

SEQ ID NO: 371346 - RNA, 64 nt, Human
gcggccgcuaggccucaagucccgaccguggagcgcuggcaagggcguccuggcccagcccuga

SEQ ID NO: 371347 - RNA, 64 nt, Human
ucugagcagaagcccaggcgggcccggggccuuggcuggcaaauaaagcguuagcccgcagcgc

SEQ ID NO: 371348 - RNA, 64 nt, Human
caggacuugggguugaggugagucauggccucuugcuggcaauggggugggaggaguaccccca

SEQ ID NO: 371349 - RNA, 64 nt, Human
acagcgucgggacugagaggggagagagacuggagcuggcaaggacgugggccuccagaguugg

SEQ ID NO: 371350 - RNA, 64 nt, Human
ccggggaggaggaugcucugagauucaggguggggcuggcaaccccugaagagaacacuuccug

SEQ ID NO: 371351 - RNA, 64 nt, Human
guaaacccugaaucucaucuggggugggggcccugcuggcaacccugagcccuguccaagguuc

SEQ ID NO: 371352 - RNA, 64 nt, Human
auguaagaaauguagaaaaaccuucagccaggaggcuggcaagauggccgaauaggaacagcuc

SEQ ID NO: 371353 - RNA, 64 nt, Human
aaacagaaacucugaggauggccuuuaugagggagcuggcaauugaacaucauucaucuaaaua

SEQ ID NO: 371354 - RNA, 64 nt, Human
gguggcgcugccgaguccgggccggggccucugcccgcgggaggagauuuuuuuuuuucauauu

SEQ ID NO: 371355 - RNA, 62 nt, Human
agcaggagacaaaccucugaggacagggccagccgcgggacugacacccugggauggaaccu

SEQ ID NO: 371356 - RNA, 64 nt, Human
ggcgaggagcagagggagcggaggaggggccggcccgcgggagccgcggccaccaggaggcccc

SEQ ID NO: 371357 - RNA, 64 nt, Human
gaucaguuucuguugggagacggguguccuuuacccgcgggaagggggcggggcuucccucccg

SEQ ID NO: 371358 - RNA, 64 nt, Human
gcauuuuugaagcccuccacaccguuccggaagagcuggcaaaaggagccucacacccccaagg

SEQ ID NO: 371359 - RNA, 64 nt, Human
cccuuguccugcagaugggaaaacaggauggggagcuggcaagaggagcugcuuguucccacca

SEQ ID NO: 371360 - RNA, 64 nt, Human
uccaagggguccgaggaaucacucacuccuggaggcuggcaaggagacagucugaggccaggga

SEQ ID NO: 371361 - RNA, 64 nt, Human
cuggcuaagggaaccauuucacugccggacuuaggcuggcaaugcccccuuccccaaccccaga

SEQ ID NO: 371362 - RNA, 64 nt, Human
agaccaucugaggccuaugccaucuggacugucugcuggcaauuucuuuuuuucuuucuuuucu

SEQ ID NO: 371363 - RNA, 64 nt, Human
gggugagccccucacagccuugccccuccccaaggcuggcaaccugccucccauugcccaagag

SEQ ID NO: 371364 - RNA, 64 nt, Human
uccagcccccucagaaggggcuggauugauggaggcuggcaagggaaaguuucagcucacugug

SEQ ID NO: 371365 - RNA, 64 nt, Human
uuggggcaauguucccuuguuggugggcccccaagcuggcaaggccucuuggcugaaggccagg

SEQ ID NO: 371366 - RNA, 64 nt, Human
ccaagacugaguuuuggggggcaagguggagagagcuggcaacuacugugagcaaguccccuag

SEQ ID NO: 371367 - RNA, 64 nt, Human
aucuccucccaccaguggcccccacucacagggagcuggcaaugcccuaccugccuguucucca

SEQ ID NO: 371368 - RNA, 64 nt, Human
uuuguauguguuuuaucagaauuugcuggacuaugcuggcaaggacuuuguuuacgaucaaauu

SEQ ID NO: 371369 - RNA, 64 nt, Human
gaucuagguuguggcugcugguaugcuucagcuugcuggcaaugaugugccuugacaaccgugg

SEQ ID NO: 371370 - RNA, 64 nt, Human
uuguuuuucuuuggggguuuuguuuauuuuuggggcuggcaauccaaaauagaaaaucugaucc

SEQ ID NO: 371371 - RNA, 64 nt, Human
accccacagugcaccugcccaggggcuguucagagcuggcaauggcagcgacagcagcaacagc

SEQ ID NO: 371372 - RNA, 64 nt, Human
cuuacuuuguuuccugaagugauagccuacuaaugcuggcaagcagaugcuuaauaguaaauuu

SEQ ID NO: 371373 - RNA, 58 nt, Human
aaaugaguuguucaccuuaacccauuacgcuggcaaacugauacaacucagaaacugc

SEQ ID NO: 371374 - RNA, 64 nt, Human
accccaggaccugccacuucuccugcuaccgggaccgcgggauggaccagauaucaagagagcc

SEQ ID NO: 371375 - RNA, 64 nt, Human
ccagggaagagcagcuccagagcccuggccggggccgcgggauaucaauaucaggcugccccac

SEQ ID NO: 371376 - RNA, 64 nt, Human
agcugguuuugauggccucccacugccccacacgccgcgggaccuccaggggcgacucuagugg

SEQ ID NO: 371377 - RNA, 64 nt, Human
cccccguauaaagaccgcgggccucgccagaagaccgcgggaggagggcgcgguccccgggggc

SEQ ID NO: 371378 - RNA, 64 nt, Human
aacugaaauuuagccuuacucccaaguuauaaaugcuggcaacaaaucacaguaguaaaagcag

SEQ ID NO: 371379 - RNA, 64 nt, Human
ucuaauaggagguuugagcucaaaugcuuaaacugcuggcaacauauaauaaaugcaugcuauu

SEQ ID NO: 371380 - RNA, 51 nt, Human
cuaccaagaacaaagcauaaugcuggcaauuaaaaaugugguuuaguuuuc

SEQ ID NO: 371381 - RNA, 64 nt, Human
agcagucacucccuaucuuccccuccaccuguccgcuggcaaccacugaucuccuuuuuauuuc

SEQ ID NO: 371382 - RNA, 64 nt, Human
cacagaaaaacaucugaagauggauugggugagggcuggcaaaacgaaggcaugccgggccagc

SEQ ID NO: 371383 - RNA, 64 nt, Human
ccaugucuuauagccucccaucgugcccacgauagcuggcaacggcgacacuuccaacuucgaa

SEQ ID NO: 371384 - RNA, 55 nt, Human
gauccuucaucaacgucuagcggccccgcgggacuggggacugagcccaggaggu

SEQ ID NO: 371385 - RNA, 64 nt, Human
ugggcaagucuacuuccugccauuucugaaagccccgcgggaccagcuucuaggcugagcugcc

SEQ ID NO: 371386 - RNA, 64 nt, Human
agcaguagggcugcgggccacgcccaggccggcuccgcgggaacucucucccucagacaggcca

SEQ ID NO: 371387 - RNA, 64 nt, Human
ucucugcuuacguaugccaugcauaccuccugccccgcgggaccacaauaaaaaccuuggcaga

SEQ ID NO: 371388 - RNA, 64 nt, Human
cuacccucacugggugggacugccagcggagaguccgcgggagguggcuugggugugcgacguc

SEQ ID NO: 371389 - RNA, 64 nt, Human
cggagggcagucccgggugggcuucuuccagcccccgcgggaacggggguacacggugggcuga

SEQ ID NO: 371390 - RNA, 64 nt, Human
cgguacgccacauaggggccugcugccugccgccccgcgggaccugugcaagcacauucaccaa

SEQ ID NO: 371391 - RNA, 64 nt, Human
cgggggccguggggggccuggaggagggcaggggccgcgggaggccgggaggaggguggggacc

SEQ ID NO: 371392 - RNA, 64 nt, Human
ggagcggcagccgagcggccuguccuucgaguauccgcgggacccggagcaucgcaguuauagc

SEQ ID NO: 371393 - RNA, 64 nt, Human
cuucgaggacgcccgccugccucgcgggucguguccgcgggacuguguucguacgugcauaguu

SEQ ID NO: 371394 - RNA, 64 nt, Human
gagggggagggccugcuggcucaccgugaggcagccgcgggagggagcgcugacgucacagaag

SEQ ID NO: 371395 - RNA, 64 nt, Human
gaguccccccaccccuccccacccaccaccgcucccgcgggaagccagcccgugcaacggaagc

SEQ ID NO: 371396 - RNA, 64 nt, Human
cgucagggucagcucccccgcggagcugacuucagcagcccacagcuguggggcuucagcagcc

SEQ ID NO: 371397 - RNA, 64 nt, Human
caggcuccccagcggcccagggugggccagaccagcagcccaggaagcagcacacgcggccgug

SEQ ID NO: 371398 - RNA, 64 nt, Human
gcugggcggugcagcuccgcccggcuccgccccugcagcccacacagcacaacgucuuaccgug

SEQ ID NO: 371399 - RNA, 64 nt, Human
acucugcagauggggcuaggacugugggcuuuuagcagcccacaggugauccuaacauaucagg

SEQ ID NO: 371400 - RNA, 64 nt, Human
accuuccuccagccugugcgcaccugcccuccuugcagcccagcacaccugcagguguaaggga

SEQ ID NO: 371401 - RNA, 64 nt, Human
gcuuccuagaaauaagcaacaccucucccaaaaagcagcccacaaggcaggggcccagcagccc

SEQ ID NO: 371402 - RNA, 64 nt, Human
ucucccaaaaagcagcccacaaggcaggggcccagcagcccagccaucacucaucuuugaggaa

SEQ ID NO: 371403 - RNA, 64 nt, Human
ugauacuuggaugcagcucuugggaccguguucugcagcccagccuuccuguugggguggggcc

SEQ ID NO: 371404 - RNA, 64 nt, Human
aaagcucacgaaccccaaaccuggcaagucaccugcagcccauggugagcucugggaagugugg

SEQ ID NO: 371405 - RNA, 64 nt, Human
uccccccccauccugucaggcacaggugacgggggcagcccaugcgagcccuucuccugcugcu

SEQ ID NO: 371406 - RNA, 64 nt, Human
aggggggcgacccgcggagaccccagcagaggucgcagcccagcucccagggggcccggcgccu

SEQ ID NO: 371407 - RNA, 64 nt, Human
cggguggugggccaaggaggagcuuagcaagucugcagcccagccccaccuccauaggguccug

SEQ ID NO: 371408 - RNA, 64 nt, Human
gagccugguguugggucaugcugggaagggagcggcagcccagccaggccuggcccauaaaagg

SEQ ID NO: 371409 - RNA, 64 nt, Human
gccaggccuggcccauaaaaggcucccaugcugagcagcccauugcugaagccaggauguucug

SEQ ID NO: 371410 - RNA, 64 nt, Human
aucggacauagaguuggagggggaggccccugaggcagcccagcuccugaauaaagauucuaca

SEQ ID NO: 371411 - RNA, 64 nt, Human
ccugaggccucuggacccaucugucuuccugagggcagcccaggaccuuuggccaaucccaguu

SEQ ID NO: 371412 - RNA, 64 nt, Human
ucuggcuccagaggaccugagacucacacucucugcagcccagccuagucagggcacagcugcc

SEQ ID NO: 371413 - RNA, 64 nt, Human
ccucucuucguccugaucccuccacccccauguggcagcccauggguaugacauaggccaaggc

SEQ ID NO: 371414 - RNA, 64 nt, Human
gagacaugacccagaagcaucagugugcaucuacgcagcccagguccaggaccacauccuggcc

SEQ ID NO: 371415 - RNA, 64 nt, Human
guggaagggccagagaguaaauauuuuaggcuuugcagcccauacggucucugucacagcuagu

SEQ ID NO: 371416 - RNA, 64 nt, Human
ccccucuccuuuuccuggacucuggccgugcgcggcagcccagguguuugcucaguugcugacc

SEQ ID NO: 371417 - RNA, 64 nt, Human
gguuggugggggccucgguguggagaagcggcuggcagcccaccccucaacaccucugcacaag

SEQ ID NO: 371418 - RNA, 64 nt, Human
cucgucacccuucuccuuuuggggugagagaccagcagcccaagggcuccagacacaccugaac

SEQ ID NO: 371419 - RNA, 64 nt, Human
uauggaaaaauaguagaauuacacagcaugaaaagcagcccaugguuuaaauuauuggacaauu

SEQ ID NO: 371420 - RNA, 64 nt, Human
aagaagcgagaacugcccucccccuccucucggugcagcccagccgggcccccuuccccaggcc

SEQ ID NO: 371421 - RNA, 64 nt, Human
gggccccugaggagcuuugugucgucuugaacgagcagcccagggccuagagguaaccguuagg

SEQ ID NO: 371422 - RNA, 64 nt, Human
gcacaggggccccagaucugccugggccugugcagcagcccagcuuccugguguauuuuucagg

SEQ ID NO: 371423 - RNA, 64 nt, Human
auccguuucccuggacaggucucuuuccuggaaugcagcccaggcaccugugcuccuggcaccc

SEQ ID NO: 371424 - RNA, 64 nt, Human
gaacccuaaaauggucguugaaggcgccugggccgcagcccagcaguaguuggagaggcaggca

SEQ ID NO: 371425 - RNA, 64 nt, Human
gggccagggcccgucgcagcggagcccccucucagcagcccaccgggucccuccaggcugcugc

SEQ ID NO: 371426 - RNA, 64 nt, Human
gaggucuccucagugcauaaggaagaacucuacagcagcccaaucuucaggcuagugggauugg

SEQ ID NO: 371427 - RNA, 64 nt, Human
gggggggggaguugggcuguguuggaaugggccugcagcccaacaaacaagggaacuaggaccg

SEQ ID NO: 371428 - RNA, 64 nt, Human
gguggccucagccacacaguucuccccaaggggagcagcccagggccaagccccgcugccuucc

SEQ ID NO: 371429 - RNA, 64 nt, Human
agcccaacaccaccuuccuccuggcuuccagggggcagcccaguggaauggaaagaauguggga

SEQ ID NO: 371430 - RNA, 64 nt, Human
agaaaaaacaacaaggaaguaaaaccaaagacaggcagcccagcgccaggcccaaaaccaggcc

SEQ ID NO: 371431 - RNA, 64 nt, Human
ugggccuccagcuucucucagagucucccccucugcagcccauccugggaguguauuaacugga

SEQ ID NO: 371432 - RNA, 64 nt, Human
caccauuaugagaaaugcuuccagucacaaaaaugcagcccagcucacucugaggaagaagcag

SEQ ID NO: 371433 - RNA, 64 nt, Human
acagcucucuggacaggaauuaacaaacgcuggagcagcccagaggaaauucgugugaaagagg

SEQ ID NO: 371434 - RNA, 64 nt, Human
gaggaaaccagacaccugagacaggagccuguaugcagcccagugcagccuugcagaggacaag

SEQ ID NO: 371435 - RNA, 64 nt, Human
aguuguuaucuaaaccuuuaaaccuaucuuccaggcagcccagagaagaucuguuucccugugu

SEQ ID NO: 371436 - RNA, 64 nt, Human
agugacuaaccaggcagcuaagaagucuuaggcagcagcccagacauguauagaggggcaguua

SEQ ID NO: 371437 - RNA, 64 nt, Human
uagaaagagauaacacauggaaagacgguguggugcagcccagcccacgguggcuguuccauga

SEQ ID NO: 371438 - RNA, 64 nt, Human
ugccagauaaccaguuucaugaacuguuuguauggcagcccauguucucuaaugccacugcucu

SEQ ID NO: 371439 - RNA, 64 nt, Human
ugugggaggaagaagccccguuuccagggcauccgcagcccaggguagggagaaauauucucuc

SEQ ID NO: 371440 - RNA, 64 nt, Human
cgccucuggaagaacguguacgacgagcuggggggcagcccaggcagcaccagcgcggccacgu

SEQ ID NO: 371441 - RNA, 64 nt, Human
cucauggcuucauuuagagaccacaguaacaacagcagcccaccaaucagagaagcugguuguu

SEQ ID NO: 371442 - RNA, 64 nt, Human
accagauucaccauuagagguugauggggcaacugcagcccaugacacaagaucucauuguucu

SEQ ID NO: 371443 - RNA, 64 nt, Human
cagauuauuaagggaauaagccaugacgucaauagcagcccagggcacuucagaguagagggcu

SEQ ID NO: 371444 - RNA, 64 nt, Human
ggcagcaugguguggcaguuaagagaugggcugugcagcccauccugagcuccaguccugaguu

SEQ ID NO: 371445 - RNA, 64 nt, Human
cugggggagagcuuggggcagcagaggccccugggcagcccagccaggggagccacagccccaa

SEQ ID NO: 371446 - RNA, 63 nt, Human
ggcuuggacuuugugacuagacguccuaacugggcagcccaacccuccccugcaaguuuguag

SEQ ID NO: 371447 - RNA, 64 nt, Human
uaucaggaaacaggcagaccagggccccgugggggcagcccagaccaguacccuuaccgaaccc

SEQ ID NO: 371448 - RNA, 64 nt, Human
gggccugccaaagccugggcccacagcugcaccggcagcccaaggggaaggaccgguuggggga

SEQ ID NO: 371449 - RNA, 64 nt, Human
gaguagcagccgaugcucucuccaaagcagggcagcagcccauaccagcuggcaucuccccccc

SEQ ID NO: 371450 - RNA, 64 nt, Human
ugaagauacaugauacacuuuguacaacuauccugcagcccauugguugcuuauauuuaucgcu

SEQ ID NO: 371451 - RNA, 64 nt, Human
acucaaagucuaacaagaaagacauggaaaauuagcagcccauuuucagaaagaucaaaaugau

SEQ ID NO: 371452 - RNA, 64 nt, Human
cauugcccugaggggccugccacucuccugaggagcagcccaccugcugcccgugaggaggggg

SEQ ID NO: 371453 - RNA, 64 nt, Human
ggcaggagaauuacuugaacgcaggagaaucacugcagcccaggaggcagagguugcagugagc

SEQ ID NO: 371454 - RNA, 64 nt, Human
guacugaauggucuuccauccccagcaagggggugcagcccagggucaggcccuucagagccag

SEQ ID NO: 371455 - RNA, 64 nt, Human
aaagagguccacaaccaggugugcacuguucacugcagcccauuugcuguaugaacugugguug

SEQ ID NO: 371456 - RNA, 64 nt, Human
ugggcagggaugggggcuugagaaaucaacaggugcagcccagugggucagaggaaagcgugcu

SEQ ID NO: 371457 - RNA, 64 nt, Human
uuguguugcaguaccccccauucacccacaaaaugcagcccaccacccagucccccaauuccag

SEQ ID NO: 371458 - RNA, 64 nt, Human
ccuuuuaaaggccacuggcaguaggauuuaaaaagcagcccacugcucaguuuccaggaucagc

SEQ ID NO: 371459 - RNA, 64 nt, Human
ggccuggggucgggagaggugggcgcuagaagaugcagcccaggauguggcaaucaaugacacu

SEQ ID NO: 371460 - RNA, 64 nt, Human
ccugccccagugagacccuggggccccuuggcgggcagcccagccucugucccucuuugccugu

SEQ ID NO: 371461 - RNA, 64 nt, Human
gcauccucuacugaggugauuucauuuauucccugcagcccacugauaaauaucucacuucucc

SEQ ID NO: 371462 - RNA, 64 nt, Human
uucuuauaugaaauuuuuuaaaagcagaaaccuagcagcccaucugcuuuuucucuuuugucgg

SEQ ID NO: 371463 - RNA, 64 nt, Human
cucagcccucuccuggagcccccggaauuucucagcagcccaggcccucccgcugcccguggcc

SEQ ID NO: 371464 - RNA, 64 nt, Human
agagugggguaagcaccccuaccugccuuacagagcagcccagguacccaggcccgggcagaca

SEQ ID NO: 371465 - RNA, 64 nt, Human
ugaggugccagcacgggccaccugcggguguggcgcagcccagggcucacacugcgugggaggg

SEQ ID NO: 371466 - RNA, 64 nt, Human
agcucugggacaggacaccuuggguuuguggacugcagcccacuaugauguuauuacuucucug

SEQ ID NO: 371467 - RNA, 64 nt, Human
cuuuuggucauccucugcgugucaguaaaagcaggcagcccauacgagcugugguaugcgugcu

SEQ ID NO: 371468 - RNA, 64 nt, Human
uggagauggucuggugccuagcugggagugagcagcagcccauccccuguucacuuucucuagc

SEQ ID NO: 371469 - RNA, 64 nt, Human
aucauagcacuuggacuguugggccggaguuugugcagcccaugccuagcgaugcugcaccucc

SEQ ID NO: 371470 - RNA, 64 nt, Human
ccacagagucucucccuggagcagcagacuaugggcagcccagugcugccaccugcugacgacc

SEQ ID NO: 371471 - RNA, 64 nt, Human
cucaggcugcuggucccaaccucagagccccaccgcagcccaguagggaugcagcacgccccag

SEQ ID NO: 371472 - RNA, 64 nt, Human
ugguauuucgauuagaagaagcugcaaaagaaaggcagcccauuuuaccauugccagccaggcc

SEQ ID NO: 371473 - RNA, 64 nt, Human
acacaucuccaaaugggcaaggagucucuagcaugcagcccaggccuucuccauaccccucucc

SEQ ID NO: 371474 - RNA, 64 nt, Human
gcugggacuucccauguggcccacaucugaccuggcagcccauguauuccggucauuagggaug

SEQ ID NO: 371475 - RNA, 64 nt, Human
aauuuaaguuuuacauagagacccauguaugacugcagcccauuggcugcaagaccagggagga

SEQ ID NO: 371476 - RNA, 64 nt, Human
augccaaccucagcgucaugccagaaugcacagggcagcccagggagaucacaccuuuggcaaa

SEQ ID NO: 371477 - RNA, 64 nt, Human
agcgggcgcagggcacaccuggccaggcuugggggcagcccaucucagguggcccugcacgcgu

SEQ ID NO: 371478 - RNA, 64 nt, Human
ugaccaaagcaguuggcucuuaaaaggugggagagcagcccaaccaauccccaauccuuuucuu

SEQ ID NO: 371479 - RNA, 64 nt, Human
caaaucuggagccacagacagguucccuccauuggcagcccauuguguuugaaauuccaugucg

SEQ ID NO: 371480 - RNA, 64 nt, Human
ugggcuggcuggguuacagcagcagggaggcccagcagcccacuggcagaggcgagagcucugg

SEQ ID NO: 371481 - RNA, 64 nt, Human
gaagaagcucugagggcggcaggaccagccagcagcagcccaagcuucccuccaucccccuuua

SEQ ID NO: 371482 - RNA, 64 nt, Human
ccaagcgccagugaggacugcuggcccugacucugcagcccacucuugccguguggcccucacc

SEQ ID NO: 371483 - RNA, 64 nt, Human
cuuuauggaaguuuaaagcauguuugcaaauauugcagcccauugaaagaauuugcauguacag

SEQ ID NO: 371484 - RNA, 64 nt, Human
aacccagaugcccccacccugccacauacuagaugcagcccauaguuggccccccuagcuucca

SEQ ID NO: 371485 - RNA, 64 nt, Human
cgggcacucccgggauggguggaccaaacccuuagcagcccagcauuucccgaaggccgacacc

SEQ ID NO: 371486 - RNA, 64 nt, Human
aacugggggagaggaggccgccagcccggaggcugcagcccagaaacucuaccucauccacacu

SEQ ID NO: 371487 - RNA, 64 nt, Human
uguagaugguagagcugggacuagcaacauugcugcagcccauuguuggccucucucuucacuu

SEQ ID NO: 371488 - RNA, 64 nt, Human
ugcucuaaggcgccugcagaggcgagcagagcccgcagcccacgccuucucgaccgcgcacuuc

SEQ ID NO: 371489 - RNA, 64 nt, Human
ggccacugguccccaacaaugugaggggucccuagcagcccacccugcugcuggugcacagcca

SEQ ID NO: 371490 - RNA, 64 nt, Human
agugcaauaaaggccauucguuaccuacuuuucagcagcccacaagauguagcacuauuagugu

SEQ ID NO: 371491 - RNA, 64 nt, Human
ucucccaccugccuguucaguggaggccagggcagcagcccagaacagcacaugugggggaggu

SEQ ID NO: 371492 - RNA, 64 nt, Human
ggugagguggucacucuugcucagggucuguugugcagcccagauggacaccuguuucuccaac

SEQ ID NO: 371493 - RNA, 64 nt, Human
guccaaguuacgacuuccaaccaaacuauauuaagcagcccagccuuuaaaaguuuuuggcaaa

SEQ ID NO: 371494 - RNA, 64 nt, Human
ugagaaccaaucaucauggaagucaguugcgggggcagcccauaaggaaagggaaagugagugg

SEQ ID NO: 371495 - RNA, 64 nt, Human
cugagccuccugcagacgggcgaagccgccugcugcagcccaggaagccagcccucugcucggc

SEQ ID NO: 371496 - RNA, 61 nt, Human
cugagagcgauccuagguagggguggcuggggcagcccaagggcucgagccaucucugcuc

SEQ ID NO: 371497 - RNA, 64 nt, Human
uguugucaaugagucuaaguugacaaauucaguggcagcccagccaccuccuaucaaucaauca

SEQ ID NO: 371498 - RNA, 64 nt, Human
ugugucgggcaucagauggagcacacagguggcugcagcccagcccaccuucccagcguucucg

SEQ ID NO: 371499 - RNA, 64 nt, Human
uguuuuguugaguugcugcuauugcacugccagugcagcccacaccaaaucacaacccaagaua

SEQ ID NO: 371500 - RNA, 64 nt, Human
acacaaucuuaaggggauagacuagacugccacagcagcccauggcacaacuaacaccuacuga

SEQ ID NO: 371501 - RNA, 64 nt, Human
gaggguuucagaauucacuggagaaggugugguugcagcccacuggagagaaguuugcuggcuu

SEQ ID NO: 371502 - RNA, 64 nt, Human
uccccaagauucuuccugggaggauggaaacagugcagcccaggucccaugggggcagcuccau

SEQ ID NO: 371503 - RNA, 64 nt, Human
gcuggccuuuggcuaccuguacuuccccauuauggcagcccauucagucuugaguuuucuucuc

SEQ ID NO: 371504 - RNA, 64 nt, Human
aggcugggugggagggaggagggccgagacaggagcagcccacccagcagaaauacaauccgag

SEQ ID NO: 371505 - RNA, 64 nt, Human
gccugcucgucgcaguccaaacccgcccaagacugcagcccaaucaacgccuggagccucauuc

SEQ ID NO: 371506 - RNA, 64 nt, Human
aacugucaucuccugguuccaaguucgggcucuggcagcccagccgcuaucuuagcugucuuuc

SEQ ID NO: 371507 - RNA, 64 nt, Human
gcaagcagcucgcagccagcccagaaucucuuaugcagcccaaagggcuucuugagguagagag

SEQ ID NO: 371508 - RNA, 64 nt, Human
ccccuaaccuccugcucccccucaagccaacuaugcagcccacaagaaggcccugcgggccccc

SEQ ID NO: 371509 - RNA, 64 nt, Human
gagagagagagaacagggaggauacagaaguauugcagcccagauccccuaucagggggacagc

SEQ ID NO: 371510 - RNA, 64 nt, Human
cguuggccuuucugucugccucuccuuccucucugcagcccaaauggaaaacaauuauuuacuc

SEQ ID NO: 371511 - RNA, 64 nt, Human
gcgcuccugaccccucccugcaggggcuacguuagcagcccagcacauagcuugccuaauggcu

SEQ ID NO: 371512 - RNA, 64 nt, Human
ggucacaggcugcguuucuccuuucuguccgugggcagcccaguccccacagucacggccaagc

SEQ ID NO: 371513 - RNA, 64 nt, Human
uccaaauuauuuucaagagagugugacucaucaggcagcccaaaaguuuauuggacuugggguu

SEQ ID NO: 371514 - RNA, 64 nt, Human
caaagacuuaucacaccaugugccuauacacccagcagcccaagguggagggugcguggaaaug

SEQ ID NO: 371515 - RNA, 64 nt, Human
gcccucuuccccuccaccacacccagguggacuugcagcccacaaggggugaggaaaggacagc

SEQ ID NO: 371516 - RNA, 64 nt, Human
aaagggacaaagagggcaaaugagaucaccuccugcagcccaccacuccagcaccugugccgag

SEQ ID NO: 371517 - RNA, 64 nt, Human
cuuaccucuuacuuccuagacuuugauuucuccggcagcccagauguucaguucucuuggcccc

SEQ ID NO: 371518 - RNA, 64 nt, Human
aaccuucucaaccaaaacugcaaucaggaaagcagcagcccacuccuucccauggaaucuagac

SEQ ID NO: 371519 - RNA, 64 nt, Human
aacuguuuuacaaauauaaaaguauaauaaauaugcagcccaguuaaauauugauuaucuguga

SEQ ID NO: 371520 - RNA, 64 nt, Human
gagggcagaagcagcguggaggggcccucacgcagcagcccagccacuuucugaguguuguccu

SEQ ID NO: 371521 - RNA, 64 nt, Human
gcuacuuuaucaugagauguguguuaagaaggcugcagcccacaggaguccagggaaggcgggg

SEQ ID NO: 371522 - RNA, 64 nt, Human
acagcucagccgccuccucugccaccagcugcucgcagcccaugccugggggugcugccaucuu

SEQ ID NO: 371523 - RNA, 64 nt, Human
accagcccuuccuugccacuggucucaaagcugggcagcccauugcaugcccucaacucuugcu

SEQ ID NO: 371524 - RNA, 64 nt, Human
auaaaguggcaccuucuggaguacacuggagggggcagcccaaguuagaggccagcauugcuga

SEQ ID NO: 371525 - RNA, 64 nt, Human
gaugcuagauuauuggcugggaggugggcaaguggcagcccagcugaagcaagaggcugauuga

SEQ ID NO: 371526 - RNA, 64 nt, Human
gacuacuuuccuuuaaccauugggguuaaguugggcagcccauuuaguuuacacgcgcauaaga

SEQ ID NO: 371527 - RNA, 64 nt, Human
cuuaagccauugcccuggcugggguugggcuggugcagcccagcuggcggaggggcgaagcuuu

SEQ ID NO: 371528 - RNA, 64 nt, Human
guccccaccccuccccuccaggagcaggccuggugcagcccacucugugccuggacaucccccg

SEQ ID NO: 371529 - RNA, 64 nt, Human
auggggugcuccagggggugccacagaccgacaggcagcccaagggccuggacaccccucccca

SEQ ID NO: 371530 - RNA, 64 nt, Human
aggucagccuugaccuaaugagguagcuauaguugcagcccaaggacaguucagagaucaggau

SEQ ID NO: 371531 - RNA, 64 nt, Human
ccacucacugcccaagucauggcaacaggcuggagcagcccaggagaugggccuaaaauguucu

SEQ ID NO: 371532 - RNA, 64 nt, Human
cugaauggcagccucuugggggccuggagcucuggcagcccagccguguguggugucagguucc

SEQ ID NO: 371533 - RNA, 64 nt, Human
ccagggccuguugaugggcuuugcaggcaguccagcagcccacaccugcaggcaggaugcuguc

SEQ ID NO: 371534 - RNA, 64 nt, Human
uuuaaaauccuauuuuucccaaacagggcccucugcagcccauccuuuccuuccguccuucuga

SEQ ID NO: 371535 - RNA, 64 nt, Human
aggacaagcacugauccugaggggauacuguggagcagcccaguccacaccagagccccacgcg

SEQ ID NO: 371536 - RNA, 64 nt, Human
uacagguagguggcgcucacguuccugcccaaaugcagcccaucggggagucacagucaguccc

SEQ ID NO: 371537 - RNA, 64 nt, Human
uccuugggccaguucugggauuuggcccugggaagcagcccagcguaccccaggccugcucugg

SEQ ID NO: 371538 - RNA, 64 nt, Human
gcuuccaggaugcuucucuggaaccucaaggcaggcagcccaggcccugggccugaucucuaac

SEQ ID NO: 371539 - RNA, 64 nt, Human
ggcagcugggacagaggccugguggcccugcugggcagcccaacugcugggggagacguuucug

SEQ ID NO: 371540 - RNA, 64 nt, Human
ccucccuuuaccagccagccccauugcacacugugcagcccauccccucccagaaauagaguga

SEQ ID NO: 371541 - RNA, 64 nt, Human
gacagagggcacaugaacagcuugccagggaugggcagcccaacagcacuuuuccucuucuaga

SEQ ID NO: 371542 - RNA, 64 nt, Human
ucagugacaccugguacuggcaguuuugggaguggcagcccaggauggacagcaguggggaggg

SEQ ID NO: 371543 - RNA, 64 nt, Human
guccaguuaaacaguuuguggacuuguaaccgucgcagcccaaugauacaacaguaguuuaauc

SEQ ID NO: 371544 - RNA, 64 nt, Human
gguucugcuucugcuucucucugcuccacugucugcagcccagauccuguugggccuggcuggu

SEQ ID NO: 371545 - RNA, 64 nt, Human
gaccccacggggugcccgcaugucccugucuagggcagcccagggcccccacuccuggcuccuc

SEQ ID NO: 371546 - RNA, 64 nt, Human
ggggccuccccacaggccaccgucgcccagccuggcagcccagcguuuugggcugaaaccacca

SEQ ID NO: 371547 - RNA, 64 nt, Human
uucucgaucacgagccugagaacugcacgggggagcagcccagacuggcuggaaaccauguuuu

SEQ ID NO: 371548 - RNA, 64 nt, Human
agggauuauggaucgggguaugaagugugcacacgcagcccaacaacgggcaguggucucugug

SEQ ID NO: 371549 - RNA, 64 nt, Human
ucugcuuccucagccuuguagcaaaggcuacacagcagcccacaguccacagucuuuuugggaa

SEQ ID NO: 371550 - RNA, 64 nt, Human
cucuacaggcugcucggccucccugcagcucagcgcagcccagggcuccaagugaggcccagaa

SEQ ID NO: 371551 - RNA, 64 nt, Human
uuccccgagagcugucggaaccagaugcaacccggcagcccagagaacucuccugggaggcugu

SEQ ID NO: 371552 - RNA, 64 nt, Human
caugauguggggggacucgacccccugacauggggcagcccauagcaggccuugugcagugggg

SEQ ID NO: 371553 - RNA, 64 nt, Human
ugacagagcuagagcucgggcccagccccaggcugcagcccauucgcaggcacccgaaagaacu

SEQ ID NO: 371554 - RNA, 64 nt, Human
aaaaugacuggcuuagcagauucuuugaaauguagcagcccagggauguaccaaaugucgaauu

SEQ ID NO: 371555 - RNA, 64 nt, Human
aauggcccccaaaacuccguaagaagcaggaaaugcagcccaaguuuuacaaauggguaaacag

SEQ ID NO: 371556 - RNA, 64 nt, Human
caggagcagaagccuggagggguggcagggcagagcagcccaggcucagcauggagcccacuua

SEQ ID NO: 371557 - RNA, 64 nt, Human
acccggccagcucuaggcucuggggggccccgcugcagcccacacuggguguggugccccaggc

SEQ ID NO: 371558 - RNA, 64 nt, Human
cacuguguuccgugcccuggggacccccggaaaagcagcccagucagaugugggaacgugccag

SEQ ID NO: 371559 - RNA, 64 nt, Human
gagcacccagcaggagaggcuccugguguagugggcagcccagcacuucccgcugcugccugcc

SEQ ID NO: 371560 - RNA, 64 nt, Human
gggcccuugggucgggcccuggagacgacacacggcagcccacaggccacgacagacgcuggau

SEQ ID NO: 371561 - RNA, 64 nt, Human
acaccugugcagggucccagacccaggccccagagcagcccaggccaugacccugccgagcacg

SEQ ID NO: 371562 - RNA, 64 nt, Human
ccuucagcaguugaggcuggggcuaguggucccagcagcccagcccccacccuccuggcagcag

SEQ ID NO: 371563 - RNA, 64 nt, Human
ugcccacugucuugcccgggcugaggucagcacugcagcccaaacagugccaacagcccugucc

SEQ ID NO: 371564 - RNA, 64 nt, Human
uuucccucaaugcugccaccaugccugagugccugcagcccaggaggcccgcacaccgguacac

SEQ ID NO: 371565 - RNA, 64 nt, Human
ccgccucuauccccuuccccacguuccagccccugcagcccacauuuuaaguauauuccuucaa

SEQ ID NO: 371566 - RNA, 64 nt, Human
ccccggcaagccacaggaaggaggggagagacaggcagcccagcaguguggagacccugccaca

SEQ ID NO: 371567 - RNA, 64 nt, Human
uucccucucugaugucccagugcucaccagcccugcagcccaccagacgucaggcccugacucc

SEQ ID NO: 371568 - RNA, 64 nt, Human
cugcccuccacggagcagcagcacccuccagcaggcagcccagcaugccaggggugugugcgca

SEQ ID NO: 371569 - RNA, 64 nt, Human
ggggaccaguagggugguuucccucucaggcccagcagcccauugacagcauuagacuggcggc

SEQ ID NO: 371570 - RNA, 64 nt, Human
cguguaacuguaaauccagaaucuauccugcaucgcagcccaccguguauagagauauaaauag

SEQ ID NO: 371571 - RNA, 64 nt, Human
aagaagggaagaagccuaaaggacagucaaagaagcagcccaguggaaccacaaaaaggccaau

SEQ ID NO: 371572 - RNA, 64 nt, Human
aaguaguauauggacaguccagggcuuaugcccagcagcccacuggaggcauucuucaggcucc

SEQ ID NO: 371573 - RNA, 64 nt, Human
aggccugaagcucccccucccccaccucugcuaggcagcccaggccuggucugggagacagccc

SEQ ID NO: 371574 - RNA, 64 nt, Human
gggagcucuaacuugaagccacauccuacagauggcagcccaaauagcacaugggcaauuggca

SEQ ID NO: 371575 - RNA, 64 nt, Human
auuggauuuccaugucagcccccacuccaggaaggcagcccaaucccuaggugauggggaaccc

SEQ ID NO: 371576 - RNA, 64 nt, Human
cucagcggggacggccuccugcugcagguccugggcagcccacaguagugcuagcugaggccca

SEQ ID NO: 371577 - RNA, 64 nt, Human
uugaaagcaucugaagacaucuaacuuagagucugcagcccagagccacaugcaaaacaccuuc

SEQ ID NO: 371578 - RNA, 64 nt, Human
ggcccagcucuucuguccuuggccaccagagacugcagcccacaacccuuggagggguugggcc

SEQ ID NO: 371579 - RNA, 64 nt, Human
cuucuggccuuagcagaugguaugcuugcggaccgcagcccagcaugccggugggcccacagcc

SEQ ID NO: 371580 - RNA, 64 nt, Human
aggugccaggugugugguggggacaacagcacgugcagcccacggaagggcucuuucacagcug

SEQ ID NO: 371581 - RNA, 64 nt, Human
gucggaagaaacucccguauuugcagcuggaacugcagcccacggcgccccgguuuuccucccc

SEQ ID NO: 371582 - RNA, 64 nt, Human
ucaaauccacacagaugucagcggcagcugcucggcagcccagcccugggccuggguggguuca

SEQ ID NO: 371583 - RNA, 64 nt, Human
cccuuuccagggcaggggacaccuuggcuccucagcagcccaaggacggcaccauccagcaccu

SEQ ID NO: 371584 - RNA, 64 nt, Human
agagggcugagccccuccucuccucguccggccugcagcccagaacgggccuccccgggggucc

SEQ ID NO: 371585 - RNA, 64 nt, Human
caccucaccggugcagugacccaggacggcaucagcagcccagugagcaccagggguggcauag

SEQ ID NO: 371586 - RNA, 64 nt, Human
ccuggggccugugcggagggagccaccucacccugcagcccaguuugcagguguggccuuguuu

SEQ ID NO: 371587 - RNA, 64 nt, Human
guggcucgggucagcgcagccagcccagcucccugcagcccaagucucaagccuccaaaccugc

SEQ ID NO: 371588 - RNA, 64 nt, Human
auggguaaauauuuucuaggcuauguaagaguuagcagcccauagcauagaaguaaucaaguag

SEQ ID NO: 371589 - RNA, 64 nt, Human
caucauccucauuagcaguggguuuccaggguuggcagcccacaccagcauuaauuucaaugaa

SEQ ID NO: 371590 - RNA, 64 nt, Human
cucuggaccacaggcggggaggaagcaugcucaagcagcccagcgggcgggccccuuccgaggg

SEQ ID NO: 371591 - RNA, 64 nt, Human
ggccgacugcugcuagcggccugccgccacgucagcagcccagggcacagcgcucgaggugugc

SEQ ID NO: 371592 - RNA, 64 nt, Human
guagcacugcuguccagccacagccccagcccaggcagcccacagugcugcacguagccauggg

SEQ ID NO: 371593 - RNA, 64 nt, Human
cuuccaccccacccucagcgucucugccccuaaggcagcccaggaaauaggaacugagacucug

SEQ ID NO: 371594 - RNA, 64 nt, Human
aguuacaguguaggcaccccggcccagcagcccagcagcccacauguguucaggacccucccug

SEQ ID NO: 371595 - RNA, 64 nt, Human
augcugcuaguuacaguguaggcaccccggcccagcagcccagcagcccacauguguucaggac

SEQ ID NO: 371596 - RNA, 64 nt, Human
agcugcaggucccccggcaucucucucugucccggcagcccaggauggccuggugcccccaccu

SEQ ID NO: 371597 - RNA, 64 nt, Human
cccucugucccugugcuccaagcugcccccggcugcagcccaggccauggacaugugcaccagu

SEQ ID NO: 371598 - RNA, 64 nt, Human
cggcuuuccagugcggagagucgagaugcucccugcagcccaggccccgggcaccuccugcaac

SEQ ID NO: 371599 - RNA, 64 nt, Human
agugcaaagcggcaugaaugcaaaguauuuuucugcagcccaguucugugggugcagcucuucc

SEQ ID NO: 371600 - RNA, 64 nt, Human
gggggaggagaacaugaguagauaauuucagggugcagcccaaucugccagacuuaaaaaaacc

SEQ ID NO: 371601 - RNA, 64 nt, Human
gcccccuccucagucuccacagacccacaugugagcagcccaggcccaucggugcuccucagag

SEQ ID NO: 371602 - RNA, 64 nt, Human
auccagguacgcacagacagguuuucacauaaaugcagcccauuucuccagaacccauuugagg

SEQ ID NO: 371603 - RNA, 64 nt, Human
uguuaacugcaggaaugccaagcaccuggccagagcagcccagccccaauaugcuuaggaggag

SEQ ID NO: 371604 - RNA, 64 nt, Human
gacaagugugaggaagacugcgcagugccaccccgcagcccaguggggugccaugcacaggcca

SEQ ID NO: 371605 - RNA, 64 nt, Human
uaagagaacguugcuguaucucaguccaggagaggcagcccaucuuggcccuggaugaagaagg

SEQ ID NO: 371606 - RNA, 64 nt, Human
gaagaaacccaggggccuccuaugcacagaucuugcagcccagaaccaagucagccucccugcg

SEQ ID NO: 371607 - RNA, 64 nt, Human
accgccuccucagucugugggccccgcaggugcagcagcccaggcccaggcucuagcugggccc

SEQ ID NO: 371608 - RNA, 64 nt, Human
ugggaucccugagugcugaaugcucgccugcagagcagcccagaaagagcccugacuggggaga

SEQ ID NO: 371609 - RNA, 64 nt, Human
uaacaccauuauuuacaguagccaaaagguagaagcagcccaagugucaucccauucacccaug

SEQ ID NO: 371610 - RNA, 64 nt, Human
gccccacuuaacuccauaaacugcuucccauuccgcagcccaguucugauuguugaggugucgc

SEQ ID NO: 371611 - RNA, 64 nt, Human
gugccugccuccugguccccucagcucugccucugcagcccacugccugcccagugccaucagg

SEQ ID NO: 371612 - RNA, 64 nt, Human
uggccucucucuaggguacauggugcugggagaggcagcccaggaagucucaucuggggagcag

SEQ ID NO: 371613 - RNA, 64 nt, Human
ccuggggaggugaaggaagagagacuuuaggcaagcagcccaaagggguaaaugaaagcaagag

SEQ ID NO: 371614 - RNA, 64 nt, Human
uucccugcagaagacaaaaaggaagcuggaagaggcagcccagcgucuggaguaucuauaugag

SEQ ID NO: 371615 - RNA, 64 nt, Human
aaccuacagggucacucaguaugccaaccuccuggcagcccagggcagccuggccacugccaug

SEQ ID NO: 371616 - RNA, 64 nt, Human
cgagcguggcagccaccagguccacagaacuacugcagcccagaggacagcuuugaaguuugcg

SEQ ID NO: 371617 - RNA, 64 nt, Human
cguccaagggacagacucagcuccaggcugcuuggcagcccagccuggaggagaaggcuaauga

SEQ ID NO: 371618 - RNA, 64 nt, Human
cgauucugaacccuucaguccugcuugggaggacgcagcccacugcccagaaacaagaaacacg

SEQ ID NO: 371619 - RNA, 64 nt, Human
aguccugucagcuuccccaggagcucucugcugagcagcccagcacaacccccaggaaacacaa

SEQ ID NO: 371620 - RNA, 64 nt, Human
gaaauugaguuguuucucuauguucuucagaugugcagcccacaauuccucgggaaaggugaac

SEQ ID NO: 371621 - RNA, 64 nt, Human
ugaggugucccucccucugaguccuuugggggcugcagcccagggguuuacccuaguguuaaga

SEQ ID NO: 371622 - RNA, 64 nt, Human
gaggccuugcccugcugggaccccgggagugagagcagcccaaggauccagggugcagggaacu

SEQ ID NO: 371623 - RNA, 64 nt, Human
gggcaggcuugggcucaauccugggcacccaggggcagcccaccccuaaccuggcuccuaccca

SEQ ID NO: 371624 - RNA, 64 nt, Human
cuucucggcacuggagugucagcggaggccccaggcagcccaagagcucagggagccagggacc

SEQ ID NO: 371625 - RNA, 64 nt, Human
acaggucacuguccuguaaugucucccggucagggcagcccaggacugcccagccuggugggcu

SEQ ID NO: 371626 - RNA, 64 nt, Human
accucaggacaggcauggaggccacaggggcccagcagcccacccuuuccucuccccacugccu

SEQ ID NO: 371627 - RNA, 64 nt, Human
uccuguugcucccuggaguuccggaggcugggcugcagcccacucagcuugcgggcaaaauacg

SEQ ID NO: 371628 - RNA, 64 nt, Human
uccccugccccggaggaucugcucagugcugauggcagcccagcuguguggacucagggggcuc

SEQ ID NO: 371629 - RNA, 64 nt, Human
gccccaaggcugggggaacuucaugcugggacaagcagcccaucaacgccauggguucaggcug

SEQ ID NO: 371630 - RNA, 64 nt, Human
cagcaaagggccucaauuccuauaagagacccucgcagcccagaggcgcccagaggaagucagc

SEQ ID NO: 371631 - RNA, 63 nt, Human
cccuaccccacggaggaugagaagaggcagaucgcagcccagaccaaccucacccuccugcaa

SEQ ID NO: 371632 - RNA, 64 nt, Human
ugggcagguucaucaaugcccggaggcgcauccugcagcccaugcuugaugccagcaacccaga

SEQ ID NO: 371633 - RNA, 64 nt, Human
ggcuuggaacacagugacucccuggaguagucgggcagcccagauggcacugaucacugagcag

SEQ ID NO: 371634 - RNA, 64 nt, Human
gaaggcagggagaguagggagagaaaaccuuccagcagcccaguaaacugcgggcgaagagauc

SEQ ID NO: 371635 - RNA, 64 nt, Human
gaacccagucuaaugagaacuccagaaagcuggagcagcccaccuagagcuggccgcggccgcc

SEQ ID NO: 371636 - RNA, 64 nt, Human
aggagccaggucuaggcccagcuuucacacuguggcagcccagugaagcagacugggccaugaa

SEQ ID NO: 371637 - RNA, 64 nt, Human
ugugggccgcauacggcccaggauggcuuugaaugcagcccaacacaaauucguaaacuuucuu

SEQ ID NO: 371638 - RNA, 64 nt, Human
aacguauagcagucaagccgagcaaccuguauaagcagcccaacacaaaacgaguguggauuua

SEQ ID NO: 371639 - RNA, 64 nt, Human
caauaaagcggaaagcgggcacgcgcagcgcccggcagcccaggccccugcgcugucuugacug

SEQ ID NO: 371640 - RNA, 64 nt, Human
gacuuggggucagagacugcuguguuugagcucugcagcccagggaccgaaaaguuggugucaa

SEQ ID NO: 371641 - RNA, 64 nt, Human
ccuggcuucccaggacccugggucaccuuccugggcagcccagagagacccugccaacuuucca

SEQ ID NO: 371642 - RNA, 57 nt, Human
uccucugccuuccagccugaggcucccgcagcccacccugaccgggacugguaagca

SEQ ID NO: 371643 - RNA, 64 nt, Human
cagggggagcugcugucacucccccauccccgaggcagcccagucccuagugcccaaggcaggg

SEQ ID NO: 371644 - RNA, 64 nt, Human
caaaauauuucccauuugugccagaggaauccuggcagcccagagacuuuguagauccuuagag

SEQ ID NO: 371645 - RNA, 64 nt, Human
gaacuuuaagacuuucuccccacugccuucugcugcagcccaagcagggagugucccccuccca

SEQ ID NO: 371646 - RNA, 64 nt, Human
ccucuuuccuggcaauugaaaauggaagccacaagcagcccagcccuccuuaaucaacuucaag

SEQ ID NO: 371647 - RNA, 64 nt, Human
accucuuuccuggcaauugaaaaugaaaccacaggcagcccagcccuccucugucaacaucaaa

SEQ ID NO: 371648 - RNA, 64 nt, Human
ggacacccagccagggaauucugaagaccagagagcagcccacgggcaucacgagcgcucugcu

SEQ ID NO: 371649 - RNA, 64 nt, Human
gccugccuugccagcacccguguccugagcuccugcagcccaguggcugcugaaguugugaucc

SEQ ID NO: 371650 - RNA, 64 nt, Human
ucugaccuggagcugaggcagccagcagaucucagcagcccaguccaaauaaacucccugucag

SEQ ID NO: 371651 - RNA, 64 nt, Human
ucuucccuacccuuccugccaagccagggacuaagcagcccagaagcccaguaacugcccuuuc

SEQ ID NO: 371652 - RNA, 64 nt, Human
gcugaaggaaccaacaguccaccucagcgggccagcagcccagggaaccccugcccaccaggau

SEQ ID NO: 371653 - RNA, 64 nt, Human
cugucccuauuacgggagccgccuugccaucccugcagcccagcugguggugcugcccuaucag

SEQ ID NO: 371654 - RNA, 64 nt, Human
cugaacgguacggagcaguguucucaucccgggagcagcccaaacuggcuggguuucagcaauu

SEQ ID NO: 371655 - RNA, 64 nt, Human
aacuggcuggguuucagcaauuccugcagagccugcagcccaggacgacugaaggugaggcagg

SEQ ID NO: 371656 - RNA, 64 nt, Human
uaagaugaauuccacucacuuccuggucacuucagcagcccagcggcauugagccaaaauauac

SEQ ID NO: 371657 - RNA, 64 nt, Human
gccugugggugcaguuagucuaugugugguaugggcagcccaagguugcaugggaaaacacgcc

SEQ ID NO: 371658 - RNA, 64 nt, Human
guuuauaaccugauagcaaaaaacuugaaauauugcagcccaguuuaauucagcacuuucccau

SEQ ID NO: 371659 - RNA, 64 nt, Human
cucuucacaggugguaaacauuuaggggaagaaagcagcccagggugccaugccugacagcacg

SEQ ID NO: 371660 - RNA, 64 nt, Human
ggccaugugcaaacccucgagucaccaccacagugcagcccagccccuggucagcgugaguguc

SEQ ID NO: 371661 - RNA, 50 nt, Human
ucaccaaaaucaguaguuaggcagcccagcugagguggaccaacuaauug

SEQ ID NO: 371662 - RNA, 64 nt, Human
ugccauaaaaaguaggauuuaauuaaaagucauugcagcccaauaaaauggagccuggcugcac

SEQ ID NO: 371663 - RNA, 64 nt, Human
uugugacagucagaaaacacaccuggaauacgaugcagcccaccauuaacucauucauguaguu

SEQ ID NO: 371664 - RNA, 59 nt, Human
uaucgcaugaugagcuaugaaccacuggagcagcccacacuggcuugauggaucacccc

SEQ ID NO: 371665 - RNA, 55 nt, Human
cugaugacgccccgcucuagggacugcagcccagccccagcuucucugcccacuc

SEQ ID NO: 371666 - RNA, 64 nt, Human
gucggugaacugccccuggccugugucccccagagcagcccaggguccugccagagucugcagg

SEQ ID NO: 371667 - RNA, 64 nt, Human
cuuugcaauggggccgccuccccgcguagcuggagcagcccaggcccggcggacagccucuucc

SEQ ID NO: 371668 - RNA, 64 nt, Human
gaaggaaaagcacacgcaugcgccucagcaaauggcagcccaggagcuguuuguccaguuuagc

SEQ ID NO: 371669 - RNA, 64 nt, Human
cuggagugaaggcggagggagccugcuacaggccgcagcccaaccccuguuuuuuauucagauu

SEQ ID NO: 371670 - RNA, 64 nt, Human
gucccaccucuuucccaggcaccugggcccugccgcagcccagccccuugccuguuuuaauaaa

SEQ ID NO: 371671 - RNA, 64 nt, Human
gaacaccugggcuagggaauguggucgagaaagggcagcccauugcccagaauuaacacauauu

SEQ ID NO: 371672 - RNA, 64 nt, Human
agcccucuccuccaagagguccccucagcaucaagcagcccaaccaaggcgugcaucgagccuu

SEQ ID NO: 371673 - RNA, 64 nt, Human
gcaagcccuuaaucagcccucugugacauagguagcagcccacggagauccuaagcuggcuguc

SEQ ID NO: 371674 - RNA, 64 nt, Human
cccaaugcaucacguaccccacugggccagcccugcagcccaaaacccagggcaacaagcccgu

SEQ ID NO: 371675 - RNA, 64 nt, Human
auccaggacaucacucccaugccagcccucccuggcagcccauguucuccucuuuucucacccc

SEQ ID NO: 371676 - RNA, 64 nt, Human
ccuaguaccccgcuacccuguucugucuuauggagcagcccagauuaucuuuacucccucuuuc

SEQ ID NO: 371677 - RNA, 64 nt, Human
caaugaugaauuguuauguaugcauuaauguuuugcagcccaaaaguuguucacauuuuuccua

SEQ ID NO: 371678 - RNA, 64 nt, Human
ucugggccacccucaaacaccgucagaugcauuagcagcccacugcaugggacaaucgcaggca

SEQ ID NO: 371679 - RNA, 64 nt, Human
ggcggucacgggaccugcgggcuggcuccgaguggcagcccaugccuucugcgggguauggguu

SEQ ID NO: 371680 - RNA, 64 nt, Human
gagacaggggccgagccucacccaucugcccucugcagcccagggccgccgugagcgggauuca

SEQ ID NO: 371681 - RNA, 64 nt, Human
cugagugagccccacgggguccaggcgggcggcagcagcccaggggccccaggccuccucccug

SEQ ID NO: 371682 - RNA, 64 nt, Human
ccucuggcucagccaauaaauccuaaggagacaagcagcccagcagugaucagcaguagccacc

SEQ ID NO: 371683 - RNA, 64 nt, Human
cggcgaggccaggugcggggcgcgcugcaccggagcagcccaggccgggccgcaagcuguuucc

SEQ ID NO: 371684 - RNA, 64 nt, Human
cuauucuuucaguugaauaagggccaguugguaugcagcccauguauaugugaauggaguaaga

SEQ ID NO: 371685 - RNA, 64 nt, Human
ugugacaaucuccaggagaaccuacagauuggaagcagcccacaccugauguggacuccugacc

SEQ ID NO: 371686 - RNA, 64 nt, Human
gcgagagcugaauuuagaaaccagacaacgucaugcagcccagaaacuccuguuguuaccuuug

SEQ ID NO: 371687 - RNA, 64 nt, Human
uggggcaggguggccagcugcuggcucccagagcgcagcccaggcguccucaacggggagcccc

SEQ ID NO: 371688 - RNA, 64 nt, Human
ugggucuguuuuaacgugggccaagccuaccugggcagcccauuugccagggcuugccucaggc

SEQ ID NO: 371689 - RNA, 64 nt, Human
uuccaucucgggugccucuguuggcaaugaucaggcagcccaaaagauuuaaaugaucuauaau

SEQ ID NO: 371690 - RNA, 64 nt, Human
gucuagaagcuagauccuaucaggaugaggagcagcagcccagggcuugucuggaucagcacca

SEQ ID NO: 371691 - RNA, 64 nt, Human
agaacagucugaggugaugcuggcuacagcccuggcagcccauggcaacucaaagugccuucca

SEQ ID NO: 371692 - RNA, 64 nt, Human
cucauuagcucccugcuccugggaugcuucccaagcagcccaggccucuagccuccauggcuga

SEQ ID NO: 371693 - RNA, 64 nt, Human
aaugguggucuccccacucccggcagcacuuuaggcagcccauaagcuaugcgagaaugugaac

SEQ ID NO: 371694 - RNA, 64 nt, Human
ggauguuuuggggaaggaacuggauaucucuccugcagcccagcaccgagauacccaggacggg

SEQ ID NO: 371695 - RNA, 64 nt, Human
cucagcaccagagcagaggcccagccagcccucugcagcccaaacguccccaacgguugccugg

SEQ ID NO: 371696 - RNA, 64 nt, Human
agaggggcccagcugaccugucucacugcuccuggcagcccagccccaucggcagguggccccu

SEQ ID NO: 371697 - RNA, 64 nt, Human
cacuugcuguuauuuacaaacgacagugcauucagcagcccagugccgugagcccugacagaug

SEQ ID NO: 371698 - RNA, 64 nt, Human
acgucaggcugaccaacaccucagaccuucugaagcagcccauugcuggcccgccauguuguaa

SEQ ID NO: 371699 - RNA, 64 nt, Human
ucuucacucagugcuucugcuugcccugccccaggcagcccacccacgcccagugcgggugugg

SEQ ID NO: 371700 - RNA, 64 nt, Human
uggccggaaagcucccgggccucuggccugcagggcagcccaagucaugacucagaccaggucc

SEQ ID NO: 371701 - RNA, 64 nt, Human
gggccucccgaggcugggcaugccucaggcuucugcagcccagggcacuagaacgucucacacu

SEQ ID NO: 371702 - RNA, 64 nt, Human
gacugcgcaucucugagaaugccaaccagaggcggcagcccacccuuccugccuccugccccac

SEQ ID NO: 371703 - RNA, 64 nt, Human
agguggagagcaccaaucugaaccagcaaugccugcagcccagccccuccucugaacacucagc

SEQ ID NO: 371704 - RNA, 64 nt, Human
gcacucaggagaggggagaaaggaggugcaccuggcagcccacauuuuuguugcuccccaaauc

SEQ ID NO: 371705 - RNA, 64 nt, Human
ccacugcacuccugucugggaggcccuuaugagggcagcccagcccccgcacccacccccaacc

SEQ ID NO: 371706 - RNA, 64 nt, Human
acugggacccagccuuugggccuccccagccagagcagcccagcaacaguguguccugugguca

SEQ ID NO: 371707 - RNA, 64 nt, Human
ucugcuccugcauggaaagggagccugggagccagcagcccacgccuggggagccugccugggg

SEQ ID NO: 371708 - RNA, 64 nt, Human
agaagagauggaaguggagcugugacuaguacaagcagcccaagaaacucugaacggggcccaa

SEQ ID NO: 371709 - RNA, 64 nt, Human
gcaguuugaaaaacuguggccacagcugugacuugcagcccaccugccacccaggacgggcccu

SEQ ID NO: 371710 - RNA, 64 nt, Human
gggggaaauuggcgaugucacccguguacgguacgcagcccagagcagacccucaauaaacguc

SEQ ID NO: 371711 - RNA, 64 nt, Human
cagcacuuugggaggcccaggcagaaggaucgcugcagcccaggaguucgagacuagccugggc

SEQ ID NO: 371712 - RNA, 64 nt, Human
cuggacugaggaaagcagugggcaggggcgcucggcagcccacagggccuggccucagccccca

SEQ ID NO: 371713 - RNA, 64 nt, Human
gaggucacucugggccuggggacccaaacccccugcagcccaggccagucagacgccaggcacc

SEQ ID NO: 371714 - RNA, 64 nt, Human
ccuggacagcuugacuuguggggcaggauucucugcagcccauucccaagggagacugaccauc

SEQ ID NO: 371715 - RNA, 64 nt, Human
aucuucaaaacguuagagaaaguucuucaaaagugcagcccagagcugcugggcccacuggccg

SEQ ID NO: 371716 - RNA, 64 nt, Human
accuaucuggccccaacacaccugagagaauucagcagcccagacugagggucugggauggggu

SEQ ID NO: 371717 - RNA, 54 nt, Human
cugccucccagggucacuaggcgggcagcccacacccaccccagacggccacca

SEQ ID NO: 371718 - RNA, 64 nt, Human
ggugugccuggcccccucuccaggggcugugcaggcagcccauccaccccaguggaguucccac

SEQ ID NO: 371719 - RNA, 64 nt, Human
aaaauucaaggcaguaugcacagaauggacgagugcagcccagcccucaugcccaggaucagca

SEQ ID NO: 371720 - RNA, 64 nt, Human
uagaaaauggacacugugcccagcccggaccuuggcagcccaggccgggguggagcaugggccu

SEQ ID NO: 371721 - RNA, 64 nt, Human
agguuuggcgagcacgaacuagaccaagcgaagggcagcccaccaccguauaucaaaccucacu

SEQ ID NO: 371722 - RNA, 64 nt, Human
gacccucuaggacuggggguggggccaauccagggcagcccagagggaacauccugccacaccg

SEQ ID NO: 371723 - RNA, 64 nt, Human
cggagcagcggggccucugccagcccuugcagcugcagcccaucccugggccauguccccucca

SEQ ID NO: 371724 - RNA, 64 nt, Human
gacccaggaccagcaacccgcgaccaaucaugcugcagcccaggggcgucugcugugccccgcc

SEQ ID NO: 371725 - RNA, 64 nt, Human
ccuaaugaggugggaaagccacggcaggcagcgagcagcccaggccagcuuucugcauggaugg

SEQ ID NO: 371726 - RNA, 64 nt, Human
ccugcccuccccuccucaguccugcccaccccgugcagcccaugcugaggcugcaguggugucg

SEQ ID NO: 371727 - RNA, 64 nt, Human
auuccgggacccugggcaucuuaucuagguccgugcagcccaagggucagcccucuugacuguc

SEQ ID NO: 371728 - RNA, 64 nt, Human
uggggcagucggaagaugugggcccugggugggagcagcccacuucagcagcacugccacugcc

SEQ ID NO: 371729 - RNA, 64 nt, Human
cagccuccccucagagacaggccucaguucgagggcagcccauuaucugucgcagacaucugcc

SEQ ID NO: 371730 - RNA, 64 nt, Human
aaaagcccauccucacucagcgcuaacaucagcagcagcccaaaaggugaggccugggggccuu

SEQ ID NO: 371731 - RNA, 64 nt, Human
agcugucccuccagcaaaaacagcagcccuaauagcagcccacggacuuuggggaggagcaaag

SEQ ID NO: 371732 - RNA, 64 nt, Human
gcggcacaggaaacagcaaacaguggggugaucugcagcccagagaccuucaaaugcgaacacu

SEQ ID NO: 371733 - RNA, 64 nt, Human
gcaacucuuggcugugugcauuuuucaacuccaagcagcccagggguaaguaaacaaaguaugg

SEQ ID NO: 371734 - RNA, 64 nt, Human
uugagggaaaguuuagacaucugcagagaggcaggcagcccagcccaggggacccguuccucuu

SEQ ID NO: 371735 - RNA, 64 nt, Human
ugcucuagggcagggaauuaugggagaagugggggcagcccaggcgguuucacgccccacacuu

SEQ ID NO: 371736 - RNA, 64 nt, Human
cagcuccgguggcgggaggaguggcagcggccaggcagcccagcuucgcgaaggcuguaggcac

SEQ ID NO: 371737 - RNA, 64 nt, Human
cagcaucuucccauuuccucaguacccacaaagugcagcccacauuggaccccagacaccccuc

SEQ ID NO: 371738 - RNA, 64 nt, Human
acaacaaaaggaacagauccuugaccgcauggcggcagcccaccuugguaagggccccagggcc

SEQ ID NO: 371739 - RNA, 64 nt, Human
uacaugugcccccggguuccuuccuagaaauguggcagcccauuccagcacacaggcuucugca

SEQ ID NO: 371740 - RNA, 64 nt, Human
gcuucucccaggcaaggcuguggaccauggaguggcagcccagccagcgucggucugugccccu

SEQ ID NO: 371741 - RNA, 64 nt, Human
cucuggaagccuggccggaaagaccaagguucaugcagcccaacaaaugauuguugagcaccuc

SEQ ID NO: 371742 - RNA, 64 nt, Human
cggaagcacgcagcauguucccugcugagcggaggcagcccaccuguccugccucccaggagcc

SEQ ID NO: 371743 - RNA, 64 nt, Human
ccugaggggccacccuaggacuugaaaggaccgugcagcccagugaccacugcccagugggagg

SEQ ID NO: 371744 - RNA, 64 nt, Human
guccccuggagugugucagagcccaggggagaaugcagcccaccaggagcaccuggacccccug

SEQ ID NO: 371745 - RNA, 64 nt, Human
cugcuuggcuguuauggugcugguaauaagccucgcagcccagguccagagcccccggcgagcc

SEQ ID NO: 371746 - RNA, 64 nt, Human
ucuguucugagagcagcgugggcagcaaggcagggcagcccagagguggcagcggcaggcaauc

SEQ ID NO: 371747 - RNA, 64 nt, Human
uaagcaacacagucuuccucggucugagagaaaagcagcccacucuuguguucucaggcagggg

SEQ ID NO: 371748 - RNA, 64 nt, Human
uaccugucucccugccugcccaucugcaucuuuugcagcccacucugacuuccaucugggggcu

SEQ ID NO: 371749 - RNA, 64 nt, Human
cauuaugagcugaggucagccuggaucuggaauugcagcccacauaaacauaaaggaggauguc

SEQ ID NO: 371750 - RNA, 64 nt, Human
cucuggccucuuagggagcagagagcagaacuccgcagcccagcccagaggagugucaccuccc

SEQ ID NO: 371751 - RNA, 64 nt, Human
acugccuaaggugugggagggacuggcugagauugcagcccaugguaggagcuggaccaacugu

SEQ ID NO: 371752 - RNA, 64 nt, Human
ccuuguugccccgcucuagacuuuuagcagaucugcagcccacaggcuuuuuuggaaggagugg

SEQ ID NO: 371753 - RNA, 64 nt, Human
guuacagccugcaucaagggcuuuaccccaaccugcagcccagccuucccugggugagcuugcu

SEQ ID NO: 371754 - RNA, 64 nt, Human
gcaaaagcuguggcugccaggucugggccacauggcagcccagggggcaggagaagcccgggag

SEQ ID NO: 371755 - RNA, 64 nt, Human
ucccucaaaugggcucuuggaggcacccccaggggcagcccauuucucaaaguccagaaaauua

SEQ ID NO: 371756 - RNA, 64 nt, Human
ccagaguggaggaggccucuccaugaggaggggagcagcccaaggcaccuguccucugacccac

SEQ ID NO: 371757 - RNA, 64 nt, Human
cuuugaagagccaguauaguuucugugcccugcagcagcccaagugcuuuaaagccguuucaag

SEQ ID NO: 371758 - RNA, 64 nt, Human
agaugucuagaggcagacuccugagugagguguugcagcccaaaggcugcagcauugccauacc

SEQ ID NO: 371759 - RNA, 64 nt, Human
ucgcuuucacccugacuaaagauugucuuaaguagcagcccagcccgcccagccccaggugggu

SEQ ID NO: 371760 - RNA, 64 nt, Human
cgaccucucuccucugaaacccuccuccacagcugcagcccauccucccggcucccuccuaguc

SEQ ID NO: 371761 - RNA, 64 nt, Human
cuggcucuggggagcugggcuaggaagaggaggugcagcccagacucuuccuagccuuucuaaa

SEQ ID NO: 371762 - RNA, 64 nt, Human
gugagacuuucagugggcucugcugagaaggaaggcagcccaggagucagguaugcaggcauug

SEQ ID NO: 371763 - RNA, 64 nt, Human
agcccgcggcugugggcaccacagcucuuguggggcagcccaccuuagaaccugacuagcgagg

SEQ ID NO: 371764 - RNA, 64 nt, Human
gggccgcucuuggccccaagguugccccgggccagcagcccagccagcagcacagucucuaugg

SEQ ID NO: 371765 - RNA, 64 nt, Human
cagccaugggaaagcaaacuucauccuaaggugugcagcccaggcccugccccuuuacagucua

SEQ ID NO: 371766 - RNA, 64 nt, Human
ccacuccuccaucucauggggcucacggccuacagcagcccacaagcugccacuggccggcgac

SEQ ID NO: 371767 - RNA, 64 nt, Human
gcuuuucgguuuuuggaaagggauccaucuccaggcagcccacccugguggggcuuguuuccug

SEQ ID NO: 371768 - RNA, 64 nt, Human
ugucauuuuagaacagagggaacuuugggagaaagcagcccaaguagguuauuuguacagucag

SEQ ID NO: 371769 - RNA, 64 nt, Human
aauucuauucugaucuuauucuguggugucuuuugcagcccagacaaaugugguuacacacuuu

SEQ ID NO: 371770 - RNA, 64 nt, Human
ucagcugggaucugcgcccggccugcuccagaacgcagcccacucgccaccgguggggaggguc

SEQ ID NO: 371771 - RNA, 64 nt, Human
ccuagguuggugggucuacaggagccucagccaggcagcccaccccacccuggggcccugccuc

SEQ ID NO: 371772 - RNA, 64 nt, Human
cuucaccgaggucggaauaacguccagccugggugcagcccaccuggacagaguccgaauccua

SEQ ID NO: 371773 - RNA, 64 nt, Human
aacaccugugcuugcagccaggucaggcccagcugcagcccaggcaggagcagucgccuuuccc

SEQ ID NO: 371774 - RNA, 64 nt, Human
aaaaaaacaaaaaaaaaccaugcauggugcaucagcagcccauggccucuggccaggcauggcg

SEQ ID NO: 371775 - RNA, 64 nt, Human
uccuccagcccggggacccccgcgggccccagaagcagcccaguucucagagagcccuuggaag

SEQ ID NO: 371776 - RNA, 64 nt, Human
uuuuaagcugccuggcauguggcacuuugucagggcagcccaggaaucugaaacaggaucaaac

SEQ ID NO: 371777 - RNA, 64 nt, Human
gccagcaucucuggcucggcuuucugggcuggaugcagcccacgacgcacuggugucugagaug

SEQ ID NO: 371778 - RNA, 64 nt, Human
gcgaguaugugcuuugccgggaggagcggcggccgcagcccacccccacugcuguucgaaucaa

SEQ ID NO: 371779 - RNA, 64 nt, Human
cauagccagguaacccaccaacuccccuggaucugcagcccacacgugggagucuggcugucac

SEQ ID NO: 371780 - RNA, 64 nt, Human
gcccugggccgucccugugugaacgcaggcaaaagcagcccagucccccucacugcuugagcua

SEQ ID NO: 371781 - RNA, 64 nt, Human
caggccggccuucagcguccggucagggaagcgugcagcccaaaugggcacuugcaugggagcc

SEQ ID NO: 371782 - RNA, 64 nt, Human
ugugccccacagcccugucagcugaggggguagcgcagcccaugcucuucuguacugucaugcc

SEQ ID NO: 371783 - RNA, 64 nt, Human
caccugcuucaguuguccuccacagcacugauuugcagcccacaagcuggcagguuuaucuguc

SEQ ID NO: 371784 - RNA, 64 nt, Human
ggcucaucucauugggacugguuagacagugggugcagcccacggagggugagcugaagcaggg

SEQ ID NO: 371785 - RNA, 64 nt, Human
agcuccucccaccucagcaccugcugcaucuggagcagcccaagccucaggauggacaagagga

SEQ ID NO: 371786 - RNA, 64 nt, Human
aauaaaucuccgguaacccguccaccuggccgaggcagcccagagcagcgggaugagcuggcgg

SEQ ID NO: 371787 - RNA, 59 nt, Human
cagcccccgcaggccuguagggcccucgugcagcccacccugaccgccaggaugcuucu

SEQ ID NO: 371788 - RNA, 64 nt, Human
uguccagccucccuggacggcccucgcggucccugcagcccaagaugggacucagacccugugc

SEQ ID NO: 371789 - RNA, 64 nt, Human
gggguguggggcccugugccuuccugaagugcuggcagcccaguggcaccuccuucaggccuuu

SEQ ID NO: 371790 - RNA, 64 nt, Human
ucugcugaccuguuccuugagcucccccauaucagcagcccagaguguggguccccugucaggc

SEQ ID NO: 371791 - RNA, 64 nt, Human
caaggagguugucagggacacacagcagggggaggcagcccagaucccugcucaugcgugguuu

SEQ ID NO: 371792 - RNA, 64 nt, Human
gucccaaauguucaggccccaagucuagauccuggcagcccagucacagaguaucccacacaca

SEQ ID NO: 371793 - RNA, 64 nt, Human
gcuguugggagccaagaccggcccuuuggagccggcagcccaggggucccugcuggaucagaga

SEQ ID NO: 371794 - RNA, 64 nt, Human
uggggggggcccagggagcagggcuuaggggcuagcagcccacggggccacacagagaaacaac

SEQ ID NO: 371795 - RNA, 64 nt, Human
caagggccccugggcucuaauagggucaucucuggcagcccacuugggccagcuacgugggagg

SEQ ID NO: 371796 - RNA, 64 nt, Human
caugagcaggcgaggagcuggccugucccgggaagcagcccagccuguggcugcccccgacacc

SEQ ID NO: 371797 - RNA, 64 nt, Human
cccaggggagugaggagggagaacuuggaagggugcagcccacuuccagacucuccccucuccc

SEQ ID NO: 371798 - RNA, 64 nt, Human
ucaggacccgagccuccagccugagccuagcucagcagcccaaggacgauggugaggggaggug

SEQ ID NO: 371799 - RNA, 64 nt, Human
cccaggucccugaucuccaggcuuggccuccagagcagcccacaccaaccccaaaauaaaaaaa

SEQ ID NO: 371800 - RNA, 64 nt, Human
ccuccggguuaggggagcaaggauugggggucgugcagcccagccagcaggagggacugaggcc

SEQ ID NO: 371801 - RNA, 64 nt, Human
gaaaggucugccucacacaggccuucccugcagggcagcccaugguggcagccggaggugcgua

SEQ ID NO: 371802 - RNA, 64 nt, Human
agcccugguggcccuggccccccacucccaaugagcagcccaggccugggcaaaaagcgcaaag

SEQ ID NO: 371803 - RNA, 64 nt, Human
cacccacucacccccuacagccugaagcaaaccagcagcccagccuugccucucugacccaugg

SEQ ID NO: 371804 - RNA, 55 nt, Human
ccaccaaaccggcucuuugacccccgcagcccacgucccgcuuucagaccccagg

SEQ ID NO: 371805 - RNA, 64 nt, Human
aguuggaggucuaagugacgagggggcugggucggcagcccaggcauccucaagcucuggacac

SEQ ID NO: 371806 - RNA, 64 nt, Human
acagccauaccucaaagauauuguggauuggguugcagcccaccacaauaaagcaaauauugcu

SEQ ID NO: 371807 - RNA, 64 nt, Human
cagacaugccccucccccgcagacacaccccaaggcagcccaacccccaccccuuccccgacac

SEQ ID NO: 371808 - RNA, 64 nt, Human
cacuccaugccgucucuuccaagccaccuugcccgcagcccaggcuccugggccagugcucucu

SEQ ID NO: 371809 - RNA, 64 nt, Human
aguccccaaacccagcaccccccucucccuggcugcagcccacacuguaacaucccuagugagg

SEQ ID NO: 371810 - RNA, 64 nt, Human
gcugcugcucugaguuauguuaaaauccgcuagagcagcccaaauuuuucucaguuuguauaga

SEQ ID NO: 371811 - RNA, 64 nt, Human
ccaugguggcaggagagagauggcugaagccugagcagcccagagucccgcuggucuaggcugg

SEQ ID NO: 371812 - RNA, 50 nt, Human
caguccaggaaugggugugagcagcccagagcccucucuauccacuuggu

SEQ ID NO: 371813 - RNA, 64 nt, Human
cgccgggacuugggcggggccugcccuacagugagcagcccacacaggaacgcuccucucgcga

SEQ ID NO: 371814 - RNA, 64 nt, Human
ugaccccgcacuacaucuacccaccagccaucgugcagcccagcguggugaucccagccgcccc

SEQ ID NO: 371815 - RNA, 64 nt, Human
caccugcccuccuagcuccagcacugcccccguggcagcccacuuggaccccccuaaaaggagg

SEQ ID NO: 371816 - RNA, 64 nt, Human
gaggcuaccugcagauaugacaggugccuugaacgcagcccaucuucaugucaucaaaggucuu

SEQ ID NO: 371817 - RNA, 64 nt, Human
ccagccgccauugccaccaggagaaccacuacaugcagcccaugcccaccugcccaucacaggg

SEQ ID NO: 371818 - RNA, 64 nt, Human
acagugauaggcccaagguccccuccacaucccagcagcccaagcuuaauagcccucccccuca

SEQ ID NO: 371819 - RNA, 64 nt, Human
ggcccacauagucaagucuuccagggcaaagccagcagcccacccaggucagguagccagcagg

SEQ ID NO: 371820 - RNA, 64 nt, Human
gcccaauucaggcagacccugaccucucccucaggcagcccaaccauccagaaugaauauucuu

SEQ ID NO: 371821 - RNA, 64 nt, Human
ggaaacaggugccaucuuggccaccucggccagggcagcccaccaugcuaaaaggaccccaaau

SEQ ID NO: 371822 - RNA, 64 nt, Human
aucaccgccuguguccuucaggggcugcuggagggcagcccaaagccaggggcccaccccgccc

SEQ ID NO: 371823 - RNA, 64 nt, Human
uccuggcuccgaggacacggguggcaggcccguugcagcccagagccacuggucccuacagggc

SEQ ID NO: 371824 - RNA, 64 nt, Human
ugaauauaaacuacugucuaaaauauacauaucagcagcccagccuuuaucaggaaaauuauac

SEQ ID NO: 371825 - RNA, 64 nt, Human
ccuugccugccguguccaggauucaugaccaguagcagcccagcuaugccugccacgucucaug

SEQ ID NO: 371826 - RNA, 64 nt, Human
cugugaacuuucugcuucauguaucaguuuuaaagcagcccaggcaaagaucaucuacagauuc

SEQ ID NO: 371827 - RNA, 64 nt, Human
gagaagaggcucagacagcaggcuccggggccacgcagcccagaccacaccugccacggucuuc

SEQ ID NO: 371828 - RNA, 64 nt, Human
ucagucccgacgcuuccugugaggugcacgcuccgcagcccagcccagccgggagaccacgugg

SEQ ID NO: 371829 - RNA, 64 nt, Human
ggauuuugacugcgaccuuggcggugcugucuccgcagcccaggaagccugcuguggggaggcu

SEQ ID NO: 371830 - RNA, 64 nt, Human
aaagugagggccacugucuccggcgggugaggcugcagcccaguuucacaugcgaggaggccua

SEQ ID NO: 371831 - RNA, 64 nt, Human
ggcccggccaccacugcuggcuucagccccuugagcagcccauggcuuagcagacccccagaug

SEQ ID NO: 371832 - RNA, 64 nt, Human
gcugugagcaccaggccaagacuccugagaacaggcagcccaguccugcgacucccgcaucccc

SEQ ID NO: 371833 - RNA, 64 nt, Human
gguuucccugaggaagaaauucugccugaggacagcagcccagugcuuggcgagaguuccugac

SEQ ID NO: 371834 - RNA, 64 nt, Human
auaaucugcaagguccaguaugaaauaagaauaagcagcccacacaacugggcauagugguuca

SEQ ID NO: 371835 - RNA, 64 nt, Human
uucccccaccggugaggaccuggcaugcagcgaagcagcccagcccggcggaucccaggccagc

SEQ ID NO: 371836 - RNA, 64 nt, Human
cuguuugccuuaugaguguggggucuggcacccugcagcccagguccccacugcucucacaccc

SEQ ID NO: 371837 - RNA, 64 nt, Human
gcguggugacagcaccguagggcagccggagaaugcagcccaagcagggccuggcauggggcag

SEQ ID NO: 371838 - RNA, 64 nt, Human
cgagucucccauguuguaguacauucuccaagaugcagcccaggagccucucugaaggaccagu

SEQ ID NO: 371839 - RNA, 64 nt, Human
gaggaggaggcagcuccggcagccacagaaggcugcagcccagcccgccugagacacgacgccu

SEQ ID NO: 371840 - RNA, 64 nt, Human
ggggcagagggugacuuaccaagagccagggagggcagcccaggcccaagugacagcaagaaca

SEQ ID NO: 371841 - RNA, 64 nt, Human
ugagcucuucacugugucuuuccaucugggcucugcagcccagcucuguggcaggaggccugac

SEQ ID NO: 371842 - RNA, 64 nt, Human
cacuggcugaccugguggccgugguggagaugaugcagcccauggcagccaacuauaaugucuu

SEQ ID NO: 371843 - RNA, 64 nt, Human
uuagggucucgauuugaggacauucauuucuucagcagcccauuagcaacugagagcccaggga

SEQ ID NO: 371844 - RNA, 64 nt, Human
uugcgucaucuuuaguagauccugagguugaccagcagcccauggggccugaagggaaaugagg

SEQ ID NO: 371845 - RNA, 64 nt, Human
gccccacaacccugcauucccagagguuagcuaugcagcccaccuagaugagucucuucaagaa

SEQ ID NO: 371846 - RNA, 64 nt, Human
caaauccaauagagauguuucuggggaagguuuugcagcccacuccccaucuuccugcuauaaa

SEQ ID NO: 371847 - RNA, 64 nt, Human
cccagcaagggcacucccaggcuuccuggugggugcagcccacucccucugcccucugcuccgu

SEQ ID NO: 371848 - RNA, 64 nt, Human
aggcagccuuggggaaccccgagcugggggguuggcagcccacugcaccgccucaggguuuugg

SEQ ID NO: 371849 - RNA, 64 nt, Human
ggaccauagucgggaugucagcagacacacaugggcagcccaaagcugcaggugccagggccca

SEQ ID NO: 371850 - RNA, 64 nt, Human
cuggccuuguuucuggaccacugggagcagcacugcagcccaggggagcuggaguccagcuugg

SEQ ID NO: 371851 - RNA, 64 nt, Human
uuggcauuuucaguucuguacgcaucugcggguugcagcccacgccgcuuacucucagcggaug

SEQ ID NO: 371852 - RNA, 64 nt, Human
gucugggcgcugugaguggggugggcacguccgggcagcccagugcgucugucgcacgucccca

SEQ ID NO: 371853 - RNA, 64 nt, Human
cugguguuuuguuaggaagacacagcugcccagagcagcccaggccguggugaggaggcggagg

SEQ ID NO: 371854 - RNA, 64 nt, Human
agaccacagaugacucaagccaugccagaaccaagcagcccaugccuggcuguggcgauucaga

SEQ ID NO: 371855 - RNA, 64 nt, Human
ggagagcacauaugcaaugccugauggguuccuugcagcccaaaaugaugccaaugagcugcuc

SEQ ID NO: 371856 - RNA, 64 nt, Human
ucucugggacagugugcuuucugauugaccugcugcagcccaaucaggcugaauucccacucuu

SEQ ID NO: 371857 - RNA, 64 nt, Human
uccucuuugacuucagcuugcauaugggguugaagcagcccacugagccaaguugaggagacug

SEQ ID NO: 371858 - RNA, 64 nt, Human
uguuguuguuguuguugagacagagucuuguuuugcagcccaggcuggagugcaguggcaccau

SEQ ID NO: 371859 - RNA, 64 nt, Human
aauccccaucugagauaaaguaaacaagugaccagcagcccacagaugauuccuuuauauagau

SEQ ID NO: 371860 - RNA, 64 nt, Human
aguucgagaucagcccuuuaaguaccuuucuguugcagcccaggcaaauaucacuuggccauuc

SEQ ID NO: 371861 - RNA, 64 nt, Human
cucagauuauguaauuuauuuguaagccugaaucgcagcccaaacagggcagcaauguugaagu

SEQ ID NO: 371862 - RNA, 56 nt, Human
aagagaggacugugcacuagaaaguugcagcccacagcccuucauguggacucugu

SEQ ID NO: 371863 - RNA, 64 nt, Human
agucugucuugacaacuggaaacaggguuccacagcagcccauucgugcugaaaacuggcuucc

SEQ ID NO: 371864 - RNA, 64 nt, Human
gagcuggcuccccugagagccaugcagggcgucugcagcccaggccucuggcagcagcucuuug

SEQ ID NO: 371865 - RNA, 64 nt, Human
gcgccugcacagacuggcugcuggaccugcgcacgcagcccaggaauggacauuccuaacgggu

SEQ ID NO: 371866 - RNA, 64 nt, Human
gcucccuguucugccccgaggccggggacgcagggcagcccacgccuccgugggcuccauucug

SEQ ID NO: 371867 - RNA, 64 nt, Human
gaggaagcguguugucuuacaagucauccccgcagcagcccauuggaugcuuugcuguaaauac

SEQ ID NO: 371868 - RNA, 64 nt, Human
guuuugugaucccaagugacucugugggaaggguggggacgaggcgucgggaggguauacaggg

SEQ ID NO: 371869 - RNA, 64 nt, Human
gggcaggcaaggucacugcucagucacguccacgggggacgagccguggguucugcugaguagg

SEQ ID NO: 371870 - RNA, 64 nt, Human
agucccugauuucgccaucaaagucagauccaggggggacgaugcuauucagguaagguucccc

SEQ ID NO: 371871 - RNA, 55 nt, Human
ucaaacguuaugccagaugauaaaaggggacgauugcaggcccauggacuguguu

SEQ ID NO: 371872 - RNA, 62 nt, Human
ucccguuccugggggcguagaggggccgggccggggacgaggccuccugcggacaccagcuc

SEQ ID NO: 371873 - RNA, 64 nt, Human
ggaaggcgauacucucgcucacgcagcaggagcaggggacgaaggugagaucuuguuuaacuga

SEQ ID NO: 371874 - RNA, 64 nt, Human
uggcugcagccccugccugugugucugguguugaggggacgaagggaccccugccccugucugc

SEQ ID NO: 371875 - RNA, 64 nt, Human
gcccacugcacagcauauccaggcugccacagguggggacgaggcugagagagucagcaggcag

SEQ ID NO: 371876 - RNA, 64 nt, Human
aguguccaagccugcuggaaacugggauguagcuggggacgaaaggacagacccaagcguucuc

SEQ ID NO: 371877 - RNA, 64 nt, Human
ucaugccacuucagauguuuauuuggaugugguuggggacgagagcagacaccaaggaaaggga

SEQ ID NO: 371878 - RNA, 64 nt, Human
gggguauggugcgccgcaugacaugggaggcgauggggacgauggacagagacagagcgugcac

SEQ ID NO: 371879 - RNA, 64 nt, Human
gguccugaugcccaaccucccaccccuucaauguggggacgagacccccucaucucagaguaau

SEQ ID NO: 371880 - RNA, 64 nt, Human
ugaauaaagcaguugaucagcaucauuggaacauggggacgagugacggcaggaggaccacgag

SEQ ID NO: 371881 - RNA, 64 nt, Human
ugggggaaagcgcacuugagacagagguaaugauggggacgaagugagaacagagacccagaag

SEQ ID NO: 371882 - RNA, 64 nt, Human
aggacaaauaaauaauugugguuguguucuuaauggggacgagcagacacacugaucugaacau

SEQ ID NO: 371883 - RNA, 64 nt, Human
ccaccagcagaguagccgccgcugcugugagccuggggacgacauggcaggcuggucccccucc

SEQ ID NO: 371884 - RNA, 64 nt, Human
aaaauacucaugcaaccagccugagucgcggugaggggacgagagguuguacacacauugguag

SEQ ID NO: 371885 - RNA, 64 nt, Human
gcacagaggcucgccaggcccugauccggucuguggggacgagggacacugaggagaggugcug

SEQ ID NO: 371886 - RNA, 64 nt, Human
ccgcagcccagacgcagcugagucggaagcucccggggacgacgcugacugcccuggaggccgc

SEQ ID NO: 371887 - RNA, 64 nt, Human
accaggcuggguuggggguuggguggggcuggacggggacgaggcgcggagaggcggcgggaaa

SEQ ID NO: 371888 - RNA, 64 nt, Human
uguugcccuccaggggccuggcacagcuggccuuggggacgagggagaggacugauucagggcc

SEQ ID NO: 371889 - RNA, 64 nt, Human
gcuggggcgggcuaggaggaggggguaggugaugggggacgagggccaggcacccacaucccca

SEQ ID NO: 371890 - RNA, 64 nt, Human
gccuugggcuugcugcuucauuacucaccuggauggggacgagggaugagaaggguguggguuu

SEQ ID NO: 371891 - RNA, 64 nt, Human
cacggugcucgccgacaguggugucugaacccuuggggacgagggccugggccgcggugaggcc

SEQ ID NO: 371892 - RNA, 64 nt, Human
aguaggguguggacgcaaaccugugacagcagagggggacgacuucacacucacugccucaugu

SEQ ID NO: 371893 - RNA, 64 nt, Human
caagugaggcccagaagcccaugggcagggcuggggggacgaagggggaacccggagcaccucc

SEQ ID NO: 371894 - RNA, 54 nt, Human
cgcccuguugggcuuccugaugacggggacgacaggccgaggauucacgcugga

SEQ ID NO: 371895 - RNA, 64 nt, Human
agggaccauccagacccucccuucuugcuggggaggggacgaguucuacccaccuccccacacu

SEQ ID NO: 371896 - RNA, 64 nt, Human
caaacuugcuugaccuccacuuuucaggagacuuggggacgacagcccucaucggcgucuuuca

SEQ ID NO: 371897 - RNA, 64 nt, Human
uccccacagcuccacaaugggcucccccgccaacggggacgacagggaucuucaggaacuucug

SEQ ID NO: 371898 - RNA, 64 nt, Human
acaccacccuuccggagcagcucagucagcccucggggacgagaaaccacaagcgcagagacgc

SEQ ID NO: 371899 - RNA, 64 nt, Human
auagggaagggcggaggggggugggcagugacuaggggacgagaagcauggggaaaauauuugc

SEQ ID NO: 371900 - RNA, 64 nt, Human
ccgcccacgggcagcaggagggacaaugcggccaggggacgagcgccuuccuugcccaccucac

SEQ ID NO: 371901 - RNA, 64 nt, Human
ugccaaggucaacccaucaccaggaacugucacuggggacgaguccauguucccaagggcagcc

SEQ ID NO: 371902 - RNA, 64 nt, Human
aagcuggggcugggaagcccgggcgcggcgcgcuggggacgaggggaggucccgggggggcgcu

SEQ ID NO: 371903 - RNA, 64 nt, Human
cccugcucccccuguccccaccccaggagaguaaggggacgagggccagcucucuggcaucagg

SEQ ID NO: 371904 - RNA, 64 nt, Human
aggccagaguagaauggaggaugauugccgcccaggggacgagcucagcccugcgccuuggcuc

SEQ ID NO: 371905 - RNA, 64 nt, Human
gcccucauuuuguugcuuuugugaacuuuuuguaggggacgagaaagaucauugaaauucugag

SEQ ID NO: 371906 - RNA, 64 nt, Human
aaggggaaccgugcuaaugggccuuauugggugaggggacgagaugggguucaugugaaggagg

SEQ ID NO: 371907 - RNA, 64 nt, Human
agcccacccucaccugcuuuuccagcccacaaagggggacgaucacggcccagcaaaagcgaug

SEQ ID NO: 371908 - RNA, 64 nt, Human
ugcaugcacugugaccuuggggggagaacagaagggggacgacgcccccgcaccuccugcgauc

SEQ ID NO: 371909 - RNA, 64 nt, Human
aucucuucugguguugacuggacugcuuggggugggggacgaucaggaggaagugagcagucgc

SEQ ID NO: 371910 - RNA, 64 nt, Human
cacagcgucugcucauaggaccugcauccuuccuggggacgaauuccacucguccaagggacag

SEQ ID NO: 371911 - RNA, 64 nt, Human
gugaguccaggccccugaugcuccaaccucccggggggacgacgaugacaaugugaaaccauca

SEQ ID NO: 371912 - RNA, 64 nt, Human
cacuaggugacagcggccaccaggcucugugcugggggacgauacuggcccuggccucgaccag

SEQ ID NO: 371913 - RNA, 64 nt, Human
agugcuagguguuuuuuaggaacuaggguggcggggggacgaacuucucuuccucacaugaggu

SEQ ID NO: 371914 - RNA, 64 nt, Human
ggcccaccuagggaccaagaaagaguaggaagaaggggacgagccgggagcaaaaccaccucag

SEQ ID NO: 371915 - RNA, 64 nt, Human
acgguuuggggacuugggguguucccaagaccugggggacgacagacaucacgggaggaagaug

SEQ ID NO: 371916 - RNA, 64 nt, Human
guuuauguuaggaucugaaucauguucuggguaaggggacgaggagcgaacacugcacuaagau

SEQ ID NO: 371917 - RNA, 64 nt, Human
caaugaaaucauugaugcuuuaugaaaagguuauggggacgauucccaaaauaaaucaccaguu

SEQ ID NO: 371918 - RNA, 64 nt, Human
uccuaggcccugcugagcugcagcaccugcucuaggggacgagcuccaagcaaagccuggcucu

SEQ ID NO: 371919 - RNA, 64 nt, Human
ucauauauaccaccuuguuuccccugggaagugaggggacgaagccuuagagggugacauagcu

SEQ ID NO: 371920 - RNA, 64 nt, Human
gaguguugaggggguuguaccugccagacuuccaggggacgauggaauacccagaacgcuccuu

SEQ ID NO: 371921 - RNA, 64 nt, Human
ggucucuccccuacaguuugcuguguucuacaagggggacgagugccugggcagcgggaagauc

SEQ ID NO: 371922 - RNA, 64 nt, Human
cugcccauccucccagcuccugugucagagccugggggacgagucacccagcucacccccacau

SEQ ID NO: 371923 - RNA, 64 nt, Human
auguuuuucauccauuccuaaucaaauucugucuggggacgaaggguuggacgggaugaccucc

SEQ ID NO: 371924 - RNA, 64 nt, Human
uugaagaaauuauaaagauaaagcugccccaucuggggacgauauggggagggagaugggaggg

SEQ ID NO: 371925 - RNA, 64 nt, Human
cgacuggccaagaccuccacguccccagaguccagcccuggaaauuccaagggcccuggcgucc

SEQ ID NO: 371926 - RNA, 64 nt, Human
gaggcuguggaagaacucugcucgagggcagggugcccuggaacacugguaguucuggggcugg

SEQ ID NO: 371927 - RNA, 64 nt, Human
uggugucugccaucccccucccucccugggcccggcccuggacccgucaggugccuguccccag

SEQ ID NO: 371928 - RNA, 64 nt, Human
ggauugggaccugcucugacagcuggacacaugagcccuggaugaguaugguaggggguuugaa

SEQ ID NO: 371929 - RNA, 64 nt, Human
auguuuccaccccacccccaaccuugucccaagugcccuggacuaaauuuccugugccagugac

SEQ ID NO: 371930 - RNA, 64 nt, Human
agccaggauuggggagagcccuugucucuggucagcccuggagcaugggaucgugggaaagagg

SEQ ID NO: 371931 - RNA, 64 nt, Human
uacaccaucccacaagggcgcuggggguggaagugcccuggaagccccuccccucucacacuga

SEQ ID NO: 371932 - RNA, 64 nt, Human
cugcuuccucagggcccagcaggcggggguuugagcccuggaccccaggcucuuagagacuaag

SEQ ID NO: 371933 - RNA, 64 nt, Human
caguguuagagcggagcccaaaggaaggaugggagcccuggagugggcaagaccaggccaccug

SEQ ID NO: 371934 - RNA, 64 nt, Human
gccaggugccuccucucagucaggcuucagagcagcccuggagacaggagggccauguuaaaag

SEQ ID NO: 371935 - RNA, 64 nt, Human
uauuuccggugaggcucaccgggucccaaguccagcccuggaucucccaauggccuuccaaucc

SEQ ID NO: 371936 - RNA, 59 nt, Human
ucaccacagugcugcccugagcgagggcugcccuggaggcuccggcucgggggaucugc

SEQ ID NO: 371937 - RNA, 64 nt, Human
guguccccaccaucagccaccacacaccucugcugcccuggagacugugcucuugaccugcucc

SEQ ID NO: 371938 - RNA, 64 nt, Human
uuucuccauauuaguuaacaagaggugucuuuaggcccuggauguuaccaucucauuuggucaa

SEQ ID NO: 371939 - RNA, 64 nt, Human
gcagugagguccucauucuccagccagccucucugcccuggagaaucaugugcuauguucuaag

SEQ ID NO: 371940 - RNA, 64 nt, Human
uguggugcugcugagugagccggccugugcccaugcccuggaggcuuuggcuacucuccugcgc

SEQ ID NO: 371941 - RNA, 64 nt, Human
aagccuucuuuugggauuugcauuguaauugagggcccuggaagaucucugagacucaaaauca

SEQ ID NO: 371942 - RNA, 64 nt, Human
aggaugcuccccaugcugccacuauuuauugugagcccuggaggcucccaugugcuugaggaag

SEQ ID NO: 371943 - RNA, 64 nt, Human
gugagagugggaggagggcacguaccgggugccagcccuggagcccucagggagacagacacag

SEQ ID NO: 371944 - RNA, 64 nt, Human
gaagagacagcccuggcugcuuuccuuuccuacugcccuggaauggguguugcucuuaggaugu

SEQ ID NO: 371945 - RNA, 64 nt, Human
uguauuuguuuucugugagagcacugaaauggcagcccuggaaucuacaauuuggcucuccacu

SEQ ID NO: 371946 - RNA, 64 nt, Human
ccucagaauaggcgagguaaccuugaauuucagggcccuggaaacucuagcugaaaccugccuu

SEQ ID NO: 371947 - RNA, 64 nt, Human
agucugaaaggguggccacagccccacguggugugcccuggaggcuuagguuggucugagguug

SEQ ID NO: 371948 - RNA, 64 nt, Human
ccccucaucacaggcuaaagaagagcaguagacagcccuggacacucugaagcagaggcaagac

SEQ ID NO: 371949 - RNA, 64 nt, Human
acccaggaguuugugugucuuuuauaaaaaguuugcccuggaugucauauuggcaguuggagga

SEQ ID NO: 371950 - RNA, 64 nt, Human
ugaugagucccaggggcacuggucagccuguggagcccuggaugcuauccacacccaccuaucc

SEQ ID NO: 371951 - RNA, 64 nt, Human
ccucugcugccuccuccccccaccaaguuucagggcccuggauuguucccaguucccauugugg

SEQ ID NO: 371952 - RNA, 64 nt, Human
cgcagcuccuagucucguccgugacuuuccgguugcccuggaucucagaauauauucguccacc

SEQ ID NO: 371953 - RNA, 64 nt, Human
auugauggugcuccccuuccugccagcgucagaggcccuggagaggggcuguccauggcagcug

SEQ ID NO: 371954 - RNA, 64 nt, Human
aaaaccucuggaaugaccuuccucauuccaggaggcccuggaauaaggaagaggcuucuuucug

SEQ ID NO: 371955 - RNA, 64 nt, Human
gaugacagaaucaaggcgccaggaugggcacucugcccuggauacaggcucuacccuccucccc

SEQ ID NO: 371956 - RNA, 64 nt, Human
cccucugcugcugaagaggcggaagaaagcucgggcccuggaggcugcggcucuggcccacuga

SEQ ID NO: 371957 - RNA, 64 nt, Human
cagaagugggugcaggaagguggcagugaccagcgcccuggaccaugcaguucggcggccgcgg

SEQ ID NO: 371958 - RNA, 64 nt, Human
cauuccuucuagaaagugcuuggggguuuuugcugcccuggaagccaggagccugcucacucca

SEQ ID NO: 371959 - RNA, 64 nt, Human
caggugucuguccccggcccagcgcaucuugaaggcccuggacucuguuaccaguggggggccu

SEQ ID NO: 371960 - RNA, 64 nt, Human
cugggaagccucccaugccaaggaggugggaggugcccuggaaauagcugccucaugccacuua

SEQ ID NO: 371961 - RNA, 64 nt, Human
gcagcagcccgcgggccucggagccguuuacgcggcccuggagcgcauggggcuggacggcugc

SEQ ID NO: 371962 - RNA, 64 nt, Human
accaggcacccucuggcacuguugcuugcccugugcccuggaccuuuuccugcccuucuccuuc

SEQ ID NO: 371963 - RNA, 64 nt, Human
agugucaugaagugcacaggagccaaaugaccgagcccuggagagccccaugguggguaggugg

SEQ ID NO: 371964 - RNA, 64 nt, Human
aucucgccaauaauucuugucuuugaguguuggagcccuggauucuggugcuauagcuccuggu

SEQ ID NO: 371965 - RNA, 64 nt, Human
cugccugcucuccagccucuggcaggaacucagggcccuggagcugcuggggccaagccaaggc

SEQ ID NO: 371966 - RNA, 64 nt, Human
ccacgugcuuugaaacuuuuccccucacccuccagcccuggaggcuuuugcugggaugaauguu

SEQ ID NO: 371967 - RNA, 64 nt, Human
aaccgugcagccacgaacacgcaugccucagccagcccuggaggcuggauggcuccccugaggc

SEQ ID NO: 371968 - RNA, 64 nt, Human
cggggccuucacagccuccauccuuagcuuuggcgcccuggacccacuuucucucucaaacugu

SEQ ID NO: 371969 - RNA, 64 nt, Human
gagcacuuaccugaagucaguggccuggaucauagcccuggaucauuucccagucuguccugug

SEQ ID NO: 371970 - RNA, 64 nt, Human
aaagaccuccguugaacauucuguauggaaaagagcccuggagcaucagguuccccagauaggc

SEQ ID NO: 371971 - RNA, 64 nt, Human
gaagauucuacacuagcguccuguugggaauuaugcccuggaauucugccugaauugaccuacg

SEQ ID NO: 371972 - RNA, 64 nt, Human
agguugccaagaaaagggaccuaguuuagccauugcccuggagaugaaauuaauggaggcucaa

SEQ ID NO: 371973 - RNA, 64 nt, Human
gugacuacugguuagccagaggagcucagcugaagcccuggaaacccucaggucugagauagga

SEQ ID NO: 371974 - RNA, 64 nt, Human
gucagagccuguuggaaagcagggguagaggggagcccuggaagcagggcuuuuccggaugccu

SEQ ID NO: 371975 - RNA, 64 nt, Human
aggccuaaaugagaggcauucugacugguuggcugcccuggaaggcaagaaaauagauuuauuu

SEQ ID NO: 371976 - RNA, 64 nt, Human
gaaccaacaaagaguaccuaggaaugggaguugagcccuggaauggggcucuauggagaggugc

SEQ ID NO: 371977 - RNA, 64 nt, Human
cccaaugcacucagaaagaaauccaguuuccauggcccuggauggucuggcccaccuccagccu

SEQ ID NO: 371978 - RNA, 64 nt, Human
auccgcuggcuaacaucugcucuugguuucugcugcccuggagccugacccucagucuccauuc

SEQ ID NO: 371979 - RNA, 64 nt, Human
ucugcggacugugaagaaucacaaugcucuauaugcccuggacuguguggcaaaugcagguugc

SEQ ID NO: 371980 - RNA, 64 nt, Human
aggcccaguucaggccucagccccucuuucccaggcccuggaucucaccagcagccaagguuga

SEQ ID NO: 371981 - RNA, 64 nt, Human
ucuauauccugaugguagagacagacuccaggcagcccuggacuugcuagcccaaagaaggagg

SEQ ID NO: 371982 - RNA, 64 nt, Human
ggauaccucaguguccacacacccaccaugcccagcccuggagccaucacuacucacaccgugg

SEQ ID NO: 371983 - RNA, 64 nt, Human
ugcagagcagucaggagaaaugguggagccuggggcccuggaauggcugacccugugccuagag

SEQ ID NO: 371984 - RNA, 64 nt, Human
uuauuugccugccagugcucuccagcgccauccugcccuggacaccacccugacgugaugccuc

SEQ ID NO: 371985 - RNA, 64 nt, Human
agagaggcaaugaugagugaucaagaauuagagugcccuggaggucacucacaaguccucaugg

SEQ ID NO: 371986 - RNA, 64 nt, Human
uggaucucuggccccaacccccaccagaccucaugcccuggacacugcugcugaguuggcucag

SEQ ID NO: 371987 - RNA, 64 nt, Human
uugcuuucugguuggagccuggccggaaggaagagcccuggaggugguugggggcaaaugugcc

SEQ ID NO: 371988 - RNA, 64 nt, Human
ggaccucugaguagcucugagguggcacuguccagcccuggauagggggggcagugggccagcu

SEQ ID NO: 371989 - RNA, 55 nt, Human
cccagccuaaggaauggugaaaugagcccuggagcccccuccaguccagucccug

SEQ ID NO: 371990 - RNA, 64 nt, Human
ugaccuguaccucuucucugcccuccacuucccugcccuggaguccguuucuggagacuagaaa

SEQ ID NO: 371991 - RNA, 64 nt, Human
cuacucgggaggcugaggcacgagaaucgcuugagcccuggaguuggagguugcagugagcaga

SEQ ID NO: 371992 - RNA, 64 nt, Human
cccuccccugcagaguggccagauggaguccugagcccuggacaugggcccggcuuuccuggau

SEQ ID NO: 371993 - RNA, 64 nt, Human
cacugccucuuccucccucauuccaccuucccaugcccuggauccaucaggccacuugaugacc

SEQ ID NO: 371994 - RNA, 64 nt, Human
ccuaugucucugauuuuuuuuuuuccccaguauugcccuggagcugucucuggaaaguagcugg

SEQ ID NO: 371995 - RNA, 64 nt, Human
cuggggucgcgcggcuuuggaaaaacaaauccuggcccuggacucgguuucccagcgcggucaa

SEQ ID NO: 371996 - RNA, 64 nt, Human
uagcuucuccgucaggaggccucaucucacuguagcccuggaacccaggguccaucuugcccuu

SEQ ID NO: 371997 - RNA, 64 nt, Human
gggugaguucuccaaggcccaugaggauaugacugcccuggagaaggauuacaaggaggugggc

SEQ ID NO: 371998 - RNA, 64 nt, Human
accuaauggggugccaucaauaagcugcgauacagcccuggagcucagucagccacaccuuccu

SEQ ID NO: 371999 - RNA, 53 nt, Human
uggagcagagcaccaaaugaucugcccuggagaggcucugggacggguuuacu

SEQ ID NO: 372000 - RNA, 64 nt, Human
aucugagcacuuugggauguauucagccuacguugcccuggaaaaggaagcaggagaugucucc

SEQ ID NO: 372001 - RNA, 64 nt, Human
aacaaugauuaaauugaauguguaaugugcaaaagcccuggaacgcaauuaaauacacuaguaa

SEQ ID NO: 372002 - RNA, 64 nt, Human
gaagacaaagccgccgccaauccugggcucuggggcccuggacuccucaccucgcgcucugccu

SEQ ID NO: 372003 - RNA, 64 nt, Human
gggugcgcucccacucuucuccugcucccccccugcccuggaggggaggggcgauaaauaccuu

SEQ ID NO: 372004 - RNA, 64 nt, Human
aaggaugagcagaaaaugagcugagcuuagcucugcccuggaaccuaccagagcagagaagggc

SEQ ID NO: 372005 - RNA, 64 nt, Human
ucagcagcaagaaaggcaaguugcuccugcuggggcccuggacucugccuuagcucccaccucu

SEQ ID NO: 372006 - RNA, 64 nt, Human
aggcaguagggcacagagggaagaggaggguggggcccuggaugacuuuccagccucuucaacu

SEQ ID NO: 372007 - RNA, 64 nt, Human
ccuccucccagggguucagauguggugggguagggcccuggaagucucccaggucuucccuccc

SEQ ID NO: 372008 - RNA, 64 nt, Human
ccacuuggguuuuuccacugcagccacguggccagcccuggauuuuggagccuguggcugcaag

SEQ ID NO: 372009 - RNA, 64 nt, Human
gagagcggagcaagugucccgggcccuucagccagcccuggauagcuacuuccaucccccgggg

SEQ ID NO: 372010 - RNA, 64 nt, Human
aaaugaagacauccugggcagcuugggcuggcgggcccuggagcucaagccguggccggggucc

SEQ ID NO: 372011 - RNA, 64 nt, Human
gggcugccagguucuguacuuguguccagcuguggcccuggaugcuggagcuggaggguuuucu

SEQ ID NO: 372012 - RNA, 64 nt, Human
cccuauagaaacaccaguaccugaaagcacuguagcccuggaccugccuccuucccucggggcc

SEQ ID NO: 372013 - RNA, 64 nt, Human
cugccuuugcuuaagccaucuuugugguagaggggcccuggaauugcagcuguacugaggauga

SEQ ID NO: 372014 - RNA, 64 nt, Human
ggggccucaagccugcagccacuggcuugauugggcccuggacguugagcccagauguuggagc

SEQ ID NO: 372015 - RNA, 64 nt, Human
ggacagugaccugaucuccuccucaugaccuucugcccuggacaagcccccugaacuggauuug

SEQ ID NO: 372016 - RNA, 50 nt, Human
cccugcccagugacagcugagcccuggaacuccuaaaccuuugccccugg

SEQ ID NO: 372017 - RNA, 64 nt, Human
aaaacaaaaugucaggaaucuagcaguguugucugcccuggagcaaacaaacaguaugugauuu

SEQ ID NO: 372018 - RNA, 64 nt, Human
guguugggauuauaggcgugagccaccgcgcccagcccuggagugauacuuuuuauggaagaca

SEQ ID NO: 372019 - RNA, 64 nt, Human
augaagguccccacacagagucuggauggaggcugcccuggaagcagccccgggcugggaaagg

SEQ ID NO: 372020 - RNA, 62 nt, Human
uauugaaugaggaccagugagcggagugaggugcccuggagaagcaggcuuugaaggcacag

SEQ ID NO: 372021 - RNA, 64 nt, Human
cuccaacgcagcacuagcaagcagguucgggacagcccuggacgauuucccgaccgcugcucag

SEQ ID NO: 372022 - RNA, 64 nt, Human
gauggacuggcuggugcugggggagcugcagauggcccuggagugggcaggcaggccagggcug

SEQ ID NO: 372023 - RNA, 64 nt, Human
acugccaaacccucagcuuauguagcuagaaagggcccuggagugagaaagccuggauuuucaa

SEQ ID NO: 372024 - RNA, 64 nt, Human
ugagcaguggaauuuuccugccauccuaauaagagcccuggauuccaucauuaacauuucagcc

SEQ ID NO: 372025 - RNA, 51 nt, Human
cacugccccaccagcucuagggcccuggaccucgggucaugauccucugcg

SEQ ID NO: 372026 - RNA, 64 nt, Human
gggcagguguucaucgcccucauccuagguacuagcccuggauguccccauggcuucacacaca

SEQ ID NO: 372027 - RNA, 64 nt, Human
gaggccugagucaccuagcauaggguugcagcaagcccuggauucagaguguuaaacagaggcu

SEQ ID NO: 372028 - RNA, 64 nt, Human
cugacugggaugagggugaggggugacggguguggcccuggauguggugguuuucccuuggcca

SEQ ID NO: 372029 - RNA, 64 nt, Human
ccacacaggaggccuguaugacuuccugcucacagcccuggaguccuguuacgagcacauccag

SEQ ID NO: 372030 - RNA, 64 nt, Human
ucugcugcgaguugccuuagagcgcaagggccaggcccuggaggaggaugaagacacagagaca

SEQ ID NO: 372031 - RNA, 64 nt, Human
aggugcacucucaccccacuguaggcugagcuuggcccuggacucggaacacaccugcaguccc

SEQ ID NO: 372032 - RNA, 64 nt, Human
cacggccugcuguugcuucagccuggccugggcagcccuggaagcucggaggagaggccaccuu

SEQ ID NO: 372033 - RNA, 64 nt, Human
caaugggccaucuggaccaaaggugggguguggggcccuggauggcagcucuggcccagacaug

SEQ ID NO: 372034 - RNA, 64 nt, Human
gacugaacucugugggaaucacauccauacuggagcccuggauuuuugcaguucugcccuccac

SEQ ID NO: 372035 - RNA, 64 nt, Human
gcugucuuucccagggugaugcaagcaugccgcagcccuggaggcugggaauguggaggcucug

SEQ ID NO: 372036 - RNA, 64 nt, Human
ggagggugagcuggugccugcuuugacgggccaggcccuggagggcagagacaaucacgggcgg

SEQ ID NO: 372037 - RNA, 64 nt, Human
ccuccccagggagggcucgaaggaagugcagggagcccuggacaccacugagucugcaugaaau

SEQ ID NO: 372038 - RNA, 64 nt, Human
uccaaggaugcaggucuggaaaaugauaucggaggcccuggaguuugugagcuuggcucuaguc

SEQ ID NO: 372039 - RNA, 64 nt, Human
agagcucuccagcuccaagaccuguugguuccaagcccuggagccaacugcugcuuuuugaggu

SEQ ID NO: 372040 - RNA, 64 nt, Human
ggccccagggcuggaaggagaccaaggggcagccgcccuggagggacaucagugcuuccucuuc

SEQ ID NO: 372041 - RNA, 64 nt, Human
cagaacugucgcucaccuguggcugacacacccagcccuggaaacggggccccagacgccacgu

SEQ ID NO: 372042 - RNA, 64 nt, Human
ucgaggaucccagguugaagaguggccccuugaggcccuggaaagaccaaucacuggacuucuu

SEQ ID NO: 372043 - RNA, 64 nt, Human
ugucucaccccugaaaacaucagaugcagaaaaagcccuggacuuggagcugggaagccugggu

SEQ ID NO: 372044 - RNA, 51 nt, Human
agaaggcaggacucaaaugaugcccuggagaugucacagauuccuggcaga

SEQ ID NO: 372045 - RNA, 64 nt, Human
augagggucccucucagagcgggagaacgccagagcccuggauggugaugcgcuggcugggggu

SEQ ID NO: 372046 - RNA, 64 nt, Human
gcugccuaauuaaugaaagaugaaaauaggaagugcccuggagggggccagcaggucacggggc

SEQ ID NO: 372047 - RNA, 64 nt, Human
cagguuaggauuccugggaaggccgcggauuccggcccuggaagaggcaggauccuggagcagu

SEQ ID NO: 372048 - RNA, 64 nt, Human
uaaacacuccuucuuucagccccaccuccccagggcccuggaggagacccccacccugcaaucc

SEQ ID NO: 372049 - RNA, 64 nt, Human
cccaucgugguccauggagccuuucaaaaugggugcccuggaggggccugacaguggguuccuu

SEQ ID NO: 372050 - RNA, 64 nt, Human
cagauaggccauugcuuucaccgauuccaacccagcccuggacugaggauggaugguuccauga

SEQ ID NO: 372051 - RNA, 64 nt, Human
cuuggggagaaaacauccuccucugauggccaaagcccuggaaucaaggguuuccacguacccu

SEQ ID NO: 372052 - RNA, 64 nt, Human
uuugugaaccaauuuuaaauacauucuccuuuuugcccuggauuguugacaugaguggaauacu

SEQ ID NO: 372053 - RNA, 64 nt, Human
agcccuccucccuuccccugccccuccuuuccacgcccuggaaaccaucucacuucacagggca

SEQ ID NO: 372054 - RNA, 64 nt, Human
aagaaaaugaacuauauaucuaauuaacaaacaggcccuggaucauauuccggggaucaucaca

SEQ ID NO: 372055 - RNA, 64 nt, Human
uaacccauaaaaccugcuuugauuccaaaaugaggcccuggagugcgcaaggagugcccggaug

SEQ ID NO: 372056 - RNA, 64 nt, Human
uuucauuuggggugcccuuucacucccaggccaagcccuggagcaaucuucuucaggcagcugu

SEQ ID NO: 372057 - RNA, 64 nt, Human
acugucaucuugcuucccaaucuaagaaccuguggcccuggaacacuuuucaagaauugguuca

SEQ ID NO: 372058 - RNA, 64 nt, Human
uaugcaggacuccugaaggaggugggagcugagggcccuggaggauggggaagguuugcagaga

SEQ ID NO: 372059 - RNA, 64 nt, Human
uugauuuuacaaaagaaaguaagcugcuuagaaggcccuggaagggaagugaggaggagggaca

SEQ ID NO: 372060 - RNA, 64 nt, Human
gccacgcagaacgaacaugacuccagaggaccucgcccuggagcugagccuggcgccgggucag

SEQ ID NO: 372061 - RNA, 64 nt, Human
gcugagucggaagcucccggggacgacgcugacugcccuggaggccgcagccaacccggcacug

SEQ ID NO: 372062 - RNA, 64 nt, Human
cccaucuuagagucaaaggcagaggggcuuccaggcccuggaugggguauuuuggugucaccug

SEQ ID NO: 372063 - RNA, 64 nt, Human
ugcugacgccaccuuccugcugaggugggacugggcccuggacacaccccucagccccucuguc

SEQ ID NO: 372064 - RNA, 64 nt, Human
aggugccuuugacugucuucuauccauuaguucugcccuggagcacacuggggaagcaggcugc

SEQ ID NO: 372065 - RNA, 64 nt, Human
gggguguaguguuugcuaggagcccaggauaccugcccuggacuuaaauugugauugaagugga

SEQ ID NO: 372066 - RNA, 64 nt, Human
uuucugcaucacccugagccccauuugcuucccagcccuggaguuuuuacccggcuuugccugc

SEQ ID NO: 372067 - RNA, 64 nt, Human
caaggauagcuaucugggacauuauuggcagugggcccuggaggccagucccuagccccccuug

SEQ ID NO: 372068 - RNA, 64 nt, Human
uggucagacaggucacccaggagccucgaggaaagcccuggagggaaucacauguguacuuuuu

SEQ ID NO: 372069 - RNA, 64 nt, Human
ggagggauaaggcugauuuggaccccaggcuucugcccuggacagcacuugugucugcagauua

SEQ ID NO: 372070 - RNA, 64 nt, Human
agagcacccuggugccaaggccuucucagcccaugcccuggagggcauuccccuggccagccuc

SEQ ID NO: 372071 - RNA, 64 nt, Human
uccuggcauucugguaccuucacccagccugagugcccuggagagggaacaggaaaugcugauc

SEQ ID NO: 372072 - RNA, 64 nt, Human
caguccugccuuucagauccuuucuacugggugagcccuggagugcugguucuccucgcggugc

SEQ ID NO: 372073 - RNA, 64 nt, Human
accuguuccccaguauugcccucaauuccugagagcccuggagcgguuuccuaccauucccuuc

SEQ ID NO: 372074 - RNA, 64 nt, Human
aaagagaauuuauuuccuucuccacucucuccaugcccuggagaaaaaaaaguccagaagaaau

SEQ ID NO: 372075 - RNA, 64 nt, Human
cccuugaccccucuauuucuguuggcuaaggccagcccuggacauuguccaggaaggccugggg

SEQ ID NO: 372076 - RNA, 64 nt, Human
gcguggggugggugggcaugggagguaggggugggcccuggagaugaggagggugggccauccu

SEQ ID NO: 372077 - RNA, 60 nt, Human
acagcaccaagagugaaugauccgcccgccgcccuggacagauggcccaagggauggcac

SEQ ID NO: 372078 - RNA, 64 nt, Human
uggguuggggcaguggugacgagcugugggaagagcccuggauaggaagccacugagucugccc

SEQ ID NO: 372079 - RNA, 62 nt, Human
agaaugagauucaccaguaaggggagggaggggcccuggaggccacauccugccccacccca

SEQ ID NO: 372080 - RNA, 64 nt, Human
gggugugcaccaggguucaguagaguccacuucugcccuggagaccacaaaucaacuagcucca

SEQ ID NO: 372081 - RNA, 64 nt, Human
cuuucacacauuccugaccagagaucccagccaggcccuggaggucugacagccccucccuccc

SEQ ID NO: 372082 - RNA, 64 nt, Human
gccuucauuucuuaucuacuuggcaugaaagggugcccuggauaggaggguguguacagggcaa

SEQ ID NO: 372083 - RNA, 64 nt, Human
gagcagagaacaaggacagaggccaggcacugaggcccuggagacagcuguuccacuugcacac

SEQ ID NO: 372084 - RNA, 64 nt, Human
ccccauccuccagcagggaaaaugcagcagggaugcccuggagguggcugagccccugucuaga

SEQ ID NO: 372085 - RNA, 64 nt, Human
caggaaauaggcccaaccaccagaugagaauuaggcccuggaugaguagcgcuauaguuacugu

SEQ ID NO: 372086 - RNA, 64 nt, Human
ucaacugauucuacaauuggacauucauuugugugcccuggaauuuccaacuaguaauaaacaa

SEQ ID NO: 372087 - RNA, 64 nt, Human
gggccucgccguuccaccagaagcucagcuccaggcccuggaggggcugcugcuccucaguugc

SEQ ID NO: 372088 - RNA, 64 nt, Human
cuaaaucuuuguguacuuuauuuguaaauuauuugcccuggaguuuuagaaaauaguuucugaa

SEQ ID NO: 372089 - RNA, 64 nt, Human
ccugauggccgcacagaaggacuucuucugggaggcccuggacaugcugcagagggcugaagga

SEQ ID NO: 372090 - RNA, 64 nt, Human
caucuccauggggaggccucaccccagggacagggcccuggagcucaggguccuuguuucugcc

SEQ ID NO: 372091 - RNA, 64 nt, Human
guggaggucugagaaugacgauacccgugacucagcccuggacacugguccgagaagggacaug

SEQ ID NO: 372092 - RNA, 64 nt, Human
cucggaggaggcagaggccacgaaggcacaccacgcccuggagcagguaggcagccaccaccuc

SEQ ID NO: 372093 - RNA, 64 nt, Human
ggugugugcuaaggcuccguccugacugcccugugcccuggaaaagcagcaauagcauccgccc

SEQ ID NO: 372094 - RNA, 64 nt, Human
cacuuaggugacaggaacuuccgcaccuccugaggcccuggaugauucuaauuguuagaaauuc

SEQ ID NO: 372095 - RNA, 64 nt, Human
cuucccuugacugcccgcacuggcgccugucugugcccuggagcauucugcccaggcuacgugg

SEQ ID NO: 372096 - RNA, 64 nt, Human
ccagccuugccuggcugagcuguguuccaggggagcccuggacaagcccucauaggcagggagg

SEQ ID NO: 372097 - RNA, 64 nt, Human
cugugugguccuugaguggguuucucggauccgugcccuggaauaccuggcucaggaaugcugu

SEQ ID NO: 372098 - RNA, 64 nt, Human
cuuugauuacaauugagauucaugugacuauugagcccuggaaauguagcuuguccaaauugag

SEQ ID NO: 372099 - RNA, 64 nt, Human
agaucaucuuuaugauuagaacaauuugcucaaagcccuggaaaaugccugguaacccagugcc

SEQ ID NO: 372100 - RNA, 64 nt, Human
ucugagaggaugcuuuccuguucaugggguuuuugcccuggagccucagcagcaaaugccacuc

SEQ ID NO: 372101 - RNA, 64 nt, Human
gucugcucuuagccuccccauggcucacguuccugcccuggaugggaugugaguggggcccaca

SEQ ID NO: 372102 - RNA, 64 nt, Human
cccucccucccuggacccaccgaugccucucgaagcccuggagacagccguugggugagggugg

SEQ ID NO: 372103 - RNA, 64 nt, Human
agaaccggagagaagugauuggaaaugaacucuugcccuggaauaaucuugacaauuaaaacug

SEQ ID NO: 372104 - RNA, 64 nt, Human
cugcccccaugcucgcgcugggcagggaccggcagcccuggaaggggcacuugauauuuuucaa

SEQ ID NO: 372105 - RNA, 64 nt, Human
cagcuucugugcaccuccugcaaagcuggcagaggcccuggaauuccagaucaccugaggggaa

SEQ ID NO: 372106 - RNA, 64 nt, Human
gaccaggccuuccggcgggcaaggaccagggcgagcccuggagcgccggagcggacgcccccag

SEQ ID NO: 372107 - RNA, 64 nt, Human
aauccccaagggcacugccacugugcucggaggugcccuggacuguguacaucugaacuuuggu

SEQ ID NO: 372108 - RNA, 64 nt, Human
ucagaggcaccugcggguuagcccaggggcccaagcccuggauuuggccugcggaggagcuuag

SEQ ID NO: 372109 - RNA, 64 nt, Human
cuggcacagugcccccuucccggacggguggcaggcccuggagaggaacugagugucacccuga

SEQ ID NO: 372110 - RNA, 64 nt, Human
caagaagcugcuucugcccacaccgcagggacaagcccuggagaaaugggagcuuggggagagg

SEQ ID NO: 372111 - RNA, 64 nt, Human
gcaggaguuucaucugcaugggggcacucugcaggcccuggaacauugggccugaguggagaug

SEQ ID NO: 372112 - RNA, 64 nt, Human
cugcugccugucccgcuuugcugccaaugcaacagcccuggaagaaacccuagaggguugcaua

SEQ ID NO: 372113 - RNA, 64 nt, Human
uaggauauaguauguuguauaugaugcugugauugcccuggaguuccugccaugacauggaaac

SEQ ID NO: 372114 - RNA, 64 nt, Human
cucuggacuggccugucuggccccugagaguggugcccuggaacacuccucuacucuuacagag

SEQ ID NO: 372115 - RNA, 64 nt, Human
caaaagugcuuuaaaaaccagccuggcgaggacagcccuggacccacuccacugucucuaagua

SEQ ID NO: 372116 - RNA, 64 nt, Human
cgaacauggaucugaggaggggcccuugggucgggcccuggagacgacacacggcagcccacag

SEQ ID NO: 372117 - RNA, 64 nt, Human
gcaguuggagcagcuccgagggaggacgaccauggcccuggaccugccauccucccacuugcag

SEQ ID NO: 372118 - RNA, 64 nt, Human
cuccugagcaccccagcuggggccaggcugggucgcccuggacugugugcucaggagcccuggg

SEQ ID NO: 372119 - RNA, 64 nt, Human
cagaaacucacugugauuccaaaaauguuucugagcccuggaccccugcccccaaaauauuuuc

SEQ ID NO: 372120 - RNA, 64 nt, Human
cuacauuucuuuuuuuuuuuuuuuccuuuagaaugcccuggaaauauauuuaagugguaaugaa

SEQ ID NO: 372121 - RNA, 64 nt, Human
gcugggugagucaccaucccaaagcaggaagggugcccuggagagaaccacccuccuccuacuc

SEQ ID NO: 372122 - RNA, 61 nt, Human
acauuacuuccagcaaauagggaacaguuuugcccuggaacagaguuacagauacacaauc

SEQ ID NO: 372123 - RNA, 64 nt, Human
uuaaagaauucuauaagcaauagcugauuaaugggcccuggaagaugaagauuauaacuguuua

SEQ ID NO: 372124 - RNA, 64 nt, Human
ucuuuccaaaacagcuacacaaaugcuucugaaugcccuggauacgcagaccgaguggcagucu

SEQ ID NO: 372125 - RNA, 64 nt, Human
caacugccauaggauucugagcaaggccuacuuggcccuggauagaaauuguuuucaaagagaa

SEQ ID NO: 372126 - RNA, 64 nt, Human
accaauccucaaggcuggcacaggcuuuggggaagcccuggagccugugaagacccuggaaacc

SEQ ID NO: 372127 - RNA, 64 nt, Human
gaaccccagcucuggggcuugggggugagggucagcccuggacagaccucugcccagggaacug

SEQ ID NO: 372128 - RNA, 64 nt, Human
ucucccggcagaggggccagaaucgcccggcccagcccuggagcccccuccacucccccaggcc

SEQ ID NO: 372129 - RNA, 64 nt, Human
acucagcagccugcgcucggcaggaaggagcggcgcccuggacuugguacaguugcaggagcgu

SEQ ID NO: 372130 - RNA, 64 nt, Human
cugccucaccuccagcugucagagggugagcagggcccuggaggcaggcacccccuccuccucc

SEQ ID NO: 372131 - RNA, 64 nt, Human
ccugggaggugguguuggaggccccaugaagagcgcccuggacugcugagggugggccaacagc

SEQ ID NO: 372132 - RNA, 64 nt, Human
uaaacgcagccucccucccuggaggcugccuccugcccuggaucuggaguggagcugcucugag

SEQ ID NO: 372133 - RNA, 64 nt, Human
cguucauuuguccacuguuucuugucaucacgcagcccuggacccaaagggugaacuaaaguuu

SEQ ID NO: 372134 - RNA, 64 nt, Human
cuauuugggaggcugaggcaggaggauugcuuuagcccuggaggucgaggcugcaguaagccau

SEQ ID NO: 372135 - RNA, 64 nt, Human
uaaguugagcgugcgcacugcaugggaaauagcggcccuggaggauguuagacuugcucccucu

SEQ ID NO: 372136 - RNA, 64 nt, Human
gcccugccugcagccagggcugggguugccagaggcccuggagggaaggacagucccugcuggg

SEQ ID NO: 372137 - RNA, 64 nt, Human
ucccugaaagcaccuuccuggaggaugugggagggcccuggacauggcccggccccacugcuga

SEQ ID NO: 372138 - RNA, 64 nt, Human
uugcccaaggucaggcuuaucuccagagggaggugcccuggacuggggcccagauguucaggga

SEQ ID NO: 372139 - RNA, 64 nt, Human
ggggcuugggcgacuacagggucuucgggccccagcccuggagcugcaggaguugggaacgggg

SEQ ID NO: 372140 - RNA, 64 nt, Human
gccccacccuccccggcugggagggcucuggagggcccuggaggggggguccccgcggcagcug

SEQ ID NO: 372141 - RNA, 64 nt, Human
ggcaagucacaugcguaaacgacacucucuggaagcccuggagacccucgcccaacuccaccag

SEQ ID NO: 372142 - RNA, 64 nt, Human
cacaguggcacagagagguaacuacggagcccaugcccuggaggaacucuguagcugugcauca

SEQ ID NO: 372143 - RNA, 64 nt, Human
ugucuuuucuuagcaaaaggauuuuaaaacuugagcccuggaccuuuuguccuaugugugugga

SEQ ID NO: 372144 - RNA, 64 nt, Human
aacccaagaugcaagaaggaggcuaugcucaggggcccuggagcagccaccccaugcuggccuu

SEQ ID NO: 372145 - RNA, 64 nt, Human
cccuaaagggccauagcccagugagcagccuggagcccuggagaccccaccagccucaccagcg

SEQ ID NO: 372146 - RNA, 64 nt, Human
gaacagggagucugcaggagcgcagacaggcacagcccuggagcaggcaggccgagggcugcgg

SEQ ID NO: 372147 - RNA, 64 nt, Human
uuuucuggaacagcggcaaccaagaggccuugcagcccuggaagugggucagggcccuuggugg

SEQ ID NO: 372148 - RNA, 64 nt, Human
agaagugcccuuaaggaucaccccagcccccacagcccuggaauaaauuucgcaauuaguuucc

SEQ ID NO: 372149 - RNA, 64 nt, Human
caggggugagaccugaaggaccucccccuguguggcccuggacacagcccacccucugugagcc

SEQ ID NO: 372150 - RNA, 64 nt, Human
ugguauccuuuagagaaaaaauauuagugaagaagcccuggaggcccagguugggagucagucg

SEQ ID NO: 372151 - RNA, 64 nt, Human
cccuucugccaaacacauccagaaccugcccucagcccuggaagcuagcaucuucuggggccag

SEQ ID NO: 372152 - RNA, 64 nt, Human
uggccacccuauucccacauggggagcaccaggagcccuggagccccuuccacccaaucccauc

SEQ ID NO: 372153 - RNA, 64 nt, Human
ggcuggagccggguccucagcugucugcucagcagcccuggacccgcgugcguuacgucaggcc

SEQ ID NO: 372154 - RNA, 64 nt, Human
gcuugugccuuaaaggcagagaagcgaggcggaugcccuggaagcacccagcaucacacccagg

SEQ ID NO: 372155 - RNA, 64 nt, Human
guggaggccuccugggguggccuguccugcaggggcccuggaaugggggcaagcagcugggugg

SEQ ID NO: 372156 - RNA, 64 nt, Human
ucagaggggccacagcccuucuccuccaugggaggcccuggagccugauagaaaucaguggugu

SEQ ID NO: 372157 - RNA, 64 nt, Human
ggaccucaccuggaaacucaccuucagcgccucagcccuggacuguuagaggugcugcagcugc

SEQ ID NO: 372158 - RNA, 64 nt, Human
cucggcccggggcaccuucggcugguccuguggggcccuggacgguggcccagugguggcaggg

SEQ ID NO: 372159 - RNA, 64 nt, Human
ccccaacacaagcuccagucuuccucuucggcaugcccuggaagcuucuuccagucuuccucuu

SEQ ID NO: 372160 - RNA, 53 nt, Human
ugcacucuggaagcaagugacuggcccuggagguggggcccggggucggggcu

SEQ ID NO: 372161 - RNA, 64 nt, Human
cgcccaugcagcaaggcuuggaggaagcgucagugcccuggagaucccagcucgcucuccccac

SEQ ID NO: 372162 - RNA, 64 nt, Human
aaauuuucuuuaagcagcugcucuccaagacagggcccuggaaaggcccacacauacagcccag

SEQ ID NO: 372163 - RNA, 64 nt, Human
ugccaguggguuggugaacaugccaucaguaaaagcccuggaaacaaggucauacuagagauug

SEQ ID NO: 372164 - RNA, 64 nt, Human
gaagaauacagauguuauagugaguccuacaauagcccuggaaggcaagagcuguuuccuuucc

SEQ ID NO: 372165 - RNA, 64 nt, Human
cgggaccuguuuauaaauugaggaauggaugagggcccuggaggguccuugggaguaguuagug

SEQ ID NO: 372166 - RNA, 64 nt, Human
guucgucuacaaauuggaaggaaauaugaaugaagcccuggaguacuaugagcgggcccugaga

SEQ ID NO: 372167 - RNA, 64 nt, Human
gagaaggugcuugguguucgccugccagcccagagcccuggaggagccggcugcacagagaggc

SEQ ID NO: 372168 - RNA, 64 nt, Human
cagugggagcuggccugggccaggacggcagguggcccuggagaugggaaagugucugugucga

SEQ ID NO: 372169 - RNA, 64 nt, Human
cuguaucucaguccaggagaggcagcccaucuuggcccuggaugaagaaggaaacccacagagg

SEQ ID NO: 372170 - RNA, 64 nt, Human
gccuucaaugagaagccuucucacugaaagagcugcccuggacggaaaaugaguagugagauga

SEQ ID NO: 372171 - RNA, 64 nt, Human
ccuaucuguggauguguaaauggcuggggggccagcccuggauagguuuuuaugggaauucuuu

SEQ ID NO: 372172 - RNA, 64 nt, Human
ccuuccuauuauguaaaucccagcuggacagacagcccuggagccagguggcccuguccccugu

SEQ ID NO: 372173 - RNA, 64 nt, Human
aaauuuucuuuaagcagcugcucuccaagacagggcccuggaaagaggcccacacauacagccc

SEQ ID NO: 372174 - RNA, 64 nt, Human
uuccugccauucuguuacccacucucccaggugagcccuggauuggcucccagaaggccuuugu

SEQ ID NO: 372175 - RNA, 64 nt, Human
cuacucuggaagcugaggugagaggaucacuugagcccuggaauuccaugccagccuaugcaac

SEQ ID NO: 372176 - RNA, 64 nt, Human
ccugugcaggcugcgcuggccccaccugccuugugcccuggagugggguuucuccuuguugaag

SEQ ID NO: 372177 - RNA, 64 nt, Human
acagaagagccucauccugucugccccucacucugcccuggaaucaacaucuuccgaguccuuc

SEQ ID NO: 372178 - RNA, 64 nt, Human
auuucccuuuacuuugguggccugcuucccucaugcccuggaauacaacucagagcuccaggca

SEQ ID NO: 372179 - RNA, 64 nt, Human
ucggcuguucuggguagccuggggcugaggaggugcccuggacucagggcuauccuguccuguc

SEQ ID NO: 372180 - RNA, 64 nt, Human
cuccuuucaccaagcucuguuuuggccuuucucggcccuggacugaggcucagccuacacgcuc

SEQ ID NO: 372181 - RNA, 64 nt, Human
cagccuuugaugucuuucaaagcuucuguggugcgcccuggauugagaaccaccacccgagggg

SEQ ID NO: 372182 - RNA, 64 nt, Human
uuacaugagcaaaagcuguugccccaaagugauggcccuggaggcggggcugaggaacagggaa

SEQ ID NO: 372183 - RNA, 64 nt, Human
accaggcucuuucucccuuuuccucuugcucacugcccuggaaucaacaggcugguugcugguu

SEQ ID NO: 372184 - RNA, 64 nt, Human
auaaacaacccccaaagucccugcugauccaguagcccuggagguuccccagguagggagagcc

SEQ ID NO: 372185 - RNA, 64 nt, Human
gagagccacagccaugauacagggcucuuauggagcccuggaguuguugggcaaggaugcuguc

SEQ ID NO: 372186 - RNA, 64 nt, Human
auaugaagcccuuggugaugaggacauagcaucugcccuggaaaucguuauuccaacauaauau

SEQ ID NO: 372187 - RNA, 64 nt, Human
aucguuauuccaacauaauauuauuuucuagaaugcccuggaaggacagaauauuuaaaaauau

SEQ ID NO: 372188 - RNA, 64 nt, Human
ggaccagacucaguggacauuugugcaauugcucgcccuggagggaaccagaucauuuuuaaac

SEQ ID NO: 372189 - RNA, 64 nt, Human
uuuuccuauccuuauaggccugucccuugccucugcccuggauugguuggcaaacuaaaggacu

SEQ ID NO: 372190 - RNA, 64 nt, Human
aaaaauuaaagacuauauauaauuaaacuacucugcccuggacacucucugagaaacagaucua

SEQ ID NO: 372191 - RNA, 64 nt, Human
ccaggcccgcgggcacagccagcccaaaccuugggcccuggaagaguccuccaccccaucacua

SEQ ID NO: 372192 - RNA, 64 nt, Human
ccucacaaaggagagagggaagaaaagaucuuuugcccuggagauaugguccugaaaucucucc

SEQ ID NO: 372193 - RNA, 64 nt, Human
aggggcaucccaccuccgggcucuggguuccucugcccuggaagggcuccaggacccgucccaa

SEQ ID NO: 372194 - RNA, 64 nt, Human
ugagacagccacuagaagaucuuccuccagcggcgcccuggacggcugcuccugcgaacagccc

SEQ ID NO: 372195 - RNA, 64 nt, Human
caggguaaccuucucccuugucaucucagccugagcccuggaggcugggccugcccacuccagc

SEQ ID NO: 372196 - RNA, 64 nt, Human
ggcaguagggcccccagcccccccccggagcugcgcccuggauccucacacuacagaucaggcc

SEQ ID NO: 372197 - RNA, 64 nt, Human
cuuccaccugggauucuccagccuccacccagcagcccuggauugcuuucuccaauuaaggccu

SEQ ID NO: 372198 - RNA, 64 nt, Human
accccacccagcuguucuaacccugcuauccacagcccuggaggaacuggggcuccuggaagga

SEQ ID NO: 372199 - RNA, 64 nt, Human
uccccccauccccagaggcuggaggaacaacugggcccuggaccagcaccacuuccgagguccc

SEQ ID NO: 372200 - RNA, 64 nt, Human
acacccacacacucgcccgcccacuguccugggcgcccuggaagccggcggcccaagcccgacu

SEQ ID NO: 372201 - RNA, 64 nt, Human
gauggauggauuuagggugggagggccugugggggcccuggacagucacaccccagcagcagug

SEQ ID NO: 372202 - RNA, 64 nt, Human
ccugccugccugagguccccgcugccagucccgggcccuggagagcagaugcugucuuguuaug

SEQ ID NO: 372203 - RNA, 64 nt, Human
gucucugcccugccuacuuuuaguugacucacaggcccuggagaagcagcuaacaaugucuggu

SEQ ID NO: 372204 - RNA, 64 nt, Human
acuuucuccuaguaacaugggcucaggggacucagcccuggacagagagccuccagagagugaa

SEQ ID NO: 372205 - RNA, 64 nt, Human
gggcccucuggccagagggaagcgggcagcucuagcccuggagauuguggucacauuggggcuu

SEQ ID NO: 372206 - RNA, 64 nt, Human
cuacucauaaggcugaggugggaggaucuauugagcccuggaauucgaggaugcaauuaauugu

SEQ ID NO: 372207 - RNA, 64 nt, Human
ugcugcuuguagacaguucccauaacuguccacggcccuggagcacgcacccaggggcagagcc

SEQ ID NO: 372208 - RNA, 64 nt, Human
ugcuggccagccuggggccuggcagggaggucaggcccuggaacucuaucugggccugggcuag

SEQ ID NO: 372209 - RNA, 64 nt, Human
ccauugucccgacauccuagagcaaguggucaacgcccuggaagaguccucuugacccugcuuu

SEQ ID NO: 372210 - RNA, 64 nt, Human
ggagcugggacggggccccgcugccggaccugcagcccuggacagauggggaacacugugccuc

SEQ ID NO: 372211 - RNA, 64 nt, Human
gccagaaacacacugugggcgugcaucugguucagcccuggauaugccuccacuguggagggaa

SEQ ID NO: 372212 - RNA, 64 nt, Human
aguauguuauuccugguuaagcaggcauugcuuugcccuggagcagcuauuuuaagccaucuca

SEQ ID NO: 372213 - RNA, 64 nt, Human
ucugccucugcccuuucuagccaagguuauagcugcccuggacugcucacucucuggucucaau

SEQ ID NO: 372214 - RNA, 56 nt, Human
ccagcagugauucugacugaauacaggcccuggacccuucccucaagucucaccag

SEQ ID NO: 372215 - RNA, 64 nt, Human
uugcucauaaacaaaaugcccauguugguccucugcccuggaccugugacauucuggacuauuu

SEQ ID NO: 372216 - RNA, 64 nt, Human
cuccuugggaggcuaagacaggaggauuccuugagcccuggaguuugaguccagccugggugac

SEQ ID NO: 372217 - RNA, 64 nt, Human
cugccagcccccuccccucugcccaggcugccacgcccuggaugccacccagugcagccuggca

SEQ ID NO: 372218 - RNA, 64 nt, Human
gccuguguagcugugaccugcugagcucugagaggcccuggaucagcguggccuuguucuguca

SEQ ID NO: 372219 - RNA, 64 nt, Human
ccuggggaacaguaacaggaaagcaucuucccuugcccuggacuugggucuagggauuuccaac

SEQ ID NO: 372220 - RNA, 64 nt, Human
guucacgugugucugugucauggaugcaaugcaggcccuggaggacugugcgucacccgucaac

SEQ ID NO: 372221 - RNA, 64 nt, Human
cccagucaggccgcaccgccgccagccuccuccggcccuggagggagcaucucgggcugggggc

SEQ ID NO: 372222 - RNA, 64 nt, Human
uggggaccggcagcagaggcaccguguucucucagcccuggauacgucuuguaaucuuucacac

SEQ ID NO: 372223 - RNA, 64 nt, Human
uauguaaugccuuuccuggacuuuuuuggccacugcccuggacuagugaaagaauggacucuau

SEQ ID NO: 372224 - RNA, 64 nt, Human
auuccccagguggcugacccagucccugggggaagcccuggauuucagaaagagcaagucugga

SEQ ID NO: 372225 - RNA, 64 nt, Human
guagcuucauccuauccggaggcacagcacaugagcccuggacaggucccaaaguuccaagcag

SEQ ID NO: 372226 - RNA, 64 nt, Human
cgagacauccaggagacagagccccugccccauggcccuggaugucacacucccaccagggcug

SEQ ID NO: 372227 - RNA, 64 nt, Human
acuuaacucccaagugugucgcgccggacaccgggcccuggacaugcugcuuccauguucaguc

SEQ ID NO: 372228 - RNA, 64 nt, Human
aaaaagaaaaaagaaagaaagaaaaaaggcagaagcccuggauucaaauccgccacacauucag

SEQ ID NO: 372229 - RNA, 64 nt, Human
agagagggaggaguaaaacugggcaagacaaagagcccuggaucguugaauugauaguuuaauu

SEQ ID NO: 372230 - RNA, 64 nt, Human
ccuauagcccugcuuugagcugucagccucaccugcccuggaaccccggcacccggcuugggca

SEQ ID NO: 372231 - RNA, 54 nt, Human
accaccaacagcaguuguaaggcugcccuggaggaaccgaaaggccaaauuccc

SEQ ID NO: 372232 - RNA, 64 nt, Human
ugaguuuuuuacugaauuaaucugaaauguacaagcccuggauuugcuacagagugagaaguua

SEQ ID NO: 372233 - RNA, 64 nt, Human
auggcuggggcggccaguuuugacacgccccagugcccuggagaacaaccagggucaucugcac

SEQ ID NO: 372234 - RNA, 64 nt, Human
uaucugggugugggccccuggccgccucccuccagcccuggagaggagggcagggcugcgggga

SEQ ID NO: 372235 - RNA, 64 nt, Human
agcagggaaugguucauuuacucuuaaucuuuaugcccuggagaagaccuacuugaacagggca

SEQ ID NO: 372236 - RNA, 64 nt, Human
uuagccacauuuccagcagggcaaaccaacugaugcccuggaagagucuuccgcacccucucca

SEQ ID NO: 372237 - RNA, 64 nt, Human
ccuuucuuauguugcuaggcuacuguuucugaaagcccuggaucucuuugcaccaaaaaugguc

SEQ ID NO: 372238 - RNA, 64 nt, Human
aauaacauaagccugggcucugagccucagcugagcccuggaagauucuccccauggggcagag

SEQ ID NO: 372239 - RNA, 64 nt, Human
caugcuuucuucacccugauuccuagaggucauugcccuggaucugcuugaaguccuccugugc

SEQ ID NO: 372240 - RNA, 64 nt, Human
ucauuguagcuguagucuccaucaguaacagcaggcccuggaagacuugaucaccuuuuucugu

SEQ ID NO: 372241 - RNA, 64 nt, Human
uuaaauuucuacuccaguccaauguaacuauuuagcccuggauuauacauacuguccaauuuuc

SEQ ID NO: 372242 - RNA, 64 nt, Human
gucuuaauugaggagaugggagacucgaacucuagcccuggaucugccuuccugcugaaacuug

SEQ ID NO: 372243 - RNA, 64 nt, Human
uacgcgccuugucuccuacuccugacuccuaccugcccuggaacauccuuugcagggcagcccc

SEQ ID NO: 372244 - RNA, 64 nt, Human
auguggcauuccugucaaauggccugcccaugaagcccuggaauuccagcuccaccuccacuac

SEQ ID NO: 372245 - RNA, 64 nt, Human
ugaggaguagcuuugccacaucuugaucugcucagcccuggaggugccagcaaagccccaugcu

SEQ ID NO: 372246 - RNA, 64 nt, Human
cacuuccccaccagugaucucucccgacugcacugcccuggagaggcagcaucaggaccuaagc

SEQ ID NO: 372247 - RNA, 64 nt, Human
ugugggggguggcccaagggaaggcuccucuggggcccuggauggcacaugacucccagugagg

SEQ ID NO: 372248 - RNA, 64 nt, Human
ggucauuccuggugcgccuaucggugugacaugagcccuggagugugucgucccucucagcccu

SEQ ID NO: 372249 - RNA, 64 nt, Human
cguggccucgugaggggcaagcuaggccccagaggcccuggaggucuccaggggccugcagaag

SEQ ID NO: 372250 - RNA, 64 nt, Human
ggguauguagggcccagggugggugucccugggagcccuggaaaugugcauaugugcauguguc

SEQ ID NO: 372251 - RNA, 64 nt, Human
ucucaccuaagcugcacuucaaguucgacacgacgcccuggauccugugcaagggggacuggag

SEQ ID NO: 372252 - RNA, 64 nt, Human
uagacgugaacaacgcaguggugugagucugcaggcccuggacccgcuggccagagggacaccu

SEQ ID NO: 372253 - RNA, 64 nt, Human
ugugggcugcagggcuccgucugcacguggacuugcccuggaccuugaguguggcccucccuuu

SEQ ID NO: 372254 - RNA, 64 nt, Human
ggaaaaccacugggugcgucucuugcugggguuugcccuggaggugaggugagugcucgaggga

SEQ ID NO: 372255 - RNA, 64 nt, Human
ccuuccccacuccucuagcaucgccacccgcauggcccuggaacucccgcggcggcgggggcgg

SEQ ID NO: 372256 - RNA, 64 nt, Human
aggucccugcaacucagcccccaccacaaacacagcccuggaaacauacaguggcgcaaggucc

SEQ ID NO: 372257 - RNA, 64 nt, Human
ggggauaccagcagcaagagagugcacccguuuagcccuggacccuguuucuuacugugugacu

SEQ ID NO: 372258 - RNA, 64 nt, Human
gcaggugagcugggggcauacagggaggaacacugcccuggacuauccauugcauuuuugccuc

SEQ ID NO: 372259 - RNA, 64 nt, Human
uuaauaguauacauuuaaaagaaaaaaaacaaaagcccuggaaguugaggccaagccugcugag

SEQ ID NO: 372260 - RNA, 64 nt, Human
auugauucgcuugcggcucaccucagucgaggaagcccuggaauguucagcagaacaccaccac

SEQ ID NO: 372261 - RNA, 64 nt, Human
guugcccucugaggccccguacaccagaagggaggcccuggaaaauuuugugcuuccaacgugg

SEQ ID NO: 372262 - RNA, 64 nt, Human
aggcuccccauuuggacauuacuggcuaucuugugcccuggaacaacucugaauuaauuagacu

SEQ ID NO: 372263 - RNA, 64 nt, Human
ugcucugagggcccagcccuccccggggcgcucugcccuggagacuccggacacugacagccgc

SEQ ID NO: 372264 - RNA, 64 nt, Human
cucuucacuagccucucugaagguguccuggccagcccuggagaagcacuggugucugcagcac

SEQ ID NO: 372265 - RNA, 64 nt, Human
aaggcccaggcuggggccagggccagaggggaaggcccuggauucucacucaugugagaucuug

SEQ ID NO: 372266 - RNA, 64 nt, Human
uggcauuucuccucuccucuugcugcucagcacagcccuggauugcagccccgaggcugagacc

SEQ ID NO: 372267 - RNA, 64 nt, Human
aaaggcaaauccuaucacccacucagccccaaaugcccuggauuauaugauuuuuaaaacauuu

SEQ ID NO: 372268 - RNA, 64 nt, Human
aggggauguaaccagcaauggccaggguacaacagcccuggaaaacaguaguaggagcacuagg

SEQ ID NO: 372269 - RNA, 64 nt, Human
guuaauuuuacaaauaggcaaacaacauaacuuugcccuggauugacuacauauuuuuaaaccu

SEQ ID NO: 372270 - RNA, 64 nt, Human
gcugcaggaggaggccgccggcggggagcaggaugcccuggaccuguaccagcacagccugggg

SEQ ID NO: 372271 - RNA, 64 nt, Human
agagauggcccgggacaagccacgccuccuagcugcccuggaaguggcuucagcugccauggcc

SEQ ID NO: 372272 - RNA, 64 nt, Human
uggaacuuuucccaaaggguuuuggguauagccugcccuggaggggaaggaaguccaugcaagc

SEQ ID NO: 372273 - RNA, 64 nt, Human
ccaagguggaggcaggcuuaaguucaguccuccugcccuggagcugguuugggcugucaaaacc

SEQ ID NO: 372274 - RNA, 64 nt, Human
aggaacgggcagccugggccuggguggaaauccugcccuggaggaaguuguggggagauccacu

SEQ ID NO: 372275 - RNA, 64 nt, Human
caaagccaggcuucacucccaaaagugcagccaggcccuggagggugauccugccagcagcccu

SEQ ID NO: 372276 - RNA, 64 nt, Human
uuuuugaggcaaugccauuucuagaguugaaaaagcccuggacccaaacugcggcacuguugaa

SEQ ID NO: 372277 - RNA, 64 nt, Human
cccgaagccugagcaugcggcucaccccgggguggcccuggaggccccugaccccaccccaccc

SEQ ID NO: 372278 - RNA, 64 nt, Human
aucacguugcucguugcucggcuuaugggaggccgcccuggagggcccggaggucccaaggucc

SEQ ID NO: 372279 - RNA, 64 nt, Human
cugccugggcagaagacucaccuuggaggagugggcccuggaguccugucccucccagaagccc

SEQ ID NO: 372280 - RNA, 64 nt, Human
ggauccaggccaggcugugguuuccccugaaccagcccuggaccuuucugagccaggcuggcca

SEQ ID NO: 372281 - RNA, 64 nt, Human
ugcacauugguuuaagcccagagauccugcuugagcccuggacucaucuugggaagggccaugg

SEQ ID NO: 372282 - RNA, 64 nt, Human
gugcaccuggggaucccccuaaacugugaauucugcccuggacagggcuuugcccuuggaggau

SEQ ID NO: 372283 - RNA, 64 nt, Human
gaaaaucauuuucuccccuuggcagugucccagggcccuggaugguccucuuaccaacaucugg

SEQ ID NO: 372284 - RNA, 64 nt, Human
accucuucacucugaauccucaugaggcuucucagcccuggauuuccugcugccauccucaccc

SEQ ID NO: 372285 - RNA, 64 nt, Human
cacauuucuggaacaacuggagaaaccggaguaugcccuggacuggauauuaaauaaaaauuua

SEQ ID NO: 372286 - RNA, 64 nt, Human
ggucugggaaauugaggggacggcaggcccggcugcccuggaacugggagacagggagaauccc

SEQ ID NO: 372287 - RNA, 64 nt, Human
ggguguggagaaggagcugacgcugcgcagccaagcccuggagcucaacaagcggaaggugagg

SEQ ID NO: 372288 - RNA, 64 nt, Human
uuuugucauuuuuuuaauaaagucaguucugguggcccuggacuuuggaggggaaggggaggcc

SEQ ID NO: 372289 - RNA, 64 nt, Human
ggcacgugcuggcacaccucacagaagcacccuggcccuggaugccugcaaccucagaagagug

SEQ ID NO: 372290 - RNA, 64 nt, Human
accugcuugcuaggggcaggaucucauucaggcugcccuggaagcaccugcuuggcccugccac

SEQ ID NO: 372291 - RNA, 64 nt, Human
ucucagcaagggaggagagucuguugcuggcauagcccuggaaggagcccccagccucuccccu

SEQ ID NO: 372292 - RNA, 64 nt, Human
caaauccuauggcuggccuucucauuccacaagggcccuggaaaggguugacagccagccuugg

SEQ ID NO: 372293 - RNA, 64 nt, Human
ccuuuggggucaagaggaguagggaucccaggcugcccuggacuuagaccagugucugaggugg

SEQ ID NO: 372294 - RNA, 64 nt, Human
aggggauuuggggcuuucuugaaagacaguccaagcccuggauaaugcuuuacuuucuguguug

SEQ ID NO: 372295 - RNA, 64 nt, Human
caggagcuguaucgagggggaggcgccugguccagcccuggacagauugauuuccagcugaaua

SEQ ID NO: 372296 - RNA, 64 nt, Human
cccuugccccugcugcugccccgagggcugcccugcccuggaagggccccucugccuccacacc

SEQ ID NO: 372297 - RNA, 64 nt, Human
uguuccccucuucccuacacgauccgcaacccaugcccuggaccagccgcccagaucaugccgc

SEQ ID NO: 372298 - RNA, 64 nt, Human
aauagucucccuaucccacgagggggcuuugauggcccuggagauccuacaguaaauaaaccag

SEQ ID NO: 372299 - RNA, 64 nt, Human
ggacucugccuuuuuucacagcccgggugugccugcccuggagggaggcucuucagugcgguag

SEQ ID NO: 372300 - RNA, 64 nt, Human
acuugggguggcccaccuguggagaggacuggcugcccuggaggaggaaagggaggaagucuac

SEQ ID NO: 372301 - RNA, 64 nt, Human
gguacucugcucacacaagcgacugggccggccggcccuggaccccuagaccccgagccgccug

SEQ ID NO: 372302 - RNA, 64 nt, Human
ggaagugcaauugcauaaaaacagaaagaacaacgcccuggagccaaucuucaagaaaggaauu

SEQ ID NO: 372303 - RNA, 64 nt, Human
uaucaggaauaaaguauuauguguguuuucugcggcccuggauaaugcuguagcauucaggguc

SEQ ID NO: 372304 - RNA, 64 nt, Human
agggacaggaccccagcucugcgucgguccuggugcccuggaugcccaggaaucuguauauauu

SEQ ID NO: 372305 - RNA, 64 nt, Human
gcucuaggaauagccugugagccagcccuggacugcccuggacuuguucucagagguaucagga

SEQ ID NO: 372306 - RNA, 64 nt, Human
uuacucccuggcucuaggaauagccugugagccagcccuggacugcccuggacuuguucucaga

SEQ ID NO: 372307 - RNA, 64 nt, Human
guuggggcugcugugaggaaaaccugccauuguggcccuggagagucaccagcagcucuuggga

SEQ ID NO: 372308 - RNA, 64 nt, Human
gagcggccucccucagcuggugucggagugcgcggcccuggaggaguucauccacgagggguag

SEQ ID NO: 372309 - RNA, 64 nt, Human
ugcccccgcccacccuccugaccgcagcucccaggcccuggagaccuccaggcuuuccugcccu

SEQ ID NO: 372310 - RNA, 64 nt, Human
ggcccgcagagcacagagcaggagaagggcuugggcccuggaggagaaagccauucuggacacc

SEQ ID NO: 372311 - RNA, 64 nt, Human
cuugugaaaacgcaaacaugaauaugguuggagagcccuggauuaggagggugacauggggaag

SEQ ID NO: 372312 - RNA, 64 nt, Human
ccuccucuaccccaacacaugcaggcuaggccuugcccuggaacauggaggcccugcccggggc

SEQ ID NO: 372313 - RNA, 64 nt, Human
gaaccccuuaccccacugcugcugacugggcagggcccuggaccccuuuauuugcacgucaggg

SEQ ID NO: 372314 - RNA, 64 nt, Human
uacccuguccuccagccucccugcuucccuucuggcccuggaagacugagucuggacggcagag

SEQ ID NO: 372315 - RNA, 64 nt, Human
gacacuguuggaagcaguuccuucuaaaaggguagcccuggacuuaauaccagccggauaccuc

SEQ ID NO: 372316 - RNA, 64 nt, Human
uccaggauccaugggagcauucucaaaggcuuuagcccuggacccagcaggugaggcucggcuu

SEQ ID NO: 372317 - RNA, 64 nt, Human
ugaagcaugccaaugugaucaaucccuaguaaaagcccuggacaccuaggcaugggugagcuac

SEQ ID NO: 372318 - RNA, 64 nt, Human
uggcuucucccucuuuaaggugcuaugccaaccagcccuggaggcugggaucugccgcucccuc

SEQ ID NO: 372319 - RNA, 64 nt, Human
ugcauguuccagccugaccuagaagcguuugucagcccuggagcccagagcgguggccuugcuc

SEQ ID NO: 372320 - RNA, 64 nt, Human
ugucccagucccagccucuggggcagagcuuguagcccuggauggccucuggggcaggaccacu

SEQ ID NO: 372321 - RNA, 64 nt, Human
cccuucuuccacuggagccccugacaccacaggugcccuggagcccuugugugacucagccucu

SEQ ID NO: 372322 - RNA, 64 nt, Human
ggccaggggugggagcaucggagggagucccagagcccuggaccuugggccuagaccgcgugau

SEQ ID NO: 372323 - RNA, 64 nt, Human
ugggggggcccuuggcugcgggagaaggcccagagcccuggaggagccaccaccccgccggccc

SEQ ID NO: 372324 - RNA, 64 nt, Human
cccagaggaugaggucaauuuccugaugcauauugcccuggagaagaucgccuucauccccuuu

SEQ ID NO: 372325 - RNA, 64 nt, Human
ucucaaacugacagccagcgagacugggugggaggcccuggaucuguucucccugacugcggga

SEQ ID NO: 372326 - RNA, 64 nt, Human
cagccucuaccgauugauuuuccucccuucucuagcccuggauguccacuuagggauaaaaaga

SEQ ID NO: 372327 - RNA, 64 nt, Human
ucccugaaggguccaaggaggggcccuccccauggcccuggagagugggccugggugguaccug

SEQ ID NO: 372328 - RNA, 64 nt, Human
cgugggaagggggacagagagggcccuccccucugcccuggacuuucccaugagccuccuggaa

SEQ ID NO: 372329 - RNA, 64 nt, Human
gucaggaggggacuucuggcccaccuugccuucagcccuggagugggcagagaguauugugggg

SEQ ID NO: 372330 - RNA, 64 nt, Human
agagcuuucucccuagaucgcacugugggccggggcccuggagggcugcucuguguuaauaaga

SEQ ID NO: 372331 - RNA, 64 nt, Human
uggcccacccgagccugagggcuggcggggagcagcccuggacguguccgcuguuguguugaga

SEQ ID NO: 372332 - RNA, 64 nt, Human
gaacuuagcucguccuacccccauguugaguucugcccuggaaaacccaaagcaaguagugauc

SEQ ID NO: 372333 - RNA, 64 nt, Human
gcccacagcacccccugccggcgggcuccguggggcccuggagcugaugacgggggaggcccgu

SEQ ID NO: 372334 - RNA, 64 nt, Human
uuggaggccgguggagaagccccaccuggcuuaugcccuggagaggguuuagcgggcugggugg

SEQ ID NO: 372335 - RNA, 64 nt, Human
ugacccccacagggucacgcaggacucggacacugcccuggaaacauggauggacaagggcuuu

SEQ ID NO: 372336 - RNA, 64 nt, Human
uguuuuacauuuuucuuuugauggguuuagucuugcccuggagugccgaugaugauucucccuc

SEQ ID NO: 372337 - RNA, 64 nt, Human
auagccacugcgcccugggggccugggcucugcugcccuggaccccucuauuuauuucccuucc

SEQ ID NO: 372338 - RNA, 64 nt, Human
augagcgaggggcagauucuagucgggagcccaugcccuggaaauccaucuuucuucaucuuuc

SEQ ID NO: 372339 - RNA, 64 nt, Human
ccgaguuuuguaggggucacugucacaugcuugugcccuggaagccccaaggcucuuccuccag

SEQ ID NO: 372340 - RNA, 64 nt, Human
aagcaucaacagccagcauccugagccuccucaugcccuggaccagccuggaacacacuagcag

SEQ ID NO: 372341 - RNA, 64 nt, Human
aggcaaccaccucgggccgcugggccaccgagcugcccuggaugggcugcuggcaugccaacuc

SEQ ID NO: 372342 - RNA, 64 nt, Human
gcauucccccuaagaggcagugagauguagccuggcccuggaacuagaaacagagguggcugcu

SEQ ID NO: 372343 - RNA, 64 nt, Human
ggagacagaagccuggacucugccccacgcuguggcccuggagggucccgguuugucaguucuu

SEQ ID NO: 372344 - RNA, 64 nt, Human
gagucucagaaacuccccuggggguuucaccugggcccuggaggaauucagcucagcuucuucc

SEQ ID NO: 372345 - RNA, 64 nt, Human
ccuggccguagguuuguaacuguuucauagaagagcccuggagaagacaguagaaugagccuau

SEQ ID NO: 372346 - RNA, 64 nt, Human
gcagguggguguugggaagaauaaaugucuguaugcccuggaagaggggauaguccgcuacacu

SEQ ID NO: 372347 - RNA, 64 nt, Human
gucccuucugccacccuucccagucccaggacgggcccuggagggagaaaggagccugugcccc

SEQ ID NO: 372348 - RNA, 64 nt, Human
aaacagaugaaggagaacuauuaacuggcuuucagcccuggauauuuaaaucuccuccucuucu

SEQ ID NO: 372349 - RNA, 64 nt, Human
gccugaccuaacugcucagggaucuuucuucccagcccuggagccuggagggagaccacccucu

SEQ ID NO: 372350 - RNA, 64 nt, Human
uccugugaccgaccccuccccagugccucuccuggcccuggaaggugccacuccagugcccauc

SEQ ID NO: 372351 - RNA, 64 nt, Human
gcaucccugugaccccuccccagugccucuccuggcccuggaaguugccacuccagugcccacc

SEQ ID NO: 372352 - RNA, 64 nt, Human
cuggguaucuuuguauauauguguauauaugugugcccuggacuguuucaagguccauggagua

SEQ ID NO: 372353 - RNA, 64 nt, Human
ccucucagccccucccugccccaccccagcuccugcccuggaaaucuggagccccuuggagcug

SEQ ID NO: 372354 - RNA, 64 nt, Human
cugcugccgagcagagcguccucugccaggccccgcccuggauuccuagagacuagcuucagcu

SEQ ID NO: 372355 - RNA, 64 nt, Human
ugagacgcaggcuggcugggcucuccugcuggcugcccuggaggauuucaacaugucccaggau

SEQ ID NO: 372356 - RNA, 64 nt, Human
cuucuaguagcuguugucugguggggacgcaguggcccuggacacggcuccccucugcaggucu

SEQ ID NO: 372357 - RNA, 64 nt, Human
gaguguguucccuguaacugccccauagugggcagcccuggaggaacaaggggcuggcuguccu

SEQ ID NO: 372358 - RNA, 64 nt, Human
uggaaaggccuccaccuguaucuacacucugagggcccuggacugggccugagcuugccacaga

SEQ ID NO: 372359 - RNA, 64 nt, Human
augcucugaugcucugaggcuucugggaggcugggcccuggaggcaacgugcugcaggcgcacu

SEQ ID NO: 372360 - RNA, 64 nt, Human
ugucucaaaagaggucauccggggacccacuguugcccuggaccucagcgggaaggagcaggag

SEQ ID NO: 372361 - RNA, 64 nt, Human
cgggagccggggguggguacugaggccugcucaggcccuggaagugaggcucuaugggguuccc

SEQ ID NO: 372362 - RNA, 64 nt, Human
ugggaauggcaagggcaagguagagugccuaggagcccuggacucaggcuggcagaggggcugg

SEQ ID NO: 372363 - RNA, 64 nt, Human
ggagcccuggacucaggcuggcagaggggcuggugcccuggagaaaauaaagagaaggcuggag

SEQ ID NO: 372364 - RNA, 64 nt, Human
uuccagggugcaguacagcagggccugaauacuggcccuggacucccuuuuccagaacaccagg

SEQ ID NO: 372365 - RNA, 64 nt, Human
gggacuccgagagccccggagagaacguggcccagcccuggagggcaggcggccacucccccag

SEQ ID NO: 372366 - RNA, 64 nt, Human
gugugguaggaccccggcggguguggcagcaacugcccuggagccccagccccugcguccaucu

SEQ ID NO: 372367 - RNA, 64 nt, Human
acccccaggaugcuguugcuguaggacgccugcugcccuggagcccuccccaggaugugagcca

SEQ ID NO: 372368 - RNA, 64 nt, Human
agcccugcagguauauugcaggggccugggggcggcccuggacuggcgggcgguuccccagugg

SEQ ID NO: 372369 - RNA, 64 nt, Human
ggcccuggacuggcgggcgguuccccaguggggugcccuggaggcugccgggcagaguggagca

SEQ ID NO: 372370 - RNA, 64 nt, Human
gggucacacgguccugcccuagaguccccaucuggcccuggagcugcagaagcagcuucugagg

SEQ ID NO: 372371 - RNA, 64 nt, Human
uuuccaugugaccccacaguggggcuggaccagggcccuggaggccaauaaagagcuuucuggg

SEQ ID NO: 372372 - RNA, 64 nt, Human
ccuuucauuuccuuggugggggaggggggcgguugcccuggagagggccggggucggggagguu

SEQ ID NO: 372373 - RNA, 64 nt, Human
gaauugauucgaccugacugccguuggaccguaggcccuggacugcagagacccccgcccccga

SEQ ID NO: 372374 - RNA, 64 nt, Human
gggccguuuuagguagagccuuaaaaaugcuucugcccuggaaucucaaccauugucuuccaag

SEQ ID NO: 372375 - RNA, 64 nt, Human
cugggccggggcggcccccaggggccaggagagagcccuggagucccgcagccaccaugcacgc

SEQ ID NO: 372376 - RNA, 64 nt, Human
gccuccccuguggccucuuugagugucugcagcagcccuggacuuccagacuucuaucacauga

SEQ ID NO: 372377 - RNA, 64 nt, Human
cugugccuggcuggacaccgcacugcgcaaaggggcccuggagcuccaggcagggggcgcuggg

SEQ ID NO: 372378 - RNA, 64 nt, Human
acaccccacccugagccgcaagagcaguccuggggcccuggaccccucuguacaguccguagga

SEQ ID NO: 372379 - RNA, 64 nt, Human
agccaguaugugccccucacccaggccuggcugggcccuggagaguccuguuugcacagcccag

SEQ ID NO: 372380 - RNA, 64 nt, Human
uuaauagaauuggcauauuuaugugauugcagcagcccuggacuauuuauuucuggauguccca

SEQ ID NO: 372381 - RNA, 64 nt, Human
gugagaucccugcagggacucccuggagauucaggcccuggaauggggcugaauggaggucccg

SEQ ID NO: 372382 - RNA, 64 nt, Human
ugcuuuuggggacugcaggaaucaucuccccugggcccuggacucggacuggggccuccccacc

SEQ ID NO: 372383 - RNA, 64 nt, Human
uccuugaagggcagccuccugcccaggccccguggcccuggagccucaauaaagugucccuuuc

SEQ ID NO: 372384 - RNA, 64 nt, Human
ccuguuguacgcugcaucaucccgcuggcccugugcccuggagggugggcggcucauggugcca

SEQ ID NO: 372385 - RNA, 64 nt, Human
cuuuaaaccuggcuucugaaacgauggcaucagagcccuggagagccagcuggagacacaggcg

SEQ ID NO: 372386 - RNA, 64 nt, Human
gguggggcuuggggcaccaugagaagguuggcgugcccuggaggcugacacagaggcuggcacu

SEQ ID NO: 372387 - RNA, 53 nt, Human
agaaggaggcuccccacugaagggcccuggacagggcucauuaaaccuuccuc

SEQ ID NO: 372388 - RNA, 64 nt, Human
accauuguaagagcuguccacauuuguauguugugcccuggaaucagccugguugagcucaaau

SEQ ID NO: 372389 - RNA, 64 nt, Human
cucauccacagcagcugggucaccugauagggccgcccuggacuuggggucccuccaccugggg

SEQ ID NO: 372390 - RNA, 64 nt, Human
cccagauggaugccaugggcuaugggagcaaauugcccuggaccuuugccugaaugggggcagg

SEQ ID NO: 372391 - RNA, 64 nt, Human
cugagguuggcagaaacguucccaaacucccccagcccuggaccccagcagaugaggaaacggc

SEQ ID NO: 372392 - RNA, 64 nt, Human
ggcuucccugcggcuccgugcccgcugggaaagugcccuggaccggcagcuggcgcaccaggcc

SEQ ID NO: 372393 - RNA, 64 nt, Human
ccccauguccuucccccacuaaauggccagagaggcccuggacaaccucuugcggcccuggcuu

SEQ ID NO: 372394 - RNA, 64 nt, Human
uuccucaugcguugccugcccuuccuccauuguugcccuggaauguacgggacccaggggcagc

SEQ ID NO: 372395 - RNA, 64 nt, Human
ccggacucagcguggagcacgugcacagcuucacgcccuggauccaggcccacgggggcugggu

SEQ ID NO: 372396 - RNA, 50 nt, Human
ugcuggcacagcaguucugagcccuggacucugccccgggggauguggcc

SEQ ID NO: 372397 - RNA, 64 nt, Human
gcgggaggccaccgaggccgccgaguaccaggaggcccuggagggcuggacggugagcagggcg

SEQ ID NO: 372398 - RNA, 64 nt, Human
cgcaugcugaucccccugcccaggugagggcccugcccuggaagacuggagggaggccccaagc

SEQ ID NO: 372399 - RNA, 64 nt, Human
ucagaaggccuuguccuuaaccaccuccuugccugcccuggaggcuugugccucuaggccccac

SEQ ID NO: 372400 - RNA, 64 nt, Human
gacaccuggugagagccugaggcugguguucagggcccuggacacagacacagagcagccgcau

SEQ ID NO: 372401 - RNA, 64 nt, Human
uuccagcagccuguaaugggagggcuacagguuagcccuggaaccugcaaucaaaccaccuuug

SEQ ID NO: 372402 - RNA, 64 nt, Human
ccuagauccccaaccccagauccccaugccucgagcccuggaucuccaagcucagcugcuggau

SEQ ID NO: 372403 - RNA, 61 nt, Human
agaaaaggcacaacugcugaccccgcccagugcccuggagccgcgcccauugcagcauguc

SEQ ID NO: 372404 - RNA, 64 nt, Human
cguggaaccucgaacccgagcuccugcagaaguggcccuggagauugagggucccuggacacuc

SEQ ID NO: 372405 - RNA, 64 nt, Human
acagccagccagcccagcgcccgcucacccaggagcccuggaucccggcgcgggaaagucacag

SEQ ID NO: 372406 - RNA, 64 nt, Human
aggcaggggccucaggcuccucuccucaaaucaagcccuggacaggucucgcacccacaaguac

SEQ ID NO: 372407 - RNA, 64 nt, Human
gaagcgguacaagaguucugugccuguguguccagcccuggagccagccagugcauuuauuuua

SEQ ID NO: 372408 - RNA, 64 nt, Human
gcgcgccuguagucccagcuacuugggaggcugagcccuggaggucgaggcuacagugagcuau

SEQ ID NO: 372409 - RNA, 64 nt, Human
ggacucaguggacacucagaccagcucccagauggcccuggacagcaggagagggugugggaug

SEQ ID NO: 372410 - RNA, 64 nt, Human
cugugguccccuggagccuggccacgcccuugaagcccuggacacuggccacauucccuguggu

SEQ ID NO: 372411 - RNA, 52 nt, Human
gggcggagaugcagucuuagaggcccuggacaccugacaaagagacagaguc

SEQ ID NO: 372412 - RNA, 64 nt, Human
cuacguuuugcagggcucaguacgaggcugcccggcccuggagggcuccguaggucucagcaac

SEQ ID NO: 372413 - RNA, 64 nt, Human
ccagccugagugcuggcccaauuacugcugaguggcccuggacaaaguuguuucucucccuggg

SEQ ID NO: 372414 - RNA, 64 nt, Human
gaaaagaccuuuuacaaaugauaccaauuaaacugcccuggaaagggcauaggugggcaucggc

SEQ ID NO: 372415 - RNA, 64 nt, Human
ccccaugcuucuuuugcugccuuaagcccccuaugcccuggaggugagggcagcucucuugucu

SEQ ID NO: 372416 - RNA, 64 nt, Human
ucaaaauaaccaguggccuggccgaccugcucuggcccuggauuccccauccaucucauugucu

SEQ ID NO: 372417 - RNA, 64 nt, Human
uccugcagccccgaccucucagguuagacccugggcccuggagcuuaggggauucuccccaccc

SEQ ID NO: 372418 - RNA, 64 nt, Human
gccuuucucuggcuccagaauaugcauaaucagcgcccuggaguccccugggccuggaccgcuu

SEQ ID NO: 372419 - RNA, 64 nt, Human
ugaacccuuucugugcaggagcagagccaggugggcccuggacauuuuuuuuuuuuuuaauaua

SEQ ID NO: 372420 - RNA, 64 nt, Human
cugcuguuuaaucacagauaagcuucuagaacaagcccuggaaugugcauuccugccacugguu

SEQ ID NO: 372421 - RNA, 64 nt, Human
ggguucucguagggucccagccucaaugguucccgcccuggaccuccagcugcccugacucccc

SEQ ID NO: 372422 - RNA, 64 nt, Human
uccccuucacgcccuugacacuaaggaguggggggcccuggacugccccuuccucccccaucgc

SEQ ID NO: 372423 - RNA, 64 nt, Human
ggcagggugagaagcuagaugccccugcaguuuggcccuggagccagggcagaggaauguaggg

SEQ ID NO: 372424 - RNA, 64 nt, Human
uugcucuccucagaguuggcuuuugaaccaaagugcccuggaccaggucagggccuacagcugu

SEQ ID NO: 372425 - RNA, 64 nt, Human
gcggggugucacagacccucugcagccccuggcugcccuggacugugcagagaugccugacucc

SEQ ID NO: 372426 - RNA, 64 nt, Human
gagagaggcacagauguucugggggcugcccugagcccuggaaggguggggguggggcggggga

SEQ ID NO: 372427 - RNA, 64 nt, Human
ggcucccacccccaagguguccuccacaggcagggcccuggagagacgcucccugcucuccaua

SEQ ID NO: 372428 - RNA, 64 nt, Human
ucaguggacuaaccacagcagcagccagggaugggcccuggagguucccggccggagagugccu

SEQ ID NO: 372429 - RNA, 64 nt, Human
ggaccuucagcugcuucuucacuguugaaaccaugcccuggaagacauauuuugaacuccugaa

SEQ ID NO: 372430 - RNA, 64 nt, Human
caggguuuccagagaugcucaccuugucucugcagcccuggagcccccugucccuggccguccu

SEQ ID NO: 372431 - RNA, 64 nt, Human
accacccuucagaccccaguucuaggggagaagagcccuggacaccccugcucuacccaugagc

SEQ ID NO: 372432 - RNA, 64 nt, Human
ucuccuccugccgcugaccagagcaugggaaauagcccuggauuggguaguggguguguggugc

SEQ ID NO: 372433 - RNA, 64 nt, Human
gcuuuuuccuaccacuaccuuauaaaccugccuggcccuggaggggcucugggacgacuuuguc

SEQ ID NO: 372434 - RNA, 64 nt, Human
guauggguguccgguuggguccuguguuuggucugcccuggaggugcugggcccuccugggaug

SEQ ID NO: 372435 - RNA, 64 nt, Human
uucuuacaguaacugaguguggcgggaagggugggcccuggaggggcccaugugggcugaagga

SEQ ID NO: 372436 - RNA, 64 nt, Human
cuggcaggggcuccaagccccagcguggggaagggcccuggagaagcccucauccucaugggaa

SEQ ID NO: 372437 - RNA, 64 nt, Human
aagacccaggccauguucccaaaggccagcgggggcccuggauugugaugcagccucgggacag

SEQ ID NO: 372438 - RNA, 52 nt, Human
gccagaaguccagcugcugacagcccuggaugugauccggagucccuuccca

SEQ ID NO: 372439 - RNA, 64 nt, Human
ccugcuggugaccggccuggaccuuggcccuacagcccuggaggccgcugcugaccagcacuga

SEQ ID NO: 372440 - RNA, 64 nt, Human
ccaaggcacagcauauacagcauggucgccccuugcccuggagucugggaacaaagagaggagc

SEQ ID NO: 372441 - RNA, 64 nt, Human
gggauuuugcugauggguucuuagagccuuagcagcccuggaugguggccagaaauaaagggac

SEQ ID NO: 372442 - RNA, 52 nt, Human; identical to SEQ ID NO: 372438

SEQ ID NO: 372443 - RNA, 64 nt, Human
cauuugugcaaguagacggggucugugggugcaggcccuggaggggcacacaauugccuggagg

SEQ ID NO: 372444 - RNA, 64 nt, Human
ccccugucugcccccugcccugagaguugcccgugcccuggacuugggcauguccuuguugcug

SEQ ID NO: 372445 - RNA, 64 nt, Human
acccuccccugcugcuggaaacccuucugaguuggcccuggaguggcucacgggcagagaaggg

SEQ ID NO: 372446 - RNA, 64 nt, Human
uggggagggguauucuucaugcaggagaccccaggcccuggaggcugcaacauaccucaauccu

SEQ ID NO: 372447 - RNA, 64 nt, Human
augugugaaguuugcaagcuugcuuuagggcugagcccuggacucccagcagcagcacaguuca

SEQ ID NO: 372448 - RNA, 64 nt, Human
cugccaguaggggcgggaggaaaggcggaggcgagcccuggaggagggaggccacaacuccgag

SEQ ID NO: 372449 - RNA, 64 nt, Human
cgagauuuggaugggacccagggcuccugacucugcccuggaagguucauggggaaacucgcuc

SEQ ID NO: 372450 - RNA, 64 nt, Human
gcaggugaaggccaaagcggguguugguggucaggcccuggauucuccguuagauacacuuggc

SEQ ID NO: 372451 - RNA, 64 nt, Human
uuggagaggacccucaggccucugagggcaccaggcccuggagaagaggugcaauucagggugu

SEQ ID NO: 372452 - RNA, 64 nt, Human
cgggagggguugucaagcccacccgggaaacugagcccuggagaggggaagcagccagcccagg

SEQ ID NO: 372453 - RNA, 64 nt, Human
ucagggcggggcuggccccacccccaugaccacugcccuggagguggcggccugcugcuguuau

SEQ ID NO: 372454 - RNA, 64 nt, Human
acugcuucugaaaggcuuuggccuuccucagugagcccuggagggguuggccuucucuccuccc

SEQ ID NO: 372455 - RNA, 64 nt, Human
uguuucuguguccccaugcugccucugaaauagcgcccuggaacaacccugccccugcacccag

SEQ ID NO: 372456 - RNA, 64 nt, Human
uaggaauaaagacuaguuuacaaaggagaaagaggcccuggacuucccaaggaaagggucaggu

SEQ ID NO: 372457 - RNA, 64 nt, Human
cucucuccagccuccaaguucaaccugcagggaagcccuggaaauccugucucccucugcccug

SEQ ID NO: 372458 - RNA, 64 nt, Human
auggaaggugcucccaucggaggggacccucagagcccuggagacugccaggugggccugcugc

SEQ ID NO: 372459 - RNA, 64 nt, Human
cuuaugugugucugugucuucuccuuaaacacucgcccuggagucuguucucacaccugugcgc

SEQ ID NO: 372460 - RNA, 64 nt, Human
acccugcccagagcugaguuggggguguggcucugcccuggaaagggggugaccucuugccucg

SEQ ID NO: 372461 - RNA, 64 nt, Human
cuuggaggccaucgagcgugccgcuuucuucguggcccuggaugaggaauccuacuccuaugac

SEQ ID NO: 372462 - RNA, 64 nt, Human
cagcuccaucccuacagacuccuccccgaguccugcccuggaaccaaaggaaggaggaacacug

SEQ ID NO: 372463 - RNA, 64 nt, Human
gaugcagaaaugagugauaaauuuggccaugaaagcccuggaauuuuaggaaaguugugauucu

SEQ ID NO: 372464 - RNA, 64 nt, Human
uggcugaccacagcaaugaccagcccucauuagggcccuggaugauuuuuggucuaauaacgca

SEQ ID NO: 372465 - RNA, 64 nt, Human
gagcagugagaggaaggcagugcagagcuggccagcccuggagguaggcugggaccaagcucug

SEQ ID NO: 372466 - RNA, 64 nt, Human
cacguaggcuaccacucuccgggcaccggcuggggcccuggagcccccuuuggggcggaguggg

SEQ ID NO: 372467 - RNA, 64 nt, Human
gaauuacguacuuguugaguacaaacugcaccaagcccuggagacccauuaccaccguuaaccc

SEQ ID NO: 372468 - RNA, 64 nt, Human
cagucauuucuuuuugguuugcaaaaagagcacagcccuggacuacaaguuuggagauuuaaau

SEQ ID NO: 372469 - RNA, 64 nt, Human
aacucauacugugcuggagccacuaacuagagcagcccuggagucaugccaagcauuuaaugua

SEQ ID NO: 372470 - RNA, 64 nt, Human
acagaaggugcacauacucccaagggccacucuugcccuggagaucuuggccuuggggccaaag

SEQ ID NO: 372471 - RNA, 64 nt, Human
uacuucucaagcuucccuccaaagaaacugauuggcccuggaaccuccaucccacucuuguuau

SEQ ID NO: 372472 - RNA, 64 nt, Human
uggccuccuuguucaugaccaagaccaaaccugggcccuggauggccuuggccugucccgagga

SEQ ID NO: 372473 - RNA, 64 nt, Human
agagccuguggccccgaggcugggacacuguguggcccuggacaagccacagccccugccuggg

SEQ ID NO: 372474 - RNA, 64 nt, Human
ugggauucugugugcugccaucccaccugcagcugcccuggaauucccuucgcuguuugccuuc

SEQ ID NO: 372475 - RNA, 64 nt, Human
gaguggcuggcucaagccuggguccccgggcugagcccuggauuggguaucguggggcagguca

SEQ ID NO: 372476 - RNA, 64 nt, Human
auuauucauguuucuuuaugcugcuggcuuuugugcccuggaagaucauaauagugaccaaaau

SEQ ID NO: 372477 - RNA, 64 nt, Human
ugggaggcagagguggugggggcagggaugauaggcccuggaugugcccacagggaccaagaag

SEQ ID NO: 372478 - RNA, 64 nt, Human
ccacagaugaugccagcagcaggcgcggcugggggcccuggaucccggccaccagggggcuccu

SEQ ID NO: 372479 - RNA, 64 nt, Human
uugucaacucuuggggcacuccuggauccuaucugcccuggacaaggugcugaggugcauuguc

SEQ ID NO: 372480 - RNA, 64 nt, Human
cagucauuucuuuuugguuugcaaaaagagcacagcccuggacuaugaguuuggagaucuaaau

SEQ ID NO: 372481 - RNA, 64 nt, Human
accaacacuggagccgcugggagucacuggcuuugcccuggaauuugccagaugcaucucaagu

SEQ ID NO: 372482 - RNA, 64 nt, Human
uuucacuuucucagaggaaaucccaagcuuaggagcccuggagccuuugugcucccacucaaua

SEQ ID NO: 372483 - RNA, 64 nt, Human
uaauggugagaggccaggagaccuugucuggaaggcccuggaaggagaagcaccaccuuaccca

SEQ ID NO: 372484 - RNA, 64 nt, Human
cagcuuaccucugcaggaggccgagugacagccagcccuggaaccccccgacccccgcagcugc

SEQ ID NO: 372485 - RNA, 64 nt, Human
cacuuguggcccagcgcguccuuggaaaucuguggcccuggaggaggaacaggagggcccuggg

SEQ ID NO: 372486 - RNA, 64 nt, Human; identical to SEQ ID NO: 308251

SEQ ID NO: 372487 - RNA, 64 nt, Human; identical to SEQ ID NO: 308252

SEQ ID NO: 372488 - RNA, 64 nt, Human; identical to SEQ ID NO: 308253

SEQ ID NO: 372489 - RNA, 64 nt, Human; identical to SEQ ID NO: 308254

SEQ ID NO: 372490 - RNA, 64 nt, Human; identical to SEQ ID NO: 308255

SEQ ID NO: 372491 - RNA, 64 nt, Human; identical to SEQ ID NO: 308256

SEQ ID NO: 372492 - RNA, 59 nt, Human; identical to SEQ ID NO: 308257

SEQ ID NO: 372493 - RNA, 64 nt, Human; identical to SEQ ID NO: 308258

SEQ ID NO: 372494 - RNA, 64 nt, Human; identical to SEQ ID NO: 308259

SEQ ID NO: 372495 - RNA, 64 nt, Human; identical to SEQ ID NO: 308260

SEQ ID NO: 372496 - RNA, 64 nt, Human; identical to SEQ ID NO: 308261

SEQ ID NO: 372497 - RNA, 64 nt, Human; identical to SEQ ID NO: 308262

SEQ ID NO: 372498 - RNA, 64 nt, Human; identical to SEQ ID NO: 308263

SEQ ID NO: 372499 - RNA, 64 nt, Human; identical to SEQ ID NO: 308264

SEQ ID NO: 372500 - RNA, 64 nt, Human; identical to SEQ ID NO: 308265

SEQ ID NO: 372501 - RNA, 64 nt, Human; identical to SEQ ID NO: 308266

SEQ ID NO: 372502 - RNA, 64 nt, Human; identical to SEQ ID NO: 308271

SEQ ID NO: 372503 - RNA, 64 nt, Human; identical to SEQ ID NO: 308272

SEQ ID NO: 372504 - RNA, 64 nt, Human; identical to SEQ ID NO: 308273

SEQ ID NO: 372505 - RNA, 64 nt, Human; identical to SEQ ID NO: 308274

SEQ ID NO: 372506 - RNA, 64 nt, Human; identical to SEQ ID NO: 308275

SEQ ID NO: 372507 - RNA, 64 nt, Human; identical to SEQ ID NO: 308276

SEQ ID NO: 372508 - RNA, 64 nt, Human; identical to SEQ ID NO: 308277

SEQ ID NO: 372509 - RNA, 64 nt, Human; identical to SEQ ID NO: 308278

SEQ ID NO: 372510 - RNA, 64 nt, Human; identical to SEQ ID NO: 308279

SEQ ID NO: 372511 - RNA, 64 nt, Human; identical to SEQ ID NO: 308280

SEQ ID NO: 372512 - RNA, 64 nt, Human; identical to SEQ ID NO: 308281

SEQ ID NO: 372513 - RNA, 64 nt, Human; identical to SEQ ID NO: 308282

SEQ ID NO: 372514 - RNA, 64 nt, Human; identical to SEQ ID NO: 308283

SEQ ID NO: 372515 - RNA, 64 nt, Human; identical to SEQ ID NO: 308284

SEQ ID NO: 372516 - RNA, 64 nt, Human; identical to SEQ ID NO: 308285

SEQ ID NO: 372517 - RNA, 64 nt, Human; identical to SEQ ID NO: 308286

SEQ ID NO: 372518 - RNA, 64 nt, Human; identical to SEQ ID NO: 308289

SEQ ID NO: 372519 - RNA, 64 nt, Human; identical to SEQ ID NO: 308290

SEQ ID NO: 372520 - RNA, 64 nt, Human; identical to SEQ ID NO: 308291

SEQ ID NO: 372521 - RNA, 64 nt, Human; identical to SEQ ID NO: 308292

SEQ ID NO: 372522 - RNA, 64 nt, Human; identical to SEQ ID NO: 308293

SEQ ID NO: 372523 - RNA, 64 nt, Human; identical to SEQ ID NO: 308294

SEQ ID NO: 372524 - RNA, 64 nt, Human; identical to SEQ ID NO: 308295

SEQ ID NO: 372525 - RNA, 64 nt, Human; identical to SEQ ID NO: 308296

SEQ ID NO: 372526 - RNA, 64 nt, Human; identical to SEQ ID NO: 308297

SEQ ID NO: 372527 - RNA, 64 nt, Human; identical to SEQ ID NO: 308298

SEQ ID NO: 372528 - RNA, 64 nt, Human; identical to SEQ ID NO: 308299

SEQ ID NO: 372529 - RNA, 54 nt, Human; identical to SEQ ID NO: 308300

SEQ ID NO: 372530 - RNA, 64 nt, Human; identical to SEQ ID NO: 308301

SEQ ID NO: 372531 - RNA, 64 nt, Human; identical to SEQ ID NO: 308302

SEQ ID NO: 372532 - RNA, 64 nt, Human; identical to SEQ ID NO: 308303

SEQ ID NO: 372533 - RNA, 64 nt, Human; identical to SEQ ID NO: 308304

SEQ ID NO: 372534 - RNA, 64 nt, Human; identical to SEQ ID NO: 308305

SEQ ID NO: 372535 - RNA, 64 nt, Human; identical to SEQ ID NO: 308306

SEQ ID NO: 372536 - RNA, 64 nt, Human; identical to SEQ ID NO: 308307

SEQ ID NO: 372537 - RNA, 64 nt, Human; identical to SEQ ID NO: 308308

SEQ ID NO: 372538 - RNA, 64 nt, Human; identical to SEQ ID NO: 308309

SEQ ID NO: 372539 - RNA, 64 nt, Human; identical to SEQ ID NO: 308310

SEQ ID NO: 372540 - RNA, 64 nt, Human; identical to SEQ ID NO: 308311

SEQ ID NO: 372541 - RNA, 64 nt, Human; identical to SEQ ID NO: 308312

SEQ ID NO: 372542 - RNA, 64 nt, Human; identical to SEQ ID NO: 308313

SEQ ID NO: 372543 - RNA, 64 nt, Human; identical to SEQ ID NO: 308314

SEQ ID NO: 372544 - RNA, 64 nt, Human; identical to SEQ ID NO: 308315

SEQ ID NO: 372545 - RNA, 64 nt, Human; identical to SEQ ID NO: 308316

SEQ ID NO: 372546 - RNA, 64 nt, Human; identical to SEQ ID NO: 308317

SEQ ID NO: 372547 - RNA, 64 nt, Human; identical to SEQ ID NO: 308318

SEQ ID NO: 372548 - RNA, 64 nt, Human; identical to SEQ ID NO: 308319

SEQ ID NO: 372549 - RNA, 64 nt, Human; identical to SEQ ID NO: 308320

SEQ ID NO: 372550 - RNA, 64 nt, Human; identical to SEQ ID NO: 308324

SEQ ID NO: 372551 - RNA, 64 nt, Human; identical to SEQ ID NO: 308325

SEQ ID NO: 372552 - RNA, 64 nt, Human; identical to SEQ ID NO: 308326

SEQ ID NO: 372553 - RNA, 64 nt, Human; identical to SEQ ID NO: 308327

SEQ ID NO: 372554 - RNA, 64 nt, Human; identical to SEQ ID NO: 308328

SEQ ID NO: 372555 - RNA, 64 nt, Human; identical to SEQ ID NO: 308329

SEQ ID NO: 372556 - RNA, 64 nt, Human; identical to SEQ ID NO: 308330

SEQ ID NO: 372557 - RNA, 64 nt, Human; identical to SEQ ID NO: 308331

SEQ ID NO: 372558 - RNA, 64 nt, Human; identical to SEQ ID NO: 308332

SEQ ID NO: 372559 - RNA, 64 nt, Human; identical to SEQ ID NO: 308333

SEQ ID NO: 372560 - RNA, 64 nt, Human; identical to SEQ ID NO: 308334

SEQ ID NO: 372561 - RNA, 64 nt, Human; identical to SEQ ID NO: 308335

SEQ ID NO: 372562 - RNA, 64 nt, Human; identical to SEQ ID NO: 308336

SEQ ID NO: 372563 - RNA, 64 nt, Human; identical to SEQ ID NO: 308337

SEQ ID NO: 372564 - RNA, 64 nt, Human; identical to SEQ ID NO: 308338

SEQ ID NO: 372565 - RNA, 64 nt, Human; identical to SEQ ID NO: 308339

SEQ ID NO: 372566 - RNA, 64 nt, Human; identical to SEQ ID NO: 308340

SEQ ID NO: 372567 - RNA, 64 nt, Human; identical to SEQ ID NO: 308341

SEQ ID NO: 372568 - RNA, 64 nt, Human; identical to SEQ ID NO: 308342

SEQ ID NO: 372569 - RNA, 64 nt, Human; identical to SEQ ID NO: 308343

SEQ ID NO: 372570 - RNA, 64 nt, Human; identical to SEQ ID NO: 308344

SEQ ID NO: 372571 - RNA, 64 nt, Human; identical to SEQ ID NO: 308345

SEQ ID NO: 372572 - RNA, 64 nt, Human; identical to SEQ ID NO: 308346

SEQ ID NO: 372573 - RNA, 64 nt, Human; identical to SEQ ID NO: 308347

SEQ ID NO: 372574 - RNA, 64 nt, Human; identical to SEQ ID NO: 308348

SEQ ID NO: 372575 - RNA, 64 nt, Human; identical to SEQ ID NO: 308349

SEQ ID NO: 372576 - RNA, 64 nt, Human; identical to SEQ ID NO: 308350

SEQ ID NO: 372577 - RNA, 64 nt, Human; identical to SEQ ID NO: 308351

SEQ ID NO: 372578 - RNA, 64 nt, Human; identical to SEQ ID NO: 308352

SEQ ID NO: 372579 - RNA, 64 nt, Human; identical to SEQ ID NO: 308353

SEQ ID NO: 372580 - RNA, 63 nt, Human; identical to SEQ ID NO: 308354

SEQ ID NO: 372581 - RNA, 64 nt, Human; identical to SEQ ID NO: 308355

SEQ ID NO: 372582 - RNA, 64 nt, Human; identical to SEQ ID NO: 308356

SEQ ID NO: 372583 - RNA, 64 nt, Human; identical to SEQ ID NO: 308357

SEQ ID NO: 372584 - RNA, 64 nt, Human; identical to SEQ ID NO: 308358

SEQ ID NO: 372585 - RNA, 64 nt, Human; identical to SEQ ID NO: 308359

SEQ ID NO: 372586 - RNA, 64 nt, Human; identical to SEQ ID NO: 308360

SEQ ID NO: 372587 - RNA, 64 nt, Human; identical to SEQ ID NO: 308361

SEQ ID NO: 372588 - RNA, 64 nt, Human; identical to SEQ ID NO: 308362

SEQ ID NO: 372589 - RNA, 64 nt, Human; identical to SEQ ID NO: 308363

SEQ ID NO: 372590 - RNA, 64 nt, Human; identical to SEQ ID NO: 308364

SEQ ID NO: 372591 - RNA, 64 nt, Human; identical to SEQ ID NO: 308365

SEQ ID NO: 372592 - RNA, 64 nt, Human; identical to SEQ ID NO: 308366

SEQ ID NO: 372593 - RNA, 64 nt, Human; identical to SEQ ID NO: 308367

SEQ ID NO: 372594 - RNA, 64 nt, Human; identical to SEQ ID NO: 308368

SEQ ID NO: 372595 - RNA, 64 nt, Human; identical to SEQ ID NO: 308369

SEQ ID NO: 372596 - RNA, 64 nt, Human; identical to SEQ ID NO: 308370

SEQ ID NO: 372597 - RNA, 64 nt, Human; identical to SEQ ID NO: 308371

SEQ ID NO: 372598 - RNA, 64 nt, Human; identical to SEQ ID NO: 308372

SEQ ID NO: 372599 - RNA, 64 nt, Human; identical to SEQ ID NO: 308373

SEQ ID NO: 372600 - RNA, 64 nt, Human; identical to SEQ ID NO: 308374

SEQ ID NO: 372601 - RNA, 64 nt, Human; identical to SEQ ID NO: 308375

SEQ ID NO: 372602 - RNA, 64 nt, Human; identical to SEQ ID NO: 308376

SEQ ID NO: 372603 - RNA, 64 nt, Human; identical to SEQ ID NO: 308377

SEQ ID NO: 372604 - RNA, 64 nt, Human; identical to SEQ ID NO: 308378

SEQ ID NO: 372605 - RNA, 64 nt, Human; identical to SEQ ID NO: 308379

SEQ ID NO: 372606 - RNA, 64 nt, Human; identical to SEQ ID NO: 308380

SEQ ID NO: 372607 - RNA, 64 nt, Human; identical to SEQ ID NO: 308381

SEQ ID NO: 372608 - RNA, 64 nt, Human; identical to SEQ ID NO: 308382

SEQ ID NO: 372609 - RNA, 64 nt, Human; identical to SEQ ID NO: 308383

SEQ ID NO: 372610 - RNA, 64 nt, Human; identical to SEQ ID NO: 308384

SEQ ID NO: 372611 - RNA, 64 nt, Human; identical to SEQ ID NO: 308385

SEQ ID NO: 372612 - RNA, 64 nt, Human; identical to SEQ ID NO: 308386

SEQ ID NO: 372613 - RNA, 64 nt, Human; identical to SEQ ID NO: 308387

SEQ ID NO: 372614 - RNA, 64 nt, Human; identical to SEQ ID NO: 308391

SEQ ID NO: 372615 - RNA, 64 nt, Human; identical to SEQ ID NO: 308392

SEQ ID NO: 372616 - RNA, 61 nt, Human; identical to SEQ ID NO: 308393

SEQ ID NO: 372617 - RNA, 64 nt, Human; identical to SEQ ID NO: 308394

SEQ ID NO: 372618 - RNA, 64 nt, Human; identical to SEQ ID NO: 308395

SEQ ID NO: 372619 - RNA, 64 nt, Human; identical to SEQ ID NO: 308396

SEQ ID NO: 372620 - RNA, 64 nt, Human; identical to SEQ ID NO: 308397

SEQ ID NO: 372621 - RNA, 64 nt, Human; identical to SEQ ID NO: 308398

SEQ ID NO: 372622 - RNA, 64 nt, Human; identical to SEQ ID NO: 308399

SEQ ID NO: 372623 - RNA, 64 nt, Human; identical to SEQ ID NO: 308400

SEQ ID NO: 372624 - RNA, 64 nt, Human; identical to SEQ ID NO: 308401

SEQ ID NO: 372625 - RNA, 64 nt, Human; identical to SEQ ID NO: 308402

SEQ ID NO: 372626 - RNA, 64 nt, Human; identical to SEQ ID NO: 308403

SEQ ID NO: 372627 - RNA, 64 nt, Human; identical to SEQ ID NO: 308404

SEQ ID NO: 372628 - RNA, 64 nt, Human; identical to SEQ ID NO: 308405

SEQ ID NO: 372629 - RNA, 64 nt, Human; identical to SEQ ID NO: 308406

SEQ ID NO: 372630 - RNA, 64 nt, Human; identical to SEQ ID NO: 308408

SEQ ID NO: 372631 - RNA, 64 nt, Human; identical to SEQ ID NO: 308409

SEQ ID NO: 372632 - RNA, 64 nt, Human; identical to SEQ ID NO: 308410

SEQ ID NO: 372633 - RNA, 64 nt, Human; identical to SEQ ID NO: 308411

SEQ ID NO: 372634 - RNA, 64 nt, Human; identical to SEQ ID NO: 308412

SEQ ID NO: 372635 - RNA, 64 nt, Human; identical to SEQ ID NO: 308413

SEQ ID NO: 372636 - RNA, 64 nt, Human; identical to SEQ ID NO: 308414

SEQ ID NO: 372637 - RNA, 64 nt, Human; identical to SEQ ID NO: 308415

SEQ ID NO: 372638 - RNA, 64 nt, Human; identical to SEQ ID NO: 308416

SEQ ID NO: 372639 - RNA, 64 nt, Human; identical to SEQ ID NO: 308417

SEQ ID NO: 372640 - RNA, 64 nt, Human; identical to SEQ ID NO: 308418

SEQ ID NO: 372641 - RNA, 64 nt, Human; identical to SEQ ID NO: 308419

SEQ ID NO: 372642 - RNA, 64 nt, Human; identical to SEQ ID NO: 308420

SEQ ID NO: 372643 - RNA, 64 nt, Human; identical to SEQ ID NO: 308421

SEQ ID NO: 372644 - RNA, 64 nt, Human; identical to SEQ ID NO: 308422

SEQ ID NO: 372645 - RNA, 64 nt, Human; identical to SEQ ID NO: 308423

SEQ ID NO: 372646 - RNA, 64 nt, Human; identical to SEQ ID NO: 308428

SEQ ID NO: 372647 - RNA, 64 nt, Human; identical to SEQ ID NO: 308429

SEQ ID NO: 372648 - RNA, 64 nt, Human; identical to SEQ ID NO: 308430

SEQ ID NO: 372649 - RNA, 64 nt, Human; identical to SEQ ID NO: 308431

SEQ ID NO: 372650 - RNA, 64 nt, Human; identical to SEQ ID NO: 308432

SEQ ID NO: 372651 - RNA, 64 nt, Human; identical to SEQ ID NO: 308433

SEQ ID NO: 372652 - RNA, 64 nt, Human; identical to SEQ ID NO: 308434

SEQ ID NO: 372653 - RNA, 64 nt, Human; identical to SEQ ID NO: 308435

SEQ ID NO: 372654 - RNA, 64 nt, Human; identical to SEQ ID NO: 308436

SEQ ID NO: 372655 - RNA, 64 nt, Human; identical to SEQ ID NO: 308437

SEQ ID NO: 372656 - RNA, 64 nt, Human; identical to SEQ ID NO: 308438

SEQ ID NO: 372657 - RNA, 64 nt, Human; identical to SEQ ID NO: 308439

SEQ ID NO: 372658 - RNA, 64 nt, Human; identical to SEQ ID NO: 308440

SEQ ID NO: 372659 - RNA, 64 nt, Human; identical to SEQ ID NO: 308441

SEQ ID NO: 372660 - RNA, 64 nt, Human; identical to SEQ ID NO: 308442

SEQ ID NO: 372661 - RNA, 64 nt, Human; identical to SEQ ID NO: 308443

SEQ ID NO: 372662 - RNA, 64 nt, Human; identical to SEQ ID NO: 308444

SEQ ID NO: 372663 - RNA, 64 nt, Human; identical to SEQ ID NO: 308445

SEQ ID NO: 372664 - RNA, 64 nt, Human; identical to SEQ ID NO: 308446

SEQ ID NO: 372665 - RNA, 64 nt, Human; identical to SEQ ID NO: 308447

SEQ ID NO: 372666 - RNA, 54 nt, Human; identical to SEQ ID NO: 308448

SEQ ID NO: 372667 - RNA, 64 nt, Human; identical to SEQ ID NO: 308449

SEQ ID NO: 372668 - RNA, 64 nt, Human; identical to SEQ ID NO: 308450

SEQ ID NO: 372669 - RNA, 64 nt, Human; identical to SEQ ID NO: 308451

SEQ ID NO: 372670 - RNA, 64 nt, Human; identical to SEQ ID NO: 308452

SEQ ID NO: 372671 - RNA, 64 nt, Human; identical to SEQ ID NO: 308453

SEQ ID NO: 372672 - RNA, 64 nt, Human; identical to SEQ ID NO: 308454

SEQ ID NO: 372673 - RNA, 64 nt, Human; identical to SEQ ID NO: 308455

SEQ ID NO: 372674 - RNA, 64 nt, Human; identical to SEQ ID NO: 308456

SEQ ID NO: 372675 - RNA, 64 nt, Human; identical to SEQ ID NO: 308457

SEQ ID NO: 372676 - RNA, 64 nt, Human; identical to SEQ ID NO: 308458

SEQ ID NO: 372677 - RNA, 64 nt, Human; identical to SEQ ID NO: 308459

SEQ ID NO: 372678 - RNA, 64 nt, Human; identical to SEQ ID NO: 308460

SEQ ID NO: 372679 - RNA, 64 nt, Human; identical to SEQ ID NO: 308461

SEQ ID NO: 372680 - RNA, 64 nt, Human; identical to SEQ ID NO: 308462

SEQ ID NO: 372681 - RNA, 64 nt, Human; identical to SEQ ID NO: 308463

SEQ ID NO: 372682 - RNA, 64 nt, Human; identical to SEQ ID NO: 308464

SEQ ID NO: 372683 - RNA, 64 nt, Human; identical to SEQ ID NO: 308465

SEQ ID NO: 372684 - RNA, 64 nt, Human; identical to SEQ ID NO: 308466

SEQ ID NO: 372685 - RNA, 64 nt, Human; identical to SEQ ID NO: 308467

SEQ ID NO: 372686 - RNA, 64 nt, Human; identical to SEQ ID NO: 308468

SEQ ID NO: 372687 - RNA, 64 nt, Human; identical to SEQ ID NO: 308469

SEQ ID NO: 372688 - RNA, 64 nt, Human; identical to SEQ ID NO: 308470

SEQ ID NO: 372689 - RNA, 64 nt, Human; identical to SEQ ID NO: 308471

SEQ ID NO: 372690 - RNA, 64 nt, Human; identical to SEQ ID NO: 308472

SEQ ID NO: 372691 - RNA, 64 nt, Human; identical to SEQ ID NO: 308473

SEQ ID NO: 372692 - RNA, 64 nt, Human; identical to SEQ ID NO: 308474

SEQ ID NO: 372693 - RNA, 64 nt, Human; identical to SEQ ID NO: 308475

SEQ ID NO: 372694 - RNA, 64 nt, Human; identical to SEQ ID NO: 308480

SEQ ID NO: 372695 - RNA, 64 nt, Human; identical to SEQ ID NO: 308481

SEQ ID NO: 372696 - RNA, 64 nt, Human; identical to SEQ ID NO: 308482

SEQ ID NO: 372697 - RNA, 64 nt, Human; identical to SEQ ID NO: 308483

SEQ ID NO: 372698 - RNA, 64 nt, Human; identical to SEQ ID NO: 308484

SEQ ID NO: 372699 - RNA, 64 nt, Human; identical to SEQ ID NO: 308485

SEQ ID NO: 372700 - RNA, 64 nt, Human; identical to SEQ ID NO: 308486

SEQ ID NO: 372701 - RNA, 64 nt, Human; identical to SEQ ID NO: 308487

SEQ ID NO: 372702 - RNA, 64 nt, Human; identical to SEQ ID NO: 308488

SEQ ID NO: 372703 - RNA, 64 nt, Human; identical to SEQ ID NO: 308489

SEQ ID NO: 372704 - RNA, 64 nt, Human; identical to SEQ ID NO: 308490

SEQ ID NO: 372705 - RNA, 64 nt, Human; identical to SEQ ID NO: 308491

SEQ ID NO: 372706 - RNA, 64 nt, Human; identical to SEQ ID NO: 308492

SEQ ID NO: 372707 - RNA, 64 nt, Human; identical to SEQ ID NO: 308493

SEQ ID NO: 372708 - RNA, 64 nt, Human; identical to SEQ ID NO: 308494

SEQ ID NO: 372709 - RNA, 64 nt, Human; identical to SEQ ID NO: 308495

SEQ ID NO: 372710 - RNA, 64 nt, Human; identical to SEQ ID NO: 308500

SEQ ID NO: 372711 - RNA, 64 nt, Human; identical to SEQ ID NO: 308501

SEQ ID NO: 372712 - RNA, 64 nt, Human; identical to SEQ ID NO: 308502

SEQ ID NO: 372713 - RNA, 64 nt, Human; identical to SEQ ID NO: 308503

SEQ ID NO: 372714 - RNA, 64 nt, Human; identical to SEQ ID NO: 308504

SEQ ID NO: 372715 - RNA, 64 nt, Human; identical to SEQ ID NO: 308505

SEQ ID NO: 372716 - RNA, 64 nt, Human; identical to SEQ ID NO: 308506

SEQ ID NO: 372717 - RNA, 64 nt, Human; identical to SEQ ID NO: 308507

SEQ ID NO: 372718 - RNA, 64 nt, Human; identical to SEQ ID NO: 308508

SEQ ID NO: 372719 - RNA, 64 nt, Human; identical to SEQ ID NO: 308509

SEQ ID NO: 372720 - RNA, 64 nt, Human; identical to SEQ ID NO: 308510

SEQ ID NO: 372721 - RNA, 64 nt, Human; identical to SEQ ID NO: 308511

SEQ ID NO: 372722 - RNA, 64 nt, Human; identical to SEQ ID NO: 308512

SEQ ID NO: 372723 - RNA, 64 nt, Human; identical to SEQ ID NO: 308513

SEQ ID NO: 372724 - RNA, 64 nt, Human; identical to SEQ ID NO: 308514

SEQ ID NO: 372725 - RNA, 64 nt, Human; identical to SEQ ID NO: 308515

SEQ ID NO: 372726 - RNA, 64 nt, Human; identical to SEQ ID NO: 308519

SEQ ID NO: 372727 - RNA, 64 nt, Human; identical to SEQ ID NO: 308520

SEQ ID NO: 372728 - RNA, 64 nt, Human; identical to SEQ ID NO: 308521

SEQ ID NO: 372729 - RNA, 64 nt, Human; identical to SEQ ID NO: 308522

SEQ ID NO: 372730 - RNA, 64 nt, Human; identical to SEQ ID NO: 308523

SEQ ID NO: 372731 - RNA, 64 nt, Human; identical to SEQ ID NO: 308524

SEQ ID NO: 372732 - RNA, 64 nt, Human; identical to SEQ ID NO: 308525

SEQ ID NO: 372733 - RNA, 64 nt, Human; identical to SEQ ID NO: 308526

SEQ ID NO: 372734 - RNA, 64 nt, Human; identical to SEQ ID NO: 308527

SEQ ID NO: 372735 - RNA, 64 nt, Human; identical to SEQ ID NO: 308528

SEQ ID NO: 372736 - RNA, 64 nt, Human; identical to SEQ ID NO: 308529

SEQ ID NO: 372737 - RNA, 64 nt, Human; identical to SEQ ID NO: 308530

SEQ ID NO: 372738 - RNA, 64 nt, Human; identical to SEQ ID NO: 308531

SEQ ID NO: 372739 - RNA, 64 nt, Human; identical to SEQ ID NO: 308532

SEQ ID NO: 372740 - RNA, 64 nt, Human; identical to SEQ ID NO: 308533

SEQ ID NO: 372741 - RNA, 64 nt, Human; identical to SEQ ID NO: 308534

SEQ ID NO: 372742 - RNA, 64 nt, Human; identical to SEQ ID NO: 308539

SEQ ID NO: 372743 - RNA, 64 nt, Human; identical to SEQ ID NO: 308540

SEQ ID NO: 372744 - RNA, 64 nt, Human; identical to SEQ ID NO: 308541

SEQ ID NO: 372745 - RNA, 64 nt, Human; identical to SEQ ID NO: 308542

SEQ ID NO: 372746 - RNA, 64 nt, Human; identical to SEQ ID NO: 308543

SEQ ID NO: 372747 - RNA, 64 nt, Human; identical to SEQ ID NO: 308544

SEQ ID NO: 372748 - RNA, 64 nt, Human; identical to SEQ ID NO: 308545

SEQ ID NO: 372749 - RNA, 58 nt, Human; identical to SEQ ID NO: 308546

SEQ ID NO: 372750 - RNA, 64 nt, Human; identical to SEQ ID NO: 308547

SEQ ID NO: 372751 - RNA, 59 nt, Human; identical to SEQ ID NO: 308548

SEQ ID NO: 372752 - RNA, 64 nt, Human; identical to SEQ ID NO: 308549

SEQ ID NO: 372753 - RNA, 64 nt, Human; identical to SEQ ID NO: 308550

SEQ ID NO: 372754 - RNA, 64 nt, Human; identical to SEQ ID NO: 308551

SEQ ID NO: 372755 - RNA, 64 nt, Human; identical to SEQ ID NO: 308552

SEQ ID NO: 372756 - RNA, 64 nt, Human; identical to SEQ ID NO: 308553

SEQ ID NO: 372757 - RNA, 64 nt, Human; identical to SEQ ID NO: 308554

SEQ ID NO: 372758 - RNA, 64 nt, Human; identical to SEQ ID NO: 308559

SEQ ID NO: 372759 - RNA, 64 nt, Human; identical to SEQ ID NO: 308560

SEQ ID NO: 372760 - RNA, 64 nt, Human; identical to SEQ ID NO: 308561

SEQ ID NO: 372761 - RNA, 63 nt, Human; identical to SEQ ID NO: 308562

SEQ ID NO: 372762 - RNA, 64 nt, Human; identical to SEQ ID NO: 308563

SEQ ID NO: 372763 - RNA, 64 nt, Human; identical to SEQ ID NO: 308564

SEQ ID NO: 372764 - RNA, 64 nt, Human; identical to SEQ ID NO: 308565

SEQ ID NO: 372765 - RNA, 64 nt, Human; identical to SEQ ID NO: 308566

SEQ ID NO: 372766 - RNA, 64 nt, Human; identical to SEQ ID NO: 308567

SEQ ID NO: 372767 - RNA, 64 nt, Human; identical to SEQ ID NO: 308568

SEQ ID NO: 372768 - RNA, 64 nt, Human; identical to SEQ ID NO: 308569

SEQ ID NO: 372769 - RNA, 64 nt, Human; identical to SEQ ID NO: 308570

SEQ ID NO: 372770 - RNA, 64 nt, Human; identical to SEQ ID NO: 308571

SEQ ID NO: 372771 - RNA, 64 nt, Human; identical to SEQ ID NO: 308572

SEQ ID NO: 372772 - RNA, 64 nt, Human; identical to SEQ ID NO: 308573

SEQ ID NO: 372773 - RNA, 64 nt, Human; identical to SEQ ID NO: 308574

SEQ ID NO: 372774 - RNA, 64 nt, Human; identical to SEQ ID NO: 308579

SEQ ID NO: 372775 - RNA, 64 nt, Human; identical to SEQ ID NO: 308580

SEQ ID NO: 372776 - RNA, 64 nt, Human; identical to SEQ ID NO: 308581

SEQ ID NO: 372777 - RNA, 64 nt, Human; identical to SEQ ID NO: 308582

SEQ ID NO: 372778 - RNA, 64 nt, Human; identical to SEQ ID NO: 308583

SEQ ID NO: 372779 - RNA, 64 nt, Human; identical to SEQ ID NO: 308584

SEQ ID NO: 372780 - RNA, 64 nt, Human; identical to SEQ ID NO: 308585

SEQ ID NO: 372781 - RNA, 64 nt, Human; identical to SEQ ID NO: 308586

SEQ ID NO: 372782 - RNA, 64 nt, Human; identical to SEQ ID NO: 308587

SEQ ID NO: 372783 - RNA, 64 nt, Human; identical to SEQ ID NO: 308588

SEQ ID NO: 372784 - RNA, 64 nt, Human; identical to SEQ ID NO: 308589

SEQ ID NO: 372785 - RNA, 64 nt, Human; identical to SEQ ID NO: 308590

SEQ ID NO: 372786 - RNA, 64 nt, Human; identical to SEQ ID NO: 308591

SEQ ID NO: 372787 - RNA, 64 nt, Human; identical to SEQ ID NO: 308592

SEQ ID NO: 372788 - RNA, 64 nt, Human; identical to SEQ ID NO: 308593

SEQ ID NO: 372789 - RNA, 64 nt, Human; identical to SEQ ID NO: 308594

SEQ ID NO: 372790 - RNA, 64 nt, Human; identical to SEQ ID NO: 308599

SEQ ID NO: 372791 - RNA, 64 nt, Human; identical to SEQ ID NO: 308600

SEQ ID NO: 372792 - RNA, 64 nt, Human; identical to SEQ ID NO: 308601

SEQ ID NO: 372793 - RNA, 64 nt, Human; identical to SEQ ID NO: 308602

SEQ ID NO: 372794 - RNA, 64 nt, Human; identical to SEQ ID NO: 308603

SEQ ID NO: 372795 - RNA, 64 nt, Human; identical to SEQ ID NO: 308604

SEQ ID NO: 372796 - RNA, 64 nt, Human; identical to SEQ ID NO: 308605

SEQ ID NO: 372797 - RNA, 64 nt, Human; identical to SEQ ID NO: 308606

SEQ ID NO: 372798 - RNA, 64 nt, Human; identical to SEQ ID NO: 308607

SEQ ID NO: 372799 - RNA, 64 nt, Human; identical to SEQ ID NO: 308608

SEQ ID NO: 372800 - RNA, 64 nt, Human; identical to SEQ ID NO: 308609

SEQ ID NO: 372801 - RNA, 64 nt, Human; identical to SEQ ID NO: 308610

SEQ ID NO: 372802 - RNA, 64 nt, Human; identical to SEQ ID NO: 308611

SEQ ID NO: 372803 - RNA, 64 nt, Human; identical to SEQ ID NO: 308612

SEQ ID NO: 372804 - RNA, 64 nt, Human; identical to SEQ ID NO: 308613

SEQ ID NO: 372805 - RNA, 64 nt, Human; identical to SEQ ID NO: 308614

SEQ ID NO: 372806 - RNA, 64 nt, Human; identical to SEQ ID NO: 308619

SEQ ID NO: 372807 - RNA, 64 nt, Human; identical to SEQ ID NO: 308620

SEQ ID NO: 372808 - RNA, 64 nt, Human; identical to SEQ ID NO: 308621

SEQ ID NO: 372809 - RNA, 64 nt, Human; identical to SEQ ID NO: 308622

SEQ ID NO: 372810 - RNA, 64 nt, Human; identical to SEQ ID NO: 308623

SEQ ID NO: 372811 - RNA, 64 nt, Human; identical to SEQ ID NO: 308624

SEQ ID NO: 372812 - RNA, 64 nt, Human; identical to SEQ ID NO: 308625

SEQ ID NO: 372813 - RNA, 64 nt, Human; identical to SEQ ID NO: 308626

SEQ ID NO: 372814 - RNA, 64 nt, Human; identical to SEQ ID NO: 308627

SEQ ID NO: 372815 - RNA, 64 nt, Human; identical to SEQ ID NO: 308628

SEQ ID NO: 372816 - RNA, 64 nt, Human; identical to SEQ ID NO: 308629

SEQ ID NO: 372817 - RNA, 64 nt, Human; identical to SEQ ID NO: 308630

SEQ ID NO: 372818 - RNA, 64 nt, Human; identical to SEQ ID NO: 308631

SEQ ID NO: 372819 - RNA, 62 nt, Human
gugcuuuuuuuuuuuugcaauaugaccccgucucucugaagugggacauucggacggaugga

SEQ ID NO: 372820 - RNA, 62 nt, Human
ucuggggcugggagggagaggggcuccggcuuucucugaaaugaacacugcucuucagcagu

SEQ ID NO: 372821 - RNA, 62 nt, Human
caaccuuguuucucacuuccugguugggcucaucucugaagaacaggucucccagcuucgcu

SEQ ID NO: 372822 - RNA, 62 nt, Human
cuuuugauguaauuuucuaggcuaaauggcaaucucugaaagaugaauaaagcuauauuuau

SEQ ID NO: 372823 - RNA, 62 nt, Human
cuccaacucaggguuggcugugucucuuuucuucucugaagacagcguccuggcuccaguug

SEQ ID NO: 372824 - RNA, 62 nt, Human
acuccugggcucugaacacacacgccagcuccucucugaagcgacucuccuguuuggaacgg

SEQ ID NO: 372825 - RNA, 62 nt, Human
auguuuguaaagcgcuuuguaaauaaacgugcucucugaaugccacagagcagcccugugug

SEQ ID NO: 372826 - RNA, 62 nt, Human
uuuggugucaacaugaaacaccaagaugucugucucugaagcgugauuuuaaaauccccaug

SEQ ID NO: 372827 - RNA, 62 nt, Human
uuccacagcacagcagacauggaacgcugaagucucugaaagugaaguuguaaaaagaaaag

SEQ ID NO: 372828 - RNA, 62 nt, Human
caaacgaagaggauuaugauguguacacuccaucucugaagaaacaacccaucguucuuuuu

SEQ ID NO: 372829 - RNA, 62 nt, Human
cauagauuagcaauuuucaaauaauuauuuuuucucugaaaauuuugugugugauugcacaa

SEQ ID NO: 372830 - RNA, 62 nt, Human
agugguuaauugaaauagucaauuuuaaaguuucucugaagcaaaaugauaggcaucauucu

SEQ ID NO: 372831 - RNA, 62 nt, Human
ugaaugaaacaggguuuuucaaguuguauaauucucugaaauacucagcuuuugucauaugg

SEQ ID NO: 372832 - RNA, 62 nt, Human
uuagaugggacaaagaugaauggcaugucccuucucugaaguccguuugagcagaacuaccu

SEQ ID NO: 372833 - RNA, 62 nt, Human
gaugcagagcagcagugcagauggcaaugaacucucugaauucucuuuuaccuuauuuagaa

SEQ ID NO: 372834 - RNA, 62 nt, Human
gcuaugaagcuuucuuuccuacacacucugagucucugaaugaagcugaaggucuuaguacc

SEQ ID NO: 372835 - RNA, 62 nt, Human
ugugggugccugacuuccucucugugcagcacucucugaaucccuccuauucaccuugcugc

SEQ ID NO: 372836 - RNA, 62 nt, Human
uggucacuucugauuuuccaacaguugcuccuucucugaagagaucuugauuccuuugggaa

SEQ ID NO: 372837 - RNA, 62 nt, Human
cuguccagcugaagcuuuugcagcacuuuaccucucugaaagccccagaggaccagagcccc

SEQ ID NO: 372838 - RNA, 62 nt, Human
uccuauguauuggucaaggcaggcaucucuguucucugaacauucauugcacuuucccaccu

SEQ ID NO: 372839 - RNA, 62 nt, Human
agcagagguucuucaguccacgcaacgguucuucucugaacagcaacagagcaaacagauag

SEQ ID NO: 372840 - RNA, 62 nt, Human
acagaaaagggcuaaccauaccacagcuggaaucucugaauauuuccuauuaaaaauuuuuu

SEQ ID NO: 372841 - RNA, 62 nt, Human
ugcuauaaccccuugggacacucauccagacuucucugaagcagaaaaccugagcuccccac

SEQ ID NO: 372842 - RNA, 62 nt, Human
guaccuaaucucaccaucucuucacuucuagcucucugaaacaagggucacacuacucagag

SEQ ID NO: 372843 - RNA, 62 nt, Human
cugaguaccaggagagguccugccccauccucucucugaagccagggcccuuccauuccauu

SEQ ID NO: 372844 - RNA, 62 nt, Human
gguugaaaucccgaggugucauuugacaugguucucugaacuuaucuuuccuauaaaauggu

SEQ ID NO: 372845 - RNA, 62 nt, Human
ccacaggccgccucuguggcaucaccaggguuucucugaagaagagggucugcauuuuccua

SEQ ID NO: 372846 - RNA, 62 nt, Human
cuccagaccccuaagcaucuccuguccuggccucucugaagcagacaagggccaccuauccc

SEQ ID NO: 372847 - RNA, 62 nt, Human
uaauggaaugaugucuuguauagaaaugcccuucucugaaauaaagagaacuccugggcuuu

SEQ ID NO: 372848 - RNA, 62 nt, Human
auucaugccacguugaagauaaaauuauccucucucugaaauacgguaaagauuuaaauagg

SEQ ID NO: 372849 - RNA, 62 nt, Human
cuauaaaagugcaaugacuaagauccuucacuucucugaaaguaaggcccuagaugccucag

SEQ ID NO: 372850 - RNA, 62 nt, Human
cuggucuccaggcugacaaggauucaaaguugucucugaaacuccucuuugucauacugcac

SEQ ID NO: 372851 - RNA, 62 nt, Human
gcuggggggccuuggguaccugcagagccuuuucucugaauuccuuauguccggugggccag

SEQ ID NO: 372852 - RNA, 62 nt, Human
aagcccuauaugccucacucauaaugaggcugucucugaaccccggagggcgggaccuacaa

SEQ ID NO: 372853 - RNA, 62 nt, Human
ucuccacugggcugccauuuagccaugugccaucucugaagucagagguguuugacucccau

SEQ ID NO: 372854 - RNA, 62 nt, Human
auacccuuaaaccauuuauaauuucuaguauuucucugaaagaucguuuuggggacaaaagu

SEQ ID NO: 372855 - RNA, 62 nt, Human
uugagggagaagguugcagagcacuucccaccucucugaauaguguguauguguugguuuau

SEQ ID NO: 372856 - RNA, 62 nt, Human
ugcacuagaugauuacgaagaucacaucccacucucugaacuacaaucacugugcucccugg

SEQ ID NO: 372857 - RNA, 62 nt, Human
cugagagauagcgagugucuggagcggaggccucucugaaugggcagggguuuguccuugca

SEQ ID NO: 372858 - RNA, 62 nt, Human
aauucaaagacccauaaaaggcuuuuaaggauucucugaaagugcugauggcuggauccaau

SEQ ID NO: 372859 - RNA, 52 nt, Human; identical to SEQ ID NO: 359918

SEQ ID NO: 372860 - RNA, 62 nt, Human
ccaggagcauuaaguucugaaauuuugaaucaucucugaaaugaagcagguguagccugccc

SEQ ID NO: 372861 - RNA, 62 nt, Human
ugacucguguuuuuuuuuccauugagauguacucucugaaguuuggucuugauuuguuuuau

SEQ ID NO: 372862 - RNA, 62 nt, Human
ugagaaccacaacucuaaagucaagauauuuuucucugaagugauuucugcuuggcacgcua

SEQ ID NO: 372863 - RNA, 62 nt, Human
cacaagacaccggccccucccaccccccugccucucugaagggccauggcuaugcuucccug

SEQ ID NO: 372864 - RNA, 55 nt, Human; identical to SEQ ID NO: 359923

SEQ ID NO: 372865 - RNA, 62 nt, Human
gcaauuagagaucgaagccuccuaucuccacaucucugaagaaguugaggggugggggagag

SEQ ID NO: 372866 - RNA, 62 nt, Human
gugggaguguugagcaucugucccccuuuagaucucugaagccacaaauaggaugcuuggga

SEQ ID NO: 372867 - RNA, 62 nt, Human
uugacaaacaacagagccuugaccacguggagucucugaaucagccuugucuggaaccagau

SEQ ID NO: 372868 - RNA, 62 nt, Human
aaauuauugucaaaguuuaaauaccuauauauucucugaaugcaauaaagggacuuaagagu

SEQ ID NO: 372869 - RNA, 62 nt, Human
cuuugaguagcacuguuuuggggcccucggucucucugaagacccuagcagaacugauaccu

SEQ ID NO: 372870 - RNA, 62 nt, Human
ccauggggguaauaagagcaguagcagcagcaucucugaacauuucucuggauuugcaaccc

SEQ ID NO: 372871 - RNA, 62 nt, Human
aggagugaaagggacaauuuggcugaagucuuucucugaaaaaagccaaaggguuauagggg

SEQ ID NO: 372872 - RNA, 62 nt, Human
gucacaaucaguauaucuucuuugggguuaccucucugaauauuauguaaacaauccaaaga

SEQ ID NO: 372873 - RNA, 62 nt, Human
aagugccuuuuugugugcaaccacuuacccuuucucugaaaaaccuguucucaggaaggauc

SEQ ID NO: 372874 - RNA, 62 nt, Human
ccagauggacaguaaggggaaccuccaaugucucucugaacuuaaagacaggagcuggcauu

SEQ ID NO: 372875 - RNA, 62 nt, Human
uuggauagauguguacauuugguguuugaaauucucugaaaaucccauuaggaaaccaggug

SEQ ID NO: 372876 - RNA, 62 nt, Human
acaggggugcagguggcuggcagcaaacaggcucucugaagacaguagccaagauuauucac

SEQ ID NO: 372877 - RNA, 62 nt, Human
aaaguggugaggagaaaacaggaaacgggcuuucucugaauugguaaaugggaaagaaguga

SEQ ID NO: 372878 - RNA, 62 nt, Human
aagaggaaaaugaaaguguuccuggggugcugucucugaagaagcagaguuucauuaccugu

SEQ ID NO: 372879 - RNA, 62 nt, Human
uauaauucuuuuuccuuguuugaguauuucugucucugaaauaaccuuuuacuuggcuuuuc

SEQ ID NO: 372880 - RNA, 62 nt, Human
agugacaguuuuaaaaguaaaaugguguuaaaucucugaaacuugaacguaugaugcucugg

SEQ ID NO: 372881 - RNA, 62 nt, Human
auggauucugcgaugcugucuggacuuugcugucucugaacaguauguguguguugcuuuaa

SEQ ID NO: 372882 - RNA, 62 nt, Human
ugugggaaaaauauugcuacaauuuuuuuuaaucucugaauguaauuucgauacuguguaca

SEQ ID NO: 372883 - RNA, 62 nt, Human
agacuuugccauaaugauagacucaauuuagcucucugaacuaguugguaauuuuuuuuuuu

SEQ ID NO: 372884 - RNA, 62 nt, Human
ugcauccucuucuuuucccagaagugaacauuucucugaauuugaugcuuauuaugcccaug

SEQ ID NO: 372885 - RNA, 62 nt, Human
auuguaauuuaauagauuaucucagaaaaaccucucugaaugaugacccuuccuuaauacug

SEQ ID NO: 372886 - RNA, 62 nt, Human
ggcacuccgcgccgaugccaccggccugugggucucugaagggacccccccccaaucggacu

SEQ ID NO: 372887 - RNA, 62 nt, Human
aaacaccuuuccuccagcuccagaauuccuugucucugaaugacucugucuugugggugucu

SEQ ID NO: 372888 - RNA, 62 nt, Human
acuccgucucaaaaaaagggcaauaaaugcccucucugaauguuugaacugccaagaaaagg

SEQ ID NO: 372889 - RNA, 62 nt, Human
uaucuucaauccuucagucccagccagaagaaucucugaaagcauauugugaauguauacaa

SEQ ID NO: 372890 - RNA, 62 nt, Human
uguaauauuuauguguuaaucacacaguaugcucucugaaguucucuuaagccuucaguuua

SEQ ID NO: 372891 - RNA, 62 nt, Human
auaaugaucccgguagagaaacagaugacaaaucucugaaagagguuuuuaaaacuuuugau

SEQ ID NO: 372892 - RNA, 62 nt, Human
ucaggcuucaauuccauuauguuuuaauguugucucugaagaugacuugugauuuuuuuuuc

SEQ ID NO: 372893 - RNA, 62 nt, Human
acuccugagcucaagaaauccuccugccugagucucugaaagugcugggauuacaggcguga

SEQ ID NO: 372894 - RNA, 62 nt, Human
uaagcacacacacacaugcacacaaauggacuucucugaagcuguguuuagugaaaugagcu

SEQ ID NO: 372895 - RNA, 62 nt, Human
ugguuaagacaaaauaguguuauagccuucauucucugaauaggccaucuuugacucauaaa

SEQ ID NO: 372896 - RNA, 62 nt, Human
acacuccucaccuguucuuucugaguguccuuucucugaaaggauuuauguuuuucuucguu

SEQ ID NO: 372897 - RNA, 62 nt, Human
ucagccccagaauuucuucuuaaguucgccugucucugaaaucccaaagucacggaaccgca

SEQ ID NO: 372898 - RNA, 62 nt, Human
auaagccuuaaacagaaaccccuaagaaagguucucugaaaauuauuugguggguuaaaugc

SEQ ID NO: 372899 - RNA, 62 nt, Human
cugcaccaaagcuggcaccagggcucggaaggucucugaacucagaaggauggcauuuuuug

SEQ ID NO: 372900 - RNA, 62 nt, Human
auaagagaauaaguauagcuagagaaauugcuucucugaaauguacaugagcccuuaaggua

SEQ ID NO: 372901 - RNA, 62 nt, Human
ccacacaaauuccgcaguuuauucuggaugauucucugaauggaccaccugagaagguagcc

SEQ ID NO: 372902 - RNA, 62 nt, Human
cuguggcuucaagcaccucuguucauagagcgucucugaaauugagucucggucaugacuua

SEQ ID NO: 372903 - RNA, 62 nt, Human
uuuauuuaagauucacuuauuagucugcuguuucucugaaaaauuuuagagcuagguauagu

SEQ ID NO: 372904 - RNA, 62 nt, Human
ucagugaaacuacuuaacacagcuaauuuuuuucucugaaaaaucaucgagacaaaagagcc

SEQ ID NO: 372905 - RNA, 62 nt, Human
cugucuuaaaaguuaaugauccaaguggcaccucucugaaccuacuuuggcuugggaggcug

SEQ ID NO: 372906 - RNA, 62 nt, Human
aguaccacccaacacuuuugcuuucuucuccaucucugaagaucugcucaagacguccagca

SEQ ID NO: 372907 - RNA, 62 nt, Human
caucagugagguuaaacuaaggcccucuugaaucucugaauuugagauacaaacauguuccu

SEQ ID NO: 372908 - RNA, 62 nt, Human
uggcaauguuaaauguauuuauuaacuuugugucucugaaucucuguucuaaugugccaugu

SEQ ID NO: 372909 - RNA, 62 nt, Human
gauguuucuugcuuuuggaaaaaaaaaaaaagucucugaaauuugauucuuacuacagauuu

SEQ ID NO: 372910 - RNA, 62 nt, Human
uuuaauauuuauguauuaaucacacagugugcucucugaaguucucuuaagccuucaguuua

SEQ ID NO: 372911 - RNA, 62 nt, Human
cauucuuucuacuaaauccauuucaagcuaguucucugaaaauuuugccauuuaucuacaga

SEQ ID NO: 372912 - RNA, 62 nt, Human
aacauuguauguacauauacaaaauuucauuuucucugaaagucgagaauuccaagaacugu

SEQ ID NO: 372913 - RNA, 62 nt, Human
ucuucccaacaccaaaggacuuaccaucugucucucugaaucucagaucuccagcuuugauc

SEQ ID NO: 372914 - RNA, 62 nt, Human
ugcaucuuacugaagguaaaauugaaaggcauucucugaagaguggguuucacaagugaaaa

SEQ ID NO: 372915 - RNA, 62 nt, Human
aacucccugaauuuuuauacaucuucaguuuuucucugaauugaauucauaccacacaaaca

SEQ ID NO: 372916 - RNA, 62 nt, Human
cccaaagacaguccacagcaggacuugcuccaucucugaacuggucuuacccccuuaaaccu

SEQ ID NO: 372917 - RNA, 62 nt, Human
ccagacagcuuauaccacccaguguucagggaucucugaagaacccacagaccaggugaauu

SEQ ID NO: 372918 - RNA, 62 nt, Human
auggcuuggcagaaucuuuguagugugugggaucucugaaggcccuauuuaaguuuuucuuc

SEQ ID NO: 372919 - RNA, 62 nt, Human
uugaucaagggccuuauguggagcagagguugucucugaaccaggagagaagguacuauacc

SEQ ID NO: 372920 - RNA, 62 nt, Human
ugcugugagaauacaguagcacaaguccuuguucucugaagagugggaaggagaggagugag

SEQ ID NO: 372921 - RNA, 62 nt, Human
uugacuuggcaugcugggggguccucguucacucucugaaguuggccuccuuucacugggga

SEQ ID NO: 372922 - RNA, 62 nt, Human
cuuuguuuuaacuguaccuuaagcggucauguucucugaaguggaauguggcuuuccuagga

SEQ ID NO: 372923 - RNA, 62 nt, Human
cuuccaaauaauaaagucuauggacagggcugucucugaaguacuaacacaaggacacucgu

SEQ ID NO: 372924 - RNA, 62 nt, Human
gaaggcaaagacuuaauucauuuucaaaagguucucugaaugugcacagaacacguggcuca

SEQ ID NO: 372925 - RNA, 62 nt, Human
ucuauuauucuguuguagucauuaggugcccuucucugaaguuauguaaaauaaaagcaucu

SEQ ID NO: 372926 - RNA, 62 nt, Human
aguacagcccauaguaucccuucacuacaaauucucugaagaccaccuaaauaucacuugcu

SEQ ID NO: 372927 - RNA, 62 nt, Human
uaugggguuuaugaaaaauacuuggggaucauucucugaauggucuaaggaagcgguagcca

SEQ ID NO: 372928 - RNA, 62 nt, Human
ucacugugaggcccuacuagguguaagcauucucucugaauuuuaauuuccucucauuaaaa

SEQ ID NO: 372929 - RNA, 62 nt, Human
gggaaugcuauacagcugggaacagcagacuuucucugaagggccagaugguaacuacauua

SEQ ID NO: 372930 - RNA, 62 nt, Human
gagugaagagguuaauuagagggacacacuuaucucugaaguuuuucuccaggcugaacauu

SEQ ID NO: 372931 - RNA, 62 nt, Human
auaauucuguucaucauuucacuccgugcaguucucugaauugagagauguaccucuuaaac

SEQ ID NO: 372932 - RNA, 62 nt, Human
gcaauaccugucaccaugcagccgcugauaguucucugaacuaaaaggacuaauuguacuuu

SEQ ID NO: 372933 - RNA, 62 nt, Human
ggucaguuuuguuacucugagagcuguucacuucucugaauucaccuagagugguuggacca

SEQ ID NO: 372934 - RNA, 62 nt, Human
cuuguuacuuuuaagaaaacucaugcucuguuucucugaaucaaaugaaguagaaguuuaca

SEQ ID NO: 372935 - RNA, 62 nt, Human
caucugucuuuauuggugaaucaucagcuaauucucugaaagaugaauucacauaugaaaaa

SEQ ID NO: 372936 - RNA, 62 nt, Human
cgaacucgagcuuguagacagcuuggauccuuucucugaaggaaucauguucagguguguaa

SEQ ID NO: 372937 - RNA, 62 nt, Human
gaaagcugcagauggauguuuccaugaagaaaucucugaagaaaccaaaagagcugaaacug

SEQ ID NO: 372938 - RNA, 62 nt, Human
ugacaguuugaauuucuucaccuaaagauaauucucugaaaguacuguuucuucauucuauu

SEQ ID NO: 372939 - RNA, 62 nt, Human
cauguuaguuuugggaggcaaugucaacugugucucugaauuccugucuuccaaauugaagc

SEQ ID NO: 372940 - RNA, 62 nt, Human
gcauaaccugaaugaaagaagcaaaugacuauucucugaagacaaccaagagaaaauugcaa

SEQ ID NO: 372941 - RNA, 62 nt, Human
ugcgagcuugggaauuagacuuuggagucuuuucucugaagucaccaggccaggggucagga

SEQ ID NO: 372942 - RNA, 62 nt, Human
auacauaacaccaaucagaccguguggauuuuucucugaauugacugauuuuguuuuuuucu

SEQ ID NO: 372943 - RNA, 62 nt, Human
agagcgcaucaccugaaugucgugaagaaguaucucugaauguauccaggagaggaacugca

SEQ ID NO: 372944 - RNA, 62 nt, Human
ugcagacucuaccaaucacgggcauuuuaucuucucugaacacugcaguuuguuagacuaga

SEQ ID NO: 372945 - RNA, 62 nt, Human
guaucucuauuggucaaagaauauuaaaucugucucugaauuacuucaaauucucaggugaa

SEQ ID NO: 372946 - RNA, 62 nt, Human
uuuuaaaaggggcagccccuugauggcucaucucucugaauaacaguuacgucuucauaucg

SEQ ID NO: 372947 - RNA, 62 nt, Human
uggcaguucuuuuuggggccaugggacaccuuucucugaagagggguuggauaaggcaaagg

SEQ ID NO: 372948 - RNA, 62 nt, Human
cugauaacccccaaauacagaaauguucuacaucucugaaugaccucugacuuuaaaaaagu

SEQ ID NO: 372949 - RNA, 62 nt, Human
ugaguaguauaagccaccuauuuuuacuuccuucucugaaauauuccaguuaacucagcuug

SEQ ID NO: 372950 - RNA, 62 nt, Human
gaauuuuugauucuuagcugcuaccagcuaguucucugaagaacugauguuauuacaaagaa

SEQ ID NO: 372951 - RNA, 62 nt, Human
aaaagaaauucaugcauagcuucugucagacuucucugaaagccaugccuaucaaaauuuga

SEQ ID NO: 372952 - RNA, 62 nt, Human
ccccaaaaaaggccuuugcuacauccugauuaucucugaaaguaaucaaucaaguggcucca

SEQ ID NO: 372953 - RNA, 62 nt, Human
uuggucuggccaggaggcuggagaaugcggggucucugaagguccucuuuggcaccccagaa

SEQ ID NO: 372954 - RNA, 62 nt, Human
gggguuuuucuuccaucugacaucugccagccucucugaauggaaguugugaauguuugcaa

SEQ ID NO: 372955 - RNA, 62 nt, Human
ucagccugcacccucuucuccucuggcuucccucucugaaauagccgaacuccaggcugggc

SEQ ID NO: 372956 - RNA, 62 nt, Human
ccuccuuuuucugauugaugguuguauuauuuucucugaauccucuucacuggccaaagguu

SEQ ID NO: 372957 - RNA, 62 nt, Human
ugagaauggcuuaguccugagaaucugcaaagucucugaagagaacucucucuucccacuaa

SEQ ID NO: 372958 - RNA, 62 nt, Human
uuuuuuuuuaacugcaaaaaaugauggucucaucucugaauuuauauuucucauucuuuuga

SEQ ID NO: 372959 - RNA, 62 nt, Human
uuuagaguuuauauagggcaagugguucuuuuucucugaauuacaggauggaaaaaggucau

SEQ ID NO: 372960 - RNA, 62 nt, Human
acaauucaaucuauuuaaucuauuaaauuuuuucucugaauuggguauauggcaucauuauu

SEQ ID NO: 372961 - RNA, 62 nt, Human
gugcuccaguucuaaaauuaaccugugccuggucucugaagcccuuucuugcucugugccuu

SEQ ID NO: 372962 - RNA, 62 nt, Human
gauaagaaacaguuuacaaccugcucucucucucucugaagucugcugagagcuuccccugc

SEQ ID NO: 372963 - RNA, 62 nt, Human
gaaaaugucagaaaccaguuaugugaaugaucucucugaauccuaagggcuggucucugcug

SEQ ID NO: 372964 - RNA, 62 nt, Human
ugcacccccgggcuucgcagccuugcuuguuuucucugaacagcaacagaacaguguucaca

SEQ ID NO: 372965 - RNA, 62 nt, Human
cugcuggguggccccgggacaguggcuuuuccucucugaaccuuagcuuccucacccuuguu

SEQ ID NO: 372966 - RNA, 62 nt, Human
uguacauuuuaauuugauucagcuggucugaaucucugaauuuauaucauccaaaacuucca

SEQ ID NO: 372967 - RNA, 62 nt, Human
uugaugaggcuugaaagagcccacugagccacucucugaauaugugaaauguacucuguguc

SEQ ID NO: 372968 - RNA, 62 nt, Human
auuuuggacugccacacauugguaccuuuaguucucugaaggcccacguuuuuaucauuaag

SEQ ID NO: 372969 - RNA, 62 nt, Human
uuucuauuuacagauaugauugaaaauuucauucucugaauuucuccucucaaggaaaacca

SEQ ID NO: 372970 - RNA, 62 nt, Human
acuacugcuuuaaugucaaguuugcagaauugucucugaaaauaaaaacccugacuuuaguu

SEQ ID NO: 372971 - RNA, 62 nt, Human
uaaugaggagggggcuuacuggaaucgucauaucucugaauauugaaaacaacaacuaaaaa

SEQ ID NO: 372972 - RNA, 62 nt, Human
ugcaauagguugaaguuuuggagauauguuucucucugaaauuacugugaauauuuaacaaa

SEQ ID NO: 372973 - RNA, 62 nt, Human
guggccuuacucuuuguggguuuuuuuuuuuuucucugaacuugauauaaagauuuuauuug

SEQ ID NO: 372974 - RNA, 62 nt, Human
guuucuuaaaugcguggauucuuguucauuuaucucugaauaugucucuuuuauauuuuggc

SEQ ID NO: 372975 - RNA, 62 nt, Human
uauuuuuauugugguucuuacccccuuuuccuucucugaaguguuaaugcuuaagaaaagag

SEQ ID NO: 372976 - RNA, 62 nt, Human
guggugcaagccgggggucuccacaucuuccuucucugaaguccagguaccugcacaagcag

SEQ ID NO: 372977 - RNA, 62 nt, Human
gaugcaacggcccaaauucuugaucugcagcuucucugaaguuuggaaaagaaaccuuccuu

SEQ ID NO: 372978 - RNA, 62 nt, Human
cuacuccaguaaaccugauuggguuuguucacucucugaaugauuauuagccagacuucaaa

SEQ ID NO: 372979 - RNA, 62 nt, Human
gaaaaauauguugcuaagauuguguuggucgcucucugaagcagaaaagggacuggaaccaa

SEQ ID NO: 372980 - RNA, 62 nt, Human
ucccagucuucagcagagaaguuuucuggaggucucugaacccagggaagacaagaaggaaa

SEQ ID NO: 372981 - RNA, 62 nt, Human
guuuuugaucccaaaauuccagagcuuucaacucucugaauuuguaguccugaauaucccag

SEQ ID NO: 372982 - RNA, 62 nt, Human
ugccaagauuuaacagacuuaagaacuauuguucucugaaugacaguuguaagagaaaugua

SEQ ID NO: 372983 - RNA, 62 nt, Human
uuuuucuagacacuuuucuuuuaucccagucaucucugaauuuacauuuuauauuaaagaaa

SEQ ID NO: 372984 - RNA, 62 nt, Human
agauacagagaugacuaaggucauugauagcgucucugaacaaucagacggaucaccuuauc

SEQ ID NO: 372985 - RNA, 62 nt, Human
uaacuucuauugacccacaaaguuucagaaauucucugaaaguuucuuccuuuuuucucuua

SEQ ID NO: 372986 - RNA, 62 nt, Human
ugcaugugcagcaguggggaguucuagauugaucucugaaugugaucgacgcccagcaagga

SEQ ID NO: 372987 - RNA, 62 nt, Human
acuucuaccaaaacauaaaucugugauugugaucucugaaagucaguccuuuuaucuacuca

SEQ ID NO: 372988 - RNA, 62 nt, Human
aaaaauuuuaaaaaucuaagcagcuuauuguuucucugaaaguguguguaguuuuacuuucc

SEQ ID NO: 372989 - RNA, 62 nt, Human
ccacauaaggaaacuggguuccugcaaugaagucucugaagugaaacugcuuguuuccuagc

SEQ ID NO: 372990 - RNA, 62 nt, Human; identical to SEQ ID NO: 372987

SEQ ID NO: 372991 - RNA, 62 nt, Human
auauccuauguuuucuugcucaaacaccuuucucucugaaagcagaaaaaggcacugauaua

SEQ ID NO: 372992 - RNA, 62 nt, Human
uuuaaauaggauuauuacagcaccaaaaaacuucucugaagccuuucuccacaaccuuguuc

SEQ ID NO: 372993 - RNA, 62 nt, Human
uacaaccaaccaguuucuuuucuagccaaucaucucugaagaguugcuguuucuuacugaca

SEQ ID NO: 372994 - RNA, 62 nt, Human
uuucuaacaguaccaguguaaauucagucuuuucucugaaaagcaaaggauguguuuucagu

SEQ ID NO: 372995 - RNA, 62 nt, Human
ggaguauuaugucuccccaccuucugcaguuuucucugaacauguauguugcccaugguggg

SEQ ID NO: 372996 - RNA, 62 nt, Human
caugauguuguaauucaagaaaauaggcacuuucucugaaagaccugcuccuuccacaagaa

SEQ ID NO: 372997 - RNA, 62 nt, Human
uguuugaaauuauguccaugaaaucacagggaucucugaaauaucuuuaggaaacuugaaau

SEQ ID NO: 372998 - RNA, 62 nt, Human
uguaaacacucugaucuuccuauuccacugagucucugaagggaauagggcugguagugggu

SEQ ID NO: 372999 - RNA, 62 nt, Human
aucugugaauucagauuuuaaaaagucuucacucucugaagaugaucauuugcccuuaagga

SEQ ID NO: 373000 - RNA, 62 nt, Human
cagagaugccacuugccucccccaccaugccaucucugaagaauauuacagaccauuuugga

SEQ ID NO: 373001 - RNA, 62 nt, Human
ugaaguuaguuucuuaagugaguuuucaggugucucugaaaaauuuauaacaaucauguauu

SEQ ID NO: 373002 - RNA, 62 nt, Human
gaaaggaagcuaagcaguggguaccugggaucucucugaacuauuuuuauaacuucuuguga

SEQ ID NO: 373003 - RNA, 62 nt, Human
ugccucagauuauguuaaauuugggucagucuucucugaacuuuuucucucuugguuucuuu

SEQ ID NO: 373004 - RNA, 62 nt, Human
agacauuuuuaaaaaugugacaacacuuuuauucucugaauuuugaucucaaaggacacaga

SEQ ID NO: 373005 - RNA, 62 nt, Human
gaggguuuucauagcuuuuggaaauacuuuggucucugaacuguaauuagcaagaaguaaaa

SEQ ID NO: 373006 - RNA, 62 nt, Human
aagcuggcccagauacaaguaccaaacaguagucucugaaguucccccauuuccuucaguac

SEQ ID NO: 373007 - RNA, 62 nt, Human
agccuucuggugccagccccaugcagggggacucucugaagcugugcaggcugccuguaugg

SEQ ID NO: 373008 - RNA, 62 nt, Human
cgaucccuuccuucuuccacuuucacagcuuuucucugaacuaggagaaccuggggguggau

SEQ ID NO: 373009 - RNA, 62 nt, Human
cagaguggggaaggugagugguagagagggggucucugaaggcccuuggggcugacagggcc

SEQ ID NO: 373010 - RNA, 62 nt, Human
aaguaucuacuguguaacaggcacuaugcuauucucugaaagaugcagcaguggacaagaca

SEQ ID NO: 373011 - RNA, 62 nt, Human
uggcaggaguaaaucucuccaccuccucuaacucucugaaaacucuagaguuggagcaaguc

SEQ ID NO: 373012 - RNA, 62 nt, Human
ggaucggugugugagacccgcgagugggcacgucucugaaugugaggucucgggcagcacgu

SEQ ID NO: 373013 - RNA, 62 nt, Human
gcucauacaugccucaugugaaguguccacccucucugaaaaucuuucuuguucaaaacagc

SEQ ID NO: 373014 - RNA, 62 nt, Human
gucacuauuugucuuucuaaucuccuucuguuucucugaauaucuucauuucuaucucugug

SEQ ID NO: 373015 - RNA, 62 nt, Human
gugaccgggaucccacucugauugcauccauuucucugaaagacuuguuuguucugcuucuc

SEQ ID NO: 373016 - RNA, 62 nt, Human
uucuguaacacccucagcauccugcacugcccucucugaaaacacccacauucuuuggucac

SEQ ID NO: 373017 - RNA, 62 nt, Human
guccuaaagugcugucaggguggcaccacugcucucugaacaacuuaccuuggucagaggga

SEQ ID NO: 373018 - RNA, 62 nt, Human
aaucagccugugugauuggggcucauuuugauucucugaauuaucgguuugacgguuacacu

SEQ ID NO: 373019 - RNA, 62 nt, Human
guuucugagcauaaugcucccaucuccugauuucucugaacagaaaacaaaagagagaauga

SEQ ID NO: 373020 - RNA, 62 nt, Human
uucucuucuuagucucucucuuuauuuuucaaucucugaauauuuuagucucucucugaguc

SEQ ID NO: 373021 - RNA, 62 nt, Human
aggaaaucugaagaaccugcuguguuuagaugucucugaaaacagguuggaaagacuuccug

SEQ ID NO: 373022 - RNA, 62 nt, Human
aguacacugaagccacaggcugguggccauguucucugaauugggugcagaagacaagggca

SEQ ID NO: 373023 - RNA, 62 nt, Human
agggggcacuuucaccaagagcaguguaauuaucucugaaagagcaagucagcuugugccgc

SEQ ID NO: 373024 - RNA, 62 nt, Human
ucuacuucuuugauuguagaaaagcagacacuucucugaaacaugaccuuauucuuccaaac

SEQ ID NO: 373025 - RNA, 62 nt, Human
agcuggaacaaugcugcugucacacagucucuucucugaaacuucaggaugcuccuugguca

SEQ ID NO: 373026 - RNA, 62 nt, Human
ggucaguaauuccgacuuucucagcaguggugucucugaauuacugcaaaggguaaaaaaaa

SEQ ID NO: 373027 - RNA, 62 nt, Human
auugugcuucuuccuccagaaagaggagcgugucucugaacugcgccaucaacuccagucuc

SEQ ID NO: 373028 - RNA, 62 nt, Human
caucucaugggguccagaguggaguccaggcuucucugaaaccagggcugagcauauuucca

SEQ ID NO: 373029 - RNA, 62 nt, Human
aggacugguugucucucuucgguggccuugagucucugaauuugucggguucucccaugauu

SEQ ID NO: 373030 - RNA, 62 nt, Human
cgucaacccuguggcuuguuagcaucagaaccucucugaagaccaaacuucccuguguggcc

SEQ ID NO: 373031 - RNA, 62 nt, Human
ucccaaaucacauuacuaaaugccaacaauuaucucugaauucccuauccaggcuccccuca

SEQ ID NO: 373032 - RNA, 62 nt, Human
agcagccauuuguguugugaagggguagaagaucucugaaacuugucuugagauugaacuca

SEQ ID NO: 373033 - RNA, 60 nt, Human; identical to SEQ ID NO: 360133

SEQ ID NO: 373034 - RNA, 62 nt, Human
uagcaaaugcugugaauuacucuuccuccccuucucugaaauggguaaaggacaaauugugu

SEQ ID NO: 373035 - RNA, 62 nt, Human
caagguuuucagcagacuuugcuccuaauggcucucugaaagugacagacuuaaauauugcu

SEQ ID NO: 373036 - RNA, 62 nt, Human
cauuaccuuuacaauacuguauaaucagaaguucucugaaccucaauuguauaucuagacau

SEQ ID NO: 373037 - RNA, 62 nt, Human
cacuucaucugaagaauguuggugaaggcaagucucugaaagcagaacuauccaguguuauc

SEQ ID NO: 373038 - RNA, 62 nt, Human
auguuuugcugaaauauuuuguucuuuaaggaucucugaaacauauuuauaguuuaauaccc

SEQ ID NO: 373039 - RNA, 62 nt, Human
cuaugcuaaccgaauuaaaauguacuuguugaucucugaauagcucacuucuuacaauguac

SEQ ID NO: 373040 - RNA, 62 nt, Human
caggcagauuugaaaacagugacauugcuugaucucugaauggauggaugcccuuggguggu

SEQ ID NO: 373041 - RNA, 62 nt, Human
ucauuuuuauucuuccuuccaacguggugcuaucucugaaacgagcguuagagugccgccuu

SEQ ID NO: 373042 - RNA, 62 nt, Human
acaugccacaggagaauucggggauuugaguuucucugaauagcauauauaugaugcaucgg

SEQ ID NO: 373043 - RNA, 62 nt, Human
uuacuuucaguauauuucuugagaccgggucaucucugaaaugcauuugggguaguuuccug

SEQ ID NO: 373044 - RNA, 62 nt, Human
ucugaaaucugcuagugugaaacuugcucuacucucugaaaugauucaaauacacuaauuuu

SEQ ID NO: 373045 - RNA, 62 nt, Human
uugagguuguucaaaguuuaagcaauucauucucucugaacacacauugcuauucccauccc

SEQ ID NO: 373046 - RNA, 62 nt, Human
ucucugaagucagaucucaauuuuuagaaaacucucugaauauaaugaauauggggaaucca

SEQ ID NO: 373047 - RNA, 62 nt, Human
cccccuugcuugucuucuuuugaaaccgggcaucucugaaguccuggugucaaggggaucaa

SEQ ID NO: 373048 - RNA, 62 nt, Human
uuccguugcugaaaaauauuugaaacuuguggucucugaagcucgguggcaccuggaauuua

SEQ ID NO: 373049 - RNA, 62 nt, Human
ucgugugugguuuucuugaucggugagaucugucucugaagucacugccagccucccuggga

SEQ ID NO: 373050 - RNA, 62 nt, Human
acuguugcacaacauaugaugaaauuuugauuucucugaaucucagaguaauuuaagauggg

SEQ ID NO: 373051 - RNA, 62 nt, Human
ggucucaacuuuuaaauacacuuugaacuucuucucugaauuauuaaaguucuuuaugaccu

SEQ ID NO: 373052 - RNA, 62 nt, Human
cuuccccuauuuucugucccagcucauccgugucucugaagaacaaauaugcuuuuggacca

SEQ ID NO: 373053 - RNA, 62 nt, Human
gcuggcuggcagaggagaaggcagucguuuccucucugaagaguauuuuuuucgauugcccu

SEQ ID NO: 373054 - RNA, 62 nt, Human
uacugagauuuugguauuacacuguauuuguaucucugaagcauguuucauguuuugugacu

SEQ ID NO: 373055 - RNA, 62 nt, Human
aauugaaauaucuuacuuuaaaaauauuuucaucucugaaauaucucguuauuuauuggagg

SEQ ID NO: 373056 - RNA, 62 nt, Human
aauuugcacuguuaacucauuauuguaaguaaucucugaaagccuuuuuacuuuaaccaaau

SEQ ID NO: 373057 - RNA, 62 nt, Human
uguucaaauagaaaccauucgugucccuucacucucugaacauagucugcaaaucucucccu

SEQ ID NO: 373058 - RNA, 62 nt, Human
gcauaaaagacuuuuuuuuaacacuuuggacuucucugaaauauuuagaagugcuaauuucu

SEQ ID NO: 373059 - RNA, 62 nt, Human
uuucuccucugugcggccuccagcugagccugucucugaauuguucccucccccgcaaugug

SEQ ID NO: 373060 - RNA, 62 nt, Human
auuuccuaccuaaauauuaaccauaugccuagucucugaaacuaaaaacuuggaccucaucc

SEQ ID NO: 373061 - RNA, 62 nt, Human
ccaggggauggcuagaggcauuucuguuguuaucucugaaacauuuuuauaucaaaaaucag

SEQ ID NO: 373062 - RNA, 62 nt, Human
uugaaaaugauuuaaaguguuuuccuuaauguucucugaaaacaaguuucuuuuguaguuuu

SEQ ID NO: 373063 - RNA, 62 nt, Human
uuggguguggguggucuccaaggccacgcugcucucugaauugauuuuuugaguuuuguuug

SEQ ID NO: 373064 - RNA, 62 nt, Human
cuccugucucugugagaauguauacuuuaugcucucugaaauguaugacacccagcuuuaaa

SEQ ID NO: 373065 - RNA, 62 nt, Human
auuagcuuccugcugaauguaguauuuggcauucucugaauuuauuuccucuccuuccccca

SEQ ID NO: 373066 - RNA, 62 nt, Human
ugauagagaaaaacaacccagcgaaggcgccuucucugaaaacaaugcugagaaugagagcg

SEQ ID NO: 373067 - RNA, 62 nt, Human
acuauuacaguguuggagaacaacaaauauguucucugaaugagccuuugugcuuuuuguca

SEQ ID NO: 373068 - RNA, 62 nt, Human
ccaggcuuuaaaaauuaaaaauggauggaucuucucugaacucagggagggcacauacuuag

SEQ ID NO: 373069 - RNA, 62 nt, Human
cugaugacacagaaugaaagggcaucucagccucucugaacuuuguaaaaaucuguccccag

SEQ ID NO: 373070 - RNA, 62 nt, Human
acaaauuuuaaaagauuugaaauaauuguauuucucugaauucagugaagaaauaauucaug

SEQ ID NO: 373071 - RNA, 62 nt, Human
aguaaaugugacuccaaagggaguucaguuaaucucugaaaugcacaaaaccuagcuauuuu

SEQ ID NO: 373072 - RNA, 62 nt, Human
aacacaaacauaagaacuggucuucuacacuuucucugaaucauuuagguuuaagauguaag

SEQ ID NO: 373073 - RNA, 62 nt, Human
cuagaggcgacuucauugcuauggaucuggagucucugaacucuuaauaggaugcagccuca

SEQ ID NO: 373074 - RNA, 62 nt, Human
ugcuucucuuuggggggccgcgagaucuagcaucucugaaauccuggcugucgaggcuuuga

SEQ ID NO: 373075 - RNA, 62 nt, Human
accuuaccucucaacucccucaagaguaccagucucugaaguuauaaugcuuuggucucuac

SEQ ID NO: 373076 - RNA, 62 nt, Human
cuuccauaaaucaaagcaugacuaauagggggucucugaaauguaagggcacaaacuucacu

SEQ ID NO: 373077 - RNA, 62 nt, Human
acaguagaaccgggagcagggauagcucagcuucucugaauagcacacuuugcucaggucuu

SEQ ID NO: 373078 - RNA, 62 nt, Human
uuuucauucuaagacaaaacauuucuccuaaaucucugaauaaaaucagugcuguaggaaga

SEQ ID NO: 373079 - RNA, 62 nt, Human
auguuacuaugaaagacuuguauuuuuuauugucucugaacuuuaauccugugaaaaugcuc

SEQ ID NO: 373080 - RNA, 62 nt, Human
gugcuauucuuugaaagcugcuauguguauuuucucugaagucugcauuuuacuaaaauuua

SEQ ID NO: 373081 - RNA, 62 nt, Human
acccagaugacaccuccccaaaguccacagacucucugaaagcauuuugaugcaggucugca

SEQ ID NO: 373082 - RNA, 62 nt, Human
ugguuuguacuaauacagacguacagauacuuucucugaagaguauuuucgaagaggagcaa

SEQ ID NO: 373083 - RNA, 62 nt, Human
cuuuuuccccauuggaacuagucauuaacccaucucugaacugguagaaaaacaucugaaga

SEQ ID NO: 373084 - RNA, 62 nt, Human
cccacacuucccacccccaggcaaggcugacuucucugaaucagaaaagcuauuaaaguuug

SEQ ID NO: 373085 - RNA, 62 nt, Human
gacuuuucccugggcuuguuuuuucucgcacaucucugaagaguuuuuaaucuucagcucau

SEQ ID NO: 373086 - RNA, 62 nt, Human
acacauaccgcacuucauagaaucaaaguugcucucugaaggagcuuuggcuccugauauuu

SEQ ID NO: 373087 - RNA, 62 nt, Human
aauaaauuaauuuguuguauauaguuccucaaucucugaaguaaagguaugaguaauauagg

SEQ ID NO: 373088 - RNA, 62 nt, Human
cuuggauuagagagaaguucguaccuugcauuucucugaauucuagucucucauaagcacug

SEQ ID NO: 373089 - RNA, 62 nt, Human
acauaacgaaaugaaggcagaaauaaagauauucucugaaagcaaugagaacaaagacacaa

SEQ ID NO: 373090 - RNA, 62 nt, Human
ucuuuaaaaugcaagcagugagaaauaagaccucucugaauuaguagcucuaaacuguuaac

SEQ ID NO: 373091 - RNA, 62 nt, Human
acaacacagaacgauguugaccuguuaaguauucucugaaacauggccaaaaugcauuuuau

SEQ ID NO: 373092 - RNA, 62 nt, Human
aagggagggaugaaaggggacacaagucccugucucugaaguuucuuuaaaaucugaguucc

SEQ ID NO: 373093 - RNA, 62 nt, Human
gcugggaaauuuguaucuccaaggcggcucugucucugaaauaaauggcaucaagugcaugu

SEQ ID NO: 373094 - RNA, 62 nt, Human
ugaccccuaggcagcucgagcaugcccugagcucucugaaaguugucacccuggaauagggu

SEQ ID NO: 373095 - RNA, 62 nt, Human
cugaccccaggcagcucgagcaugcccugagcucucugaaaguugucacccuggaauacgau

SEQ ID NO: 373096 - RNA, 62 nt, Human
gaccuagaaccgaaccucaucuccgaguugggucucugaagacgggggugaggugagguagg

SEQ ID NO: 373097 - RNA, 62 nt, Human
gagcaaguucuucugccagggucacacuguggucucugaacugaccaguauaucccuaacuc

SEQ ID NO: 373098 - RNA, 62 nt, Human
aacaaggaacacuaaaacaguguugauucuugucucugaagacaaauaauuaaaccuuuuuu

SEQ ID NO: 373099 - RNA, 62 nt, Human
acaccccugcucaacagagguuuaguuuacagucucugaacuaaaguaguaaccucccaaau

SEQ ID NO: 373100 - RNA, 62 nt, Human
aauuagaucagagacugguagcaucguuucucucucugaaagcaccagugcccagagucugc

SEQ ID NO: 373101 - RNA, 62 nt, Human
gggggucaggacagggccugauuugagccuccucucugaagaugauuuggccgagcggaagg

SEQ ID NO: 373102 - RNA, 62 nt, Human
ggacaggaggugcugaggcuggcugcaccugcucucugaagacgccuuccucucuagguuca

SEQ ID NO: 373103 - RNA, 62 nt, Human
acugacugugaaguggcuucuccguacgauugucucugaaacaucguggccucaggugccag

SEQ ID NO: 373104 - RNA, 62 nt, Human
uuaagaauuuacaucuuuuacaaauauguauaucucugaaauaaugaaauauauugaugggu

SEQ ID NO: 373105 - RNA, 62 nt, Human
uggggcucuggaauuugggucagaaccuucucucucugaauuuggaucagcuccaagcagug

SEQ ID NO: 373106 - RNA, 62 nt, Human
ucaacaacacucgguccccuugaagaggcaacucucugaacccgucucugacuguuggaggg

SEQ ID NO: 373107 - RNA, 62 nt, Human
acagauggaaccuucacaagggcgccuuugguucucugaacaucuccuuucucuucuugcuu

SEQ ID NO: 373108 - RNA, 62 nt, Human
ugauccuccuucccgcagccaccagcgugagcucucugaaucccgggaccccuucacguggc

SEQ ID NO: 373109 - RNA, 62 nt, Human
uucaucaccaacucagugcuauuaauucuccuucucugaaugacucaggguacccuauaggg

SEQ ID NO: 373110 - RNA, 62 nt, Human
aaaggaaaucuauuuuuucccuucauguuuucucucugaaaguuggcuugagaguuguuguc

SEQ ID NO: 373111 - RNA, 62 nt, Human
auuggccuuuauuuacuacuuccuuggaaccaucucugaauucugaauagcugacaaccccc

SEQ ID NO: 373112 - RNA, 62 nt, Human
agcaaucaugagugcguggcuggggacagaccucucugaagugucuccuguugugaggggcu

SEQ ID NO: 373113 - RNA, 62 nt, Human
accaucuacugugcuugugucaugaugcuuuuucucugaaguggugugggaaguaccagggg

SEQ ID NO: 373114 - RNA, 62 nt, Human
cgccugacgaaucgagugccugugugucuaccucucugaagccugagcaccaugauucccac

SEQ ID NO: 373115 - RNA, 62 nt, Human
cauggaauaagcuggcuugcuacuucccuacaucucugaagggcuccaccauuccucuagca

SEQ ID NO: 373116 - RNA, 62 nt, Human
cagggaagaaacuuucuggugcugucuuuuguucucugaauuuucagagacuuuuuuuauaa

SEQ ID NO: 373117 - RNA, 62 nt, Human
cuugagcuuuaaacuugauuugaguuucagugucucugaauugaacaucccacguuggaaga

SEQ ID NO: 373118 - RNA, 62 nt, Human
acuucuuguuugcugaguaauuguuucuaaugucucugaacucaaagugaggugcuccaaga

SEQ ID NO: 373119 - RNA, 62 nt, Human
aaagcagaguuuugugcaagcacucacugugcucucugaaagagccugaggccgggcguggu

SEQ ID NO: 373120 - RNA, 62 nt, Human
uauguaaacugacaaggaugcuaaaauaaaagucucugaaguauuccaugccuuuuggaccc

SEQ ID NO: 373121 - RNA, 62 nt, Human
gucuguaacaugguauuggcuuaucguuuuuaucucugaagggcaguagccugaagauaaca

SEQ ID NO: 373122 - RNA, 62 nt, Human
ucuccuccaugguggucacugccccuggcaggucucugaaagggaaaugcuuuucugcagag

SEQ ID NO: 373123 - RNA, 62 nt, Human
gguuaacuuauuuaagggggauguacauauauucucugaaacuaggaugcaugcaauugugu

SEQ ID NO: 373124 - RNA, 62 nt, Human
ccaccuuccccagcugccuccuaccagcaguuucucugaagaucugucaacagguuaaguca

SEQ ID NO: 373125 - RNA, 62 nt, Human
ggucggccaagcugacuguaaauuucacagucucucugaagaaaccauugugcuucugagac

SEQ ID NO: 373126 - RNA, 62 nt, Human
agagccauaaaugaccuaacguuucccguuagucucugaacuaggugaucucaguucucuuu

SEQ ID NO: 373127 - RNA, 62 nt, Human
accuucuaaugucgggacaucaucuucaccucucucugaaguuaacuccacuuuaaaacucg

SEQ ID NO: 373128 - RNA, 62 nt, Human
gaggggaggccaagaguggccccaccuggcccucucugaaggaggccaccuccuaaaaggcc

SEQ ID NO: 373129 - RNA, 62 nt, Human
cgaauauaagagaauacuucuaaggacagaaaucucugaaucaauggcuaagacaacaguaa

SEQ ID NO: 373130 - RNA, 62 nt, Human
ucgccuguggauuuuguccauucaucucaugcucucugaacagaagguauaccugggaagau

SEQ ID NO: 373131 - RNA, 62 nt, Human
gcucccuuguucuuggagggaccauuauuacaucucugaacuaccuuuguauccaacauguu

SEQ ID NO: 373132 - RNA, 62 nt, Human
ucaaaaugccauugaucauuauuccuguauuuucucugaaacugauuauaaaaaccaauguc

SEQ ID NO: 373133 - RNA, 62 nt, Human
cuuacuccuuaggugcccagaauuuaccaucaucucugaaggaguuacagggaaguggucuc

SEQ ID NO: 373134 - RNA, 62 nt, Human
ccagggaauagcccuccucuccccaggaaacuucucugaaaucuuagacuuagccagucuua

SEQ ID NO: 373135 - RNA, 62 nt, Human
uccucaggaacccccuuucccgggugagccccucucugaagagacuguccuugggccuccuc

SEQ ID NO: 373136 - RNA, 62 nt, Human
gaucuaaauuugcagcaaugauacuaaacaacucucugaaauuucucaagcaccaagagaaa

SEQ ID NO: 373137 - RNA, 62 nt, Human
uaaauagucauuuugcauuugauuagugcaguucucugaaucauaaagcaaguuuuaccucu

SEQ ID NO: 373138 - RNA, 62 nt, Human
ucagcccaacauuuuccaccagucuguccccaucucugaaauccuuccuucucuuucccccu

SEQ ID NO: 373139 - RNA, 62 nt, Human
ggggcuuccauauuucaaaguggaagcuuucuucucugaagucgauauaugguuuugaauua

SEQ ID NO: 373140 - RNA, 62 nt, Human
auugcagcuguguccugaauuccugaagcacgucucugaaucuguccuccucuggacuaagg

SEQ ID NO: 373141 - RNA, 62 nt, Human
ggacuguaaacacagacagggucaaaguguuuucucugaacacauugaguuggaaucacugu

SEQ ID NO: 373142 - RNA, 62 nt, Human
aaaauguacacagacugauuuggagaacacauucucugaaaauacuguaaauacguugggga

SEQ ID NO: 373143 - RNA, 62 nt, Human
agcucaccccacucccuucugccccuuuuuugucucugaaauuugcacuacgucuuggacgg

SEQ ID NO: 373144 - RNA, 62 nt, Human
gcuugagugaauguuaggccuugggggcugagucucugaaaagucuaagaagcucugccuag

SEQ ID NO: 373145 - RNA, 62 nt, Human
gggaagcagaaauauagugcaauagugcaacaucucugaauccuuuuaaucuagagaaggca

SEQ ID NO: 373146 - RNA, 62 nt, Human
gcaucccugggcccagggaguuuacucagagcucucugaagauguggcaacccaugcccccu

SEQ ID NO: 373147 - RNA, 62 nt, Human
ucuccucuuuggugaaagcauuucuuaugguuucucugaaucaguucaucccacacaucauc

SEQ ID NO: 373148 - RNA, 62 nt, Human
uuugucacgucuucugagaaugacuuucagucucucugaaaaugaaaagcuuaggaccagaa

SEQ ID NO: 373149 - RNA, 62 nt, Human
uugcuagagaaaaggugaggguuguuuuucuuucucugaaaccuacaguaaauggguaugau

SEQ ID NO: 373150 - RNA, 62 nt, Human
gggcuugcuugaccugaugauuuuccuucagcucucugaaggugcuuuuuccacaauccaag

SEQ ID NO: 373151 - RNA, 62 nt, Human
cuugauguccaggguagauaaagggucgaaucucucugaagaacugccaccuggucaucagc

SEQ ID NO: 373152 - RNA, 62 nt, Human
cucacccugcuagcuuugcccuugacucgucuucucugaaccucagccucgugcauugccug

SEQ ID NO: 373153 - RNA, 62 nt, Human
uaaagagcaauaguuugccccuuuuggaaugaucucugaauauauaaaacacacacacaaag

SEQ ID NO: 373154 - RNA, 62 nt, Human
acuuaacuauuuuggcuuuuuaaacauaauuuucucugaaaauuaauuguggcucuuauuug

SEQ ID NO: 373155 - RNA, 62 nt, Human
uuccaccuucuauguuucuacucccucccuggucucugaaugccuucgccuguauaaagagu

SEQ ID NO: 373156 - RNA, 62 nt, Human
agccuuccuacacguuagauuugccguaccaaucucugaaugccccauaauuauuauuucca

SEQ ID NO: 373157 - RNA, 62 nt, Human
uuuuguauguaauauuuuuauugaugaauacaucucugaacguuccagaagucuuaagguuc

SEQ ID NO: 373158 - RNA, 62 nt, Human
guaacugagaguuugguaaaagaauauuuucuucucugaauaauaauuauuuucacagugaa

SEQ ID NO: 373159 - RNA, 62 nt, Human
aaaauauauaacuuacuauauguuucaguugcucucugaacaaaaauuaucuucaauuuaau

SEQ ID NO: 373160 - RNA, 62 nt, Human
cuucaauggacuaagauuuuuuuggucaguaaucucugaaauuuccuuaaauuauauacuua

SEQ ID NO: 373161 - RNA, 62 nt, Human
aacauuuucuuucauuccaguggccuuagucaucucugaagaaauacuuacuugauuuuuuu

SEQ ID NO: 373162 - RNA, 62 nt, Human
uuccucgcccuccuccacccgagaugccagagucucugaagaagaagcuuggguuaacucag

SEQ ID NO: 373163 - RNA, 62 nt, Human
uuuaguugaagcguaaaucuaaagaaacauuuucucugaaauauauuauuaagggcaaugga

SEQ ID NO: 373164 - RNA, 61 nt, Human
auagauccaaauaaaagaaaagaagcaaagacucucugaaaauuaguauaugaguucuucc

SEQ ID NO: 373165 - RNA, 62 nt, Human
uuuuaauuuguuuuuuucuccaaguccaccagucucugaaauuagaacaguaggcgguauga

SEQ ID NO: 373166 - RNA, 62 nt, Human
aguauuguuuucucuguuuuucuucucuaacuucucugaaaucaucuccuauuaagggauag

SEQ ID NO: 373167 - RNA, 62 nt, Human
cucuccauagcugggaaguuuauuuuguuuugucucugaagacagcaguuuuauugcaucac

SEQ ID NO: 373168 - RNA, 62 nt, Human
uuuuaaaaaauagauucaaauguguuauccucucucugaaacgcuuccuauaacucgaguuu

SEQ ID NO: 373169 - RNA, 62 nt, Human
cauucuccacagccucacuucauuccaccuauucucugaaaauauucccugagagagaacag

SEQ ID NO: 373170 - RNA, 62 nt, Human
uuggggggacugugaugacaauuaaaucaccuucucugaaguucuggcucugcagagaccaa

SEQ ID NO: 373171 - RNA, 62 nt, Human
acguccaccgucccaaggcugucacuaguauuucucugaagugccugaagguaggaaugggc

SEQ ID NO: 373172 - RNA, 62 nt, Human
acaacuucaggagacaucugaaaagaaugaugucucugaaagcuguccuuucagaugaggga

SEQ ID NO: 373173 - RNA, 62 nt, Human
augcccaaaaaugauggauagagaaacagaaaucucugaaugucagaacccugucuuuuaaa

SEQ ID NO: 373174 - RNA, 62 nt, Human
uuauauguauggaucuauauuuucagagcuuaucucugaagaucuaaacuuuugagaauguu

SEQ ID NO: 373175 - RNA, 62 nt, Human
uccugucucugcuuugaggcaaucaaguacccucucugaaccuagguucccucaucuguaaa

SEQ ID NO: 373176 - RNA, 62 nt, Human
uauuuucaaugugaauccaaagcuugucugguucucugaaaauaauuuuuuccccuuuaggu

SEQ ID NO: 373177 - RNA, 62 nt, Human
acugcuucaagauuaccaggacuccuacacacucucugaaacucaggcugaggcagcagcug

SEQ ID NO: 373178 - RNA, 62 nt, Human
cucaucaaaagaagccaaauucaugaucaacaucucugaaguuucaaguaaggcccacacuu

SEQ ID NO: 373179 - RNA, 62 nt, Human
cuuaaucauuuaaaguaaacacaauugaagccucucugaaguuaaacccaacuauguuuauu

SEQ ID NO: 373180 - RNA, 62 nt, Human
auaugaauaauuucacauacagaaccuuuuuuucucugaaguccuguggacuugcaaauaua

SEQ ID NO: 373181 - RNA, 62 nt, Human
uggcucuugagauuaauaguaaccccagcaucucucugaaacgaaaaaagaaauuaauuaag

SEQ ID NO: 373182 - RNA, 62 nt, Human
ggccaggaaaaaaaaaaaaaagacucccuggaucucugaauauaugcaaaaagaaggcccca

SEQ ID NO: 373183 - RNA, 62 nt, Human
gguguuguauagauccaguugcacuaaauuccucucugaaucuuggcugcuggagccauuca

SEQ ID NO: 373184 - RNA, 62 nt, Human
auguguauggcguguguucuugaaaugaugucucucugaauauccaaaaaaguacuguacug

SEQ ID NO: 373185 - RNA, 62 nt, Human
uaaauuuuguagcugguacacucuggccugggucucugaauucagccugucaccgauggcug

SEQ ID NO: 373186 - RNA, 62 nt, Human
guccuugaucuuuucuuuagauugaaagucugucucugaacacaauuauuuguaaaaguuag

SEQ ID NO: 373187 - RNA, 62 nt, Human
augcauuuuguuuguuucuucacuuauccuguucucugaagauguuuugugaccagguuugu

SEQ ID NO: 373188 - RNA, 62 nt, Human
gaaaaaagaacguauuuuuugugcuuugaagaucucugaagaauuucuuuuauaauagaaug

SEQ ID NO: 373189 - RNA, 62 nt, Human
accuugaggguccaaugggaccuugaggguuuucucugaaauauacaaacuuaaaggacucu

SEQ ID NO: 373190 - RNA, 62 nt, Human
aucgcacaccuuugcaacagauguguucugauucucugaaccuacaaaauaguuauacauag

SEQ ID NO: 373191 - RNA, 62 nt, Human
uucauacacaacguaaucaaauaugugguccaucucugaaaacaagagacugcuugacaaag

SEQ ID NO: 373192 - RNA, 62 nt, Human
auccagugucgggaagacaaagauguuuugcuucucugaagaagcuuauaauaauauacagu

SEQ ID NO: 373193 - RNA, 62 nt, Human
uaggcugcggcuggccacugugucuccucacuucucugaacaaagcaguuccuccccuacca

SEQ ID NO: 373194 - RNA, 62 nt, Human
cuaccugcaguggacugucauuuuccuuucuuucucugaauuacugcuuuuucugugggcau

SEQ ID NO: 373195 - RNA, 62 nt, Human
uucacugguuuugaacucagugccuaagaaagucucugaaauguucguuuuuaggcaauaua

SEQ ID NO: 373196 - RNA, 62 nt, Human
ccuccacaguggcucccagagguuccacacacucucugaagcuccuucucccacacugcacc

SEQ ID NO: 373197 - RNA, 55 nt, Human; identical to SEQ ID NO: 360330

SEQ ID NO: 373198 - RNA, 62 nt, Human
aauuauucuccacaauauuaccaugcaaguuaucucugaaauuuaaaauguuaaagaaaaac

SEQ ID NO: 373199 - RNA, 62 nt, Human
ccucaguauguuaaacagguaauguaagaaguucucugaaaugucagcaaguaaguucugaa

SEQ ID NO: 373200 - RNA, 62 nt, Human
uaaucaggaaauaaacuugacuuuucuauuuuucucugaagcuuuacaggacauacucccac

SEQ ID NO: 373201 - RNA, 62 nt, Human
uuaagaagauaaauccaguuaucagcuuccugucucugaaguuuggaucauuuuauagaucc

SEQ ID NO: 373202 - RNA, 62 nt, Human
aaaauaucucacccaagacuuaaaggaagaauucucugaagggauaaagauuacuaaaaaaa

SEQ ID NO: 373203 - RNA, 62 nt, Human
aaugauuuacucugaagaaacaaacaaugguaucucugaaacucacaaccuaaagcccaauc

SEQ ID NO: 373204 - RNA, 62 nt, Human
ugggaguaugucagcaugaucgaacugaaggaucucugaaaggccacagcuggagcaauuug

SEQ ID NO: 373205 - RNA, 62 nt, Human
gagggauuuaaacagcuccuuuggcacgugccucucugaauccagccugccauuccaucaaa

SEQ ID NO: 373206 - RNA, 62 nt, Human
agggagugugauuuuguuggaggugcacauggucucugaauuugacagagaacaccuucccu

SEQ ID NO: 373207 - RNA, 62 nt, Human
ggccccugauggcgucccugcugguuuucaauucucugaagccuuguguagcuuucagagca

SEQ ID NO: 373208 - RNA, 62 nt, Human
cagccccacaacuuuaaacauugacgauuccuucucugaacacaggcagcuuucuagaaguu

SEQ ID NO: 373209 - RNA, 62 nt, Human
ugaugcuccaugucugaauuucguccagccucucucugaacugugaucuuuguccucaugaa

SEQ ID NO: 373210 - RNA, 50 nt, Human; identical to SEQ ID NO: 360345

SEQ ID NO: 373211 - RNA, 62 nt, Human
uuuuguuucaucaacuaagaugcacuguaacaucucugaaaucuggauauauuaucaauggu

SEQ ID NO: 373212 - RNA, 62 nt, Human
aaauuuauguagugaguaaaguugcucucuagucucugaaaagcaaaaaaagugagaaaaua

SEQ ID NO: 373213 - RNA, 62 nt, Human
ugggggaagggguaugugucacuaauagaauaucucugaagcuggauugauacggggaaaac

SEQ ID NO: 373214 - RNA, 62 nt, Human
gucucaaggucauuccccucuucccucaagacucucugaaugcugcuccacugucuuuuguc

SEQ ID NO: 373215 - RNA, 62 nt, Human
gccugugggcaacguucuuuugagccaagacuucucugaauggcccugcugguggaaggggu

SEQ ID NO: 373216 - RNA, 62 nt, Human
auggcucuuagccagaaaugucuugccucuggucucugaaaagcuggggugagugguuaccu

SEQ ID NO: 373217 - RNA, 62 nt, Human
ugcugguguguauuuuuguaaauguuaugcacucucugaaaggaaaaacacacacaaaagaa

SEQ ID NO: 373218 - RNA, 62 nt, Human
cauuccuaaucuuggucucuauagcaguguucucucugaaugcugagcugaagaaauuauac

SEQ ID NO: 373219 - RNA, 62 nt, Human
agaaagucauguauuuguucgcaauuaugcuuucucugaauuuaauaaaaauauuccuaaug

SEQ ID NO: 373220 - RNA, 62 nt, Human
ucuugucuuucuucccugcuuugcugcuuugcucucugaaaccuacauuccgucaguuuccg

SEQ ID NO: 373221 - RNA, 62 nt, Human
gccuacacagagaaccguucguguugggcuucucucugaacgccccgaaccuugcaucaagg

SEQ ID NO: 373222 - RNA, 62 nt, Human
uuuccuaaauggaaaaugggaaggagauacugucucugaacaaaaauagcuggaaaaacaca

SEQ ID NO: 373223 - RNA, 62 nt, Human
ugggcccagccccaaagggcagugaauggccuucucugaaacccugcgucaagcagugggag

SEQ ID NO: 373224 - RNA, 62 nt, Human
uguaguguccauggguucuucaugugcuaugaucucugaaaagacguuaucaccuuaaagcu

SEQ ID NO: 373225 - RNA, 62 nt, Human
ccaccaggagggggaauucauccuccgggucuucucugaaaagaggaaccucucugagugag

SEQ ID NO: 373226 - RNA, 62 nt, Human
gaacugcuuuuuacacauuuaauaaaaaaaggucucugaauuaucugaugucauuuaucaag

SEQ ID NO: 373227 - RNA, 62 nt, Human
auuuaccuguauuguaaguacccacaucugugucucugaaguccuuugaaacaucucauuau

SEQ ID NO: 373228 - RNA, 62 nt, Human
acugcagcacaccuagagggcccuuuccugcuucucugaaagcacaggucacccagccucag

SEQ ID NO: 373229 - RNA, 62 nt, Human
guugauguuugagucuucaggaaguauuugcaucucugaaaucuuuuuuauauguguuuugc

SEQ ID NO: 373230 - RNA, 62 nt, Human
cuccaggguucucugguucucuggagcagaguucucugaauaccccaucccccaacugcuga

SEQ ID NO: 373231 - RNA, 62 nt, Human
agaucauaagaaauccuuuaagaguuuaaaugucucugaaacaggcauacaggcucuaguca

SEQ ID NO: 373232 - RNA, 62 nt, Human
uguuguccacagucuucaggcagcuccccaggucucugaaccccagagugucaucauuggag

SEQ ID NO: 373233 - RNA, 62 nt, Human
acuuuagauucuuauugaauucauaauacuuaucucugaaaaugucuuugacuguaaauuua

SEQ ID NO: 373234 - RNA, 62 nt, Human
aaaucuuuguacagcuuuaaguugugucagauucucugaaaacauuuuuuagaaagcaaaau

SEQ ID NO: 373235 - RNA, 62 nt, Human
ugaugucacugugccacuuggacagggcguuuucucugaauugaagggaaagccaauggugu

SEQ ID NO: 373236 - RNA, 62 nt, Human
uuauuaaagcuuaauugccaugccguuuaucuucucugaaagaacuucaaaucuuaccugcc

SEQ ID NO: 373237 - RNA, 62 nt, Human
uucacccuacauuccucuccucuucacuagccucucugaagguguccuggccagcccuggag

SEQ ID NO: 373238 - RNA, 62 nt, Human
accuggaauggagacuuuuaucuacuucucucucucugaagaugucaaaucgugguuuagau

SEQ ID NO: 373239 - RNA, 62 nt, Human
ggaacaggcaaggaugggggccugggcuguccucucugaaugccuuggagggaucccaggaa

SEQ ID NO: 373240 - RNA, 62 nt, Human
cuuugauugugaaguagccccaaaugaugucgucucugaagugggaauauuuuacagaauag

SEQ ID NO: 373241 - RNA, 62 nt, Human
cuucacuguguguuuucuaucucggaucccagucucugaagacaacuugcuuugauucaacc

SEQ ID NO: 373242 - RNA, 62 nt, Human
cagcugcgguccacccaggagccccgaggccuucucugaaggacauugcggacagccacggc

SEQ ID NO: 373243 - RNA, 62 nt, Human
uuuauggaaaucauugaaggucuggaucccuuucucugaauggagagauugagagggauguc

SEQ ID NO: 373244 - RNA, 62 nt, Human
gucccaaagguggaauacaaccagaggucucaucucugaacuuucuugcguacugauuacau

SEQ ID NO: 373245 - RNA, 62 nt, Human
auucaugcuuuuuaaauucagccagcccccccucucugaaauuuuauuauguaaauaauuug

SEQ ID NO: 373246 - RNA, 62 nt, Human
ccuauggucucaacugugcuugaaaaacacugucucugaaaacaacuuugugauucucccug

SEQ ID NO: 373247 - RNA, 62 nt, Human
ccaaacuacuugaaaagggcauuuggcaccacucucugaaacaacacagucacucuagcaag

SEQ ID NO: 373248 - RNA, 62 nt, Human
gaggggaccugcucagcaggugugaccaggguucucugaaucuguuauuguuuuugcuucug

SEQ ID NO: 373249 - RNA, 62 nt, Human
ugaacauguacagacuuuuuucuugucauuauucucugaacaauacaagaacucuuuaugua

SEQ ID NO: 373250 - RNA, 62 nt, Human
aaggcuuaaggacaacaguuucuaaccaaguuucucugaauccuuuccugagaggugguggg

SEQ ID NO: 373251 - RNA, 62 nt, Human
augcugaggaugauugaggugggucuaccucaucucugaaaauucuggaaggaauggaggag

SEQ ID NO: 373252 - RNA, 62 nt, Human
caucuuguaauauccagagcuacuuuauaaauucucugaaccaaaaguauuuuccucagugu

SEQ ID NO: 373253 - RNA, 62 nt, Human
uugcugccaccuggugucagccucagucacuuucucugaaugcuucugagccuugccuacau

SEQ ID NO: 373254 - RNA, 62 nt, Human
uccccguuugucaaagaggauggacuaaaugaucucugaaaguguugaagcgcggacccuuc

SEQ ID NO: 373255 - RNA, 62 nt, Human
gccuccaggaggugagcccugggugcagcuggucucugaaugacguuacacccucaccuucu

SEQ ID NO: 373256 - RNA, 62 nt, Human
agcucagguuuuuuuauuugaacuggguugaaucucugaagaaaucuguucaagaccaugcu

SEQ ID NO: 373257 - RNA, 62 nt, Human
cuaggacuuugggguuaggccauggggcucuuucucugaaggccacuuuccugacguacucu

SEQ ID NO: 373258 - RNA, 62 nt, Human
gaggaacaggguugccucuuggcuggguggagucucugaaauguuagaagaagcgcugaagc

SEQ ID NO: 373259 - RNA, 62 nt, Human
gcagccuuccaugaggcagaaggggucgucguucucugaaaacagugacucugaaauguugg

SEQ ID NO: 373260 - RNA, 62 nt, Human
guugaucuaugaccuuacccccaaccuggugcucucugaaacaugugcuguguccacucagg

SEQ ID NO: 373261 - RNA, 62 nt, Human
gaucaucccagagguucaggcaguuccugucaucucugaaaagacugggggauaugaaaucu

SEQ ID NO: 373262 - RNA, 62 nt, Human
agauuccuuuccuauccauccuuccauccaguucucugaaucuuuaaugaaaucauuugcca

SEQ ID NO: 373263 - RNA, 62 nt, Human
uaccuuucuaggucaaggccugucccuggccaucucugaacuucagcuagagcuucaagucu

SEQ ID NO: 373264 - RNA, 62 nt, Human
ccauggaagauugagagcccaagguuuaaacuucucugaagggagguggggaugagaagagg

SEQ ID NO: 373265 - RNA, 62 nt, Human
augcuaaugaaaucauaguauuuuguguagcuucucugaagaccuuagagaucugcagcuuu

SEQ ID NO: 373266 - RNA, 62 nt, Human
ggccuggagaggggaggcaggggccccugugcucucugaacaaguugaaaguccaaauaaaa

SEQ ID NO: 373267 - RNA, 62 nt, Human
aguuaaucagcaaccugacucaggccagugugucucugaaacggauccagcaauuccugagc

SEQ ID NO: 373268 - RNA, 62 nt, Human
gucgaucuaguucaguucaacucaguggauguucucugaaugcuuacugggugccaggacca

SEQ ID NO: 373269 - RNA, 62 nt, Human
acguuccccaggcccauaacagaggacuaaaaucucugaauuuuaaagacacagaugacugg

SEQ ID NO: 373270 - RNA, 62 nt, Human
auuuguguaaauuuguauccacacaaauucagucucugaauacacaguauucagagucucug

SEQ ID NO: 373271 - RNA, 62 nt, Human
aagguucaucuguccaugcaguccucuuggauucucugaauguaguaacuaugaagcuaugc

SEQ ID NO: 373272 - RNA, 62 nt, Human
uccccgaaaaaggguguuuugaugccucagggucucugaaaucucccgggaagccccagagc

SEQ ID NO: 373273 - RNA, 62 nt, Human
cucaagcccuuaaccucuguaagccuguuucuucucugaaaucacaguaauaaagcgucgua

SEQ ID NO: 373274 - RNA, 62 nt, Human
uccugacuugccuuauuuauuuguucgacgcgucucugaauguauccgccucgguucccacc

SEQ ID NO: 373275 - RNA, 62 nt, Human
uuggauguugcccuuaguucuuguuuaaugucucucugaaugcaguuuuaaaauagaaaaca

SEQ ID NO: 373276 - RNA, 62 nt, Human
gaugugccuuuauccucuaaugccccaaucucucucugaacacccccauucuccaccuguug

SEQ ID NO: 373277 - RNA, 62 nt, Human
ugaugguagcuggcuuuugaaauccuauggggucucugaaugaaaacauucuccagcugcuc

SEQ ID NO: 373278 - RNA, 62 nt, Human
accuacuuaaguuguucacuuuacuugccuggucucugaaggcauuugaguuugccucuucu

SEQ ID NO: 373279 - RNA, 62 nt, Human
ccagccuaccuucucucacagggggacccaauucucugaagucuacgauggagcauuuuuug

SEQ ID NO: 373280 - RNA, 62 nt, Human
aaguuuggaucugcuccucgucaggcgcagcaucucugaagcuuggaaagcugucuuccagc

SEQ ID NO: 373281 - RNA, 62 nt, Human
aggaaaagcggacaucagcuggucaaacaaacucucugaaccccucccuccaucguuuucuu

SEQ ID NO: 373282 - RNA, 62 nt, Human
uuugcuuauuuucaauugccuaggucacagugucucugaacuguucaucccuugaccaccuc

SEQ ID NO: 373283 - RNA, 62 nt, Human
acccucuaccaaaugaauacaaguuugaauuuucucugaaauaugucaaccccauguucccu

SEQ ID NO: 373284 - RNA, 62 nt, Human
uggaauucuguuuguuaaaucaaauuagcuggucucugaauuaagggggagacgaccuucuc

SEQ ID NO: 373285 - RNA, 62 nt, Human
auucuuaaccccauggacuccuuucccuuucuucucugaaaaaaacuaauuuaaauuugcuu

SEQ ID NO: 373286 - RNA, 62 nt, Human
ugaggaugucauggagaaugcuuaauuuucuuucucugaacuucaaaauauuaaauauuuuc

SEQ ID NO: 373287 - RNA, 62 nt, Human
ccucaaugaaauggagcuggcucacucuuccuucucugaaaugcagacagcugugagugaca

SEQ ID NO: 373288 - RNA, 62 nt, Human
uggcuuuguuuucagucuauuucuaggagcuuucucugaaucgcuaauuguccuuucaguug

SEQ ID NO: 373289 - RNA, 62 nt, Human
agcugcucagggugcccucuccugcggaccagucucugaauguucaaagaugagggccuggc

SEQ ID NO: 373290 - RNA, 62 nt, Human
gagaauuuuuauuuuguaauagaagugaacugucucugaagggugaaggcaggccguccugg

SEQ ID NO: 373291 - RNA, 62 nt, Human
gaaggagggcgucgccggaaacccagggaaccucucugaagugacaccucaccccuacacac

SEQ ID NO: 373292 - RNA, 62 nt, Human
aaguaaaagaaauauaggaauauuccagucaaucucugaaauguuuaugaaaaacagguuaa

SEQ ID NO: 373293 - RNA, 62 nt, Human
ccuagaagaauccauccaaaucccugccuuccucucugaaccaacaguucccuucucugaca

SEQ ID NO: 373294 - RNA, 62 nt, Human
cuacugcuuuagaaugaagucguauaauaaagucucugaaaaggccuuauucagaauaagca

SEQ ID NO: 373295 - RNA, 62 nt, Human
uucacuuuugcuucuggggcuggcaaaaaccuucucugaacccacacaccaaguucguaguu

SEQ ID NO: 373296 - RNA, 62 nt, Human
ucuuagccauuccguccugcuccccagcucacucucugaagcacacaucauuggcuuuccua

SEQ ID NO: 373297 - RNA, 62 nt, Human
agaggacucagauuuccuggaggcaaagucuaucucugaaacuccaugaagacuuuugcagc

SEQ ID NO: 373298 - RNA, 62 nt, Human
gcugaccgaugacccuggaacuccacggugccucucugaaucucuguuauggaucccccacu

SEQ ID NO: 373299 - RNA, 62 nt, Human
ccauaagagcaguagcuuuugaaacucauaauucucugaaauaaaugaaagacauuuaauuc

SEQ ID NO: 373300 - RNA, 62 nt, Human
caugcaugaagagaugaguguguucuaauaagucucugaaagccaguggcuuuaugacuuuu

SEQ ID NO: 373301 - RNA, 62 nt, Human
agggcuuuguccaguuaucuucauaugacuguucucugaaaaaaggucuuacuaccugauau

SEQ ID NO: 373302 - RNA, 62 nt, Human
cuaacacaguuauuccuauacuggauuuuaggucucugaagaacugcugguguuuaggaaua

SEQ ID NO: 373303 - RNA, 62 nt, Human
acaugauaucuuugcuuuugaguuccucacgcucucugaauuuuauuaguuggacaauucca

SEQ ID NO: 373304 - RNA, 62 nt, Human
ugauuuagaaagacugcgugagucuuauuuauucucugaaacacagcccaaguuucauguua

SEQ ID NO: 373305 - RNA, 62 nt, Human
augaagacuucauugggcaugaaugagucaagucucugaagcgguggccacuucuuggacau

SEQ ID NO: 373306 - RNA, 62 nt, Human
cccagcccccacccccaguuaacacugcugcuucucugaaugcaugucacgcugcaccccau

SEQ ID NO: 373307 - RNA, 62 nt, Human
caaucuuccaagggugccagccccuccguucaucucugaaacccagcauccuuuucagcugc

SEQ ID NO: 373308 - RNA, 62 nt, Human
ucagucgugugauuugcaagucuucuuccuagucucugaaguuucuuucuuucauagagcaa

SEQ ID NO: 373309 - RNA, 62 nt, Human
uccaucucaagaaaaaauaaaaauaaaguuguucucugaagagcaaaugucucauuccagua

SEQ ID NO: 373310 - RNA, 62 nt, Human
cccucccaagacuaaaccaggaagaaguugaaucucugaauagaccaauaacagccucuggg

SEQ ID NO: 373311 - RNA, 62 nt, Human
ugaauacuuuaauaucagcuuguuuugugaauucucugaauacugucaacacucuuaucuaa

SEQ ID NO: 373312 - RNA, 62 nt, Human
gauuaaacuuccauuuauaaagucagaaccuaucucugaaaauuaaugugagaaagaaaucu

SEQ ID NO: 373313 - RNA, 62 nt, Human
uaggggauggaggugagaauacuccuugguuuucucugaagcccacccuuucccccaacucu

SEQ ID NO: 373314 - RNA, 62 nt, Human
uaauuucguccucuccuucggaacacuggcugucucugaagacuucucgcucaguuucagug

SEQ ID NO: 373315 - RNA, 62 nt, Human
gaaaauaaggaacaaagagaaacuuguaauggucucugaaaaggaauugagaaguaauuccu

SEQ ID NO: 373316 - RNA, 62 nt, Human
aaguuucuaucuugugucacuauccaucucauucucugaauacuuauccaggauuaagauac

SEQ ID NO: 373317 - RNA, 62 nt, Human
agaaaggccuuagggugacagguuauguacugucucugaaucaauaugaccucacuuaaaac

SEQ ID NO: 373318 - RNA, 62 nt, Human
ccuaagcugcucucccuuggaaccugcacagcucucugaaauggggcauuuuguugggacca

SEQ ID NO: 373319 - RNA, 62 nt, Human
agcuccuaccucugaccccaacuucucuuugaucucugaauccccucugacuccaacuucuc

SEQ ID NO: 373320 - RNA, 62 nt, Human
ggcuucugaccuuugauccgcuaggccccccaucucugaacccuagagccccgcuuucccuc

SEQ ID NO: 373321 - RNA, 62 nt, Human
gaaugugggaaaaccuaaaggugucccuguucucucugaagacaugaaaacucacuggggag

SEQ ID NO: 373322 - RNA, 62 nt, Human
aaaccauuuucucucuuucgguaauagaaaaaucucugaaagacuuuacugaccaaucagcc

SEQ ID NO: 373323 - RNA, 62 nt, Human
cggugguggcuggugguuuaaagguugaacuuucucugaagcuccuuuccccuugcucuugg

SEQ ID NO: 373324 - RNA, 62 nt, Human
aagggaggugaguggguggaggcagggugacgucucugaacccaaaacccugacggccucuc

SEQ ID NO: 373325 - RNA, 62 nt, Human
ccagccugggcaacauagcaagacccccaccaucucugaaaaaaaaaauuagccaggcaugg

SEQ ID NO: 373326 - RNA, 62 nt, Human
agaauuuggagaugguucugcccacucugguuucucugaaaaaacgagguaauucccugagc

SEQ ID NO: 373327 - RNA, 62 nt, Human
uccuuggucccuucagggaagcccucaacucaucucugaacuuagaaucucauccuuagggc

SEQ ID NO: 373328 - RNA, 62 nt, Human
ucuuuuguauuugucuuuauacuuugcugaauucucugaaauaccuauuacuguauguugcu

SEQ ID NO: 373329 - RNA, 62 nt, Human
caugcuguugcgccuggcacgcccagccaaacucucugaacucauccagccccuuccccugg

SEQ ID NO: 373330 - RNA, 62 nt, Human
cugcugugugacuuugggcaagccaagugcccucucugaaccucaguuuccucaucugcaaa

SEQ ID NO: 373331 - RNA, 62 nt, Human
cacacacacacacacacacagucaaauacuguucucugaaaaaugaugucccaaaaguauua

SEQ ID NO: 373332 - RNA, 62 nt, Human
aucaaagcugaggacagggugugagcgccacaucucugaaagcacaggagacacugugcuau

SEQ ID NO: 373333 - RNA, 62 nt, Human
uggaucuauuuuagaugagcccagguaagaccucucugaagagcugucaugaaggagggagg

SEQ ID NO: 373334 - RNA, 62 nt, Human
aguaaaugaaucccaccuuuacuaaaacacuuucucugaaccccccuugccccucacugauc

SEQ ID NO: 373335 - RNA, 62 nt, Human
gguccauguguuggguuuggccuuaguagaaaucucugaaggcagcagccaucauccucuuc

SEQ ID NO: 373336 - RNA, 62 nt, Human
aauuucacacauuuagccaaucuuucuagaugucucugaagguaagaucauuuaauaucuuu

SEQ ID NO: 373337 - RNA, 62 nt, Human
uuuucuauuguagauacuuugucccuugcacuucucugaaucuguccuuuuguggauucuug

SEQ ID NO: 373338 - RNA, 62 nt, Human
aagcuuuuuuuuuuugaaccccauucuuuccuucucugaaaguggugcuauaaguuuuagaa

SEQ ID NO: 373339 - RNA, 62 nt, Human
auguggacauuuugguugcagcuaaaaaucagucucugaagucucucucccuucuagagguu

SEQ ID NO: 373340 - RNA, 62 nt, Human
gauugcucucacagcccaggcccaucgucuguucucugaaugcagcccuguucucaacaaca

SEQ ID NO: 373341 - RNA, 62 nt, Human
ucuugucagauuucaucuguauaccuucaaauucucugaaaguaaaaauaaaaguuuuuaaa

SEQ ID NO: 373342 - RNA, 62 nt, Human
agugauucccauugguguaggaaaugagacccucucugaagcugaggagagcacguugaucu

SEQ ID NO: 373343 - RNA, 62 nt, Human
gagguuugucuacccacagugucauggaaucuucucugaaaacuaauccauaaaguucccug

SEQ ID NO: 373344 - RNA, 62 nt, Human
aagccucugcaauuuuaacuucucaaaggaugucucugaaaagaaucacuuuaaaccaaugc

SEQ ID NO: 373345 - RNA, 62 nt, Human
ccucguaggugcgaggucagaagccagcaggcucucugaacuccugccaggcaguccccaca

SEQ ID NO: 373346 - RNA, 62 nt, Human
ucggccgaggccugcgcccugacaugcuaaccucucugaacugcaacacuggauuguucuuu

SEQ ID NO: 373347 - RNA, 62 nt, Human
uuuauuuauucuguucccccagcucggccacuucucugaaggagggcuggguucugggccug

SEQ ID NO: 373348 - RNA, 62 nt, Human
agcccacgguccccucagcagggaugcgauggucucugaaucagugugcagcugggguccca

SEQ ID NO: 373349 - RNA, 62 nt, Human
uaguacauucuccaagaugcagcccaggagccucucugaaggaccagucugguuacgauggu

SEQ ID NO: 373350 - RNA, 62 nt, Human
cucaauuuaaaacaagagagaaccagacugagucucugaagaccacagggacagggucucuu

SEQ ID NO: 373351 - RNA, 62 nt, Human
gggcuugguuuuuccuuguugugaaaucgacaucucugaagacagguuauuuuauaaaagau

SEQ ID NO: 373352 - RNA, 62 nt, Human
ugggaaggaaaauauugagcuaggcacauuacucucugaacgaaauucauauuaucuuauua

SEQ ID NO: 373353 - RNA, 62 nt, Human
uuuaaaaaggauauaggaaccugcauugucauucucugaauuaagaacugaugguuucuauc

SEQ ID NO: 373354 - RNA, 62 nt, Human
guucauccaacgugaagauaccauaagcuuuuucucugaaccagagaaaugaaagucaguuu

SEQ ID NO: 373355 - RNA, 61 nt, Human
auuugaaaauucucucaauaaaguuugaguuuucucugaagaagucaugcgugucuuuugu

SEQ ID NO: 373356 - RNA, 62 nt, Human
ugaucauuuuauccauaaauauucuuuauauaucucugaaagcuaugggaugauauggaaaa

SEQ ID NO: 373357 - RNA, 62 nt, Human
aauggcucuguauaaucuauggcuauccgaauucucugaaaaaauaauaaaaguccccucua

SEQ ID NO: 373358 - RNA, 62 nt, Human
gaaugagguugugaucuuuccuguccugacccucucugaauuauguuucaauaguacucuug

SEQ ID NO: 373359 - RNA, 62 nt, Human
cagcucuccgucugugucccacccaugcagacucucugaauaaccuagccaauaucaaacga

SEQ ID NO: 373360 - RNA, 62 nt, Human
acauaaaugaagaugcuugugauuccaguuuaucucugaaacuauucaacauggaguuauuu

SEQ ID NO: 373361 - RNA, 62 nt, Human
uuagauuaaaaaugagguagguugaaguuucuucucugaaaugauagauaaauggugaagau

SEQ ID NO: 373362 - RNA, 62 nt, Human
agggagcucucauagauacuaguugaaaaaagucucugaacaauucucucuaauacauauuu

SEQ ID NO: 373363 - RNA, 62 nt, Human
uguuucacaaaauuaaguguuguucauuauacucucugaaauauagguuuaauuucaaauag

SEQ ID NO: 373364 - RNA, 62 nt, Human
cauuccagccugggugacagagugagauccugucucugaagaaaaaaaaaaccugccuggca

SEQ ID NO: 373365 - RNA, 62 nt, Human
ucccugagcccaccucccagcccucuccucauucucugaacccacuguggugagaagaauuu

SEQ ID NO: 373366 - RNA, 62 nt, Human
aaauuuguacuaccuaaaagucccagugcaugucucugaauguguaagcuauauaaaugcua

SEQ ID NO: 373367 - RNA, 62 nt, Human
aauaagugguagaagagugucacugaauuuugucucugaauucaguauaacugaguuuuguc

SEQ ID NO: 373368 - RNA, 62 nt, Human
ucuuucuucccgccucuccagguugacagccuucucugaacgaccucuccauuacucucaug

SEQ ID NO: 373369 - RNA, 62 nt, Human
aguggacacucuuuuuuccuaauuauaacucaucucugaaugcauugugccaaucaagagua

SEQ ID NO: 373370 - RNA, 62 nt, Human
agcuucuuacacuacuauauuugcuuauuuugucucugaauaagcuuuaggcaccacaaggg

SEQ ID NO: 373371 - RNA, 62 nt, Human
agugagaagcuguugucacgacuaaccuucugucucugaaauuguuuguuucaaauaaagag

SEQ ID NO: 373372 - RNA, 62 nt, Human
aucagaaauauuuuuaaaaaauacaauuuagaucucugaaaauuggaaccacucaagaguau

SEQ ID NO: 373373 - RNA, 62 nt, Human
ucuucagcacccucccauguaccuuauaucccucucugaaacagaacagcuccaauagcaac

SEQ ID NO: 373374 - RNA, 62 nt, Human
caccacuaucuggagauuucgacguguuuuccucucugaaucuguuaugaacacguugguug

SEQ ID NO: 373375 - RNA, 62 nt, Human
uuuuggcgcugcuucucauucauuuuaaggcuucucugaauugugcucauuccaaauuaacc

SEQ ID NO: 373376 - RNA, 62 nt, Human
acuccaaccuagguaacagagagacaccucugucucugaaaaaacaaaacuugaaguuugaa

SEQ ID NO: 373377 - RNA, 62 nt, Human
gguggagaaaggaguuucuuuagcugacagaaucucugaauuuuaaaucacuuaguaagcgg

SEQ ID NO: 373378 - RNA, 64 nt, Human
cccagcuggccuugucccaggggcgacggcugccccggacgacugcgcugggcaccgcaugucc

SEQ ID NO: 373379 - RNA, 64 nt, Human
aaaagcccagaaacuuucgaacaaaaccaaacacccggacgacccucuccggugagcggcgaag

SEQ ID NO: 373380 - RNA, 64 nt, Human
gaaauugccuauacagucuuagugaccauuuaaaccggacgaacuagguguuuaauuuucacuc

SEQ ID NO: 373381 - RNA, 64 nt, Human
cugacguauagucaucuaccaccugcgguccuggccggacgaaacacacguguugcaucucaag

SEQ ID NO: 373382 - RNA, 52 nt, Human
ugguccugagaaagaaauaaggccggacgaguucauggggaucuggggggug

SEQ ID NO: 373383 - RNA, 64 nt, Human
ugggaaaagucaacuccgaugccaccauugcgggccggacgaaggaugcuuucuuccuagaggc

SEQ ID NO: 373384 - RNA, 64 nt, Human
gugugggaaagcucuugagcugggcacuggccccccggacgagguggcuguguguucacacaca

SEQ ID NO: 373385 - RNA, 64 nt, Human
agagggacacuggcauuccauuugucagagcaucccggacgaugcagagggugggagaacuaca

SEQ ID NO: 373386 - RNA, 64 nt, Human
aagcagguucuucccuccaggaaaugaggaccggccggacgaugcccugcagacugcucugaag

SEQ ID NO: 373387 - RNA, 64 nt, Human
gugaagaagugaaaccuuucccuuuucccaucugccggacgaaccacaacagcguuccccauga

SEQ ID NO: 373388 - RNA, 64 nt, Human
gaguggguuuccuuuccuccccuauucccggggcccggacgacuucugcuugggaacugccaac

SEQ ID NO: 373389 - RNA, 64 nt, Human; identical to SEQ ID NO: 94676

SEQ ID NO: 373390 - RNA, 64 nt, Human; identical to SEQ ID NO: 94677

SEQ ID NO: 373391 - RNA, 59 nt, Human; identical to SEQ ID NO: 94678

SEQ ID NO: 373392 - RNA, 64 nt, Human; identical to SEQ ID NO: 94679

SEQ ID NO: 373393 - RNA, 64 nt, Human; identical to SEQ ID NO: 94680

SEQ ID NO: 373394 - RNA, 64 nt, Human; identical to SEQ ID NO: 94681

SEQ ID NO: 373395 - RNA, 64 nt, Human; identical to SEQ ID NO: 94682

SEQ ID NO: 373396 - RNA, 64 nt, Human; identical to SEQ ID NO: 94683

SEQ ID NO: 373397 - RNA, 64 nt, Human; identical to SEQ ID NO: 94684

SEQ ID NO: 373398 - RNA, 64 nt, Human; identical to SEQ ID NO: 94685

SEQ ID NO: 373399 - RNA, 64 nt, Human; identical to SEQ ID NO: 94686

SEQ ID NO: 373400 - RNA, 64 nt, Human; identical to SEQ ID NO: 94687

SEQ ID NO: 373401 - RNA, 64 nt, Human; identical to SEQ ID NO: 94688

SEQ ID NO: 373402 - RNA, 64 nt, Human; identical to SEQ ID NO: 94689

SEQ ID NO: 373403 - RNA, 64 nt, Human; identical to SEQ ID NO: 94690

SEQ ID NO: 373404 - RNA, 64 nt, Human; identical to SEQ ID NO: 94691

SEQ ID NO: 373405 - RNA, 64 nt, Human; identical to SEQ ID NO: 94692

SEQ ID NO: 373406 - RNA, 64 nt, Human; identical to SEQ ID NO: 94693

SEQ ID NO: 373407 - RNA, 64 nt, Human; identical to SEQ ID NO: 94694

SEQ ID NO: 373408 - RNA, 64 nt, Human; identical to SEQ ID NO: 94695

SEQ ID NO: 373409 - RNA, 64 nt, Human; identical to SEQ ID NO: 94696

SEQ ID NO: 373410 - RNA, 64 nt, Human; identical to SEQ ID NO: 94697

SEQ ID NO: 373411 - RNA, 64 nt, Human; identical to SEQ ID NO: 94698

SEQ ID NO: 373412 - RNA, 64 nt, Human; identical to SEQ ID NO: 94699

SEQ ID NO: 373413 - RNA, 64 nt, Human; identical to SEQ ID NO: 94700

SEQ ID NO: 373414 - RNA, 64 nt, Human; identical to SEQ ID NO: 94701

SEQ ID NO: 373415 - RNA, 64 nt, Human; identical to SEQ ID NO: 94702

SEQ ID NO: 373416 - RNA, 64 nt, Human; identical to SEQ ID NO: 94703

SEQ ID NO: 373417 - RNA, 64 nt, Human; identical to SEQ ID NO: 94704

SEQ ID NO: 373418 - RNA, 64 nt, Human; identical to SEQ ID NO: 94705

SEQ ID NO: 373419 - RNA, 64 nt, Human; identical to SEQ ID NO: 94706

SEQ ID NO: 373420 - RNA, 64 nt, Human; identical to SEQ ID NO: 94707

SEQ ID NO: 373421 - RNA, 64 nt, Human; identical to SEQ ID NO: 94708

SEQ ID NO: 373422 - RNA, 64 nt, Human; identical to SEQ ID NO: 94709

SEQ ID NO: 373423 - RNA, 64 nt, Human; identical to SEQ ID NO: 94710

SEQ ID NO: 373424 - RNA, 64 nt, Human; identical to SEQ ID NO: 94711

SEQ ID NO: 373425 - RNA, 64 nt, Human; identical to SEQ ID NO: 94712

SEQ ID NO: 373426 - RNA, 64 nt, Human; identical to SEQ ID NO: 94713

SEQ ID NO: 373427 - RNA, 64 nt, Human; identical to SEQ ID NO: 94714

SEQ ID NO: 373428 - RNA, 64 nt, Human; identical to SEQ ID NO: 94715

SEQ ID NO: 373429 - RNA, 64 nt, Human; identical to SEQ ID NO: 94716

SEQ ID NO: 373430 - RNA, 64 nt, Human; identical to SEQ ID NO: 94717

SEQ ID NO: 373431 - RNA, 64 nt, Human; identical to SEQ ID NO: 94718

SEQ ID NO: 373432 - RNA, 64 nt, Human; identical to SEQ ID NO: 94719

SEQ ID NO: 373433 - RNA, 64 nt, Human; identical to SEQ ID NO: 94720

SEQ ID NO: 373434 - RNA, 64 nt, Human; identical to SEQ ID NO: 94721

SEQ ID NO: 373435 - RNA, 64 nt, Human; identical to SEQ ID NO: 94722

SEQ ID NO: 373436 - RNA, 64 nt, Human; identical to SEQ ID NO: 94723

SEQ ID NO: 373437 - RNA, 64 nt, Human; identical to SEQ ID NO: 94724

SEQ ID NO: 373438 - RNA, 64 nt, Human; identical to SEQ ID NO: 94725

SEQ ID NO: 373439 - RNA, 64 nt, Human; identical to SEQ ID NO: 94726

SEQ ID NO: 373440 - RNA, 64 nt, Human; identical to SEQ ID NO: 94727

SEQ ID NO: 373441 - RNA, 64 nt, Human; identical to SEQ ID NO: 94728

SEQ ID NO: 373442 - RNA, 64 nt, Human; identical to SEQ ID NO: 94729

SEQ ID NO: 373443 - RNA, 64 nt, Human; identical to SEQ ID NO: 94730

SEQ ID NO: 373444 - RNA, 64 nt, Human; identical to SEQ ID NO: 94731

SEQ ID NO: 373445 - RNA, 64 nt, Human; identical to SEQ ID NO: 94732

SEQ ID NO: 373446 - RNA, 64 nt, Human; identical to SEQ ID NO: 94733

SEQ ID NO: 373447 - RNA, 64 nt, Human; identical to SEQ ID NO: 94734

SEQ ID NO: 373448 - RNA, 64 nt, Human; identical to SEQ ID NO: 94735

SEQ ID NO: 373449 - RNA, 64 nt, Human; identical to SEQ ID NO: 94736

SEQ ID NO: 373450 - RNA, 64 nt, Human; identical to SEQ ID NO: 94737

SEQ ID NO: 373451 - RNA, 64 nt, Human; identical to SEQ ID NO: 94738

SEQ ID NO: 373452 - RNA, 64 nt, Human; identical to SEQ ID NO: 94739

SEQ ID NO: 373453 - RNA, 64 nt, Human; identical to SEQ ID NO: 94740

SEQ ID NO: 373454 - RNA, 64 nt, Human; identical to SEQ ID NO: 94741

SEQ ID NO: 373455 - RNA, 64 nt, Human; identical to SEQ ID NO: 94742

SEQ ID NO: 373456 - RNA, 64 nt, Human; identical to SEQ ID NO: 94743

SEQ ID NO: 373457 - RNA, 64 nt, Human; identical to SEQ ID NO: 94744

SEQ ID NO: 373458 - RNA, 64 nt, Human; identical to SEQ ID NO: 94745

SEQ ID NO: 373459 - RNA, 64 nt, Human; identical to SEQ ID NO: 94746

SEQ ID NO: 373460 - RNA, 64 nt, Human; identical to SEQ ID NO: 94747

SEQ ID NO: 373461 - RNA, 64 nt, Human; identical to SEQ ID NO: 94748

SEQ ID NO: 373462 - RNA, 64 nt, Human; identical to SEQ ID NO: 94749

SEQ ID NO: 373463 - RNA, 64 nt, Human; identical to SEQ ID NO: 94750

SEQ ID NO: 373464 - RNA, 64 nt, Human; identical to SEQ ID NO: 94751

SEQ ID NO: 373465 - RNA, 64 nt, Human; identical to SEQ ID NO: 94752

SEQ ID NO: 373466 - RNA, 64 nt, Human; identical to SEQ ID NO: 94753

SEQ ID NO: 373467 - RNA, 64 nt, Human; identical to SEQ ID NO: 94754

SEQ ID NO: 373468 - RNA, 64 nt, Human; identical to SEQ ID NO: 94755

SEQ ID NO: 373469 - RNA, 64 nt, Human; identical to SEQ ID NO: 94756

SEQ ID NO: 373470 - RNA, 64 nt, Human; identical to SEQ ID NO: 94757

SEQ ID NO: 373471 - RNA, 64 nt, Human; identical to SEQ ID NO: 94758

SEQ ID NO: 373472 - RNA, 64 nt, Human; identical to SEQ ID NO: 94759

SEQ ID NO: 373473 - RNA, 64 nt, Human; identical to SEQ ID NO: 94760

SEQ ID NO: 373474 - RNA, 64 nt, Human; identical to SEQ ID NO: 94761

SEQ ID NO: 373475 - RNA, 64 nt, Human; identical to SEQ ID NO: 94762

SEQ ID NO: 373476 - RNA, 64 nt, Human; identical to SEQ ID NO: 94763

SEQ ID NO: 373477 - RNA, 64 nt, Human; identical to SEQ ID NO: 94764

SEQ ID NO: 373478 - RNA, 64 nt, Human; identical to SEQ ID NO: 94765

SEQ ID NO: 373479 - RNA, 64 nt, Human; identical to SEQ ID NO: 94766

SEQ ID NO: 373480 - RNA, 64 nt, Human; identical to SEQ ID NO: 94767

SEQ ID NO: 373481 - RNA, 64 nt, Human; identical to SEQ ID NO: 94768

SEQ ID NO: 373482 - RNA, 64 nt, Human; identical to SEQ ID NO: 94769

SEQ ID NO: 373483 - RNA, 64 nt, Human; identical to SEQ ID NO: 94770

SEQ ID NO: 373484 - RNA, 64 nt, Human; identical to SEQ ID NO: 94771

SEQ ID NO: 373485 - RNA, 64 nt, Human; identical to SEQ ID NO: 94772

SEQ ID NO: 373486 - RNA, 64 nt, Human; identical to SEQ ID NO: 94773

SEQ ID NO: 373487 - RNA, 64 nt, Human; identical to SEQ ID NO: 94774

SEQ ID NO: 373488 - RNA, 64 nt, Human; identical to SEQ ID NO: 94775

SEQ ID NO: 373489 - RNA, 64 nt, Human; identical to SEQ ID NO: 94776

SEQ ID NO: 373490 - RNA, 64 nt, Human; identical to SEQ ID NO: 94777

SEQ ID NO: 373491 - RNA, 64 nt, Human; identical to SEQ ID NO: 94778

SEQ ID NO: 373492 - RNA, 64 nt, Human; identical to SEQ ID NO: 94779

SEQ ID NO: 373493 - RNA, 64 nt, Human; identical to SEQ ID NO: 94780

SEQ ID NO: 373494 - RNA, 64 nt, Human; identical to SEQ ID NO: 94781

SEQ ID NO: 373495 - RNA, 64 nt, Human; identical to SEQ ID NO: 94782

SEQ ID NO: 373496 - RNA, 64 nt, Human; identical to SEQ ID NO: 94783

SEQ ID NO: 373497 - RNA, 64 nt, Human; identical to SEQ ID NO: 94784

SEQ ID NO: 373498 - RNA, 64 nt, Human; identical to SEQ ID NO: 94785

SEQ ID NO: 373499 - RNA, 64 nt, Human; identical to SEQ ID NO: 94786

SEQ ID NO: 373500 - RNA, 64 nt, Human; identical to SEQ ID NO: 94787

SEQ ID NO: 373501 - RNA, 64 nt, Human; identical to SEQ ID NO: 94788

SEQ ID NO: 373502 - RNA, 64 nt, Human; identical to SEQ ID NO: 94789

SEQ ID NO: 373503 - RNA, 64 nt, Human; identical to SEQ ID NO: 94790

SEQ ID NO: 373504 - RNA, 64 nt, Human; identical to SEQ ID NO: 94791

SEQ ID NO: 373505 - RNA, 64 nt, Human; identical to SEQ ID NO: 94792

SEQ ID NO: 373506 - RNA, 64 nt, Human; identical to SEQ ID NO: 94793

SEQ ID NO: 373507 - RNA, 64 nt, Human; identical to SEQ ID NO: 94794

SEQ ID NO: 373508 - RNA, 64 nt, Human; identical to SEQ ID NO: 94795

SEQ ID NO: 373509 - RNA, 64 nt, Human; identical to SEQ ID NO: 94796

SEQ ID NO: 373510 - RNA, 64 nt, Human; identical to SEQ ID NO: 94797

SEQ ID NO: 373511 - RNA, 64 nt, Human; identical to SEQ ID NO: 94798

SEQ ID NO: 373512 - RNA, 64 nt, Human; identical to SEQ ID NO: 94799

SEQ ID NO: 373513 - RNA, 64 nt, Human; identical to SEQ ID NO: 94800

SEQ ID NO: 373514 - RNA, 64 nt, Human; identical to SEQ ID NO: 94801

SEQ ID NO: 373515 - RNA, 64 nt, Human; identical to SEQ ID NO: 94802

SEQ ID NO: 373516 - RNA, 64 nt, Human; identical to SEQ ID NO: 94803

SEQ ID NO: 373517 - RNA, 64 nt, Human; identical to SEQ ID NO: 94804

SEQ ID NO: 373518 - RNA, 64 nt, Human; identical to SEQ ID NO: 94805

SEQ ID NO: 373519 - RNA, 64 nt, Human; identical to SEQ ID NO: 94806

SEQ ID NO: 373520 - RNA, 64 nt, Human; identical to SEQ ID NO: 94807

SEQ ID NO: 373521 - RNA, 64 nt, Human; identical to SEQ ID NO: 94808

SEQ ID NO: 373522 - RNA, 64 nt, Human; identical to SEQ ID NO: 94809

SEQ ID NO: 373523 - RNA, 64 nt, Human; identical to SEQ ID NO: 94810

SEQ ID NO: 373524 - RNA, 64 nt, Human; identical to SEQ ID NO: 94811

SEQ ID NO: 373525 - RNA, 64 nt, Human; identical to SEQ ID NO: 94812

SEQ ID NO: 373526 - RNA, 64 nt, Human; identical to SEQ ID NO: 94813

SEQ ID NO: 373527 - RNA, 64 nt, Human; identical to SEQ ID NO: 94814

SEQ ID NO: 373528 - RNA, 64 nt, Human; identical to SEQ ID NO: 94815

SEQ ID NO: 373529 - RNA, 64 nt, Human; identical to SEQ ID NO: 94816

SEQ ID NO: 373530 - RNA, 64 nt, Human; identical to SEQ ID NO: 94817

SEQ ID NO: 373531 - RNA, 64 nt, Human; identical to SEQ ID NO: 94818

SEQ ID NO: 373532 - RNA, 64 nt, Human; identical to SEQ ID NO: 94819

SEQ ID NO: 373533 - RNA, 64 nt, Human; identical to SEQ ID NO: 94820

SEQ ID NO: 373534 - RNA, 64 nt, Human; identical to SEQ ID NO: 94821

SEQ ID NO: 373535 - RNA, 64 nt, Human; identical to SEQ ID NO: 94822

SEQ ID NO: 373536 - RNA, 64 nt, Human; identical to SEQ ID NO: 94823

SEQ ID NO: 373537 - RNA, 64 nt, Human; identical to SEQ ID NO: 94824

SEQ ID NO: 373538 - RNA, 64 nt, Human; identical to SEQ ID NO: 94825

SEQ ID NO: 373539 - RNA, 64 nt, Human; identical to SEQ ID NO: 94826

SEQ ID NO: 373540 - RNA, 64 nt, Human; identical to SEQ ID NO: 94827

SEQ ID NO: 373541 - RNA, 64 nt, Human; identical to SEQ ID NO: 94828

SEQ ID NO: 373542 - RNA, 64 nt, Human; identical to SEQ ID NO: 94829

SEQ ID NO: 373543 - RNA, 64 nt, Human; identical to SEQ ID NO: 94830

SEQ ID NO: 373544 - RNA, 64 nt, Human; identical to SEQ ID NO: 94831

SEQ ID NO: 373545 - RNA, 64 nt, Human; identical to SEQ ID NO: 94832

SEQ ID NO: 373546 - RNA, 64 nt, Human; identical to SEQ ID NO: 94833

SEQ ID NO: 373547 - RNA, 64 nt, Human; identical to SEQ ID NO: 94834

SEQ ID NO: 373548 - RNA, 64 nt, Human; identical to SEQ ID NO: 94835

SEQ ID NO: 373549 - RNA, 64 nt, Human; identical to SEQ ID NO: 94836

SEQ ID NO: 373550 - RNA, 64 nt, Human; identical to SEQ ID NO: 94837

SEQ ID NO: 373551 - RNA, 64 nt, Human; identical to SEQ ID NO: 94838

SEQ ID NO: 373552 - RNA, 64 nt, Human; identical to SEQ ID NO: 94839

SEQ ID NO: 373553 - RNA, 64 nt, Human; identical to SEQ ID NO: 94840

SEQ ID NO: 373554 - RNA, 64 nt, Human; identical to SEQ ID NO: 94841

SEQ ID NO: 373555 - RNA, 64 nt, Human; identical to SEQ ID NO: 94842

SEQ ID NO: 373556 - RNA, 64 nt, Human; identical to SEQ ID NO: 94843

SEQ ID NO: 373557 - RNA, 64 nt, Human; identical to SEQ ID NO: 94844

SEQ ID NO: 373558 - RNA, 64 nt, Human; identical to SEQ ID NO: 94845

SEQ ID NO: 373559 - RNA, 64 nt, Human; identical to SEQ ID NO: 94846

SEQ ID NO: 373560 - RNA, 64 nt, Human; identical to SEQ ID NO: 94847

SEQ ID NO: 373561 - RNA, 64 nt, Human; identical to SEQ ID NO: 94848

SEQ ID NO: 373562 - RNA, 64 nt, Human; identical to SEQ ID NO: 94849

SEQ ID NO: 373563 - RNA, 64 nt, Human; identical to SEQ ID NO: 94850

SEQ ID NO: 373564 - RNA, 64 nt, Human; identical to SEQ ID NO: 94851

SEQ ID NO: 373565 - RNA, 64 nt, Human; identical to SEQ ID NO: 94852

SEQ ID NO: 373566 - RNA, 64 nt, Human; identical to SEQ ID NO: 94853

SEQ ID NO: 373567 - RNA, 64 nt, Human; identical to SEQ ID NO: 94854

SEQ ID NO: 373568 - RNA, 64 nt, Human; identical to SEQ ID NO: 94855

SEQ ID NO: 373569 - RNA, 64 nt, Human; identical to SEQ ID NO: 94856

SEQ ID NO: 373570 - RNA, 64 nt, Human; identical to SEQ ID NO: 94857

SEQ ID NO: 373571 - RNA, 64 nt, Human; identical to SEQ ID NO: 94858

SEQ ID NO: 373572 - RNA, 64 nt, Human; identical to SEQ ID NO: 94859

SEQ ID NO: 373573 - RNA, 58 nt, Human; identical to SEQ ID NO: 94860

SEQ ID NO: 373574 - RNA, 64 nt, Human; identical to SEQ ID NO: 94861

SEQ ID NO: 373575 - RNA, 64 nt, Human; identical to SEQ ID NO: 94862

SEQ ID NO: 373576 - RNA, 64 nt, Human; identical to SEQ ID NO: 94863

SEQ ID NO: 373577 - RNA, 64 nt, Human; identical to SEQ ID NO: 94864

SEQ ID NO: 373578 - RNA, 64 nt, Human; identical to SEQ ID NO: 94865

SEQ ID NO: 373579 - RNA, 64 nt, Human; identical to SEQ ID NO: 94866

SEQ ID NO: 373580 - RNA, 64 nt, Human; identical to SEQ ID NO: 94867

SEQ ID NO: 373581 - RNA, 64 nt, Human; identical to SEQ ID NO: 94868

SEQ ID NO: 373582 - RNA, 64 nt, Human; identical to SEQ ID NO: 94869

SEQ ID NO: 373583 - RNA, 64 nt, Human; identical to SEQ ID NO: 94870

SEQ ID NO: 373584 - RNA, 64 nt, Human; identical to SEQ ID NO: 94871

SEQ ID NO: 373585 - RNA, 64 nt, Human; identical to SEQ ID NO: 94872

SEQ ID NO: 373586 - RNA, 64 nt, Human; identical to SEQ ID NO: 94873

SEQ ID NO: 373587 - RNA, 64 nt, Human; identical to SEQ ID NO: 94874

SEQ ID NO: 373588 - RNA, 64 nt, Human; identical to SEQ ID NO: 94875

SEQ ID NO: 373589 - RNA, 64 nt, Human; identical to SEQ ID NO: 94876

SEQ ID NO: 373590 - RNA, 64 nt, Human; identical to SEQ ID NO: 94877

SEQ ID NO: 373591 - RNA, 64 nt, Human; identical to SEQ ID NO: 94878

SEQ ID NO: 373592 - RNA, 64 nt, Human; identical to SEQ ID NO: 94879

SEQ ID NO: 373593 - RNA, 64 nt, Human; identical to SEQ ID NO: 94880

SEQ ID NO: 373594 - RNA, 64 nt, Human; identical to SEQ ID NO: 94881

SEQ ID NO: 373595 - RNA, 64 nt, Human; identical to SEQ ID NO: 94882

SEQ ID NO: 373596 - RNA, 64 nt, Human; identical to SEQ ID NO: 94883

SEQ ID NO: 373597 - RNA, 64 nt, Human; identical to SEQ ID NO: 94884

SEQ ID NO: 373598 - RNA, 64 nt, Human; identical to SEQ ID NO: 94885

SEQ ID NO: 373599 - RNA, 64 nt, Human; identical to SEQ ID NO: 94886

SEQ ID NO: 373600 - RNA, 64 nt, Human; identical to SEQ ID NO: 94887

SEQ ID NO: 373601 - RNA, 64 nt, Human; identical to SEQ ID NO: 94888

SEQ ID NO: 373602 - RNA, 64 nt, Human; identical to SEQ ID NO: 94889

SEQ ID NO: 373603 - RNA, 64 nt, Human; identical to SEQ ID NO: 94890

SEQ ID NO: 373604 - RNA, 64 nt, Human; identical to SEQ ID NO: 94891

SEQ ID NO: 373605 - RNA, 64 nt, Human; identical to SEQ ID NO: 94892

SEQ ID NO: 373606 - RNA, 64 nt, Human; identical to SEQ ID NO: 94893

SEQ ID NO: 373607 - RNA, 64 nt, Human; identical to SEQ ID NO: 94894

SEQ ID NO: 373608 - RNA, 64 nt, Human; identical to SEQ ID NO: 94895

SEQ ID NO: 373609 - RNA, 64 nt, Human; identical to SEQ ID NO: 94896

SEQ ID NO: 373610 - RNA, 64 nt, Human; identical to SEQ ID NO: 94897

SEQ ID NO: 373611 - RNA, 64 nt, Human; identical to SEQ ID NO: 94898

SEQ ID NO: 373612 - RNA, 64 nt, Human; identical to SEQ ID NO: 94899

SEQ ID NO: 373613 - RNA, 64 nt, Human; identical to SEQ ID NO: 94900

SEQ ID NO: 373614 - RNA, 64 nt, Human; identical to SEQ ID NO: 94901

SEQ ID NO: 373615 - RNA, 64 nt, Human; identical to SEQ ID NO: 94902

SEQ ID NO: 373616 - RNA, 64 nt, Human; identical to SEQ ID NO: 94903

SEQ ID NO: 373617 - RNA, 64 nt, Human; identical to SEQ ID NO: 94904

SEQ ID NO: 373618 - RNA, 64 nt, Human; identical to SEQ ID NO: 94905

SEQ ID NO: 373619 - RNA, 64 nt, Human; identical to SEQ ID NO: 94906

SEQ ID NO: 373620 - RNA, 64 nt, Human; identical to SEQ ID NO: 94907

SEQ ID NO: 373621 - RNA, 64 nt, Human; identical to SEQ ID NO: 94908

SEQ ID NO: 373622 - RNA, 64 nt, Human; identical to SEQ ID NO: 94909

SEQ ID NO: 373623 - RNA, 64 nt, Human; identical to SEQ ID NO: 94910

SEQ ID NO: 373624 - RNA, 64 nt, Human; identical to SEQ ID NO: 94911

SEQ ID NO: 373625 - RNA, 64 nt, Human; identical to SEQ ID NO: 94912

SEQ ID NO: 373626 - RNA, 64 nt, Human; identical to SEQ ID NO: 94913

SEQ ID NO: 373627 - RNA, 64 nt, Human; identical to SEQ ID NO: 94914

SEQ ID NO: 373628 - RNA, 64 nt, Human; identical to SEQ ID NO: 94915

SEQ ID NO: 373629 - RNA, 64 nt, Human; identical to SEQ ID NO: 94916

SEQ ID NO: 373630 - RNA, 64 nt, Human; identical to SEQ ID NO: 94917

SEQ ID NO: 373631 - RNA, 64 nt, Human; identical to SEQ ID NO: 94918

SEQ ID NO: 373632 - RNA, 64 nt, Human; identical to SEQ ID NO: 94919

SEQ ID NO: 373633 - RNA, 64 nt, Human; identical to SEQ ID NO: 94920

SEQ ID NO: 373634 - RNA, 64 nt, Human; identical to SEQ ID NO: 94921

SEQ ID NO: 373635 - RNA, 64 nt, Human; identical to SEQ ID NO: 94922

SEQ ID NO: 373636 - RNA, 64 nt, Human; identical to SEQ ID NO: 94923

SEQ ID NO: 373637 - RNA, 64 nt, Human; identical to SEQ ID NO: 94924

SEQ ID NO: 373638 - RNA, 64 nt, Human; identical to SEQ ID NO: 94925

SEQ ID NO: 373639 - RNA, 64 nt, Human; identical to SEQ ID NO: 94926

SEQ ID NO: 373640 - RNA, 64 nt, Human; identical to SEQ ID NO: 94927

SEQ ID NO: 373641 - RNA, 64 nt, Human; identical to SEQ ID NO: 94928

SEQ ID NO: 373642 - RNA, 64 nt, Human; identical to SEQ ID NO: 94929

SEQ ID NO: 373643 - RNA, 64 nt, Human; identical to SEQ ID NO: 94930

SEQ ID NO: 373644 - RNA, 64 nt, Human; identical to SEQ ID NO: 94931

SEQ ID NO: 373645 - RNA, 64 nt, Human; identical to SEQ ID NO: 94932

SEQ ID NO: 373646 - RNA, 64 nt, Human; identical to SEQ ID NO: 94933

SEQ ID NO: 373647 - RNA, 64 nt, Human; identical to SEQ ID NO: 94934

SEQ ID NO: 373648 - RNA, 64 nt, Human; identical to SEQ ID NO: 94935

SEQ ID NO: 373649 - RNA, 64 nt, Human; identical to SEQ ID NO: 94936

SEQ ID NO: 373650 - RNA, 64 nt, Human; identical to SEQ ID NO: 94937

SEQ ID NO: 373651 - RNA, 64 nt, Human; identical to SEQ ID NO: 94938

SEQ ID NO: 373652 - RNA, 64 nt, Human; identical to SEQ ID NO: 94939

SEQ ID NO: 373653 - RNA, 64 nt, Human; identical to SEQ ID NO: 94940

SEQ ID NO: 373654 - RNA, 64 nt, Human; identical to SEQ ID NO: 94941

SEQ ID NO: 373655 - RNA, 64 nt, Human; identical to SEQ ID NO: 94942

SEQ ID NO: 373656 - RNA, 64 nt, Human; identical to SEQ ID NO: 94943

SEQ ID NO: 373657 - RNA, 64 nt, Human; identical to SEQ ID NO: 94944

SEQ ID NO: 373658 - RNA, 64 nt, Human; identical to SEQ ID NO: 94945

SEQ ID NO: 373659 - RNA, 64 nt, Human; identical to SEQ ID NO: 94946

SEQ ID NO: 373660 - RNA, 64 nt, Human; identical to SEQ ID NO: 94947

SEQ ID NO: 373661 - RNA, 64 nt, Human; identical to SEQ ID NO: 94948

SEQ ID NO: 373662 - RNA, 64 nt, Human; identical to SEQ ID NO: 94949

SEQ ID NO: 373663 - RNA, 64 nt, Human; identical to SEQ ID NO: 94950

SEQ ID NO: 373664 - RNA, 64 nt, Human; identical to SEQ ID NO: 242542

SEQ ID NO: 373665 - RNA, 64 nt, Human; identical to SEQ ID NO: 242543

SEQ ID NO: 373666 - RNA, 64 nt, Human; identical to SEQ ID NO: 242544

SEQ ID NO: 373667 - RNA, 64 nt, Human; identical to SEQ ID NO: 242545

SEQ ID NO: 373668 - RNA, 64 nt, Human; identical to SEQ ID NO: 242546

SEQ ID NO: 373669 - RNA, 64 nt, Human; identical to SEQ ID NO: 242547

SEQ ID NO: 373670 - RNA, 64 nt, Human; identical to SEQ ID NO: 242548

SEQ ID NO: 373671 - RNA, 64 nt, Human; identical to SEQ ID NO: 242549

SEQ ID NO: 373672 - RNA, 64 nt, Human; identical to SEQ ID NO: 242550

SEQ ID NO: 373673 - RNA, 64 nt, Human; identical to SEQ ID NO: 242551

SEQ ID NO: 373674 - RNA, 64 nt, Human; identical to SEQ ID NO: 242552

SEQ ID NO: 373675 - RNA, 64 nt, Human; identical to SEQ ID NO: 242553

SEQ ID NO: 373676 - RNA, 64 nt, Human; identical to SEQ ID NO: 242554

SEQ ID NO: 373677 - RNA, 64 nt, Human; identical to SEQ ID NO: 242555

SEQ ID NO: 373678 - RNA, 64 nt, Human; identical to SEQ ID NO: 242556

SEQ ID NO: 373679 - RNA, 64 nt, Human; identical to SEQ ID NO: 242557

SEQ ID NO: 373680 - RNA, 64 nt, Human; identical to SEQ ID NO: 240726

SEQ ID NO: 373681 - RNA, 64 nt, Human; identical to SEQ ID NO: 240123

SEQ ID NO: 373682 - RNA, 64 nt, Human; identical to SEQ ID NO: 242436

SEQ ID NO: 373683 - RNA, 64 nt, Human; identical to SEQ ID NO: 242437

SEQ ID NO: 373684 - RNA, 64 nt, Human; identical to SEQ ID NO: 242438

SEQ ID NO: 373685 - RNA, 64 nt, Human; identical to SEQ ID NO: 242470

SEQ ID NO: 373686 - RNA, 64 nt, Human; identical to SEQ ID NO: 240124

SEQ ID NO: 373687 - RNA, 54 nt, Human; identical to SEQ ID NO: 242453

SEQ ID NO: 373688 - RNA, 64 nt, Human; identical to SEQ ID NO: 242454

SEQ ID NO: 373689 - RNA, 64 nt, Human; identical to SEQ ID NO: 242455

SEQ ID NO: 373690 - RNA, 64 nt, Human; identical to SEQ ID NO: 242351

SEQ ID NO: 373691 - RNA, 64 nt, Human; identical to SEQ ID NO: 240125

SEQ ID NO: 373692 - RNA, 64 nt, Human; identical to SEQ ID NO: 242471

SEQ ID NO: 373693 - RNA, 64 nt, Human; identical to SEQ ID NO: 242472

SEQ ID NO: 373694 - RNA, 64 nt, Human; identical to SEQ ID NO: 242276

SEQ ID NO: 373695 - RNA, 64 nt, Human; identical to SEQ ID NO: 240126

SEQ ID NO: 373696 - RNA, 64 nt, Human; identical to SEQ ID NO: 242487

SEQ ID NO: 373697 - RNA, 64 nt, Human; identical to SEQ ID NO: 242488

SEQ ID NO: 373698 - RNA, 64 nt, Human; identical to SEQ ID NO: 242489

SEQ ID NO: 373699 - RNA, 64 nt, Human; identical to SEQ ID NO: 242504

SEQ ID NO: 373700 - RNA, 64 nt, Human; identical to SEQ ID NO: 240127

SEQ ID NO: 373701 - RNA, 64 nt, Human; identical to SEQ ID NO: 242505

SEQ ID NO: 373702 - RNA, 64 nt, Human; identical to SEQ ID NO: 242506

SEQ ID NO: 373703 - RNA, 64 nt, Human; identical to SEQ ID NO: 242385

SEQ ID NO: 373704 - RNA, 64 nt, Human; identical to SEQ ID NO: 240128

SEQ ID NO: 373705 - RNA, 64 nt, Human; identical to SEQ ID NO: 242521

SEQ ID NO: 373706 - RNA, 64 nt, Human; identical to SEQ ID NO: 242522

SEQ ID NO: 373707 - RNA, 64 nt, Human; identical to SEQ ID NO: 242523

SEQ ID NO: 373708 - RNA, 64 nt, Human; identical to SEQ ID NO: 242352

SEQ ID NO: 373709 - RNA, 64 nt, Human; identical to SEQ ID NO: 240129

SEQ ID NO: 373710 - RNA, 64 nt, Human; identical to SEQ ID NO: 242538

SEQ ID NO: 373711 - RNA, 64 nt, Human; identical to SEQ ID NO: 242539

SEQ ID NO: 373712 - RNA, 64 nt, Human; identical to SEQ ID NO: 242540

SEQ ID NO: 373713 - RNA, 64 nt, Human; identical to SEQ ID NO: 242334

SEQ ID NO: 373714 - RNA, 64 nt, Human; identical to SEQ ID NO: 240130

SEQ ID NO: 373715 - RNA, 64 nt, Human; identical to SEQ ID NO: 242182

SEQ ID NO: 373716 - RNA, 64 nt, Human; identical to SEQ ID NO: 242183

SEQ ID NO: 373717 - RNA, 64 nt, Human; identical to SEQ ID NO: 242184

SEQ ID NO: 373718 - RNA, 64 nt, Human; identical to SEQ ID NO: 242335

SEQ ID NO: 373719 - RNA, 64 nt, Human; identical to SEQ ID NO: 240131

SEQ ID NO: 373720 - RNA, 64 nt, Human; identical to SEQ ID NO: 242201

SEQ ID NO: 373721 - RNA, 64 nt, Human; identical to SEQ ID NO: 242202

SEQ ID NO: 373722 - RNA, 64 nt, Human; identical to SEQ ID NO: 242203

SEQ ID NO: 373723 - RNA, 64 nt, Human; identical to SEQ ID NO: 242353

SEQ ID NO: 373724 - RNA, 64 nt, Human; identical to SEQ ID NO: 240132

SEQ ID NO: 373725 - RNA, 64 nt, Human; identical to SEQ ID NO: 242220

SEQ ID NO: 373726 - RNA, 64 nt, Human; identical to SEQ ID NO: 242221

SEQ ID NO: 373727 - RNA, 64 nt, Human; identical to SEQ ID NO: 242222

SEQ ID NO: 373728 - RNA, 64 nt, Human; identical to SEQ ID NO: 242240

SEQ ID NO: 373729 - RNA, 64 nt, Human; identical to SEQ ID NO: 240133

SEQ ID NO: 373730 - RNA, 64 nt, Human; identical to SEQ ID NO: 242241

SEQ ID NO: 373731 - RNA, 64 nt, Human; identical to SEQ ID NO: 242305

SEQ ID NO: 373732 - RNA, 64 nt, Human; identical to SEQ ID NO: 240134

SEQ ID NO: 373733 - RNA, 64 nt, Human; identical to SEQ ID NO: 242257

SEQ ID NO: 373734 - RNA, 64 nt, Human; identical to SEQ ID NO: 242258

SEQ ID NO: 373735 - RNA, 64 nt, Human; identical to SEQ ID NO: 242259

SEQ ID NO: 373736 - RNA, 64 nt, Human; identical to SEQ ID NO: 242260

SEQ ID NO: 373737 - RNA, 64 nt, Human; identical to SEQ ID NO: 242402

SEQ ID NO: 373738 - RNA, 64 nt, Human; identical to SEQ ID NO: 240135

SEQ ID NO: 373739 - RNA, 64 nt, Human; identical to SEQ ID NO: 242277

SEQ ID NO: 373740 - RNA, 64 nt, Human; identical to SEQ ID NO: 242278

SEQ ID NO: 373741 - RNA, 64 nt, Human; identical to SEQ ID NO: 242144

SEQ ID NO: 373742 - RNA, 64 nt, Human; identical to SEQ ID NO: 240136

SEQ ID NO: 373743 - RNA, 64 nt, Human; identical to SEQ ID NO: 242368

SEQ ID NO: 373744 - RNA, 64 nt, Human; identical to SEQ ID NO: 242369

SEQ ID NO: 373745 - RNA, 64 nt, Human; identical to SEQ ID NO: 242370

SEQ ID NO: 373746 - RNA, 64 nt, Human; identical to SEQ ID NO: 242049

SEQ ID NO: 373747 - RNA, 64 nt, Human; identical to SEQ ID NO: 240137

SEQ ID NO: 373748 - RNA, 64 nt, Human; identical to SEQ ID NO: 242336

SEQ ID NO: 373749 - RNA, 64 nt, Human; identical to SEQ ID NO: 242403

SEQ ID NO: 373750 - RNA, 64 nt, Human; identical to SEQ ID NO: 240138

SEQ ID NO: 373751 - RNA, 64 nt, Human; identical to SEQ ID NO: 242386

SEQ ID NO: 373752 - RNA, 64 nt, Human; identical to SEQ ID NO: 242387

SEQ ID NO: 373753 - RNA, 64 nt, Human; identical to SEQ ID NO: 242306

SEQ ID NO: 373754 - RNA, 64 nt, Human; identical to SEQ ID NO: 240154

SEQ ID NO: 373755 - RNA, 64 nt, Human; identical to SEQ ID NO: 242419

SEQ ID NO: 373756 - RNA, 64 nt, Human; identical to SEQ ID NO: 242420

SEQ ID NO: 373757 - RNA, 64 nt, Human; identical to SEQ ID NO: 242421

SEQ ID NO: 373758 - RNA, 64 nt, Human; identical to SEQ ID NO: 242289

SEQ ID NO: 373759 - RNA, 64 nt, Human; identical to SEQ ID NO: 240155

SEQ ID NO: 373760 - RNA, 64 nt, Human; identical to SEQ ID NO: 241969

SEQ ID NO: 373761 - RNA, 64 nt, Human; identical to SEQ ID NO: 241970

SEQ ID NO: 373762 - RNA, 64 nt, Human; identical to SEQ ID NO: 241971

SEQ ID NO: 373763 - RNA, 64 nt, Human; identical to SEQ ID NO: 242290

SEQ ID NO: 373764 - RNA, 64 nt, Human; identical to SEQ ID NO: 240156

SEQ ID NO: 373765 - RNA, 64 nt, Human; identical to SEQ ID NO: 241979

SEQ ID NO: 373766 - RNA, 64 nt, Human; identical to SEQ ID NO: 241980

SEQ ID NO: 373767 - RNA, 64 nt, Human; identical to SEQ ID NO: 241981

SEQ ID NO: 373768 - RNA, 64 nt, Human; identical to SEQ ID NO: 242307

SEQ ID NO: 373769 - RNA, 64 nt, Human; identical to SEQ ID NO: 240172

SEQ ID NO: 373770 - RNA, 64 nt, Human; identical to SEQ ID NO: 242011

SEQ ID NO: 373771 - RNA, 64 nt, Human; identical to SEQ ID NO: 242012

SEQ ID NO: 373772 - RNA, 64 nt, Human; identical to SEQ ID NO: 242013

SEQ ID NO: 373773 - RNA, 64 nt, Human; identical to SEQ ID NO: 242030

SEQ ID NO: 373774 - RNA, 64 nt, Human; identical to SEQ ID NO: 240173

SEQ ID NO: 373775 - RNA, 64 nt, Human; identical to SEQ ID NO: 242031

SEQ ID NO: 373776 - RNA, 64 nt, Human; identical to SEQ ID NO: 242032

SEQ ID NO: 373777 - RNA, 64 nt, Human; identical to SEQ ID NO: 242125

SEQ ID NO: 373778 - RNA, 64 nt, Human; identical to SEQ ID NO: 240174

SEQ ID NO: 373779 - RNA, 64 nt, Human; identical to SEQ ID NO: 242050

SEQ ID NO: 373780 - RNA, 64 nt, Human; identical to SEQ ID NO: 242051

SEQ ID NO: 373781 - RNA, 64 nt, Human; identical to SEQ ID NO: 241281

SEQ ID NO: 373782 - RNA, 64 nt, Human; identical to SEQ ID NO: 240190

SEQ ID NO: 373783 - RNA, 64 nt, Human; identical to SEQ ID NO: 242106

SEQ ID NO: 373784 - RNA, 64 nt, Human; identical to SEQ ID NO: 242107

SEQ ID NO: 373785 - RNA, 64 nt, Human; identical to SEQ ID NO: 242108

SEQ ID NO: 373786 - RNA, 64 nt, Human; identical to SEQ ID NO: 242126

SEQ ID NO: 373787 - RNA, 64 nt, Human; identical to SEQ ID NO: 240191

SEQ ID NO: 373788 - RNA, 64 nt, Human; identical to SEQ ID NO: 242127

SEQ ID NO: 373789 - RNA, 64 nt, Human; identical to SEQ ID NO: 241908

SEQ ID NO: 373790 - RNA, 64 nt, Human; identical to SEQ ID NO: 240192

SEQ ID NO: 373791 - RNA, 64 nt, Human; identical to SEQ ID NO: 242145

SEQ ID NO: 373792 - RNA, 64 nt, Human; identical to SEQ ID NO: 242146

SEQ ID NO: 373793 - RNA, 64 nt, Human; identical to SEQ ID NO: 240869

SEQ ID NO: 373794 - RNA, 64 nt, Human; identical to SEQ ID NO: 240208

SEQ ID NO: 373795 - RNA, 64 nt, Human; identical to SEQ ID NO: 242291

SEQ ID NO: 373796 - RNA, 64 nt, Human; identical to SEQ ID NO: 242323

SEQ ID NO: 373797 - RNA, 64 nt, Human; identical to SEQ ID NO: 240209

SEQ ID NO: 373798 - RNA, 64 nt, Human; identical to SEQ ID NO: 242324

SEQ ID NO: 373799 - RNA, 57 nt, Human; identical to SEQ ID NO: 242325

SEQ ID NO: 373800 - RNA, 64 nt, Human; identical to SEQ ID NO: 242087

SEQ ID NO: 373801 - RNA, 64 nt, Human; identical to SEQ ID NO: 240210

SEQ ID NO: 373802 - RNA, 64 nt, Human; identical to SEQ ID NO: 242404

SEQ ID NO: 373803 - RNA, 64 nt, Human; identical to SEQ ID NO: 242068

SEQ ID NO: 373804 - RNA, 64 nt, Human; identical to SEQ ID NO: 240226

SEQ ID NO: 373805 - RNA, 64 nt, Human; identical to SEQ ID NO: 240817

SEQ ID NO: 373806 - RNA, 64 nt, Human; identical to SEQ ID NO: 240818

SEQ ID NO: 373807 - RNA, 64 nt, Human; identical to SEQ ID NO: 242088

SEQ ID NO: 373808 - RNA, 64 nt, Human; identical to SEQ ID NO: 240227

SEQ ID NO: 373809 - RNA, 64 nt, Human; identical to SEQ ID NO: 240834

SEQ ID NO: 373810 - RNA, 64 nt, Human; identical to SEQ ID NO: 240835

SEQ ID NO: 373811 - RNA, 64 nt, Human; identical to SEQ ID NO: 240836

SEQ ID NO: 373812 - RNA, 64 nt, Human; identical to SEQ ID NO: 240780

SEQ ID NO: 373813 - RNA, 64 nt, Human; identical to SEQ ID NO: 240228

SEQ ID NO: 373814 - RNA, 64 nt, Human; identical to SEQ ID NO: 240852

SEQ ID NO: 373815 - RNA, 64 nt, Human; identical to SEQ ID NO: 240853

SEQ ID NO: 373816 - RNA, 64 nt, Human; identical to SEQ ID NO: 240870

SEQ ID NO: 373817 - RNA, 64 nt, Human; identical to SEQ ID NO: 240244

SEQ ID NO: 373818 - RNA, 64 nt, Human; identical to SEQ ID NO: 240887

SEQ ID NO: 373819 - RNA, 64 nt, Human; identical to SEQ ID NO: 240888

SEQ ID NO: 373820 - RNA, 64 nt, Human; identical to SEQ ID NO: 240889

SEQ ID NO: 373821 - RNA, 64 nt, Human; identical to SEQ ID NO: 241909

SEQ ID NO: 373822 - RNA, 64 nt, Human; identical to SEQ ID NO: 240245

SEQ ID NO: 373823 - RNA, 64 nt, Human; identical to SEQ ID NO: 240959

SEQ ID NO: 373824 - RNA, 64 nt, Human; identical to SEQ ID NO: 240960

SEQ ID NO: 373825 - RNA, 64 nt, Human; identical to SEQ ID NO: 240961

SEQ ID NO: 373826 - RNA, 64 nt, Human; identical to SEQ ID NO: 242163

SEQ ID NO: 373827 - RNA, 64 nt, Human; identical to SEQ ID NO: 240246

SEQ ID NO: 373828 - RNA, 64 nt, Human; identical to SEQ ID NO: 241029

SEQ ID NO: 373829 - RNA, 64 nt, Human; identical to SEQ ID NO: 241030

SEQ ID NO: 373830 - RNA, 64 nt, Human; identical to SEQ ID NO: 240871

SEQ ID NO: 373831 - RNA, 64 nt, Human; identical to SEQ ID NO: 240262

SEQ ID NO: 373832 - RNA, 64 nt, Human; identical to SEQ ID NO: 241931

SEQ ID NO: 373833 - RNA, 64 nt, Human; identical to SEQ ID NO: 241949

SEQ ID NO: 373834 - RNA, 64 nt, Human; identical to SEQ ID NO: 240263

SEQ ID NO: 373835 - RNA, 64 nt, Human; identical to SEQ ID NO: 241950

SEQ ID NO: 373836 - RNA, 51 nt, Human; identical to SEQ ID NO: 241951

SEQ ID NO: 373837 - RNA, 64 nt, Human; identical to SEQ ID NO: 240762

SEQ ID NO: 373838 - RNA, 64 nt, Human; identical to SEQ ID NO: 240264

SEQ ID NO: 373839 - RNA, 64 nt, Human; identical to SEQ ID NO: 241992

SEQ ID NO: 373840 - RNA, 64 nt, Human; identical to SEQ ID NO: 241993

SEQ ID NO: 373841 - RNA, 64 nt, Human; identical to SEQ ID NO: 241994

SEQ ID NO: 373842 - RNA, 64 nt, Human; identical to SEQ ID NO: 240672

SEQ ID NO: 373843 - RNA, 64 nt, Human; identical to SEQ ID NO: 240280

SEQ ID NO: 373844 - RNA, 64 nt, Human; identical to SEQ ID NO: 242089

SEQ ID NO: 373845 - RNA, 50 nt, Human; identical to SEQ ID NO: 240636

SEQ ID NO: 373846 - RNA, 64 nt, Human; identical to SEQ ID NO: 240281

SEQ ID NO: 373847 - RNA, 64 nt, Human; identical to SEQ ID NO: 242164

SEQ ID NO: 373848 - RNA, 64 nt, Human; identical to SEQ ID NO: 242165

SEQ ID NO: 373849 - RNA, 64 nt, Human; identical to SEQ ID NO: 240618

SEQ ID NO: 373850 - RNA, 64 nt, Human; identical to SEQ ID NO: 240282

SEQ ID NO: 373851 - RNA, 64 nt, Human; identical to SEQ ID NO: 240564

SEQ ID NO: 373852 - RNA, 64 nt, Human; identical to SEQ ID NO: 240565

SEQ ID NO: 373853 - RNA, 64 nt, Human; identical to SEQ ID NO: 240566

SEQ ID NO: 373854 - RNA, 64 nt, Human; identical to SEQ ID NO: 240619

SEQ ID NO: 373855 - RNA, 64 nt, Human; identical to SEQ ID NO: 240298

SEQ ID NO: 373856 - RNA, 58 nt, Human; identical to SEQ ID NO: 240600

SEQ ID NO: 373857 - RNA, 64 nt, Human; identical to SEQ ID NO: 240601

SEQ ID NO: 373858 - RNA, 64 nt, Human; identical to SEQ ID NO: 240602

SEQ ID NO: 373859 - RNA, 64 nt, Human; identical to SEQ ID NO: 240654

SEQ ID NO: 373860 - RNA, 64 nt, Human; identical to SEQ ID NO: 240299

SEQ ID NO: 373861 - RNA, 64 nt, Human; identical to SEQ ID NO: 240620

SEQ ID NO: 373862 - RNA, 64 nt, Human; identical to SEQ ID NO: 240727

SEQ ID NO: 373863 - RNA, 64 nt, Human; identical to SEQ ID NO: 240300

SEQ ID NO: 373864 - RNA, 64 nt, Human; identical to SEQ ID NO: 240637

SEQ ID NO: 373865 - RNA, 64 nt, Human; identical to SEQ ID NO: 240638

SEQ ID NO: 373866 - RNA, 64 nt, Human; identical to SEQ ID NO: 240798

SEQ ID NO: 373867 - RNA, 64 nt, Human; identical to SEQ ID NO: 240316

SEQ ID NO: 373868 - RNA, 64 nt, Human; identical to SEQ ID NO: 240673

SEQ ID NO: 373869 - RNA, 64 nt, Human; identical to SEQ ID NO: 240674

SEQ ID NO: 373870 - RNA, 64 nt, Human; identical to SEQ ID NO: 240529

SEQ ID NO: 373871 - RNA, 64 nt, Human; identical to SEQ ID NO: 240317

SEQ ID NO: 373872 - RNA, 64 nt, Human; identical to SEQ ID NO: 240710

SEQ ID NO: 373873 - RNA, 64 nt, Human; identical to SEQ ID NO: 240763

SEQ ID NO: 373874 - RNA, 64 nt, Human; identical to SEQ ID NO: 240318

SEQ ID NO: 373875 - RNA, 64 nt, Human; identical to SEQ ID NO: 240728

SEQ ID NO: 373876 - RNA, 64 nt, Human; identical to SEQ ID NO: 240493

SEQ ID NO: 373877 - RNA, 52 nt, Human; identical to SEQ ID NO: 240334

SEQ ID NO: 373878 - RNA, 64 nt, Human; identical to SEQ ID NO: 240764

SEQ ID NO: 373879 - RNA, 64 nt, Human; identical to SEQ ID NO: 241889

SEQ ID NO: 373880 - RNA, 64 nt, Human; identical to SEQ ID NO: 240335

SEQ ID NO: 373881 - RNA, 64 nt, Human; identical to SEQ ID NO: 240781

SEQ ID NO: 373882 - RNA, 64 nt, Human; identical to SEQ ID NO: 240782

SEQ ID NO: 373883 - RNA, 64 nt, Human; identical to SEQ ID NO: 240582

SEQ ID NO: 373884 - RNA, 64 nt, Human; identical to SEQ ID NO: 240336

SEQ ID NO: 373885 - RNA, 64 nt, Human; identical to SEQ ID NO: 240799

SEQ ID NO: 373886 - RNA, 57 nt, Human; identical to SEQ ID NO: 240800

SEQ ID NO: 373887 - RNA, 64 nt, Human; identical to SEQ ID NO: 240494

SEQ ID NO: 373888 - RNA, 64 nt, Human; identical to SEQ ID NO: 240352

SEQ ID NO: 373889 - RNA, 64 nt, Human; identical to SEQ ID NO: 241910

SEQ ID NO: 373890 - RNA, 64 nt, Human; identical to SEQ ID NO: 241911

SEQ ID NO: 373891 - RNA, 64 nt, Human; identical to SEQ ID NO: 240457

SEQ ID NO: 373892 - RNA, 64 nt, Human; identical to SEQ ID NO: 240353

SEQ ID NO: 373893 - RNA, 64 nt, Human; identical to SEQ ID NO: 242069

SEQ ID NO: 373894 - RNA, 64 nt, Human; identical to SEQ ID NO: 242070

SEQ ID NO: 373895 - RNA, 64 nt, Human; identical to SEQ ID NO: 240439

SEQ ID NO: 373896 - RNA, 64 nt, Human; identical to SEQ ID NO: 240354

SEQ ID NO: 373897 - RNA, 64 nt, Human; identical to SEQ ID NO: 240440

SEQ ID NO: 373898 - RNA, 64 nt, Human; identical to SEQ ID NO: 240441

SEQ ID NO: 373899 - RNA, 64 nt, Human; identical to SEQ ID NO: 241890

SEQ ID NO: 373900 - RNA, 64 nt, Human; identical to SEQ ID NO: 241891

SEQ ID NO: 373901 - RNA, 64 nt, Human; identical to SEQ ID NO: 240367

SEQ ID NO: 373902 - RNA, 64 nt, Human; identical to SEQ ID NO: 240368

SEQ ID NO: 373903 - RNA, 64 nt, Human; identical to SEQ ID NO: 240369

SEQ ID NO: 373904 - RNA, 64 nt, Human; identical to SEQ ID NO: 240385

SEQ ID NO: 373905 - RNA, 64 nt, Human; identical to SEQ ID NO: 240386

SEQ ID NO: 373906 - RNA, 64 nt, Human; identical to SEQ ID NO: 240387

SEQ ID NO: 373907 - RNA, 64 nt, Human
aaaaacaaaacaaacaaaacaaaacaaaaaagacaaaaccuaaaacugagcuaucuaaggggga

SEQ ID NO: 373908 - RNA, 64 nt, Human
guccuuauuucaagccauauucaacccacccaacaaaaccuaacauugagguggugggcacacg

SEQ ID NO: 373909 - RNA, 64 nt, Human
cuguaucauugcucauaauauuggaaacuaaaauaaaaccuaguuggaaauccuuugugagauc

SEQ ID NO: 373910 - RNA, 64 nt, Human
augucaaacgcuuucuucuggacacuuggaaacuaaaaccuaggucuuagguacauccuaaagg

SEQ ID NO: 373911 - RNA, 64 nt, Human
gaauccuugccugugucugacgggaccacuacuaaaaaccuaaaaauaucugugaauggagcaa

SEQ ID NO: 373912 - RNA, 64 nt, Human
uagaucauaguagauacugguuuucuauuaacucaaaaccuacauugacaaguuuaacauugag

SEQ ID NO: 373913 - RNA, 64 nt, Human
uuucccuuauaucuggaauuugucagcauuccugaaaaccuacacguguauaucaguaaccaaa

SEQ ID NO: 373914 - RNA, 64 nt, Human
uucauuaaccacauuccugcacaacucauuucugaaaaccuaccauguuucuuuacagagccau

SEQ ID NO: 373915 - RNA, 64 nt, Human
ccucccugugugucacuagagaaaaaaaaaaacaaaaaccuagauuccggauuaggggaugaca

SEQ ID NO: 373916 - RNA, 64 nt, Human
gccauuuaauaaguuaaaaaaagauacaaaaacaaaaaccuacuagucuugaacaaacugucau

SEQ ID NO: 373917 - RNA, 64 nt, Human
agaaaauggaggaaaacgacauuauaugugacuuaaaaccuagaagaaauaaauaaaacuauug

SEQ ID NO: 373918 - RNA, 64 nt, Human
aaggguuuuuagccagggaaaacugagccccaggaaaaccuaaccacugggcaggcagaauuug

SEQ ID NO: 373919 - RNA, 64 nt, Human
uaaagauacagugucugacuauaaccuuguuccaaaaaccuaggcaaagaguauauguaggagg

SEQ ID NO: 373920 - RNA, 64 nt, Human
ugucccuuuccaggugggagcuuaacaccuguauaaaaccuaagguuuugguaaguaccuuagu

SEQ ID NO: 373921 - RNA, 64 nt, Human
ccuagaaggguacacaaaaugucuucuaaacuagaaaaccuaaggcuggacacgguggcucaug

SEQ ID NO: 373922 - RNA, 64 nt, Human
ucacuaaauucuuagggauggaaguauuuggaaaaaaaccuaacaguagagucaccaccuaagg

SEQ ID NO: 373923 - RNA, 64 nt, Human
ucaguaaauucuuagggauggaaguauuuggacaaaaaccuaauagaagagucaccaccaaaug

SEQ ID NO: 373924 - RNA, 64 nt, Human
agguaacagaagauggaacucgaaaucccaaugaaaaaccuacccagcaaagaagcauagcuuu

SEQ ID NO: 373925 - RNA, 64 nt, Human
ccacuguaaguccacaugucaucaguuuucuuuaaaaaccuacaaaugggauaguauugcaagg

SEQ ID NO: 373926 - RNA, 64 nt, Human
cuuaaagcaggagaauccaaaguaaauccugaacaaaaccuaaacacagccaucuaacucauua

SEQ ID NO: 373927 - RNA, 64 nt, Human
ccuuuugugcaaagccaaaaccuucguccuuuuaaaaaccuaggucuccaguuggcuuuacuuu

SEQ ID NO: 373928 - RNA, 64 nt, Human
uacucaacuaacuacucaacucauaucuggagagaaaaccuaggaguuucucaucuaugagaaa

SEQ ID NO: 373929 - RNA, 64 nt, Human
aucugaaguggaaauuguuugcuuagaguuuuuaaaaaccuagucuuugaaaagcaguuugugc

SEQ ID NO: 373930 - RNA, 64 nt, Human
gcuucuuuggacucccuauaugauugaugaugugaaaaccuaaauuacuugcagcauaguauua

SEQ ID NO: 373931 - RNA, 64 nt, Human
aucagaaacaggaaagaauuuagaaaaacuugagaaaaccuaauccaaaauaaaauucacuuaa

SEQ ID NO: 373932 - RNA, 64 nt, Human
agaagacugcaaucaagugagagcuaaacaaaagaaaaccuaaacuaaugucauuggaaacaaa

SEQ ID NO: 373933 - RNA, 64 nt, Human
agugguaacccaaauucauaaagcaauaauaauaaaaaccuauauaguauguucucuccuccaa

SEQ ID NO: 373934 - RNA, 64 nt, Human
uauagguuagggaucuuuugguuuuaaaucacagaaaaccuaauucaaacuggcuuaaaauaaa

SEQ ID NO: 373935 - RNA, 64 nt, Human
gcagcuacucuucagaucuggcucucuguacccuaaaaccuaguaucuuuuucucuucuaugga

SEQ ID NO: 373936 - RNA, 64 nt, Human
gaaauaggagaauaugguucucacucuugagaaaaaaaccuaagauuagcccagguaguugccu

SEQ ID NO: 373937 - RNA, 64 nt, Human
uggugcacuuuucugugucauaccacaauaaaaaaaaaccuagcaucuuacaaaaacaagacac

SEQ ID NO: 373938 - RNA, 64 nt, Human
cgcaaaaaaaaagacaaaaaaaaaccaaaaaaaaaaaaccuacaaaaaaaacuuuguugcuagg

SEQ ID NO: 373939 - RNA, 64 nt, Human
aucaucaaagacagaaaaugccugaccaaauucuaaaaccuaauccauauaaguuuauucauuu

SEQ ID NO: 373940 - RNA, 64 nt, Human
uauguauaguguuuauacaugaugcugauuucuuaaaaccuacauauaagcaguaguacuuuuu

SEQ ID NO: 373941 - RNA, 64 nt, Human
cuagaacuuagguucacguuuauguaaaguguguaaaaccuaguagagcuugcauagucggcac

SEQ ID NO: 373942 - RNA, 64 nt, Human
ccccauuauaauauucaugcgcugcuuuuucaucaaaaccuacccuguccuagagaucuauggg

SEQ ID NO: 373943 - RNA, 64 nt, Human
caaaaacaccaaaaggaacaaaggggccugcguuaaaaccuaauugcuaaugcuucacaacuag

SEQ ID NO: 373944 - RNA, 64 nt, Human
ucaguuguauuauaguccaguucuuaucaacauuaaaaccuauagcaaucauuucaaaucuauu

SEQ ID NO: 373945 - RNA, 64 nt, Human
gaaaaaugaguaagauuauaagguuugccaugugaaaaccuagagcauauuuuggaaauguucu

SEQ ID NO: 373946 - RNA, 64 nt, Human
caucugacuguuuuguacaugugacaauugccuuaaaaccuagcacaguccucagaaaugaaua

SEQ ID NO: 373947 - RNA, 64 nt, Human
cucgagacuacucuguuaccagucaugaaacauuaaaaccuacaagccuuacuucucugugugg

SEQ ID NO: 373948 - RNA, 64 nt, Human
auuuuuguauuguauaguuucuuugguguaucuuaaaaccuauuuuugaaaaacaaacuuggcu

SEQ ID NO: 373949 - RNA, 64 nt, Human
acaucaguuuacucaucugcgaaguggggauaauaaaaccuaccucaggguugcuucaaggauu

SEQ ID NO: 373950 - RNA, 64 nt, Human
ggcagagggggugaggguacuauucuggauugagaaaaccuauauccauucuuuauaucaaugu

SEQ ID NO: 373951 - RNA, 64 nt, Human
uggccuaaacuuuauuauugcacacugccugaacaaaaccuauuugucucuauguaaauuuuuu

SEQ ID NO: 373952 - RNA, 64 nt, Human
ucuguuuugagaauccucuccauuuucccaaauaaaaaccuaucacaacagugacuauaucacu

SEQ ID NO: 373953 - RNA, 64 nt, Human
cgucucauucuucccuuucuaaauggaacuuuuuaaaaccuacauuauuuucccucaaacaauu

SEQ ID NO: 373954 - RNA, 64 nt, Human
uaucaucucugucugggaucugggcugacaaauuaaaaccuagaguagugcuuaugcugaaaug

SEQ ID NO: 373955 - RNA, 64 nt, Human
uauuuuauuuacuugguguugaaauagcccucauaaaaccuaagcacuuggaaacacaauaaua

SEQ ID NO: 373956 - RNA, 64 nt, Human
uucuuauagcuaugugugguuucugggucaacugaaaaccuaccauuugcuuuucuauucaucu

SEQ ID NO: 373957 - RNA, 64 nt, Human
cucuugguguauucuaaaacgagcauucuuuuaaaaaaccuaaaguuucuugauaauaaacauu

SEQ ID NO: 373958 - RNA, 64 nt, Human
aacguuagaccuaaaaccauaaaaacccuagaagaaaaccuaggcauuaccauucgggacauag

SEQ ID NO: 373959 - RNA, 64 nt, Human
acuucacagcccugcagugcccuagacuggcugaaaaaccuaaacucuuuuucauccaggccug

SEQ ID NO: 373960 - RNA, 64 nt, Human
uggcaaagcagcaacuauucacaaaauaucaccaaaaaccuauuccacuuacauccaaggcacu

SEQ ID NO: 373961 - RNA, 64 nt, Human
ucugucuuugcaggucuccaucauggcagugaugaaaaccuaacaggguggcccccugugccag

SEQ ID NO: 373962 - RNA, 64 nt, Human
cacuuucaaucaacacuuuuucagacuaaaggccaaaaccuaaucguacgcaucguguccuuuu

SEQ ID NO: 373963 - RNA, 64 nt, Human
uuugcaaaaacaauuuagaaaaaaacaacaaagcaaaaccuaucuuggcaaaaaaaggaaguga

SEQ ID NO: 373964 - RNA, 64 nt, Human
ggacuuuauucuaacuugagaucaguggcggaucaaaaccuacaagauucaacugaaaaguugg

SEQ ID NO: 373965 - RNA, 64 nt, Human
cuuuguacaguauaugaaacaguauauuaacccuaaaaccuagauguuguccaccugaugccaa

SEQ ID NO: 373966 - RNA, 64 nt, Human
cucacugggaugagguuaggucaugaggacaccaaaaaccuaaaaauaaacaaaaagccaaaca

SEQ ID NO: 373967 - RNA, 64 nt, Human
accuauguauauauaucuaagaccucugaucauuaaaaccuauaaaggguugagcugucccaag

SEQ ID NO: 373968 - RNA, 64 nt, Human
ucuguuuugagaauccucuccauuuucccaaauaaaaaccuaucccaacagugacuauaucacu

SEQ ID NO: 373969 - RNA, 64 nt, Human
uuucaaggaaacacacuggauacugccuacugacaaaaccuauucuucauauuuugcuaaaaau

SEQ ID NO: 373970 - RNA, 64 nt, Human
aacacugcaaaaauguguuuaaauuaucuuuuuuaaaaccuauucaggauuauuagccuggacu

SEQ ID NO: 373971 - RNA, 64 nt, Human
cuguaaaauggaugaaaugaaaagagguucaauuaaaaccuacuuuuuucuagugcuaaagaaa

SEQ ID NO: 373972 - RNA, 64 nt, Human
guugugguaaagaucuuguacaggaugcaaacuaaaaaccuaaucccugccaucaaauuuauua

SEQ ID NO: 373973 - RNA, 64 nt, Human
caaaguuuuuagucagcuuugcuugucacauugcaaaaccuagcuuaagagcauuaaaaaaaaa

SEQ ID NO: 373974 - RNA, 64 nt, Human
cacaaauguuggcaaagucaaaaccccaugaauuaaaaccuacuggaauuugguuuuuaggagu

SEQ ID NO: 373975 - RNA, 64 nt, Human
uaauuagcuguugcagaauaaguaauauauuuuaaaaaccuagcuccuuucauuauuuaaaaca

SEQ ID NO: 373976 - RNA, 64 nt, Human
aauuaaacuaugaaauuaaaggcagaaaaacuggaaaaccuacugcagguccagagacuucugu

SEQ ID NO: 373977 - RNA, 64 nt, Human
acaaaacauugcucuuaacuucaccgccuaacccaaaaccuauaagaacuaaugauaauccauc

SEQ ID NO: 373978 - RNA, 64 nt, Human
gcuugucacuaagaauuuucauuuuuaggggucaaaaaccuauuuugaaaauaguguuguguga

SEQ ID NO: 373979 - RNA, 64 nt, Human
ggaauguguaagucuuuaaugccgauaucuucagaaaaccuaagcaaacuuacagguccugcug

SEQ ID NO: 373980 - RNA, 64 nt, Human
gaggaacacuuuagauagagggcaaauauaucugaaaaccuaauuucuuucuuuuuuugauaag

SEQ ID NO: 373981 - RNA, 64 nt, Human
uaaaguuacuauucuguaucauugauucaucaagaaaaccuagaucugcacucaccucacuguu

SEQ ID NO: 373982 - RNA, 64 nt, Human
ggccagggccaucucccuuuaauguguucauguuaaaaccuauuugaguguaagacuugcccuu

SEQ ID NO: 373983 - RNA, 64 nt, Human
ggaaaaauaaaaauacagugguguggaauacuccaaaaccuagaaaugcuguaggaauaaaucu

SEQ ID NO: 373984 - RNA, 64 nt, Human
ucuagacaggaaucuuacagauugucuccuguucaaaaccuagucauaaauauuuauaaugcaa

SEQ ID NO: 373985 - RNA, 64 nt, Human
aaagcaaauacugauuuucaaaaaaauguuuuuaaaaaccuauuuugaaaggucagaauuuugu

SEQ ID NO: 373986 - RNA, 64 nt, Human
uuuuuuaccaacauuaauuauuuuggguuuguuuaaaaccuagaggcacaaucuugacuuguca

SEQ ID NO: 373987 - RNA, 64 nt, Human
uagaguuccuauuuucagcuaguugaaaacagagaaaaccuagugauucugucuggucauccca

SEQ ID NO: 373988 - RNA, 64 nt, Human
cgauucaguugugagcauucuuuuuuuccuucucaaaaccuacuaugauuuguuuuacugaaca

SEQ ID NO: 373989 - RNA, 64 nt, Human
uuauuguuaauuuuagucaccaaugguauaaagcaaaaccuagguuuagagugugcuaggauac

SEQ ID NO: 373990 - RNA, 64 nt, Human
gaacaauacacugcauuacuguucuauacauaugaaaaccuaauaauauaagucuuagagauca

SEQ ID NO: 373991 - RNA, 64 nt, Human
aguccuaugaauguaucccuaaaugugguuauugaaaaccuaauagcugccucaugacaaguac

SEQ ID NO: 373992 - RNA, 64 nt, Human
acuuuaccuacggagacaugauaaacacgcaaaaaaaaccuagaaauuaagcaaaaaauagcac

SEQ ID NO: 373993 - RNA, 64 nt, Human
uacguagccacaggagcccugcuaugaaaggaauaaaaccuacacacaagguuggagcuuugca

SEQ ID NO: 373994 - RNA, 64 nt, Human
aacagcuaagguauagacauucuaauaauuugggaaaaccuaugauuacaaguaaaaacucaga

SEQ ID NO: 373995 - RNA, 64 nt, Human
gcauguuguggaagggggaauuggaaauuaaaugaaaaccuaugacuuuggucaugucaaucug

SEQ ID NO: 373996 - RNA, 64 nt, Human
ccuuccucucucuaccagucuauuuccacugaacaaaaccuacgcacauaccuucauguggcuc

SEQ ID NO: 373997 - RNA, 64 nt, Human
ccuuccucucucuaccagucuauuuccacugaacaaaaccuacacacauaccuucaugugguuc

SEQ ID NO: 373998 - RNA, 64 nt, Human
ucagcuggcugagacacugaagaagucacugaacaaaaccuacacacguaccuucaugugauuc

SEQ ID NO: 373999 - RNA, 64 nt, Human
uauuuuuggugaauuacuuuguuguagugaggaaaaaaccuaagaaauuuccccuuuuuuuaaa

SEQ ID NO: 374000 - RNA, 64 nt, Human
uguaauuguuuuaaugugugcuugaaauauccagaaaaccuauggaguuaguaaauucugggcu

SEQ ID NO: 374001 - RNA, 64 nt, Human
ccauaguaguaugaugauacaagauuagaagcugaaaaccuaaguccuuuauguggaaaacaga

SEQ ID NO: 374002 - RNA, 64 nt, Human
aguuucucuaguucuaaauuuuaccaauucccaaaaaaccuaaguuuugcugaaaucugauuug

SEQ ID NO: 374003 - RNA, 64 nt, Human
gaaggagugaucaaauaccgaaauugaacuuucuaaaaccuacacauagcaugcguuuaaauuc

SEQ ID NO: 374004 - RNA, 64 nt, Human
acuuaacucaucauuucagccucugaguagagguaaaaccuauguguacuucuguuuaugaucc

SEQ ID NO: 374005 - RNA, 64 nt, Human
uuggaaaagacucccuuuagucccuuuuucaauuaaaaccuauggugaaaaaggcguuugcacu

SEQ ID NO: 374006 - RNA, 64 nt, Human
uuuaggauaaacaaaauucuauuuaauccaccuuaaaaccuaaauguauuuucauggauuucau

SEQ ID NO: 374007 - RNA, 64 nt, Human
acucuaugaauaugauucuauauauugaaaucagaaaaccuaccaaacaaaaacaucagaagcu

SEQ ID NO: 374008 - RNA, 64 nt, Human
uuucaaauggcagcaguuccaugaagacacgcuuaaaaccuagaacuucaaaauguucguauuc

SEQ ID NO: 374009 - RNA, 64 nt, Human
uguaaguuuaaguuuuccaucugaccauagcagaaaaaccuagacccaccuagugaaacuuugu

SEQ ID NO: 374010 - RNA, 64 nt, Human
ucuuccuggauuccucacuuugaagagugugaggaaaaccuauguuugccgcuuaagcuuucag

SEQ ID NO: 374011 - RNA, 64 nt, Human
uuuuaaaaucaaacucaguuuuuauuucuucacuaaaaccuauuuucauaugauauacauguua

SEQ ID NO: 374012 - RNA, 64 nt, Human
agggcuguguuauauuaaguucucccuuacuguuaaaaccuaauuaaauaugcuuuagaauuuu

SEQ ID NO: 374013 - RNA, 64 nt, Human
caaaacauaugaaguccuggaaaagagcaucugaaaaaccuagaacaaguuuaacugugacuac

SEQ ID NO: 374014 - RNA, 64 nt, Human
ucuuucaagagauuaaaaauaaaucaacagucugaaaaccuaagcagacacggagcauuauccg

SEQ ID NO: 374015 - RNA, 64 nt, Human
cuaaacacuuuacuagaagaacauuucaguauaaaaaaccuaauuuauuuuuacagaaaaauau

SEQ ID NO: 374016 - RNA, 64 nt, Human
uuuauaauuuuaacaucuuauauugaagauucugaaaaccuaucuuuauuagaggaaaaucuca

SEQ ID NO: 374017 - RNA, 64 nt, Human
auacauuuggauaaacaacauugagauuaugaugaaaaccuacauauuccauguuuggaagacc

SEQ ID NO: 374018 - RNA, 64 nt, Human
uccagcguacuauaaugaaaacauccuuguuuugaaaaccuaaaagacaggcucuguauauaua

SEQ ID NO: 374019 - RNA, 64 nt, Human
aauacagaucaucuagaaguuagauucaaaauggaaaaccuauucauggcucagauuuuucauu

SEQ ID NO: 374020 - RNA, 64 nt, Human
uuaaauaugcuuuuugcuuucaaaaauaaaccagaaaaccuauauccuaugauacaacucuaag

SEQ ID NO: 374021 - RNA, 64 nt, Human
auuuuuuuuugauaaaggaucacaaaacaauucuaaaaccuaacuguuuuuaccauugaaauuu

SEQ ID NO: 374022 - RNA, 64 nt, Human
guuguagucucaaggcuuucucucuugcuuaacuaaaaccuaaggaccacuguuuuugguagca

SEQ ID NO: 374023 - RNA, 64 nt, Human
aauuuuaaaagaaccauaaauucuaagguaucuaaaaaccuaugaguauuuaauucauagaaaa

SEQ ID NO: 374024 - RNA, 64 nt, Human
cugauauuuuuaaaucuuuaacuuuuuaaaguuaaaaaccuacagcugcuuagguccagcuucu

SEQ ID NO: 374025 - RNA, 64 nt, Human
gggacaugagacaccacauuccauuugugcuagaaaaaccuauccacugaugagucuaacuguu

SEQ ID NO: 374026 - RNA, 64 nt, Human
cuacaaggagaguguuacaugguguugggggaagaaaaccuacgcuucaggcucagagaaaccu

SEQ ID NO: 374027 - RNA, 64 nt, Human
ggaaaaucauucaggaagaaaugaccugucuaaaaaaaccuaaggaagaauaauaauauaagaa

SEQ ID NO: 374028 - RNA, 64 nt, Human
uucagaguuguuuggggguucuguuucagagcauaaaaccuaaagguuauaguagaacaaggca

SEQ ID NO: 374029 - RNA, 64 nt, Human
uuuuucaucaacugucaaaaacuucaacccuuuuaaaaccuagauauaaaugcuuacauguaaa

SEQ ID NO: 374030 - RNA, 64 nt, Human
gcagcuuaacaacaaaggauaaaucagacuauacaaaaccuaaguguauuaauuugaugauugu

SEQ ID NO: 374031 - RNA, 64 nt, Human
cuagugacaacacuuaauuucuuuucuaauaaaaaaaaccuauagaugauucagugauuuuugu

SEQ ID NO: 374032 - RNA, 64 nt, Human
uuaacgugaacucacaggcggauuaaagugaaauaaaaccuaccauuugaguuacauucucagc

SEQ ID NO: 374033 - RNA, 64 nt, Human
uugucccuauuguagaugaaauagugauguagcaaaaaccuaguaaauucugaaugcuuuucca

SEQ ID NO: 374034 - RNA, 64 nt, Human
agguauucaguuucuuguauuaugauuucuaaagaaaaccuauuaaauauuuggaauuuagaug

SEQ ID NO: 374035 - RNA, 64 nt, Human
agacguggaagaaagcuuaaguaaacaauaaaauaaaaccuauacacuauuuuaagaaggggcu

SEQ ID NO: 374036 - RNA, 64 nt, Human
uucagccaaaauucuucagcuucauauugucuugaaaaccuaugauugucucuaacaaacaggc

SEQ ID NO: 374037 - RNA, 64 nt, Human
agcauuaaacuguugaacuuuuuuuuguacuuagaaaaccuagauacugcagucagauuuugga

SEQ ID NO: 374038 - RNA, 64 nt, Human
aacaugaaaaagccauacauguauuauuucuccuaaaaccuaaggcauuaucuguugguuuggc

SEQ ID NO: 374039 - RNA, 64 nt, Human
uuuccaggcacuugaacugugcuacaaguaggggaaaaccuacuuuaaaguaugguaaaugugu

SEQ ID NO: 374040 - RNA, 64 nt, Human
ucacauugaguugggcccauugguuauuugaccuaaaaccuaaucaccgcuaccauagcacauc

SEQ ID NO: 374041 - RNA, 64 nt, Human
ucaaagaaucaguguaagccacuaaaaggaacugaaaaccuaggugucacaauaaacagucuac

SEQ ID NO: 374042 - RNA, 64 nt, Human
gaaaugcauucauaucaaaauuggaauagaaaggaaaaccuauuuuuaagauaucaaccuauuu

SEQ ID NO: 374043 - RNA, 64 nt, Human
aaaaaaagaagaaagagagaaagaaagaaacagaaaaaccuaaaagaaagcgaaugaauuugac

SEQ ID NO: 374044 - RNA, 64 nt, Human
ggcacacugugucuucagacaguuugaaggaaugaaaaccuagagauuuuaaaucaugaauuga

SEQ ID NO: 374045 - RNA, 64 nt, Human
cugugauacuauuaccaccaccugcucacuggucaaaaccuacacagcuguuuccucacgucca

SEQ ID NO: 374046 - RNA, 64 nt, Human
uugagcaccagaaaauaaaauccauauauuaauaaaaaccuaucuugaaaaacuaguggagugu

SEQ ID NO: 374047 - RNA, 64 nt, Human
uauccuauaguuacuaugaaguuaacacagcccaaaaaccuacuucuccuuguguuuuuuucca

SEQ ID NO: 374048 - RNA, 64 nt, Human
uucucugaaauggguaaaggacaaauuguguaaaaaaaccuaugcacuauagaagggaauagua

SEQ ID NO: 374049 - RNA, 64 nt, Human
uagcuuauauaaggucauuacauuuuuuaacugaaaaaccuaguuaccugauuauugcacauua

SEQ ID NO: 374050 - RNA, 64 nt, Human
ggaccagaauccaaacggccucaaguggaauuuuaaaaccuagccugucucuuuucccugggau

SEQ ID NO: 374051 - RNA, 64 nt, Human
caaagagcaguguuuaaaaggagagcuucuauacaaaaccuauuccuggcguuacuuuucauac

SEQ ID NO: 374052 - RNA, 64 nt, Human
ucucuuuuuaaauauuuuauaacuuuuaaauggaaaaaccuauuagguaaauggaaauaauccu

SEQ ID NO: 374053 - RNA, 64 nt, Human
aauuugguaucuuauuaaugaguuuuaaagauguaaaaccuaaccuuuuuuaaagcuccauugu

SEQ ID NO: 374054 - RNA, 64 nt, Human
ucaauuuuguaaaaucaaauuacauauauauaaaaaaaccuaucuguauuagacaaaaacuguu

SEQ ID NO: 374055 - RNA, 64 nt, Human
aggucagcugccagaugaguugcaaaaacagaaaaaaaccuacccauugaauaacuucuuugaa

SEQ ID NO: 374056 - RNA, 64 nt, Human
cacuggaggcuacaucacccaaaguagauguuagaaaaccuaaauuaaugaaccauauuuuuaa

SEQ ID NO: 374057 - RNA, 64 nt, Human
aaaagauuaucaggauaacaugaccuugccuugaaaaaccuaaauuucauacagaaaggaaaaa

SEQ ID NO: 374058 - RNA, 64 nt, Human
uuuucccacagcagcauauuuuagaggcacauacaaaaccuacauucucuaguugggaguggau

SEQ ID NO: 374059 - RNA, 64 nt, Human
gauaaaucaaaacauuagguuccaaaaauucuaaaaaaccuaaacucuucaggcuaccuuugug

SEQ ID NO: 374060 - RNA, 64 nt, Human
ugaaauuagacaaucuaccaauucuucaaccagaaaaaccuauuguucuaaaagugcacuuaag

SEQ ID NO: 374061 - RNA, 64 nt, Human
agcucggauucaacuaccuuagauaauauuucugaaaaccuaccagccagaggguagggcacaa

SEQ ID NO: 374062 - RNA, 64 nt, Human
uagagaauaguaaccagguuuuguuuuuaacuuuaaaaccuaauuacuuuugugccucucagcc

SEQ ID NO: 374063 - RNA, 64 nt, Human
uguuuagacaugaaaucaucuuccuugucucaugaaaaccuaaauauaaaaaaaaggaaaauac

SEQ ID NO: 374064 - RNA, 59 nt, Human
ugaaccaguugcuacuauaagaguacuugaaaaccuagaagaaacuaccacagaagcaa

SEQ ID NO: 374065 - RNA, 64 nt, Human
uuuuguacaucccuguucuauauuguuuauagggaaaaccuacaggacuuucacuaaagcuagc

SEQ ID NO: 374066 - RNA, 64 nt, Human
acuaugacuuaguugcguuacacccuuucuugacaaaaccuaacuugcgcagaaaacaagauga

SEQ ID NO: 374067 - RNA, 64 nt, Human
cuuguagcauuuggaaaugauuuacuggaauuacaaaaccuauuuuuccuuuaaauuucagcuu

SEQ ID NO: 374068 - RNA, 64 nt, Human
gccaggaguuuaaggccagccugggcaacauagcaaaaccuagucccuaaaauuaaaaaaaaaa

SEQ ID NO: 374069 - RNA, 64 nt, Human
ugccauuaauccaauauguuuccaucacuuugccaaaaccuauuuaaaacagugaauuaaauuu

SEQ ID NO: 374070 - RNA, 64 nt, Human
auuucgaaccuaaaguuuagaugcauuguauaaaaaaaccuaaaagcaguaucuguuauuuagc

SEQ ID NO: 374071 - RNA, 64 nt, Human
uccaaagggaguucaguuaaucucugaaaugcacaaaaccuagcuauuuucucccucucaucac

SEQ ID NO: 374072 - RNA, 64 nt, Human
ugucuucuuccugcccucagcaccacagcucaagaaaaccuaaaguuucaauacaagccauagg

SEQ ID NO: 374073 - RNA, 64 nt, Human
uugcuuagagcuaugagaaauguuuguuuuaauaaaaaccuacaguccaauaaugccaacugcc

SEQ ID NO: 374074 - RNA, 64 nt, Human
aguuguuguuugggguacaagaugagaagaaagaaaaaccuacagccuuucuacauucugacau

SEQ ID NO: 374075 - RNA, 64 nt, Human
uccucgccgugucuggcacugaaaauaaggaaaaaaaaccuacuacugaauaaaagugacaaag

SEQ ID NO: 374076 - RNA, 64 nt, Human
ccaaauuaggaagugcagaagcacaugauggugaaaaaccuaggauuuggcagccuuccagaau

SEQ ID NO: 374077 - RNA, 64 nt, Human
auuuccuaugucuacagcauaccuuauuagguauaaaaccuacugcaacuuagaaaaaggaaag

SEQ ID NO: 374078 - RNA, 64 nt, Human
gauuguauauaguaagaaaagaucaaaagacuuuaaaaccuaaaugacuuuugacauacaaacu

SEQ ID NO: 374079 - RNA, 64 nt, Human
uaguaauuaugaauuuaagaccauauuauuaucaaaaaccuagagaccaaucauauaucugaaa

SEQ ID NO: 374080 - RNA, 64 nt, Human
acccuaagucuuacauaaugccaccaguccauccaaaaccuauauaucaccuauacuauauaua

SEQ ID NO: 374081 - RNA, 64 nt, Human
aauuccuggcacuucuuuuuacugucuauaagagaaaaccuaucauaagcccaauuuuuuuuuu

SEQ ID NO: 374082 - RNA, 64 nt, Human
ugaacugagagaaaaaaaucagguuuuaaacaggaaaaccuauggggaaugauauuuuuugaaa

SEQ ID NO: 374083 - RNA, 64 nt, Human
aaaaggaaaaaaauuggugacagagcacaaauagaaaaccuauuuuuaaauagaaaucacaaau

SEQ ID NO: 374084 - RNA, 64 nt, Human
ucugguuuuguuugccaaugagcauaauaaauguaaaaccuauauaguaucccugugauuauug

SEQ ID NO: 374085 - RNA, 64 nt, Human
augcuuaaaauuauacauaaaaugcuuuauuuagaaaaccuacaugauacaguggugucagccu

SEQ ID NO: 374086 - RNA, 64 nt, Human
uuaaaggacuggggguuugcucaaaaggaaauccaaaaccuauucuaaacaauuugcauuuaua

SEQ ID NO: 374087 - RNA, 64 nt, Human
aauaucauuguacauagcauguuuauaucugcaaaaaaccuaauagcuaauuaaucuggaauau

SEQ ID NO: 374088 - RNA, 64 nt, Human
aaugcgccgguggggaaugaacuguuucauuaauaaaaccuaauuugucuugauccauuccacu

SEQ ID NO: 374089 - RNA, 64 nt, Human
cuguaguuaucuguguacacaguuuacagcuacaaaaaccuacuuugguauuuauuacagaaaa

SEQ ID NO: 374090 - RNA, 64 nt, Human
cuuugugggaucauaugucuuggccaaagaugggaaaaccuauguugaagaggcagcccuugag

SEQ ID NO: 374091 - RNA, 64 nt, Human
gagcaaguggggaccuggccauggccccucagcaaaaaccuauucacagcggguggggaaacac

SEQ ID NO: 374092 - RNA, 64 nt, Human
gacauuuucauaugcaauggaaaacagccacaaaaaaaccuaccuuauauggaaguuguagccc

SEQ ID NO: 374093 - RNA, 64 nt, Human
gggguaggagaaacccaugacauuagaauugaauaaaaccuagaaguuggauauuggcauauug

SEQ ID NO: 374094 - RNA, 64 nt, Human
caucucauucuucccuuucuaaauggaacuuuuuaaaaccuacguuauuuucccucaaacaauu

SEQ ID NO: 374095 - RNA, 64 nt, Human
aaguauuuuagguucagugagcauuugccugaauaaaaccuaaaagaguagucuuaacacauua

SEQ ID NO: 374096 - RNA, 64 nt, Human
ggaaaugaguagaauugcugaaagucucuauguuaaaaccuauaguguuugaauucaaaaagcu

SEQ ID NO: 374097 - RNA, 64 nt, Human
aaauguuauaaauccuuaggagaaauauucccucaaaaccuagucaagaaagugccacauuccc

SEQ ID NO: 374098 - RNA, 64 nt, Human
agcaugagcugcuauagaauacccucccagcaacaaaaccuaaucaguaaggccagcuagaccc

SEQ ID NO: 374099 - RNA, 64 nt, Human
caucucaagucuagugaagacagccaacagaaacaaaaccuagcauagggauagaaaauaccau

SEQ ID NO: 374100 - RNA, 64 nt, Human
gaaauaaaaaugcaugauuaaaaacuaagaauaaaaaaccuauuuuuauguuuccuaaaggaaa

SEQ ID NO: 374101 - RNA, 64 nt, Human
cgucucauucuucccuuucuaaauggaacuuuuuaaaaccuacauuauuuucccucaauuuauu

SEQ ID NO: 374102 - RNA, 64 nt, Human
uuuauucacuaaaguagcugacacaaaacacaccaaaaccuagagcgguaguuuuauguaaaug

SEQ ID NO: 374103 - RNA, 64 nt, Human
aagaaacuauauagguauacacuuacgacuucacaaaaccuauacuuaauauaguaaaucuaag

SEQ ID NO: 374104 - RNA, 64 nt, Human
auucaagaguggauguggcccugucacagguagaaaaaccuauuuaguuaauucuuucuuggcc

SEQ ID NO: 374105 - RNA, 64 nt, Human
gcaugcaaaauuugaaauuuuaacauuggcacccaaaaccuacauggaauguaugucuggagua

SEQ ID NO: 374106 - RNA, 64 nt, Human
ucuuaaggguagaucagaaaugacaaaugaauucaaaaccuagcaggugcauuguaaaugugug

SEQ ID NO: 374107 - RNA, 64 nt, Human
ugcuuaaaaaaaauuucaugugagggaaaaaaaaaaaaccuauuccagaauaaguuuuguguug

SEQ ID NO: 374108 - RNA, 64 nt, Human
ucuuacggcuuccauaauggcuaguugauauucaaaaaccuauuucuguguuuugagggguggg

SEQ ID NO: 374109 - RNA, 64 nt, Human
auucaguuuuugaggccaguacaaccuugauaacaaaaccuaaaaaaaaaacaacaaaaaaacc

SEQ ID NO: 374110 - RNA, 64 nt, Human
caagaaaaaucucagcuugcuuacugcuuaauuaaaaaccuacaauuuacacaccucccugccu

SEQ ID NO: 374111 - RNA, 64 nt, Human
uuuaaaguuuucaauuacgagcaauuuggaagaaaaaaccuaaggugcuuuucaaaagaguaac

SEQ ID NO: 374112 - RNA, 64 nt, Human
uguaauuaaucuauaaugccauaaaugauaaugcaaaaccuaaauaauaugguggccggagggg

SEQ ID NO: 374113 - RNA, 64 nt, Human
aacauucaaagugucagauuccuugggaguauggaaaaccuaauggugcuucucccuuggaaau

SEQ ID NO: 374114 - RNA, 64 nt, Human
auuguggaaacaagccaaaccaaaugaacucuggaaaaccuaaaacaaauguacauuuuccuuu

SEQ ID NO: 374115 - RNA, 64 nt, Human
ggaagagacaagcaagcaaugaacaaauuagcagaaaaccuaguuuuagugaaaaaugcuguaa

SEQ ID NO: 374116 - RNA, 64 nt, Human
aggcaaacaguuccaaaacuguucuuuuagguucaaaaccuaauucccccagauuaguauacuc

SEQ ID NO: 374117 - RNA, 64 nt, Human
cccauaacagaaugaccuauauuacaaccgauauaaaaccuagguguaggauauucuucaagca

SEQ ID NO: 374118 - RNA, 64 nt, Human
cagggcgcaagccucacuauuacuugaacuuuccaaaaccuaaagaggaaaagugcaaugcgug

SEQ ID NO: 374119 - RNA, 64 nt, Human
gguguggaaaaugcuuuucuguuaguagaaugcaaaaaccuaccuaagccacauaauaauaaaa

SEQ ID NO: 374120 - RNA, 64 nt, Human
caaaauuuaaaaagcgcaaauagguaucuaguggaaaaccuaagccucccucucuccuccggca

SEQ ID NO: 374121 - RNA, 64 nt, Human
auuaauuggaaaguugauuuuuaugauaauauggaaaaccuaaccauuauaaaaaagcaaacuu

SEQ ID NO: 374122 - RNA, 64 nt, Human
uugugccacacaggauuuuuuuuuuuuuuuaagaaaaaccuauagaugaaaaauuacuaaugaa

SEQ ID NO: 374123 - RNA, 64 nt, Human
uugaaucuucauaaguuaaaguaaaaaacagcaaaaaaccuagaucuuugucuuuuagaacaca

SEQ ID NO: 374124 - RNA, 64 nt, Human
ucaagacaugcuucaacauugccuucauuccuuaaaaaccuacaaaaggugguguaaauuaaua

SEQ ID NO: 374125 - RNA, 64 nt, Human
gaguugugaauggcagggaucauucuggguaaaaaaaaccuagaaucauuucugaugugcaaca

SEQ ID NO: 374126 - RNA, 64 nt, Human
caguuguauuugugggauuucacccauuauuaauaaaaccuauauuuauacaguaugcaaugug

SEQ ID NO: 374127 - RNA, 64 nt, Human
uggauuuacaagguuguuaaggcuguaagagucuaaaaccuacagugaaucacaaugcauuuac

SEQ ID NO: 374128 - RNA, 64 nt, Human
uacugccucaucuugauuuauaagcaaaaccuggaaaaccuacaaaauaaguguugugguuuau

SEQ ID NO: 374129 - RNA, 64 nt, Human
aacuuggucgagaccacucagccuugagaucaagaaaaccuaaucuucugacucccaggccagg

SEQ ID NO: 374130 - RNA, 64 nt, Human
aaagcucuaauagagucacagcuuucccagguauaaaaccuaaaauuaagaaguacaauaagca

SEQ ID NO: 374131 - RNA, 64 nt, Human
auuuucuguccagucaauguugguuacuaaauagaaaaccuaauuaaggaaguaacuuuuuucc

SEQ ID NO: 374132 - RNA, 64 nt, Human
acauuucaucauguaaaauuccuguuauucuggaaaaaccuauuguuuugaucuucuuguuuuc

SEQ ID NO: 374133 - RNA, 64 nt, Human
cagcuuggcuggucugaggccaccuucuuagccaaaaaccuaggguucauuuucaggacuuuga

SEQ ID NO: 374134 - RNA, 64 nt, Human
ccuugaagaaguaugugagagggccacauuggcuaaaaccuaaagguggccucuaggagaugag

SEQ ID NO: 374135 - RNA, 64 nt, Human
uaccauccacauuggaauauacauggaauauuguaaaaccuacaugagcagaugaaauagaagc

SEQ ID NO: 374136 - RNA, 64 nt, Human
ucugccaauaaauucuaaauuacaaagguaagagaaaaccuaguacauuacuaaauauauaaag

SEQ ID NO: 374137 - RNA, 64 nt, Human
auuggggagguuuguggaaauucaauuaugaugaaaaaccuaucuuuuuuguaauguuggcaua

SEQ ID NO: 374138 - RNA, 64 nt, Human
aucuuuugcauguagcuuccuuaauggagaaaaaaaaaccuaauaaauuuccagaaucauaauc

SEQ ID NO: 374139 - RNA, 64 nt, Human
auuguaaauuggcauacaauacugccuuuaauagaaaaccuaaaugcuggggcacauuucacau

SEQ ID NO: 374140 - RNA, 64 nt, Human
ucauggguucugacuucagccaaacaaaacaaucaaaaccuaccaaaaagggacuggauuguaa

SEQ ID NO: 374141 - RNA, 64 nt, Human
aaaauaacccagaaaugcucuuugaccgucacuuaaaaccuaagacauguggcgaaauuccauc

SEQ ID NO: 374142 - RNA, 64 nt, Human
ggaaaaaaauauauauauauagacaggacuagagaaaaccuauuuuuguaaugauguuucuuug

SEQ ID NO: 374143 - RNA, 64 nt, Human
aagauuuaaagggaugccagcgauugcucuuuucaaaaccuaccagucccacuguggguggaga

SEQ ID NO: 374144 - RNA, 64 nt, Human
agccaaccagagaucuugaucucucucugaggaaaaaaccuagaaaugaugguuagaaucagga

SEQ ID NO: 374145 - RNA, 64 nt, Human
cuucuacuaauacuucuaaaaauuuucuguuaugaaaaccuauuuaauuccacuaaauuuguuc

SEQ ID NO: 374146 - RNA, 64 nt, Human
guucccaauguaucuuaaugaaaagugcaaaagaaaaaccuaccaauuaacuugugugguuugu

SEQ ID NO: 374147 - RNA, 64 nt, Human
uaaucuaaacauuuuauauuuccuucuuuuggaaaaaaccuacaugcuacaagccaccauaugc

SEQ ID NO: 374148 - RNA, 64 nt, Human
gaguuacucuggucugagucaacuuucgcuggggaaaaccuauggaaccuacugcaaaaagauu

SEQ ID NO: 374149 - RNA, 64 nt, Human
uuucaaucuguuauauguucuguguuuaaugaagaaaaccuauuuauuaaugaaaaauauaaua

SEQ ID NO: 374150 - RNA, 64 nt, Human
uagaccauuuuccaaaaaggaaacuuuauuuucaaaaaccuaauccguaguaauuccuaaucuu

SEQ ID NO: 374151 - RNA, 64 nt, Human
ucuuuauuaaaaaucacaauauuccgaaaacaaaaaaaccuaggagauaaauguagagguauug

SEQ ID NO: 374152 - RNA, 64 nt, Human
guucuauuaaagaguauacuccuauuggaugaaaaaaaccuauuuuugaauaguaguugcagcu

SEQ ID NO: 374153 - RNA, 64 nt, Human
cuguccugugaggacagcugaggccaaggagugaaaaaccuauuacuacuaagagaaggggugc

SEQ ID NO: 374154 - RNA, 64 nt, Human
ugcacauauugcuuccagucacaucucauggguuaaaaccuagacauuugccacaucuagcugc

SEQ ID NO: 374155 - RNA, 64 nt, Human
caguugccuguuacagaauaacucuucuuaacuaaaaaccuagucaaacaaggaagcuguaggu

SEQ ID NO: 374156 - RNA, 64 nt, Human
aguauuuaucauuugcaugacuaauggcacaggaaaaaccuauucauaaguuuuacaaucaagu

SEQ ID NO: 374157 - RNA, 64 nt, Human
gugggaaugaaggaauucuggagcuuuuugacacaaaaccuauuaccacauuuagcaguuaaau

SEQ ID NO: 374158 - RNA, 64 nt, Human
caaggaaccuuuuucaaugaaagagaaggaaguuaaaaccuauagguuauuuuguagagcugag

SEQ ID NO: 374159 - RNA, 64 nt, Human
uguguaaguuaagucuugacucuuucaaaugcaaaaaaccuauuuuaugcuuuguuaaaauuau

SEQ ID NO: 374160 - RNA, 64 nt, Human
guuaacgucauauuauguuaauguugcugaaaacaaaaccuaacaaaccuugauguaccagucc

SEQ ID NO: 374161 - RNA, 64 nt, Human
auacguauuaaacaguuuacagucuaaaggaaacaaaaccuauauguuauaauauccaagaagu

SEQ ID NO: 374162 - RNA, 64 nt, Human
auuagcucuuugauacaaaguaacucagaacgucaaaaccuauacccacuaaagggaaggcugc

SEQ ID NO: 374163 - RNA, 64 nt, Human
ucucuuuguacuguuuuuaauuuggccugaugcuaaaaccuaucagcuuaguuuuuuaacaugg

SEQ ID NO: 374164 - RNA, 64 nt, Human
uuuuaucugaaacuuuguacacuuuuccacuuucaaaaccuauuuuaaguacagcaaaauuuau

SEQ ID NO: 374165 - RNA, 64 nt, Human
aaggcacuucauguaaagugucagaaggagcuacaaaaccuacccucagugagcaugguacuug

SEQ ID NO: 374166 - RNA, 64 nt, Human
uuuucuuuuaaaaauaacuuuuuaucaguacagaaaaaccuaagggaugacuagcuuacaaaua

SEQ ID NO: 374167 - RNA, 64 nt, Human
uuguauuaaaaaugaaaaaugaaaaaacaaauucaaaaccuauucaaauggguucuaguucaau

SEQ ID NO: 374168 - RNA, 64 nt, Human
aacaaaugggaauugauguugaauauuuaccuuaaaaaccuauacaacaauaagaggagugcgc

SEQ ID NO: 374169 - RNA, 64 nt, Human
gauuuggguacuauuauuuccauuugacagaugaaaaaccuaaugcauagaaagauaaguagac

SEQ ID NO: 374170 - RNA, 64 nt, Human
aauacccauuuauuggcuauuuaagguaaauuauaaaaccuaaaauuaguaucaguauuuuaga

SEQ ID NO: 374171 - RNA, 64 nt, Human
accuuccgguggguugcugaugagagaaccugaaaaaaccuacaccucuacagcaggucgaauu

SEQ ID NO: 374172 - RNA, 64 nt, Human
ucauguagucagccacuuaugcaccaaugugaggaaaaccuaaagggaaauuaaacuaaacacu

SEQ ID NO: 374173 - RNA, 64 nt, Human
cugugauugcaaugugagaccgaauguaauauggaaaaccuaccaguggggugugguugugccc

SEQ ID NO: 374174 - RNA, 64 nt, Human
gugaucuguaaugaaaagaaucuguacugcaaguaaaaccuacuccccaaaaauguguggcuuu

SEQ ID NO: 374175 - RNA, 64 nt, Human
guagaugcaccucuuuaccuuuuuuacuuggauaaaaaccuaugaugauuuuguccugugugua

SEQ ID NO: 374176 - RNA, 64 nt, Human
gauguagcuugugcagauguagcaggaaaauaggaaaaccuaccaucucagugagcaccagcug

SEQ ID NO: 374177 - RNA, 64 nt, Human
cuucuuccuguacaacgccuccaaggccaggagcaaaaccuacaucaacaugcgggaggugucc

SEQ ID NO: 374178 - RNA, 64 nt, Human
augauguccuuuaaguccuaaaggaaugcuucagaaaaccuaaagugcuguaaaaugaaaucau

SEQ ID NO: 374179 - RNA, 64 nt, Human
auugggaaccuaaguugcuacuaaaucauaguucaaaaccuaauaauguugucguuguugcuau

SEQ ID NO: 374180 - RNA, 64 nt, Human
ggaauuguaauuggcuuaacagaaacagucuguaaaaaccuaacaguggugcaaucauguuguc

SEQ ID NO: 374181 - RNA, 64 nt, Human
ugucauguguuaugaacaauuuucauaugcacuaaaaaccuaauuuaaaauaaaauuuugguuc

SEQ ID NO: 374182 - RNA, 64 nt, Human
uguuauucagguauaaaaacaagagaucauaauaaaaaccuaaaagaaccuaugaucacggucu

SEQ ID NO: 374183 - RNA, 64 nt, Human
ucauuauuuguagacaauaaaacugccuaccuguaaaaccuaagaaucaacugaagaccuguua

SEQ ID NO: 374184 - RNA, 64 nt, Human
gacuuuauaagcauuaaaaaaaacuaauggagguaaaaccuaaaugcgaugugaaauaauuuua

SEQ ID NO: 374185 - RNA, 64 nt, Human
auguaccuuauuaugcugacauacuaaaaaaaauaaaaccuaguauuguaugaaggauagcuau

SEQ ID NO: 374186 - RNA, 64 nt, Human
ucugugugggaacacaagauaguaaacuuauuuaaaaaccuauuaguagaauuaguggaaacac

SEQ ID NO: 374187 - RNA, 64 nt, Human
auuuuuaaaaaaggaaaaauaaaaguaucaugaaaaaaccuauuuuuuuuuccacuguccuucc

SEQ ID NO: 374188 - RNA, 64 nt, Human
ccagagcaucuugaccuaaucagcuuacaguuugaaaaccuagcucuccagaacaugagaugag

SEQ ID NO: 374189 - RNA, 64 nt, Human
ugguuuuuaccccacccucaacccucuccagcauaaaaccuagugagcuaaaggcuuugucugc

SEQ ID NO: 374190 - RNA, 64 nt, Human
acaaugcauugaguaguuaggaagaagauggauaaaaaccuauuacauauuuguaauuuauuaa

SEQ ID NO: 374191 - RNA, 64 nt, Human
ugccaucuagugauacacuuuuguaaaguacagcaaaaccuacagauauauacaguauauaaau

SEQ ID NO: 374192 - RNA, 64 nt, Human
guacguuggggacugccuguauuuggaagauuuaaaaaccuagcauccuguucucacccucuaa

SEQ ID NO: 374193 - RNA, 64 nt, Human
uuuuauaauuugcaaauuuuuaaguaauuuaugaaaaaccuagaucaguggaucuccucucugg

SEQ ID NO: 374194 - RNA, 64 nt, Human
auaaagauuguuguaauauugaaaugagccuacaaaaaccuaggaagagauaacuagggaauaa

SEQ ID NO: 374195 - RNA, 64 nt, Human
ucauguuaaaaaaaaaaauguauuucauaucuauaaaaccuauauagccauuuagcugaagccc

SEQ ID NO: 374196 - RNA, 64 nt, Human
ggcacaugccuguauuacugaaagcuaaauccucaaaaccuaguaaggggacuaaugauucauu

SEQ ID NO: 374197 - RNA, 64 nt, Human
uaucagggcaaaaucucacuggauuucuccacugaaaaccuacuugagguuucuggucugaagg

SEQ ID NO: 374198 - RNA, 64 nt, Human
aaccugcgugccagauuuagacucgucuuuaggcaaaaccuacagcgcccccccccucacccca

SEQ ID NO: 374199 - RNA, 64 nt, Human
guaagugauguggacauaauugccuacaauaaugaaaaccuacaggaauuuuuuuauuuuucau

SEQ ID NO: 374200 - RNA, 64 nt, Human
uuuucuucauucauuuggaaccuuauuuucgcaaaaaaccuagcuggaauaauaaugccauauu

SEQ ID NO: 374201 - RNA, 64 nt, Human
agagccacuccuuuaauacagaaacuucauugaaaaaaccuagcccuguacagcugcccuuuua

SEQ ID NO: 374202 - RNA, 64 nt, Human
ucuaauuuguauaaaugguacuaugguacuaauaaaaaccuaaauucuccaaccaauuuuuuua

SEQ ID NO: 374203 - RNA, 64 nt, Human
uuauuaagcuuguuuuuguggaaaaaaacuuacuaaaaccuagguaacucuagauuaggccagu

SEQ ID NO: 374204 - RNA, 64 nt, Human
aggucaugaaguuccuggcaaagauuuucuguuaaaaaccuaugcugguuugcuuuggaucaca

SEQ ID NO: 374205 - RNA, 64 nt, Human
cugggcuccgggccuuuccacuacguugaagaagaaaaccuauuuuuaaauguaaauaaaauau

SEQ ID NO: 374206 - RNA, 64 nt, Human
acgagaucaacgcgaggggccuguaucuugaauuaaaaccuacucgcuuccuuucugcacucug

SEQ ID NO: 374207 - RNA, 64 nt, Human
ucuuguguuggaguuauagaauucuacaucuuauaaaaccuaacuggcauuuaaaaaauacugu

SEQ ID NO: 374208 - RNA, 64 nt, Human
gcuaugaagacuacuuuuagaucaacaauaaaaaaaaaccuacaaaaaaaccuuuauucuuuaa

SEQ ID NO: 374209 - RNA, 64 nt, Human
cccuuggccaaaaaaaaacaaaaagcaaaaaacaaaaaccuacccuguucugguuuuuuuccuc

SEQ ID NO: 374210 - RNA, 64 nt, Human
agagaaauaauaacuaaaaaauauacccuuuaaaaaaaccuauauuucucugucuaaaaauaug

SEQ ID NO: 374211 - RNA, 64 nt, Human
ggaggcaauuuggaaauuauuucugcuucuuaaaaaaaccuaagauuuuuuaaaaaauugauuu

SEQ ID NO: 374212 - RNA, 64 nt, Human
uugauugaagauguauauaauaucuccgguuuauaaaaccuauuuauaacacuuuuuacauaua

SEQ ID NO: 374213 - RNA, 64 nt, Human
aguagagaguaauauugaagacaaaauauuugggaaaaccuaucggaagaaggcaagccucccc

SEQ ID NO: 374214 - RNA, 64 nt, Human
ccagcagcggcaccaaggggccuuagggagccccaaaaccuaccacucgcguguuccccaagcg

SEQ ID NO: 374215 - RNA, 64 nt, Human
auagagucugugaaugauucuugaaauaauauguaaaaccuacugaaaguuaauccuuuuuaaa

SEQ ID NO: 374216 - RNA, 64 nt, Human
cuucacccaacuuaaauguucuugagaugaaaauaaaaccuauucccauguucuaugguuggca

SEQ ID NO: 374217 - RNA, 64 nt, Human
cucccuguuuuuaagagacucuuuuaaaaaaaaaaaaaccuaauguuuuuaucuugagucaaua

SEQ ID NO: 374218 - RNA, 64 nt, Human
uuacaaauaaacuuguuuauccaacuaaguguccaaaaccuaaauugaauguacuaaguuuuca

SEQ ID NO: 374219 - RNA, 64 nt, Human
auugacucagcauugccuucauuccuuaaaauuaaaaaccuacaaaaguugguguaaauuugua

SEQ ID NO: 374220 - RNA, 64 nt, Human
uauuuauuuguagguauuuauauauugaaauauaaaaaccuagauuuauggaguuuccucuaga

SEQ ID NO: 374221 - RNA, 64 nt, Human
uuugaauuagagcuacuuugagccucuuaggcagaaaaccuaccacauucacuacugcaaaaug

SEQ ID NO: 374222 - RNA, 64 nt, Human
auuagcauagcauucuuaaaggaaugcagugcucaaaaccuacccaaauucccgcaggauucua

SEQ ID NO: 374223 - RNA, 64 nt, Human
acuuuauuagaauuggaaggcaaauuuuuguccaaaaaccuacagacaaguacuuugagagaau

SEQ ID NO: 374224 - RNA, 64 nt, Human
guaauuaaacucggguacaaauuggcauaacaugaaaaccuauggaacuagaauuauuauuaaa

SEQ ID NO: 374225 - RNA, 64 nt, Human
auguugaaauccccuaaacacaguucucaguggcaaaaccuaggaaggcucauguucccagaga

SEQ ID NO: 374226 - RNA, 64 nt, Human
ucauguaugaaaacauaaaauugaaaaaaaaaaaaaaaccuacacgagcaccgugauuucaagu

SEQ ID NO: 374227 - RNA, 64 nt, Human
gcuuuaaauuacgagagacuugugauaggacaguaaaaccuagaguuggaguuggaucucugga

SEQ ID NO: 374228 - RNA, 64 nt, Human
caaacagaagcccuacaagugugaagaauguggcaaaaccuauaaaccuauaacaaguucucaa

SEQ ID NO: 374229 - RNA, 64 nt, Human
cauguuagaccuaaaaccauaaaaacccuagaagaaaaccuaggcaauaccauucaggacauag

SEQ ID NO: 374230 - RNA, 64 nt, Human
cauuaguaaacauaagauaauucauacuggagagaaaaccuacaaaugugaggaauguggcaaa

SEQ ID NO: 374231 - RNA, 64 nt, Human
uaggcccugucuaggaaaugggaauuuacauccuaaaaccuaguuguucauuuguuuagaguau

SEQ ID NO: 374232 - RNA, 64 nt, Human
uaucguuuugagcuaccugccaucuucucuuugaaaaaccuaugggcuugaggaggucacgaug

SEQ ID NO: 374233 - RNA, 64 nt, Human
cugaguuuuuauaguuaucugaauuccauugaagaaaaccuauuuuuguaugaauaugaccagu

SEQ ID NO: 374234 - RNA, 64 nt, Human
cagcucucugauuccccaaaucugcauccuuuucaaaaccuaaaaacaaaaagaaaaacaaaua

SEQ ID NO: 374235 - RNA, 64 nt, Human
gauuacuauaaacaccuguaugcacacaaacuagaaaaccuagaaaaaauuaauaaauuccuug

SEQ ID NO: 374236 - RNA, 64 nt, Human
aaaucaacucaagauggauuaaagacuuaaauauaaaaccuaaaaguauuaaauuccuagaaga

SEQ ID NO: 374237 - RNA, 64 nt, Human
uuaaguuaaagcacacauucuucaaaauagccuaaaaaccuagccucuaacaccuuguuccagg

SEQ ID NO: 374238 - RNA, 64 nt, Human
cagaagguacuaaugucagcucacguggccuuuaaaaaccuacuuccccgcccgcaggagcuca

SEQ ID NO: 374239 - RNA, 64 nt, Human
uguuagggaaaauauggaacuucucccuggaugcaaaaccuaugaguauauuaauauuggaaaa

SEQ ID NO: 374240 - RNA, 60 nt, Human
augagagacugucagcauaaggaaugugggaaaaccuaaaggugucccuguucucucuga

SEQ ID NO: 374241 - RNA, 64 nt, Human
uguacagaaacgcuaugaauguaaacaauguggaaaaaccuacauaucuucuguagguuuucaa

SEQ ID NO: 374242 - RNA, 64 nt, Human
uuauacaagaaauaauuagaaaauguguugauagaaaaccuaagaauaaacacaacaaugaguu

SEQ ID NO: 374243 - RNA, 64 nt, Human
ucccagauuagauuuuugagauccaaaaaaaaugaaaaccuaggaaaguagcaaauaugugagc

SEQ ID NO: 374244 - RNA, 64 nt, Human
aaaucuugaaccccaggaauaguauuauguaaugaaaaccuaugaauauaacaaauauggaagu

SEQ ID NO: 374245 - RNA, 64 nt, Human
accauuuuuuaucguuuuugaaggagaucuuuuuaaaaccuacaagagacaucucucuaugccu

SEQ ID NO: 374246 - RNA, 64 nt, Human
cacuaaaaccacaaaguccugcuuaaaacuauggaaaaccuaaccugauuagagccuugacuau

SEQ ID NO: 374247 - RNA, 64 nt, Human
agcuauuuacuaauaggcuuuucauauaauuaggaaaaccuaauaucacaucuauaguaaccau

SEQ ID NO: 374248 - RNA, 64 nt, Human
gauucuuacuuucuggaucuugacacugggcugcaaaaccuaccuuccucucucccgccucccc

SEQ ID NO: 374249 - RNA, 64 nt, Human
uuuuuucagcggauacugccgccaccaagaauccaaaaccuauuuuugacuuggagagacuugc

SEQ ID NO: 374250 - RNA, 64 nt, Human
aaauacucagaaaguacugucaaaagccuaauaaaaaaccuaaaguuugcucugauuugugggu

SEQ ID NO: 374251 - RNA, 64 nt, Human
agguuuguggaacccaguccccugcagaaucuguaaaaccuaauaaaucaugguuguggccauu

SEQ ID NO: 374252 - RNA, 64 nt, Human
cuuuacaaaaugugugcuuuaacuguuuacaaguaaaaccuaaaguugcaggaaacauuuuuua

SEQ ID NO: 374253 - RNA, 64 nt, Human
caauuucaaacccugcuuaugauaugaaaauauuaaaaccuagucuauuguaguuuuauucaga

SEQ ID NO: 374254 - RNA, 64 nt, Human
uuaauuaaaaugauugauaauaaccacuuuauuaaaaaccuaagguuuuuuuuuuuuccguaga

SEQ ID NO: 374255 - RNA, 64 nt, Human
auccaaugaacaagauccuacaagcugugcaggcaaaaccuagcaggaaaaaaaaacaacgcau

SEQ ID NO: 374256 - RNA, 64 nt, Human
ugccaagguuuguacacgacucccaucuaggcugaaaaccuagaaguggaccuugugugugugc

SEQ ID NO: 374257 - RNA, 64 nt, Human
auuuuacuugcacuguguuuuuuagcuaaaagugaaaaccuagauuaaauaaaaucaaaguuga

SEQ ID NO: 374258 - RNA, 64 nt, Human
gcucuccguguuccuuuccuuuuuuugauauaugaaaaccuauucuggucuaaauuguguuacu

SEQ ID NO: 374259 - RNA, 64 nt, Human
auaggagaggaagauaagauaaauauuuguaaauaaaaccuaaaguuuaaauguuuuaaucuga

SEQ ID NO: 374260 - RNA, 64 nt, Human
aacaacucuuuaaaggauaauuauccaauaaaaaaaaaccuagugcugauucacagcuuauuau

SEQ ID NO: 374261 - RNA, 64 nt, Human
cuuugaucgaaggaaaauagaucuaugagacugaaaaaccuauuugcuugauuaccauucccaa

SEQ ID NO: 374262 - RNA, 64 nt, Human
aaaccaaaauuauaggauuuuuucuuuuuuaguaaaaaccuauaugaaaaccaaaauuauagga

SEQ ID NO: 374263 - RNA, 64 nt, Human
aaccaaaauuauaggauuuuuuucuuuuuuaguaaaaaccuauauaaaaaccaaaauuauagga

SEQ ID NO: 374264 - RNA, 64 nt, Human
aauauuucggggguaauagagccacuggugaguaaaaaccuauauaaaaaccaaaauuauagga

SEQ ID NO: 374265 - RNA, 64 nt, Human
ucagcaggagcaauucugcaucccuaauucugucaaaaccuaugaaggugacuaaauugucuaa

SEQ ID NO: 374266 - RNA, 64 nt, Human
uggcaguuggacuaaugugaaaaaaacauugcugaaaaccuaaaaaugaaaguuugugaguguu

SEQ ID NO: 374267 - RNA, 64 nt, Human
gggauucccuuugguguuuggucuucuacuuagaaaaaccuauugcaguuaguuuaucuuguag

SEQ ID NO: 374268 - RNA, 64 nt, Human
gaaauuagcuccagguucuuaaacuaacaaaaauaaaaccuaagcaugccacagagcuauugau

SEQ ID NO: 374269 - RNA, 64 nt, Human
uugcauuagacugaccaguuuaaaaauaugaacuaaaaccuaauggcuaaaguaacuugaccau

SEQ ID NO: 374270 - RNA, 64 nt, Human
agaaagcuuuggaaaaaaagagcuggcuggccuaaaaaccuaaauauaugaugaagauuguagg

SEQ ID NO: 374271 - RNA, 64 nt, Human
uguacucauguaaccaaaugcuaccuguuccaccaaaaccuauggaaauuuaaaaaaaacaaaa

SEQ ID NO: 374272 - RNA, 64 nt, Human
aguugugcuccuggacauucauuccagagaaaugaaaaccuauauuguacuuguacucaaauau

SEQ ID NO: 374273 - RNA, 64 nt, Human
ggauacgaaguuuacaguuucauaccaacuaucuaaaaccuaauugcaaauugaccacagaccu

SEQ ID NO: 374274 - RNA, 64 nt, Human
aagaaugguugccaaaaacaacagccaaaaaaaaaaaaccuauuuuauuauccaaaugcuagaa

SEQ ID NO: 374275 - RNA, 64 nt, Human
uaguucauacccuuccagaauucucucucuuuuuaaaaccuagaugagauuaaccuguuuuuua

SEQ ID NO: 374276 - RNA, 64 nt, Human
ccagacaccaagaaucauagggguuuuuuuuuaaaaaaccuaauagaaguagggugaccucucu

SEQ ID NO: 374277 - RNA, 64 nt, Human
uagaagagaauuuguuuaauagauuuuacuacauaaaaccuauacuguggaguccuguggggau

SEQ ID NO: 374278 - RNA, 64 nt, Human
agguauguuuggcaaaauaaaauaaagguaauuaaaaaccuaagaaauggcuguaaacugagau

SEQ ID NO: 374279 - RNA, 64 nt, Human
uucccugugagcuagcagacacaaugaccaggaaaaaaccuaugaauuccauucuuagguuucc

SEQ ID NO: 374280 - RNA, 64 nt, Human
guguugugacucaauaauugccguguaguucaucaaaaccuacauauuagccuuuggcuuuaag

SEQ ID NO: 374281 - RNA, 64 nt, Human
gaaaccccagaccgagaaguugaugcucggcccacgccguuagcucgugugcguguagucugug

SEQ ID NO: 374282 - RNA, 64 nt, Human
cuucuguucgugugcagggaaagcagcucacagacgccguuaaaaccagcuucaucuuuccuuc

SEQ ID NO: 374283 - RNA, 64 nt, Human
ggaaauauuuugaaccaaagaccaaauguuaggccgccguuauauuugcagaagcuuugagaac

SEQ ID NO: 374284 - RNA, 64 nt, Human
agauuuuucucaggagauacuuuaccuauaacaacgccguuaaauccaaaucucuucuaaacga

SEQ ID NO: 374285 - RNA, 64 nt, Human
gaacuaaguuaaacuuguacauuucuguugaucacgccguuauguugccucaaauaguuuuaga

SEQ ID NO: 374286 - RNA, 64 nt, Human
uacauucccuguucagagugggguagggguucuccgccguuacccgauccacuccaucccccac

SEQ ID NO: 374287 - RNA, 64 nt, Human
ucugggcuccagggacgccacugcggggcaaaggcgccguuaccuggagucugcaucauggguc

SEQ ID NO: 374288 - RNA, 64 nt, Human
ccugcgccccgcugcgcuucgcuccccgcccuugcgccguuaguaaacaucgcucaaacgaaac

SEQ ID NO: 374289 - RNA, 64 nt, Human
uggcccacuugcggaaccugacucaggcugcuggcaagcguagcuauguguuggcccuggggcg

SEQ ID NO: 374290 - RNA, 64 nt, Human
auaacaaggccagccacguagccaaaggucgcuccaagcguacaggagaugggccauaccugag

SEQ ID NO: 374291 - RNA, 64 nt, Human
cagaaauguaaauauuguacaguauugucauguacaagcguaccuaaugcacacuuuaucuuuu

SEQ ID NO: 374292 - RNA, 64 nt, Human
ugcauucgcaaacagugauuaucuggcccuucuacaagcguauaagguaaguauauaaccuaau

SEQ ID NO: 374293 - RNA, 64 nt, Human
cagucuuuuucuuucccugccacccuuuauuuaucaagcguaauguuacacuuuaaaggacagc

SEQ ID NO: 374294 - RNA, 64 nt, Human
ugcuacuaggaauuggaaucaaacaaugccaccccaagcguaauuuuagccagcaguuucaguu

SEQ ID NO: 374295 - RNA, 64 nt, Human
ccucaaggcaaccugaggccagacaccaagaaaccaagcguaucugcucuaaaaugacuuguuc

SEQ ID NO: 374296 - RNA, 64 nt, Human
cccauaaauuaucuuuucuucuguaucucuguuacaagcguagugugauaauaccagauaauaa

SEQ ID NO: 374297 - RNA, 64 nt, Human
guuucaagugcauggccuucuacggcuucuaugccaagcguaugauacuauagauauaguguac

SEQ ID NO: 374298 - RNA, 64 nt, Human
uuugacccugguauucgggcaaagaggacaugagcaagcguaucacaucugcccucccugcaau

SEQ ID NO: 374299 - RNA, 57 nt, Human
aaccagucaaggcaaaguaaacucuccgguccccaaagguuguuaacuagguccgcu

SEQ ID NO: 374300 - RNA, 64 nt, Human; identical to SEQ ID NO: 136769

SEQ ID NO: 374301 - RNA, 64 nt, Human; identical to SEQ ID NO: 136775

SEQ ID NO: 374302 - RNA, 64 nt, Human; identical to SEQ ID NO: 136781

SEQ ID NO: 374303 - RNA, 64 nt, Human
ugaacccggauacuucuccaaucacugccaaagucaagcguaacgugucagagaggaaggauca

SEQ ID NO: 374304 - RNA, 64 nt, Human
uggucucccugcuacaugaaaccguguauacuaacaagcguacaauuuuuaguugauuuuuuuu

SEQ ID NO: 374305 - RNA, 64 nt, Human
aucuaagcaggccacguuuaaaauaacaucaaggcaagcguacgugucacccucuguacugaca

SEQ ID NO: 374306 - RNA, 64 nt, Human
uuuggaaacugagcgaaauccaagaugcuggcaccaagcguauuccguguggcccuuuggaugg

SEQ ID NO: 374307 - RNA, 64 nt, Human
acacgccaggaggaaugucugauacccucugcaucaagcguaagaaggucccaaaucauaacca

SEQ ID NO: 374308 - RNA, 64 nt, Human
aagagugaguuuugucuuguaucuaaaguggauacaagcguauguuuaaacugcaagauuuuua

SEQ ID NO: 374309 - RNA, 64 nt, Human
gagaccaccuuuuugagugacuugagcccaaaggcaagcguauaucaaacgaucuucuccacau

SEQ ID NO: 374310 - RNA, 64 nt, Human
acuaaaagcgucuuaaaaugaccaauuccagaaucaagcguauuccguuuucuuccugcaugau

SEQ ID NO: 374311 - RNA, 64 nt, Human
auguuucugguuauaagaagcauagcuuacaaagcaagcguaagauugaggcaugaaguucaga

SEQ ID NO: 374312 - RNA, 64 nt, Human
aagucauaguaaacccuguagaugauguugcuugcaagcguaauauccaacaguuuaagguacu

SEQ ID NO: 374313 - RNA, 64 nt, Human
cucuaugcuagguacuggggauacaggagagaaucaagcguaaagucuuuguucucaaggaauu

SEQ ID NO: 374314 - RNA, 64 nt, Human
agugcaaucucacggccagguucuaugcccuguccaagcguaaacccucuuggaaacuucuuuu

SEQ ID NO: 374315 - RNA, 64 nt, Human
uuuuuguuauugauauuaaacaguguaaucuuugcaagcguauauugaagauuauucuggagca

SEQ ID NO: 374316 - RNA, 64 nt, Human
caggaccgccacguggccuucagaggaauccacagguccccacccaagaucccucaauuauaug

SEQ ID NO: 374317 - RNA, 64 nt, Human
uuguggguguacuuuggcuuccuuuuguaugauagguccccaucaugaccaccucugaugucug

SEQ ID NO: 374318 - RNA, 64 nt, Human
cugcugcggcuggcaggugcagacagccuuugcugguccccagcacguccagggugggugcucc

SEQ ID NO: 374319 - RNA, 64 nt, Human
gcccaggagaaugaggagccucccugcaguguugucggccgaggccugagcucgcccugcccag

SEQ ID NO: 374320 - RNA, 64 nt, Human
ccuggacugggcuagccugcacugccugggaaagucggccgagggcccaaagcugcugaggggu

SEQ ID NO: 374321 - RNA, 61 nt, Human
gaaaugugaaacuugguggggucagggaggaaaggcagaagcugggagccucccuucccuu

SEQ ID NO: 374322 - RNA, 61 nt, Human
aauguauuuuuaugagauuuuaaccagaacaaaggcagauaaacaggcauuccauagcagu

SEQ ID NO: 374323 - RNA, 63 nt, Human
ugcagugccggcccagcuagacccuccagcccugguccccagccccugcuacuggcuggaccc

SEQ ID NO: 374324 - RNA, 64 nt, Human
ugcuggcugaccugggcccacagagccuggcuuugguccccagcauugcaguaugguguggugu

SEQ ID NO: 374325 - RNA, 64 nt, Human
uccuggaggagcaggagguagcaggagaggaccagguccccaagucccuucacaggguccccac

SEQ ID NO: 374326 - RNA, 64 nt, Human
caggagaggaccagguccccaagucccuucacaggguccccacccccacuggcuuuggugcugu

SEQ ID NO: 374327 - RNA, 64 nt, Human
ugcacacaggcagacauaccucccaucaugacaugguccccaggcuggccugaggaugucacag

SEQ ID NO: 374328 - RNA, 64 nt, Human
gagucucauucauccagcuccucuucagacagaagguccccauggucagacagcuggucugcau

SEQ ID NO: 374329 - RNA, 64 nt, Human
cccuugcccugaccucccagcccuauggaugugggguccccaucaucccagcugcucccaaaua

SEQ ID NO: 374330 - RNA, 64 nt, Human
ucacggauguucaguggauaucggucacaugccagguccccagcuacgcauucaaggauggaua

SEQ ID NO: 374331 - RNA, 64 nt, Human
cuuuauuccucccucaugagcacagggucggggggguccccauucuuggaagagguugagaaga

SEQ ID NO: 374332 - RNA, 64 nt, Human
uuucucucaaauauaucucccguaugagauuucagguccccauguuuucaccaagcaaucugcu

SEQ ID NO: 374333 - RNA, 64 nt, Human
gcgucgagcugggaagguuccaugaagcgagucggguccccaacccgugccccugggauccgag

SEQ ID NO: 374334 - RNA, 64 nt, Human
auuggagcccaagcaccccuggagaggaagggaggguccccacuggcccguggggucugaguuc

SEQ ID NO: 374335 - RNA, 64 nt, Human
ggguggaggggaagggugggucucaguuagcagggguccccagggcaagucagccuccucccuc

SEQ ID NO: 374336 - RNA, 64 nt, Human
uguggagcaaaaggcagcucaccccugggcaggcgguccccauccccaccagcucguuuuucag

SEQ ID NO: 374337 - RNA, 64 nt, Human
acacaguguuccagcugccugggaggcuuuuggugguccccacagccucugggccaagacuccu

SEQ ID NO: 374338 - RNA, 64 nt, Human
guaaauauuuguugaaaugaaugauaagagcauugguccccaagccagagagccagaagccauc

SEQ ID NO: 374339 - RNA, 61 nt, Human
acaaccauuuuuuguucugugucccuuuuaaaaggcagauuaaaagcacaagcguguuucu

SEQ ID NO: 374340 - RNA, 61 nt, Human
gggggugccuggcagccaugaagcaggcugaaaggcagaggggcuccagguccuguuucca

SEQ ID NO: 374341 - RNA, 61 nt, Human
gccacccaaauucucagaucuuuucuggaacaaggcagaauauaaaauaaauauacauuua

SEQ ID NO: 374342 - RNA, 61 nt, Human
aaggggcuccugggugucuguauacacgccaaaggcagauacaaauaaaauacagauuguc

SEQ ID NO: 374343 - RNA, 64 nt, Human
ugcagggagaaggauuccauuuuucuucucagcugguccccaggcccacgggcacagggagagg

SEQ ID NO: 374344 - RNA, 64 nt, Human
agcaacugcaggacaagccucccuggaugaucgagguccccaguagcucugaacaagaguccag

SEQ ID NO: 374345 - RNA, 64 nt, Human
ccucugccugcugcccccucucuccucgggaucggguccccagagccaccaucuccugagccuc

SEQ ID NO: 374346 - RNA, 64 nt, Human
ugccaggccugagcuacuugaagggggccaucuagguccccaacccauggacuuugccuccauu

SEQ ID NO: 374347 - RNA, 64 nt, Human
cauccuucccccaaccacccaccagaggaguucugguccccaaaccaaagaguugccugcaggu

SEQ ID NO: 374348 - RNA, 64 nt, Human
ggcauacguagcuuuuuaacuauuuggaacucgagguccccagugcgucauuggauuugcuuuu

SEQ ID NO: 374349 - RNA, 64 nt, Human
aaggaauggagagagcaggaucccuggacucccugguccccaaacuccuugacugucacuugua

SEQ ID NO: 374350 - RNA, 64 nt, Human
ucacccuuuuccuuucccaugaacccuggagggugguccccaccagcucuuuggaagugagcag

SEQ ID NO: 374351 - RNA, 64 nt, Human
cuggauggggcaggccaccuggcucucaccucuagguccccauacuccuaugaucugagucaga

SEQ ID NO: 374352 - RNA, 64 nt, Human
gucaaggcagccucaucuccccaggugaggggcggguccccacuuuaggacaagaggcagcuug

SEQ ID NO: 374353 - RNA, 64 nt, Human
agcuguugcucccaccuuuccccacagggugcccgguccccacggcgcaaggaggccaagcuca

SEQ ID NO: 374354 - RNA, 64 nt, Human
uccuuccauccuauuccccagucacgaaagggcugguccccagagcucacccagaaagcaucuu

SEQ ID NO: 374355 - RNA, 64 nt, Human
ggccccuguguucagcccgagaguuuguaaaacagguccccagguagguguauaagaugaguug

SEQ ID NO: 374356 - RNA, 64 nt, Human
aaguaagcuugaugggcuggaacuuuugacuuuggguccccaaacagccaaaaacagauacaga

SEQ ID NO: 374357 - RNA, 64 nt, Human
uggagaaaguggaaacccagcagucccuaaagcugguccccagaaagcaggacagaaagaagga

SEQ ID NO: 374358 - RNA, 64 nt, Human
ucccugccccagccccagcagccauggguacauggguccccagcucaccuauggauucccgcca

SEQ ID NO: 374359 - RNA, 61 nt, Human
uuuaagaaacuggaggcugcaacaggagggaaaggcagaaugauaucacagcaguacuauu

SEQ ID NO: 374360 - RNA, 61 nt, Human
acgagggaagagggaggcaggccucuauucaaaggcagaaauuccuuuaagauuguggucu

SEQ ID NO: 374361 - RNA, 61 nt, Human
gaaaugcucaaugucugaugcuaagugggagaaggcagagaacaaaggauguggcauaaug

SEQ ID NO: 374362 - RNA, 61 nt, Human
aguuugguucagauggucugucacuaauuauaaggcagauaggaacagacagaaaaaucua

SEQ ID NO: 374363 - RNA, 64 nt, Human
uaacuugagagguuuggggccuuguuccccagaggguccccagggacucugcaguguccuuggc

SEQ ID NO: 374364 - RNA, 64 nt, Human
agguguuggagaaauccaaagcugaccaaaacaugguccccaccuuuuggagcuuacagucugu

SEQ ID NO: 374365 - RNA, 64 nt, Human
aaaugaucuuuaccguggccugccccaugcuuaugguccccagcauuuacaguaacuugugaau

SEQ ID NO: 374366 - RNA, 64 nt, Human
auaauuuaaaacuguauauauugacgguacagaugguccccaacuuguaaugauucaauuuagg

SEQ ID NO: 374367 - RNA, 64 nt, Human
acccauggugccucugggcuugacaggucaaaaugguccccaucagccuggagcagcccuccag

SEQ ID NO: 374368 - RNA, 64 nt, Human
agccucugaccccuccucacuggccaucccucgugguccccaacagcgacauagcccaucccug

SEQ ID NO: 374369 - RNA, 64 nt, Human
aaaaacgcacaccagacgggcaacaaacagucuggguccccagcucgcucuugguacuugggac

SEQ ID NO: 374370 - RNA, 64 nt, Human
acuggcaaucagggcugcgcacuucccuguccacgguccccaggccuuccugucuugucccuuu

SEQ ID NO: 374371 - RNA, 64 nt, Human
cgcacaguggacggagguccccgguugcuggucagguccccauggcuuguucucuggaaccuga

SEQ ID NO: 374372 - RNA, 64 nt, Human
agugcugccugggaacuaacacgugccucguaaagguccccaauguaaugacugagcagaaaau

SEQ ID NO: 374373 - RNA, 64 nt, Human
acuccacucaucaaaucugagaaaaguauccacugguccccaggguuucagucaugcuuuuggg

SEQ ID NO: 374374 - RNA, 64 nt, Human
aagggggaaaugcucuuugaaagcuccaauuauugguccccaaaagcagcuuccaacguuugcc

SEQ ID NO: 374375 - RNA, 64 nt, Human
aaaauaguuauguuggcacuguguucacacgcaugguccccacacccccagguuggguggguuu

SEQ ID NO: 374376 - RNA, 64 nt, Human
uauuuuuacaaaauuuguucuagugcauuuccaugguccccaauucauaguuuauucauaaugc

SEQ ID NO: 374377 - RNA, 64 nt, Human
ugcuuacagccguagcuaugaauauauauagggugguccccagucucuguuaugguugcgcaua

SEQ ID NO: 374378 - RNA, 64 nt, Human
aauauaaagaaauguggccaugcuuuaaaccugugguccccacccuuuuugggaccaguuucau

SEQ ID NO: 374379 - RNA, 61 nt, Human
gaggagaugcggggaagacuauguaaagaugaaggcagagaucggaguuuugcagccacaa

SEQ ID NO: 374380 - RNA, 61 nt, Human
cucccgagguguccucgggcucauaugugggaaggcagaggaucucugaggaguucccugg

SEQ ID NO: 374381 - RNA, 61 nt, Human
aagaauuuaggaaauuaauguggacacuauaaaggcagacuuagggccaacuuuuuuuuuu

SEQ ID NO: 374382 - RNA, 61 nt, Human
aggggccaagugcgccccaauuccaagaaugaaggcagagcgacaacagugcggacacccc

SEQ ID NO: 374383 - RNA, 64 nt, Human
uggacuuuggggggcugugagggaaauauacugggguccccagauucugcucuaagggggccag

SEQ ID NO: 374384 - RNA, 64 nt, Human
ugcccugauaccccugaggguggcugccuccucugguccccaggccccuccaguucaucggaau

SEQ ID NO: 374385 - RNA, 64 nt, Human
aacaccugcugauguggcaacugcugaugcucaugguccccauggcaugggggccucagggcag

SEQ ID NO: 374386 - RNA, 64 nt, Human
ccuccagcauaggugguuugugaaacucacaggugguccccaggccaagaugggcaggugucac

SEQ ID NO: 374387 - RNA, 64 nt, Human
gcuugcuugguccacagucggacugcauugcuuggguccccauguccagccuugugcagugagu

SEQ ID NO: 374388 - RNA, 64 nt, Human
cuggcuccaggccagggggccagucccugaggcagguccccagacuccaccaagccuggucagc

SEQ ID NO: 374389 - RNA, 64 nt, Human
gaagaguccagccaccaucuuccugacugucccagguccccacucuccagggcccaucaaguca

SEQ ID NO: 374390 - RNA, 64 nt, Human
aagcugugcuguagccuguaauuacugacaugaagguccccacacagagucuggauggaggcug

SEQ ID NO: 374391 - RNA, 64 nt, Human
ccaucucccuuagggacuacccauagacaugaaagguccccacagagcaagagauaagucuuuc

SEQ ID NO: 374392 - RNA, 64 nt, Human
caaggagccuaccugaggucccuacucucacugggguccccaggaugaaaacgacaaugugccu

SEQ ID NO: 374393 - RNA, 64 nt, Human
ggccuucucgcucacugguagagacagggguugugguccccaaccugccuucugcucugccccu

SEQ ID NO: 374394 - RNA, 64 nt, Human
ucugcaccaggaggcucuccaccuggcagccagagguccccagugggccgggcucacacacaaa

SEQ ID NO: 374395 - RNA, 64 nt, Human
gcucuccaagggaaugccuggggauucacccagugguccccagaggugcuccauggaggcaaca

SEQ ID NO: 374396 - RNA, 64 nt, Human
gccacugcccucuccaggaccaagccggguucuugguccccacccucccugcacuccgcaucuc

SEQ ID NO: 374397 - RNA, 64 nt, Human
uagauggccacaggugccugacuaggagccccuagguccccaggcuugagaaaggguuaaaaua

SEQ ID NO: 374398 - RNA, 64 nt, Human
gaccaaagauuugaccugucggucuugaugucaagguccccaaagaccagguuaagugacgaca

SEQ ID NO: 374399 - RNA, 61 nt, Human
uaaaauuugaaaaaugauuguaggaucaaaaaaggcagaugaaauuacuuaauacucagug

SEQ ID NO: 374400 - RNA, 61 nt, Human
auauucauagcagcuuauucacaagacccaaaaggcagaagcaacccaaauguucaucaau

SEQ ID NO: 374401 - RNA, 61 nt, Human
gccacgcccccaccaucaucagcugggaggaaaggcagaguugggaaauagauggcuccca

SEQ ID NO: 374402 - RNA, 61 nt, Human
aguuaguggaaaucugaacauucuccuguggaaggcagagaaaucuaagcugugucugccc

SEQ ID NO: 374403 - RNA, 59 nt, Human
gugggggcucgcggacgugaagggccacugguccccaacaaugugaggggucccuagca

SEQ ID NO: 374404 - RNA, 64 nt, Human
aacugagggcagagagguuaacagauuuaucuaagguccccagcagaauugacaguugaacaga

SEQ ID NO: 374405 - RNA, 64 nt, Human
cuacuuuccucuucuauuguuuuuuaaccuuacagguccccaacagcgauacugcuguuucucg

SEQ ID NO: 374406 - RNA, 64 nt, Human
uggaagaggaaggguuuuuguuuucacucauugugguccccaagccuauugacacuaguugccu

SEQ ID NO: 374407 - RNA, 64 nt, Human
uaugccugugacaggaauagauucuggguucagggguccccaucugucaaaugagaagauugga

SEQ ID NO: 374408 - RNA, 64 nt, Human
cagcuccacagguugggagccgucgugggaccuggguccccaccgugaggaccccgugggcgac

SEQ ID NO: 374409 - RNA, 64 nt, Human
ggccccuguggguggcacggaggggcugugaccugguccccaguguugcccuccccaguggcug

SEQ ID NO: 374410 - RNA, 64 nt, Human
gaaagggguggcugccugagggagucacuuguaugguccccagggugggagccccauccuguuc

SEQ ID NO: 374411 - RNA, 64 nt, Human
ugccgugguggcagcuggggcuguggaugggagggguccccaacauggauguguugccccuccu

SEQ ID NO: 374412 - RNA, 64 nt, Human
guuccuuccgaugacagugcucuaggcugccccggguccccagcuccccaggacucacccucau

SEQ ID NO: 374413 - RNA, 64 nt, Human
cuaagucauagacuagguaggaaggcccuauauugguccccagcaucuacugaggcagaccugc

SEQ ID NO: 374414 - RNA, 64 nt, Human
ccucugccccugggguccauccccucuugcccaggguccccauccuguaccaagcagacugggc

SEQ ID NO: 374415 - RNA, 64 nt, Human
ggcuucuuugcgugguccccugcugguggggguggguccccagggggcccccugcggccugggc

SEQ ID NO: 374416 - RNA, 64 nt, Human
ggugccguuucucuuccgugaaggccacugcccagguccccagugcgcccccuaguggccauag

SEQ ID NO: 374417 - RNA, 64 nt, Human
ggucugccaguaacauguucccauguacagacacgguccccacacccucccagccucaggccca

SEQ ID NO: 374418 - RNA, 64 nt, Human
gcagcccugcccgaggcuaguaggcugcaacccugguccccaccccuaaccuccugcucccccu

SEQ ID NO: 374419 - RNA, 61 nt, Human
ugggugcucuaggcagggaaaacugaacaaaaaggcagaaaugauucaggggaaaaucggg

SEQ ID NO: 374420 - RNA, 61 nt, Human
uuuaaugaaaauauuaaauauuugguuucaaaaggcagauuuaucuucucccaacauucug

SEQ ID NO: 374421 - RNA, 61 nt, Human
gagcccccaaccuuuucucucugccuucaagaaggcagacauuugguaugauuuagcauca

SEQ ID NO: 374422 - RNA, 61 nt, Human
acacgcgggaccccagccgccaaaacuuuucaaggcagaaguuucaagauguguguuuguc

SEQ ID NO: 374423 - RNA, 64 nt, Human
accccguccuguccaugcgcuuccagggccccacgguccccaggaggacgcuuccuggccaaag

SEQ ID NO: 374424 - RNA, 64 nt, Human
gcaagcucugagggggagccuggggacggguuuggguccccaggaggagagccuuggguauaau

SEQ ID NO: 374425 - RNA, 64 nt, Human
agaaauaucuaaccauucaauuuauaaauaauuagguccccaacgaauuaaauauuauguccua

SEQ ID NO: 374426 - RNA, 64 nt, Human
gcaggugcuggacacagagccugucucagcagaggguccccacuggccgcaacggcucagugac

SEQ ID NO: 374427 - RNA, 64 nt, Human
guacccucaccgccaggggggaccggaaugccuggguccccaccaugcucagugugucugacuc

SEQ ID NO: 374428 - RNA, 64 nt, Human
aaacagaucacaggagucaaagggccuugcucaagguccccagcuucagccccaggcccuaagc

SEQ ID NO: 374429 - RNA, 59 nt, Human
ccuaccuuggccuugaguagcaggggccugguccccacagcccacaggauggaccaaag

SEQ ID NO: 374430 - RNA, 64 nt, Human
ccugagcuccuggucccucagccaagaccucagggguccccagccagccugcugcuggggaccc

SEQ ID NO: 374431 - RNA, 64 nt, Human
ccaaggucccgaccccaucccuauccauaguccugguccccagaaacuccaaccccugcccuuc

SEQ ID NO: 374432 - RNA, 64 nt, Human
gugcuaggcguggacgggcgcaccugcauggagggguccccagagcccccaaccagugccagca

SEQ ID NO: 374433 - RNA, 64 nt, Human
gugugaccugacaaaaacacguaggggcagggacgguccccacccccagggacacaaccccugg

SEQ ID NO: 374434 - RNA, 64 nt, Human
ccuucuaacuuccagauuguaugcuugagugauggguccccagcccaagcccacucuucccuca

SEQ ID NO: 374435 - RNA, 64 nt, Human
gacugcaaggaguccccacaccuuggcagcucaggguccccaguccaagcccuugaccucuccu

SEQ ID NO: 374436 - RNA, 64 nt, Human
ccucccuucgccacccuccacccacccaccucgcgguccccaggaccacuggcugccaacuccu

SEQ ID NO: 374437 - RNA, 64 nt, Human
gagccucagccaaggaggggccugggcacacucagguccccaugguuguccauugaauggagug

SEQ ID NO: 374438 - RNA, 64 nt, Human
cugagugcagcgaggccuccugcggccacccucggguccccaugcucucugggaggugugcugg

SEQ ID NO: 374439 - RNA, 61 nt, Human
aggaacaaauuuucaaagacuugggggagugaaggcagagccuggugcagauggacgaggu

SEQ ID NO: 374440 - RNA, 61 nt, Human
aaaagagcuacuguauuuagacuuaggaaaaaaggcagaguaacauuacuuaaaaaaaaaa

SEQ ID NO: 374441 - RNA, 61 nt, Human
cucaggacgucaaaaacucaccauggaccccaaggcagaaaccaagaacugucugcaggca

SEQ ID NO: 374442 - RNA, 64 nt, Human
ggcugguguuggcagccggggggaggugccugaggguccccacgguuccuuucugcuuuucuga

SEQ ID NO: 374443 - RNA, 64 nt, Human
ugcaaaaacauaauauauuucuguuaaacaguucuucaccuaacagcauauugcucuuauaacu

SEQ ID NO: 374444 - RNA, 64 nt, Human
caguguuuuucuaagacuaaauaaauagcaaacuuucaccuauucaugaguuauuauugaaacc

SEQ ID NO: 374445 - RNA, 64 nt, Human
gaugcagucaccuggaaagaacagagauuacccuuucaccuaccucagcaaaacaaacuuucaa

SEQ ID NO: 374446 - RNA, 64 nt, Human
ggauauuauauguuucugggagaagagaaaauacuucaccuauugggaugccaauauuucuguu

SEQ ID NO: 374447 - RNA, 64 nt, Human
caugaggcaagggaaggaaaagcagagcuuauuuuucaccuaagguggagaaggaucacuuuac

SEQ ID NO: 374448 - RNA, 64 nt, Human
guagagaaaauaaauguuauauacccuauaaucuuucaccuaauuaguauuuaauuauauggau

SEQ ID NO: 374449 - RNA, 64 nt, Human
aaaauugaucuuaauaacucucccuucauaucuuuucaccuauuuccaguccuuaucauaguug

SEQ ID NO: 374450 - RNA, 64 nt, Human
gcccggccuuuuuaacuuuaaacauguuuuagaauucaccuaaagaucaaaauaucauggauug

SEQ ID NO: 374451 - RNA, 64 nt, Human
ucauccagccggaaguuaaagcacacuuacuuuauucaccuauuuuuauaauaaacguucuugc

SEQ ID NO: 374452 - RNA, 64 nt, Human
cuggcacauuuauuucuucuuuuguugaaauuuauucaccuagauaaaggcagcaguuugggac

SEQ ID NO: 374453 - RNA, 64 nt, Human
cugaguuauaaggccacaggaguggauagcuguuuucaccuaaaggaaaagcccacccgaaucu

SEQ ID NO: 374454 - RNA, 64 nt, Human
uguucggagcucuucugugcccuggcuccaugcuuucaccuacacaagcaucaccuuccuaauc

SEQ ID NO: 374455 - RNA, 64 nt, Human
acauccugcuacacucauccgcaggucaccuuaguucaccuacccugagugaacacccccagcu

SEQ ID NO: 374456 - RNA, 64 nt, Human
uguaagugauaugucagaagagcuucuuacugauuucaccuaaaaugagaaggaaguccuguuu

SEQ ID NO: 374457 - RNA, 64 nt, Human
ugguuuuccauguaauauuuugaauuauagcaucuucaccuagaagaucucaauugucuuaguc

SEQ ID NO: 374458 - RNA, 64 nt, Human; identical to SEQ ID NO: 136786

SEQ ID NO: 374459 - RNA, 64 nt, Human; identical to SEQ ID NO: 136790

SEQ ID NO: 374460 - RNA, 64 nt, Human; identical to SEQ ID NO: 136794

SEQ ID NO: 374461 - RNA, 64 nt, Human
gagaggggaagggcaggggacucaggaagcaggggguccccauccccagcugggaagaacaugc

SEQ ID NO: 374462 - RNA, 64 nt, Human
uuaaugagauuugauaaaucaguagauagaaugagguccccauucugaaauauuuagcagacug

SEQ ID NO: 374463 - RNA, 64 nt, Human
uuauccuggcgaacaccccuacccuucuauugcggguccccacaugcacacagaacucugacac

SEQ ID NO: 374464 - RNA, 64 nt, Human
ugggauugacaaaaugugucugcugaaaugcugagguccccacgugugaaugggugaggcugau

SEQ ID NO: 374465 - RNA, 64 nt, Human
gugcauucagucucucugccucugccugccuccugguccccacuuuaaaggcugugcagcuccu

SEQ ID NO: 374466 - RNA, 64 nt, Human
acaaguaauauuuuguauaaaacauagcaguuuagguccccauaauccucaaaaauagucacaa

SEQ ID NO: 374467 - RNA, 64 nt, Human
uuugaagcuuuuugagggcaaacuuuaccuuugugguccccaaaugauggcauuucucuuugaa

SEQ ID NO: 374468 - RNA, 64 nt, Human
ggcugugguggcugcuccugugcuccccuggggagguccccaccccuccccuccaggagcaggc

SEQ ID NO: 374469 - RNA, 64 nt, Human
cugucccaagccagugaggagcuaaagacacccagguccccaaaugaucuuacuccaugcccca

SEQ ID NO: 374470 - RNA, 64 nt, Human
auaugugugguagugauucuuggaaagaauuugagguccccaaagguguauuuuugggcaaaug

SEQ ID NO: 374471 - RNA, 64 nt, Human
uguuauucuaagucaguguuuuucaaagcguagugguccccauauuagcugcauugccaucuuc

SEQ ID NO: 374472 - RNA, 64 nt, Human
caaagcagagagagggcugaucccauggggcggagguccccaguggcugagcaaacagccccuu

SEQ ID NO: 374473 - RNA, 64 nt, Human
guuguacuucauuucuagagaaaaguuauacccagguccccaauugagaaugucuugcuugauu

SEQ ID NO: 374474 - RNA, 64 nt, Human
aggugccucagccaucccaacagugucgucagaggguccccagggcauuuucauggcaaguacc

SEQ ID NO: 374475 - RNA, 64 nt, Human
ggaaaucggcaacaggcauugcacuccgguuggggguccccaggguggggcagggaucccccag

SEQ ID NO: 374476 - RNA, 64 nt, Human
aagucucucccaaauaccuuagaguagggacacugguccccauuuauuggugagaaaacaggcu

SEQ ID NO: 374477 - RNA, 61 nt, Human
aagcugaggcaggagaauugcuucaaucuggaaggcagagguugcagugagauugcaccau

SEQ ID NO: 374478 - RNA, 61 nt, Human
gguacauuuccugugugcaaucaguaccuugaaggcagaacauucugaauaaaguuggaaa

SEQ ID NO: 374479 - RNA, 61 nt, Human
agcguagcaugucugauuugccaccuggaugaaggcagacaucaacaugggucagcacguu

SEQ ID NO: 374480 - RNA, 61 nt, Human
ggggcucacucagccuggcagaggaagaaggaaggcagacaucuccgcagccacuccuggg

SEQ ID NO: 374481 - RNA, 64 nt, Human
gugucuggcugcagagcagugggccuggccagcagguccccagcuuuggcuaugagggccuuga

SEQ ID NO: 374482 - RNA, 64 nt, Human
cagcaccacugauggcuccucugcucccauaguggguccccaguuuccaagucaccuaggccuu

SEQ ID NO: 374483 - RNA, 64 nt, Human
gggacaugcaaggaaacagcacagaacacgaggugguccccaugucccuggcacacuagcauuc

SEQ ID NO: 374484 - RNA, 64 nt, Human
aagaagcugggcaugggugcaccccacccccuaggguccccaugggaaagggacaugcaaggaa

SEQ ID NO: 374485 - RNA, 64 nt, Human
gaguuuugaaugggcagauuucaaacugaauauggguccccaaauguucccagaggguccucca

SEQ ID NO: 374486 - RNA, 64 nt, Human
aaaacuaaaggggcccccugugaccgaggagcaggguccccagggggcagcucccacggagcgg

SEQ ID NO: 374487 - RNA, 64 nt, Human
uccccgcagagagcacaggaagaggcaggggcgggguccccagcacuuguuacaaacacacgau

SEQ ID NO: 374488 - RNA, 64 nt, Human
uuuccugcucaguuaucuaaugucuuagaucagugguccccaaauuuugcuacauauuagaauc

SEQ ID NO: 374489 - RNA, 64 nt, Human
agcccuguggagcagaacgggaaccaccugcagagguccccagacccaaagcaggacgggagac

SEQ ID NO: 374490 - RNA, 64 nt, Human
gcaacuacagagcagugugggcagccccaagugugguccccagagagcguuuggcuuuccuguc

SEQ ID NO: 374491 - RNA, 64 nt, Human
cccuccccguguuguucauggagggaguacuggcgguccccauuuucauguauggagacuucag

SEQ ID NO: 374492 - RNA, 64 nt, Human
acaucaggaccaagucccauggacaugcugacaggguccccagggagaccgugucaguagggau

SEQ ID NO: 374493 - RNA, 64 nt, Human
cagagccgggaagguggguggcccauuacagggggguccccaggguguccucuggcagggcugu

SEQ ID NO: 374494 - RNA, 64 nt, Human
gggcuguguuuaccccaaacucuuccccaccucggguccccaagccgcugggagaugucccaug

SEQ ID NO: 374495 - RNA, 64 nt, Human
aaugcuuugggaacuguguuuauugccuauaauggguccccaaaauggguaaccuagacuucag

SEQ ID NO: 374496 - RNA, 64 nt, Human
gggcauuuuuauacucagaacugucccauccccagguccccaaacuuauggacacugccuuagc

SEQ ID NO: 374497 - RNA, 61 nt, Human
augggcucccucucccaccugucugcauagaaaggcagaauuagacauagcaugcuuugga

SEQ ID NO: 374498 - RNA, 61 nt, Human
ccccuguuccuuuguugcgggugguuuugguaaggcagagcccucugcugagaauguagua

SEQ ID NO: 374499 - RNA, 64 nt, Human; identical to SEQ ID NO: 136800

SEQ ID NO: 374500 - RNA, 64 nt, Human; identical to SEQ ID NO: 136806

SEQ ID NO: 374501 - RNA, 59 nt, Human
uaucuguuuauccauucuaacagaagacugguccccagcgcucucaguccaaucaguuu

SEQ ID NO: 374502 - RNA, 64 nt, Human
ggcagaauccacauccuuucgguggcagggccaagguccccacuuucuugcugacuguaaacua

SEQ ID NO: 374503 - RNA, 64 nt, Human
ccuguccccgccuccucucccucccucggcccgugguccccagcuggugacugcucaggaguuu

SEQ ID NO: 374504 - RNA, 64 nt, Human
aaccacaacacacggcuaugaucaugacaaccacgguccccaccacgacacaaucacguucaca

SEQ ID NO: 374505 - RNA, 64 nt, Human
guugguguguuagcgggcaggggagccauugugggguccccaggaaagggcaagggcucagcca

SEQ ID NO: 374506 - RNA, 64 nt, Human
ggcuacuggaggaguagaaggaugggccccgugggguccccacugccccgguacgagggggccc

SEQ ID NO: 374507 - RNA, 64 nt, Human
ugauuccucagaguauggggaccugacaucuuuggguccccaagaguuggcucuuggaugugga

SEQ ID NO: 374508 - RNA, 64 nt, Human
ccuuccccagauucucaagcagaugcccaagggagguccccacagagccagagugccugaggcu

SEQ ID NO: 374509 - RNA, 64 nt, Human
gguggcuggaagccacccugcuuuagaucacucggguccccaccuuagaaggguccccgccuua

SEQ ID NO: 374510 - RNA, 64 nt, Human
uguggaccuugcaggagugaagacugugaugugugguccccauauguggcucagcaaagacucg

SEQ ID NO: 374511 - RNA, 64 nt, Human
ugcgcuucugagcuggaagaggccgggcauuggugguccccaggcugggcccugcaggugcugg

SEQ ID NO: 374512 - RNA, 64 nt, Human
uagaugggacacaagucacuucaagaagucuggugguccccagagaaacaacuauguuauccau

SEQ ID NO: 374513 - RNA, 64 nt, Human
ccuguagcugccacguuuugaagagcuugagcuggguccccagugggcugucucucugugggga

SEQ ID NO: 374514 - RNA, 64 nt, Human
cauccaccaugguccccuucaguaccucacgcaugguccccagcuucuccuaggaucccagugg

SEQ ID NO: 374515 - RNA, 64 nt, Human
cuagaguuuuccaggggguucugagggaaucuuugguccccaguacucauuaacucagcagaca

SEQ ID NO: 374516 - RNA, 64 nt, Human
ccuugggaguaguuaguggagggcaggauucucagguccccauagagagggaaagagaagacca

SEQ ID NO: 374517 - RNA, 51 nt, Human
agaauggccuggcccucugaggguccccagggaggaaacgggcaccacccg

SEQ ID NO: 374518 - RNA, 61 nt, Human
gugcccguacugcacacauguggugaagcggaaggcagaccuaaagcgccaccuucguugu

SEQ ID NO: 374519 - RNA, 61 nt, Human
aggcugaggcaggagaaucacuugaaccaggaaggcagagguugcacugagcugagauugu

SEQ ID NO: 374520 - RNA, 61 nt, Human
aaugaaaaagcagggacaacaggaggaaaugaaggcagagaaauauaguuuccuuuccuag

SEQ ID NO: 374521 - RNA, 64 nt, Human
ggggcccuuuccugcucucccguccgcugugggugguccccagcucuccucuguggguuuuacc

SEQ ID NO: 374522 - RNA, 64 nt, Human
ccuuccucccaggcccugguucuugcuauuuccugguccccaacguuuaucuagcuuguuugcc

SEQ ID NO: 374523 - RNA, 64 nt, Human
aaggcaagggagguaagggaggaggagcuucugggguccccagggcugucaucugaauuugccc

SEQ ID NO: 374524 - RNA, 64 nt, Human
ccugcggcugugccuggacugaagcugucccgcagguccccacccuccaacacgugcucaccug

SEQ ID NO: 374525 - RNA, 64 nt, Human
gaugucucacaguagagcacuuagcgcagaaucagguccccacggcuguugcucaauaaaagug

SEQ ID NO: 374526 - RNA, 64 nt, Human
aggcccugauacccagccgccuccagcuugcagugguccccagccuggagcagagcauugggga

SEQ ID NO: 374527 - RNA, 64 nt, Human
uauuaaaaaaaaaaaagaaauaaaccucuaacucgguccccaaugaucauaaauaauauguuuc

SEQ ID NO: 374528 - RNA, 64 nt, Human
cuggaccaucuuugucuugccuuuucacgguagugguccccaugcugacccucaucugggccug

SEQ ID NO: 374529 - RNA, 64 nt, Human
ccaccggccuugaagaggugagcuuggccucucugguccccauggacuuagggggaccaggcaa

SEQ ID NO: 374530 - RNA, 64 nt, Human
aagaguuuugugcucccugggacggggguccugagguccccaccuaugccagcaaucagagaag

SEQ ID NO: 374531 - RNA, 64 nt, Human
agaacacaacauuagcagcugggaaggugucugagguccccaauuacauaucccaaagaguuuc

SEQ ID NO: 374532 - RNA, 64 nt, Human
acaagaucugucuuuccaauggccgggggcauuugguccccaaauuaaggcuauuggacaucug

SEQ ID NO: 374533 - RNA, 64 nt, Human
gaagaggcuuccugggcccccuggucuucggccggguccccagcccccgcuccugccccacccc

SEQ ID NO: 374534 - RNA, 64 nt, Human
gccuggggcugggagcagucccgguuuagccugagguccccauagggcuuccuccccugcuggg

SEQ ID NO: 374535 - RNA, 64 nt, Human
cgagcagcgacccgaaccagccccgugccagcccgguccccagacccaagccugaccccauccg

SEQ ID NO: 374536 - RNA, 64 nt, Human
cuccauuuccagaggcccagaggcugcccucugagguccccacucucccccagggcugccccuc

SEQ ID NO: 374537 - RNA, 61 nt, Human
aucuauguauaugucuuaccucaucuccuaaaaggcagaguacaaaguaagccauguaucu

SEQ ID NO: 374538 - RNA, 61 nt, Human
ccaaaccuggugucuauccggcagagggaggaaggcagagcaaguggagcagggcuuagca

SEQ ID NO: 374539 - RNA, 61 nt, Human
gugagacucaauaauaacugaacuacagcaaaaggcagagaauuacagggagaaaaaacuu

SEQ ID NO: 374540 - RNA, 61 nt, Human
acaaaaugggcgaagauauugucuuuaggauaaggcagagaaacagauguugcagacuucc

SEQ ID NO: 374541 - RNA, 64 nt, Human
ugcccccgccucucagcacagggcaggggcugcagguccccaguggacaucagagucaaaagca

SEQ ID NO: 374542 - RNA, 64 nt, Human
ucagagccagccugccagaggcaaaugcaaaagagguccccagaacacagccagcugggcagcc

SEQ ID NO: 374543 - RNA, 64 nt, Human
guuuccuucucggaaaugagaaagcuggaauccugguccccagcaggagagccuaguccucccc

SEQ ID NO: 374544 - RNA, 64 nt, Human
ugcacugggcccugugccccuccuccccauccaugguccccagcagugccugguucugagcaaa

SEQ ID NO: 374545 - RNA, 64 nt, Human
gcaguauuuucuaaacaggauagauuaugaucucgguccccauccauccuaacuucugaguuca

SEQ ID NO: 374546 - RNA, 64 nt, Human
acaagcuuagaucagguccuguggaugagcaugugguccccacgaccuccuguuggacccccac

SEQ ID NO: 374547 - RNA, 64 nt, Human
uucccuuugggauggggcucccacaccucccucagguccccacucagaccagcaccagugucug

SEQ ID NO: 374548 - RNA, 64 nt, Human
ccacuuacaacugaccaaaguggcccccucuggggguccccaccacacaaguguuuguaaacug

SEQ ID NO: 374549 - RNA, 64 nt, Human
ccgugcccuuuuaguuaguucugcagucuaguaugguccccauuugcccuuccacuccacccca

SEQ ID NO: 374550 - RNA, 64 nt, Human
ccaauuggaacagcagcauggagggucccaguuggguccccaacgugcuccccaugggcaagac

SEQ ID NO: 374551 - RNA, 64 nt, Human
ucuguugguuacaagauccagacuugggccgagcgguccccagcccucuucauguuccgaagug

SEQ ID NO: 374552 - RNA, 64 nt, Human
gaacaacugggcccuggaccagcaccacuuccgagguccccagacccccugagcccucccaggg

SEQ ID NO: 374553 - RNA, 64 nt, Human
uacuguagaagcagcuugcugagccccuccgagcgguccccagaauuagcugguucacaacccc

SEQ ID NO: 374554 - RNA, 64 nt, Human
cugggcccuagagcugugcguccagccaguccuggguccccacgauugaccagccacacucugg

SEQ ID NO: 374555 - RNA, 64 nt, Human
gcuggcucuaggguucuucuaguucgaggccuuggguccccauccucuggaaccagggggaggc

SEQ ID NO: 374556 - RNA, 64 nt, Human
caccuccccagccacccucccuucucuccucugggguccccacuuuagggcgacuuugcccgag

SEQ ID NO: 374557 - RNA, 61 nt, Human
uuauaaugaaagaaaaaggcauuggagacugaaggcagaaaugguugugacagugcuguuu

SEQ ID NO: 374558 - RNA, 61 nt, Human
gcuuuggugcuguccacacagugcccaccagaaggcagagggaacuccagggcagggaugu

SEQ ID NO: 374559 - RNA, 61 nt, Human
augucgcuuuuccuucaucaugaucuaaauaaaggcagauauguaaaauuucucaccauuu

SEQ ID NO: 374560 - RNA, 61 nt, Human
ugcugccaguccuaggccccugcccuguaggaaggcagaauguaacuguucuguuuguuua

SEQ ID NO: 374561 - RNA, 64 nt, Human
gacaccccaaagagaagaaggggacucuggauaggguccccacauccagggcguggggagacca

SEQ ID NO: 374562 - RNA, 64 nt, Human
ggggccaagggaggcccagggggccgagggcccagguccccaucaugcccucaccacuuuaugc

SEQ ID NO: 374563 - RNA, 64 nt, Human
gugguaugacauucaaagcuaccagaagcaucaugguccccagacccuguaccugccuguaacu

SEQ ID NO: 374564 - RNA, 64 nt, Human
ccuggcagucugcccaccugggugcacugggacggguccccagaucugcuggaaugauuguccg

SEQ ID NO: 374565 - RNA, 64 nt, Human
aaggacacccccccacaacaagaguuagcagcgagguccccaugagucccacccaugaccugcc

SEQ ID NO: 374566 - RNA, 64 nt, Human
gugggcacagaugagcagaguggaugguucgguggguccccacgaggcgagugguggucauaug

SEQ ID NO: 374567 - RNA, 64 nt, Human
aacacuccuccuuaggccuggaggccaagguguggguccccacgccugaucuuugaaaacacua

SEQ ID NO: 374568 - RNA, 64 nt, Human
ggaccugggaccacaaugggguaccugccgaggggguccccaagagauccaggcugucauguga

SEQ ID NO: 374569 - RNA, 64 nt, Human
ggugguggagaugacaaggacacuguggggucuggguccccagaacucuggagcuacaggccac

SEQ ID NO: 374570 - RNA, 64 nt, Human
agagcccuucgugggagcugucccauguuuccaugguccccagucuccccuccacuuggugggg

SEQ ID NO: 374571 - RNA, 64 nt, Human
cagucccuggggggaggcaggaggcacaugugaggguccccagagagaagggagugggugggca

SEQ ID NO: 374572 - RNA, 53 nt, Human
acucagaaaagaccuccuagcuagguccccaugugaggagaucugcuuucagc

SEQ ID NO: 374573 - RNA, 64 nt, Human
gaauggcaccucucccuaggauacacagccugcagguccccaggaccuggaugacacccgccuc

SEQ ID NO: 374574 - RNA, 64 nt, Human
accucauccgucuguuugcagagccucaucuacagguccccacgcugccuucuuuacucacucu

SEQ ID NO: 374575 - RNA, 64 nt, Human
aacccacuaugccuuccuguccuuucuacucaaugguccccacuccaagaugaguugacacaac

SEQ ID NO: 374576 - RNA, 64 nt, Human
accuguaaauugauuuacaaguacuuaaaagcgugguccccagugaggccaagaaaguuuccgg

SEQ ID NO: 374577 - RNA, 61 nt, Human
cauuucuuaauaacaucguugugauguucuuaaggcagaucuuucuucauaaaaaggaaag

SEQ ID NO: 374578 - RNA, 61 nt, Human
uccuugguuauaaaaugaaauggcauauguaaaggcagaguuguuaacugcuauauuucau

SEQ ID NO: 374579 - RNA, 64 nt, Human; identical to SEQ ID NO: 249419

SEQ ID NO: 374580 - RNA, 64 nt, Human; identical to SEQ ID NO: 249420

SEQ ID NO: 374581 - RNA, 64 nt, Human
uuuuuuuuuucuaauuucucccacauguauuucugguccccagugauacuagcugaguuguagu

SEQ ID NO: 374582 - RNA, 61 nt, Human
accacgugucaagugauuaggcuagugcccagguccccaucuccaugucccgggucccccc

SEQ ID NO: 374583 - RNA, 64 nt, Human
gugcucccgccggcccacagggccuccguccccagguccccaguggggcagcccuccccacaga

SEQ ID NO: 374584 - RNA, 64 nt, Human
aggggaacauugggcauuugaacauaucagggaggguccccauuuuagugggaacaaguauuua

SEQ ID NO: 374585 - RNA, 64 nt, Human
uccuuuuauuugaagggggcaagggcugagaugugguccccaaggggccagaaauucccaaguu

SEQ ID NO: 374586 - RNA, 64 nt, Human
cagugaaaagugguuuucuuaaugcagcccugcugguccccauuaacaauugcuugaaauucac

SEQ ID NO: 374587 - RNA, 64 nt, Human
uuguguccccaacgcauccauccuuggguccacugguccccauucuuccccacagacuuccuuu

SEQ ID NO: 374588 - RNA, 64 nt, Human
cacaauuguggacuggggccaugaggccuucccugguccccacugaacccaccuuaguuccaca

SEQ ID NO: 374589 - RNA, 64 nt, Human
ucucaagccauuaggagagagagaaauugggagugguccccaaagacccuucaaccuccccagu

SEQ ID NO: 374590 - RNA, 64 nt, Human
cugggucuacccgcucgggguucgcggaaggggagguccccagcgguacgggcuccuaggcgcu

SEQ ID NO: 374591 - RNA, 64 nt, Human
agccagugcggugguguguguagccccaaccacugguccccaggaagugguggugguugauggc

SEQ ID NO: 374592 - RNA, 64 nt, Human
agacaagaaauccuaguggccucccagacugcaggguccccaaggauggaaagggaauguucug

SEQ ID NO: 374593 - RNA, 64 nt, Human
gcaggcccuguccagcccccagugcgcucguuccgguccccacagacugccccagccaacgaga

SEQ ID NO: 374594 - RNA, 64 nt, Human
aucugaguagagauaguacuaauauuggcaagaagguccccaggauagaccuagcaaggagaua

SEQ ID NO: 374595 - RNA, 64 nt, Human
uauaaaaucuggucuuauagcuagacaugaugaugguccccaaaccauugauguucuguuaugu

SEQ ID NO: 374596 - RNA, 64 nt, Human
auucgagcaggucagcgucuucucucgccacgacgguccccauuccacccccucuuucuuucac

SEQ ID NO: 374597 - RNA, 61 nt, Human
agcacucugugaaaccuugaaaugagaaguaaaggcagaugaaaagaaagaaaaagccuuu

SEQ ID NO: 374598 - RNA, 61 nt, Human
ucuaaccugugcccugugguuucuggaaggaaaggcagacuuuaggugguccugccuggac

SEQ ID NO: 374599 - RNA, 64 nt, Human
gaccucaaaucgccacucuuugggcggcaggugcgguccccacggccggcucuacgaggaagag

SEQ ID NO: 374600 - RNA, 64 nt, Human
cuccccucuggcagccccaggugggagcugggaggguccccagcccaggagguggcuggauugc

SEQ ID NO: 374601 - RNA, 52 nt, Human
cccggggucugcucacauagccgguccccacgcccagcggcccacccaccag

SEQ ID NO: 374602 - RNA, 64 nt, Human
aguccggggaaagagagguggggggagagccugagguccccaagugaggggaguccuaggcaga

SEQ ID NO: 374603 - RNA, 64 nt, Human
cacaggcuugugagggccccgucgcugccugcuggguccccaccagggcucccucuaggaaugc

SEQ ID NO: 374604 - RNA, 64 nt, Human
gggagcaggaagcccuaggaagaggggacugcaggguccccaggggaucuuuccucccuccccu

SEQ ID NO: 374605 - RNA, 64 nt, Human
ccccaggcagccaguggugggcccugagcccucagguccccagcuccuugagggaugaaccugg

SEQ ID NO: 374606 - RNA, 64 nt, Human
ugggucuggggacaggcccgcuugcuggguaccugguccccacugcugagcuggcccuugggga

SEQ ID NO: 374607 - RNA, 64 nt, Human
ggggagaugcuggugagggguccguacagggugggguccccaccccuagccccuuacugagggg

SEQ ID NO: 374608 - RNA, 64 nt, Human
aggccccucacgcucugugccccuagauccuucagguccccacccucagcugucaccaccaccc

SEQ ID NO: 374609 - RNA, 64 nt, Human
ucagggccaggaaguagaggcugggaacucuucugguccccaguauggcaggcgccagggaggg

SEQ ID NO: 374610 - RNA, 64 nt, Human
acagugguucucuggacaaggcuuuguccaucccgguccccagcugagugcccagcgcugagcu

SEQ ID NO: 374611 - RNA, 64 nt, Human
uccuguucucggcagcuucugucgcuggcccugggguccccacagcugcagcucuccugugagg

SEQ ID NO: 374612 - RNA, 64 nt, Human
ugcccgccgccugcuccccacacggacuccaggcgguccccacccacagaagcagaccuucagc

SEQ ID NO: 374613 - RNA, 64 nt, Human
cagcguccagggccagcgagcucccccggcagcagguccccaagccaugucaggcaucuccacc

SEQ ID NO: 374614 - RNA, 64 nt, Human
aucacagccagagccuguugugucucaguugggugguccccaggacacugccuguggggaccug

SEQ ID NO: 374615 - RNA, 61 nt, Human
cagccacaugggaagugaaagcugagaagggaaggcagaugggagaagccaaugggaacuu

SEQ ID NO: 374616 - RNA, 61 nt, Human
aagggagggaccaguggccccuuguuugccaaaggcagaguggggcugagaaacaggcugc

SEQ ID NO: 374617 - RNA, 61 nt, Human
auacauugagcccaaagucaaguuuggggaaaaggcagacuaaggccuccuuucucugacc

SEQ ID NO: 374618 - RNA, 61 nt, Human
aaugcuaaugagguccacuaaaaaggggaggaaggcagaccuccugggagacccacgaagg

SEQ ID NO: 374619 - RNA, 64 nt, Human
agcagccaucgcgggcugcaucaucccccagccagguccccaccaggccugucucccagcguuu

SEQ ID NO: 374620 - RNA, 64 nt, Human
aagccauucuggacaccaggggaccuggacggaggguccccacagcccgugccccacgccgccu

SEQ ID NO: 374621 - RNA, 64 nt, Human
ugagagagaggcaacccugggggccaguucaggugguccccaaccauaagcuaggucugaaagu

SEQ ID NO: 374622 - RNA, 64 nt, Human
cucuuugucuccaaucagucccacucccuccugagguccccaagggcaguauucagagagguuu

SEQ ID NO: 374623 - RNA, 64 nt, Human
cugggaugagccgcugugagccccugguccugaggguccccaccugggacccuugagaguauca

SEQ ID NO: 374624 - RNA, 64 nt, Human
ucuuccggguccuaaagagcacagagaaaauggagguccccagucuagguaggaagcugauugg

SEQ ID NO: 374625 - RNA, 64 nt, Human
acccucagaaggacggguaagcaggaggccaggggguccccagggcugagguggggagccuucu

SEQ ID NO: 374626 - RNA, 64 nt, Human
gagaugucugauucuaaaugggaguugaugcucagguccccagccagguuugcauccagcccug

SEQ ID NO: 374627 - RNA, 64 nt, Human
ugucagaaagucaaguucagcuaagagacacccagguccccagcuugcccugagcagcccuuca

SEQ ID NO: 374628 - RNA, 64 nt, Human
cgccccucucaguggcuccagggccucccucagagguccccaaagauggacacacaaccccagc

SEQ ID NO: 374629 - RNA, 64 nt, Human
aaaagcacagaggcagcggguggggcgccugggugguccccaaggucgcugccacccuugcccg

SEQ ID NO: 374630 - RNA, 64 nt, Human
cucugccagccaagaccauugauuuggaaaauccgguccccacccgcuaaugagcuguugacac

SEQ ID NO: 374631 - RNA, 64 nt, Human
gggagccugggcuuuuggggaaccaggcugcucugguccccagcauugccuccuccuagccccu

SEQ ID NO: 374632 - RNA, 64 nt, Human
cugccuagggcacaggccccaaccugugugcugggguccccagcagcaaacacuggaaagucug

SEQ ID NO: 374633 - RNA, 64 nt, Human
gugccccuuugcccgccuccugcaaaccucacaggguccccacacaacagugcccuccagaagc

SEQ ID NO: 374634 - RNA, 64 nt, Human
cccuuaagguacuuaguuucuuacuacuacagcggguccccauugcuagguagaauaucuuuua

SEQ ID NO: 374635 - RNA, 61 nt, Human
ggagggaaggaugucugggaugugaagaggcaaggcagaaauggaugaugaacaucaaaaa

SEQ ID NO: 374636 - RNA, 61 nt, Human
cagccaccacugugccauggugacacaggccaaggcagacauuggcccucccuucucccag

SEQ ID NO: 374637 - RNA, 61 nt, Human
uaagaauuaaaccauuacaugccccuuccaaaaggcagaaauccauucaaacgugacuguc

SEQ ID NO: 374638 - RNA, 61 nt, Human
uguagacaagcgcgugcucgcugagcccugcaaggcagaaaugacagugcaaggaggaaau

SEQ ID NO: 374639 - RNA, 64 nt, Human
ugaaccuugcccagccgugguggcccccaggccugguccccaagagcuuuggaggcuuggauuc

SEQ ID NO: 374640 - RNA, 64 nt, Human
cucacauuucaggacuggggcugcaccacacaaggguccccagggcccccaggugggccuugua

SEQ ID NO: 374641 - RNA, 64 nt, Human
cuuauaaauguagugauaggauuccuuguugcuugguccccaaagccuuauacuuuuugcauug

SEQ ID NO: 374642 - RNA, 64 nt, Human
ggcccaccagagcugccauuugucuccagccccugguccccagcucuugccaaagggccuggag

SEQ ID NO: 374643 - RNA, 64 nt, Human
aaauguggaccagugauucucaguuuggugcccagguccccaaaggaagugauggagagccuug

SEQ ID NO: 374644 - RNA, 64 nt, Human
accuucucuucucuugucacuagggggacuaggggguccccaaaguggcccacuuucuguggcu

SEQ ID NO: 374645 - RNA, 64 nt, Human
ggauuguaaucaggcccaaggaauauccuggagugguccccagaagcauccaagaaaagauauu

SEQ ID NO: 374646 - RNA, 64 nt, Human
aagcgugggguggggacacugacagccccuaucugguccccaggaacauucuaccauuucugcc

SEQ ID NO: 374647 - RNA, 64 nt, Human
uucccagugauguugagagcaccugcagcaaucugguccccagucgcacaacuucccacauacc

SEQ ID NO: 374648 - RNA, 64 nt, Human
ucaccuacccaugaccugaagccccucccugagugguccccaccuuucuggacggaaccacgua

SEQ ID NO: 374649 - RNA, 64 nt, Human
ggaggaggccggggcucccaggaagcggacgcccgguccccacacagcgccgcggccgccccuc

SEQ ID NO: 374650 - RNA, 64 nt, Human
agagcaaagcuguuuuagcagaggcuggggcugagguccccaugggguuugggugcaggggcau

SEQ ID NO: 374651 - RNA, 64 nt, Human
cugggagggggcccuuccagauugggggcccugggguccccacucccuguccauccccaguugg

SEQ ID NO: 374652 - RNA, 64 nt, Human
gucaagagaccagggaugcaggguuaggcagacagguccccagaguccucacccugcuccccag

SEQ ID NO: 374653 - RNA, 64 nt, Human
ucaaaccaauggggcugugucuauugucccccucgguccccagggguggggggccuuggaaggc

SEQ ID NO: 374654 - RNA, 64 nt, Human
cugucuccccaggggcgucgaccuggcccagcuggguccccagggccagcacauggaauaaaau

SEQ ID NO: 374655 - RNA, 61 nt, Human
aggauccuugucaccccagccagguauccccaaggcagagcaccucucguuuggcccucug

SEQ ID NO: 374656 - RNA, 61 nt, Human
gcccugagaaagcccugucgggcuuugugugaaggcagagaaagggacaaugauaguagag

SEQ ID NO: 374657 - RNA, 61 nt, Human
gccacuaggccucccuugcagccaacucuggaaggcagaggaguaagagaggaagaugcuu

SEQ ID NO: 374658 - RNA, 61 nt, Human
caugccuguaaucccagcacucugggaggccaaggcagaugaucaccugaggucaggaguu

SEQ ID NO: 374659 - RNA, 64 nt, Human
cacagccagggguuaggucugcaggcccgucugcgguccccaucgagcaucaaggggacgcugu

SEQ ID NO: 374660 - RNA, 61 nt, Human
aucagacacagaucuacugagucagcaucaggguccccagccucugggcuccuguuuccau

SEQ ID NO: 374661 - RNA, 64 nt, Human
caugaaggggcccaucugucagcagcgucuucuagguccccagcucagggagccauccccagcu

SEQ ID NO: 374662 - RNA, 64 nt, Human
cauuaacccacuccccugaccucacgcuggggcagguccccaagugugcaagcucaguauucau

SEQ ID NO: 374663 - RNA, 64 nt, Human
gugcucauuggaaucugaguagagucugggggaggguccccaccuuccuguaccuccuccccac

SEQ ID NO: 374664 - RNA, 64 nt, Human
agggccuccuuggaauaaaugguuauuguuacuagguccccaccuucccucuuuucuggaagcc

SEQ ID NO: 374665 - RNA, 64 nt, Human
aggugucuggacuguggcuuuggcuggcucagaagguccccacuggcguguguggucuauguag

SEQ ID NO: 374666 - RNA, 64 nt, Human
aauugucuuacccacuaugccccucucuagucaugguccccaagaggggcuuggagacccacuu

SEQ ID NO: 374667 - RNA, 64 nt, Human
acauggaggaugguguccugaggccuccaaggacgguccccaccccucuacguuuccccaauaa

SEQ ID NO: 374668 - RNA, 64 nt, Human
ggggugggaugggaagaggcucuuugcaaacgaggguccccagagaagacuggcggggaccuga

SEQ ID NO: 374669 - RNA, 64 nt, Human
ugaacaugccucucucuugcuuacaaaugucuaagguccccacugccugcuggagagaaaacac

SEQ ID NO: 374670 - RNA, 64 nt, Human
ugaacgugccucucccuugcuuacaaaugucuaagguccccacugccugcuggagagaaaacac

SEQ ID NO: 374671 - RNA, 64 nt, Human
ugaaugugccucucucuugcuuacaaaugucuaagguccccacugccugcuggagaaaaaacac

SEQ ID NO: 374672 - RNA, 64 nt, Human
aucuggugccugucucuugcuuaccaaugucuaagguccccacugccugcugcagagaaaacac

SEQ ID NO: 374673 - RNA, 64 nt, Human
aaucuggugccucucucuugcuuacaaaugucuagguccccacugccugcuggaaagaaaacac

SEQ ID NO: 374674 - RNA, 64 nt, Human; identical to SEQ ID NO: 374669

SEQ ID NO: 374675 - RNA, 64 nt, Human; identical to SEQ ID NO: 249422

SEQ ID NO: 374676 - RNA, 64 nt, Human
auccagugcagugcaccggaauaaagagaauuuguaggcguauacagcuuuaaaugauuuauuu

SEQ ID NO: 374677 - RNA, 64 nt, Human
uugaaguuuuauuauuuuuaaagugccucccaccuaggcguaggccaugaccauuugggguacg

SEQ ID NO: 374678 - RNA, 64 nt, Human
gcccucagcauuuggaggggaaccuguucccgucgguccccaaauauccccuucuuuuuauggg

SEQ ID NO: 374679 - RNA, 64 nt, Human
cacccccgcucacguccugccgcaccccuccgccgguccccacccucugccccccagcccucug

SEQ ID NO: 374680 - RNA, 64 nt, Human
aguccgguggccgugggggugcucugccuucccugguccccacugcccauaucuguggacugcc

SEQ ID NO: 374681 - RNA, 64 nt, Human
gccccugcuguggagaagccggacccauccccgagguccccagcgaggacacacacuccacgag

SEQ ID NO: 374682 - RNA, 64 nt, Human
ucgagucccgcagccuuaacaggaugggaucgaggguccccaugggguggcucagagauaggac

SEQ ID NO: 374683 - RNA, 64 nt, Human
ugccugucugggaaaaggucacuggaccuggaaggguccccaggguccccugacucccgucucc

SEQ ID NO: 374684 - RNA, 64 nt, Human
ggccagggcucccacuggcuguagcugugcucuggguccccaggucccugcgcagccaccaggg

SEQ ID NO: 374685 - RNA, 64 nt, Human
ccuggcaacugcagcugcuggauuccagauucuggguccccaaucccucugcccagucccucaa

SEQ ID NO: 374686 - RNA, 64 nt, Human
ggucaccaggcuggucuaccagguaguuggggaggguccccagccaaggggccggcucucguca

SEQ ID NO: 374687 - RNA, 64 nt, Human
auauuuuguaguuguguguguguguuuuugccuugguccccauuaugggaugcauuaggacugg

SEQ ID NO: 374688 - RNA, 64 nt, Human
cagccaggccaucagcccaccuccaccucuggaggguccccagagacccacgcccgacgcagac

SEQ ID NO: 374689 - RNA, 64 nt, Human
ggggugauuauagggaaggacgcaggcauuccuagguccccagcucuaauuccauccaucuacc

SEQ ID NO: 374690 - RNA, 64 nt, Human
ucugccugggacccgagcugggcuccugggccuugguccccagaagauggcggcuagggccucg

SEQ ID NO: 374691 - RNA, 64 nt, Human
cugggaccacucagggcaucagggggcguggucugguccccauugcgggcccgggaggggaaug

SEQ ID NO: 374692 - RNA, 64 nt, Human
agaauguuauuuguuaucuaccugugacccagaagguccccaauuccaguuauuccaccuuucc

SEQ ID NO: 374693 - RNA, 64 nt, Human
ggaucaguagccaggaccagaguggccgccuggagguccccaucucacgugugaugccaccccg

SEQ ID NO: 374694 - RNA, 61 nt, Human
ucuaaagaaaauauguuucagcauuauaagaaaggcagaaugcagaacaccuacauuuuug

SEQ ID NO: 374695 - RNA, 61 nt, Human
ucuucguucuggcccuuccaggguaauuaggaaggcagaacaagacagaugagcuccugcc

SEQ ID NO: 374696 - RNA, 61 nt, Human
gagaagacggugaaaugauguaaugacagagaaggcagacaacauguuuccgugacucauc

SEQ ID NO: 374697 - RNA, 61 nt, Human
uuuccagcucucaugccccgcaguguggaacaaggcagaaaaggauccuaggaaauaaguc

SEQ ID NO: 374698 - RNA, 64 nt, Human
caccaucaccucuuuggaacugccagacccuggggguccccagugagcaaaggucuguccuugu

SEQ ID NO: 374699 - RNA, 64 nt, Human
gagacucugggaucccaucaccucaaagccagaggguccccaagucaccgcugagagcacuuga

SEQ ID NO: 374700 - RNA, 64 nt, Human
auuacagacaaccuaucauuuauucugcuucgaggguccccagggcccuuguacaaccgacagc

SEQ ID NO: 374701 - RNA, 64 nt, Human
ucccucuccaggagaccuacccuccacaggcacagguccccagaugagaagucugcuacccuca

SEQ ID NO: 374702 - RNA, 64 nt, Human
ccucugaacccauucacccuucacccucacuccugguccccauacccagcaucuaaucauccau

SEQ ID NO: 374703 - RNA, 64 nt, Human
ccccuacuccuggccccuccauccuuucuucucugguccccaucccugucucucccuuucaccc

SEQ ID NO: 374704 - RNA, 64 nt, Human
agaaccuaugacuuucuuccaguuccuucuaccagguccccauccugcugccagcucucaacau

SEQ ID NO: 374705 - RNA, 64 nt, Human
agggguauauuuagacccuguuuccuuucaggaggguccccagcugguccagggccugggaaau

SEQ ID NO: 374706 - RNA, 64 nt, Human
uaccacguuggaucccauucgucacccaugcuaggguccccaaagcacuggggcaggggccaga

SEQ ID NO: 374707 - RNA, 64 nt, Human
cauugggacagggucacuucugacaggggaaguggguccccaggucagcccuucucuucccuuu

SEQ ID NO: 374708 - RNA, 64 nt, Human
ggcccucaugucuuugauaggagagugcuuaggugguccccaacagugccuagggguacaguac

SEQ ID NO: 374709 - RNA, 64 nt, Human
acugcucuguuugggugggagaagauucucuggggguccccacauccucccaaggcuccccuca

SEQ ID NO: 374710 - RNA, 64 nt, Human
gugagggagcaucaggagguccaggcguggggcagguccccaccuuccugaaccuuccccugcc

SEQ ID NO: 374711 - RNA, 64 nt, Human
ucccaccagguugaggugggggccuugcaucggggguccccaggguaugggguagggguggggg

SEQ ID NO: 374712 - RNA, 64 nt, Human
ugccccuggcccaucucagccuccugagccuguggguccccacucacccccuuugcugugagga

SEQ ID NO: 374713 - RNA, 64 nt, Human
cacagcagcacgggccccacugugcugcucuucagguccccacagcccugccuuugguuccugg

SEQ ID NO: 374714 - RNA, 61 nt, Human
gagaaagacaucugaggaaaauggaagaccuaaggcagacaggaaggaagcacaaaagaca

SEQ ID NO: 374715 - RNA, 61 nt, Human
caugccuauaauuccagcacuuugggaggccaaggcagaaggaucacuugagaccaggagu

SEQ ID NO: 374716 - RNA, 64 nt, Human
caaaccucugaaaacugaaauauuuuucauaaauuaggcguaaauucuaugcccugaacaaaug

SEQ ID NO: 374717 - RNA, 64 nt, Human
auauauuuuuucagcuacuuaaacuguucaugaauaggcguacuuucuguauuuaaaaauggcc

SEQ ID NO: 374718 - RNA, 64 nt, Human
uagucaaacacagacaugguuguugcaccagaaagguccccacuagagcuaagcgugaagcuga

SEQ ID NO: 374719 - RNA, 64 nt, Human
gugucccuagggugugggagacuccgcccugccggguccccaccagggaggcgcgaccccuugu

SEQ ID NO: 374720 - RNA, 64 nt, Human
acccauuggcgcucaaccgaauugcugcucaggagguccccauugagaucaagccaguaaaccc

SEQ ID NO: 374721 - RNA, 50 nt, Human
agaaaggacacccucucuaggguccccaggggggccgggcuggggcugcg

SEQ ID NO: 374722 - RNA, 64 nt, Human
aguggguggacuuggaggaggaacggcaagggccgguccccacacucuugcuccuccugggcau

SEQ ID NO: 374723 - RNA, 64 nt, Human
gcagggcugucagggcacaugccuggccggcugggguccccacccgcggagacgguccuagacc

SEQ ID NO: 374724 - RNA, 64 nt, Human
cucacgccuuaguuugaaacagauucuccacggugguccccaaaacacugucugcauauccaua

SEQ ID NO: 374725 - RNA, 64 nt, Human
uucacaccugcuggagccugugagggagguggcggguccccacuguggcgacggagagcugaca

SEQ ID NO: 374726 - RNA, 64 nt, Human
uggaguacccauaauacagugagcccacccucgugguccccagacauuucaggaggucgggaaa

SEQ ID NO: 374727 - RNA, 64 nt, Human
cacccucagcagccccaccccacucaacccugaggguccccaggguccugaugaagaccuccga

SEQ ID NO: 374728 - RNA, 64 nt, Human
cgcccauguccagcaggcgcaggccuggcaacacgguccccagaguccugagcagcaguuaggu

SEQ ID NO: 374729 - RNA, 64 nt, Human
uguacacagagaaaaucacaugaaggagaccugggguccccacuugugagugcaacugcaagua

SEQ ID NO: 374730 - RNA, 64 nt, Human
ccgggaccuuugcgcagcucugucgacucugguggguccccacuccuggggcccccuaacccca

SEQ ID NO: 374731 - RNA, 64 nt, Human
ggggggccccaggaggcaggggagcccagcugucgguccccagcccugcccggcgggcccggag

SEQ ID NO: 374732 - RNA, 64 nt, Human
uggcuguggagggccgggugguggcucugaggaugguccccagccccacccuguccccacccug

SEQ ID NO: 374733 - RNA, 64 nt, Human
aggccaaagccugcccugagcccagacacaccuggguccccauucuggggccugguccccuaaa

SEQ ID NO: 374734 - RNA, 64 nt, Human
ggcuccgggcuguguccuaaaugcaaagcacaccucggccgaggccugcgcccugacaugcuaa

SEQ ID NO: 374735 - RNA, 64 nt, Human
aucagcaguggcccaggaaggaggucaagcaucuucggccgauauuuaaacaugggcagcuucc

SEQ ID NO: 374736 - RNA, 64 nt, Human
ucaauucuuacacauaaauguuugccagaguguuucggccgacguauuuacagcucugacaaau

SEQ ID NO: 374737 - RNA, 64 nt, Human
cuuaugaguguggggucuggcacccugcagcccagguccccacugcucucacacccuuaggcug

SEQ ID NO: 374738 - RNA, 64 nt, Human
gugcuggguucacuguguccuaggaaaccaagaggguccccaguccuggccucugcccgccccu

SEQ ID NO: 374739 - RNA, 64 nt, Human
gaacacugaagggcagguggugggccauggccaugguccccagcugaggagcaggugucccuga

SEQ ID NO: 374740 - RNA, 64 nt, Human
gugugugugugugcgugugugugcggugaagggcgguccccauccugggcccccacucuagacc

SEQ ID NO: 374741 - RNA, 64 nt, Human
uccaaggcugagcuggggcucuggccccaggugagguccccagcuccugagcacuucugagggg

SEQ ID NO: 374742 - RNA, 64 nt, Human
augggggcccaaagcucagggcuggggagccugggguccccacuugaaucuccagcaggagggu

SEQ ID NO: 374743 - RNA, 64 nt, Human
ugugggggucugcgggcugggaacucucguccucgguccccagggcgcagcuguuggggcugcg

SEQ ID NO: 374744 - RNA, 64 nt, Human
gaggagaggagaaagggaggaagcugggcugugugguccccaugaaggcauucagaguccaccu

SEQ ID NO: 374745 - RNA, 64 nt, Human
guccccgcaaugucucacguugucuuugaccagugguccccaguaccaggccagcgaagacaac

SEQ ID NO: 374746 - RNA, 64 nt, Human
cagagguacuugagggggacuggaggccgucucugguccccagggcaagggaacagcagaacuu

SEQ ID NO: 374747 - RNA, 64 nt, Human
gaugagaggaaccaucgcaggaugacagcucccggguccccaaaccuguuccccucugcuacua

SEQ ID NO: 374748 - RNA, 51 nt, Human
agcugcugcucucacccugaggguccccagccucucaccggccccagcuga

SEQ ID NO: 374749 - RNA, 64 nt, Human
aaagcuguucuccagucuggggagggagaggcaggguccccaauguccgagcugcaucuggacg

SEQ ID NO: 374750 - RNA, 64 nt, Human
guaauagaguaacaaguggcagggccagaaccaggguccccaaaguccugguguuggcacauuu

SEQ ID NO: 374751 - RNA, 64 nt, Human
gaggauggugugggcccuccccgccggcccccuggguccccaguguucgcugugugugcguuug

SEQ ID NO: 374752 - RNA, 64 nt, Human
cugcccuugaaguggagugggcccagaguguggcgguccccaugguggcagccccccgacugau

SEQ ID NO: 374753 - RNA, 64 nt, Human
auuauuucacagauaaugagaccuuaauaacaaauaggcguaaaaaaauuuucacauugaaaug

SEQ ID NO: 374754 - RNA, 64 nt, Human
ccucccaccuuggccucccaaagugcugggauuauaggcguaagccacugugucuggccuagug

SEQ ID NO: 374755 - RNA, 64 nt, Human
aaaugugucuaugaauuuguaaaacaaucaaaaguaggcguaagcagaauaaggcaaaagggaa

SEQ ID NO: 374756 - RNA, 64 nt, Human
ccacccgccucggccucccgaagugcugggauuauaggcguaagccaccaugccuggccaaaaa

SEQ ID NO: 374757 - RNA, 64 nt, Human
augcacuugagcucugaggggagguuucacaaaagguccccaguggcucauaaagacucaaagc

SEQ ID NO: 374758 - RNA, 64 nt, Human
aggaucccccauuccccacccugggagaugaggggguccccaugugcuuuuccaguucuucugg

SEQ ID NO: 374759 - RNA, 64 nt, Human
cgugugugagucuguuguguggaugugcgugugugguccccagccccagacuggauuggaaaag

SEQ ID NO: 374760 - RNA, 64 nt, Human
guguuagccuucaugaaauugcaguacagagauggguccccaaaguggaguguauuuacagcuu

SEQ ID NO: 374761 - RNA, 64 nt, Human
ccugacuaugcggugacugcuguaaccaagaucagguccccagcccuuuuguccauuaacaccc

SEQ ID NO: 374762 - RNA, 64 nt, Human
cccaggccuccagcucagcagugacuguggccaugguccccaagaccucuauauuugcucuuuu

SEQ ID NO: 374763 - RNA, 64 nt, Human
gaacuugcugccucggauccccuuccuaccacccgguccccacuuuauugccaaaacccagcug

SEQ ID NO: 374764 - RNA, 64 nt, Human
gaacucccaagacccgagcugggaccaguaccuggguccccagcccuuccucugcucccccuuu

SEQ ID NO: 374765 - RNA, 64 nt, Human
gcccuccugccugggccuuguggggcaaauauuggguccccaggcuggaaagauggacagaggc

SEQ ID NO: 374766 - RNA, 64 nt, Human
gugaugugacuuugggcgagucucagugccacuugguccccagccauggacucuauacagugag

SEQ ID NO: 374767 - RNA, 62 nt, Human
ugaaaucguuagcaccuuaggagaggggaccuucggccgaguuguacaauguguugaccauc

SEQ ID NO: 374768 - RNA, 64 nt, Human
caacaggcuggccaacaaggcggugcagcggggcucggccgacaacgucacugugaugguggug

SEQ ID NO: 374769 - RNA, 64 nt, Human
aagaguagaugguugcccugcaucuugggcuccaucggccgaaacuuucccaagccagggugug

SEQ ID NO: 374770 - RNA, 64 nt, Human
ggcuccaacuuccuuccuuccuucggggccagucucggccgaagucuggucacgcucagacaga

SEQ ID NO: 374771 - RNA, 64 nt, Human
cuuggggucccacugcucgaaauggccccugucuucggccgagcugguuuccugcccagccugg

SEQ ID NO: 374772 - RNA, 64 nt, Human
gaaacaucccaggcccugagcagcgugucuuuccucggccgagucaggcuuccuggugagccuc

SEQ ID NO: 374773 - RNA, 64 nt, Human
cagaaaugaggaggcuguuuuccucugauucuccucggccgaccaccuguccaaugcugcuggu

SEQ ID NO: 374774 - RNA, 64 nt, Human
cccugcaucagcaaggccagccccagaaggagccucggccgagcgugcaacccggagccgccuu

SEQ ID NO: 374775 - RNA, 61 nt, Human
guguggugugcggcuucacccagggcagaacaaggcagaaucgcaggaaacccgcuucccc

SEQ ID NO: 374776 - RNA, 61 nt, Human
cagauggggcuaagucacaaacuugcagccuaaggcagaaucugaagaacuuuccagagug

SEQ ID NO: 374777 - RNA, 61 nt, Human
ucugucucccuccccaaauggcugcuuugacaaggcagacgucguacccagccauguguug

SEQ ID NO: 374778 - RNA, 61 nt, Human
aucuaauauagugauuuuaagcaucccgucaaaggcagaaucugucacuugaaugaaggaa

SEQ ID NO: 374779 - RNA, 61 nt, Human
agggccuuugugcuuugucaucccaugccagaaggcagaaggguaagagagggcaagagug

SEQ ID NO: 374780 - RNA, 61 nt, Human
auguucaaaauucggccacagcucucuuaugaaggcagagucagauaaaaugauauucugc

SEQ ID NO: 374781 - RNA, 61 nt, Human
aagaugaagaaggaaaccaggugaacucagcaaggcagacuggcugcuuacuucagcacua

SEQ ID NO: 374782 - RNA, 61 nt, Human
aaaaagcauaaaucauucaaaucuucaaaccaaggcagaaauaauuuuaugucgcuauagu

SEQ ID NO: 374783 - RNA, 61 nt, Human
augcacuagcagagugcaggaucuguucugaaaggcagacgugcuccucagacaucagaac

SEQ ID NO: 374784 - RNA, 61 nt, Human
uuuuacuaccugaaguacaauuuaacuuuuuaaggcagauuuuuauuuccuuugaaauaau

SEQ ID NO: 374785 - RNA, 61 nt, Human
ccugauucuauacccucuuccuucuuucugcaaggcagaggaauaauauuuuuaaagguua

SEQ ID NO: 374786 - RNA, 61 nt, Human
gggaccuggggcgggggacgggacuuaaauaaaggcagacgcuguuuuucuacccaugugg

SEQ ID NO: 374787 - RNA, 61 nt, Human
aagggcuugaggccucuaugggugggggcagaaggcagagccugugucccagggggaccca

SEQ ID NO: 374788 - RNA, 61 nt, Human
acauucaaaugguuguagccuggugggguagaaggcagagaagacuacccagccagugaag

SEQ ID NO: 374789 - RNA, 61 nt, Human
uccugcagaaaagagugugaggagccagggaaaggcagaaccaccuccaugcuguagcaaa

SEQ ID NO: 374790 - RNA, 61 nt, Human
aaaaaauuuuuuuacaguaaugauagccuccaaggcagaaacacuuuucaguguuaaguuu

SEQ ID NO: 374791 - RNA, 61 nt, Human
gguuaguuuuauagacaggaaggggcugucaaaggcagaaagaaaugaagaacaaaaaaaa

SEQ ID NO: 374792 - RNA, 61 nt, Human
cuggccagcacgccuguccucccccggggccaaggcagaggaggaggacgacauccugacc

SEQ ID NO: 374793 - RNA, 61 nt, Human
uuuuuuuuucuuuuuugggggaagauaauuaaaggcagaaugacugcguuuguaaaagaag

SEQ ID NO: 374794 - RNA, 61 nt, Human
uuucaugccuugaaauuaaacuaugaaauuaaaggcagaaaaacuggaaaaccuacugcag

SEQ ID NO: 374795 - RNA, 61 nt, Human
aggaugucaccauagauaaaagccucauacaaaggcagaacuacacuccaaauuuaaugug

SEQ ID NO: 374796 - RNA, 61 nt, Human
ggguucugauauguagcaugguauuuucccuaaggcagaacuuuaaaaauaaagaacuuuc

SEQ ID NO: 374797 - RNA, 61 nt, Human
caucucagacuuccuaacacagccuguguggaaggcagaacaaagaaugcaugcccaguca

SEQ ID NO: 374798 - RNA, 61 nt, Human
guacugcugugcaacccagcugcaaggauggaaggcagaggguggguguggggccugaggc

SEQ ID NO: 374799 - RNA, 61 nt, Human
auuuaagggcucuguccuguuauacauauuuaaggcagaaaaaaaguuacaugucgauuag

SEQ ID NO: 374800 - RNA, 61 nt, Human
aggaugaccaaaaccaaugucucaggccaggaaggcagaagagaagcccuggugggacacu

SEQ ID NO: 374801 - RNA, 61 nt, Human
aagggaagauuuauuacuaccaugugaucacaaggcagacucagugggauccuccuacuug

SEQ ID NO: 374802 - RNA, 61 nt, Human
ugacuucugccugugggucugaggaagggagaaggcagaacccauaggcagucccugggca

SEQ ID NO: 374803 - RNA, 61 nt, Human
cccuugggugaccucuuguacccccagguggaaggcagacagcaggcagcgccaagugcgu

SEQ ID NO: 374804 - RNA, 61 nt, Human
gcggugcugucugcugggaggucagcuggucaaggcagaggaggagaggaggaaaggaugg

SEQ ID NO: 374805 - RNA, 61 nt, Human
cacaaccuaugacuggagcagaauaagucuaaaggcagagccccagccucagagacaaaua

SEQ ID NO: 374806 - RNA, 61 nt, Human
uccuggauuguauuaucugcuuuccuuuaccaaggcagacagaacugcugccuuagccuga

SEQ ID NO: 374807 - RNA, 61 nt, Human
caaugcuaccaucugauaaggguauuuguaaaaggcagaauguuugggccaugaagaagua

SEQ ID NO: 374808 - RNA, 61 nt, Human
uuuuguuuauguuuuuguuuuuuuccugaugaaggcagaagagaugguggucuauuaaaua

SEQ ID NO: 374809 - RNA, 61 nt, Human
ugccaguuuauuuaauuuguuuaaaaaaaaaaaggcagaaaacccaccaugggaaaauaag

SEQ ID NO: 374810 - RNA, 61 nt, Human
guuucucuuccuugccuggacugccuuugacaaggcagaaaugaacaugaaaaguccccag

SEQ ID NO: 374811 - RNA, 61 nt, Human
auacaguugaaaacauuuuuguuuugauuggaaggcagauuauuuuauauuaguauuaaaa

SEQ ID NO: 374812 - RNA, 61 nt, Human
ggcauggaugaucaggagcugccuauauaugaaggcagaaucagacuaucaggaaaggagc

SEQ ID NO: 374813 - RNA, 61 nt, Human
aggcaguaauuuccuuuuggaaaggacucugaaggcagaaaagaagggagagaaccucaug

SEQ ID NO: 374814 - RNA, 61 nt, Human
gcuguuugaaagcuucaccucaccuuucugcaaggcagaaaaaguaugaaaaaaaccaagg

SEQ ID NO: 374815 - RNA, 61 nt, Human
acaggagggagccuggggauugugguuugggaaggcagacaccugguucuagaacuagcuc

SEQ ID NO: 374816 - RNA, 61 nt, Human
agguuucaugacacaaccuuucaugucgugaaaggcagagggugacugugugugaugugca

SEQ ID NO: 374817 - RNA, 61 nt, Human
caggcagggcuuauuggggccauuucauagaaaggcagauugaagcucagcagggaagagg

SEQ ID NO: 374818 - RNA, 61 nt, Human
ugcugccucucuucugugucguuuuguugccaaggcagaaugaaaaguccuuaaccgugga

SEQ ID NO: 374819 - RNA, 61 nt, Human
ucacaaaacacaaacccaggacuuucugccuaaggcagagcacaagacucacagcagcacc

SEQ ID NO: 374820 - RNA, 61 nt, Human
cauacuugcaaaauugguuuuucaagacugaaaggcagauuaacuuuccauucuacuuaug

SEQ ID NO: 374821 - RNA, 61 nt, Human
uauauguaaugucuuaauugagauuucuguuaaggcagaaauaauuaggcuagggcucuua

SEQ ID NO: 374822 - RNA, 61 nt, Human
ccugccuuccucaaccuagagaaggguuguuaaggcagaccgcccuguuccccagaguugu

SEQ ID NO: 374823 - RNA, 61 nt, Human
agaccuuggaucagaugaacucuuagaaaugaaggcagaaaaaugucauugaguaauauag

SEQ ID NO: 374824 - RNA, 61 nt, Human
cagaggaaguguggagauggcuguuugcaggaaggcagacgagacaguguuuaaaaagucc

SEQ ID NO: 374825 - RNA, 61 nt, Human
gaccaacauauuccuuugucacauuauguaaaaggcagaaacauaccuuugacuauaagaa

SEQ ID NO: 374826 - RNA, 61 nt, Human
ucuguucaguacaguagugcagaggguggugaaggcagauauuguaaacuacaaccaggaa

SEQ ID NO: 374827 - RNA, 61 nt, Human
aaaaaaguaaaaauaaaaacaaaaaaguuggaaggcagaaaccauuaaaaaacaaaaagcc

SEQ ID NO: 374828 - RNA, 61 nt, Human
uucuuuacucaugacauuucgcagugcagagaaggcagaacccaagaaaaacgucaucuuu

SEQ ID NO: 374829 - RNA, 61 nt, Human
uauuugaugguuuguaaguagacaguaaggcaaggcagaugauuauuacccucagaaaggu

SEQ ID NO: 374830 - RNA, 61 nt, Human
ugagcagagacaugacucagccuguuccaugaaggcagagccauggaccacgcaggaaggg

SEQ ID NO: 374831 - RNA, 61 nt, Human
gggguggaggaccgucacuuacacucugcccaaggcagaggucgcauugcuguaucacagu

SEQ ID NO: 374832 - RNA, 61 nt, Human
caugcagccaaauuuacaggaauuuuuuuaaaaggcagaaaaacuugaaauaccaacauuc

SEQ ID NO: 374833 - RNA, 61 nt, Human
ggaaaauaaagguaaguaauaagcucaucuaaaggcagaaauauauccaaaguuauguacu

SEQ ID NO: 374834 - RNA, 61 nt, Human
gcugcccugaagggggccacagccuggguggaaggcagaccugaaucacaacgggccagcu

SEQ ID NO: 374835 - RNA, 61 nt, Human
aagugaagcaaucuuguauuuuuaauauuuaaaggcagauguacgcuuuaaauuggucucc

SEQ ID NO: 374836 - RNA, 61 nt, Human
ucuuuuucuccucucagcucauacauaacacaaggcagaaaucuggauaugagauuugccu

SEQ ID NO: 374837 - RNA, 61 nt, Human
cugagagagaucaaccucccugagaucaaccaaggcagaugugacagcaagggccacggac

SEQ ID NO: 374838 - RNA, 61 nt, Human
cagccuucagauuugggagcaaacuucagagaaggcagaggaagauacauugccuugcugu

SEQ ID NO: 374839 - RNA, 61 nt, Human
uuuaauugucacuguaaauaacauuuaccacaaggcagauaaaauaagaaaugcugacacu

SEQ ID NO: 374840 - RNA, 61 nt, Human
caugcaagucucccugaggguucugccccuaaaggcagacugccucaugcccgcuagcugu

SEQ ID NO: 374841 - RNA, 61 nt, Human
ugcaccuauagucccagcugcucaggaggcuaaggcagaaagaccauucaagcccaggagu

SEQ ID NO: 374842 - RNA, 61 nt, Human
gcugaucgugucucagcaucaggaaaggagaaaggcagagggagagcgcugagaagacugu

SEQ ID NO: 374843 - RNA, 61 nt, Human
cccccgcugaaccuggcuggaccgcgugugaaaggcagaacuaacgugcggaaacauuuga

SEQ ID NO: 374844 - RNA, 61 nt, Human
agagcggggguccugccccaucuuagagucaaaggcagaggggcuuccaggcccuggaugg

SEQ ID NO: 374845 - RNA, 61 nt, Human
gaaguuugcagauguauuugcagagaagacgaaggcagaguggugucaaaucuuugacggc

SEQ ID NO: 374846 - RNA, 61 nt, Human
cugaguuucauccuauccgagggaugagauuaaggcagaggcaaaaguuucacacaaaguu

SEQ ID NO: 374847 - RNA, 61 nt, Human
uguguguguuugugugugucagucaucuucaaaggcagauuauuagauuccagcaaucuga

SEQ ID NO: 374848 - RNA, 61 nt, Human
caaggucuacaaaaucaugauacuuuuuuaaaaggcagagcauucuuuuuucggcaauuuu

SEQ ID NO: 374849 - RNA, 61 nt, Human
acuuaaauaagccaauacuuagaucuacuguaaggcagaugcuaauuauaaggcauuaagu

SEQ ID NO: 374850 - RNA, 61 nt, Human
aaggcagcacagaggugagggauuaaaaggaaaggcagauuuugaaaucugacucucaggu

SEQ ID NO: 374851 - RNA, 61 nt, Human
gugccccuggaccuucuggacccuugaguccaaggcagauccucucucccagggaauccga

SEQ ID NO: 374852 - RNA, 61 nt, Human
cuucucucccucagggacucuccagcaccaaaaggcagaagguggaagccguuuuuccccc

SEQ ID NO: 374853 - RNA, 61 nt, Human
auaaaugaagaaagggaggcccagccgcaggaaggcagaauaaauccuugggagucauuac

SEQ ID NO: 374854 - RNA, 61 nt, Human
caauaaggagaggaguccaaggggacaaauaaaggcagagagaagagacagaacuaaaaau

SEQ ID NO: 374855 - RNA, 61 nt, Human
ugauagucaucucauccuacucaauuuuucaaaggcagaaaccaacccuggagcaauugag

SEQ ID NO: 374856 - RNA, 61 nt, Human
aggcugaggcaggagaauggcaugaacccggaaggcagagcuugcagugagccgagaucac

SEQ ID NO: 374857 - RNA, 61 nt, Human
cuucuguuggcugggugcccaauacaacaaaaaggcagaggaaaggcaaauucuucucucc

SEQ ID NO: 374858 - RNA, 61 nt, Human
cacacuggugagaggucuuucaguguacuaaaaggcagaaaggucaucacaacuuuagugu

SEQ ID NO: 374859 - RNA, 61 nt, Human
uacaguucuggaggcuggaaacuccaagauuaaggcagauuucaugccuauugagggccug

SEQ ID NO: 374860 - RNA, 61 nt, Human
gcccucccaccccuucucuaacacuagcuucaaggcagaagccacagcagccucuguccag

SEQ ID NO: 374861 - RNA, 61 nt, Human
gccucucacuccguggaugaggacaugggggaaggcagagacuucagacuucucagugugu

SEQ ID NO: 374862 - RNA, 61 nt, Human
auaugugaaaugaauuuggaaauaaugcaagaaggcagaacucaaucauuuaaauuguguc

SEQ ID NO: 374863 - RNA, 61 nt, Human
cccccuauaggaauacaaggggcacacagggaaggcagauccccuaguuggcaagacuauu

SEQ ID NO: 374864 - RNA, 61 nt, Human
ggccugaaaagaggggcugcccuccugcgccaaggcagacacaagcugcgggcugugcggu

SEQ ID NO: 374865 - RNA, 61 nt, Human
auagcaaaucacugaauucagaaucucacuuaaggcagaaauuaaaaucauaauauaaacg

SEQ ID NO: 374866 - RNA, 61 nt, Human
uuguuguuacuguauuacaauuaguauucuaaaggcagaagcagaaguagcugcuuuuuag

SEQ ID NO: 374867 - RNA, 61 nt, Human
gccacccaguaguucucauguaggaccucugaaggcagagugagagcagaaaccccaccuc

SEQ ID NO: 374868 - RNA, 61 nt, Human
gaggaggggagccauccagggugcaaacucaaaggcagagggcacagcgugcuuaggccca

SEQ ID NO: 374869 - RNA, 61 nt, Human
uaccgauggggcagggaccgagucucccaugaaggcagacuccuccucccagcagagcagc

SEQ ID NO: 374870 - RNA, 61 nt, Human
ccauuuucuggggugaggcuugacuuggagaaaggcagaagagacgucccgcuucugugau

SEQ ID NO: 374871 - RNA, 61 nt, Human
gggaccuggcccugagguuauuacuggccguaaggcagaguuaauccauacagaaaccagu

SEQ ID NO: 374872 - RNA, 61 nt, Human
ccuacgugacacaaggagacaugggcuagggaaggcagaacugggcccaaagacacacacc

SEQ ID NO: 374873 - RNA, 61 nt, Human
ugaucagggaaguugggggcauuuggccugaaaggcagaauguucccaguauuucuggaua

SEQ ID NO: 374874 - RNA, 61 nt, Human
ugcaauuugcuuguguaaaucagguuguaaaaaggcagauaaauugaaauguuugugguau

SEQ ID NO: 374875 - RNA, 61 nt, Human
guggcauugcuuguguccauaggaguccaucaaggcagagcggcagagcggcaagcagagc

SEQ ID NO: 374876 - RNA, 61 nt, Human
cggugugcugcuuucccuccgagccuguggaaaggcagagcccuuuugcagauacgaaagc

SEQ ID NO: 374877 - RNA, 61 nt, Human
uucugagguuuuucugccagugucuugucugaaggcagacuucauucugaggcuuuggaca

SEQ ID NO: 374878 - RNA, 61 nt, Human
agugccagagcugcgaacgugaacacaguggaaggcagaggguuuacuacaggccaggcca

SEQ ID NO: 374879 - RNA, 61 nt, Human
ucacucuccuuagaauuggaacuaugcaguuaaggcagauaaaauguacagauguuucaua

SEQ ID NO: 374880 - RNA, 61 nt, Human
cuaacuguaccgcaccggccauuaaaagaugaaggcagaccgcugcaccgccgccugcaag

SEQ ID NO: 374881 - RNA, 61 nt, Human
acauggaugugcuuuggucaaggaauaggccaaggcagagauccaugccugcaugacucag

SEQ ID NO: 374882 - RNA, 61 nt, Human
ccauuuguguccuggagacggugguacccugaaggcagaggccagcugccgcaagacagca

SEQ ID NO: 374883 - RNA, 61 nt, Human
ggaugauucaggaagcugacauuguuuccucaaggcagaauuuuccugguucuguuuucuc

SEQ ID NO: 374884 - RNA, 61 nt, Human
cacccugaggaccuuuaaaaggcaaagccgcaaggcagaaggaggcugggucccugaauca

SEQ ID NO: 374885 - RNA, 61 nt, Human
uuauacaguaaguugacaccacuuagauuuaaaggcagacaguuuugcuuuaguacaauag

SEQ ID NO: 374886 - RNA, 61 nt, Human
caaagcuucuagucuagaggucuguugguugaaggcagacauuuccaaguuuguugaaaua

SEQ ID NO: 374887 - RNA, 61 nt, Human
uucugggcacagacaucuaaccugguauuguaaggcagaggcucccauuggaaugguagug

SEQ ID NO: 374888 - RNA, 61 nt, Human
uaggcacaagaaaaagucaggcauaaagcacaaggcagacuguuugaguggauugguugcu

SEQ ID NO: 374889 - RNA, 61 nt, Human
ccauuuguguccuggagacggugguacccugaaggcagaggccagcugcugcaagacagca

SEQ ID NO: 374890 - RNA, 61 nt, Human
uuuucuccuguaucugaauuuuaaaauuaaaaaggcagauaagacauaaauaguuaucauu

SEQ ID NO: 374891 - RNA, 61 nt, Human
acuggaagacucauguuaaacucuaauugugaaggcagaaucucugcuaauuuuucagauu

SEQ ID NO: 374892 - RNA, 61 nt, Human
caguguauuuguuuauggaaagaaaaacacaaaggcagacuguugaguaaaaaauauuaaa

SEQ ID NO: 374893 - RNA, 61 nt, Human
ggcugaggcaggagaaucgcuugaucccaggaaggcagagguggcagugagcugagaacgc

SEQ ID NO: 374894 - RNA, 61 nt, Human
ugccugaggcaggagaaucucuuaaaccaggaaggcagagauugcagugagcugagauaau

SEQ ID NO: 374895 - RNA, 61 nt, Human
ggccugaccuccccuuccccuuuccugccccaaggcagauccacaucaccgaagcucccua

SEQ ID NO: 374896 - RNA, 61 nt, Human
gugacuguggaauccuaugcagguauuaaccaaggcagaaagaggugaguaacuugcccau

SEQ ID NO: 374897 - RNA, 61 nt, Human
gguggaagagaaagggugggcguggguggggaaggcagagaucucuguuauucugguccau

SEQ ID NO: 374898 - RNA, 61 nt, Human
acagcagaaguaauuacaagcacuucucacgaaggcagaagacugaugcaauuuucgagua

SEQ ID NO: 374899 - RNA, 61 nt, Human
guauaauauucgucucccuggaguuauguugaaggcagaguuuucauaggguuagauuuuu

SEQ ID NO: 374900 - RNA, 61 nt, Human
uuguggcaaagcagaaagcuuuuugacugugaaggcagaggucagcacugggggaaacuug

SEQ ID NO: 374901 - RNA, 61 nt, Human
gugggaaaagaugagcuaugauaaugcugggaaggcagagauugauuaagugcaugcuuug

SEQ ID NO: 374902 - RNA, 61 nt, Human
uuuggaagaaauaauauguaagaauggccucaaggcagaccacuuuaaguuuggcuagacu

SEQ ID NO: 374903 - RNA, 61 nt, Human
uccaaucucuuuccucuuucugccaccucccaaggcagaaauccccucuucagcuucuuuu

SEQ ID NO: 374904 - RNA, 61 nt, Human
aacccaguugcacccugugaagugucugacaaaggcagaaugcuugugagauuauaagccu

SEQ ID NO: 374905 - RNA, 61 nt, Human
cuuccucugguuuccucaggaggaaaugggcaaggcagaguaagcaggggagacagguuua

SEQ ID NO: 374906 - RNA, 61 nt, Human
aggccauucuggaugccauggccgaggagacaaggcagaagcaacuucuggccgacgagaa

SEQ ID NO: 374907 - RNA, 61 nt, Human
cggcuguguuaggaaaaacauguuacacuguaaggcagaugaucguccccguaugaugauu

SEQ ID NO: 374908 - RNA, 61 nt, Human
auagacaguacuuuaacuuguguuuccagauaaggcagauuuuggucaucuuucugugaaa

SEQ ID NO: 374909 - RNA, 61 nt, Human
ggaucacucuugauuuaauuagaggcuaauaaaggcagaauguuuauugugaauauguaau

SEQ ID NO: 374910 - RNA, 61 nt, Human
uccugggugugaccaauauggaauaaagaagaaggcagaaagagagcaaaugaaaaauuuc

SEQ ID NO: 374911 - RNA, 61 nt, Human
ccugaaugaguacuggguacauaacgaaaugaaggcagaaauaaagauauucucugaaagc

SEQ ID NO: 374912 - RNA, 61 nt, Human
agcuuuaguaaaacaaagugaugagguuaggaaggcagacucuacacaugucagauugaca

SEQ ID NO: 374913 - RNA, 61 nt, Human
cuuuagguacaauagaagaaaagaucuaucaaaggcagaucaguaagcaaggucuuugugg

SEQ ID NO: 374914 - RNA, 61 nt, Human
gacaaugguacaugcccagguaaauucccaaaaggcagaauugacaguuguaucugcugug

SEQ ID NO: 374915 - RNA, 61 nt, Human
uuggaaaauagcgaauuaaccuaagacacagaaggcagacugggugaggagaccuagcaug

SEQ ID NO: 374916 - RNA, 61 nt, Human
agguuguugauggggaacuugccacuaagagaaggcagagaggucccuaguggguauauuu

SEQ ID NO: 374917 - RNA, 61 nt, Human
uaacagggcacauuucugaccgaacccucucaaggcagaggaggaguuugguggguuucau

SEQ ID NO: 374918 - RNA, 61 nt, Human
cugugaggccccagguggaaacgugcaagagaaggcagagccuuugacaguucucaaaagu

SEQ ID NO: 374919 - RNA, 61 nt, Human
uucuguugcccuugugcuccagucauugcacaaggcagaaaacagcucuggcaggaaggga

SEQ ID NO: 374920 - RNA, 61 nt, Human
uuuacucaugcuugcaaaacuagagaccccuaaggcagaacugagaauaaacauguuuacu

SEQ ID NO: 374921 - RNA, 61 nt, Human
gccuuagcaugugacuccugaagggaaggcaaaggcagaggaauuuggcugcuucuacggc

SEQ ID NO: 374922 - RNA, 61 nt, Human
ccauaugggccguguggugaugcuggcccggaaggcagaaagaggcagcaugggcacugcc

SEQ ID NO: 374923 - RNA, 61 nt, Human
ccagaggcuggucccagccaggcacacacaaaaggcagauucucguaaacgcagccucccu

SEQ ID NO: 374924 - RNA, 61 nt, Human
cugcccagucauaaaucugcuuuuccauuauaaggcagagagaaguacauucguucauuug

SEQ ID NO: 374925 - RNA, 61 nt, Human
ccuguaucaaagguacguauguggugcaaacaaggcagaaacuuccuuuuaauuuccuucu

SEQ ID NO: 374926 - RNA, 61 nt, Human
ucuuggggagagaauaagugacagcugauuaaaggcagagacacaggacugcuuucaggcu

SEQ ID NO: 374927 - RNA, 61 nt, Human
aaaaggcugcccagccuuacagcagaugcugaaggcagagcagcugagggaggggcgcugg

SEQ ID NO: 374928 - RNA, 61 nt, Human
auucagugucccuguuccucacucagagaggaaggcagaaccagucaggcuuauuucagua

SEQ ID NO: 374929 - RNA, 61 nt, Human
ggaaaagaggaagacuggacaaaacaacacaaaggcagaaaggaaagaaacugaagaaaga

SEQ ID NO: 374930 - RNA, 61 nt, Human
ccagggcccuaugccaaccugccuuuguuacaaggcagaggaagcuuuguauuuauuggcu

SEQ ID NO: 374931 - RNA, 61 nt, Human
ucuacacauaauuuaguuaucuucugcuaggaaggcagaaagcuucuguguaagccaggcu

SEQ ID NO: 374932 - RNA, 61 nt, Human
gaccagaacugggagaggaagagagcaggacaaggcagacagaaggucaggucaggaacug

SEQ ID NO: 374933 - RNA, 61 nt, Human
caccaggagcaccacagaguccuccucuuggaaggcagaacucccugaaaucuggaaucag

SEQ ID NO: 374934 - RNA, 61 nt, Human
agggauguuuuccccccuugcuugugccuuaaaggcagagaagcgaggcggaugcccugga

SEQ ID NO: 374935 - RNA, 61 nt, Human
gaagccuaaacgcgauggauauauguuuuugaaggcagaaagcaaaauuauguuugccacu

SEQ ID NO: 374936 - RNA, 61 nt, Human
aggcugaggcaggagaauugcuugaaccuggaaggcagagguugcagugagccgaaauggc

SEQ ID NO: 374937 - RNA, 61 nt, Human
uauuuauagugcuuagagaccaaacuaauggaaggcagacuauuuacagcuuaguauaugu

SEQ ID NO: 374938 - RNA, 61 nt, Human; identical to SEQ ID NO: 374715

SEQ ID NO: 374939 - RNA, 61 nt, Human
ccagugagccacguccaugcccauuccgugcaaggcagauauuccagucauauuaacagaa

SEQ ID NO: 374940 - RNA, 61 nt, Human
ggucucuuggacaaccccaggaacuuggaccaaggcagagccaaucuugcaaacuggccau

SEQ ID NO: 374941 - RNA, 61 nt, Human
auauuuggaaugaaggacuuuggcccuauuuaaggcagauuuuacagagcgcaccucaaac

SEQ ID NO: 374942 - RNA, 61 nt, Human
ccuuucuuaaagacaggcugaaaccccuucaaaggcagaugaggagguacagacacgugac

SEQ ID NO: 374943 - RNA, 61 nt, Human
agcuuaauaaaugccagggaaucugaccuggaaggcagaugggagggggcuggucuggcug

SEQ ID NO: 374944 - RNA, 61 nt, Human
uuauauacagucuuucaagagagauacaaacaaggcagaaacauuuaaacuaguauuaaag

SEQ ID NO: 374945 - RNA, 61 nt, Human
gguuuuuacuucuaggcagucccaauuuuuaaaggcagagaaguaucugcaucuuuauuug

SEQ ID NO: 374946 - RNA, 61 nt, Human
gggaaaauucauguugcugcagaaguaggcuaaggcagaccacccacuucugcugaaaugc

SEQ ID NO: 374947 - RNA, 61 nt, Human
accuuaaaguucuguugguaucacagaagacaaggcagaguuuaaagugaggaauuuuaua

SEQ ID NO: 374948 - RNA, 61 nt, Human
uaccaucuggcggcugcacauuguaacaguaaaggcagaaagcuguagugauaaccucucu

SEQ ID NO: 374949 - RNA, 61 nt, Human
gggcucugggguagaugagagaagccugaaaaaggcagaguuugaaagcucccauuuaaaa

SEQ ID NO: 374950 - RNA, 61 nt, Human
aggaagcugcuggguggggguggggggagaaaaggcagauaauuaaaccaucucaucgucu

SEQ ID NO: 374951 - RNA, 61 nt, Human
ggcuugagguuuuuggcuguuuuuuacuaacaaggcagaauguauguacuaccugaauucu

SEQ ID NO: 374952 - RNA, 61 nt, Human
uauucugcaucaagccuuagaagaggaagcaaaggcagauucagggaccaaaaggauuaau

SEQ ID NO: 374953 - RNA, 61 nt, Human
cacacagccucuauagcaggccuuccuguggaaggcagaggcagugagggagguggacggu

SEQ ID NO: 374954 - RNA, 61 nt, Human
gaguuuagauugagaauauuuuuauuuucugaaggcagagauaucuacuguauaauugcac

SEQ ID NO: 374955 - RNA, 61 nt, Human
uaagccaguuuacuuagaguauaugauaaagaaggcagaggaauagcuacauauuuggcaa

SEQ ID NO: 374956 - RNA, 61 nt, Human
ggccugugugucugugagcucaaccuggcuaaaggcagagucacucccaaaugggucucuu

SEQ ID NO: 374957 - RNA, 61 nt, Human
aaccucaggggaccugcaaucagaagacgugaaggcagauuuucauucuucuucuggccaa

SEQ ID NO: 374958 - RNA, 61 nt, Human
cuucuuuugagcaacuuucuuacacugaagaaaggcagaaugagugcuucagaaugugauu

SEQ ID NO: 374959 - RNA, 61 nt, Human
cucuuguuucccauggaaacggccucuucagaaggcagaucgggcugucucuuuccugugg

SEQ ID NO: 374960 - RNA, 61 nt, Human
gaagagacgcuacguuccuuuccgauggaggaaggcagaccugccgucacacgugugcuug

SEQ ID NO: 374961 - RNA, 61 nt, Human
gcucaugcccagaaagcaagcccaggagaggaaggcagagugugacagagcagagccaggg

SEQ ID NO: 374962 - RNA, 61 nt, Human
caguuuuacaucuuuguaaaauuguaucucaaaggcagaaaaggccauuucgucucucauu

SEQ ID NO: 374963 - RNA, 61 nt, Human
aauauauuauuauuccuguuugaugugggugaaggcagagaucuaaccuggcuuguuuagg

SEQ ID NO: 374964 - RNA, 61 nt, Human
acuuaauuuuuaaacggucaguguccaguugaaggcagaacacuaaucagauuucaaggcc

SEQ ID NO: 374965 - RNA, 61 nt, Human
agccaaggguggaguggaaaaagauauggugaaggcagaacugcucacaccagcuccagaa

SEQ ID NO: 374966 - RNA, 61 nt, Human
ccauugguuuccacgauuucaauuggcugagaaggcagagagcuagcuccucccuuucuuu

SEQ ID NO: 374967 - RNA, 61 nt, Human
cagcuuccuuucuucauucuguccuucagggaaggcagaagaaacauuggaaagcaucuag

SEQ ID NO: 374968 - RNA, 61 nt, Human
aggaauugaaauuuuugucucuggugcacguaaggcagaauguucccugacaccagugugu

SEQ ID NO: 374969 - RNA, 61 nt, Human
uccagccagccuugugacagacuccggccugaaggcagaaugaacccacaccuggagugag

SEQ ID NO: 374970 - RNA, 61 nt, Human
ccugccucggccucacccgcacuucucccaaaaggcagaugacggggaguuaggcaugggg

SEQ ID NO: 374971 - RNA, 61 nt, Human
auuagccaaauagucugaauuuccagaaaacaaggcagaaugaucauucccagaaacauuu

SEQ ID NO: 374972 - RNA, 61 nt, Human
cuugugacccagcacugcccaaagugcuuccaaggcagaagcagcaggggauggcgugguc

SEQ ID NO: 374973 - RNA, 61 nt, Human
ucuggaagaagaggaggaagacucuggagccaaggcagaggggagcuugagggacaaugcc

SEQ ID NO: 374974 - RNA, 61 nt, Human
cucuucagcccuguguucugcuggggccaugaaggcagaagguuuagccucugagaagccc

SEQ ID NO: 374975 - RNA, 61 nt, Human
gcauuuguccagugccccaucaugggccugaaaggcagagaaacuuuuuccuacacagauu

SEQ ID NO: 374976 - RNA, 61 nt, Human
ggaucccaugcccagguguccagcagaccucaaggcagaagggucaccuaacccaggaguc

SEQ ID NO: 374977 - RNA, 61 nt, Human
aacccagcuaugcccacaugcucaagcccagaaggcagaaucaagcuuugcuuucuagaag

SEQ ID NO: 374978 - RNA, 61 nt, Human
guacaaaaucauaaaagcuguuucacuagaaaaggcagaaagcaguguauuaagguguuga

SEQ ID NO: 374979 - RNA, 61 nt, Human
ggaugaaagacaaagaaggaaaagaguaucaaaggcagaaaggagaucauuuaguuggguc

SEQ ID NO: 374980 - RNA, 61 nt, Human
aagacagggaauagugggaucaaagcuaggaaaggcagaaacacaaccacucaccaguccu

SEQ ID NO: 374981 - RNA, 61 nt, Human
guugaggcaucuggagacugagaaagaaucaaaggcagagaagaccagccgugcuccugca

SEQ ID NO: 374982 - RNA, 61 nt, Human
uaugugagcaaccugucuucaguguaguacaaaggcagagugagggggcuuguggcuccuu

SEQ ID NO: 374983 - RNA, 61 nt, Human
cugaugaauuggagcauccauauggaaagcaaaggcagaauuaucccagcuguauuauuuu

SEQ ID NO: 374984 - RNA, 61 nt, Human
acauugaaccaagggauccucccuccccuucaaggcagacguucaguacaaacauuuaugc

SEQ ID NO: 374985 - RNA, 61 nt, Human
uuuaucacccaugacugacugagucugagaaaaggcagaagaaggggggcacaagggcacc

SEQ ID NO: 374986 - RNA, 61 nt, Human
auggaaagagaaaagaaaaaccaauuagaauaaggcagaauguacgugcgucauuggaaca

SEQ ID NO: 374987 - RNA, 61 nt, Human
ccuaagguggcccucuugcacaaaccagccuaaggcagacacucuccacuguccagguuau

SEQ ID NO: 374988 - RNA, 61 nt, Human
cucagauggacuacaggagauuacaacguacaaggcagauggagcauugacguuuucaaaa

SEQ ID NO: 374989 - RNA, 61 nt, Human
agcaucagccuuccagaguuacugucugcuuaaggcagaaacagcaguaaauaaugaggaa

SEQ ID NO: 374990 - RNA, 61 nt, Human
cagccacuaucauacccuuuauucucacugaaaggcagaacucagaaccuguuauuuuaug

SEQ ID NO: 374991 - RNA, 61 nt, Human
uccccugagacaagugagggguagucggugaaaggcagauggacaaggggcucagggcugc

SEQ ID NO: 374992 - RNA, 61 nt, Human
aagaugucagggacuagggagggagggagggaaggcagagaaaaauuacuuagccucuccc

SEQ ID NO: 374993 - RNA, 61 nt, Human
uauggcaaaaaaugaaacugcuuuaaacuccaaggcagaaauuguaucuuuauagcuaacc

SEQ ID NO: 374994 - RNA, 61 nt, Human
agcccagcugagucagaaagguugugaccugaaggcagaagaacccgaaugccacaccuca

SEQ ID NO: 374995 - RNA, 61 nt, Human
uuuuuaaggguuaaggugguauuuucaagaaaaggcagaacaaauaaugcaaaauucucag

SEQ ID NO: 374996 - RNA, 61 nt, Human
uuccauccaguucuaagugaaagaguuucagaaggcagaagauuuugaauuauuauccagc

SEQ ID NO: 374997 - RNA, 61 nt, Human
aaguauuccugaauggucaaauacagcaauaaaggcagaagaauuaagauuuuucuuuguu

SEQ ID NO: 374998 - RNA, 61 nt, Human
aucuaaaucacuggaaaggcuggaggagcagaaggcagaggccaccacuggacuauugguu

SEQ ID NO: 374999 - RNA, 61 nt, Human
gguaaaagaggguugcauuucuugcagccagaaggcagagaaagugaagaccaaguccaga

SEQ ID NO: 375000 - RNA, 61 nt, Human
uuaaauacaucuuuuguaagguuuuuuaauaaaggcagauugagucaaguuuauuaaaacu

SEQ ID NO: 375001 - RNA, 61 nt, Human
gggcuagggcuagagcagacccggguaaguaaaggcagacccagggcuccucuagccucau

SEQ ID NO: 375002 - RNA, 61 nt, Human
cccugagagggaaggagagguuucucacaccaaggcagaugcuccucuggugggagggugc

SEQ ID NO: 375003 - RNA, 61 nt, Human
uaaaguuaggcaugaggaggagcacucauuaaaggcagaagacggaaaaguguuuuuaaaa

SEQ ID NO: 375004 - RNA, 61 nt, Human
acuauaaagacuccuaauagcuuuuccuguuaaggcagacccaguaugaaauggggauuau

SEQ ID NO: 375005 - RNA, 61 nt, Human
ucccagaaauacagaagcuugaaaugcuaugaaggcagagcuucuauucuuuaugggauga

SEQ ID NO: 375006 - RNA, 61 nt, Human
auuuauugucuuccuguaagaccuucgggucaaggcagaggcaggaaacuaacugguguga

SEQ ID NO: 375007 - RNA, 61 nt, Human
aauugagagaauuccugaguugauagcucuaaaggcagauaugcuguauuugccuacuuua

SEQ ID NO: 375008 - RNA, 61 nt, Human
aaaaaaaaaaagaaaaaagaaagaaagaaaaaaggcagaagcccuggauucaaauccgcca

SEQ ID NO: 375009 - RNA, 61 nt, Human
ggcugaggcaggagaaaucgccugaacccagaaggcagagguugcagugagccaagaucac

SEQ ID NO: 375010 - RNA, 61 nt, Human
auggagguaugauagguuuaucacacagccuaaggcagauuuuguuuugucuguacugacu

SEQ ID NO: 375011 - RNA, 61 nt, Human
gcauuucuuaaaagggugagcaacagaacaaaaggcagaaaaggcauaccuaaggacuaau

SEQ ID NO: 375012 - RNA, 61 nt, Human
cagacaaugccagcauaaauccauccauccaaaggcagagaaccaaaggggccauggaagg

SEQ ID NO: 375013 - RNA, 61 nt, Human
aaacaguaaaaacuaccaagagaacacgaggaaggcagaaacgauguuuagcaacaguauu

SEQ ID NO: 375014 - RNA, 61 nt, Human
ucacacaucguugccgcagcggugggaaggaaaggcagauguaaaugauguguugguuuac

SEQ ID NO: 375015 - RNA, 61 nt, Human
ucucucucccuuauauuuuacuacucgaagaaaggcagaagaaguuacaaauaguucugaa

SEQ ID NO: 375016 - RNA, 61 nt, Human
uguggccgugaagugggagcucuccuuuccaaaggcagagcuuacugucauggcucagaug

SEQ ID NO: 375017 - RNA, 61 nt, Human
gaucgccugcaucacuugaggagcuggugaaaaggcagauucuuaggcccaacuguagacc

SEQ ID NO: 375018 - RNA, 61 nt, Human
uggauaggcauuaugguuuccacuuuggcagaaggcagacuauucacagcccuauuuacuu

SEQ ID NO: 375019 - RNA, 61 nt, Human
cagagaaccuaauaagugcuacuuugccauuaaggcagacuaggguucaugucuuuuuacc

SEQ ID NO: 375020 - RNA, 61 nt, Human
aguuggaguguuuaugauuauugcuagaaagaaggcagacuucauauucucaucgcccauu

SEQ ID NO: 375021 - RNA, 61 nt, Human
aagaacacucuugacccuacacugaaggcugaaggcagaagccacaagaggccuugagugc

SEQ ID NO: 375022 - RNA, 61 nt, Human
cccaaacucaggcagcuggggcugaggcccaaaggcagaacagccagagggggcaggaggg

SEQ ID NO: 375023 - RNA, 61 nt, Human
ggccacgauaggguggagugagcuagugaagaaggcagagggagacuuggcuucuggucuc

SEQ ID NO: 375024 - RNA, 61 nt, Human
uuuucuucugaacuuggcaauauaaccuaauaaggcagaauaaguuucuguuaaaauacuu

SEQ ID NO: 375025 - RNA, 61 nt, Human
gaacauggcuuuaacaagcagaucuuguaucaaggcagaggugaugccaugccauacuuuu

SEQ ID NO: 375026 - RNA, 61 nt, Human
agaaggaugggaaaaaggcuggaaggaaagcaaggcagaaggccaggaguaagcccaagcu

SEQ ID NO: 375027 - RNA, 61 nt, Human
aaauauuuauugaagaaaugaaaggugacaaaaggcagaaggagggagaccccaaaaagag

SEQ ID NO: 375028 - RNA, 61 nt, Human
caucccuccugguaccaagcugcugggugcgaaggcagaucauauggggucacccaugugc

SEQ ID NO: 375029 - RNA, 61 nt, Human
auguauacacuuuuucuguacuuacuagguuaaggcagauuuauuuuuaugauuuguuuag

SEQ ID NO: 375030 - RNA, 61 nt, Human
uggaacuggagccaaggggaggcugccuaugaaggcagaagauguggaugaauucaggcac

SEQ ID NO: 375031 - RNA, 61 nt, Human
ccagauaucuuguuggcauaaauguuaugaaaaggcagaauacuggcaagaaaugaggaag

SEQ ID NO: 375032 - RNA, 61 nt, Human
cuggcuuuguucacuugcagaaaaggagcgcaaggcagaggcucugaagcacuuuccuugu

SEQ ID NO: 375033 - RNA, 61 nt, Human
cuccaagugcaucuagccuggccuggagggcaaggcagaugcauucuccuggcugcuggga

SEQ ID NO: 375034 - RNA, 61 nt, Human
agaauacugaccucaccuugggaugucaccaaaggcagagcagaugggacugucaaaguug

SEQ ID NO: 375035 - RNA, 61 nt, Human
acagaugauaaaauucagaccucucuccugaaaggcagagguucaacauucaggacuguuu

SEQ ID NO: 375036 - RNA, 61 nt, Human
gaauuauauugauucugugcaaucaaaacaaaaggcagaauagaaugcugagauugguuaa

SEQ ID NO: 375037 - RNA, 61 nt, Human
acuuaaaguuguuagugaguggaaugaauugaaggcagaauuuaaaguuugguugauaaca

SEQ ID NO: 375038 - RNA, 61 nt, Human
cuuguguucacucgaacuaagaacaaugguuaaggcagaauaaugacuaaaauauguucau

SEQ ID NO: 375039 - RNA, 61 nt, Human
cagaguggauuuaauuaagcacacaaaugcuaaggcagaauuuugagggugggagagaaga

SEQ ID NO: 375040 - RNA, 61 nt, Human
aaaaguuauauugcauuuacaaauguuuuacaaggcagaaaguuugacuggauaguuagug

SEQ ID NO: 375041 - RNA, 61 nt, Human
ggcucucaccuggcccugcuuccugcuugccaaggcagaggccugggcugggaaaaacuuu

SEQ ID NO: 375042 - RNA, 61 nt, Human
gggugguuuuccccaauaccuggagcucagaaaggcagagccaucuggcccuccagggugu

SEQ ID NO: 375043 - RNA, 61 nt, Human
uaauuacaguaaauuaaauaaagauuccuuuaaggcagacaagggcuaagauuuccuuagc

SEQ ID NO: 375044 - RNA, 61 nt, Human
cuuguuuagugaaccaaaucuagaaaguaccaaggcagagguaugcuccugcuguaaucag

SEQ ID NO: 375045 - RNA, 61 nt, Human
agcacacagcacuugggccagcaaauccuggaaggcagacaaaaauaagagccugaagcaa

SEQ ID NO: 375046 - RNA, 61 nt, Human
cugauccacuucuaagacaggaaggaaagugaaggcagagugagcagguaagagagggaua

SEQ ID NO: 375047 - RNA, 61 nt, Human
aggcugagaaggguggagcuuggcccuggggaaggcagaccagggucugauggcuucuagg

SEQ ID NO: 375048 - RNA, 61 nt, Human
uaguuuuauuaucuguuuacuuccucuggggaaggcagacugauaaaauuauaugggcugg

SEQ ID NO: 375049 - RNA, 61 nt, Human
ggccagggcccacagggcaucugcugaugggaaggcagagccucggggcugcccagcccug

SEQ ID NO: 375050 - RNA, 61 nt, Human
uguggcauuguuauagcagcucgagaagacuaaggcagaugggcuuccaggacuggcccag

SEQ ID NO: 375051 - RNA, 61 nt, Human
cuaaagguuacagcugagaucuuuggaaccaaaggcagagcaagcagagcccguugucugg

SEQ ID NO: 375052 - RNA, 61 nt, Human
ggcgauauuuuaucagaccauuuuguaaauaaaggcagaauuuguguugaagauucuuaua

SEQ ID NO: 375053 - RNA, 61 nt, Human
aacaaaacaaaacaaaacaacaaaaaaagaaaaggcagaguacaaggagauacauguaaca

SEQ ID NO: 375054 - RNA, 61 nt, Human
caugccuguaauccuagcacuuugggaggccaaggcagaaagauagcuugaguccaggagu

SEQ ID NO: 375055 - RNA, 61 nt, Human
uauuuguugagggcaaaagacuauggacuggaaggcagaaagugggauccuggccccacuc

SEQ ID NO: 375056 - RNA, 61 nt, Human
gcugauuaucuuccugaucuacucaccccaaaaggcagaaaagcaacacagucacugcugu

SEQ ID NO: 375057 - RNA, 61 nt, Human
agucaaaccaggcaauacagaggagaagggaaaggcagagggugugauuauggugacaaua

SEQ ID NO: 375058 - RNA, 61 nt, Human
ucuugucucauucacucaccuuuugauaucgaaggcagaaauugcguuuacaacacugaag

SEQ ID NO: 375059 - RNA, 61 nt, Human
gcaggcaggucccaaaugcaaaagccagagaaaggcagauggggucuccggggcugggcag

SEQ ID NO: 375060 - RNA, 61 nt, Human
aagugaaccaaaucauuguuuuuauuuuacaaaggcagaaaaugaaacaccacuagguaaa

SEQ ID NO: 375061 - RNA, 61 nt, Human
cuagguggccaguggguaugaggagggcuggaaggcagagcuuugggccaaaagcaggcgu

SEQ ID NO: 375062 - RNA, 61 nt, Human
cauuuugauaggagcguuuuguuauuuuuacaaggcagaaugggguguaacaguugaauua

SEQ ID NO: 375063 - RNA, 61 nt, Human
caggguggcagccacccuucagugaggccccaaggcagagucggcugggcguggaccaggg

SEQ ID NO: 375064 - RNA, 61 nt, Human
uggcuuaaacaauuuauaaaagccuuucuagaaggcagacuuagccccagcagagccuggg

SEQ ID NO: 375065 - RNA, 61 nt, Human
augaaagagcgaaugacugaacagccauggcaaggcagaccuacaggcgaggccgcagcag

SEQ ID NO: 375066 - RNA, 61 nt, Human
aaaucucuggucacuuuaagacccuaaauaaaaggcagacagcuccacucaaaaacuaagg

SEQ ID NO: 375067 - RNA, 61 nt, Human
uaacagugcucaugugccuuccagacgguucaaggcagaggccacugugcucaguguaguc

SEQ ID NO: 375068 - RNA, 61 nt, Human
aaccccugacuuccucccuccccacaucaugaaggcagaggcaugcacauuccucacugaa

SEQ ID NO: 375069 - RNA, 61 nt, Human
acuggggucaucgggaaaggcaaagaaacugaaggcagaguccuaacguugcaucuuauuc

SEQ ID NO: 375070 - RNA, 61 nt, Human
ucuuuccugaaugacuuucuaacugugcagaaaggcagaaaagucaucauauguauauguc

SEQ ID NO: 375071 - RNA, 61 nt, Human
gcugauuguuguguuuuauaaaucuucuguuaaggcagaagggugauuaugagugguucac

SEQ ID NO: 375072 - RNA, 61 nt, Human
ugcuaccuggggaauggggcaccugggggccaaggcagagggaaggggguccucccgauua

SEQ ID NO: 375073 - RNA, 61 nt, Human
gugcagauaaaaguacucuugauuuaacacaaaggcagaugauacacuuauaaaacuggga

SEQ ID NO: 375074 - RNA, 61 nt, Human
gugaaggaggccgccccugcccccaccugagaaggcagagcagugucugugcugccagguc

SEQ ID NO: 375075 - RNA, 61 nt, Human
auaauguggcauacacaguggguuugguuguaaggcagauguaauagaugacuucaaaagc

SEQ ID NO: 375076 - RNA, 61 nt, Human
gaauaaugugaaucaaccgaaaacugggggcaaggcagaggacagguuuucucagguuaag

SEQ ID NO: 375077 - RNA, 61 nt, Human
guccuucagucuucuagaaacagagacaagaaaggcagacacaccgcggccaggcacccau

SEQ ID NO: 375078 - RNA, 61 nt, Human
gagagcccuggauuaggagggugacauggggaaggcagaggcuggcaccauggugacugcc

SEQ ID NO: 375079 - RNA, 61 nt, Human
cugggcuggcauuggucacaccaggccuaagaaggcagaaguugaaucaauugaacuaggg

SEQ ID NO: 375080 - RNA, 61 nt, Human
gauaccagaggaggcgagggacagagacagcaaggcagacaguggcuggcaggggggccca

SEQ ID NO: 375081 - RNA, 61 nt, Human
ccgccaguugcuuugucugguagcucaagagaaggcagagccccagcaccucugugccccc

SEQ ID NO: 375082 - RNA, 61 nt, Human
aaugugacguuauuuaaaaacaacaacaaagaaggcagagccaggauauaacuagaaaaag

SEQ ID NO: 375083 - RNA, 61 nt, Human
uguccccaggguccagccuggcuagaguuagaaggcagaccuagccuuuggaagcagggug

SEQ ID NO: 375084 - RNA, 61 nt, Human
ccucggugaaucugagaggagaggaugggguaaggcagaagcaccagcuguacuacuagaa

SEQ ID NO: 375085 - RNA, 61 nt, Human
gaauguugcaugacaacaguuggccgauuagaaggcagacuuucuacaugcaaaucuggcu

SEQ ID NO: 375086 - RNA, 61 nt, Human
ccacccccacccccgcacccccauucuacacaaggcagaagaggcacggguuuuucuggga

SEQ ID NO: 375087 - RNA, 61 nt, Human
gugacuuccguaucucagcccaugacucagcaaggcagaauggccaccccugccaaaguuu

SEQ ID NO: 375088 - RNA, 61 nt, Human
uccaucagagaaggugcaggugacagaggcgaaggcagauggggcacugacccaggaggag

SEQ ID NO: 375089 - RNA, 61 nt, Human
acaaagcaccuauguguagaagcuaggguucaaggcagaucugugauuccagaagcuguuc

SEQ ID NO: 375090 - RNA, 61 nt, Human
agauucauugucuauggguacauuuuauaaaaaggcagauucuaguucagugucauaagga

SEQ ID NO: 375091 - RNA, 61 nt, Human
gaggcccacauccaggcaagaacuaauucaaaaggcagaucagaaaccacaggagucaaaa

SEQ ID NO: 375092 - RNA, 61 nt, Human
uuuguggggagggaggccugcaaggucaugaaaggcagaagagucuaauugugccuggauu

SEQ ID NO: 375093 - RNA, 61 nt, Human
gcccccgguugccugccugggccccauguggaaggcagaugccugcucgcucugucaccug

SEQ ID NO: 375094 - RNA, 61 nt, Human
gcuguuaaauauauauucuauucuuuggaagaaggcagagagaggagucuuauuauuuuua

SEQ ID NO: 375095 - RNA, 61 nt, Human
gcagaagauccccuuugucaguggggaaaccaaggcagagcugaggggacagggaggagca

SEQ ID NO: 375096 - RNA, 61 nt, Human
caaguacaugaguacuugauuuuuaugguauaaggcagagccuuuucuuccucuucuugau

SEQ ID NO: 375097 - RNA, 61 nt, Human
gcaaaggacacagcuagcaacgggcuggaaaaaggcagagaacguggagugaucaucucca

SEQ ID NO: 375098 - RNA, 61 nt, Human
ugaaauuauuucagauacauauuuuagugucaaggcagauuaguuauuuagccaccaaaaa

SEQ ID NO: 375099 - RNA, 61 nt, Human
uagucaaaccugccagauaucaaaccugaggaaggcagaagugaauuuggagaacuagggu

SEQ ID NO: 375100 - RNA, 61 nt, Human
uaggagcaaagucucuccauucuccagguccaaggcagagauccugaaaagauagggcuau

SEQ ID NO: 375101 - RNA, 61 nt, Human
guugaaggcacgacagccacugcucuacgaaaaggcagaguacguuuuucccuucugguug

SEQ ID NO: 375102 - RNA, 61 nt, Human
ucagcgggucaacaucgugccuauccuggcuaaggcagacacacugacaccucccgaagug

SEQ ID NO: 375103 - RNA, 61 nt, Human
ccucggcuucgcuggaguguacuccagggugaaggcagagugggauuugagacccagguua

SEQ ID NO: 375104 - RNA, 61 nt, Human
cagcugaagugggugcugcaacgucuugaacaaggcagaaguuggugagaggaucugugug

SEQ ID NO: 375105 - RNA, 61 nt, Human
cagggaugccgggaacacugucgaagaacggaaggcagaggacagaggcuggacgugggcc

SEQ ID NO: 375106 - RNA, 61 nt, Human
aagacacgcaaugucaggccauggcugggucaaggcagaaggccuuggugcacacccaggg

SEQ ID NO: 375107 - RNA, 61 nt, Human
gccucucuacagcacggccuguggccuguucaaggcagaaccacgacccuugacucccggg

SEQ ID NO: 375108 - RNA, 58 nt, Human
cauaugccgcagacccauagccgccugcaaggcagagaggacacaggagagccagccc

SEQ ID NO: 375109 - RNA, 61 nt, Human
aggcugaggugggagaauugcuugaaccuggaaggcagaaguugcagugagcugagaucac

SEQ ID NO: 375110 - RNA, 61 nt, Human
guaaccccuuugaaacauaagcaguuucagaaaggcagacucucucaucuuucucauccug

SEQ ID NO: 375111 - RNA, 61 nt, Human
ucuacagaauaauccaguauugcugauuuuaaaggcagagaaguucucaaaguuaauucac

SEQ ID NO: 375112 - RNA, 61 nt, Human
uccagucauuucucuaugagacugaagcaggaaggcagagcaucaucuuguucagccucag

SEQ ID NO: 375113 - RNA, 61 nt, Human
acaguuuuggccucugaaacacagcugaagaaaggcagagugcuuucugugaucuuuuaau

SEQ ID NO: 375114 - RNA, 61 nt, Human
aacaaucgacaaaugaaauucuuacagccugaaggcagacgugugcccagaugugaaagag

SEQ ID NO: 375115 - RNA, 61 nt, Human
aaauuauaguuacaaugaauugcauaugaagaaggcagacauuuauuuuuaauagccaagu

SEQ ID NO: 375116 - RNA, 61 nt, Human
acgcacacacucaggaggaaaagaaaaaacaaaggcagaagaagaagaagaagaaauaaaa

SEQ ID NO: 375117 - RNA, 61 nt, Human
cacagagcagagacagacgcaggcggggacaaaggcagaggauguagccccauuggggagg

SEQ ID NO: 375118 - RNA, 61 nt, Human
ucacugguggccuaucuuacauaugauuucgaaggcagacaugaggaaggccuuagucaca

SEQ ID NO: 375119 - RNA, 61 nt, Human
uuugucucaaaaaaaaaaaaaaaaacaauggaaggcagacagcaagucccugaggacacau

SEQ ID NO: 375120 - RNA, 61 nt, Human
ucccacucuuuaaaaacugguuccgugaggaaaggcagaagccguuccgugucucuugcag

SEQ ID NO: 375121 - RNA, 61 nt, Human
gcuggaugaugggugcggaggaauuuggguaaaggcagagggaagggguggaggagggcca

SEQ ID NO: 375122 - RNA, 61 nt, Human
gaaccagcuacgggaagagcuuugggaagcaaaggcagaggcccuggggugggagcaggcu

SEQ ID NO: 375123 - RNA, 61 nt, Human
ggcccugaaggauuugcuucccuccccugggaaggcagagggcucuuaauaaagaggaccc

SEQ ID NO: 375124 - RNA, 61 nt, Human
agugacccucagagucuucuccccuuaggacaaggcagacaccccaccaugcgggccucag

SEQ ID NO: 375125 - RNA, 59 nt, Human
ccgccuuggcucagggcuaaugcgcccugaaggcagaguccagggaccuugacccagcc

SEQ ID NO: 375126 - RNA, 61 nt, Human
ccaagugucugcaaguaaacaccuggaggugaaggcagagaggagccaggacuguggaguc

SEQ ID NO: 375127 - RNA, 61 nt, Human
cuggacacagacacagagcagccgcaucucaaaggcagagcccugccugaaggaggaaucc

SEQ ID NO: 375128 - RNA, 61 nt, Human
gugugugucaaucacuccauuuugcucagggaaggcagacuucugugcuuucuuuccuguu

SEQ ID NO: 375129 - RNA, 61 nt, Human
gugggcacuggucacuccuaugugcuaagacaaggcagacaucuguguguucucuuaaguc

SEQ ID NO: 375130 - RNA, 61 nt, Human
cagucccucaauguugaaaccucaucucuugaaggcagauccugauauuccaaggcacuga

SEQ ID NO: 375131 - RNA, 61 nt, Human
guggcucaugccugcaaucccagcacuguagaaggcagaggccggcagaucacuugagccc

SEQ ID NO: 375132 - RNA, 61 nt, Human
gaguguguccaccacuccacugugcucagggaaggcagaccucuccucucucuuuccaauc

SEQ ID NO: 375133 - RNA, 61 nt, Human
uaaguuuggacucucggggccaaagguggcuaaggcagaggcugagggggcugggcgagcu

SEQ ID NO: 375134 - RNA, 61 nt, Human
cagggcuccggaggugcagcuaaaggccaccaaggcagaacaggcagaagggauggaauuu

SEQ ID NO: 375135 - RNA, 61 nt, Human
caaacugcuccaugccggguuauuuaaaagaaaggcagaguuugugguggcuuuuuuuuuu

SEQ ID NO: 375136 - RNA, 61 nt, Human
uaauugauuuucuacuccugcccugugaauuaaggcagaguuuuacuguaauauuugcaag

SEQ ID NO: 375137 - RNA, 61 nt, Human
gagucucagggaaagagaaccacaauagaaaaaggcagaaaaggccgggcgcgguggcuca

SEQ ID NO: 375138 - RNA, 61 nt, Human
agucaguuacaguaaaauccacuguguguggaaggcagaagcuagcgguuguaucccaagc

SEQ ID NO: 375139 - RNA, 61 nt, Human
ccuuugcagggccaucucacccaugcagcauaaggcagaagccauagucacuuuccaucuu

SEQ ID NO: 375140 - RNA, 61 nt, Human
gccaaaccuucagugccuuccagaagggagaaaggcagaagccuguguggagugugcugug

SEQ ID NO: 375141 - RNA, 61 nt, Human
cuacaaauccacaaaaauuuacuauuccaguaaggcagaguccaaccauugauaauacaac

SEQ ID NO: 375142 - RNA, 61 nt, Human
aaccugacagcuagguaucuagcuagcuagaaaggcagauagacagauauauagaugauag

SEQ ID NO: 375143 - RNA, 61 nt, Human
aaucauguuuuccucuuggauggaagugucaaaggcagaagggugugggagggggacaagg

SEQ ID NO: 375144 - RNA, 61 nt, Human
cggaccucaccaccucuuuuccuuugagcccaaggcagagcuggagcuggcgccacccaga

SEQ ID NO: 375145 - RNA, 61 nt, Human
caaaacugaagaugguuugaaacagcuucacaaggcagaacaguaucaaaagaagaaucgg

SEQ ID NO: 375146 - RNA, 61 nt, Human
ccauuugaaucagggucuccaguuucuagaaaaggcagacacugguugggaccaaagucuc

SEQ ID NO: 375147 - RNA, 61 nt, Human
ucaggaagccggccugcagcaggagcagaggaaggcagacacccacaagaagaugacugag

SEQ ID NO: 375148 - RNA, 61 nt, Human
ucagccugcccagcucuggcuggucagagacaaggcagaacuuuuggaaaaacaaagacug

SEQ ID NO: 375149 - RNA, 61 nt, Human
uggccagaucacuuuccaagggagcgauacuaaggcagacucagcuuuuuaaagaugggag

SEQ ID NO: 375150 - RNA, 61 nt, Human
cccgggauaguaaacaugauacacaucaauaaaggcagacuuuauugugaaucacagcgcc

SEQ ID NO: 375151 - RNA, 61 nt, Human
gcucuaggagaacaaaugugcuuucuguaaaaaggcagaccagggauguaauguuuuuaau

SEQ ID NO: 375152 - RNA, 61 nt, Human
gugccuucuguucgggcccuccuuuggugggaaggcagagcccugacccuugaaugguugu

SEQ ID NO: 375153 - RNA, 61 nt, Human
accucgugauauccacaaaugcuauucagauaaggcagaacuaggagucuucacugcucug

SEQ ID NO: 375154 - RNA, 61 nt, Human
aggggggccgggcuggggcugcguaggugaaaaggcagaacacuccgcgcuucuuagaaga

SEQ ID NO: 375155 - RNA, 55 nt, Human
agagagaaauuacagagugacggagaaggcagacaucaugcaacaugcucaaggg

SEQ ID NO: 375156 - RNA, 61 nt, Human
ccuuuauuucccuggcaggcagccuugccagaaggcagagaggcaguucugaaucauucuc

SEQ ID NO: 375157 - RNA, 61 nt, Human
ugugucacgagcccuuuuagaugcuuaggugaaggcagaagugaugauuguaagucccaug

SEQ ID NO: 375158 - RNA, 61 nt, Human
gagcucaggccucucgugccuggugucagagaaggcagagcccacaguaggugcacggugc

SEQ ID NO: 375159 - RNA, 61 nt, Human
gucaucauuuucauuaucagcagacauaagcaaggcagaugugucuuccuccccaacaccu

SEQ ID NO: 375160 - RNA, 61 nt, Human
uugagggaaguuugauagauccuuuaaaaaaaaggcagauuuccauuuuuuguauuuuaac

SEQ ID NO: 375161 - RNA, 61 nt, Human
cuuuuuccccacuaagauuccugugccuuuuaaggcagagggagaucccuauggcguuagu

SEQ ID NO: 375162 - RNA, 61 nt, Human
uugauggucaggaaguuugcagauacucgccaaggcagagcgcaaagugcuagccacugga

SEQ ID NO: 375163 - RNA, 61 nt, Human
gugacagugaugcucugugcugguaccaaacaaggcagacuugcaagaaccauggcaucuu

SEQ ID NO: 375164 - RNA, 61 nt, Human
cugccuguguguuuccuccugggaugcgugcaaggcagaccuggugcugcaaaggaaaggg

SEQ ID NO: 375165 - RNA, 61 nt, Human
aagcacaauaccauuaaaaagccucaagcccaaggcagaagaccuaucugcauuugagccc

SEQ ID NO: 375166 - RNA, 61 nt, Human
ucaguucuuccuuccacagggauuuucaggaaaggcagaagcucguggaggaugggcaucu

SEQ ID NO: 375167 - RNA, 61 nt, Human
ggagggucagcugccugcaugacuuuucuggaaggcagagccucgaaaauaggcagaccgu

SEQ ID NO: 375168 - RNA, 61 nt, Human
cagagaaugccaugcggccuguguaagaauuaaggcagauuuauaugcacugaugaggaaa

SEQ ID NO: 375169 - RNA, 61 nt, Human
gaccacuucaaagcccucugcaaacaccccaaaggcagaaucugcuauuuugaguuuucca

SEQ ID NO: 375170 - RNA, 61 nt, Human
gaagggaaguccacucagucacauccagaaaaaggcagacuaagaaucagaagccauguga

SEQ ID NO: 375171 - RNA, 61 nt, Human
uccccguuaccucgagcugacucuagaggggaaggcagagcucaggagggugggugggagc

SEQ ID NO: 375172 - RNA, 61 nt, Human
aggcugaggcaggaggaucacuuaagcccagaaggcagagguuguagugagcugagaucgc

SEQ ID NO: 375173 - RNA, 61 nt, Human
gaaacugaaggaugggccucagucucuaaggaaggcagagaccuggguugagcagcagaau

SEQ ID NO: 375174 - RNA, 61 nt, Human; identical to SEQ ID NO: 375173

SEQ ID NO: 375175 - RNA, 61 nt, Human
aaaacugaaggaugggccucagucucuaaggaaggcagagaccuggguugagccucagaau

SEQ ID NO: 375176 - RNA, 61 nt, Human
aggcugaggcaggagaauggcgugaacccagaaggcagagcuugcagugagccaagaucgc

SEQ ID NO: 375177 - RNA, 61 nt, Human
gggaggagugguccacccacggucccagcacaaggcagagcugggaugaaaacagggcuga

SEQ ID NO: 375178 - RNA, 61 nt, Human
uggggcuuccugggaaaaggaaggccaugagaaggcagagaaguaggccagagcuggguuc

SEQ ID NO: 375179 - RNA, 61 nt, Human
uggcacccaccacucucaggaccacccugccaaggcagaauaaaccggauccuguugcagc

SEQ ID NO: 375180 - RNA, 61 nt, Human
aauauguucgacugacuuccaggaguuccgaaaggcagaagugaggcuaggccauaugugc

SEQ ID NO: 375181 - RNA, 61 nt, Human
cuuuuauccgggaaucuugacggugaccuggaaggcagaugguacccccaucacccagggc

SEQ ID NO: 375182 - RNA, 61 nt, Human
gcaaggggagcaggguuagggcuguuccugaaaggcagagagccucuugcccugagccuca

SEQ ID NO: 375183 - RNA, 61 nt, Human
gguuacucaagauggcaagugcgccaaggagaaggcagaaaugcuggggccuggaauaagg

SEQ ID NO: 375184 - RNA, 61 nt, Human
cagcagagacucagaguccagggcaagguucaaggcagacuaaccucaugcauggauugua

SEQ ID NO: 375185 - RNA, 61 nt, Human
cuccuuccagcccagaguggcccaguagagcaaggcagacagugaccuccacccccgcagc

SEQ ID NO: 375186 - RNA, 61 nt, Human
gcagacagaagcagggugguggcaccguugaaaggcagaaagagccaggagaaagcugaug

SEQ ID NO: 375187 - RNA, 61 nt, Human
uccauugcucuuggcuucaugguguuccuggaaggcagaugagcuggucauuucgccuggg

SEQ ID NO: 375188 - RNA, 61 nt, Human
gcccagggagcuguagcaagaggguaguccaaaggcagaugccagacaagacacagccagg

SEQ ID NO: 375189 - RNA, 61 nt, Human
acccuguuucuuuggugccugcaguuuagagaaggcagagccacugguuuugagaaccaga

SEQ ID NO: 375190 - RNA, 61 nt, Human
acagcguuaaguuuuaauuuacaacuuuuaaaaggcagagcauuuuuaacaaggggugaca

SEQ ID NO: 375191 - RNA, 61 nt, Human
cccaaauccuagacugcuccugggcauuagcaaggcagagccuuuuuaccuggccuagaaa

SEQ ID NO: 375192 - RNA, 61 nt, Human
aauauucacagucaacaggggugugauggugaaggcagagugugaaaaacgugagagagga

SEQ ID NO: 375193 - RNA, 61 nt, Human
auaagacaugcucauuguaaaaaauguacacaaggcagaaggaaguaaaauuuccacaguu

SEQ ID NO: 375194 - RNA, 61 nt, Human
gauagacugacuuuggccauuggauugagcaaaggcagaaaugggggcuaguguaacagca

SEQ ID NO: 375195 - RNA, 61 nt, Human
guaaccuuuaagcgaaguuucuagaggugaaaaggcagaaucuuaaaugguaccauuggug

SEQ ID NO: 375196 - RNA, 61 nt, Human
aguuggaguuugagguuggaaaauaucuuugaaggcagaaucaguugaguugugaggguga

SEQ ID NO: 375197 - RNA, 61 nt, Human
uuuuaggagaucagcgacaaaucuuuaguggaaggcagaaaguccauaaguccuuucugga

SEQ ID NO: 375198 - RNA, 61 nt, Human
gcccaggaaaaacuggaagccuucccccagcaaggcagaagcuuggaggaggguuguaaaa

SEQ ID NO: 375199 - RNA, 61 nt, Human
cguuagggaaauccaacuccaggguuaaagaaaggcagagauugggggggcuugggguaga

SEQ ID NO: 375200 - RNA, 56 nt, Human
ccauucguaugcagccuugaagggagaaggcagagaaaacacacgcuccucugccc

SEQ ID NO: 375201 - RNA, 61 nt, Human
cugagauauaaauuagaauggcaugugcugcaaggcagauguaugggagccaaucauuugg

SEQ ID NO: 375202 - RNA, 61 nt, Human
ccucaaguauuaagucaaggagccggucacaaaggcagaaaugcuggagagagucaucaaa

SEQ ID NO: 375203 - RNA, 61 nt, Human
ccuaguuacccagacagugagaagccccuggaaggcagaaaaguugggagcauggcagaca

SEQ ID NO: 375204 - RNA, 61 nt, Human
uacucauuuucaggaaaguuuguaguauuacaaggcagaaggaaacacaguagcaaugguu

SEQ ID NO: 375205 - RNA, 61 nt, Human
uuaauaaguuaaaauucuggacacauuauuaaaggcagaaacuucuuucaaagcaaacacc

SEQ ID NO: 375206 - RNA, 61 nt, Human
ucauaacuuuguaugucugacccaagugccaaaggcagacgugcuuuauagcuaaaugaac

SEQ ID NO: 375207 - RNA, 64 nt, Human
aaugcagcuuucccuagggggaggccuacaacaggacgaccauucugagccagugagucuauug

SEQ ID NO: 375208 - RNA, 64 nt, Human
uggugacccggcgggaccugcgggcgcgcggcccgacgaccagagggcgagccugcuccucucg

SEQ ID NO: 375209 - RNA, 64 nt, Human
augaguugccaccacucagaaguuuauucuuccagacgaccaguggauacugaggaaagucuua

SEQ ID NO: 375210 - RNA, 64 nt, Human
uugagcuugguucugggcucuuuccuuguguacugacgaccagggccagcuguucuagagcggg

SEQ ID NO: 375211 - RNA, 64 nt, Human
cucgacccccagccuggguagagccaccagguacgacgaccagguaccagaaaccaccaggcac

SEQ ID NO: 375212 - RNA, 64 nt, Human
gacugggaaguucuuuuaaaucauuaaauauuaagacgaccaucucuucuauuaaauuacagua

SEQ ID NO: 375213 - RNA, 64 nt, Human
caugggaaucccacggaccucucgcgugucaacagacgaccagaggagugcuggagcuccagca

SEQ ID NO: 375214 - RNA, 64 nt, Human
ucaacaucuccccccaggcgauguucucccccaagacgaccagaaaauuguuuauuggggaaug

SEQ ID NO: 375215 - RNA, 64 nt, Human
aucugcagcugcaguuggagcagcuccgagggaggacgaccauggcccuggaccugccauccuc

SEQ ID NO: 375216 - RNA, 64 nt, Human
auuauuagcaugcuuuccagcugcaaggaaaagagacgaccaccggauaauucuuuuuaugugc

SEQ ID NO: 375217 - RNA, 64 nt, Human
ucuuuaacauggacacucaugagucauccuccaggacgaccagugcauccucaagcucugcucc

SEQ ID NO: 375218 - RNA, 64 nt, Human
uuguagccauuuuucugacgccugccaaggacgcgacgaccagggaggaggaaucggcggacgc

SEQ ID NO: 375219 - RNA, 64 nt, Human
gcaguuggguucaaaugccaaauagugauuagaagacgaccauucugaucugugugugaucugg

SEQ ID NO: 375220 - RNA, 64 nt, Human
uuauagucuugugugugcaguuauauuuuauauggacgaccaaauuuuuuauuaagaugaguaa

SEQ ID NO: 375221 - RNA, 64 nt, Human
auuaacagcagggaaaugccaucuuauuaccugagacgaccagcacugggaguuagguacgguc

SEQ ID NO: 375222 - RNA, 64 nt, Human
cugcuggcgugaccgugucuaacuccccuggagugacgaccaccgccccaccaccuccugggac

SEQ ID NO: 375223 - RNA, 64 nt, Human
aacaucucacugaacauaaguccugagguauuaggacgaccauacugccucugagcugaaaaca

SEQ ID NO: 375224 - RNA, 64 nt, Human
auccaauggaaucgaugacgggcugcaugcugaggacgaccagcugaggguguauuauaugcag

SEQ ID NO: 375225 - RNA, 64 nt, Human
aaagauauguuuauuuuuugccuucagagggucagacgaccaguugccugccguuuugucuucu

SEQ ID NO: 375226 - RNA, 64 nt, Human
cuacuuccugucauaaccuucuaacuuguuucuugacgaccaccucauguggccaauaaaugga

SEQ ID NO: 375227 - RNA, 64 nt, Human
cucucucugguuguauuuagaucgggugucagaggacgaccaaucuuagggaauuuccagacca

SEQ ID NO: 375228 - RNA, 64 nt, Human
gggagucccugugguccugaauucuuuccccaaagacgaccagcauuuaaccaaccuaagggcc

SEQ ID NO: 375229 - RNA, 54 nt, Human
ucauuuuacaacagaacugagacagacgaccaccauauucacugaggucuaaau

SEQ ID NO: 375230 - RNA, 64 nt, Human
ggaagguagccuggccaggcggggccuccccuucgacgaccaggccucggucacaacggacgug

SEQ ID NO: 375231 - RNA, 64 nt, Human
accuccaagucuccgggccaccuucuccugggaggacgaccaucucuaccccuagaggacuguc

SEQ ID NO: 375232 - RNA, 64 nt, Human
acccaggaggucacagaaugacagcaagggaaaugacgaccaagagaagaagcuuaaaguccug

SEQ ID NO: 375233 - RNA, 64 nt, Human
auucagccuguguaaccauguggaaauaaaaauugacgaccaauguauuauauggacaacuuuu

SEQ ID NO: 375234 - RNA, 64 nt, Human
cgagaauuaggcgcccaccguguccccuccagcgcgcgcgaagaagcuugggagucguggcggg

SEQ ID NO: 375235 - RNA, 64 nt, Human
ugcgggcugccccgcuuugcggacgggcuguccccgcgcgaacggaacguuggacuuuucguua

SEQ ID NO: 375236 - RNA, 64 nt, Human
uggccccgcccugcacuccagcucgccccuuucccgcgcgaagugaaggaugcgucacuuuucu

SEQ ID NO: 375237 - RNA, 57 nt, Human; identical to SEQ ID NO: 289640

SEQ ID NO: 375238 - RNA, 64 nt, Human
ugguaaaagcuucccgacuguucuacuuuggguccgcgcgaagcccacucacgugugaucugug

SEQ ID NO: 375239 - RNA, 64 nt, Human
auccggccaggaccccggcccccaaugcacuuuacgcgcgaagaaguugccggaugguuguccc

SEQ ID NO: 375240 - RNA, 64 nt, Human
agccgcgccaacgcacgcaacccuugcugcugcccgcgcgaagugggcauugcaaagugcgcuc

SEQ ID NO: 375241 - RNA, 64 nt, Human
cgguagugugacuguggcucaacuuuccaugguacgcgcgaauuguucuggaagucacagaugg

SEQ ID NO: 375242 - RNA, 64 nt, Human
ggccacgucuccuugagaaccaauaccaaacgagcgcgcgaaccuugaaaugucacgggcuucu

SEQ ID NO: 375243 - RNA, 64 nt, Human; identical to SEQ ID NO: 38790

SEQ ID NO: 375244 - RNA, 64 nt, Human; identical to SEQ ID NO: 38791

SEQ ID NO: 375245 - RNA, 64 nt, Human; identical to SEQ ID NO: 38792

SEQ ID NO: 375246 - RNA, 64 nt, Human; identical to SEQ ID NO: 38793

SEQ ID NO: 375247 - RNA, 64 nt, Human; identical to SEQ ID NO: 38794

SEQ ID NO: 375248 - RNA, 64 nt, Human; identical to SEQ ID NO: 38795

SEQ ID NO: 375249 - RNA, 64 nt, Human; identical to SEQ ID NO: 38796

SEQ ID NO: 375250 - RNA, 64 nt, Human; identical to SEQ ID NO: 38797

SEQ ID NO: 375251 - RNA, 64 nt, Human; identical to SEQ ID NO: 38798

SEQ ID NO: 375252 - RNA, 64 nt, Human; identical to SEQ ID NO: 38799

SEQ ID NO: 375253 - RNA, 64 nt, Human; identical to SEQ ID NO: 38800

SEQ ID NO: 375254 - RNA, 64 nt, Human; identical to SEQ ID NO: 38801

SEQ ID NO: 375255 - RNA, 64 nt, Human; identical to SEQ ID NO: 38802

SEQ ID NO: 375256 - RNA, 64 nt, Human; identical to SEQ ID NO: 38803

SEQ ID NO: 375257 - RNA, 64 nt, Human; identical to SEQ ID NO: 38804

SEQ ID NO: 375258 - RNA, 64 nt, Human; identical to SEQ ID NO: 38805

SEQ ID NO: 375259 - RNA, 64 nt, Human; identical to SEQ ID NO: 38806

SEQ ID NO: 375260 - RNA, 64 nt, Human; identical to SEQ ID NO: 38807

SEQ ID NO: 375261 - RNA, 64 nt, Human; identical to SEQ ID NO: 38808

SEQ ID NO: 375262 - RNA, 64 nt, Human; identical to SEQ ID NO: 38809

SEQ ID NO: 375263 - RNA, 64 nt, Human; identical to SEQ ID NO: 38810

SEQ ID NO: 375264 - RNA, 64 nt, Human; identical to SEQ ID NO: 38811

SEQ ID NO: 375265 - RNA, 64 nt, Human; identical to SEQ ID NO: 38812

SEQ ID NO: 375266 - RNA, 64 nt, Human; identical to SEQ ID NO: 38813

SEQ ID NO: 375267 - RNA, 64 nt, Human; identical to SEQ ID NO: 38814

SEQ ID NO: 375268 - RNA, 64 nt, Human; identical to SEQ ID NO: 38815

SEQ ID NO: 375269 - RNA, 64 nt, Human; identical to SEQ ID NO: 38816

SEQ ID NO: 375270 - RNA, 64 nt, Human; identical to SEQ ID NO: 38817

SEQ ID NO: 375271 - RNA, 64 nt, Human; identical to SEQ ID NO: 38818

SEQ ID NO: 375272 - RNA, 64 nt, Human; identical to SEQ ID NO: 38819

SEQ ID NO: 375273 - RNA, 64 nt, Human; identical to SEQ ID NO: 38820

SEQ ID NO: 375274 - RNA, 64 nt, Human; identical to SEQ ID NO: 38821

SEQ ID NO: 375275 - RNA, 64 nt, Human; identical to SEQ ID NO: 38822

SEQ ID NO: 375276 - RNA, 64 nt, Human; identical to SEQ ID NO: 38823

SEQ ID NO: 375277 - RNA, 64 nt, Human; identical to SEQ ID NO: 38824

SEQ ID NO: 375278 - RNA, 64 nt, Human; identical to SEQ ID NO: 38825

SEQ ID NO: 375279 - RNA, 64 nt, Human; identical to SEQ ID NO: 38826

SEQ ID NO: 375280 - RNA, 64 nt, Human; identical to SEQ ID NO: 38827

SEQ ID NO: 375281 - RNA, 64 nt, Human; identical to SEQ ID NO: 38828

SEQ ID NO: 375282 - RNA, 64 nt, Human; identical to SEQ ID NO: 38829

SEQ ID NO: 375283 - RNA, 64 nt, Human; identical to SEQ ID NO: 38830

SEQ ID NO: 375284 - RNA, 64 nt, Human; identical to SEQ ID NO: 38831

SEQ ID NO: 375285 - RNA, 64 nt, Human; identical to SEQ ID NO: 38832

SEQ ID NO: 375286 - RNA, 64 nt, Human; identical to SEQ ID NO: 38833

SEQ ID NO: 375287 - RNA, 64 nt, Human; identical to SEQ ID NO: 38834

SEQ ID NO: 375288 - RNA, 64 nt, Human; identical to SEQ ID NO: 38835

SEQ ID NO: 375289 - RNA, 64 nt, Human; identical to SEQ ID NO: 38836

SEQ ID NO: 375290 - RNA, 64 nt, Human; identical to SEQ ID NO: 38837

SEQ ID NO: 375291 - RNA, 64 nt, Human; identical to SEQ ID NO: 38838

SEQ ID NO: 375292 - RNA, 64 nt, Human; identical to SEQ ID NO: 38839

SEQ ID NO: 375293 - RNA, 64 nt, Human; identical to SEQ ID NO: 38840

SEQ ID NO: 375294 - RNA, 64 nt, Human; identical to SEQ ID NO: 38841

SEQ ID NO: 375295 - RNA, 64 nt, Human; identical to SEQ ID NO: 38842

SEQ ID NO: 375296 - RNA, 55 nt, Human; identical to SEQ ID NO: 38843

SEQ ID NO: 375297 - RNA, 64 nt, Human; identical to SEQ ID NO: 38844

SEQ ID NO: 375298 - RNA, 64 nt, Human; identical to SEQ ID NO: 38845

SEQ ID NO: 375299 - RNA, 64 nt, Human; identical to SEQ ID NO: 38846

SEQ ID NO: 375300 - RNA, 64 nt, Human; identical to SEQ ID NO: 38847

SEQ ID NO: 375301 - RNA, 64 nt, Human; identical to SEQ ID NO: 38848

SEQ ID NO: 375302 - RNA, 64 nt, Human; identical to SEQ ID NO: 38849

SEQ ID NO: 375303 - RNA, 64 nt, Human; identical to SEQ ID NO: 38850

SEQ ID NO: 375304 - RNA, 64 nt, Human; identical to SEQ ID NO: 38851

SEQ ID NO: 375305 - RNA, 64 nt, Human; identical to SEQ ID NO: 38852

SEQ ID NO: 375306 - RNA, 64 nt, Human; identical to SEQ ID NO: 38853

SEQ ID NO: 375307 - RNA, 64 nt, Human; identical to SEQ ID NO: 38854

SEQ ID NO: 375308 - RNA, 64 nt, Human; identical to SEQ ID NO: 38855

SEQ ID NO: 375309 - RNA, 64 nt, Human; identical to SEQ ID NO: 38856

SEQ ID NO: 375310 - RNA, 64 nt, Human; identical to SEQ ID NO: 38857

SEQ ID NO: 375311 - RNA, 64 nt, Human; identical to SEQ ID NO: 38858

SEQ ID NO: 375312 - RNA, 64 nt, Human; identical to SEQ ID NO: 38859

SEQ ID NO: 375313 - RNA, 64 nt, Human; identical to SEQ ID NO: 38860

SEQ ID NO: 375314 - RNA, 64 nt, Human; identical to SEQ ID NO: 38861

SEQ ID NO: 375315 - RNA, 64 nt, Human; identical to SEQ ID NO: 38862

SEQ ID NO: 375316 - RNA, 64 nt, Human; identical to SEQ ID NO: 38863

SEQ ID NO: 375317 - RNA, 64 nt, Human; identical to SEQ ID NO: 38864

SEQ ID NO: 375318 - RNA, 64 nt, Human; identical to SEQ ID NO: 38865

SEQ ID NO: 375319 - RNA, 64 nt, Human; identical to SEQ ID NO: 38866

SEQ ID NO: 375320 - RNA, 64 nt, Human; identical to SEQ ID NO: 38867

SEQ ID NO: 375321 - RNA, 64 nt, Human; identical to SEQ ID NO: 38868

SEQ ID NO: 375322 - RNA, 64 nt, Human; identical to SEQ ID NO: 38869

SEQ ID NO: 375323 - RNA, 64 nt, Human; identical to SEQ ID NO: 38870

SEQ ID NO: 375324 - RNA, 64 nt, Human; identical to SEQ ID NO: 38871

SEQ ID NO: 375325 - RNA, 64 nt, Human; identical to SEQ ID NO: 38872

SEQ ID NO: 375326 - RNA, 64 nt, Human; identical to SEQ ID NO: 38873

SEQ ID NO: 375327 - RNA, 64 nt, Human; identical to SEQ ID NO: 38874

SEQ ID NO: 375328 - RNA, 64 nt, Human; identical to SEQ ID NO: 38875

SEQ ID NO: 375329 - RNA, 64 nt, Human; identical to SEQ ID NO: 38876

SEQ ID NO: 375330 - RNA, 64 nt, Human; identical to SEQ ID NO: 38877

SEQ ID NO: 375331 - RNA, 64 nt, Human; identical to SEQ ID NO: 38878

SEQ ID NO: 375332 - RNA, 64 nt, Human; identical to SEQ ID NO: 38879

SEQ ID NO: 375333 - RNA, 64 nt, Human; identical to SEQ ID NO: 38880

SEQ ID NO: 375334 - RNA, 64 nt, Human; identical to SEQ ID NO: 38881

SEQ ID NO: 375335 - RNA, 64 nt, Human; identical to SEQ ID NO: 38882

SEQ ID NO: 375336 - RNA, 64 nt, Human; identical to SEQ ID NO: 38883

SEQ ID NO: 375337 - RNA, 64 nt, Human; identical to SEQ ID NO: 38884

SEQ ID NO: 375338 - RNA, 64 nt, Human; identical to SEQ ID NO: 38885

SEQ ID NO: 375339 - RNA, 64 nt, Human; identical to SEQ ID NO: 38886

SEQ ID NO: 375340 - RNA, 64 nt, Human; identical to SEQ ID NO: 38887

SEQ ID NO: 375341 - RNA, 64 nt, Human; identical to SEQ ID NO: 38888

SEQ ID NO: 375342 - RNA, 64 nt, Human; identical to SEQ ID NO: 38889

SEQ ID NO: 375343 - RNA, 64 nt, Human; identical to SEQ ID NO: 38890

SEQ ID NO: 375344 - RNA, 64 nt, Human; identical to SEQ ID NO: 38891

SEQ ID NO: 375345 - RNA, 64 nt, Human; identical to SEQ ID NO: 38892

SEQ ID NO: 375346 - RNA, 64 nt, Human; identical to SEQ ID NO: 38893

SEQ ID NO: 375347 - RNA, 64 nt, Human; identical to SEQ ID NO: 38894

SEQ ID NO: 375348 - RNA, 64 nt, Human; identical to SEQ ID NO: 38895

SEQ ID NO: 375349 - RNA, 64 nt, Human; identical to SEQ ID NO: 38896

SEQ ID NO: 375350 - RNA, 64 nt, Human; identical to SEQ ID NO: 38897

SEQ ID NO: 375351 - RNA, 64 nt, Human; identical to SEQ ID NO: 38898

SEQ ID NO: 375352 - RNA, 64 nt, Human; identical to SEQ ID NO: 38899

SEQ ID NO: 375353 - RNA, 64 nt, Human; identical to SEQ ID NO: 38900

SEQ ID NO: 375354 - RNA, 64 nt, Human; identical to SEQ ID NO: 38901

SEQ ID NO: 375355 - RNA, 64 nt, Human; identical to SEQ ID NO: 38902

SEQ ID NO: 375356 - RNA, 64 nt, Human; identical to SEQ ID NO: 38903

SEQ ID NO: 375357 - RNA, 64 nt, Human; identical to SEQ ID NO: 38904

SEQ ID NO: 375358 - RNA, 64 nt, Human; identical to SEQ ID NO: 38905

SEQ ID NO: 375359 - RNA, 64 nt, Human; identical to SEQ ID NO: 38906

SEQ ID NO: 375360 - RNA, 64 nt, Human; identical to SEQ ID NO: 38907

SEQ ID NO: 375361 - RNA, 64 nt, Human; identical to SEQ ID NO: 38908

SEQ ID NO: 375362 - RNA, 64 nt, Human; identical to SEQ ID NO: 38909

SEQ ID NO: 375363 - RNA, 64 nt, Human; identical to SEQ ID NO: 38910

SEQ ID NO: 375364 - RNA, 64 nt, Human; identical to SEQ ID NO: 38911

SEQ ID NO: 375365 - RNA, 64 nt, Human; identical to SEQ ID NO: 38912

SEQ ID NO: 375366 - RNA, 64 nt, Human; identical to SEQ ID NO: 38913

SEQ ID NO: 375367 - RNA, 64 nt, Human; identical to SEQ ID NO: 38914

SEQ ID NO: 375368 - RNA, 64 nt, Human; identical to SEQ ID NO: 38915

SEQ ID NO: 375369 - RNA, 64 nt, Human; identical to SEQ ID NO: 38916

SEQ ID NO: 375370 - RNA, 64 nt, Human; identical to SEQ ID NO: 38917

SEQ ID NO: 375371 - RNA, 64 nt, Human; identical to SEQ ID NO: 38918

SEQ ID NO: 375372 - RNA, 64 nt, Human; identical to SEQ ID NO: 38919

SEQ ID NO: 375373 - RNA, 64 nt, Human; identical to SEQ ID NO: 38920

SEQ ID NO: 375374 - RNA, 64 nt, Human; identical to SEQ ID NO: 38921

SEQ ID NO: 375375 - RNA, 64 nt, Human; identical to SEQ ID NO: 38922

SEQ ID NO: 375376 - RNA, 64 nt, Human; identical to SEQ ID NO: 38923

SEQ ID NO: 375377 - RNA, 64 nt, Human; identical to SEQ ID NO: 38924

SEQ ID NO: 375378 - RNA, 64 nt, Human; identical to SEQ ID NO: 38925

SEQ ID NO: 375379 - RNA, 64 nt, Human; identical to SEQ ID NO: 38926

SEQ ID NO: 375380 - RNA, 64 nt, Human; identical to SEQ ID NO: 38927

SEQ ID NO: 375381 - RNA, 64 nt, Human; identical to SEQ ID NO: 38928

SEQ ID NO: 375382 - RNA, 64 nt, Human; identical to SEQ ID NO: 38929

SEQ ID NO: 375383 - RNA, 64 nt, Human; identical to SEQ ID NO: 38930

SEQ ID NO: 375384 - RNA, 64 nt, Human; identical to SEQ ID NO: 38931

SEQ ID NO: 375385 - RNA, 64 nt, Human; identical to SEQ ID NO: 38932

SEQ ID NO: 375386 - RNA, 64 nt, Human; identical to SEQ ID NO: 38933

SEQ ID NO: 375387 - RNA, 64 nt, Human; identical to SEQ ID NO: 38934

SEQ ID NO: 375388 - RNA, 64 nt, Human; identical to SEQ ID NO: 38935

SEQ ID NO: 375389 - RNA, 64 nt, Human; identical to SEQ ID NO: 38936

SEQ ID NO: 375390 - RNA, 64 nt, Human; identical to SEQ ID NO: 38937

SEQ ID NO: 375391 - RNA, 64 nt, Human; identical to SEQ ID NO: 38938

SEQ ID NO: 375392 - RNA, 64 nt, Human; identical to SEQ ID NO: 38939

SEQ ID NO: 375393 - RNA, 64 nt, Human; identical to SEQ ID NO: 38940

SEQ ID NO: 375394 - RNA, 64 nt, Human; identical to SEQ ID NO: 38941

SEQ ID NO: 375395 - RNA, 64 nt, Human; identical to SEQ ID NO: 38942

SEQ ID NO: 375396 - RNA, 64 nt, Human; identical to SEQ ID NO: 38943

SEQ ID NO: 375397 - RNA, 64 nt, Human; identical to SEQ ID NO: 38944

SEQ ID NO: 375398 - RNA, 64 nt, Human; identical to SEQ ID NO: 38945

SEQ ID NO: 375399 - RNA, 64 nt, Human; identical to SEQ ID NO: 38946

SEQ ID NO: 375400 - RNA, 64 nt, Human; identical to SEQ ID NO: 38947

SEQ ID NO: 375401 - RNA, 64 nt, Human; identical to SEQ ID NO: 38948

SEQ ID NO: 375402 - RNA, 64 nt, Human; identical to SEQ ID NO: 38949

SEQ ID NO: 375403 - RNA, 64 nt, Human; identical to SEQ ID NO: 38950

SEQ ID NO: 375404 - RNA, 64 nt, Human; identical to SEQ ID NO: 38951

SEQ ID NO: 375405 - RNA, 64 nt, Human; identical to SEQ ID NO: 38952

SEQ ID NO: 375406 - RNA, 64 nt, Human; identical to SEQ ID NO: 38953

SEQ ID NO: 375407 - RNA, 64 nt, Human; identical to SEQ ID NO: 38954

SEQ ID NO: 375408 - RNA, 64 nt, Human; identical to SEQ ID NO: 38955

SEQ ID NO: 375409 - RNA, 64 nt, Human; identical to SEQ ID NO: 38956

SEQ ID NO: 375410 - RNA, 64 nt, Human; identical to SEQ ID NO: 38957

SEQ ID NO: 375411 - RNA, 64 nt, Human; identical to SEQ ID NO: 38958

SEQ ID NO: 375412 - RNA, 58 nt, Human; identical to SEQ ID NO: 38959

SEQ ID NO: 375413 - RNA, 64 nt, Human; identical to SEQ ID NO: 38960

SEQ ID NO: 375414 - RNA, 64 nt, Human; identical to SEQ ID NO: 38961

SEQ ID NO: 375415 - RNA, 64 nt, Human; identical to SEQ ID NO: 38962

SEQ ID NO: 375416 - RNA, 64 nt, Human; identical to SEQ ID NO: 38963

SEQ ID NO: 375417 - RNA, 64 nt, Human; identical to SEQ ID NO: 38964

SEQ ID NO: 375418 - RNA, 64 nt, Human; identical to SEQ ID NO: 38965

SEQ ID NO: 375419 - RNA, 64 nt, Human; identical to SEQ ID NO: 38966

SEQ ID NO: 375420 - RNA, 64 nt, Human; identical to SEQ ID NO: 38967

SEQ ID NO: 375421 - RNA, 64 nt, Human; identical to SEQ ID NO: 38968

SEQ ID NO: 375422 - RNA, 64 nt, Human; identical to SEQ ID NO: 38969

SEQ ID NO: 375423 - RNA, 64 nt, Human; identical to SEQ ID NO: 38970

SEQ ID NO: 375424 - RNA, 64 nt, Human; identical to SEQ ID NO: 38971

SEQ ID NO: 375425 - RNA, 64 nt, Human; identical to SEQ ID NO: 38972

SEQ ID NO: 375426 - RNA, 64 nt, Human; identical to SEQ ID NO: 38973

SEQ ID NO: 375427 - RNA, 64 nt, Human; identical to SEQ ID NO: 38974

SEQ ID NO: 375428 - RNA, 64 nt, Human; identical to SEQ ID NO: 38975

SEQ ID NO: 375429 - RNA, 64 nt, Human; identical to SEQ ID NO: 38976

SEQ ID NO: 375430 - RNA, 64 nt, Human; identical to SEQ ID NO: 38977

SEQ ID NO: 375431 - RNA, 64 nt, Human; identical to SEQ ID NO: 38978

SEQ ID NO: 375432 - RNA, 64 nt, Human; identical to SEQ ID NO: 38979

SEQ ID NO: 375433 - RNA, 64 nt, Human; identical to SEQ ID NO: 38980

SEQ ID NO: 375434 - RNA, 64 nt, Human; identical to SEQ ID NO: 38981

SEQ ID NO: 375435 - RNA, 64 nt, Human; identical to SEQ ID NO: 38982

SEQ ID NO: 375436 - RNA, 64 nt, Human; identical to SEQ ID NO: 38983

SEQ ID NO: 375437 - RNA, 64 nt, Human; identical to SEQ ID NO: 38984

SEQ ID NO: 375438 - RNA, 64 nt, Human; identical to SEQ ID NO: 38985

SEQ ID NO: 375439 - RNA, 64 nt, Human; identical to SEQ ID NO: 38986

SEQ ID NO: 375440 - RNA, 64 nt, Human; identical to SEQ ID NO: 38987

SEQ ID NO: 375441 - RNA, 64 nt, Human; identical to SEQ ID NO: 38988

SEQ ID NO: 375442 - RNA, 64 nt, Human; identical to SEQ ID NO: 38989

SEQ ID NO: 375443 - RNA, 64 nt, Human; identical to SEQ ID NO: 38990

SEQ ID NO: 375444 - RNA, 64 nt, Human; identical to SEQ ID NO: 38991

SEQ ID NO: 375445 - RNA, 64 nt, Human; identical to SEQ ID NO: 38992

SEQ ID NO: 375446 - RNA, 64 nt, Human; identical to SEQ ID NO: 38993

SEQ ID NO: 375447 - RNA, 64 nt, Human; identical to SEQ ID NO: 38994

SEQ ID NO: 375448 - RNA, 64 nt, Human; identical to SEQ ID NO: 38995

SEQ ID NO: 375449 - RNA, 64 nt, Human; identical to SEQ ID NO: 38996

SEQ ID NO: 375450 - RNA, 64 nt, Human; identical to SEQ ID NO: 38997

SEQ ID NO: 375451 - RNA, 64 nt, Human; identical to SEQ ID NO: 38998

SEQ ID NO: 375452 - RNA, 62 nt, Human; identical to SEQ ID NO: 38999

SEQ ID NO: 375453 - RNA, 64 nt, Human; identical to SEQ ID NO: 39000

SEQ ID NO: 375454 - RNA, 64 nt, Human; identical to SEQ ID NO: 39001

SEQ ID NO: 375455 - RNA, 64 nt, Human; identical to SEQ ID NO: 39002

SEQ ID NO: 375456 - RNA, 64 nt, Human; identical to SEQ ID NO: 39003

SEQ ID NO: 375457 - RNA, 64 nt, Human; identical to SEQ ID NO: 39004

SEQ ID NO: 375458 - RNA, 64 nt, Human; identical to SEQ ID NO: 39005

SEQ ID NO: 375459 - RNA, 64 nt, Human; identical to SEQ ID NO: 39006

SEQ ID NO: 375460 - RNA, 64 nt, Human; identical to SEQ ID NO: 39007

SEQ ID NO: 375461 - RNA, 64 nt, Human; identical to SEQ ID NO: 39008

SEQ ID NO: 375462 - RNA, 64 nt, Human; identical to SEQ ID NO: 39009

SEQ ID NO: 375463 - RNA, 64 nt, Human; identical to SEQ ID NO: 39010

SEQ ID NO: 375464 - RNA, 64 nt, Human; identical to SEQ ID NO: 39011

SEQ ID NO: 375465 - RNA, 64 nt, Human; identical to SEQ ID NO: 39012

SEQ ID NO: 375466 - RNA, 64 nt, Human; identical to SEQ ID NO: 39013

SEQ ID NO: 375467 - RNA, 64 nt, Human; identical to SEQ ID NO: 39014

SEQ ID NO: 375468 - RNA, 64 nt, Human; identical to SEQ ID NO: 39015

SEQ ID NO: 375469 - RNA, 64 nt, Human; identical to SEQ ID NO: 39016

SEQ ID NO: 375470 - RNA, 64 nt, Human; identical to SEQ ID NO: 39017

SEQ ID NO: 375471 - RNA, 64 nt, Human; identical to SEQ ID NO: 39018

SEQ ID NO: 375472 - RNA, 64 nt, Human; identical to SEQ ID NO: 39019

SEQ ID NO: 375473 - RNA, 64 nt, Human; identical to SEQ ID NO: 39020

SEQ ID NO: 375474 - RNA, 64 nt, Human; identical to SEQ ID NO: 39021

SEQ ID NO: 375475 - RNA, 64 nt, Human; identical to SEQ ID NO: 39022

SEQ ID NO: 375476 - RNA, 64 nt, Human; identical to SEQ ID NO: 39023

SEQ ID NO: 375477 - RNA, 64 nt, Human; identical to SEQ ID NO: 39024

SEQ ID NO: 375478 - RNA, 64 nt, Human; identical to SEQ ID NO: 39025

SEQ ID NO: 375479 - RNA, 64 nt, Human; identical to SEQ ID NO: 39026

SEQ ID NO: 375480 - RNA, 64 nt, Human; identical to SEQ ID NO: 39027

SEQ ID NO: 375481 - RNA, 64 nt, Human; identical to SEQ ID NO: 39028

SEQ ID NO: 375482 - RNA, 64 nt, Human; identical to SEQ ID NO: 39029

SEQ ID NO: 375483 - RNA, 64 nt, Human; identical to SEQ ID NO: 39030

SEQ ID NO: 375484 - RNA, 64 nt, Human; identical to SEQ ID NO: 39031

SEQ ID NO: 375485 - RNA, 61 nt, Human; identical to SEQ ID NO: 39032

SEQ ID NO: 375486 - RNA, 64 nt, Human; identical to SEQ ID NO: 39033

SEQ ID NO: 375487 - RNA, 64 nt, Human; identical to SEQ ID NO: 39034

SEQ ID NO: 375488 - RNA, 64 nt, Human; identical to SEQ ID NO: 39035

SEQ ID NO: 375489 - RNA, 64 nt, Human; identical to SEQ ID NO: 39036

SEQ ID NO: 375490 - RNA, 64 nt, Human; identical to SEQ ID NO: 39037

SEQ ID NO: 375491 - RNA, 64 nt, Human; identical to SEQ ID NO: 39038

SEQ ID NO: 375492 - RNA, 64 nt, Human; identical to SEQ ID NO: 39039

SEQ ID NO: 375493 - RNA, 64 nt, Human; identical to SEQ ID NO: 39040

SEQ ID NO: 375494 - RNA, 64 nt, Human; identical to SEQ ID NO: 39041

SEQ ID NO: 375495 - RNA, 64 nt, Human; identical to SEQ ID NO: 39042

SEQ ID NO: 375496 - RNA, 64 nt, Human; identical to SEQ ID NO: 39043

SEQ ID NO: 375497 - RNA, 64 nt, Human; identical to SEQ ID NO: 39044

SEQ ID NO: 375498 - RNA, 64 nt, Human; identical to SEQ ID NO: 39045

SEQ ID NO: 375499 - RNA, 64 nt, Human; identical to SEQ ID NO: 39046

SEQ ID NO: 375500 - RNA, 64 nt, Human; identical to SEQ ID NO: 39047

SEQ ID NO: 375501 - RNA, 64 nt, Human; identical to SEQ ID NO: 39048

SEQ ID NO: 375502 - RNA, 64 nt, Human; identical to SEQ ID NO: 39049

SEQ ID NO: 375503 - RNA, 64 nt, Human; identical to SEQ ID NO: 39050

SEQ ID NO: 375504 - RNA, 64 nt, Human; identical to SEQ ID NO: 39051

SEQ ID NO: 375505 - RNA, 64 nt, Human; identical to SEQ ID NO: 39052

SEQ ID NO: 375506 - RNA, 64 nt, Human; identical to SEQ ID NO: 39053

SEQ ID NO: 375507 - RNA, 64 nt, Human; identical to SEQ ID NO: 39054

SEQ ID NO: 375508 - RNA, 64 nt, Human; identical to SEQ ID NO: 39055

SEQ ID NO: 375509 - RNA, 64 nt, Human; identical to SEQ ID NO: 39056

SEQ ID NO: 375510 - RNA, 64 nt, Human; identical to SEQ ID NO: 39057

SEQ ID NO: 375511 - RNA, 64 nt, Human; identical to SEQ ID NO: 39058

SEQ ID NO: 375512 - RNA, 64 nt, Human; identical to SEQ ID NO: 39059

SEQ ID NO: 375513 - RNA, 64 nt, Human; identical to SEQ ID NO: 39060

SEQ ID NO: 375514 - RNA, 64 nt, Human; identical to SEQ ID NO: 39061

SEQ ID NO: 375515 - RNA, 51 nt, Human; identical to SEQ ID NO: 39062

SEQ ID NO: 375516 - RNA, 64 nt, Human; identical to SEQ ID NO: 39063

SEQ ID NO: 375517 - RNA, 64 nt, Human; identical to SEQ ID NO: 39064

SEQ ID NO: 375518 - RNA, 64 nt, Human; identical to SEQ ID NO: 39065

SEQ ID NO: 375519 - RNA, 64 nt, Human; identical to SEQ ID NO: 39066

SEQ ID NO: 375520 - RNA, 64 nt, Human; identical to SEQ ID NO: 39067

SEQ ID NO: 375521 - RNA, 64 nt, Human; identical to SEQ ID NO: 39068

SEQ ID NO: 375522 - RNA, 64 nt, Human; identical to SEQ ID NO: 39069

SEQ ID NO: 375523 - RNA, 64 nt, Human; identical to SEQ ID NO: 39070

SEQ ID NO: 375524 - RNA, 64 nt, Human; identical to SEQ ID NO: 39071

SEQ ID NO: 375525 - RNA, 64 nt, Human; identical to SEQ ID NO: 39072

SEQ ID NO: 375526 - RNA, 64 nt, Human; identical to SEQ ID NO: 39073

SEQ ID NO: 375527 - RNA, 64 nt, Human; identical to SEQ ID NO: 39074

SEQ ID NO: 375528 - RNA, 64 nt, Human; identical to SEQ ID NO: 39075

SEQ ID NO: 375529 - RNA, 64 nt, Human; identical to SEQ ID NO: 39076

SEQ ID NO: 375530 - RNA, 62 nt, Human; identical to SEQ ID NO: 39077

SEQ ID NO: 375531 - RNA, 64 nt, Human; identical to SEQ ID NO: 39078

SEQ ID NO: 375532 - RNA, 64 nt, Human; identical to SEQ ID NO: 39079

SEQ ID NO: 375533 - RNA, 64 nt, Human; identical to SEQ ID NO: 39080

SEQ ID NO: 375534 - RNA, 64 nt, Human; identical to SEQ ID NO: 39081

SEQ ID NO: 375535 - RNA, 64 nt, Human; identical to SEQ ID NO: 39082

SEQ ID NO: 375536 - RNA, 64 nt, Human; identical to SEQ ID NO: 39083

SEQ ID NO: 375537 - RNA, 64 nt, Human; identical to SEQ ID NO: 39084

SEQ ID NO: 375538 - RNA, 64 nt, Human; identical to SEQ ID NO: 39085

SEQ ID NO: 375539 - RNA, 64 nt, Human; identical to SEQ ID NO: 39086

SEQ ID NO: 375540 - RNA, 64 nt, Human; identical to SEQ ID NO: 39087

SEQ ID NO: 375541 - RNA, 64 nt, Human; identical to SEQ ID NO: 39088

SEQ ID NO: 375542 - RNA, 64 nt, Human; identical to SEQ ID NO: 39089

SEQ ID NO: 375543 - RNA, 64 nt, Human; identical to SEQ ID NO: 39090

SEQ ID NO: 375544 - RNA, 64 nt, Human; identical to SEQ ID NO: 39091

SEQ ID NO: 375545 - RNA, 64 nt, Human; identical to SEQ ID NO: 39092

SEQ ID NO: 375546 - RNA, 64 nt, Human; identical to SEQ ID NO: 39093

SEQ ID NO: 375547 - RNA, 64 nt, Human; identical to SEQ ID NO: 39094

SEQ ID NO: 375548 - RNA, 64 nt, Human; identical to SEQ ID NO: 39095

SEQ ID NO: 375549 - RNA, 64 nt, Human; identical to SEQ ID NO: 39096

SEQ ID NO: 375550 - RNA, 64 nt, Human; identical to SEQ ID NO: 39097

SEQ ID NO: 375551 - RNA, 64 nt, Human; identical to SEQ ID NO: 39098

SEQ ID NO: 375552 - RNA, 64 nt, Human; identical to SEQ ID NO: 39099

SEQ ID NO: 375553 - RNA, 64 nt, Human; identical to SEQ ID NO: 39100

SEQ ID NO: 375554 - RNA, 64 nt, Human; identical to SEQ ID NO: 39101

SEQ ID NO: 375555 - RNA, 64 nt, Human; identical to SEQ ID NO: 39102

SEQ ID NO: 375556 - RNA, 64 nt, Human; identical to SEQ ID NO: 39103

SEQ ID NO: 375557 - RNA, 64 nt, Human; identical to SEQ ID NO: 39104

SEQ ID NO: 375558 - RNA, 64 nt, Human; identical to SEQ ID NO: 39105

SEQ ID NO: 375559 - RNA, 64 nt, Human; identical to SEQ ID NO: 39106

SEQ ID NO: 375560 - RNA, 64 nt, Human; identical to SEQ ID NO: 39107

SEQ ID NO: 375561 - RNA, 64 nt, Human; identical to SEQ ID NO: 39108

SEQ ID NO: 375562 - RNA, 62 nt, Human; identical to SEQ ID NO: 39109

SEQ ID NO: 375563 - RNA, 64 nt, Human; identical to SEQ ID NO: 39110

SEQ ID NO: 375564 - RNA, 64 nt, Human; identical to SEQ ID NO: 39111

SEQ ID NO: 375565 - RNA, 64 nt, Human; identical to SEQ ID NO: 39112

SEQ ID NO: 375566 - RNA, 64 nt, Human; identical to SEQ ID NO: 39113

SEQ ID NO: 375567 - RNA, 64 nt, Human; identical to SEQ ID NO: 39114

SEQ ID NO: 375568 - RNA, 64 nt, Human; identical to SEQ ID NO: 39115

SEQ ID NO: 375569 - RNA, 64 nt, Human; identical to SEQ ID NO: 39116

SEQ ID NO: 375570 - RNA, 64 nt, Human; identical to SEQ ID NO: 39117

SEQ ID NO: 375571 - RNA, 64 nt, Human; identical to SEQ ID NO: 39118

SEQ ID NO: 375572 - RNA, 64 nt, Human; identical to SEQ ID NO: 39119

SEQ ID NO: 375573 - RNA, 64 nt, Human; identical to SEQ ID NO: 39120

SEQ ID NO: 375574 - RNA, 64 nt, Human; identical to SEQ ID NO: 39121

SEQ ID NO: 375575 - RNA, 64 nt, Human; identical to SEQ ID NO: 39122

SEQ ID NO: 375576 - RNA, 64 nt, Human; identical to SEQ ID NO: 39123

SEQ ID NO: 375577 - RNA, 64 nt, Human; identical to SEQ ID NO: 39124

SEQ ID NO: 375578 - RNA, 64 nt, Human; identical to SEQ ID NO: 39125

SEQ ID NO: 375579 - RNA, 64 nt, Human; identical to SEQ ID NO: 39126

SEQ ID NO: 375580 - RNA, 64 nt, Human; identical to SEQ ID NO: 39126

SEQ ID NO: 375581 - RNA, 64 nt, Human; identical to SEQ ID NO: 39126

SEQ ID NO: 375582 - RNA, 64 nt, Human; identical to SEQ ID NO: 39129

SEQ ID NO: 375583 - RNA, 64 nt, Human; identical to SEQ ID NO: 39130

SEQ ID NO: 375584 - RNA, 64 nt, Human; identical to SEQ ID NO: 39131

SEQ ID NO: 375585 - RNA, 64 nt, Human; identical to SEQ ID NO: 39132

SEQ ID NO: 375586 - RNA, 64 nt, Human; identical to SEQ ID NO: 39133

SEQ ID NO: 375587 - RNA, 64 nt, Human; identical to SEQ ID NO: 39134

SEQ ID NO: 375588 - RNA, 64 nt, Human; identical to SEQ ID NO: 39135

SEQ ID NO: 375589 - RNA, 64 nt, Human; identical to SEQ ID NO: 39136

SEQ ID NO: 375590 - RNA, 64 nt, Human; identical to SEQ ID NO: 39137

SEQ ID NO: 375591 - RNA, 64 nt, Human; identical to SEQ ID NO: 39138

SEQ ID NO: 375592 - RNA, 64 nt, Human; identical to SEQ ID NO: 39139

SEQ ID NO: 375593 - RNA, 64 nt, Human; identical to SEQ ID NO: 39140

SEQ ID NO: 375594 - RNA, 64 nt, Human; identical to SEQ ID NO: 39141

SEQ ID NO: 375595 - RNA, 64 nt, Human; identical to SEQ ID NO: 39142

SEQ ID NO: 375596 - RNA, 64 nt, Human; identical to SEQ ID NO: 39143

SEQ ID NO: 375597 - RNA, 64 nt, Human; identical to SEQ ID NO: 39144

SEQ ID NO: 375598 - RNA, 64 nt, Human; identical to SEQ ID NO: 39145

SEQ ID NO: 375599 - RNA, 64 nt, Human; identical to SEQ ID NO: 39146

SEQ ID NO: 375600 - RNA, 64 nt, Human; identical to SEQ ID NO: 39147

SEQ ID NO: 375601 - RNA, 64 nt, Human; identical to SEQ ID NO: 39148

SEQ ID NO: 375602 - RNA, 64 nt, Human; identical to SEQ ID NO: 39149

SEQ ID NO: 375603 - RNA, 64 nt, Human; identical to SEQ ID NO: 39150

SEQ ID NO: 375604 - RNA, 64 nt, Human; identical to SEQ ID NO: 39151

SEQ ID NO: 375605 - RNA, 64 nt, Human; identical to SEQ ID NO: 39152

SEQ ID NO: 375606 - RNA, 64 nt, Human; identical to SEQ ID NO: 39153

SEQ ID NO: 375607 - RNA, 64 nt, Human; identical to SEQ ID NO: 39154

SEQ ID NO: 375608 - RNA, 64 nt, Human; identical to SEQ ID NO: 39155

SEQ ID NO: 375609 - RNA, 64 nt, Human; identical to SEQ ID NO: 39156

SEQ ID NO: 375610 - RNA, 64 nt, Human; identical to SEQ ID NO: 39157

SEQ ID NO: 375611 - RNA, 64 nt, Human; identical to SEQ ID NO: 39158

SEQ ID NO: 375612 - RNA, 64 nt, Human; identical to SEQ ID NO: 39159

SEQ ID NO: 375613 - RNA, 64 nt, Human; identical to SEQ ID NO: 39160

SEQ ID NO: 375614 - RNA, 64 nt, Human; identical to SEQ ID NO: 39161

SEQ ID NO: 375615 - RNA, 64 nt, Human; identical to SEQ ID NO: 39162

SEQ ID NO: 375616 - RNA, 64 nt, Human; identical to SEQ ID NO: 39163

SEQ ID NO: 375617 - RNA, 64 nt, Human; identical to SEQ ID NO: 39164

SEQ ID NO: 375618 - RNA, 64 nt, Human; identical to SEQ ID NO: 39165

SEQ ID NO: 375619 - RNA, 64 nt, Human; identical to SEQ ID NO: 39166

SEQ ID NO: 375620 - RNA, 64 nt, Human; identical to SEQ ID NO: 39167

SEQ ID NO: 375621 - RNA, 64 nt, Human; identical to SEQ ID NO: 39168

SEQ ID NO: 375622 - RNA, 64 nt, Human; identical to SEQ ID NO: 39169

SEQ ID NO: 375623 - RNA, 64 nt, Human; identical to SEQ ID NO: 39170

SEQ ID NO: 375624 - RNA, 64 nt, Human; identical to SEQ ID NO: 39171

SEQ ID NO: 375625 - RNA, 64 nt, Human; identical to SEQ ID NO: 39172

SEQ ID NO: 375626 - RNA, 64 nt, Human; identical to SEQ ID NO: 39173

SEQ ID NO: 375627 - RNA, 64 nt, Human; identical to SEQ ID NO: 39174

SEQ ID NO: 375628 - RNA, 64 nt, Human; identical to SEQ ID NO: 39175

SEQ ID NO: 375629 - RNA, 64 nt, Human; identical to SEQ ID NO: 39176

SEQ ID NO: 375630 - RNA, 64 nt, Human; identical to SEQ ID NO: 39177

SEQ ID NO: 375631 - RNA, 64 nt, Human; identical to SEQ ID NO: 39178

SEQ ID NO: 375632 - RNA, 64 nt, Human; identical to SEQ ID NO: 39179

SEQ ID NO: 375633 - RNA, 64 nt, Human; identical to SEQ ID NO: 39180

SEQ ID NO: 375634 - RNA, 64 nt, Human; identical to SEQ ID NO: 39181

SEQ ID NO: 375635 - RNA, 64 nt, Human; identical to SEQ ID NO: 39182

SEQ ID NO: 375636 - RNA, 64 nt, Human; identical to SEQ ID NO: 39183

SEQ ID NO: 375637 - RNA, 64 nt, Human; identical to SEQ ID NO: 39184

SEQ ID NO: 375638 - RNA, 64 nt, Human; identical to SEQ ID NO: 39185

SEQ ID NO: 375639 - RNA, 64 nt, Human; identical to SEQ ID NO: 39186

SEQ ID NO: 375640 - RNA, 64 nt, Human; identical to SEQ ID NO: 39187

SEQ ID NO: 375641 - RNA, 64 nt, Human; identical to SEQ ID NO: 39188

SEQ ID NO: 375642 - RNA, 64 nt, Human; identical to SEQ ID NO: 39189

SEQ ID NO: 375643 - RNA, 64 nt, Human; identical to SEQ ID NO: 39190

SEQ ID NO: 375644 - RNA, 64 nt, Human; identical to SEQ ID NO: 39191

SEQ ID NO: 375645 - RNA, 64 nt, Human; identical to SEQ ID NO: 39192

SEQ ID NO: 375646 - RNA, 64 nt, Human; identical to SEQ ID NO: 39193

SEQ ID NO: 375647 - RNA, 64 nt, Human; identical to SEQ ID NO: 39194

SEQ ID NO: 375648 - RNA, 64 nt, Human; identical to SEQ ID NO: 39195

SEQ ID NO: 375649 - RNA, 64 nt, Human; identical to SEQ ID NO: 39196

SEQ ID NO: 375650 - RNA, 64 nt, Human; identical to SEQ ID NO: 39197

SEQ ID NO: 375651 - RNA, 64 nt, Human; identical to SEQ ID NO: 39198

SEQ ID NO: 375652 - RNA, 64 nt, Human; identical to SEQ ID NO: 39199

SEQ ID NO: 375653 - RNA, 64 nt, Human; identical to SEQ ID NO: 39200

SEQ ID NO: 375654 - RNA, 64 nt, Human; identical to SEQ ID NO: 39201

SEQ ID NO: 375655 - RNA, 64 nt, Human; identical to SEQ ID NO: 39202

SEQ ID NO: 375656 - RNA, 64 nt, Human; identical to SEQ ID NO: 39203

SEQ ID NO: 375657 - RNA, 64 nt, Human; identical to SEQ ID NO: 39204

SEQ ID NO: 375658 - RNA, 64 nt, Human; identical to SEQ ID NO: 39205

SEQ ID NO: 375659 - RNA, 64 nt, Human; identical to SEQ ID NO: 39206

SEQ ID NO: 375660 - RNA, 64 nt, Human; identical to SEQ ID NO: 39207

SEQ ID NO: 375661 - RNA, 64 nt, Human; identical to SEQ ID NO: 39208

SEQ ID NO: 375662 - RNA, 64 nt, Human; identical to SEQ ID NO: 39209

SEQ ID NO: 375663 - RNA, 64 nt, Human; identical to SEQ ID NO: 39210

SEQ ID NO: 375664 - RNA, 64 nt, Human; identical to SEQ ID NO: 39211

SEQ ID NO: 375665 - RNA, 64 nt, Human; identical to SEQ ID NO: 39212

SEQ ID NO: 375666 - RNA, 64 nt, Human; identical to SEQ ID NO: 39213

SEQ ID NO: 375667 - RNA, 64 nt, Human; identical to SEQ ID NO: 39214

SEQ ID NO: 375668 - RNA, 64 nt, Human; identical to SEQ ID NO: 39215

SEQ ID NO: 375669 - RNA, 64 nt, Human; identical to SEQ ID NO: 39216

SEQ ID NO: 375670 - RNA, 64 nt, Human; identical to SEQ ID NO: 39217

SEQ ID NO: 375671 - RNA, 64 nt, Human; identical to SEQ ID NO: 39218

SEQ ID NO: 375672 - RNA, 64 nt, Human; identical to SEQ ID NO: 39219

SEQ ID NO: 375673 - RNA, 64 nt, Human; identical to SEQ ID NO: 39220

SEQ ID NO: 375674 - RNA, 64 nt, Human; identical to SEQ ID NO: 39221

SEQ ID NO: 375675 - RNA, 64 nt, Human; identical to SEQ ID NO: 39222

SEQ ID NO: 375676 - RNA, 64 nt, Human; identical to SEQ ID NO: 39223

SEQ ID NO: 375677 - RNA, 50 nt, Human; identical to SEQ ID NO: 39224

SEQ ID NO: 375678 - RNA, 64 nt, Human; identical to SEQ ID NO: 39225

SEQ ID NO: 375679 - RNA, 64 nt, Human; identical to SEQ ID NO: 39226

SEQ ID NO: 375680 - RNA, 64 nt, Human; identical to SEQ ID NO: 39227

SEQ ID NO: 375681 - RNA, 64 nt, Human; identical to SEQ ID NO: 39228

SEQ ID NO: 375682 - RNA, 64 nt, Human; identical to SEQ ID NO: 39229

SEQ ID NO: 375683 - RNA, 50 nt, Human; identical to SEQ ID NO: 39230

SEQ ID NO: 375684 - RNA, 64 nt, Human; identical to SEQ ID NO: 39231

SEQ ID NO: 375685 - RNA, 64 nt, Human; identical to SEQ ID NO: 39232

SEQ ID NO: 375686 - RNA, 64 nt, Human; identical to SEQ ID NO: 39233

SEQ ID NO: 375687 - RNA, 64 nt, Human; identical to SEQ ID NO: 39234

SEQ ID NO: 375688 - RNA, 64 nt, Human; identical to SEQ ID NO: 39235

SEQ ID NO: 375689 - RNA, 64 nt, Human; identical to SEQ ID NO: 39236

SEQ ID NO: 375690 - RNA, 64 nt, Human; identical to SEQ ID NO: 39237

SEQ ID NO: 375691 - RNA, 64 nt, Human; identical to SEQ ID NO: 39238

SEQ ID NO: 375692 - RNA, 64 nt, Human; identical to SEQ ID NO: 39239

SEQ ID NO: 375693 - RNA, 64 nt, Human; identical to SEQ ID NO: 39240

SEQ ID NO: 375694 - RNA, 64 nt, Human; identical to SEQ ID NO: 39241

SEQ ID NO: 375695 - RNA, 64 nt, Human; identical to SEQ ID NO: 39242

SEQ ID NO: 375696 - RNA, 64 nt, Human; identical to SEQ ID NO: 39243

SEQ ID NO: 375697 - RNA, 64 nt, Human; identical to SEQ ID NO: 39244

SEQ ID NO: 375698 - RNA, 64 nt, Human; identical to SEQ ID NO: 39245

SEQ ID NO: 375699 - RNA, 64 nt, Human; identical to SEQ ID NO: 39246

SEQ ID NO: 375700 - RNA, 64 nt, Human; identical to SEQ ID NO: 39247

SEQ ID NO: 375701 - RNA, 64 nt, Human; identical to SEQ ID NO: 39248

SEQ ID NO: 375702 - RNA, 64 nt, Human; identical to SEQ ID NO: 39249

SEQ ID NO: 375703 - RNA, 64 nt, Human; identical to SEQ ID NO: 39250

SEQ ID NO: 375704 - RNA, 64 nt, Human; identical to SEQ ID NO: 39251

SEQ ID NO: 375705 - RNA, 64 nt, Human; identical to SEQ ID NO: 39252

SEQ ID NO: 375706 - RNA, 64 nt, Human; identical to SEQ ID NO: 39253

SEQ ID NO: 375707 - RNA, 64 nt, Human; identical to SEQ ID NO: 39254

SEQ ID NO: 375708 - RNA, 64 nt, Human; identical to SEQ ID NO: 39255

SEQ ID NO: 375709 - RNA, 64 nt, Human; identical to SEQ ID NO: 39256

SEQ ID NO: 375710 - RNA, 64 nt, Human
agaacacuuagaaugauaaaaaaaaaaaaaaaaaaccugacaaaagaaauaguaugaaaaguag

SEQ ID NO: 375711 - RNA, 64 nt, Human
ccgccuccccauacuuccugggaugaugugugaaaccugacaccuagauuuauuuggaaauauu

SEQ ID NO: 375712 - RNA, 64 nt, Human
uugggaccaccaaguuguaaagauguauguuuuuaccugacaguuauaccacagguagacuguc

SEQ ID NO: 375713 - RNA, 64 nt, Human
ggggugugcagucugcccuguccuucugcucauaaccugacaaaaugccaaacuaguaagcagg

SEQ ID NO: 375714 - RNA, 64 nt, Human
guuggccacuaggcaaugguaugggcagggcuucaccugacauuauggaccucagaccugagaa

SEQ ID NO: 375715 - RNA, 64 nt, Human
acugugauccuuccaccuuggauggaagaggcuuaccugacagccagccugccugcugggagcc

SEQ ID NO: 375716 - RNA, 64 nt, Human
ucugaagggaggggaagagagaggccugggugugaccugacaccugccgcugcuugaguggaca

SEQ ID NO: 375717 - RNA, 64 nt, Human
aaaacagacagacaaguccagcagaagcagaugcaccugacaaaaauggauguauuaauuggcu

SEQ ID NO: 375718 - RNA, 64 nt, Human
agcucucgugacuuaaucaccuucuaaagaucucaccugacaacacuguugcauuggcaguuaa

SEQ ID NO: 375719 - RNA, 64 nt, Human
aaugugaugacuguacuucagguaucucugacauaccugacaauguuaaucugcaacugggauu

SEQ ID NO: 375720 - RNA, 64 nt, Human
gaguguccccagagacaugcaagucaugggucacaccugacaaauggaaggaguuccucuaaca

SEQ ID NO: 375721 - RNA, 64 nt, Human
uucgugucucucccaccccggccuccacucccccaccugacaauggcagcuagacuggagugag

SEQ ID NO: 375722 - RNA, 64 nt, Human
cucaggagcacaggcagcuggaugagacuuccaaaccugacagaugucagccgagccgggccug

SEQ ID NO: 375723 - RNA, 64 nt, Human
agcauuauaaacuaaaaugaaaaccaaaccagacaccugacauagagucuuuauuuuaccccaa

SEQ ID NO: 375724 - RNA, 64 nt, Human
gugaaaucucauuauacaaagagaaccuuaugcaaccugacaaaccacugaggucauggugacu

SEQ ID NO: 375725 - RNA, 64 nt, Human
acaaacugucaaaggguuaauacagaugacccagaccugacauuaaauccucuugauuagaaau

SEQ ID NO: 375726 - RNA, 64 nt, Human
gauuugugcugagaucaagaggcagguuagaagaaccugacauccacuguuugccuuggauagu

SEQ ID NO: 375727 - RNA, 64 nt, Human
ucaacagcaaucaugcaguuccagagacacaugaaccugacacaaucucucuuauccuugaggc

SEQ ID NO: 375728 - RNA, 64 nt, Human
guagugcucccaauccuauggccaugacugcugaaccugacaggcguguggggaguucacugug

SEQ ID NO: 375729 - RNA, 64 nt, Human
ggcaggaugggccauggaggugccccacccccacaccugacaaucacccacacuccuggggcuc

SEQ ID NO: 375730 - RNA, 64 nt, Human
ggacacacccagucucaaugcacgaaguuggagaaccugacagggcugguccaggccacagagg

SEQ ID NO: 375731 - RNA, 64 nt, Human
ggaggucuuuuaagucucuucccuuugguugcccaccugacaauuuuauuaaguacauuugaau

SEQ ID NO: 375732 - RNA, 64 nt, Human
ccaaaaaugcuuagauaaggccccuauacacaggaccugacauuuagcucaaugaugcguuugu

SEQ ID NO: 375733 - RNA, 64 nt, Human
ugucugcaucccugggccugugaaugaugacagcaccugacauucugcaccagcuaccucugcc

SEQ ID NO: 375734 - RNA, 64 nt, Human
aaaugaagauaaaaagccagauuguacaaaagucaccugacaaagacuagaugaagcuacaacu

SEQ ID NO: 375735 - RNA, 64 nt, Human
uacagaacugaagggaauauugaggcucaaugaaaccugacaaagagacuguaauauuguaguu

SEQ ID NO: 375736 - RNA, 64 nt, Human
aacccuucucccaucugccuucccuauccccuguaccugacaaucuaugaguuugcuucuuuau

SEQ ID NO: 375737 - RNA, 64 nt, Human
ccuuuuuggagauguaacuuuuagcaguuuguuaaccugacaucucugccagucuaguuucugg

SEQ ID NO: 375738 - RNA, 64 nt, Human
uuucuucuuugaguuaguaaagauuuauucuguaaccugacacucaucuggcccuuugcaguuu

SEQ ID NO: 375739 - RNA, 64 nt, Human
uucaaaagguauuuauugagcaccugcaggcgugaccugacagcccaaggguggguggggugag

SEQ ID NO: 375740 - RNA, 64 nt, Human
aauagagguauauuaauaccccucccucacucccaccugacacccccuuuuucaccacuccccu

SEQ ID NO: 375741 - RNA, 64 nt, Human
agucuguguagaaaggcugaggcaacggggaaagaccugacagcuaguuacauacgcucugaca

SEQ ID NO: 375742 - RNA, 64 nt, Human
agcugcuuuucauuuauuacuucuucuuuccaggaccugacagaagucagggaagagucccugg

SEQ ID NO: 375743 - RNA, 64 nt, Human
gugucacugcauccauugccaccuccuguucgugaccugacagggugacacagccccuuucaca

SEQ ID NO: 375744 - RNA, 64 nt, Human
agucuaccuuaccaauggggcaucuggcuaaacaaccugacaaacuguggccaggggaaccgac

SEQ ID NO: 375745 - RNA, 64 nt, Human
cacuaaacuuguuccuuucauuuacaaaagagauaccugacauccugagacacugagaaauguc

SEQ ID NO: 375746 - RNA, 64 nt, Human
aaauacucccacuaugccugaugugacgcuacuaaccugacaucaccaaguguggaauuggaga

SEQ ID NO: 375747 - RNA, 64 nt, Human
ugguauagcucugagcagggucacauuuggccaaaccugacacugucuugcugcauucuccuuu

SEQ ID NO: 375748 - RNA, 64 nt, Human
acauucaaaacuugagccuuggauguuccuguggaccugacaguuaaaaauauaaagaaccuag

SEQ ID NO: 375749 - RNA, 64 nt, Human
auuguagcaacuuugaaagguuaguguuuuauuuaccugacaaauggaaguuauagaagucuaa

SEQ ID NO: 375750 - RNA, 64 nt, Human
ccccaggaaccaggcuuugcugaggugcugcccaaccugacaguccaggagauggacuggcugg

SEQ ID NO: 375751 - RNA, 64 nt, Human
uugaugauuuggguuuuaauuuuguuuuuauugcaccugacaaaauacaguuaucugauggucc

SEQ ID NO: 375752 - RNA, 64 nt, Human
gguguggaggacugugacggcucugacuuuggcuaccugacaugcgagaccuaucucccugggu

SEQ ID NO: 375753 - RNA, 56 nt, Human
aaaaccauauuagagauuagccugggaccugacagugacaguggggguggguucuc

SEQ ID NO: 375754 - RNA, 64 nt, Human
uaaggcgcucgucggcaccugcugaaacgcccccaccugacagccccauccucaaagacugucu

SEQ ID NO: 375755 - RNA, 64 nt, Human
ugacacugcucuaacagcccuccucugcacucccaccugacacaccaggcgcuaauucaaggaa

SEQ ID NO: 375756 - RNA, 64 nt, Human
ucugacccuccccugcucgccucccucaccccacaccugacacagagcaggcacucaauaaaug

SEQ ID NO: 375757 - RNA, 64 nt, Human
uaaagauggaaggcugggcagacuggcuuuuguuaccugacaugccguagggugagcuuagagg

SEQ ID NO: 375758 - RNA, 64 nt, Human
aacuguauuauuuuguauagcuuuuuauuugcuuaccugacauuuuaugagagcuucauaguug

SEQ ID NO: 375759 - RNA, 64 nt, Human
cagcaaaacaacggaugaauguagcccuuccaacaccugacagaaugagaccaaacgcagccag

SEQ ID NO: 375760 - RNA, 64 nt, Human
agccaguggugacccugcuuuuguaaccgcguuaaccugacaaaaccucagcagcagaaguccc

SEQ ID NO: 375761 - RNA, 64 nt, Human
ccucgucaccugugaguugauguagaggagagccaccugacagcugaccaggugaagagaggau

SEQ ID NO: 375762 - RNA, 64 nt, Human
caugaguaugccacucuaucagcuacucugauuaaccugacagucggguuguuuagucaguacc

SEQ ID NO: 375763 - RNA, 64 nt, Human
aaagcagcguuccaaccugaggccaacccaucucaccugacacugaauacugccuugguagaaa

SEQ ID NO: 375764 - RNA, 64 nt, Human
uuuuuuuaagggaaugagaaugucauggugcuaaaccugacaaauaagagaucauugaaaugcu

SEQ ID NO: 375765 - RNA, 64 nt, Human
gagucaguaaccaaucccaccaaccacuccagcaaccugacaagacuaugaguaguucuccuuc

SEQ ID NO: 375766 - RNA, 64 nt, Human
guacuucagaugcgaaauggauauucgaguggaaaccugacaaagugcgccugcuuugauguga

SEQ ID NO: 375767 - RNA, 64 nt, Human
agugugugggcaaucagaagcauagccuugaaggaccugacagcaguaugaaaagauaaauagg

SEQ ID NO: 375768 - RNA, 64 nt, Human
uaucaccagauauucuagcuacaguuuuucaaccaccugacaccaauuuauggaaaaauaaagg

SEQ ID NO: 375769 - RNA, 64 nt, Human
cagauucaaguugguuaauuuuaguuauguaacaaccugacaugauggaggaaaacaaccuuua

SEQ ID NO: 375770 - RNA, 64 nt, Human
gaaagcagcucccuaacuucaaaaccauuuugguaccugacaacaagagcauuuuagaguaauu

SEQ ID NO: 375771 - RNA, 64 nt, Human
aagaauauuuugaccauaauacagcacagccuggaccugacaacuugucauuuggacuuuuuuu

SEQ ID NO: 375772 - RNA, 64 nt, Human
caaggucuuuguguuuucuuccucauggaauugaaccugacauuuucuggaucuccugcauguc

SEQ ID NO: 375773 - RNA, 64 nt, Human
gcaguguuucccgccuugggcuugcagcagaaaaaccugacaacauaguguuugcuaaggcagu

SEQ ID NO: 375774 - RNA, 64 nt, Human
cuagccucuugucacauguggugcacaaaccucaaccugacagcuuucagacagcauucuugca

SEQ ID NO: 375775 - RNA, 64 nt, Human
gaaaaaaacuuccuuagagguauuuauucucaauaccugacaggggcccaugggaaugacuuca

SEQ ID NO: 375776 - RNA, 64 nt, Human
uggccauugguaaauguuaggaacacaccaggucaccugacaucccaagaaugcucacaaaccu

SEQ ID NO: 375777 - RNA, 64 nt, Human
cucccccacaucucauagcaccagguugugucugaccugacauacccugcagcucucagcuggc

SEQ ID NO: 375778 - RNA, 64 nt, Human
gauggaugggaacgcaagagauacuuacauggaaaccugacaaugcaaaccuguugagaagauc

SEQ ID NO: 375779 - RNA, 64 nt, Human
ccuugagagguugugggaccucuggauccagcugaccugacaggucaucuacucagggaggagc

SEQ ID NO: 375780 - RNA, 64 nt, Human
uauuagucuguucucaugcugcuauuaaagacauaccugacacuggguaauuuauaaaggaaag

SEQ ID NO: 375781 - RNA, 64 nt, Human
cggagagaaggcccauaccuucugguugcuucagaccugacaccgucccucagugauacguaca

SEQ ID NO: 375782 - RNA, 64 nt, Human
accggggaggcccgggccagcagcucccagugugaccugacaaaaacacguaggggcagggacg

SEQ ID NO: 375783 - RNA, 64 nt, Human
uuuacuggguuaccagguucauacauugcugaggaccugacaggacaaccuaggggcagggcug

SEQ ID NO: 375784 - RNA, 64 nt, Human
gaaaacugcaauacaaguuucauccagaacuaccaccugacauuccuugcugaaacgcaucuag

SEQ ID NO: 375785 - RNA, 64 nt, Human
gcaaaaacaauguuuuuuaagauugagaauacauaccugacaacgauccggaaacugcuccuca

SEQ ID NO: 375786 - RNA, 64 nt, Human
aagaacugucauguaaacauaccaacauguuuaaaccugacaaugguguuauuugaaacuuuau

SEQ ID NO: 375787 - RNA, 64 nt, Human
uaucuugcaccuucuuuaaaacucacauaugcagaccugacacucaagaguggcuagcuacaca

SEQ ID NO: 375788 - RNA, 64 nt, Human
agaagagcuaggguaagagaaggacguaaacagaaccugacaccagcuccuuuuccuucuauac

SEQ ID NO: 375789 - RNA, 64 nt, Human
cuacaaccagagccccccacaaugaugauuaaacaccugacacaucuugcucuugugugucugu

SEQ ID NO: 375790 - RNA, 64 nt, Human
ggacugguugagggaguggggaggugguaagaacaccugacaacuucugaauauuggacauuuu

SEQ ID NO: 375791 - RNA, 64 nt, Human
aauaaguuaauugcuuuugcagguugacacucucaccugacagaugauguaauucuucaauuuu

SEQ ID NO: 375792 - RNA, 64 nt, Human
caacagcauuucuucucccugcaccuuuucgugaaccugacauuuugaacauaagcaauaacau

SEQ ID NO: 375793 - RNA, 64 nt, Human
gggaagccacugaagaugaguuugaccuguggugaccugacagagagaacauucagauccucag

SEQ ID NO: 375794 - RNA, 64 nt, Human
acaacugauccgugugugaggugggaguacugcaaccugacacaaugcucagaaacagaaucag

SEQ ID NO: 375795 - RNA, 64 nt, Human
acgauggaucccaaagucagaugggaguacugcaaccugacacgaugcucagacacagaaggga

SEQ ID NO: 375796 - RNA, 64 nt, Human
acaacggaucccaaagucaggugggaguacugcaaccugacaggaugcucagacaagaauaggg

SEQ ID NO: 375797 - RNA, 64 nt, Human
ucugagacagcccuguccgccccgcccaggugggaccugacauacaggcggcuccagcccuggg

SEQ ID NO: 375798 - RNA, 64 nt, Human
ucagucuaguucuguuaucuguugauuucccaucaccugacaguaacuuucaugacauaggauu

SEQ ID NO: 375799 - RNA, 64 nt, Human
ggugaagaaaacuccuuuagcaggugguccugagaccugacaagcacugcuaggcgagugccag

SEQ ID NO: 375800 - RNA, 64 nt, Human
cagggcccaauucuagacauaaaacaaaggauauaccugacagacuacuucuggaaaagguuuu

SEQ ID NO: 375801 - RNA, 64 nt, Human
gaagaaaaacuagcuguggcauuccagguggagaaccugacagaggacuaagaaguuaucuaau

SEQ ID NO: 375802 - RNA, 64 nt, Human
uuucaccuucgccuacuaugaaaugucucaucagaccugacaugucugagauaaccaaggugau

SEQ ID NO: 375803 - RNA, 64 nt, Human
aggguggggcccccacuuuuuaccaaacuaguaaaccugacauuccaggcccaugaggggaaag

SEQ ID NO: 375804 - RNA, 64 nt, Human
cuagauguuuugucuucucuuuucugcacuuaauaccugacaguaugaccgaucucugcgccuu

SEQ ID NO: 375805 - RNA, 64 nt, Human
ccuuccuuauaggccaaaaagcaaauggauuuccaccugacaaaucuucgggauccaagaagca

SEQ ID NO: 375806 - RNA, 64 nt, Human
ugagauguuaacuuaguaaaauaguuugauuuuuaccugacaguguuugucaaauuuaaaauca

SEQ ID NO: 375807 - RNA, 64 nt, Human
accacacaccuauaauuuuuuugaucuucgaugaaccugacaaaaacaagcaaugggcaaugga

SEQ ID NO: 375808 - RNA, 64 nt, Human
cugugucacauuagguaccaugggagcugcugagaccugacauuuuguccccugccuacauggc

SEQ ID NO: 375809 - RNA, 64 nt, Human
cccuagaggguugcauagucuagaaaggagugugaccugacagugcuggagccuccuaguuucc

SEQ ID NO: 375810 - RNA, 64 nt, Human
aauuuaaaagacauaagacuaaauuacaccuuagaccugacaucuggcuaucacacagacagaa

SEQ ID NO: 375811 - RNA, 64 nt, Human
aaaugcucucugucuuagcaggagaauggcccaaaccugacauggacaagcauuguuuggaaag

SEQ ID NO: 375812 - RNA, 64 nt, Human
cacaccuacaaaugcuucacucuguccuuccgagaccugacaagcuuugaggaccucacagcuc

SEQ ID NO: 375813 - RNA, 64 nt, Human
agaaccuagagccaguuuucaggaacaauuguaaaccugacaugguacugugcaucuauucaua

SEQ ID NO: 375814 - RNA, 64 nt, Human
auacauagcauuaaaucccaaauccuauuuaaagaccugacagcuugagaaggucacuacugca

SEQ ID NO: 375815 - RNA, 64 nt, Human
uuaagauguguuuugauuugguguucagaaagcaaccugacaaugauaauacuguaacuaugau

SEQ ID NO: 375816 - RNA, 64 nt, Human
guggaaauguuucagauuaaaugauaguaaaaacaccugacaacuaaacauaguaaguaauacu

SEQ ID NO: 375817 - RNA, 64 nt, Human
augaagcguuuucucagcuuuuggaauugcuucgaccugacauccguuguaaccguuugccacu

SEQ ID NO: 375818 - RNA, 64 nt, Human
cagacccggggaaugguguggugcuaaucucaacaccugacauucacagcaagcauggcccagc

SEQ ID NO: 375819 - RNA, 64 nt, Human
acugggcuguguccugauuccucagaguauggggaccugacaucuuuggguccccaagaguugg

SEQ ID NO: 375820 - RNA, 64 nt, Human
ggcuccacccccaccuccaggaggggaggagaggaccugacaucuguagguggccccugaugcc

SEQ ID NO: 375821 - RNA, 64 nt, Human
cuaagacauuaccaagguuuguacaaauucuacuaccugacauuuauuccaagaagaucuggaa

SEQ ID NO: 375822 - RNA, 64 nt, Human
auucugggcagugcccagccaccggcugacccacaccugacacuuccagccagucugcugccug

SEQ ID NO: 375823 - RNA, 64 nt, Human
cuggugaggagguaaagcaggcccagugaaauggaccugacagcccaaacugucagagaggagg

SEQ ID NO: 375824 - RNA, 64 nt, Human
agccugggaaccuucucccucguacagcacaggaaccugacacauaguaggcacacaguaaacg

SEQ ID NO: 375825 - RNA, 64 nt, Human
caggccagaggcaagaaccugggcuguaacugccaccugacaccgcugacuggcuaaaugcuuu

SEQ ID NO: 375826 - RNA, 64 nt, Human
guuuggccaaugugcauaaccuacucggauccccaccugacacuaaccagagucagcacaggcc

SEQ ID NO: 375827 - RNA, 64 nt, Human
gacaaggggacggaguccaaggcguuauugggccaccugacagcuggacagaaaaggggcagac

SEQ ID NO: 375828 - RNA, 64 nt, Human
gagaaauacaagaugagccugaaucaucucauguaccugacaguaagaaaauacucuggcuggu

SEQ ID NO: 375829 - RNA, 64 nt, Human
ggacauuggagugggcaaagauuucuuguguaauaccugacaaacaggcaaccaaagcaaaagu

SEQ ID NO: 375830 - RNA, 64 nt, Human
agauauuccacaggacaugccacuuuauuauaaaaccugacacaggcauaguaccaaguauuuc

SEQ ID NO: 375831 - RNA, 64 nt, Human
aguuauuuauuggcuggagauggaaaaucacaccaccugacaggccuucugggccuccaaagcc

SEQ ID NO: 375832 - RNA, 64 nt, Human
uccuuuguacuuugugcuuguauagguuuuaaagaccugacaccuuucauaaucuuugcuuuau

SEQ ID NO: 375833 - RNA, 64 nt, Human
cagaaaccuuuaauccaggccuaaauuugcauagaccugacauucagcugccuugcaguugcuu

SEQ ID NO: 375834 - RNA, 64 nt, Human
aaacacaagugagaaacccuagaugggcacugccaccugacacagcuauacagcaggaccugaa

SEQ ID NO: 375835 - RNA, 64 nt, Human
uuucacaaaguauuuuucaaucagaguuuucagaaccugacauuguuaaagauacugcuugucc

SEQ ID NO: 375836 - RNA, 64 nt, Human
cucaucugucccuccgggaccuggugcugccucuaccugacacucccuugggcucccuguaacc

SEQ ID NO: 375837 - RNA, 64 nt, Human
gccuuuuauacaaaaccaaauuaacuuaccuaauaccugacaccucuuugggcucugaacugcu

SEQ ID NO: 375838 - RNA, 64 nt, Human
gaucagggauaggggcagguuguauggcagaugcaccugacagcaauaacuuaagcauccccug

SEQ ID NO: 375839 - RNA, 64 nt, Human
cagguagcuacacagaaucuacacagcaaaguuaaccugacacagaaaauccuugugcaaauaa

SEQ ID NO: 375840 - RNA, 64 nt, Human
uggacuaaccccaacgcacaggaaaagguagcuuaccugacacaagaggaauaagaauggagca

SEQ ID NO: 375841 - RNA, 64 nt, Human
ggucccucaaggucuucgaauagauguuuaucuaaccugacaguugcaguuuucacccauggaa

SEQ ID NO: 375842 - RNA, 64 nt, Human
cucuaguucaaguucaccagacucuauaaauaaaaccugacagaccaugacuuucucugcuuug

SEQ ID NO: 375843 - RNA, 64 nt, Human
agggccccacucuccuccccucauuaaaccauccaccugacaccagcacaucaggccugguuca

SEQ ID NO: 375844 - RNA, 64 nt, Human
ccaggggacuggaggcaggaugguggcuuucccuaccugacacagccauggcccagccccaagg

SEQ ID NO: 375845 - RNA, 64 nt, Human
cugaggagcugucacagagagggccucagcucugaccugacaccugcucuccccagccuguuuu

SEQ ID NO: 375846 - RNA, 64 nt, Human
cuuucuucagcucugaaagagaaacacguaucccaccugacauguccuucugagcccgguaaga

SEQ ID NO: 375847 - RNA, 64 nt, Human
gugcaagguuauuugcaggcagggaugggcuuguaccugacagcacccaccccuguguggcccc

SEQ ID NO: 375848 - RNA, 64 nt, Human
agccugcccccagagacgucccugccccuccaggaccugacagccccucccauccuggccaccc

SEQ ID NO: 375849 - RNA, 64 nt, Human
gggcguuagcugaagacaugucugucccaccuguaccugacacagaagcuggggagccuaggag

SEQ ID NO: 375850 - RNA, 64 nt, Human
gaaaggacuccuccuuuuuccaugcccuaaacagaccugacaggugaggucuguuccuuuuaua

SEQ ID NO: 375851 - RNA, 64 nt, Human
aagacaaaaacaaaacaacaacaacaacacacaaaccugacaagagaaaaacaaaccugaagcu

SEQ ID NO: 375852 - RNA, 64 nt, Human
caaaauagaaguaaauuaaaguuguacauuggacaccugacaacccucugccaugaccgagacc

SEQ ID NO: 375853 - RNA, 64 nt, Human
uagcuccuaccugaagaggaaagggggccauuugaccugacaugucaggaaagcccuaaacuga

SEQ ID NO: 375854 - RNA, 64 nt, Human
ugcagcucacuaccaacagccucaugugcacuugaccugacagugcucgcugagaacucucacc

SEQ ID NO: 375855 - RNA, 64 nt, Human
gaauuuuccuuuccugugggcaugcuguauucagaccugacagaucuuugauagaggucagcuu

SEQ ID NO: 375856 - RNA, 64 nt, Human
cagagauuugggguuggggaaagggccccuccccaccugacacccacuggggugcacuuuaaug

SEQ ID NO: 375857 - RNA, 64 nt, Human
uuugugaguugcucaguaguaaaaacuggcccuuaccugacagagcccuggcuuugaccugcuc

SEQ ID NO: 375858 - RNA, 64 nt, Human
cucccucccccaaaccuguuuacagucaauuauaaccugacaaacgagacuuuuguaacauauu

SEQ ID NO: 375859 - RNA, 64 nt, Human
acacucuugggugauuucauggacccuaaagcagaccugacacugauccagauuugcaguccau

SEQ ID NO: 375860 - RNA, 64 nt, Human
uuccuauugggcgaauucccucaaacucuauuugaccugacagccauacguauuccccucuggu

SEQ ID NO: 375861 - RNA, 64 nt, Human
aaauaaaguuuuguagugggaccagaaauuacuuaccugacauccacccccauucccccucauc

SEQ ID NO: 375862 - RNA, 64 nt, Human
auccuauccaaagcugauucacaaacccacgcucaccugacagccgagggacacgagcaucacu

SEQ ID NO: 375863 - RNA, 64 nt, Human
cugagaacuagugauuauauauuuuucuguauuuaccugacauuuauuuuaauguucaaaaagu

SEQ ID NO: 375864 - RNA, 64 nt, Human
uuuucuuuccuuucauuuuuuuucuuuguaaugcaccugacagaaaaaaaagaaaaaugaauuu

SEQ ID NO: 375865 - RNA, 64 nt, Human
cuuggcuuucccgugcucuuugggcuccccagagaccugacaguauuagggagugaagggagga

SEQ ID NO: 375866 - RNA, 64 nt, Human
cacauguauacacaauugucucuuauguacuccuaccugacaguagucuuuguauucuauagua

SEQ ID NO: 375867 - RNA, 64 nt, Human
gugaucucucaucuagcauggacccuguucugagaccugacaaagaguuuuuuuucaugcccca

SEQ ID NO: 375868 - RNA, 64 nt, Human
auacauuccacaaagccauuuucuuuuugugcaaaccugacauguucaaauauauucacaaugg

SEQ ID NO: 375869 - RNA, 64 nt, Human
cacauauuugugguaaacauuucuguauaaaguuaccugacacacauauaaacacaaggaacau

SEQ ID NO: 375870 - RNA, 64 nt, Human
cagucuuccagcuuguaaaugccauugacuucugaccugacauuuaguauaauaaaaaugaaau

SEQ ID NO: 375871 - RNA, 64 nt, Human
gugcuggaugaguggcugccucaguagcaaaacuaccugacaguauuugacaguguccuuucca

SEQ ID NO: 375872 - RNA, 64 nt, Human
gcuugaggcuaccucuaccuucaaauaaagauagaccugacaauuugugauaucuaauaauaac

SEQ ID NO: 375873 - RNA, 64 nt, Human
auugaaauauucccccaaaauauucucagacuaaaccugacauagggaacaccgagaaugaaaa

SEQ ID NO: 375874 - RNA, 64 nt, Human
acucagguccugaugagggcguugugggagcuguaccugacaggccuucugaggaagccaagac

SEQ ID NO: 375875 - RNA, 64 nt, Human
aucuaaauagugacugcuuugccauuucauucaaaccugacaagucuaucucuaagagccgcca

SEQ ID NO: 375876 - RNA, 64 nt, Human
cugauccucuugacccuucugggaauguuugcacaccugacacucuugugagacuggcuuaugg

SEQ ID NO: 375877 - RNA, 64 nt, Human
agaaugagauuccuugugugaaaauagcuauuauaccugacacacucaucguaugggcucugca

SEQ ID NO: 375878 - RNA, 64 nt, Human
acgcgugccggcgggaggagccacgcgugagcacaccugacacguuuuauaauagacuagccac

SEQ ID NO: 375879 - RNA, 64 nt, Human
aagucugauggccaccugagugcaggugacaaggaccugacagagcccaugcagggcuuuagau

SEQ ID NO: 375880 - RNA, 64 nt, Human
cuugauugauaaagauccugccucugcugaguguaccugacaguagucuaagaugagagaguuu

SEQ ID NO: 375881 - RNA, 64 nt, Human
gaugaggcuggacuccuguccccgcgggccgcucaccugacauguggaccugcagcuuuguccc

SEQ ID NO: 375882 - RNA, 64 nt, Human
cagacuucagaaacaaaucucagaagacaagcugaccugacaaguacuaugugugugcaugucu

SEQ ID NO: 375883 - RNA, 64 nt, Human
ggacuuggacaacucagauuaucugaagacacaaaccugacaggagggagaagaaaaaacaaaa

SEQ ID NO: 375884 - RNA, 64 nt, Human
caucucaguuggccaccuuccuggcaggcuguagaccugacauuuugagacaagccuagaggag

SEQ ID NO: 375885 - RNA, 64 nt, Human
ugguucccagagccccucccguugugccgcuucgaccugacaccugcucgaugcugacuuaggc

SEQ ID NO: 375886 - RNA, 64 nt, Human
gacccaugaccguucucugaggcaaaggagggcaaccugacagcaaacacagucacuguugguu

SEQ ID NO: 375887 - RNA, 64 nt, Human
caggaguagggacaggaaggacaggggaugccugaccugacagguggcuucaggccucgggaau

SEQ ID NO: 375888 - RNA, 64 nt, Human
uaguggcuuugugaaggaaagaaaccauuaaaugaccugacaaaaacugacucaugucuuuaaa

SEQ ID NO: 375889 - RNA, 64 nt, Human
ucggccagagucuguuucaggagcggcgcccugcaccugacagcuuuaucuccccaggagcagc

SEQ ID NO: 375890 - RNA, 64 nt, Human
cuaauacagaauaagcaauauggugugcauguaaaccugacacagacaaaauaaaaacaguuaa

SEQ ID NO: 375891 - RNA, 64 nt, Human
gcugacggguggccucucaccccccucuagagaaaccugacauuuacaauggauuguauuuguc

SEQ ID NO: 375892 - RNA, 64 nt, Human
uuuuuaggcuggacagcgucccgccacagcuacuaccugacacugagcucaugcagagagauga

SEQ ID NO: 375893 - RNA, 64 nt, Human
cuuuuuagggcgugugcagggcuggggccaguggaccugacaguaccuuaccuggcucugagaa

SEQ ID NO: 375894 - RNA, 64 nt, Human
uguaauggcuuauggggaacauugugagcuuccuaccugacauguuggcagaaguagaauauua

SEQ ID NO: 375895 - RNA, 64 nt, Human
gccgcccauuccuggcccucccgcugcaucucagaccugacacccaacggggggaugugguggc

SEQ ID NO: 375896 - RNA, 64 nt, Human
aaauaaaggcauacaugaaaaugccuggcaaauuaccugacacagagcagacauucaauacauu

SEQ ID NO: 375897 - RNA, 64 nt, Human
ucuuagugggagaaugagagagagcuguagugucaccugacauuccccaaaccuugugaagcac

SEQ ID NO: 375898 - RNA, 64 nt, Human
gggaccgaugcugugcagcucacaccacuccagaaccugacaaggcaccagcaggaccccuugc

SEQ ID NO: 375899 - RNA, 64 nt, Human
acagacugauagcagaaaaaguacaggcugagcgaccugacaccauguuggggguugugugugg

SEQ ID NO: 375900 - RNA, 64 nt, Human
gagcccaggggaggggagggagcgaggggcucacaccugacauguauucgccuccagggggcgc

SEQ ID NO: 375901 - RNA, 64 nt, Human
gggaguccuuggccagggucucugacucugugucaccugacauuugcccaugagagccgcuggg

SEQ ID NO: 375902 - RNA, 64 nt, Human
caugggucauuccccacaagagccacauccucacaccugacagaugcacggcccaaggggcugc

SEQ ID NO: 375903 - RNA, 64 nt, Human
agagaugcaggacauacacauuauucaagagaccaccugacaugcaucuccuccgcaggaauac

SEQ ID NO: 375904 - RNA, 64 nt, Human
gacauacuuaaucauauaucucuccagagaacucaccugacaaaugucucugagcacaggcuga

SEQ ID NO: 375905 - RNA, 64 nt, Human
agaacuuacaagagccacaggagccaauuauagcaccugacagaauacuucuccucuuccucac

SEQ ID NO: 375906 - RNA, 64 nt, Human
ggaaagccucuaaggaaaggaugcaugagcuaacaccugacauuaaagaagcaagccaagugag

SEQ ID NO: 375907 - RNA, 64 nt, Human
aaauuucagauuuuggaaugggcuuauuuaacugaccugacaaucuugaugauuuccauuagaa

SEQ ID NO: 375908 - RNA, 64 nt, Human
uuaucuugucacuguaguuugguuuuauuugaaaaccugacaaaaaaaaaguuccaggugugga

SEQ ID NO: 375909 - RNA, 64 nt, Human
auuacaggcaugagccaccacaccuggcaaggguaccugacauucuaagauaucaagacacuua

SEQ ID NO: 375910 - RNA, 64 nt, Human
uccagaugggaaaggcagggucguaucuguggggaccugacaagggcaggggaagcggagacca

SEQ ID NO: 375911 - RNA, 64 nt, Human
ccuaugaauguaagcaguaugggaaagcguucagaccugacaagauucuuugaauacagauaau

SEQ ID NO: 375912 - RNA, 64 nt, Human
gggcugucaauaacccccuuccucacuggccaccaccugacaucagcaccagugacaggcuggu

SEQ ID NO: 375913 - RNA, 64 nt, Human
ugccacauaucuacaacuaucugaccuuugacaaaccugacaaaaacaagcaauggggaaagga

SEQ ID NO: 375914 - RNA, 64 nt, Human
uggagcgauggaauccggccaggacuccccuggcaccugacaucucccacgcuccaccugcgcg

SEQ ID NO: 375915 - RNA, 64 nt, Human
auucaugaauauaugugaacucaguguauguuagaccugacaucaugaauuaguagggaaauga

SEQ ID NO: 375916 - RNA, 64 nt, Human
cagcgggcgcaggaagugacuucccacccccaggaccugacacaucucgucuccccucuuuucc

SEQ ID NO: 375917 - RNA, 64 nt, Human
cgagagguagccccacucuaaggggagcagggggaccugacagcacaccacugucuuccccagu

SEQ ID NO: 375918 - RNA, 64 nt, Human
cccggcugugccaucuuguguaugggcagauaugaccugacagcccccuccagugccacagggu

SEQ ID NO: 375919 - RNA, 64 nt, Human
gauucuaugaggccagcaucauucuaauaccaaaaccugacaggcacaaugaaaaaagaaaacu

SEQ ID NO: 375920 - RNA, 64 nt, Human
acaggacuggaagaagauguuugcucuaagguacaccugacaaaggaacucucauagaaaauau

SEQ ID NO: 375921 - RNA, 64 nt, Human
ucacacaccuguugucagcaucgagccaacaccaaccugacaagguucggagugaugggggcgg

SEQ ID NO: 375922 - RNA, 64 nt, Human
gccccgcucucaguugagagcgaaggagaaauaaaccugacauguuggugcuugggccuggagu

SEQ ID NO: 375923 - RNA, 64 nt, Human
cuggagggugugcaccucuuccucacugcacggaaccugacaguggucaacuacucaagcauca

SEQ ID NO: 375924 - RNA, 61 nt, Human
gggcggagaugcagucuuagaggcccuggacaccugacaaagagacagaguccccacuagc

SEQ ID NO: 375925 - RNA, 64 nt, Human
caacucgauguaaauuucaugggaaaacccuuguaccugacaugugagccacucagaacucacc

SEQ ID NO: 375926 - RNA, 64 nt, Human
aauugcagcaaaaaccgcaauuacuuuugcuccaaccugacagcuagguaucuagcuagcuaga

SEQ ID NO: 375927 - RNA, 64 nt, Human
aguuauuuaugaaugaugucgugauucucccuccaccugacaguuuguaagagugaaagagcau

SEQ ID NO: 375928 - RNA, 64 nt, Human
ucagaguuaucccaaagucugagccaccagccacaccugacaggggugagaaguccucgcugug

SEQ ID NO: 375929 - RNA, 64 nt, Human
cgagguacuggcugcagagucgccuuaguccagaaccugacaggccucuggagccaggcgacuu

SEQ ID NO: 375930 - RNA, 64 nt, Human
uugcugugugugagggcccagguggaaggcgcggaccugacagcauuccaauaaagcauacggg

SEQ ID NO: 375931 - RNA, 64 nt, Human
gggggagaaauccuugagccagggcugccauauaaccugacaggaacaugcuacugaaguuuau

SEQ ID NO: 375932 - RNA, 64 nt, Human
ucagcuguauuugugugugugugugugugugagcaccugacaaaucuaugaaaccgagugaaag

SEQ ID NO: 375933 - RNA, 64 nt, Human
uuuuuuuuugccaacccugugucacuuagugaggaccugacacaaucccuacagggugucuguc

SEQ ID NO: 375934 - RNA, 64 nt, Human
cuggguaaucagccaaguucauuuucuggcuccaaccugacauugaaugaugacuggaauaaag

SEQ ID NO: 375935 - RNA, 64 nt, Human
acacauuucugguuuauaaucuccuuuuaugcucaccugacauuaauuaucuauccuugaugau

SEQ ID NO: 375936 - RNA, 64 nt, Human
ggacugggccggcugccucccagcgaugcacuugaccugacacuccccauguccuggugcgcac

SEQ ID NO: 375937 - RNA, 64 nt, Human
auuuuacguugaguccauuuuuaauguucugaucaccugacagggcaccccaaacccccaacuc

SEQ ID NO: 375938 - RNA, 64 nt, Human
cccuccgugucgccucgggugcgaaaucagacccaccugacaccaucacgcggaggcccagcag

SEQ ID NO: 375939 - RNA, 64 nt, Human
cuagugaaggggcaaaccugagauuucuccguggaccugacagccaaggcagggcacugucucc

SEQ ID NO: 375940 - RNA, 64 nt, Human
cccaguuuuuugacacuaaugcuguuugggucuuaccugacacacaccagugugcaagaaaugu

SEQ ID NO: 375941 - RNA, 64 nt, Human
cuggcuguaaccccaaauccaagccauuaacuacaccugacaguagcaauugucugauuaauca

SEQ ID NO: 375942 - RNA, 64 nt, Human
guauguuuguguguguguguguuuguguguguauaccugacauauauaguagauauauauaccu

SEQ ID NO: 375943 - RNA, 64 nt, Human
ucuuauuuuaaauaagacuaaguauaggcauuguaccugacauugcuacguuucuaccaguguu

SEQ ID NO: 375944 - RNA, 64 nt, Human
uugcugagagccauuuuccuuuacacauaacuacaccugacaccaggcucugcuggaugugagu

SEQ ID NO: 375945 - RNA, 64 nt, Human
uagcuuuuaacugauuauaacaaugcacacacauaccugacacacuguuaaauuuucuucucuu

SEQ ID NO: 375946 - RNA, 64 nt, Human
uuguucccagaccugcgcacacagcauuucagccaccugacaaucuccuuggagucaaagcucc

SEQ ID NO: 375947 - RNA, 64 nt, Human
uggucaugugaugcuauguguuaccuugggacuuaccugacagcucuuaccaacaagaaggcca

SEQ ID NO: 375948 - RNA, 64 nt, Human
guaaaaagugacggauuuucucuuucuuaaacuuaccugacacuuaaccagaguaccaguucuc

SEQ ID NO: 375949 - RNA, 64 nt, Human
guuucucaucuccauggacaucuucaacagcuucaccugacaacgacuguuccuaugaagaagc

SEQ ID NO: 375950 - RNA, 64 nt, Human; identical to SEQ ID NO: 38790

SEQ ID NO: 375951 - RNA, 64 nt, Human; identical to SEQ ID NO: 38791

SEQ ID NO: 375952 - RNA, 64 nt, Human; identical to SEQ ID NO: 38792

SEQ ID NO: 375953 - RNA, 64 nt, Human; identical to SEQ ID NO: 38793

SEQ ID NO: 375954 - RNA, 64 nt, Human; identical to SEQ ID NO: 38794

SEQ ID NO: 375955 - RNA, 64 nt, Human; identical to SEQ ID NO: 38795

SEQ ID NO: 375956 - RNA, 64 nt, Human; identical to SEQ ID NO: 38796

SEQ ID NO: 375957 - RNA, 64 nt, Human; identical to SEQ ID NO: 38797

SEQ ID NO: 375958 - RNA, 64 nt, Human; identical to SEQ ID NO: 38798

SEQ ID NO: 375959 - RNA, 64 nt, Human; identical to SEQ ID NO: 38799

SEQ ID NO: 375960 - RNA, 64 nt, Human; identical to SEQ ID NO: 38800

SEQ ID NO: 375961 - RNA, 64 nt, Human; identical to SEQ ID NO: 38801

SEQ ID NO: 375962 - RNA, 64 nt, Human; identical to SEQ ID NO: 38802

SEQ ID NO: 375963 - RNA, 64 nt, Human; identical to SEQ ID NO: 38803

SEQ ID NO: 375964 - RNA, 64 nt, Human; identical to SEQ ID NO: 38804

SEQ ID NO: 375965 - RNA, 64 nt, Human; identical to SEQ ID NO: 38805

SEQ ID NO: 375966 - RNA, 64 nt, Human; identical to SEQ ID NO: 38806

SEQ ID NO: 375967 - RNA, 64 nt, Human; identical to SEQ ID NO: 38807

SEQ ID NO: 375968 - RNA, 64 nt, Human; identical to SEQ ID NO: 38808

SEQ ID NO: 375969 - RNA, 64 nt, Human; identical to SEQ ID NO: 38809

SEQ ID NO: 375970 - RNA, 64 nt, Human; identical to SEQ ID NO: 38810

SEQ ID NO: 375971 - RNA, 64 nt, Human; identical to SEQ ID NO: 38811

SEQ ID NO: 375972 - RNA, 64 nt, Human; identical to SEQ ID NO: 38812

SEQ ID NO: 375973 - RNA, 64 nt, Human; identical to SEQ ID NO: 38813

SEQ ID NO: 375974 - RNA, 64 nt, Human; identical to SEQ ID NO: 38814

SEQ ID NO: 375975 - RNA, 64 nt, Human; identical to SEQ ID NO: 38815

SEQ ID NO: 375976 - RNA, 64 nt, Human; identical to SEQ ID NO: 38816

SEQ ID NO: 375977 - RNA, 64 nt, Human; identical to SEQ ID NO: 38817

SEQ ID NO: 375978 - RNA, 64 nt, Human; identical to SEQ ID NO: 38818

SEQ ID NO: 375979 - RNA, 64 nt, Human; identical to SEQ ID NO: 38819

SEQ ID NO: 375980 - RNA, 64 nt, Human; identical to SEQ ID NO: 38820

SEQ ID NO: 375981 - RNA, 64 nt, Human; identical to SEQ ID NO: 38821

SEQ ID NO: 375982 - RNA, 64 nt, Human; identical to SEQ ID NO: 38822

SEQ ID NO: 375983 - RNA, 64 nt, Human; identical to SEQ ID NO: 38823

SEQ ID NO: 375984 - RNA, 64 nt, Human; identical to SEQ ID NO: 38824

SEQ ID NO: 375985 - RNA, 64 nt, Human; identical to SEQ ID NO: 38825

SEQ ID NO: 375986 - RNA, 64 nt, Human; identical to SEQ ID NO: 38826

SEQ ID NO: 375987 - RNA, 64 nt, Human; identical to SEQ ID NO: 38827

SEQ ID NO: 375988 - RNA, 64 nt, Human; identical to SEQ ID NO: 38828

SEQ ID NO: 375989 - RNA, 64 nt, Human; identical to SEQ ID NO: 38829

SEQ ID NO: 375990 - RNA, 64 nt, Human; identical to SEQ ID NO: 38830

SEQ ID NO: 375991 - RNA, 64 nt, Human; identical to SEQ ID NO: 38831

SEQ ID NO: 375992 - RNA, 64 nt, Human; identical to SEQ ID NO: 38832

SEQ ID NO: 375993 - RNA, 64 nt, Human; identical to SEQ ID NO: 38833

SEQ ID NO: 375994 - RNA, 64 nt, Human; identical to SEQ ID NO: 38834

SEQ ID NO: 375995 - RNA, 64 nt, Human; identical to SEQ ID NO: 38835

SEQ ID NO: 375996 - RNA, 64 nt, Human; identical to SEQ ID NO: 38836

SEQ ID NO: 375997 - RNA, 64 nt, Human; identical to SEQ ID NO: 38837

SEQ ID NO: 375998 - RNA, 64 nt, Human; identical to SEQ ID NO: 38838

SEQ ID NO: 375999 - RNA, 64 nt, Human; identical to SEQ ID NO: 38839

SEQ ID NO: 376000 - RNA, 64 nt, Human; identical to SEQ ID NO: 38840

SEQ ID NO: 376001 - RNA, 64 nt, Human; identical to SEQ ID NO: 38841

SEQ ID NO: 376002 - RNA, 64 nt, Human; identical to SEQ ID NO: 38842

SEQ ID NO: 376003 - RNA, 55 nt, Human; identical to SEQ ID NO: 38843

SEQ ID NO: 376004 - RNA, 64 nt, Human; identical to SEQ ID NO: 38844

SEQ ID NO: 376005 - RNA, 64 nt, Human; identical to SEQ ID NO: 38845

SEQ ID NO: 376006 - RNA, 64 nt, Human; identical to SEQ ID NO: 38846

SEQ ID NO: 376007 - RNA, 64 nt, Human; identical to SEQ ID NO: 38847

SEQ ID NO: 376008 - RNA, 64 nt, Human; identical to SEQ ID NO: 38848

SEQ ID NO: 376009 - RNA, 64 nt, Human; identical to SEQ ID NO: 38849

SEQ ID NO: 376010 - RNA, 64 nt, Human; identical to SEQ ID NO: 38850

SEQ ID NO: 376011 - RNA, 64 nt, Human; identical to SEQ ID NO: 38851

SEQ ID NO: 376012 - RNA, 64 nt, Human; identical to SEQ ID NO: 38852

SEQ ID NO: 376013 - RNA, 64 nt, Human; identical to SEQ ID NO: 38853

SEQ ID NO: 376014 - RNA, 64 nt, Human; identical to SEQ ID NO: 38854

SEQ ID NO: 376015 - RNA, 64 nt, Human; identical to SEQ ID NO: 38855

SEQ ID NO: 376016 - RNA, 64 nt, Human; identical to SEQ ID NO: 38856

SEQ ID NO: 376017 - RNA, 64 nt, Human; identical to SEQ ID NO: 38857

SEQ ID NO: 376018 - RNA, 64 nt, Human; identical to SEQ ID NO: 38858

SEQ ID NO: 376019 - RNA, 64 nt, Human; identical to SEQ ID NO: 38859

SEQ ID NO: 376020 - RNA, 64 nt, Human; identical to SEQ ID NO: 38860

SEQ ID NO: 376021 - RNA, 64 nt, Human; identical to SEQ ID NO: 38861

SEQ ID NO: 376022 - RNA, 64 nt, Human; identical to SEQ ID NO: 38862

SEQ ID NO: 376023 - RNA, 64 nt, Human; identical to SEQ ID NO: 38863

SEQ ID NO: 376024 - RNA, 64 nt, Human; identical to SEQ ID NO: 38864

SEQ ID NO: 376025 - RNA, 64 nt, Human; identical to SEQ ID NO: 38865

SEQ ID NO: 376026 - RNA, 64 nt, Human; identical to SEQ ID NO: 38866

SEQ ID NO: 376027 - RNA, 64 nt, Human; identical to SEQ ID NO: 38867

SEQ ID NO: 376028 - RNA, 64 nt, Human; identical to SEQ ID NO: 38868

SEQ ID NO: 376029 - RNA, 64 nt, Human; identical to SEQ ID NO: 38869

SEQ ID NO: 376030 - RNA, 64 nt, Human; identical to SEQ ID NO: 38870

SEQ ID NO: 376031 - RNA, 64 nt, Human; identical to SEQ ID NO: 38871

SEQ ID NO: 376032 - RNA, 64 nt, Human; identical to SEQ ID NO: 38872

SEQ ID NO: 376033 - RNA, 64 nt, Human; identical to SEQ ID NO: 38873

SEQ ID NO: 376034 - RNA, 64 nt, Human; identical to SEQ ID NO: 38874

SEQ ID NO: 376035 - RNA, 64 nt, Human; identical to SEQ ID NO: 38875

SEQ ID NO: 376036 - RNA, 64 nt, Human; identical to SEQ ID NO: 38876

SEQ ID NO: 376037 - RNA, 64 nt, Human; identical to SEQ ID NO: 38877

SEQ ID NO: 376038 - RNA, 64 nt, Human; identical to SEQ ID NO: 38878

SEQ ID NO: 376039 - RNA, 64 nt, Human; identical to SEQ ID NO: 38879

SEQ ID NO: 376040 - RNA, 64 nt, Human; identical to SEQ ID NO: 38880

SEQ ID NO: 376041 - RNA, 64 nt, Human; identical to SEQ ID NO: 38881

SEQ ID NO: 376042 - RNA, 64 nt, Human; identical to SEQ ID NO: 38882

SEQ ID NO: 376043 - RNA, 64 nt, Human; identical to SEQ ID NO: 38883

SEQ ID NO: 376044 - RNA, 64 nt, Human; identical to SEQ ID NO: 38884

SEQ ID NO: 376045 - RNA, 64 nt, Human; identical to SEQ ID NO: 38885

SEQ ID NO: 376046 - RNA, 64 nt, Human; identical to SEQ ID NO: 38886

SEQ ID NO: 376047 - RNA, 64 nt, Human; identical to SEQ ID NO: 38887

SEQ ID NO: 376048 - RNA, 64 nt, Human; identical to SEQ ID NO: 38888

SEQ ID NO: 376049 - RNA, 64 nt, Human; identical to SEQ ID NO: 38889

SEQ ID NO: 376050 - RNA, 64 nt, Human; identical to SEQ ID NO: 38890

SEQ ID NO: 376051 - RNA, 64 nt, Human; identical to SEQ ID NO: 38891

SEQ ID NO: 376052 - RNA, 64 nt, Human; identical to SEQ ID NO: 38892

SEQ ID NO: 376053 - RNA, 64 nt, Human; identical to SEQ ID NO: 38893

SEQ ID NO: 376054 - RNA, 64 nt, Human; identical to SEQ ID NO: 38894

SEQ ID NO: 376055 - RNA, 64 nt, Human; identical to SEQ ID NO: 38895

SEQ ID NO: 376056 - RNA, 64 nt, Human; identical to SEQ ID NO: 38896

SEQ ID NO: 376057 - RNA, 64 nt, Human; identical to SEQ ID NO: 38897

SEQ ID NO: 376058 - RNA, 64 nt, Human; identical to SEQ ID NO: 38898

SEQ ID NO: 376059 - RNA, 64 nt, Human; identical to SEQ ID NO: 38899

SEQ ID NO: 376060 - RNA, 64 nt, Human; identical to SEQ ID NO: 38900

SEQ ID NO: 376061 - RNA, 64 nt, Human; identical to SEQ ID NO: 38901

SEQ ID NO: 376062 - RNA, 64 nt, Human; identical to SEQ ID NO: 38902

SEQ ID NO: 376063 - RNA, 64 nt, Human; identical to SEQ ID NO: 38903

SEQ ID NO: 376064 - RNA, 64 nt, Human; identical to SEQ ID NO: 38904

SEQ ID NO: 376065 - RNA, 64 nt, Human; identical to SEQ ID NO: 38905

SEQ ID NO: 376066 - RNA, 64 nt, Human; identical to SEQ ID NO: 38906

SEQ ID NO: 376067 - RNA, 64 nt, Human; identical to SEQ ID NO: 38907

SEQ ID NO: 376068 - RNA, 64 nt, Human; identical to SEQ ID NO: 38908

SEQ ID NO: 376069 - RNA, 64 nt, Human; identical to SEQ ID NO: 38909

SEQ ID NO: 376070 - RNA, 64 nt, Human; identical to SEQ ID NO: 38910

SEQ ID NO: 376071 - RNA, 64 nt, Human; identical to SEQ ID NO: 38911

SEQ ID NO: 376072 - RNA, 64 nt, Human; identical to SEQ ID NO: 38912

SEQ ID NO: 376073 - RNA, 64 nt, Human; identical to SEQ ID NO: 38913

SEQ ID NO: 376074 - RNA, 64 nt, Human; identical to SEQ ID NO: 38914

SEQ ID NO: 376075 - RNA, 64 nt, Human; identical to SEQ ID NO: 38915

SEQ ID NO: 376076 - RNA, 64 nt, Human; identical to SEQ ID NO: 38916

SEQ ID NO: 376077 - RNA, 64 nt, Human; identical to SEQ ID NO: 38917

SEQ ID NO: 376078 - RNA, 64 nt, Human; identical to SEQ ID NO: 38918

SEQ ID NO: 376079 - RNA, 64 nt, Human; identical to SEQ ID NO: 38919

SEQ ID NO: 376080 - RNA, 64 nt, Human; identical to SEQ ID NO: 38920

SEQ ID NO: 376081 - RNA, 64 nt, Human; identical to SEQ ID NO: 38921

SEQ ID NO: 376082 - RNA, 64 nt, Human; identical to SEQ ID NO: 38922

SEQ ID NO: 376083 - RNA, 64 nt, Human; identical to SEQ ID NO: 38923

SEQ ID NO: 376084 - RNA, 64 nt, Human; identical to SEQ ID NO: 38924

SEQ ID NO: 376085 - RNA, 64 nt, Human; identical to SEQ ID NO: 38925

SEQ ID NO: 376086 - RNA, 64 nt, Human; identical to SEQ ID NO: 38926

SEQ ID NO: 376087 - RNA, 64 nt, Human; identical to SEQ ID NO: 38927

SEQ ID NO: 376088 - RNA, 64 nt, Human; identical to SEQ ID NO: 38928

SEQ ID NO: 376089 - RNA, 64 nt, Human; identical to SEQ ID NO: 38929

SEQ ID NO: 376090 - RNA, 64 nt, Human; identical to SEQ ID NO: 38930

SEQ ID NO: 376091 - RNA, 64 nt, Human; identical to SEQ ID NO: 38931

SEQ ID NO: 376092 - RNA, 64 nt, Human; identical to SEQ ID NO: 38932

SEQ ID NO: 376093 - RNA, 64 nt, Human; identical to SEQ ID NO: 38933

SEQ ID NO: 376094 - RNA, 64 nt, Human; identical to SEQ ID NO: 38934

SEQ ID NO: 376095 - RNA, 64 nt, Human; identical to SEQ ID NO: 38935

SEQ ID NO: 376096 - RNA, 64 nt, Human; identical to SEQ ID NO: 38936

SEQ ID NO: 376097 - RNA, 64 nt, Human; identical to SEQ ID NO: 38937

SEQ ID NO: 376098 - RNA, 64 nt, Human; identical to SEQ ID NO: 38938

SEQ ID NO: 376099 - RNA, 64 nt, Human; identical to SEQ ID NO: 38939

SEQ ID NO: 376100 - RNA, 64 nt, Human; identical to SEQ ID NO: 38940

SEQ ID NO: 376101 - RNA, 64 nt, Human; identical to SEQ ID NO: 38941

SEQ ID NO: 376102 - RNA, 64 nt, Human; identical to SEQ ID NO: 38942

SEQ ID NO: 376103 - RNA, 64 nt, Human; identical to SEQ ID NO: 38943

SEQ ID NO: 376104 - RNA, 64 nt, Human; identical to SEQ ID NO: 38944

SEQ ID NO: 376105 - RNA, 64 nt, Human; identical to SEQ ID NO: 38945

SEQ ID NO: 376106 - RNA, 64 nt, Human; identical to SEQ ID NO: 38946

SEQ ID NO: 376107 - RNA, 64 nt, Human; identical to SEQ ID NO: 38947

SEQ ID NO: 376108 - RNA, 64 nt, Human; identical to SEQ ID NO: 38948

SEQ ID NO: 376109 - RNA, 64 nt, Human; identical to SEQ ID NO: 38949

SEQ ID NO: 376110 - RNA, 64 nt, Human; identical to SEQ ID NO: 38950

SEQ ID NO: 376111 - RNA, 64 nt, Human; identical to SEQ ID NO: 38951

SEQ ID NO: 376112 - RNA, 64 nt, Human; identical to SEQ ID NO: 38952

SEQ ID NO: 376113 - RNA, 64 nt, Human; identical to SEQ ID NO: 38953

SEQ ID NO: 376114 - RNA, 64 nt, Human; identical to SEQ ID NO: 38954

SEQ ID NO: 376115 - RNA, 64 nt, Human; identical to SEQ ID NO: 38955

SEQ ID NO: 376116 - RNA, 64 nt, Human; identical to SEQ ID NO: 38956

SEQ ID NO: 376117 - RNA, 64 nt, Human; identical to SEQ ID NO: 38957

SEQ ID NO: 376118 - RNA, 64 nt, Human; identical to SEQ ID NO: 38958

SEQ ID NO: 376119 - RNA, 58 nt, Human; identical to SEQ ID NO: 38959

SEQ ID NO: 376120 - RNA, 64 nt, Human; identical to SEQ ID NO: 38960

SEQ ID NO: 376121 - RNA, 64 nt, Human; identical to SEQ ID NO: 38961

SEQ ID NO: 376122 - RNA, 64 nt, Human; identical to SEQ ID NO: 38962

SEQ ID NO: 376123 - RNA, 64 nt, Human; identical to SEQ ID NO: 38963

SEQ ID NO: 376124 - RNA, 64 nt, Human; identical to SEQ ID NO: 38964

SEQ ID NO: 376125 - RNA, 64 nt, Human; identical to SEQ ID NO: 38965

SEQ ID NO: 376126 - RNA, 64 nt, Human; identical to SEQ ID NO: 38966

SEQ ID NO: 376127 - RNA, 64 nt, Human; identical to SEQ ID NO: 38967

SEQ ID NO: 376128 - RNA, 64 nt, Human; identical to SEQ ID NO: 38968

SEQ ID NO: 376129 - RNA, 64 nt, Human; identical to SEQ ID NO: 38969

SEQ ID NO: 376130 - RNA, 64 nt, Human; identical to SEQ ID NO: 38970

SEQ ID NO: 376131 - RNA, 64 nt, Human; identical to SEQ ID NO: 38971

SEQ ID NO: 376132 - RNA, 64 nt, Human; identical to SEQ ID NO: 38972

SEQ ID NO: 376133 - RNA, 64 nt, Human; identical to SEQ ID NO: 38973

SEQ ID NO: 376134 - RNA, 64 nt, Human; identical to SEQ ID NO: 38974

SEQ ID NO: 376135 - RNA, 64 nt, Human; identical to SEQ ID NO: 38975

SEQ ID NO: 376136 - RNA, 64 nt, Human; identical to SEQ ID NO: 38976

SEQ ID NO: 376137 - RNA, 64 nt, Human; identical to SEQ ID NO: 38977

SEQ ID NO: 376138 - RNA, 64 nt, Human; identical to SEQ ID NO: 38978

SEQ ID NO: 376139 - RNA, 64 nt, Human; identical to SEQ ID NO: 38979

SEQ ID NO: 376140 - RNA, 64 nt, Human; identical to SEQ ID NO: 38980

SEQ ID NO: 376141 - RNA, 64 nt, Human; identical to SEQ ID NO: 38981

SEQ ID NO: 376142 - RNA, 64 nt, Human; identical to SEQ ID NO: 38982

SEQ ID NO: 376143 - RNA, 64 nt, Human; identical to SEQ ID NO: 38983

SEQ ID NO: 376144 - RNA, 64 nt, Human; identical to SEQ ID NO: 38984

SEQ ID NO: 376145 - RNA, 64 nt, Human; identical to SEQ ID NO: 38985

SEQ ID NO: 376146 - RNA, 64 nt, Human; identical to SEQ ID NO: 38986

SEQ ID NO: 376147 - RNA, 64 nt, Human; identical to SEQ ID NO: 38987

SEQ ID NO: 376148 - RNA, 64 nt, Human; identical to SEQ ID NO: 38988

SEQ ID NO: 376149 - RNA, 64 nt, Human; identical to SEQ ID NO: 38989

SEQ ID NO: 376150 - RNA, 64 nt, Human; identical to SEQ ID NO: 38990

SEQ ID NO: 376151 - RNA, 64 nt, Human; identical to SEQ ID NO: 38991

SEQ ID NO: 376152 - RNA, 64 nt, Human; identical to SEQ ID NO: 38992

SEQ ID NO: 376153 - RNA, 64 nt, Human; identical to SEQ ID NO: 38993

SEQ ID NO: 376154 - RNA, 64 nt, Human; identical to SEQ ID NO: 38994

SEQ ID NO: 376155 - RNA, 64 nt, Human; identical to SEQ ID NO: 38995

SEQ ID NO: 376156 - RNA, 64 nt, Human; identical to SEQ ID NO: 38996

SEQ ID NO: 376157 - RNA, 64 nt, Human; identical to SEQ ID NO: 38997

SEQ ID NO: 376158 - RNA, 64 nt, Human; identical to SEQ ID NO: 38998

SEQ ID NO: 376159 - RNA, 62 nt, Human; identical to SEQ ID NO: 38999

SEQ ID NO: 376160 - RNA, 64 nt, Human; identical to SEQ ID NO: 39000

SEQ ID NO: 376161 - RNA, 64 nt, Human; identical to SEQ ID NO: 39001

SEQ ID NO: 376162 - RNA, 64 nt, Human; identical to SEQ ID NO: 39002

SEQ ID NO: 376163 - RNA, 64 nt, Human; identical to SEQ ID NO: 39003

SEQ ID NO: 376164 - RNA, 64 nt, Human; identical to SEQ ID NO: 39004

SEQ ID NO: 376165 - RNA, 64 nt, Human; identical to SEQ ID NO: 39005

SEQ ID NO: 376166 - RNA, 64 nt, Human; identical to SEQ ID NO: 39006

SEQ ID NO: 376167 - RNA, 64 nt, Human; identical to SEQ ID NO: 39007

SEQ ID NO: 376168 - RNA, 64 nt, Human; identical to SEQ ID NO: 39008

SEQ ID NO: 376169 - RNA, 64 nt, Human; identical to SEQ ID NO: 39009

SEQ ID NO: 376170 - RNA, 64 nt, Human; identical to SEQ ID NO: 39010

SEQ ID NO: 376171 - RNA, 64 nt, Human; identical to SEQ ID NO: 39011

SEQ ID NO: 376172 - RNA, 64 nt, Human; identical to SEQ ID NO: 39012

SEQ ID NO: 376173 - RNA, 64 nt, Human; identical to SEQ ID NO: 39013

SEQ ID NO: 376174 - RNA, 64 nt, Human; identical to SEQ ID NO: 39014

SEQ ID NO: 376175 - RNA, 64 nt, Human; identical to SEQ ID NO: 39015

SEQ ID NO: 376176 - RNA, 64 nt, Human; identical to SEQ ID NO: 39016

SEQ ID NO: 376177 - RNA, 64 nt, Human; identical to SEQ ID NO: 39017

SEQ ID NO: 376178 - RNA, 64 nt, Human; identical to SEQ ID NO: 39018

SEQ ID NO: 376179 - RNA, 64 nt, Human; identical to SEQ ID NO: 39019

SEQ ID NO: 376180 - RNA, 64 nt, Human; identical to SEQ ID NO: 39020

SEQ ID NO: 376181 - RNA, 64 nt, Human; identical to SEQ ID NO: 39021

SEQ ID NO: 376182 - RNA, 64 nt, Human; identical to SEQ ID NO: 39022

SEQ ID NO: 376183 - RNA, 64 nt, Human; identical to SEQ ID NO: 39023

SEQ ID NO: 376184 - RNA, 64 nt, Human; identical to SEQ ID NO: 39024

SEQ ID NO: 376185 - RNA, 64 nt, Human; identical to SEQ ID NO: 39025

SEQ ID NO: 376186 - RNA, 64 nt, Human; identical to SEQ ID NO: 39026

SEQ ID NO: 376187 - RNA, 64 nt, Human; identical to SEQ ID NO: 39027

SEQ ID NO: 376188 - RNA, 64 nt, Human; identical to SEQ ID NO: 39028

SEQ ID NO: 376189 - RNA, 64 nt, Human; identical to SEQ ID NO: 39029

SEQ ID NO: 376190 - RNA, 64 nt, Human; identical to SEQ ID NO: 39030

SEQ ID NO: 376191 - RNA, 64 nt, Human; identical to SEQ ID NO: 39031

SEQ ID NO: 376192 - RNA, 61 nt, Human; identical to SEQ ID NO: 39032

SEQ ID NO: 376193 - RNA, 64 nt, Human; identical to SEQ ID NO: 39033

SEQ ID NO: 376194 - RNA, 64 nt, Human; identical to SEQ ID NO: 39034

SEQ ID NO: 376195 - RNA, 64 nt, Human; identical to SEQ ID NO: 39035

SEQ ID NO: 376196 - RNA, 64 nt, Human; identical to SEQ ID NO: 39036

SEQ ID NO: 376197 - RNA, 64 nt, Human; identical to SEQ ID NO: 39037

SEQ ID NO: 376198 - RNA, 64 nt, Human; identical to SEQ ID NO: 39038

SEQ ID NO: 376199 - RNA, 64 nt, Human; identical to SEQ ID NO: 39039

SEQ ID NO: 376200 - RNA, 64 nt, Human; identical to SEQ ID NO: 39040

SEQ ID NO: 376201 - RNA, 64 nt, Human; identical to SEQ ID NO: 39041

SEQ ID NO: 376202 - RNA, 64 nt, Human; identical to SEQ ID NO: 39042

SEQ ID NO: 376203 - RNA, 64 nt, Human; identical to SEQ ID NO: 39043

SEQ ID NO: 376204 - RNA, 64 nt, Human; identical to SEQ ID NO: 39044

SEQ ID NO: 376205 - RNA, 64 nt, Human; identical to SEQ ID NO: 39045

SEQ ID NO: 376206 - RNA, 64 nt, Human; identical to SEQ ID NO: 39046

SEQ ID NO: 376207 - RNA, 64 nt, Human; identical to SEQ ID NO: 39047

SEQ ID NO: 376208 - RNA, 64 nt, Human; identical to SEQ ID NO: 39048

SEQ ID NO: 376209 - RNA, 64 nt, Human; identical to SEQ ID NO: 39049

SEQ ID NO: 376210 - RNA, 64 nt, Human; identical to SEQ ID NO: 39050

SEQ ID NO: 376211 - RNA, 64 nt, Human; identical to SEQ ID NO: 39051

SEQ ID NO: 376212 - RNA, 64 nt, Human; identical to SEQ ID NO: 39052

SEQ ID NO: 376213 - RNA, 64 nt, Human; identical to SEQ ID NO: 39053

SEQ ID NO: 376214 - RNA, 64 nt, Human; identical to SEQ ID NO: 39054

SEQ ID NO: 376215 - RNA, 64 nt, Human; identical to SEQ ID NO: 39055

SEQ ID NO: 376216 - RNA, 64 nt, Human; identical to SEQ ID NO: 39056

SEQ ID NO: 376217 - RNA, 64 nt, Human; identical to SEQ ID NO: 39057

SEQ ID NO: 376218 - RNA, 64 nt, Human; identical to SEQ ID NO: 39058

SEQ ID NO: 376219 - RNA, 64 nt, Human; identical to SEQ ID NO: 39059

SEQ ID NO: 376220 - RNA, 64 nt, Human; identical to SEQ ID NO: 39060

SEQ ID NO: 376221 - RNA, 64 nt, Human; identical to SEQ ID NO: 39061

SEQ ID NO: 376222 - RNA, 51 nt, Human; identical to SEQ ID NO: 39062

SEQ ID NO: 376223 - RNA, 64 nt, Human; identical to SEQ ID NO: 39063

SEQ ID NO: 376224 - RNA, 64 nt, Human; identical to SEQ ID NO: 39064

SEQ ID NO: 376225 - RNA, 64 nt, Human; identical to SEQ ID NO: 39065

SEQ ID NO: 376226 - RNA, 64 nt, Human; identical to SEQ ID NO: 39066

SEQ ID NO: 376227 - RNA, 64 nt, Human; identical to SEQ ID NO: 39067

SEQ ID NO: 376228 - RNA, 64 nt, Human; identical to SEQ ID NO: 39068

SEQ ID NO: 376229 - RNA, 64 nt, Human; identical to SEQ ID NO: 39069

SEQ ID NO: 376230 - RNA, 64 nt, Human; identical to SEQ ID NO: 39070

SEQ ID NO: 376231 - RNA, 64 nt, Human; identical to SEQ ID NO: 39071

SEQ ID NO: 376232 - RNA, 64 nt, Human; identical to SEQ ID NO: 39072

SEQ ID NO: 376233 - RNA, 64 nt, Human; identical to SEQ ID NO: 39073

SEQ ID NO: 376234 - RNA, 64 nt, Human; identical to SEQ ID NO: 39074

SEQ ID NO: 376235 - RNA, 64 nt, Human; identical to SEQ ID NO: 39075

SEQ ID NO: 376236 - RNA, 64 nt, Human; identical to SEQ ID NO: 39076

SEQ ID NO: 376237 - RNA, 62 nt, Human; identical to SEQ ID NO: 39077

SEQ ID NO: 376238 - RNA, 64 nt, Human; identical to SEQ ID NO: 39078

SEQ ID NO: 376239 - RNA, 64 nt, Human; identical to SEQ ID NO: 39079

SEQ ID NO: 376240 - RNA, 64 nt, Human; identical to SEQ ID NO: 39080

SEQ ID NO: 376241 - RNA, 64 nt, Human; identical to SEQ ID NO: 39081

SEQ ID NO: 376242 - RNA, 64 nt, Human; identical to SEQ ID NO: 39082

SEQ ID NO: 376243 - RNA, 64 nt, Human; identical to SEQ ID NO: 39083

SEQ ID NO: 376244 - RNA, 64 nt, Human; identical to SEQ ID NO: 39084

SEQ ID NO: 376245 - RNA, 64 nt, Human; identical to SEQ ID NO: 39085

SEQ ID NO: 376246 - RNA, 64 nt, Human; identical to SEQ ID NO: 39086

SEQ ID NO: 376247 - RNA, 64 nt, Human; identical to SEQ ID NO: 39087

SEQ ID NO: 376248 - RNA, 64 nt, Human; identical to SEQ ID NO: 39088

SEQ ID NO: 376249 - RNA, 64 nt, Human; identical to SEQ ID NO: 39089

SEQ ID NO: 376250 - RNA, 64 nt, Human; identical to SEQ ID NO: 39090

SEQ ID NO: 376251 - RNA, 64 nt, Human; identical to SEQ ID NO: 39091

SEQ ID NO: 376252 - RNA, 64 nt, Human; identical to SEQ ID NO: 39092

SEQ ID NO: 376253 - RNA, 64 nt, Human; identical to SEQ ID NO: 39093

SEQ ID NO: 376254 - RNA, 64 nt, Human; identical to SEQ ID NO: 39094

SEQ ID NO: 376255 - RNA, 64 nt, Human; identical to SEQ ID NO: 39095

SEQ ID NO: 376256 - RNA, 64 nt, Human; identical to SEQ ID NO: 39096

SEQ ID NO: 376257 - RNA, 64 nt, Human; identical to SEQ ID NO: 39097

SEQ ID NO: 376258 - RNA, 64 nt, Human; identical to SEQ ID NO: 39098

SEQ ID NO: 376259 - RNA, 64 nt, Human; identical to SEQ ID NO: 39099

SEQ ID NO: 376260 - RNA, 64 nt, Human; identical to SEQ ID NO: 39100

SEQ ID NO: 376261 - RNA, 64 nt, Human; identical to SEQ ID NO: 39101

SEQ ID NO: 376262 - RNA, 64 nt, Human; identical to SEQ ID NO: 39102

SEQ ID NO: 376263 - RNA, 64 nt, Human; identical to SEQ ID NO: 39103

SEQ ID NO: 376264 - RNA, 64 nt, Human; identical to SEQ ID NO: 39104

SEQ ID NO: 376265 - RNA, 64 nt, Human; identical to SEQ ID NO: 39105

SEQ ID NO: 376266 - RNA, 64 nt, Human; identical to SEQ ID NO: 39106

SEQ ID NO: 376267 - RNA, 64 nt, Human; identical to SEQ ID NO: 39107

SEQ ID NO: 376268 - RNA, 64 nt, Human; identical to SEQ ID NO: 39108

SEQ ID NO: 376269 - RNA, 62 nt, Human; identical to SEQ ID NO: 39109

SEQ ID NO: 376270 - RNA, 64 nt, Human; identical to SEQ ID NO: 39110

SEQ ID NO: 376271 - RNA, 64 nt, Human; identical to SEQ ID NO: 39111

SEQ ID NO: 376272 - RNA, 64 nt, Human; identical to SEQ ID NO: 39112

SEQ ID NO: 376273 - RNA, 64 nt, Human; identical to SEQ ID NO: 39113

SEQ ID NO: 376274 - RNA, 64 nt, Human; identical to SEQ ID NO: 39114

SEQ ID NO: 376275 - RNA, 64 nt, Human; identical to SEQ ID NO: 39115

SEQ ID NO: 376276 - RNA, 64 nt, Human; identical to SEQ ID NO: 39116

SEQ ID NO: 376277 - RNA, 64 nt, Human; identical to SEQ ID NO: 39117

SEQ ID NO: 376278 - RNA, 64 nt, Human; identical to SEQ ID NO: 39118

SEQ ID NO: 376279 - RNA, 64 nt, Human; identical to SEQ ID NO: 39119

SEQ ID NO: 376280 - RNA, 64 nt, Human; identical to SEQ ID NO: 39120

SEQ ID NO: 376281 - RNA, 64 nt, Human; identical to SEQ ID NO: 39121

SEQ ID NO: 376282 - RNA, 64 nt, Human; identical to SEQ ID NO: 39122

SEQ ID NO: 376283 - RNA, 64 nt, Human; identical to SEQ ID NO: 39123

SEQ ID NO: 376284 - RNA, 64 nt, Human; identical to SEQ ID NO: 39124

SEQ ID NO: 376285 - RNA, 64 nt, Human; identical to SEQ ID NO: 39125

SEQ ID NO: 376286 - RNA, 64 nt, Human; identical to SEQ ID NO: 39126

SEQ ID NO: 376287 - RNA, 64 nt, Human; identical to SEQ ID NO: 39126

SEQ ID NO: 376288 - RNA, 64 nt, Human; identical to SEQ ID NO: 39126

SEQ ID NO: 376289 - RNA, 64 nt, Human; identical to SEQ ID NO: 39129

SEQ ID NO: 376290 - RNA, 64 nt, Human; identical to SEQ ID NO: 39130

SEQ ID NO: 376291 - RNA, 64 nt, Human; identical to SEQ ID NO: 39131

SEQ ID NO: 376292 - RNA, 64 nt, Human; identical to SEQ ID NO: 39132

SEQ ID NO: 376293 - RNA, 64 nt, Human; identical to SEQ ID NO: 39133

SEQ ID NO: 376294 - RNA, 64 nt, Human; identical to SEQ ID NO: 39134

SEQ ID NO: 376295 - RNA, 64 nt, Human; identical to SEQ ID NO: 39135

SEQ ID NO: 376296 - RNA, 64 nt, Human; identical to SEQ ID NO: 39136

SEQ ID NO: 376297 - RNA, 64 nt, Human; identical to SEQ ID NO: 39137

SEQ ID NO: 376298 - RNA, 64 nt, Human; identical to SEQ ID NO: 39138

SEQ ID NO: 376299 - RNA, 64 nt, Human; identical to SEQ ID NO: 39139

SEQ ID NO: 376300 - RNA, 64 nt, Human; identical to SEQ ID NO: 39140

SEQ ID NO: 376301 - RNA, 64 nt, Human; identical to SEQ ID NO: 39141

SEQ ID NO: 376302 - RNA, 64 nt, Human; identical to SEQ ID NO: 39142

SEQ ID NO: 376303 - RNA, 64 nt, Human; identical to SEQ ID NO: 39143

SEQ ID NO: 376304 - RNA, 64 nt, Human; identical to SEQ ID NO: 39144

SEQ ID NO: 376305 - RNA, 64 nt, Human; identical to SEQ ID NO: 39145

SEQ ID NO: 376306 - RNA, 64 nt, Human; identical to SEQ ID NO: 39146

SEQ ID NO: 376307 - RNA, 64 nt, Human; identical to SEQ ID NO: 39147

SEQ ID NO: 376308 - RNA, 64 nt, Human; identical to SEQ ID NO: 39148

SEQ ID NO: 376309 - RNA, 64 nt, Human; identical to SEQ ID NO: 39149

SEQ ID NO: 376310 - RNA, 64 nt, Human; identical to SEQ ID NO: 39150

SEQ ID NO: 376311 - RNA, 64 nt, Human; identical to SEQ ID NO: 39151

SEQ ID NO: 376312 - RNA, 64 nt, Human; identical to SEQ ID NO: 39152

SEQ ID NO: 376313 - RNA, 64 nt, Human; identical to SEQ ID NO: 39153

SEQ ID NO: 376314 - RNA, 64 nt, Human; identical to SEQ ID NO: 39154

SEQ ID NO: 376315 - RNA, 64 nt, Human; identical to SEQ ID NO: 39155

SEQ ID NO: 376316 - RNA, 64 nt, Human; identical to SEQ ID NO: 39156

SEQ ID NO: 376317 - RNA, 64 nt, Human; identical to SEQ ID NO: 39157

SEQ ID NO: 376318 - RNA, 64 nt, Human; identical to SEQ ID NO: 39158

SEQ ID NO: 376319 - RNA, 64 nt, Human; identical to SEQ ID NO: 39159

SEQ ID NO: 376320 - RNA, 64 nt, Human; identical to SEQ ID NO: 39160

SEQ ID NO: 376321 - RNA, 64 nt, Human; identical to SEQ ID NO: 39161

SEQ ID NO: 376322 - RNA, 64 nt, Human; identical to SEQ ID NO: 39162

SEQ ID NO: 376323 - RNA, 64 nt, Human; identical to SEQ ID NO: 39163

SEQ ID NO: 376324 - RNA, 64 nt, Human; identical to SEQ ID NO: 39164

SEQ ID NO: 376325 - RNA, 64 nt, Human; identical to SEQ ID NO: 39165

SEQ ID NO: 376326 - RNA, 64 nt, Human; identical to SEQ ID NO: 39166

SEQ ID NO: 376327 - RNA, 64 nt, Human; identical to SEQ ID NO: 39167

SEQ ID NO: 376328 - RNA, 64 nt, Human; identical to SEQ ID NO: 39168

SEQ ID NO: 376329 - RNA, 64 nt, Human; identical to SEQ ID NO: 39169

SEQ ID NO: 376330 - RNA, 64 nt, Human; identical to SEQ ID NO: 39170

SEQ ID NO: 376331 - RNA, 64 nt, Human; identical to SEQ ID NO: 39171

SEQ ID NO: 376332 - RNA, 64 nt, Human; identical to SEQ ID NO: 39172

SEQ ID NO: 376333 - RNA, 64 nt, Human; identical to SEQ ID NO: 39173

SEQ ID NO: 376334 - RNA, 64 nt, Human; identical to SEQ ID NO: 39174

SEQ ID NO: 376335 - RNA, 64 nt, Human; identical to SEQ ID NO: 39175

SEQ ID NO: 376336 - RNA, 64 nt, Human; identical to SEQ ID NO: 39176

SEQ ID NO: 376337 - RNA, 64 nt, Human; identical to SEQ ID NO: 39177

SEQ ID NO: 376338 - RNA, 64 nt, Human; identical to SEQ ID NO: 39178

SEQ ID NO: 376339 - RNA, 64 nt, Human; identical to SEQ ID NO: 39179

SEQ ID NO: 376340 - RNA, 64 nt, Human; identical to SEQ ID NO: 39180

SEQ ID NO: 376341 - RNA, 64 nt, Human; identical to SEQ ID NO: 39181

SEQ ID NO: 376342 - RNA, 64 nt, Human; identical to SEQ ID NO: 39182

SEQ ID NO: 376343 - RNA, 64 nt, Human; identical to SEQ ID NO: 39183

SEQ ID NO: 376344 - RNA, 64 nt, Human; identical to SEQ ID NO: 39184

SEQ ID NO: 376345 - RNA, 64 nt, Human; identical to SEQ ID NO: 39185

SEQ ID NO: 376346 - RNA, 64 nt, Human; identical to SEQ ID NO: 39186

SEQ ID NO: 376347 - RNA, 64 nt, Human; identical to SEQ ID NO: 39187

SEQ ID NO: 376348 - RNA, 64 nt, Human; identical to SEQ ID NO: 39188

SEQ ID NO: 376349 - RNA, 64 nt, Human; identical to SEQ ID NO: 39189

SEQ ID NO: 376350 - RNA, 64 nt, Human; identical to SEQ ID NO: 39190

SEQ ID NO: 376351 - RNA, 64 nt, Human; identical to SEQ ID NO: 39191

SEQ ID NO: 376352 - RNA, 64 nt, Human; identical to SEQ ID NO: 39192

SEQ ID NO: 376353 - RNA, 64 nt, Human; identical to SEQ ID NO: 39193

SEQ ID NO: 376354 - RNA, 64 nt, Human; identical to SEQ ID NO: 39194

SEQ ID NO: 376355 - RNA, 64 nt, Human; identical to SEQ ID NO: 39195

SEQ ID NO: 376356 - RNA, 64 nt, Human; identical to SEQ ID NO: 39196

SEQ ID NO: 376357 - RNA, 64 nt, Human; identical to SEQ ID NO: 39197

SEQ ID NO: 376358 - RNA, 64 nt, Human; identical to SEQ ID NO: 39198

SEQ ID NO: 376359 - RNA, 64 nt, Human; identical to SEQ ID NO: 39199

SEQ ID NO: 376360 - RNA, 64 nt, Human; identical to SEQ ID NO: 39200

SEQ ID NO: 376361 - RNA, 64 nt, Human; identical to SEQ ID NO: 39201

SEQ ID NO: 376362 - RNA, 64 nt, Human; identical to SEQ ID NO: 39202

SEQ ID NO: 376363 - RNA, 64 nt, Human; identical to SEQ ID NO: 39203

SEQ ID NO: 376364 - RNA, 64 nt, Human; identical to SEQ ID NO: 39204

SEQ ID NO: 376365 - RNA, 64 nt, Human; identical to SEQ ID NO: 39205

SEQ ID NO: 376366 - RNA, 64 nt, Human; identical to SEQ ID NO: 39206

SEQ ID NO: 376367 - RNA, 64 nt, Human; identical to SEQ ID NO: 39207

SEQ ID NO: 376368 - RNA, 64 nt, Human; identical to SEQ ID NO: 39208

SEQ ID NO: 376369 - RNA, 64 nt, Human; identical to SEQ ID NO: 39209

SEQ ID NO: 376370 - RNA, 64 nt, Human; identical to SEQ ID NO: 39210

SEQ ID NO: 376371 - RNA, 64 nt, Human; identical to SEQ ID NO: 39211

SEQ ID NO: 376372 - RNA, 64 nt, Human; identical to SEQ ID NO: 39212

SEQ ID NO: 376373 - RNA, 64 nt, Human; identical to SEQ ID NO: 39213

SEQ ID NO: 376374 - RNA, 64 nt, Human; identical to SEQ ID NO: 39214

SEQ ID NO: 376375 - RNA, 64 nt, Human; identical to SEQ ID NO: 39215

SEQ ID NO: 376376 - RNA, 64 nt, Human; identical to SEQ ID NO: 39216

SEQ ID NO: 376377 - RNA, 64 nt, Human; identical to SEQ ID NO: 39217

SEQ ID NO: 376378 - RNA, 64 nt, Human; identical to SEQ ID NO: 39218

SEQ ID NO: 376379 - RNA, 64 nt, Human; identical to SEQ ID NO: 39219

SEQ ID NO: 376380 - RNA, 64 nt, Human; identical to SEQ ID NO: 39220

SEQ ID NO: 376381 - RNA, 64 nt, Human; identical to SEQ ID NO: 39221

SEQ ID NO: 376382 - RNA, 64 nt, Human; identical to SEQ ID NO: 39222

SEQ ID NO: 376383 - RNA, 64 nt, Human; identical to SEQ ID NO: 39223

SEQ ID NO: 376384 - RNA, 50 nt, Human; identical to SEQ ID NO: 39224

SEQ ID NO: 376385 - RNA, 64 nt, Human; identical to SEQ ID NO: 39225

SEQ ID NO: 376386 - RNA, 64 nt, Human; identical to SEQ ID NO: 39226

SEQ ID NO: 376387 - RNA, 64 nt, Human; identical to SEQ ID NO: 39227

SEQ ID NO: 376388 - RNA, 64 nt, Human; identical to SEQ ID NO: 39228

SEQ ID NO: 376389 - RNA, 64 nt, Human; identical to SEQ ID NO: 39229

SEQ ID NO: 376390 - RNA, 50 nt, Human; identical to SEQ ID NO: 39230

SEQ ID NO: 376391 - RNA, 64 nt, Human; identical to SEQ ID NO: 39231

SEQ ID NO: 376392 - RNA, 64 nt, Human; identical to SEQ ID NO: 39232

SEQ ID NO: 376393 - RNA, 64 nt, Human; identical to SEQ ID NO: 39233

SEQ ID NO: 376394 - RNA, 64 nt, Human; identical to SEQ ID NO: 39234

SEQ ID NO: 376395 - RNA, 64 nt, Human; identical to SEQ ID NO: 39235

SEQ ID NO: 376396 - RNA, 64 nt, Human; identical to SEQ ID NO: 39236

SEQ ID NO: 376397 - RNA, 64 nt, Human; identical to SEQ ID NO: 39237

SEQ ID NO: 376398 - RNA, 64 nt, Human; identical to SEQ ID NO: 39238

SEQ ID NO: 376399 - RNA, 64 nt, Human; identical to SEQ ID NO: 39239

SEQ ID NO: 376400 - RNA, 64 nt, Human; identical to SEQ ID NO: 39240

SEQ ID NO: 376401 - RNA, 64 nt, Human; identical to SEQ ID NO: 39241

SEQ ID NO: 376402 - RNA, 64 nt, Human; identical to SEQ ID NO: 39242

SEQ ID NO: 376403 - RNA, 64 nt, Human; identical to SEQ ID NO: 39243

SEQ ID NO: 376404 - RNA, 64 nt, Human; identical to SEQ ID NO: 39244

SEQ ID NO: 376405 - RNA, 64 nt, Human; identical to SEQ ID NO: 39245

SEQ ID NO: 376406 - RNA, 64 nt, Human; identical to SEQ ID NO: 39246

SEQ ID NO: 376407 - RNA, 64 nt, Human; identical to SEQ ID NO: 39247

SEQ ID NO: 376408 - RNA, 64 nt, Human; identical to SEQ ID NO: 39248

SEQ ID NO: 376409 - RNA, 64 nt, Human; identical to SEQ ID NO: 39249

SEQ ID NO: 376410 - RNA, 64 nt, Human; identical to SEQ ID NO: 39250

SEQ ID NO: 376411 - RNA, 64 nt, Human; identical to SEQ ID NO: 39251

SEQ ID NO: 376412 - RNA, 64 nt, Human; identical to SEQ ID NO: 39252

SEQ ID NO: 376413 - RNA, 64 nt, Human; identical to SEQ ID NO: 39253

SEQ ID NO: 376414 - RNA, 64 nt, Human; identical to SEQ ID NO: 39254

SEQ ID NO: 376415 - RNA, 64 nt, Human; identical to SEQ ID NO: 39255

SEQ ID NO: 376416 - RNA, 64 nt, Human; identical to SEQ ID NO: 39256

SEQ ID NO: 376417 - RNA, 64 nt, Human; identical to SEQ ID NO: 375710

SEQ ID NO: 376418 - RNA, 64 nt, Human; identical to SEQ ID NO: 375711

SEQ ID NO: 376419 - RNA, 64 nt, Human; identical to SEQ ID NO: 375712

SEQ ID NO: 376420 - RNA, 64 nt, Human; identical to SEQ ID NO: 375713

SEQ ID NO: 376421 - RNA, 64 nt, Human; identical to SEQ ID NO: 375714

SEQ ID NO: 376422 - RNA, 64 nt, Human; identical to SEQ ID NO: 375715

SEQ ID NO: 376423 - RNA, 64 nt, Human; identical to SEQ ID NO: 375716

SEQ ID NO: 376424 - RNA, 64 nt, Human; identical to SEQ ID NO: 375717

SEQ ID NO: 376425 - RNA, 64 nt, Human; identical to SEQ ID NO: 375718

SEQ ID NO: 376426 - RNA, 64 nt, Human; identical to SEQ ID NO: 375719

SEQ ID NO: 376427 - RNA, 64 nt, Human; identical to SEQ ID NO: 375720

SEQ ID NO: 376428 - RNA, 64 nt, Human; identical to SEQ ID NO: 375721

SEQ ID NO: 376429 - RNA, 64 nt, Human; identical to SEQ ID NO: 375722

SEQ ID NO: 376430 - RNA, 64 nt, Human; identical to SEQ ID NO: 375723

SEQ ID NO: 376431 - RNA, 64 nt, Human; identical to SEQ ID NO: 375724

SEQ ID NO: 376432 - RNA, 64 nt, Human; identical to SEQ ID NO: 375725

SEQ ID NO: 376433 - RNA, 64 nt, Human; identical to SEQ ID NO: 375726

SEQ ID NO: 376434 - RNA, 64 nt, Human; identical to SEQ ID NO: 375727

SEQ ID NO: 376435 - RNA, 64 nt, Human; identical to SEQ ID NO: 375728

SEQ ID NO: 376436 - RNA, 64 nt, Human; identical to SEQ ID NO: 375729

SEQ ID NO: 376437 - RNA, 64 nt, Human; identical to SEQ ID NO: 375730

SEQ ID NO: 376438 - RNA, 64 nt, Human; identical to SEQ ID NO: 375731

SEQ ID NO: 376439 - RNA, 64 nt, Human; identical to SEQ ID NO: 375732

SEQ ID NO: 376440 - RNA, 64 nt, Human; identical to SEQ ID NO: 375733

SEQ ID NO: 376441 - RNA, 64 nt, Human; identical to SEQ ID NO: 375734

SEQ ID NO: 376442 - RNA, 64 nt, Human; identical to SEQ ID NO: 375735

SEQ ID NO: 376443 - RNA, 64 nt, Human; identical to SEQ ID NO: 375736

SEQ ID NO: 376444 - RNA, 64 nt, Human; identical to SEQ ID NO: 375737

SEQ ID NO: 376445 - RNA, 64 nt, Human; identical to SEQ ID NO: 375738

SEQ ID NO: 376446 - RNA, 64 nt, Human; identical to SEQ ID NO: 375739

SEQ ID NO: 376447 - RNA, 64 nt, Human; identical to SEQ ID NO: 375740

SEQ ID NO: 376448 - RNA, 64 nt, Human; identical to SEQ ID NO: 375741

SEQ ID NO: 376449 - RNA, 64 nt, Human; identical to SEQ ID NO: 375742

SEQ ID NO: 376450 - RNA, 64 nt, Human; identical to SEQ ID NO: 375743

SEQ ID NO: 376451 - RNA, 64 nt, Human; identical to SEQ ID NO: 375744

SEQ ID NO: 376452 - RNA, 64 nt, Human; identical to SEQ ID NO: 375745

SEQ ID NO: 376453 - RNA, 64 nt, Human; identical to SEQ ID NO: 375746

SEQ ID NO: 376454 - RNA, 64 nt, Human; identical to SEQ ID NO: 375747

SEQ ID NO: 376455 - RNA, 64 nt, Human; identical to SEQ ID NO: 375748

SEQ ID NO: 376456 - RNA, 64 nt, Human; identical to SEQ ID NO: 375749

SEQ ID NO: 376457 - RNA, 64 nt, Human; identical to SEQ ID NO: 375750

SEQ ID NO: 376458 - RNA, 64 nt, Human; identical to SEQ ID NO: 375751

SEQ ID NO: 376459 - RNA, 64 nt, Human; identical to SEQ ID NO: 375752

SEQ ID NO: 376460 - RNA, 56 nt, Human; identical to SEQ ID NO: 375753

SEQ ID NO: 376461 - RNA, 64 nt, Human; identical to SEQ ID NO: 375754

SEQ ID NO: 376462 - RNA, 64 nt, Human; identical to SEQ ID NO: 375755

SEQ ID NO: 376463 - RNA, 64 nt, Human; identical to SEQ ID NO: 375756

SEQ ID NO: 376464 - RNA, 64 nt, Human; identical to SEQ ID NO: 375757

SEQ ID NO: 376465 - RNA, 64 nt, Human; identical to SEQ ID NO: 375758

SEQ ID NO: 376466 - RNA, 64 nt, Human; identical to SEQ ID NO: 375759

SEQ ID NO: 376467 - RNA, 64 nt, Human; identical to SEQ ID NO: 375760

SEQ ID NO: 376468 - RNA, 64 nt, Human; identical to SEQ ID NO: 375761

SEQ ID NO: 376469 - RNA, 64 nt, Human; identical to SEQ ID NO: 375762

SEQ ID NO: 376470 - RNA, 64 nt, Human; identical to SEQ ID NO: 375763

SEQ ID NO: 376471 - RNA, 64 nt, Human; identical to SEQ ID NO: 375764

SEQ ID NO: 376472 - RNA, 64 nt, Human; identical to SEQ ID NO: 375765

SEQ ID NO: 376473 - RNA, 64 nt, Human; identical to SEQ ID NO: 375766

SEQ ID NO: 376474 - RNA, 64 nt, Human; identical to SEQ ID NO: 375767

SEQ ID NO: 376475 - RNA, 64 nt, Human; identical to SEQ ID NO: 375768

SEQ ID NO: 376476 - RNA, 64 nt, Human; identical to SEQ ID NO: 375769

SEQ ID NO: 376477 - RNA, 64 nt, Human; identical to SEQ ID NO: 375770

SEQ ID NO: 376478 - RNA, 64 nt, Human; identical to SEQ ID NO: 375771

SEQ ID NO: 376479 - RNA, 64 nt, Human; identical to SEQ ID NO: 375772

SEQ ID NO: 376480 - RNA, 64 nt, Human; identical to SEQ ID NO: 375773

SEQ ID NO: 376481 - RNA, 64 nt, Human; identical to SEQ ID NO: 375774

SEQ ID NO: 376482 - RNA, 64 nt, Human; identical to SEQ ID NO: 375775

SEQ ID NO: 376483 - RNA, 64 nt, Human; identical to SEQ ID NO: 375776

SEQ ID NO: 376484 - RNA, 64 nt, Human; identical to SEQ ID NO: 375777

SEQ ID NO: 376485 - RNA, 64 nt, Human; identical to SEQ ID NO: 375778

SEQ ID NO: 376486 - RNA, 64 nt, Human; identical to SEQ ID NO: 375779

SEQ ID NO: 376487 - RNA, 64 nt, Human; identical to SEQ ID NO: 375780

SEQ ID NO: 376488 - RNA, 64 nt, Human; identical to SEQ ID NO: 375781

SEQ ID NO: 376489 - RNA, 64 nt, Human; identical to SEQ ID NO: 375782

SEQ ID NO: 376490 - RNA, 64 nt, Human; identical to SEQ ID NO: 375783

SEQ ID NO: 376491 - RNA, 64 nt, Human; identical to SEQ ID NO: 375784

SEQ ID NO: 376492 - RNA, 64 nt, Human; identical to SEQ ID NO: 375785

SEQ ID NO: 376493 - RNA, 64 nt, Human; identical to SEQ ID NO: 375786

SEQ ID NO: 376494 - RNA, 64 nt, Human; identical to SEQ ID NO: 375787

SEQ ID NO: 376495 - RNA, 64 nt, Human; identical to SEQ ID NO: 375788

SEQ ID NO: 376496 - RNA, 64 nt, Human; identical to SEQ ID NO: 375789

SEQ ID NO: 376497 - RNA, 64 nt, Human; identical to SEQ ID NO: 375790

SEQ ID NO: 376498 - RNA, 64 nt, Human; identical to SEQ ID NO: 375791

SEQ ID NO: 376499 - RNA, 64 nt, Human; identical to SEQ ID NO: 375792

SEQ ID NO: 376500 - RNA, 64 nt, Human; identical to SEQ ID NO: 375793

SEQ ID NO: 376501 - RNA, 64 nt, Human; identical to SEQ ID NO: 375794

SEQ ID NO: 376502 - RNA, 64 nt, Human; identical to SEQ ID NO: 375795

SEQ ID NO: 376503 - RNA, 64 nt, Human; identical to SEQ ID NO: 375796

SEQ ID NO: 376504 - RNA, 64 nt, Human; identical to SEQ ID NO: 375797

SEQ ID NO: 376505 - RNA, 64 nt, Human; identical to SEQ ID NO: 375798

SEQ ID NO: 376506 - RNA, 64 nt, Human; identical to SEQ ID NO: 375799

SEQ ID NO: 376507 - RNA, 64 nt, Human; identical to SEQ ID NO: 375800

SEQ ID NO: 376508 - RNA, 64 nt, Human; identical to SEQ ID NO: 375801

SEQ ID NO: 376509 - RNA, 64 nt, Human; identical to SEQ ID NO: 375802

SEQ ID NO: 376510 - RNA, 64 nt, Human; identical to SEQ ID NO: 375803

SEQ ID NO: 376511 - RNA, 64 nt, Human; identical to SEQ ID NO: 375804

SEQ ID NO: 376512 - RNA, 64 nt, Human; identical to SEQ ID NO: 375805

SEQ ID NO: 376513 - RNA, 64 nt, Human; identical to SEQ ID NO: 375806

SEQ ID NO: 376514 - RNA, 64 nt, Human; identical to SEQ ID NO: 375807

SEQ ID NO: 376515 - RNA, 64 nt, Human; identical to SEQ ID NO: 375808

SEQ ID NO: 376516 - RNA, 64 nt, Human; identical to SEQ ID NO: 375809

SEQ ID NO: 376517 - RNA, 64 nt, Human; identical to SEQ ID NO: 375810

SEQ ID NO: 376518 - RNA, 64 nt, Human; identical to SEQ ID NO: 375811

SEQ ID NO: 376519 - RNA, 64 nt, Human; identical to SEQ ID NO: 375812

SEQ ID NO: 376520 - RNA, 64 nt, Human; identical to SEQ ID NO: 375813

SEQ ID NO: 376521 - RNA, 64 nt, Human; identical to SEQ ID NO: 375814

SEQ ID NO: 376522 - RNA, 64 nt, Human; identical to SEQ ID NO: 375815

SEQ ID NO: 376523 - RNA, 64 nt, Human; identical to SEQ ID NO: 375816

SEQ ID NO: 376524 - RNA, 64 nt, Human; identical to SEQ ID NO: 375817

SEQ ID NO: 376525 - RNA, 64 nt, Human; identical to SEQ ID NO: 375818

SEQ ID NO: 376526 - RNA, 64 nt, Human; identical to SEQ ID NO: 375819

SEQ ID NO: 376527 - RNA, 64 nt, Human; identical to SEQ ID NO: 375820

SEQ ID NO: 376528 - RNA, 64 nt, Human; identical to SEQ ID NO: 375821

SEQ ID NO: 376529 - RNA, 64 nt, Human; identical to SEQ ID NO: 375822

SEQ ID NO: 376530 - RNA, 64 nt, Human; identical to SEQ ID NO: 375823

SEQ ID NO: 376531 - RNA, 64 nt, Human; identical to SEQ ID NO: 375824

SEQ ID NO: 376532 - RNA, 64 nt, Human; identical to SEQ ID NO: 375825

SEQ ID NO: 376533 - RNA, 64 nt, Human; identical to SEQ ID NO: 375826

SEQ ID NO: 376534 - RNA, 64 nt, Human; identical to SEQ ID NO: 375827

SEQ ID NO: 376535 - RNA, 64 nt, Human; identical to SEQ ID NO: 375828

SEQ ID NO: 376536 - RNA, 64 nt, Human; identical to SEQ ID NO: 375829

SEQ ID NO: 376537 - RNA, 64 nt, Human; identical to SEQ ID NO: 375830

SEQ ID NO: 376538 - RNA, 64 nt, Human; identical to SEQ ID NO: 375831

SEQ ID NO: 376539 - RNA, 64 nt, Human; identical to SEQ ID NO: 375832

SEQ ID NO: 376540 - RNA, 64 nt, Human; identical to SEQ ID NO: 375833

SEQ ID NO: 376541 - RNA, 64 nt, Human; identical to SEQ ID NO: 375834

SEQ ID NO: 376542 - RNA, 64 nt, Human; identical to SEQ ID NO: 375835

SEQ ID NO: 376543 - RNA, 64 nt, Human; identical to SEQ ID NO: 375836

SEQ ID NO: 376544 - RNA, 64 nt, Human; identical to SEQ ID NO: 375837

SEQ ID NO: 376545 - RNA, 64 nt, Human; identical to SEQ ID NO: 375838

SEQ ID NO: 376546 - RNA, 64 nt, Human; identical to SEQ ID NO: 375839

SEQ ID NO: 376547 - RNA, 64 nt, Human; identical to SEQ ID NO: 375840

SEQ ID NO: 376548 - RNA, 64 nt, Human; identical to SEQ ID NO: 375841

SEQ ID NO: 376549 - RNA, 64 nt, Human; identical to SEQ ID NO: 375842

SEQ ID NO: 376550 - RNA, 64 nt, Human; identical to SEQ ID NO: 375843

SEQ ID NO: 376551 - RNA, 64 nt, Human; identical to SEQ ID NO: 375844

SEQ ID NO: 376552 - RNA, 64 nt, Human; identical to SEQ ID NO: 375845

SEQ ID NO: 376553 - RNA, 64 nt, Human; identical to SEQ ID NO: 375846

SEQ ID NO: 376554 - RNA, 64 nt, Human; identical to SEQ ID NO: 375847

SEQ ID NO: 376555 - RNA, 64 nt, Human; identical to SEQ ID NO: 375848

SEQ ID NO: 376556 - RNA, 64 nt, Human; identical to SEQ ID NO: 375849

SEQ ID NO: 376557 - RNA, 64 nt, Human; identical to SEQ ID NO: 375850

SEQ ID NO: 376558 - RNA, 64 nt, Human; identical to SEQ ID NO: 375851

SEQ ID NO: 376559 - RNA, 64 nt, Human; identical to SEQ ID NO: 375852

SEQ ID NO: 376560 - RNA, 64 nt, Human; identical to SEQ ID NO: 375853

SEQ ID NO: 376561 - RNA, 64 nt, Human; identical to SEQ ID NO: 375854

SEQ ID NO: 376562 - RNA, 64 nt, Human; identical to SEQ ID NO: 375855

SEQ ID NO: 376563 - RNA, 64 nt, Human; identical to SEQ ID NO: 375856

SEQ ID NO: 376564 - RNA, 64 nt, Human; identical to SEQ ID NO: 375857

SEQ ID NO: 376565 - RNA, 64 nt, Human; identical to SEQ ID NO: 375858

SEQ ID NO: 376566 - RNA, 64 nt, Human; identical to SEQ ID NO: 375859

SEQ ID NO: 376567 - RNA, 64 nt, Human; identical to SEQ ID NO: 375860

SEQ ID NO: 376568 - RNA, 64 nt, Human; identical to SEQ ID NO: 375861

SEQ ID NO: 376569 - RNA, 64 nt, Human; identical to SEQ ID NO: 375862

SEQ ID NO: 376570 - RNA, 64 nt, Human; identical to SEQ ID NO: 375863

SEQ ID NO: 376571 - RNA, 64 nt, Human; identical to SEQ ID NO: 375864

SEQ ID NO: 376572 - RNA, 64 nt, Human; identical to SEQ ID NO: 375865

SEQ ID NO: 376573 - RNA, 64 nt, Human; identical to SEQ ID NO: 375866

SEQ ID NO: 376574 - RNA, 64 nt, Human; identical to SEQ ID NO: 375867

SEQ ID NO: 376575 - RNA, 64 nt, Human; identical to SEQ ID NO: 375868

SEQ ID NO: 376576 - RNA, 64 nt, Human; identical to SEQ ID NO: 375869

SEQ ID NO: 376577 - RNA, 64 nt, Human; identical to SEQ ID NO: 375870

SEQ ID NO: 376578 - RNA, 64 nt, Human; identical to SEQ ID NO: 375871

SEQ ID NO: 376579 - RNA, 64 nt, Human; identical to SEQ ID NO: 375872

SEQ ID NO: 376580 - RNA, 64 nt, Human; identical to SEQ ID NO: 375873

SEQ ID NO: 376581 - RNA, 64 nt, Human; identical to SEQ ID NO: 375874

SEQ ID NO: 376582 - RNA, 64 nt, Human; identical to SEQ ID NO: 375875

SEQ ID NO: 376583 - RNA, 64 nt, Human; identical to SEQ ID NO: 375876

SEQ ID NO: 376584 - RNA, 64 nt, Human; identical to SEQ ID NO: 375877

SEQ ID NO: 376585 - RNA, 64 nt, Human; identical to SEQ ID NO: 375878

SEQ ID NO: 376586 - RNA, 64 nt, Human; identical to SEQ ID NO: 375879

SEQ ID NO: 376587 - RNA, 64 nt, Human; identical to SEQ ID NO: 375880

SEQ ID NO: 376588 - RNA, 64 nt, Human; identical to SEQ ID NO: 375881

SEQ ID NO: 376589 - RNA, 64 nt, Human; identical to SEQ ID NO: 375882

SEQ ID NO: 376590 - RNA, 64 nt, Human; identical to SEQ ID NO: 375883

SEQ ID NO: 376591 - RNA, 64 nt, Human; identical to SEQ ID NO: 375884

SEQ ID NO: 376592 - RNA, 64 nt, Human; identical to SEQ ID NO: 375885

SEQ ID NO: 376593 - RNA, 64 nt, Human; identical to SEQ ID NO: 375886

SEQ ID NO: 376594 - RNA, 64 nt, Human; identical to SEQ ID NO: 375887

SEQ ID NO: 376595 - RNA, 64 nt, Human; identical to SEQ ID NO: 375888

SEQ ID NO: 376596 - RNA, 64 nt, Human; identical to SEQ ID NO: 375889

SEQ ID NO: 376597 - RNA, 64 nt, Human; identical to SEQ ID NO: 375890

SEQ ID NO: 376598 - RNA, 64 nt, Human; identical to SEQ ID NO: 375891

SEQ ID NO: 376599 - RNA, 64 nt, Human; identical to SEQ ID NO: 375892

SEQ ID NO: 376600 - RNA, 64 nt, Human; identical to SEQ ID NO: 375893

SEQ ID NO: 376601 - RNA, 64 nt, Human; identical to SEQ ID NO: 375894

SEQ ID NO: 376602 - RNA, 64 nt, Human; identical to SEQ ID NO: 375895

SEQ ID NO: 376603 - RNA, 64 nt, Human; identical to SEQ ID NO: 375896

SEQ ID NO: 376604 - RNA, 64 nt, Human; identical to SEQ ID NO: 375897

SEQ ID NO: 376605 - RNA, 64 nt, Human; identical to SEQ ID NO: 375898

SEQ ID NO: 376606 - RNA, 64 nt, Human; identical to SEQ ID NO: 375899

SEQ ID NO: 376607 - RNA, 64 nt, Human; identical to SEQ ID NO: 375900

SEQ ID NO: 376608 - RNA, 64 nt, Human; identical to SEQ ID NO: 375901

SEQ ID NO: 376609 - RNA, 64 nt, Human; identical to SEQ ID NO: 375902

SEQ ID NO: 376610 - RNA, 64 nt, Human; identical to SEQ ID NO: 375903

SEQ ID NO: 376611 - RNA, 64 nt, Human; identical to SEQ ID NO: 375904

SEQ ID NO: 376612 - RNA, 64 nt, Human; identical to SEQ ID NO: 375905

SEQ ID NO: 376613 - RNA, 64 nt, Human; identical to SEQ ID NO: 375906

SEQ ID NO: 376614 - RNA, 64 nt, Human; identical to SEQ ID NO: 375907

SEQ ID NO: 376615 - RNA, 64 nt, Human; identical to SEQ ID NO: 375908

SEQ ID NO: 376616 - RNA, 64 nt, Human; identical to SEQ ID NO: 375909

SEQ ID NO: 376617 - RNA, 64 nt, Human; identical to SEQ ID NO: 375910

SEQ ID NO: 376618 - RNA, 64 nt, Human; identical to SEQ ID NO: 375911

SEQ ID NO: 376619 - RNA, 64 nt, Human; identical to SEQ ID NO: 375912

SEQ ID NO: 376620 - RNA, 64 nt, Human; identical to SEQ ID NO: 375913

SEQ ID NO: 376621 - RNA, 64 nt, Human; identical to SEQ ID NO: 375914

SEQ ID NO: 376622 - RNA, 64 nt, Human; identical to SEQ ID NO: 375915

SEQ ID NO: 376623 - RNA, 64 nt, Human; identical to SEQ ID NO: 375916

SEQ ID NO: 376624 - RNA, 64 nt, Human; identical to SEQ ID NO: 375917

SEQ ID NO: 376625 - RNA, 64 nt, Human; identical to SEQ ID NO: 375918

SEQ ID NO: 376626 - RNA, 64 nt, Human; identical to SEQ ID NO: 375919

SEQ ID NO: 376627 - RNA, 64 nt, Human; identical to SEQ ID NO: 375920

SEQ ID NO: 376628 - RNA, 64 nt, Human; identical to SEQ ID NO: 375921

SEQ ID NO: 376629 - RNA, 64 nt, Human; identical to SEQ ID NO: 375922

SEQ ID NO: 376630 - RNA, 64 nt, Human; identical to SEQ ID NO: 375923

SEQ ID NO: 376631 - RNA, 61 nt, Human; identical to SEQ ID NO: 375924

SEQ ID NO: 376632 - RNA, 64 nt, Human; identical to SEQ ID NO: 375925

SEQ ID NO: 376633 - RNA, 64 nt, Human; identical to SEQ ID NO: 375926

SEQ ID NO: 376634 - RNA, 64 nt, Human; identical to SEQ ID NO: 375927

SEQ ID NO: 376635 - RNA, 64 nt, Human; identical to SEQ ID NO: 375928

SEQ ID NO: 376636 - RNA, 64 nt, Human; identical to SEQ ID NO: 375929

SEQ ID NO: 376637 - RNA, 64 nt, Human; identical to SEQ ID NO: 375930

SEQ ID NO: 376638 - RNA, 64 nt, Human; identical to SEQ ID NO: 375931

SEQ ID NO: 376639 - RNA, 64 nt, Human; identical to SEQ ID NO: 375932

SEQ ID NO: 376640 - RNA, 64 nt, Human; identical to SEQ ID NO: 375933

SEQ ID NO: 376641 - RNA, 64 nt, Human; identical to SEQ ID NO: 375934

SEQ ID NO: 376642 - RNA, 64 nt, Human; identical to SEQ ID NO: 375935

SEQ ID NO: 376643 - RNA, 64 nt, Human; identical to SEQ ID NO: 375936

SEQ ID NO: 376644 - RNA, 64 nt, Human; identical to SEQ ID NO: 375937

SEQ ID NO: 376645 - RNA, 64 nt, Human; identical to SEQ ID NO: 375938

SEQ ID NO: 376646 - RNA, 64 nt, Human; identical to SEQ ID NO: 375939

SEQ ID NO: 376647 - RNA, 64 nt, Human; identical to SEQ ID NO: 375940

SEQ ID NO: 376648 - RNA, 64 nt, Human; identical to SEQ ID NO: 375941

SEQ ID NO: 376649 - RNA, 64 nt, Human; identical to SEQ ID NO: 375942

SEQ ID NO: 376650 - RNA, 64 nt, Human; identical to SEQ ID NO: 375943

SEQ ID NO: 376651 - RNA, 64 nt, Human; identical to SEQ ID NO: 375944

SEQ ID NO: 376652 - RNA, 64 nt, Human; identical to SEQ ID NO: 375945

SEQ ID NO: 376653 - RNA, 64 nt, Human; identical to SEQ ID NO: 375946

SEQ ID NO: 376654 - RNA, 64 nt, Human; identical to SEQ ID NO: 375947

SEQ ID NO: 376655 - RNA, 64 nt, Human; identical to SEQ ID NO: 375948

SEQ ID NO: 376656 - RNA, 64 nt, Human; identical to SEQ ID NO: 375949

SEQ ID NO: 376657 - RNA, 64 nt, Human
gaagcaggcgagagagaaacagcuacugcgugcgugcgcgcacgcauacacacacacacacaca

SEQ ID NO: 376658 - RNA, 64 nt, Human
agucagguggcccguccuuggugagugcacacacugcgcgcacacaucgcggccuuccuggcuu

SEQ ID NO: 376659 - RNA, 64 nt, Human
gccucucgguggcagucuugguugguuagcuauuugcgcgcaaauguugugauccugccauuau

SEQ ID NO: 376660 - RNA, 64 nt, Human
cagaggggucacuagcaccuuguguguaugugugugcgcgcacguguguguagguggguaugug

SEQ ID NO: 376661 - RNA, 64 nt, Human
accuuguggaccuaauuuugugugcgugugugugugcgcgcauauguauauagacaggcacauc

SEQ ID NO: 376662 - RNA, 64 nt, Human
acacacacugccuggaugcauguaugcacacacaugcgcgcacacgugcucccugaaggcacac

SEQ ID NO: 376663 - RNA, 64 nt, Human
gggcagcuccucggguggggccugcgggguucccugcgcgcagcuggcgcguguguggccuaau

SEQ ID NO: 376664 - RNA, 64 nt, Human
uacuaaaaauacaaaaauuagccggacgugguggugcgcgcauguaaucccagcuacucgggag

SEQ ID NO: 376665 - RNA, 64 nt, Human
aaccaugcugcccguaagagucacaaccugugugugcgcgcaagguuagcaacaaacguacccg

SEQ ID NO: 376666 - RNA, 64 nt, Human
gcaucuauauguguauuauguaugcgugcaugcgugcgcgcacacacacacacacacacacaca

SEQ ID NO: 376667 - RNA, 64 nt, Human
cuaagaguugauuguggaaaacacgugaaucuauugcgcgcauuugucauuuagcaagauggca

SEQ ID NO: 376668 - RNA, 64 nt, Human
gagcacuuuccaaggcaucccccagccccaagccugcgcgcaucugucacucagggacuuucua

SEQ ID NO: 376669 - RNA, 64 nt, Human
agaccccuuuuuucugauacaaugcacgauucucugcgcgcaaggacccucgacucacccccau

SEQ ID NO: 376670 - RNA, 64 nt, Human
gcagcucugccuccgcagccucagugcgcuuuccugcgcgcacugcggagggcgcccuaagcgu

SEQ ID NO: 376671 - RNA, 62 nt, Human
cagguggaacuguaguguagcgaccucacugcugcgcgcacagucucccgggacuuggacuc

SEQ ID NO: 376672 - RNA, 64 nt, Human
aggagcaaaggcugagaacacugugaaaacauuuugcgcgcacaauaguaaccuggguaaaugc

SEQ ID NO: 376673 - RNA, 64 nt, Human
gugcggagggagaggggcgggcaggaaccggggcugcgcgcagcgcuugcgggccagagugagu

SEQ ID NO: 376674 - RNA, 64 nt, Human
caacaaaucagaaucacguuuuuaguugugcgugugcgcgcacacguguguaaaaagcacuuuc

SEQ ID NO: 376675 - RNA, 64 nt, Human
agcgucucuccucccuccuggggaaggucgcccuugcgcgcaagguuuuagcuuucagcaacug

SEQ ID NO: 376676 - RNA, 64 nt, Human
gaguuuccccagacaccgccacauggcuuccuccugcgcgcaugugcgcacacacacacacaca

SEQ ID NO: 376677 - RNA, 64 nt, Human
ccgcucagccccggcggggaggagcgggugggugugcgcgcaaggaggccgcacaccguuccuu

SEQ ID NO: 376678 - RNA, 64 nt, Human
gagcugcggcggcccagguacgaagcugcaacucugcgcgcagugggcgagaucucaucagccc

SEQ ID NO: 376679 - RNA, 64 nt, Human
cccugcguggacguggccugugcuucgcccgcacugcgcgcauccccaaccucuguccgcaugc

SEQ ID NO: 376680 - RNA, 64 nt, Human
ugugucugacaccugccagcagcccuuugcuaucugcgcgcaggaugggggugacugcccagac

SEQ ID NO: 376681 - RNA, 64 nt, Human
auggggcgucgucagcuggcacugucucugcugcagcggccacacuguacucugcacuggugug

SEQ ID NO: 376682 - RNA, 64 nt, Human
cuaacauaguucuacuaugcuagaaguggcauccagcggccacagcuagaaaacagucugcagu

SEQ ID NO: 376683 - RNA, 64 nt, Human
gcaccucugugucagggcucaccugggcauccaaagcggccacgcccacaauccgacagccccc

SEQ ID NO: 376684 - RNA, 64 nt, Human
aggacacagacucugcccugggaucuccugugcuagcggccaaugacaaauccagucauuggcc

SEQ ID NO: 376685 - RNA, 64 nt, Human
aaccggcucccacccucaaggugcggggagaagaagcggccaggcggggcgccccaagagccca

SEQ ID NO: 376686 - RNA, 64 nt, Human
gggagccugcucaccccacuccagggccuuccccagcggccaccaacugaccuggggcgcugcu

SEQ ID NO: 376687 - RNA, 64 nt, Human
uugcuauuuucugcuaccauuucuuuuccucugaagcggccaugacauucccuuuggcaacuaa

SEQ ID NO: 376688 - RNA, 64 nt, Human
acagcauccuaccuggguuuuuauccacaaagguagcggccacaugguuuuuaaaguaugagaa

SEQ ID NO: 376689 - RNA, 64 nt, Human
ccggcuguucuucccgccacgaucuuucugugguagcggccagcagaagacauggccugcuccc

SEQ ID NO: 376690 - RNA, 53 nt, Human
caucaucugaugaugucugaggaagcggccaagaaugucauucucaaugccca

SEQ ID NO: 376691 - RNA, 64 nt, Human
cggcucgggcggcgggcuccgggcccagccucgcagcggccaggagcgcgggccggcgaugcgg

SEQ ID NO: 376692 - RNA, 64 nt, Human
acgagcggucaccggaaucgcccgaucacagacgagcggccaccggaaucgcccaaucacagac

SEQ ID NO: 376693 - RNA, 64 nt, Human
ccccugcaccuggaggagagcaggcuagaggcacagcggccacauggugcuggcucugaacguu

SEQ ID NO: 376694 - RNA, 64 nt, Human
uccgagucuacccagcccuuguuagauucagaggagcggccagaagaucuacaauuaguagauc

SEQ ID NO: 376695 - RNA, 64 nt, Human
auguccaagaauggcuuucccucgggcagguggcagcggccaucucccacugggaauauggcgu

SEQ ID NO: 376696 - RNA, 64 nt, Human
ucccauccaggcuggaaggagcucucugugaccuagcggccauuuauuucucuguagcccuaug

SEQ ID NO: 376697 - RNA, 64 nt, Human
ccugcccuccccaccgaguccuguggccauucagagcggccacaugacuuuugcauccauugua

SEQ ID NO: 376698 - RNA, 64 nt, Human
ccuuggugguccucauguggaugggcaagaagagagcggccaucucggaucauaaucuccuugg

SEQ ID NO: 376699 - RNA, 64 nt, Human
gugggggaagugaaagggaaagcauccgugagaaagcggccacgguuuucccuccuugugugcc

SEQ ID NO: 376700 - RNA, 64 nt, Human
agucugucuuaauguuacuuuugaaaaucugcugagcggccaccauaugcaggcugagagcugg

SEQ ID NO: 376701 - RNA, 64 nt, Human
ccccacauaugcagggggugccccacacagcuagagcggccaggagagcgccuccuaaccacca

SEQ ID NO: 376702 - RNA, 64 nt, Human
ugaauguaaguuuugagaaauacgagucugucagagcggccauaagccauaaagagucaaucuc

SEQ ID NO: 376703 - RNA, 64 nt, Human
ucucugcuaugcuggagacgguuccagccuggaaagcggccaaguucaucuucucacugugagu

SEQ ID NO: 376704 - RNA, 64 nt, Human
cuugaacagcuggagggaagaugcaggggugggaagcggccaggcagaaagagcuccaggcucu

SEQ ID NO: 376705 - RNA, 64 nt, Human
auccagaaaaccaaguguccggauggcaggggccagcggccaccaagcucaugggacacccaga

SEQ ID NO: 376706 - RNA, 64 nt, Human
ucaggugccagcggaccaucggcuggcagagcccagcggccaccacccgucaacccugccagga

SEQ ID NO: 376707 - RNA, 56 nt, Human
agcagaucccgcaguccugaggagccagcggccaccugcggggagaccaccgccgc

SEQ ID NO: 376708 - RNA, 64 nt, Human
acucggauaccucuugauuucuguggauaagggaagcggccacuucucccucccugagacccga

SEQ ID NO: 376709 - RNA, 64 nt, Human
ccagagaaauuccuuuugggacuggaggcagaaaagcggccagaaggcagcagcccuggcuccu

SEQ ID NO: 376710 - RNA, 64 nt, Human
cugcccacgccgacuugggaggaugguggccugcagcggccaagaagccaaaaaaaauuuuuuu

SEQ ID NO: 376711 - RNA, 64 nt, Human
ccguggagggugccguggccaaguacaugggugcagcggccauguaccucaucagcaagcgacu

SEQ ID NO: 376712 - RNA, 64 nt, Human
cgggaggaucccgcccuguggcccguggaugcucagcggccaggcacugaccugccaugccucg

SEQ ID NO: 376713 - RNA, 64 nt, Human
gcaugucaauaauaaauguuuccccuuacugauaagcggccacuuuaggaguguagcaaauaua

SEQ ID NO: 376714 - RNA, 64 nt, Human
aaauaauccuaaauguuugauuaccucuccaugaagcggccacagaaacuguuggugcacauua

SEQ ID NO: 376715 - RNA, 64 nt, Human
gaaggaauagaaaggggcccccaauuuuuuuuuaagcggccagauaauaaauaauguaaccuuu

SEQ ID NO: 376716 - RNA, 64 nt, Human
aaagcaccgucgagaaauggcuccagcgcugacuagcggccaccucauuuccccccuugaccac

SEQ ID NO: 376717 - RNA, 64 nt, Human
ugcgacugaggauuaugcaacgugguccaaccggagcggccagcaugaccagcuguccaggggc

SEQ ID NO: 376718 - RNA, 64 nt, Human
uuuagcuguuaauuugaguacuuauggcccugaaagcggccacggugccuccagauggcagguu

SEQ ID NO: 376719 - RNA, 64 nt, Human
ugucugaaggguuacuuguaggucguggcuucugagcggccaccgaugcugcucucugcgggug

SEQ ID NO: 376720 - RNA, 64 nt, Human
ugagccuggacaacaacguggagccugcaccaggagcggccagggaggguucuccccaugacaa

SEQ ID NO: 376721 - RNA, 64 nt, Human
ucuguaaaaugggcugauuggccuccacggucagagcggccaucuggcugugccauccugcauu

SEQ ID NO: 376722 - RNA, 64 nt, Human
gugcccucuccuugccagcuucuccccaggccagagcggccaucgcguagaaagaaccagggug

SEQ ID NO: 376723 - RNA, 64 nt, Human
ggacuugagaacaccugugccucccugcucggccagcggccacggugccagagucaccaccuug

SEQ ID NO: 376724 - RNA, 64 nt, Human
cuggccuggucugcggguccaucgucagugccugagcggccagcagaaggggggcagcagccuc

SEQ ID NO: 376725 - RNA, 64 nt, Human
cuucuguguauucagcaaacacucacuaggugacagcggccaccaggcucugugcugggggacg

SEQ ID NO: 376726 - RNA, 64 nt, Human
ccaggggccaggcuugcggagggggagcccgcggagcggccagacuccccggggcgcucagccu

SEQ ID NO: 376727 - RNA, 64 nt, Human
ccuggagcccagccugggagcgcaaaacccaagaagcggccagaacgcaccuccggcuccggcg

SEQ ID NO: 376728 - RNA, 64 nt, Human
uagcgagagcagcuccgguggcgggaggaguggcagcggccaggcagcccagcuucgcgaaggc

SEQ ID NO: 376729 - RNA, 64 nt, Human
acagaugacgguacuggucaagaugggucaagcaagcggccacaagggacugaggcaagcacaa

SEQ ID NO: 376730 - RNA, 64 nt, Human
gccaccaccaccagacucaggcccugguguaagaagcggccaagugccuggacccagaggcuuu

SEQ ID NO: 376731 - RNA, 64 nt, Human
gccaucccgcgcaccuccagccuagcucgggccaagcggccaucggucuccuucgcggaaggua

SEQ ID NO: 376732 - RNA, 64 nt, Human
uuauuggacauccuucgagggggaagaggagggaagcggccagcucacccuuccgggacccuag

SEQ ID NO: 376733 - RNA, 64 nt, Human
gagcaaucccuucacgcuccuuggccauguucugagcggccagcuuggccuuugccuuaauaaa

SEQ ID NO: 376734 - RNA, 64 nt, Human
ucuacgacauguagacugcgcccacgggaugcacagcggccaugccugaugcuguccccacccu

SEQ ID NO: 376735 - RNA, 64 nt, Human
cccgucaaaucugugccuuauggagggguccggcagcggccacaauugucuuguccccucaccc

SEQ ID NO: 376736 - RNA, 64 nt, Human
gagcagcuccuuggccagaggcuuacaggcaacaagcggccaggcagggucuggccccgggcug

SEQ ID NO: 376737 - RNA, 64 nt, Human
ucccccgaccccuaccccacgcuacccagggcccagcggccaccccguaccacuguugauguga

SEQ ID NO: 376738 - RNA, 64 nt, Human
ccuucauuccacggaggaagcugaggccacagggagcggccaucgccauugggaaggggcgacu

SEQ ID NO: 376739 - RNA, 64 nt, Human
cugucuuccccagucagcucccucuaaaauacucagcggccagggcggcugccacucuucaccc

SEQ ID NO: 376740 - RNA, 64 nt, Human
ucggcagccugccccugugagacccacccucccgagcggccaaucgcauuugaguccuuauuug

SEQ ID NO: 376741 - RNA, 64 nt, Human
cagggaccagcgggcuagucccagggcauggcccagcggccagauucuuuuucccaggauuaaa

SEQ ID NO: 376742 - RNA, 64 nt, Human
cccgagcagagggucaugcgggccccacaggagaagcggccagggcccgcggggggcaccaccu

SEQ ID NO: 376743 - RNA, 64 nt, Human
ccauaguguuaggggcggugguggaggugggaucagcggccaggggaugccucagggccuggcc

SEQ ID NO: 376744 - RNA, 64 nt, Human
gaacaguguccccaggaaccaccuucuggagccuagcggccagacguggcuucuccugaguucu

SEQ ID NO: 376745 - RNA, 64 nt, Human
ugggcugcagcacagaggccugugacugcguuccagcggccaguucacuacgcaguaucucugg

SEQ ID NO: 376746 - RNA, 64 nt, Human
uuucuacaugaacaaggcaauuucagugucuuacagcggccaaaccaugacgugaagaaugaga

SEQ ID NO: 376747 - RNA, 64 nt, Human
gaaagaaaagagacaaaguuagaacgugcuggggagcggccauuucuaaggccagucugguuua

SEQ ID NO: 376748 - RNA, 64 nt, Human
uggaccuguggucuuagucccagcgauucugcagagcggccaucggcagcaugucaaccauuug

SEQ ID NO: 376749 - RNA, 64 nt, Human
ucuucacggcaugugcuuucucaggaaccuuucaagcggccagaaccccugcgaaucacacaug

SEQ ID NO: 376750 - RNA, 64 nt, Human
cgucgugggcgcauggcggcgcaccugcugcaggagcggccacgucucagcuucauuauaccau

SEQ ID NO: 376751 - RNA, 64 nt, Human
uccucauggcauguacuuucucaggaaccuuucaagcggccagaaccccugcgaaucacacaug

SEQ ID NO: 376752 - RNA, 64 nt, Human
agcccucugcacccaaagaggacuagagaugccgagcggccaugagagagagcggaaggagcag

SEQ ID NO: 376753 - RNA, 64 nt, Human
ccaaagcacucuucccacccuagucuuuguguccagcggccaagcuuaagccaugaagucaugg

SEQ ID NO: 376754 - RNA, 64 nt, Human; identical to SEQ ID NO: 376657

SEQ ID NO: 376755 - RNA, 64 nt, Human; identical to SEQ ID NO: 376658

SEQ ID NO: 376756 - RNA, 64 nt, Human; identical to SEQ ID NO: 376659

SEQ ID NO: 376757 - RNA, 64 nt, Human; identical to SEQ ID NO: 376660

SEQ ID NO: 376758 - RNA, 64 nt, Human; identical to SEQ ID NO: 376661

SEQ ID NO: 376759 - RNA, 64 nt, Human; identical to SEQ ID NO: 376662

SEQ ID NO: 376760 - RNA, 64 nt, Human; identical to SEQ ID NO: 376663

SEQ ID NO: 376761 - RNA, 64 nt, Human; identical to SEQ ID NO: 376664

SEQ ID NO: 376762 - RNA, 64 nt, Human; identical to SEQ ID NO: 376665

SEQ ID NO: 376763 - RNA, 64 nt, Human; identical to SEQ ID NO: 376666

SEQ ID NO: 376764 - RNA, 64 nt, Human; identical to SEQ ID NO: 376667

SEQ ID NO: 376765 - RNA, 64 nt, Human; identical to SEQ ID NO: 376668

SEQ ID NO: 376766 - RNA, 64 nt, Human; identical to SEQ ID NO: 376669

SEQ ID NO: 376767 - RNA, 64 nt, Human; identical to SEQ ID NO: 376670

SEQ ID NO: 376768 - RNA, 62 nt, Human; identical to SEQ ID NO: 376671

SEQ ID NO: 376769 - RNA, 64 nt, Human; identical to SEQ ID NO: 376672

SEQ ID NO: 376770 - RNA, 64 nt, Human; identical to SEQ ID NO: 376673

SEQ ID NO: 376771 - RNA, 64 nt, Human; identical to SEQ ID NO: 376674

SEQ ID NO: 376772 - RNA, 64 nt, Human; identical to SEQ ID NO: 376675

SEQ ID NO: 376773 - RNA, 64 nt, Human; identical to SEQ ID NO: 376676

SEQ ID NO: 376774 - RNA, 64 nt, Human; identical to SEQ ID NO: 376677

SEQ ID NO: 376775 - RNA, 64 nt, Human; identical to SEQ ID NO: 376678

SEQ ID NO: 376776 - RNA, 64 nt, Human; identical to SEQ ID NO: 376679

SEQ ID NO: 376777 - RNA, 64 nt, Human; identical to SEQ ID NO: 376680

SEQ ID NO: 376778 - RNA, 64 nt, Human; identical to SEQ ID NO: 376681

SEQ ID NO: 376779 - RNA, 64 nt, Human; identical to SEQ ID NO: 376682

SEQ ID NO: 376780 - RNA, 64 nt, Human; identical to SEQ ID NO: 376683

SEQ ID NO: 376781 - RNA, 64 nt, Human; identical to SEQ ID NO: 376684

SEQ ID NO: 376782 - RNA, 64 nt, Human; identical to SEQ ID NO: 376685

SEQ ID NO: 376783 - RNA, 64 nt, Human; identical to SEQ ID NO: 376686

SEQ ID NO: 376784 - RNA, 64 nt, Human; identical to SEQ ID NO: 376687

SEQ ID NO: 376785 - RNA, 64 nt, Human; identical to SEQ ID NO: 376688

SEQ ID NO: 376786 - RNA, 64 nt, Human; identical to SEQ ID NO: 376689

SEQ ID NO: 376787 - RNA, 53 nt, Human; identical to SEQ ID NO: 376690

SEQ ID NO: 376788 - RNA, 64 nt, Human; identical to SEQ ID NO: 376691

SEQ ID NO: 376789 - RNA, 64 nt, Human; identical to SEQ ID NO: 376692

SEQ ID NO: 376790 - RNA, 64 nt, Human; identical to SEQ ID NO: 376693

SEQ ID NO: 376791 - RNA, 64 nt, Human; identical to SEQ ID NO: 376694

SEQ ID NO: 376792 - RNA, 64 nt, Human; identical to SEQ ID NO: 376695

SEQ ID NO: 376793 - RNA, 64 nt, Human; identical to SEQ ID NO: 376696

SEQ ID NO: 376794 - RNA, 64 nt, Human; identical to SEQ ID NO: 376697

SEQ ID NO: 376795 - RNA, 64 nt, Human; identical to SEQ ID NO: 376698

SEQ ID NO: 376796 - RNA, 64 nt, Human; identical to SEQ ID NO: 376699

SEQ ID NO: 376797 - RNA, 64 nt, Human; identical to SEQ ID NO: 376700

SEQ ID NO: 376798 - RNA, 64 nt, Human; identical to SEQ ID NO: 376701

SEQ ID NO: 376799 - RNA, 64 nt, Human; identical to SEQ ID NO: 376702

SEQ ID NO: 376800 - RNA, 64 nt, Human; identical to SEQ ID NO: 376703

SEQ ID NO: 376801 - RNA, 64 nt, Human; identical to SEQ ID NO: 376704

SEQ ID NO: 376802 - RNA, 64 nt, Human; identical to SEQ ID NO: 376705

SEQ ID NO: 376803 - RNA, 64 nt, Human; identical to SEQ ID NO: 376706

SEQ ID NO: 376804 - RNA, 56 nt, Human; identical to SEQ ID NO: 376707

SEQ ID NO: 376805 - RNA, 64 nt, Human; identical to SEQ ID NO: 376708

SEQ ID NO: 376806 - RNA, 64 nt, Human; identical to SEQ ID NO: 376709

SEQ ID NO: 376807 - RNA, 64 nt, Human; identical to SEQ ID NO: 376710

SEQ ID NO: 376808 - RNA, 64 nt, Human; identical to SEQ ID NO: 376711

SEQ ID NO: 376809 - RNA, 64 nt, Human; identical to SEQ ID NO: 376712

SEQ ID NO: 376810 - RNA, 64 nt, Human; identical to SEQ ID NO: 376713

SEQ ID NO: 376811 - RNA, 64 nt, Human; identical to SEQ ID NO: 376714

SEQ ID NO: 376812 - RNA, 64 nt, Human; identical to SEQ ID NO: 376715

SEQ ID NO: 376813 - RNA, 64 nt, Human; identical to SEQ ID NO: 376716

SEQ ID NO: 376814 - RNA, 64 nt, Human; identical to SEQ ID NO: 376717

SEQ ID NO: 376815 - RNA, 64 nt, Human; identical to SEQ ID NO: 376718

SEQ ID NO: 376816 - RNA, 64 nt, Human; identical to SEQ ID NO: 376719

SEQ ID NO: 376817 - RNA, 64 nt, Human; identical to SEQ ID NO: 376720

SEQ ID NO: 376818 - RNA, 64 nt, Human; identical to SEQ ID NO: 376721

SEQ ID NO: 376819 - RNA, 64 nt, Human; identical to SEQ ID NO: 376722

SEQ ID NO: 376820 - RNA, 64 nt, Human; identical to SEQ ID NO: 376723

SEQ ID NO: 376821 - RNA, 64 nt, Human; identical to SEQ ID NO: 376724

SEQ ID NO: 376822 - RNA, 64 nt, Human; identical to SEQ ID NO: 376725

SEQ ID NO: 376823 - RNA, 64 nt, Human; identical to SEQ ID NO: 376726

SEQ ID NO: 376824 - RNA, 64 nt, Human; identical to SEQ ID NO: 376727

SEQ ID NO: 376825 - RNA, 64 nt, Human; identical to SEQ ID NO: 376728

SEQ ID NO: 376826 - RNA, 64 nt, Human; identical to SEQ ID NO: 376729

SEQ ID NO: 376827 - RNA, 64 nt, Human; identical to SEQ ID NO: 376730

SEQ ID NO: 376828 - RNA, 64 nt, Human; identical to SEQ ID NO: 376731

SEQ ID NO: 376829 - RNA, 64 nt, Human; identical to SEQ ID NO: 376732

SEQ ID NO: 376830 - RNA, 64 nt, Human; identical to SEQ ID NO: 376733

SEQ ID NO: 376831 - RNA, 64 nt, Human; identical to SEQ ID NO: 376734

SEQ ID NO: 376832 - RNA, 64 nt, Human; identical to SEQ ID NO: 376735

SEQ ID NO: 376833 - RNA, 64 nt, Human; identical to SEQ ID NO: 376736

SEQ ID NO: 376834 - RNA, 64 nt, Human; identical to SEQ ID NO: 376737

SEQ ID NO: 376835 - RNA, 64 nt, Human; identical to SEQ ID NO: 376738

SEQ ID NO: 376836 - RNA, 64 nt, Human; identical to SEQ ID NO: 376739

SEQ ID NO: 376837 - RNA, 64 nt, Human; identical to SEQ ID NO: 376740

SEQ ID NO: 376838 - RNA, 64 nt, Human; identical to SEQ ID NO: 376741

SEQ ID NO: 376839 - RNA, 64 nt, Human; identical to SEQ ID NO: 376742

SEQ ID NO: 376840 - RNA, 64 nt, Human; identical to SEQ ID NO: 376743

SEQ ID NO: 376841 - RNA, 64 nt, Human; identical to SEQ ID NO: 376744

SEQ ID NO: 376842 - RNA, 64 nt, Human; identical to SEQ ID NO: 376745

SEQ ID NO: 376843 - RNA, 64 nt, Human; identical to SEQ ID NO: 376746

SEQ ID NO: 376844 - RNA, 64 nt, Human; identical to SEQ ID NO: 376747

SEQ ID NO: 376845 - RNA, 64 nt, Human; identical to SEQ ID NO: 376748

SEQ ID NO: 376846 - RNA, 64 nt, Human; identical to SEQ ID NO: 376749

SEQ ID NO: 376847 - RNA, 64 nt, Human; identical to SEQ ID NO: 376750

SEQ ID NO: 376848 - RNA, 64 nt, Human; identical to SEQ ID NO: 376751

SEQ ID NO: 376849 - RNA, 64 nt, Human; identical to SEQ ID NO: 376752

SEQ ID NO: 376850 - RNA, 64 nt, Human; identical to SEQ ID NO: 376753

SEQ ID NO: 376851 - RNA, 64 nt, Human
cuguggagcaagaggcccugggucucuccaagcagcugcagaccccagcucgaauuuugcacau

SEQ ID NO: 376852 - RNA, 64 nt, Human
gcuggcccggccucccuuccguccaggcagccgugcugcagacagaccuagugccgagggaugg

SEQ ID NO: 376853 - RNA, 64 nt, Human
agugggagaucaaguuggggaacagauggcugaggcugcagacucaggcccaggacacucaacc

SEQ ID NO: 376854 - RNA, 64 nt, Human
cgccucgggucccagaugucugcagcccucagcagcugcagaccgccccucaccaacccagaga

SEQ ID NO: 376855 - RNA, 64 nt, Human
ccacagccucugccaagcuuugucuuuggggcuugcugcagaaaccuggccuacggaagauacg

SEQ ID NO: 376856 - RNA, 64 nt, Human
aaugaugauggcaaaaaggguguuugggggaacagcugcagaccugcugcucuaugcucacccc

SEQ ID NO: 376857 - RNA, 64 nt, Human
guguccuuucccuuaccucccucugccaggacuugcugcagagcugcugagaggauuagugccu

SEQ ID NO: 376858 - RNA, 64 nt, Human
cuaaaagaccucgggcaagucucacagaaacugagcugcagacggggaguagcuuuguggaaac

SEQ ID NO: 376859 - RNA, 64 nt, Human
agccaauuuaagaagacccuuauggagaccugaggcugcagaaacugguagguuucaucaggug

SEQ ID NO: 376860 - RNA, 64 nt, Human
ccauggcuacauugccaaaccucugacugccacagcugcagacugagagggugggucugagucc

SEQ ID NO: 376861 - RNA, 64 nt, Human
acaaccucccucacagaacagggaagcagugacagcugcagauggcagcgggccucuccccagc

SEQ ID NO: 376862 - RNA, 64 nt, Human
gggacggggcagggccuggccugggaagagcacagcugcagaucccaggccucuggcgccccca

SEQ ID NO: 376863 - RNA, 64 nt, Human
aacuauugacugggccccagaaauccauaaaauggcugcagacaguuguuucuguguccuguuc

SEQ ID NO: 376864 - RNA, 64 nt, Human
aguacaugcugacaggcaauuugcacuauauuuggcugcagauucaaauaggcaguucucuuau

SEQ ID NO: 376865 - RNA, 64 nt, Human
gguggguaaccagugccuucccuguaacgguaaugcugcagaacugcaaccuuuuguaccuuuc

SEQ ID NO: 376866 - RNA, 64 nt, Human
gacuggugccucgcuggugcugggucucugguuugcugcagagccguaggacacuccuggcucc

SEQ ID NO: 376867 - RNA, 64 nt, Human
cagaacaucgcgaugggaaccgaugguggguggggcugcagagugccccaucggucaccuuguu

SEQ ID NO: 376868 - RNA, 64 nt, Human
ucgugcacaaaaguuuccuuaaaauuccuggauggcugcagauguugggggaaaaaguacguga

SEQ ID NO: 376869 - RNA, 64 nt, Human
agaagcugauggacagugcggucuauguggagaugcugcagauccugcugccgcacuucagcga

SEQ ID NO: 376870 - RNA, 64 nt, Human
gcccuuauauuaauuuaugagcuuuuccaucucugcugcagaccugugcuaaugcuuagugugu

SEQ ID NO: 376871 - RNA, 64 nt, Human
aaucugaguuuaaaaagauuuuaccuuuuugauugcugcagaaauguccuaugcacucuuugca

SEQ ID NO: 376872 - RNA, 64 nt, Human
gaacuagaccacuuucuucauucuuuucuaaacugcugcagauugccgugaacucuaucaauag

SEQ ID NO: 376873 - RNA, 64 nt, Human
gcuguugauauuaucacugcaaaucacauugccagcugcagagcauauuguggauuggaaaggc

SEQ ID NO: 376874 - RNA, 64 nt, Human
acaucaggaacuuuccccacugccuccaugcaaggcugcagagcuauggucccuuucuccacug

SEQ ID NO: 376875 - RNA, 55 nt, Human
gcucugggggcugcugcugaccugggcugcagaagagcucugguacugaaugguc

SEQ ID NO: 376876 - RNA, 64 nt, Human
acaaauuccacaaagaacacccuauaugaccacagcugcagaucaguucuuagcaaugauguuu

SEQ ID NO: 376877 - RNA, 64 nt, Human
gcccagccuagcgugcccugccccucuggccacugcugcagacaccugccuuaacacacacacc

SEQ ID NO: 376878 - RNA, 64 nt, Human
acggguaggcaccaggggcuuuguacauucaggagcugcagagaggaaaggucucccauguacc

SEQ ID NO: 376879 - RNA, 64 nt, Human
cuguauuuuauguaauguaauugacaggauggcugcugcagaaugcugguugacacagggauua

SEQ ID NO: 376880 - RNA, 64 nt, Human
augagcaccccaggcagcucaagcugaauaaauagcugcagacauggccaacaacauggggcuc

SEQ ID NO: 376881 - RNA, 64 nt, Human
ggaucgugcauuugaggggccaggggcaggcagggcugcagagggagacggcccugcuggggcu

SEQ ID NO: 376882 - RNA, 64 nt, Human
acauagaaacacccacauggacacaaggaauguugcugcagagacugaaugacaugcaacaggu

SEQ ID NO: 376883 - RNA, 64 nt, Human
ggaagaccucguuuucuaaaggcuggacuaaauggcugcagaacucccuuuggcaaaaggcaug

SEQ ID NO: 376884 - RNA, 64 nt, Human
aggucguuagcugggugugugggucccaaggcgugcugcagauggagaaucagaauuccuuggg

SEQ ID NO: 376885 - RNA, 64 nt, Human
gucaugcugggaagugccuacucucugggccacugcugcagaggccguggcacuugucaugggu

SEQ ID NO: 376886 - RNA, 62 nt, Human
cagugcugaggcggcauuaagaggaaguccuggcugcagacaccugcuucugauuccacaag

SEQ ID NO: 376887 - RNA, 64 nt, Human
guggcuggaucugagugcuccugagcuggcuucagcugcagaacucucagucccucaucagauc

SEQ ID NO: 376888 - RNA, 64 nt, Human
uacugucccuugaagcccagccacaaguguuggagcugcagagagaccccaaagguaguagauu

SEQ ID NO: 376889 - RNA, 64 nt, Human
ugucagacuuggcaucuaucucaguuaggauccugcugcagaaaacaagagccacuuguagcug

SEQ ID NO: 376890 - RNA, 64 nt, Human
ugccguguccugaaaaggcagaaaaggaagaggggcugcagacagaggaagaaaguuuauggau

SEQ ID NO: 376891 - RNA, 64 nt, Human
aauggcagagucucuagagguagaaauuugccuugcugcagagagagaaggaauggcgugggau

SEQ ID NO: 376892 - RNA, 64 nt, Human
agcuauuucaucuuccagcucagcuccacacaaagcugcagaaggacgaaaugaaaagcauuug

SEQ ID NO: 376893 - RNA, 64 nt, Human
cucuucugcacucugagcuggccagccccucggggcugcagagcagugagccuacaucugccac

SEQ ID NO: 376894 - RNA, 64 nt, Human
ccaggccuauguugauccauccagcuugccagaugcugcagagucacaagccucgaggugccuu

SEQ ID NO: 376895 - RNA, 50 nt, Human
acaagaaaguagacuccugagcugcagagucccccccgguugccggcaag

SEQ ID NO: 376896 - RNA, 64 nt, Human
uuaguuccgaauucaggcuguuggccagguaauugcugcagagggagaaauaagacagacagau

SEQ ID NO: 376897 - RNA, 64 nt, Human
ccacguuuaauacuuuguuuuggaaaauuuaaaugcugcagauuuguguagaguucuaauacca

SEQ ID NO: 376898 - RNA, 64 nt, Human
uggcgagacgaaacagcuguagagaugaaaacaggcugcagaggcuggcacagccuggccggcu

SEQ ID NO: 376899 - RNA, 64 nt, Human
caucuguuaacauuaaaaccagaaggcaguaugugcugcagaguacauaagaagaggcuuuaaa

SEQ ID NO: 376900 - RNA, 64 nt, Human
agcccuuaaguucacuaagaaggucugaguuucugcugcagauagugguguuaacugcuccaac

SEQ ID NO: 376901 - RNA, 64 nt, Human
agcauugucauuucuucucugagggucccagggagcugcagaugcagaccccgucguuagucca

SEQ ID NO: 376902 - RNA, 64 nt, Human
cagguuggaguccuguccuuacucugcugcaccagcugcagaaccaacugcucaaagccaaaca

SEQ ID NO: 376903 - RNA, 64 nt, Human
gaugacaggaagcgacgccucuggcagggcccuugcugcagaguugguggagaacagaaaucca

SEQ ID NO: 376904 - RNA, 64 nt, Human
aggcuuccagagaguccucuggauggcaccagaggcugcagaaggccaagaaucaagcuagaag

SEQ ID NO: 376905 - RNA, 64 nt, Human
ggucuguguuuguuuuuauuuuuauauguuguuagcugcagauuaaccccagccccucugucuu

SEQ ID NO: 376906 - RNA, 64 nt, Human
ucaaguagcucacucuaaguuacaggguuugcuagcugcagacuggagacuagaucucagguca

SEQ ID NO: 376907 - RNA, 64 nt, Human
agucccagcuuugagccagcagcugccacuuggggcugcagagcucuguugagggaacugccca

SEQ ID NO: 376908 - RNA, 64 nt, Human
caagagcaucuuggcccugggaagaggucccuaggcugcagaugcuacugacugcuugcuaggu

SEQ ID NO: 376909 - RNA, 64 nt, Human
uauaacguuuucaucuccuuuccuggagaaagcagcugcagagguucuguauuuccugcauuuc

SEQ ID NO: 376910 - RNA, 64 nt, Human
gauugggaggugaguggaggagagucucugaccagcugcagagccaaccccuaucauuuuauua

SEQ ID NO: 376911 - RNA, 64 nt, Human
gacuuugagacgguguaccagcagugugucaggugcugcagagcguucuuggagaaggcccacu

SEQ ID NO: 376912 - RNA, 64 nt, Human
ccccaccccugggaugcgaagccagcaagcuuuugcugcagauggacagguuucuuuucugugg

SEQ ID NO: 376913 - RNA, 64 nt, Human
uccucucucuugcuccccgcuucguucuguuuuggcugcagagagugguucauccauacucuca

SEQ ID NO: 376914 - RNA, 64 nt, Human
uuuuuuuugucguguaagaaggaugcuggucagagcugcagaaaauaugaggcaauuaaaaguc

SEQ ID NO: 376915 - RNA, 64 nt, Human
uuggaaaggaguagaacaugcagcauaagaaacugcugcagaguggugcgaggaguacauuuuc

SEQ ID NO: 376916 - RNA, 64 nt, Human
cccgacucacucagaccccaaggcccacuguccagcugcagaaauucguugccaaagauuggac

SEQ ID NO: 376917 - RNA, 64 nt, Human
gcuauaccccacugcugcccgacacugcccuuuagcugcagagcuggauuagcuguugaccauu

SEQ ID NO: 376918 - RNA, 64 nt, Human
aguucgaacguggucuugaccgucagcacaucccgcugcagagggcauucccuuuaaggcuuga

SEQ ID NO: 376919 - RNA, 64 nt, Human
cgagcucggcaccuccccggccucucucuucccagcugcagaugccacaccugcuccuucuugc

SEQ ID NO: 376920 - RNA, 64 nt, Human
caggcagaguggagccuccugcucuccuggaccagcugcagacccccaacccugguuucugugc

SEQ ID NO: 376921 - RNA, 64 nt, Human
gaugugugaaaaucuuuuccagggaaauggguucgcugcagagguaaggauguguuccuguauc

SEQ ID NO: 376922 - RNA, 64 nt, Human
gugcugugcugcugcuggucuccugauggcuguugcugcagaagauguccucguagacugucau

SEQ ID NO: 376923 - RNA, 64 nt, Human
ugagaugaugcaugaugcccuccccucagcgcaggcugcagagcccggccccaccucccugcgc

SEQ ID NO: 376924 - RNA, 64 nt, Human
cccgcagacaccuuggacauccuccucccacccggcugcagaggccagaggcccccagcccagg

SEQ ID NO: 376925 - RNA, 64 nt, Human
ccggcagcagagcgcauggugcuagccauggccggcugcagaggacccagugaggaaagcucag

SEQ ID NO: 376926 - RNA, 64 nt, Human
uaaaauuaauacuuuauaauaaaacacuuuuauugcugcagaauguuaaacugcauaacaggca

SEQ ID NO: 376927 - RNA, 64 nt, Human
gauuuuugcuaagugcaggaggcccuuuauuauugcugcagaaaacaaaagccuggcugaguug

SEQ ID NO: 376928 - RNA, 55 nt, Human
cgcagcccaaaaacaaaugaguuaggcugcagaggacugguuuguuuuuuggcau

SEQ ID NO: 376929 - RNA, 64 nt, Human
uaauaguuucuucauacucugcauauaauuuguggcugcagaauauuguaauuuguugcacacu

SEQ ID NO: 376930 - RNA, 64 nt, Human
gcucugaauguagccagcccacauccauuccagagcugcagaaccagucccucugagugaaguc

SEQ ID NO: 376931 - RNA, 64 nt, Human
agucauagauguuaauagaggaagcaguuuuccugcugcagauuccugaauagaguugcugaaa

SEQ ID NO: 376932 - RNA, 64 nt, Human
aaggcauuuggaugccucucuguuggggccuggggcugcagaacacaccugcguuucacuggcc

SEQ ID NO: 376933 - RNA, 64 nt, Human
gaaaugcauguaugaacuacccuaugaaauguaagcugcagaauagauaaaacacagguuucca

SEQ ID NO: 376934 - RNA, 64 nt, Human
cgcggaggugcccuuuuccuggugcuuugugguggcugcagaagaccaguuuuguugagaacug

SEQ ID NO: 376935 - RNA, 64 nt, Human
accuugcacccagagcaagaggacugggugcugggcugcagaggccggucaguggagccccuag

SEQ ID NO: 376936 - RNA, 64 nt, Human
cccaagaucagggguccggcuguccuucuguccugcugcagacuaaaggucuggccaaugucuu

SEQ ID NO: 376937 - RNA, 64 nt, Human
cauucuuaguucucagguugggacuucaauuacugcugcagagcaguagugguuaaaaauaaga

SEQ ID NO: 376938 - RNA, 64 nt, Human
ccuuugugaggcauuaguauagaccaaauaaaaagcugcagaaauuggaaaguuuauguuuuaa

SEQ ID NO: 376939 - RNA, 64 nt, Human
ugucugcggcgcugccucagcgugcuaaucaauggcugcagaaaccuaacaccauguaccagca

SEQ ID NO: 376940 - RNA, 64 nt, Human
ggacaaagcagcagaggucguaaagaauacaaaugcugcagaggaauccuuaccagagauccag

SEQ ID NO: 376941 - RNA, 64 nt, Human
gcuaaugaaggggagauuuacaaacaucaagaaagcugcagauggauguuuccaugaagaaauc

SEQ ID NO: 376942 - RNA, 64 nt, Human
uccuggcuccugggcugggacaagugaggaacuagcugcagagggaugagugaccaccauccag

SEQ ID NO: 376943 - RNA, 64 nt, Human
caggccaugcauccugcugccaaggguggacacggcugcagacuucugggggaauugucgccuc

SEQ ID NO: 376944 - RNA, 64 nt, Human
ggucugggggccucucauccggcaccgggcccuggcugcagagaccuucagugccauccugacu

SEQ ID NO: 376945 - RNA, 64 nt, Human
caguccaggagauggacuggcuggugcugggggagcugcagauggcccuggagugggcaggcag

SEQ ID NO: 376946 - RNA, 64 nt, Human
gcccugggcugggugcccgaggggcucauaugcugcugcagaaugagcucuuccugaacguggg

SEQ ID NO: 376947 - RNA, 64 nt, Human
gaagugagcaaaaaagaguugggugucuccuuaagcugcagagauuucucauugacuuuuauaa

SEQ ID NO: 376948 - RNA, 64 nt, Human
gcagauacuccccugaguccccgaucuagggccagcugcagagggcucucucuaggcagagcgu

SEQ ID NO: 376949 - RNA, 64 nt, Human
agcccgggagcuuugagacaggugccuggggcuggcugcagacggugugguugggggugggagg

SEQ ID NO: 376950 - RNA, 64 nt, Human
gauaacaggccaauccugaagguacucccuguuugcugcagaaugucagauauuuuggauguug

SEQ ID NO: 376951 - RNA, 64 nt, Human
auguauguuaugcagagacacucugccucugguggcugcagagcaauacccaagccucauuugg

SEQ ID NO: 376952 - RNA, 64 nt, Human
cccaagcuucccuccaucccccuuuacccucuuugcugcagagaaacuuaagcaaaggggacag

SEQ ID NO: 376953 - RNA, 64 nt, Human
uucucaagucguuauugauacagcaagugaaccugcugcagacagaagcagaggaaagccaaga

SEQ ID NO: 376954 - RNA, 64 nt, Human
cauuuugaucuguaacugcacaacccugggguuugcugcagagcuauuucuuuccauguaaagu

SEQ ID NO: 376955 - RNA, 64 nt, Human
cacugaggacgcccgacagagcuugugcaccuaagcugcagaccaagccuuugcccagaauuua

SEQ ID NO: 376956 - RNA, 64 nt, Human
cauguauuaaugcuguggcuaugagaggccuccugcugcagaaacacacuucccuacaucaaga

SEQ ID NO: 376957 - RNA, 64 nt, Human
gguagugcagaggcacagauuccguccuuuaccagcugcagaaucuugggcaaguuacauagcc

SEQ ID NO: 376958 - RNA, 64 nt, Human
cccaccaaaacaaacuuuucaaugaucaaaaaaugcugcagauuuuuugaguucccaauacguu

SEQ ID NO: 376959 - RNA, 64 nt, Human
uuuuuuacuuuuuuguuaauaagcaaacuuauuugcugcagaauuuggguugacuccugagcau

SEQ ID NO: 376960 - RNA, 64 nt, Human
cucgagaggcuggucccuggagaacugcgaacgagcugcagaaaaccagauuuuaaaauguaga

SEQ ID NO: 376961 - RNA, 64 nt, Human
gccagacaggcagacugggaggauggaggacggagcugcagacgaaggcaggggacccauggcg

SEQ ID NO: 376962 - RNA, 64 nt, Human
guuccaagcgcugccuucuccaacugggguccuggcugcagagcugucugcuccccacguuggg

SEQ ID NO: 376963 - RNA, 64 nt, Human
guucugcugccucaggucaggccagggcagugcugcugcagagcuagaaggcccugcagcuaca

SEQ ID NO: 376964 - RNA, 64 nt, Human
gcacgaccucacugaguccucacaacaaauccaggcugcagauuuuuuuccccacuuggagaug

SEQ ID NO: 376965 - RNA, 64 nt, Human
ccagugccgccugugcccacgugugcagacuguggcugcagagaccuugcgaccauguguagau

SEQ ID NO: 376966 - RNA, 64 nt, Human
ucugccccuacaucucagcugaaucuccagggaggcugcagagcaucguggagaccacuuucug

SEQ ID NO: 376967 - RNA, 64 nt, Human
uccuggagcccucccaguaccucgggcugcaagagcugcagacccguucagacacugcguugcg

SEQ ID NO: 376968 - RNA, 64 nt, Human
uuuacacaucuauaaaauguaaugggauugcagagcugcagaguacaguguaacaguacucuca

SEQ ID NO: 376969 - RNA, 64 nt, Human
cccuuauaggaacagaagaggaaagagagacacagcugcagaggccaccuggauugugccuaau

SEQ ID NO: 376970 - RNA, 64 nt, Human
agacccccacccugcaauccacaccccauccucugcugcagaagcuauggucuguguggugaca

SEQ ID NO: 376971 - RNA, 64 nt, Human
ggaggggaagaaagucacagcacugaugaggacagcugcagagguggcaguguguggacacagg

SEQ ID NO: 376972 - RNA, 64 nt, Human
caguggucuguuauggggcuuugcagcguggggggcugcagaagauucucagacauucuuaucc

SEQ ID NO: 376973 - RNA, 64 nt, Human
uuuggauuggggucaauugcaguccacguaacuggcugcagagaaaucuaccgagcaaggaaaa

SEQ ID NO: 376974 - RNA, 64 nt, Human
cccuuacaggaacagaagaggaaagagagacacagcugcagaggccaccuggauugcgccuaau

SEQ ID NO: 376975 - RNA, 64 nt, Human
guauuggcuugggaguagaagaagggucgucccugcugcagaagcuguauacugauaauugaag

SEQ ID NO: 376976 - RNA, 64 nt, Human
uugaaauggagauuuuuaagaguuuuaaccagcugcugcagauauauaacucaaaacagauaua

SEQ ID NO: 376977 - RNA, 64 nt, Human
uaacuguguuguuauguggcaaaggggaaugaaggcugcagauggaaguaaaauagauuaugcu

SEQ ID NO: 376978 - RNA, 64 nt, Human
uuaggccucaaaugacaguagcauugaaguguuugcugcagaguugagggaaacccccagccac

SEQ ID NO: 376979 - RNA, 64 nt, Human
acuguauuucccucucauuuugaccuacucucaugcugcagaggguacuuuaagacauacuccu

SEQ ID NO: 376980 - RNA, 64 nt, Human
uacacaacagccccuucugcccccgcacagaaaugcugcagaguauauaaaacuugagacauuu

SEQ ID NO: 376981 - RNA, 64 nt, Human
uguagcuguacuuuuguauguguauauuuuuauagcugcagauuguccacacaguauacuuuug

SEQ ID NO: 376982 - RNA, 64 nt, Human
aaagggcuccucuccagucugaucugugaauugagcugcagaaacgaagccaucuuucuuugga

SEQ ID NO: 376983 - RNA, 64 nt, Human
gggcgacucagcuugagccccuccacccccgcaggcugcagagcaaggaugaagccucaggagg

SEQ ID NO: 376984 - RNA, 64 nt, Human
ugcagauggcuggaugugaaagagacaugcucuagcugcagaggcaaauuugaagugccacgga

SEQ ID NO: 376985 - RNA, 64 nt, Human
aggacuuuaguagagacugaguaccaggccacgggcugcagauccugaauggaggaaggauaug

SEQ ID NO: 376986 - RNA, 64 nt, Human
acuccuaggagucaaguucagcaucuucaccguggcugcagagcugccugaugggcacuagagg

SEQ ID NO: 376987 - RNA, 64 nt, Human
ggaguggagucauacgcgaaggguguguggccaggcugcagagcugcgugccguuuguguccga

SEQ ID NO: 376988 - RNA, 64 nt, Human
accaggucaggccugugcagaccccugcccugccgcugcagaaauccagaagcauccuuaaugc

SEQ ID NO: 376989 - RNA, 64 nt, Human
auugcuugaaccugggagacggagguugcggugagcugcagaggccucaccucuaauugagaca

SEQ ID NO: 376990 - RNA, 64 nt, Human
augucaaauguucuugauagacucugaagagucugcugcagaagaaccagguuaaaaaaacagg

SEQ ID NO: 376991 - RNA, 64 nt, Human
uacaaaaaaauaaaaauuaaaaaaaaauuauuaggcugcagaggcaagaggauccccugagccc

SEQ ID NO: 376992 - RNA, 64 nt, Human
aguacacccauugcuccuacuuguuacuauuauugcugcagaucugccuccaagguugaaaagg

SEQ ID NO: 376993 - RNA, 64 nt, Human
aggccucuugcugcggcugcaauggaggcaaggggcugcagagcccaggugcacugugugauga

SEQ ID NO: 376994 - RNA, 64 nt, Human
cccucccacaccucucaccucacaggcacaucaggcugcagaaugcgcuuuagaaagcauuguu

SEQ ID NO: 376995 - RNA, 64 nt, Human
ucucaguuggcuucccccagauucugauucuacagcugcagaauguauauaacgcaauaaaagc

SEQ ID NO: 376996 - RNA, 64 nt, Human
caccgggcucccugggcacccagcaagaucuggggcugcagagaacagaagagcuggugcacuu

SEQ ID NO: 376997 - RNA, 64 nt, Human
ugacccggcacagccagccggccacgcccacgccgcugcagagccgcaccuccauugugcaggc

SEQ ID NO: 376998 - RNA, 64 nt, Human
gcugagcgccaggccuggggaggaagaggcuugggcugcagaugcacgcacauuuguuuuucac

SEQ ID NO: 376999 - RNA, 64 nt, Human
acucuagcagacacauacacaccccugaaauggggcugcagagcaggcugucucagccuugcca

SEQ ID NO: 377000 - RNA, 64 nt, Human
guaacuagggaccaauaugugccacgugccuguggcugcagacucccagagaaccagcacuggg

SEQ ID NO: 377001 - RNA, 64 nt, Human
cuuauuauucuuauuucagagccugcgaggucaagcugcagagaacaugagcuucuaccuccag

SEQ ID NO: 377002 - RNA, 64 nt, Human
caaccuccccgcagagcucccuuccugacccuccgcugcagaggauugaggcuuaauucugagc

SEQ ID NO: 377003 - RNA, 64 nt, Human
gacccacuaauccucugggauuggccgacugugagcugcagauaaggcuaucagccaccaaaga

SEQ ID NO: 377004 - RNA, 64 nt, Human
uagacuucaagugaaugucagccuaagaggccaagcugcagaucguggcaacagaugagcucug

SEQ ID NO: 377005 - RNA, 64 nt, Human
ggugagggcaagaugaaggcuuccaggcagaacagcugcagagaguuuggcuauaugcaucugc

SEQ ID NO: 377006 - RNA, 64 nt, Human
ucaacugccuacaucuggggcaagcagcacaccggcugcagaugggacagccagcccugccuau

SEQ ID NO: 377007 - RNA, 64 nt, Human
cagcgcugguugacaaaggguguugaagauuuuugcugcagaaucaguuacaaacaucacaguu

SEQ ID NO: 377008 - RNA, 64 nt, Human
uuaagaaaggaaagggacagaagucuugcaauaggcugcagacauuuuaauaccaugccagaga

SEQ ID NO: 377009 - RNA, 64 nt, Human
ucuuaccagucacaaagucagagaugguggugaggcugcagagcaaaagaaacagacacuguug

SEQ ID NO: 377010 - RNA, 64 nt, Human
aaguggugguauaucuuauccauaucuuuaggcugcugcagaauuuuaagguuauagauaaagc

SEQ ID NO: 377011 - RNA, 64 nt, Human
ugggcugaggcgucuguggagagguggcaccggggcugcagagggcggcugggguuccgucgug

SEQ ID NO: 377012 - RNA, 64 nt, Human
agcaguggcacuggaccuccugucuguccgugaggcugcagaacacaaggcagcucccaaugcc

SEQ ID NO: 377013 - RNA, 64 nt, Human
agcaauguguggcugaagacuuuuguuaugaggagcugcagauuagcuaggggacagcuggaau

SEQ ID NO: 377014 - RNA, 64 nt, Human
agaacauaguaucaugaauggaguagacagggaggcugcagaagccauuucucuuuguagauaa

SEQ ID NO: 377015 - RNA, 64 nt, Human
cccuccucuccuccggggggcaaggauggagucugcugcagacccauuggauuugcugcuggua

SEQ ID NO: 377016 - RNA, 64 nt, Human
gaacaacuuuuuaaaugccuucagugucaguugugcugcagacaguaugaacaucucauuggac

SEQ ID NO: 377017 - RNA, 64 nt, Human
ggugcuggaacaggcccuggccccuacuugugaagcugcagauauagguaagauaauaucaucc

SEQ ID NO: 377018 - RNA, 64 nt, Human
uuucuggaaauuccuucaggugcucucaagcccugcugcagagauccuuuucagagcacacacu

SEQ ID NO: 377019 - RNA, 64 nt, Human
cucccuuuucuucucucugugguggagaaccacagcugcagaguaggcagcugccuccaggaug

SEQ ID NO: 377020 - RNA, 64 nt, Human
gcccucggcuccaaauucuggccucucaucccaggcugcagacccuucugccccaugacaggcc

SEQ ID NO: 377021 - RNA, 64 nt, Human
cacagggcuccuucuggagcauuugguggggacagcugcagagaagaggccuggaacucgggca

SEQ ID NO: 377022 - RNA, 64 nt, Human
cccgaggaaaugugaccagugguuucugcucggagcugcagaccccagggcucuugguggaggc

SEQ ID NO: 377023 - RNA, 64 nt, Human
auauuuggucauauugccugccuaccccaugccugcugcagaaauauucauccagguuaaccuu

SEQ ID NO: 377024 - RNA, 64 nt, Human
caccugaaauucuuggccaguccucuuucccgcagcugcagagaggaggaagacuauuaaagga

SEQ ID NO: 377025 - RNA, 64 nt, Human
ccgauccugagcacagccauuuugccccauccccgcugcagaaggacucaaccacuccccuaag

SEQ ID NO: 377026 - RNA, 64 nt, Human
aggggccaaacuuacuaccuugacuucaucucuagcugcagaaacacuaagucucaagggcuuc

SEQ ID NO: 377027 - RNA, 64 nt, Human
cuugucugaagcucuccugaucuuagaaccuggagcugcagauuccuccaugucagcucccauc

SEQ ID NO: 377028 - RNA, 62 nt, Human
uaaagucaaagccauuguagaagacuuaacaagcugcagauaaccauguggacuucugucau

SEQ ID NO: 377029 - RNA, 64 nt, Human
ugcauucgauuguccaucgggaccacacuaggaagcugcagagagugauggugcuuguuaggga

SEQ ID NO: 377030 - RNA, 64 nt, Human
ccagggcagagcaggcuuuguucgcaccucaucugcugcagaaccacauccugaggagucucag

SEQ ID NO: 377031 - RNA, 64 nt, Human
cauaggcuugcuaguuccuucuuggucagagguagcugcagaggggggaggccaaggguuuggu

SEQ ID NO: 377032 - RNA, 64 nt, Human
gcagcccuugccaccucccucugccaagccugcugcugcagaacgguuuuugcugaggugcccc

SEQ ID NO: 377033 - RNA, 64 nt, Human
uucagcuucuaaacgaugccuggagagucuguuugcugcagacacccuugcuccugagucauua

SEQ ID NO: 377034 - RNA, 64 nt, Human
cugaugcaggccggcucccaguggggcaggccucgcugcagaaugcccaguaguacugcggcca

SEQ ID NO: 377035 - RNA, 64 nt, Human
cacagaaggacuucuucugggaggcccuggacaugcugcagagggcugaaggaggcgggggugg

SEQ ID NO: 377036 - RNA, 64 nt, Human
gccagcucacggauccugcugugugagcccuucagcugcagagcgggggaggucugcacccugg

SEQ ID NO: 377037 - RNA, 54 nt, Human
acccagcuggcaugcaauaacaaggcugcagacggugacuggcccuggcuuccu

SEQ ID NO: 377038 - RNA, 64 nt, Human
augcuauauaauucagcaaguaccaacuuguguagcugcagaauaaccaaguggcuauccaguc

SEQ ID NO: 377039 - RNA, 64 nt, Human
gcuuauuagugaaagagaccuguggauugaaauggcugcagauagaucccgcagucccuucuga

SEQ ID NO: 377040 - RNA, 64 nt, Human
cgugccuaggaucccuucccagcucugaggacgggcugcagagcucugcagguguggauucacc

SEQ ID NO: 377041 - RNA, 64 nt, Human
agagccccaggcaggacaaagggagcaggcagcagcugcagaaacagcccuagacaggugcugg

SEQ ID NO: 377042 - RNA, 64 nt, Human
acacguaaugaaacuuggauuugcucagugucuggcugcagagcagugggccuggccagcaggu

SEQ ID NO: 377043 - RNA, 64 nt, Human
ucuggcaaagucaggcucagggagacucugcccugcugcagaccucgguguggacacacgcugc

SEQ ID NO: 377044 - RNA, 64 nt, Human
ccugguggcgucugcaggugagcaaagcuaccacgcugcagaagacagcugaguacauccuuau

SEQ ID NO: 377045 - RNA, 64 nt, Human
aggggccuacagcuccuaccuugggcccucaggggcugcagaggaaccugggucccuguccugc

SEQ ID NO: 377046 - RNA, 64 nt, Human
ccccucagcugggccuggggaggagucgaagggggcugcagagaggguagagaagggacuuugc

SEQ ID NO: 377047 - RNA, 64 nt, Human
gaggugagggugggcgugggcgggaugcuguucagcugcagacuuucuuccugggacgaggaga

SEQ ID NO: 377048 - RNA, 64 nt, Human
ucagcgggccggagcugaucgcucucacuggccugcugcagaugagccagggggagccuaggcc

SEQ ID NO: 377049 - RNA, 64 nt, Human
cugccuuuguagggacagcaaaaggggaaaauuugcugcagaaaauuccaaaagauugcuguag

SEQ ID NO: 377050 - RNA, 64 nt, Human
caaaugucgacucagcuaaccauauguccagguugcugcagaguuucuuucaaaucugaguguu

SEQ ID NO: 377051 - RNA, 64 nt, Human
ucacauggaaggcggcacagaggcagcugugugggcugcagauuuccugugugggguucagcgu

SEQ ID NO: 377052 - RNA, 64 nt, Human
cugagcauguggagcgagagggaggcagguggacgcugcagaccccagguucagugcggccccu

SEQ ID NO: 377053 - RNA, 64 nt, Human
uguggggagggugucuggggacguugcugagccagcugcagaaggguggggauaucagggcaca

SEQ ID NO: 377054 - RNA, 64 nt, Human
aguugacauuucugcuuacugcuacuggauuuuugcugcagaaauauaucaguggcccacauua

SEQ ID NO: 377055 - RNA, 64 nt, Human
aaaggggcaggcuugcguuauuggccuagauuuugcugcagauuaaauccuuugaggauucucu

SEQ ID NO: 377056 - RNA, 64 nt, Human
cgcagacagggcccagaagcuuuagagguaugaggcugcagaaccggagagauuuuccucugug

SEQ ID NO: 377057 - RNA, 64 nt, Human
aagggggcuccucuggagugguggggaggauuaggcugcagaagggccaaccccuugcaacagg

SEQ ID NO: 377058 - RNA, 64 nt, Human
cagagcaaauggggggcuucacccucaucccgcagcugcagagacuggaaacugccuucaaggc

SEQ ID NO: 377059 - RNA, 64 nt, Human
ccugugaguuugccaguagagcugugaagaaacagcugcagagaacauuugaccuuccuggcau

SEQ ID NO: 377060 - RNA, 64 nt, Human
cuaguuuuaucuucugacuuugggacuaguuuuugcugcagaguuguguugcuuugugauuuuc

SEQ ID NO: 377061 - RNA, 64 nt, Human
ucuggacuguggauacugaaucaguguacuauuggcugcagaauuuguuucaauugaaaauaga

SEQ ID NO: 377062 - RNA, 64 nt, Human
aaacccaaagauguuaacaguauuuuaagaaguugcugcagauuccuuuggccacuguauuugu

SEQ ID NO: 377063 - RNA, 64 nt, Human
acuccucuacucuuacagagccuugagagacccagcugcagaccaugccagacccacugaaaug

SEQ ID NO: 377064 - RNA, 64 nt, Human
gugacacacugagcugacgcacauuuccagugcagcugcagaagagaaaugggauuggcucuug

SEQ ID NO: 377065 - RNA, 64 nt, Human
cccccuuaaacuuccaaagcuucgucuuguguuugcugcagagugauucgggggcugaccuaga

SEQ ID NO: 377066 - RNA, 64 nt, Human
agggcucgcacgccugggagguggcccuuggggggcugcagagcuggagggugggcgugguacg

SEQ ID NO: 377067 - RNA, 64 nt, Human
aggagacggaggugcuggcacaugagaucgagcggcugcagauggagaugaaggaggacgacgu

SEQ ID NO: 377068 - RNA, 64 nt, Human
ucucuccacaaaguccguggugccuuccuggugggcugcagacacuaaugguguuggggggucu

SEQ ID NO: 377069 - RNA, 64 nt, Human
uaugucucagaagagcugggaccuccuuccagcugcugcagaugcugacaggcccugggaggcu

SEQ ID NO: 377070 - RNA, 64 nt, Human
ucuuggcuucugaguagcucagguguggcuuuuggcugcagauguuaaauuuugauaccaugua

SEQ ID NO: 377071 - RNA, 64 nt, Human
ggugggccaagguccgccuugcaggggaggccuggcugcagagaggcggaggaggaagcuggcg

SEQ ID NO: 377072 - RNA, 60 nt, Human
caauucagacugaaauuuaggcccauaaaugcugcagaauaauuaccacuguacaaccgu

SEQ ID NO: 377073 - RNA, 64 nt, Human
uguggaauacucaauguguacaccuuugacuacagcugcagaaguguuccuuuagacaaaguug

SEQ ID NO: 377074 - RNA, 64 nt, Human
gggcuaaugucaggagcugauuuuuaaugauaaagcugcagaugggcuaaauaaaagccaaauu

SEQ ID NO: 377075 - RNA, 64 nt, Human
aagagauuaugauucuguaaagcuguggaaugaagcugcagauuuagagaacauuggcuucuga

SEQ ID NO: 377076 - RNA, 64 nt, Human
cagcuugaguuuuuaguggaagcuucuaaauggugcugcagauuugauauuugcauugaggaaa

SEQ ID NO: 377077 - RNA, 64 nt, Human
agcucccauccaaauccuacuaggaagagagugggcugcagaugaaucugugacucauguuucc

SEQ ID NO: 377078 - RNA, 58 nt, Human
cccagaccucacaguucuagggccccuggcugcagaugacuggaaacaaggaaggaca

SEQ ID NO: 377079 - RNA, 64 nt, Human
agagcccgagagcccuucccaagccauuggcuuggcugcagaguagacugagagcuggggccac

SEQ ID NO: 377080 - RNA, 64 nt, Human
acugaaaauaaucuaaguuccaaccauagaagaagcugcagaagaaaugaagaaagugaugaug

SEQ ID NO: 377081 - RNA, 64 nt, Human
uaaccuugaaguuuggaaacagguggucuucuaugcugcagagaaacuaugcauuaggucucuu

SEQ ID NO: 377082 - RNA, 64 nt, Human
gugguauguguacguguugucuaccaguacacaggcugcagaagacagagacagaagaaagaga

SEQ ID NO: 377083 - RNA, 64 nt, Human
uggucacugggcaggcuggcccagcagccugggggcugcagaagacauggugugaguaguuggg

SEQ ID NO: 377084 - RNA, 64 nt, Human
ugaaucauuguaucugucucauaaucacagcacagcugcagacacaacaacgugcagcauuuuu

SEQ ID NO: 377085 - RNA, 64 nt, Human
aaggcguguuugugcccagaagagaggccgggcugcugcagaaccccgccguguaaagaggcag

SEQ ID NO: 377086 - RNA, 64 nt, Human
ccggggugggcacuaagcuaugggagagaccauagcugcagaaaccaacccugcccuaggcaua

SEQ ID NO: 377087 - RNA, 64 nt, Human
gcgacgacagaugcuaaaaucccuggaucacgacgcugcagagcaccuuugcacaggaugcugg

SEQ ID NO: 377088 - RNA, 64 nt, Human
ggguguguauguuucaggggcuucacauggaggagcugcagauagauauguguuucuguguaug

SEQ ID NO: 377089 - RNA, 64 nt, Human
uacuaucuucccccacccccagcuacccauaggggcugcagaguuauaagccccaaacagguca

SEQ ID NO: 377090 - RNA, 64 nt, Human
agccagagagggacagguauauguacagggcugagcugcagagggcuacaacuuccauauaagg

SEQ ID NO: 377091 - RNA, 64 nt, Human
gagggcuaguugucugagaggguaacugcuuaaggcugcagacuaggaaaugggauuccagguu

SEQ ID NO: 377092 - RNA, 64 nt, Human
uggccacaauagcccagagggucagaacuggacagcugcagagaccugugcccagagaaggguc

SEQ ID NO: 377093 - RNA, 64 nt, Human; identical to SEQ ID NO: 377016

SEQ ID NO: 377094 - RNA, 64 nt, Human
ccccgugacagaaccacacugggcagaggggucugcugcagaaacacugucggcucuggcugcg

SEQ ID NO: 377095 - RNA, 64 nt, Human
ggucggagauuggccuugccugucgaggcaagaggcugcagaggcggggacacaccuguguccu

SEQ ID NO: 377096 - RNA, 58 nt, Human
ugggcuuccugucacaguagcaggcccagcugcagaaggaccgugaguguccaccgga

SEQ ID NO: 377097 - RNA, 64 nt, Human
gaucaguugacaaaggagaagugacaaaagauaagcugcagaaggaccucagaagggcagagca

SEQ ID NO: 377098 - RNA, 64 nt, Human
caaugguagcuugccacaugccccaucucccauugcugcagaggcauaagacagaagagauggg

SEQ ID NO: 377099 - RNA, 64 nt, Human
aaaucugcugggacugccuggagauuugucaggagcugcagacaaguaccuuggagcauucugu

SEQ ID NO: 377100 - RNA, 64 nt, Human
aaugugaaaugguuuaaauuuuacaugcugaaaagcugcagagcagaggaaccaaaccagguuu

SEQ ID NO: 377101 - RNA, 64 nt, Human
acacugaccacaucuguagacaucuugaguuguagcugcagacggggaccaguggcucccauuu

SEQ ID NO: 377102 - RNA, 64 nt, Human
ugaggacuauggcugcauguccucugcuugcccggcugcagagcagagaugugcagcccucugg

SEQ ID NO: 377103 - RNA, 64 nt, Human
cagcucuguagggagcucugccagaggggcagcagcugcagauccacuuaggccccagggucca

SEQ ID NO: 377104 - RNA, 64 nt, Human
aggcauaucagccuggaguauuugggagagacuggcugcagauccccgccagccaagaugcaag

SEQ ID NO: 377105 - RNA, 64 nt, Human
ucucucucccacuaccugaugggcacauggacaggcugcagagggcuccagguucugggccccu

SEQ ID NO: 377106 - RNA, 64 nt, Human
cuucucaaugccuaaauucuguaguugaagcucugcugcagagaguugggauaauuuucuuuug

SEQ ID NO: 377107 - RNA, 64 nt, Human
auccgcaggaaguagguugguggggguggauguagcugcagaaagcaugcacaacuuugugaaa

SEQ ID NO: 377108 - RNA, 64 nt, Human
auguggggagucuggaaacacccggcccacgcgugcugcagauguggggagcccggaaacaccu

SEQ ID NO: 377109 - RNA, 64 nt, Human
auguggggagccuggaaacacccggcccacgcgugcugcagauguggggagucuggaaacaccc

SEQ ID NO: 377110 - RNA, 64 nt, Human
auguggggagccuggaaacacccggcccacgcgugcugcagauguggggagccuggaaacaccc

SEQ ID NO: 377111 - RNA, 64 nt, Human
acguggggagccuggaaacacccggcccacgcgugcugcagauguggggagccuggaaacaccc

SEQ ID NO: 377112 - RNA, 64 nt, Human
cucggagccuucugcaaccaggacuuguggugcagcugcagacacagagcacagcucaugggca

SEQ ID NO: 377113 - RNA, 64 nt, Human
accugaagcagcaggcagaacaggagcgggacaagcugcagagguaucagaccuuccuccagcu

SEQ ID NO: 377114 - RNA, 64 nt, Human
ucaauggcuaauuagaauguguuauuugauuucugcugcagaaggcagugugauuguaacaaaa

SEQ ID NO: 377115 - RNA, 64 nt, Human
auauuuuuaacucuucccagggaaaauucauguugcugcagaaguaggcuaaggcagaccaccc

SEQ ID NO: 377116 - RNA, 64 nt, Human
cggcuguggugcaggugaauggcacgcccguaaugcugcagaccacgugugcugugcacagcgg

SEQ ID NO: 377117 - RNA, 64 nt, Human
ggagagggggucggcucagcaggaggaggcuguggcugcagagccugggggagcuuuuaggugu

SEQ ID NO: 377118 - RNA, 64 nt, Human
aauuggucauggccuugguuucccucaaaacaacgcugcagauuuaucugcacaaacaucucca

SEQ ID NO: 377119 - RNA, 64 nt, Human
ugucuuguuuaguguagaagggaagagaauuggugcugcagaaguguacccgccaugaagccga

SEQ ID NO: 377120 - RNA, 64 nt, Human
cuagcguggacauuuuucuagcauucacccuugggcugcagauaguaauauauaaacacacaca

SEQ ID NO: 377121 - RNA, 64 nt, Human
gucucaugcagaagagggaaugagcuuccauuaugcugcagagcuggcagcaauggaugaaagu

SEQ ID NO: 377122 - RNA, 64 nt, Human
uuauaaaaauaaaaucuuuaccugucgaauuguugcugcagaugauuguuguggaaaaucugga

SEQ ID NO: 377123 - RNA, 64 nt, Human
agaaguguguacggcuugagguuucagcauccaggcugcagaccccacgcagugucucauacag

SEQ ID NO: 377124 - RNA, 64 nt, Human
uggaggagggcaggagcaguccucacucugaauggcugcagaguuaauguucccagcccagucc

SEQ ID NO: 377125 - RNA, 64 nt, Human
uaacggccucuguaaauguucugauuugcucucagcugcagagacacagagacacugcagaugu

SEQ ID NO: 377126 - RNA, 64 nt, Human
gcccacagacaguucacuuuuauuucucaaaguugcugcagaucccucagcuuggcuucucuug

SEQ ID NO: 377127 - RNA, 64 nt, Human
uccagaugguuuguguuuugagguacaaaaaaaugcugcagaucuagaaaugcauauauuuagc

SEQ ID NO: 377128 - RNA, 64 nt, Human
uugcugccuucauccccuggggccugugaauaaagcugcagaacccccuucacagucuguacuu

SEQ ID NO: 377129 - RNA, 64 nt, Human
gguauaccuggggcuggucuuaggagggugcuaggcugcagacugccuuguacucccuggacac

SEQ ID NO: 377130 - RNA, 64 nt, Human
ggaggccaguuuuccacagccuaaacagggaggagcugcagaauggggcucuggucucugggca

SEQ ID NO: 377131 - RNA, 64 nt, Human
aagcauucuguauaauaugugauugcuuguccuagcugcagaaggccuuuuguuuggucaaaug

SEQ ID NO: 377132 - RNA, 64 nt, Human
cccagcagccacuguggaccuggggcguucuggggcugcagaagacugacuguggaugugccau

SEQ ID NO: 377133 - RNA, 64 nt, Human
cccuuguauccuccuugucaauaaaggaaguuccgcugcagaaggggugugugcuguguucuug

SEQ ID NO: 377134 - RNA, 64 nt, Human
accugacucaauuauuugcauauuuugagaaacugcugcagauuaguucuuuuugccaguuuuc

SEQ ID NO: 377135 - RNA, 64 nt, Human
gaccauauuaccuggauuaccagggacuaucuuugcugcagagaucaaggguuaagaucuaugg

SEQ ID NO: 377136 - RNA, 64 nt, Human
ccaaaggguggugggcacugcugugaccaccccagcugcagagucagugcccuggguggaagga

SEQ ID NO: 377137 - RNA, 64 nt, Human
auccgacuugaauuuucccacugcacccccuccugcugcagaggggcaggcccugcacuguccu

SEQ ID NO: 377138 - RNA, 64 nt, Human
guaaugcuuguuaucuuccaucuaauaaaaaucugcugcagauguguauauguaugugugugug

SEQ ID NO: 377139 - RNA, 64 nt, Human
caggggaggaacccacagcuuccuucuccugccagcugcagaugguuugccuugccuuuccacc

SEQ ID NO: 377140 - RNA, 64 nt, Human
cggauugcuuuccaagcugccuuguugcgggguugcugcagagcagcaacuggaccuuuccagc

SEQ ID NO: 377141 - RNA, 64 nt, Human
gacgugagggcaugaaugguucauucaggcagcugcugcagauguggucaccuggugccaucug

SEQ ID NO: 377142 - RNA, 64 nt, Human
aggaggaggaggagcuggaggaggaggucgacgagcugcagacgacaaaugucagcgaccuggg

SEQ ID NO: 377143 - RNA, 64 nt, Human
uggacgugaccaucauguacaagggccgcacggugcugcagaagguggugggacacccgagcug

SEQ ID NO: 377144 - RNA, 64 nt, Human
guuggaagcccugcugaacccucaacuauugacugcugcagacagcuuaucucccuaacccuga

SEQ ID NO: 377145 - RNA, 64 nt, Human
uucaggacuggcucaccccucucccccgcccaaggcugcagaggcugugggagguacugggccc

SEQ ID NO: 377146 - RNA, 64 nt, Human
ugcugagcaaagggaacagugaggugcccagcuagcugcagagccacccuguguugacaccucg

SEQ ID NO: 377147 - RNA, 64 nt, Human
gagguuugucaacacaaagacacaggaagaaugggcugcagaagauuuagauguuuuccauuug

SEQ ID NO: 377148 - RNA, 64 nt, Human
uagaugagguguuugcacugccgcuggcccaccugcugcagacgcagaaucagggcuauaccca

SEQ ID NO: 377149 - RNA, 64 nt, Human
aagcacguccucaagacuguaguauuccagaugagcugcagaugcuuaccuaccacggccgucu

SEQ ID NO: 377150 - RNA, 64 nt, Human
caggccucaggucagggagaaugucugugacuuagcugcagacuaggagacugcccugcuaacu

SEQ ID NO: 377151 - RNA, 64 nt, Human
cccucaagaaucucccagucugguaggagagagugcugcagagccacguggccgccacgcagug

SEQ ID NO: 377152 - RNA, 64 nt, Human
accccgaccccagcaucaaaaaaccaaugauuuugcugcagacuuuggaaugauccaaaaugga

SEQ ID NO: 377153 - RNA, 64 nt, Human
acuuggacgaugaccaggcggcuugggagaaugagcugcagaagaugacccgggggcaggugag

SEQ ID NO: 377154 - RNA, 64 nt, Human
ucaggaaagcccuaaacugaauguuugcgccugggcugcagaagccagggugcaugaccaggcu

SEQ ID NO: 377155 - RNA, 64 nt, Human
cucaggguuuguagaggacugcaggggggcauccgcugcagacucagccuuucucugcagccau

SEQ ID NO: 377156 - RNA, 62 nt, Human
augacuacaaaaugcguuagcacacgugggaagcugcagagagcaacgagaaaaggaacucu

SEQ ID NO: 377157 - RNA, 64 nt, Human
ugagggaggccaaaaucaucacagaugcugcugugcugcagacagauacaugcuaguccagaga

SEQ ID NO: 377158 - RNA, 64 nt, Human
cgggugaggagacuggccccaggccccagccacggcugcagagccugggcucagccccagggag

SEQ ID NO: 377159 - RNA, 64 nt, Human
uuguuaauaucuucacauugugugaauacuggaagcugcagaucuuugcuaggacgcaauaaau

SEQ ID NO: 377160 - RNA, 64 nt, Human
uaggcugggagacugaagacucagcccggguggggcugcagaaaaaugauuggccccagucccc

SEQ ID NO: 377161 - RNA, 52 nt, Human
aacacauccuaagcgucugagugcugcagauccagugggguccggacacugg

SEQ ID NO: 377162 - RNA, 64 nt, Human
aacugggucaaguccuccuagcucugaagcuaaggcugcagagcuguccuuuggacuguauuuc

SEQ ID NO: 377163 - RNA, 64 nt, Human
gcugucaccagauuuuaccuucacugcuggccuugcugcagaaguggcugcuagaucucucucc

SEQ ID NO: 377164 - RNA, 64 nt, Human
acacagcaucuccaggugaugcccaaggcacagggcugcagaaaauaaaccuccagauuccacc

SEQ ID NO: 377165 - RNA, 64 nt, Human
ucuuagcagaaucuaaauuacagccagaccucuggcugcagaggagucugagacauguaugauu

SEQ ID NO: 377166 - RNA, 64 nt, Human
gaguugaauuucugggaggaugacgcagaugucugcugcagagcugggcugagaguucugcagu

SEQ ID NO: 377167 - RNA, 64 nt, Human
guuaucauuguuuuucagaccugcuuuuuuaaaggcugcagaaaacuucacucuuuugguuaag

SEQ ID NO: 377168 - RNA, 64 nt, Human
gcuuugggaggauuucucaggcuaugccauggcagcugcagaggcccagggagagguaaccucu

SEQ ID NO: 377169 - RNA, 64 nt, Human
aaacaugagagcccagaaaacugucauuuagcuggcugcagaacuccuuugcagaaacuggggu

SEQ ID NO: 377170 - RNA, 64 nt, Human
caagggucuagggagagacccuuguuugauuuuagcugcagaacguauugguccagcuugcucu

SEQ ID NO: 377171 - RNA, 64 nt, Human
uugaggggucucccacugaaguccucuucuggaagcugcagaugggggcccgggaggcacacac

SEQ ID NO: 377172 - RNA, 64 nt, Human
auccccauaagaacugaaacucagucuagguccagcugcagaugaggaguccucucuuuaauug

SEQ ID NO: 377173 - RNA, 64 nt, Human
gcucucggucccacaguccucaggcccuucucuggcugcagagccgucuccucagguugccuau

SEQ ID NO: 377174 - RNA, 64 nt, Human
gcucucggucccacaguccucaggccccucucuggcugcagagcccucuccucagguugccuuu

SEQ ID NO: 377175 - RNA, 64 nt, Human
cacacaccuuucugaaauccuucuccagccagcugcugcagacaaaagaucacauuucugggaa

SEQ ID NO: 377176 - RNA, 64 nt, Human
ccacccaucaccgccaaagugugggggaaggauagcugcagauugacaggcgaggcucagaaac

SEQ ID NO: 377177 - RNA, 64 nt, Human
cagaaugggacuggggaagcccuuuggaaauccagcugcagaaacagacaccccaaugcuauuu

SEQ ID NO: 377178 - RNA, 64 nt, Human
cuuauuagaggaggaggaggagucaggugaggaggcugcagaagcaauggagugaaccucugcu

SEQ ID NO: 377179 - RNA, 64 nt, Human
ugucuccuggcacgcugggcccuccgggaggagagcugcagauuucgaguaugucgcuugucau

SEQ ID NO: 377180 - RNA, 64 nt, Human
uggcugaaugggcauaaccacuguggcuucuugugcugcagaagcucguugacaagacugagga

SEQ ID NO: 377181 - RNA, 64 nt, Human
ccgcacagcuccgagguuuggccucuaucguuaugcugcagaucaguuugagcccaaggcaucc

SEQ ID NO: 377182 - RNA, 64 nt, Human
uauggacaaaauugcagauaccauuucuguugaggcugcagauuuccaacuuuuauuucagugg

SEQ ID NO: 377183 - RNA, 64 nt, Human
agcgguucuucuaaccgggguaugcaggaacauggcugcagacacguuuggguaaacaggcacc

SEQ ID NO: 377184 - RNA, 64 nt, Human
accaggagauuuucuuaccuucauuugcuuuuaugcugcagaaguaaaggaaucucacguugug

SEQ ID NO: 377185 - RNA, 64 nt, Human
uauguuccgugaugagcguuuagugagccugcuggcugcagagcacuaugaaaucaugguacgu

SEQ ID NO: 377186 - RNA, 64 nt, Human
uuugauugucacacugggucggguaggaagguaugcugcagacauuugguggguagaggccagg

SEQ ID NO: 377187 - RNA, 64 nt, Human
aggcaggagaauugcugaaacccgggagucagaggcugcagagagccgagacugggccacugca

SEQ ID NO: 377188 - RNA, 64 nt, Human
guuugaaguuaaguggaauccuuucaaaugacgagcugcagagaacucagcaccaagggcugcc

SEQ ID NO: 377189 - RNA, 64 nt, Human
cuaacugcggugguggccuccagcaggcccccccgcugcagacccucuguccugccucugccuc

SEQ ID NO: 377190 - RNA, 64 nt, Human
gugggcagggguuccagcuucccuuugauuuuuugcugcagacucauccuuuuuaaaugagacu

SEQ ID NO: 377191 - RNA, 64 nt, Human
gggaauggaugcuucacuugaucuccggaccuuggcugcagaggccaucgcagcuuuugaaaag

SEQ ID NO: 377192 - RNA, 64 nt, Human
ucccaucauagggggguguccccccagagacaaagcugcagagcacauuccaugccagacgcuc

SEQ ID NO: 377193 - RNA, 64 nt, Human
cuaaaagggugaaucugcuaaauccuuuugaaaugcugcagauuugauaaauauuuauuuuaga

SEQ ID NO: 377194 - RNA, 64 nt, Human
uugaccucuauguguuaccagucauuaaugagcugcugcagaggugacuauuuguuuuacuuuc

SEQ ID NO: 377195 - RNA, 64 nt, Human
uaguuuacauaaaaaugauguuuuccacuugauugcugcagauaucaagaguuuguuauuuuca

SEQ ID NO: 377196 - RNA, 64 nt, Human
aaauguauacaccuaacauagaaaauuaaagauagcugcagaccauuagaaauaauacaauugu

SEQ ID NO: 377197 - RNA, 64 nt, Human
aaacacgaacucaaagaggacauccagcugcucagcugcagaaugacugcccuagaaaagcagg

SEQ ID NO: 377198 - RNA, 64 nt, Human
augccuacugaaauaaaaagaggaaaggcuggaagcugcagacaggaucccuagcuuguuuucu

SEQ ID NO: 377199 - RNA, 64 nt, Human
uugagaauugguagguacugcuucugagaaccuggcugcagauccuuagcauaggcagcaaaug

SEQ ID NO: 377200 - RNA, 64 nt, Human
ggggcagggcugggucucaguauccuagaguccagcugcagaaggaguggcuuuuccuccagga

SEQ ID NO: 377201 - RNA, 64 nt, Human
gguuuaaugagaccagccucagcugacucacagagcugcagagccaggcuggguccuaacaacu

SEQ ID NO: 377202 - RNA, 64 nt, Human
aaaauaaaccuuagacauaucacaccuaaaauaugcugcagauuuuauaauugauugguuacuu

SEQ ID NO: 377203 - RNA, 64 nt, Human
guggccuuuuuuucauuuagccauugcacagucagcugcagaaguccugcugaccaccuaguca

SEQ ID NO: 377204 - RNA, 64 nt, Human
ggagguggcacugggugaggacagcugggcaggggcugcagagggagguggaaaugaacccuga

SEQ ID NO: 377205 - RNA, 64 nt, Human
caaagccagccccuccucccaccuauucugaguagcugcagaggccuuggguccaggcucuagg

SEQ ID NO: 377206 - RNA, 64 nt, Human
caggguucuagcgaugggacugcccauuuccucagcugcagaggaggaaagggaaaggguaggc

SEQ ID NO: 377207 - RNA, 64 nt, Human
agcuuacuaggugacccggaugcugacaucugcugcugcagaaaggaagacuuuucauuguaau

SEQ ID NO: 377208 - RNA, 64 nt, Human
cucagcuacuugcugaccauuuccugcuucucaagcugcagagaagcuuuucauucccaccccc

SEQ ID NO: 377209 - RNA, 64 nt, Human
aagugccgccuggccugcaugcauuggcuaacaggcugcagaauggcaggaaggacucgcuaga

SEQ ID NO: 377210 - RNA, 64 nt, Human
uuaaaaaucuauaggccugggaauuccgauccuagcugcagaucgcaucccacaaugcgagaau

SEQ ID NO: 377211 - RNA, 57 nt, Human
cccugcccaaggccgacugaggggugggcugcagaacggggugggaacugggggacc

SEQ ID NO: 377212 - RNA, 64 nt, Human
uccaucagaauccaccuuaggccucagcuggagggcugcagagccccucccaauauugggagaa

SEQ ID NO: 377213 - RNA, 64 nt, Human
aaaugagaccagacucaacugccaccaguccccagcugcagaccuucauccccuucaucuccca

SEQ ID NO: 377214 - RNA, 64 nt, Human
aaacccaccggaccuugcaggggaccauggggaagcugcagagccgcuuuauggagcucaugca

SEQ ID NO: 377215 - RNA, 64 nt, Human
cucagcaucagcucccucaagcuuaaugauccaggcugcagaagaaaguugucacuccagugag

SEQ ID NO: 377216 - RNA, 64 nt, Human
uccuugucugcugcuauuugaaguaauuaguacagcugcagaucucucuguguauaucuaucua

SEQ ID NO: 377217 - RNA, 64 nt, Human
gaagcuacaaagugggcauccaagccggguucuggcugcagaaguucugccucugccugggguc

SEQ ID NO: 377218 - RNA, 64 nt, Human
guuccccagggaccucucauacacuggccaggaggcugcagaacgugugucucccccucccucc

SEQ ID NO: 377219 - RNA, 64 nt, Human
gugauuggccccacugacguuggccuaacacugggcugcagagacuggaccccgcccagcauug

SEQ ID NO: 377220 - RNA, 64 nt, Human
uugccuucauguuagcuuccggcuccccucccaggcugcagacucugaccuguggcaucaggcu

SEQ ID NO: 377221 - RNA, 64 nt, Human
cccuguguccgcucucucauguggggauguuugugcugcagacaaaaagaacaaaaaaaaauuu

SEQ ID NO: 377222 - RNA, 64 nt, Human
caggcccuggcucagaaucagagcccagaaaguggcugcagacaaaaucaauaaaacuaauguc

SEQ ID NO: 377223 - RNA, 64 nt, Human
uagaggagugcaggcacccugaccagcagagauugcugcagaaauaaagucugcuuggcucuug

SEQ ID NO: 377224 - RNA, 64 nt, Human
cacuuuggggcgaaaacuagagacuugcuugggggcugcagaagugcccucuccucgaauccug

SEQ ID NO: 377225 - RNA, 64 nt, Human
ugcucaucccuucucccuuucacuucuguucucugcugcagaaagcagacuugcauaucccuga

SEQ ID NO: 377226 - RNA, 64 nt, Human
cuuccaugcaggagcacggcauggcgggagcggggcugcagaguauccgaggugcugccggggc

SEQ ID NO: 377227 - RNA, 64 nt, Human
agagacggaacauucucuagagacaacagucugugcugcagauugguuggaucacagaaugugu

SEQ ID NO: 377228 - RNA, 64 nt, Human
uagaaggagcucagcaccucuuccagcccuuaaagcugcagaaaaggugucacacggcugccug

SEQ ID NO: 377229 - RNA, 64 nt, Human
ccaucugggucuguguagcuggggagaggaugaggcugcagagauggggaccagaagcccccca

SEQ ID NO: 377230 - RNA, 64 nt, Human
cagcaggcagcaccccucugccagccgggccccggcugcagaagugcuguugguuuggaugcug

SEQ ID NO: 377231 - RNA, 64 nt, Human
aaauugaaaguguucugaggcacauagcagaggagcugcagauuuccugcuuguauuggcguau

SEQ ID NO: 377232 - RNA, 64 nt, Human
uguauuaggagggaggcugcgcuccuucagacuugcugcagaaucauuuuguaucauguauggu

SEQ ID NO: 377233 - RNA, 64 nt, Human
cguagcgcugaucaucccguguugcccgugcguugcugcagaccaucuggggucuugcccaagc

SEQ ID NO: 377234 - RNA, 64 nt, Human
caggcaucguugagcauuaacacucugugacagagcugcagaccccugccuugagucucaucuc

SEQ ID NO: 377235 - RNA, 64 nt, Human
cuugaucuuugguguccuggacuucauccugggugcugcagauacugcagugaaguaaaacagg

SEQ ID NO: 377236 - RNA, 64 nt, Human
gccagaugccuggcccugugcuggggcagacaacgcugcagagcccagggagccuggcgcuagg

SEQ ID NO: 377237 - RNA, 64 nt, Human
gagcuuuccgcgucagcaaguaggaaucguuuuugcugcagagaauaaaaggaccacgugcaau

SEQ ID NO: 377238 - RNA, 64 nt, Human
acgagccugaagagccccuuucagugcagacggggcugcagagugacacuggcugggcaccugc

SEQ ID NO: 377239 - RNA, 64 nt, Human
gugccugcugguggaagucagaaugcuccuggaggcugcagaggggguggaggacucuccccug

SEQ ID NO: 377240 - RNA, 64 nt, Human
agaguugcuuguccugcugugggcugggcuuccagcugcagaccuccaguugcuugguguucac

SEQ ID NO: 377241 - RNA, 62 nt, Human
uccucgagaucaaacacuaaggcacggggcuggcugcagagcagccuuaggacccugggacc

SEQ ID NO: 377242 - RNA, 64 nt, Human
ucugcccuuuggcugcauuggaauuucagagaaggcugcagaggccuggguuacacagccugag

SEQ ID NO: 377243 - RNA, 64 nt, Human
uccugcuuuaaaacacuccuguuguugguauuaugcugcagaguugugugcuacauaagcuauu

SEQ ID NO: 377244 - RNA, 64 nt, Human
acucagcguccccugcuacuccugugcucuggaggcugcagagcugacccagaguggagucuga

SEQ ID NO: 377245 - RNA, 64 nt, Human
acuaucagcagggacagaugugugggagugcagggcugcagaggguauggggggaggaggcugc

SEQ ID NO: 377246 - RNA, 64 nt, Human
accugagcuucagacccucucuccagcaggaagggcugcagacucggccuguucccagacucgg

SEQ ID NO: 377247 - RNA, 64 nt, Human
cuaagcuggaccugcuacuggagaagaccaaggagcugcagaagcuggugagaugggaaaggga

SEQ ID NO: 377248 - RNA, 64 nt, Human
ggguccuggggagagagaauuuauccagaggccugcugcagauggggaagagcuggaaaccaag

SEQ ID NO: 377249 - RNA, 64 nt, Human
cucuaaggcccgaagaacaggugauaucgggggcgcugcagagcugggcucuagcaggacaguu

SEQ ID NO: 377250 - RNA, 64 nt, Human
aagaggcugcugagaaagagaaugagaagaggcugcugcagacaaguggacagggaaggccucu

SEQ ID NO: 377251 - RNA, 64 nt, Human
ugcacgaagguugugcugggagaccggacccggggcugcagaagaagcugaaggcugacuuugu

SEQ ID NO: 377252 - RNA, 64 nt, Human
cccuccauugccucgccucuauuccagaaucaaugcugcagaauguguuagcugcagauaggca

SEQ ID NO: 377253 - RNA, 64 nt, Human
cucuauuccagaaucaaugcugcagaauguguuagcugcagauaggcauggucucagguaugaa

SEQ ID NO: 377254 - RNA, 64 nt, Human
caccugcaggacuccgaagacagugcgacuucuggcugcagaauaccuuuucagaaaccugcuu

SEQ ID NO: 377255 - RNA, 64 nt, Human
ucccacucauacccgccucccuggacaguucccugcugcagaguucuuucugcuuucagcccua

SEQ ID NO: 377256 - RNA, 64 nt, Human
caccucacuuuauuuccauguaaucagagcauuagcugcagaaaaaccccccgacagagcccug

SEQ ID NO: 377257 - RNA, 64 nt, Human
ccggggacgcuuuugagugggcccugcccggggagcugcagagcagcagcaccuuucucugaga

SEQ ID NO: 377258 - RNA, 64 nt, Human
ccggaggccccuuuccuagucucauccuccccuggcugcagaugcuuagcugggccagggauug

SEQ ID NO: 377259 - RNA, 64 nt, Human
augugacacauuuucaagggcaucucuaucuuucgcugcagaguuguaguucugggcccucgau

SEQ ID NO: 377260 - RNA, 64 nt, Human
ugguggguuugggcagucccuggcucuagucucugcugcagauucucaggaccaaaaugugggu

SEQ ID NO: 377261 - RNA, 64 nt, Human
ggucaccgggaagaacaacucucaucccacaauugcugcagaacucuucucuccccaucauggg

SEQ ID NO: 377262 - RNA, 64 nt, Human
accccaguucugcagacacauacacaacccguuugcugcagagccggacccaguggcuacaccc

SEQ ID NO: 377263 - RNA, 64 nt, Human
aggauaucgggucacugucgaguccccagaaccagcugcagauggagguuuuguuugggggcuu

SEQ ID NO: 377264 - RNA, 64 nt, Human
aggcaggaggauugcuugagcucaggaguucaaggcugcagagagcuaugaucaucccacugca

SEQ ID NO: 377265 - RNA, 64 nt, Human
aacacccaccucuuuuagagaauuauccuuugaugcugcagaaucuacucuuacaaugccuucc

SEQ ID NO: 377266 - RNA, 64 nt, Human
gcuaccucccccaugugaggagcugagaacggaagcugcagaaagauacgacugaggcgccuac

SEQ ID NO: 377267 - RNA, 64 nt, Human
ggaaaaaauccuucccuagagcuaguauccuaaagcugcagagcuagcccagaccucauugguu

SEQ ID NO: 377268 - RNA, 64 nt, Human
gcuggaggagucagagugagagcuaguggccacagcugcagagcacugcagcucccagcuccuu

SEQ ID NO: 377269 - RNA, 64 nt, Human
cgccugggccacagcuaggcccucccaccggcucgcugcagagccgggcccagcgcgcccuguc

SEQ ID NO: 377270 - RNA, 64 nt, Human
gugcgcuccucaccccucuacagacaggggcgcugcugcagaugcuccaggcccaccuuggugg

SEQ ID NO: 377271 - RNA, 64 nt, Human
gagaggaaggccucacucacccacugcgucgagggcugcagaacacagcgggguccuguccagg

SEQ ID NO: 377272 - RNA, 64 nt, Human
uagaaauucuacugcacugccuggcucagcugcagcugcagacauuucugcaggaggagcaggu

SEQ ID NO: 377273 - RNA, 64 nt, Human
gggcugcucugcacccacgggagaggcuggcccagcugcagacugcuuagggacuucugugucc

SEQ ID NO: 377274 - RNA, 64 nt, Human
guggguggccauccauuuugagcaccucugccaggcugcagaccuggaggcgaagggagugugg

SEQ ID NO: 377275 - RNA, 64 nt, Human
auuaauuauauguuuaaaaguuaaagaaaaaagagcugcagaguauuuauaaaacugucuuuua

SEQ ID NO: 377276 - RNA, 64 nt, Human
uccuuuucaaugucaaagcgccaauuuauaaaacgcugcagauguagagguuaugugcaacuga

SEQ ID NO: 377277 - RNA, 64 nt, Human
gcggcggcaugccucccuuccacaagcccaugcugcugcagagggagccuguguuugcaaaacc

SEQ ID NO: 377278 - RNA, 64 nt, Human
ucugucccugugucugcuagcacuagacuuuguugcugcagauugauccaguggguacauaggc

SEQ ID NO: 377279 - RNA, 64 nt, Human
guugugacaguguacaguggcagcuguuggccacgcugcagaaaugagcuggagcucauggguu

SEQ ID NO: 377280 - RNA, 64 nt, Human
gcgcuuuugcuggucacugccauggaggcacacagcugcagagacagagaggacgugggcggca

SEQ ID NO: 377281 - RNA, 64 nt, Human
cgguccugcccuagaguccccaucuggcccuggagcugcagaagcagcuucugaggggcuuccc

SEQ ID NO: 377282 - RNA, 64 nt, Human
uaaucaaaacugcugaggagcagaacuuccuacagcugcagacuuccaggaguaaccgcuucuc

SEQ ID NO: 377283 - RNA, 64 nt, Human
ccaccacgagggauggauuccacccgcccgcccugcugcagauacaugcggcacagcaggcacg

SEQ ID NO: 377284 - RNA, 64 nt, Human
uugucccauccuggacuuuuccucucaugucuuugcugcagaacugaagagacuaggcgcuggg

SEQ ID NO: 377285 - RNA, 64 nt, Human
uggggguggacagugugugcugggggguucgggugcugcagaccuggaacucccuucugccagg

SEQ ID NO: 377286 - RNA, 64 nt, Human
gaggacggccccugcacuggagcugggcgccagagcugcagagcuaguguucggcccucagaga

SEQ ID NO: 377287 - RNA, 64 nt, Human
caccgugcccgccccaagagcaagcaccggccaugcugcagaggcaagaccucaauucuuggcu

SEQ ID NO: 377288 - RNA, 64 nt, Human
auccuuuggccugcccccaggugcauggcggccugcugcagaucuucccugagggccggcccgu

SEQ ID NO: 377289 - RNA, 64 nt, Human
guuugugucucccuuauucccaguuaaauaccuagcugcagauugugccaucacccuucauucu

SEQ ID NO: 377290 - RNA, 64 nt, Human
aaauaaauuguugucgaugauagucaccuuuagugcugcagaacagcagaacuucuuccucuua

SEQ ID NO: 377291 - RNA, 64 nt, Human
caucggcugggcugccagguacccugggccuggcgcugcagaccugagcuggcuuggacccauu

SEQ ID NO: 377292 - RNA, 64 nt, Human
uguauguauguaugcccucagugcagugggguuugcugcagaauucacugcauagcaggagaug

SEQ ID NO: 377293 - RNA, 64 nt, Human
auuauuaaaaaaucaaaacauagaugcuagugaggcugcagagaaaagcaaauacuuauacacu

SEQ ID NO: 377294 - RNA, 64 nt, Human
ucuugcuuaccaaugucuaagguccccacugccugcugcagagaaaacacacuccuuugcuuag

SEQ ID NO: 377295 - RNA, 64 nt, Human
ucuugcuuacaaaugccuaaggucgccacugccugcugcagagaaaacacacuccuuugcuuag

SEQ ID NO: 377296 - RNA, 64 nt, Human
ggagggaacagaaaaggcaugggccugaauucaggcugcagagccugacuccucccuguggcua

SEQ ID NO: 377297 - RNA, 64 nt, Human
ccccacgaaggccuugggcugugcguccgacccugcugcagaaccagcaggguguccccucggg

SEQ ID NO: 377298 - RNA, 64 nt, Human
gugaccccagaaaugccagcagggaacggaggcugcugcagagacgcagccccaggcagccggg

SEQ ID NO: 377299 - RNA, 64 nt, Human
aggcuuggacgccgguggggaauggggggccacagcugcagaccuaagcccucccccaccccug

SEQ ID NO: 377300 - RNA, 64 nt, Human
augggcgucauagccaucacgagcaugucacagugcugcagagauuuuguuuauggccaguuuc

SEQ ID NO: 377301 - RNA, 64 nt, Human
gcagcccugccugggaggacuggaccaggcaguggcugcagagggagccuccugcucccugcuc

SEQ ID NO: 377302 - RNA, 64 nt, Human
cccuggacaggucucgcacccacaaguacuaucugcugcagagauccucucaucuguggccagg

SEQ ID NO: 377303 - RNA, 58 nt, Human
gcuauguggcuugcucuuaggacaccaggcugcagaugaucagggauccaauaugacu

SEQ ID NO: 377304 - RNA, 64 nt, Human
uucuuuucuaacaaagaacagccuguaaaaucgagcugcagacauagacaagcaagcuggaagc

SEQ ID NO: 377305 - RNA, 64 nt, Human
ugccauugggguuuuacauuaaaaccccagaauggcugcagaggggugaacaggccccaauauu

SEQ ID NO: 377306 - RNA, 64 nt, Human
aggggacggccagagcgagcugugcaagcuggaagcugcagaagacauugcauaccagcucuca

SEQ ID NO: 377307 - RNA, 64 nt, Human
ggacaaguucauucacguggcacaggcuccaccagcugcagaauuucaacacgcugauggcagu

SEQ ID NO: 377308 - RNA, 64 nt, Human
gcauaagugaucugugccuuaacgacauguuccugcugcagauaacuagccagacccaucccuu

SEQ ID NO: 377309 - RNA, 64 nt, Human
ggugggacaacaaagaggacaccauuuuuccagagcugcagagagcaccugguggggaggaaga

SEQ ID NO: 377310 - RNA, 64 nt, Human
cuuuccuucccaauugccucucagggguagugaagcugcagacugacaguuucaaggauaccca

SEQ ID NO: 377311 - RNA, 50 nt, Human
agguggaggccgaccaguaggcugcagaccagggacauggguuaguuaag

SEQ ID NO: 377312 - RNA, 64 nt, Human
cccagcuaugggaagugccaucaggguggccgcagcugcagagagccacuucaccugagaccac

SEQ ID NO: 377313 - RNA, 64 nt, Human
cagagccaagacaccugcugcagcucuccaccuagcugcagauagcucccaaagagaaaucagu

SEQ ID NO: 377314 - RNA, 64 nt, Human
uacaccuggucuuuucuagaaaucccugcuuggagcugcagaaggguugccuucuguaggucgg

SEQ ID NO: 377315 - RNA, 64 nt, Human
ccagacuugcucucaagccucauccagagaaggagcugcagaugagggagcccguacacucccu

SEQ ID NO: 377316 - RNA, 64 nt, Human
gcauuugccuucugagagaagagacuagcaaaaagcugcagagaggauucggcccaaacucaga

SEQ ID NO: 377317 - RNA, 64 nt, Human
guguaaccuuggguggccccugcugucucucugggcugcagagucugccccacauguggccaug

SEQ ID NO: 377318 - RNA, 64 nt, Human
uuuuagggauuaugagcuucuuucaagggcuaaggcugcagagauauuuccuccaggaaucgug

SEQ ID NO: 377319 - RNA, 64 nt, Human
uucuggguucuaggcccugcuuccuugccccuuugcugcagaagggcagcugaaggcucacccu

SEQ ID NO: 377320 - RNA, 64 nt, Human
gggaaggaccugaugagaacagaauagcugggaggcugcagagggugcugggagccccuagaag

SEQ ID NO: 377321 - RNA, 64 nt, Human
auucgccucccagcggacgugagcuuccacugcggcugcagagacgcgagcaaccucuucucau

SEQ ID NO: 377322 - RNA, 64 nt, Human
ccuucaagacauaagagggcggggcgagguacuggcugcagagucgccuuaguccagaaccuga

SEQ ID NO: 377323 - RNA, 64 nt, Human
ugcugcuguggggcuccgcgccugccggugaagagcugcagaugccgagaagccagcaaacaca

SEQ ID NO: 377324 - RNA, 64 nt, Human
gggaccuagccuggagucaggacaaauggaucgggcugcagaggguuagaagcgagggcaccag

SEQ ID NO: 377325 - RNA, 64 nt, Human
ccucucccucuaggugccauggccggccaggugggcugcagagugggcucccugccccucucug

SEQ ID NO: 377326 - RNA, 64 nt, Human
cccgcaccuuucuaagccugugguugcuucacccgcugcagagcacacgcaacccagccucagc

SEQ ID NO: 377327 - RNA, 64 nt, Human
ucaugggaugugcugggccugccuuuggcgccaugcugcagacuccagugggccugguuucugc

SEQ ID NO: 377328 - RNA, 64 nt, Human
ugggccugguuucugcagaauguccaugguggccgcugcagaguugcagaggucccuguagaga

SEQ ID NO: 377329 - RNA, 64 nt, Human
gagaaaguguccaggugggggcuggcagucccuggcugcagaccccgagcuggcccugggccag

SEQ ID NO: 377330 - RNA, 64 nt, Human
gcuuuagacuugaaaagagacaggcaggugaucugcugcagagcaguaagggaacaaguugagc

SEQ ID NO: 377331 - RNA, 64 nt, Human
ugaauccacacuugauguugcaaagccuaaguuugcugcagaaauacaauuuccuacacuucau

SEQ ID NO: 377332 - RNA, 64 nt, Human
acacucucaguuuacagaggccacugggccucuggcugcagaauacaaagucccgggcuguuag

SEQ ID NO: 377333 - RNA, 64 nt, Human
auuaguucuuuucuucugacucguggggcucccugcugcagagagcacagcccuugccuggagc

SEQ ID NO: 377334 - RNA, 64 nt, Human
agcuucggagggccccugugugggggccagucaggcugcagaggcaccucaacauuccauggug

SEQ ID NO: 377335 - RNA, 64 nt, Human
gcuuuggucccccuucccaacuucugaagcacgugcugcagagccaccuuggucugagcaccug

SEQ ID NO: 377336 - RNA, 64 nt, Human
uuguguuguugccuucaguagaaggcauuugugggcugcagaguugagaguugggugagguuag

SEQ ID NO: 377337 - RNA, 64 nt, Human
guggcugucccagccaccaaaacccaugcacagugcugcagaaacuggacaguuccggacagcg

SEQ ID NO: 377338 - RNA, 64 nt, Human
cagcaaagcauuuggcuuuguccugcccaagugggcugcagacugagugcugcccuuguagcuu

SEQ ID NO: 377339 - RNA, 64 nt, Human
agaucaagccaguaaacccauccccccugagccagcugcagagaauggagcccaaacagauguu

SEQ ID NO: 377340 - RNA, 64 nt, Human
uuguuaauggaaguauugacccucuaugauaugugcugcagauaucgaggucagccauucggaa

SEQ ID NO: 377341 - RNA, 64 nt, Human
uaccucugggcuuuggugcuuaacacacaacacagcugcagacccugcuggaggccgagggcuc

SEQ ID NO: 377342 - RNA, 64 nt, Human
uggacccagugccccucacggcugccgcaagucugcugcagaugaccucaugaacuggaagggg

SEQ ID NO: 377343 - RNA, 64 nt, Human
cugccaggguuggccccagggacccugggacgaggcugcagaagcucucccucccuacucccug

SEQ ID NO: 377344 - RNA, 64 nt, Human
ggcgagcccuggcuucuccucacggugcuuccuggcugcagaccacaacccuccgcuggucgcu

SEQ ID NO: 377345 - RNA, 64 nt, Human
caggcaggggcuagggaaugccugcugcugaucggcugcagacggaccauggggugucaacgau

SEQ ID NO: 377346 - RNA, 64 nt, Human
caacuugccaccagaugcuaaaugagacuugacagcugcagagcuugggcugugcucauagcua

SEQ ID NO: 377347 - RNA, 64 nt, Human
aggaagcugccuuucccuuugcccuaagcagacagcugcagaugagagggucagcaucuccacu

SEQ ID NO: 377348 - RNA, 64 nt, Human; identical to SEQ ID NO: 377344

SEQ ID NO: 377349 - RNA, 64 nt, Human
gcuucuucccugcagacaugguggagcugcugcugcugcagaacgcacaggugcaccaguuggu

SEQ ID NO: 377350 - RNA, 64 nt, Human
gucuccgcccgcagcugaggcgcaugcaggagaugcugcagaggaugaagcagcagaugcagga

SEQ ID NO: 377351 - RNA, 64 nt, Human
uucccaggauccugggucuguucccugccccagugcugcagaacggacuugggagcccuccuuu

SEQ ID NO: 377352 - RNA, 64 nt, Human
cugaacgcacgagggaugaguuggagaggaggcugcugcagaugaaagaagaagcaacaauggc

SEQ ID NO: 377353 - RNA, 64 nt, Human
cgggggcaaggggcucagccccacuggacucugggcugcagaggccaccccccaggugggggug

SEQ ID NO: 377354 - RNA, 64 nt, Human
agccagugugauacagccaucuguaccuacuggagcugcagaagggaaguccacucagucacau

SEQ ID NO: 377355 - RNA, 64 nt, Human
gaguguagucaagggccugggcacaggagggagagcugcagaguguccugccugccuuggcugg

SEQ ID NO: 377356 - RNA, 62 nt, Human
gcaacagccuggcugaguagaggucccgcccagcugcagacccuccaggcuggaggaccagc

SEQ ID NO: 377357 - RNA, 64 nt, Human
ucgggccugcgucugagguggcccaggaccccaagcugcagagcccagggaagagcagcuccag

SEQ ID NO: 377358 - RNA, 64 nt, Human
gagaaagcaccuaccugucuucugugcagcuagggcugcagagcuguauucagguccaagguuc

SEQ ID NO: 377359 - RNA, 64 nt, Human
uuugcagaggguggggguccaucucuccagcuuggcugcagaccuccuuuacccugacucacaa

SEQ ID NO: 377360 - RNA, 63 nt, Human
uggagaaaaaggaugccugaacacgcaaagucggcugcagaauuauugccaaguugcugcugc

SEQ ID NO: 377361 - RNA, 64 nt, Human
cagcugagccccaucugaagcccagucccucggagcugcagacagcagguccugcagcaacaau

SEQ ID NO: 377362 - RNA, 64 nt, Human
ugccugggcuggguguggggcagggccuggcacagcugcagagugcacagggagggucagaagu

SEQ ID NO: 377363 - RNA, 64 nt, Human
ggucugguuaagagucucacuagggccaaggcaggcugcagaacuuucccucuuccucucauug

SEQ ID NO: 377364 - RNA, 64 nt, Human
gcagugaggaaacgggguaaaguggaccaugcaggcugcagagggugggccuugggcuggccgg

SEQ ID NO: 377365 - RNA, 64 nt, Human
acaaggaaguccuggccacaggaguccccuacuggcugcagaggacgaagcaggaagcaugccg

SEQ ID NO: 377366 - RNA, 64 nt, Human
agcugcccauugcucccaagaggaggagagggaggcugcagaugccugggacucagaccaggaa

SEQ ID NO: 377367 - RNA, 64 nt, Human
cccugccuucccaggcaggguggugcuggagguggcugcagagagccacuugucccacgucacc

SEQ ID NO: 377368 - RNA, 64 nt, Human
gcuguccccucccuguggcguuucuuagcagauggcugcagagcuucguugauggucuuuucug

SEQ ID NO: 377369 - RNA, 64 nt, Human
guacguucccaugugccccgugaaagcauguguggcugcagacguguccacaugggccuugcga

SEQ ID NO: 377370 - RNA, 64 nt, Human
uuagggccaccauggcgcagcgccuggugcgcgugcugcagaucugugcuggccacgugcccgg

SEQ ID NO: 377371 - RNA, 64 nt, Human
ugcaggccuggaaguccuacagcgccguggaugugcugcagacccucgaacauguggaccugga

SEQ ID NO: 377372 - RNA, 64 nt, Human
uggccaaagaauuccaggacaagacugcccccaggcugcagaaauaccuggugcucaagucaug

SEQ ID NO: 377373 - RNA, 64 nt, Human
ugugguuuucucucuuuuugugguauuagcagcugcugcagauaaaugcauuaauucaugaugc

SEQ ID NO: 377374 - RNA, 64 nt, Human
ggaguggcucgccaggccaaaucacccuuagaaggcugcagauaacagaaaggcuuuuuauaaa

SEQ ID NO: 377375 - RNA, 64 nt, Human
gagaucuccaacucucucuguguccguguggagggcugcagagccugcagggugaccugcuucc

SEQ ID NO: 377376 - RNA, 64 nt, Human
agaaucucaaggagcugcuggccgucagggcggagcugcagaagcguguggagggccuacagcg

SEQ ID NO: 377377 - RNA, 64 nt, Human
cgguuagaaaagaaaaucccacuuuaaaaugccagcugcagauaacucaaagccaucccuuuuu

SEQ ID NO: 377378 - RNA, 64 nt, Human
ccgcugcuacuuugggggguggggaaggggccaagcugcagacacacacagucauucauuucug

SEQ ID NO: 377379 - RNA, 64 nt, Human
aggagguggcguccagcaguccaggaccccugcagcugcagacaucugcuucaccaaggagcua

SEQ ID NO: 377380 - RNA, 64 nt, Human
acgaccucagcgagagugagcuggauguggccgggcugcagagccgggccacaccucagugcca

SEQ ID NO: 377381 - RNA, 64 nt, Human
aaggagucccugguucauugauggaugucuucuagcugcagaugccucugcgcaccaaggaaug

SEQ ID NO: 377382 - RNA, 64 nt, Human
aaagcuacagcugagaaauaaaauaaaaugucaugcugcagaauauguuauacccuuauuuugu

SEQ ID NO: 377383 - RNA, 64 nt, Human
ugaacgugguugucagaggcgggggacagcagaggcugcagacuggcccacuucccuccucccc

SEQ ID NO: 377384 - RNA, 64 nt, Human
gagaacauagaucaauuauacuacuucuaagguagcugcagauaaguggccuugacacauuaca

SEQ ID NO: 377385 - RNA, 64 nt, Human
gguggaauaucucaucuaaacggccaaaucaagagcugcagauuaucagcaaaaaugcuuuuaa

SEQ ID NO: 377386 - RNA, 64 nt, Human
cacuuuucuaaacuaggcuccuucaacaaggcuugcugcagauacuacugaccagacaagcugu

SEQ ID NO: 377387 - RNA, 60 nt, Human
ucucugccccucacauuuagccgacugacugcugcagaccaccgccaacugcagcucucc

SEQ ID NO: 377388 - RNA, 64 nt, Human
aaaaucucuccacuuucagcugucuuuuggaggacguacguaauaagguuuuaauuuaguaaac

SEQ ID NO: 377389 - RNA, 64 nt, Human
uuuugaguguaugcuguagcugaaagaguauguacguacguauaagacuagagagauauuaagu

SEQ ID NO: 377390 - RNA, 64 nt, Human
ccccauuggcgccgcccuacuggggaagccgguccguacguaggccuugcaucucgccaccucc

SEQ ID NO: 377391 - RNA, 64 nt, Human
gugugaacuuuaugguaacuucuacucuagaauacguacguaugcacccacagacacacacagu

SEQ ID NO: 377392 - RNA, 64 nt, Human
uucuccuuuggaagugaggcauugcacagggagacguacguaucagcggccccuugacucuggg

SEQ ID NO: 377393 - RNA, 64 nt, Human
aaauguguggguuauguugcagcuguugcagucccccagauaccuauuauuuuacacaauuuga

SEQ ID NO: 377394 - RNA, 64 nt, Human
gggcccccccaggccccugccccaacugauucugcccagauaaucgugucuccugccuccacuc

SEQ ID NO: 377395 - RNA, 64 nt, Human
aaaaaucuguaucuuuuacugagaacacccaauacccagauaaaugacuguaucaggauuucau

SEQ ID NO: 377396 - RNA, 64 nt, Human
cccuuaugacaucagcaauacagacuacuucuuccccagauagcuggcuggguggcaccagcag

SEQ ID NO: 377397 - RNA, 64 nt, Human
aaauuagccaagugugguagagugugccugaagucccagauacuuggggggcugaggugggagg

SEQ ID NO: 377398 - RNA, 64 nt, Human
aaauuagccaggcaugauggcacaugccuguaaucccagauacuugggaggcugaggcaggaga

SEQ ID NO: 377399 - RNA, 64 nt, Human
ggagaaagaaaggcuaggaccauguccucauugacccagauacugcugugugcugcacagcagu

SEQ ID NO: 377400 - RNA, 64 nt, Human
agugguuuaguguuuucaaaucauguuucucauacccagauaguagauuauucacuuaggacag

SEQ ID NO: 377401 - RNA, 64 nt, Human
ugagacuccauuuucuccagggaaacgaggcuugcccagauagacuaacaacccuuuagugcuc

SEQ ID NO: 377402 - RNA, 64 nt, Human
ccagaaacgaucaagaagggcaauggguugacagcccagauauggcaggaccagacugcaaugg

SEQ ID NO: 377403 - RNA, 64 nt, Human
agcuucauucauaauuaccaaaaacuagaaauaacccagauauccuucaacaggugauuggaua

SEQ ID NO: 377404 - RNA, 64 nt, Human
uuagccaggccuggucaggguccuggggacggcacccagauaugcagagucacccugacacugg

SEQ ID NO: 377405 - RNA, 64 nt, Human
cggacacuguguuuucucugggacaugucuucugcccagauauggccgccuuaaaagaugcaga

SEQ ID NO: 377406 - RNA, 64 nt, Human
cacagagguugcagcagaugguguggguaccucacccagauaucauccaggcccaaggccccuc

SEQ ID NO: 377407 - RNA, 64 nt, Human
ugcccccacugucccccuacccaccgauggagcccccagauagagcuggguggccuguuucugc

SEQ ID NO: 377408 - RNA, 64 nt, Human
cucagccuccugauucauggguccccuaguuaggcccagauaaaaauccaguuggcugaggguu

SEQ ID NO: 377409 - RNA, 64 nt, Human
aguugcucgcuucugggugugcucccuucgaaggcccagauaagacagggaacacuugugagca

SEQ ID NO: 377410 - RNA, 64 nt, Human
guauaugcauaugcaaacucgacccccguuccugcccagauaauggcucaauaacucugaggcu

SEQ ID NO: 377411 - RNA, 64 nt, Human
ucugccucccaccagacccucuccaguguacuuccccagauaggaccagaggaugucuaguucu

SEQ ID NO: 377412 - RNA, 64 nt, Human
ucagcucuggauuuuaagcccagacuucaguggacccagauagaaaauauaaagucucugaucu

SEQ ID NO: 377413 - RNA, 64 nt, Human
cuucagguuucuucccuccccccucuugaccuaccccagauauuuguguggaagaggaggaauc

SEQ ID NO: 377414 - RNA, 64 nt, Human
ucuguauggaaaagagcccuggagcaucagguuccccagauaggcccccaaauaaagaccuguc

SEQ ID NO: 377415 - RNA, 64 nt, Human
gggcccaggaaaaccccaucuugaugcaugaguucccagauacccucuucuggcuuucacaggc

SEQ ID NO: 377416 - RNA, 64 nt, Human
ccgagcccugcauguggagcccucccaccccacccccagauagagggaaauaaccaaaaaacua

SEQ ID NO: 377417 - RNA, 64 nt, Human
auggcuuuucaugcuuccaagugucagggccuugcccagauagacagggcuggcucugcugccc

SEQ ID NO: 377418 - RNA, 64 nt, Human
aggaaggaggggaaaagagugagagaaugguauucccagauacuucuuccuccugccccuuuuc

SEQ ID NO: 377419 - RNA, 64 nt, Human
agugucaggucuaggaaauuaauggcuauucuuccccagauacauucuggcuuauuugagauac

SEQ ID NO: 377420 - RNA, 64 nt, Human
cacauuauuugcaauauccaaauguuuaaaaauucccagauaauuaacuagcuauuacagaucu

SEQ ID NO: 377421 - RNA, 64 nt, Human
uuguuggauacucucauuuuaaacuucuccucuccccagauaccuccuauauuuccauauugug

SEQ ID NO: 377422 - RNA, 64 nt, Human
augggcauuugguggaugauaaugagcagccccucccagauagaaugucaauauuugagcagua

SEQ ID NO: 377423 - RNA, 64 nt, Human
caccucugauguguuucacaagcacguaguucaacccagauagggaccacagagauucuggggc

SEQ ID NO: 377424 - RNA, 64 nt, Human
gucucuaucgcucuuccccucuccucggccacuccccagauaccagaccugaggcaauucacuu

SEQ ID NO: 377425 - RNA, 64 nt, Human
ggcaggcaaggcagccaggacaggggagcccgaccccagauaaugaucccgguagagaaacaga

SEQ ID NO: 377426 - RNA, 64 nt, Human
cuuuuuaccuuuugcuguuugcuguggcagauuccccagauaaccaaggaaaaggggccaccca

SEQ ID NO: 377427 - RNA, 64 nt, Human
aaaacuagcuggcaugguagcacacaccuguagucccagauacuugggaggccaaggcaggagg

SEQ ID NO: 377428 - RNA, 64 nt, Human
acagcuuuaccuacuuccuacagaugcaucuaaacccagauauuacugagaagaguguauugac

SEQ ID NO: 377429 - RNA, 64 nt, Human
gaccuguaguuuaagaaugacaggugguuagagacccagauauuuaaaaauagguguucaauaa

SEQ ID NO: 377430 - RNA, 64 nt, Human
uuuacgcaggacauucuugccguauucucaugaucccagauaaguguguguuuuauacugcaac

SEQ ID NO: 377431 - RNA, 64 nt, Human
ccuucauguaaaccagcuuugcaaaauuuuccagcccagauacucuucaucuauucaaauggau

SEQ ID NO: 377432 - RNA, 64 nt, Human
ccaagcccccaccccaucccacuccccuucccuccccagauauuuaugugaaaugaacugcagc

SEQ ID NO: 377433 - RNA, 64 nt, Human
uuuuuuguguaucauugaaaauaagagaaguaaucccagauaauaaauuccuaaaaggaaacug

SEQ ID NO: 377434 - RNA, 64 nt, Human
uugcuagaguaacaucuuuguauaagcaaguaaccccagauagaguugacguuucagcuuuggg

SEQ ID NO: 377435 - RNA, 64 nt, Human
ggauggaauucuguccacaaaauaauuuugugagcccagauaucauuaggaucacacagaguua

SEQ ID NO: 377436 - RNA, 64 nt, Human
agacuuccccucuaggaaaugcacggcuugauaccccagauauaaacauuguuuugaagcagga

SEQ ID NO: 377437 - RNA, 64 nt, Human
uguuucugugagaugagcuaaauugcuuucauaccccagauaagagcuaaaaccaccuaaugcu

SEQ ID NO: 377438 - RNA, 64 nt, Human
uuucaaaagcuugucacaaacccuuggagucauucccagauaauagaacuggaaaugauaaauc

SEQ ID NO: 377439 - RNA, 64 nt, Human
uucaggaauccaaauccugaacauuuggaaugagcccagauagaaauaucgaaugcaaagcuac

SEQ ID NO: 377440 - RNA, 52 nt, Human
cagguacugcccaggacugaggcccagauaaugagcugagauucagcauccc

SEQ ID NO: 377441 - RNA, 64 nt, Human
aguuugaagaaugcagcagccuuuuuguaaacuucccagauaucaaaauagacuuugauauaua

SEQ ID NO: 377442 - RNA, 64 nt, Human
aauccccaaauccauuaaaagugacuucagaggucccagauagggaccaacauuuguuuaaacc

SEQ ID NO: 377443 - RNA, 64 nt, Human
aaccacaacaaaaugaauucuauuaaagaauagccccagauauaaauucucuugaaagcaaugu

SEQ ID NO: 377444 - RNA, 64 nt, Human
aaauuagccaagagugguggcacaugccuguagucccagauacuugggagugggcugagauggg

SEQ ID NO: 377445 - RNA, 64 nt, Human
auaaaaaaaaggcuugucaauuaugaaggugugucccagauauuacaugaagaucaugcaaacu

SEQ ID NO: 377446 - RNA, 64 nt, Human
ccagagcuuugucguauuuggcacacagcagaggcccagauauuagaaaggcucuauuccaaua

SEQ ID NO: 377447 - RNA, 64 nt, Human
uguaaaaaaacaaaaagcaaaaaaauucccaaaacccagauaacaaccagagcaaaacuguugu

SEQ ID NO: 377448 - RNA, 64 nt, Human
uuauuaaauuaugcaugcuaagauuuaaaggagccccagauaaacaugauggggaaaagcacug

SEQ ID NO: 377449 - RNA, 64 nt, Human
ccugugauacccaucagcccacugccccggccggcccagauaggucugccucugccuuccagcu

SEQ ID NO: 377450 - RNA, 64 nt, Human
auaacacagaugaucuucuccacacaccccaucacccagauaauuuacaguucuguuaacagug

SEQ ID NO: 377451 - RNA, 64 nt, Human
gugagggaaugguaguuaaggcuucuuuuuugcccccagauacauggugaugguuagcauaugg

SEQ ID NO: 377452 - RNA, 64 nt, Human
caugggaagagcguagacagguguuacuuacagucccagauacacuaaaguuacaaacagacca

SEQ ID NO: 377453 - RNA, 64 nt, Human
auccuuuccuaacuuguugcagcaguuugaauuucccagauauuuauguuugaacauaauggcu

SEQ ID NO: 377454 - RNA, 64 nt, Human
acauuccuuaggauuucucucccuaucaagcuggcccagauacaaguaccaaacaguagucucu

SEQ ID NO: 377455 - RNA, 64 nt, Human
caggcuuucuccccuggaaaacuccagcuugagucccagauacacucaugggcugcccugggca

SEQ ID NO: 377456 - RNA, 64 nt, Human
cauccacaaccuaaagaucucuguguucauacgccccagauaugugaguuacaugagauggcac

SEQ ID NO: 377457 - RNA, 64 nt, Human
aaagggaugaugggauugaaggggcuucuaaugacccagauauggaaacagaagacaaaauugu

SEQ ID NO: 377458 - RNA, 64 nt, Human
gcaguuguauccccucaccuuccucccgucccaccccagauauccuaaaugagagagaaaugac

SEQ ID NO: 377459 - RNA, 64 nt, Human
caaaucugaacagucacuguaaaucauucuuaagcccagauaugagaacuucugcuggaaagug

SEQ ID NO: 377460 - RNA, 64 nt, Human
aaugcagucagcuccagcuaguacuauuuauguacccagauaacuaagauauuguuucauggcc

SEQ ID NO: 377461 - RNA, 64 nt, Human
acucgaaggcgccugaaaagaucaaauucuauaucccagauaccuuccguaagucuuuauguaa

SEQ ID NO: 377462 - RNA, 64 nt, Human
gcaauaaaaagaaugaucucccugagccuuugaccccagauaaaccccucccaauuaaugcauu

SEQ ID NO: 377463 - RNA, 64 nt, Human
aagcaguuaaagaagacugaccuucguccauuuucccagauaauugggucuuggacucuugagg

SEQ ID NO: 377464 - RNA, 64 nt, Human
ugcugacuucccucuggauucuucugcaaccagucccagauauugugccauuuuauccaugguu

SEQ ID NO: 377465 - RNA, 64 nt, Human
ccagagauucugaaugaauuggucugggguggaacccagauacuacuaauuuuuagauacuccu

SEQ ID NO: 377466 - RNA, 64 nt, Human
agggaucugcuugauaucccaaguuggaagggaccccagauaccugugaggacugguugucucu

SEQ ID NO: 377467 - RNA, 64 nt, Human
aggaauccucugggagcuucuuccguuucuuccccccagauacccaucuugaaaaacacuauuu

SEQ ID NO: 377468 - RNA, 64 nt, Human
gggaguuagggcuuaaacuauucugucuagaugucccagauaguucccauucuacuuggagauu

SEQ ID NO: 377469 - RNA, 64 nt, Human
aaauuagcugggcguggugacgggcgccuguaaucccagauacucaggaggcugagguaggaga

SEQ ID NO: 377470 - RNA, 64 nt, Human
aguuacgugaaaagagcaucucacuuuuaauacacccagauauuuucuucaagucuuugugcau

SEQ ID NO: 377471 - RNA, 64 nt, Human
cucaaggagguuaccuuuaauaaaagaagacaaacccagauagauauguaaaccaaaauacuau

SEQ ID NO: 377472 - RNA, 64 nt, Human
caaaugucucuggugauguuccuaagacccuugucccagauacucuaaaugugaauguaugagc

SEQ ID NO: 377473 - RNA, 64 nt, Human
auccuaaguggaagaacuaguuuguuuuaguuuucccagauaaaaccaacaugcuuuuuaagga

SEQ ID NO: 377474 - RNA, 64 nt, Human
aggcuguaagucuagaauuuagauauccugaucccccagauaccgcucuucugguuauacacag

SEQ ID NO: 377475 - RNA, 64 nt, Human
auuaucucuaacgucuuuguuguuuauggaaaagcccagauacuggauauaucacuauguauuu

SEQ ID NO: 377476 - RNA, 64 nt, Human
gaguuuguauagguaacuagguaacuuauuguggcccagauaaggcuuuaggaugccucagugc

SEQ ID NO: 377477 - RNA, 64 nt, Human
guucauauuugaguuuaauuguacugacccuggacccagauaagcagcaacuuugugucuuugg

SEQ ID NO: 377478 - RNA, 64 nt, Human
ggcccuggggugcagaggcccggcacguagagaacccagauagacgccggugguggaacugguc

SEQ ID NO: 377479 - RNA, 64 nt, Human
aacuugaagaaacgcuucagaacucguugcuuugcccagauaaugauaauaaugcuuaauaaua

SEQ ID NO: 377480 - RNA, 64 nt, Human
ugguaugggagccaggaguccuggcaucauuagucccagauagcugcauuacucacuugcugcg

SEQ ID NO: 377481 - RNA, 64 nt, Human
uauuuaccccugguuggaacaauauuugaaaugucccagauauuucuaugcuacuuagauauuu

SEQ ID NO: 377482 - RNA, 64 nt, Human
cgugaggccaacugaacaauuccccccguggcugcccagauagucacagucaagguuggagagu

SEQ ID NO: 377483 - RNA, 64 nt, Human
ucagacuaacuuccagaauuauacuuuaaccccucccagauaugguccgccuuuggcauugugu

SEQ ID NO: 377484 - RNA, 64 nt, Human
ccuuuugccuuuuccuaguuaagcccacuccagccccagauaaccacuuucuauccucauagau

SEQ ID NO: 377485 - RNA, 64 nt, Human
ccugggaggaucagucuguccaggucagcgaggccccagauaccagagcaucaagaguacagga

SEQ ID NO: 377486 - RNA, 64 nt, Human
agugcuucgugccucgauugaaggugaccucugccccagauagguggugccaguggcuuauuaa

SEQ ID NO: 377487 - RNA, 64 nt, Human
acgagacccuacaggagagggaagagugcauuuucccagauacuucccauuuuggaaguuuuca

SEQ ID NO: 377488 - RNA, 64 nt, Human
cuggagagagcacagugaaauugaaauacccauucccagauagucaaaaacaugaacuuucccc

SEQ ID NO: 377489 - RNA, 64 nt, Human
uguguuuaaagucuuguaaaguucaugucuuucacccagauauaucaaauguuagaagaccagu

SEQ ID NO: 377490 - RNA, 64 nt, Human
aggauguuaugcuggcuggcucgccuccucuugacccagauaguuacgguuaaccacugcuuug

SEQ ID NO: 377491 - RNA, 64 nt, Human
uucuucaaguuucuucaagaagccucuauuguuccccagauaauguucccucaaauagcacggg

SEQ ID NO: 377492 - RNA, 64 nt, Human
aaguuagccagguaugguggcauauacuuguggucccagauacuugggaggcugagauaggauc

SEQ ID NO: 377493 - RNA, 64 nt, Human
gccaaaugaauugccuaauugcugcaaaguauaacccagauaggaaaucauauguuuuuuucca

SEQ ID NO: 377494 - RNA, 64 nt, Human
gccaucuucuccccgaggcugccccaggccggagcccagauacgggggcugugacucugggcag

SEQ ID NO: 377495 - RNA, 64 nt, Human
aauuagccaggugugguggugcacgccuguaauccccagauacucgggaggcugaagcaggaga

SEQ ID NO: 377496 - RNA, 64 nt, Human
gugugugcaggggugugugugugugggggggguucccagauauucagggcaagggaccagucgg

SEQ ID NO: 377497 - RNA, 64 nt, Human
ucaccccacccuccaggguugggggagcaggaagcccagauauuuggaggaacagaaacaccag

SEQ ID NO: 377498 - RNA, 64 nt, Human
gaaaugucuguuuugaggaaagggcuuugaauuccccagauacugaacaauuuguguuugugac

SEQ ID NO: 377499 - RNA, 64 nt, Human
ugaaaagagcuuuguauuauuuuuuaauucccuccccagauaucauuuaggaguauuauauaaa

SEQ ID NO: 377500 - RNA, 64 nt, Human
ggacuucugccagcauaauacuugcuuuggaaaacccagauaaagguucaugcaaacuuuauuu

SEQ ID NO: 377501 - RNA, 64 nt, Human
cuuugagaacucugugagacaagguccuuaggcacccagauaucagccacuuucacauuucauu

SEQ ID NO: 377502 - RNA, 64 nt, Human
aaaauauaguauuuucuguuguccagaaaaucuucccagauagggaaacugaggcagagagugc

SEQ ID NO: 377503 - RNA, 64 nt, Human
cgagucuaaagacaugaauucucaccacuaaagucccagauagcaucauauuuacgccuguacu

SEQ ID NO: 377504 - RNA, 64 nt, Human
gaauacuguauuuuguauuguuucaauugcaucucccagauaaugugaaaaugguccaggagaa

SEQ ID NO: 377505 - RNA, 64 nt, Human
ccggcuccacuuuccccuuuuauuaauacauucacccagauaaucauuaaaauuaacaugugcc

SEQ ID NO: 377506 - RNA, 64 nt, Human
auauggccuugaugguguagugcauggacaucuacccagauaaacaaauuguugacugcugaau

SEQ ID NO: 377507 - RNA, 64 nt, Human
aaucuucaaucaaccugggcucuccccaccccaccccagauaaccuccucaguucccuaggguc

SEQ ID NO: 377508 - RNA, 64 nt, Human
cucauuugucauuuacccugguggaggcuucuugcccagauagagaucugaaauuggugggaag

SEQ ID NO: 377509 - RNA, 64 nt, Human
caagccaaaccugcugccacagcccucccccggccccagauagcagccccagggaggaugcugc

SEQ ID NO: 377510 - RNA, 64 nt, Human
agaggaccaggacuugugcagacgccacagucuccccagauauggaccaucagugacucaugcu

SEQ ID NO: 377511 - RNA, 64 nt, Human
ucccagcuagaauucacuccacuuggacaugggccccagauaccaugaugcugagcccggaaac

SEQ ID NO: 377512 - RNA, 64 nt, Human
gaaucuggauauauuuaaaaaaagaaauuugaugcccagauaauauauuaggcacuacugauuu

SEQ ID NO: 377513 - RNA, 64 nt, Human
gcccaggccuaggccccacagacuuuuaggcuggcccagauauuccccaguggaugggcagagc

SEQ ID NO: 377514 - RNA, 64 nt, Human
accccuguccacccugugccuggcugucccugcacccagauacagcaacauggccuguacccag

SEQ ID NO: 377515 - RNA, 64 nt, Human
uguguaugccugggauccuuccaagcacucauagcccagauaggaauccucugcuccucccaaa

SEQ ID NO: 377516 - RNA, 64 nt, Human
ucauuacccuccccuacucagacugagcagcagucccagauaaccaagcaagcucagcucugug

SEQ ID NO: 377517 - RNA, 64 nt, Human
gccucucucacuuuccuccuucccucuuuguuaccccagauacucuugggcaggugcagugagg

SEQ ID NO: 377518 - RNA, 64 nt, Human
agauggguucagugguaugagcagaggaagagaucccagauaguagccaguuaaccaagacuca

SEQ ID NO: 377519 - RNA, 64 nt, Human
uguaucauacaguuaguguugccagugaaacguucccagauacaaagaauugugcuuuuaauuc

SEQ ID NO: 377520 - RNA, 64 nt, Human
cuucucccuucccaucuccaggccuucugucugucccagauaaaggcgcuguucucccauccuc

SEQ ID NO: 377521 - RNA, 64 nt, Human
uuggaagcauguuugguaaugucaaguggaguaccccagauacauuuuagacauuuaucgucau

SEQ ID NO: 377522 - RNA, 64 nt, Human
gucaccuucuaucuauacuuugcuuaaaagcuaucccagauacucccccuugaggagcucaugc

SEQ ID NO: 377523 - RNA, 64 nt, Human
aguuugggcugauguaagacuagaggcuggcccucccagauaacagagaaaagggagccccaaa

SEQ ID NO: 377524 - RNA, 64 nt, Human
uugauggacagaggcugaggaauuuccuggcuuccccagauaguguccugggacaugguaugcu

SEQ ID NO: 377525 - RNA, 64 nt, Human
gagcccucggggccuccuccugggccucagcuugcccagauacauaccuaaauauauauauaua

SEQ ID NO: 377526 - RNA, 64 nt, Human
cuggaaggguucccuuguccuagacauugaggggcccagauaagaccaaaaccaagcauaagag

SEQ ID NO: 377527 - RNA, 64 nt, Human
aaggacacucaaauuuauaagguagaagcaauuucccagauauaggcugaacagaaacauuuac

SEQ ID NO: 377528 - RNA, 64 nt, Human
uguugaacuuuuuaaaaagugcuacuuuuaaaaucccagauacucugaauuuuagaaaacaaac

SEQ ID NO: 377529 - RNA, 64 nt, Human
uagaaaaauugggauuuccccccaccccgccccacccagauaaacuauaucuacacugucucgu

SEQ ID NO: 377530 - RNA, 64 nt, Human
gaaacugcauaaaaaauuuaaaacuaagucaucucccagauauaaguaucaugguccagcagua

SEQ ID NO: 377531 - RNA, 64 nt, Human
aaguuauugcuguuggaacugaacaauaauauuucccagauagcuggccuuagcaugugaucac

SEQ ID NO: 377532 - RNA, 64 nt, Human
ucucccaaaucccaaaugccacuccaaguacccccccagauaccaugucaggauauuuuuagug

SEQ ID NO: 377533 - RNA, 64 nt, Human
cagcuguuguuuucguggcauuuggcaccucugucccagauacguuugccagcaaagcugcugc

SEQ ID NO: 377534 - RNA, 64 nt, Human
gaauuaugggaaaccugguaagcaaaacuuuccucccagauaauugcuuccaaauucgaagagu

SEQ ID NO: 377535 - RNA, 64 nt, Human
uacgggguugcucugccggaggcugccgcaacuucccagauacuuucuggaccaacccucagua

SEQ ID NO: 377536 - RNA, 64 nt, Human
gcguguguaaaacagaacaguaacucuaugugaccccagauaacauuuuguaacauugugcuuc

SEQ ID NO: 377537 - RNA, 64 nt, Human
agaacuguaugucauggaguccucuugacguucccccagauacaaguaaagcacagguggauuu

SEQ ID NO: 377538 - RNA, 64 nt, Human
augcccagagacacagcccccacggacaaaaccccccagauaucaucuaccuagauuuaauaua

SEQ ID NO: 377539 - RNA, 64 nt, Human
cauuucauuuuaaacucguauuugugguuuuuuucccagauaaaaaugaaauuaaaccauuucu

SEQ ID NO: 377540 - RNA, 64 nt, Human
aagggccaggccccgcggagugucuuugguggaucccagauaacuccuaggugcugcucucaga

SEQ ID NO: 377541 - RNA, 64 nt, Human
gcaaccuuaugccaauaaaauguaauuuaacagccccagauauuguugaauauucaacaauaac

SEQ ID NO: 377542 - RNA, 64 nt, Human
gaagaaacaucuaucaagcaacacagccccuuaucccagauagaaaagugucucaaaugcauuc

SEQ ID NO: 377543 - RNA, 64 nt, Human
cucgcucucccagcaccagugcccuucuccugcucccagauacucuuuccuuuccucucuccug

SEQ ID NO: 377544 - RNA, 64 nt, Human
cagcuggacuccagccauccuccugccucagcuucccagauagcugggccacaggcgugugcca

SEQ ID NO: 377545 - RNA, 64 nt, Human
ugacgccugcaccgggcccuccagcccuccccugcccagauagcugguggugggcgcuaauccu

SEQ ID NO: 377546 - RNA, 64 nt, Human
gccauccugacacacuuuaugcaaaaagaauuuucccagauaggcuagccagaaaaaacuucaa

SEQ ID NO: 377547 - RNA, 64 nt, Human
cugguggggaccugggacccagacccggaaccagcccagauaucaccccugaggacccaugcgc

SEQ ID NO: 377548 - RNA, 64 nt, Human
ucagcccagugacgguggggcuggggccuggaggcccagauacagcacauccacccaggucccg

SEQ ID NO: 377549 - RNA, 64 nt, Human
gcucaggcugggugcucugccaugggcugaguggcccagauauucuucuguccaucuuuggccu

SEQ ID NO: 377550 - RNA, 64 nt, Human
gaucuggcauccuccuaaggaccggggcgcguggcccagauaagaauagguguuccuuugugcu

SEQ ID NO: 377551 - RNA, 64 nt, Human
cuuggucuuaaaacccaauugagugauuugcaaacccagauauuguacauuuagaaauguuuug

SEQ ID NO: 377552 - RNA, 64 nt, Human
agagaagccacccacguggggugugccaggcacccccagauacaaaugcagccacgcacagacg

SEQ ID NO: 377553 - RNA, 64 nt, Human
guaagccuguguccuuccugaagcuucucgacugcccagauagggaggugaguccucucuaucu

SEQ ID NO: 377554 - RNA, 64 nt, Human
aagcagccuguuuucacucagcuuaauucuccuucccagauaaggcaagccagucauggaaucu

SEQ ID NO: 377555 - RNA, 64 nt, Human
ccccucuggauucccuuuugacucuuccgugcaucccagauaauggagaauguaucagccagcc

SEQ ID NO: 377556 - RNA, 64 nt, Human
cguauuuccuuggauuucugaauggcugcagugacccagauauugcacuaggucaaaacauuca

SEQ ID NO: 377557 - RNA, 64 nt, Human
ccuggucuuagccccaaagaugggccuucucucucccagauaaguugguccucccucugccuuu

SEQ ID NO: 377558 - RNA, 64 nt, Human
augaaucucguggggggucccugcccuugcgacccccagauaccuccacuugcuaccgagucaa

SEQ ID NO: 377559 - RNA, 64 nt, Human
gcuaucuacuaaguuuccuuuuaauucuaccaaccccagauaaguaagaguacuauuaauagaa

SEQ ID NO: 377560 - RNA, 64 nt, Human
ggugcccaccucggcgaauugaagggcuaagagucccagauagcuaggccagagcuggaagcag

SEQ ID NO: 377561 - RNA, 64 nt, Human
uagcuauuuaauuaucagaagcaaguaaucuuuccccagauaauauuuugcccuagaagaagcc

SEQ ID NO: 377562 - RNA, 64 nt, Human
aguaguuugccagauguuaagguagaccagaugacccagauaugaagaacuuaccuuugguuuu

SEQ ID NO: 377563 - RNA, 64 nt, Human
agagggacaucccgacuuacguuuuucuaccuugcccagauaaguggauacaaccacucuauau

SEQ ID NO: 377564 - RNA, 64 nt, Human
cgucugaauacacaaaaaguugugucauaacuuacccagauauguuuuucuaucauuugaaacc

SEQ ID NO: 377565 - RNA, 64 nt, Human
auuagcuggaaauggggacagaguucucauuuaucccagauauauacauuggcuuuuuuggaau

SEQ ID NO: 377566 - RNA, 64 nt, Human
uuuacucugcauguuuuuaaugguaaacuggaaucccagauaugguugcacaaaaccacuuuuu

SEQ ID NO: 377567 - RNA, 64 nt, Human
gaaagcuaacacauagggaaauuagguaacuuuccccagauaacucaguaaacaguggagcugg

SEQ ID NO: 377568 - RNA, 64 nt, Human
cuaaacuuggccauucccaggaggcuuggagacccccagauaaccauaacagggaagcagggga

SEQ ID NO: 377569 - RNA, 64 nt, Human
ugucacauaauuuaaaaaugaaauugcuguuugccccagauauguuuuucuguguucuuuuuaa

SEQ ID NO: 377570 - RNA, 64 nt, Human
gaggaauucuuauuuguguuagagcagaggaggucccagauaccaaguggcgccucccaggaaa

SEQ ID NO: 377571 - RNA, 64 nt, Human
uuaccaacuggaaaauuuuaugcaucccaugaagcccagauacacaaaauuccaccccaugauc

SEQ ID NO: 377572 - RNA, 64 nt, Human
ccuuuccaauuccaaaauuccaucccuaagaauucccagauagucccagcagccuccccacgug

SEQ ID NO: 377573 - RNA, 64 nt, Human
cucagccuccagaguagcuggaaauacagugccacccagauagccucacaaaacuuugacccag

SEQ ID NO: 377574 - RNA, 64 nt, Human
gguuugcaguguccguucucauccaccugaugggcccagauaaaggcccccgcuguccagccuc

SEQ ID NO: 377575 - RNA, 64 nt, Human
caccccacccuccaggguuagggggagcaggaagcccagauaaucagagggacagaaacaccag

SEQ ID NO: 377576 - RNA, 64 nt, Human
gauggacucuaagacccccaguggauaccuaaaacccagauaggaccaaacucuaugucuaugu

SEQ ID NO: 377577 - RNA, 54 nt, Human
uccacugucuuccccagugagucucccagauacguugcauugugccaacaucag

SEQ ID NO: 377578 - RNA, 64 nt, Human
auguuugaggacccuugugauuacacugugaaaacccagauaagccaggauaaucucccuaucu

SEQ ID NO: 377579 - RNA, 64 nt, Human
agcgugaaagccugagucccaccagaaggaccuucccagauaccccuucuccucacagucagaa

SEQ ID NO: 377580 - RNA, 64 nt, Human
acuggcccagcagccucuucucugagcuccaugucccagauaaaccaggccagacugagaaggc

SEQ ID NO: 377581 - RNA, 64 nt, Human
cucuuugaaagccagaacaagagagcgcuccucucccagauaggaaaagggccucuaacaagga

SEQ ID NO: 377582 - RNA, 64 nt, Human
gccaccacuuguucccacgagaauaugucacuugcccagauaaaacugggcggcagccagaguu

SEQ ID NO: 377583 - RNA, 54 nt, Human
ucagccuccaggcuguuuagcccucccagauagcugccccugccacgcaggcca

SEQ ID NO: 377584 - RNA, 64 nt, Human
cuucauuuauucuuucucauuugugggcuuuguucccagauaagaucacuccuucuggggacaa

SEQ ID NO: 377585 - RNA, 64 nt, Human
gucauuuuuaacuacuguauucccacaaggaauccccagauauuuauguaucuugauguucaga

SEQ ID NO: 377586 - RNA, 64 nt, Human
uuguauagaaggauuuugcuaagggggcaaaaagcccagauaccauuuuaacuggcccaguuca

SEQ ID NO: 377587 - RNA, 64 nt, Human
agagauggaagccaggacaagggagcccaccgggcccagauagagacuucagaacccacuccug

SEQ ID NO: 377588 - RNA, 64 nt, Human
uuuugaaaaaucccuccaagugauucuuuuacaucccagauagaaaacccuaaauuaaagguga

SEQ ID NO: 377589 - RNA, 64 nt, Human
guaagggcuuggggucuuagaagcugcucuuuagcccagauacacauacucuuuuuugucuuug

SEQ ID NO: 377590 - RNA, 64 nt, Human
uaaaaauugaugucagugcaggcccaggcccgcccccagauacacuaguuucuaggucuggggc

SEQ ID NO: 377591 - RNA, 64 nt, Human
gccacuuugcagaggauggaggucaaaaaccacucccagauaaguuugguuuucaacauuuagu

SEQ ID NO: 377592 - RNA, 64 nt, Human
aaauuagccgggcgugguggcaggcaccuguagucccagauacucgggaggcuaaggcaggaga

SEQ ID NO: 377593 - RNA, 64 nt, Human
cuuaccugacagcucuuaccaacaagaaggccaucccagauauggccucucaaccucagacuuc

SEQ ID NO: 377594 - RNA, 64 nt, Human
ccuuugaugagugauauuucccuauaccuauguacccagauagauauaugcauagauaaaagug

SEQ ID NO: 377595 - RNA, 64 nt, Human
ucaagucuaucugaaaagucuccagaagucuaaccccagauaaauagccaacaggguguagagu

SEQ ID NO: 377596 - RNA, 64 nt, Human
ucaagucuaucugaaaagucuccagaggucuaaccccagauaaauagccaacaggguguagagu

SEQ ID NO: 377597 - RNA, 64 nt, Human
ugcugggauuacaggugugagccaccgugcccggcccagauagguugaucuuaauguaacaacc

SEQ ID NO: 377598 - RNA, 57 nt, Human
cugucuccugggucuauuaggccucuccccagauaucugagcauaacugggagcacc

SEQ ID NO: 377599 - RNA, 64 nt, Human
ucuggaaaucugauucagccagcauggauaauaacccagauaacuaaccccuaccucacaggau

SEQ ID NO: 377600 - RNA, 64 nt, Human
cccaacucccuuccaggguucgccucaucugaggcccagauaauggugagaggccaggagaccu

SEQ ID NO: 377601 - RNA, 64 nt, Human
aguaaauuuuguucagggcuacugucuguaugugcccagauaaaauuuucaugagaguaguuua

SEQ ID NO: 377602 - RNA, 64 nt, Human
cagagccaucugggucugauguucuguuccauuguacaucgaagagauauauaugcacauauag

SEQ ID NO: 377603 - RNA, 64 nt, Human
gacuccagugccuucugagaaggaagaucaaguuuacaucgagcaaagugaccuuggaagacag

SEQ ID NO: 377604 - RNA, 64 nt, Human
agacacaaagauauggaagaacauuggacagauuuacaucgauauauuaauuaaggugauuuca

SEQ ID NO: 377605 - RNA, 64 nt, Human
guauuuccuuuuucccugggcuggucuucccuuguacaucgauuuuugggcccuagaaaugcuc

SEQ ID NO: 377606 - RNA, 64 nt, Human
gucauauggagaccugcaaugcacccaguacugcuacaucgacuccacgcccugccgcuacuuc

SEQ ID NO: 377607 - RNA, 64 nt, Human
cccuugguugccuugaucaucugcuacaacuggcuacaucgaagacuagcaggugcaguggcug

SEQ ID NO: 377608 - RNA, 64 nt, Human
guagguguaaaaacaacugucuguggcauuuguauacaucgagaacauuuuucuuucccucauu

SEQ ID NO: 377609 - RNA, 63 nt, Human
acgugaccccacccgcccaccgccacuaucaggccccgggaccgcacugacaggaaaccuucc

SEQ ID NO: 377610 - RNA, 63 nt, Human
aaacugccugucuggccgggccgcacuuguggcccccgggaccccaccucuggccccaccucc

SEQ ID NO: 377611 - RNA, 63 nt, Human
cuccugccugggcagcaacaaccaagaacaaagccccgggacuguuuucuuuuuaauaaagcc

SEQ ID NO: 377612 - RNA, 63 nt, Human
ugccacccccacucucacccccaagcucuaagcccccgggaggccuggacugucuuccucauc

SEQ ID NO: 377613 - RNA, 64 nt, Human
agacauccauuuaagaucaacuguuuacaugugauacaucgaaaacuguuuacuucaacuuuua

SEQ ID NO: 377614 - RNA, 64 nt, Human
ugccgccaugcggaacaccaaacgagguuccugguacaucgaggcucuugcucaaguguuuucu

SEQ ID NO: 377615 - RNA, 64 nt, Human
cucaacuagaaccgguccaaaugcagaauauuaauacaucgaacaacuucauccuuaaucucug

SEQ ID NO: 377616 - RNA, 64 nt, Human
uauuaaaacaucgcaauaauguuccuguguguuauacaucgaggguuuuagaaaugugauuuuc

SEQ ID NO: 377617 - RNA, 64 nt, Human
acacgucaaauaucccaagacagauuaugcuaaauacaucgacuucaucuucuaacaugauaua

SEQ ID NO: 377618 - RNA, 64 nt, Human
cgcagcgugcaucgccuacauccgccucacccaguacaucgacgggcagggucggccucgcacc

SEQ ID NO: 377619 - RNA, 64 nt, Human
gauugccugacaggcccccaagaagcugauccgauacaucgacaaccagguagugagcaccaaa

SEQ ID NO: 377620 - RNA, 64 nt, Human
cagggaccacuuccugacuaaggagcugcagcgauacaucgaagggcucaagaagcgccggagc

SEQ ID NO: 377621 - RNA, 64 nt, Human
auggugaagggaggccuuccuauggcuguacaauuacaucgauucuuccaaauuucauauuuca

SEQ ID NO: 377622 - RNA, 64 nt, Human
acacauuucucugucuuuuuugaucaguguccuauacaucgaaggugugcauauauguugaaug

SEQ ID NO: 377623 - RNA, 64 nt, Human
cuaggaaacugggaguuuagaucagcuuuacagauacaucgaucagaggcuaaaaugaaaccuc

SEQ ID NO: 377624 - RNA, 64 nt, Human
agaagcuugaaugcuguucuuuuuaucgcauuguuacaucgacucauucuccauuuugcuuugg

SEQ ID NO: 377625 - RNA, 64 nt, Human
gaaagaaagaaaaaguaugaauggucaaaaugaauacaucgagagagauaaauggcaaauugcu

SEQ ID NO: 377626 - RNA, 64 nt, Human
ggaaaggcaauaucucugguggaaaaaacucgucuacaucgaccuccguuuguacauuccauca

SEQ ID NO: 377627 - RNA, 64 nt, Human
auacgucuuuuucagaacuguuaaaguuuugauguacaucgagcugaauucuguuuuuaccagu

SEQ ID NO: 377628 - RNA, 64 nt, Human
uaaauuuucuuuggguaguaacuaaugucaagucuacaucgacugguaaaacauucaaagaaca

SEQ ID NO: 377629 - RNA, 63 nt, Human
cauguacagagcccagagaagcccccuacauccccccgggaaaaaaaagaaaacuagacagaa

SEQ ID NO: 377630 - RNA, 63 nt, Human
caguugcugcaaaguccuggaucugccacucaaccccgggagugguguucccaguguggcucc

SEQ ID NO: 377631 - RNA, 63 nt, Human
gaacgcaggugcuggcgcccguucugccugggaccccgggaaccucuccugccggaagccgga

SEQ ID NO: 377632 - RNA, 63 nt, Human
agcgacagguaacgcagugcgggguuagggauuccccgggagagaggacgaagcgaggagagu

SEQ ID NO: 377633 - RNA, 64 nt, Human
gcucuuuccuaaaaagcugagcuguaaaauauuuuacaucgagguauaauaaauaaucauguac

SEQ ID NO: 377634 - RNA, 64 nt, Human
ggccugcccuccugugaugggcagaggcuccugguacaucgagaagauuccuguggaucccguc

SEQ ID NO: 377635 - RNA, 64 nt, Human
cugcucuccccgggaaucucuaacaugcucuguuuacaucgauaaaugcacuuaaggaaaacaa

SEQ ID NO: 377636 - RNA, 64 nt, Human
ggcagaacuuccagaggaaaucgacaucuccacauacaucgagcagagccgguaaccaccacgu

SEQ ID NO: 377637 - RNA, 64 nt, Human
cuccuaccucaccaucuucgggcagaucccgggcuacaucgacgguaggagccgggcgccaugg

SEQ ID NO: 377638 - RNA, 64 nt, Human
uuauacgaauacugggacuguuaacagguggcuauacaucgacguuuucaaugugcuuaaauuu

SEQ ID NO: 377639 - RNA, 63 nt, Human
gcgaagacagcccgguaggcugcgucgcccgagccccgggagagaggagcgaagauccggaac

SEQ ID NO: 377640 - RNA, 63 nt, Human
gacaagguggcaucucaaccucacccaagaaacccccgggacuuuaccccagcaggcugccac

SEQ ID NO: 377641 - RNA, 63 nt, Human
uggcugaggcuaggcgcucucaugauccaccugccccgggagggcagcggggaagacagagaa

SEQ ID NO: 377642 - RNA, 63 nt, Human
ggucaaggggccugcuggguuaggcaugcccgaccccgggacaggacuaacccaagggggaaa

SEQ ID NO: 377643 - RNA, 63 nt, Human
accaggaccaagaagugaccguggcuccagccaccccgggacauugcuaagaugggagggcug

SEQ ID NO: 377644 - RNA, 63 nt, Human
ggcugggcuggguggcacaccacccgaggggggccccgggacccacggagcccucccuauguc

SEQ ID NO: 377645 - RNA, 63 nt, Human
cagagaccgcagcaucacccaaaucggcgccggccccgggaggaucucaauaaagaacucgag

SEQ ID NO: 377646 - RNA, 63 nt, Human
ccccccaaucggacugccaaauucuccgguuugccccgggauauuauagaaaauuauuuguau

SEQ ID NO: 377647 - RNA, 63 nt, Human
aggcagcuuugugagcagagcuccuuccccucuccccgggaacggcagggcacugggaccucu

SEQ ID NO: 377648 - RNA, 63 nt, Human
gaggggagggugugguggguucuccccugccacccccgggauggcugcuuccaaguuguuugc

SEQ ID NO: 377649 - RNA, 63 nt, Human
cagggcgaguggccuguccagaccccugugaggccccgggaaagguacagcccugucugcggu

SEQ ID NO: 377650 - RNA, 63 nt, Human
accuucuggguucaagcgauucucuuuauucagccccgggaguggcgcgcgccaccacgccca

SEQ ID NO: 377651 - RNA, 63 nt, Human
cccccgccccagccccugacacacacucggaccccccgggaccacaaagccaccgccgcuguu

SEQ ID NO: 377652 - RNA, 63 nt, Human
uucuuguccacaccccuuauccccaggcuggugccccgggagggcuggagaccaggccauggg

SEQ ID NO: 377653 - RNA, 53 nt, Human; identical to SEQ ID NO: 230668

SEQ ID NO: 377654 - RNA, 63 nt, Human
gacugaggccagagcaaggccaaugucagagacccccgggauggggccucacacuugccaccc

SEQ ID NO: 377655 - RNA, 63 nt, Human
agaagaaacaggccgaggcccagaguggccugcccccgggagccaaagaccccaguggccaca

SEQ ID NO: 377656 - RNA, 63 nt, Human
auuuauuaacaggauaacccuugaauguagcagccccgggagggcggcacaggucgggcgcag

SEQ ID NO: 377657 - RNA, 63 nt, Human
auguuaguaacguguacaaaguuuagguucagaccccgggagucuugggcacgugggucucgg

SEQ ID NO: 377658 - RNA, 63 nt, Human
cggccccgcgggcggcgggcggcgcuuccugcgccccgggacucaauuaaacccgcccggaga

SEQ ID NO: 377659 - RNA, 63 nt, Human
gcccgcccaggcccacggggggcccacgggaccccccgggacuccccggacauggcccugccc

SEQ ID NO: 377660 - RNA, 63 nt, Human
agcucggggcugggcugccuggcugcuggguggccccgggacaguggcuuuuccucucugaac

SEQ ID NO: 377661 - RNA, 63 nt, Human
uccacgugcccaaggauucagauggugcacuggccccgggaggagucugaccaaaaauggagc

SEQ ID NO: 377662 - RNA, 63 nt, Human
uagccaugggggaggugggugacaaagauaggaccccgggagggggcgcagguacaugcuagu

SEQ ID NO: 377663 - RNA, 63 nt, Human
gcugauguuuauuacauuguugguggcacguccccccgggaggggguggucaucacgaggaac

SEQ ID NO: 377664 - RNA, 63 nt, Human
ccugcaccaccuagagccccacccccgaccccaccccgggagggcagagccagaagaaggcuc

SEQ ID NO: 377665 - RNA, 63 nt, Human
ccgaggaccuggccaggccagccacuccugaagccccgggaggagaggaaggcagcggcgaac

SEQ ID NO: 377666 - RNA, 63 nt, Human
gagauucccaaugccaugggcuuucccccauccccccgggauugggcaaggucagacuuagag

SEQ ID NO: 377667 - RNA, 63 nt, Human
ugccagagcagcaacacuucccugugggcacagccccgggaaauccgguaccaagugagcaag

SEQ ID NO: 377668 - RNA, 63 nt, Human
aucugcaccccugaguugggcagccaggagugcccccgggaauggauaauaaagauacuagag

SEQ ID NO: 377669 - RNA, 63 nt, Human
agcaguagucauuguuguuuuaaccuccccucuccccgggaccgcgcuagggcuccgaggagc

SEQ ID NO: 377670 - RNA, 63 nt, Human
cggcuccaugacgcccguggggucaccccccggccccgggacucagccagccucgcuccucgc

SEQ ID NO: 377671 - RNA, 63 nt, Human
aggccccugaugcccggaagcuccugcgugcauccccgggaugaccagacucccggacuccuc

SEQ ID NO: 377672 - RNA, 63 nt, Human
aaggugggggcacagggcccaccccgcccgggaccccgggagcagaagacgcgccugggcucc

SEQ ID NO: 377673 - RNA, 63 nt, Human
gccagccccaccacauccuggaagaggagggggccccgggaaggggccuccccuacaucgcug

SEQ ID NO: 377674 - RNA, 51 nt, Human; identical to SEQ ID NO: 230693

SEQ ID NO: 377675 - RNA, 63 nt, Human
aacaaaucugggcauugagcaagcuaugaggguccccgggagcacacgaacccugccaggccc

SEQ ID NO: 377676 - RNA, 63 nt, Human
ggauaggggcugcccuuuuugucugauaccuggccccgggauagucaggacaggugaauguug

SEQ ID NO: 377677 - RNA, 63 nt, Human
gccucggguggggugggagcgggggggacagugccccgggaacccggugggucacacacacgc

SEQ ID NO: 377678 - RNA, 63 nt, Human
uuccucgaugggacccgguguaugccaaguggcccccgggaggacgggacccugagccugugu

SEQ ID NO: 377679 - RNA, 63 nt, Human
gggcccgccccacgcucuguccacacccacgcgccccgggagcggggccaugccuccagcccc

SEQ ID NO: 377680 - RNA, 63 nt, Human
gccucagcggaccacucuucucuccaaggaaauccccgggaagaguuagccuggauagccuug

SEQ ID NO: 377681 - RNA, 63 nt, Human
ucuauguguuuccucuaacgcuaaaggcacagcccccgggaaucuacugcuuccuaagagucu

SEQ ID NO: 377682 - RNA, 63 nt, Human
ggacucagcuccuuucauccugugcucugcccuccccgggagccucagaguuugcuucuggcu

SEQ ID NO: 377683 - RNA, 63 nt, Human
cccaggugcugacgugccgggguugagcuggcaccccgggaugugauguaagaacgcccugcg

SEQ ID NO: 377684 - RNA, 63 nt, Human
cacagggggccucucugccuccagccccaccuuccccgggagaagcuuuccccaauccccagg

SEQ ID NO: 377685 - RNA, 63 nt, Human
gcaccgggaccuggggcugggccgccucgugcuccccgggacuguguggcuccggucucgccu

SEQ ID NO: 377686 - RNA, 63 nt, Human
ggaggggcugagagggugggggcuggaaccccuccccgggaggagugccaucugggucuucca

SEQ ID NO: 377687 - RNA, 63 nt, Human
uuaccuuuuccagugggacaguacagugugagcccccgggaaguacugccugaccuauccuaa

SEQ ID NO: 377688 - RNA, 63 nt, Human
gagccccugcucugguggggcugccaggggagaccccgggagccggggaaggaggccguccau

SEQ ID NO: 377689 - RNA, 63 nt, Human
cuaccacagggagacagagggagguaagccaucccccgggagaccuugcugcugaccauccua

SEQ ID NO: 377690 - RNA, 63 nt, Human
augggggugagacccucgcagaccuaagcccugccccgggaugcaccgguuauuugggggggc

SEQ ID NO: 377691 - RNA, 63 nt, Human
cuggucccaagcagaggccuugcccugcugggaccccgggagugagagcagcccaaggaucca

SEQ ID NO: 377692 - RNA, 59 nt, Human; identical to SEQ ID NO: 230719

SEQ ID NO: 377693 - RNA, 63 nt, Human
ccacgccgacgcccgcccggauugcuccccgagccccgggaccgcuguggaccucgggaccug

SEQ ID NO: 377694 - RNA, 63 nt, Human
auugucaucaagacguggagccgcucuccacccccccgggacuguuggggggauucugagggc

SEQ ID NO: 377695 - RNA, 63 nt, Human
gugauuucccguggccccagccuggcccagcucccccgggaggggcccgcuugccucggcucc

SEQ ID NO: 377696 - RNA, 63 nt, Human
ugaaaaagaaaagagagaacagcccauaaugcuccccgggagcagaggccacuaauggagagu

SEQ ID NO: 377697 - RNA, 63 nt, Human
gccccauucucacugcuaucuggggagugauuaccccgggagacugaacugcaggguucaagc

SEQ ID NO: 377698 - RNA, 63 nt, Human
aggaaggaaggaagggcugcuggagcccagucaccccgggaccgugggccgaggugacugcag

SEQ ID NO: 377699 - RNA, 63 nt, Human
ggggcgggacccaggcaccugcauuuuaaagcgccccgggagacucugaaucuuuuucagaaa

SEQ ID NO: 377700 - RNA, 63 nt, Human
ggacugucuucucacccuuccccacucccugguccccgggagcagcuccuucugcccgacuca

SEQ ID NO: 377701 - RNA, 63 nt, Human
acagacagccccaccuggggcgcucagccuggcccccgggaaagaggaaaacccgcugccucc

SEQ ID NO: 377702 - RNA, 63 nt, Human
auaguccccucuccugcaucccuccaccccaguccccgggaaaggccggugggaagagggcag

SEQ ID NO: 377703 - RNA, 51 nt, Human; identical to SEQ ID NO: 230730

SEQ ID NO: 377704 - RNA, 63 nt, Human
ugcugccccagccugacauguguccaggccccuccccgggagguacagcuggcagagggaaag

SEQ ID NO: 377705 - RNA, 63 nt, Human
agaggcacgcgaacugucagucuuuccuaaggcccccgggagacgcaggcaauggggccucgc

SEQ ID NO: 377706 - RNA, 63 nt, Human
cagucuuccaaguaggaaacuuccuuuccccugccccgggacccuaucugccuauccccuccc

SEQ ID NO: 377707 - RNA, 63 nt, Human
cggggccagagacauaugggccauaccccuuaaccccgggaugcaagguagcauggguccaag

SEQ ID NO: 377708 - RNA, 63 nt, Human
ucacccucuaccucccugugcucaugcacuaggccccgggaagccuguacaucucaacaacuu

SEQ ID NO: 377709 - RNA, 63 nt, Human
ccagagggaggguuuaguacaugggagggcuagccccgggacuuggggccaauacggaaaccc

SEQ ID NO: 377710 - RNA, 63 nt, Human
caagagccagggggcccucuucagcgcauccugccccgggagucuccugucuccuuggaccuc

SEQ ID NO: 377711 - RNA, 61 nt, Human; identical to SEQ ID NO: 230742

SEQ ID NO: 377712 - RNA, 63 nt, Human
gagcaguaggggcugcaucgcacagcgcucgucccccgggacuuacacugcaugauucccuca

SEQ ID NO: 377713 - RNA, 63 nt, Human
cucuaccacaggacacauaucccuguuagcauuccccgggaccuuuagccaagaggagcugca

SEQ ID NO: 377714 - RNA, 63 nt, Human
ccaaacaggugacugucaagcugcccaacugugccccgggagucgaccccuucuacaccuauc

SEQ ID NO: 377715 - RNA, 63 nt, Human
cuucuuuaaacaucuuucagcccagcgcugcggccccgggaagggccacugcgaauagagagg

SEQ ID NO: 377716 - RNA, 63 nt, Human
caacaucuauggugucccaggcacagugccaggccccgggaguggggaccaagauguacauaa

SEQ ID NO: 377717 - RNA, 63 nt, Human
acaggccugcucacaacugccccucaaguucaaccccgggaccgcccagccccgcaaagcaaa

SEQ ID NO: 377718 - RNA, 63 nt, Human
gcuugugcuucugcgcuucugagggcuguucucccccgggaaccaucuguccccaccuucccu

SEQ ID NO: 377719 - RNA, 63 nt, Human
cuccauccucuugaaagguggauucagagggacccccgggacaagggucugagacccaaaggc

SEQ ID NO: 377720 - RNA, 63 nt, Human
uaggacccuucccacagccccgcugugguccagccccgggacccauggccucucuccaggccc

SEQ ID NO: 377721 - RNA, 63 nt, Human
cggaguucagacucucagaccugaaguaggcgcccccgggacugggcuaggaguuggacggaa

SEQ ID NO: 377722 - RNA, 63 nt, Human
agagcggccaucgcguagaaagaaccaggguguccccgggacaggccgucccccaccccaucc

SEQ ID NO: 377723 - RNA, 63 nt, Human
gagggcugaaaauauccuccccacaagggcaauccccgggaccugccgagcagccaaggcccu

SEQ ID NO: 377724 - RNA, 63 nt, Human
ggagcaaggcccugcagcuccacgagaccuuuaccccgggaagaagccgccacccaugaaagc

SEQ ID NO: 377725 - RNA, 63 nt, Human
cgguccauggcgguguccugcggaccccagagcccccgggaagggcgcaagucaaagagcacu

SEQ ID NO: 377726 - RNA, 63 nt, Human
augcgggaucccgagggccuuccugcccacaugccccgggagaaaccgaggccccucccuccu

SEQ ID NO: 377727 - RNA, 63 nt, Human
ugccguguauuuccuccccagggaguggggccuccccgggagcugacgccaccacccugcuua

SEQ ID NO: 377728 - RNA, 63 nt, Human
cugggccuccugcccgcgcgggaggggagggcgccccgggaccagggauggggcagcgcacag

SEQ ID NO: 377729 - RNA, 63 nt, Human
uuccccaaccacaaagguguuugugauuccucaccccgggaaaccaaggagcugcaaagugga

SEQ ID NO: 377730 - RNA, 63 nt, Human
uccggucggaguuguagccagucuuucaggggaccccgggacgcugaugaggcccagggugca

SEQ ID NO: 377731 - RNA, 63 nt, Human
gccugccugugucugcugccgagaagcccgugcccccgggagggcugccgcacugccaaagag

SEQ ID NO: 377732 - RNA, 63 nt, Human
cuuuaaucagugugauuaaugcagcacccauugccccgggaaccguuucugcuguacuaucug

SEQ ID NO: 377733 - RNA, 63 nt, Human
guccaauccccgcgccccacacugcccagcgccccccgggaccuccgcgggugccgcccucgc

SEQ ID NO: 377734 - RNA, 63 nt, Human
aaggaccuggagucacagcgaauccccgccccgccccgggaagccaccaaaccuugcuuuuuc

SEQ ID NO: 377735 - RNA, 63 nt, Human
cuuguggccucacuaaagguggggucgcuuaguccccgggaguaaaaugagugaccucagaaa

SEQ ID NO: 377736 - RNA, 63 nt, Human
acaggcuccggagggagccggcgucugaaaggcccccgggaccugcugcagugccagaggggc

SEQ ID NO: 377737 - RNA, 63 nt, Human
caccaugaggcauggagcagggcagagcaagggccccgggacagaguuuucccagaccuggcu

SEQ ID NO: 377738 - RNA, 63 nt, Human
gauugggucuaggauaugguggguggacaggggccccgggacuuggaggguugguccucuugc

SEQ ID NO: 377739 - RNA, 63 nt, Human
cacuggcuuccuuggacauagaucagacaaaagccccgggaucuguuugguagcaggagaaau

SEQ ID NO: 377740 - RNA, 63 nt, Human
gacugacggaugacucucacgucuccuccauagccccgggaccguguugcuccaguauuaacc

SEQ ID NO: 377741 - RNA, 63 nt, Human
uaggccugcuccuccacccuucccgggaggcagccccgggaugcugagaguugguggaggggc

SEQ ID NO: 377742 - RNA, 63 nt, Human
aagccccggagauguagacgccacccugcccacccccgggauccugcccccaagucauuuccg

SEQ ID NO: 377743 - RNA, 63 nt, Human
gccuuuuccuaagcaccagcggaaggagcugugccccgggauggagugaggguggagggcgcg

SEQ ID NO: 377744 - RNA, 63 nt, Human
cgucgccgucgccccggcuccccugggcgcccaccccgggacacagaacuagugagcgccccc

SEQ ID NO: 377745 - RNA, 63 nt, Human
cguuggccugggcuagggcugagacgcuucggaccccgggaaaggccauacgaagaaacagca

SEQ ID NO: 377746 - RNA, 63 nt, Human
ggaagucaggaccuugcucuucucuauuggaggccccgggaucucucgcaguguggggauuug

SEQ ID NO: 377747 - RNA, 63 nt, Human
gauuaggcuggacugaucgcgggucgcaggugaccccgggaccagaugucccuccccucauga

SEQ ID NO: 377748 - RNA, 63 nt, Human
auaccgcagaccuuggggaggaagcugagcaucccccgggaugucuccaguccugacacaguc

SEQ ID NO: 377749 - RNA, 63 nt, Human
ccuuucucugaggggacaccccgccagagagggccccgggagccggggguggguacugaggcc

SEQ ID NO: 377750 - RNA, 63 nt, Human
ugcaggggccgcgccuggcucaggcggccccacccccgggacguggggucacuuccuucaugu

SEQ ID NO: 377751 - RNA, 63 nt, Human
cgcccacuggagacagacagacagacgccugucccccgggaccgaggccugugccguccccac

SEQ ID NO: 377752 - RNA, 63 nt, Human
uccagacagcaccuggguccucgccacccuaagccccgggacaccuguuggagggcggauggg

SEQ ID NO: 377753 - RNA, 63 nt, Human
aagacugcgcgugcguagagcacgccggcgcggccccgggacucucgcgauaacuguacugag

SEQ ID NO: 377754 - RNA, 63 nt, Human
gcggguacacacccugggcacaggguccucagcccccgggaaaugagcucccagggcuggcgu

SEQ ID NO: 377755 - RNA, 63 nt, Human
auuaaaaccaacauaucagcaauagucugcucuccccgggaaucucuaacaugcucuguuuac

SEQ ID NO: 377756 - RNA, 63 nt, Human
cuccuugcaaagacagcagcgugcggggcagagccccgggagggcgcgucuguccacgccuac

SEQ ID NO: 377757 - RNA, 63 nt, Human
ucuaccuccacccccaccggccugacgcuguggccccgggacccagcagagcugggggaggga

SEQ ID NO: 377758 - RNA, 55 nt, Human; identical to SEQ ID NO: 230800

SEQ ID NO: 377759 - RNA, 63 nt, Human
aguacuggccucauuaaggauuauaaauuuucuccccgggaagaaacccugacuaacgcauug

SEQ ID NO: 377760 - RNA, 63 nt, Human
ccgcccuccccgcgugugcgccaggcuugggguccccgggagagcagagcuugcgccucgggc

SEQ ID NO: 377761 - RNA, 63 nt, Human
ccaggagaugcugcuucaggcgccgccacugggccccgggacccccacggcgcugcccgauga

SEQ ID NO: 377762 - RNA, 63 nt, Human
ugcagcagugccccugccagccccgaaucccacccccgggaccagccacauccacagcacaac

SEQ ID NO: 377763 - RNA, 63 nt, Human
cucucguggucucacuuuguuacuuguuucuguccccgggagccucagggcucugagagcugu

SEQ ID NO: 377764 - RNA, 56 nt, Human; identical to SEQ ID NO: 230806

SEQ ID NO: 377765 - RNA, 63 nt, Human
uccaaagcgggaaucaugugccccucagcggagccccgggaguguccaagacagccuggcugg

SEQ ID NO: 377766 - RNA, 63 nt, Human
cccagacuauggucacagggccguccuguuccuccccgggacuccagaauuucucuccucaaa

SEQ ID NO: 377767 - RNA, 63 nt, Human
cgucaccuggggacuccccacugucagcagcagccccgggacacccuacccccagcaacccca

SEQ ID NO: 377768 - RNA, 63 nt, Human
acgcugugcugcgcgcgcucaugcacgcggccgccccgggagccgccgaccugcccugcugcg

SEQ ID NO: 377769 - RNA, 63 nt, Human
ccaacugcccccguggucgccugguggcuggacccccgggauugacuagagaccggccguaca

SEQ ID NO: 377770 - RNA, 63 nt, Human
gccugcgcccacuaucaucccugcuccagcugcccccgggaagccagccuccgcagccaccgu

SEQ ID NO: 377771 - RNA, 63 nt, Human
ccuggcugccgcugggcgggaaccccaacagggccccgggagggaacccugcccccaaccccc

SEQ ID NO: 377772 - RNA, 63 nt, Human
agccaaguaggagggggcugggccgcgcccgcaccccgggagccuccucaggcucccucuauu

SEQ ID NO: 377773 - RNA, 63 nt, Human
cccucugccccuuccucucugccccaaacucuuccccgggaagggggacagacccaccccagc

SEQ ID NO: 377774 - RNA, 51 nt, Human; identical to SEQ ID NO: 230820

SEQ ID NO: 377775 - RNA, 63 nt, Human
guuucugcugggggcaggcuccucuucccccagccccgggagccucccccagcuuccugcagc

SEQ ID NO: 377776 - RNA, 63 nt, Human
gacccucgcggacacacccagaugccccagggaccccgggaagggaaggcagccugguuucuc

SEQ ID NO: 377777 - RNA, 63 nt, Human
ugcucuggggaagccgagggacagccauaacacccccgggacaguaggucugggcggcaccac

SEQ ID NO: 377778 - RNA, 63 nt, Human
gagccccggacccgcuggggccucuggccugcuccccgggaggggcgcucucucccggccaug

SEQ ID NO: 377779 - RNA, 63 nt, Human
gggauugucugguuucccuuacagggcccccucccccgggaaugcgcccaccaaggcccuaga

SEQ ID NO: 377780 - RNA, 63 nt, Human
aguuuagcugcaucugucuccccaccacccccaccccgggaggggcuuauguuacaaggugau

SEQ ID NO: 377781 - RNA, 63 nt, Human
uaacaacugagccagaccugcacacgccgagggccccgggacccugccugccucccucuggag

SEQ ID NO: 377782 - RNA, 63 nt, Human
ggagcauuguucugccacagcccugcauacugaccccgggaggcugggcagguggacagcccc

SEQ ID NO: 377783 - RNA, 63 nt, Human
cacgccugggccuggcuucaccucacccuaaucccccgggagggagcugacugaugcaaaaag

SEQ ID NO: 377784 - RNA, 63 nt, Human
ccuccagaaccucagagcuucccuggugggcucccccgggauccccagugucucucugcaccu

SEQ ID NO: 377785 - RNA, 63 nt, Human
uguccuccugggaguggacggccgggucccgucccccgggagcaucgcucggcucagcaccuu

SEQ ID NO: 377786 - RNA, 63 nt, Human
uuaaacccugccccacuucucuacucuggaaguccccgggagccucuccuugccuggugaccu

SEQ ID NO: 377787 - RNA, 63 nt, Human
caaagacccgcgggcgcccucugccaccuugcuccccgggaacccauggaaggagaagcgagg

SEQ ID NO: 377788 - RNA, 63 nt, Human
ccccaucugucucuauugucccccugccccaggccccgggaucagcugcccccccauccccgc

SEQ ID NO: 377789 - RNA, 63 nt, Human
cagcacacacacagcucagacccacggacaggaccccgggacagaaccccgggagcacugccc

SEQ ID NO: 377790 - RNA, 63 nt, Human
gcucagacccacggacaggaccccgggacagaaccccgggagcacugcccuaggagcccggac

SEQ ID NO: 377791 - RNA, 63 nt, Human
accccucugaagcugggcagcccucuaccugggccccgggagccgugcuccuuggaacgcaaa

SEQ ID NO: 377792 - RNA, 63 nt, Human
ucaggucuccugacaaacacagccccugaggggccccgggaguggccuuggcucccuggagag

SEQ ID NO: 377793 - RNA, 63 nt, Human
augaagccacgggugccagaagcuacugcgaugccccgggaguuagcccccugguaauagcug

SEQ ID NO: 377794 - RNA, 63 nt, Human
ccagggcccacagcguggcccuagcccuccccuccccgggauguagaacggggacccucgcag

SEQ ID NO: 377795 - RNA, 63 nt, Human
accaaagaacgaggggcccaggucuuguuggcaccccgggagccacugcccagggugauggug

SEQ ID NO: 377796 - RNA, 63 nt, Human
cagggcuuucuggaggacgcgcuggggccgggaccccgggagacucaaagggagaggucucag

SEQ ID NO: 377797 - RNA, 63 nt, Human
cucccggaccaccugcccagcguuggcgaggagccccgggaggugcuucugcggcuguacgga

SEQ ID NO: 377798 - RNA, 63 nt, Human
cgcgucuccuguaggccccaaggcgcugagcagccccgggaaacugucgccgucgccgcaucu

SEQ ID NO: 377799 - RNA, 63 nt, Human
ggguggggguagggaccacgcaugagucgaagcccccgggaagagccaaaggccaaagugccc

SEQ ID NO: 377800 - RNA, 63 nt, Human
gcccugugccagugaggacaggagacccuaaggccccgggagcccagugccagccagagguug

SEQ ID NO: 377801 - RNA, 63 nt, Human
gcugaggaguccuguguucccccgcaaggagcaccccgggaucauuuucuagguucauuucuc

SEQ ID NO: 377802 - RNA, 63 nt, Human
aguuuauuuuggugaaguuguucccauucugagccccgggacucuuauucugaugauguguca

SEQ ID NO: 377803 - RNA, 63 nt, Human
augggaggaagugcagcaggaauagcacccucuccccgggaggcccuagcuuccgugaggggc

SEQ ID NO: 377804 - RNA, 63 nt, Human
gaagugcuuggaagugucaucuacccuggccauccccgggaucccuccccugcuaaucugaac

SEQ ID NO: 377805 - RNA, 63 nt, Human
ggagcuccuuccgcggccaccgugcuccgggcaccccgggagcuccugcaagaggccugagga

SEQ ID NO: 377806 - RNA, 64 nt, Human
cgcaccucccuguaucugcgcagcuugcucguguggcuggaagcgcugucgauaagcuucacgc

SEQ ID NO: 377807 - RNA, 64 nt, Human
ucuacacauuauuuuuaaaacacaaaaauuguucggcuggaacugacccaggcuggacuugcgg

SEQ ID NO: 377808 - RNA, 64 nt, Human
ccuccccucccuucagggcacccacugguucccaggcuggaaccagggucucucuuuaccuccu

SEQ ID NO: 377809 - RNA, 64 nt, Human
auuccagcgccccaaggaggauucaaacuguuggggcuggaagaacuugguggccugggucccu

SEQ ID NO: 377810 - RNA, 64 nt, Human
cagauugaggaggaagugggcucugaggcugcagggcuggaaguccuugcccacuucccacucu

SEQ ID NO: 377811 - RNA, 64 nt, Human
uauauacaacuuucagagccucuuguauuuggaaggcuggaagggcccagacuuuggaauagug

SEQ ID NO: 377812 - RNA, 64 nt, Human
uugguuuuaauaaguuuauuccaagagaccuucuggcuggaaugagugagagugugugugcaug

SEQ ID NO: 377813 - RNA, 64 nt, Human
aauucuaaucuuucauaacuacaucucaauuaguggcuggaaaguacaugguaaaacaaaguaa

SEQ ID NO: 377814 - RNA, 64 nt, Human
gcccuagacugaaagucaagacaucugaauuucaggcuggaaaacuaucaguaugaucucagcc

SEQ ID NO: 377815 - RNA, 64 nt, Human
ucacugagcaccacauucucuagcuucuuguugaggcuggaacuguuucuuuaaaaucccuuaa

SEQ ID NO: 377816 - RNA, 64 nt, Human
ccuccuugaacaugcuuauuccaacgcuuugaggggcuggaagccuugacacauggaaucaggg

SEQ ID NO: 377817 - RNA, 64 nt, Human
cucuaagugguccaggaguccaaguaagcagucuggcuggaauaaggcagcaucacggaaauuc

SEQ ID NO: 377818 - RNA, 64 nt, Human
ggggcugcagggggaagcugugcaccugagaugaggcuggaacgggaauuggccucucugcucc

SEQ ID NO: 377819 - RNA, 64 nt, Human
aagcccaaacuauaucuaaacccaaaucucacuuggcuggaaacaucaaucuuaaccauuuauu

SEQ ID NO: 377820 - RNA, 64 nt, Human
aagugaagccagaggagggucccccagcugggugggcuggaauggaacuccucacuagcugcug

SEQ ID NO: 377821 - RNA, 59 nt, Human
cguccauugaaaagcccuagugucuuuagggcuggaaggcagcaucccucugacagggg

SEQ ID NO: 377822 - RNA, 64 nt, Human
caaucaagugccaccagauaaaaacaacugcagaggcuggaacugccacaggcuguaugaaagg

SEQ ID NO: 377823 - RNA, 64 nt, Human
ccgaguccaaacccaccucuugccccagcauucaggcuggaaaacacugauguggacucaguau

SEQ ID NO: 377824 - RNA, 64 nt, Human
agauuguugagagauggacuaggaaguggaagcaggcuggaaagacacauauggcgaaagucaa

SEQ ID NO: 377825 - RNA, 64 nt, Human
agcaggcucugaugcugagaggcuugccuccgggggcuggaagccuggguggccggggccccug

SEQ ID NO: 377826 - RNA, 64 nt, Human
uccacucaaugucuuaggucaggaguugugucuaggcuggaagagccaaagaauauuccauuuu

SEQ ID NO: 377827 - RNA, 64 nt, Human
accuugcaaguucaaaugaguuccugggagcggaggcuggaaggccacaaggugcuugcuaagg

SEQ ID NO: 377828 - RNA, 64 nt, Human
ggcuuaggagagagggaccagcgcccagcguuagggcuggaagacggcaguguucagaauucca

SEQ ID NO: 377829 - RNA, 64 nt, Human
ccaaggccaguuaaccaggcaagacacaagccuuggcuggaaaacugugguagagccgggcugu

SEQ ID NO: 377830 - RNA, 64 nt, Human
ccuacagggagcucaguaaccuggacggcucuaaggcuggaaugaccacauagguagguauggu

SEQ ID NO: 377831 - RNA, 64 nt, Human
cuaagcuagaaaaaugacauugaauucuggaccuggcuggaaggaaaagaagcccuuucuuguc

SEQ ID NO: 377832 - RNA, 64 nt, Human
auccagacacacucacacucucaucucuuuccuuggcuggaaacaagugcaggaagcuccccuc

SEQ ID NO: 377833 - RNA, 64 nt, Human
augacugacuggcugcagccuucccacgccaagaggcuggaacauagugucugccucgcuuccu

SEQ ID NO: 377834 - RNA, 64 nt, Human
gggacugagggcuuagaaaugacuuucucuaugaggcuggaaccuccuccuucuuccagugaag

SEQ ID NO: 377835 - RNA, 64 nt, Human
caggccgaaccuggagggccuggauuucuuuuugggcuggaaugcugcccugaggguggggcug

SEQ ID NO: 377836 - RNA, 64 nt, Human
gggccaggaucacacauucuucucacccuugagaggcuggaauuaaccccgcuugacggaaaau

SEQ ID NO: 377837 - RNA, 64 nt, Human
ccacccucauguuucuguaggauucucaccguggggcuggaagaaaagagcaucgacuugauuu

SEQ ID NO: 377838 - RNA, 64 nt, Human
aaggcuccacauuaggucaccugugcacagccauggcuggaaugaugaaggggauacgcuggag

SEQ ID NO: 377839 - RNA, 64 nt, Human
ccucugcucuccaucuccccaccccuagaaacagggcuggaaaucucccccacagcagugugac

SEQ ID NO: 377840 - RNA, 64 nt, Human
gagggggaaaaugcaguaauguuugugggagccuggcuggaaacuuuuaagugugugcacacag

SEQ ID NO: 377841 - RNA, 64 nt, Human
ucuguggcuuucuucugaacuuaccaccagcccuggcuggaauguagauuguguuuuuaguaau

SEQ ID NO: 377842 - RNA, 64 nt, Human
gguagaaggaaugguauuuguauggggggagggaggcuggaauggagaaucuggauucucuccu

SEQ ID NO: 377843 - RNA, 64 nt, Human
uaaugugaguucagacuuugggcaucuugcucuuggcuggaacuggauaauaaaaaucagacug

SEQ ID NO: 377844 - RNA, 64 nt, Human
uggagcugguggcuuaggccaucacccuucccuuggcuggaacuacuggacagacccuuuugag

SEQ ID NO: 377845 - RNA, 64 nt, Human
uuguuuggagacagagucucgcuauugucaccagggcuggaaugauuucagcucacugcaaccu

SEQ ID NO: 377846 - RNA, 64 nt, Human
uuaucugagcaauaacuucuauguugguuucaguggcuggaauuaaaacaaaacaaaacaaacu

SEQ ID NO: 377847 - RNA, 64 nt, Human
acucaggaggcagaaaucaaaagaaauccuugagggcuggaaccugaggauagagcgaaaaugg

SEQ ID NO: 377848 - RNA, 64 nt, Human
ccgugcgugaaguaggcauauaucacuaagcuguggcuggaauugauuaggaagcauuugguag

SEQ ID NO: 377849 - RNA, 64 nt, Human
auuggcauaucuccccccaguuuuuguggcucaaggcuggaauauuuaugccuuaauauaucua

SEQ ID NO: 377850 - RNA, 64 nt, Human
ggaacgugccagggggaacaaaguaagcuugaugggcuggaacuuuugacuuuggguccccaaa

SEQ ID NO: 377851 - RNA, 64 nt, Human
uguuuuuugagauggagucucacucugucgcccaggcuggaaugcaguggcaugaucucagcuc

SEQ ID NO: 377852 - RNA, 64 nt, Human
guauuauacuugagacauugcaccuaccccggaaggcuggaaauacagaaacagcauggaauug

SEQ ID NO: 377853 - RNA, 64 nt, Human
auguaaaaaagauacuuuccagcacauaaauaaaggcuggaauuuuacaaccugauguauauau

SEQ ID NO: 377854 - RNA, 64 nt, Human
uccccuugagguuccuccacucuaggguuugaggggcuggaaucagggccagggccuaacagug

SEQ ID NO: 377855 - RNA, 64 nt, Human
uuuuuguagagacgggguuuugccauguugcccaggcuggaagugucuauguuuaacugcaucu

SEQ ID NO: 377856 - RNA, 64 nt, Human
acgacuggcuaagacuugcuggacugacaccuauggcuggaagaugacuuguuuugcuccaugu

SEQ ID NO: 377857 - RNA, 64 nt, Human
agccacugaggaggaggcugugcugaguuuguguggcuggaaucucuggguaaggaacuuaaag

SEQ ID NO: 377858 - RNA, 64 nt, Human
cagggucccugcucaaguuuucuuugaaaaggagggcuggaaugguacaucacauaggcaaguc

SEQ ID NO: 377859 - RNA, 64 nt, Human
uaccccuaaaugguccauucugcauuguauuucaggcuggaaaugaauuauucuuuaccaguuu

SEQ ID NO: 377860 - RNA, 64 nt, Human
ugggaauaagaggaggaagcggcuggcaacugaaggcuggaacacuugcuacuggauaaucgua

SEQ ID NO: 377861 - RNA, 64 nt, Human
uuuucagacagagccauuccuaagaacacugaagggcuggaaugcuggcuggccacucucugcc

SEQ ID NO: 377862 - RNA, 64 nt, Human
uucacugccugugagacuuagcaccaagugcugaggcuggaagaaaaacgcacaccagacgggc

SEQ ID NO: 377863 - RNA, 64 nt, Human
acguguguucuuuugaguccuuguaugaauaaaaggcuggaaaccuacagcagggcgaggccuc

SEQ ID NO: 377864 - RNA, 64 nt, Human
ugcagccuugaugacaccugccgcugccccucggggcuggaauaaaacuccccacccagaguca

SEQ ID NO: 377865 - RNA, 64 nt, Human
guguuuuugaaacggaguuuugcucugucacccaggcuggaaugcaauggcaccaucuuggcuc

SEQ ID NO: 377866 - RNA, 64 nt, Human
gccccagacccaucucuuggauugagggugugugggcuggaaccagugggucacuguggcagcu

SEQ ID NO: 377867 - RNA, 64 nt, Human
uccguuagcuccuguggccccacccugggcccugggcuggaaucaggaauauuuuccaaagagu

SEQ ID NO: 377868 - RNA, 64 nt, Human
gauccgacugcuuuggaccuaaauggccucauguggcuggaagauccugcggguggggcuuggg

SEQ ID NO: 377869 - RNA, 64 nt, Human
aacugacuagcaccauuaugaucaccaguauuguggcuggaauggaagaagaucaccuuggugu

SEQ ID NO: 377870 - RNA, 64 nt, Human
gucccacaguggcauucuggaguccgucugucuuggcuggaaauucucugacgucuuggaggca

SEQ ID NO: 377871 - RNA, 64 nt, Human
cauguuuaucuuuacccuuagcaggaagaugcuuggcuggaacuuuguguucacagacuuaguc

SEQ ID NO: 377872 - RNA, 64 nt, Human
aaacauaauugcauguuuuuaaaaauuccuuggaggcuggaagggguuaagccagaagugcaau

SEQ ID NO: 377873 - RNA, 64 nt, Human
ccagaaaacuacuacaauggccaaguacaguauaggcuggaaagaccuuaucugaaggucagaa

SEQ ID NO: 377874 - RNA, 64 nt, Human
uuucuuuacagaacaagcauuguuuaggaagacuggcuggaaacuuauuuuaaucacacccaug

SEQ ID NO: 377875 - RNA, 64 nt, Human
cugggagguauuggagggaaaaaacaagcaggauggcuggaacacuguacugaggaaugaauag

SEQ ID NO: 377876 - RNA, 64 nt, Human
agaauaaagaaugcugagucaagauuuauauuaaggcuggaagcuguggcucacaccuguaauc

SEQ ID NO: 377877 - RNA, 64 nt, Human
auggugggaggauggguugagcacaggagucagaggcuggaaugcaauggcgugaucuuggcuc

SEQ ID NO: 377878 - RNA, 64 nt, Human
gcugugugaaauuuaaaaaagggauguuuuuccaggcuggaacaauaaauguggcugugcaguu

SEQ ID NO: 377879 - RNA, 64 nt, Human
cccgggugucugcggccgcaacgcaacggacacuggcuggaaccccggaaugagccuucgaccc

SEQ ID NO: 377880 - RNA, 64 nt, Human
aauucaguauuccauuuaauaaaaacaauacaguggcuggaaaggagcaucagaaacauguguc

SEQ ID NO: 377881 - RNA, 64 nt, Human
auaugcaaaaauauaccuucagagacugucaguaggcuggaagaaguggauauugaaguuuuga

SEQ ID NO: 377882 - RNA, 64 nt, Human
cugacagggucuugcucuauugcucugucacccaggcuggaaugcaguggcgagaucuccgcuc

SEQ ID NO: 377883 - RNA, 64 nt, Human
cuggugcuggguuugcucucccgcuguugccaggggcuggaagcuggaggggucucuugggcca

SEQ ID NO: 377884 - RNA, 64 nt, Human
uuugccacuugauggggccuggguuuguuccuggggcuggaaugcuggguaugcucugugacaa

SEQ ID NO: 377885 - RNA, 64 nt, Human
auuuuuuugaaacuagcucucauucugucacccaggcuggaauacagugguacagucacggcuc

SEQ ID NO: 377886 - RNA, 64 nt, Human
uauuauuugagauggagucucacucugucacccaggcuggaaugcaguggugugaucuuggcuc

SEQ ID NO: 377887 - RNA, 64 nt, Human
uuuaauagcacagacuugaaggaguuuaaaaggaggcuggaaaucaauacugcacacugcacau

SEQ ID NO: 377888 - RNA, 64 nt, Human
acauugaagauaugugguccuccugaaagucacuggcuggaaauaauccaauuauuccugcuug

SEQ ID NO: 377889 - RNA, 64 nt, Human
aggcaggcagcuguacccaagcuggugggcagggggcuggaaggcaccaggccucaggaggagc

SEQ ID NO: 377890 - RNA, 64 nt, Human
acugggaagucuuugucccuaggaaauccaaaggggcuggaauaugguguugguuuggcuuucu

SEQ ID NO: 377891 - RNA, 64 nt, Human
cuaugacuuuaucuuacagauuuggaaaacuauaggcuggaaacuccuaucuguuucauuaacu

SEQ ID NO: 377892 - RNA, 64 nt, Human
gaccaccauccaggcugagacugaaaggagcagaggcuggaacuacaguauucuuuccccugcu

SEQ ID NO: 377893 - RNA, 64 nt, Human
ccauccugacuguggaguugggauguggaaguggggcuggaacaaagcuucugccuagggagga

SEQ ID NO: 377894 - RNA, 64 nt, Human
agacacagggaaauugagccauauuuuggcuaucggcuggaaccagcaguucagagaucugccu

SEQ ID NO: 377895 - RNA, 64 nt, Human
cugacagcacaguaacgugcauacauaucugcagggcuggaauggaagcuuuaaaggugguagu

SEQ ID NO: 377896 - RNA, 64 nt, Human
cuuguagguacaaucuaggccuugaagaaacaaaggcuggaauaucugcccaugcuuugggcau

SEQ ID NO: 377897 - RNA, 64 nt, Human
aguguuggauggaccacccaagggugaggagaggggcuggaagcccugggcauuaggagaaggg

SEQ ID NO: 377898 - RNA, 64 nt, Human
gcagggaguuggggacuaagggcuuccagagaguggcuggaagagacuccaggccccuggggag

SEQ ID NO: 377899 - RNA, 64 nt, Human
ccugcacaugaacacauucaugacacacaaaacuggcuggaaggagauaagagcacuggguuug

SEQ ID NO: 377900 - RNA, 64 nt, Human
gggguggggaaauaguucuggugccuuaacgcauggcuggaauuuauagaggcuacaaccacau

SEQ ID NO: 377901 - RNA, 64 nt, Human
guugaauguuugugauucuguguggccuuuuuggggcuggaaaauguaugaauucuucaacugu

SEQ ID NO: 377902 - RNA, 64 nt, Human
cugucuucauauuugcauuucauguuuaaccuccggcuggaaauagaaagcauucccuuagaga

SEQ ID NO: 377903 - RNA, 64 nt, Human
uacaagccaagcugaugaggcaguacaggggagaggcuggaaaacauauuaagagcauaaauug

SEQ ID NO: 377904 - RNA, 64 nt, Human
ugacaauguuuacaaauuacguacuaaggauacaggcuggaaaguaagggaagcagaaggaagg

SEQ ID NO: 377905 - RNA, 64 nt, Human
uguauugggccaccggaagacaagcuaauaaauaggcuggaaguaauauucuaccagcaggaac

SEQ ID NO: 377906 - RNA, 64 nt, Human
uuccaacaggaugaugcauuugcucaauucucagggcuggaaugagccggcuggucccccagaa

SEQ ID NO: 377907 - RNA, 64 nt, Human
guggcugaagagccagccucgguggcccagcuggggcuggaaccaggucuccugcccuuguucc

SEQ ID NO: 377908 - RNA, 64 nt, Human
auucucuggcggggaccagggcccaaggccccagggcuggaaggagaccaaggggcagccgccc

SEQ ID NO: 377909 - RNA, 64 nt, Human
uccccacaggggggaggcacuaagucaugguccuggcuggaagguacugaaggcuucugcagcu

SEQ ID NO: 377910 - RNA, 64 nt, Human
cggcagaugcuguuguuguuacuucccuccaagaggcuggaaaagggcucagagcugcugagca

SEQ ID NO: 377911 - RNA, 64 nt, Human
uucacucuccgaagucugaucccugccaaaaaguggcuggaagagucccuuaguacucuucuag

SEQ ID NO: 377912 - RNA, 64 nt, Human
acaccacaccacccuccaggccccccugcccuccggcuggaaacugcagcucuguaaaugccuc

SEQ ID NO: 377913 - RNA, 64 nt, Human
uggaaaccaagcugggagaggcugaggauggcagggcuggaagggccaucagcgugacccucau

SEQ ID NO: 377914 - RNA, 64 nt, Human
uggaugagaaaaugauaaaauaugcuaaguucuaggcuggaaauaagggcaaaaugcugugaaa

SEQ ID NO: 377915 - RNA, 64 nt, Human
gguuuuguuuaaaugggcaagaaguaaauaauguggcuggaauacaaguugaacaaacuagaag

SEQ ID NO: 377916 - RNA, 64 nt, Human
ucauacucuuccagguuuuuuuuuuuuggucuaaggcuggaacuuuuuucuuuuuuuucagcug

SEQ ID NO: 377917 - RNA, 64 nt, Human
guuuguuugagauggagucuugcucugucgcccaggcuggaacgcaguggugacaucucggcuc

SEQ ID NO: 377918 - RNA, 64 nt, Human
uuguggugauucucaguggcucaucuaauauuuuggcuggaauaaaucagagacuuccauaauc

SEQ ID NO: 377919 - RNA, 64 nt, Human
aauuuucugauuuccuauuuuauaaugauacaugggcuggaaaaauguagaacguuuuuauauu

SEQ ID NO: 377920 - RNA, 60 nt, Human
agaaggggaaaagagauuaauuacgucugaggcuggaagcugggaaacccaauaaaugaa

SEQ ID NO: 377921 - RNA, 64 nt, Human
uuuucguagagagagggucuuacucuuucacucaggcuggaauguaguggagagaucauagcuc

SEQ ID NO: 377922 - RNA, 64 nt, Human
cuuucacuuuacacuugcauguucuacuugucagggcuggaacuauuguauagaagauaauaug

SEQ ID NO: 377923 - RNA, 64 nt, Human
ggucaacugcaguguugcuucccucccccuauagggcuggaaucugucuaggagcccucucucg

SEQ ID NO: 377924 - RNA, 64 nt, Human
agugcugggauuacagacaugaaccaccacgccuggcuggaauacuuacucuugucgggagauu

SEQ ID NO: 377925 - RNA, 64 nt, Human
caauuagauuuuaaguaaggauugugauauuagaggcuggaaauccuuauuuuuuaaaaaauca

SEQ ID NO: 377926 - RNA, 64 nt, Human
uuaaucauugguucggcugcuuuuauguaguuuaggcuggaaaugguuucacuugcucuuugac

SEQ ID NO: 377927 - RNA, 64 nt, Human
uacuccuccuaacccuaaacccucuaugcucaggggcuggaacuggggaauggaguaagucacc

SEQ ID NO: 377928 - RNA, 64 nt, Human
ggcuugucuuguucagaagacucuagcaucuuggggcuggaagguccuuugacggguaugaaac

SEQ ID NO: 377929 - RNA, 64 nt, Human
agucaaugguagguuucaugcaacugcugcucuaggcuggaaaaguuguucuugcacuggaugc

SEQ ID NO: 377930 - RNA, 64 nt, Human
ugugugcugucccuucccacagucccuggcaggcggcuggaaggccaggccuggucaucuguca

SEQ ID NO: 377931 - RNA, 64 nt, Human
agaggguggggaggauagugucuggcucauuccaggcuggaauguggauccagcuuucccuucu

SEQ ID NO: 377932 - RNA, 64 nt, Human
ggccacauggugcuggcucugaacguugguugguggcuggaaaacagcccugcuucugagggcc

SEQ ID NO: 377933 - RNA, 64 nt, Human
uaauuuuuuuucauuaauuuuugaagauacuuguggcuggaaaagugcauuccuuguuaauaaa

SEQ ID NO: 377934 - RNA, 64 nt, Human
aacuugaaauaggaaguucucacugaauccuggaggcuggaacagcuggcucuuuuagacucac

SEQ ID NO: 377935 - RNA, 64 nt, Human
uuuuuuuugagauggagucucacucugucacacaggcuggaaugcagugaugccaucucagcuc

SEQ ID NO: 377936 - RNA, 64 nt, Human
uggaagaaaaaccucagacaucuacaaacaaccuggcuggaaaacacacagcaaaaacaauaaa

SEQ ID NO: 377937 - RNA, 64 nt, Human
cuaucuaggguggugaaaugccugaaaucucuggggcuggaaaccauccaucaaggucucuagu

SEQ ID NO: 377938 - RNA, 64 nt, Human
cuuaucguggcacuguugcagcuuccucugcccuggcuggaaagacuccagaauccaguguggu

SEQ ID NO: 377939 - RNA, 64 nt, Human
uguuuuuaaagauggggucuuguuauauugccuaggcuggaaugcagugguuauucacaggcau

SEQ ID NO: 377940 - RNA, 64 nt, Human
agguaagaacugagaagggaggcaugaggcgugaggcuggaagauaauacagaaugucccaggc

SEQ ID NO: 377941 - RNA, 64 nt, Human
agcacugcugaugaaguccccgugggcucauccgggcuggaauucuugguuuuucagccauucc

SEQ ID NO: 377942 - RNA, 64 nt, Human
agagggugacaagauagagagcuauuuaauggccggcuggaaaugcugggcugacggugcaguc

SEQ ID NO: 377943 - RNA, 64 nt, Human
guuucaguugaggccauggauuugauuguuccauggcuggaaguucccuuuagauuucacauuu

SEQ ID NO: 377944 - RNA, 64 nt, Human
agcuggcaggaacagggagcagcccugugucgggggcuggaauaguucuggccagaccccguuc

SEQ ID NO: 377945 - RNA, 64 nt, Human
auaagacauuucacaaauauucacuuacauuacaggcuggaaguauuuuauucauauguauauu

SEQ ID NO: 377946 - RNA, 64 nt, Human
uaaauaacaaacauuucuuucuuacaguucuggaggcuggaaacuccaagauuaaggcagauuu

SEQ ID NO: 377947 - RNA, 64 nt, Human
ggaccuccucugugagacugugccuucccauccaggcuggaaggagcucucugugaccuagcgg

SEQ ID NO: 377948 - RNA, 64 nt, Human
cuccacugagggcaccuagacucuacagccaggcggcuggaauugaauucccugccuggaucuc

SEQ ID NO: 377949 - RNA, 64 nt, Human
ggagguucagcagacccaugcagugugcugccagggcuggaagaagcggcacccgggggcgcuc

SEQ ID NO: 377950 - RNA, 64 nt, Human
uugcauuuggaaggcuaaauggggccaugaagaaggcuggaagggacagggggugauggcagcc

SEQ ID NO: 377951 - RNA, 64 nt, Human
uggagagauaggggguaguucucccuacugcccaggcuggaauccaagaguggggaguggggaa

SEQ ID NO: 377952 - RNA, 64 nt, Human
aaacagcagaacuugauucccuuacaguucuggaggcuggaaaucugggauggagguguuggca

SEQ ID NO: 377953 - RNA, 64 nt, Human
gcaccugcccucccagucucccaccccggccccaggcuggaagcccucccuccacuuaaguuau

SEQ ID NO: 377954 - RNA, 64 nt, Human
ucuccccgccccaucuucaaggcucagcgacugaggcuggaagaugauauggauuggaacacaa

SEQ ID NO: 377955 - RNA, 64 nt, Human
aaaaagacuggguucgaucagcccuccuaaagcuggcuggaaaaagaagccccagcccagccug

SEQ ID NO: 377956 - RNA, 64 nt, Human
uacuguguccaauauucuuucaagcaaaugcaauggcuggaauauaauucagaauuaacugaaa

SEQ ID NO: 377957 - RNA, 64 nt, Human
uaaacaacagaaauuuguuucucacaguucuggaggcuggaaguccaaggucggggugcccuca

SEQ ID NO: 377958 - RNA, 64 nt, Human
acgggagacagagugacgcacugacucaccuagaggcuggaacguggguagggauuuagcaugc

SEQ ID NO: 377959 - RNA, 64 nt, Human
ccuauuuccucuuccucuugaaugucuuuccaauggcuggaaaggucccucugugguuaucugu

SEQ ID NO: 377960 - RNA, 64 nt, Human
cucauccauuugugaggaggacuucucgcccucuggcuggaagcugauaccugaagcacuccca

SEQ ID NO: 377961 - RNA, 64 nt, Human
aggaauuccaaaaaugauuacccauuaaaaggcaggcuggaaggccuuccugguuuuaagaugg

SEQ ID NO: 377962 - RNA, 64 nt, Human
guguggggugugugcagggcugcaucccgcagauggcuggaauauuaaaauucuucuauauugg

SEQ ID NO: 377963 - RNA, 64 nt, Human
ugcuccuaaucccuccaaucucucuccacugaguggcuggaaugcuuuuuuuuuuuucuuucac

SEQ ID NO: 377964 - RNA, 64 nt, Human
gaugggcaguaauaugugacagagcccaaagcaaggcuggaacgcagucccuuccagcuuaguc

SEQ ID NO: 377965 - RNA, 64 nt, Human
ugucucugacuuguuuguuuugaauuacauuacaggcuggaauguaauuguggugaaaguauuu

SEQ ID NO: 377966 - RNA, 64 nt, Human
cuaacaaguccaaaagcuggagugugaggcaggaggcuggaaacccaggaaagcugauggugca

SEQ ID NO: 377967 - RNA, 64 nt, Human
ccuuuuuccuucagcagcauuucuuacuggcuguggcuggaaucugccuuuuaucacagcuguc

SEQ ID NO: 377968 - RNA, 64 nt, Human
uaggacugacccuugugguguuuuuuugggugguggcuggaaacagccccucucccacguggca

SEQ ID NO: 377969 - RNA, 64 nt, Human
caccuuccuugcuugcaggguuaucuucucacagggcuggaaugcaaauuucagaggcuucuuu

SEQ ID NO: 377970 - RNA, 64 nt, Human
agcgcagccguggcagccaccuuccaggagcaggggcuggaauguccuguggccgcaucucuca

SEQ ID NO: 377971 - RNA, 64 nt, Human
uaaaggaaaugguuuuauugcccauagucauuuaggcuggaaaaaaguugaaaacuuaacgaaa

SEQ ID NO: 377972 - RNA, 64 nt, Human
cagggcaccguauuccucucccagguguuuguggggcuggaaggaccugcucccacaggggcca

SEQ ID NO: 377973 - RNA, 64 nt, Human
ugccacacccaggugauuuccucuaaagaaacuuggcuggaauuucugcuguggucuauaaaau

SEQ ID NO: 377974 - RNA, 64 nt, Human
ugcaaccuggggggacauuccuuuguaaaaccugggcuggaagucaaagccgucgguuacagag

SEQ ID NO: 377975 - RNA, 64 nt, Human
aucaaauuugucuugaccaaauaaguuuccugagggcuggaauuaugccuuaacuauaucuaua

SEQ ID NO: 377976 - RNA, 64 nt, Human
cagaagccuucuggcugauuguuccgaugugcccggcuggaaaacaugucuuuagggcugucug

SEQ ID NO: 377977 - RNA, 59 nt, Human
cagcaaauccacuccucuaagacuccagcggcuggaauuggguggggggcuucauacac

SEQ ID NO: 377978 - RNA, 64 nt, Human
cuggggucaagagccugcacacaugagccuuccgggcuggaaggcuggcguaggacuuggggcu

SEQ ID NO: 377979 - RNA, 64 nt, Human
aaucccaccagaauacgggucccucuaacccaguggcuggaagaaccacugucuagagcaacuu

SEQ ID NO: 377980 - RNA, 64 nt, Human
gugaaaaugugccuagaaucaaaugugacacguaggcuggaacugaguaccauucagaauagga

SEQ ID NO: 377981 - RNA, 64 nt, Human
aggugaggauacaacuagaagccagcagucuacaggcuggaagaaggcccucaccagaacccaa

SEQ ID NO: 377982 - RNA, 64 nt, Human
aagagcccagacaccgggaaccccugacccaggaggcuggaagugucccccuugaggacgaagc

SEQ ID NO: 377983 - RNA, 64 nt, Human
auugcuaccccaauucucuggggacauaaaaccaggcuggaaagggaccaggaaguuugaaaua

SEQ ID NO: 377984 - RNA, 64 nt, Human
ucccgggcaggggugaaacuccagcagguggcugggcuggaaaggagggcagggcuacauccug

SEQ ID NO: 377985 - RNA, 64 nt, Human
accaugaugguuuaaggugccuguugugucugguggcuggaacauggcaguggugcugagacau

SEQ ID NO: 377986 - RNA, 64 nt, Human
agccugagaacugcacgggggagcagcccagacuggcuggaaaccauguuuucagagugcaggg

SEQ ID NO: 377987 - RNA, 64 nt, Human
ccacaaaccuguuaacauugucuuaaggugaaauggcuggaaaaucaguauuuaacuaauaaau

SEQ ID NO: 377988 - RNA, 64 nt, Human
aggugccaccagucaguugugccuaugucccuuuggcuggaaaugcagaauaugaauugauuag

SEQ ID NO: 377989 - RNA, 64 nt, Human
uguggacauugaagcuugagcucucaaagcaguuggcuggaauacuuuugucagaauacgguac

SEQ ID NO: 377990 - RNA, 64 nt, Human
uggcugccuccccuccacggccuccagggcggcuggcuggaaagccacgcguaugcugcccucu

SEQ ID NO: 377991 - RNA, 64 nt, Human
aauauaagaaauggucugguuuucauaaugagaaggcuggaauugagcuucccucccauuuucc

SEQ ID NO: 377992 - RNA, 64 nt, Human
aauaaaaacugccucuguuguguuucucacuggaggcuggaaugaaugaucacuagaacacaaa

SEQ ID NO: 377993 - RNA, 64 nt, Human
uaaaaugagggucucacugcuuuaggauugaaguggcuggaaagagugaugccuggggaaggag

SEQ ID NO: 377994 - RNA, 64 nt, Human
gccaucgccaagcacaaucagguggaggcugcauggcuggaaggccggauccggcaggaguuug

SEQ ID NO: 377995 - RNA, 64 nt, Human
aaacaggcuaaaaguuuaguauucugggagaaguggcuggaagaagggguaauauggugaaagc

SEQ ID NO: 377996 - RNA, 56 nt, Human
auaaauucaagcauuugugaauacauggcuggaauaagaggacacuagaugauauu

SEQ ID NO: 377997 - RNA, 64 nt, Human
caaaauccagaaagcauuuaagaauugaacuaggggcuggaagaagugaaagggaagcaucuaa

SEQ ID NO: 377998 - RNA, 64 nt, Human
gauucuucuaaagcacugguuucaagaauauggaggcuggaaggaaauaaacauuacgguacag

SEQ ID NO: 377999 - RNA, 64 nt, Human
uggcuuaaauccaguuuucaaucuucgacagcugggcuggaacgugaacucaguagcugaaccu

SEQ ID NO: 378000 - RNA, 64 nt, Human
cacccuagccuagaacaagccagagccgcacccuggcuggaaugggggccaggcugagccgauc

SEQ ID NO: 378001 - RNA, 64 nt, Human
uagugacuuaacacaaauuuauugcaauucuguaggcuggaagucugacuaugggucucacugg

SEQ ID NO: 378002 - RNA, 64 nt, Human
ugaauggagagcauggauugugaugaggaaacaaggcuggaagagcugccaagggacuuacuac

SEQ ID NO: 378003 - RNA, 64 nt, Human
gagccagcagcugaagucucuuuuucuuccucucggcuggaagaacaucaagauaccuuugcgu

SEQ ID NO: 378004 - RNA, 64 nt, Human
gacaaaaaguagauucauguuugcaaggggcuggggcuggaagcugguagugacugcuaauggg

SEQ ID NO: 378005 - RNA, 64 nt, Human
cugagcgccuccuccgcagagcugcagcagcaguggcuggaaacccuaagcacugcugcccaug

SEQ ID NO: 378006 - RNA, 64 nt, Human
uuugcaguuuucaagauuuuuuuuuuaucugcuuggcuggaaaggagacuagaguaucuaguuu

SEQ ID NO: 378007 - RNA, 64 nt, Human
acuggcaaagucuuuuggauggguugggagauguggcuggaaaguacuuuggaaaauauacaau

SEQ ID NO: 378008 - RNA, 64 nt, Human
cuuaugguccagaaacuccuguuucuccuuaguuggcuggaaacugcucccaucauuccuucug

SEQ ID NO: 378009 - RNA, 64 nt, Human
uuuuuuugagacagaguuucgcuuuuguugcccgggcuggaaugcaauggcgcgauucagcuca

SEQ ID NO: 378010 - RNA, 64 nt, Human
gccuggagugcacacagcccagucggcaccugguggcuggaagccacccugcuuuagaucacuc

SEQ ID NO: 378011 - RNA, 64 nt, Human
ucccaggccaugccgggguggccaucuaugguagggcuggaagcugaggcuggccgccagcugu

SEQ ID NO: 378012 - RNA, 64 nt, Human
ccccacacuccucccacggcuuguggcugcccuuggcuggaaguccagggucauacgacgccau

SEQ ID NO: 378013 - RNA, 64 nt, Human
caagugucaccacuucccugaaccccccuaggugggcuggaaucagcaucuggugcaaagcucu

SEQ ID NO: 378014 - RNA, 64 nt, Human
uuccugcauuucagcagugcauaaucgagcaggaggcuggaaucuggagaccuuuguuauucau

SEQ ID NO: 378015 - RNA, 64 nt, Human
caagcaugguaucaucucacuuuucuaauuuacaggcuggaacagaugagagcccuccugcugg

SEQ ID NO: 378016 - RNA, 64 nt, Human; identical to SEQ ID NO: 378004

SEQ ID NO: 378017 - RNA, 64 nt, Human
ugucuguaaccuguaguaggcucugaccuagucaggcuggaagcgucaggauaucuuuucuucg

SEQ ID NO: 378018 - RNA, 64 nt, Human
acaaagagaggaaauguguuucaguuucuggaguggcuggaauuuacaagcuaauuguucaaua

SEQ ID NO: 378019 - RNA, 64 nt, Human
uaguuuauggauuuaaacauuagagcuggaguggggcuggaaaucuuuguaaaggaaguucuuu

SEQ ID NO: 378020 - RNA, 64 nt, Human
uccugcuugugccaagggcuggacacugcuggggggcuggaaagccccucccuuccuguccuuc

SEQ ID NO: 378021 - RNA, 64 nt, Human
ggacugagaauuuggccacaaccaaauugaugcuggcuggaaccagaggccagaaagccuggcc

SEQ ID NO: 378022 - RNA, 64 nt, Human
ugagacuucuguagccugccuggcuccuccuugaggcuggaacucucuccagggugguuaacuc

SEQ ID NO: 378023 - RNA, 64 nt, Human
caucggcagcgccggcaagaccuucagcgccacuggcuggaaggugggcuggguccugggucca

SEQ ID NO: 378024 - RNA, 64 nt, Human
gugguuuccuuccucuucaggcagccaggcccauggcuggaaggccgggcuggaggcccaggga

SEQ ID NO: 378025 - RNA, 64 nt, Human
ugcugaggcccagcccagcccagcauagcccgagggcuggaaaaacgcuuucaucucuaaaacu

SEQ ID NO: 378026 - RNA, 64 nt, Human
ccacccugaacaaaucuugggugggugaaggccuggcuggaagagggugaaaggcagggcccuu

SEQ ID NO: 378027 - RNA, 64 nt, Human
guugagcuggcaggggaggggcugagagggugggggcuggaaccccuccccgggaggagugcca

SEQ ID NO: 378028 - RNA, 64 nt, Human
gucgucucucagacaggcguccuaaagaccucuaggcuggaagcuugggcuugcaaguggaucc

SEQ ID NO: 378029 - RNA, 64 nt, Human
gcaugguuuccccagaggaugugugccccaagguggcuggaauuuuugacagacaagaagggug

SEQ ID NO: 378030 - RNA, 64 nt, Human
uuuuuccucuacuccuuccccuucacacccccguggcuggaaggaaccucggcuucccugaaag

SEQ ID NO: 378031 - RNA, 64 nt, Human
uuuuuuucaagauggagucuugcucugucgcccaggcuggaaugcaguggcgcgaucucggcuc

SEQ ID NO: 378032 - RNA, 64 nt, Human
aggugccauuuuguugcauauguacaggauuaugggcuggaaagcauuuguuauaaaccuauag

SEQ ID NO: 378033 - RNA, 64 nt, Human
uggucuuaaaagacuagacaguuaaguaaaagguggcuggaacaucuauuuuucuacaaaacug

SEQ ID NO: 378034 - RNA, 64 nt, Human
guuuuacuugaaucuucauguacguccauucccuggcuggaaccuucgcuguuugguauuuggu

SEQ ID NO: 378035 - RNA, 64 nt, Human
aagggaaaagugccuuuaaaauuaccucacugugggcuggaagaagcgaaaaucucugcccagc

SEQ ID NO: 378036 - RNA, 64 nt, Human
uuagaaacauacuagcuauuuuuucuuuaauuagggcuggaauaggaagccagugucucaacca

SEQ ID NO: 378037 - RNA, 64 nt, Human
acuuggccgagacuaauguguggcccacagcuuuggcuggaaucauuuucuuucucucugccag

SEQ ID NO: 378038 - RNA, 64 nt, Human
aacgcaguuauguuuccagagaacaucuagaaguggcuggaaaccagaagcuggggauuccagg

SEQ ID NO: 378039 - RNA, 64 nt, Human
uucugucugguuuuguugccauuuugguuugggaggcuggaaaagcaccccaagagcuauuaca

SEQ ID NO: 378040 - RNA, 64 nt, Human
accgccauucugcguguguuccccagcugggcagggcuggaagccuuacguaugaagcauggag

SEQ ID NO: 378041 - RNA, 64 nt, Human
ugagucagcaagccagaggucaugccacaggccuggcuggaacuuacacuucacguucccuuuu

SEQ ID NO: 378042 - RNA, 64 nt, Human
ugagcuggcagcgauucagagcccuggggcugggggcuggaauccaccuccucccacacaagcu

SEQ ID NO: 378043 - RNA, 64 nt, Human
agaccuugcugaagcuccugggguguggggugugggcuggaagcacuggcucccugguagggac

SEQ ID NO: 378044 - RNA, 64 nt, Human
cugauuuaaacuguaauuguauugccguacugugggcuggaaaucccaaaucuagauuccagca

SEQ ID NO: 378045 - RNA, 64 nt, Human
caaagguugcaaaguguuuguaauauauucaugaggcuggaaguaagaagaauuaaaaauuugu

SEQ ID NO: 378046 - RNA, 64 nt, Human
ucugcagguuuuaugggcuugucacaacgugaagggcuggaauguauauuaccaaaugggaauu

SEQ ID NO: 378047 - RNA, 64 nt, Human
cuaccugaagcacuaggacacucuugcagggccaggcuggaagaccggcccuuuucuugguuga

SEQ ID NO: 378048 - RNA, 64 nt, Human
aggcaggcaggauccucaggccccagccgcgggaggcuggaagggcuggcagaucgcuucccuc

SEQ ID NO: 378049 - RNA, 64 nt, Human
ucauugagccucaggcuauacuccagcuggccaaggcuggaaaccugucucccucaggcucacc

SEQ ID NO: 378050 - RNA, 64 nt, Human
ggagggaacuuuucagucaaauuccucaaaaagaggcuggaauaaagccugggcuuaaaaagag

SEQ ID NO: 378051 - RNA, 64 nt, Human
acaaggacagguggggcagggagcaagacagguaggcuggaagaacaguuauuggcaaguaugc

SEQ ID NO: 378052 - RNA, 64 nt, Human
aaaggacucuuggcuccugccggguuccugcucaggcuggaauugggaaaauaugcaggugaca

SEQ ID NO: 378053 - RNA, 64 nt, Human
uuaaaugaugaggaguuuuuuuuuuuuuaaauauggcuggaaagcuuguuuugaaaaaugaagc

SEQ ID NO: 378054 - RNA, 64 nt, Human
uauuuuuugagauggagucucacuuuguaacccaggcuggaaugcaauggcaugaucucagcuc

SEQ ID NO: 378055 - RNA, 64 nt, Human
ccaguugcccauaagcacaucaguacuuuucucuggcuggaauaguaaacuaaaguaugguaca

SEQ ID NO: 378056 - RNA, 64 nt, Human
cuggagacuggcugcuggggccuccuugcuuggaggcuggaaagagcuccauuucaguaucuuu

SEQ ID NO: 378057 - RNA, 64 nt, Human
caacuccagcuggcuguacugauucacacaccucggcuggaaguacagcucaggcuucguuacu

SEQ ID NO: 378058 - RNA, 64 nt, Human
uuuuaaaagagacaggaucuugcuuugucucccaggcuggaacacaguggugugaucauagcuc

SEQ ID NO: 378059 - RNA, 64 nt, Human
agaggggaaggaccuuugucugggcguuaccaagggcuggaaacuuuaccugguaccuaaaggu

SEQ ID NO: 378060 - RNA, 64 nt, Human
uauuggaacaccugugagagagauuguucuauagggcuggaauauucagaguuacauucuugga

SEQ ID NO: 378061 - RNA, 64 nt, Human
ggguggggggagaugaucaugugugcucgggguuggcuggaagcccugggugggggguuggggg

SEQ ID NO: 378062 - RNA, 64 nt, Human
caccaaucuggauugagcggguggugauaauaggggcuggaaagccagcagcugugguacucca

SEQ ID NO: 378063 - RNA, 64 nt, Human
ggggaggugggcagaggggccuuacagcagcagaggcuggaagagaagcucugucuucaggggc

SEQ ID NO: 378064 - RNA, 64 nt, Human
gaagcucagaaguauggcagcuaagaacacagcuggcuggaagaagacagggaccagacugaac

SEQ ID NO: 378065 - RNA, 64 nt, Human
cauguucugagugugccaugaugugaguggaccuggcuggaaucuucggagagcgacugaggug

SEQ ID NO: 378066 - RNA, 64 nt, Human
gguaggaaccauaguuguguccuauacuugaagaggcuggaaaguagcccauaaccauaauugc

SEQ ID NO: 378067 - RNA, 64 nt, Human
ucuuugaauauguaguaucuauaugacuaugcguggcuggaaccacauugaagaauguuagagu

SEQ ID NO: 378068 - RNA, 64 nt, Human
uuacuuuaauuuugcauuuguuccuuguaagaauggcuggaaacuguguguugacauuugagga

SEQ ID NO: 378069 - RNA, 64 nt, Human
aaaaacuagauugacuauuuauacaaaugggggcggcuggaaagaggagaaggagagggaguac

SEQ ID NO: 378070 - RNA, 64 nt, Human
accagcagagcugucaacucuucucaaaaucccaggcuggaaauuaccuggagacaagaguuga

SEQ ID NO: 378071 - RNA, 64 nt, Human
ccuccccuccccagggucauagagggggccaugaggcuggaauuggccagugacugaaucuugg

SEQ ID NO: 378072 - RNA, 64 nt, Human
gugcuggaguuagcaccucccucugcccuuaacuggcuggaacugguucauucuccauuacugc

SEQ ID NO: 378073 - RNA, 64 nt, Human
aucauguccaccuuuugcuaauuuaaaaucaucaggcuggaagaugaagccaugauagcuacag

SEQ ID NO: 378074 - RNA, 64 nt, Human
ggagcaccuuagacaaacuacccagcacaggcggggcuggaauucuggcggagggcaugagccu

SEQ ID NO: 378075 - RNA, 64 nt, Human
caaccuuggggcagcugagcccuggccgccuccuggcuggaaccaugagaaggaagcucaguac

SEQ ID NO: 378076 - RNA, 64 nt, Human
gugggccgccuuccuggagacccguagaugccagggcuggaagcuuucauuugccgggacacuc

SEQ ID NO: 378077 - RNA, 64 nt, Human
caggucugggugccccuuuuccuccccugggaagggcuggaauaggauagaaagcuggggguuu

SEQ ID NO: 378078 - RNA, 64 nt, Human
ggaacccuucaguggguguguggccaguuuuggaggcuggaaugaugggccaggguguaggauu

SEQ ID NO: 378079 - RNA, 64 nt, Human
gguuucuguugcuuauaagcgauucauuugcuacggcuggaauaugggaaaauuaauuugggcu

SEQ ID NO: 378080 - RNA, 64 nt, Human
agaaggcagaagauuuugaauuauuauccagcagggcuggaagcacuagaugcagcaugagcac

SEQ ID NO: 378081 - RNA, 64 nt, Human
ugcacgcacacccacgugccuguacuugcccccaggcuggaagagaagagacagaaagacccca

SEQ ID NO: 378082 - RNA, 64 nt, Human
aggccuuuaacuuccucaaacaggcccaagcaaaggcuggaagacauuuggguccuagaagaag

SEQ ID NO: 378083 - RNA, 64 nt, Human
uuuuuuuuuugacagagucucgcacuguugccugggcuggaaugcaguggugcgaucucggcuc

SEQ ID NO: 378084 - RNA, 64 nt, Human
uuuuuuggugucagagucucgcucuugucacccaggcuggaaugcaguggcgccaucucagcuc

SEQ ID NO: 378085 - RNA, 64 nt, Human
gucuuaaaugcugacuacagccacugacaugguuggcuggaauuucuuucuuuuaauuguggca

SEQ ID NO: 378086 - RNA, 64 nt, Human
uaucaccauuccacguugccacacaaggugcacaggcuggaagucuuuugugaaauucccaguu

SEQ ID NO: 378087 - RNA, 60 nt, Human
ccauacuggacgcuuuauaagagguccaugggcuggaaucugaugagguuguaugauggc

SEQ ID NO: 378088 - RNA, 64 nt, Human
cuuguuuuuuugggggcuccagggaccaaucuggggcuggaaauguuaggagguugccuuggug

SEQ ID NO: 378089 - RNA, 64 nt, Human
ugaccucaaggucagaagguucccaaaccccuggggcuggaacaugggaucuccucuuccaccu

SEQ ID NO: 378090 - RNA, 64 nt, Human
caagguguguucaaagaggcuugccuugagggagggcuggaaucugucuucccugacucggcuc

SEQ ID NO: 378091 - RNA, 64 nt, Human
agagucagagggggaagaguuagaaugggucaguggcuggaacaaaguucugguuaaggaggaa

SEQ ID NO: 378092 - RNA, 64 nt, Human
uucaugaggcacuuaaagcuuauaaaagaacugcggcuggaacucaucuggugcuccccaugag

SEQ ID NO: 378093 - RNA, 64 nt, Human
uuauacuugaguucacuccuggucaauggcacauggcuggaaaaugcagaaagcaaguucacuu

SEQ ID NO: 378094 - RNA, 64 nt, Human
uugcacaugcucgugcuggugugggcaugggacuggcuggaaacgucuguaugcagggagccag

SEQ ID NO: 378095 - RNA, 64 nt, Human
cccuggcuugcuuuuagcuacaagcaagcagcguggcuggaagcugaugggaaacgacccggca

SEQ ID NO: 378096 - RNA, 64 nt, Human
aguuuuuaacauguggggaauagggcauuuuaaaggcuggaaccaguucagaggaaacaagggu

SEQ ID NO: 378097 - RNA, 50 nt, Human
agcgguccaaccggcggugaggcuggaaccagggccagccagcccugcgg

SEQ ID NO: 378098 - RNA, 64 nt, Human
auggcagauacaggagagacgacagaggguccuaggcuggaauguuccuuucgaaagcaaugcu

SEQ ID NO: 378099 - RNA, 64 nt, Human
uucccugcccugggacgcucaccccugggcaagaggcuggaaguucacaccauccaaaauuuau

SEQ ID NO: 378100 - RNA, 64 nt, Human
agaaggugagcgcugaagaaccaggaugggacggggcuggaacagcuggguucagcuuuugcag

SEQ ID NO: 378101 - RNA, 64 nt, Human
ggaaaagagcaauaaauugcccggugcucugcagggcuggaauuucaaacagaaagagggaaua

SEQ ID NO: 378102 - RNA, 64 nt, Human
aaguguauuuuaaaugugaccuuucguaaauuugggcuggaacauguaaaagggugaaaguuag

SEQ ID NO: 378103 - RNA, 64 nt, Human
aaguauagccacugauggugacaggugugagucuggcuggaacacuuucaguuucaggagugca

SEQ ID NO: 378104 - RNA, 64 nt, Human
uuaaaccauaaauuaguuuaaacugaaaguacgaggcuggaagaaauauuaguaaauuauuugg

SEQ ID NO: 378105 - RNA, 64 nt, Human
uuuguaaugcuguuuaucagaggagggugacaggggcuggaaauaaagagaggggacaugguga

SEQ ID NO: 378106 - RNA, 64 nt, Human
agcucugaaaggugacuuuuauuaccaacacacuggcuggaaaagggacaaaccacaucacggg

SEQ ID NO: 378107 - RNA, 64 nt, Human
caagccuuugaccuguucagaaggaugggaaaaaggcuggaaggaaagcaaggcagaaggccag

SEQ ID NO: 378108 - RNA, 64 nt, Human
gagaaaccugagugacgacgugguggaggaacagggcuggaaagaggcugcuggcugucuggcu

SEQ ID NO: 378109 - RNA, 64 nt, Human
ccugagcuagaagcuggaggacuagaaccuggagggcuggaaucuggagagcuagaaccuggag

SEQ ID NO: 378110 - RNA, 64 nt, Human
gagagcuagaaccuagaagggcuagaaccuggagggcuggaaucuggagagcuagaaccuggag

SEQ ID NO: 378111 - RNA, 64 nt, Human
gagggcuagaaccuagaagggcuagaaccuggagggcuggaaucuggagagcuagaaccuggag

SEQ ID NO: 378112 - RNA, 64 nt, Human
gccagcugcugggggagcggcacuggggacuggaggcuggaagcgggugguguguguccccugu

SEQ ID NO: 378113 - RNA, 64 nt, Human
uauuuuugaacuuuagguccuuccucuucuuuggggcuggaacagaauuaaauuuguuuggaaa

SEQ ID NO: 378114 - RNA, 64 nt, Human
ccugccugccaaagccccccuuuaggccuuggguggcuggaaggcuuuguuaagggacuaggag

SEQ ID NO: 378115 - RNA, 64 nt, Human
acugugugcgaggcaaugcucuagguccuguaggggcuggaaaauaaaccgcaugcuggccuag

SEQ ID NO: 378116 - RNA, 64 nt, Human
uaucauugaugccuacugaaauaaaaagaggaaaggcuggaagcugcagacaggaucccuagcu

SEQ ID NO: 378117 - RNA, 64 nt, Human
acucauccugcugcagggaagggagcuguacggaggcuggaagcugcaggguuaggcccgagag

SEQ ID NO: 378118 - RNA, 64 nt, Human
accacuauaacucucugugaacguuuuuccagguggcuggaagaaggaagaaaaccugauauag

SEQ ID NO: 378119 - RNA, 64 nt, Human
ucucuccccaaagcagccccacaguggagccuuuggcuggaaguccaugggccacccuguucuu

SEQ ID NO: 378120 - RNA, 64 nt, Human
acccagucccacacuguggccaggccuuacaucuggcuggaaagcagagccuccugggaacaca

SEQ ID NO: 378121 - RNA, 64 nt, Human
agagagggggccaaugagggcagggccuccugugggcuggaaaaccacugggugcgucucuugc

SEQ ID NO: 378122 - RNA, 64 nt, Human
uuuucuuuccuuuuauuuuuuaguaaucaagaaaggcuggaaaacuacugaaaaacugaucaag

SEQ ID NO: 378123 - RNA, 64 nt, Human
aaguacuaaaugcuguguaaguagacguuaaucuggcuggaaccaugggaagcacuuugcagug

SEQ ID NO: 378124 - RNA, 64 nt, Human
uuuuuuugagacggaguuucacucuuguugcccaggcuggaaugcaauggcacgaucucggcuc

SEQ ID NO: 378125 - RNA, 64 nt, Human
uuuuaguagagaugggguuuggccaugauggccaggcuggaaaauugaaacauaauuucacaau

SEQ ID NO: 378126 - RNA, 64 nt, Human
uuguugcacagccuacauaauuaagagaucaacuggcuggaagcagaucaaggccuaacuucau

SEQ ID NO: 378127 - RNA, 64 nt, Human
cuccuuggagcccaacaacuuaacaaaucaacuuggcuggaaguuagagucauuauaugaagau

SEQ ID NO: 378128 - RNA, 64 nt, Human
cagggaaaucugggcucgaggccuacaacuuaggggcuggaaucacaggucucacauagagaaa

SEQ ID NO: 378129 - RNA, 64 nt, Human
ugucugugccucccuucuuuauuggggacaugugggcuggaacagcagauuucagcuacauaua

SEQ ID NO: 378130 - RNA, 64 nt, Human
cucugcaggccuucugcaaaucagugcuggccugggcuggaaacagcucugugugugaagguga

SEQ ID NO: 378131 - RNA, 64 nt, Human
uguucacugcacaagggcaccugcagcuaauggaggcuggaauucagcuuguguucugcucacu

SEQ ID NO: 378132 - RNA, 64 nt, Human
aggcuguugucuugacacugaagcagcuggugugggcuggaacuggcccagcauugaccugggc

SEQ ID NO: 378133 - RNA, 64 nt, Human
aauccugggauuacaggcgcgagccaccacacccggcuggaaguaaacauuuuuaaagcuacuu

SEQ ID NO: 378134 - RNA, 64 nt, Human
uuuuuuuugagaccgagucuugcucugucgcccaggcuggaaugcaguggugcgaucuuggcuc

SEQ ID NO: 378135 - RNA, 64 nt, Human
uuuuuuuugagacagagucucacucugucacccaggcuggaauccaguggcacuaucucagcuc

SEQ ID NO: 378136 - RNA, 64 nt, Human
gccgcugaccccagucugcccacugaggggcuagggcuggaagccaguucuaggcuuccaggcg

SEQ ID NO: 378137 - RNA, 64 nt, Human
cuuuuuuugagacggagucucacucuguuacccaggcuggaaugcaguggcgcaaucuuggcuc

SEQ ID NO: 378138 - RNA, 64 nt, Human
uuuuuuuugagagagagccuuguucugucaccuaggcuggaaugcaguggugcaaucauagcuc

SEQ ID NO: 378139 - RNA, 64 nt, Human
uuccugguccuagguggccaguggguaugaggagggcuggaaggcagagcuuugggccaaaagc

SEQ ID NO: 378140 - RNA, 64 nt, Human
cgcuuuugcugggccgugaucgucccccuuugugggcuggaaaagcaggugagggugggcuggg

SEQ ID NO: 378141 - RNA, 64 nt, Human
gaauauuuaugugcaaacauaggcaacuguuaaaggcuggaauuuucaaaagauccaaacagag

SEQ ID NO: 378142 - RNA, 64 nt, Human
aucccuuauccuacuuagcaguguuggucucuggggcuggaagccgagcgcaugcugggagcgg

SEQ ID NO: 378143 - RNA, 64 nt, Human
cuauacauuuucucugagacuccagcagaguuggggcuggaacuuggcacuggggacucauguu

SEQ ID NO: 378144 - RNA, 64 nt, Human
uuguuuuugacacagagucucgcucugucgcccaggcuggaaugcaguugugagaucucggcuc

SEQ ID NO: 378145 - RNA, 64 nt, Human
uucuuuugagacagagucucacucucgucgcccaggcuggaaugcaguggugcgaucucggcuc

SEQ ID NO: 378146 - RNA, 64 nt, Human
gcagccaacggacaccucccgaugccagugcuaaggcuggaaauggcccccucuuaguugccau

SEQ ID NO: 378147 - RNA, 64 nt, Human
gcacagcuggccucccgcguugggcaacauugcuggcuggaagggaggagcgcccucuagggag

SEQ ID NO: 378148 - RNA, 64 nt, Human
ggugucgggaaaugugugacuuaaccguggugagggcuggaaauccaaacucaccaccaugauc

SEQ ID NO: 378149 - RNA, 64 nt, Human
cuuugggaaugagggguucccuugaacaugcguaggcuggaaccccgucugagaggucucccug

SEQ ID NO: 378150 - RNA, 64 nt, Human
cacagcagaaucuaaagaaagcauugaguccuggggcuggaagagguuaccagggaaggcuugc

SEQ ID NO: 378151 - RNA, 64 nt, Human
uuucuuuugugguaucucccccuaccacaaaccaggcuggaacccaagccccuuccuccacagc

SEQ ID NO: 378152 - RNA, 64 nt, Human
agacugcugguugacaucagacccaacccaugaaggcuggaaggcagcaggcauuugcuaaggc

SEQ ID NO: 378153 - RNA, 64 nt, Human
uuucucaguauuuuucuuggaugggaugacgcuaggcuggaaaguuuuuuucaucacuaugauu

SEQ ID NO: 378154 - RNA, 64 nt, Human
auucucgccuggaagaguggguggcuggcuggcuggcuggaaggggaggggcgagagggcuguc

SEQ ID NO: 378155 - RNA, 64 nt, Human
ucagucuaacugggguuccuuagcuggaagccagggcuggaagcuacaggccugaccuuccugg

SEQ ID NO: 378156 - RNA, 64 nt, Human
gacaucaugcuggugagugccacguuacuccccuggcuggaaaugcuuuucugaaaguaugagu

SEQ ID NO: 378157 - RNA, 64 nt, Human
uucccgcccaguggggcuggaauguggcccagccggcuggaaccucaagggccccacccaccga

SEQ ID NO: 378158 - RNA, 64 nt, Human
cccccuucuccacccucuacuucccgcccaguggggcuggaauguggcccagccggcuggaacc

SEQ ID NO: 378159 - RNA, 64 nt, Human
cagcaccccccuuauuuccggggcacuggagccaggcuggaagucaaguggcuucucccugccc

SEQ ID NO: 378160 - RNA, 64 nt, Human
aagggaggaagucuacacagaggagcaccaggacggcuggaauuuccauaugugcuucacauug

SEQ ID NO: 378161 - RNA, 64 nt, Human
ggcuugccaagagguuggaagggaaauggcucugggcuggaacugucuucccuugguccuucug

SEQ ID NO: 378162 - RNA, 64 nt, Human
ccuggaugcugaagacauggcagacuauggggaaggcuggaaugccaccacccucaguaauggc

SEQ ID NO: 378163 - RNA, 64 nt, Human
ugucucggaggguggcugcccacggccuggguguggcuggaaugguggcaggagugggcaccag

SEQ ID NO: 378164 - RNA, 64 nt, Human
acauuccuuugcugggguucagcgccucuccuggggcuggaagugccaaagccuggggcaaagc

SEQ ID NO: 378165 - RNA, 64 nt, Human
caugaagaagaucucucaaaugaggaacugaugcggcuggaacaggagcuggcagugggggagg

SEQ ID NO: 378166 - RNA, 64 nt, Human
agcuuuuaugaagagucaccguagcagcccccacggcuggaaagaggccuguacguucuggacg

SEQ ID NO: 378167 - RNA, 64 nt, Human
cugugccuuaccagcccuggggaggggggcauuuggcuggaagacuggaauuuaauugccaucg

SEQ ID NO: 378168 - RNA, 64 nt, Human
caagagaggugaagaaaguggaugcgcagaguucggcuggaaaagaggacaugcuccuaagcaa

SEQ ID NO: 378169 - RNA, 64 nt, Human
gccccggcguggcaggccauuccaagcccuuccgggcuggaacuggugucggaggagccucggg

SEQ ID NO: 378170 - RNA, 64 nt, Human
caggaaguagcacuucugaaacaggaaguggucuggcuggaacuccaaguggcuuagucugggg

SEQ ID NO: 378171 - RNA, 64 nt, Human
cuuucacgacccacaucucaauccugaacaucuaggcuggaaccugcacaccucccccucagcu

SEQ ID NO: 378172 - RNA, 64 nt, Human
uuaaugucauucaggugugcccauggauuuugagggcuggaaaugcaaagacacauuuuucuau

SEQ ID NO: 378173 - RNA, 64 nt, Human
cguguugggaaccugguuggggcugugcaguuugggcuggaaggagagaugccagcccucgugc

SEQ ID NO: 378174 - RNA, 64 nt, Human
gccccuguggggaacaggucuuggggucaugaagggcuggaaacaagugaccccagggccuguc

SEQ ID NO: 378175 - RNA, 64 nt, Human
auggaacgggcaugggccucucugggggaggcagggcuggaaugggagaccuguuggccugugg

SEQ ID NO: 378176 - RNA, 64 nt, Human
cccccagucuccagggacccuugccugccuccuaggcuggaagccauggucccgaaguguaggg

SEQ ID NO: 378177 - RNA, 64 nt, Human
uaaggaaccuuccuuccugcuugaguucccagauggcuggaagggguccagccucguuggaaga

SEQ ID NO: 378178 - RNA, 64 nt, Human
ucccucacccugaccuuucuccuguccuuuucuuggcuggaagaaguuggccuccugggagugu

SEQ ID NO: 378179 - RNA, 64 nt, Human
ugguuuguuacaugacuaucgugauggggaaacuggcuggaaauaguaaucacaccucucuguu

SEQ ID NO: 378180 - RNA, 64 nt, Human
ugguuuucaguaaucucuuccuuccccccaguaaggcuggaagaggcucuuggcaaacuucuua

SEQ ID NO: 378181 - RNA, 64 nt, Human
cccugcucaaacacaguggggaucagagaaaaggggcuggaaaggggggaauggcccacaucuc

SEQ ID NO: 378182 - RNA, 64 nt, Human
ggugacccggggcaggccacagaggccaggccagggcuggaaggacaggccugcccaugcagga

SEQ ID NO: 378183 - RNA, 64 nt, Human
cgcuucuaugcagccacaucacggcaacugaagcggcuggaaucagucagccgcucaccuaucu

SEQ ID NO: 378184 - RNA, 64 nt, Human
aguauucaaaaacggggaaugaaggcaggaaggaggcuggaauaaauaaaaauaaaaauagaca

SEQ ID NO: 378185 - RNA, 64 nt, Human
cauauucacuauccguuaauccuucuuucuuugaggcuggaacuugcucucucugccccuauuu

SEQ ID NO: 378186 - RNA, 64 nt, Human
ccauccgcagacugcuuggccagaugcggggacaggcuggaaugagggaggcgucuucaucucc

SEQ ID NO: 378187 - RNA, 64 nt, Human
gcucuaccccaaaaggcuucaggccagcugccacggcuggaagcagaggccuucguaggugaug

SEQ ID NO: 378188 - RNA, 64 nt, Human
uuuuuuugagacagaauuucacucuucucacccaggcuggaaugcaguggcacaauuuuggcuc

SEQ ID NO: 378189 - RNA, 64 nt, Human
ugcuggacuucuguuguacaaguuggcaaacacuggcuggaacugggcugcaauaaaacaugcc

SEQ ID NO: 378190 - RNA, 64 nt, Human
uuuucguggagacggggccucacuauguugccuaggcuggaaauaggauuuugaacccaaauug

SEQ ID NO: 378191 - RNA, 64 nt, Human
cccaugcugugcuugccgcucugaaacaaacagaggcuggaacuuugugguccuugccgaguuu

SEQ ID NO: 378192 - RNA, 64 nt, Human
gcacaacaaguggcaaaggacacagcuagcaacgggcuggaaaaaggcagagaacguggaguga

SEQ ID NO: 378193 - RNA, 64 nt, Human
aaaugcacacagccaagaguugcuuucugaauagggcuggaaacuuucaaagaaaacccccaaa

SEQ ID NO: 378194 - RNA, 64 nt, Human
augcaggccuaccagucccuggcuuuuugucuggggcuggaauaaagaggugccuucagcuggu

SEQ ID NO: 378195 - RNA, 64 nt, Human
agccuggcuuagcaaggagccaacauaacagaugggcuggaaguaaggaaacauguaaugauag

SEQ ID NO: 378196 - RNA, 64 nt, Human
gggcugaacaacuaggagcugaaaacaacguagaggcuggaaaguguccccugcauucuggagg

SEQ ID NO: 378197 - RNA, 64 nt, Human
cauacugugaaaucaaaaccauguuguuuuggggggcuggaauuugcauugaaacacuggucca

SEQ ID NO: 378198 - RNA, 64 nt, Human
uuuuuuuugagacagagucuuggucuguugcccaggcuggaaugcaguggugugcucugggcuc

SEQ ID NO: 378199 - RNA, 64 nt, Human
gaagggcauuucugucuuuuuaagcacagacuaaggcuggaacaguccauccuuaucccucuuc

SEQ ID NO: 378200 - RNA, 64 nt, Human
cuuggccucuccuucucuuccuucacuuugcagaggcuggaagacggcagccgccggacugggc

SEQ ID NO: 378201 - RNA, 64 nt, Human
acucuuuuagccaggcaaagucuuuuuuggcuguggcuggaauaaaucauuuauuacuugggag

SEQ ID NO: 378202 - RNA, 64 nt, Human
gccaguuacuggucauggcugcugugggcauggaggcuggaacuugugguugaggcagggccau

SEQ ID NO: 378203 - RNA, 64 nt, Human
ugcuacaugugaugauucugaaauccaggcagcaggcuggaauaaacgcugcugguaugucugu

SEQ ID NO: 378204 - RNA, 64 nt, Human
gccagagcuugugagggugacagaagaggguccaggcuggaaaccugaacuuucugggugggag

SEQ ID NO: 378205 - RNA, 64 nt, Human
agacguucuugauuuuggugacuugacuuauggaggcuggaaagcccucccacuaaaauugaua

SEQ ID NO: 378206 - RNA, 64 nt, Human
uuuuaguagagaugagguuuugccauuuuggucaggcuggaauuuuuuuuuuuuuaauuuugau

SEQ ID NO: 378207 - RNA, 64 nt, Human
guauguaugggacagggucucacucugucacccaggcuggaaugacgaagugaaguagugcaaa

SEQ ID NO: 378208 - RNA, 64 nt, Human
caguggugcaagauuuaaaauuaccuuccuuuuuggcuggaagacuuagaagccgccugaucau

SEQ ID NO: 378209 - RNA, 64 nt, Human
ggggcccacccacagcggcccagggccagacccuggcuggaagccagaacgcagacugcagggg

SEQ ID NO: 378210 - RNA, 64 nt, Human
cgggaaugaagacugugcggaauuuaguggcaguggcuggaacgacaaucgaugugacguugac

SEQ ID NO: 378211 - RNA, 64 nt, Human
uggggacuugcugguugaaggagcucaucuugcaggcuggaagcaccagggaauuaauuccccc

SEQ ID NO: 378212 - RNA, 64 nt, Human
uugggagagggagggaggaaggaagggagggaggggcuggaagauacugaaggauuccuuuuug

SEQ ID NO: 378213 - RNA, 64 nt, Human
gggcucugcaacugagcgaagcugcgggcuaggaggcuggaaagccauuuauccuaggacauaa

SEQ ID NO: 378214 - RNA, 64 nt, Human
cuguguuccccaagaauucagagaacagcacuggggcuggaaugaucuuuaaugggcccaaggc

SEQ ID NO: 378215 - RNA, 64 nt, Human
aagcaggacccgccuaguggcugccugugugcauggcuggaaggcacuggugaugucccaggag

SEQ ID NO: 378216 - RNA, 64 nt, Human
cuuucggauaucacaugggacagaggaagagcccggcuggaaucugacuuaccuggaccgcugu

SEQ ID NO: 378217 - RNA, 64 nt, Human
cuugaagugaucauuucacacccuuuugugagacggcuggaaauucuuauuuccccuuuccaau

SEQ ID NO: 378218 - RNA, 64 nt, Human
cagccagccaucaaauagugaauggucucucuuuggcuggaauuacaaaacucagagaaaugug

SEQ ID NO: 378219 - RNA, 64 nt, Human
ggcacccagaugugcugcucaagggagccccaagggcuggaaggggguugugaaaccgaaauaa

SEQ ID NO: 378220 - RNA, 64 nt, Human
aacccccaauauuuuuggacuggcagacucaaggggcuggaaucucaugauuccaugcccgagu

SEQ ID NO: 378221 - RNA, 64 nt, Human
ccuugguggggacagcuggggagauggcagugcaggcuggaaccugggcugccccagaacacag

SEQ ID NO: 378222 - RNA, 64 nt, Human
guggagcugugccuggcccuguaggcccaggguuggcuggaaggugacaucuguguuucguuuu

SEQ ID NO: 378223 - RNA, 64 nt, Human
uggagauauuuccguccuccacccacgugucuguggcuggaacugcccagccugcuccuggccc

SEQ ID NO: 378224 - RNA, 64 nt, Human
uccacccgcagccccgggguggcguagggaagggggcuggaagccacggguacgguuaaccugg

SEQ ID NO: 378225 - RNA, 64 nt, Human
caagacugaaggccucaguuccucgcuggcuguuggcuggaagcugcccuuuguucuguaccau

SEQ ID NO: 378226 - RNA, 64 nt, Human
cggggacuuacugguugcaagagcucauuuugcaggcuggaagcaccagggaauuaauuccccc

SEQ ID NO: 378227 - RNA, 64 nt, Human
ccaaaacacaaauuuauauucucacauaucuggaggcuggaagucugagaucagagugccagca

SEQ ID NO: 378228 - RNA, 64 nt, Human
gcccccugguggaaugcgggggagcaggcaguggggcuggaagcagaaacaaaaugaaaaaaaa

SEQ ID NO: 378229 - RNA, 64 nt, Human
aaauguuuaccagagaacuaauaaauguuguuauggcuggaaauacucacugaugcccaacucu

SEQ ID NO: 378230 - RNA, 64 nt, Human
ggagaacaucggcuaccagaugcugaugaagaugggcuggaaggagggcgaggggcugggcuca

SEQ ID NO: 378231 - RNA, 64 nt, Human
acuuauaugaaaaccaacacaaccauauguuuagggcuggaaagggccaugacgccuggccauu

SEQ ID NO: 378232 - RNA, 64 nt, Human
cagccauucgucaaaugucaaauauucucucuuuggcuggaaugacaaaaacucaaauaaaugu

SEQ ID NO: 378233 - RNA, 64 nt, Human
aaaauuuaaagguugcuguaguguuuagaacuuaggcuggaaaaccauauuuuagugcaucauu

SEQ ID NO: 378234 - RNA, 64 nt, Human
aguaaucugccuuagccuugggaggucugggaagggcuggaaaucacuggggacaggaaaccac

SEQ ID NO: 378235 - RNA, 62 nt, Human
cuccucuuguuucuucauucauucaacaaaauuuggcuggaaucugguuauuuugagauuaa

SEQ ID NO: 378236 - RNA, 64 nt, Human
uggguuuguggggggaggcugacuccugguccuaggcuggaaggaggaagaauagggcccaugg

SEQ ID NO: 378237 - RNA, 64 nt, Human
gucucucucaaggccacucggcuacucaggacagggcuggaauuuaaagccuguccgauucuga

SEQ ID NO: 378238 - RNA, 64 nt, Human
gacuguagagucaggucccuaaguccaccccaggggcuggaaaccuggaguucagggcccagac

SEQ ID NO: 378239 - RNA, 64 nt, Human
uuuuuuuuugagauggagucuugcucugucaccaggcuggaaugcaguggcgcaaucugggcuc

SEQ ID NO: 378240 - RNA, 64 nt, Human
gaaucccagccuggccauacccucaaccucagugggcuggaaaugacagugggcccuguagcag

SEQ ID NO: 378241 - RNA, 64 nt, Human
gcuaaauuuguaggguaggcuaucaggaagugcaggcuggaaacaugcaggagcugucccugaa

SEQ ID NO: 378242 - RNA, 64 nt, Human
auccuggccucugcucaugcgcaggccacaaccgggcuggaagugcgguugagcucucugccac

SEQ ID NO: 378243 - RNA, 64 nt, Human
gucuguauugaaggcccauugaaugacuaauccaggcuggaagcauucccaugugggugucuga

SEQ ID NO: 378244 - RNA, 64 nt, Human
ugugguguccaugagguaccacagcuccacuccuggcuggaacccagcacccucugugggaagc

SEQ ID NO: 378245 - RNA, 64 nt, Human
acugcugcggaggaacugccuucagagaagguggggcuggaaaaggguuagaagccuccuagcu

SEQ ID NO: 378246 - RNA, 64 nt, Human
cauuuggggugggcucuucaacaucucaggcuguggcuggaacaggacaggaugaucuaaaaca

SEQ ID NO: 378247 - RNA, 64 nt, Human
gcaucuuucauuaauucgguucucagagaaccaaggcuggaaggcauagaacuggcaccuuggg

SEQ ID NO: 378248 - RNA, 64 nt, Human
gaaaaugaacacagcaguucugcagaggacgggaggcuggaagcugggaggucagguggggugg

SEQ ID NO: 378249 - RNA, 64 nt, Human
ggcugggguguggguguggccugggguggcucagggcuggaacugcugccugauuccugugugg

SEQ ID NO: 378250 - RNA, 64 nt, Human
guuauucaaagaggagacuuugaaauuccccgauggcuggaauguggagcccaggugccucugg

SEQ ID NO: 378251 - RNA, 64 nt, Human
cgguguggccgcgggcggguuuauccaaagggauggcuggaaauuggccgcucccacgaggcuc

SEQ ID NO: 378252 - RNA, 64 nt, Human
ucccuguguguguguugcgggaggggaggacuggggcuggaaguccagcacccagggaagaucu

SEQ ID NO: 378253 - RNA, 64 nt, Human
ucacauuuuuuguuacagaaucuauuggaucuuuggcuggaaaacuagaauuuauagcaguuua

SEQ ID NO: 378254 - RNA, 64 nt, Human
cuccugcucuuucuacaugacugggccucccuugggcuggaagaauuggggauucucuauugga

SEQ ID NO: 378255 - RNA, 64 nt, Human
ugccguuucaagcccugcugggaccuuguggcuuggcuggaauccaggacuguauuuucaugga

SEQ ID NO: 378256 - RNA, 64 nt, Human
uuucucuugcccuguuccuggugccuucugauggggcuggaauaguugagguggaugguucuac

SEQ ID NO: 378257 - RNA, 64 nt, Human
uauggguaaaacugagacguccccgugagcccgaggcuggaaguggugucugccuucaaggguu

SEQ ID NO: 378258 - RNA, 64 nt, Human
uagggagcuaaggaagacacagcccagacaagauggcuggaaggagccagccaggacuccuuag

SEQ ID NO: 378259 - RNA, 64 nt, Human
cucagcaggggucugaggguagccggccagaagaggcuggaaccuccugcucaagucuagaccc

SEQ ID NO: 378260 - RNA, 64 nt, Human
ccauaaaucuuaaaggggguaugugauaauagagggcuggaauuuaaaccuguauuuaaaaaaa

SEQ ID NO: 378261 - RNA, 64 nt, Human
aauuaucauuuucugugaacacagcucagauuuuggcuggaauggcuauggcuaugcaguggca

SEQ ID NO: 378262 - RNA, 64 nt, Human
ucuucaacgaauuaugaaaucuguaccaaccaacggcuggaaaugcaaaguaaguuguuuacuu

SEQ ID NO: 378263 - RNA, 64 nt, Human
aucagugaugaggaugaagaggaaaguuuuuccuggcuggaagagaugggugugcaagauaaaa

SEQ ID NO: 378264 - RNA, 64 nt, Human
cacgggcuuggguggguuccuuuggagaagauguggcuggaacacaaacaaucuuugaaagaaa

SEQ ID NO: 378265 - RNA, 64 nt, Human
cuguccuucuggaaaagugguccaugucugugcuggcuggaagagggcuugcuuagggcagcuu

SEQ ID NO: 378266 - RNA, 64 nt, Human
ccggaaugaaucagcugcugacugucuccagaagggcuggaaaggaugcugccaggugacccga

SEQ ID NO: 378267 - RNA, 64 nt, Human
gaaagacagaaggauguaagguuggaguuguauuggcuggaauuugaaccuccagcagcugucu

SEQ ID NO: 378268 - RNA, 64 nt, Human
gaggcccuggcucugaucccaggcuggauggaguggcuggaaggaaugguuccaaacaacacca

SEQ ID NO: 378269 - RNA, 64 nt, Human
gccccuggucccagcaugccccgcgccugagacuggcuggaaaugcucugacuccugugaaggc

SEQ ID NO: 378270 - RNA, 64 nt, Human
ucagagcugguugggaacccuuugcugcuggggaggcuggaagcauauuccccaagagcacugc

SEQ ID NO: 378271 - RNA, 64 nt, Human
cuggguggcucccuagccccaagaggccaggaagggcuggaaggcagggccugcaggugcuccc

SEQ ID NO: 378272 - RNA, 64 nt, Human
uucccgccgccacccuccucgcugccauucucugggcuggaaugugaagccucagucacucuaa

SEQ ID NO: 378273 - RNA, 64 nt, Human
cccuggcaugucaacagcguuccuagagaagacaggcuggaagauagcugugacuucuauuuua

SEQ ID NO: 378274 - RNA, 64 nt, Human
uuuuuuuuugagauggaguguugcccuguugccaggcuggaaugcaguggcgugaucuuggcuu

SEQ ID NO: 378275 - RNA, 64 nt, Human
aucccguuccuucugccuacaaauaaaaagugcaggcuggaaugaucucagucacauuuggauc

SEQ ID NO: 378276 - RNA, 64 nt, Human
uucuggucuuugacaggcaauucugguuggcuguggcuggaauccacaugcugauagauaggaa

SEQ ID NO: 378277 - RNA, 64 nt, Human
ccccguggggaccgggguugucugucauuuauguggcuggaaagcacccaaagugguggucagg

SEQ ID NO: 378278 - RNA, 64 nt, Human
ccuggaauguaaaucagcuguguggugcccgcguggcuggaaggaaauagacccuuuuguagcu

SEQ ID NO: 378279 - RNA, 64 nt, Human
gggccccagcuguacggagucuucccagagggccggcuggaacaguacaucccaguacgggccc

SEQ ID NO: 378280 - RNA, 64 nt, Human
gaaucuucuuuguucauugggugguuuuucagucggcuggaauucuaucuucugggggccuucc

SEQ ID NO: 378281 - RNA, 64 nt, Human
cucugcagccagugagggagguccccgccaugccggcuggaagaagaaccucgcaucuuuuggu

SEQ ID NO: 378282 - RNA, 64 nt, Human
uguacaguuuuuaugcuguuuuauuugacuuaaaggcuggaagacagaaacgaagugaguucag

SEQ ID NO: 378283 - RNA, 64 nt, Human
auggccaucuucuuucuuccacccacaaacuccaggcuggaaguacuuggcccccuucaggagc

SEQ ID NO: 378284 - RNA, 64 nt, Human
augcauuuugagaagaacaaagugugcacucagcggcuggaaaggaaauaagugcauuucugca

SEQ ID NO: 378285 - RNA, 64 nt, Human
acugcuuuuuccaaacucuguauaacuuuuaaauggcuggaacuacucguauaaggacuagacu

SEQ ID NO: 378286 - RNA, 64 nt, Human
agccugccucagcugcucgcacagauuacuucagggcuggaaaagucacacagacacacaaaau

SEQ ID NO: 378287 - RNA, 64 nt, Human
ggugcagguucaguuuauauggaaaugcaaacugggcuggaagauauuccugaguuaggcuuuc

SEQ ID NO: 378288 - RNA, 64 nt, Human
uaauuugacagacauccccaguagccuucacccuggcuggaagcucuuuucugcccuuucuuug

SEQ ID NO: 378289 - RNA, 64 nt, Human
gaaaaggauuauuauuguacauaauagcaguucuggcuggaauuccaauccacuuucuggggau

SEQ ID NO: 378290 - RNA, 64 nt, Human
agcuccuuaacccaaugacccagugaugcugcaaggcuggaacgggguccaggagacugugugu

SEQ ID NO: 378291 - RNA, 64 nt, Human
ggccaguagcaggaauaauaaaucccacuuuguaggcuggaaaacugagcugucaaaagaauca

SEQ ID NO: 378292 - RNA, 64 nt, Human
cugaccuaccccugcugcaccauucccccagcugggcuggaagguuccauaacuggccagcugc

SEQ ID NO: 378293 - RNA, 64 nt, Human
ugccguguuagcaaccacagucaccuugcagucaggcuggaaucuugggccaccccaaagugcu

SEQ ID NO: 378294 - RNA, 64 nt, Human
gccugggccuuguggggcaaauauuggguccccaggcuggaaagauggacagaggcccaauggg

SEQ ID NO: 378295 - RNA, 64 nt, Human
cugcuccuuggaggaggcccccaggggugguagaggcuggaaggaagccacaucaggaggacgc

SEQ ID NO: 378296 - RNA, 64 nt, Human
cauuuucucccuugcuuuuucucuggaccauccuggcuggaaacuuggcuguagacaucugaag

SEQ ID NO: 378297 - RNA, 64 nt, Human; identical to SEQ ID NO: 195072

SEQ ID NO: 378298 - RNA, 64 nt, Human; identical to SEQ ID NO: 195073

SEQ ID NO: 378299 - RNA, 64 nt, Human; identical to SEQ ID NO: 195074

SEQ ID NO: 378300 - RNA, 64 nt, Human; identical to SEQ ID NO: 195075

SEQ ID NO: 378301 - RNA, 64 nt, Human; identical to SEQ ID NO: 195076

SEQ ID NO: 378302 - RNA, 64 nt, Human; identical to SEQ ID NO: 195077

SEQ ID NO: 378303 - RNA, 64 nt, Human; identical to SEQ ID NO: 195078

SEQ ID NO: 378304 - RNA, 64 nt, Human; identical to SEQ ID NO: 195079

SEQ ID NO: 378305 - RNA, 64 nt, Human; identical to SEQ ID NO: 195080

SEQ ID NO: 378306 - RNA, 64 nt, Human; identical to SEQ ID NO: 195081

SEQ ID NO: 378307 - RNA, 64 nt, Human; identical to SEQ ID NO: 192582

SEQ ID NO: 378308 - RNA, 64 nt, Human; identical to SEQ ID NO: 191787

SEQ ID NO: 378309 - RNA, 64 nt, Human; identical to SEQ ID NO: 195084

SEQ ID NO: 378310 - RNA, 64 nt, Human; identical to SEQ ID NO: 195085

SEQ ID NO: 378311 - RNA, 64 nt, Human; identical to SEQ ID NO: 195086

SEQ ID NO: 378312 - RNA, 61 nt, Human; identical to SEQ ID NO: 195087

SEQ ID NO: 378313 - RNA, 64 nt, Human; identical to SEQ ID NO: 195088

SEQ ID NO: 378314 - RNA, 64 nt, Human; identical to SEQ ID NO: 191788

SEQ ID NO: 378315 - RNA, 63 nt, Human; identical to SEQ ID NO: 195090

SEQ ID NO: 378316 - RNA, 64 nt, Human; identical to SEQ ID NO: 195091

SEQ ID NO: 378317 - RNA, 64 nt, Human; identical to SEQ ID NO: 194651

SEQ ID NO: 378318 - RNA, 64 nt, Human; identical to SEQ ID NO: 191312

SEQ ID NO: 378319 - RNA, 64 nt, Human; identical to SEQ ID NO: 194784

SEQ ID NO: 378320 - RNA, 64 nt, Human; identical to SEQ ID NO: 191805

SEQ ID NO: 378321 - RNA, 64 nt, Human; identical to SEQ ID NO: 194786

SEQ ID NO: 378322 - RNA, 64 nt, Human; identical to SEQ ID NO: 194824

SEQ ID NO: 378323 - RNA, 64 nt, Human; identical to SEQ ID NO: 191313

SEQ ID NO: 378324 - RNA, 64 nt, Human; identical to SEQ ID NO: 194803

SEQ ID NO: 378325 - RNA, 64 nt, Human; identical to SEQ ID NO: 191806

SEQ ID NO: 378326 - RNA, 64 nt, Human; identical to SEQ ID NO: 194805

SEQ ID NO: 378327 - RNA, 64 nt, Human; identical to SEQ ID NO: 194842

SEQ ID NO: 378328 - RNA, 64 nt, Human; identical to SEQ ID NO: 191314

SEQ ID NO: 378329 - RNA, 64 nt, Human; identical to SEQ ID NO: 194843

SEQ ID NO: 378330 - RNA, 64 nt, Human; identical to SEQ ID NO: 191807

SEQ ID NO: 378331 - RNA, 64 nt, Human; identical to SEQ ID NO: 191331

SEQ ID NO: 378332 - RNA, 64 nt, Human; identical to SEQ ID NO: 194880

SEQ ID NO: 378333 - RNA, 64 nt, Human; identical to SEQ ID NO: 194881

SEQ ID NO: 378334 - RNA, 64 nt, Human; identical to SEQ ID NO: 191824

SEQ ID NO: 378335 - RNA, 64 nt, Human; identical to SEQ ID NO: 191332

SEQ ID NO: 378336 - RNA, 64 nt, Human; identical to SEQ ID NO: 194898

SEQ ID NO: 378337 - RNA, 64 nt, Human; identical to SEQ ID NO: 194899

SEQ ID NO: 378338 - RNA, 64 nt, Human; identical to SEQ ID NO: 194900

SEQ ID NO: 378339 - RNA, 64 nt, Human; identical to SEQ ID NO: 191825

SEQ ID NO: 378340 - RNA, 64 nt, Human; identical to SEQ ID NO: 191333

SEQ ID NO: 378341 - RNA, 64 nt, Human; identical to SEQ ID NO: 194918

SEQ ID NO: 378342 - RNA, 64 nt, Human; identical to SEQ ID NO: 194919

SEQ ID NO: 378343 - RNA, 64 nt, Human; identical to SEQ ID NO: 194936

SEQ ID NO: 378344 - RNA, 64 nt, Human; identical to SEQ ID NO: 191350

SEQ ID NO: 378345 - RNA, 64 nt, Human; identical to SEQ ID NO: 194992

SEQ ID NO: 378346 - RNA, 64 nt, Human; identical to SEQ ID NO: 194993

SEQ ID NO: 378347 - RNA, 64 nt, Human; identical to SEQ ID NO: 194709

SEQ ID NO: 378348 - RNA, 59 nt, Human; identical to SEQ ID NO: 191351

SEQ ID NO: 378349 - RNA, 64 nt, Human; identical to SEQ ID NO: 195061

SEQ ID NO: 378350 - RNA, 64 nt, Human; identical to SEQ ID NO: 191843

SEQ ID NO: 378351 - RNA, 64 nt, Human; identical to SEQ ID NO: 195063

SEQ ID NO: 378352 - RNA, 64 nt, Human; identical to SEQ ID NO: 194652

SEQ ID NO: 378353 - RNA, 64 nt, Human; identical to SEQ ID NO: 191352

SEQ ID NO: 378354 - RNA, 64 nt, Human; identical to SEQ ID NO: 195069

SEQ ID NO: 378355 - RNA, 64 nt, Human; identical to SEQ ID NO: 195070

SEQ ID NO: 378356 - RNA, 64 nt, Human; identical to SEQ ID NO: 191844

SEQ ID NO: 378357 - RNA, 64 nt, Human; identical to SEQ ID NO: 194632

SEQ ID NO: 378358 - RNA, 64 nt, Human; identical to SEQ ID NO: 191369

SEQ ID NO: 378359 - RNA, 64 nt, Human; identical to SEQ ID NO: 194502

SEQ ID NO: 378360 - RNA, 64 nt, Human; identical to SEQ ID NO: 194503

SEQ ID NO: 378361 - RNA, 64 nt, Human; identical to SEQ ID NO: 194504

SEQ ID NO: 378362 - RNA, 64 nt, Human; identical to SEQ ID NO: 191845

SEQ ID NO: 378363 - RNA, 64 nt, Human; identical to SEQ ID NO: 191370

SEQ ID NO: 378364 - RNA, 64 nt, Human; identical to SEQ ID NO: 194521

SEQ ID NO: 378365 - RNA, 64 nt, Human; identical to SEQ ID NO: 194522

SEQ ID NO: 378366 - RNA, 64 nt, Human; identical to SEQ ID NO: 194523

SEQ ID NO: 378367 - RNA, 64 nt, Human; identical to SEQ ID NO: 191862

SEQ ID NO: 378368 - RNA, 64 nt, Human; identical to SEQ ID NO: 191371

SEQ ID NO: 378369 - RNA, 64 nt, Human; identical to SEQ ID NO: 194541

SEQ ID NO: 378370 - RNA, 64 nt, Human; identical to SEQ ID NO: 194542

SEQ ID NO: 378371 - RNA, 64 nt, Human; identical to SEQ ID NO: 195072

SEQ ID NO: 378372 - RNA, 64 nt, Human; identical to SEQ ID NO: 195073

SEQ ID NO: 378373 - RNA, 64 nt, Human; identical to SEQ ID NO: 195074

SEQ ID NO: 378374 - RNA, 64 nt, Human; identical to SEQ ID NO: 195075

SEQ ID NO: 378375 - RNA, 64 nt, Human; identical to SEQ ID NO: 195076

SEQ ID NO: 378376 - RNA, 64 nt, Human; identical to SEQ ID NO: 195077

SEQ ID NO: 378377 - RNA, 64 nt, Human; identical to SEQ ID NO: 195078

SEQ ID NO: 378378 - RNA, 64 nt, Human; identical to SEQ ID NO: 195079

SEQ ID NO: 378379 - RNA, 64 nt, Human; identical to SEQ ID NO: 195080

SEQ ID NO: 378380 - RNA, 64 nt, Human; identical to SEQ ID NO: 195081

SEQ ID NO: 378381 - RNA, 64 nt, Human; identical to SEQ ID NO: 192582

SEQ ID NO: 378382 - RNA, 64 nt, Human; identical to SEQ ID NO: 191787

SEQ ID NO: 378383 - RNA, 64 nt, Human; identical to SEQ ID NO: 195084

SEQ ID NO: 378384 - RNA, 64 nt, Human; identical to SEQ ID NO: 195085

SEQ ID NO: 378385 - RNA, 64 nt, Human; identical to SEQ ID NO: 195086

SEQ ID NO: 378386 - RNA, 61 nt, Human; identical to SEQ ID NO: 195087

SEQ ID NO: 378387 - RNA, 64 nt, Human; identical to SEQ ID NO: 195088

SEQ ID NO: 378388 - RNA, 64 nt, Human; identical to SEQ ID NO: 191788

SEQ ID NO: 378389 - RNA, 63 nt, Human; identical to SEQ ID NO: 195090

SEQ ID NO: 378390 - RNA, 64 nt, Human; identical to SEQ ID NO: 195091

SEQ ID NO: 378391 - RNA, 64 nt, Human; identical to SEQ ID NO: 194651

SEQ ID NO: 378392 - RNA, 64 nt, Human; identical to SEQ ID NO: 191312

SEQ ID NO: 378393 - RNA, 64 nt, Human; identical to SEQ ID NO: 194784

SEQ ID NO: 378394 - RNA, 64 nt, Human; identical to SEQ ID NO: 191805

SEQ ID NO: 378395 - RNA, 64 nt, Human; identical to SEQ ID NO: 194786

SEQ ID NO: 378396 - RNA, 64 nt, Human; identical to SEQ ID NO: 194824

SEQ ID NO: 378397 - RNA, 64 nt, Human; identical to SEQ ID NO: 191313

SEQ ID NO: 378398 - RNA, 64 nt, Human; identical to SEQ ID NO: 194803

SEQ ID NO: 378399 - RNA, 64 nt, Human; identical to SEQ ID NO: 191806

SEQ ID NO: 378400 - RNA, 64 nt, Human; identical to SEQ ID NO: 194805

SEQ ID NO: 378401 - RNA, 64 nt, Human; identical to SEQ ID NO: 194842

SEQ ID NO: 378402 - RNA, 64 nt, Human; identical to SEQ ID NO: 191314

SEQ ID NO: 378403 - RNA, 64 nt, Human; identical to SEQ ID NO: 194843

SEQ ID NO: 378404 - RNA, 64 nt, Human; identical to SEQ ID NO: 191807

SEQ ID NO: 378405 - RNA, 64 nt, Human; identical to SEQ ID NO: 191331

SEQ ID NO: 378406 - RNA, 64 nt, Human; identical to SEQ ID NO: 194880

SEQ ID NO: 378407 - RNA, 64 nt, Human; identical to SEQ ID NO: 194881

SEQ ID NO: 378408 - RNA, 64 nt, Human; identical to SEQ ID NO: 191824

SEQ ID NO: 378409 - RNA, 64 nt, Human; identical to SEQ ID NO: 191332

SEQ ID NO: 378410 - RNA, 64 nt, Human; identical to SEQ ID NO: 194898

SEQ ID NO: 378411 - RNA, 64 nt, Human; identical to SEQ ID NO: 194899

SEQ ID NO: 378412 - RNA, 64 nt, Human; identical to SEQ ID NO: 194900

SEQ ID NO: 378413 - RNA, 64 nt, Human; identical to SEQ ID NO: 191825

SEQ ID NO: 378414 - RNA, 64 nt, Human; identical to SEQ ID NO: 191333

SEQ ID NO: 378415 - RNA, 64 nt, Human; identical to SEQ ID NO: 194918

SEQ ID NO: 378416 - RNA, 64 nt, Human; identical to SEQ ID NO: 194919

SEQ ID NO: 378417 - RNA, 64 nt, Human; identical to SEQ ID NO: 194936

SEQ ID NO: 378418 - RNA, 64 nt, Human; identical to SEQ ID NO: 191350

SEQ ID NO: 378419 - RNA, 64 nt, Human; identical to SEQ ID NO: 194992

SEQ ID NO: 378420 - RNA, 64 nt, Human; identical to SEQ ID NO: 194993

SEQ ID NO: 378421 - RNA, 64 nt, Human; identical to SEQ ID NO: 194709

SEQ ID NO: 378422 - RNA, 59 nt, Human; identical to SEQ ID NO: 191351

SEQ ID NO: 378423 - RNA, 64 nt, Human; identical to SEQ ID NO: 195061

SEQ ID NO: 378424 - RNA, 64 nt, Human; identical to SEQ ID NO: 191843

SEQ ID NO: 378425 - RNA, 64 nt, Human; identical to SEQ ID NO: 195063

SEQ ID NO: 378426 - RNA, 64 nt, Human; identical to SEQ ID NO: 194652

SEQ ID NO: 378427 - RNA, 64 nt, Human; identical to SEQ ID NO: 191352

SEQ ID NO: 378428 - RNA, 64 nt, Human; identical to SEQ ID NO: 195069

SEQ ID NO: 378429 - RNA, 64 nt, Human; identical to SEQ ID NO: 195070

SEQ ID NO: 378430 - RNA, 64 nt, Human; identical to SEQ ID NO: 191844

SEQ ID NO: 378431 - RNA, 64 nt, Human; identical to SEQ ID NO: 194632

SEQ ID NO: 378432 - RNA, 64 nt, Human; identical to SEQ ID NO: 191369

SEQ ID NO: 378433 - RNA, 64 nt, Human; identical to SEQ ID NO: 194502

SEQ ID NO: 378434 - RNA, 64 nt, Human; identical to SEQ ID NO: 194503

SEQ ID NO: 378435 - RNA, 64 nt, Human; identical to SEQ ID NO: 194504

SEQ ID NO: 378436 - RNA, 64 nt, Human; identical to SEQ ID NO: 191845

SEQ ID NO: 378437 - RNA, 64 nt, Human; identical to SEQ ID NO: 191370

SEQ ID NO: 378438 - RNA, 64 nt, Human; identical to SEQ ID NO: 194521

SEQ ID NO: 378439 - RNA, 64 nt, Human; identical to SEQ ID NO: 194522

SEQ ID NO: 378440 - RNA, 64 nt, Human; identical to SEQ ID NO: 194523

SEQ ID NO: 378441 - RNA, 64 nt, Human; identical to SEQ ID NO: 191862

SEQ ID NO: 378442 - RNA, 64 nt, Human; identical to SEQ ID NO: 191371

SEQ ID NO: 378443 - RNA, 64 nt, Human; identical to SEQ ID NO: 194541

SEQ ID NO: 378444 - RNA, 64 nt, Human; identical to SEQ ID NO: 194542

SEQ ID NO: 378445 - RNA, 64 nt, Human
gaccagcugacugucucucggcccagcccaccacgccgaguagcuuguguggaugcaguccugu

SEQ ID NO: 378446 - RNA, 64 nt, Human
acuuuuuuuuuucuuuuugagucaggacuauggagccgaguaguugaucuuuuaauauagccgu

SEQ ID NO: 378447 - RNA, 64 nt, Human
caaccagacugaccccuuacuauucacacagccugccgaguagcugggacuacaggucuaauuu

SEQ ID NO: 378448 - RNA, 64 nt, Human
ggccaaugcacugaaccuggacuugggggaaagagccgaguaucuuccagccgcugccuccuga

SEQ ID NO: 378449 - RNA, 64 nt, Human
guuauuuuuauuuuuuacuuuuugccugagacaagccgaguaugaggugguuugauuuaagaaa

SEQ ID NO: 378450 - RNA, 64 nt, Human
caugccuguaaucccagcauuuugggaggcucaggcagacaaaucgcucuagcucagaaguugc

SEQ ID NO: 378451 - RNA, 64 nt, Human
guugacgggcuguccgugugccuccugugugucugcagacaagucuugcugugcuuuauuugug

SEQ ID NO: 378452 - RNA, 64 nt, Human
cuugacagcuugguaaggucaacucuguagcccugcagacaaaagcugguuagguuuggguuug

SEQ ID NO: 378453 - RNA, 52 nt, Human
acaaagccaaaagcaaauaaaugcagacaaacaaaccaagaccaaaggcucu

SEQ ID NO: 378454 - RNA, 64 nt, Human
acagcucucugcccugcgcguucuucccuuuggugccgaguauguuucgguccccuccagacuc

SEQ ID NO: 378455 - RNA, 64 nt, Human
ugaauggggaugaggucggacaguggcucauagagccgaguaugagcccuagcugugggcuaga

SEQ ID NO: 378456 - RNA, 64 nt, Human
gcucucaauccccagcccucauccagaguuugcagccgaguagggacuccuccccuguccucua

SEQ ID NO: 378457 - RNA, 64 nt, Human
accuuguguuagcauucucucucuaucucaucuggccgaguaucuuuuuccuuuuauuuucuuu

SEQ ID NO: 378458 - RNA, 64 nt, Human
gccccccgacguccagcccgugauugacaagcuggccgaguaugucgccaggaacggccugaag

SEQ ID NO: 378459 - RNA, 64 nt, Human
gaaggcucccuaacacacacagcggggaagcugggccgaguaccuuaaucugccauaaagccau

SEQ ID NO: 378460 - RNA, 64 nt, Human
uuuuuuuuucaguuuuuguuuuuacuuuugucccgccgaguacuauguauuaccagccccccac

SEQ ID NO: 378461 - RNA, 64 nt, Human
cugugacgucggccgaccaggcuggacacccucugccgaguaaugacguguguggcugggaccu

SEQ ID NO: 378462 - RNA, 64 nt, Human
cagcguaaguaugcacagaugaagauggaacuaagccgaguaagaagacauacaaaagccucuu

SEQ ID NO: 378463 - RNA, 64 nt, Human
auaccacgagcugcugcgggaggccaccgaggccgccgaguaccaggaggcccuggagggcugg

SEQ ID NO: 378464 - RNA, 64 nt, Human
agggcaggaauucuauuuucgggagaugucuauugccgaguagaguaauauauacccagaguau

SEQ ID NO: 378465 - RNA, 64 nt, Human
aagaacgcaacagaagaguccuggucugaacuuggccgaguaggggugggggugggauggcagg

SEQ ID NO: 378466 - RNA, 59 nt, Human
agaucuucuugaguuggugagaaugcagggccgaguagccagcugcauugcuuagauuu

SEQ ID NO: 378467 - RNA, 64 nt, Human
auuuguacuucagcgcuagccccuguuuugcacagccgaguacuggcgaguauguucuauguug

SEQ ID NO: 378468 - RNA, 64 nt, Human
ugaugagugcgggaguccugaggagauguggccugcagacaacaugcagccaugcagggaccca

SEQ ID NO: 378469 - RNA, 64 nt, Human
cuacaggaucuuuuuuugcaaacaacugauauaugcagacaaauuuuugacaaauucaccuuuu

SEQ ID NO: 378470 - RNA, 64 nt, Human
ggugccuccucaaacccagucucagacacuaaaugcagacaacaccuuccuccugcagacaccu

SEQ ID NO: 378471 - RNA, 64 nt, Human
accccuaagcaucuccuguccuggccucucugaagcagacaagggccaccuaucccgggggugg

SEQ ID NO: 378472 - RNA, 64 nt, Human
gagaccccaaauagccugcucaguagagggucaugcagacaaggaagaaaacuuaggggcugcu

SEQ ID NO: 378473 - RNA, 64 nt, Human
auggguacaauaaaaagaacaugggcuuucagcagcagacaaaucccacuuccaccacugacua

SEQ ID NO: 378474 - RNA, 64 nt, Human
ugucaggaggaauaguacagacagaaggugcuaagcagacaauucaacugccauguuuugccac

SEQ ID NO: 378475 - RNA, 64 nt, Human
cuuuggggcuaucugacuaaugagagggaagugggcagacaagaggcuggccccagucccaagg

SEQ ID NO: 378476 - RNA, 64 nt, Human
gagaagacggugaaaugauguaaugacagagaaggcagacaacauguuuccgugacucaucuag

SEQ ID NO: 378477 - RNA, 64 nt, Human
gcaaauaugcagccuccgcaagaugagcucuccugcagacaagcauggucugaaacauucuuug

SEQ ID NO: 378478 - RNA, 64 nt, Human
ucuuggucuuggcuagacugccuagauucccacagcagacaagguugagaauccauugcuggaa

SEQ ID NO: 378479 - RNA, 64 nt, Human
uuuuuuuaaugugcaugaauucaccgcaacacaugcagacaacugcugcaauggagaguaugaa

SEQ ID NO: 378480 - RNA, 64 nt, Human
cuccaccaccuccucuuugaugacaucccaauucgcagacaauguccucugugcuguauuugcc

SEQ ID NO: 378481 - RNA, 64 nt, Human
guccaauaguuggacuauucaaaguugcaauugugcagacaagguagaguguguggucccugug

SEQ ID NO: 378482 - RNA, 64 nt, Human
uuugaauuuugagccuccagguuagaggcuccaagcagacaaagaagaaaguuuguagacacaa

SEQ ID NO: 378483 - RNA, 64 nt, Human
uagcugaggguaguaggagcaguucacccugggagcagacaauaagaggaagaaugaagccaac

SEQ ID NO: 378484 - RNA, 64 nt, Human
caaagaaucaugggcuuuuuuuuugaauaaaaaagcagacaaauagacuuucucgggauuucag

SEQ ID NO: 378485 - RNA, 64 nt, Human
cguuugauccaguagcuucuucuaaaucauaaaugcagacaauguuuagguaaagacauacuca

SEQ ID NO: 378486 - RNA, 64 nt, Human
auauucucuuugaauaaaccuauaauagaaaauagcagacaacauaaacaucuuuguaaauauc

SEQ ID NO: 378487 - RNA, 61 nt, Human
uacaggagaacaguucaugaguugcauuguagcagacaauggacaacuguaguuucugaau

SEQ ID NO: 378488 - RNA, 64 nt, Human
caagccacagcucccaggccccuggcucaaagacgcagacaaggccugagcagugcucucggca

SEQ ID NO: 378489 - RNA, 64 nt, Human
acaaaagaaggcgugcgugcaaguuauaauuacugcagacaaaacuucuugucuggaagaguuc

SEQ ID NO: 378490 - RNA, 64 nt, Human
gguucuugaaaauuagccaggaucaaaugcuauugcagacaaagccaauaaaaaguuggacuuc

SEQ ID NO: 378491 - RNA, 64 nt, Human
auuuaaaagaucacuuacaggaucauguuagugagcagacaaauagucacaaauuucaaacuug

SEQ ID NO: 378492 - RNA, 64 nt, Human
caaaccuacacagcauguuacugugcugaauacugcagacaauuguaacacaauauuuguguau

SEQ ID NO: 378493 - RNA, 64 nt, Human
cacuucucuuuaauauuuuuccuccaacuggagggcagacaauuuucugacuugcuuuucucua

SEQ ID NO: 378494 - RNA, 64 nt, Human
agucagaugguuuguggcaggugccaccgggcaagcagacaacauaauuuauuuccagaaaaca

SEQ ID NO: 378495 - RNA, 64 nt, Human
ugccuuacagagcagcccagguacccaggcccgggcagacaaggccccugggguaaaaaguagc

SEQ ID NO: 378496 - RNA, 64 nt, Human
auaaggcagcuuccccuguagugauaaauuacaagcagacaaucuuauuuuguaaugugaugaa

SEQ ID NO: 378497 - RNA, 64 nt, Human
cugcaaggacauuucucaagggccaugugguuuugcagacaacccuguccucaggccugaacuc

SEQ ID NO: 378498 - RNA, 64 nt, Human
auuuuaggggccucugaaguaucuuucuacaaacgcagacaagcuccacuaccccuaaccugcc

SEQ ID NO: 378499 - RNA, 64 nt, Human
uccagugcaguggcuugccacucaaaagaaggcagcagacaaagucgucuuccuucuuuccaau

SEQ ID NO: 378500 - RNA, 64 nt, Human
ucuucaccacaauuccaggcaauggccugucggagcagacaauucuaccacugcaaagaguugu

SEQ ID NO: 378501 - RNA, 64 nt, Human
aaagaggagcaagucacaucuuacauggauggcagcagacaaggagagagagcuugugcaggga

SEQ ID NO: 378502 - RNA, 64 nt, Human
uggaacucacugccucaguuuggguaaaggaugagcagacaagucaacuaaagaaaaaagaaaa

SEQ ID NO: 378503 - RNA, 64 nt, Human
aagaaguuaaguuguugcuaucgcaacaauccuggcagacaauugaguaauauuuugaugauuu

SEQ ID NO: 378504 - RNA, 64 nt, Human
gucagcagcaucuauggaugcaaauccagccacagcagacaaucauggauauacggcacuucac

SEQ ID NO: 378505 - RNA, 64 nt, Human
agccccacuuucgggaccagccugagguguaagggcagacaaacaggugagggugaguguggca

SEQ ID NO: 378506 - RNA, 64 nt, Human
acauuuucuuucagguaaaugucugcucuaagaagcagacaaccggacaugcgcauucauagca

SEQ ID NO: 378507 - RNA, 64 nt, Human
aagguaauugcgugccauucagcacugcaccagagcagacaaccuauuugaggaaaaacaguga

SEQ ID NO: 378508 - RNA, 57 nt, Human
uauucaagaaggugcagugaggcccaggcagacaaccuugucccaaggaaucagcag

SEQ ID NO: 378509 - RNA, 64 nt, Human
gcaaaaauuacaaucgguucaaaggaacuuugaugcagacaaaaugcugcugcugcugcuccug

SEQ ID NO: 378510 - RNA, 64 nt, Human
gggcgcauuccuccagcgccaagcgucagagccugcagacaacggagggcagcgcccccccgag

SEQ ID NO: 378511 - RNA, 64 nt, Human
aaaaguaguauugcagacauugcugcaaugggaagcagacaauaacuucuuaaaggaauucuac

SEQ ID NO: 378512 - RNA, 64 nt, Human
uuuucacuuuccagcuaggucuguuuuucagcuugcagacaagauugagaaauccuugaaaauu

SEQ ID NO: 378513 - RNA, 64 nt, Human
uuuuagggaacauauugauagaaaugaccaccuugcagacaaaaucucucucucucuuuuuguu

SEQ ID NO: 378514 - RNA, 64 nt, Human
gccauuacaauuccaggggcuaagaaggcucagggcagacaaagucaagaggaggaaguuuuug

SEQ ID NO: 378515 - RNA, 64 nt, Human
gcggaugcugaggccacagcuggugaacagcucagcagacaacaugcuggaguacaagucuugg

SEQ ID NO: 378516 - RNA, 64 nt, Human
cagacaugccacucuguggcucccaauauagggugcagacaagagcaaucccugacaugacauu

SEQ ID NO: 378517 - RNA, 64 nt, Human
cuaaaacgacuuauuauuuauuaauuauguuguggcagacaauaugcugaacauuagacauaau

SEQ ID NO: 378518 - RNA, 64 nt, Human
uaagugcuugaauucaagacuggucaguccaagagcagacaaaaauaucacaagucagucaguc

SEQ ID NO: 378519 - RNA, 64 nt, Human
uguacucugaagaaaaagauuucaaaaucuaccagcagacaagaauauagauaauggaaaacag

SEQ ID NO: 378520 - RNA, 64 nt, Human
auuuuaaaugaaaguauuggcauucaaaaagacagcagacaaaaugaaagaaaaugagagcaga

SEQ ID NO: 378521 - RNA, 64 nt, Human
auuuguucauuauuugugcuaccccuuugauuaugcagacaaccucaucagcugccuaacuuau

SEQ ID NO: 378522 - RNA, 64 nt, Human
auuuaagauuaaugggcaugcaaugaagucuccagcagacaaucagauguuguuggaugucuag

SEQ ID NO: 378523 - RNA, 64 nt, Human
acuguugucuauugagaccuagccuaguuuuccugcagacaaugaaugaagugugcucauugaa

SEQ ID NO: 378524 - RNA, 64 nt, Human
gccugugaccuuugggaccaacuccaccuacgcagcagacaaggcggugagccugggggucccc

SEQ ID NO: 378525 - RNA, 64 nt, Human
gugccugucugcccggugagaccucaaguuccuugcagacaaaggccauggguuguuggcucuu

SEQ ID NO: 378526 - RNA, 64 nt, Human
uuaguacccuucaccuaacaucucucgguaaaaagcagacaagaucacaaauuacaguaaaaau

SEQ ID NO: 378527 - RNA, 64 nt, Human
gguaguuuugaagcucuccaggugauuccaaugugcagacaaauuugaaaacugaaccaaccac

SEQ ID NO: 378528 - RNA, 64 nt, Human
ugccuuauugcuuaacuuaauguagugaaauaaagcagacaaagcuugagcgugucuuuuguuu

SEQ ID NO: 378529 - RNA, 64 nt, Human
ggagaugcagccagcuaagacuguccacacuuuggcagacaaccgguuuucccuuuucuggguc

SEQ ID NO: 378530 - RNA, 64 nt, Human
ccucguuccuugggagaugauggccuuugaauaugcagacaaccuuugaauugugccuacuaaa

SEQ ID NO: 378531 - RNA, 64 nt, Human
cagcauucugguuuuuauguuuuuuaugaucuaugcagacaacuguguauucuguuuuauaaca

SEQ ID NO: 378532 - RNA, 64 nt, Human
cuucguugccuucaguaaucagggugugaaaaaagcagacaaguuguguguguguguguguguc

SEQ ID NO: 378533 - RNA, 64 nt, Human
uccaccuugcucuucuuucugagaguuggcucaggcagacaagagcugcuguccuuuuaggaau

SEQ ID NO: 378534 - RNA, 64 nt, Human
gaguacauggguuuuagguugaaugugagagucugcagacaauguggguucuccgacugcccuc

SEQ ID NO: 378535 - RNA, 64 nt, Human
cagacaagaaaaaagauuuagcuuaucacaagaagcagacaauuuauaaaacuacacaaugucu

SEQ ID NO: 378536 - RNA, 64 nt, Human
cauaucuguauggcaaggagggagcuguccuucagcagacaaagucaagcagcuuuaaguacaa

SEQ ID NO: 378537 - RNA, 64 nt, Human
aguuaacgcuucaugcacugcuguuuuucugucagcagacaaaaucagccuaacagcaaaggcu

SEQ ID NO: 378538 - RNA, 64 nt, Human
guucggacaggcucugcgugccaggcaacagugggcagacaaagggcucccuggcuacugggaa

SEQ ID NO: 378539 - RNA, 64 nt, Human
aacuuucugaaagugauggaaaauguugucuugugcagacaacaucauggcucuuggcaguuua

SEQ ID NO: 378540 - RNA, 64 nt, Human
cacccauauuuccuuauugauauuauugguacaggcagacaacccugguaggagagauggauuc

SEQ ID NO: 378541 - RNA, 64 nt, Human
gagaauguuuggacucuaacucaccgauugcuuugcagacaaaggucuuuuauuucuccugucc

SEQ ID NO: 378542 - RNA, 64 nt, Human
gacuuuuguuaaagccaugacuuuuguuugcuuggcagacaaacccuuuuuuuaaaacuuugau

SEQ ID NO: 378543 - RNA, 64 nt, Human
acagaaccaggccaauauauuuugaaauauugaugcagacaaaugaaauaauaaagagauuuuc

SEQ ID NO: 378544 - RNA, 64 nt, Human
accuagacauguccagaugggagucccauuccuagcagacaagcugagcaccguuguaaccaga

SEQ ID NO: 378545 - RNA, 64 nt, Human
aguuccucccaggaagcccaggagccucacuggggcagacaauaaacccucagagccucgcucu

SEQ ID NO: 378546 - RNA, 64 nt, Human
guccuaggccaguagauggcagcagcuuuucauugcagacaaaaccucuugaaacccuuccccc

SEQ ID NO: 378547 - RNA, 64 nt, Human
aauaauaauaaagaaaaauaaauaaaaaggagaggcagacaaugucuggauuccuguuuuuugg

SEQ ID NO: 378548 - RNA, 64 nt, Human
aagguaauaaauagcuuacugauauuuuauggaugcagacaauccaugcacaaccacuucuuau

SEQ ID NO: 378549 - RNA, 64 nt, Human
cuagguuauuuauaauguauuucugaaccacuuggcagacaaauucacaacacuuaauguucau

SEQ ID NO: 378550 - RNA, 64 nt, Human
cagucaccaaaguuuccuguuauaauuucuuuuagcagacaaguuauaagucagauuuaauuag

SEQ ID NO: 378551 - RNA, 64 nt, Human
ucugcaggacguugguugccaugguaacaucgccgcagacaaacauguggccccgcucgaggca

SEQ ID NO: 378552 - RNA, 64 nt, Human
gguagacggcagaugccugacagagaguggguuggcagacaacacacuagcauuuucacgggug

SEQ ID NO: 378553 - RNA, 64 nt, Human
gaagcccgcugaaaggucagcgacugaaggccuugcagacaaccgucuggagguggcuguccuc

SEQ ID NO: 378554 - RNA, 64 nt, Human
uccuccuggccagccacauaagccaaucggggaugcagacaaguggcuacaaacuuuccauaca

SEQ ID NO: 378555 - RNA, 64 nt, Human
gugggaaccgagucagaauauuuuugaaagcuacgcagacaagaacagccgccugacgaaaugg

SEQ ID NO: 378556 - RNA, 64 nt, Human
guuuccuguuggaugcacauaauccauuugcacugcagacaauuuuaggaugugguuuacagua

SEQ ID NO: 378557 - RNA, 64 nt, Human
gcaggacaucgacuggaacguaugcuaaaugaaagcagacaaauuucuauuuucuuaccugagc

SEQ ID NO: 378558 - RNA, 64 nt, Human
uguguuuacagcauuuccagguccagagagguuggcagacaagugccauuuuaauaaaaaaugu

SEQ ID NO: 378559 - RNA, 64 nt, Human
acagcuugagaauagaggaaaaaauaaaagcgaagcagacaaaaagaaccuuaccucccccaca

SEQ ID NO: 378560 - RNA, 64 nt, Human
aagguucugcccuuauggagcucacacuccaguggcagacaaacagaccauaaauaaggaaacg

SEQ ID NO: 378561 - RNA, 64 nt, Human
ggcugggcauucagugaagucuuaggacuucuuugcagacaacugacuggguauauauaggaau

SEQ ID NO: 378562 - RNA, 64 nt, Human
cucgugcagugcugcguagguuagcccgcaucgugcagacaaccucaguccucuugucuauuuu

SEQ ID NO: 378563 - RNA, 64 nt, Human
augauaacuuaccuuagcauugccaagaacuucagcagacaacaagcaauucuauuuauuuuau

SEQ ID NO: 378564 - RNA, 64 nt, Human
caaaguggaacuaggaguuuggaaugcauuaagagcagacaagcuuggucauaauagauccagu

SEQ ID NO: 378565 - RNA, 64 nt, Human
cauccacauguguuguacuuucagcucuaggcaugcagacaaccccacacggccacaccaccac

SEQ ID NO: 378566 - RNA, 64 nt, Human
gccucccauccccagacccaccagacaccacacagcagacaauacacacccacucgcacaagcu

SEQ ID NO: 378567 - RNA, 64 nt, Human
cuaguuagcuauuguuauuaacaagaucuccauggcagacaagcuaaagcaucugccuaagucg

SEQ ID NO: 378568 - RNA, 64 nt, Human
auuuuugcaugaauuaagacguuuuaauuucuuugcagacaaggucuagaugcggagucagaga

SEQ ID NO: 378569 - RNA, 64 nt, Human
agcaucauaaaggcacaagugcacacacaucuaugcagacaagcuuccucgcugcuuaugccca

SEQ ID NO: 378570 - RNA, 64 nt, Human
ucugcugggacugccuggagauuugucaggagcugcagacaaguaccuuggagcauucuguuau

SEQ ID NO: 378571 - RNA, 64 nt, Human
ucagcaaacuaaccagcauucccuacagccuagggcagacaauaguauagaagucuggaaaaaa

SEQ ID NO: 378572 - RNA, 64 nt, Human
agauccugcuuuuuuguuucaaggguuaaauggggcagacaauugcaauacuuguacuaaacac

SEQ ID NO: 378573 - RNA, 64 nt, Human
cucuccuucccccuaaaagcgaauguuugugugugcagacaaucuuagcaugaaaaugguuuaa

SEQ ID NO: 378574 - RNA, 64 nt, Human
gcccgcugcuuuuucuauccucccagucaccuuugcagacaaagaccaggggcagcucccgagg

SEQ ID NO: 378575 - RNA, 64 nt, Human
cauugccuggucuaguagcggaucucacucagccgcagacaaguaaucacuaacccguuuuauu

SEQ ID NO: 378576 - RNA, 64 nt, Human
ucuuuggacagaaaaaaaaaaaaaagucuuucuugcagacaagucacuacagaaacauacccca

SEQ ID NO: 378577 - RNA, 64 nt, Human
cauggaguagaggccuaaguugacacugcccugggcagacaagacaggagcugucgccccaggc

SEQ ID NO: 378578 - RNA, 64 nt, Human
gugcccucuugcccccaggaagggcagcuggcuggcagacaaggugaagaggcugaugcggccc

SEQ ID NO: 378579 - RNA, 64 nt, Human
ggucaggcucaacugcugaugugucucacacguagcagacaaggggugucugacuggcuucuuu

SEQ ID NO: 378580 - RNA, 64 nt, Human
cuagauuggguauuuugcuaaauuaccaagcaaagcagacaaucuuuuucuugaaauuaccucc

SEQ ID NO: 378581 - RNA, 64 nt, Human
gcgcuacggacuccucccaauucugacaucucuugcagacaauacuaugcucucuacacacugu

SEQ ID NO: 378582 - RNA, 64 nt, Human
ccagcggaaccccccagggggcaccagccccccagcagacaauggcccuccuggugccucacca

SEQ ID NO: 378583 - RNA, 64 nt, Human
uuccuagcuauccuauuagccuguaaauaugucagcagacaauguguuuggaagaaacaaggug

SEQ ID NO: 378584 - RNA, 64 nt, Human
aucugccucccucagccucccaaagucugggauugcagacaagucaucguacccggccuucuuu

SEQ ID NO: 378585 - RNA, 64 nt, Human
ugauggaucacguaaaacugaaaggcagcggggagcagacaaagaugaggucuacacuguccuu

SEQ ID NO: 378586 - RNA, 64 nt, Human
cagucuugugcuccuggacaugcgguacugaggugcagacaagggucuccacuguggugacugg

SEQ ID NO: 378587 - RNA, 64 nt, Human
uuccggagcagacacauccgggcggagagacucagcagacaagugcugcaguugcacgguggga

SEQ ID NO: 378588 - RNA, 64 nt, Human
caagagggaggagaaagugaagaagcagcggucagcagacaaggagaagagcaaggguucccuc

SEQ ID NO: 378589 - RNA, 64 nt, Human
uuuguuuucagcaacauaaauugauuuuuagcuggcagacaagaauauccauauaagauuuguu

SEQ ID NO: 378590 - RNA, 64 nt, Human
aaacagaaaauaaguaguuuuugugaauugacuugcagacaaaguagaaacugugcugcaugau

SEQ ID NO: 378591 - RNA, 64 nt, Human
uuccaugugucaauacugcccuguaguacacagagcagacaagaaagaagagcccuugaaaaca

SEQ ID NO: 378592 - RNA, 64 nt, Human
acaccuuucugaaauccuucuccagccagcugcugcagacaaaagaucacauuucugggaagau

SEQ ID NO: 378593 - RNA, 64 nt, Human
aggcauggaguuuaaaauuggaaugcaaaaauuagcagacaauccauuccuacuguauuucugu

SEQ ID NO: 378594 - RNA, 64 nt, Human
cccuucauguauuuuaaauuuauuugacaagucugcagacaauccuuaucuaaccagcuauuuu

SEQ ID NO: 378595 - RNA, 64 nt, Human
ucugagcugcaaucacugcugcugcugucacccugcagacaaacugcuguggccagugggcccc

SEQ ID NO: 378596 - RNA, 64 nt, Human
agaagaaaggaccgaagcugcugcguaagcccaugcagacaagauauuuguuguuuaaccuccu

SEQ ID NO: 378597 - RNA, 64 nt, Human
gcucuaggucccuauacuaauugagauguuuucagcagacaaaaauaagucacucuuacgcaug

SEQ ID NO: 378598 - RNA, 64 nt, Human
gcuauauuuuuaaagaaggaggucguuuaugugugcagacaauucucccugagguuagcccaau

SEQ ID NO: 378599 - RNA, 64 nt, Human
caaccagcucuaugacaucauuaccaugcgguacgcagacaaacacaugaacaucgacuuugac

SEQ ID NO: 378600 - RNA, 64 nt, Human
uaauuacaguaaauuaaauaaagauuccuuuaaggcagacaagggcuaagauuuccuuagcagu

SEQ ID NO: 378601 - RNA, 64 nt, Human
cuaaaacugccuagggcaggauucauuagggcuugcagacaaugucaccuaaauugcugaaugu

SEQ ID NO: 378602 - RNA, 64 nt, Human
agcacacagcacuugggccagcaaauccuggaaggcagacaaaaauaagagccugaagcaaugc

SEQ ID NO: 378603 - RNA, 64 nt, Human
agggcuggucauucacagauccccauggucuucagcagacaagugagggugguaaauguaggag

SEQ ID NO: 378604 - RNA, 64 nt, Human
aacuccuuguaggucugcagaugugugucccauggcagacaaagcacccuguaggcacagacaa

SEQ ID NO: 378605 - RNA, 64 nt, Human
gcaggcagauugccucacuuaacuuaaaucugcggcagacaacugccagugcccaucaaacagg

SEQ ID NO: 378606 - RNA, 64 nt, Human
gccaggucccagggaagucuugcacagacucuuagcagacaagcagggaaaagagaggguccug

SEQ ID NO: 378607 - RNA, 64 nt, Human
cagggaccagcugaccaggcuugugcucagagaagcagacaaaacaaagauucaagguuuuaau

SEQ ID NO: 378608 - RNA, 64 nt, Human
ccacauuuuuuaccuaaaaugcacagaauugccugcagacaaaauauuugaugugccaauuaug

SEQ ID NO: 378609 - RNA, 64 nt, Human
augaccaagcucacacaugcuggcugaagcguaagcagacaacugagguacucuuuugaaggau

SEQ ID NO: 378610 - RNA, 64 nt, Human
uguguccgcucucucauguggggauguuugugcugcagacaaaaagaacaaaaaaaaauuuuua

SEQ ID NO: 378611 - RNA, 64 nt, Human
gcccuggcucagaaucagagcccagaaaguggcugcagacaaaaucaauaaaacuaaugucccu

SEQ ID NO: 378612 - RNA, 64 nt, Human
gcuaacccgugcagaaccagcacuaagguggacagcagacaagagggcaagccucuaguguacc

SEQ ID NO: 378613 - RNA, 64 nt, Human
cuguuucaugcuucaagaauguucaggauuaaaagcagacaagaaauugugcuacuugaaguug

SEQ ID NO: 378614 - RNA, 64 nt, Human
uagagccucgacacccccccaacccccgcaccaagcagacaaagucaauaaaagagcugucuga

SEQ ID NO: 378615 - RNA, 64 nt, Human
caugcagcugauuucuaguggggagaguagacaagcagacaagagaaauaaauaaaaugucauc

SEQ ID NO: 378616 - RNA, 64 nt, Human
ugucgaugacuucaucaacacgagaauacaggaggcagacaaugaccccacggcuccuccuuau

SEQ ID NO: 378617 - RNA, 64 nt, Human
acgcagccagccagaugccuggcccugugcuggggcagacaacgcugcagagcccagggagccu

SEQ ID NO: 378618 - RNA, 64 nt, Human
uauuacuguagguucucuucaaauaauuaauugagcagacaaguuuguuuuauuuuggagccuu

SEQ ID NO: 378619 - RNA, 64 nt, Human
gcucagacaguguguggaggggcaggagcgugaugcagacaaggacuuagucaugacugauuuu

SEQ ID NO: 378620 - RNA, 64 nt, Human
uguguccaguuuuggaggcugaguucugguucaugcagacaaagcccuguccuucagucuucua

SEQ ID NO: 378621 - RNA, 64 nt, Human
gcgcucccuuuucucaucauugggguuagcgggugcagacaaauucagcaauaguaugcagauc

SEQ ID NO: 378622 - RNA, 64 nt, Human
agguuucuucucaucaccagcucagcuaggccgggcagacaaggacagaagacucugggccacu

SEQ ID NO: 378623 - RNA, 64 nt, Human
cuaucauuccagaaggaaaagugugucagggcaagcagacaacacaauuuccuaucagaauaug

SEQ ID NO: 378624 - RNA, 64 nt, Human
uccauuaugccaaacuugggaugggauuuucgaagcagacaacacuauuucaucguguuucaaa

SEQ ID NO: 378625 - RNA, 64 nt, Human
aggcugcugagaaagagaaugagaagaggcugcugcagacaaguggacagggaaggccucugac

SEQ ID NO: 378626 - RNA, 64 nt, Human
caggugcugacucccgcacucccuggcauuuuuugcagacaagggcuugggauggacccucagc

SEQ ID NO: 378627 - RNA, 64 nt, Human
ucccagaccccuccuguucccgccucagucaggugcagacaagugggcgguguccauuaaagag

SEQ ID NO: 378628 - RNA, 64 nt, Human
cguacauagggaagggaggaagggaaaacagaaagcagacaaagaaaaaagagcuagcccaaaa

SEQ ID NO: 378629 - RNA, 64 nt, Human
aagcgagcuaugcugaacucuucuccaucuccaagcagacaaccuuugucuuuacaugcaagag

SEQ ID NO: 378630 - RNA, 64 nt, Human
uccggugcugcugggcuggguugagcaagccuacgcagacaaguguguguguggaccauccgca

SEQ ID NO: 378631 - RNA, 64 nt, Human
uguauugaguccaucuguaauuugcucagugauggcagacaagauggcugucugguuuugagac

SEQ ID NO: 378632 - RNA, 64 nt, Human
aauuguuaagaguuaacagguaguuggauuugucgcagacaaugaguuaaggaauccuuucacg

SEQ ID NO: 378633 - RNA, 64 nt, Human
ccucacucugagagccuugggggucuccaccagugcagacaagggcuacagucuccagggccgg

SEQ ID NO: 378634 - RNA, 64 nt, Human
gcaccgaugagaacucuccuuauugcugugaagggcagacaaugcauggcugaucuacucuguu

SEQ ID NO: 378635 - RNA, 64 nt, Human
gagcacucaguucagcagggguaugcugacuucagcagacaaagacuuuugaauaaauaaacug

SEQ ID NO: 378636 - RNA, 64 nt, Human
uugucuucaguaugacuagaagaucgcacugaaagcagacaagacuccuuagaacuguccucag

SEQ ID NO: 378637 - RNA, 64 nt, Human
gcacccccuuccccagccucucgccugcacugaugcagacaaaaucucaccuggcaggcccaac

SEQ ID NO: 378638 - RNA, 64 nt, Human
ucaauaaaacagggauauuuuaaaucacauaccugcagacaaacuggagcaauguuauuuuuaa

SEQ ID NO: 378639 - RNA, 64 nt, Human
cugagagaaacgcagguguuccagaggcuuccuugcagacaaagcaccccugcaccuccuaugg

SEQ ID NO: 378640 - RNA, 64 nt, Human
ccgggaagagccgacacagccacgaaccagacaagcagacaaucagcggacaaucgguucugga

SEQ ID NO: 378641 - RNA, 64 nt, Human
auucuuccuguacccucggucgucugagcugugugcagacaacauccccccaccacccaagagg

SEQ ID NO: 378642 - RNA, 64 nt, Human
agaaguccaaacuuuuuuuuuauuacuagcuucagcagacaaaaacuuccucugucaagguguu

SEQ ID NO: 378643 - RNA, 64 nt, Human
gucuuagagcauguguguauucagucagauacuggcagacaauucagaacuuucaccacaugag

SEQ ID NO: 378644 - RNA, 64 nt, Human
ucuguucauccaagacuuccuaggggccagccuagcagacaagagaccacaagggacuggggau

SEQ ID NO: 378645 - RNA, 64 nt, Human
uccucccacugcugacggaggaauuaacacaaaagcagacaacacucuagaacuggagagaggu

SEQ ID NO: 378646 - RNA, 64 nt, Human
cugcauucagaacauugaccauuagcugauacaugcagacaagaggaucaggaaggaugagucu

SEQ ID NO: 378647 - RNA, 64 nt, Human
uacccauaaaaaccccaggcuccacuggcagacggcagacaaggggagaagagacgaagcagcu

SEQ ID NO: 378648 - RNA, 64 nt, Human
auucaccuggagccuuuauaaaguuuuucucuaugcagacaaccauugauuuacucugcuguau

SEQ ID NO: 378649 - RNA, 64 nt, Human
uuuguccuuuuguucagacagaguuguaccugcagcagacaacucugaauuaaagcaugaaaac

SEQ ID NO: 378650 - RNA, 64 nt, Human
caacaaccgacaucugaacaccuacauuuccuuugcagacaaauugaagaacuggugggauuuu

SEQ ID NO: 378651 - RNA, 64 nt, Human
gaguccuugagcuccacaacaucuaccagauauagcagacaagcacccauggaggcagguuucg

SEQ ID NO: 378652 - RNA, 64 nt, Human
caacucucucccuccccucaucccacaucucaaagcagacaauguaaagagagaacaucucaca

SEQ ID NO: 378653 - RNA, 64 nt, Human
cauuucuauaauaucuaccugcaaugguuuacaggcagacaaugaaauugaucuuuugacugug

SEQ ID NO: 378654 - RNA, 64 nt, Human
aagacaaaaugacuauacagacuuuagucagacugcagacaauaaagcugaaaaucgcauggcg

SEQ ID NO: 378655 - RNA, 64 nt, Human
gacaaaaccuuuucuccuguguaucuuugaaguggcagacaaggcgaagcaucagacugguauu

SEQ ID NO: 378656 - RNA, 64 nt, Human
cuugguugccaguaguaccuuguuuugccauguagcagacaacacacaaaauaaugcaguugug

SEQ ID NO: 378657 - RNA, 64 nt, Human
ugggggacaaaagccaaaggugccaggccuuagagcagacaagggcucucagcccuggcaugcc

SEQ ID NO: 378658 - RNA, 64 nt, Human
gucaccccauggugguauggcugaacaaggagcggcagacaacucagggagaaacucaggagug

SEQ ID NO: 378659 - RNA, 64 nt, Human
caauugaaacagaagaagaaaaaaaaaaaaagcagcagacaacacacuguagagucuugcacac

SEQ ID NO: 378660 - RNA, 64 nt, Human
cuggaggucugcaagcacugguagugauauugcagcagacaaggucuggguugggcgucugcag

SEQ ID NO: 378661 - RNA, 64 nt, Human
agagcuguguuuuguuuuguuucgcauuuagagagcagacaaggcacccuucugcugcgcugau

SEQ ID NO: 378662 - RNA, 59 nt, Human
gggaaccugcuggcuacugauugcuccaggcagacaaggcugacaagcaauccagggac

SEQ ID NO: 378663 - RNA, 64 nt, Human
agucuugacgaggagcaaaccccgccuucagagggcagacaaagcagguggcaugaauugauca

SEQ ID NO: 378664 - RNA, 64 nt, Human
cuugaaugauucggcuaccaccuguuccagaggugcagacaagagguggcgagagcccccauca

SEQ ID NO: 378665 - RNA, 64 nt, Human
cuuagcaaauucuguaacuaaaaaaguaccauuagcagacaauaaaaugcauuaaaaaucauuc

SEQ ID NO: 378666 - RNA, 64 nt, Human
gucuccuuccuaagccauccucagagaguccuuagcagacaaaugguagauguaucuuugggca

SEQ ID NO: 378667 - RNA, 64 nt, Human
ccuccugcuacccucccucuaugaaaauagccaugcagacaagucucucaucugaagaacaaau

SEQ ID NO: 378668 - RNA, 64 nt, Human
gugguggaaggugaaaggcaugucucacauggcagcagacaagagaagaaaacuugugcaggga

SEQ ID NO: 378669 - RNA, 64 nt, Human
gcggaagcugcuacucgugagcgccagugcgggugcagacaaucuucuguuggguggcaucauu

SEQ ID NO: 378670 - RNA, 64 nt, Human
ugaccacguuuauguuuaaauuucauuuuguucagcagacaaaauguacuucccuuaacuuuca

SEQ ID NO: 378671 - RNA, 64 nt, Human
aaaauguauauagcugugagcucaaacaaaaacugcagacaaacaaaaaagagaaaagcuuuua

SEQ ID NO: 378672 - RNA, 64 nt, Human
cugccaggcaugguggcccacgcacuucgggaggucgaggcaggaggaucacuugaguccagaa

SEQ ID NO: 378673 - RNA, 64 nt, Human
ucuuucucccagcuuugccucccuuaucccacccucgaggcagggaaaagccaucuauucuucu

SEQ ID NO: 378674 - RNA, 64 nt, Human
cugcugggaaccccgcagcccgugaagcagugccucgaggcaccggcgcugcagguacuuccuc

SEQ ID NO: 378675 - RNA, 64 nt, Human
aauaacugcaaggaggggcaagagaaaggaugauucgaggcaccuuggcccuucaaggucaugc

SEQ ID NO: 378676 - RNA, 64 nt, Human
cuguaaauauuuuuuuaaccuaauaucacuuaaaucgaggcagaaagauacagacauucaauga

SEQ ID NO: 378677 - RNA, 64 nt, Human
ccuaguucucaguguuugggacucuuaugcagaaucgaggcaguuaacucuuccaagaacagaa

SEQ ID NO: 378678 - RNA, 64 nt, Human
aggagggcaagcggccucccagcucccugguaccucgaggcaccauuccagccagggacgcugc

SEQ ID NO: 378679 - RNA, 64 nt, Human
ccuaauacaacccguaauagcauuuuugccugccucgaggcagaguuucccgugagcaauaaac

SEQ ID NO: 378680 - RNA, 64 nt, Human
uuaauugccuuaauuuuaaggacgucaaaggcucucgaggcaagcugucaacgucuuguugaaa

SEQ ID NO: 378681 - RNA, 64 nt, Human
acgaaaggucucuugccaacaguaucuacugcccucgaggcagcccucccaagucagacaccuc

SEQ ID NO: 378682 - RNA, 64 nt, Human
cccgccgucaggguggcuggggcuggcacgggugucgaggcaggaaggauuguuucuggugacu

SEQ ID NO: 378683 - RNA, 64 nt, Human
aggguaagcacaaagaaggagucacggguucuguucgaggcacuguugggauuaggagccggag

SEQ ID NO: 378684 - RNA, 64 nt, Human
aacggucauauguguucaacggugacuuuguggaucgaggcaaggauucaguagagauccugau

SEQ ID NO: 378685 - RNA, 64 nt, Human
uucaguaccagaagugucuuguggccucugcagcucgaggcaaggccuggggugcccaggcccg

SEQ ID NO: 378686 - RNA, 64 nt, Human
agcagcagugcuaccacgguaauggacagaguuaucgaggcacauacuucaccacugucacagg

SEQ ID NO: 378687 - RNA, 64 nt, Human
uguaggagugcuaccauggaaauggacagaguuaucgaggcacauacuucaccaccgucacagg

SEQ ID NO: 378688 - RNA, 64 nt, Human
uuuucuaagugugaaaaacccucacagaaagucaucgaggcaaaaagaggcaggcaguggaguc

SEQ ID NO: 378689 - RNA, 64 nt, Human
gguaacaucgccgcagacaaacauguggccccgcucgaggcacagcacgcggugcaccuccgca

SEQ ID NO: 378690 - RNA, 64 nt, Human
ucgcucacaccuauaauccuaggaucuugggaggucgaggcaagcugaucgcuugagcccagga

SEQ ID NO: 378691 - RNA, 64 nt, Human
aagauccaggcgccacgcuggcgguucgugagugucgaggcaccacuaaauauagcugucugcc

SEQ ID NO: 378692 - RNA, 64 nt, Human
cuuuggguccugggcaggugggagcugaaaaggaucgaggcauggggcauguccuuuccaucug

SEQ ID NO: 378693 - RNA, 64 nt, Human
acaaucucugccaccaccaagucauugacuuugcucgaggcaccuuuuuuccuguuucuccuuu

SEQ ID NO: 378694 - RNA, 64 nt, Human
acacccugccccuuagcccuugcgaggguuggucucgaggcagaggucauguucccagccaaga

SEQ ID NO: 378695 - RNA, 64 nt, Human
gcucccucuuuaggucggagauuggccuugccugucgaggcaagaggcugcagaggcggggaca

SEQ ID NO: 378696 - RNA, 64 nt, Human
ccaccaucacaucuuuauuccucagcccagacacucgaggcacucaacagaaucagccauccac

SEQ ID NO: 378697 - RNA, 64 nt, Human
uccaucuguaaagggcgguaauggugcccaccuuucgaggcauugcgaggcuagaugguaacac

SEQ ID NO: 378698 - RNA, 64 nt, Human
cgggcgcuggaaguagagaggccagaaaggccccucgaggcagagacccuccgcccucuugcac

SEQ ID NO: 378699 - RNA, 64 nt, Human
cagucacggggaggugcugguuccaugccugcucucgaggcagcaguggguucaggcccaucag

SEQ ID NO: 378700 - RNA, 64 nt, Human
cuuugccacaaugguaugauggcuugguagccccucgaggcagaugcaccugacuugcugcuau

SEQ ID NO: 378701 - RNA, 64 nt, Human
ucuuccugcugcugcucucccuggacgaccggccucgaggcaacccuggggcccaccagccccu

SEQ ID NO: 378702 - RNA, 64 nt, Human
cuuugaaugauauauuuuuguacaucuagcuguaucgaggcaucaggccugaauaaacauccuu

SEQ ID NO: 378703 - RNA, 52 nt, Human
agggggcgcaccgggacugacuucgaggcacgcuucccuucauuagagacgg

SEQ ID NO: 378704 - RNA, 64 nt, Human
gacuccugucugcauucccaaauuuggcucugagucgaggcaaccugcacacaagaccccacca

SEQ ID NO: 378705 - RNA, 64 nt, Human
ugucaacagguacuauuugucacauaacuaacuuucgaggcacuggaacauaccugaacuaaga

SEQ ID NO: 378706 - RNA, 64 nt, Human
ucagguggugcugccccagaaacuuaaaauuuagucgaggcaguuucaauuguuacuguggacc

SEQ ID NO: 378707 - RNA, 64 nt, Human
ggccagcaggugcuuccuuggcucccaugaucgaucgaggcauagugaaagaagggcaaagaca

SEQ ID NO: 378708 - RNA, 64 nt, Human
gucccuggacggguggacuuagcuagggagaaagucgaggcagcagcccucgaggcccucacag

SEQ ID NO: 378709 - RNA, 64 nt, Human
uggcucacaccucuaaucccagcacuuugggaggucgaggcagguagaucacgaggucaggaau

SEQ ID NO: 378710 - RNA, 64 nt, Human
ugccuuccccuggucagccuggaagaagccugugucgaggcagcuucccuuugccugcugauau

SEQ ID NO: 378711 - RNA, 64 nt, Human
guguugccaucaucuuguugaaucagccauuuuaucgaggcacgugaucaguguugcaacauaa

SEQ ID NO: 378712 - RNA, 64 nt, Human
ucuucagcaccuaccugcgccccccacacaccucucgaggcaccucccagacaccaaaugccuc

SEQ ID NO: 378713 - RNA, 64 nt, Human
cucggcuccucccccagccucuagcuacccuguaucgaggcaaggggaggccaguaaaguuugc

SEQ ID NO: 378714 - RNA, 64 nt, Human
cuguugaggguccucuuccaucuugcugaacuguucgaggcaaagacaaaacccaacuuugacc

SEQ ID NO: 378715 - RNA, 64 nt, Human
aggaggccgcucuccuucaguaaauguaacacagucgaggcacgucaucgggcagccuucccug

SEQ ID NO: 378716 - RNA, 64 nt, Human
auguagauacucauuucuuauuuuuauuuuuuucucgaggcagaaucuugcucugucaccuagg

SEQ ID NO: 378717 - RNA, 64 nt, Human
guggcucacgccuguaauaccagcaccuuagaggucgaggcaggcggaucacuugaggucagga

SEQ ID NO: 378718 - RNA, 64 nt, Human
uugugguuauauucccaacaacauuaaaaaauacucgaggcauaaauguaguugucuccuacuc

SEQ ID NO: 378719 - RNA, 64 nt, Human
uacccugaaccgugugacucugcaagcagacaccucgaggcagguguucuaggcaaagggaugg

SEQ ID NO: 378720 - RNA, 64 nt, Human
agacuugucucggucaccugugcccuguccagacucgaggcagugguaacacugcacagugcua

SEQ ID NO: 378721 - RNA, 64 nt, Human
gaggcuguggacaccccgaggacaguguccugucucgaggcagggcugacacauggugccauag

SEQ ID NO: 378722 - RNA, 64 nt, Human
aggugagugacuggugggaagaguacaucuaccuucgaggcaggagcccucucauggugaacag

SEQ ID NO: 378723 - RNA, 64 nt, Human
agguuuucugacauuaacuuaugugaugacuugaucgaggcaggcuuuuccagcaucacugucc

SEQ ID NO: 378724 - RNA, 64 nt, Human
agggaagggacuugaccgaggucccacuucuguuucgaggcagaagccagacuaauuuucaugc

SEQ ID NO: 378725 - RNA, 64 nt, Human
cacuaggcuugauugcaucccuguugugcccuuuaagagacauguuuccaccccacccccaacc

SEQ ID NO: 378726 - RNA, 64 nt, Human
gacccagagccuaggggauccggggcuuguacagaagagacaguccaaggggacuggaucccag

SEQ ID NO: 378727 - RNA, 64 nt, Human
auccuguaaagaacaggagucaggagccgcuggcaagagacagcaugucaccugggacucugcc

SEQ ID NO: 378728 - RNA, 64 nt, Human
cggcuucaccugcagccaacggccuggaaucgcaaagagacaccacucugggcagagcagagca

SEQ ID NO: 378729 - RNA, 64 nt, Human
acccagagccccaugcacaguguccugcgugggaaagagacacggucccccuggcugagccccu

SEQ ID NO: 378730 - RNA, 64 nt, Human
gcauccagaggccauggaaacauucuuugcauuuaagagacagauuuauucccuguggagagug

SEQ ID NO: 378731 - RNA, 64 nt, Human
ucgugccauucacaaagucagaaaauacagcaggaagagacagcuuuuagaggggcagagaauu

SEQ ID NO: 378732 - RNA, 64 nt, Human
cuuggaaaaagugggcuugcuacaucucuguucaaagagacauuuguucaaucucuguguguca

SEQ ID NO: 378733 - RNA, 64 nt, Human
agacaccagaagaaauggccuucaauuauuugaaaagagacacagagacaccucuggcuaccua

SEQ ID NO: 378734 - RNA, 64 nt, Human
uuuaggaacaagaucuugauauuuggccucuuugaagagacagcccuggcugcuuuccuuuccu

SEQ ID NO: 378735 - RNA, 64 nt, Human
caacaggaaaaaaggagggaggaggaaaagccacaagagacauucuguacaauuccaaggaaca

SEQ ID NO: 378736 - RNA, 64 nt, Human
auguacagaagauuaagacagagaaacagacagaaagagacacacacacagccaggagugggua

SEQ ID NO: 378737 - RNA, 64 nt, Human
auugggauuaacauaaaagaguggaacuauccaaaagagacagggagaaauaaauaaauugccu

SEQ ID NO: 378738 - RNA, 61 nt, Human
gccaccuggacgucaaaugauugccaucagaaagagacaacuugaagaaaccaacaaugac

SEQ ID NO: 378739 - RNA, 64 nt, Human
gacccgucuccaucggaccccagccccuaucuccaagagacagaggaggggucaggaggcacug

SEQ ID NO: 378740 - RNA, 64 nt, Human
ucagacauguugaauauuuuauuagacucagcugaagagacaagugaacuaaacuauaagcugg

SEQ ID NO: 378741 - RNA, 64 nt, Human
ucucacucugaaaagcaggaauguaagaugaugaaagagacaauguaauacuguugguccaaaa

SEQ ID NO: 378742 - RNA, 64 nt, Human
ccauaggugggacagcuauggccaauaggcuauaaagagacauuuagcacuuuuuucuauuuaa

SEQ ID NO: 378743 - RNA, 64 nt, Human
cacacguuucaucuuuuuccccucugagagcaagaagagacauggcauguucucugggacccug

SEQ ID NO: 378744 - RNA, 64 nt, Human
caauaacucucuacaggaauauauuuuuuaaacgaagagacagaacuguccacaucugccuccu

SEQ ID NO: 378745 - RNA, 64 nt, Human
guggugucugucuaggaaggaaggggugauugacaagagacaagucuggcccaguuaaugcuuu

SEQ ID NO: 378746 - RNA, 64 nt, Human
gagagaagacucaccucugucgcuuggguuaaacaagagacagguuuuguagaauauugauugg

SEQ ID NO: 378747 - RNA, 64 nt, Human
auagcgguggauacccacccccacaaaugcacccaagagacaagccauuuacauacagauauuc

SEQ ID NO: 378748 - RNA, 64 nt, Human
gaaggacucauuacaacaaacagggaaguaaaggaagagacacauccucucauacucccugaga

SEQ ID NO: 378749 - RNA, 64 nt, Human
uaccacugaggacuguugcuguauugauuaggaaaagagacagaguaauuugcaguuuguuuga

SEQ ID NO: 378750 - RNA, 64 nt, Human
gagcagagggaggcccccaagagugccauugaccaagagacagcagacagccugccuccugggg

SEQ ID NO: 378751 - RNA, 64 nt, Human
uccuaccagaaagcuuugucucaagccugaccacaagagacaugauggaguuucauggccauga

SEQ ID NO: 378752 - RNA, 64 nt, Human
cggagccagcgugucacauggugagagagggagcaagagacagacaggggaggaaauucacaca

SEQ ID NO: 378753 - RNA, 64 nt, Human
cccuuuccuggaggggagaggcuucuuacuagguaagagacagguuuccucuuuccuuauuucc

SEQ ID NO: 378754 - RNA, 64 nt, Human
gagcacugugguagagcacuggcccugccuugagaagagacacaggucucccgucccugcacca

SEQ ID NO: 378755 - RNA, 64 nt, Human
aucaagaucuuugagggaccaccucacccugcaaaagagacagguccuccaguacccugucuuc

SEQ ID NO: 378756 - RNA, 64 nt, Human
ggguuggacuguaagggauugaaggggguaccuuaagagacacuccaaaccugaaguuuuuuug

SEQ ID NO: 378757 - RNA, 64 nt, Human
gagguuuccuuuuuuaaguguucgagguuauaacaagagacagccaaggaccuacaagacaguu

SEQ ID NO: 378758 - RNA, 64 nt, Human
aguuauccuaguccagcaaagucauuucuuucaaaagagacaucaugucugaaaauaauuacug

SEQ ID NO: 378759 - RNA, 64 nt, Human
acaggguaaauaacaugccaaaucacaaacuaguaagagacauaguugaagcuuaaauucaagu

SEQ ID NO: 378760 - RNA, 64 nt, Human
aaaaaaaaaaaaaaaaaaaaaaaaaaaacauucaaagagacauauacuaagauguucacugugg

SEQ ID NO: 378761 - RNA, 64 nt, Human
agugaaagacuuuugaaaagugcccuuuccccuuaagagacaguuggaauaccaguugacuaau

SEQ ID NO: 378762 - RNA, 64 nt, Human
aaaccagaaaaagguuuggaauguuggaaugaccaagagacaaguuaacucgugcaagagccag

SEQ ID NO: 378763 - RNA, 64 nt, Human
gggucugccuguaugucuucugcauaagacaaagaagagacaucgaaucaaccaauaagaagag

SEQ ID NO: 378764 - RNA, 64 nt, Human
gucauuagugacaaagauuugcaacauuagagaaaagagacacaaauauaaaauuaaaaacuua

SEQ ID NO: 378765 - RNA, 64 nt, Human
gggguuagauuaagaucuaaauuacaucaggacaaagagacagacuauuaacuccacaguuaau

SEQ ID NO: 378766 - RNA, 64 nt, Human
cccaccgcaggugugaguucugugagucacugcuaagagacagagcacauuuucaggccagcaa

SEQ ID NO: 378767 - RNA, 64 nt, Human
guuccuuuucuuuucuucuuuuagccauuuugcuaagagacacagucuucucaucacuucguuu

SEQ ID NO: 378768 - RNA, 64 nt, Human
gcgaccaguacagacccuguccuggcugaacaagaagagacacaugcuccacuugggagccuuu

SEQ ID NO: 378769 - RNA, 64 nt, Human
acuggggucccgcccgacgugucuacgucggcugaagagacagcgggggcggcgggcuccuggg

SEQ ID NO: 378770 - RNA, 64 nt, Human
uuucagcuguuucugugauuauaaagcauuuuuuaagagacaaauuuuaacuuuuaauuuuuau

SEQ ID NO: 378771 - RNA, 64 nt, Human
ucugcuucacagaaaaaagcaucucaguuaggagaagagacauccccuccuucucacuugccaa

SEQ ID NO: 378772 - RNA, 64 nt, Human
uaaaaggaccccagaauagcucuuuaucuuucacaagagacacaaauucuaauugaguuaauua

SEQ ID NO: 378773 - RNA, 64 nt, Human
uucaggguuuacaaaagaguaugugauugguaguaagagacacacagaauguuuaugaagaaau

SEQ ID NO: 378774 - RNA, 64 nt, Human
acucaagagacugacuucgccauucaagacaaggaagagacacaugugugcacuccugcauguu

SEQ ID NO: 378775 - RNA, 64 nt, Human
uagugccucugccagacacacacugccugaguugaagagacacaggccacacauuucaggcugg

SEQ ID NO: 378776 - RNA, 64 nt, Human
uauggcaauuugaaugcuuagaauuuuaaaccugaagagacacugugaauucuuuuguuuggaa

SEQ ID NO: 378777 - RNA, 64 nt, Human
aagccauaccuuaaagauaacuuuuuaaauucugaagagacaugccaaugucaaacuaaacaug

SEQ ID NO: 378778 - RNA, 64 nt, Human
gugugucuaagaugucuucaggggaaagauggguaagagacaguguugcuaaugcuguuccuuc

SEQ ID NO: 378779 - RNA, 64 nt, Human
aacaggaaugcauuuuuccccuugucuuuguuguaagagacaaaagaggaaacaaaagugucuc

SEQ ID NO: 378780 - RNA, 64 nt, Human
gucacauucucauugugaauuauguaaaguuguuaagagacauacccucuaaaaaagaacuuua

SEQ ID NO: 378781 - RNA, 64 nt, Human
aacacuauuugaugagucuuagaguccagacacaaagagacaaagcuuugaagaugcuuuuuga

SEQ ID NO: 378782 - RNA, 64 nt, Human
gacagauaacuaaccgaugaugaggccgagguaaaagagacaucugcagugugacagaagggag

SEQ ID NO: 378783 - RNA, 64 nt, Human
gggacugggagacugcuugguguucccugaggacaagagacauccugacaguguugggcaucug

SEQ ID NO: 378784 - RNA, 64 nt, Human
aguauauuaaacaaaguuucagaguauauuguugaagagacagagacaaguaauuucaguguaa

SEQ ID NO: 378785 - RNA, 64 nt, Human
aucugaguaggcugacccugagaagggacaauuaaagagacaaccaagggaacacauugagacu

SEQ ID NO: 378786 - RNA, 64 nt, Human
gcccccaagggugucucaugcuacaagaagaggcaagagacaggccccagggcuucuggcuaga

SEQ ID NO: 378787 - RNA, 64 nt, Human
gagaagaaauuuggcuuuuuuuuucuuaauggacaagagacaguugcuguucucauguuccaag

SEQ ID NO: 378788 - RNA, 64 nt, Human
ucuguuuuuagcuugauaauggaacuauacagcgaagagacaaucucuggcaaguuuuuguaga

SEQ ID NO: 378789 - RNA, 64 nt, Human
ucuuccacaguccuagaaucaaucuuuuuuaauuaagagacagggucugucuuuguuacccagg

SEQ ID NO: 378790 - RNA, 64 nt, Human
auuuucacugaugcauaauuuucuuauuaauauuaagagacaguuuuucuauggcaucuccaaa

SEQ ID NO: 378791 - RNA, 64 nt, Human
ggccguugguugucugaagaguagaagggaaacuaagagacaguucucugugguucaggaaaac

SEQ ID NO: 378792 - RNA, 64 nt, Human
uucuuguuguaggaaaaacggcuugcagauuauaaagagacauuugguugauauucauuaaugg

SEQ ID NO: 378793 - RNA, 64 nt, Human
ucuaccaaugugcuuaaggccagaugggcuuccuaagagacaaggguggguggaccuaaccaac

SEQ ID NO: 378794 - RNA, 64 nt, Human
auuggacuuggcuggccagagggucucugagggcaagagacauggccaaccaagggcaaggagu

SEQ ID NO: 378795 - RNA, 64 nt, Human
auucaagcuuuccgagucaagugauugacaacugaagagacacguggcuaggguuccacuggag

SEQ ID NO: 378796 - RNA, 64 nt, Human
uggacuagaggaguccugagaggacacuuccaacaagagacauuuauucucugauuuuaccuga

SEQ ID NO: 378797 - RNA, 64 nt, Human
cacuacccacaugcugaucuauuggggaacagagaagagacaggccacgaaggucaggcucuuu

SEQ ID NO: 378798 - RNA, 64 nt, Human
uugggacauucagaaacugccugggugguuugagaagagacaacccaguuugaucugcaauaca

SEQ ID NO: 378799 - RNA, 64 nt, Human
uugccauugccugccucccccuccccuucuccuuaagagacaauuucugcagguggcaggugag

SEQ ID NO: 378800 - RNA, 64 nt, Human
uauuguuuuuuuuuuaaaaaaaaaaagaagaaaaaagagacagagaaaauugguauuuauuuuu

SEQ ID NO: 378801 - RNA, 64 nt, Human
ugcaauaguccuugguacuucuaauauuuuuagcaagagacaauuuucuguacuagaaucuucc

SEQ ID NO: 378802 - RNA, 64 nt, Human
aacugagcuucuuucuuucauugcuuuuucccuuaagagacaaguccuuacuauauugcccugu

SEQ ID NO: 378803 - RNA, 64 nt, Human
caugagaaagaaggagggaugggaccuuuguaggaagagacacaguccugcagccucauauggc

SEQ ID NO: 378804 - RNA, 64 nt, Human
uuugcccagagggcacgggcuuucccaccucucaaagagacaaggaagccaccuguaagcagaa

SEQ ID NO: 378805 - RNA, 64 nt, Human
agugcuaccaccguugccacugagcccacaucccaagagacaggcccagagccuaaaggcaagg

SEQ ID NO: 378806 - RNA, 64 nt, Human
aacggguagcagaauuggacaaaauuacuuaugaaagagacaguuuuagacaggcauaugaaga

SEQ ID NO: 378807 - RNA, 64 nt, Human
guggucaggggcugauguggcaacacccucugccaagagacagagcuguccugagaaugcuuug

SEQ ID NO: 378808 - RNA, 64 nt, Human
aaagguuucuauucaaugaagaaaucggagugggaagagacacagggaaauugagccauauuuu

SEQ ID NO: 378809 - RNA, 64 nt, Human
gggaccaaauuuaagcaauuuuuguuuuuggcugaagagacaccaaaauauuagaggacaaaua

SEQ ID NO: 378810 - RNA, 64 nt, Human
gagaguaucacacccuaaaugaacacugucuacuaagagacaucauuccauuuccacaaaugaa

SEQ ID NO: 378811 - RNA, 64 nt, Human
agcuugcaaccuagccucacccaagaagacuggaaagagacauaucucucagcuuuuucaggag

SEQ ID NO: 378812 - RNA, 64 nt, Human
agguggcuacagaugguagaacuaaacaauaagcaagagacaauaauaauggcccuuaauuauu

SEQ ID NO: 378813 - RNA, 64 nt, Human
gagauguugucaauaggaaaugggauaaaauaucaagagacaaugaaaacacugccuugacaug

SEQ ID NO: 378814 - RNA, 64 nt, Human
aauguauagacuuuaugucuuccaaguuuaaaaaaagagacagggucuugguauguugcccaga

SEQ ID NO: 378815 - RNA, 64 nt, Human
gggaacgaggccaucagcugccaugcacauaacaaagagacaaugcauuccuucuuauuuuucc

SEQ ID NO: 378816 - RNA, 64 nt, Human
aucauuggucuuuucaaaacuagguguuuaaaaaaagagacauauaugauauugcuguuauauc

SEQ ID NO: 378817 - RNA, 64 nt, Human
ccuuugugugaauucauauauuauagcaaaauacaagagacaugggacuguuugcaauaccaua

SEQ ID NO: 378818 - RNA, 64 nt, Human
uacuacccaaaauaugaauuccaacacugcuuccaagagacauuuacauaaaauugcuuccauu

SEQ ID NO: 378819 - RNA, 64 nt, Human
aacaguuugauuuuuuaagaugauuuuugauuugaagagacaggcuuuacauaagccuucauuc

SEQ ID NO: 378820 - RNA, 64 nt, Human
aaacuuaacuguucuaugaaggagauugagggagaagagacaaacuccuaugucaugagaauaa

SEQ ID NO: 378821 - RNA, 64 nt, Human
gggcucauuuuccugacauuuguuuauuuuuuggaagagacaaagauuucuucugcacucugag

SEQ ID NO: 378822 - RNA, 64 nt, Human
uugaagcuuggacuagaauuucuucuugguauuaaagagacaaguuuaucacagaauuuuuuuu

SEQ ID NO: 378823 - RNA, 64 nt, Human
ucacacauuauaggggcaucagagaauggcauggaagagacagucuacagagagcuuuaagagg

SEQ ID NO: 378824 - RNA, 64 nt, Human
uauaaauacugauauuucauuccuuuguuuacuaaagagacauauuuaucaguugcagauagcc

SEQ ID NO: 378825 - RNA, 64 nt, Human
caaugguuuacaugaacacagcugcugaagaggcaagagacagaaugauauccaguaagcacau

SEQ ID NO: 378826 - RNA, 64 nt, Human
agacacaauaggggccaguuuuguuuaaggaucaaagagacaaccacuuuggggaauuaguauc

SEQ ID NO: 378827 - RNA, 64 nt, Human
auaccauuacuggaaaaaggaaaucuguauauuaaagagacauuugaacccuauguuuacugca

SEQ ID NO: 378828 - RNA, 64 nt, Human
aguauuccaugcauauuagauaucaccaugaagcaagagacaugcauucuauaaucauguagac

SEQ ID NO: 378829 - RNA, 64 nt, Human
acuaaacuggagccaauagaaaagacaaaaaugaaagagacacaggguguauaucuagaacgau

SEQ ID NO: 378830 - RNA, 64 nt, Human
aauuuccacaccuuaauuaucauucaacuugcaaaagagacaacugauaagaagaaaauugaaa

SEQ ID NO: 378831 - RNA, 64 nt, Human
cccaggucgggagacagcagcuuuggagacacaaaagagacagagccucagccagggagaguga

SEQ ID NO: 378832 - RNA, 64 nt, Human
uucuucuauauuugugugacauguugggcagaucaagagacagcuacaaaaaugaagguuuuca

SEQ ID NO: 378833 - RNA, 64 nt, Human
caauccuauaaaugugauuuuuuuauauaaguuaaagagacaaauaguaggcuaaaaacauuuu

SEQ ID NO: 378834 - RNA, 64 nt, Human
augauuaaaugaauucucuaaaagaacauauuuuaagagacagaacuuagacauaaccaaguag

SEQ ID NO: 378835 - RNA, 64 nt, Human
ccuaguaucagcaucaaguaugugguacuacuguaagagacaugaauggagacuucuaauuugu

SEQ ID NO: 378836 - RNA, 64 nt, Human
ugaauuuuccauuuuuuacauccauuucacauguaagagacaaaaaagucuagauuggucuuga

SEQ ID NO: 378837 - RNA, 64 nt, Human
aaguacaucuugaaaguaaaggugacuuagagaaaagagacauuuugacagauacuuuuaauuu

SEQ ID NO: 378838 - RNA, 64 nt, Human
gcuauucugcaugggugcagauggcuggaugugaaagagacaugcucuagcugcagaggcaaau

SEQ ID NO: 378839 - RNA, 64 nt, Human
gccugucaaguucaaaacagagaggugaaagcagaagagacacuuuccuauuuugccuaauagg

SEQ ID NO: 378840 - RNA, 64 nt, Human
cucaaucucauuaaguuggaaaaaaaacuuaucaaagagacauuuacaugguuuggcuuuuaua

SEQ ID NO: 378841 - RNA, 64 nt, Human
ggucagucuuuauuuuuuuccuuuuuucuuuuuuaagagacagucauccaggccagagugcagu

SEQ ID NO: 378842 - RNA, 64 nt, Human
cggacagugauuccugccucacaggugaagauuaaagagacaacgaaugugaaucaugcuugca

SEQ ID NO: 378843 - RNA, 64 nt, Human
ggaaaaauauaaaacauaugaauauaaagaaagaaagagacaagucaaauguaguaaaaugaca

SEQ ID NO: 378844 - RNA, 64 nt, Human
uucagaauguccggucccugugguguugccaggcaagagacacgaagugccgagacacuccucg

SEQ ID NO: 378845 - RNA, 64 nt, Human
aaccuuuauagaugauguuugcaaaauaagacugaagagacacgaggcguacuagucuuuuauc

SEQ ID NO: 378846 - RNA, 64 nt, Human
gaaacucaauguaauuuaaaauauuaaguacaggaagagacauauuuugaauuacccucuagac

SEQ ID NO: 378847 - RNA, 64 nt, Human
uggacaaucaaauugcagaaaaggcucaauauccaagagacagggacuaaugcacuguacaauc

SEQ ID NO: 378848 - RNA, 55 nt, Human
aucugaucugccuccuuuaguuuggaagagacaaugccauuuucucccuugagua

SEQ ID NO: 378849 - RNA, 64 nt, Human
ucacaguuuuaucucacaaaaccauuuuucuaauaagagacaucauguuggaaagauguucuag

SEQ ID NO: 378850 - RNA, 64 nt, Human
ucaacuugcuacuacaugaaauggauuuucacggaagagacagcucugaaaaguuuugaugcuu

SEQ ID NO: 378851 - RNA, 64 nt, Human
agaggaguccaaggggacaaauaaaggcagagagaagagacagaacuaaaaauacgaggaaagg

SEQ ID NO: 378852 - RNA, 64 nt, Human
uuaguggaggaagucuggggaggugagcuacuggaagagacagggcaagaugccucgguggagc

SEQ ID NO: 378853 - RNA, 64 nt, Human
agauuacaggcaugagccauugcaccuggccaagaagagacaucuugacuugagccugaagacu

SEQ ID NO: 378854 - RNA, 64 nt, Human
uuguuuguuuuaccaagguauuccugcugccaccaagagacagcaaugacauguacagccaucu

SEQ ID NO: 378855 - RNA, 64 nt, Human
guuacauuaauuacugcaaaucaguggaauucucaagagacaagauaagcuucauguacauuug

SEQ ID NO: 378856 - RNA, 64 nt, Human
auaucugcagccacuguuacuuuuaauugacauuaagagacacuucauagguucccacaauuca

SEQ ID NO: 378857 - RNA, 64 nt, Human
uccuagaagcugaagguuagagcauuauaaaaugaagagacagacaugauuacucagggucagc

SEQ ID NO: 378858 - RNA, 64 nt, Human
aaaucaagcacgugagaguuuuuguuuaaaagauaagagacacagcauguauuaugcacuucau

SEQ ID NO: 378859 - RNA, 64 nt, Human
aaagagcaacacuaucggauuauuuauauuacucaagagacaauauauaugaauucuuaugaaa

SEQ ID NO: 378860 - RNA, 64 nt, Human
guacccagugaaaguggcugguacguagauugucaagagacauaagaccgaccagccacccugg

SEQ ID NO: 378861 - RNA, 64 nt, Human
gugacucuugcugcccagaaugcacagcgaugguaagagacaccguggauauucuucaucagaa

SEQ ID NO: 378862 - RNA, 64 nt, Human
aaaaaaaaaaaguccuguucuucuuuagauaaacaagagacauuuucauaauugcuuucuagca

SEQ ID NO: 378863 - RNA, 64 nt, Human
cauaccuuccucccucuagacaucccuccaccagaagagacaucuauuuaaaggcacacuggcc

SEQ ID NO: 378864 - RNA, 64 nt, Human
cagauaaacuguccccagacccugccacacauggaagagacagcucaggccaaauacaggcaug

SEQ ID NO: 378865 - RNA, 64 nt, Human
uucggaggaaacuuguaggacacccaaggcgacuaagagacagccuccuuggcaagggcaggca

SEQ ID NO: 378866 - RNA, 64 nt, Human
caugggacauuuuucuaacaaaaauaaaugcaugaagagacauagccuuuuaguuuugcuaauu

SEQ ID NO: 378867 - RNA, 64 nt, Human
aaggaauggacgaauucuugagcaaaaggaggggaagagacaaucuccagccacccgccccacg

SEQ ID NO: 378868 - RNA, 64 nt, Human
cucuaaaccaauguuauguaucaaagacuguugaaagagacagggcuacucuaggaauggaugg

SEQ ID NO: 378869 - RNA, 64 nt, Human
aacuucucugucuauauuguaauauagaauuucgaagagacauuuucacuuuuuacacauuggg

SEQ ID NO: 378870 - RNA, 64 nt, Human
acaggaacaauauuauuuuuccuuuaacaaaaugaagagacaggcuaucugguuaauguuacau

SEQ ID NO: 378871 - RNA, 64 nt, Human
gugcucucuuuucagugucauggaacugguuuugaagagacacucugaaaugauaaagacagcc

SEQ ID NO: 378872 - RNA, 64 nt, Human
acagcucugcaguuucccacacugucagcuccccaagagacaguccugaugggcacaggcugcc

SEQ ID NO: 378873 - RNA, 64 nt, Human
cuuuuucucuccuuccugaaaaauaaagugugggaagagacaagaccuugguauuguaauuauu

SEQ ID NO: 378874 - RNA, 64 nt, Human
cacugugcacuuagccaugauggcaacagaaaccaagagacacaauuacgcagguauuuagaag

SEQ ID NO: 378875 - RNA, 64 nt, Human
aucauucacaucagaacugcagccccuggaaaagaagagacagccauagacgaggagccagagu

SEQ ID NO: 378876 - RNA, 64 nt, Human
uuuacacaagaaucuagaaaaucagaucgcgauuaagagacagagaaucuuggauuaaccgcau

SEQ ID NO: 378877 - RNA, 64 nt, Human
ugaaauuaauuguaugaagcaaugugauuauaugaagagacacaaauuaaaaagacaaauuaaa

SEQ ID NO: 378878 - RNA, 64 nt, Human
uuaugaagcucauauccuuuugaagguaguugcaaagagacauuucaaaacugcccuaggccau

SEQ ID NO: 378879 - RNA, 64 nt, Human
gugagcagugaguuacagcgagaggcagagaaagaagagacaggagggcaagggccaugcugaa

SEQ ID NO: 378880 - RNA, 64 nt, Human
ugggggauggagggggguggcauugguucccccgaagagacacugcagucagggacugaguucu

SEQ ID NO: 378881 - RNA, 64 nt, Human
aaugcuuaauaauaauugaagaaugggaaagagaaagagacagagacuggcauuuuccucuccc

SEQ ID NO: 378882 - RNA, 64 nt, Human
aauccuuagccagggcucagagaugaagcagugaaagagacaggaauugggagggaaagggaga

SEQ ID NO: 378883 - RNA, 64 nt, Human
uugugauucugggauggacccucgcagcaggugcaagagacagagcccccaagccucugcccca

SEQ ID NO: 378884 - RNA, 64 nt, Human
uaaacguuuucagggaaugcagaagguauuaaugaagagacaaaaccuuuauuccaugugcuuu

SEQ ID NO: 378885 - RNA, 64 nt, Human
agaacgcacacccagcccagccccaaagagaaagaagagacagcaaagagccgcagccggugcu

SEQ ID NO: 378886 - RNA, 64 nt, Human
cucaaauaucaaauuuucuucucucuuuuauauuaagagacagaaaauuguuucaugaguucac

SEQ ID NO: 378887 - RNA, 64 nt, Human
acucucuaucacgagccuaacccgcgggaggcggaagagacauccauucgagaacugaagcggc

SEQ ID NO: 378888 - RNA, 64 nt, Human
uauggguuuaagcagagggcuacagaaaacagggaagagacauaccccugggcuuggauuccca

SEQ ID NO: 378889 - RNA, 64 nt, Human
uuacaucaggauagagguagaguuucuguaaaagaagagacauuaagaguuccugaaauuuaua

SEQ ID NO: 378890 - RNA, 64 nt, Human
acacacuagauuucuguucuucagcaaagcccugaagagacacuuaagcuaaaaauucccuugu

SEQ ID NO: 378891 - RNA, 64 nt, Human
uugacaaaaguuccaaauaauccauagacagucaaagagacaucucccucaauaaucgucauag

SEQ ID NO: 378892 - RNA, 64 nt, Human
agcugggcaccuuggaccuccagcuggccaauagaagagacaggagacaggaagccuucccauu

SEQ ID NO: 378893 - RNA, 64 nt, Human
uaaggaggacuugggccuuucugacaucauccugaagagacaggacuuugcguuuuuccucugg

SEQ ID NO: 378894 - RNA, 64 nt, Human
ucaguuaguccuaacuuuuaaaagaaggaaaaccaagagacauaucugguguacguguugcagu

SEQ ID NO: 378895 - RNA, 64 nt, Human
auucagguuuuacuguaaugguaaggauugacucaagagacaguauuaguaaauuuauugugua

SEQ ID NO: 378896 - RNA, 64 nt, Human
ucucuuuuauguguguccuuguuacauugagguuaagagacaaaaucauuggcagugcaaucuc

SEQ ID NO: 378897 - RNA, 64 nt, Human
cacccaccagacuuuuuuaaacaucaaauaauugaagagacaauagcauuagaaauaagugauu

SEQ ID NO: 378898 - RNA, 64 nt, Human
uuuuuacaccauauuagcuaccuuuucaauggagaagagacaguucacacaauucccugguuag

SEQ ID NO: 378899 - RNA, 64 nt, Human
aauugaaauaaagcuacugggccuccucucauaaaagagacaguuguuggcaagguagcaauac

SEQ ID NO: 378900 - RNA, 64 nt, Human
auauuuugguggagaagagguugggcuuuuuugaaagagacaaaaauuuauuauaacacuaaac

SEQ ID NO: 378901 - RNA, 64 nt, Human
uguuugcauauuaaaaaaagagaaaagagaaagcaagagacagaaaucaggacuaaguccucug

SEQ ID NO: 378902 - RNA, 64 nt, Human
guccaaguggauuaaugaugucaugcauaauuuuaagagacaagggagaaaacacaauguauag

SEQ ID NO: 378903 - RNA, 64 nt, Human
gaaaguucuauuaucuggguuuuagaaauucuauaagagacaaaguuuggaaguacauaaagua

SEQ ID NO: 378904 - RNA, 64 nt, Human
augcuaccacuggagaaggaaugagagauaaagaaagagacaggugacaucuaagggaaaugaa

SEQ ID NO: 378905 - RNA, 64 nt, Human
uaaaugucagaagacagauuuccuaaacaaguaaaagagacaucaaaaauuuuaacauaaucac

SEQ ID NO: 378906 - RNA, 64 nt, Human
ccuguuuugucaucugaugcaauuugcucuuauaaagagacauuuucauagguucagaguaacu

SEQ ID NO: 378907 - RNA, 64 nt, Human
uugaguucuucugcagagaugauuaaauauauccaagagacauuggaaaaccugcugaacauuu

SEQ ID NO: 378908 - RNA, 64 nt, Human
ccucaucaaguugaauaaagacagagaaaacagaaagagacauuguucuuuuccugagucuuuu

SEQ ID NO: 378909 - RNA, 64 nt, Human
cccugaacuguccauugcuuuuauagggugagguaagagacagccucccaagcccaggcuuugg

SEQ ID NO: 378910 - RNA, 64 nt, Human
agcugcgguggggagcuauaaaaaugacaauuaaaagagacacuagucuuuuauuucuagugag

SEQ ID NO: 378911 - RNA, 64 nt, Human
ccuuaguuaguuaugagaacagggaagggcugggaagagacagccuccaaggucaacacuugga

SEQ ID NO: 378912 - RNA, 64 nt, Human
aaaauacuuaggcuuggauacucauucucgaaaaaagagacaacucuacagugcauuggcuaau

SEQ ID NO: 378913 - RNA, 64 nt, Human
ccaguuuugacagaauaauucuuggucuuccccaaagagacaauuuguuguacccaugacuguu

SEQ ID NO: 378914 - RNA, 64 nt, Human
uaauuuaaaggaccacauuaauuuuucaaagggaaagagacaauuaauuguacauaauguauac

SEQ ID NO: 378915 - RNA, 54 nt, Human
aggaaguggcagcauucugaggccaagagacacucacuggacaauaucaaacca

SEQ ID NO: 378916 - RNA, 64 nt, Human
ucugucugguuaugucaaguuaauucagaaagagaagagacagugaccaacccugagaggccua

SEQ ID NO: 378917 - RNA, 64 nt, Human
gcgggccccuuccgagggagccucccacggagugaagagacaugggggacuuuugcacaaccga

SEQ ID NO: 378918 - RNA, 64 nt, Human
cagaaaaaaucaaaagaucaauaauugggagaaaaagagacaaauuuaacuguuacauaauuuu

SEQ ID NO: 378919 - RNA, 64 nt, Human
aguuaagucguagcuauaacuucaaauuuuuuaaaagagacaaacuguaaaaaauguguguauu

SEQ ID NO: 378920 - RNA, 64 nt, Human
ugaaacacuuugcauaacguauaaaagccuguuuaagagacagccaacuauggccuguggauca

SEQ ID NO: 378921 - RNA, 64 nt, Human
gcagguugacuuaauuuauuuauuuuuugaaaagaagagacagaaaauaccuuauuaucugcag

SEQ ID NO: 378922 - RNA, 64 nt, Human
gcgugagccaccuugcccagccaauuuuuuuuuaaagagacauggucuugcuauguugcccagg

SEQ ID NO: 378923 - RNA, 64 nt, Human
gcucucugaggagcugccccaccagccauccuugaagagacaauucagggcaguugaugaauau

SEQ ID NO: 378924 - RNA, 64 nt, Human
gagauaaagucccugccugcaugcauucuggcggaagagacaagcaagcaaugaacaaauuagc

SEQ ID NO: 378925 - RNA, 64 nt, Human
uggcugcacaguuggugggguccugccggagaggaagagacacucagaccagagaaggggugug

SEQ ID NO: 378926 - RNA, 64 nt, Human
ucuuuucaggcccggaaugggaaaaucuauuccaaagagacacacuaauaaauacuucauuaua

SEQ ID NO: 378927 - RNA, 64 nt, Human
cccaaauccagugaccuccucuucaccuucuuaaaagagacaggagaaucacuugaacccggga

SEQ ID NO: 378928 - RNA, 64 nt, Human
accuaaccccacagaaacggacaacauggagcaaaagagacagggagagguggagaaggaaaaa

SEQ ID NO: 378929 - RNA, 64 nt, Human
gagucacuucuaggugggauuuuuuuguuuuaccaagagacaaugaaauccugaaguuuaugcu

SEQ ID NO: 378930 - RNA, 64 nt, Human
ggaaagaauuugccuucucccugggaacugguucaagagacacugcuuggguuccuuuuucaac

SEQ ID NO: 378931 - RNA, 64 nt, Human
gagcccucacgaaugggauuaaggcccuuauaagaagagacauggggccaggugcaguggcuca

SEQ ID NO: 378932 - RNA, 64 nt, Human
ugaucagauucucucucucuugagagcaugaauuaagagacauggagacugcagucacuuggga

SEQ ID NO: 378933 - RNA, 64 nt, Human
aagaacugcugucaugaaggaggggccaccuuguaagagacaucauuacuaccagaacuguggu

SEQ ID NO: 378934 - RNA, 64 nt, Human
uuugcccccuuggaacacauuggucagcaguucuaagagacacugcccacaugauggccauucc

SEQ ID NO: 378935 - RNA, 64 nt, Human
aaagggauauauuuucuugcacaguuguucaaaaaagagacaaguuucaguccucaaugcuguc

SEQ ID NO: 378936 - RNA, 64 nt, Human
uguucacuggcauuuugaaggcauggcccaagagaagagacacuagccauaaaaucuaguuucu

SEQ ID NO: 378937 - RNA, 64 nt, Human
cucuacagagauaagaaaacaaguuuggcagagcaagagacagaagaccguggagaaaucagaa

SEQ ID NO: 378938 - RNA, 64 nt, Human
ccccggauuguugugggagcuacccuccacucuaaagagacaucaucuuacagauugggauccc

SEQ ID NO: 378939 - RNA, 64 nt, Human
caaagaaaaccuaaaacaagccucuugcucaguaaagagacaaaagccacacaggaguaggugc

SEQ ID NO: 378940 - RNA, 64 nt, Human
agcuaacugggucuuagcauccuccuguguauggaagagacaggugaccgcuccagguugggug

SEQ ID NO: 378941 - RNA, 64 nt, Human
acccuucuugguuggaacugaaagcuucuguuugaagagacaugaguucuggaaggagcaaggc

SEQ ID NO: 378942 - RNA, 64 nt, Human
gccagaagguaaucacucagauacacuugggaccaagagacagugaaaaauagaugaacuaaga

SEQ ID NO: 378943 - RNA, 64 nt, Human
uucuuuucuaucaguuuguauauuacuaagccccaagagacauuuccugugcuagaguccaaua

SEQ ID NO: 378944 - RNA, 64 nt, Human
cuucccuuaaaauuagcucugagugaaaaaucaaaagagacaaaagacaucuucgaauccauau

SEQ ID NO: 378945 - RNA, 64 nt, Human
cgaaaaguggauggagagagugauggcuccacugaagagacagacgagucggagacuugaggag

SEQ ID NO: 378946 - RNA, 64 nt, Human
cuaugaugucagacaguggaugggcuccagcaacaagagacaaaauaacuaaaggccuuugcuc

SEQ ID NO: 378947 - RNA, 64 nt, Human
uuuccuuuuuuaaacauuaguguucauagcuuccaagagacaugcugacuuucauuucuugagg

SEQ ID NO: 378948 - RNA, 64 nt, Human
cugccccguuggaugcccugacugggggcaggggaagagacagggcacagcuggccacagggcu

SEQ ID NO: 378949 - RNA, 64 nt, Human
cucacugguacuggcccuuuagugcuuugccugaaagagacacagucacauggccagaugagaa

SEQ ID NO: 378950 - RNA, 64 nt, Human
gaagauguaugcaaagugaaaugccagcccuuuaaagagacauuaguuaguguaaaauggaucu

SEQ ID NO: 378951 - RNA, 64 nt, Human
uguaaaucauguggcaucuauguauaauaaaagaaagagacaacuauauuacucaauuucauau

SEQ ID NO: 378952 - RNA, 64 nt, Human
ucugagauuucagaguccucaaauuucuuagauuaagagacaagaggccagugcagugguucac

SEQ ID NO: 378953 - RNA, 64 nt, Human
guuuuuuuuuugguuuguuuguuuuuuguuuuaaaagagacaggaucuugcuuugucucccagg

SEQ ID NO: 378954 - RNA, 64 nt, Human
ccaggauuccuuuugccucaagugguauguuuaaaagagacaacgcuuuguuacaagguucuug

SEQ ID NO: 378955 - RNA, 64 nt, Human
ucucucuuuuaaaucagauaccuuugaaacauacaagagacaugagauuccaguuguuuuuguc

SEQ ID NO: 378956 - RNA, 64 nt, Human
guccauugcuggcaguggacauuauucuugcccuaagagacacugccuuuucagcagcagauac

SEQ ID NO: 378957 - RNA, 64 nt, Human
uggaaauaaacaguagaaauaagcaaacaauauaaagagacacgggaaaugcuucucgugaagg

SEQ ID NO: 378958 - RNA, 64 nt, Human
uguuuacuauuggagauaaccacacuuaauaaagaagagacagugaaaguaccaucauaauuaa

SEQ ID NO: 378959 - RNA, 64 nt, Human
uuagaauagucauaccuggaaugugucaaauuauaagagacagacacuugguuaguggcugccu

SEQ ID NO: 378960 - RNA, 64 nt, Human
agcuucagugacaaacauauccuuucaagacagaaagagacaggagacaugagucuuugccgga

SEQ ID NO: 378961 - RNA, 64 nt, Human
uauaucuuauaaaguggaaguauguauauuaaaaaagagacauccaaauuuuuuuuuaaagcag

SEQ ID NO: 378962 - RNA, 64 nt, Human
aaugagguguccaacuggcccuauuuagaugauaaagagacagugauauuggaacuugcgagaa

SEQ ID NO: 378963 - RNA, 64 nt, Human
uugguacacaguucugguguuccuaccaggacucaagagacaccccuuccugcugacauuccca

SEQ ID NO: 378964 - RNA, 64 nt, Human
cccuuaaccccgggaugcaagguagcauggguccaagagacauggaagagagagccaugaagca

SEQ ID NO: 378965 - RNA, 64 nt, Human
aagagcagcagugagaaggcaaagagagaggcagaagagacagacgaggcagagacaaaacacu

SEQ ID NO: 378966 - RNA, 64 nt, Human
guuuuuaacugcaacguacuuuuccccuaccuugaagagacaugguggucgcagcuucucaucu

SEQ ID NO: 378967 - RNA, 64 nt, Human
gcacacuaacuaaugaaaguccuagaagccauaaaagagacacuuuccugcuggugguaucuau

SEQ ID NO: 378968 - RNA, 64 nt, Human
cuucagcuguguaucccagacuguuaauacagaaaagagacauuucagcugugauuaugaccau

SEQ ID NO: 378969 - RNA, 64 nt, Human
gguaaaaccagaggcuacauccaguauuacugcuaagagacauucuucauccaccaauguugua

SEQ ID NO: 378970 - RNA, 64 nt, Human
acaccugcaugaucacuguucuugcuuuuuugggaagagacacuuuguugcaacccuuuuucaa

SEQ ID NO: 378971 - RNA, 64 nt, Human
ggaaaccuuugggacuucugacaggcaucuggugaagagacaauucaagccuuagugacuauuu

SEQ ID NO: 378972 - RNA, 64 nt, Human
gcccaagauaaauacuuuaauuguuaaaagucagaagagacagaauauguaggaaauguuuuuu

SEQ ID NO: 378973 - RNA, 64 nt, Human
ggaguauuauuuuauauuuuugacuucauguuuuaagagacaaucaugccagagucccacauga

SEQ ID NO: 378974 - RNA, 64 nt, Human
ccacgugccuguacuugcccccaggcuggaagagaagagacagaaagaccccaugaccccccca

SEQ ID NO: 378975 - RNA, 64 nt, Human
ccccugacuucauggaugaggaaccuggagaccaaagagacaaagggacuuuuucaaguucaca

SEQ ID NO: 378976 - RNA, 64 nt, Human
cuaguugccucuugaaguggauuuaacuaaagcgaagagacaagaucuugaaccgucuguggag

SEQ ID NO: 378977 - RNA, 64 nt, Human
gagggagugaggggcaguggugcccuuccugcagaagagacaugcagcaguagcgcuggcgcca

SEQ ID NO: 378978 - RNA, 64 nt, Human
cacacaaggcacuggguauaugguauccccaaacaagagacauaaucccgguccuuagguagug

SEQ ID NO: 378979 - RNA, 64 nt, Human
auugauaaucauaccuaaagcacauugaacuucuaagagacaggugcuacguaagcacacuguc

SEQ ID NO: 378980 - RNA, 64 nt, Human
augggagacagugguagagagguuuuucuugggaaagagacagagugcugaggggcacucuccc

SEQ ID NO: 378981 - RNA, 64 nt, Human
cuagaauagcuucauccauaugaaauauaaaaugaagagacaccuagcucuaucaggcuuagga

SEQ ID NO: 378982 - RNA, 64 nt, Human
cccaguuggugaucccagcuggagggagaacccaaagagacagcucuucuacuacccccacaga

SEQ ID NO: 378983 - RNA, 64 nt, Human
uugaauucuaacuuuucuaagauagcaauuuuugaagagacacgaacaaaaaucugaauuaguu

SEQ ID NO: 378984 - RNA, 64 nt, Human
uauguccuuacauuucugaaagcuuucaaucuucaagagacaaaaaaaauuaaaauaacuaccc

SEQ ID NO: 378985 - RNA, 64 nt, Human
uuugcuagucauuucuuccugggaauacagagaaaagagacaacuuuaugaguuguuuucaacu

SEQ ID NO: 378986 - RNA, 64 nt, Human
accugucauccuuuuuauaaaaaggcucacugacaagagacagcuguuaauuucccacagcaau

SEQ ID NO: 378987 - RNA, 64 nt, Human
agugggccuaggguggccacagcuuugauuuuucaagagacaagaaaccuagauguuuuuuggu

SEQ ID NO: 378988 - RNA, 64 nt, Human
ugguggugguugauggcuuuucagcgggaaacagaagagacaguguccuuuugcacaagagucu

SEQ ID NO: 378989 - RNA, 64 nt, Human
aaauacuacaaauuagugucaggcaguucccagaaagagacaagaaauccuaguggccucccag

SEQ ID NO: 378990 - RNA, 64 nt, Human
acuguguauuuaucacuaaaaaguacaugaacuuaagagacaacuaagccuuucguguuuuucc

SEQ ID NO: 378991 - RNA, 64 nt, Human
ucagggaagggaaacaauaaaucucgcugaauugaagagacaggacuggcaguuggggaggcca

SEQ ID NO: 378992 - RNA, 64 nt, Human
ccccccacccaaaauguuucgagucaacaaauuuaagagacagagcccauuuucuccauaaauu

SEQ ID NO: 378993 - RNA, 64 nt, Human
cccuuucgucaccccaaaaguuuugaaucaaugaaagagacauugaaaacucuuaagagguuuu

SEQ ID NO: 378994 - RNA, 64 nt, Human
cuaucagucucgggacugagagggaaccgugaugaagagacacuuucugccucauuucuucucu

SEQ ID NO: 378995 - RNA, 64 nt, Human
cauauaucaugugcuguaaaauaagaacuagcugaagagacaaccaaagaagcauuaaggcagg

SEQ ID NO: 378996 - RNA, 64 nt, Human
acccgggccugggagcucagugacauaaaugcugaagagacaggcauuguuuuccgugcugugu

SEQ ID NO: 378997 - RNA, 64 nt, Human
ugagucugguuaggcauuacuuuaaacauacauaaagagacaguaggacauuguggcugagucu

SEQ ID NO: 378998 - RNA, 64 nt, Human
cauauuugcaagugguaaauuggauuugcgguggaagagacaggggagggaaacgguugggguu

SEQ ID NO: 378999 - RNA, 64 nt, Human
uucuucauaaagaucuugauaugaucaagauggaaagagacaagcauaaacaaugugcccuguu

SEQ ID NO: 379000 - RNA, 64 nt, Human
guucagaagcacaauacuaucuccugaaagagauaagagacauucccuagauucaaaggcaaaa

SEQ ID NO: 379001 - RNA, 64 nt, Human
ugagaaauucugagccaaucaggcuucuuaauucaagagacaaaccaagacguucugucaacug

SEQ ID NO: 379002 - RNA, 64 nt, Human
aaauaaaagggguuguuaggcuacugcaaauauaaagagacauaaucacaaaucuauuuauaua

SEQ ID NO: 379003 - RNA, 64 nt, Human
aauaagauaaaucaaccaaguuuuggggccucaaaagagacaccagcaacugggccuugagaac

SEQ ID NO: 379004 - RNA, 64 nt, Human
aaacugguuguauggccauagcuauccgaaaagcaagagacaaagcaagacaaauauucacaca

SEQ ID NO: 379005 - RNA, 64 nt, Human
uaccugucuuauguaacuacuugagaccaucugcaagagacaugauuuagugugucuguaauuc

SEQ ID NO: 379006 - RNA, 64 nt, Human
cccagcaucucaggagcaccucagggugucgguuaagagacaggccuccaccccugcaccagag

SEQ ID NO: 379007 - RNA, 64 nt, Human
caucucuaggaaugugcuuuaaccacugcugcaaaagagacaagucugcauuuauuugugcagg

SEQ ID NO: 379008 - RNA, 64 nt, Human
aucaguguuuuucuuacuggagcuucauuuugguaagagacagaauguaucugugaaguaguuc

SEQ ID NO: 379009 - RNA, 64 nt, Human
ggugcgagccacugcaccuggcccacauuuuuuaaagagacacugucccacuccaucacccagg

SEQ ID NO: 379010 - RNA, 64 nt, Human
caucuguaauuuacuguugguaagccuagcaguaaagagacauuggucaauugcucugacccug

SEQ ID NO: 379011 - RNA, 64 nt, Human
aaaauaauguucauaaggagucaauauguaguuuaagagacaaucagugugugucuuauaaaug

SEQ ID NO: 379012 - RNA, 64 nt, Human
guaggugagaaaauauuccugaaaguagaacugaaagagacaaagagaaaagaugaaagccaca

SEQ ID NO: 379013 - RNA, 64 nt, Human
agagaagcaaggcugauauuagcuuguugaauguaagagacacaaaugaagaagaacaaagagc

SEQ ID NO: 379014 - RNA, 64 nt, Human
uuuccggccaaggugccaccacccugcccccccuaagagacacauacagagugggccccgggcu

SEQ ID NO: 379015 - RNA, 64 nt, Human
uaucacauguguagauucaugugaccaccaucacaagagacagaacaguucugucacauggauc

SEQ ID NO: 379016 - RNA, 64 nt, Human
aagauaaguguaauuuuguuacaaguuuauuuugaagagacaaaucuccugugaucuaugcagg

SEQ ID NO: 379017 - RNA, 64 nt, Human
uacuugcuauuggcccucggauacauuuaagagaaagagacagucacucuuuuuuuucuuaaau

SEQ ID NO: 379018 - RNA, 64 nt, Human
auccaaaguaaaggaaauguuuuaaaacugcaacaagagacacagacaguaaaaucaaaguauu

SEQ ID NO: 379019 - RNA, 64 nt, Human
cuggauugaaagggagugccuaucuauauuuagcaagagacacuauuaccaaagauuguugguu

SEQ ID NO: 379020 - RNA, 64 nt, Human
uguaaaaacacauacauggccaaaugcaauacugaagagacaaucauccuguaucuuuuauggu

SEQ ID NO: 379021 - RNA, 64 nt, Human
aggguaugguuuggucgcuuugguugucaugagaaagagacauucuccuugcagcuaccuccau

SEQ ID NO: 379022 - RNA, 64 nt, Human
ccagaugggcugcucuccuguaacuuucuaggagaagagacauuuucuucuuucccuuuccugg

SEQ ID NO: 379023 - RNA, 64 nt, Human
auguuuuaaagcuugcucacaucuuggcacauuuaagagacagucaccccaggacucaaaaaua

SEQ ID NO: 379024 - RNA, 64 nt, Human
gaauguugguucuuuuccuucugccuuuuugggaaagagacaggaaagauucacuugaaaacau

SEQ ID NO: 379025 - RNA, 64 nt, Human
aggcuuccccaggcaugccguccgugggggccugaagagacagugagugccauuggccccauuc

SEQ ID NO: 379026 - RNA, 64 nt, Human
augaagcucuguuagaaacaccgugugcuuugggaagagacaauaaagaugucuuuauuuauca

SEQ ID NO: 379027 - RNA, 64 nt, Human
ucccaaagaaucauuuaaaaguaaagugacuucuaagagacaaggaaguaggaacauuucugau

SEQ ID NO: 379028 - RNA, 64 nt, Human
uaaaauaugacaacugcuuuaugguuucuuuuggaagagacagauugaaaaaucaugaauggaa

SEQ ID NO: 379029 - RNA, 64 nt, Human
ucuuugacaauugggagcugccaagagugaagggaagagacagcccaggauacuggcacagagg

SEQ ID NO: 379030 - RNA, 64 nt, Human
gcuuuuagcaagaaaucacauaacuuuuauuucuaagagacaguuguuaggcaguuguugcaaa

SEQ ID NO: 379031 - RNA, 57 nt, Human
gaaaagcccgugcgcagugagacaucuaagagacauucauuuggauuccccucuucu

SEQ ID NO: 379032 - RNA, 64 nt, Human
gcaccuggccuaggacugguguccuaagaagaggaagagacacuuagguggaaggcacacagag

SEQ ID NO: 379033 - RNA, 64 nt, Human
accuugccagggaccaggagcucucacuuugccuaagagacagacacacagaaacccuccuagc

SEQ ID NO: 379034 - RNA, 64 nt, Human
ccuguguaacucaccuucccccaugacagugaguaagagacacucacaggcuaugaggguacac

SEQ ID NO: 379035 - RNA, 64 nt, Human
accugcccagcuccccaacucccugccauuuuuuaagagacaguuucgcuccaucgcccaggcc

SEQ ID NO: 379036 - RNA, 64 nt, Human
gcuccgggcaccaggggccaaccucaggcuccuaaagagacauuuuccgcccacuccugggaca

SEQ ID NO: 379037 - RNA, 64 nt, Human
agaugugggcggcaagccacccaggcaccgaggcaagagacagaggacacgagcuguuccagua

SEQ ID NO: 379038 - RNA, 64 nt, Human
uuacgucuccagugguuagcucacauugccucucaagagacagguuuccaggugucuucauugu

SEQ ID NO: 379039 - RNA, 64 nt, Human
cagcagcagcgggaucaauacgauuuccacugggaagagacaggaauucuaccuacacauagga

SEQ ID NO: 379040 - RNA, 64 nt, Human
gguggcucugagguggacaaagagcucucgcaagaagagacagcgugaugccucccacagucca

SEQ ID NO: 379041 - RNA, 64 nt, Human
aagguggcuuccggcacacuccccgcugccccggaagagacauccuuugacccucucagcaagu

SEQ ID NO: 379042 - RNA, 64 nt, Human
ucacugcugugagugcgccucaccagaaccaguuaagagacaacuaucaauucuugagacccaa

SEQ ID NO: 379043 - RNA, 64 nt, Human
ggacauggcucuggaaaauaacuuuuuuuuuuuuaagagacagggucuugcucuguuguccagg

SEQ ID NO: 379044 - RNA, 64 nt, Human
acccuucuuucuggcaccaccucuuucccuuuugaagagacagcaacagccguagcaaaagcag

SEQ ID NO: 379045 - RNA, 64 nt, Human
gaguagaaaaaucucauucccagagucagaggagaagagacauguaccuugaccaucguccuuc

SEQ ID NO: 379046 - RNA, 64 nt, Human
uaucacacaugggcacugggguugggcuaacagcaagagacaauaggccuuuguuccuauuuau

SEQ ID NO: 379047 - RNA, 64 nt, Human
gaaaucaaaguacucaggcacacagcccacugacaagagacaccucauccauuaacugcuguuu

SEQ ID NO: 379048 - RNA, 64 nt, Human
gagggaaccuguuagucuccccaccucuucccugaagagacaggcaccccucccagccgugguc

SEQ ID NO: 379049 - RNA, 64 nt, Human
aagaaaacaaagccccaugggcugccuugaaaucaagagacaauaacuuugaaccucagcaaga

SEQ ID NO: 379050 - RNA, 64 nt, Human
uuugcuucaagaugucagaaagucaaguucagcuaagagacacccagguccccagcuugcccug

SEQ ID NO: 379051 - RNA, 64 nt, Human
aacucauauuuuuccuuccuucacuguuguaguaaagagacauauuucaugaauggcauugaug

SEQ ID NO: 379052 - RNA, 64 nt, Human
agagaggcugugggaaucuucagaaccccccuguaagagacagacaugagagacaagcaucuuc

SEQ ID NO: 379053 - RNA, 64 nt, Human
uuuauuuauuuuuuucuuuugagagagugaaaggaagagacagauacuugaaacuuggugugug

SEQ ID NO: 379054 - RNA, 64 nt, Human
aaaauauaauauauuuuuuuaccaaucgguagagaagagacaguuuaauauuugugcugaaaau

SEQ ID NO: 379055 - RNA, 64 nt, Human
aagagaggcagagagggaaagaggcagagaaggaaagagacaggcagagaaggagagaggcaga

SEQ ID NO: 379056 - RNA, 64 nt, Human
agaacagggagcgaagcaaaaccacccggcccacaagagacaacagaguauucagaucgccaca

SEQ ID NO: 379057 - RNA, 64 nt, Human
cacuggugacuacagacguucucaggcuggccagaagagacaucuuggguuccuuggccucacu

SEQ ID NO: 379058 - RNA, 64 nt, Human
aaaaaaaaagagagagagagagaagaagaagaagaagagacacaaaucucuaccucccauguua

SEQ ID NO: 379059 - RNA, 55 nt, Human
ugaagcccuacucaauauaauaauaaagagacaaaagaggccagccacccaccuc

SEQ ID NO: 379060 - RNA, 64 nt, Human
gccccacccugcugagaaaacacuccgccacgugaagagacagaggaggauggcaggaguuacc

SEQ ID NO: 379061 - RNA, 64 nt, Human
auggaaagggagggaaagacaagaugcaacuaggaagagacacaccugaccagccccucccccc

SEQ ID NO: 379062 - RNA, 64 nt, Human
agaggaagagugagggauggagaaagggcagaggaagagacaugagaaagggagaggaagagaa

SEQ ID NO: 379063 - RNA, 64 nt, Human
acuuaccucccacccccucuccaauuuuuuuuuuaagagacaaggucuugcuauguugcccagg

SEQ ID NO: 379064 - RNA, 64 nt, Human
guuggcaguuuuggugccaaaccccaaaucuccaaagagacauaccaggcaagacaaaccccca

SEQ ID NO: 379065 - RNA, 64 nt, Human
acuaucuucauagaguuauggaguggcugccagcaagagacaguguucagauguggaugauauu

SEQ ID NO: 379066 - RNA, 64 nt, Human
acaacugugaacucacagugagcccuguggaaagaagagacagacagaguguggguuuguucgg

SEQ ID NO: 379067 - RNA, 64 nt, Human
cuuucucagccuccaggacacuauggccuguuuuaagagacaucuuauuuuucuaaaggugaau

SEQ ID NO: 379068 - RNA, 64 nt, Human
ccaauuuuacuugucuaccaccguguugugcucaaagagacacuacuugagugaagauuucuuc

SEQ ID NO: 379069 - RNA, 64 nt, Human
cucggggccacuggcggagccagccuguggauccaagagacaguccccaccugggcuucacggc

SEQ ID NO: 379070 - RNA, 64 nt, Human
acaguucccgcacggccugaacgcuucuuaggccaagagacaccaugcagagccuagucuguga

SEQ ID NO: 379071 - RNA, 64 nt, Human
cuggaggaagcggcauuguuaugagccuugaaggaagagacagacucugcuacauucaaccucg

SEQ ID NO: 379072 - RNA, 64 nt, Human
cacccccuggccccuggagugguggggccauggcaagagacaccguggcgucucaugugaacuu

SEQ ID NO: 379073 - RNA, 64 nt, Human
cugauaaaacagaauuuaaaccaacaaagaucaaaagagacaaggccauuauauaaugguaaau

SEQ ID NO: 379074 - RNA, 64 nt, Human
ggaggaggaggaggagaaggaggagagagaggggaagagacaaaguggguguguggccucccug

SEQ ID NO: 379075 - RNA, 64 nt, Human
gagacuaaguggaagugggaaaagaguacaagagaagagacaaaguggggauauuuguaaggcu

SEQ ID NO: 379076 - RNA, 64 nt, Human
gucucuugaccuuuuuuuuuuuuuuuuuuuuuuaaagagacagagucucacucugucacccagg

SEQ ID NO: 379077 - RNA, 64 nt, Human
guuggccguccccaggccucccagcgcaaacuucaagagacagggcuuugcugaaaaccaaaca

SEQ ID NO: 379078 - RNA, 64 nt, Human
cacagcgagacccugucucaagaaagaaaagaaaaagagacaaauuacccagaaaccccucccu

SEQ ID NO: 379079 - RNA, 64 nt, Human
gccaaacucagacacguggacagggauagacagaaagagacagaagcuggggcuacguccaugu

SEQ ID NO: 379080 - RNA, 64 nt, Human
gagaugcagucuuagaggcccuggacaccugacaaagagacagaguccccacuagcaucuccug

SEQ ID NO: 379081 - RNA, 64 nt, Human
gaagggcaaccauuaacagauuaaaagagacuuaaagagacauaucaacuaaauucaguauguu

SEQ ID NO: 379082 - RNA, 64 nt, Human
gaaauagauaugagauguaugaggauuugaaauuaagagacaaaauuaucauuuuugugauguu

SEQ ID NO: 379083 - RNA, 64 nt, Human
agcuuccucagccccccagaaggggagugucaggaagagacauuuaguucauuugccugcaaau

SEQ ID NO: 379084 - RNA, 64 nt, Human
guugaagcauuaauagauaugagaggccauaagcaagagacaucauguaaacauauguggcaga

SEQ ID NO: 379085 - RNA, 64 nt, Human
uaucguuuuugaaggagaucuuuuuaaaaccuacaagagacaucucucuaugccuucuuaaacc

SEQ ID NO: 379086 - RNA, 64 nt, Human
agugauguuuuuaugauaucccugauccuaacugaagagacaguuauuuauagucauuuauuuu

SEQ ID NO: 379087 - RNA, 64 nt, Human
aaagcauguauauaagagcacguuguaaacuugaaagagacaaaggcacaaauguggcuguuga

SEQ ID NO: 379088 - RNA, 64 nt, Human
ccccuagacuaggacuccagugcccuccucucccaagagacaaaggccauugcauugaaggagg

SEQ ID NO: 379089 - RNA, 64 nt, Human
guucccacccuccccugaacagaacccagcccauaagagacauucucagaugaaacucuguuuu

SEQ ID NO: 379090 - RNA, 64 nt, Human
agagugcgguacauaauuauauccgcaaauaaagaagagacaaaggcuugcgcggcccgguguc

SEQ ID NO: 379091 - RNA, 64 nt, Human
ucuacagaaaugauauaaaaacuauagucauaagaagagacaaucaaaaauaaucagccauaaa

SEQ ID NO: 379092 - RNA, 64 nt, Human
auuucaguaagcuguguggugaggcuaccaguggaagagacaucccuugacuuuuguggccugg

SEQ ID NO: 379093 - RNA, 64 nt, Human
uguauuauuuuuuuucagcauguauuacuugacaaagagacacugugcagagggugaccacagu

SEQ ID NO: 379094 - RNA, 64 nt, Human
uguuuguuuuuuguuuuucugcuuuagacuugaaaagagacaggcaggugaucugcugcagagc

SEQ ID NO: 379095 - RNA, 64 nt, Human
ugaaaauguucagaagguugcucuagauugagagaagagacaaacaccucccaggagacaguuc

SEQ ID NO: 379096 - RNA, 64 nt, Human
cacccugcgggaggccuccccaugugccugugccaagagacagacagagaaggcugcaggaguc

SEQ ID NO: 379097 - RNA, 64 nt, Human
cacccugcgggaggccuccccaugugccugcgccaagagacagacagagaaggcugcaggaguc

SEQ ID NO: 379098 - RNA, 64 nt, Human
agaguggaggguuugacgggccuggaggguauuaaagagacacagaagaagcugccuguccgag

SEQ ID NO: 379099 - RNA, 64 nt, Human
uuaucuauucugaacucuauuuuuuuucuuuuuuaagagacaagguuuugcucuguugcccagc

SEQ ID NO: 379100 - RNA, 64 nt, Human
accccuguguuucuuuggugguagcuuucuuuggaagagacaaacaagauaagauuugauuauu

SEQ ID NO: 379101 - RNA, 64 nt, Human
uaucuccagcucugauuaccuuugaaguguucagaagagacauugucuucuacuguucugccag

SEQ ID NO: 379102 - RNA, 64 nt, Human
cagccccacuucuaugcgaugucaucuuuucuaaaagagacaaaugaagccacagggaaaguga

SEQ ID NO: 379103 - RNA, 64 nt, Human
uuuaagucaaccaugauuucuccuugauuucuacaagagacaaagaaaugauuuugccuccugg

SEQ ID NO: 379104 - RNA, 64 nt, Human
uauaguguugauuucaccaaaaucagagggcugaaagagacacuucuauagacugcauccugag

SEQ ID NO: 379105 - RNA, 64 nt, Human
cacagcaccguuccgacagggaccagugaaagaaaagagacaaaguuagaacgugcuggggagc

SEQ ID NO: 379106 - RNA, 64 nt, Human
uuauuuaagauguguauugugucauaugaaguuuaagagacauaaauggcauuuuguuauuuau

SEQ ID NO: 379107 - RNA, 64 nt, Human
uucuuaaguaaguuuaaauuuacuacauauugugaagagacaggaucaaguucagaauccuuaa

SEQ ID NO: 379108 - RNA, 64 nt, Human
gaguugaucucggccagccaaagacacacgacaaaagagacaaucgauauaauguggccuugaa

SEQ ID NO: 379109 - RNA, 64 nt, Human
ccuugggccacccccaaguguugggccaucugccaagagacagcgacccaaagccgaaggacag

SEQ ID NO: 379110 - RNA, 64 nt, Human
caccaccuuuugcccccuucuguucugacuuuauaagagacaggauuuggauucuucagaaauu

SEQ ID NO: 379111 - RNA, 64 nt, Human
aacuuucccucuuccucucauugagggugaugacaagagacauccggggacugugcacuuacag

SEQ ID NO: 379112 - RNA, 64 nt, Human
uauuuuauauuuuuccccucaagaacuuuuuuuuaagagacagauuugccauccuccuuaauuu

SEQ ID NO: 379113 - RNA, 64 nt, Human
gaaaaacagucucauuacucauauacagcaggcaaagagacagaaaauuaacugaaaagcaguu

SEQ ID NO: 379114 - RNA, 64 nt, Human
uccagcucccuccccugcucagaaucugauaccaaagagacagggcccgggcccaggcagagag

SEQ ID NO: 379115 - RNA, 64 nt, Human
ggcaacaaagugagccccugucucuaaauaaauaaagagacaauaagccacucauucauucuuu

SEQ ID NO: 379116 - RNA, 64 nt, Human
uaguuaaaguaaaauucaguaacauuuucugaccaagagacauguuuuguuaaacaacaaaaag

SEQ ID NO: 379117 - RNA, 64 nt, Human
caucagucuuugaggaaggcuauucgguaccagcaagagacacaaguuucucuuacagauaccu

SEQ ID NO: 379118 - RNA, 60 nt, Human
auccaaaaauucauccaugacucagauucgaagagacagauuuuaucuuccuuucauuuc

SEQ ID NO: 379119 - RNA, 64 nt, Human
gauggaggaugaaccuauagauuuaaagagacuuaagagacauauuaaccaauuguuaauugga

SEQ ID NO: 379120 - RNA, 64 nt, Human
cacugcccaggccaagcaaaagcagagugugguuaagagacaagggucuaugucaucaucccuu

SEQ ID NO: 379121 - RNA, 64 nt, Human
gcauagcuggacuugauuaaguauugacucauagaagagacauguauguuucccggggcuaccc

SEQ ID NO: 379122 - RNA, 64 nt, Human
gagaaaauaccuuguuucaguauaacacuaaaccaagagacaauugauguuuaaugggggcggu

SEQ ID NO: 379123 - RNA, 64 nt, Human
gggacaaugauauuucauggucaguuuauuuuguaagagacagaagaaauuauaucuauacauu

SEQ ID NO: 379124 - RNA, 64 nt, Human
agucaauguggcaccaugagcuucaugguggcagaagagacaauaguccuuagcucuccuccca

SEQ ID NO: 379125 - RNA, 64 nt, Human
gauaggaggagaaaaacaauuacacacuaauuuaaagagacaguaucuuuuuuaaucaguucuc

SEQ ID NO: 379126 - RNA, 64 nt, Human
guacauaauugugaauucauaaguuaucucuggaaagagacaugagaaccugguaacccugauu

SEQ ID NO: 379127 - RNA, 64 nt, Human
ucauuuggaggaaucaccccauuucagaguuaucaagagacacuccccccuccauucccacccc

SEQ ID NO: 379128 - RNA, 64 nt, Human
uaagagaaaaagaaaccuacucaagaaaagacagaagagacagugauuugggaugagucuacuc

SEQ ID NO: 379129 - RNA, 64 nt, Human
cucuaagagugcacacacacgcacacaagaggguaagagacaagguucugauugugaaacagag

SEQ ID NO: 379130 - RNA, 64 nt, Human
uggaggcccagggaauagacccucaagagcccccaagagacaggagagacuccgaacuccauca

SEQ ID NO: 379131 - RNA, 64 nt, Human
aauuuuucugugauacaugaagacuuuccauaucaagagacaugguauugacucaacaguuucc

SEQ ID NO: 379132 - RNA, 64 nt, Human
aauguaauugggggcggcgggggaggagaggggaaagagacauucgcuugguuuagugaaacgc

SEQ ID NO: 379133 - RNA, 64 nt, Human
aaauugucccaugcaaauuacccuauaacuaggaaagagacacuauaacccaaaugccauaccc

SEQ ID NO: 379134 - RNA, 64 nt, Human; identical to SEQ ID NO: 379122

SEQ ID NO: 379135 - RNA, 64 nt, Human
ccacuuuugaccgucacacacauuucagcauuugaagagacacaggcuaccuggaaacugccca

SEQ ID NO: 379136 - RNA, 64 nt, Human
ccuaucccucugccccuacugcucagcaauguaaaagagacaaauaaggagaaagaaaaucucc

SEQ ID NO: 379137 - RNA, 64 nt, Human
cagugaaacugcagcugucaaaugaggaauugauaagagacacgaggugggacauacaauccua

SEQ ID NO: 379138 - RNA, 64 nt, Human
uggagaaacuuuguaugugcacacaaaaguauucaagagacaguauugcuaacaucucaucuua

SEQ ID NO: 379139 - RNA, 64 nt, Human
uaagcacccuaaaugccaugacagguguccuuccaagagacagaagaggagacacagacacaga

SEQ ID NO: 379140 - RNA, 64 nt, Human
aggcaggcccgggaaggcugcuguuuacucaucgggcagccacgugcucucuggaggaagugau

SEQ ID NO: 379141 - RNA, 64 nt, Human
aguaucacuuguuugggcccuagcgggacuccaaggcagccacacgccccuccuggaagggugu

SEQ ID NO: 379142 - RNA, 64 nt, Human
gccggcaccucugauguacagccagcagggcccaggcagccaccaagcccaccccaggucaugc

SEQ ID NO: 379143 - RNA, 64 nt, Human
cuccagaggcuaguggucacagacagcugggaauggcagccacagaggguccccucugggagaa

SEQ ID NO: 379144 - RNA, 64 nt, Human
cgguggcuggaccugacuguugugaaggccaaggggcagccagacuugccagaggggucucucc

SEQ ID NO: 379145 - RNA, 64 nt, Human
uuucuguuugugaauaaggccagcacucaagaugggcagccaagggugcacugacuauuagcug

SEQ ID NO: 379146 - RNA, 64 nt, Human
caagacacuugggaguuauuuacuguguuccucuggcagccaauaaaaucaucauaagcccuuu

SEQ ID NO: 379147 - RNA, 64 nt, Human
acgcaccccugcacuacuaugagaccguucgcauggcagccaucaaagagguucggggcugggu

SEQ ID NO: 379148 - RNA, 64 nt, Human
gugcuauucugugaaacuaaucauaagcugccuaggcagccagcuacaggcuugagcuuuaaau

SEQ ID NO: 379149 - RNA, 64 nt, Human
gaagagucuauacuaaguucuuggugcccucuucggcagccaagggugaaggccccauagagga

SEQ ID NO: 379150 - RNA, 64 nt, Human
ugggguaaucuuuaucccuuuuguuaaaacaggaggcagccaugggcugggagaucauagcccu

SEQ ID NO: 379151 - RNA, 64 nt, Human
acuuuucuuucuuuccuucuuauuuuguuaugcuggcagccauuugccccugcaugguauggga

SEQ ID NO: 379152 - RNA, 64 nt, Human
ugggaauccuguccugccucgaaggagcagccugggcagccaucacaccacgaggacaggaagc

SEQ ID NO: 379153 - RNA, 64 nt, Human
cgggaaaacauggagaauuaagucagauaaugcuggcagccaaaggggcaaaauggccugugac

SEQ ID NO: 379154 - RNA, 64 nt, Human
uccucauucauauuauguugauacaaaagaccuuggcagccauuucucccagcaguuuuaaagg

SEQ ID NO: 379155 - RNA, 64 nt, Human
augucccagguccaggaaauccaauguuggugaaggcagccacucucuugcuuguccccaaauc

SEQ ID NO: 379156 - RNA, 64 nt, Human
gugguggggugggcucucccuuaggcuugggcaaggcagccaccugcccuugcucucccuuagu

SEQ ID NO: 379157 - RNA, 64 nt, Human
accuucauggaccaacagugauugaggauuugugggcagccagagggagucugacugaaguuua

SEQ ID NO: 379158 - RNA, 64 nt, Human
ccuguggaguggcugcucuguaccgugggcauccggcagccaggaagugagacaacauaauuau

SEQ ID NO: 379159 - RNA, 64 nt, Human
uagccgguggccucaggcagacucugcccagaggggcagccaggcugcucagggaaggggcuga

SEQ ID NO: 379160 - RNA, 64 nt, Human
cuucucgagcuacgagaccuucacagagacacguggcagccacacucacccagccucuuuauuu

SEQ ID NO: 379161 - RNA, 64 nt, Human
guccauagcuuugguugggccugugucacauccaggcagccauguggagggagucagggucugu

SEQ ID NO: 379162 - RNA, 64 nt, Human
guuacgugaggccugucucucggggccuggaaguggcagccaucaguugcucuugcugaccccu

SEQ ID NO: 379163 - RNA, 64 nt, Human
ucaggacccaggcccuccaugggcuagugugaguggcagccaugccucaugccacaccuucuuc

SEQ ID NO: 379164 - RNA, 52 nt, Human
ugggggaggcuccugugugaugggcagccauggccuaggaccccaccuccau

SEQ ID NO: 379165 - RNA, 64 nt, Human
uggacuuagaucuucgguggccucauguaaacguggcagccagccucuucuagaacccuagccc

SEQ ID NO: 379166 - RNA, 64 nt, Human
ccaaggccccucucccugagugaggccagguguuggcagccaacugcuccaaucugccuccuuc

SEQ ID NO: 379167 - RNA, 58 nt, Human
uucggaugaugcuucgauagggcacucuggcagccagugcccuuaucucuccuguaca

SEQ ID NO: 379168 - RNA, 64 nt, Human
caugccaguaccugccuggggguggggggugccuggcagccaugaagcaggcugaaaggcagag

SEQ ID NO: 379169 - RNA, 64 nt, Human
ucugccaacuguggaaacuucagucccucaggcuggcagccaugccaguaccugccugggggug

SEQ ID NO: 379170 - RNA, 64 nt, Human
cucaacagaugguuucaguggcucaggagguaguggcagccaugguucaucuguggguguucag

SEQ ID NO: 379171 - RNA, 64 nt, Human
cagggcuccccaaccugaguuggguuacuucaagggcagccagcaggccuggauggaggccuag

SEQ ID NO: 379172 - RNA, 57 nt, Human
gcaugcucaaggacuccuagggcugguggcagccaggauucuggcccagggcgccuc

SEQ ID NO: 379173 - RNA, 64 nt, Human
ugggaaagggcaaccucccuuucacugcuccaguggcagccauggggaaggcaguuugugaggg

SEQ ID NO: 379174 - RNA, 64 nt, Human
cgugccgaaggagcucugccagugggccugggcaggcagccacagagggcauguuaucugcuaa

SEQ ID NO: 379175 - RNA, 64 nt, Human
auggugaagccuccugacccuccccgcugugguuggcagccacccaccccagaggcuggcagag

SEQ ID NO: 379176 - RNA, 64 nt, Human
ccuuggaucaacgaaaaucagaggauucuggaaaggcagccaacuugcgccucuuagaaggauc

SEQ ID NO: 379177 - RNA, 64 nt, Human
gagcgcugggcuguuuuagugccaggcugcggugggcagccaugagaacaaaaccucuucugua

SEQ ID NO: 379178 - RNA, 64 nt, Human
cccaucaguauaaggcaagcaaaagucuuaacauggcagccauucugccuuugccguggcccug

SEQ ID NO: 379179 - RNA, 64 nt, Human
aggacagcucuuccccacccugggaucucaggagggcagccacggaguggggaggccccagaug

SEQ ID NO: 379180 - RNA, 64 nt, Human
cuucgucauaauguuaagggagaugcuaguguguggcagccaugaaaaguuacacauacacacc

SEQ ID NO: 379181 - RNA, 64 nt, Human
guggggcugacuccagaucucuccugcccucccuggcagccaggaccagcaccuguagucaccc

SEQ ID NO: 379182 - RNA, 64 nt, Human
guuaagguuugggcaggagcagaacucuguggcuggcagccacuauucucaguuacaccuccca

SEQ ID NO: 379183 - RNA, 64 nt, Human
uucuaagccuuuuggguaugauuagagugaaaauggcagccagcaaacuugauagugcuuuugg

SEQ ID NO: 379184 - RNA, 64 nt, Human
uaauuugaagggccuccacucaggcuccaaauguggcagccaaagagaacaauccagggaaccu

SEQ ID NO: 379185 - RNA, 64 nt, Human
caccgagcugucacaucagcaaauauguagucaaggcagccaggccaacuagaccacacuuauu

SEQ ID NO: 379186 - RNA, 64 nt, Human
gaggaugggguuaggcuucaugccuucaugcccaggcagccacagaaacccacucuuccccgcc

SEQ ID NO: 379187 - RNA, 64 nt, Human
ccuagaaggugagaagcagauuuuaaccccaucuggcagccauucaaggaaaacccagcccugg

SEQ ID NO: 379188 - RNA, 64 nt, Human
ccagcucuggcugggguccgugaagcccaggccaggcagccaaaucuugccugugcugggcaua

SEQ ID NO: 379189 - RNA, 64 nt, Human
aguccuggguguggcugcucuggaagaauuaggaggcagccauaauaagagucuucagagagau

SEQ ID NO: 379190 - RNA, 64 nt, Human
caggccaccugccaggguucucuggcaucacgcuggcagccauuagacacacagggggguuucu

SEQ ID NO: 379191 - RNA, 64 nt, Human
cccgacgacagguggcaacaaugccccgagugguggcagccaggagagcagcgcagaacagccc

SEQ ID NO: 379192 - RNA, 64 nt, Human
cugcggcugcagguagcgcgagggccggggagggggcagccacgcggccgaggauccccagcug

SEQ ID NO: 379193 - RNA, 64 nt, Human
aguuaauucaacagcaccauguuagaaauauauuggcagccaagacucugaacucugcagaaac

SEQ ID NO: 379194 - RNA, 64 nt, Human
auaagagaacgugccaucuguaaagcacucagaaggcagccaucccuagauguugguuucaugu

SEQ ID NO: 379195 - RNA, 64 nt, Human
agcucccuacaaguucguuuacaccuggcagcacggcagccacacaccgguauuccaaaccuua

SEQ ID NO: 379196 - RNA, 64 nt, Human
gaagucaaauaauacauuccaccuggcagcugaaggcagccagucagucugucccagaaagggc

SEQ ID NO: 379197 - RNA, 64 nt, Human
ugguccagaccagcccugcagcccccacucagccggcagccagauggccccgcaaggccuccag

SEQ ID NO: 379198 - RNA, 64 nt, Human
cagauccccacaugggaggagauucccaaguagaggcagccagaauucugacucccuggcagca

SEQ ID NO: 379199 - RNA, 64 nt, Human
ucacugugacccacccccaugggcccccgucccaggcagccagcaccaugggcaggcccugcca

SEQ ID NO: 379200 - RNA, 64 nt, Human
ucuuaggucccgggaggaacgugguucagagacuggcagccagggagcccggggcagagcucag

SEQ ID NO: 379201 - RNA, 64 nt, Human
auuaggccacaguacagugauccaaggcaggcaaggcagccaggacaggggagcccgaccccag

SEQ ID NO: 379202 - RNA, 64 nt, Human
cagauagguucugcaguguuaccugucacuuggaggcagccaacacuucuggacauugcauccu

SEQ ID NO: 379203 - RNA, 64 nt, Human
agcaucaauucccuugauccagcccaagagaccaggcagccauggccacugccuuccucucuga

SEQ ID NO: 379204 - RNA, 64 nt, Human
auguaauucuuuacaaugacuuuauuuauuaaagggcagccaguugucauuuuuacaggauugu

SEQ ID NO: 379205 - RNA, 64 nt, Human
cacccugucugggaagugaggagcgucuccgcccggcagccacccaguccgggagggagguggg

SEQ ID NO: 379206 - RNA, 64 nt, Human
ccugugccagguucccugugcccuccucgaggugggcagccaucaccagccacaguuaagccaa

SEQ ID NO: 379207 - RNA, 64 nt, Human
ucagaagaccugugcaggcuggcgugagaggagcggcagccacacugcggccccacgcccaagg

SEQ ID NO: 379208 - RNA, 64 nt, Human
ggagagacaagccaguccuaagagaaaaggugguggcagccacaaauucuagguacacuggcug

SEQ ID NO: 379209 - RNA, 64 nt, Human
gucaggcugcccauccaauagacuccugggauggggcagccaacccuggcucaucucaucugcc

SEQ ID NO: 379210 - RNA, 64 nt, Human
cacugcucauuguauaagccccgaggccuagaguggcagccaagagccaucugaagccaccucu

SEQ ID NO: 379211 - RNA, 64 nt, Human
ucaccagacuagccauugcugcagugugggccgcggcagccaagaguggagagcgggagacgaa

SEQ ID NO: 379212 - RNA, 64 nt, Human
acuuacuagagcuccacuaacagucucauaaggaggcagccaucauaaccauugaauagcaugc

SEQ ID NO: 379213 - RNA, 64 nt, Human
gguugcugcuccccggcuuucacagacaugguauggcagccauucuuuuaucuauuuaaccaag

SEQ ID NO: 379214 - RNA, 64 nt, Human
ccuggguagccaguuuggggagugggcugcaaggggcagccagcagcucccacuggugugucac

SEQ ID NO: 379215 - RNA, 64 nt, Human
ugucacuccugcuuuccuaacuccugcaguccaaggcagccaugaaucuacuuucuauguaaga

SEQ ID NO: 379216 - RNA, 64 nt, Human
ggugacauggaaucuuggagcagccuugugcaguggcagccaguggcuuccugaacgugccucu

SEQ ID NO: 379217 - RNA, 64 nt, Human
caucuuaauccuuaacaagacagcacuccagauaggcagccacgaccccaaaggugaggauaau

SEQ ID NO: 379218 - RNA, 64 nt, Human
ugaaaggaggaucagaaugcuuugggauuaauugggcagccaucgcagaauuguuugugggcaa

SEQ ID NO: 379219 - RNA, 64 nt, Human
uggugccugaauucuuucuuuucgccgacacgauggcagccaaacugcagcuucaaacgcucac

SEQ ID NO: 379220 - RNA, 64 nt, Human
gagccaccgugccauccugugcugugcucaagcgggcagccagggcugaagaacaaacucuugc

SEQ ID NO: 379221 - RNA, 64 nt, Human
caucccccucagagugggcacaagugcccucuagggcagccaggggaauacuauuguucgauac

SEQ ID NO: 379222 - RNA, 64 nt, Human
uuugguuuuguuucuccuggggcuguguucugcaggcagccagaaaaggaggaggcacggguga

SEQ ID NO: 379223 - RNA, 64 nt, Human
gcagggaacgcaugauucagggaugcugucacucggcagccagauuccgaaacucccauucucc

SEQ ID NO: 379224 - RNA, 64 nt, Human
aagagcagacguaaccccugccccaccucagcccggcagccagcgagguacaccagguggugcu

SEQ ID NO: 379225 - RNA, 64 nt, Human
uacugccgagucugggggcuuguuuugguuugggggcagccauccuccaccagaaagggggagc

SEQ ID NO: 379226 - RNA, 64 nt, Human
uucuucauucuaucaagcccaggugccagccugaggcagccacuucggccaggucacacgaccg

SEQ ID NO: 379227 - RNA, 64 nt, Human
acugagggacucugaagccucugggaaaugagaaggcagccaccagcgaaugcuaggucucgga

SEQ ID NO: 379228 - RNA, 64 nt, Human
cacuauggccccagugccuugaggcccaggccagggcagccaguggcucuagcucagggaaagc

SEQ ID NO: 379229 - RNA, 64 nt, Human
gaagccaugaggaccuggccuucugcccgacccaggcagccauucaaguugagcaauggccacu

SEQ ID NO: 379230 - RNA, 64 nt, Human
gccgggcacccuacagaaacucagagggcagaguggcagccaggcccacaugucucucaaguac

SEQ ID NO: 379231 - RNA, 64 nt, Human
ugaaauuuaauuacaaacaauaagaacaaguuuuggcagccaugauaauaggucauauguugug

SEQ ID NO: 379232 - RNA, 64 nt, Human
cauuauuucuaaacagaaccuagcacagugcuugggcagccaauaggcauuaaucaguaucuau

SEQ ID NO: 379233 - RNA, 64 nt, Human
gcugagcggcugcccuugggugacaccuccgagaggcagccagacccagagcccucugagccgc

SEQ ID NO: 379234 - RNA, 64 nt, Human
ugaaagccucaggcugcuuccauucauagcaaagggcagccagugugugcagaaaucaaaugac

SEQ ID NO: 379235 - RNA, 64 nt, Human
ccuuauugaagcuaaggggugcuuacuaaaaggaggcagccauauaggccuuuuaaaggccugg

SEQ ID NO: 379236 - RNA, 64 nt, Human
agacuccccaagugggacagggagccccugggagggcagccagugaggguggggugggacugaa

SEQ ID NO: 379237 - RNA, 64 nt, Human
aaaaaggcaggaaaaugaucaucagaaacuaaauggcagccaggcaugggggcucacaacugua

SEQ ID NO: 379238 - RNA, 64 nt, Human
ugaggacuccaucugcuccgggaagccagcccagggcagccagcucaaccacuucuaccagaag

SEQ ID NO: 379239 - RNA, 64 nt, Human
ugacuggugguagaacuccaguucuguggcaaggggcagccacaccauuucucucucauugacu

SEQ ID NO: 379240 - RNA, 64 nt, Human
gucacacccaagugguccaguaucucaauggugaggcagccagacuggucagggcugcuuuguu

SEQ ID NO: 379241 - RNA, 64 nt, Human
ccgcccccucuccccuucccuggcuguggacacuggcagccaauggggaggcggccucuccccu

SEQ ID NO: 379242 - RNA, 64 nt, Human
gaacuagagccccaaccacagcagaugcuuccugggcagccacuggccaggccguuguauccau

SEQ ID NO: 379243 - RNA, 64 nt, Human
gugauagggccacccuggaugggaagaccuggagggcagccacacagcuggacggaugcugcca

SEQ ID NO: 379244 - RNA, 53 nt, Human
cucugcacuaugagcugugacaaggcagccacccugucaccuagcucaaugga

SEQ ID NO: 379245 - RNA, 64 nt, Human
gugcccuuugucagacccuaccacagccuggauaggcagccacauugguccucgcccuugcucg

SEQ ID NO: 379246 - RNA, 64 nt, Human
gcucccagguauuuucuacaggaccacuugagugggcagccaagcccaggcucgcaguaucaau

SEQ ID NO: 379247 - RNA, 64 nt, Human
uuuucaauccccagggucggguaggaccccuacuggcagccagccucuguuucugggaggauga

SEQ ID NO: 379248 - RNA, 64 nt, Human
caccuugcuaucugcaccaggaggcucuccaccuggcagccagagguccccagugggccgggcu

SEQ ID NO: 379249 - RNA, 64 nt, Human
aacguauuuaauuccaggccuccgcuucuccuggggcagccaguuuuaaccccagccugucacc

SEQ ID NO: 379250 - RNA, 64 nt, Human
ccauaccacccuugguacugugaaaaggcuucuuggcagccagguggcauugaggaugguauuc

SEQ ID NO: 379251 - RNA, 64 nt, Human
caaccuggagaucuaguccuaagccacacaccugggcagccacuucauauaaagguuacuccag

SEQ ID NO: 379252 - RNA, 64 nt, Human
gaggcaaaucaguauucccaaggauggcgacaagggcagccaagcagggcuuaggauaucccag

SEQ ID NO: 379253 - RNA, 64 nt, Human
aaccugagcucuuccuaaguagauccaggccuguggcagccaaggccaagcaggcccaucucac

SEQ ID NO: 379254 - RNA, 64 nt, Human
ccagccccgccugcuuagucagccccggcagcagggcagccaugggaacucaggaaaagcagga

SEQ ID NO: 379255 - RNA, 64 nt, Human
cgguuuccgccccucccuuccugggguguggaaaggcagccagaccucuuuuucagaaguuguu

SEQ ID NO: 379256 - RNA, 64 nt, Human
caguguugaguccuccauugaggaugcccacugaggcagccaggccccucaccagcccuggggg

SEQ ID NO: 379257 - RNA, 64 nt, Human
guucuuuuuuuuucuuuuuuuuuucuuaaagaagggcagccaagguaguaaccuaaaaauagug

SEQ ID NO: 379258 - RNA, 64 nt, Human
ucaauuguuuuagaaucuuuuuaucuuagauguaggcagccaugaacaaucuauuuugagccac

SEQ ID NO: 379259 - RNA, 64 nt, Human
agggugcgguggaacugcaggcccugcagaugacggcagccagcugcuuccaggaaccaggugu

SEQ ID NO: 379260 - RNA, 64 nt, Human
cauuagccuggauccucaguucucaaauguguguggcagccaggaugacuagauccuggguuuc

SEQ ID NO: 379261 - RNA, 64 nt, Human
uuuugaguacuuugugaucuugcugaagacuacaggcagccaaaugguuccagauacuucagcu

SEQ ID NO: 379262 - RNA, 64 nt, Human
ucugcauggaaggcugggaaauguugaucgguagggcagccauauguguaggaaggagaaaaca

SEQ ID NO: 379263 - RNA, 64 nt, Human
uuuuggcaguuggauaggaaaugagacauucuuuggcagccaaaauaagagaggccgaugguga

SEQ ID NO: 379264 - RNA, 64 nt, Human
aguuccaagggaggaccaauaggucuuuuuauuaggcagccagaauguagugaaggacaauuua

SEQ ID NO: 379265 - RNA, 64 nt, Human
guauuuuuuuuaaguuccacagauuuuucuguugggcagccaaggauuauaaaccacuucccua

SEQ ID NO: 379266 - RNA, 64 nt, Human
cagggcagguaaccacaggaggaggcaugcccgaggcagccaggacugggcgggaaggugcucc

SEQ ID NO: 379267 - RNA, 64 nt, Human
cuggccuaggcgaggguuccagguuucagacacuggcagccaaugaagacugugcucgcugggu

SEQ ID NO: 379268 - RNA, 64 nt, Human
gcuguccucccaucuccugugggcagccccucccggcagccagggcuuccuggaggcgaugcag

SEQ ID NO: 379269 - RNA, 64 nt, Human
acuguaauuugcuuugcaaucaaacugcuuuuagggcagccaauauuuuauuauuggaauucag

SEQ ID NO: 379270 - RNA, 64 nt, Human
aauccaugagcuuccuuuauuucuggcucacagaggcagccacgaggcacuacaccaaguauua

SEQ ID NO: 379271 - RNA, 64 nt, Human
uuaagacuuuuugccuauuucuuguauaaguuaaggcagccauaaaugaaaauacaaaacaaac

SEQ ID NO: 379272 - RNA, 64 nt, Human
acaagugccuugugagaaaagcuggagaagugagggcagccagguuauucucuggagguuggug

SEQ ID NO: 379273 - RNA, 64 nt, Human
gaccagacuuucuaaaucuuacaacucaagagguggcagccacccucuaggagacaaaacuacc

SEQ ID NO: 379274 - RNA, 64 nt, Human
ggacccuucccacuacauaauagggcucagcccaggcagccagcuuugggcugagcuaacagga

SEQ ID NO: 379275 - RNA, 64 nt, Human
ccgcagaccuggcgcccccgccuuggcuccugggggcagccagcccuggcugggagagcgggag

SEQ ID NO: 379276 - RNA, 64 nt, Human
ugaaaucugacucucagguuagcuggaguuacaaggcagccaacaaugauuauacacaaucugc

SEQ ID NO: 379277 - RNA, 64 nt, Human
gcuugagucccagauacacucaugggcugcccugggcagccagcauucauuguaaguucccucu

SEQ ID NO: 379278 - RNA, 64 nt, Human
auggcccccacugugaaggccacgccugugggugggcagccaccuggugccaccacagggcacc

SEQ ID NO: 379279 - RNA, 64 nt, Human
gaagccuccaggagcagcaauccuaagagugggaggcagccaagacccccuuccuucaaaaccu

SEQ ID NO: 379280 - RNA, 64 nt, Human
cacagcauuauucuagugcuguacuguuccguacggcagccacuacccacauguaacuuuuuaa

SEQ ID NO: 379281 - RNA, 64 nt, Human
ccauuucugggagcugcccgagaucacuggagaaggcagccagcagcagcugcacuggaacagu

SEQ ID NO: 379282 - RNA, 64 nt, Human
gacgugagaugccugcgccagccccgagcccacuggcagccacugccauuccacccaugguccc

SEQ ID NO: 379283 - RNA, 64 nt, Human
ccuuucccaaucaauuccucuaccccuagcccuaggcagccacagauuugcuuuugguuaccga

SEQ ID NO: 379284 - RNA, 64 nt, Human
ggccccccgcccccuccucugccugcugcguggaggcagccaugggaaggagcccaggggagcu

SEQ ID NO: 379285 - RNA, 64 nt, Human
accuaggggcagggcugggguggggaccgcagggggcagccagggcuggggaacacugugaaag

SEQ ID NO: 379286 - RNA, 64 nt, Human
acgggccgcaggagggaggcggggaggaggaacgggcagccacaggacugagcccucucacucc

SEQ ID NO: 379287 - RNA, 64 nt, Human
agcagccucccccucauggagagucagcagcuugggcagccacuuccaggccagggugguggcu

SEQ ID NO: 379288 - RNA, 64 nt, Human
aucuuguuaaagauuucaaauaaagguacuucugggcagccaggcugcacagcauuugcuuucc

SEQ ID NO: 379289 - RNA, 64 nt, Human
gaccuuggcacaccgucagcucgaacucaacacuggcagccaccgucucaccccugcggaggag

SEQ ID NO: 379290 - RNA, 64 nt, Human
gugaguuuguaugaguuuguaccggagugaccccggcagccacugcccaccuccccucuaccca

SEQ ID NO: 379291 - RNA, 59 nt, Human
aggacuuugugaccaaauagucuacaggaggcagccauuuggaagguuagucuuggguc

SEQ ID NO: 379292 - RNA, 64 nt, Human
ucuuccaggggugaggcauguggugcuggggauuggcagccauccuggggcccacacaggugug

SEQ ID NO: 379293 - RNA, 64 nt, Human
cauggugcagggagacaucugcaccccugaguugggcagccaggagugcccccgggaauggaua

SEQ ID NO: 379294 - RNA, 64 nt, Human
cugcaaugccgccgauaugauggcugggagcucuggcagccauacggcaccaugaaguagcggc

SEQ ID NO: 379295 - RNA, 64 nt, Human
augcccuagugguggcccagcuggcuggaguccaggcagccaaggugaccagccagcugauccc

SEQ ID NO: 379296 - RNA, 64 nt, Human
cagguuucugugguucaguagcccagaccuguuuggcagccauuucuagcaggggcggggccuc

SEQ ID NO: 379297 - RNA, 64 nt, Human
uucugcucaucaggggacacgcucccuuacucauggcagccauguuugauugucacagagcccc

SEQ ID NO: 379298 - RNA, 64 nt, Human
uuggcuccaggucuaauuuuucacuguggucccuggcagccagucuuuugaaguuuaaagauua

SEQ ID NO: 379299 - RNA, 64 nt, Human
ccaggucccgaaagaugcagugacuuuuugucguggcagccaguggugacuggauugaccuacu

SEQ ID NO: 379300 - RNA, 59 nt, Human
acuccagcggcagccacuagaccgcgcccggcagccacccaccccacgugccaacuucc

SEQ ID NO: 379301 - RNA, 64 nt, Human
gcccucgaggcucgaugccugugccaaggccaggggcagccagagggcagcuggauggccacgu

SEQ ID NO: 379302 - RNA, 64 nt, Human
guuaacaugaaaacccaguaagacuuuccaucuuggcagccauccuuuuuaagaguaaguuggu

SEQ ID NO: 379303 - RNA, 64 nt, Human
aggcuaaccggccucuuucccaacacuuaaucauggcagccaggaugggugaaugaugaaagcu

SEQ ID NO: 379304 - RNA, 64 nt, Human
gcuggccccggcguuucaugaagucagaaggccuggcagccauuuccuggacguugagaggauu

SEQ ID NO: 379305 - RNA, 64 nt, Human
ugaauuuucccaugguguucugacuucaagggcuggcagccagggagaaugggcccaggggaag

SEQ ID NO: 379306 - RNA, 64 nt, Human
ugggggaguggaagggagcucccagcgcagccguggcagccaccuuccaggagcaggggcugga

SEQ ID NO: 379307 - RNA, 64 nt, Human
aggacggggaaccggauuacgugaauggggagguggcagccacagaagccuagggcagaccaag

SEQ ID NO: 379308 - RNA, 64 nt, Human
aguaugaaggauucucucuccugagauuguagcaggcagccaaacauuuucaaaugaugcccaa

SEQ ID NO: 379309 - RNA, 64 nt, Human
cagcccaccccacccucccugggcagggucuugaggcagccacugugaugcucauaccuuaccu

SEQ ID NO: 379310 - RNA, 64 nt, Human
gugaugucagaauucuucccagcacaguguucugggcagccaguaccaaucaauuuggcacuca

SEQ ID NO: 379311 - RNA, 64 nt, Human
augaaggcuuuuggucucccugggaguggguggaggcagccagggcuuaccuguacacugacuu

SEQ ID NO: 379312 - RNA, 64 nt, Human
ugcuucauuuuugggagaaaacuucucacacuauggcagccauccaugagaguuucaaagguua

SEQ ID NO: 379313 - RNA, 64 nt, Human
ccagcucuccagccuggcaggaaagagggggugcggcagccaagggggacugcaagggacaggg

SEQ ID NO: 379314 - RNA, 64 nt, Human
aacagcuugaccagaccuagaccugggccaaaagggcagccaggggcugcucaucacccagucc

SEQ ID NO: 379315 - RNA, 64 nt, Human
ucaggccaagagccaacgcugugggaggccggucggcagccacucccuccagggcgcaccugca

SEQ ID NO: 379316 - RNA, 64 nt, Human
guuugucuuggguauagggaagccuuccuugucaggcagccaacucccagcccuguucacacaa

SEQ ID NO: 379317 - RNA, 64 nt, Human
aggguguauuuguaaacuucggcccccaggccuuggcagccagggacacacugaaauccccaug

SEQ ID NO: 379318 - RNA, 64 nt, Human
cacgugggugucacgugucccagaugcaguauucggcagccagccggggagggcuaccuccucc

SEQ ID NO: 379319 - RNA, 64 nt, Human
ugagugugcgucuguacgggaagaggcagagggaggcagccagcggggcgugaugcagugugca

SEQ ID NO: 379320 - RNA, 64 nt, Human
aaagcacaggugucucccacuuugcaaccuauguggcagccaugagggccaucaacaucgcaga

SEQ ID NO: 379321 - RNA, 64 nt, Human
ccccagccacaggccaaauccuuggagucccaggggcagccacaccacugccauuacccagugc

SEQ ID NO: 379322 - RNA, 64 nt, Human
gcagggaaccaugaaacagaaacagcaagauggaggcagccagacaccaaacugggaacucaga

SEQ ID NO: 379323 - RNA, 64 nt, Human
agaaaaaauuuaaagcuccccagagcaaggccuuggcagccagcuuuucagagggaaaagaagu

SEQ ID NO: 379324 - RNA, 64 nt, Human
agcccggacccccagccccugggcuguaggccagggcagccacagcggcguggaccgagggucc

SEQ ID NO: 379325 - RNA, 64 nt, Human
ggaaccuucuuggagaccccuuugaagaaaaccaggcagccaagggagccaaacacacuagauu

SEQ ID NO: 379326 - RNA, 64 nt, Human
cgcgaugucaaaggucgggacagcugugccgggaggcagccacagggaagcucacacauccugu

SEQ ID NO: 379327 - RNA, 64 nt, Human
cugucugucugcuccuccuagcccuuggucagauggcagccagagucccucaggaccugcagcc

SEQ ID NO: 379328 - RNA, 64 nt, Human
gccccugagccuggcgggaaguggcugcggcccaggcagccaguccuggugguguucucccugc

SEQ ID NO: 379329 - RNA, 64 nt, Human
cucaaaucccccucuggcucuuguucuuugguguggcagccaucucuccucccagggguccuga

SEQ ID NO: 379330 - RNA, 64 nt, Human
gagaagcuggggaggagcuuuguuuugggggucaggcagccagugagaugagggaugggccugg

SEQ ID NO: 379331 - RNA, 64 nt, Human
cgggacccacaauggcccgagcccucuuugcaugggcagccagcuggacuaggagugggaaggg

SEQ ID NO: 379332 - RNA, 64 nt, Human
uuuugagaaguaauuguucacucuuuacuuuugaggcagccauuagguugaaaguauauauuua

SEQ ID NO: 379333 - RNA, 64 nt, Human
cugcagcucaggcaccaagaaaacagccgauacuggcagccauugcagcuccaaacugcagagg

SEQ ID NO: 379334 - RNA, 64 nt, Human
aggagcagugguggcuggcgcgcuuucgcacuguggcagccacgagagucugugcacgucugug

SEQ ID NO: 379335 - RNA, 64 nt, Human
gugcugcagguucuacucuguuccuggcccugccggcagccacugacaagaggccaguguguca

SEQ ID NO: 379336 - RNA, 64 nt, Human
cauucuucaucauggaaagccacaagccucagaaggcagccagaggacaggaagagucugugau

SEQ ID NO: 379337 - RNA, 64 nt, Human
ucuguucguaggaugaugugcagccugucacaguggcagccacaggcauucaguuugugggcau

SEQ ID NO: 379338 - RNA, 64 nt, Human
ucuuuauguugggacacagaccacauauuuggacggcagccaugcauccaucgcugaagggcug

SEQ ID NO: 379339 - RNA, 64 nt, Human
caugccuagcaucugcuugaguuauaaaccccaaggcagccaugucauagacuaguguuuacuc

SEQ ID NO: 379340 - RNA, 64 nt, Human
caugucagauccccaggugcugcaccugcagggaggcagccaggacggccggcugccccgcacc

SEQ ID NO: 379341 - RNA, 64 nt, Human
uccagagaacucagauugcacagagcuagacucgggcagccagagcggcgagcugaguaacagg

SEQ ID NO: 379342 - RNA, 64 nt, Human
cgguguacucuguaaacgggaggagguggggcgaggcagccagagcccuuggacuggcacaggg

SEQ ID NO: 379343 - RNA, 64 nt, Human
ggcaaaaggcaucgggaagcaggagcaucuucuuggcagccaggcugggccaucuucuccugga

SEQ ID NO: 379344 - RNA, 64 nt, Human
aaaggagggccuugaggaagcagcccccaggccuggcagccacgcagcggcugagcucaugaac

SEQ ID NO: 379345 - RNA, 64 nt, Human
ugcuggguacuucugagcccuugggauucaaaguggcagccauggggccacuguugugggcuuu

SEQ ID NO: 379346 - RNA, 64 nt, Human
cgaccccagcccccagccucagccccgguccgggggcagccaggccucucggguucucucuuuu

SEQ ID NO: 379347 - RNA, 64 nt, Human
ccucccucagaggccauggggugagaggggcucaggcagccaaggaggcccaggcgugcucccu

SEQ ID NO: 379348 - RNA, 64 nt, Human
ucuaacugcccccuacuggugucuggggguugggggcagccaggcacagccggcucacggaggg

SEQ ID NO: 379349 - RNA, 64 nt, Human
guggcucccagggcagagccucuccuuguacuuuggcagccauagaaagcgugcucauuuucug

SEQ ID NO: 379350 - RNA, 64 nt, Human
cauugguuugugaggccuaaggugaagcacuccuggcagccacacuguguaguguauuugaggg

SEQ ID NO: 379351 - RNA, 64 nt, Human
gcgguggaggcggccuugccgguggugcuuucugggcagccagggguuccugggugggaggacu

SEQ ID NO: 379352 - RNA, 64 nt, Human
cuuccaugcugccugcuguguuccagaucacagaggcagccaaggcucaggaaaaacuggggcu

SEQ ID NO: 379353 - RNA, 64 nt, Human
ccuccacuggauccccuucacacgugacccguggggcagccaguccucccagggacuacauaac

SEQ ID NO: 379354 - RNA, 64 nt, Human
agcuccugccacauggagcccccucugccggucgggcagccagcagagggggaguagccaagcu

SEQ ID NO: 379355 - RNA, 64 nt, Human
acugacagaccccaggaccagcccuggggcucagggcagccaccccgggccgcugaccgacuga

SEQ ID NO: 379356 - RNA, 64 nt, Human
gcaaccaaguugggggugguuuccuuccucuucaggcagccaggcccauggcuggaaggccggg

SEQ ID NO: 379357 - RNA, 64 nt, Human
ccuuccucugugggagcagacccgugggccucagggcagccagcaggcaggucuuguugccaau

SEQ ID NO: 379358 - RNA, 64 nt, Human
cuuccacagcuguucaguuugucggucucuuugaggcagccaccgucccugagggccccugcac

SEQ ID NO: 379359 - RNA, 64 nt, Human
aggcuacggggaggacugagaggacagggcuggaggcagccaaguaacguagucauaucaucgc

SEQ ID NO: 379360 - RNA, 64 nt, Human
gacgagagacagcccacccccagccugcaagagaggcagccagaggccagguaucugcuggccg

SEQ ID NO: 379361 - RNA, 64 nt, Human
ggucuguacuggggagggucacagcccacgggcuggcagccagcccagcaccuacuuguaaaaa

SEQ ID NO: 379362 - RNA, 64 nt, Human
auguggaggucggaggggcugggacuggggagggggcagccaccuccauccaaggcucuuccua

SEQ ID NO: 379363 - RNA, 64 nt, Human
gcugagggacugauuccugugguuggaaaacugaggcagccaccuaagguggaggugggggaau

SEQ ID NO: 379364 - RNA, 64 nt, Human
ggcgccaucuagcacagccuggcccugaucuccgggcagccaccaccuccucggucugcccccu

SEQ ID NO: 379365 - RNA, 64 nt, Human
cuacgcgccaccaguucccgguacccagggagcaggcagccacacacgggccuugcaaccuugu

SEQ ID NO: 379366 - RNA, 64 nt, Human
ucaagcccuguuuuccugugaagauacuuugaguggcagccauucucuccacgugaaccacacg

SEQ ID NO: 379367 - RNA, 64 nt, Human
gaaaaggaauccagaagacccucuccacuacucaggcagccacuauucaucuauuuuuaaagua

SEQ ID NO: 379368 - RNA, 64 nt, Human
auggcagaauaaucuuuggguaacuucaaaacggggcagccaaacccaugaggcaaugucagga

SEQ ID NO: 379369 - RNA, 64 nt, Human
aauauuacuguuuuaaggaaaacuaauuuaggguggcagccaauaaaggugguuggugucuaau

SEQ ID NO: 379370 - RNA, 64 nt, Human
uaaguaaaacgaaugucaagacauuuucugucagggcagccagcuguagacauccaaaagcuca

SEQ ID NO: 379371 - RNA, 64 nt, Human
gcuagucuugaaaccuaucaucuacagaggggagggcagccaacagcccucuucccaccugggu

SEQ ID NO: 379372 - RNA, 64 nt, Human
uaggaacauuugaguuacuucaaucauuuucacaggcagccaacaagcaauuaagagcaguuau

SEQ ID NO: 379373 - RNA, 64 nt, Human
cauggccacagaaauggagggcgcccaggauccaggcagccaccgggaacagucagcuuucuuu

SEQ ID NO: 379374 - RNA, 64 nt, Human
ggagaguuugcccuugucugucuuggaaagugugggcagccacagaugcccccaaaucagagcu

SEQ ID NO: 379375 - RNA, 64 nt, Human
ccuccagcuaggaggaaauggagcaagaugaacaggcagccacgaggugggugggagcuggcag

SEQ ID NO: 379376 - RNA, 64 nt, Human
cuggggcgggagacggggcgguucugaucuggcaggcagccaggaucccugacccuuggcccaa

SEQ ID NO: 379377 - RNA, 64 nt, Human
cuccccuugcaaaccaucccagcacugcaccccaggcagccacuccuagccuuggccuuuggca

SEQ ID NO: 379378 - RNA, 64 nt, Human
gagaggcagcccaggaagucucaucuggggagcaggcagccagcaucugggccuuggccuggag

SEQ ID NO: 379379 - RNA, 64 nt, Human
uugugggccugggcuccuggaccccccuuucacaggcagccagugcccugagccagggucucca

SEQ ID NO: 379380 - RNA, 64 nt, Human
uacuaguucagugaucagcauugaaugguuguuaggcagccaugugcucaacacugauuucacc

SEQ ID NO: 379381 - RNA, 64 nt, Human
aucagauuucaguuuucccuaugagaaacucugaggcagccacuuaucuuggcuaaauagaacc

SEQ ID NO: 379382 - RNA, 64 nt, Human
ucccccaggagaucaggauuccacugacguccugggcagccagugaauuuaauuuuccaugaga

SEQ ID NO: 379383 - RNA, 64 nt, Human
gggugugucagccucucaccggcuccccgagcguggcagccaccagguccacagaacuacugca

SEQ ID NO: 379384 - RNA, 64 nt, Human
aggcugaugagugugugggguauggggcagcagaggcagccagccagcaaagaggggccacuga

SEQ ID NO: 379385 - RNA, 64 nt, Human
uguggcucaggaggaaaagcucagccuggacuguggcagccacggcagaagguggaucuuggga

SEQ ID NO: 379386 - RNA, 64 nt, Human
uaaagauaaaugggccaaaguguacauugagacuggcagccaucuaugguaccacugaaacccu

SEQ ID NO: 379387 - RNA, 64 nt, Human
guucuggcuguuguccaaagcaugggauucuggaggcagccagagcccugcugaguuccugcuu

SEQ ID NO: 379388 - RNA, 64 nt, Human
gagaggcugcucuuagggagggcaaagguucgggggcagccagugucucccaucagugccuuuu

SEQ ID NO: 379389 - RNA, 64 nt, Human
uguguucaguagccguccucugagcagggcccaaggcagccaggggccuggaggggccagagga

SEQ ID NO: 379390 - RNA, 59 nt, Human
gaagcucccuggugggcuaaugcugaaggggcagccagucaccagagcgcccaccuggc

SEQ ID NO: 379391 - RNA, 64 nt, Human
agaggucauauaguugggccauggggcaauuguuggcagccaugacugacggccccuugugcaa

SEQ ID NO: 379392 - RNA, 64 nt, Human
ggaaagugcuuagcucucucccuccugaccucugggcagccagucaucaaagcagagagacgug

SEQ ID NO: 379393 - RNA, 64 nt, Human
gagccagugggagcuggugucugugggugccaagggcagccagggucuucccugccugguguuu

SEQ ID NO: 379394 - RNA, 64 nt, Human
gggcacccacagaacugggagugagggcuccucaggcagccacaaggcaggaaaacuggcgcaa

SEQ ID NO: 379395 - RNA, 64 nt, Human
ggggacuuccugggacaagcaaggaaaguacugaggcagccacuugauugaacgguguugcaau

SEQ ID NO: 379396 - RNA, 64 nt, Human
uggcccuccuccccaucucaguuugcaacucaagggcagccaugcacucccccggggugucgcu

SEQ ID NO: 379397 - RNA, 64 nt, Human
auaauugguguagcacagugccuugcaugcaguaggcagccaacaaauccuuaaugauugguaa

SEQ ID NO: 379398 - RNA, 64 nt, Human
uucaccucauggagcccgggaagcugcucgccucggcagccauaggagcgaacacugcugcucu

SEQ ID NO: 379399 - RNA, 64 nt, Human
cggggggccucagcccuugggaggggacaccugaggcagccagcgcccccuccccaguccccag

SEQ ID NO: 379400 - RNA, 64 nt, Human
acaucccgaaacuccacccguucccacugcccugggcagccaucuugaauaugggcggaaguac

SEQ ID NO: 379401 - RNA, 64 nt, Human
aggacugucugccuuugagggcuugggcagcagcggcagccaucuugguuuuaggaaauggggc

SEQ ID NO: 379402 - RNA, 64 nt, Human
aagaggcugggguucccauuugacuccagucccaggcagccauggggaucucgggucaguucca

SEQ ID NO: 379403 - RNA, 64 nt, Human
ugggcuggggacuccagggguggcugggagacugggcagccaccagcaaacagacccuguggcc

SEQ ID NO: 379404 - RNA, 64 nt, Human
agucgaaacucgugacuucgguuuguugaacuuuggcagccaguuggugagggccagauguuau

SEQ ID NO: 379405 - RNA, 64 nt, Human
accaucugccaaaaauuacugauccucgcaugauggcagccauagugcauagcuacuaaaauca

SEQ ID NO: 379406 - RNA, 64 nt, Human
uucuccaugggguaaccacccucgccugggcaggggcagccaaggcugggaaaugaggaggcca

SEQ ID NO: 379407 - RNA, 64 nt, Human
uggacagcaagagucguuuucgcggaagccgacuggcagccaggccugucgggccccccgacgc

SEQ ID NO: 379408 - RNA, 64 nt, Human
agguugcaucauuguuuuaagcuugccuguucaaggcagccaggcgaggggugauggcaacggu

SEQ ID NO: 379409 - RNA, 64 nt, Human
caccccgccgaccauccaagggagagugagaccuggcagccacaacugcagucccauccucuug

SEQ ID NO: 379410 - RNA, 64 nt, Human
gggaggccucucugggccuggaggugggggugggggcagccaaguccagccacucuucaccugg

SEQ ID NO: 379411 - RNA, 61 nt, Human
ccgagccggagcagcucugaccuggagcugaggcagccagcagaucucagcagcccagucc

SEQ ID NO: 379412 - RNA, 64 nt, Human
ccagucaaggauggaugcagauccagagguuucuggcagccaguaccuccugccccaugcugcc

SEQ ID NO: 379413 - RNA, 64 nt, Human
gacgcuggccuucagaccugaucagacucccaggggcagccaccacauguaugacagagaacag

SEQ ID NO: 379414 - RNA, 64 nt, Human
cauuaccaaguagaaagggucugaaacauuacuuggcagccaagaauuuggagguuuuaaaaug

SEQ ID NO: 379415 - RNA, 64 nt, Human
acagaaggaaguucacucuggagugucuuugggaggcagccauuccaaaugcccuccuccauuu

SEQ ID NO: 379416 - RNA, 64 nt, Human
ccaggguggcacacccaucuguuugcugggguguggcagccacauccaagacuggagcagcagg

SEQ ID NO: 379417 - RNA, 64 nt, Human
gugggggcccugggugaaugcugcugccccugcuggcagccaccuugagaccucaccgggccug

SEQ ID NO: 379418 - RNA, 64 nt, Human
caaaguuuaugcagcuacuguccaaacucaaaguggcagccaguugguuuugauagguugccuu

SEQ ID NO: 379419 - RNA, 64 nt, Human
ccuauggagagcccugggaccgcuacaccacucuggcagccacacuucucaggacacaggccug

SEQ ID NO: 379420 - RNA, 64 nt, Human
ccucccagguggaguacacggcagacucgaccguggcagccauguauuacagcuacuacaugcu

SEQ ID NO: 379421 - RNA, 64 nt, Human
uuucuaguuaguagaucccuagacauggaaucagggcagccaagcuugaguuuuuauuuuuuau

SEQ ID NO: 379422 - RNA, 64 nt, Human
uuggacuugucugacaguagugagucacugcaggggcagccaaacauaugccccauuuggaaca

SEQ ID NO: 379423 - RNA, 64 nt, Human
aguggacucgagucccuggagcaggcaguguggaggcagccauccccugugaugacuggcagcu

SEQ ID NO: 379424 - RNA, 64 nt, Human
ugcacugggccaucagcucaugccaggcuaugggggcagccaguuggcauugcuccccagacug

SEQ ID NO: 379425 - RNA, 64 nt, Human
ccuaaccaggaucaggcaggagggcagggaugguggcagccauaggagggcaggguaggguagg

SEQ ID NO: 379426 - RNA, 64 nt, Human
caggaaggggugggcuggauuuuguaaagcuggaggcagccaggaaucugacuguccggaaugu

SEQ ID NO: 379427 - RNA, 64 nt, Human
cuguggaggucacuugugaaucaggcagugucauggcagccacccucgccaacggugggaucug

SEQ ID NO: 379428 - RNA, 64 nt, Human
gagcacaaacacaaaguaggaucccagugcauuaggcagccagucucgggagaaggggaacuug

SEQ ID NO: 379429 - RNA, 64 nt, Human
ugugauuacaaggcuuuaucucaggggccaacuaggcagccaaccuaagcaagaucccaugggu

SEQ ID NO: 379430 - RNA, 60 nt, Human
uuucaggaccuggacagugaagggagcccgggcagccaccgucuccagagcccugggcag

SEQ ID NO: 379431 - RNA, 64 nt, Human
uuaucaggagcccacuaugcagaggccaaaggucggcagccagcgaggcuaugaauuggaccuu

SEQ ID NO: 379432 - RNA, 64 nt, Human
acaaauaaguuacccucaacucagaucaaaaaugggcagccaagucuucgguaggaauuggagc

SEQ ID NO: 379433 - RNA, 64 nt, Human
cugccuucuagaugccucugagcuccaaacccagggcagccauggcuucucauuuacaccaaca

SEQ ID NO: 379434 - RNA, 64 nt, Human
ggaaggggccggggagggggcacggcaggcguguggcagccacacgcaggcggccagggcggcc

SEQ ID NO: 379435 - RNA, 64 nt, Human
gcuggccacaccacucagugcauggcggccgaugggcagccaacccaaacccgcgccuuuccuu

SEQ ID NO: 379436 - RNA, 64 nt, Human
caucaccaugccacaucccugcucccuacuuccuggcagccaagaaaagcccuuucuacaugcu

SEQ ID NO: 379437 - RNA, 64 nt, Human
uuccugauuggauugguuuugccgcugauguuaaggcagccagcuucuuaguucaaaaagaauu

SEQ ID NO: 379438 - RNA, 64 nt, Human
guaggaccauggggaguucagagucaucauacaaggcagccaagaacugccauaaacacuacac

SEQ ID NO: 379439 - RNA, 64 nt, Human
auggcuuuacucaagcagaucucaucucaugacaggcagccacgucucaacauggguaaggggu

SEQ ID NO: 379440 - RNA, 64 nt, Human
ucucggggugggacagacgagacaacagcacacaggcagccagccguggccagaggcucgaggg

SEQ ID NO: 379441 - RNA, 64 nt, Human
cccuuccuucuuaauaaaggcugacaguucuguuggcagccaagaacccacaccaugaagacag

SEQ ID NO: 379442 - RNA, 64 nt, Human
aaacucuuuccacugugacuuauuuucucucucaggcagccagccaccuggucccuugugcuga

SEQ ID NO: 379443 - RNA, 64 nt, Human
uguucagaggcauccaaaaaaagucucccacuucggcagccaugaagcccacucaugcaaccgu

SEQ ID NO: 379444 - RNA, 64 nt, Human
aaagggcacucaggcagcccuuugcaaucgcgauggcagccacuagauaucacucucaacuugu

SEQ ID NO: 379445 - RNA, 64 nt, Human
gugaauucgcaggaucauuucagacccgcacuucggcagccaacucgaaagcaggcgguugugu

SEQ ID NO: 379446 - RNA, 64 nt, Human
cagagcauuacucucccacugugccugccauccaggcagccaugggaggcggccucccuguucc

SEQ ID NO: 379447 - RNA, 64 nt, Human
cuugcugcccaggcagcguggaggggaaggguagggcagccagagaaaggagcagagaaggcac

SEQ ID NO: 379448 - RNA, 64 nt, Human
gggaccugccuccaccccauccagggaugagaauggcagccaaucucuguggccaagcuccagc

SEQ ID NO: 379449 - RNA, 64 nt, Human
ucuuucaaaaacccacccaguguuuagccucaacggcagccaguuaccagcuucucucuguagc

SEQ ID NO: 379450 - RNA, 64 nt, Human
uggcaggcugcuagcaaggcagugagaagcucuuggcagccaaaugggugcauucagggcugau

SEQ ID NO: 379451 - RNA, 64 nt, Human
cccuccuucccccaccacaggucucuccugcauaggcagccacuguccguucuuucacacacug

SEQ ID NO: 379452 - RNA, 64 nt, Human
uacauguccgaugggggcaggagcucccauccugggcagccaaccaggcaacaccaaggacucu

SEQ ID NO: 379453 - RNA, 64 nt, Human
ugaagugguguauauggaagcaucucccuacacuggcagccagucauuacuaguaccucugcgg

SEQ ID NO: 379454 - RNA, 64 nt, Human
cugccugcaagcccagggcgaguauuggaggaggggcagccacgggcagagcaccaugcccauc

SEQ ID NO: 379455 - RNA, 64 nt, Human
gacaggaauuccagagccaggugcauccacucagggcagccaguguugguggagcugccucuag

SEQ ID NO: 379456 - RNA, 64 nt, Human
cccuuuccacaccagacuggcagcacuucccccaggcagccaguggugggcccugagcccucag

SEQ ID NO: 379457 - RNA, 64 nt, Human
gaacugaugaagucaccuggccuggaguguguugggcagccaguguccccagagcugcuugugg

SEQ ID NO: 379458 - RNA, 57 nt, Human
aaaaggagagagacccuugaaccacugggcagccaccuccuuugcccuagaccagcu

SEQ ID NO: 379459 - RNA, 64 nt, Human
ggcuggcaaauguuuaaaaucaccacguguaagaggcagccaagucagcucugccaacugcuag

SEQ ID NO: 379460 - RNA, 64 nt, Human
acuuggaagggaagagcucugaaggagccagaggggcagccaccuugcaugagggugaggaagg

SEQ ID NO: 379461 - RNA, 64 nt, Human
ccugcucagucaguuccuuucacucccaauuguuggcagccauugauaggaauucuaucacuau

SEQ ID NO: 379462 - RNA, 64 nt, Human
gccugccaccuacgcccacaggcagggcacacugggcagccagccugccggcaggacuugccug

SEQ ID NO: 379463 - RNA, 64 nt, Human
agcuuuguuccuucggucauuuggaauuccugagggcagccagagcuccuugguccuuucagua

SEQ ID NO: 379464 - RNA, 64 nt, Human
cagucuaaacuauccagucaauaccgagugaaguggcagccagcacuguucacucugugucuuu

SEQ ID NO: 379465 - RNA, 64 nt, Human
auuuuaagaaagagaaugaacuguggaauuuauuggcagccaaggaauguguccaagacacaug

SEQ ID NO: 379466 - RNA, 64 nt, Human
gggagaaagcuggcuguuguccaaugccuuccuuggcagccaaguggauaaaaccuuuaggagc

SEQ ID NO: 379467 - RNA, 64 nt, Human
aucucucccacuguauggccgugccuagaccgauggcagccaucgaauauuccucugggcucac

SEQ ID NO: 379468 - RNA, 64 nt, Human
aagaaaacagaugcccccagaaggggccagugcgggcagccagggccuagugggucauuggcca

SEQ ID NO: 379469 - RNA, 64 nt, Human
guuagggccuugguccaggagccaguugagccagggcagccacauccaggcgucucccuacccu

SEQ ID NO: 379470 - RNA, 64 nt, Human
cugaggccuagacucugucuaccuggucugguugggcagccagaccagcaggcuggccuaugug

SEQ ID NO: 379471 - RNA, 64 nt, Human
cauggauuccuuagugaucugugcagagagagauggcagccacucccuucaguccucccagauu

SEQ ID NO: 379472 - RNA, 64 nt, Human
ucaccucugugccuugcugcuccugaggcccaagggcagccauggugcucuguacugcucgggc

SEQ ID NO: 379473 - RNA, 64 nt, Human
cccucccugugggcucagggucuccugcgggcuaggcagccaggagcucuguccgcaaaaccaa

SEQ ID NO: 379474 - RNA, 64 nt, Human
gagcgggcgcgcuucgaacaggcgggcgagccgcggcagccacaggcgcgggcccuccuugcgc

SEQ ID NO: 379475 - RNA, 64 nt, Human
ugaacauuggcgccugccuucuggccacgcuggcggcagccaugcucaucuggaacauucucca

SEQ ID NO: 379476 - RNA, 64 nt, Human
gccagguggcacaaauaagagaggggagauggggggcagccaggagaggaggugucccuuccuc

SEQ ID NO: 379477 - RNA, 64 nt, Human
cugaggaauggcccaacaguggccccuucaggguggcagccacccuucagugaggccccaaggc

SEQ ID NO: 379478 - RNA, 64 nt, Human
agugguuuccuggugcuucccacggaggaguuuuggcagccagacuucuggaggaauugguugu

SEQ ID NO: 379479 - RNA, 64 nt, Human
caacaaaggaggcuguaaauuuaguuucuacuugggcagccaaaacucugaggaaggagauucu

SEQ ID NO: 379480 - RNA, 64 nt, Human
cuuauccaugccugggaaaugccaccuccuggaaggcagccaggcuggcagauuuccaaaagac

SEQ ID NO: 379481 - RNA, 64 nt, Human
aaguguguuguguuucauguucaagcuuaaucaaggcagccauuaauauacgaacugagcaugc

SEQ ID NO: 379482 - RNA, 64 nt, Human
cugcaaccucagaagagugcagcucccagagggaggcagccauccaucugggaugguccuaagc

SEQ ID NO: 379483 - RNA, 64 nt, Human
ccacauuccugaugcuucuucagagacuccugcaggcagccaggccacaagacccuuguggucc

SEQ ID NO: 379484 - RNA, 64 nt, Human
ucuggacaacagccacaagggggcgcucggaccaggcagccacuuuccuggugcucucugggcc

SEQ ID NO: 379485 - RNA, 64 nt, Human
uggccagagccccuugcauauccccacugucaggggcagccaggacuguucccauccuccugga

SEQ ID NO: 379486 - RNA, 64 nt, Human
gcucccucugccuaggccccugguacucagucacggcagccaggagaccccaggugaguuucug

SEQ ID NO: 379487 - RNA, 64 nt, Human
ggcgcucagcgagaggcugauccaagaacggcuuggcagccaguccggcuaaguggagcucaga

SEQ ID NO: 379488 - RNA, 64 nt, Human
ugagcguccuuccuccuuccucuccgggcugccaggcagccagguaaggccuggugaggccacu

SEQ ID NO: 379489 - RNA, 64 nt, Human
cggguggguuuggugaaugugggugugucagcguggcagccacguggaagcagggcauguagca

SEQ ID NO: 379490 - RNA, 64 nt, Human
ccuccucucccuucugggggcuggagggagccggggcagccacagggagagacaugggcgaaug

SEQ ID NO: 379491 - RNA, 64 nt, Human
gaacaagggcaaggacaggcucugaguguccaguggcagccagaacaggugacacagagcaggg

SEQ ID NO: 379492 - RNA, 64 nt, Human
gcguggaccaucuggguguccucagccccuguggggcagccaaguuccugauagcacuugugcc

SEQ ID NO: 379493 - RNA, 64 nt, Human
ccaggccuuacucaggccucagguccauggguugggcagccagucugggcccuucucaggaucc

SEQ ID NO: 379494 - RNA, 64 nt, Human
uccaggguggcagcaacaauaaauagacacgcacggcagccacagcuuggguguguguucaucc

SEQ ID NO: 379495 - RNA, 64 nt, Human
gccacggggccgugcuguguuuauggcuggcagaggcagccagcgggugggggauucugcugcu

SEQ ID NO: 379496 - RNA, 64 nt, Human
uggcugguuugcccagagccaagcuggggcaaggggcagccagcccuggcuuccaaggcucccg

SEQ ID NO: 379497 - RNA, 64 nt, Human
uuugguugcucacaacucagguaugcacccauguggcagccaggcagcggagcccuacuagacu

SEQ ID NO: 379498 - RNA, 64 nt, Human
cacuguaccuggcgaaaaacaguuuguuaacacaggcagccaacaucacucaggauaagccuca

SEQ ID NO: 379499 - RNA, 64 nt, Human
auugggcaccucugggaaggggaggggaccaugaggcagccagccccuggcaggggcgacugug

SEQ ID NO: 379500 - RNA, 64 nt, Human
ugcugugugaauccaggaggcaguggacaucguaggcagccacggccccggguccaggagaagu

SEQ ID NO: 379501 - RNA, 64 nt, Human
ggcugacgccuugagccgagggcauaugcgggggggcagccaaccagagcuggucacuccucag

SEQ ID NO: 379502 - RNA, 64 nt, Human
ucucaacuacucagcucuccugcugcagcaugaaggcagccacagacaacauggaaaugagugu

SEQ ID NO: 379503 - RNA, 64 nt, Human
gaacugccaucagcuaccacacuggacucugcagggcagccauccuggaugauggaagccacca

SEQ ID NO: 379504 - RNA, 64 nt, Human
uuugguuauuucugugcaaacaaaaggugugccuggcagccauuucuccauggaguugcuaagu

SEQ ID NO: 379505 - RNA, 64 nt, Human
uuugcaacggccucagaaguuuggccggagagggggcagccagagcggcagcccccggccucag

SEQ ID NO: 379506 - RNA, 64 nt, Human
cgcccugucugagaagugaggagccccuccgcccggcagccaccccaucugggaagugaggagc

SEQ ID NO: 379507 - RNA, 64 nt, Human
gucugucugccugucucucuccuccuggacccagggcagccaagggcagggauaggcgcagugg

SEQ ID NO: 379508 - RNA, 64 nt, Human
guugagauuugccucaguucaguagaucuuccuuggcagccagccauagguuguuucuuugucu

SEQ ID NO: 379509 - RNA, 64 nt, Human
agcaagaccagcggguucuugcaacacugugaggggcagccagggcggccccaauaaagcccuu

SEQ ID NO: 379510 - RNA, 64 nt, Human
gcucaacucgggggcgccuggagggaugcccccaggcagccaccaguggaccuagccuggaugg

SEQ ID NO: 379511 - RNA, 64 nt, Human
cucugccuucuccaacaggguucuuggugaugcuggcagccauggccauggcagcggguggcau

SEQ ID NO: 379512 - RNA, 64 nt, Human
ucuuuuccuccacagccagccuguccaacagaggggcagccaggacaucucugcccucuucuca

SEQ ID NO: 379513 - RNA, 64 nt, Human
guggccuggggcucccucugcaggggccucucucggcagccacagccaaggguggaggcuucag

SEQ ID NO: 379514 - RNA, 64 nt, Human
cuuccgugguucccagcacagcccaagauuauuuggcagccaaguggauggaacuaacuuuccu

SEQ ID NO: 379515 - RNA, 64 nt, Human
gcagcucuggcccaggagcugcaggcugggagggggcagccaagaagccggagcuggcagcaua

SEQ ID NO: 379516 - RNA, 64 nt, Human
ggauaguggccacacugcagcugaggccccagguggcagccauggaucauguagacuuccagau

SEQ ID NO: 379517 - RNA, 64 nt, Human
cacagccucaccugcugcugccccucuaggucugggcagccaugaccugcagggcccagagaca

SEQ ID NO: 379518 - RNA, 64 nt, Human
uggcacaagugcccuuagugcugccacacucccuggcagccaggugcccuggugcccaccccug

SEQ ID NO: 379519 - RNA, 64 nt, Human
acucuguaccuugcugguacagacagggguggugggcagccaggcucuaugagugggccccuag

SEQ ID NO: 379520 - RNA, 64 nt, Human
cauacagacuggcacugggcagggccucucauguggcagccacauguggcguugugaggccacc

SEQ ID NO: 379521 - RNA, 64 nt, Human
aggggaaaaaccccugcucacuuguuugcccucaggcagccaaagcacuuuaaccccugcauag

SEQ ID NO: 379522 - RNA, 64 nt, Human
aacaucauuugcauggcuggaguugcccgcguaaggcagccaagaaacucacccaaagccugua

SEQ ID NO: 379523 - RNA, 64 nt, Human
guuuccgugugaccaggggaauguguggcccgcuggcagccaggcaggcccgggugguggugcc

SEQ ID NO: 379524 - RNA, 64 nt, Human
cucugacuccaacugaggcucagccccaccccagggcagccagggagagcccaggagcuccccu

SEQ ID NO: 379525 - RNA, 64 nt, Human
cagggcacagauaggcaggaccccagagagggcaggcagccacgcccugcacuguggagaagug

SEQ ID NO: 379526 - RNA, 64 nt, Human
cauuccccaucuauuacccuagguguguuuucaaggcagccagcgguagaauccauguaguucc

SEQ ID NO: 379527 - RNA, 64 nt, Human
agaagccuaggaucacagggugauaaugucaauuggcagccaguuguguuuuuuugaaacauca

SEQ ID NO: 379528 - RNA, 64 nt, Human
gcuucguccugucacccccaucaccaauuuugagggcagccagucucaggaccacaguggaauc

SEQ ID NO: 379529 - RNA, 64 nt, Human
caccccacuaugaccuuugacccuacggcgcaggggcagccaggacccuugauucagaccaugg

SEQ ID NO: 379530 - RNA, 64 nt, Human
uacucaggucaguuaacuaaugaggcggggcuguggcagccagcgguuuuccucucuucucuau

SEQ ID NO: 379531 - RNA, 64 nt, Human
gcuggaaguuuggguuuggugguuugggggccggggcagccaagcuguauggggcaggacagac

SEQ ID NO: 379532 - RNA, 64 nt, Human
gacucucccugaggugcuuucagcguaagcuuuuggcagccacccaacucaguucucgcaucuu

SEQ ID NO: 379533 - RNA, 64 nt, Human
uucaacaugucccaggauuugcuccacccucgagggcagccagacagcgucgccaggcaaugag

SEQ ID NO: 379534 - RNA, 64 nt, Human
gcaaaugggaggccugaggcccucuucaggcuuuggcagccacagauacuucugaacccuucac

SEQ ID NO: 379535 - RNA, 64 nt, Human
ugcccccauuuccccgauguccccugcgggcgcgggcagccacccaagccugcuggcugcggcc

SEQ ID NO: 379536 - RNA, 64 nt, Human
uaugcucuuuucuuucucaggguccucuuuggugggcagccacuccccgagauguugccaucag

SEQ ID NO: 379537 - RNA, 64 nt, Human
aaguuguaaggggccaauucuaaguauucuucacggcagccagaaguuaauggugguagcagcu

SEQ ID NO: 379538 - RNA, 64 nt, Human
ggugcccggaggcggccauggugucucgauggacggcagccaggauggagcacccaugggucuc

SEQ ID NO: 379539 - RNA, 64 nt, Human
ggccgggggcugcaggggaggcuguggggguccuggcagccaggaggccccaggugguuuugag

SEQ ID NO: 379540 - RNA, 56 nt, Human
cccuggacgaggagagcugagccgcgggcagccaggcccagcccccgcccgagcuc

SEQ ID NO: 379541 - RNA, 64 nt, Human
ggagaccucccuucccugggccccuucucuccugggcagccacaccacagagcggggaggggca

SEQ ID NO: 379542 - RNA, 64 nt, Human
ccuuuugccgcuccggggaccagcagcaauccugggcagccaguggcucuuguagagaagacuu

SEQ ID NO: 379543 - RNA, 64 nt, Human
ccccugcccugagcugcaugguucccccacccugggcagccaggaaggaaucugaauggagaau

SEQ ID NO: 379544 - RNA, 64 nt, Human
cugacccgugccucucugacacaugucuccggggggcagccaccuggccaaugugcauuuuugc

SEQ ID NO: 379545 - RNA, 64 nt, Human
cacgucccaucacucacugcccugucugaaauguggcagccacugugggccaggcucagggcag

SEQ ID NO: 379546 - RNA, 64 nt, Human
ucaccaaaguugaaaugaaggaaaaaauguuaagggcagccagagagaaaggucggguuaccca

SEQ ID NO: 379547 - RNA, 64 nt, Human
aggguccuccgaugcuggccuuugcgccucuagaggcagccacucauggauucaaguccuggcu

SEQ ID NO: 379548 - RNA, 64 nt, Human
cucccacuaaggccugcccaccaccgcccgccugggcagccaugaauguagcgccccaggcccu

SEQ ID NO: 379549 - RNA, 64 nt, Human
ggacaggguuaaugucuccagaguguacacugcaggcagccacauuuacacgccugcaguuguu

SEQ ID NO: 379550 - RNA, 64 nt, Human
ucccccagaaaggaccucaaccacacuccacgccggcagccaacgcacaggaugggggcgccag

SEQ ID NO: 379551 - RNA, 64 nt, Human
ggagggcguuggcuuguccagaauggggacguggggcagccaccccugcccagcgagagcgcag

SEQ ID NO: 379552 - RNA, 64 nt, Human
gggcugugacacaauagggacucuauggaaaacuggcagccauugggugugggggcagucugua

SEQ ID NO: 379553 - RNA, 64 nt, Human
gaugcacaccuugcucauuagugaguucauuucaggcagccagcucuuccucacccacuacauc

SEQ ID NO: 379554 - RNA, 64 nt, Human
ucccuccacccaccguuucccugcagugcacgcuggcagccaccaagcuaggaaguggcaggag

SEQ ID NO: 379555 - RNA, 64 nt, Human
uugucuguguguauauuguuugaucaggguacauggcagccagucacagauuggaauuacauau

SEQ ID NO: 379556 - RNA, 64 nt, Human
accuuuggaaggugagagcagggcccugagaaaaggcagccaccuccucucccuggcugaaccc

SEQ ID NO: 379557 - RNA, 64 nt, Human
uggcugcccagcuucggacagcgggaacuccucaggcagccacgcagcgggugugggccagcau

SEQ ID NO: 379558 - RNA, 64 nt, Human
uuuccuggaaugugggugugauggcuggagcccuggcagccauacugccacguguacagacgag

SEQ ID NO: 379559 - RNA, 64 nt, Human
ggcuuucuccggagcagagcagcgcugcuggccuggcagccaggacuucuccguguacgugcau

SEQ ID NO: 379560 - RNA, 64 nt, Human
auguauaguugguguacacucaaaaccuguccccggcagccagugcucucuguauagggccaua

SEQ ID NO: 379561 - RNA, 64 nt, Human
ggucuucugugucuacuggaagagcacagggcagggcagccagugguccagggauggcugcuuc

SEQ ID NO: 379562 - RNA, 64 nt, Human
uggccuagcauugcuuacauccacccugugccugggcagccacuucuguucuuggacagagggu

SEQ ID NO: 379563 - RNA, 64 nt, Human
aaaaagguagggggagcaaaaccaucaaccaccaggcagccaggccaucagcccaccuccaccu

SEQ ID NO: 379564 - RNA, 64 nt, Human
acucccagcccugccugucccgggggcgggccggggcagccacuccagccccagcccagccugg

SEQ ID NO: 379565 - RNA, 63 nt, Human
ugcuacaauccagcuucuaauccgcccaaaagcggcagccaaucggagcgcgaggacgugguc

SEQ ID NO: 379566 - RNA, 64 nt, Human
ugcugauggucuuggucccagccagggucgugggggcagccacucucuccaaagcauagucaua

SEQ ID NO: 379567 - RNA, 64 nt, Human
aggcuccugggccagugcucucuccucaaauggaggcagccauggccugaagugcagaucacug

SEQ ID NO: 379568 - RNA, 64 nt, Human
uccccaccccuccuuggcucuccagcacuuccugggcagccacggcccccuccccccacauugc

SEQ ID NO: 379569 - RNA, 64 nt, Human
ucacagagaaucagacagggccacagcccccucaggcagccaggucaucugaguaucauuaaga

SEQ ID NO: 379570 - RNA, 64 nt, Human
gggcugaagccacacagcccagaaggccagaaaaggcagccagauccccagggcagccucguua

SEQ ID NO: 379571 - RNA, 64 nt, Human
accagagucugagcugguccuuccagccaggccuggcagccagaggugcuccgggauugcaaac

SEQ ID NO: 379572 - RNA, 60 nt, Human
gcucuccugucucccagugaagacuuggauggcagccaucagggaaggcugggucccagc

SEQ ID NO: 379573 - RNA, 64 nt, Human
gucugcggagccagugugccauucucugcacaugggcagccagccugagcugccuccuccaugg

SEQ ID NO: 379574 - RNA, 64 nt, Human
cugacacuaagacauuaggggagaauguuggguaggcagccagcacucuuuuaccagagggccu

SEQ ID NO: 379575 - RNA, 64 nt, Human
cagaagcgcuccaguaucuccaaggguaccuucaggcagccagugugacacugcuuuaaacugc

SEQ ID NO: 379576 - RNA, 64 nt, Human
ugaugggaagguugauuauuuucucagucauccuggcagccaaaaaugugccaggaaaagaaag

SEQ ID NO: 379577 - RNA, 64 nt, Human
augguaccucaggguuucuuucccuuuacucgcuggcagccauugucugugggcaccucauguu

SEQ ID NO: 379578 - RNA, 64 nt, Human
acaccgcuguccccuuagccccaagggcccugggggcagccacccucccgccugucggcccgua

SEQ ID NO: 379579 - RNA, 64 nt, Human
cucuggcucaggaggguugggucccugggaggccggcagccaggccacagaauccacacgugga

SEQ ID NO: 379580 - RNA, 64 nt, Human
ccacacguggaccauugugggucccugggaggccggcagccaggccacggaauccacacgugga

SEQ ID NO: 379581 - RNA, 64 nt, Human
cgagaauaugucacuugcccagauaaaacugggcggcagccagaguucccugaagugggaaguc

SEQ ID NO: 379582 - RNA, 64 nt, Human
caggcagaucugugccccaugccuguccagccugggcagccaggcugccaaggccagaguggcc

SEQ ID NO: 379583 - RNA, 64 nt, Human
cccagggagccagaccugugcuguugggguuaggggcagccaugggccccagccaggacaugcu

SEQ ID NO: 379584 - RNA, 64 nt, Human
ccccgccgugucuguggcccucucuuaaugccacggcagccacccugccauggaggcgccuucc

SEQ ID NO: 379585 - RNA, 64 nt, Human
gucaggaggccacagggagcagaggagcggggcaggcagccacagggcccugcggggagcacau

SEQ ID NO: 379586 - RNA, 64 nt, Human
aauggccgccuggggagccuguguggcugugccgggcagccauccugcauucccacccagcgcg

SEQ ID NO: 379587 - RNA, 64 nt, Human
cagggucucgugcugcccuucccucccacagccuggcagccauccagaggaggggcucuaccag

SEQ ID NO: 379588 - RNA, 64 nt, Human
uggccccuccugugcccucugcccugguggaagcggcagccacaaguccuccucagggagcccc

SEQ ID NO: 379589 - RNA, 64 nt, Human
uggacccaugagccucgcuggggccuccuccccaggcagccaaugggccccagacaagccuuug

SEQ ID NO: 379590 - RNA, 64 nt, Human
cugagccuagugcagggcuugucuagcuaaugugggcagccaccacccacuguguaugaacaag

SEQ ID NO: 379591 - RNA, 64 nt, Human
agaugcuggaaucgcuaggaggguuggcuccaggggcagccaauuccuaucauucagaucuucc

SEQ ID NO: 379592 - RNA, 64 nt, Human
uuaaacucaaagcaagcucuucuccucagcuuggggcagccauuggccucugucucguuuuggg

SEQ ID NO: 379593 - RNA, 64 nt, Human
agugcugaacugugaggagagaggcggacugugaggcagccaggagccagcugcguccgugugu

SEQ ID NO: 379594 - RNA, 64 nt, Human
uuuuugggaugggagagaauccagaccaucuuggggcagccaggcccuugccuucauuuuuaca

SEQ ID NO: 379595 - RNA, 64 nt, Human
aacaacacagcuggggcgggcccuguggcugggcggcagccaguccagcucuugcuuccucugg

SEQ ID NO: 379596 - RNA, 61 nt, Human
aggcggaccaagaacugugaccacagggcagggcagccaccaggagagauaugccuggcag

SEQ ID NO: 379597 - RNA, 64 nt, Human
guauuaucagaguagagcugacuuccaguacccgggcagccagcucugucuccagggaggccug

SEQ ID NO: 379598 - RNA, 64 nt, Human
gacuugcaccuuggccaagccacacaaucaguggggcagccagagcucagaccugagccauuuu

SEQ ID NO: 379599 - RNA, 64 nt, Human
gcuggcccauggcccggguguagagaaaccaagcggcagccaccaccaguguuguuuugaauaa

SEQ ID NO: 379600 - RNA, 64 nt, Human
acagggacuggagccauggcucagaggugauucgggcagccagggacaggagccacccucccca

SEQ ID NO: 379601 - RNA, 64 nt, Human
guagucaagcaccugaacaggcccugagcucacaggcagccaauguaaagagggaaacacagug

SEQ ID NO: 379602 - RNA, 64 nt, Human
uguccucagaggaggaggaggaggaggcagcuccggcagccacagaaggcugcagcccagcccg

SEQ ID NO: 379603 - RNA, 64 nt, Human
acccaccucaccugaagggggugagacccuuguuggcagccagacaaggguggggcuccacagg

SEQ ID NO: 379604 - RNA, 64 nt, Human
aagcaugccguggaucccacaugcacuggggcagggcagccagguuccagagcagcaggcaugu

SEQ ID NO: 379605 - RNA, 64 nt, Human
aggcauggcuugcuggccaggauauucagagguaggcagccaaagggcacagaacccugugccc

SEQ ID NO: 379606 - RNA, 64 nt, Human
uucuguagcagccaccccccugcccccacuccagggcagccaugaugugcuugggcccaccagg

SEQ ID NO: 379607 - RNA, 64 nt, Human
cccggggugggaccagaggucauaggugcccaacggcagccaaaccaaagacacuggugugcau

SEQ ID NO: 379608 - RNA, 64 nt, Human
uucugcauggaagggaagguggggugauagggagggcagccagaaaagacagcuggccuucagu

SEQ ID NO: 379609 - RNA, 64 nt, Human
ccagccagguggcccugcccgaccuguggggugaggcagccaagguuccuuccauccccccagu

SEQ ID NO: 379610 - RNA, 64 nt, Human
accugguggccgugguggagaugaugcagcccauggcagccaacuauaaugucuuccucaacag

SEQ ID NO: 379611 - RNA, 64 nt, Human
agaccccggggugagggggggcucccuggggggaggcagccagccaagacugggcccaugaaca

SEQ ID NO: 379612 - RNA, 64 nt, Human
gagagccugggccagcccacagcguuccuagucaggcagccacaccuugguccucaucuugguc

SEQ ID NO: 379613 - RNA, 64 nt, Human
cugcuauaaaugugggugugauggcuggaucuggggcagccaccuugcuaccaugaaggaaagg

SEQ ID NO: 379614 - RNA, 64 nt, Human
gcagugguggugaggccgccccgcuccaucccgaggcagccaggguuuguuuugcgcucuccug

SEQ ID NO: 379615 - RNA, 64 nt, Human
ccugggacgggugggccugaggugcccagcucagggcagccagguggcucaugggcuguaguga

SEQ ID NO: 379616 - RNA, 64 nt, Human
aaucccuaccuacccagcugggccagaggcacgaggcagccaggcagggugggagcaggggcug

SEQ ID NO: 379617 - RNA, 62 nt, Human
aauucaaaaucaagcuuugagcaggggagugaggcagccagaagugggggcagaggagggug

SEQ ID NO: 379618 - RNA, 64 nt, Human
aagaaccucgcaucuuuugguguguaugcaccuuggcagccagcaggaaagcagcgaagagccg

SEQ ID NO: 379619 - RNA, 64 nt, Human
ggaccuggggcuagaggagggugcugugguacauggcagccaggggcuucauuucuucuugugg

SEQ ID NO: 379620 - RNA, 64 nt, Human
gcauccucagaaaccuacucaacacagcacucuaggcagccacuaucaaucaauugaaguugac

SEQ ID NO: 379621 - RNA, 64 nt, Human
ccucuuguguucuugccuaggcccagguguuccuggcagccaaaucgagucucucauuuucucu

SEQ ID NO: 379622 - RNA, 64 nt, Human
caaggagaccaccgccuucuccagugcuuccuugggcagccaguaauucccaggcaaggccaga

SEQ ID NO: 379623 - RNA, 64 nt, Human
aacagcagaugaguugaguggggcagagggacagggcagccagaccaaggccaagccuucucac

SEQ ID NO: 379624 - RNA, 64 nt, Human
cugucuugccugccagggccccuguucccccgcuggcagccacccccucccccaucauauccuu

SEQ ID NO: 379625 - RNA, 64 nt, Human
gcuaacugauuuccuauaagcacacuggauuaagggcagccacagugguuucuacuguauguau

SEQ ID NO: 379626 - RNA, 64 nt, Human
aaguccagauggccuuagguguccugacugucuaggcagccaaagagcacacguuaagcaaucc

SEQ ID NO: 379627 - RNA, 64 nt, Human
uaacccugacuccuucaccaagaagacgggagucggcagccaggaguucccguggcaccucucu

SEQ ID NO: 379628 - RNA, 64 nt, Human
ccccaccagauugcugcaggggcgcggugugccuggcagccaaauuguugacacuucuuuuuuc

SEQ ID NO: 379629 - RNA, 64 nt, Human; identical to SEQ ID NO: 277197

SEQ ID NO: 379630 - RNA, 64 nt, Human; identical to SEQ ID NO: 277198

SEQ ID NO: 379631 - RNA, 64 nt, Human; identical to SEQ ID NO: 277199

SEQ ID NO: 379632 - RNA, 64 nt, Human; identical to SEQ ID NO: 277200

SEQ ID NO: 379633 - RNA, 64 nt, Human; identical to SEQ ID NO: 277201

SEQ ID NO: 379634 - RNA, 64 nt, Human; identical to SEQ ID NO: 277202

SEQ ID NO: 379635 - RNA, 58 nt, Human; identical to SEQ ID NO: 277203

SEQ ID NO: 379636 - RNA, 64 nt, Human; identical to SEQ ID NO: 277204

SEQ ID NO: 379637 - RNA, 64 nt, Human; identical to SEQ ID NO: 277205

SEQ ID NO: 379638 - RNA, 64 nt, Human; identical to SEQ ID NO: 277206

SEQ ID NO: 379639 - RNA, 64 nt, Human; identical to SEQ ID NO: 277207

SEQ ID NO: 379640 - RNA, 64 nt, Human; identical to SEQ ID NO: 277208

SEQ ID NO: 379641 - RNA, 64 nt, Human; identical to SEQ ID NO: 277209

SEQ ID NO: 379642 - RNA, 64 nt, Human; identical to SEQ ID NO: 277210

SEQ ID NO: 379643 - RNA, 64 nt, Human; identical to SEQ ID NO: 277211

SEQ ID NO: 379644 - RNA, 64 nt, Human; identical to SEQ ID NO: 277212

SEQ ID NO: 379645 - RNA, 64 nt, Human; identical to SEQ ID NO: 277213

SEQ ID NO: 379646 - RNA, 64 nt, Human; identical to SEQ ID NO: 277214

SEQ ID NO: 379647 - RNA, 64 nt, Human; identical to SEQ ID NO: 277215

SEQ ID NO: 379648 - RNA, 64 nt, Human; identical to SEQ ID NO: 277216

SEQ ID NO: 379649 - RNA, 64 nt, Human; identical to SEQ ID NO: 277217

SEQ ID NO: 379650 - RNA, 64 nt, Human; identical to SEQ ID NO: 277218

SEQ ID NO: 379651 - RNA, 64 nt, Human; identical to SEQ ID NO: 277219

SEQ ID NO: 379652 - RNA, 64 nt, Human; identical to SEQ ID NO: 277220

SEQ ID NO: 379653 - RNA, 64 nt, Human; identical to SEQ ID NO: 277221

SEQ ID NO: 379654 - RNA, 64 nt, Human; identical to SEQ ID NO: 277222

SEQ ID NO: 379655 - RNA, 64 nt, Human; identical to SEQ ID NO: 277223

SEQ ID NO: 379656 - RNA, 64 nt, Human; identical to SEQ ID NO: 277224

SEQ ID NO: 379657 - RNA, 64 nt, Human; identical to SEQ ID NO: 277225

SEQ ID NO: 379658 - RNA, 64 nt, Human; identical to SEQ ID NO: 277226

SEQ ID NO: 379659 - RNA, 64 nt, Human; identical to SEQ ID NO: 277227

SEQ ID NO: 379660 - RNA, 64 nt, Human; identical to SEQ ID NO: 277228

SEQ ID NO: 379661 - RNA, 64 nt, Human; identical to SEQ ID NO: 277229

SEQ ID NO: 379662 - RNA, 64 nt, Human; identical to SEQ ID NO: 277230

SEQ ID NO: 379663 - RNA, 64 nt, Human; identical to SEQ ID NO: 277231

SEQ ID NO: 379664 - RNA, 64 nt, Human; identical to SEQ ID NO: 277232

SEQ ID NO: 379665 - RNA, 64 nt, Human; identical to SEQ ID NO: 277233

SEQ ID NO: 379666 - RNA, 64 nt, Human; identical to SEQ ID NO: 277234

SEQ ID NO: 379667 - RNA, 64 nt, Human; identical to SEQ ID NO: 277235

SEQ ID NO: 379668 - RNA, 64 nt, Human; identical to SEQ ID NO: 277236

SEQ ID NO: 379669 - RNA, 64 nt, Human; identical to SEQ ID NO: 277237

SEQ ID NO: 379670 - RNA, 64 nt, Human; identical to SEQ ID NO: 277238

SEQ ID NO: 379671 - RNA, 64 nt, Human; identical to SEQ ID NO: 277239

SEQ ID NO: 379672 - RNA, 64 nt, Human; identical to SEQ ID NO: 277240

SEQ ID NO: 379673 - RNA, 64 nt, Human; identical to SEQ ID NO: 277241

SEQ ID NO: 379674 - RNA, 64 nt, Human; identical to SEQ ID NO: 277242

SEQ ID NO: 379675 - RNA, 64 nt, Human; identical to SEQ ID NO: 277243

SEQ ID NO: 379676 - RNA, 64 nt, Human; identical to SEQ ID NO: 277244

SEQ ID NO: 379677 - RNA, 64 nt, Human; identical to SEQ ID NO: 277245

SEQ ID NO: 379678 - RNA, 64 nt, Human; identical to SEQ ID NO: 277246

SEQ ID NO: 379679 - RNA, 64 nt, Human; identical to SEQ ID NO: 277247

SEQ ID NO: 379680 - RNA, 64 nt, Human; identical to SEQ ID NO: 277248

SEQ ID NO: 379681 - RNA, 64 nt, Human; identical to SEQ ID NO: 277249

SEQ ID NO: 379682 - RNA, 64 nt, Human; identical to SEQ ID NO: 277250

SEQ ID NO: 379683 - RNA, 51 nt, Human; identical to SEQ ID NO: 277251

SEQ ID NO: 379684 - RNA, 64 nt, Human; identical to SEQ ID NO: 277252

SEQ ID NO: 379685 - RNA, 64 nt, Human; identical to SEQ ID NO: 277253

SEQ ID NO: 379686 - RNA, 64 nt, Human; identical to SEQ ID NO: 277254

SEQ ID NO: 379687 - RNA, 64 nt, Human; identical to SEQ ID NO: 277255

SEQ ID NO: 379688 - RNA, 64 nt, Human; identical to SEQ ID NO: 277256

SEQ ID NO: 379689 - RNA, 64 nt, Human; identical to SEQ ID NO: 277257

SEQ ID NO: 379690 - RNA, 64 nt, Human; identical to SEQ ID NO: 277258

SEQ ID NO: 379691 - RNA, 64 nt, Human; identical to SEQ ID NO: 277259

SEQ ID NO: 379692 - RNA, 64 nt, Human; identical to SEQ ID NO: 277260

SEQ ID NO: 379693 - RNA, 64 nt, Human; identical to SEQ ID NO: 277261

SEQ ID NO: 379694 - RNA, 64 nt, Human; identical to SEQ ID NO: 277262

SEQ ID NO: 379695 - RNA, 64 nt, Human; identical to SEQ ID NO: 277263

SEQ ID NO: 379696 - RNA, 64 nt, Human; identical to SEQ ID NO: 277264

SEQ ID NO: 379697 - RNA, 64 nt, Human; identical to SEQ ID NO: 277265

SEQ ID NO: 379698 - RNA, 64 nt, Human; identical to SEQ ID NO: 277266

SEQ ID NO: 379699 - RNA, 64 nt, Human; identical to SEQ ID NO: 277267

SEQ ID NO: 379700 - RNA, 64 nt, Human
uucucucccaacgcugaagcggucagacuggaggucgaagcaaucagcaaacacaauaagaguc

SEQ ID NO: 379701 - RNA, 64 nt, Human
caagaugguggggcugccucuggugagggucuucucgaagcaucauaauaugcuggaaggcauc

SEQ ID NO: 379702 - RNA, 64 nt, Human
agugcuguccugggaguccucugacucagaacccucgaagcauccugcauugucuuuacccacc

SEQ ID NO: 379703 - RNA, 52 nt, Human
ccuucgcagaagucacaugauaucgaagcagaugguuuuucacugcauugga

SEQ ID NO: 379704 - RNA, 64 nt, Human
uagaacaagguggggcugccuaggagaaggggcuucgaagcagccaggacucuuccuaccacaa

SEQ ID NO: 379705 - RNA, 64 nt, Human
guauaucuaacuucgaauauaucuguaaagauaaucgaagcaaaaguaaucacuuaaaggcaca

SEQ ID NO: 379706 - RNA, 64 nt, Human
augaacuaaacaaacauauuuuagagcauggaucucgaagcagaauuuggcuaaauuuuaacaa

SEQ ID NO: 379707 - RNA, 64 nt, Human
agaauuauuuugguaaaagauuuugcuuuacuuuucgaagcauuauuuuuuuaaagaguguuuu

SEQ ID NO: 379708 - RNA, 64 nt, Human
cugcauugauguggacuucauagacacaaaggcuucgaagcacaagccaaauaugucaauauuu

SEQ ID NO: 379709 - RNA, 64 nt, Human
aggaugggcagcucccacugccccagagcggagcucgaagcacccagguugcccacggaaaauc

SEQ ID NO: 379710 - RNA, 64 nt, Human
ugccaaggugaagagauacagccuuccguauccaucgaagcagaugcucugaacccugagcagg

SEQ ID NO: 379711 - RNA, 64 nt, Human
gaaaaaugaguuucaaauuuaagauguuuauugaucgaagcaauugaaguaucauggauuggau

SEQ ID NO: 379712 - RNA, 64 nt, Human
ugagcaguuguaaaacagguggauaccaacuaccucgaagcaaauuggugaaagaaaaggcaaa

SEQ ID NO: 379713 - RNA, 61 nt, Human
uucguucagacccugagugagucggaaaacuucgaagcagcuguuggcaaguuggccaaga

SEQ ID NO: 379714 - RNA, 64 nt, Human
aauggauuaaacuggcauuucaguccaaggaagcucgaagcagguuuaggaccagguccccuug

SEQ ID NO: 379715 - RNA, 64 nt, Human
aggucucacugacagcaugccagacacaacugaaucgaagcaggccugaagccuaggucagggu

SEQ ID NO: 379716 - RNA, 64 nt, Human
ggcuucuuacuggcauuguccaacucaucccuucucgaagcaugucuuugccaugggcuguguc

SEQ ID NO: 379717 - RNA, 64 nt, Human
ucuauuuuggagaaaaaaagaaaauaugagggucucgaagcaugauuuuuauauaacuaguuuc

SEQ ID NO: 379718 - RNA, 64 nt, Human
ggaggcaaaaagccagagauucugcaacacgaauucgaagcaaacaaacacaacacaacagaau

SEQ ID NO: 379719 - RNA, 64 nt, Human
uugguaugccuguauugcugggcugugcugcugcucgaagcagaugguuuugacugucuuuuug

SEQ ID NO: 379720 - RNA, 64 nt, Human
uugaagcagcugcccucauuccgacuucagaaaaucgaagcagcuggcuccuccccuuguucuc

SEQ ID NO: 379721 - RNA, 64 nt, Human
aacugcaaucacagccguccgcuggaaaaacguuucgaagcacaguggccagcgagcgagcacg

SEQ ID NO: 379722 - RNA, 64 nt, Human
aauguaaaaauuaauuucagcuucauuucguauuucgaagcaaucuagacuguugugaugagug

SEQ ID NO: 379723 - RNA, 64 nt, Human
cgagacaggcgcugcugcucacguggagacgcucucgaagcagaguugacggacacugcuccca

SEQ ID NO: 379724 - RNA, 64 nt, Human
uguguauuuugucacggcggaaaaucugcucgcaucgaagcauucuucuaagcgacuucgaugc

SEQ ID NO: 379725 - RNA, 64 nt, Human
ccggacucggcuccuggcagccgccucuucccucucgaagcaauaaacccaggcuggccggccg

SEQ ID NO: 379726 - RNA, 64 nt, Human
aaaacaguuguuccuguugugugguuuauagauuucgaagcaacaugucacaacaauaaccucc

SEQ ID NO: 379727 - RNA, 64 nt, Human
aaccaaaaagacagggaaaaccagauauuuagagucgaagcagcaugcaaaaaauaauaauguu

SEQ ID NO: 379728 - RNA, 64 nt, Human
auacaguauugaaaaucagaucaucaacaguauuucgaagcauguaaagguguuuaagacuucc

SEQ ID NO: 379729 - RNA, 64 nt, Human
cggcuuucccaaaaggcggcacccagcuccucaaucgaagcaucugccucccaccccucggccc

SEQ ID NO: 379730 - RNA, 64 nt, Human
cucaggaggccugcagaagagaacugauugguggucgaagcaccaucuucacagauguucaggg

SEQ ID NO: 379731 - RNA, 64 nt, Human
gaggauuucucagacacaugcaccagauucuggcucgaagcagccacugagccauaaugcgcag

SEQ ID NO: 379732 - RNA, 64 nt, Human
gaagcagccggcacaggagggaagguggccaggcucgaagcagucucuguuuccagcacugcac

SEQ ID NO: 379733 - RNA, 64 nt, Human
caaaauggggacaauggggauaaugauccccaccucgaagcacaguugugaguguuaaacaagc

SEQ ID NO: 379734 - RNA, 64 nt, Human
uaacuuccauuaugccaaacuugggaugggauuuucgaagcagacaacacuauuucaucguguu

SEQ ID NO: 379735 - RNA, 64 nt, Human
ccaauauuuuaaccaagugacaccgagguuuuuaucgaagcauuucacuuaaaugaacaaauca

SEQ ID NO: 379736 - RNA, 64 nt, Human
gcuuccuaagaauaguucucauuggaggcugaggucgaagcagccucccaccagcgaucccuug

SEQ ID NO: 379737 - RNA, 64 nt, Human
uuggauaaauugggccagaaaggcaggguagauuucgaagcacugguucuguugaaguuaaguu

SEQ ID NO: 379738 - RNA, 64 nt, Human
acggcauccuugcagccaccucugcugucacugcucgaagcagcagucucucuggaagcaucug

SEQ ID NO: 379739 - RNA, 64 nt, Human
gacucuuucugucuguggguucuguauucauggaucgaagcaaccauggaucaaaaguauuugg

SEQ ID NO: 379740 - RNA, 64 nt, Human
gaaugcaacucuggguguguguuuuugugggggcucgaagcagugacuauggccuccuuuguuc

SEQ ID NO: 379741 - RNA, 64 nt, Human
gccucagguuucucuaauuuccuccacucccaguucgaagcaaacagcuuacugccuagucccc

SEQ ID NO: 379742 - RNA, 64 nt, Human
uggguggcuucuuuuggaaaguacuaugaacgucucgaagcaguauucuagugauaagaauucu

SEQ ID NO: 379743 - RNA, 64 nt, Human; identical to SEQ ID NO: 277197

SEQ ID NO: 379744 - RNA, 64 nt, Human; identical to SEQ ID NO: 277198

SEQ ID NO: 379745 - RNA, 64 nt, Human; identical to SEQ ID NO: 277199

SEQ ID NO: 379746 - RNA, 64 nt, Human; identical to SEQ ID NO: 277200

SEQ ID NO: 379747 - RNA, 64 nt, Human; identical to SEQ ID NO: 277201

SEQ ID NO: 379748 - RNA, 64 nt, Human; identical to SEQ ID NO: 277202

SEQ ID NO: 379749 - RNA, 58 nt, Human; identical to SEQ ID NO: 277203

SEQ ID NO: 379750 - RNA, 64 nt, Human; identical to SEQ ID NO: 277204

SEQ ID NO: 379751 - RNA, 64 nt, Human; identical to SEQ ID NO: 277205

SEQ ID NO: 379752 - RNA, 64 nt, Human; identical to SEQ ID NO: 277206

SEQ ID NO: 379753 - RNA, 64 nt, Human; identical to SEQ ID NO: 277207

SEQ ID NO: 379754 - RNA, 64 nt, Human; identical to SEQ ID NO: 277208

SEQ ID NO: 379755 - RNA, 64 nt, Human; identical to SEQ ID NO: 277209

SEQ ID NO: 379756 - RNA, 64 nt, Human; identical to SEQ ID NO: 277210

SEQ ID NO: 379757 - RNA, 64 nt, Human; identical to SEQ ID NO: 277211

SEQ ID NO: 379758 - RNA, 64 nt, Human; identical to SEQ ID NO: 277212

SEQ ID NO: 379759 - RNA, 64 nt, Human; identical to SEQ ID NO: 277213

SEQ ID NO: 379760 - RNA, 64 nt, Human; identical to SEQ ID NO: 277214

SEQ ID NO: 379761 - RNA, 64 nt, Human; identical to SEQ ID NO: 277215

SEQ ID NO: 379762 - RNA, 64 nt, Human; identical to SEQ ID NO: 277216

SEQ ID NO: 379763 - RNA, 64 nt, Human; identical to SEQ ID NO: 277217

SEQ ID NO: 379764 - RNA, 64 nt, Human; identical to SEQ ID NO: 277218

SEQ ID NO: 379765 - RNA, 64 nt, Human; identical to SEQ ID NO: 277219

SEQ ID NO: 379766 - RNA, 64 nt, Human; identical to SEQ ID NO: 277220

SEQ ID NO: 379767 - RNA, 64 nt, Human; identical to SEQ ID NO: 277221

SEQ ID NO: 379768 - RNA, 64 nt, Human; identical to SEQ ID NO: 277222

SEQ ID NO: 379769 - RNA, 64 nt, Human; identical to SEQ ID NO: 277223

SEQ ID NO: 379770 - RNA, 64 nt, Human; identical to SEQ ID NO: 277224

SEQ ID NO: 379771 - RNA, 64 nt, Human; identical to SEQ ID NO: 277225

SEQ ID NO: 379772 - RNA, 64 nt, Human; identical to SEQ ID NO: 277226

SEQ ID NO: 379773 - RNA, 64 nt, Human; identical to SEQ ID NO: 277227

SEQ ID NO: 379774 - RNA, 64 nt, Human; identical to SEQ ID NO: 277228

SEQ ID NO: 379775 - RNA, 64 nt, Human; identical to SEQ ID NO: 277229

SEQ ID NO: 379776 - RNA, 64 nt, Human; identical to SEQ ID NO: 277230

SEQ ID NO: 379777 - RNA, 64 nt, Human; identical to SEQ ID NO: 277231

SEQ ID NO: 379778 - RNA, 64 nt, Human; identical to SEQ ID NO: 277232

SEQ ID NO: 379779 - RNA, 64 nt, Human; identical to SEQ ID NO: 277233

SEQ ID NO: 379780 - RNA, 64 nt, Human; identical to SEQ ID NO: 277234

SEQ ID NO: 379781 - RNA, 64 nt, Human; identical to SEQ ID NO: 277235

SEQ ID NO: 379782 - RNA, 64 nt, Human; identical to SEQ ID NO: 277236

SEQ ID NO: 379783 - RNA, 64 nt, Human; identical to SEQ ID NO: 277237

SEQ ID NO: 379784 - RNA, 64 nt, Human; identical to SEQ ID NO: 277238

SEQ ID NO: 379785 - RNA, 64 nt, Human; identical to SEQ ID NO: 277239

SEQ ID NO: 379786 - RNA, 64 nt, Human; identical to SEQ ID NO: 277240

SEQ ID NO: 379787 - RNA, 64 nt, Human; identical to SEQ ID NO: 277241

SEQ ID NO: 379788 - RNA, 64 nt, Human; identical to SEQ ID NO: 277242

SEQ ID NO: 379789 - RNA, 64 nt, Human; identical to SEQ ID NO: 277243

SEQ ID NO: 379790 - RNA, 64 nt, Human; identical to SEQ ID NO: 277244

SEQ ID NO: 379791 - RNA, 64 nt, Human; identical to SEQ ID NO: 277245

SEQ ID NO: 379792 - RNA, 64 nt, Human; identical to SEQ ID NO: 277246

SEQ ID NO: 379793 - RNA, 64 nt, Human; identical to SEQ ID NO: 277247

SEQ ID NO: 379794 - RNA, 64 nt, Human; identical to SEQ ID NO: 277248

SEQ ID NO: 379795 - RNA, 64 nt, Human; identical to SEQ ID NO: 277249

SEQ ID NO: 379796 - RNA, 64 nt, Human; identical to SEQ ID NO: 277250

SEQ ID NO: 379797 - RNA, 51 nt, Human; identical to SEQ ID NO: 277251

SEQ ID NO: 379798 - RNA, 64 nt, Human; identical to SEQ ID NO: 277252

SEQ ID NO: 379799 - RNA, 64 nt, Human; identical to SEQ ID NO: 277253

SEQ ID NO: 379800 - RNA, 64 nt, Human; identical to SEQ ID NO: 277254

SEQ ID NO: 379801 - RNA, 64 nt, Human; identical to SEQ ID NO: 277255

SEQ ID NO: 379802 - RNA, 64 nt, Human; identical to SEQ ID NO: 277256

SEQ ID NO: 379803 - RNA, 64 nt, Human; identical to SEQ ID NO: 277257

SEQ ID NO: 379804 - RNA, 64 nt, Human; identical to SEQ ID NO: 277258

SEQ ID NO: 379805 - RNA, 64 nt, Human; identical to SEQ ID NO: 277259

SEQ ID NO: 379806 - RNA, 64 nt, Human; identical to SEQ ID NO: 277260

SEQ ID NO: 379807 - RNA, 64 nt, Human; identical to SEQ ID NO: 277261

SEQ ID NO: 379808 - RNA, 64 nt, Human; identical to SEQ ID NO: 277262

SEQ ID NO: 379809 - RNA, 64 nt, Human; identical to SEQ ID NO: 277263

SEQ ID NO: 379810 - RNA, 64 nt, Human; identical to SEQ ID NO: 277264

SEQ ID NO: 379811 - RNA, 64 nt, Human; identical to SEQ ID NO: 277265

SEQ ID NO: 379812 - RNA, 64 nt, Human; identical to SEQ ID NO: 277266

SEQ ID NO: 379813 - RNA, 64 nt, Human; identical to SEQ ID NO: 277267

SEQ ID NO: 379814 - RNA, 64 nt, Human; identical to SEQ ID NO: 379700

SEQ ID NO: 379815 - RNA, 64 nt, Human; identical to SEQ ID NO: 379701

SEQ ID NO: 379816 - RNA, 64 nt, Human; identical to SEQ ID NO: 379702

SEQ ID NO: 379817 - RNA, 52 nt, Human; identical to SEQ ID NO: 379703

SEQ ID NO: 379818 - RNA, 64 nt, Human; identical to SEQ ID NO: 379704

SEQ ID NO: 379819 - RNA, 64 nt, Human; identical to SEQ ID NO: 379705

SEQ ID NO: 379820 - RNA, 64 nt, Human; identical to SEQ ID NO: 379706

SEQ ID NO: 379821 - RNA, 64 nt, Human; identical to SEQ ID NO: 379707

SEQ ID NO: 379822 - RNA, 64 nt, Human; identical to SEQ ID NO: 379708

SEQ ID NO: 379823 - RNA, 64 nt, Human; identical to SEQ ID NO: 379709

SEQ ID NO: 379824 - RNA, 64 nt, Human; identical to SEQ ID NO: 379710

SEQ ID NO: 379825 - RNA, 64 nt, Human; identical to SEQ ID NO: 379711

SEQ ID NO: 379826 - RNA, 64 nt, Human; identical to SEQ ID NO: 379712

SEQ ID NO: 379827 - RNA, 61 nt, Human; identical to SEQ ID NO: 379713

SEQ ID NO: 379828 - RNA, 64 nt, Human; identical to SEQ ID NO: 379714

SEQ ID NO: 379829 - RNA, 64 nt, Human; identical to SEQ ID NO: 379715

SEQ ID NO: 379830 - RNA, 64 nt, Human; identical to SEQ ID NO: 379716

SEQ ID NO: 379831 - RNA, 64 nt, Human; identical to SEQ ID NO: 379717

SEQ ID NO: 379832 - RNA, 64 nt, Human; identical to SEQ ID NO: 379718

SEQ ID NO: 379833 - RNA, 64 nt, Human; identical to SEQ ID NO: 379719

SEQ ID NO: 379834 - RNA, 64 nt, Human; identical to SEQ ID NO: 379720

SEQ ID NO: 379835 - RNA, 64 nt, Human; identical to SEQ ID NO: 379721

SEQ ID NO: 379836 - RNA, 64 nt, Human; identical to SEQ ID NO: 379722

SEQ ID NO: 379837 - RNA, 64 nt, Human; identical to SEQ ID NO: 379723

SEQ ID NO: 379838 - RNA, 64 nt, Human; identical to SEQ ID NO: 379724

SEQ ID NO: 379839 - RNA, 64 nt, Human; identical to SEQ ID NO: 379725

SEQ ID NO: 379840 - RNA, 64 nt, Human; identical to SEQ ID NO: 379726

SEQ ID NO: 379841 - RNA, 64 nt, Human; identical to SEQ ID NO: 379727

SEQ ID NO: 379842 - RNA, 64 nt, Human; identical to SEQ ID NO: 379728

SEQ ID NO: 379843 - RNA, 64 nt, Human; identical to SEQ ID NO: 379729

SEQ ID NO: 379844 - RNA, 64 nt, Human; identical to SEQ ID NO: 379730

SEQ ID NO: 379845 - RNA, 64 nt, Human; identical to SEQ ID NO: 379731

SEQ ID NO: 379846 - RNA, 64 nt, Human; identical to SEQ ID NO: 379732

SEQ ID NO: 379847 - RNA, 64 nt, Human; identical to SEQ ID NO: 379733

SEQ ID NO: 379848 - RNA, 64 nt, Human; identical to SEQ ID NO: 379734

SEQ ID NO: 379849 - RNA, 64 nt, Human; identical to SEQ ID NO: 379735

SEQ ID NO: 379850 - RNA, 64 nt, Human; identical to SEQ ID NO: 379736

SEQ ID NO: 379851 - RNA, 64 nt, Human; identical to SEQ ID NO: 379737

SEQ ID NO: 379852 - RNA, 64 nt, Human; identical to SEQ ID NO: 379738

SEQ ID NO: 379853 - RNA, 64 nt, Human; identical to SEQ ID NO: 379739

SEQ ID NO: 379854 - RNA, 64 nt, Human; identical to SEQ ID NO: 379740

SEQ ID NO: 379855 - RNA, 64 nt, Human; identical to SEQ ID NO: 379741

SEQ ID NO: 379856 - RNA, 64 nt, Human; identical to SEQ ID NO: 379742

SEQ ID NO: 379857 - RNA, 64 nt, Human
agagaccacacgcaguauugagcugccugagugggcgugguaccugcugugggugccagcgccc

SEQ ID NO: 379858 - RNA, 64 nt, Human
auuuuuaauuauauggcuugaguuuaaauuguaauaggcguaacuaauuuuaacucuauaaugu

SEQ ID NO: 379859 - RNA, 64 nt, Human
gggcugcuuaggucucauggaccaguggcuggucucacccaacugcaguuuacuauugcuaucu

SEQ ID NO: 379860 - RNA, 64 nt, Human
ggacaaaauacugacucaguccuuagauguaguuucacccaagagcaucuuggcccugggaaga

SEQ ID NO: 379861 - RNA, 64 nt, Human
agacgauaucugguagagagggccagagaugcccgcgugguagggcugcuggcaggcacacugg

SEQ ID NO: 379862 - RNA, 64 nt, Human
gcagaagucuaagaauguaccuuuuucuggccgggcgugguagcucaugccuguaaucccagca

SEQ ID NO: 379863 - RNA, 64 nt, Human
gaggaagauuaaugaaagaacauuguuauauucugcgugguauauuuuaaaguuuaagaaggca

SEQ ID NO: 379864 - RNA, 64 nt, Human
ccccaucucuaugaagaauaaaaaaaugagcuaggcgugguagugcacaccuguaguccuagcu

SEQ ID NO: 379865 - RNA, 64 nt, Human
agccuguaucuauuaaaagacaaaaauuagcugggcgugguaguacaugccuguaaucccagcu

SEQ ID NO: 379866 - RNA, 64 nt, Human
agucaccuuaacuuugaaccauucuuuggaauuggcgugguauauuuaaccacgggagcguguc

SEQ ID NO: 379867 - RNA, 64 nt, Human
acacuaucuguacuaaaaacacaaaauuagcugggcgugguagugcgugccuguaaucccagcu

SEQ ID NO: 379868 - RNA, 64 nt, Human
aagcagugaugagggcggccaguaccugcggugugcgugguagguuuaaagaaaagggaauguu

SEQ ID NO: 379869 - RNA, 64 nt, Human
uccugucuccacuaaaaacacaaaaauuagucaggcgugguagugggugccuguaaucccagcu

SEQ ID NO: 379870 - RNA, 64 nt, Human
augggggaaauggagauggcacgggcuccucagagcgugguagccgacugugaggaaaagcaga

SEQ ID NO: 379871 - RNA, 64 nt, Human
acuguaaguuacuuaagaucauuuuuggaagcaggcgugguagaguccuguaaaugaaugcucu

SEQ ID NO: 379872 - RNA, 64 nt, Human
gcauuuccauuucuaaagauggacaggcccuuuggcgugguaccaaccagauaaugacugcauc

SEQ ID NO: 379873 - RNA, 64 nt, Human
guggcccuuggggggcugcagagcuggagggugggcgugguacgugugcgccaggacucgggcg

SEQ ID NO: 379874 - RNA, 64 nt, Human
auucucauuuguucucacaccaacagugugaagugcgugguauaaucuccauuucaaaaccaag

SEQ ID NO: 379875 - RNA, 64 nt, Human
accccaucucuacuaaaaauacaaaauuagccgggcgugguagcgcauggcuguaauccuggcu

SEQ ID NO: 379876 - RNA, 64 nt, Human
cuccaucucuacugaaaauacaaaaauuagcugggcgugguagugcaagcugaaggcugaggca

SEQ ID NO: 379877 - RNA, 64 nt, Human; identical to SEQ ID NO: 136761

SEQ ID NO: 379878 - RNA, 64 nt, Human; identical to SEQ ID NO: 136762

SEQ ID NO: 379879 - RNA, 64 nt, Human; identical to SEQ ID NO: 136785

SEQ ID NO: 379880 - RNA, 64 nt, Human
auauuaacaagccagcaaagugugucagaccauggcgugguauuuauugugcagcagauccaga

SEQ ID NO: 379881 - RNA, 64 nt, Human
agccucgugggcuuugugacggcccaguggcucugcgugguacaugacugagaagagaaaaaca

SEQ ID NO: 379882 - RNA, 64 nt, Human
uguggcacuugggcugaaaggugauaauggcauugcgugguagcugacaaugagcaccuucggu

SEQ ID NO: 379883 - RNA, 64 nt, Human
ccccgucuguacucaaaaugcaaaaauuagccaggcgugguagcaggcaccuguaaucccagcu

SEQ ID NO: 379884 - RNA, 64 nt, Human
cacgccacucuuacucaguucagugggugugcuugcgugguaggauguggugcagcccucucua

SEQ ID NO: 379885 - RNA, 64 nt, Human
aucagaccgauuuccugcccaccugaccagcccagcgugguaaaccucuguauauugagaccuu

SEQ ID NO: 379886 - RNA, 64 nt, Human
cgacagcacagacugacuuuauaccuucauuucagcgugguaaaaaccgauuaacacuucuaau

SEQ ID NO: 379887 - RNA, 64 nt, Human
aagaaauuaagaaaaacguuuaagucuagccucugcgugguagacagguauggggagggagaau

SEQ ID NO: 379888 - RNA, 64 nt, Human
gguccaaagugcguguguguaugugugagugggugcgugguauacauguguacauauauguaua

SEQ ID NO: 379889 - RNA, 64 nt, Human
cgcucugcccgggggacuccggacacugacagccgcgugguacaaaauaaacguguauuuguug

SEQ ID NO: 379890 - RNA, 64 nt, Human
cgcucugcccuggagacuccggacacugacagccgcgugguacagaauaaacguuauuuauuuu

SEQ ID NO: 379891 - RNA, 64 nt, Human
cucucgccccaugagguuguguugugucuucuaagcgugguacuagugcuugccaccuggucac

SEQ ID NO: 379892 - RNA, 64 nt, Human
uucaugccaaaccccacgcggcugucaacugugugcgugguaggcauggagauccugguugugc

SEQ ID NO: 379893 - RNA, 64 nt, Human
cccaucucuacuaaaaauacaaaaaauuagccgggcgugguagcgggcgccuguagucccagcu

SEQ ID NO: 379894 - RNA, 64 nt, Human
cucaucuccaaauaaaacguguuuuauuccuuuagcgugguaaauauagcucuauggcugauua

SEQ ID NO: 379895 - RNA, 64 nt, Human
gcgucagacagcaaggaacugucaccagccgcacgcgugguaaaugacccagacccaacucgcc

SEQ ID NO: 379896 - RNA, 64 nt, Human; identical to SEQ ID NO: 136804

SEQ ID NO: 379897 - RNA, 64 nt, Human; identical to SEQ ID NO: 136805

SEQ ID NO: 379898 - RNA, 64 nt, Human; identical to SEQ ID NO: 136807

SEQ ID NO: 379899 - RNA, 64 nt, Human
gagugucuuucuccaagcugagacgugggcggccgcgugguaucucccgagggcugcuuggacc

SEQ ID NO: 379900 - RNA, 64 nt, Human
gacauggcuccaggugcuuagcaaucaauggugagcgugguauuccaggcuaaagguaauuaac

SEQ ID NO: 379901 - RNA, 64 nt, Human
ccccuucucuacuaaaaauacaaaaauuagcugggcgugguagugcaugccuguaaucccagcu

SEQ ID NO: 379902 - RNA, 64 nt, Human
ucucugccaaaaaauuuuuuaaacuauuagccuggcgugguagcgcacgccuguggucccagcu

SEQ ID NO: 379903 - RNA, 64 nt, Human
caugaccucccacccuaggagggagggaaggacaccguccuaggguauaaccuggcaauaaacc

SEQ ID NO: 379904 - RNA, 64 nt, Human
auaacccuucucuccacacccccuacccccacccccguccuaggcucccauccuuuccaucaag

SEQ ID NO: 379905 - RNA, 64 nt, Human
gguauuuacuuuaggguucuuuuaauaauaauguccguccuaaugcuuuaaauauaugauuuaa

SEQ ID NO: 379906 - RNA, 64 nt, Human
ccugaggaaggaguagaggcuggguuggcuggagccguccuacugggcaagauggcgccccacu

SEQ ID NO: 379907 - RNA, 64 nt, Human
gaggcaccuacacucaccugcacuaacagaguggccguccuaaccucgggccugcugcgcagac

SEQ ID NO: 379908 - RNA, 64 nt, Human
agccauaccauccacugguuccagcugacaguggccguccuacggguggaagcacugaccguau

SEQ ID NO: 379909 - RNA, 64 nt, Human
ccuccuccucuuucaccuucauacaagcaggcccccguccuaucaguacaccccccugugaugc

SEQ ID NO: 379910 - RNA, 64 nt, Human
ucuucagcacauuccuuuacuaagcaguuuaaagccguccuaguggagcaagcccuaaagcaga

SEQ ID NO: 379911 - RNA, 64 nt, Human; identical to SEQ ID NO: 136798

SEQ ID NO: 379912 - RNA, 64 nt, Human; identical to SEQ ID NO: 136799

SEQ ID NO: 379913 - RNA, 64 nt, Human
ggcugggcugcccugcuccuggucaggccggagcccguccuaagacacacgcuuugcagagcug

SEQ ID NO: 379914 - RNA, 64 nt, Human
augaauguuuggacuguacaucuaaagaaugauuccguccuaacacccacccagccuguuugaa

SEQ ID NO: 379915 - RNA, 64 nt, Human
gccgugaggucucugucgaaacuacucaacucugccguccuagcacaaaagcagccauagacaa

SEQ ID NO: 379916 - RNA, 64 nt, Human
cacacacacacacacacacacacacacacacacaccguccuacacuuuaagcugcuccuuuggu

SEQ ID NO: 379917 - RNA, 64 nt, Human
ggucugagucuuucccaccuggggccgccgucuuccguccuaggagacuccaggacacccucug

SEQ ID NO: 379918 - RNA, 64 nt, Human
agcagucagcaccaguucugcaccagcagcgccuccguccuaguggguguuccuguuucuccug

SEQ ID NO: 379919 - RNA, 64 nt, Human
uuucuaacaaauccacaaauagccccgagauucaccguccuagagcuuaggccugucuuccacc

SEQ ID NO: 379920 - RNA, 64 nt, Human
caaucccagacuucacacaguauucucccccacgccguccuaugaccaaaggccccugccaggu

SEQ ID NO: 379921 - RNA, 64 nt, Human
cagccgacucugagauuagcuggcuucuccacggccguccuauagacaggauuucuaaagcuca

SEQ ID NO: 379922 - RNA, 64 nt, Human
gucucuucagccaccucccaggaagaucuggccuccguccuaugcccacuuuagauguaucuaa

SEQ ID NO: 379923 - RNA, 64 nt, Human
gcugagcugccagagagucuucccggaccuauucccguccuaugcauucacauuggcauccugg

SEQ ID NO: 379924 - RNA, 64 nt, Human
uguaaauguuguagagaugugggccguggcccaaccguccuauaugagauguagcaugguacag

SEQ ID NO: 379925 - RNA, 64 nt, Human
gagaaacagcaguaugaaucuugacgguuucugcccguccuaauggcagagcucucugacuugg

SEQ ID NO: 379926 - RNA, 64 nt, Human
auguucuuuaacugcaacacuauaaugucucaccccguccuagucccaccaauuagucaacucu

SEQ ID NO: 379927 - RNA, 64 nt, Human
ugcuauucuguguuuuggaaaagaagaaauagugccguccuauuuauuucuauauuuagaaauu

SEQ ID NO: 379928 - RNA, 64 nt, Human
aggggcuggugcucauccccacccccagcgacuuccguccuaccuggcaugcugcagcccucug

SEQ ID NO: 379929 - RNA, 64 nt, Human; identical to SEQ ID NO: 136773

SEQ ID NO: 379930 - RNA, 64 nt, Human; identical to SEQ ID NO: 136774

SEQ ID NO: 379931 - RNA, 64 nt, Human
ugaugcaaaaccacaaagggaccuaccugagccaccguccuagccaagcgagcaaaccugcagg

SEQ ID NO: 379932 - RNA, 64 nt, Human
ggcagggcaggugcugcguggggcccucuccagcccguccuacccugggcucacauggggccug

SEQ ID NO: 379933 - RNA, 64 nt, Human
gacaaaggaccccaggaccaggcagaaggcgccuccguccuagccacucaggaaucaucgagga

SEQ ID NO: 379934 - RNA, 64 nt, Human
ucccuccucacgaugcacccaccgcccugagggcccguccuaggaauggauguggggauggucg

SEQ ID NO: 379935 - RNA, 64 nt, Human
gucgcugagacuccccuucgaggauugcacccgcccguccuaagccuccccacaaggcgagggg

SEQ ID NO: 379936 - RNA, 64 nt, Human
gccauauuuuguaugagcgcuuggcgcuccuccuccguccuaucccaacucacccccaaacccc

SEQ ID NO: 379937 - RNA, 64 nt, Human
cuggaucugcacgugcccuuguagaggauccuuaccguccuagagagcagacgcuuucugaaaa

SEQ ID NO: 379938 - RNA, 64 nt, Human
aaucuguagauugguuuccauacagggaaguucuccguccuaugcaauguuucuaauuaauuug

SEQ ID NO: 379939 - RNA, 64 nt, Human
gcuggggggagagcgcaauaccucacgcgggcugccguccuaaucaacgugccuauggcgggac

SEQ ID NO: 379940 - RNA, 64 nt, Human
aucugcaccaguacacaggcaggcauuaucauucuucaccuacuuuuuaaauaguggcaacuug

SEQ ID NO: 379941 - RNA, 64 nt, Human
uugagaaauauuuuucuuucaaauucugguuccuuucaccuauguaaccgcaucccucaggcau

SEQ ID NO: 379942 - RNA, 64 nt, Human
uuuauuaaaacuuguguggcacuuuaacauugcuuucaccuauauuuuguguacuuuguuacuu

SEQ ID NO: 379943 - RNA, 64 nt, Human
aaggcagggccuuuccaguccucacaaccuguccuucaccuagucccuccugacccagggaugg

SEQ ID NO: 379944 - RNA, 64 nt, Human
ugacacaaaaaaaguugaaggccuuauucuacauuucaccuacuuuguaagugagagagacaag

SEQ ID NO: 379945 - RNA, 64 nt, Human
cucucagaagcgcuaccgggccgccagugccuucuucaccuacgugucgcugagccaggaaggc

SEQ ID NO: 379946 - RNA, 64 nt, Human
gagccccacccaaggggacccuggucucuccgccuucaccuagcaaugggaacccugcuuccca

SEQ ID NO: 379947 - RNA, 64 nt, Human
aacagaugcuauagaacucuuuuaauauguuuaauucaccuaucacacucuguuaaaaacacau

SEQ ID NO: 379948 - RNA, 64 nt, Human
ugcuuggcucuuuaaacacaucagugcuuccacauucaccuauguauuuauuauucaaaagugu

SEQ ID NO: 379949 - RNA, 64 nt, Human
ccaaaauaagacuuagaacuguacagguuggcccuucaccuaguugacucagcccucgauaguc

SEQ ID NO: 379950 - RNA, 64 nt, Human
uuugugguuuaguuuauuuacucacuucauguuuuucaccuauaaaauugucaagcuagcaaaa

SEQ ID NO: 379951 - RNA, 64 nt, Human
aagaauuguuccuuggggaaaaauuuuuuuaaaauucaccuagaaucauagggccucauuuugu

SEQ ID NO: 379952 - RNA, 64 nt, Human
gcgauaucacuuuaacuuucugaaccucagagucuucaccuauaagacggggaaaauaauacca

SEQ ID NO: 379953 - RNA, 64 nt, Human
ucaggggcaauuuggcacucagauucuacucuacuucaccuaaccaccccuagaucugaguuuu

SEQ ID NO: 379954 - RNA, 64 nt, Human
caugaaggaaagagauuuugccucucuuuuacuuuucaccuaaguuucucugagaaauagagac

SEQ ID NO: 379955 - RNA, 64 nt, Human
gagaaaacuccacuggggcuugcagaauccaggguucaccuaagcugcacaguuccugcagcuu

SEQ ID NO: 379956 - RNA, 64 nt, Human
gucuucuagagccuuugauccagcaauaccccacuucaccuacaauauuguuaacuauuuguua

SEQ ID NO: 379957 - RNA, 64 nt, Human
ugauugaaacucacugcaaaaucaccacgacucuuucaccuacugagaugauugaccgagguuu

SEQ ID NO: 379958 - RNA, 64 nt, Human
auuauacacauuauuggaccauaaggacauuuguuucaccuagauuuuaagauuauggagacug

SEQ ID NO: 379959 - RNA, 64 nt, Human
cugccuccuagaauauagacugucuguauuauuauucaccuauaauuagucauuaugaugcuuu

SEQ ID NO: 379960 - RNA, 64 nt, Human
ucuuugcacuuacacacacucuuccuguucugccuucaccuaugccgggauaagcagagaucuc

SEQ ID NO: 379961 - RNA, 64 nt, Human; identical to SEQ ID NO: 136792

SEQ ID NO: 379962 - RNA, 64 nt, Human; identical to SEQ ID NO: 136793

SEQ ID NO: 379963 - RNA, 64 nt, Human
gaaagcugugugacugccugagagaaccuguuucuucaccuaaaaaaugggacuuuuugucuca

SEQ ID NO: 379964 - RNA, 64 nt, Human
uuauuaaguuuccaaauuuaauuugaauuccaaauucaccuagcaauaaaaucuaauuuuuaaa

SEQ ID NO: 379965 - RNA, 64 nt, Human
cucucugcguccuauuucauuagugaagacauaguucaccuaaaauggcauccugcucugaauc

SEQ ID NO: 379966 - RNA, 64 nt, Human
uuuaguucuagaaucaccuguugacuccucagacuucaccuaacuuuggaaacucucuuuugga

SEQ ID NO: 379967 - RNA, 64 nt, Human
ucauguuuucaauaugcaguuuugaaaaugaggauucaccuagacuuuuuuagauuuacuacua

SEQ ID NO: 379968 - RNA, 64 nt, Human
caacuauuuuuugacccucugaaaauuauuauacuucaccuaaauggaagacugcuguguuugu

SEQ ID NO: 379969 - RNA, 64 nt, Human
uguuaaaaaagaacugcaaagagacggacuccuguucaccuaggugaggugugugcagcaguug

SEQ ID NO: 379970 - RNA, 64 nt, Human
uaauacuccauugucuagaugaauaguuuauccauucaccuauugaaagacuucuuggugguuu

SEQ ID NO: 379971 - RNA, 64 nt, Human
aguuuuccuaaauguauaccuguaacugcagcaguucaccuauuucaaaaauuuggaauucugu

SEQ ID NO: 379972 - RNA, 64 nt, Human
aucaugcuuugaaaaaucacuugauucauaaagauucaccuaagagauucugauuugccacuga

SEQ ID NO: 379973 - RNA, 64 nt, Human
caagaauucuuauuucuauaauaaauuaacaagauucaccuaaccuuugaaaauaaaguaguau

SEQ ID NO: 379974 - RNA, 64 nt, Human
gagugaagacacuuggcagacuugagccagacacuucaccuaguaguuccugaaacugugagca

SEQ ID NO: 379975 - RNA, 64 nt, Human
cuucaggcccuuacacaaaagccaugaagagauguucaccuacccgguauuuuaaauguucugu

SEQ ID NO: 379976 - RNA, 64 nt, Human
uuuuguuacucugagagcuguucacuucucugaauucaccuagagugguuggaccaucagaugu

SEQ ID NO: 379977 - RNA, 64 nt, Human
ggccagcucuaugcaaagggaaaagcauguugcauucaccuaggccaagaaacaguguuguagg

SEQ ID NO: 379978 - RNA, 64 nt, Human
uguacaguauauuacucuugacaguuugaauuucuucaccuaaagauaauucucugaaaguacu

SEQ ID NO: 379979 - RNA, 64 nt, Human
aggaauggaacugauggauuccucucccacugccucacccaaaaaaaacggucuuggcggccua

SEQ ID NO: 379980 - RNA, 64 nt, Human
agagucggggaggaucugcgcagagaccgcagcaucacccaaaucggcgccggccccgggagga

SEQ ID NO: 379981 - RNA, 64 nt, Human
aaauccucuggguuuugacuuuuuggcuuccacuucacccaaaauguuaaaauuuuuacuuaau

SEQ ID NO: 379982 - RNA, 64 nt, Human
ugggcaguauguaguuauuuauuacaaaauuauauucaccuaaaugccaaccaucuacaaaaac

SEQ ID NO: 379983 - RNA, 64 nt, Human
gcgagcuggccucugccccacagucucaucuguacaccgacaggguugaugccucccucacagg

SEQ ID NO: 379984 - RNA, 64 nt, Human
ugacagucuccuuccagcucucccuaaucgacuccaccgacaaggucccuaccccagagcuucc

SEQ ID NO: 379985 - RNA, 64 nt, Human
gccaaaagagggugcugccccuagccugggcccccaccgacagacugcagcugcguuacugugc

SEQ ID NO: 379986 - RNA, 64 nt, Human
auuggccuuccuuaggcuggcuacuugucaccaucaccgacaucacuguugccugcaaggacac

SEQ ID NO: 379987 - RNA, 64 nt, Human
uucuuggcagcacuccacucaccuucagcuccugcaccgacaucaggaacccacggccaccacc

SEQ ID NO: 379988 - RNA, 64 nt, Human
gucgggggguggcugccagggggcaaggagaaagcaccgacaaucuuugauuacugaaaguauu

SEQ ID NO: 379989 - RNA, 64 nt, Human
aauaagcaugaaucaaaugguaaugcccaauauccaccgacacugcuuuucuugaaugaacagc

SEQ ID NO: 379990 - RNA, 64 nt, Human
caaagcaaauuuuuuuaaaagcagcguauguaagcaccgacacccacucaaaacagcucuuucu

SEQ ID NO: 379991 - RNA, 64 nt, Human
gagucucccacagggaggccauuccccuucuacucaccgacaucccucccagcaccacacaccc

SEQ ID NO: 379992 - RNA, 64 nt, Human
aaauuuuuuaugaucucuaaaccauaaaagaaaacaccgacagcuguaaaauguucuaagauaa

SEQ ID NO: 379993 - RNA, 64 nt, Human
caucaacuccuucuagcauccagcaagucaaugucaccgacagugaugaggaggaagaagaaaa

SEQ ID NO: 379994 - RNA, 64 nt, Human
cagucucggcagcagcuccgcucccggcgccacccaccgacacccccagaacccucugggggcc

SEQ ID NO: 379995 - RNA, 64 nt, Human
uauagaagcucagccuggccugcuccccucuggucaccgacaccccuguccucgcugggacaag

SEQ ID NO: 379996 - RNA, 64 nt, Human
aaucuacaucuggaccauuccuuaaguuuuuccucaccgacaguaccaucaugccuugaguguu

SEQ ID NO: 379997 - RNA, 64 nt, Human
gcugcacaucacaacauuuacuuaacagaacagucaccgacaacaugcugugugcuggagacac

SEQ ID NO: 379998 - RNA, 64 nt, Human
ccugucucuacuaaaaauacaaaaaaaaauuagcuaggcguagugguuggcaccuauaguccca

SEQ ID NO: 379999 - RNA, 64 nt, Human
uaaaauauacuuuuuuuuuuuuuuuugguaaagguaggcguauuuuaagauauuuucuuaacuu

SEQ ID NO: 380000 - RNA, 64 nt, Human
guacucgccccuuggccacagugcccagacccauguaacccacuggcuccugcauuaacccaga

SEQ ID NO: 380001 - RNA, 64 nt, Human
acugaccaucagcucugaacuguggcuuuuuuuguucaccuaugaugccauguaccaaauucag

SEQ ID NO: 380002 - RNA, 64 nt, Human
acagaauuuacuuuaaaugucacguaaaaacaaauucaccuaagauagucuugcuuauuuuguu

SEQ ID NO: 380003 - RNA, 64 nt, Human
caauugaccuaugacaaacugugaaccugcagauuucaccuauuuugauuuacuauaagagcug

SEQ ID NO: 380004 - RNA, 64 nt, Human
auuuuaaaauguucauguucuguucuauauuuucuucaccuacucuccaaauauuguaaugcaa

SEQ ID NO: 380005 - RNA, 64 nt, Human
uguguguacaacacuggugacuccaggaaccauuuucaccuauuaccaguguucccuggggacu

SEQ ID NO: 380006 - RNA, 64 nt, Human
ggucgagaugcaauaacacuucguaagcaacgaguucaccuaaguaaggcucagauccuaguuu

SEQ ID NO: 380007 - RNA, 64 nt, Human
guaggguacccugcguccucgaaaagccagaggguucaccuagucagacgaaacuccagaacag

SEQ ID NO: 380008 - RNA, 64 nt, Human
ccauaauuuauaaucauuauuuuuuacuuuuggguucaccuagaucauaugaguugaugugaua

SEQ ID NO: 380009 - RNA, 64 nt, Human
ucucaccacagacgucuuugcuaauuuggccaccuucaccuacugacaugaccaggauuuuccu

SEQ ID NO: 380010 - RNA, 64 nt, Human
ucuuuaauacuaagagauggguaccuuaguacccuucaccuaacaucucucgguaaaaagcaga

SEQ ID NO: 380011 - RNA, 62 nt, Human
caaggcuaauaucaauaguuuauaagcaguauauuucaccuacacuaaauaugggcauuuua

SEQ ID NO: 380012 - RNA, 64 nt, Human
acuuaggcuaaguuaauuuggauuuguuacuugauucaccuacugaccuuuucuuuuguuugaa

SEQ ID NO: 380013 - RNA, 64 nt, Human
aaaccucaugcuuuuaggcauaucuauguugaauuucaccuagggaauguucuguucuuaguua

SEQ ID NO: 380014 - RNA, 64 nt, Human
aucuugauuagauccaaagucaaagcaaccauacuucaccuagagaagacaguauuggcaauca

SEQ ID NO: 380015 - RNA, 64 nt, Human
aguccauuuccccuuccuauuucagcuguuccuuuucaccuaacuguucagucauucugguuuu

SEQ ID NO: 380016 - RNA, 64 nt, Human
aguaaauaugauuuagggguuuugugggaucuuuuucaccuaagaguuuccuagcucugucaca

SEQ ID NO: 380017 - RNA, 64 nt, Human; identical to SEQ ID NO: 136776

SEQ ID NO: 380018 - RNA, 64 nt, Human; identical to SEQ ID NO: 136777

SEQ ID NO: 380019 - RNA, 64 nt, Human; identical to SEQ ID NO: 136778

SEQ ID NO: 380020 - RNA, 64 nt, Human
ucaaccugcuggcgggcugucuauggauugggguuucaccuaaucaugcuguguuuccuuucuu

SEQ ID NO: 380021 - RNA, 64 nt, Human
guuuugcaggccaccuagaaauacaaaaugccaauucaccuaauuuuuauacugaaauguagau

SEQ ID NO: 380022 - RNA, 56 nt, Human
cuacagcaggagaaaguugaagguucuucaccuaccaacgaggggagagagcugug

SEQ ID NO: 380023 - RNA, 64 nt, Human
acaaaugaaaaaggcaauugaaaaucccagcuauuucaccuagauggaauagccacccugagca

SEQ ID NO: 380024 - RNA, 64 nt, Human
uccauaugauauucaacauuuuacaacugcaguauucaccuaaaguagaaauaaucuguuacuu

SEQ ID NO: 380025 - RNA, 64 nt, Human
ggcugacuguacaaaugacuccuggaaaaaacucuucaccuagucuagaauagggagguggaga

SEQ ID NO: 380026 - RNA, 64 nt, Human
gcuugcugcaggcggcccagccguguauuuauuuuucaccuaucuccuuccugucaaggcaggc

SEQ ID NO: 380027 - RNA, 64 nt, Human
uaccuuucuaaaauaugaaauuuuguaagauguuuucaccuaaauaaaaauugaaagcaagugg

SEQ ID NO: 380028 - RNA, 64 nt, Human
ccccaggugacuuacuaaaaauaguugaaaauuauucaccuaagaauagaaucucagcauugug

SEQ ID NO: 380029 - RNA, 64 nt, Human
ggauuugggcaacauucugcagucuuugcaauaguucaccuauaauccuauuuuaaaucucaga

SEQ ID NO: 380030 - RNA, 64 nt, Human
guguauugugcuuagaaagguugcagauuucaucuucaccuaccaagaggcggccgccuccuug

SEQ ID NO: 380031 - RNA, 64 nt, Human
cuauguaaacuacuucucuuguuagguaauuuuuuucaccuagauuuuuuucccaauugagaaa

SEQ ID NO: 380032 - RNA, 64 nt, Human
acuccaaagccugcguucucaucccagucugauauucaccuaaguuuccggacccuuuuccuua

SEQ ID NO: 380033 - RNA, 64 nt, Human
cuuauuuugaagaaaauccuagacaucaaaucauuucaccuauaaaaaugucaucauauauaau

SEQ ID NO: 380034 - RNA, 64 nt, Human
cuugaucaccacaacucaauuauuucggcaucuuuucaccuaugcugugauuuguuuuuuuuuu

SEQ ID NO: 380035 - RNA, 64 nt, Human
cuuaaagaacgagagcaucuuguucauugccuuuuucaccuaagcauagggggaaaaacucuca

SEQ ID NO: 380036 - RNA, 64 nt, Human; identical to SEQ ID NO: 136770

SEQ ID NO: 380037 - RNA, 64 nt, Human; identical to SEQ ID NO: 136771

SEQ ID NO: 380038 - RNA, 64 nt, Human; identical to SEQ ID NO: 136772

SEQ ID NO: 380039 - RNA, 64 nt, Human
uguggacccacauacuuacugccuuuuguggaaauucaccuagagugaguacuuuccuugugca

SEQ ID NO: 380040 - RNA, 64 nt, Human
caauuucaaaaaaauaaaauaaaauaaaaauaaauucaccuagucuaaggaugcuaaaccuuag

SEQ ID NO: 380041 - RNA, 55 nt, Human
aacagacuggugaaaaguaaaccuuuucaccuacaaaauuucaccugcaaaccuu

SEQ ID NO: 380042 - RNA, 64 nt, Human
aauucgcugaaaaaggaacuaccuauccuuacauuucaccuacuaaugucucuucuaacaucuu

SEQ ID NO: 380043 - RNA, 64 nt, Human
ugggaaaacuuuaauauccguaccugaaggcugauucaccuaaaaauguguuaacugaaagaaa

SEQ ID NO: 380044 - RNA, 64 nt, Human
ugaccuguguguguguguguggggggguggggccuucaccuaagaccucugcagcagaccugga

SEQ ID NO: 380045 - RNA, 64 nt, Human
agguuuaagauagcuccuuucuggaccucaguccuucaccuagucaccuagucacaggguggau

SEQ ID NO: 380046 - RNA, 64 nt, Human
gacauuuguaacauuuccucuuugagacucugaguucaccuagagaagucuaagcauaacagcu

SEQ ID NO: 380047 - RNA, 64 nt, Human
ugucacuguuaacacuuuucacucuuucuguugauucaccuaacucauuauuuugcuuuauuaa

SEQ ID NO: 380048 - RNA, 62 nt, Human
auuauuuaagcauaaaauaaauuguguuaaacucuucaccuaucugugcucuacagucuccu

SEQ ID NO: 380049 - RNA, 64 nt, Human
ucugauauuuuugagccauucuauuguguucuacuucaccuaaaaaaauaaaauaaaaauguug

SEQ ID NO: 380050 - RNA, 64 nt, Human
aauacuuggaccucagccaaccucucgaacaguauucaccuaguuacccugacacaagaaguuc

SEQ ID NO: 380051 - RNA, 63 nt, Human
uaugcccaccaagcucuugaauuuucucauuucuucaccuacaacccuuugucuugacuuauc

SEQ ID NO: 380052 - RNA, 64 nt, Human
gaaaacagccacuccuauucugagucuugguuucuucaccuagaaagugaggguuuggacuaga

SEQ ID NO: 380053 - RNA, 64 nt, Human
cccuguaguuugaaagugaaguaaagauuuagaauucaccuaaguccaaaggaaaacacguggu

SEQ ID NO: 380054 - RNA, 64 nt, Human
aaagaaaagaucacauuuguauauucaacaaucuuucaccuauuucauaagucauuuuuucacc

SEQ ID NO: 380055 - RNA, 64 nt, Human; identical to SEQ ID NO: 136782

SEQ ID NO: 380056 - RNA, 64 nt, Human; identical to SEQ ID NO: 136783

SEQ ID NO: 380057 - RNA, 64 nt, Human; identical to SEQ ID NO: 136784

SEQ ID NO: 380058 - RNA, 64 nt, Human
aaguuaauaauccuauauaauaauugcuuuggcuuucaccuaaaauucugggcaucacaauuuc

SEQ ID NO: 380059 - RNA, 64 nt, Human
gcugcccccuccccccaggugggucccccugcuuuucaccuaucuacuccugagcuuccccaac

SEQ ID NO: 380060 - RNA, 64 nt, Human
aaauuuaaaaccaaaaacuauucuguuguuuuucuucaccuacuagccuuaguuuuuaaccaag

SEQ ID NO: 380061 - RNA, 64 nt, Human
agcaucgagggcgaggggaauaugaaaguuggucuucaccuaauuaccuguuugguuuggauuu

SEQ ID NO: 380062 - RNA, 64 nt, Human
auucaugucucuacccacuaugcacagauuaaacuucaccuacaaacuccuuaauaugaucugu

SEQ ID NO: 380063 - RNA, 64 nt, Human
ccuggagaagcuggguuauacccaggacaugauuuucaccuacuaacaccuccacgugcucagc

SEQ ID NO: 380064 - RNA, 64 nt, Human
gguuuccccaucuguaaaaugaugguaauaauacuucaccuaccucauaggggagguugugagg

SEQ ID NO: 380065 - RNA, 64 nt, Human
acaauaugggcacuuuaaaugaagcuaauaauucuucaccuaagucucugugaauugaaauguu

SEQ ID NO: 380066 - RNA, 64 nt, Human
gggacuucuuugggcagaugcuaggucaguuguuuucaccuaauauccucuuuuagcugcaugu

SEQ ID NO: 380067 - RNA, 64 nt, Human
gugaaacaauguguuuuaaaauugaugaaauucguucaccuacauuugagaauuauaaaauuaa

SEQ ID NO: 380068 - RNA, 64 nt, Human
agcacuuaacuaugagccaggcaucauacuaaacuucaccuacauuaucucacuuaguccuuua

SEQ ID NO: 380069 - RNA, 64 nt, Human
ggguccaagggcagagccugugcccuucagcccuuucaccuaacaggcccauauucgggccuuu

SEQ ID NO: 380070 - RNA, 64 nt, Human
gagagaggugagcaaccaagggaagcuccucugauucaccuagaaccuguucucugccgucuuu

SEQ ID NO: 380071 - RNA, 64 nt, Human
gcagacaggacagugagguugucaccacucagacuucaccuauucagcauucuuucugauuucu

SEQ ID NO: 380072 - RNA, 64 nt, Human
ugucaacauuuuugauucuagcuaccuguauuauuucaccuagcuugucccaagcuucccugcc

SEQ ID NO: 380073 - RNA, 64 nt, Human
aguaaaauuuaguguucaaaacauugagacacucuucaccuauuguaugaccaaauaaagguua

SEQ ID NO: 380074 - RNA, 64 nt, Human; identical to SEQ ID NO: 136779

SEQ ID NO: 380075 - RNA, 64 nt, Human; identical to SEQ ID NO: 136780

SEQ ID NO: 380076 - RNA, 64 nt, Human
uuugugaaucuuuccccccauuuccuguuuacauguaacccaacaaaaugcaauuucuagugcc

SEQ ID NO: 380077 - RNA, 64 nt, Human
ugccaguguugaguaaacucaacuacuaugaaauuucaccuaauguuuucaguuucacuuccuu

SEQ ID NO: 380078 - RNA, 64 nt, Human
guuuuuuaaagcauuaaugaacaucaucauuaauuucaccuauuauauuguacccacauauauu

SEQ ID NO: 380079 - RNA, 64 nt, Human
aauaaauuaauuugcucucaucguauuguguauauucaccuaaugcccauuguguauugauauu

SEQ ID NO: 380080 - RNA, 64 nt, Human
ggaaccaaguuuaguauagucugauuacauuccauucaccuaacuuuagacauucguuuagaca

SEQ ID NO: 380081 - RNA, 64 nt, Human
uuucuuccuaaaaaaaguucuuucuuuuauuauuuucaccuauuggcugcugcauuuuacgaag

SEQ ID NO: 380082 - RNA, 64 nt, Human
ucuagauuauuuuuuuccuccacaguccuuuuuuuucaccuaacgcaccuaaaucuugaaacua

SEQ ID NO: 380083 - RNA, 64 nt, Human
aauguaaauauuccuuauuuaagacauguuuaaauucaccuacuagcacgacuuacauagcuca

SEQ ID NO: 380084 - RNA, 64 nt, Human
ccguggcaacuguggaaggcacacugagcaaguuuucaccuaucuggaaaaaaaaaaauaugag

SEQ ID NO: 380085 - RNA, 64 nt, Human
agcuauuauuaacaacuuuuguguacuuauaauguucaccuaaaaauguuguagcauaauucug

SEQ ID NO: 380086 - RNA, 64 nt, Human
guguugaggauguaaucuccuuugccaucuuuaauucaccuaacuuacacuagguguucucuua

SEQ ID NO: 380087 - RNA, 64 nt, Human
uaagccucaucugauggaagagaggaauaaauaauucaccuauauguguuugagguugugacag

SEQ ID NO: 380088 - RNA, 64 nt, Human
agcauuccauuuuguccuguuaaaaccuuuuguuuucaccuaaacccuuucugcuuaguuguau

SEQ ID NO: 380089 - RNA, 64 nt, Human
cugauuugauacuagucaguuugcuugaaacuaguucaccuaaagcuagaucucuuaaaaccaa

SEQ ID NO: 380090 - RNA, 64 nt, Human
uuuaaugauacuucugauguuucggaacagucauuucaccuacuauuucugaauauauuuugca

SEQ ID NO: 380091 - RNA, 64 nt, Human
acuugacauaggauauuuucccucuggcuacacauucaccuacccuuguucucuauuuagauua

SEQ ID NO: 380092 - RNA, 64 nt, Human
ucuuacuauacuuuucauaauguugcaugcauauuucaccuaccaaagcugugcuguuaaugcc

SEQ ID NO: 380093 - RNA, 64 nt, Human
ccucucgagggugaggccuagccuucuugucuuuguaacccacagcagcugguacugugccuug

SEQ ID NO: 380094 - RNA, 64 nt, Human
cccaaagagaacuccguauguucucuuagguugaguaacccacucugaauucugguuacaugug

SEQ ID NO: 380095 - RNA, 64 nt, Human
agggugcuacauucacucuugccuuagguauacuguaacccagguucugccugucguguauaag

SEQ ID NO: 380096 - RNA, 64 nt, Human
ucggccgccuuggggguuccgcuuccuguuccaguucaccuaaaggcugauugugcaggcccag

SEQ ID NO: 380097 - RNA, 64 nt, Human
uuguuguguucucaauaugauggcuauuugaaacuucaccuacuuuucauuagauugguuguac

SEQ ID NO: 380098 - RNA, 64 nt, Human
agugcuggugacuggauagcaguuuuaaguggcguucaccuagucaacacgaccgcguguguug

SEQ ID NO: 380099 - RNA, 64 nt, Human
aagauuuuucuucuuuccuuaaaaauauuuuuuuuucaccuaggucuaaauagcuaacuaacug

SEQ ID NO: 380100 - RNA, 64 nt, Human
gucuuauagagccuuugauccagcaauaccccacuucaccuacaauaauuguugacgcuauuug

SEQ ID NO: 380101 - RNA, 64 nt, Human
caaagacccuaaacaaaaaguuaaguuucuuucuuucaccuauuuguacaacuccaaguuacag

SEQ ID NO: 380102 - RNA, 64 nt, Human
ucauuuuuauauucauuuauucaucauucauucauucaccuaacuuucauuaaauagcugcacc

SEQ ID NO: 380103 - RNA, 64 nt, Human
cucacuaagccagaggccaaagugcccccucccguucaccuaccacccaaguccucaugcccuc

SEQ ID NO: 380104 - RNA, 64 nt, Human
gggccacugcaggagaugagaccagccuucuguguucaccuaacgauuuauacuguguaucugu

SEQ ID NO: 380105 - RNA, 64 nt, Human
cccacccccucaaucugucggggagccccugcccuucaccuagcucccuuggccaggagcgagc

SEQ ID NO: 380106 - RNA, 64 nt, Human
cuggccacaggggcucaccugggccccauggcuuuucaccuaaguggguccugcccccuccccc

SEQ ID NO: 380107 - RNA, 64 nt, Human
cagguaguggaggcucagacaaguuauuuagccauucaccuagagaguaaguguugaagccaga

SEQ ID NO: 380108 - RNA, 64 nt, Human
aaacauugcaaccaaaaaggucagcacaaaggccuucaccuacgugaagaccuccugguaggau

SEQ ID NO: 380109 - RNA, 64 nt, Human
gagaaacucaguuaauauaaagaacaauaagucauucaccuagaugucaacuccacaagaugaa

SEQ ID NO: 380110 - RNA, 64 nt, Human
cucagggggaccuuaccaccccucagagugcugcuucaccuacacuaccuacaagaucccgcgu

SEQ ID NO: 380111 - RNA, 64 nt, Human
ugagauugaaaaagucaacauagaagcuuuagcauucaccuaucucaguaccuacaacuaaugu

SEQ ID NO: 380112 - RNA, 64 nt, Human; identical to SEQ ID NO: 136767

SEQ ID NO: 380113 - RNA, 64 nt, Human; identical to SEQ ID NO: 136768

SEQ ID NO: 380114 - RNA, 64 nt, Human; identical to SEQ ID NO: 136787

SEQ ID NO: 380115 - RNA, 64 nt, Human
guaccccaucccaagcauagccagcucccccuccuucaccuaguggucaaggcccggagcugga

SEQ ID NO: 380116 - RNA, 64 nt, Human
gaaaauucugaaauuguaaaugucuauuuuaauauucaccuaugaaagaaucugugaauauaug

SEQ ID NO: 380117 - RNA, 64 nt, Human
uuuuuucugauuuaugaggguuugaaagaaagaauucaccuaaaagauuccauuuccaguuuua

SEQ ID NO: 380118 - RNA, 64 nt, Human
gccaagaaaaauaauacucuuaaauacuuagauguucaccuaaaguugauauuauuugguaugg

SEQ ID NO: 380119 - RNA, 64 nt, Human
cugauuuuaaaggcagagaaguucucaaaguuaauucaccuauguuauuuuguguacaaguugu

SEQ ID NO: 380120 - RNA, 64 nt, Human
uggaguguuuggggugccugccauugccucugccuucaccuaagucugugcccauuguuucagg

SEQ ID NO: 380121 - RNA, 64 nt, Human
cguuguaguggaaccucuacauguuuuaguuugcuucaccuaaaauaaugcugaucuagagaua

SEQ ID NO: 380122 - RNA, 64 nt, Human
uuacaguuccuucaauaaccaugaugaccugaaguucaccuaucccauuuuagcaucuacuugu

SEQ ID NO: 380123 - RNA, 64 nt, Human
gaugcaauuagucugucacuccauuuagaaaauguucaccuagagguguucugguaaacugauu

SEQ ID NO: 380124 - RNA, 64 nt, Human
auuuggugugcuuuccuccgauugaucccaacccuucaccuauuuuacguauaccugcccuuuc

SEQ ID NO: 380125 - RNA, 64 nt, Human
uuauuaacuuacggauuuauuauauaaauauauauucaccuagcaacauaucucugccgucucu

SEQ ID NO: 380126 - RNA, 64 nt, Human
gagugcaguggugcaaucucgccucacugcaaccuucaccuaccgaguucaagugauuuuccug

SEQ ID NO: 380127 - RNA, 64 nt, Human
acccucaggccugaggugugugccacucagagacuucaccuaacuagagacaggcaaacugcaa

SEQ ID NO: 380128 - RNA, 64 nt, Human
acagcaucagauaucaagaguuuguaggucuggauucaccuaagauucaagggaguguugcuuc

SEQ ID NO: 380129 - RNA, 64 nt, Human
acggucaccuguugcagcuucaccugccuggggauucaccuaccuggguccucacuuuccuggg

SEQ ID NO: 380130 - RNA, 64 nt, Human
aaucuagaagaacuuggaugguuucguaauacaauucaccuauagccaaucuugcaugagauuu

SEQ ID NO: 380131 - RNA, 64 nt, Human; identical to SEQ ID NO: 136788

SEQ ID NO: 380132 - RNA, 64 nt, Human; identical to SEQ ID NO: 136789

SEQ ID NO: 380133 - RNA, 64 nt, Human; identical to SEQ ID NO: 136791

SEQ ID NO: 380134 - RNA, 64 nt, Human
gcacaugggggcuuccaugcaccugcgcacacccuucaccuaccgugugccugaggacaccugg

SEQ ID NO: 380135 - RNA, 64 nt, Human
uuaccuacuacagacauugaaguuguuucuaauguucaccuagaacucuaauuuuaccuucuuu

SEQ ID NO: 380136 - RNA, 64 nt, Human
ucuguggcuuucauuugaguaucuuuggccccuuuucaccuacugcgaccacccaccucauccu

SEQ ID NO: 380137 - RNA, 64 nt, Human
aguaguauacauauuugauguaguaguuuauccauucaccuaugagauauauuugcacuguuuu

SEQ ID NO: 380138 - RNA, 64 nt, Human
cuggcugagggcaugggguaaagguuagaaaaccuucaccuaggacuugacccuuaccaaacca

SEQ ID NO: 380139 - RNA, 64 nt, Human
agggaaucauuuuguguucauuuuuguuuucuguuucaccuaaaccagcauaggauugauaggg

SEQ ID NO: 380140 - RNA, 64 nt, Human
cauguauuuuuauuaaauauaacaaugucugaguuucaccuaagauguuuuugugccauaugcu

SEQ ID NO: 380141 - RNA, 64 nt, Human
cccauuccuguguuaccaccuuccucccgauuuguucaccuauuuugugcuuuaaaucucaaua

SEQ ID NO: 380142 - RNA, 64 nt, Human
cuuauuuauuuuauauuuuuaaaagaagacaguauucaccuauguauuuugcauaacgauuaua

SEQ ID NO: 380143 - RNA, 64 nt, Human
guuaacaggagggcuggggucccugccaccaguuuucaccuagccagucuugagucuucuccgu

SEQ ID NO: 380144 - RNA, 64 nt, Human
ucugcuuucuguuagcuuaggcagacauugggccuucaccuacaaguuuuuccuuaccccugug

SEQ ID NO: 380145 - RNA, 64 nt, Human
gcuucuugcugcucagcagaccaugaccuguagguucaccuauaaaacagggaaauugaauaac

SEQ ID NO: 380146 - RNA, 64 nt, Human
gaucaugggcaagaagccugaccccaagugugucuucaccuaugugcagucgcucuacaaccac

SEQ ID NO: 380147 - RNA, 64 nt, Human
aagaugauaaucuacuuaauuuuagaacaccuuuuucaccuaacuaaaauaauguuuaaagagu

SEQ ID NO: 380148 - RNA, 64 nt, Human
cuuuauaaggcaaaaagaucuguauuuacacuccuucaccuagggauguguuuguugcccuccu

SEQ ID NO: 380149 - RNA, 64 nt, Human
gaugcuuugaaagagcccuaaacauugggaaccauucaccuaauuuggagacauuucucacugg

SEQ ID NO: 380150 - RNA, 64 nt, Human; identical to SEQ ID NO: 136795

SEQ ID NO: 380151 - RNA, 64 nt, Human; identical to SEQ ID NO: 136796

SEQ ID NO: 380152 - RNA, 51 nt, Human; identical to SEQ ID NO: 136797

SEQ ID NO: 380153 - RNA, 64 nt, Human
cacacuucucaaaagugacacaagagaaauccaguucaccuacagagguagagcacucacgccc

SEQ ID NO: 380154 - RNA, 64 nt, Human
aauuuugucuaucagaauaaacacaagugaaauuuucaccuacauuaacauuaugucuuugcag

SEQ ID NO: 380155 - RNA, 64 nt, Human
gcuacuuucuauccaaauaauuuaaaaaacacuuuucaccuacuccuuucaugguuauaacaca

SEQ ID NO: 380156 - RNA, 64 nt, Human
ggguugaggugcagcaaaaccaccauggcacacguucaccuauguaacaaaccugcacauccug

SEQ ID NO: 380157 - RNA, 64 nt, Human
aauuuagaaaguuaacuaacaauacagugcauucuacccguagggccaccaugcccuucugccc

SEQ ID NO: 380158 - RNA, 64 nt, Human
uuguaucucagaaauuagaaacuugcuacagacuuacccguaauauuugucaagaucauagcug

SEQ ID NO: 380159 - RNA, 64 nt, Human
acuguucgauaaacuccaaagcuuguucccgucauacccguaaugcuuucuuuuuuccuuuauu

SEQ ID NO: 380160 - RNA, 64 nt, Human
uguuccuccauggcuagaaccauaauaaacaauguacccguaauuuguaacauaaaguauugca

SEQ ID NO: 380161 - RNA, 64 nt, Human
auguguaauuuuguucuaguuuucaguuuguauauacccguacaacguguccucacggugccuu

SEQ ID NO: 380162 - RNA, 64 nt, Human
augguuaucuaacauacuaaguugguacccuaccuacccguaaaauaugaaauacucagaagua

SEQ ID NO: 380163 - RNA, 64 nt, Human
gaccacaucacuuguuaauaacacaaccuuuaaaguaacccaucuuccagggggguuccuucau

SEQ ID NO: 380164 - RNA, 64 nt, Human
ugaauagcacagucgaggaaaauugauaccugcaguaacccauaggaaauaaacuguagaguuc

SEQ ID NO: 380165 - RNA, 64 nt, Human
agauucgucuuuuuuuuuuuuucuuauaaaagccguaacccagucagacaaauucaccuucacu

SEQ ID NO: 380166 - RNA, 64 nt, Human
agauaugcuaggaguaggaugaugauucaaagugguaacccaaauucauaaagcaauaauaaua

SEQ ID NO: 380167 - RNA, 64 nt, Human
guggaaaggguguuugggaaauuguuaaaucaguuacccguaguagagcuauuucuuguacuuc

SEQ ID NO: 380168 - RNA, 64 nt, Human
agugggggagaggaagagagagagagagcauguauacccguauguuaucauagagcacgauucu

SEQ ID NO: 380169 - RNA, 64 nt, Human
ccacaacccaccaaguacccauguuggcccugccuacccguaacaaauuguucacacaaccuau

SEQ ID NO: 380170 - RNA, 64 nt, Human
gcuuuuuaaaggugcuuucacauagcacaggcauuacccguagucgugucaaauagcaguuggu

SEQ ID NO: 380171 - RNA, 64 nt, Human
agcaaaauacuuuuaaaaacauauugguaaaugauacccguaaaauuaaauuaguuauauuuua

SEQ ID NO: 380172 - RNA, 64 nt, Human
cuguacuagccaugcaaggagucgcucuagcugguacccguaaaaguugugggaauugugaccc

SEQ ID NO: 380173 - RNA, 64 nt, Human
aacaaauauuuucccacuauuacagccugaguaauacccguauuaaaagagccucauuuuagaa

SEQ ID NO: 380174 - RNA, 64 nt, Human
cuguauguaaguaguauaauuuguuacuuucaaauacccguacuuugaauguagguuuuuuugu

SEQ ID NO: 380175 - RNA, 64 nt, Human
uuccccggacacaccuggagcagccucugagucuuacccguaauggagccggccaacccugugu

SEQ ID NO: 380176 - RNA, 64 nt, Human
accgaaugagcugguucuuuccauccucuugugguacccguagugcccagcauccagaccuuug

SEQ ID NO: 380177 - RNA, 64 nt, Human
auuuccaagacagugguacaaggugacccuuaauuacccguaucaugguucuugaccagcacau

SEQ ID NO: 380178 - RNA, 64 nt, Human
cuguauucgaggagugccguguguugcaugcagcuacccguaggaagacuucgcgcauaucacu

SEQ ID NO: 380179 - RNA, 64 nt, Human
gaagauugugaggaaauuuuguaggaaauuugcauacccguaaagggagacuuuuuuaaauaac

SEQ ID NO: 380180 - RNA, 64 nt, Human
aacaacacaaugcauguugccuuuuuaauguaaauacccguagguaucauuaauaguuucaaaa

SEQ ID NO: 380181 - RNA, 64 nt, Human
uggaagguuccacaagucacccugugaucaacaguacccguaugggacaaagcugcaaggucaa

SEQ ID NO: 380182 - RNA, 64 nt, Human
gacuucugaugggucaaggaaaaagaugccaacauacccguauuuaccaaguacuaugauaaug

SEQ ID NO: 380183 - RNA, 64 nt, Human; identical to SEQ ID NO: 136801

SEQ ID NO: 380184 - RNA, 64 nt, Human; identical to SEQ ID NO: 136802

SEQ ID NO: 380185 - RNA, 53 nt, Human; identical to SEQ ID NO: 136803

SEQ ID NO: 380186 - RNA, 64 nt, Human
uaaauauuuuucccaacuggaaagcacuugauuguacccguaaguguuugagugaugacaugug

SEQ ID NO: 380187 - RNA, 64 nt, Human
cauacagagagaggcuucccucccagccucaguuuacccguaaaugcacuagcgcgaggucaga

SEQ ID NO: 380188 - RNA, 64 nt, Human
ucuguggccaagccccacccuuuccuggucaugguacccguacagcguugauggccacagcucg

SEQ ID NO: 380189 - RNA, 64 nt, Human; identical to SEQ ID NO: 136744

SEQ ID NO: 380190 - RNA, 64 nt, Human; identical to SEQ ID NO: 136745

SEQ ID NO: 380191 - RNA, 50 nt, Human; identical to SEQ ID NO: 136746

SEQ ID NO: 380192 - RNA, 64 nt, Human; identical to SEQ ID NO: 136747

SEQ ID NO: 380193 - RNA, 64 nt, Human; identical to SEQ ID NO: 136748

SEQ ID NO: 380194 - RNA, 64 nt, Human; identical to SEQ ID NO: 136749

SEQ ID NO: 380195 - RNA, 64 nt, Human; identical to SEQ ID NO: 136750

SEQ ID NO: 380196 - RNA, 64 nt, Human; identical to SEQ ID NO: 136751

SEQ ID NO: 380197 - RNA, 64 nt, Human; identical to SEQ ID NO: 136752

SEQ ID NO: 380198 - RNA, 64 nt, Human; identical to SEQ ID NO: 136753

SEQ ID NO: 380199 - RNA, 64 nt, Human; identical to SEQ ID NO: 136754

SEQ ID NO: 380200 - RNA, 64 nt, Human; identical to SEQ ID NO: 136755

SEQ ID NO: 380201 - RNA, 64 nt, Human; identical to SEQ ID NO: 136756

SEQ ID NO: 380202 - RNA, 64 nt, Human; identical to SEQ ID NO: 136757

SEQ ID NO: 380203 - RNA, 64 nt, Human; identical to SEQ ID NO: 136758

SEQ ID NO: 380204 - RNA, 64 nt, Human; identical to SEQ ID NO: 136759

SEQ ID NO: 380205 - RNA, 64 nt, Human; identical to SEQ ID NO: 136760

SEQ ID NO: 380206 - RNA, 64 nt, Human
agcaggagcagcuccuacagugaacuauuggcaccaccgacagugacaccagggcacauggcug

SEQ ID NO: 380207 - RNA, 64 nt, Human
gacggcugugacgcagccggagggaggcacuagucaccgacagcggccuugaagacagagcaaa

SEQ ID NO: 380208 - RNA, 64 nt, Human
gacccagcgaaaauguggcccuucugagucacaucaccgacacugagcaguggaaaggggcuau

SEQ ID NO: 380209 - RNA, 64 nt, Human
agggcacgucacugcagacacgcucugcagcauucaccgacagucugucaugcacccaccacgu

SEQ ID NO: 380210 - RNA, 64 nt, Human
ugggcuagccccacccagagcgcagaggagggggcaccgacagcgcugcgagccaggcucuggg

SEQ ID NO: 380211 - RNA, 64 nt, Human
gcaaagggguuuuagcugcagccuuggaaggaggcaccgacacgacaccaggcaggagugagcc

SEQ ID NO: 380212 - RNA, 64 nt, Human
ugccucugcccugaucgucacaacccucaggaaccaccgacagaaagaaagaaacacaaaaaca

SEQ ID NO: 380213 - RNA, 64 nt, Human
aaaaaggaauccauaccaugaugcguuuuaaaaccaccgacagcccuuggguuggcaagaaggc

SEQ ID NO: 380214 - RNA, 64 nt, Human
gccaccaccaccaccaacacaacagcaauggcaacaccgacagcaaccaaucagauauauacaa

SEQ ID NO: 380215 - RNA, 64 nt, Human
caacuggcagcugcgggacccuuggcuugucccccaccgacaagucccaccugcugggugagga

SEQ ID NO: 380216 - RNA, 64 nt, Human
gcugcccggccugccuggggcugggagccccagacaccgacacccugaggacguguggagcuaa

SEQ ID NO: 380217 - RNA, 64 nt, Human
ugacccugcagcuggugcucugugucuucgcuuccaccgacagccgucagacaucaggcucccc

SEQ ID NO: 380218 - RNA, 64 nt, Human
acgcugugcucccucccaacaacggccgagccugcaccgacaacccccuggaggaggaguaccu

SEQ ID NO: 380219 - RNA, 64 nt, Human
cauccacccacagagaaaugccucugugcgagugcaccgacagaaaacugucagcucugcuuuc

SEQ ID NO: 380220 - RNA, 64 nt, Human
ccgagugcacccgcuuagccuuuacauuccucuccaccgacaaaaggaaggggaaacucaauca

SEQ ID NO: 380221 - RNA, 64 nt, Human
cugugccuuugucagcucuucuuucaaaagaccccaccgacagaccgcauuccacccccaacau

SEQ ID NO: 380222 - RNA, 59 nt, Human
aggucaucuucuacaccuaggcugcccgacaccgacaccgcccucccuccguggggaua

SEQ ID NO: 380223 - RNA, 64 nt, Human
ccaauaaaaagcauuuaaaaauuuaggggauauuguaacccaguauaauuuucugacagguugg

SEQ ID NO: 380224 - RNA, 64 nt, Human
caguugaggaauaugacuguuuuuauaugcacauguaacccaaauguccaauauaaauuggcuu

SEQ ID NO: 380225 - RNA, 62 nt, Human
uuaaguaaauuucugauuuuccuuuauugauuauguaacccacgugauuugcauauuuuagu

SEQ ID NO: 380226 - RNA, 64 nt, Human
gcagaggaaacagaaacucccaacuguccuuacccaccgacaucacagccccuaugaagaaagu

SEQ ID NO: 380227 - RNA, 64 nt, Human
gagccuucaggugccaaagccauacucaggcccccaccgacauuguccacccuggccagaaggg

SEQ ID NO: 380228 - RNA, 64 nt, Human
accuagccuaggugagacacugcagccaggcaaccaccgacacacgccccuucucaaagccaga

SEQ ID NO: 380229 - RNA, 64 nt, Human
ccaacuugccacccgcgucccugguaccugagaccaccgacauccucagguuccugaccguggc

SEQ ID NO: 380230 - RNA, 64 nt, Human
gcggucugugguagagaacucucuuccuucuuuccaccgacaggggcgagggcugcuuccucgc

SEQ ID NO: 380231 - RNA, 64 nt, Human
gggcuucggugccgcgugggcaguacgcaggucccaccgacacucaccugggagcacggcgccu

SEQ ID NO: 380232 - RNA, 64 nt, Human
uuagagcuuguggcuugaauguuaaaggugugaccaccgacaccacucaugucaauggcugaaa

SEQ ID NO: 380233 - RNA, 64 nt, Human
gcccacccccacugacccccgcugccucccccaacaccgacacccuccucggccuccuccucuu

SEQ ID NO: 380234 - RNA, 64 nt, Human
ucgcucucacacccccuccagcuuuccgaccccacaccgacaacuccccggcuuccagacccua

SEQ ID NO: 380235 - RNA, 64 nt, Human
gggacacgcccuucagagcccgucucuaugacgucaccgacagccaucaccuccuucuuggaac

SEQ ID NO: 380236 - RNA, 64 nt, Human
acuuccacaaggugcaaccucaggaaccaaaggucaccgacacugaguacucagaaaucaagau

SEQ ID NO: 380237 - RNA, 64 nt, Human
cuugaaagguguagguuugauuacuaggagauaccaccgacauuuuucaauaaaguacugcaaa

SEQ ID NO: 380238 - RNA, 64 nt, Human
cugcgauggcguucauguccgucucgcucaucaucaccgacauguccuucuuaucuggaaagag

SEQ ID NO: 380239 - RNA, 64 nt, Human
cuggacaucagggacuuuugcccacagcacaugacaccgacagcugcccagccuguucacaugc

SEQ ID NO: 380240 - RNA, 64 nt, Human
caucaccaacacggccucccugcagcugcccugccaccgacagaccccgauuaaacccacaccu

SEQ ID NO: 380241 - RNA, 64 nt, Human
auuccauauuuuuuuaagaaaagguuacacugugcaccgacauguggagcuagaaggaaaagcu

SEQ ID NO: 380242 - RNA, 64 nt, Human; identical to SEQ ID NO: 249417

SEQ ID NO: 380243 - RNA, 64 nt, Human; identical to SEQ ID NO: 249418

SEQ ID NO: 380244 - RNA, 64 nt, Human; identical to SEQ ID NO: 249421

SEQ ID NO: 380245 - RNA, 64 nt, Human
aaaugcucaugccaguuaaugccaggaaaaaaaucaccgacacacuacuaguacuuuguuccug

SEQ ID NO: 380246 - RNA, 64 nt, Human; identical to SEQ ID NO: 289167

SEQ ID NO: 380247 - RNA, 64 nt, Human; identical to SEQ ID NO: 289168

SEQ ID NO: 380248 - RNA, 64 nt, Human; identical to SEQ ID NO: 278442

SEQ ID NO: 380249 - RNA, 64 nt, Human; identical to SEQ ID NO: 278569

SEQ ID NO: 380250 - RNA, 64 nt, Human; identical to SEQ ID NO: 289412

SEQ ID NO: 380251 - RNA, 64 nt, Human; identical to SEQ ID NO: 289504

SEQ ID NO: 380252 - RNA, 64 nt, Human
agucuauuuggaagagagggaggaagagaaggaaguaacccaaaguacuacucauuuaucauug

SEQ ID NO: 380253 - RNA, 64 nt, Human
acucucaguuccagucaagcugguugcucugaaaguaacccagcuuguugcucuaaaauaccuc

SEQ ID NO: 380254 - RNA, 64 nt, Human
ggagagcuaggucccuuggggcucuggaugcuggguaacccagagguaauguggguacccuuuc

SEQ ID NO: 380255 - RNA, 64 nt, Human; identical to SEQ ID NO: 289467

SEQ ID NO: 380256 - RNA, 56 nt, Human; identical to SEQ ID NO: 278570

SEQ ID NO: 380257 - RNA, 64 nt, Human; identical to SEQ ID NO: 278443

SEQ ID NO: 380258 - RNA, 64 nt, Human; identical to SEQ ID NO: 289297

SEQ ID NO: 380259 - RNA, 64 nt, Human; identical to SEQ ID NO: 289298

SEQ ID NO: 380260 - RNA, 64 nt, Human; identical to SEQ ID NO: 278571

SEQ ID NO: 380261 - RNA, 64 nt, Human; identical to SEQ ID NO: 288733

SEQ ID NO: 380262 - RNA, 64 nt, Human; identical to SEQ ID NO: 288734

SEQ ID NO: 380263 - RNA, 64 nt, Human; identical to SEQ ID NO: 278457

SEQ ID NO: 380264 - RNA, 64 nt, Human; identical to SEQ ID NO: 289299

SEQ ID NO: 380265 - RNA, 64 nt, Human; identical to SEQ ID NO: 278585

SEQ ID NO: 380266 - RNA, 64 nt, Human; identical to SEQ ID NO: 288771

SEQ ID NO: 380267 - RNA, 64 nt, Human; identical to SEQ ID NO: 288772

SEQ ID NO: 380268 - RNA, 64 nt, Human; identical to SEQ ID NO: 288773

SEQ ID NO: 380269 - RNA, 64 nt, Human; identical to SEQ ID NO: 278458

SEQ ID NO: 380270 - RNA, 64 nt, Human
cugacugccccuuucuagcuggaccuuuaacaaaucacccaaucuuuuuuguguuucucuaaag

SEQ ID NO: 380271 - RNA, 64 nt, Human; identical to SEQ ID NO: 186559

SEQ ID NO: 380272 - RNA, 64 nt, Human; identical to SEQ ID NO: 186564

SEQ ID NO: 380273 - RNA, 64 nt, Human; identical to SEQ ID NO: 288791

SEQ ID NO: 380274 - RNA, 64 nt, Human; identical to SEQ ID NO: 278586

SEQ ID NO: 380275 - RNA, 64 nt, Human; identical to SEQ ID NO: 288792

SEQ ID NO: 380276 - RNA, 62 nt, Human; identical to SEQ ID NO: 288866

SEQ ID NO: 380277 - RNA, 64 nt, Human; identical to SEQ ID NO: 288867

SEQ ID NO: 380278 - RNA, 64 nt, Human; identical to SEQ ID NO: 278459

SEQ ID NO: 380279 - RNA, 64 nt, Human; identical to SEQ ID NO: 288809

SEQ ID NO: 380280 - RNA, 64 nt, Human; identical to SEQ ID NO: 288810

SEQ ID NO: 380281 - RNA, 64 nt, Human; identical to SEQ ID NO: 278460

SEQ ID NO: 380282 - RNA, 64 nt, Human; identical to SEQ ID NO: 288959

SEQ ID NO: 380283 - RNA, 64 nt, Human; identical to SEQ ID NO: 288960

SEQ ID NO: 380284 - RNA, 64 nt, Human; identical to SEQ ID NO: 278601

SEQ ID NO: 380285 - RNA, 64 nt, Human; identical to SEQ ID NO: 288847

SEQ ID NO: 380286 - RNA, 64 nt, Human; identical to SEQ ID NO: 288848

SEQ ID NO: 380287 - RNA, 64 nt, Human; identical to SEQ ID NO: 278474

SEQ ID NO: 380288 - RNA, 64 nt, Human; identical to SEQ ID NO: 186570

SEQ ID NO: 380289 - RNA, 64 nt, Human; identical to SEQ ID NO: 186574

SEQ ID NO: 380290 - RNA, 64 nt, Human; identical to SEQ ID NO: 186580

SEQ ID NO: 380291 - RNA, 64 nt, Human; identical to SEQ ID NO: 288714

SEQ ID NO: 380292 - RNA, 64 nt, Human; identical to SEQ ID NO: 288715

SEQ ID NO: 380293 - RNA, 64 nt, Human; identical to SEQ ID NO: 278602

SEQ ID NO: 380294 - RNA, 64 nt, Human; identical to SEQ ID NO: 288868

SEQ ID NO: 380295 - RNA, 64 nt, Human; identical to SEQ ID NO: 288961

SEQ ID NO: 380296 - RNA, 64 nt, Human; identical to SEQ ID NO: 278475

SEQ ID NO: 380297 - RNA, 64 nt, Human; identical to SEQ ID NO: 288885

SEQ ID NO: 380298 - RNA, 64 nt, Human; identical to SEQ ID NO: 288886

SEQ ID NO: 380299 - RNA, 64 nt, Human; identical to SEQ ID NO: 288887

SEQ ID NO: 380300 - RNA, 64 nt, Human; identical to SEQ ID NO: 278476

SEQ ID NO: 380301 - RNA, 64 nt, Human; identical to SEQ ID NO: 278617

SEQ ID NO: 380302 - RNA, 64 nt, Human; identical to SEQ ID NO: 288940

SEQ ID NO: 380303 - RNA, 64 nt, Human; identical to SEQ ID NO: 288941

SEQ ID NO: 380304 - RNA, 64 nt, Human; identical to SEQ ID NO: 278490

SEQ ID NO: 380305 - RNA, 64 nt, Human; identical to SEQ ID NO: 289110

SEQ ID NO: 380306 - RNA, 64 nt, Human
uuacaaucaauaaaccuccauugacacaucauuaucacccaaaguccauaguuuacaugaagau

SEQ ID NO: 380307 - RNA, 64 nt, Human
agaccuaaaagggggugggggacauuuucuuaccucacccaagaaagaggucgucacuuuugcu

SEQ ID NO: 380308 - RNA, 64 nt, Human
aaguauacucugugauguucauacagugaugaaaucacccaaagacacauuucucagaacguag

SEQ ID NO: 380309 - RNA, 62 nt, Human; identical to SEQ ID NO: 289111

SEQ ID NO: 380310 - RNA, 64 nt, Human
guugugcugcuuuucuaguaaucugucccauuuuucagguuauaauauuuccucuugccaaauc

SEQ ID NO: 380311 - RNA, 64 nt, Human
uuuaaguauaaagcacugugaaugaagguaguugucagguuagcugcagggguguggguguuuu

SEQ ID NO: 380312 - RNA, 64 nt, Human
uaucagaucagugauacugguguuaguguuguaaucagguuaaacccacuuccauuaaacuuga

SEQ ID NO: 380313 - RNA, 64 nt, Human
uuguucuugagcaaugaacuuucacugcagaauuucagguuaguuacaaaaagcucaguuuuca

SEQ ID NO: 380314 - RNA, 64 nt, Human
ccuauauuuucaaguuaugucaauuaaaucauuaucagguuauuuccuaauguaagaauagcua

SEQ ID NO: 380315 - RNA, 64 nt, Human
guaggguagaaaaagagggagucacuugaugcuuucagguuaaucagagcuaugggugcuacag

SEQ ID NO: 380316 - RNA, 64 nt, Human
uuuacucauccuccaggaacugcaggucaaguugucagguuauuuauuuuauaauguccauaug

SEQ ID NO: 380317 - RNA, 64 nt, Human
aacucaaaagcuaucaugguguucacucuacauaucagguuauggugucucuagaaucuguugu

SEQ ID NO: 380318 - RNA, 64 nt, Human
ucauuaaaggcuaauuuaugaaauuugaaaaucuucagguuauacuccuuaaguuaucccaaag

SEQ ID NO: 380319 - RNA, 64 nt, Human
uauguaggugaguuauauuuucuuucuuuucugaucagguuauuggugacuuacuggacuggca

SEQ ID NO: 380320 - RNA, 64 nt, Human
ccaugacaacaaaaauacauacgaagaaaacuucucagguuacuaugcugaaauuccaaaaugu

SEQ ID NO: 380321 - RNA, 64 nt, Human
gagcauuuggaaaugaaggacuagcuccuauguaucagguuaagagcaagggagagcuggccag

SEQ ID NO: 380322 - RNA, 64 nt, Human
uuuuuuauuucaggaaauguaagaaaccauuauuucagguuaugaaaguauaaccaagcauccu

SEQ ID NO: 380323 - RNA, 64 nt, Human
uuggaggaugaauacuggagacggguuaccaaugucagguuauacuaaaacuaaaucagaaagu

SEQ ID NO: 380324 - RNA, 64 nt, Human
aguguaacaagaucacuggauuaaauauaaacauucagguuaauuaucuagauuuuuguccaca

SEQ ID NO: 380325 - RNA, 64 nt, Human
cauauuuuuuaggcaagucagaaagagaacauggucacccaaaagcaacuguaacucagaaauu

SEQ ID NO: 380326 - RNA, 64 nt, Human
aaauaaugcuuugaaauugaaccuuugugcccuaucacccaacgcuccaaagucauaauugcau

SEQ ID NO: 380327 - RNA, 64 nt, Human
ucauggauguucugcaugucauggggacuaaaacucacccaacagaucuuuccagagguccaug

SEQ ID NO: 380328 - RNA, 64 nt, Human; identical to SEQ ID NO: 278618

SEQ ID NO: 380329 - RNA, 64 nt, Human; identical to SEQ ID NO: 278491

SEQ ID NO: 380330 - RNA, 64 nt, Human; identical to SEQ ID NO: 288828

SEQ ID NO: 380331 - RNA, 64 nt, Human; identical to SEQ ID NO: 288829

SEQ ID NO: 380332 - RNA, 64 nt, Human; identical to SEQ ID NO: 278619

SEQ ID NO: 380333 - RNA, 64 nt, Human; identical to SEQ ID NO: 289187

SEQ ID NO: 380334 - RNA, 64 nt, Human; identical to SEQ ID NO: 278492

SEQ ID NO: 380335 - RNA, 64 nt, Human; identical to SEQ ID NO: 288753

SEQ ID NO: 380336 - RNA, 64 nt, Human; identical to SEQ ID NO: 278633

SEQ ID NO: 380337 - RNA, 64 nt, Human; identical to SEQ ID NO: 288511

SEQ ID NO: 380338 - RNA, 64 nt, Human; identical to SEQ ID NO: 288512

SEQ ID NO: 380339 - RNA, 64 nt, Human; identical to SEQ ID NO: 278506

SEQ ID NO: 380340 - RNA, 64 nt, Human; identical to SEQ ID NO: 288830

SEQ ID NO: 380341 - RNA, 64 nt, Human; identical to SEQ ID NO: 278634

SEQ ID NO: 380342 - RNA, 64 nt, Human; identical to SEQ ID NO: 288530

SEQ ID NO: 380343 - RNA, 64 nt, Human
ugaaaugauaugaccaaaauuuuaaguaggaaagucacccaaacacuucugcuuucacuuaagu

SEQ ID NO: 380344 - RNA, 64 nt, Human
gaaccauggaggaggaagacccucaguuauuuugucacccaaccuggcauaggacucuuugguc

SEQ ID NO: 380345 - RNA, 64 nt, Human
uagaagaccugagucuuccugaccgacuccaccaucacccaaucuguugauucuccauugggaa

SEQ ID NO: 380346 - RNA, 64 nt, Human; identical to SEQ ID NO: 288531

SEQ ID NO: 380347 - RNA, 64 nt, Human; identical to SEQ ID NO: 288532

SEQ ID NO: 380348 - RNA, 64 nt, Human; identical to SEQ ID NO: 278507

SEQ ID NO: 380349 - RNA, 64 nt, Human; identical to SEQ ID NO: 288550

SEQ ID NO: 380350 - RNA, 63 nt, Human; identical to SEQ ID NO: 278635

SEQ ID NO: 380351 - RNA, 64 nt, Human; identical to SEQ ID NO: 278508

SEQ ID NO: 380352 - RNA, 64 nt, Human; identical to SEQ ID NO: 288622

SEQ ID NO: 380353 - RNA, 64 nt, Human; identical to SEQ ID NO: 288623

SEQ ID NO: 380354 - RNA, 64 nt, Human; identical to SEQ ID NO: 278649

SEQ ID NO: 380355 - RNA, 64 nt, Human; identical to SEQ ID NO: 278522

SEQ ID NO: 380356 - RNA, 64 nt, Human; identical to SEQ ID NO: 288585

SEQ ID NO: 380357 - RNA, 64 nt, Human; identical to SEQ ID NO: 288586

SEQ ID NO: 380358 - RNA, 64 nt, Human; identical to SEQ ID NO: 288754

SEQ ID NO: 380359 - RNA, 64 nt, Human; identical to SEQ ID NO: 278523

SEQ ID NO: 380360 - RNA, 64 nt, Human; identical to SEQ ID NO: 288603

SEQ ID NO: 380361 - RNA, 64 nt, Human
cuggcccccucaguguugucaccagaucugauuuguaacccacugagaggacagagagaaauaa

SEQ ID NO: 380362 - RNA, 64 nt, Human
caccaagucccaaguucuucccauccuaacagaaguaacccagcaagucaaggccaggaggacc

SEQ ID NO: 380363 - RNA, 64 nt, Human
aguaucaccagucccaaagacaggauacgucccuguaacccaaucucucgguugauugauagca

SEQ ID NO: 380364 - RNA, 64 nt, Human
gaaaagauuguguuuuauaucaucccuaucuauuguaacccaaaagaccuaccaucgcaucagu

SEQ ID NO: 380365 - RNA, 64 nt, Human; identical to SEQ ID NO: 288604

SEQ ID NO: 380366 - RNA, 64 nt, Human; identical to SEQ ID NO: 288605

SEQ ID NO: 380367 - RNA, 64 nt, Human; identical to SEQ ID NO: 278524

SEQ ID NO: 380368 - RNA, 64 nt, Human; identical to SEQ ID NO: 278651

SEQ ID NO: 380369 - RNA, 64 nt, Human; identical to SEQ ID NO: 288641

SEQ ID NO: 380370 - RNA, 64 nt, Human; identical to SEQ ID NO: 288642

SEQ ID NO: 380371 - RNA, 64 nt, Human; identical to SEQ ID NO: 288643

SEQ ID NO: 380372 - RNA, 64 nt, Human; identical to SEQ ID NO: 288660

SEQ ID NO: 380373 - RNA, 64 nt, Human; identical to SEQ ID NO: 278538

SEQ ID NO: 380374 - RNA, 64 nt, Human; identical to SEQ ID NO: 278665

SEQ ID NO: 380375 - RNA, 64 nt, Human; identical to SEQ ID NO: 288678

SEQ ID NO: 380376 - RNA, 64 nt, Human; identical to SEQ ID NO: 288679

SEQ ID NO: 380377 - RNA, 64 nt, Human; identical to SEQ ID NO: 288680

SEQ ID NO: 380378 - RNA, 64 nt, Human; identical to SEQ ID NO: 287557

SEQ ID NO: 380379 - RNA, 64 nt, Human; identical to SEQ ID NO: 278539

SEQ ID NO: 380380 - RNA, 64 nt, Human
gcgcagaagccggcuggccguggugggggcagcguaggcguagcaucccucuccucucacuuag

SEQ ID NO: 380381 - RNA, 64 nt, Human
ggcgggcccagucguguuccugcagugggcacccuaggcguauguguauacacgcacagauauu

SEQ ID NO: 380382 - RNA, 64 nt, Human
acuuaacguugaaauuuucuucaggaauuuucuaguaacccaggucuaaaguagcuacagaaag

SEQ ID NO: 380383 - RNA, 64 nt, Human
gacacugggaacugggcugucuagccggguauagguaacccacaggcccagugccagcccucaa

SEQ ID NO: 380384 - RNA, 64 nt, Human; identical to SEQ ID NO: 278666

SEQ ID NO: 380385 - RNA, 64 nt, Human; identical to SEQ ID NO: 288697

SEQ ID NO: 380386 - RNA, 64 nt, Human; identical to SEQ ID NO: 249378

SEQ ID NO: 380387 - RNA, 64 nt, Human; identical to SEQ ID NO: 249379

SEQ ID NO: 380388 - RNA, 64 nt, Human; identical to SEQ ID NO: 249380

SEQ ID NO: 380389 - RNA, 64 nt, Human; identical to SEQ ID NO: 249381

SEQ ID NO: 380390 - RNA, 64 nt, Human; identical to SEQ ID NO: 249382

SEQ ID NO: 380391 - RNA, 64 nt, Human; identical to SEQ ID NO: 249383

SEQ ID NO: 380392 - RNA, 64 nt, Human; identical to SEQ ID NO: 249384

SEQ ID NO: 380393 - RNA, 64 nt, Human; identical to SEQ ID NO: 249385

SEQ ID NO: 380394 - RNA, 64 nt, Human; identical to SEQ ID NO: 249386

SEQ ID NO: 380395 - RNA, 64 nt, Human; identical to SEQ ID NO: 249387

SEQ ID NO: 380396 - RNA, 58 nt, Human; identical to SEQ ID NO: 249388

SEQ ID NO: 380397 - RNA, 64 nt, Human; identical to SEQ ID NO: 249389

SEQ ID NO: 380398 - RNA, 64 nt, Human; identical to SEQ ID NO: 249390

SEQ ID NO: 380399 - RNA, 64 nt, Human
gaccagcaagcuaggccgcuggaggaaagggaacucacccaacucuaaauugugccgcuuagac

SEQ ID NO: 380400 - RNA, 64 nt, Human; identical to SEQ ID NO: 249391

SEQ ID NO: 380401 - RNA, 64 nt, Human; identical to SEQ ID NO: 249392

SEQ ID NO: 380402 - RNA, 64 nt, Human; identical to SEQ ID NO: 249396

SEQ ID NO: 380403 - RNA, 64 nt, Human; identical to SEQ ID NO: 249397

SEQ ID NO: 380404 - RNA, 64 nt, Human; identical to SEQ ID NO: 249398

SEQ ID NO: 380405 - RNA, 64 nt, Human; identical to SEQ ID NO: 249399

SEQ ID NO: 380406 - RNA, 64 nt, Human; identical to SEQ ID NO: 249400

SEQ ID NO: 380407 - RNA, 64 nt, Human; identical to SEQ ID NO: 249401

SEQ ID NO: 380408 - RNA, 50 nt, Human; identical to SEQ ID NO: 249393

SEQ ID NO: 380409 - RNA, 64 nt, Human; identical to SEQ ID NO: 249402

SEQ ID NO: 380410 - RNA, 64 nt, Human; identical to SEQ ID NO: 249403

SEQ ID NO: 380411 - RNA, 64 nt, Human; identical to SEQ ID NO: 249404

SEQ ID NO: 380412 - RNA, 64 nt, Human; identical to SEQ ID NO: 249405

SEQ ID NO: 380413 - RNA, 64 nt, Human; identical to SEQ ID NO: 249406

SEQ ID NO: 380414 - RNA, 64 nt, Human; identical to SEQ ID NO: 249407

SEQ ID NO: 380415 - RNA, 64 nt, Human; identical to SEQ ID NO: 249408

SEQ ID NO: 380416 - RNA, 64 nt, Human; identical to SEQ ID NO: 249409

SEQ ID NO: 380417 - RNA, 64 nt, Human; identical to SEQ ID NO: 249410

SEQ ID NO: 380418 - RNA, 64 nt, Human; identical to SEQ ID NO: 249411

SEQ ID NO: 380419 - RNA, 64 nt, Human; identical to SEQ ID NO: 249416

SEQ ID NO: 380420 - RNA, 64 nt, Human
cccccaccccagcccaccuggcucuuuguugacagucggcgacaagguugugcguggcuccuga

SEQ ID NO: 380421 - RNA, 64 nt, Human
gaggcgcccaagcuggagccgccuggagggcucggucggcgaccucugaagagagugcaccgag

SEQ ID NO: 380422 - RNA, 64 nt, Human
agccgugccagccggcggaccucaggcgguggacgucggcgauagccguguggacggugaccgg

SEQ ID NO: 380423 - RNA, 64 nt, Human
cagguuguagauaagcaugagaguguggagcagagucggcgagcgcaagccgagcccaucaacc

SEQ ID NO: 380424 - RNA, 64 nt, Human
cacugcuuccauuuaauggggugcaccuguccaauaggcguagcuauccggacagagcacguuu

SEQ ID NO: 380425 - RNA, 64 nt, Human
cuucucacccaccaucagaggacuuuuaaaaucauaggcguagagaguuaggcuaucugcugaa

SEQ ID NO: 380426 - RNA, 64 nt, Human
uucaaguucuugacuauuauucucuuauaaguaguaggcguaaauaaucaggaguuagaauucu

SEQ ID NO: 380427 - RNA, 64 nt, Human
uguuaaugcuucuguuuauuccagaagcauuaagguaacccauugccaaguaucauucuugcaa

SEQ ID NO: 380428 - RNA, 64 nt, Human
auacagaauuagccaggcaugguggcacaugccuguaacccagcuacucgggaggcugaagcag

SEQ ID NO: 380429 - RNA, 64 nt, Human
aucucuguagagcaccuuuucuuucuuagacuaaguaacccaguacaauaguugugaacugaau

SEQ ID NO: 380430 - RNA, 64 nt, Human
augcucauuuacaugugccauuuuuuuaauucgaguaacccauauuuguuuaauuguauuuaca

SEQ ID NO: 380431 - RNA, 64 nt, Human
auuccuaaaacuguggaauggaucacguagacauguaacccagcagcaguuugcuucuguuguc

SEQ ID NO: 380432 - RNA, 64 nt, Human
agaaagggaaaguggauuuaaaauauauauauacguaacccaagccccauaaccccuaacugga

SEQ ID NO: 380433 - RNA, 64 nt, Human
acagugccaguguuuuaagguucugucacacucaguaacccacuucugguuccucauuccgugu

SEQ ID NO: 380434 - RNA, 64 nt, Human
cuuccaguagagacuaaaagaagauucaauuccuguaacccaagacugagucuuagggcuccag

SEQ ID NO: 380435 - RNA, 64 nt, Human
aauaaauacauucgaaggaaccuguguuaucacaguaacccagagcuguauuuggcuagcaauc

SEQ ID NO: 380436 - RNA, 64 nt, Human
uuuugaagugggauguuaaugaaaucaaguuccaguaacccaaaucuuguuuacaaaauauucg

SEQ ID NO: 380437 - RNA, 64 nt, Human
guaaggguauguuuuuagagaaauggaaguuugaguaacccacagaacaucugugaucuuucua

SEQ ID NO: 380438 - RNA, 64 nt, Human
gagcacucccaagucuacagagugauagccuuccguaacccaacucuccuggacugccuugaau

SEQ ID NO: 380439 - RNA, 55 nt, Human
uauguucaggugucucuugaucacaguaacccauagucccccacuggggggacgg

SEQ ID NO: 380440 - RNA, 64 nt, Human
gccaauacuagucaccccaaguagucugcucacaguaacccaaaccucaaguaaacuccccuuu

SEQ ID NO: 380441 - RNA, 64 nt, Human
gaauaaauggcuuguaaagaaguuuuuccaagcuguaacccaugcuguuauuauaguugcugca

SEQ ID NO: 380442 - RNA, 64 nt, Human
uuacacuaccuuggauuuugcaugagugaguauaguaacccaagaugccauaaaaaaaaaacuu

SEQ ID NO: 380443 - RNA, 64 nt, Human
uaugaguacauuccucugcuuaauguuaauacauguaacccacagugguaccaugagaugucaa

SEQ ID NO: 380444 - RNA, 64 nt, Human
cuggacccuauuaugccuuuuaaaaauaauuucaguaacccauaaauacauguuguaaaaaauu

SEQ ID NO: 380445 - RNA, 64 nt, Human
uuaaaggaaaaaggaagccauucaucuauauuuaguaacccaguaauaucucacuuaguuuagg

SEQ ID NO: 380446 - RNA, 64 nt, Human
uauuuuguuuuuguuuuuaggaggagauguuaaaguaacccaucuugcaggacgacauugaaga

SEQ ID NO: 380447 - RNA, 64 nt, Human
agcccugucucaacuaauggaaauauauuugcauguaacccaaaauuagcuuaucuugcauaga

SEQ ID NO: 380448 - RNA, 64 nt, Human
gccacuauguuuccuggcucuaaggcucgucuguguaacccauaaaaccugcuuugauuccaaa

SEQ ID NO: 380449 - RNA, 64 nt, Human
uaaaauacagauguuaugucacuaauaaugaguaguaacccaauuuagcuuuacaaagauuuuu

SEQ ID NO: 380450 - RNA, 64 nt, Human
cauguggcugccuccccuuucagaaacaagcugaguaacccagccugccguuuguaugugagag

SEQ ID NO: 380451 - RNA, 61 nt, Human
augaaaacugucagcuguaaccuacaaugcuguaacccaguaccuacaaaaucagcucgcu

SEQ ID NO: 380452 - RNA, 64 nt, Human
auuuauccagucauugggaauaguaaguuucuguguaacccaucucaauuauagaagcaaguuc

SEQ ID NO: 380453 - RNA, 64 nt, Human
agaguuccacauuuuugccuucauggcuuauucaguaacccauaauuuuaaugcuacacaaauc

SEQ ID NO: 380454 - RNA, 64 nt, Human
agagcaauucugggagaaugaaaggaaguauaaaguaacccauaaucugcuuggcaauaguuaa

SEQ ID NO: 380455 - RNA, 64 nt, Human
uuucaucagcuucuucucucuccccuugaacuugguaacccacaugguucucccguggccccua

SEQ ID NO: 380456 - RNA, 64 nt, Human
uacaaaaauuagccgggcauggugguaggggccuguaacccagcuacucgugaggccaaggcag

SEQ ID NO: 380457 - RNA, 64 nt, Human
ccuggaaacccuccgagacaauuacuugcaugggguaacccaguaauacugugggaugcaacuu

SEQ ID NO: 380458 - RNA, 64 nt, Human
aagaaaaaguaaauucaguuagaaguuucuucuaguaacccaacggcucuuuuaagagccaccu

SEQ ID NO: 380459 - RNA, 64 nt, Human
agcugaaguugccugaaugauccuccuguugcauguaacccacuggccucccugagcaugucca

SEQ ID NO: 380460 - RNA, 64 nt, Human
gccaacucuaaauuuauucagaucguuaacauggguaacccagcaaauauuucccagcagugac

SEQ ID NO: 380461 - RNA, 64 nt, Human
guauuuaggcuaucauuauguugggcaaaaauaaguaacccaaugguagauaaaugaauucaac

SEQ ID NO: 380462 - RNA, 64 nt, Human
aguaauuuaagaugggcaaauccaaugaguugauguaacccaucuacauuuuguggcuauuuca

SEQ ID NO: 380463 - RNA, 64 nt, Human
uuaucuuaguaggcaauuguaacacuuuuugaaaguaacccauuucagauuugaaauacugcaa

SEQ ID NO: 380464 - RNA, 64 nt, Human
uggcaccaccugauuucaugauguaccauaugcaguaacccauguuugagguacagaauugaag

SEQ ID NO: 380465 - RNA, 64 nt, Human
agaacaauuugcucaaagcccuggaaaaugccugguaacccagugccuagaauauuauaugauu

SEQ ID NO: 380466 - RNA, 64 nt, Human
augaguguuaaguagcagguguguugugagugcuguaacccaugaaaggaaaaaugucauucug

SEQ ID NO: 380467 - RNA, 64 nt, Human
gggagaugucugugcuuggagguaccucagagagguaacccaggggucagcccaggcugcuggg

SEQ ID NO: 380468 - RNA, 64 nt, Human
ucagagaacuaauuuuucacuggauaagaccugaguaacccagaccccccaccgugguucuuuu

SEQ ID NO: 380469 - RNA, 51 nt, Human
cccuuuugaaggaagguuaauguaacccaacaagagcacauuuuaucauag

SEQ ID NO: 380470 - RNA, 64 nt, Human
uuuugugucuguaggcugaccucaacccuguaacguaacccauuaaaaugaauuucuuuuuuuu

SEQ ID NO: 380471 - RNA, 64 nt, Human
aacagaaaucaaaaucuccgcuuugccugcaaaaguaacccaguugcacccugugaagugucug

SEQ ID NO: 380472 - RNA, 64 nt, Human
gacuuuugaauuucuuugguuucguuuuuaagaaguaacccaacauuuccuacaacacuaaaua

SEQ ID NO: 380473 - RNA, 64 nt, Human
ggacaaaaguggccaggagcgguagcucauacuuguaacccagcacuuugggaagccgaggcgg

SEQ ID NO: 380474 - RNA, 64 nt, Human
gauguggacugagugcuuugucaccugcaggguaguaacccagugauguuucuuacagaagcac

SEQ ID NO: 380475 - RNA, 64 nt, Human
aaauuucggcccuuaacccagccuuuuccaguguguaacccaguuugaaaucuuaaaaaaagaa

SEQ ID NO: 380476 - RNA, 64 nt, Human
guaucuaaccccuucuuuuguuuucugagaccugguaacccacgcucuugcauuguggauuuua

SEQ ID NO: 380477 - RNA, 64 nt, Human
cguggcagggucugcacagggccauguccuggcuguaacccaggcagugggaggucugcagccu

SEQ ID NO: 380478 - RNA, 64 nt, Human
gcacaauaucaccaggcuucuucugccucccuugguaacccaaggaaugauggaaucaacacaa

SEQ ID NO: 380479 - RNA, 64 nt, Human
ggacaaucugcaugggcaucaccccuccccgcauguaacccaaaagagguguccagagccaagg

SEQ ID NO: 380480 - RNA, 64 nt, Human
gggucauaucuuagaauuguauauaaaacaacauguaacccauucaugaaaaacguuuuuaagu

SEQ ID NO: 380481 - RNA, 64 nt, Human
ggucaacaaucuguuguggggaaaccaccuccauguaacccacuggauacaguccccuuaaugu

SEQ ID NO: 380482 - RNA, 64 nt, Human
cuggguagugccauuuuggccggacaugguugggguaacccagugacaccagcacugauuggac

SEQ ID NO: 380483 - RNA, 64 nt, Human
gugcacuccggucccaaauguagcagguguaaccguaacccacccccaacccguuucccgguuc

SEQ ID NO: 380484 - RNA, 64 nt, Human
gguuaccucacuuuuaauuagugaugcaggcaguguaacccaagcauuuguggacaaugagugg

SEQ ID NO: 380485 - RNA, 64 nt, Human
guccugaaaacaggacaucagauucacugguucuguaacccaguagcugugacguuccaucucu

SEQ ID NO: 380486 - RNA, 64 nt, Human
auuauuauuauuuuuugagauggagucucacuuuguaacccaggcuggaaugcaauggcaugau

SEQ ID NO: 380487 - RNA, 64 nt, Human
uaauuucuuauauuuucuguugacuaaggcaccaguaacccauucuucacccuccauuuguaug

SEQ ID NO: 380488 - RNA, 64 nt, Human
ucccucauuuucugggauucucaagaaagaaaaaguaacccauuaucacucugaguuucgucgu

SEQ ID NO: 380489 - RNA, 64 nt, Human
gaagacaauaguuccucagacagaccucaauaugguaacccaguuagccaagauguuggaugcg

SEQ ID NO: 380490 - RNA, 64 nt, Human
aacuguuucuacuuccccauuucaggugugagauguaacccaccuugaccauaaauuggcuuuu

SEQ ID NO: 380491 - RNA, 64 nt, Human
aaaaaagcagcaaguaauggaauugcacauauuaguaacccaguggaccauaauuggcagucac

SEQ ID NO: 380492 - RNA, 64 nt, Human
agagagggucgucuggccugcuugcugggucuuuguaacccagcacuuccucuugcccuccugg

SEQ ID NO: 380493 - RNA, 64 nt, Human
acaguuauauuagaaauaacaacuaguguggaaaguaacccacauucuguucaggauacuuuug

SEQ ID NO: 380494 - RNA, 64 nt, Human
uccauauuguauccacaauuuaugauaucacuuuguaacccauacauuuauacaauuauaaauu

SEQ ID NO: 380495 - RNA, 64 nt, Human
ugugccugagaugugaaacaucccauuuuaugauguaacccaacaacuuacagaccaguucauc

SEQ ID NO: 380496 - RNA, 64 nt, Human
gugcuguuuuacaacgugaggguagacgcugucaguaacccagagggaccaggccuuccuaggu

SEQ ID NO: 380497 - RNA, 64 nt, Human
cuagcaacauauuugaaucaggcugguaauucggguaacccagguagcacagauuuuuaaugac

SEQ ID NO: 380498 - RNA, 64 nt, Human
accaucagcuccaggcuucuauccugcuaacccaguaacccagugggaagagauuuacuuauuc

SEQ ID NO: 380499 - RNA, 64 nt, Human
ggaggcacuuuagggcuguaaaaugcaugauuuuguaacccagauuuugcuguauauuugugau

SEQ ID NO: 380500 - RNA, 64 nt, Human
uuuuuuuuuuuuaaucuacugacaaguugcucuaguaacccaaagaagugaaggagaaagcagc

SEQ ID NO: 380501 - RNA, 64 nt, Human
acugcuaccuucagggcagaagacacugcucuuuguaacccagccaccaccaaaaagcaaacag

SEQ ID NO: 380502 - RNA, 64 nt, Human
aaagggggcugccuguucccaacucuuucacucuguaacccauuuuaaaaugaguuuuugaauc

SEQ ID NO: 380503 - RNA, 64 nt, Human
aauucuacuuuauuccucaacuucuuugaugaauguaacccaauuuuacuucuuuaaaaagucu

SEQ ID NO: 380504 - RNA, 64 nt, Human
caggacuaccccaagaacccaugugcucucccgaguaacccagauggcugucuuguucauucca

SEQ ID NO: 380505 - RNA, 64 nt, Human
ugagggauugggguggaccugggguuuauuuucaguaacccagcugcaauaccugucuguaaua

SEQ ID NO: 380506 - RNA, 64 nt, Human
gacaugcuggccuggcugagaaaccccugagcagguaacccagggaagagaaggaagccaggcc

SEQ ID NO: 380507 - RNA, 64 nt, Human
caaugugguuuugcagcucugacuucugcucccaguaacccaucguuagggcacucuagcacua

SEQ ID NO: 380508 - RNA, 64 nt, Human
gcccagcaggauggagucccaguugcccgcagcaguaacccacucauucauguacuuccugcgg

SEQ ID NO: 380509 - RNA, 64 nt, Human
cuuuuaaauauuaguuuacauaggaaugaaauauguaacccagaacaaauaacauccuucauua

SEQ ID NO: 380510 - RNA, 64 nt, Human
agugggcaauggugcuucugugcuuuucccccuuguaacccaugugccagauguguggaauuuu

SEQ ID NO: 380511 - RNA, 64 nt, Human
aaaaucgaagagcuaaaaaauacgucuaauuuauguaacccauuggaauguauuucuagguucu

SEQ ID NO: 380512 - RNA, 64 nt, Human
uauaguccaucugcaaucacaagcacauagccagguaacccaccaacuccccuggaucugcagc

SEQ ID NO: 380513 - RNA, 64 nt, Human
uucgugcacuccccgugcgguacaggggcacuucguaacccagggaaagggcggggggcauauu

SEQ ID NO: 380514 - RNA, 64 nt, Human
ugcuauguaaggcugggcgugguggcucacgccuguaacccagcacuaugggaggucgaggugg

SEQ ID NO: 380515 - RNA, 64 nt, Human
uagccauuucuccuucucuauaaauagugcagaaguaacccacuugguaacaggcauccuugcc

SEQ ID NO: 380516 - RNA, 64 nt, Human
ucaugaauacuuuuccaggucaguacguaaagauguaacccauucuuuguaagguucagaauau

SEQ ID NO: 380517 - RNA, 64 nt, Human
cuugcaaaaaaaaaaaaucucaggccauguugggguaacccagcaagggccagugaugauuucc

SEQ ID NO: 380518 - RNA, 64 nt, Human
acuaagagggcaccaaguggggcaaauaccccugguaacccauuuauggaggcugccacagaaa

SEQ ID NO: 380519 - RNA, 64 nt, Human
ucugcagaccucucagcuacccgcgggaccucuuguaacccaucggcaucuuccaggaauccgc

SEQ ID NO: 380520 - RNA, 64 nt, Human
ccaagacagugcccaugaaugggacaccuguaauguaacccacacagcgguuugcagagaaugu

SEQ ID NO: 380521 - RNA, 64 nt, Human
aguaguuaagagccgucccauuucuccuggcgggguaacccauuacaccgaaguccuuuguuuu

SEQ ID NO: 380522 - RNA, 64 nt, Human
uaaggagagcgaugcccacuccuauaccacccuuguaacccaguagacuugccccauaugcccc

SEQ ID NO: 380523 - RNA, 64 nt, Human
ugcauuuaucacuuccaaaucuaacuuugcacaaguaacccauguaaaaaaaaauguacauuuu

SEQ ID NO: 380524 - RNA, 64 nt, Human
ccuauuacaagcugaccaagauaaaaagaaguauguaacccacugugcugucaagcaucaugau

SEQ ID NO: 380525 - RNA, 64 nt, Human
agguccauuucuugaacccacuuauacauaaaauguaacccauuuagaaaaagauucuggauau

SEQ ID NO: 380526 - RNA, 64 nt, Human
gacugcccccaagaucaaaucucuccuggcuguaguaacccaguggaaugaauuuggacaugcc

SEQ ID NO: 380527 - RNA, 63 nt, Human
auuaccuucugggcauuuauuccaaagugggaucaacuguacgccuuugguaucugaccauaa

SEQ ID NO: 380528 - RNA, 63 nt, Human
gagauucagaauccaagauugucuuuaaguuuucaacuguaaauaaaguuuuuuuguaugcgu

SEQ ID NO: 380529 - RNA, 63 nt, Human
uaugucauaaguacuuuguaaagauuugacauucaacuguaguauccauauguugcuuaaauu

SEQ ID NO: 380530 - RNA, 63 nt, Human
cuuaaaaagagaaaagugauggaaugacuucugcaacuguagucccagcaggaacugugaaga

SEQ ID NO: 380531 - RNA, 63 nt, Human
uaugagugacugaauauugccucugagggaguccaacuguauaccugcaucagugucauuccu

SEQ ID NO: 380532 - RNA, 63 nt, Human
gaaguucuaaguauucacuggcacuucucuccucaacuguaauucuauuuuuaauaauaaaaa

SEQ ID NO: 380533 - RNA, 63 nt, Human
aucaagccacaggccuuauuucauauguuuccucaacuguacaaugaacuauucucaugaaaa

SEQ ID NO: 380534 - RNA, 63 nt, Human
uccuggaaaugagaccugguggaauauuauuuucaacuguagucuuucuauacuguggacuaa

SEQ ID NO: 380535 - RNA, 63 nt, Human
ucuuuuuuuuugucuuuaaaaaauaauuggcagcaacuguauuugaauaaaaugauuucuuag

SEQ ID NO: 380536 - RNA, 63 nt, Human
uuuuaccuuucacuugaaaaagaaguauaaaaacaacuguauugaguugaggcuguggagaaa

SEQ ID NO: 380537 - RNA, 63 nt, Human
gcaggcacuuuaauaccaaacuguaacaugucucaacuguauacaacucaaaauacaccagcu

SEQ ID NO: 380538 - RNA, 63 nt, Human
gguuuuuggccaagugacuaaaacaguuuuccacaacuguaaacaaacugcuaagccccaccu

SEQ ID NO: 380539 - RNA, 63 nt, Human
ugaguaguguauuuauauuguauaucauacuuucaacuguagacaauuaugaugcuaauuuau

SEQ ID NO: 380540 - RNA, 63 nt, Human
gucuaucuccagagauaaaauaccauuccuucacaacuguauugucuggaagccccaugagau

SEQ ID NO: 380541 - RNA, 63 nt, Human
ccaguaaacacccuggggacuaggaaaaggaaccaacuguaggcaccucuccagggccuaggg

SEQ ID NO: 380542 - RNA, 63 nt, Human
gaaagcuaguacuuuuaaaugggugccaaaggucaacuguaaugagauaauuaucccugccug

SEQ ID NO: 380543 - RNA, 63 nt, Human
guauaauauaauuaaaaggccaauuuuuucuggcaacuguaaauggaaaaauauauggacuaa

SEQ ID NO: 380544 - RNA, 63 nt, Human
uccggggcuagugaucgugaucccuuuuauuugcaacuguaaugagaauuuuucacacuaaca

SEQ ID NO: 380545 - RNA, 63 nt, Human
guuuacguaaaaauaucugacucacaagaaagccaacuguaugucuugugaugggacaguuca

SEQ ID NO: 380546 - RNA, 63 nt, Human
caagcccuagguguagccauuuugucaagucaucaacuguauuuuuguacuggcauuaacaaa

SEQ ID NO: 380547 - RNA, 63 nt, Human
caccaaaaaaaguuaaacuauguuguaagcagccaacuguaaaugucuauuuugaaauucccu

SEQ ID NO: 380548 - RNA, 63 nt, Human
caauguaucaauguagaguugcucuguuuucuucaacuguauuuauugcugcauuucucagca

SEQ ID NO: 380549 - RNA, 63 nt, Human
auccauucuuuggagauggaguauacaugacugcaacuguauuucauacguucuuuucaaagu

SEQ ID NO: 380550 - RNA, 63 nt, Human
aggcaaaccccccuuggaagcugucaaaaaggacaacuguagaugaaauugucuuccuuuuuu

SEQ ID NO: 380551 - RNA, 63 nt, Human
uugcugcgcuugcauccaugcccagccaauauacaacuguaaagcaaauauagaaagucggcu

SEQ ID NO: 380552 - RNA, 63 nt, Human
ugucuguauagauggccuaauaguucucuauaccaacuguaguucuuuuucuguucuuucaau

SEQ ID NO: 380553 - RNA, 63 nt, Human
auaugacuucaccaaggagcaaugcugggauugcaacuguagggaacaccauuuaugcagugg

SEQ ID NO: 380554 - RNA, 63 nt, Human
uagggguugguccuuaugccagcaagauuuaaccaacuguaaagauaguagucuuugcauaca

SEQ ID NO: 380555 - RNA, 63 nt, Human
ugccuucuugaacuuccugagucacacagaaagcaacuguacacaguagaauucuguggcgca

SEQ ID NO: 380556 - RNA, 63 nt, Human
caguucauucaccugauuacuuugguugcagcacaacuguauauauuguauaaccgaaauuga

SEQ ID NO: 380557 - RNA, 63 nt, Human
agucuaccuagaaaauagauggacaauauuuuucaacuguaugagcacguagauaaccgagag

SEQ ID NO: 380558 - RNA, 63 nt, Human
aaaauacaaaaauuagcugggcguggcggugcgcaacuguagucccagcuacucgggaggcug

SEQ ID NO: 380559 - RNA, 63 nt, Human
ggcaaguguagguugcagugagcugagauugagcaacuguacuccagcuuggcgacagagcaa

SEQ ID NO: 380560 - RNA, 63 nt, Human
cuuuagggcauuuccucuguaauguggcgcuuucaacuguacugcugcagcuuuaaguaccuu

SEQ ID NO: 380561 - RNA, 63 nt, Human
gcaagucagaaagagaacauggucacccaaaagcaacuguaacucagaaauuaaguuacucag

SEQ ID NO: 380562 - RNA, 63 nt, Human
cagaggguuguccaccccgggcaucucaucccucaacuguaaaauaaucgcuaaggauuccuu

SEQ ID NO: 380563 - RNA, 63 nt, Human
uuuguggauguggaacccauggauacagagggccaacuguauuuaggauaauuucaucacuuu

SEQ ID NO: 380564 - RNA, 63 nt, Human
ccuggagagaagguggugacacccauggguucucaacuguaaggaaaaaagacaccagacuuu

SEQ ID NO: 380565 - RNA, 63 nt, Human
aauuuguauguuuuuaaaauuguuacaucuagacaacuguaaacauuauuuuuuuagcuagug

SEQ ID NO: 380566 - RNA, 63 nt, Human
gguauuccuuccucuuuugacuuuuuauugguacaacuguagggaagaaucuacaaccuggag

SEQ ID NO: 380567 - RNA, 63 nt, Human
auauuuucacaguuaauugaacauauuuuuaaacaacuguaguuuugggcaacuuuucacuuu

SEQ ID NO: 380568 - RNA, 63 nt, Human
gaaacaugcaugcauuuaaaaauaaagcuuaaacaacuguauggauguuacauuuacuuucuu

SEQ ID NO: 380569 - RNA, 63 nt, Human
caguucaugaguugcauuguagcagacaauggacaacuguaguuucugaauugacuucuauag

SEQ ID NO: 380570 - RNA, 63 nt, Human
aauuguucuaauuuggugccauuuccugaaucacaacuguauuuuuguaucucaagcuauuuu

SEQ ID NO: 380571 - RNA, 63 nt, Human
uccugccaguuugacuuugagauacauuggagccaacuguaaacuuuaguuuuuaaauuacag

SEQ ID NO: 380572 - RNA, 63 nt, Human
cauuguuaaaaacugauuuacaguaacuuacaacaacuguacuuuuguuggauuagcaaauca

SEQ ID NO: 380573 - RNA, 63 nt, Human
ugcaagcaaaaaccgaagaaaaacacuuaaguacaacuguagugacagugaucaaaguuuuca

SEQ ID NO: 380574 - RNA, 63 nt, Human
ucuauggauguggaaccugugcauauggagggucaacuguacuauaaauaauacgaauaugcc

SEQ ID NO: 380575 - RNA, 63 nt, Human
aggaucccaguuuugccgcagauaauuaauggacaacuguagugcagugauccuuuacagguu

SEQ ID NO: 380576 - RNA, 63 nt, Human
caaaugcuucucuguaaugugcaauaugcuuugcaacuguagaugauauuuuauguuuaaucu

SEQ ID NO: 380577 - RNA, 63 nt, Human
gacaagguaccaggaggaaauuuuuuaagggaucaacuguaucacagugcccacucuggaccu

SEQ ID NO: 380578 - RNA, 63 nt, Human
cugcugugguucuguauuuuuuuauuuuuugaccaacuguauggaaaguugucaguaaaaccu

SEQ ID NO: 380579 - RNA, 63 nt, Human
ugucuuccaaauuauaaaaugugcucacuggcucaacuguauuuuucaaauagccuagauuua

SEQ ID NO: 380580 - RNA, 63 nt, Human
uuaaauucucugauggagggacaacaaugguuucaacuguaugcccaugccugauccucuuau

SEQ ID NO: 380581 - RNA, 63 nt, Human
auuuuguauaguguaaguaugaagaacauagugcaacuguacagguagucaccaguuauugug

SEQ ID NO: 380582 - RNA, 63 nt, Human
uucacaaauacggaauccaugaauaacgaggaucaacuguacuuaacuauauuuuaaagcugu

SEQ ID NO: 380583 - RNA, 63 nt, Human
uggaguggacaaagcucuguauggaagacugaacaacuguaaauagaugauauccaaacuuaa

SEQ ID NO: 380584 - RNA, 63 nt, Human
gaaguguccagcugcguacagucuaguaaccagcaacuguaaacgaaccugugccucuaacaa

SEQ ID NO: 380585 - RNA, 63 nt, Human
gagacccugcccuuccacccggaggccaaaggccaacuguacucccaaaggcaugggagaagg

SEQ ID NO: 380586 - RNA, 63 nt, Human
agaaacuaaauggcagccaggcaugggggcucacaacuguaauccucgcacuuugggaggcuc

SEQ ID NO: 380587 - RNA, 63 nt, Human
caucauuuccuugugucuggacaucagggguaacaacuguacuuacuuuacaggaagaaauuu

SEQ ID NO: 380588 - RNA, 63 nt, Human
ccuuaauauacccccuuuuuuguuugugacuuucaacuguaaucaguuaauaaaguauuuauu

SEQ ID NO: 380589 - RNA, 63 nt, Human
uagagcugcauaauaguauuuauuaaagaaucacaacuguaaacaugagaauaauuuaaggau

SEQ ID NO: 380590 - RNA, 63 nt, Human
aaaaaacaaaaaaguuagaguucgaggaauuaccaacuguaguuuuagccuugguucaugcuc

SEQ ID NO: 380591 - RNA, 63 nt, Human
cauuuaaaacuccucaagaaaggauugguacugcaacuguagguaaacugaaaaaaaauaaga

SEQ ID NO: 380592 - RNA, 63 nt, Human
auuaugccaucagaaugguaaaugagaacacuacaacuguagucagcucacaauuuuuaaaua

SEQ ID NO: 380593 - RNA, 63 nt, Human
ucuucccauuauuuagagcacaguuuuuuaaagcaacuguacaauuucucagccuuaugagcu

SEQ ID NO: 380594 - RNA, 50 nt, Human
acaacauaaccuuaggcugacaacuguacauaggguuaacuucuauuuau

SEQ ID NO: 380595 - RNA, 63 nt, Human
guuuuuauguugugaaugugcuaauaugugcaucaacuguaaagauguaucaguuuuauuaaa

SEQ ID NO: 380596 - RNA, 63 nt, Human
caaaguuuauaaagaugauacaaccaugauuugcaacuguaacaggagaccauuuauuauaag

SEQ ID NO: 380597 - RNA, 63 nt, Human
acuucuguggccuugaguauuuuuuaaaaggcucaacuguaagccucuuagccaguuggauaa

SEQ ID NO: 380598 - RNA, 63 nt, Human
auugucaucacucuuguaaacauuugccaaauccaacuguaauuaguaccagaacuuagaagg

SEQ ID NO: 380599 - RNA, 63 nt, Human
uugucaucagccaccauccuauugcaaagguuccaacuguauauauucccaauagcaacguag

SEQ ID NO: 380600 - RNA, 63 nt, Human
gccagccaguaugaccuaucuuaaucaucagcucaacuguaauuuaaauuuggcuguucucug

SEQ ID NO: 380601 - RNA, 63 nt, Human
caugcaccaacccauacagaguaaaucuuuuaucaacuguauacugguguuuaauagagaaug

SEQ ID NO: 380602 - RNA, 63 nt, Human
aaauagacuugauguuuauaauuaauaccauuacaacuguauaauaaaagcaauuugaagaaa

SEQ ID NO: 380603 - RNA, 63 nt, Human
ucugggaaucaguccccuguggauaccaagguacaacuguauuuauuaacgcuuacuagaugu

SEQ ID NO: 380604 - RNA, 63 nt, Human
aguuauuuccguagaucccuuuaauagugucaacaacuguacacagcuccuucuguaaggcug

SEQ ID NO: 380605 - RNA, 63 nt, Human
caaacaugaaaguuagaagaacggaucaugugccaacuguaguuuuuuaaaaaaaacgcuccu

SEQ ID NO: 380606 - RNA, 63 nt, Human
uaaaugaaucaguaguuaaauauuccuuaaagucaacuguauuucauugugauuuuuguuuuc

SEQ ID NO: 380607 - RNA, 63 nt, Human
agauucauguauauuauagacauaagcacugugcaacuguacuguaacaccaucucuuuugga

SEQ ID NO: 380608 - RNA, 63 nt, Human
aagacuuucuaguguacaagacaccauuguguccaacuguauauagcugccaauuaguuuucu

SEQ ID NO: 380609 - RNA, 63 nt, Human
gauccuauuuaguuaaaaagauaauuuugcuuucaacuguagguccagaaaacuaauuauugg

SEQ ID NO: 380610 - RNA, 63 nt, Human
auacaaaaugucaucguuauccucucuuaugaacaacuguagucaaaauaagguggcacaauu

SEQ ID NO: 380611 - RNA, 63 nt, Human
aucaaggaaauaaaaccaauuuugccacagccacaacuguaaauguuuuuguacccaugcuga

SEQ ID NO: 380612 - RNA, 63 nt, Human
aguuugccuagugucuugguuuacacaauaugacaacuguaacuguacuuuagcuauuguuug

SEQ ID NO: 380613 - RNA, 63 nt, Human
guacauauguggauaagcugauuaaugguuuugcaacuguaauaguagcuguaucguucuaau

SEQ ID NO: 380614 - RNA, 63 nt, Human
ugcaaggucauaaaucuuucagagugacaucaccaacuguacugcaucuuacuggauuuagga

SEQ ID NO: 380615 - RNA, 63 nt, Human
aaggaaacgauccaugcaagagaggcccaaucucaacuguagacugugucccaguaagagagu

SEQ ID NO: 380616 - RNA, 63 nt, Human
auuugugaacaaaaaauggagaauuaaaaauaccaacuguacaaaauaacucuccaguaacag

SEQ ID NO: 380617 - RNA, 63 nt, Human
ugacuacuuguuguaucugcuggauauuuaguucaacuguauaguuuuauuuacuucuguaug

SEQ ID NO: 380618 - RNA, 63 nt, Human
acaaaucuaugcugauaaaugagauugagaacucaacuguauuuugccauaaaugcuucuaag

SEQ ID NO: 380619 - RNA, 63 nt, Human
aggaagaaaaaugauggaugaugccaccugcuucaacuguauauaauaaacacuuaugaugac

SEQ ID NO: 380620 - RNA, 63 nt, Human
gaccugcaccccuggaaccucccaccaucaucacaacuguagucucauuugcaguggagaaaa

SEQ ID NO: 380621 - RNA, 63 nt, Human
uuaccuuuuucaagcucagauucaucuaauccucaacuguacauguguacauucuucaccucc

SEQ ID NO: 380622 - RNA, 63 nt, Human
uuauaugaaagauggaauaagcgcuagagcuuccaacuguauauuuuuuacuuuuauagauuu

SEQ ID NO: 380623 - RNA, 63 nt, Human
gcugaaacuuuuuaaaugagacuguguuuuuuucaacuguauggucuauuccugacagcuaaa

SEQ ID NO: 380624 - RNA, 63 nt, Human
uugugaagaaagcggguccaaaugugauucaaacaacuguacggaguggcauauuagaauugc

SEQ ID NO: 380625 - RNA, 63 nt, Human
cuucuggacuugggcuuacagagcaagaccccacaacuguaggcuggggguggggggucgagu

SEQ ID NO: 380626 - RNA, 63 nt, Human
ugaauaauguggcuuuaguaaauaaucauuuuucaacuguaaacuuauucugaaauaaaguaa

SEQ ID NO: 380627 - RNA, 63 nt, Human
ugggugcucuccagcagcugcuccugccugauucaacuguagccuguaauggguaaaagccac

SEQ ID NO: 380628 - RNA, 63 nt, Human
uccuucaccaauuacuuuaauuaaaaauggcugcaacuguaagaacccuugucugauauauuu

SEQ ID NO: 380629 - RNA, 63 nt, Human
cccauaaaacaguauuuuuuagaaguuguguuacaacuguagcaaauuuuccuuuuaaaaaau

SEQ ID NO: 380630 - RNA, 63 nt, Human
gcucuaucauauagacaggcuucugauaguuugcaacuguaagcagaaaccuacauauaguua

SEQ ID NO: 380631 - RNA, 63 nt, Human
aaugugcugccuagaaacagaccugcauucaaccaacuguaaugcaggauuggaccaugaaug

SEQ ID NO: 380632 - RNA, 63 nt, Human
ggcuuuucgugaagacauauuuccccagccuuucaacuguaaacuccuuuaguaccauugaaa

SEQ ID NO: 380633 - RNA, 63 nt, Human
gauauagcaguuuugccaaauguagacauuguucaacuguauguuauuggcacguguuguuua

SEQ ID NO: 380634 - RNA, 63 nt, Human
gaagaacaacuuuguaguaaucaaaauguuauccaacuguauauuguuuacuuuauuguaaau

SEQ ID NO: 380635 - RNA, 63 nt, Human
agucaacuagaggcaagggaguugagagagcugcaacuguaaagggcaagaacaggcagaggu

SEQ ID NO: 380636 - RNA, 63 nt, Human
cacgguuauugggugaaauuugagauuguaggccaacuguauuuucaagcuucugaacuuagg

SEQ ID NO: 380637 - RNA, 63 nt, Human
uuguaauuuagguauguuuuguuuuguuuugcacaacuguaacccuguuguuacuuuauauuu

SEQ ID NO: 380638 - RNA, 63 nt, Human
caucaacuguuguacaagaaaucucucaacaaacaacuguagugccagaaucugauucaaaua

SEQ ID NO: 380639 - RNA, 63 nt, Human
agaaggcacuuaauaguacaucauguaagauggcaacuguauuaaagaaaaauccggaaaaca

SEQ ID NO: 380640 - RNA, 63 nt, Human
ugcccuucccaggugauucuguaaguugucccucaacuguacuuggagaaaucguguuuuaaa

SEQ ID NO: 380641 - RNA, 63 nt, Human
agcucuaaaggaccaaugcuuuuauaauguuuucaacuguaucugagucagccagagagauaa

SEQ ID NO: 380642 - RNA, 63 nt, Human
gcuuaaugguuucucauuauguuuaucaaaaaacaacuguagcuguuauuuucaguacuuggc

SEQ ID NO: 380643 - RNA, 63 nt, Human
gguaaaaugguaauugaauuuuccuaacugcaucaacuguaaugauauacucccuucuccucc

SEQ ID NO: 380644 - RNA, 63 nt, Human
agccaaagcaggaccucggccgguguggggggccaacuguagcucaggagccucguucucagg

SEQ ID NO: 380645 - RNA, 63 nt, Human
ugauucuuuguuuucuuuuucguccaacuaaaacaacuguaauguacuugauacauuuauauc

SEQ ID NO: 380646 - RNA, 63 nt, Human
ugaaacaguauacagacaccuuguacuuuuccucaacuguaagagcagacuuucaauguuagc

SEQ ID NO: 380647 - RNA, 63 nt, Human
ugcuaucauguaagauaaaauguaaauugcugccaacuguaguaaugaugcuuuuaauaaaag

SEQ ID NO: 380648 - RNA, 63 nt, Human
aagggauuacaggugugagccaccacuccuggccaacuguaguugaacucagguauuggaagg

SEQ ID NO: 380649 - RNA, 63 nt, Human
aauguuggcacgucaaaaauaugaauguguagacaacuguaguugugcucaguuuguagugau

SEQ ID NO: 380650 - RNA, 63 nt, Human
cccuuucucuuuccucauuuccuagacguacgucaacuguauguacauaccggggcuccucuc

SEQ ID NO: 380651 - RNA, 63 nt, Human
cugugaagugcugcgcucuaguaacugccuuagcaacuguagaugucucggauaaaaguccug

SEQ ID NO: 380652 - RNA, 63 nt, Human
cuugaaaccaaaauguauaauguacaguuuucacaacuguaucugcucuaauaaaaaaaaguu

SEQ ID NO: 380653 - RNA, 63 nt, Human
cacucacuagaguuguauaaugugcagccugcacaacuguacaguccagcuguagcuaucuuc

SEQ ID NO: 380654 - RNA, 63 nt, Human
aaagaggcugagaauuaccauacaaggguauuacaacuguaaaacaauuuaucuuuguuucau

SEQ ID NO: 380655 - RNA, 63 nt, Human
uuuuacaaggcaacuuccgucauuuaauguuuucaacuguaauugucuuaauggaaauguuaa

SEQ ID NO: 380656 - RNA, 63 nt, Human
acuguaauauauuauuauuugauuguauauguacaacuguaaauacauuuguaccucucuugu

SEQ ID NO: 380657 - RNA, 63 nt, Human
ugugguuucuacucaccacgugaaauaaacuaucaacuguauaaagagaacaaagugauuuua

SEQ ID NO: 380658 - RNA, 63 nt, Human
uugugaagcaugacugauuaacagaauuuuauacaacuguaccaauaaaauuccaaauuggaa

SEQ ID NO: 380659 - RNA, 63 nt, Human
uuuucacuuuacgcaauuuccauuaaccauggucaacuguacuuuaaaguuauuaaauggauc

SEQ ID NO: 380660 - RNA, 63 nt, Human
aaucuucauuuguuggaaaugaaaacguucuagcaacuguauaaaagcguugggcauguuugu

SEQ ID NO: 380661 - RNA, 63 nt, Human
ggaagggggcugagcccuguggcuggguucugacaacuguaacgguuuugucgagcuuaggcc

SEQ ID NO: 380662 - RNA, 63 nt, Human
gccuaaaaaagaugugaaacaguuuacauaugucaacuguaacaguaggucccaaaugggccc

SEQ ID NO: 380663 - RNA, 63 nt, Human
aaacaauacagggaagagucaaaagggcuucuccaacuguagagguacagauugucuuaaccu

SEQ ID NO: 380664 - RNA, 63 nt, Human
agagcauguaaaaugauuuuacuggauucuguucaacuguaaucaaugaaaaagauguacguu

SEQ ID NO: 380665 - RNA, 63 nt, Human
ugcacaacagugugaguguacuuaaugccacugcaacuguauauuuaaaaauaguuaaaauga

SEQ ID NO: 380666 - RNA, 63 nt, Human
uucaugcaccuguccuuucuaacacgucgccuucaacuguaaucacaacauccugacuccguc

SEQ ID NO: 380667 - RNA, 63 nt, Human
augaucucuguuccuuuuggcucuaauaugcuacaacuguaggccaauuaucacuuuaccaau

SEQ ID NO: 380668 - RNA, 63 nt, Human
aagguuauuucaaaguuaauaaagacaaaguggcaacuguagaaaguguugccuccaaucuug

SEQ ID NO: 380669 - RNA, 63 nt, Human
ccugcccucaaggguguguauauuguauaggggcaacuguaugaaaaauuggggaggaggggg

SEQ ID NO: 380670 - RNA, 63 nt, Human
uguauguguaaaaauguacgauuuuucacugugcaacuguaaauuauaaauaaaaaauauuuu

SEQ ID NO: 380671 - RNA, 63 nt, Human
gcaaguuucccuguagauguaucaaaauacuaccaacuguaaauugagauuuaauucccaaau

SEQ ID NO: 380672 - RNA, 63 nt, Human
gagccacagugcccuucacucucuccuggaaaccaacuguaagcuggugggcucaaccugugg

SEQ ID NO: 380673 - RNA, 63 nt, Human
uuugguuaugaaaauggaauccuuguucuugcacaacuguaaauguuuuguugcuagauaaua

SEQ ID NO: 380674 - RNA, 63 nt, Human
gcguaacggagggugaagagcauaguuaauaagcaacuguaaaaaguuuuauuuguuuacuuu

SEQ ID NO: 380675 - RNA, 63 nt, Human
gagucacagcagcagacugcucugggucagugacaacuguacaucaggagauuguguuguuuu

SEQ ID NO: 380676 - RNA, 63 nt, Human
cugagacugguggcuucuagaagcagccauuaccaacuguaccuucccuucuugcucagccaa

SEQ ID NO: 380677 - RNA, 63 nt, Human
gccuccugaugggacauagcccuaacuccuuaacaacuguagcaagaacugcacgguacaaac

SEQ ID NO: 380678 - RNA, 63 nt, Human
aacaccucucaucauaacuacauuuaaaugaaacaacuguauuaauauuuuaaauauaauagu

SEQ ID NO: 380679 - RNA, 63 nt, Human
caacucugcugccuccacugugaugcagcaguccaacuguaacugacaguggcugccuucucu

SEQ ID NO: 380680 - RNA, 63 nt, Human
aguguuaaaauacccuagauacuguguuaugugcaacuguagaaacccuccagaaauuuccac

SEQ ID NO: 380681 - RNA, 63 nt, Human
uuacauuuccuaaaacauacugcugccaaagaccaacuguagaauccuuaaguccuguucaag

SEQ ID NO: 380682 - RNA, 63 nt, Human
auauuuauguuguaauuacauguguaacuuccacaacuguaaauauugggcuagauagaacaa

SEQ ID NO: 380683 - RNA, 63 nt, Human
acuuacauuuuaauacucuuguaggagaaaaagcaacuguauaaaugaauguagagugacuuu

SEQ ID NO: 380684 - RNA, 63 nt, Human
uaacauugcuaauaaccuguggcucaauuuccucaacuguauaaugagguuacuacuaguauc

SEQ ID NO: 380685 - RNA, 63 nt, Human
agauaaaugcagaaaauguuuagagagcuuggccaacuguaaucuuaaccaagaaauugaagg

SEQ ID NO: 380686 - RNA, 63 nt, Human
aaaauagaggauacaauggaaaauagaggauaccaacuguaugcuacugggacagacuguugc

SEQ ID NO: 380687 - RNA, 63 nt, Human
uugcauuacugucuuccguggauguuucaguuacaacuguaauguuauuuauagaacaacauu

SEQ ID NO: 380688 - RNA, 63 nt, Human
gcucugcuuguagacuggccaguguccaugaaacaacuguaaauaccaacaugugugcauggg

SEQ ID NO: 380689 - RNA, 63 nt, Human
uuuguuggaugaugauuuuugaaaaauagucaccaacuguauauacuuccucaagaacugaua

SEQ ID NO: 380690 - RNA, 63 nt, Human
guauauuuuaaaaaagaaaaauauucuuuguagcaacuguaaauucucccauuauaacaguga

SEQ ID NO: 380691 - RNA, 63 nt, Human
uuaagcuuuuugcuguccaugaauccucuguggcaacuguaaucacagagccagaagccagag

SEQ ID NO: 380692 - RNA, 63 nt, Human
ugaggagcuggugaaaaggcagauucuuaggcccaacuguagaccuucagagucagaaugucu

SEQ ID NO: 380693 - RNA, 63 nt, Human
uuucugaaaugaaauguuuuuagauuacuuuuucaacuguaaauaauguacauuuaaugucac

SEQ ID NO: 380694 - RNA, 63 nt, Human
gaaucucuucaggauuauaaaaguuguaaaaugcaacuguauugcugagcaaaaaaaaaaaaa

SEQ ID NO: 380695 - RNA, 63 nt, Human
uauauguaacugaagcaaccuacuuuugaaaaucaacuguauuggguagugggaggugggagg

SEQ ID NO: 380696 - RNA, 63 nt, Human
gagaaaauccaggucaugcaguuccuggcccaucaacuguauugggccuuuuggauaugcuga

SEQ ID NO: 380697 - RNA, 63 nt, Human
uaaugguucuagaaggaugaacaguucucccuucaacuguauaccgugugcuccaguguuuuc

SEQ ID NO: 380698 - RNA, 63 nt, Human
aaugauuuaugaugaaucuugggcaaaaaaauacaacuguaaaaaauuucacaggucauuugu

SEQ ID NO: 380699 - RNA, 63 nt, Human
gcccagcuuggaaauaguugcuuuccauagucucaacuguauugugucaucuccugaugcuga

SEQ ID NO: 380700 - RNA, 63 nt, Human
ugugcucuuguuuuuaacuuauuuuuuuuuuaacaacuguaguacacuacccugagacacugc

SEQ ID NO: 380701 - RNA, 63 nt, Human
acauacgcuaccuugaugaaagggaccuucgugcaacuguagucaucuuaaaggcuucucauc

SEQ ID NO: 380702 - RNA, 63 nt, Human
uccaggaaccaauaccccauggauaccaagggacaacuguacuuauuuaccuuuauugucauu

SEQ ID NO: 380703 - RNA, 63 nt, Human
cuucguugaauuuuuuuugacacuggaaauguucaacuguaguuuuauuaaggaagccaggca

SEQ ID NO: 380704 - RNA, 63 nt, Human
cucaauacugauucacaauugaguuaaauuagacaacuguaagagaaaaauuuaugcuuugua

SEQ ID NO: 380705 - RNA, 63 nt, Human
aagaaauuggccacugguaaaacucugcagcuucaacuguacuucauuuaaugccauuaaugc

SEQ ID NO: 380706 - RNA, 63 nt, Human
ucacacaucuuugcguucuccccugccguccuucaacuguaucuuacuuuucuuaccagaaag

SEQ ID NO: 380707 - RNA, 63 nt, Human
cuuguuggcauuauuuuagggaguugaaacuaucaacuguaaagcuccuuuucuuccacuuua

SEQ ID NO: 380708 - RNA, 63 nt, Human
ggaaggagguugugauugcuggcaagucccccccaacuguaccacgggcaugaggagcugaag

SEQ ID NO: 380709 - RNA, 63 nt, Human
caagguuaagccauucugguauucugguauuagcaacuguaaauucugccaccucauacaugg

SEQ ID NO: 380710 - RNA, 63 nt, Human
uaaaacaaauguuaacagaauggaauuuuuuuucaacuguauguagggcugcagugguggcca

SEQ ID NO: 380711 - RNA, 63 nt, Human
auuuaggucucuaaacacagacuuuuuaaauugcaacuguaaauaugaaauggucaucacauc

SEQ ID NO: 380712 - RNA, 63 nt, Human
acuuuuuacacugaaacuauacuugaacaguuccaacuguacauacauacuguaugaagcuug

SEQ ID NO: 380713 - RNA, 63 nt, Human
aaggacugucuggcaaugacuuguauuggccaccaacuguagauguauauauggugcccuucu

SEQ ID NO: 380714 - RNA, 63 nt, Human
ucccucuggacuggaugguucuucauaggagagcaacuguaggugaucauuauccugugaaaa

SEQ ID NO: 380715 - RNA, 63 nt, Human
ggcugagauugcagcccaugguaggagcuggaccaacuguauauaguuuucaauaaacuuuuu

SEQ ID NO: 380716 - RNA, 63 nt, Human
guauaacugggagcaaaaauauauucugcuuuucaacuguaggugcuccagacuugcucuccg

SEQ ID NO: 380717 - RNA, 63 nt, Human
gccugaggcgugcccagagcacaagacugggggcaacuguagaugugguuucuaguccuggcu

SEQ ID NO: 380718 - RNA, 63 nt, Human
ugguaaagauaguucauauaaguuguaucuagacaacuguaucgucuaaauuguaaacaauua

SEQ ID NO: 380719 - RNA, 63 nt, Human
guaaaauuuguaucuuccagauuagaaaaauuucaacuguaggugccuuugcaaccuauccug

SEQ ID NO: 380720 - RNA, 63 nt, Human
uauuuuacuaccaacaguuauaguuugaaaguccaacuguauuaauugacugauaauaugaua

SEQ ID NO: 380721 - RNA, 63 nt, Human
gaggaaucaauaauaaaacugcaacagaacuaucaacuguauacuuauuugguggagaugaaa

SEQ ID NO: 380722 - RNA, 63 nt, Human
auucacaaauacauaaccuugaauaaugaggaucaacuguaccauauuuaauaaagcacaaaa

SEQ ID NO: 380723 - RNA, 63 nt, Human
uugaucccacucaacuaugaaaacaggacuuuucaacuguauuuuaucaaaaaaggaaaucug

SEQ ID NO: 380724 - RNA, 63 nt, Human
acauucauguuuguuaaaaacugguaaauuuugcaacuguauucauacaugucaaacacagua

SEQ ID NO: 380725 - RNA, 63 nt, Human
uuuauaaaugugaacuuaaacucuaauuaauuccaacuguacuuuuaaggcaguggcuguuuu

SEQ ID NO: 380726 - RNA, 63 nt, Human
uuaucagugaguauuucauucuuauaugugucacaacuguagauccuaugaauauuuuaguua

SEQ ID NO: 380727 - RNA, 63 nt, Human
acaaaaaaagaaaaaaaaaagaaagaaacacagcaacuguagaugcuccuguuccugguuccc

SEQ ID NO: 380728 - RNA, 63 nt, Human
aucuggcaugccaggcuuaggugucuagaacagcaacuguaugugaaggggagccagggaacg

SEQ ID NO: 380729 - RNA, 63 nt, Human
agaacucagcgucccaagacgcucugggcgggccaacuguagcuuguucucaugugguucuuc

SEQ ID NO: 380730 - RNA, 63 nt, Human
ugacuuacaaugaaccauaauguccacauuucccaacuguauuuuggagccucuucugucccc

SEQ ID NO: 380731 - RNA, 63 nt, Human
uaaauugugccucgugugccaaagaaacauagacaacuguagaggcaauggauauggaaaaca

SEQ ID NO: 380732 - RNA, 63 nt, Human
aacaugcaugcugagacuauuacuccuggaccacaacuguaggugaggauucauaggaagagu

SEQ ID NO: 380733 - RNA, 63 nt, Human
augaguauuccagacuacagaguuugcccaaaucaacuguaaaugacacuuguguaacguaua

SEQ ID NO: 380734 - RNA, 63 nt, Human
agcuauuuauagaaagcuucaauagaacuguuucaacuguauaacuauuuacuauucaaauaa

SEQ ID NO: 380735 - RNA, 63 nt, Human
aucuucuauuuuuaucaugaauucccuuuuaaucaacuguagguuauuuaaaauaaauuccua

SEQ ID NO: 380736 - RNA, 63 nt, Human
caggagaggagccuuaugaguauagaguacgggcaacuguagccaucagucagccuugagcau

SEQ ID NO: 380737 - RNA, 63 nt, Human
aggugagcaaaauaccgaauacugaauggaaaucaacuguaaguauuaggacuucauaugcaa

SEQ ID NO: 380738 - RNA, 63 nt, Human
aaaauauauaaauauauaaaccugcggcuuuaacaacuguaauacaaccuuuugaauuaguuc

SEQ ID NO: 380739 - RNA, 63 nt, Human
ggguuuguacacacaugcaugcauguguguauacaacuguaaucuggaacuucaggaaguaaa

SEQ ID NO: 380740 - RNA, 63 nt, Human
uugaguuugguucagaucuuaagcagcuccaugcaacuguauuuauuuuugaugacaagacuc

SEQ ID NO: 380741 - RNA, 63 nt, Human
ugcucuuaaggaguacauauggucauuaauugccaacuguagauuccagugaucuggccccug

SEQ ID NO: 380742 - RNA, 63 nt, Human
uucuccugcaggagagacaucauugaauuuuuucaacuguaucaguagcacaguauuuuugua

SEQ ID NO: 380743 - RNA, 63 nt, Human
ggaguugucucuuaccccacccucccugcccaucaacuguaucugauuucacuaauuuugaca

SEQ ID NO: 380744 - RNA, 63 nt, Human
auacauaugguaauuguaggguaauacccacaacaacuguaguuucuuacuuggccaagagaa

SEQ ID NO: 380745 - RNA, 63 nt, Human
uuuucaucucauuagggcuuuuuuguacauagccaacuguagccacccuggcaugcugucucu

SEQ ID NO: 380746 - RNA, 63 nt, Human
acucagauuuuuaaaagcccuuuccaaagguuucaacuguaaaauacuucuuuuuacaaugua

SEQ ID NO: 380747 - RNA, 63 nt, Human
ugggauuuucccaccaauacaaaccaguuacagcaacuguaauguaacauaaaaagggcaucu

SEQ ID NO: 380748 - RNA, 63 nt, Human
uuucaccugcauugacaaguauuaauugaaccccaacuguauauguugcacugugcuagguac

SEQ ID NO: 380749 - RNA, 63 nt, Human
uagguguaagagaggguggggcuaagugaaugucaacuguaguagguauucagucagucuuuc

SEQ ID NO: 380750 - RNA, 63 nt, Human
uuuaauuacaaugaaaaauuuuguguuccaaggcaacuguaucauagguguaaacauaaagca

SEQ ID NO: 380751 - RNA, 63 nt, Human
aacuaugguuauuggcuagaaauccugaguuuucaacuguauauaucuauaguuuguaaaaag

SEQ ID NO: 380752 - RNA, 63 nt, Human
uuucugauuacuuagucuaauuuugcacaaaaucaacuguauuaguccauucuugcaaagaaa

SEQ ID NO: 380753 - RNA, 63 nt, Human
cacgucauccauaguuuauuguuaguaugaacacaacuguaacauuuaccugguaucuacauc

SEQ ID NO: 380754 - RNA, 63 nt, Human
acuguucucuaacuguggagugaauggaaauuccaacuguauguucacccucugaagugggua

SEQ ID NO: 380755 - RNA, 63 nt, Human
aggcccgcugcuguguguggcuucuggaugggacaacuguagaggcaguucgaccagccaggg

SEQ ID NO: 380756 - RNA, 63 nt, Human
gugguggcuggggggauggaauugagagggagacaacuguauccuuucauagcuuuugaaaau

SEQ ID NO: 380757 - RNA, 63 nt, Human
ccccaccaucaggccagucaacugcacaauacacaacuguauuucccaauacacuugagcagu

SEQ ID NO: 380758 - RNA, 63 nt, Human
uauuuuuuuaggaaucaaugacuuaacagaacucaacuguauaaauaguuugguccccuuaaa

SEQ ID NO: 380759 - RNA, 63 nt, Human
gguaaaaaacuagugugccaaaugguauaggaacaacuguacuuuuuuugaucaguuggcaug

SEQ ID NO: 380760 - RNA, 63 nt, Human
uacauuuuugccauuauguaaaucccaugauuucaacuguaaacaucuguccauugguguagc

SEQ ID NO: 380761 - RNA, 63 nt, Human
cccaucccucuaaagccugcccuccuuugccuucaacuguauaugcuggguauuucauuuguc

SEQ ID NO: 380762 - RNA, 59 nt, Human
ccccggaaggcccuguggucaugugcuccuagcugcacgguggcugcuggccacaccac

SEQ ID NO: 380763 - RNA, 59 nt, Human
aacaucuuuagugucugagcuucucaaauuagcugcaauaggaaaaaaacaaauuggga

SEQ ID NO: 380764 - RNA, 59 nt, Human
gaaguauguuugaacucuccagugcccuauagcugcaagaguugaauuagucaugcagu

SEQ ID NO: 380765 - RNA, 59 nt, Human
gaucaccucuuagaacugguuuuaaccuuuagcugcagcggcuacgcugccacgugugu

SEQ ID NO: 380766 - RNA, 59 nt, Human
uccaucagacccaaaggacucaugggggcuagcugcaccucacauuucuuggacauaua

SEQ ID NO: 380767 - RNA, 59 nt, Human
auguauguaaaaauuauauauacacaaauuagcugcacguauauacauauauauauuuc

SEQ ID NO: 380768 - RNA, 59 nt, Human
gacacccuccaccucuaguuguuacuaaguagcugcaguaggcauugcuggggaagaaa

SEQ ID NO: 380769 - RNA, 59 nt, Human
augugggucucuagugccuugcccuggcuuagcugcaggagaagauggcugcuuucacu

SEQ ID NO: 380770 - RNA, 59 nt, Human
uucccucuauuuuuuaaauugaaauauaauagcugcaucagcccugaaaagccaaauuc

SEQ ID NO: 380771 - RNA, 59 nt, Human
acuggcugauacucaaaguugcaguuacuuagcugcaugagaauaauacuauuauaagu

SEQ ID NO: 380772 - RNA, 59 nt, Human
acaagcccugggguuugaagcugacuuuauagcugcaaguguaucuccuuuuaucuggu

SEQ ID NO: 380773 - RNA, 59 nt, Human
agcaccccaggcagcucaagcugaauaaauagcugcagacauggccaacaacauggggc

SEQ ID NO: 380774 - RNA, 59 nt, Human
gugcuccacuacaaucgccgcauucuuucuagcugcagcugguuucuucaaggcuccug

SEQ ID NO: 380775 - RNA, 59 nt, Human
uguucauuuuaugcauauuuaagaaauuauagcugcauaucccuucuuucaaaaaaugu

SEQ ID NO: 380776 - RNA, 59 nt, Human
ucuuuaucguaauaaacauguggcucuauuagcugcaagcuuuaccaaguaauuggcau

SEQ ID NO: 380777 - RNA, 59 nt, Human
auauaaacuugugguauaaccauagaccauagcugcagguuaaccaauuaguuacuauc

SEQ ID NO: 380778 - RNA, 59 nt, Human
uucaggacuucugccaauuuugaaugauauagcugcaccaacaauaucccgccuccucu

SEQ ID NO: 380779 - RNA, 59 nt, Human
caacugcagcaguggggaggaggcacagcuagcugcacaguucucucuucuccuugucc

SEQ ID NO: 380780 - RNA, 59 nt, Human
gcuuuauuaugucugucaccaugaaaacuuagcugcaucuuuugaaauaucaaauauga

SEQ ID NO: 380781 - RNA, 59 nt, Human
uuggguugaaaaaaaguaaaaagauaauguagcugcauuucuuuaguuauuuugaaccc

SEQ ID NO: 380782 - RNA, 59 nt, Human
ucuagguggccucucagcucugccaccucuagcugcaugaccuugggcaagcuauguaa

SEQ ID NO: 380783 - RNA, 59 nt, Human
ugaucuucaagcagggaagccccagugaguagcugcauuccuagaaauugaaguuucag

SEQ ID NO: 380784 - RNA, 59 nt, Human
uuauuaguaagaaaacaucacugaaaugcuagcugcaagugacaucucuuugaugucau

SEQ ID NO: 380785 - RNA, 59 nt, Human
cuguguuuguuuuuauuuuuauauguuguuagcugcagauuaaccccagccccucuguc

SEQ ID NO: 380786 - RNA, 59 nt, Human
gggaacagcagagaugaauggcaaacucauagcugcagguggcuauaacagagaggaau

SEQ ID NO: 380787 - RNA, 59 nt, Human
aguagcucacucuaaguuacaggguuugcuagcugcagacuggagacuagaucucaggu

SEQ ID NO: 380788 - RNA, 59 nt, Human
cugcugccacccugugcugcugaggugcguagcugcacagcugggggcuggggcguccc

SEQ ID NO: 380789 - RNA, 59 nt, Human
uuggccugggaguuuggacaccaaaguucuagcugcagcuuugcuuccaaugugaccuu

SEQ ID NO: 380790 - RNA, 59 nt, Human
agcguggggugagucccugggcucaguccuagcugcauggggugcaggcauugcacaga

SEQ ID NO: 380791 - RNA, 59 nt, Human
uuggccugcacuacgaugagggauggagguagcugcaggcucagaagagacugagcuug

SEQ ID NO: 380792 - RNA, 59 nt, Human
uacucucaggcauggaugaauaaauguuauagcugcauuugucuggccuuuucuuguaa

SEQ ID NO: 380793 - RNA, 59 nt, Human
aaguaauuacuaacaaaagguacuaggauuagcugcaaucucuacuuucgaugaggaaa

SEQ ID NO: 380794 - RNA, 59 nt, Human
cagaccuggauuaaaaucugccauuuaauuagcugcauaucaccuuaggguacagcacu

SEQ ID NO: 380795 - RNA, 59 nt, Human
uuagucaugguguugcguaaaucauauuuuagcugcacggcauuaccccacacagggug

SEQ ID NO: 380796 - RNA, 59 nt, Human
cauaauuuauauugcuuuuucaaaugauguagcugcauuaauuguguucaucaugacuu

SEQ ID NO: 380797 - RNA, 59 nt, Human
gauguugaauucuuuugccaagggaauuauagcugcagguucucucucacugccaucaa

SEQ ID NO: 380798 - RNA, 59 nt, Human
ucuccuuagaaaaauggcaacacagaugguagcugcacagcuugcaucaauggugugga

SEQ ID NO: 380799 - RNA, 59 nt, Human
ccuuuggugaaaccacggccaauguuccuuagcugcaccaggcccgaagcuguucccau

SEQ ID NO: 380800 - RNA, 59 nt, Human
auaccccacugcugcccgacacugcccuuuagcugcagagcuggauuagcuguugacca

SEQ ID NO: 380801 - RNA, 59 nt, Human
agguuuuguaaaacuuuugaaaaugaacuuagcugcaaaauauagcuaaccacuuucca

SEQ ID NO: 380802 - RNA, 59 nt, Human
cgucauucuuguuacaucacucauacuuuuagcugcaaccacacuaauucacauuuuua

SEQ ID NO: 380803 - RNA, 59 nt, Human
uagccuauuuuuuuagauugagaaauguguagcugcaaaaauaaucaugaaccaaucug

SEQ ID NO: 380804 - RNA, 59 nt, Human
aaacaaaauugccugaauuguacuguauguagcugcacuacaacagauucuuaccgucu

SEQ ID NO: 380805 - RNA, 59 nt, Human
gccauuuaauggcaaugguagucuuugguuagcugcaaaaauacuccauuucaaguuaa

SEQ ID NO: 380806 - RNA, 59 nt, Human
agauguuucuggacuugcuagagccugcuuagcugcauguuuuguaguuacgauuuuug

SEQ ID NO: 380807 - RNA, 59 nt, Human
uacucuugccucagccuccucuuccugaguagcugcaacuacagacacaugccccaaua

SEQ ID NO: 380808 - RNA, 59 nt, Human
auguuuuauaguaauuuaauuugcuccuguagcugcauuauuucuugauuagagguuug

SEQ ID NO: 380809 - RNA, 59 nt, Human
aauacauggcguaauuaacucagcuguucuagcugcaguacugcugcagugauccaccc

SEQ ID NO: 380810 - RNA, 59 nt, Human
guuauguuuuuaagcugguuuagauacauuagcugcaauuuuuuuugcauuugacacaa

SEQ ID NO: 380811 - RNA, 59 nt, Human
ggcaggagggccgagaguuuggacccacauagcugcaacccaagcuggcccauaaucag

SEQ ID NO: 380812 - RNA, 59 nt, Human
ugugguucguacucaagugaucuauuaucuagcugcaaagccuggcuuugauuugaaau

SEQ ID NO: 380813 - RNA, 59 nt, Human
cuguacuguuuuuucuauucacgugugucuagcugcaggauguaacauggaaaacagua

SEQ ID NO: 380814 - RNA, 59 nt, Human
ugguacccggccaacaucaagugacuuuauagcugcaagaaaugugguauguggagaag

SEQ ID NO: 380815 - RNA, 59 nt, Human
uggcuccugggcugggacaagugaggaacuagcugcagagggaugagugaccaccaucc

SEQ ID NO: 380816 - RNA, 59 nt, Human
cccugccccucaugaucucccacuuucucuagcugcagccuuaaauuagcuucuuugcc

SEQ ID NO: 380817 - RNA, 59 nt, Human
cagaaaacaagauuacuguaagccaguuuuagcugcacugauuucaaaagauauaagaa

SEQ ID NO: 380818 - RNA, 59 nt, Human
aaagucauuuucuucaaagagacuacagcuagcugcacauuguguagagcagcuucuaa

SEQ ID NO: 380819 - RNA, 59 nt, Human
uuuccucaaguuuccaugugcgguucuccuagcugcagcaauacuuugacauuuaaaga

SEQ ID NO: 380820 - RNA, 59 nt, Human
uuugcuuugaaaauauuuguccaauugaguagcugcaugcuguucccccagguguugua

SEQ ID NO: 380821 - RNA, 59 nt, Human
ggaaaaaaaaauacaacacuaacaauacauagcugcaauguguacaauggcugauuuaa

SEQ ID NO: 380822 - RNA, 59 nt, Human
ugacugagaaucuagcacuucuccacuuguagcugcacuuuaagucucagcagaagaua

SEQ ID NO: 380823 - RNA, 59 nt, Human
cacccccaggccaaugcagcuaauuuugauagcugcauucauuuaucaccagcauauug

SEQ ID NO: 380824 - RNA, 59 nt, Human
cagauuucauaaaacacuuccuuggaauauagcugcauuaacuuggaaagaagccuguu

SEQ ID NO: 380825 - RNA, 59 nt, Human
cuugaauuccugggcucaagcuucccaaguagcugcaacaacaggcacacaccaccaug

SEQ ID NO: 380826 - RNA, 59 nt, Human
aaaaauguucugucuuuuugaaugccacuuagcugcauuuucagaagcuuauaggcuau

SEQ ID NO: 380827 - RNA, 59 nt, Human
accaccccacugccuuccuucagcaccuuuagcugcauuuguaugccagugcuuaacac

SEQ ID NO: 380828 - RNA, 59 nt, Human
uugcucuccuuggccacacgugcuccuuuuagcugcacggccugucuuuaggugccagu

SEQ ID NO: 380829 - RNA, 59 nt, Human
agcuguacuuuuguauguguauauuuuuauagcugcagauuguccacacaguauacuuu

SEQ ID NO: 380830 - RNA, 59 nt, Human
aaaauacauguaaaaucuuguacacaucuuagcugcaauguauguugaaggaaauuuau

SEQ ID NO: 380831 - RNA, 59 nt, Human
agauggcuggaugugaaagagacaugcucuagcugcagaggcaaauuugaagugccacg

SEQ ID NO: 380832 - RNA, 59 nt, Human
cuacacaaaucagcaccagcacagucugauagcugcaaauguccauucaucugcugugu

SEQ ID NO: 380833 - RNA, 59 nt, Human
gcccggcccucccguucgcccguccucacuagcugcacccuguuugcucgcagaccucc

SEQ ID NO: 380834 - RNA, 59 nt, Human
acuuaaagauauauaaauuuaaaaaaacauagcugcaggucuuuggucccagggcugug

SEQ ID NO: 380835 - RNA, 59 nt, Human
uccaucucagaacaccccagccuugagcuuagcugcaggcccaggcccucugcucugcu

SEQ ID NO: 380836 - RNA, 59 nt, Human
aggcgauccucuugcccuggccucccauguagcugcaacuauaggugugugccacuaca

SEQ ID NO: 380837 - RNA, 59 nt, Human
gaggcugccagggccuuguacgguaaaccuagcugcauguaaucuguggacaauggcau

SEQ ID NO: 380838 - RNA, 59 nt, Human
aauuaauacauauauccaaggauauguuauagcugcaguguuugaaagccaaaggauuu

SEQ ID NO: 380839 - RNA, 59 nt, Human
ggaugguguacaacagguccuagcauguauagcugcauagauuucuucaccugaucuuu

SEQ ID NO: 380840 - RNA, 59 nt, Human
gggaguuauuuuuaccauccgggcgcugauagcugcacuauuaauaaauugcauguguu

SEQ ID NO: 380841 - RNA, 59 nt, Human
ggccaaacuuacuaccuugacuucaucucuagcugcagaaacacuaagucucaagggcu

SEQ ID NO: 380842 - RNA, 59 nt, Human
agaugagagagaaaaauuaaagcuaaaauuagcugcaaagaaguauuaauaaucaccuc

SEQ ID NO: 380843 - RNA, 59 nt, Human
aaugugacaacauuacaaauuuaauuuguuagcugcauuccuucugauguuaccacgau

SEQ ID NO: 380844 - RNA, 59 nt, Human
ugacaacauaaauuaccuaggguaaaggauagcugcaacaaugaaacaggaaagaagag

SEQ ID NO: 380845 - RNA, 59 nt, Human
cacaucauuuuuaucuggaaagacuuuucuagcugcaauuuaaggcagcaauccaagag

SEQ ID NO: 380846 - RNA, 59 nt, Human
aggcuugcuaguuccuucuuggucagagguagcugcagaggggggaggccaaggguuug

SEQ ID NO: 380847 - RNA, 59 nt, Human
uguuuuucaaagcguagugguccccauauuagcugcauugccaucuucugggagcuugc

SEQ ID NO: 380848 - RNA, 59 nt, Human
cuauauaauucagcaaguaccaacuuguguagcugcagaauaaccaaguggcuauccag

SEQ ID NO: 380849 - RNA, 59 nt, Human
cauuuauguuuccugcuguaaagccaggguagcugcaugcacuggcauuugaacagggu

SEQ ID NO: 380850 - RNA, 59 nt, Human
gucccaggagcugccuucauucaggcggguagcugcacugggcaugggguggugguggg

SEQ ID NO: 380851 - RNA, 59 nt, Human
aucugguuuuggacaaugcuucuguaguguagcugcacguccugguacuguauccucug

SEQ ID NO: 380852 - RNA, 59 nt, Human
ggauaauguggggauucacaugaauuaaauagcugcaauuggaagaagagggucagggu

SEQ ID NO: 380853 - RNA, 59 nt, Human
cagccucuccccugccccucaaccugccuuagcugcacucucuuaccuacagcuggaca

SEQ ID NO: 380854 - RNA, 59 nt, Human
uuguguuaaauguauacuuguaaauaaaauagcugcaaaccucaguccuuugugcuacu

SEQ ID NO: 380855 - RNA, 59 nt, Human
ccaggaguccuggcaucauuagucccagauagcugcauuacucacuugcugcgagacuu

SEQ ID NO: 380856 - RNA, 59 nt, Human
cguguguguuugauauuuuuuacgauaauuagcugcaugugaauuuuucaugaccuucu

SEQ ID NO: 380857 - RNA, 59 nt, Human
cguuauagacuguauacucagugcaaauauagcugcauuuauaccucagaggggccaag

SEQ ID NO: 380858 - RNA, 59 nt, Human
uccuuaagacaaaauaaggaaggaaaacguagcugcaguuguccacgauggauauuggu

SEQ ID NO: 380859 - RNA, 59 nt, Human
auggaguggcaauauagaaacacgaacuuuagcugcauccuccaagaaucuaucugcuu

SEQ ID NO: 380860 - RNA, 59 nt, Human
ugguccuuggaccccauguguccaucaccuagcugcaucacuuaucagcuauggucaac

SEQ ID NO: 380861 - RNA, 59 nt, Human
uuuaacacuauaucucagugauagggaaauagcugcauugaucuuacaugagcauaauc

SEQ ID NO: 380862 - RNA, 59 nt, Human
ggggugacaucuuaauuccuaaacuaccuuagcugcauaguggaagaggagagcaugaa

SEQ ID NO: 380863 - RNA, 59 nt, Human
ucuucccaggguagcccgccugccaguccuagcugcacagggcagcugggcccaacccu

SEQ ID NO: 380864 - RNA, 59 nt, Human
gccacagucgugcugcuagaacagucucguagcugcaguucagcugugcuuccucagcc

SEQ ID NO: 380865 - RNA, 59 nt, Human
uggugggacagcugauuucuuugauucccuagcugcaaaaccugaaauugaccacuagg

SEQ ID NO: 380866 - RNA, 59 nt, Human
gcccccaccuggagcugaaucacaugaccuagcugcaccccagcgccugggcccgcccc

SEQ ID NO: 380867 - RNA, 59 nt, Human
gggugggcacuaagcuaugggagagaccauagcugcagaaaccaacccugcccuaggca

SEQ ID NO: 380868 - RNA, 59 nt, Human
aggugcaaaaagcacugggggcuacccguuagcugcaucugcccuggcuguuugcccgu

SEQ ID NO: 380869 - RNA, 59 nt, Human
ggcaaaagcccaucuuauacacuuuuauauagcugcaaaaaauuuauaucuguacagau

SEQ ID NO: 380870 - RNA, 59 nt, Human
acucccaacucgucugccguccagaaagcuagcugcaguguucaggacguccgggagga

SEQ ID NO: 380871 - RNA, 59 nt, Human
guuuauaaacuuuacucauguauuuguaguagcugcauuugucauuaauaagagagaca

SEQ ID NO: 380872 - RNA, 59 nt, Human
gucuuagcagugguagguugggaaggagauagcugcaaccaaaaaagaaauaaauauuc

SEQ ID NO: 380873 - RNA, 59 nt, Human
caccccagcauuucauucauaccagauaauagcugcauuacugccaacugaccuuauaa

SEQ ID NO: 380874 - RNA, 51 nt, Human
cuucuaugcguauuagguaacuagcugcagugaaggcugugggaagggugu

SEQ ID NO: 380875 - RNA, 59 nt, Human
agggagaaggaagcagcuagcuaugucccuagcugcaggaagccccuauuuuuuccaag

SEQ ID NO: 380876 - RNA, 59 nt, Human
cugaccacaucuguagacaucuugaguuguagcugcagacggggaccaguggcucccau

SEQ ID NO: 380877 - RNA, 59 nt, Human
uacuuuaacagaaaacgagucggaccuucuagcugcacucuguacugugugccgagaag

SEQ ID NO: 380878 - RNA, 59 nt, Human
cgcaggaaguagguugguggggguggauguagcugcagaaagcaugcacaacuuuguga

SEQ ID NO: 380879 - RNA, 59 nt, Human
ggaggggcuccauucaggcaaagggguuuuagcugcagccuuggaaggaggcaccgaca

SEQ ID NO: 380880 - RNA, 59 nt, Human
auugauauguuuuucugauauaauuacuuuagcugcacuaacaguacaaugcuuguuaa

SEQ ID NO: 380881 - RNA, 59 nt, Human
uuaucugugauaaaucuauagaaagaauuuagcugcaaguggacaaaggaacaagcccc

SEQ ID NO: 380882 - RNA, 59 nt, Human
cauucuguauaauaugugauugcuuguccuagcugcagaaggccuuuuguuuggucaaa

SEQ ID NO: 380883 - RNA, 59 nt, Human
ugagcaaagggaacagugaggugcccagcuagcugcagagccacccuguguugacaccu

SEQ ID NO: 380884 - RNA, 59 nt, Human
ccaggggcuccccgccccaccccacgccuuagcugcaggcccuuuugggcaaaggggcc

SEQ ID NO: 380885 - RNA, 59 nt, Human
gccucaggucagggagaaugucugugacuuagcugcagacuaggagacugcccugcuaa

SEQ ID NO: 380886 - RNA, 59 nt, Human
ucccuguuguguuccugcuucuccuucaguagcugcacaacuugcgcagaucgacacac

SEQ ID NO: 380887 - RNA, 59 nt, Human
gucaguuguuuucaccuaauauccucuuuuagcugcauguauauuuauuuauaauuaua

SEQ ID NO: 380888 - RNA, 59 nt, Human
aucucccaagcuaucuaaaguuuguuagauagcugcauguggcuuuuuuaaaaaagcaa

SEQ ID NO: 380889 - RNA, 59 nt, Human
gucacuucacacagaccuuuugccuuuuuuagcugcaagucaaggacuagguugaugau

SEQ ID NO: 380890 - RNA, 59 nt, Human
acauucacccauaaccaagagaacucagguagcugcaucaccaggcuugcuuggcguag

SEQ ID NO: 380891 - RNA, 59 nt, Human
auuuuucuuacaauaauuuuuuucagcuauagcugcaguuuaaucaggauggguagaga

SEQ ID NO: 380892 - RNA, 59 nt, Human
uaggcugccguauauacuacuaugauauuuagcugcaguaucaauguggcauaaauacu

SEQ ID NO: 380893 - RNA, 59 nt, Human
auuucgugccuucauuuguguuacauacauagcugcaagcaaaccauuuuuccccuuuc

SEQ ID NO: 380894 - RNA, 59 nt, Human
gggucuagggagagacccuuguuugauuuuagcugcagaacguauugguccagcuugcu

SEQ ID NO: 380895 - RNA, 59 nt, Human
uuucucucugcuguagguguucuaaggaauagcugcauaagacauuuugaaauaaugua

SEQ ID NO: 380896 - RNA, 59 nt, Human
cucugauuguaagcugaauguuaacacacuagcugcauuguaaagaaacaaauugaaac

SEQ ID NO: 380897 - RNA, 59 nt, Human
agcacugugaaugaagguaguugucagguuagcugcagggguguggguguuuuuauuuu

SEQ ID NO: 380898 - RNA, 59 nt, Human
ccaguagguuacagcuauugauguaacuauagcugcaauuuuugugcaggacugagaaa

SEQ ID NO: 380899 - RNA, 59 nt, Human
cccaucaccgccaaagugugggggaaggauagcugcagauugacaggcgaggcucagaa

SEQ ID NO: 380900 - RNA, 59 nt, Human
caaggagucagagcagggcuggcccucaguagcugcagggagcuuugaugcaacuuauu

SEQ ID NO: 380901 - RNA, 59 nt, Human
uggguuaaaaccuagacauuugccacaucuagcugcaaagaaggcuagggaaugucuuu

SEQ ID NO: 380902 - RNA, 59 nt, Human
gcugcaguucuagugauaaauagcaucuuuagcugcacagucuacuacucaucaaccag

SEQ ID NO: 380903 - RNA, 59 nt, Human
uguauacaccuaacauagaaaauuaaagauagcugcagaccauuagaaauaauacaauu

SEQ ID NO: 380904 - RNA, 59 nt, Human
aggaagagggucauucuuaagccacacauuagcugcacugcguggcugcagccaaaaca

SEQ ID NO: 380905 - RNA, 59 nt, Human
uuacuuguaagcuuucagaucaacacaaauagcugcagccuggguuaaaauauaacauc

SEQ ID NO: 380906 - RNA, 59 nt, Human
caaguuugguugccaaauggaaggggccauagcugcagcaauugcugacauauuaaaug

SEQ ID NO: 380907 - RNA, 59 nt, Human
uccuguuaaauuuucucuaaacuguuucuuagcugcacuguuuauggaaauaccaggac

SEQ ID NO: 380908 - RNA, 59 nt, Human
ccauuuggcacuaugguuuguugccuaccuagcugcaucuauaaugucagcuuauccua

SEQ ID NO: 380909 - RNA, 59 nt, Human
agccagccccuccucccaccuauucugaguagcugcagaggccuuggguccaggcucua

SEQ ID NO: 380910 - RNA, 59 nt, Human
agguuuuauaaacaaaugcugcuauuuauuagcugcaagaaugcacuuuagaacuauuu

SEQ ID NO: 380911 - RNA, 59 nt, Human
cuaccugucagcccagccugggugcacaguagcugcaacuccccauuggugcuaccugg

SEQ ID NO: 380912 - RNA, 59 nt, Human
aaaaucuauaggccugggaauuccgauccuagcugcagaucgcaucccacaaugcgaga

SEQ ID NO: 380913 - RNA, 59 nt, Human
caaaagacugagaggcaaaacuuggcuuuuagcugcagcacauagcccuguuauauuug

SEQ ID NO: 380914 - RNA, 59 nt, Human
caggcacugagguucugguuuaaauuaaauagcugcaaaugagacaauuuauaacccau

SEQ ID NO: 380915 - RNA, 59 nt, Human
auucauucauucaccuaacuuucauuaaauagcugcaccaucccaggcccugugcggag

SEQ ID NO: 380916 - RNA, 59 nt, Human
ugcaugccuaggauguuuguuguuuuaauuagcugcaauauauacggccuguguacaca

SEQ ID NO: 380917 - RNA, 59 nt, Human
aauacaaguaacuacucugacuccuucgguagcugcaaccaggagugagcccuucucug

SEQ ID NO: 380918 - RNA, 59 nt, Human
uuggugcaaauguggugccgagcuguccauagcugcagugaaagaugaagagcaagacc

SEQ ID NO: 380919 - RNA, 59 nt, Human
caucaagucccucuuccucggaguuucucuagcugcaguggaagauucuguuuuccugu

SEQ ID NO: 380920 - RNA, 59 nt, Human
uauuccagaaucaaugcugcagaauguguuagcugcagauaggcauggucucagguaug

SEQ ID NO: 380921 - RNA, 59 nt, Human
ccaagacgugcagcagaugcaaaggguucuagcugcaguuugucgaauugagguuuuag

SEQ ID NO: 380922 - RNA, 59 nt, Human
cucacuuuauuuccauguaaucagagcauuagcugcagaaaaaccccccgacagagccc

SEQ ID NO: 380923 - RNA, 59 nt, Human
cuccuccuggccucguccccucucagcuguagcugcaccacccccgcucuggcuaccag

SEQ ID NO: 380924 - RNA, 59 nt, Human
gcucuuuccuccuuccauggaaccugacguagcugcaaaggacagauccagggacugaa

SEQ ID NO: 380925 - RNA, 59 nt, Human
gaaaugggugaagagagaaguccccucacuagcugcaugagaaaucuaucuuacugugg

SEQ ID NO: 380926 - RNA, 59 nt, Human
augaggcaugucaccacacugucgccucauagcugcaagagagaggcaccagcugaagu

SEQ ID NO: 380927 - RNA, 59 nt, Human
aaauacaguaagcucugcaaaugacaucguagcugcauauaaauaaacccagugacaau

SEQ ID NO: 380928 - RNA, 59 nt, Human
ggcuaugacuuucccucguaauacuccuuuagcugcauccuguguuucaauguauaaua

SEQ ID NO: 380929 - RNA, 59 nt, Human
guuaggaguuaggcuuuagcauaaauuucuagcugcaucugagucuccugggaugggug

SEQ ID NO: 380930 - RNA, 59 nt, Human
ugugucucccuuauucccaguuaaauaccuagcugcagauugugccaucacccuucauu

SEQ ID NO: 380931 - RNA, 59 nt, Human
cacugcugucucuccagcucuuaguccaguagcugcauggugagugagcguagggcgca

SEQ ID NO: 380932 - RNA, 59 nt, Human
ucugccuaaauugaaugucauacaucaaauagcugcauacauuccagguaugugggaac

SEQ ID NO: 380933 - RNA, 59 nt, Human
ugcgcuuugccaaagucgcuucucugccauagcugcacagaccuuaaacccugaccuuc

SEQ ID NO: 380934 - RNA, 59 nt, Human
agccaagacaccugcugcagcucuccaccuagcugcagauagcucccaaagagaaauca

SEQ ID NO: 380935 - RNA, 59 nt, Human
aagguacuuuaaguuccagaaugaacauguagcugcacuaugccagaaauuaaugaggg

SEQ ID NO: 380936 - RNA, 59 nt, Human
ucauuaauucacucacguaauuuacugaguagcugcaacaugccagccucuacguuagg

SEQ ID NO: 380937 - RNA, 59 nt, Human
guuuuuuuuccaacuugugaaaagcaguuuagcugcaucugucuccccaccacccccac

SEQ ID NO: 380938 - RNA, 59 nt, Human
agccauauauguaauuaaaauguuucuaguagcugcauuacaaaaaagaagccugggca

SEQ ID NO: 380939 - RNA, 59 nt, Human
uauggccuaaauagcuucaggauguaucuuagcugcacuccaacauugcauccuuucug

SEQ ID NO: 380940 - RNA, 59 nt, Human
ccuuguguuuguuauaccaauaaaugcuuuagcugcaacuaaaauaaaaaaguuaaagg

SEQ ID NO: 380941 - RNA, 59 nt, Human
uguauauacacuuuguguuuauuuuucaguagcugcaguauauuuuuuuucaauauuca

SEQ ID NO: 380942 - RNA, 59 nt, Human
aacgcuccuucugaagaaauggggcccuguagcugcagcacaggggaagggcccggcac

SEQ ID NO: 380943 - RNA, 59 nt, Human
cuccccugcccaccugccccucaacccuguagcugcagggggaggggacuucauucaug

SEQ ID NO: 380944 - RNA, 59 nt, Human
acauucuugauuaguuuccauauuuuaaguagcugcagucuuucauguuuuucuuuagc

SEQ ID NO: 380945 - RNA, 59 nt, Human
uucaggagccuggccaggcagggagagaguagcugcagccuucaucagaacucuuccuc

SEQ ID NO: 380946 - RNA, 59 nt, Human
cauguauguuucccggggcuaccccuucauagcugcauuuaaaaaugguguucaggcca

SEQ ID NO: 380947 - RNA, 59 nt, Human
ccacggugcuguguccaugaucugagugauagcugcacugcugccugggauugcagcug

SEQ ID NO: 380948 - RNA, 59 nt, Human
gagucccugguucauugauggaugucuucuagcugcagaugccucugcgcaccaaggaa

SEQ ID NO: 380949 - RNA, 59 nt, Human
cuuguaaggacagugccugggaacugguguagcugcaaggauugagaauggcaugcauu

SEQ ID NO: 380950 - RNA, 59 nt, Human
uacuccuauuucuaugucauaccacacaguagcugcacaguuuuaagauuaugccauca

SEQ ID NO: 380951 - RNA, 59 nt, Human
aacauagaucaauuauacuacuucuaagguagcugcagauaaguggccuugacacauua

SEQ ID NO: 380952 - RNA, 59 nt, Human
aucuuguuuuaccuuaaaagacugaaauguagcugcaguauuuuucgucaguuaaaacu

SEQ ID NO: 380953 - RNA, 59 nt, Human
cccugggggcucccagggccugggcaacuuagcugcaacuggcaaaggagaaggguagu

SEQ ID NO: 380954 - RNA, 59 nt, Human
uucucuuaagccaagaaguuugcuuucccuagcugcaguguagauggcucuuguuuuug

SEQ ID NO: 380955 - RNA, 59 nt, Human
agguguuuccaagggugucucauuaacuguagcugcaaagaugugucaaguagaagaga

SEQ ID NO: 380956 - RNA, 59 nt, Human
uuuuaaccucuguucaggaaguccuuaucuagcugcauaucuucaucauauugguauau

SEQ ID NO: 380957 - RNA, 59 nt, Human
agccaaagauguuugaagaucaugucccuuagcugcauuguggguuauucuagaaaucc

SEQ ID NO: 380958 - RNA, 63 nt, Human
ggagcugccugcagaagagccagcuggcgugucgggaaggauccaggaucugcaaacacaacu

SEQ ID NO: 380959 - RNA, 63 nt, Human
aguggggcgggaggaagaauuggcaccuuccuagggaaggagacgagcgcuucgccuugauuc

SEQ ID NO: 380960 - RNA, 54 nt, Human
ucaucuucccaucugccugagccagggaaggacccccucccccacccaccucuc

SEQ ID NO: 380961 - RNA, 63 nt, Human
cgcugugucagugaagauguacgacuaccuguugggaaggacaaagggaugaggcuccagaga

SEQ ID NO: 380962 - RNA, 63 nt, Human
aagcucuaauggaacauuuuuaguggugauuuggggaaggaaaguuaaugagguuuuuaaaau

SEQ ID NO: 380963 - RNA, 63 nt, Human
gagaagcuggagcagagagcuggcaugaguauagggaaggaggaaggacacauuuucaauccu

SEQ ID NO: 380964 - RNA, 63 nt, Human
uccaccggggacagacccaggggcgggcagagagggaaggagggaggaggcaucuucccugaa

SEQ ID NO: 380965 - RNA, 63 nt, Human
aaagugaggggcuugagaaagugggugggaggagggaaggauuuuuuaggagccuuaaucaga

SEQ ID NO: 380966 - RNA, 63 nt, Human
gaagcauugguuuuuuuuugauccucugaguaagggaaggaagauuccuguggcauguugauu

SEQ ID NO: 380967 - RNA, 63 nt, Human
gaugggcaguguuauggcuacgugauauuugaagggaaggauaaguguugcuuucaguaguua

SEQ ID NO: 380968 - RNA, 63 nt, Human
uuccaaaucauuuuuuuuuuucuuuuggggaaagggaaggaaaaauuauaaucacuaaucuug

SEQ ID NO: 380969 - RNA, 63 nt, Human
uuuucuagguaaacuucacuacugguaauuaaggggaaggauaugaggaagcaguuuaaauag

SEQ ID NO: 380970 - RNA, 63 nt, Human
cagcucaaucugcccuggccauagggcuucccagggaaggaagaagagggaagaauccgacca

SEQ ID NO: 380971 - RNA, 63 nt, Human
ggaccaugguguccuggcugguuccuuagcccugggaaggaguugucaggggauauaagaaac

SEQ ID NO: 380972 - RNA, 63 nt, Human
augacacaucaagcugcuaacaauugggggaaggggaaggaagaaaacucugaaaacaaaauc

SEQ ID NO: 380973 - RNA, 63 nt, Human
uccuucuaagucaugucugcugccugugagccugggaaggagugcuuucaaaaccuguauuuu

SEQ ID NO: 380974 - RNA, 63 nt, Human
gucagauggugguggugagaggccuuggggcuggggaaggagaguggacuuuggcucacucug

SEQ ID NO: 380975 - RNA, 63 nt, Human
auagauggauggauggauggacggauggggugggggaaggaaggaaaggagggagaaaggagg

SEQ ID NO: 380976 - RNA, 63 nt, Human
auugccuucacaccacuggguuugccagaaacagggaaggagggcguuaagggaaaaaaaaaa

SEQ ID NO: 380977 - RNA, 63 nt, Human
aguaacaacgcacccagcugcagcaaggagguggggaaggagggcaccccaaaggacagcgcc

SEQ ID NO: 380978 - RNA, 63 nt, Human
cuuguugcucgggugcauuugaggauggauuuggggaaggaucaagugaaccaucccuagucu

SEQ ID NO: 380979 - RNA, 63 nt, Human
ccgccuccacccagggggcguggugggggcggagggaaggagggcggcggggcacagagacag

SEQ ID NO: 380980 - RNA, 63 nt, Human
acucccgcacaugaccucccacccuaggagggagggaaggacaccguccuaggguauaaccug

SEQ ID NO: 380981 - RNA, 63 nt, Human
cccccaccccuguacccagccaccuuccugacugggaaggacauaaaagguuuaaugucaggg

SEQ ID NO: 380982 - RNA, 63 nt, Human
ccuauuaguaucgccugguugggccugggcaaugggaaggagccagaaaugccaucuucaccc

SEQ ID NO: 380983 - RNA, 63 nt, Human
cuugcuuggugggaccugacgaguugguggcaugggaaggaugugggucucuagugccuugcc

SEQ ID NO: 380984 - RNA, 63 nt, Human
aucuccuuuuagaccugggacggcaaaagggaagggaaggaaacuuagcagagugcuauugac

SEQ ID NO: 380985 - RNA, 63 nt, Human
agaaauggaggacauuucauucuuuuuccugaggggaaggacugugaccugccauaaagacug

SEQ ID NO: 380986 - RNA, 63 nt, Human
cuaauugauuauccuggaacauuuugaauauuggggaaggaagaugauacuucuuucucaaga

SEQ ID NO: 380987 - RNA, 63 nt, Human
aggcacccagguuguccaugcuugggauucugggggaaggagagaagggcagcucagggugga

SEQ ID NO: 380988 - RNA, 63 nt, Human
agguguccgggggucuaggacuuuagggaucuggggaaggaccaacccaugcccugccaagcc

SEQ ID NO: 380989 - RNA, 63 nt, Human
agacaucgcccuggcccugcuggcccggguaucgggaaggaggagcgagggaaugacggaggu

SEQ ID NO: 380990 - RNA, 63 nt, Human
ggaggaggguucacaguguuuuugugggggcgggggaaggaagaggcagccccgcccccgcca

SEQ ID NO: 380991 - RNA, 63 nt, Human
ugacgccuauaccugagcucuaggcugccuggagggaaggaacaggcccaugggaagaagggg

SEQ ID NO: 380992 - RNA, 63 nt, Human
gcgguuuacugugggagacagcccaccuugaaggggaaggagauggggaaggccccuugcagc

SEQ ID NO: 380993 - RNA, 63 nt, Human
cugcuguucuccccagaagcagccauaaaaccugggaaggauuuucugaccuuccccugaagu

SEQ ID NO: 380994 - RNA, 63 nt, Human
uuggauggauggauggagggauggaaggagggagggaaggaugucugggaugugaagaggcaa

SEQ ID NO: 380995 - RNA, 63 nt, Human
ccugucauaaguaccucccuauuguagauagaagggaaggaaacuguugacuugagcuuggcu

SEQ ID NO: 380996 - RNA, 63 nt, Human
gucacuuaauccagaguacaggggcuggggucagggaaggaagaucuaaagaacccacugugg

SEQ ID NO: 380997 - RNA, 63 nt, Human
cagcugccacguggaggaagcucaauaucagcugggaaggaacugugccucugucugacuggc

SEQ ID NO: 380998 - RNA, 63 nt, Human
aaguguaaggagcaaguggaauugaguccuucagggaaggaaccacagagucccuucccaagg

SEQ ID NO: 380999 - RNA, 63 nt, Human
gacaucccaggagcagggucuggugggaggaaagggaaggaggaggcuaaggcugcccaggag

SEQ ID NO: 381000 - RNA, 63 nt, Human
ggucguugggugaccugcgauugucagaaagaggggaaggaagccagguugauacagcugccc

SEQ ID NO: 381001 - RNA, 63 nt, Human
gggaccacugggccccucaggggaagcugcuaggggaaggacuggccguggcuccagaaugug

SEQ ID NO: 381002 - RNA, 63 nt, Human
cugauucaguguuuuaugucuuucacuuucccugggaaggaguaaaguucuuuucuacagcuc

SEQ ID NO: 381003 - RNA, 63 nt, Human
caggcccagacagagccuggcaggcauccuggcgggaaggaccagguccccucuggguggaca

SEQ ID NO: 381004 - RNA, 63 nt, Human
gggggagcaucugcuguuugaggacgggggguggggaaggaaggaacaugaucccuccagaag

SEQ ID NO: 381005 - RNA, 63 nt, Human
ggaagagauagugucgugagcuggaggaacauugggaaggaagcccgcggggagagaggagga

SEQ ID NO: 381006 - RNA, 63 nt, Human
cucccauggaauagguaggcaagccaggacuccgggaaggaggugcagccaggaugcucuggu

SEQ ID NO: 381007 - RNA, 63 nt, Human
ugcguccugacggcgcccccagugugcacgagugggaaggacuuggcgcgcccucccuuggcg

SEQ ID NO: 381008 - RNA, 63 nt, Human
auauuuuaaagauuucugagcuagcaggcaugugggaaggaaggcucugucuucaacucuuug

SEQ ID NO: 381009 - RNA, 63 nt, Human
uccuccucaaaaacugauucagaaacugacuuggggaaggaauuuaauacuuugaagucauga

SEQ ID NO: 381010 - RNA, 63 nt, Human
ccuagacacuccccgcgucucccccaugcacaggggaaggauguugacauagcacugggcugu

SEQ ID NO: 381011 - RNA, 63 nt, Human
ggaauuuuucuaauggacaaaucaccaaacacugggaaggaggagagaggagggaucucuccc

SEQ ID NO: 381012 - RNA, 63 nt, Human
gaagugcugauuccacagcaugcagccugguaggggaaggaaaauaaaagggugugaagaagg

SEQ ID NO: 381013 - RNA, 63 nt, Human
ccacuggaggagucagacuaccaugacaucguagggaaggaggggagauuuuuuuguaguuuu

SEQ ID NO: 381014 - RNA, 63 nt, Human
cauuucacuggaauggguucuuggaucucugaggggaaggaacagcaaaagaggcccuucuuc

SEQ ID NO: 381015 - RNA, 63 nt, Human
uaccaguccauaaauuaaggcccgcucucuggagggaaggacauuacugaaccugucuugcug

SEQ ID NO: 381016 - RNA, 63 nt, Human
ccagccucuugcaguauucccauacuugaugcagggaaggaaccagaagcagaggggccucua

SEQ ID NO: 381017 - RNA, 63 nt, Human
ugcccggcacuggggacuuaggggugcggggaggggaaggacgccuccaagcccgcucccugc

SEQ ID NO: 381018 - RNA, 63 nt, Human
cagagaauccuuccucagcucucuucuuuccaggggaaggaggugcucagggguggguaucca

SEQ ID NO: 381019 - RNA, 63 nt, Human
uggcucaggggagcaagcuuacacaagaagugagggaaggauguuuagcaguggcuggugccc

SEQ ID NO: 381020 - RNA, 63 nt, Human
gagcaugucacuguguacagcuggccacacacagggaaggagcagcaucugguaugcagccac

SEQ ID NO: 381021 - RNA, 63 nt, Human
cugcacauggcccuccuccccacccucaugacugggaaggaagccugugaugaggcugagaua

SEQ ID NO: 381022 - RNA, 63 nt, Human
auaugugauucauagcaauuuugaugugaagaagggaaggacaucauugacuuaauaauagua

SEQ ID NO: 381023 - RNA, 63 nt, Human
ggagcgcaaggauugagaggcccuguggacaaggggaaggagagcuugggggugggagaggga

SEQ ID NO: 381024 - RNA, 63 nt, Human
gagugaucuggggguaccccuuggguugguguggggaaggagugccuccuuaguggugcuugc

SEQ ID NO: 381025 - RNA, 63 nt, Human
gccuuauauguguguuuaccccuuccuggccuggggaaggaggcggggagggcuccuuucuac

SEQ ID NO: 381026 - RNA, 63 nt, Human
uucguuagaaugucugccuuacugguuuccccagggaaggaaaaauacacuuccacccuuuuu

SEQ ID NO: 381027 - RNA, 63 nt, Human
gagagugggcgugggcuucuucacauaagccuggggaaggaagaaaaaacggcuuucauuacc

SEQ ID NO: 381028 - RNA, 58 nt, Human
gacccugcaauccucucuagcccaugucgggaaggaugugugcucugacagacguguc

SEQ ID NO: 381029 - RNA, 63 nt, Human
ggggggauggcaugguguuuguggacugguucagggaaggaggggaaaagggaggugcagaga

SEQ ID NO: 381030 - RNA, 63 nt, Human
ccuucugucccccggggccguggagcugucggagggaaggaggacggugcggggccgcagggg

SEQ ID NO: 381031 - RNA, 63 nt, Human
cacuguuagcauuuaacuucuuguuaggauucagggaaggaacaguuggccaagaauuuuuuu

SEQ ID NO: 381032 - RNA, 63 nt, Human
ugguuuggacaaaaacccucaguagagacaagcgggaaggauaauuagcugaaagcuaugaug

SEQ ID NO: 381033 - RNA, 63 nt, Human
ucaaaaaacccuugcuuuuaggggagggaagcggggaaggaaaggaaugagggaggaaauauu

SEQ ID NO: 381034 - RNA, 63 nt, Human
aggcccacgggugcaccagggcugaggucugaugggaaggacuugacuccaggugcagagaug

SEQ ID NO: 381035 - RNA, 63 nt, Human
ccauauuugaauuggccugaacagauguaaaucgggaaggaugggaaaaacugcagucaucaa

SEQ ID NO: 381036 - RNA, 63 nt, Human
gagaccaggggaccagagggaugggagagucaagggaaggacaaucccaggaaguccuaagaa

SEQ ID NO: 381037 - RNA, 63 nt, Human
augagaucaauacuacugauccaucuguagccugggaaggagacaggacauuccuguacuaag

SEQ ID NO: 381038 - RNA, 63 nt, Human
uagaaauagaaggcccagugguggaauauuagagggaaggaaacugacaacgugugaaaguua

SEQ ID NO: 381039 - RNA, 63 nt, Human
gcaugccccaugaugaguuucuggccuaauugagggaaggaggaaauucauaccagcaguuuu

SEQ ID NO: 381040 - RNA, 63 nt, Human
ucaagcucccugccaaccucuggauacaucaaugggaaggaaaccagggaagcauagaccuau

SEQ ID NO: 381041 - RNA, 63 nt, Human
uuuguguucaaaagaaaauuccaacugcuguuggggaaggacacagaaaagaaaaauaaccac

SEQ ID NO: 381042 - RNA, 63 nt, Human
acauuugauaaguauaugccaaaaaaugaagccgggaaggaggacaaggcccaugggugggug

SEQ ID NO: 381043 - RNA, 63 nt, Human
uuacaaaucacaguauaagauuuaagugccugggggaaggauacaauuuuuagaaauuacaua

SEQ ID NO: 381044 - RNA, 63 nt, Human
ugaggaaaaggugguaaauaggaaaccaugaaugggaaggauggcaauaaguagcaacuauac

SEQ ID NO: 381045 - RNA, 63 nt, Human
ucagcgaguuauuguaacuggucaccacuggacgggaaggagaacagaggagagggaaagaga

SEQ ID NO: 381046 - RNA, 63 nt, Human
uauaaauauguacauguguauauagauuuuuaggggaaggagagagggaagggucaggguaga

SEQ ID NO: 381047 - RNA, 63 nt, Human
uccauccccaacuuccucaaagcccaaagccaagggaaggauaaaucaaggcucaaggcuucc

SEQ ID NO: 381048 - RNA, 63 nt, Human
ucuguuugucugucugugugucugugacagucagggaaggaugccucggagcugagguggggu

SEQ ID NO: 381049 - RNA, 63 nt, Human
ggagaccaggccaugggcccucacggagaggaagggaaggaaggagagggagggggaggauag

SEQ ID NO: 381050 - RNA, 63 nt, Human
cucaucagccagggaagaguaagugggaucacagggaaggauguuggcagcgacaccauccca

SEQ ID NO: 381051 - RNA, 63 nt, Human
guuugggaaacaagacuuuuccugcaauagccugggaaggaauaaaaggauagaguguuuggg

SEQ ID NO: 381052 - RNA, 63 nt, Human
acugggaguagaggggcagguagaguuccuggagggaaggaugaaggagccuuggcuacugua

SEQ ID NO: 381053 - RNA, 63 nt, Human
ggauggccucugcuaagcucaaggcgugaggaugggaaggagggagguauucguaaggauggg

SEQ ID NO: 381054 - RNA, 63 nt, Human
cucuccagcagaaugucugcuugugucuagauggggaaggagcagguucaucggguacuggga

SEQ ID NO: 381055 - RNA, 63 nt, Human
cucaucaaccagggaagaggaacugagaucacagggaaggagauuggaggugauaccagcaca

SEQ ID NO: 381056 - RNA, 63 nt, Human
agccugggcccacagcugcaccggcagcccaaggggaaggaccgguugggggagccgggcaug

SEQ ID NO: 381057 - RNA, 63 nt, Human
aguccucccuaggagaggggcucgaugggcugggggaaggagccugaagguugccccugguug

SEQ ID NO: 381058 - RNA, 63 nt, Human
uggguccucuguggcugugcgauugaccucgaugggaaggagcguucuacccauuuuccuugu

SEQ ID NO: 381059 - RNA, 63 nt, Human
uucaucuguuccuaagucagcauguuaguucuggggaaggaucauaagaaaggaaauacuuuu

SEQ ID NO: 381060 - RNA, 63 nt, Human
accgguucugugccugugcucuguuguguuggagggaaggacuggcgguucugguuuuuacuc

SEQ ID NO: 381061 - RNA, 63 nt, Human
caugcuccuuagaaggauguggaguagagggaagggaaggauuggugauagcagagcuccagg

SEQ ID NO: 381062 - RNA, 63 nt, Human
cuugagaaccuugggucuggagagccaugaagagggaaggaaaagagggcaaguccugaaccu

SEQ ID NO: 381063 - RNA, 63 nt, Human
guugugcuuccuauaaacagcuccgcucuuucagggaaggaugguaacaaacuagaaggacaa

SEQ ID NO: 381064 - RNA, 63 nt, Human
agugcacuggcccugacuccaggcgugaguauggggaaggauacggguucuucugacggggag

SEQ ID NO: 381065 - RNA, 63 nt, Human
auggaaagaaugggguaaaccacagucuacauagggaaggacucuuuccuuagccuucucuua

SEQ ID NO: 381066 - RNA, 63 nt, Human
cucacaacaggcuggaugggugggugguaaaaagggaaggaugaggcucccccaaugucacau

SEQ ID NO: 381067 - RNA, 63 nt, Human
aaccaugauccuccuaaaagcauuucuacugcggggaaggagagguaaauguuugaagcccua

SEQ ID NO: 381068 - RNA, 63 nt, Human
ccuugaagcauggucagcagcagagagagcaacgggaaggacaaagaaagagguggggcaggg

SEQ ID NO: 381069 - RNA, 63 nt, Human
gaagggaagagaggaagaacgagaggaagagaagggaaggaaguguuuguguagaagagagag

SEQ ID NO: 381070 - RNA, 63 nt, Human
ggcccugggggcugggcuguagaagaguuguuggggaaggagggagcugaggagggggcaucu

SEQ ID NO: 381071 - RNA, 63 nt, Human
gauucaccauugcccgccugaagaagcccucaggggaaggaacuuagcagugugcaggugagc

SEQ ID NO: 381072 - RNA, 63 nt, Human
uuucuuuacuucuuuugaaaaucuguuugcaaggggaaggaccauuucguaauggucugacac

SEQ ID NO: 381073 - RNA, 63 nt, Human
gcaggaaagauggaguuaccaguuacugaaauagggaaggaugggcuggguaaguauggaauu

SEQ ID NO: 381074 - RNA, 63 nt, Human
uacaguagcacaaguccuuguucucugaagagugggaaggagaggagugagugaaguagccug

SEQ ID NO: 381075 - RNA, 63 nt, Human
gccuaaccuauguguggcucagggaccagcuuggggaaggaaaggagguuuguucugcucccc

SEQ ID NO: 381076 - RNA, 63 nt, Human
gaggaugggaaggagggagguauucguaaggaugggaaggagggagguauucgugcagcauau

SEQ ID NO: 381077 - RNA, 63 nt, Human
ccauugcaacucacaguaagagacuggguuucggggaaggaggggcuagggacauuuuggcac

SEQ ID NO: 381078 - RNA, 63 nt, Human
ggaagaaagagacuauggucuucuauuuauugugggaaggaaaacaggguggggcgggugagu

SEQ ID NO: 381079 - RNA, 63 nt, Human
gccauuggacagcuuucacaaguaacaggauuagggaaggacauaauguauuuaagaauaagu

SEQ ID NO: 381080 - RNA, 63 nt, Human
auccuccauaucaaagacccuaagaaucagguggggaaggaggugaucugccaggugcugcac

SEQ ID NO: 381081 - RNA, 63 nt, Human
gggcuugcucucauuuggccuguucucaggggugggaaggaagagcgucccuuccuucuccuu

SEQ ID NO: 381082 - RNA, 63 nt, Human
gcaacacauuuauuaagugauccaacaugggaugggaaggaaugggcaaagagauuaaaauga

SEQ ID NO: 381083 - RNA, 63 nt, Human
aacugagaugaggaccuugguacuagggagggagggaaggacgugggaauguuuucuuauugg

SEQ ID NO: 381084 - RNA, 63 nt, Human
uagcuguugaaauguuuuggccuuuuggagugggggaaggacaaaucugauccuguaaucuuu

SEQ ID NO: 381085 - RNA, 63 nt, Human
caacggcaauggcaugagaacucuuguuucuuggggaaggagaggagggaaaaggaccagggu

SEQ ID NO: 381086 - RNA, 63 nt, Human
agugggcugcaguugcccaaccacaggaagaaagggaaggagguagagggaagaaacagaagc

SEQ ID NO: 381087 - RNA, 63 nt, Human
acagcgaagcuguaacugaggacccugcugcucgggaaggaggugguuuccagugugacucgg

SEQ ID NO: 381088 - RNA, 63 nt, Human
gaugacuguucacugccacuguccuguggcucggggaaggagagucgaugcuguucccgcugc

SEQ ID NO: 381089 - RNA, 63 nt, Human
agcuccuccccuuccucuugucugauuucuuaggggaaggagaaguaagaggcuaccucuuac

SEQ ID NO: 381090 - RNA, 63 nt, Human
caaaggagcaaauguagaugccaaagauaaguggggaaggacagcguugcauagagggguaag

SEQ ID NO: 381091 - RNA, 63 nt, Human
uuaauuuccagaacugcacaaugaccagcaggagggaaggacagacaucaagugccagauguu

SEQ ID NO: 381092 - RNA, 63 nt, Human
cagccuuuauuccaggcccagggauguaggagggggaaggaggaaacaggaagcccagagagg

SEQ ID NO: 381093 - RNA, 63 nt, Human
ccccugggauggagugcagggagccagcuggaagggaaggagaggggccagggaggccacagg

SEQ ID NO: 381094 - RNA, 63 nt, Human
uuuuuaauuuauuuaaaauuggggggagggcaugggaaggauuuaacaccgauauauuguuac

SEQ ID NO: 381095 - RNA, 63 nt, Human
ugugugaugcugacaccagcggccuggagucgugggaaggaggggagccuuaccaagacuccu

SEQ ID NO: 381096 - RNA, 63 nt, Human
gaaaugcugcuggccaaauagcaaagacaaccugggaaggaaaggucuuugugggauaaucca

SEQ ID NO: 381097 - RNA, 63 nt, Human
aggaguccccuccauguacacacacacaacucagggaaggagguccugggacuccaaguucag

SEQ ID NO: 381098 - RNA, 63 nt, Human
uauuuuaaugaggaaaaaauaauggagaacccugggaaggaccugguucuuuugcuucucggg

SEQ ID NO: 381099 - RNA, 63 nt, Human
gucccugggaggccccuucucucccugccagaggggaaggaggguacagcugggcuggggagg

SEQ ID NO: 381100 - RNA, 63 nt, Human
ugcagguaucagcuugcucucuuugcacuuucggggaaggaggacucacagugaggaagcaaa

SEQ ID NO: 381101 - RNA, 63 nt, Human
cacuuaccauggcuagagaugggggugagacuggggaaggacaaaagcagggaacagauaagu

SEQ ID NO: 381102 - RNA, 63 nt, Human
cacauuuguucacaggaguuuuuggugcggggugggaaggauggaaggccuuggauuuauauu

SEQ ID NO: 381103 - RNA, 63 nt, Human
gcuucauuaagggcuuggggcagagacagcauggggaaggagguccccuuccccaagaguccu

SEQ ID NO: 381104 - RNA, 63 nt, Human
cuggcacccugggcugcuggccuggaggaguucgggaaggaggauagaccaggaaauaaaggg

SEQ ID NO: 381105 - RNA, 63 nt, Human
cuuucauagauaacauuucuugaaggcugggaggggaaggagggccuggcagauggcagccuc

SEQ ID NO: 381106 - RNA, 63 nt, Human
uuuguuuuucaaaccuccugcuucucccaccuugggaaggagaaaugugaaacccggcagcgg

SEQ ID NO: 381107 - RNA, 63 nt, Human
ucacauggggacaggggauggagcaugaggcaagggaaggaaaagcagagcuuauuuuucacc

SEQ ID NO: 381108 - RNA, 63 nt, Human
ugcccaucgcggcugcgggucaagcaucuucaagggaaggacggacuggaggccucaccgugg

SEQ ID NO: 381109 - RNA, 63 nt, Human
caucaaacaaccuugugauuauaaaacgauccugggaaggagccccuaacuagggcaagucag

SEQ ID NO: 381110 - RNA, 63 nt, Human
uuuucaaauuggugucauaauauuguguaaaaagggaaggaaaaaaaaaaccacccccagcuu

SEQ ID NO: 381111 - RNA, 63 nt, Human
uuuccugccuauggugagaucagauguggccaagggaaggagcucugguuccagagaauuugc

SEQ ID NO: 381112 - RNA, 63 nt, Human
aaucugcguuguugggaagccagcaguggccuugggaaggaagccauggcugugguucagaga

SEQ ID NO: 381113 - RNA, 63 nt, Human
gagggacuuuguauagaagguuugggggcuguggggaaggagaguccccugaaggucugacac

SEQ ID NO: 381114 - RNA, 63 nt, Human
cucuuuuguguuuucugcugguauucuggaggugggaaggacuuggagagaguuaagaaacac

SEQ ID NO: 381115 - RNA, 63 nt, Human
agugagcuuugccuugguggcuggggcuugauugggaaggaggggauuaccagcuuacugggu

SEQ ID NO: 381116 - RNA, 63 nt, Human
cgaggacacucgcuugccgggccugggccuccugggaaggagggagcugcucagaaugccgca

SEQ ID NO: 381117 - RNA, 63 nt, Human
ccccacccagaccugaaugcuucugagagcaaagggaaggacugacgagagauguauauuuaa

SEQ ID NO: 381118 - RNA, 63 nt, Human
acugugaacauaccgggcgagaucauucuucaggggaaggagcugcccagagcaucacaggau

SEQ ID NO: 381119 - RNA, 63 nt, Human
uagcuuguaacaggagccuugggcuaggggcuggggaaggaaagccgagcuggcauucguucu

SEQ ID NO: 381120 - RNA, 63 nt, Human
aagaacauguugggcauguggacccaagcaccugggaaggagguggcaucugagacagccuga

SEQ ID NO: 381121 - RNA, 63 nt, Human
aagaguacagagguggcagaaugaagcuagagugggaaggacuaaagacugagccccagagug

SEQ ID NO: 381122 - RNA, 63 nt, Human
aacccaccuugaagguauaacuggauccagagagggaaggacugacaagaaggaauuauucag

SEQ ID NO: 381123 - RNA, 63 nt, Human
gugccuccuuuauaaacaguaauagcuacguuugggaaggaggaaacauuuaaauuauaaagg

SEQ ID NO: 381124 - RNA, 63 nt, Human
auagagcacaguggaacgcaggcugagaacgcagggaaggagaaauaaagaguaaagccagag

SEQ ID NO: 381125 - RNA, 63 nt, Human
uccauaggccacacuuuaauaucacauuauaaagggaaggacagucuucauuccuccugguua

SEQ ID NO: 381126 - RNA, 63 nt, Human
uaacauagaccccaaaauuagauauaaagaauugggaaggauaccuggagcacaaggaauaag

SEQ ID NO: 381127 - RNA, 63 nt, Human
ccaggcaauguaaguguucgagguguugaagaugggaaggauuugcagggcugagucuaucca

SEQ ID NO: 381128 - RNA, 63 nt, Human
ucuguacagaucaaagaagacagaacaugucaggggaaggagggaaagaucuugaugcagggu

SEQ ID NO: 381129 - RNA, 63 nt, Human
caaugauuuuuaagcuaugaaaaauacaauggggggaaggauagcauuuggagauauaccuaa

SEQ ID NO: 381130 - RNA, 63 nt, Human
ggagggagggaguccuguguguuuguggggagagggaaggaggaagucaguuauuugaguaag

SEQ ID NO: 381131 - RNA, 63 nt, Human
accaaggaagugaugaauaaauacaagguacacgggaaggaaauacuaagaacccugcaagau

SEQ ID NO: 381132 - RNA, 63 nt, Human
gccugccuuucccaucugucugucuggcuggcagggaaggaaagaacuugcauguuggugaag

SEQ ID NO: 381133 - RNA, 63 nt, Human
cacucucauuuguuaaugcuuucccacucucaggggaaggauuugcauuuugagcuuuaucuc

SEQ ID NO: 381134 - RNA, 63 nt, Human
ggcuggagcuugugauuuuaggaucuccauggugggaaggaaggcaggcccuuccuauccaca

SEQ ID NO: 381135 - RNA, 63 nt, Human
uucauguuguuaauuuugaauacagcaaguguagggaaggaagcguucguguuugacuugucc

SEQ ID NO: 381136 - RNA, 63 nt, Human
ccuuuuuaaaaaauucauuacagcaaacagcuggggaaggacaugcaguccucccccagcucu

SEQ ID NO: 381137 - RNA, 63 nt, Human
aaucuauaagguuauuuucaugauuuugcaaaugggaaggauuucuuuaaagcaagacacaaa

SEQ ID NO: 381138 - RNA, 63 nt, Human
uucuuucugaugucaaaaaugucuuggguaggcgggaaggaggguuagggagggguaaaauuc

SEQ ID NO: 381139 - RNA, 63 nt, Human
accacaucugccuccacacacagcuccuccgcagggaaggagaagcugcucuguaacucauuc

SEQ ID NO: 381140 - RNA, 63 nt, Human
ugaguaucccugccaccaagagagcaaugggcagggaaggaaggggucugccgaccccagcuc

SEQ ID NO: 381141 - RNA, 63 nt, Human
guacuuguggaaagguguguuugcguagccuuagggaaggaaggcaauugcuccuuaacagca

SEQ ID NO: 381142 - RNA, 63 nt, Human
guucccuggggacuccucuuaauguuuccaaaugggaaggacaguugauuuccaacaugaggu

SEQ ID NO: 381143 - RNA, 63 nt, Human
uuuggcuuaacuuccagaugcucagucggcuuggggaaggacugaagggcagcugccaagacc

SEQ ID NO: 381144 - RNA, 63 nt, Human
gcaggagcuccacuucucucugccucuggcuaugggaaggagcaggcgguuggaaauccugug

SEQ ID NO: 381145 - RNA, 63 nt, Human
guagguccugggacuugacaaaguaugugggaggggaaggaaggacagaacuugacuggcucc

SEQ ID NO: 381146 - RNA, 63 nt, Human
gcgaaugacacaacucaaguugggaggggaacagggaaggaagggauggauggggguggugua

SEQ ID NO: 381147 - RNA, 63 nt, Human
cucccugguuugcauuuaccucauauaaagaaugggaaggagaccauuggguaacccucaagu

SEQ ID NO: 381148 - RNA, 63 nt, Human
cauguugacgagacagcagcagggggagagggagggaaggaaggugcggcugcaagaaggaag

SEQ ID NO: 381149 - RNA, 63 nt, Human
aacugugccagugcccauguuuacagaagucaggggaaggaaggagccugugucccugggacg

SEQ ID NO: 381150 - RNA, 63 nt, Human
gaggcuggagaccugggcuggggccuuccuccagggaaggaggcuggggugggaacacuggcc

SEQ ID NO: 381151 - RNA, 63 nt, Human
aacacuccacaguguuuauauugggaagauauugggaaggaaauauauuuguaaaagaugaag

SEQ ID NO: 381152 - RNA, 63 nt, Human
aauuccuaagggaaccuuagcauaaagguuuuggggaaggaggccguaggccggcccggagga

SEQ ID NO: 381153 - RNA, 63 nt, Human
uuuuuggcacaaguucuaucacuccuuuaccuagggaaggaaaaaaaaaauauauauauauau

SEQ ID NO: 381154 - RNA, 63 nt, Human
gcucacacgugccauccccaccccggugcuccagggaaggaggacacggacccgacgugggag

SEQ ID NO: 381155 - RNA, 63 nt, Human
augguacgaauggcagcauacacagaugaaggugggaaggaugguccagaauucacuuuuacu

SEQ ID NO: 381156 - RNA, 63 nt, Human
uggggagggguggauuuuuaaaaugucaagacagggaaggaugacaaaauggaaauuuaaaug

SEQ ID NO: 381157 - RNA, 63 nt, Human
augcuauuguuguuccuaaagcuaagcuuugcugggaaggaaaugaccuauaguuucuuaaag

SEQ ID NO: 381158 - RNA, 63 nt, Human
gggaaggcggggcaggcagccuguugcaggcaggggaaggagaagagacugaggggcugugac

SEQ ID NO: 381159 - RNA, 63 nt, Human
caguuuguucuguauaggaacagaggugccuccgggaaggaggcagcgagguagguagcuaug

SEQ ID NO: 381160 - RNA, 63 nt, Human
ccaggcuucccucacgcagccugugguggaugugggaaggagaucaacuucuccucacucugg

SEQ ID NO: 381161 - RNA, 63 nt, Human
uugaggugucaaauacaaauaaaucugggcuuagggaaggagagaccuuauuccaaagcacga

SEQ ID NO: 381162 - RNA, 63 nt, Human
gggucugcgguggcuccugucuucccugcagcagggaaggagggccguguggugcuuugcuag

SEQ ID NO: 381163 - RNA, 63 nt, Human
acgugagugacacgcagccugcagacucacugugggaaggagacaaaacuagagacucaaaga

SEQ ID NO: 381164 - RNA, 63 nt, Human
ugcacacugguucaucaaaagaagguuaccgaggggaaggaacuaaagguguuugcacuucau

SEQ ID NO: 381165 - RNA, 63 nt, Human
gcccugauugcgcaaaacugaaaggcaugugaagggaaggaagaggaagagugcaaaacauug

SEQ ID NO: 381166 - RNA, 63 nt, Human
ucacucaguaacguuguuuaauucucugcccuggggaaggaggauggauugagagaaugucuu

SEQ ID NO: 381167 - RNA, 63 nt, Human
guauaauaauaaaaacaauacagcauauggcuagggaaggacaugguguauauaauuguaaaa

SEQ ID NO: 381168 - RNA, 63 nt, Human
gugggguucuuugagugggggaggcagggacgagggaaggaaaguaacuccugacucuccaau

SEQ ID NO: 381169 - RNA, 63 nt, Human
ccccuccucugccugcugcguggaggcagccaugggaaggagcccaggggagcuggccugggg

SEQ ID NO: 381170 - RNA, 63 nt, Human
caauccaggugggagagacacucccagggacaagggaaggaagggacacacacacacacacac

SEQ ID NO: 381171 - RNA, 63 nt, Human
gaauuucuccuuuccuacaguuggguaggguaggggaaggaggauaagcuuuuguuuuuuaaa

SEQ ID NO: 381172 - RNA, 63 nt, Human
uuuucacuuucuuuaggaaagagaagcuuucaggggaaggagagaaugauuuugcugacuucc

SEQ ID NO: 381173 - RNA, 63 nt, Human
uuauuuuuaccacaauaguuugaagcaguaagggggaaggagggugauuauauugcuuuguaa

SEQ ID NO: 381174 - RNA, 63 nt, Human
uuaggcugugacucucucucuaaugcugcucucgggaaggacgaaagugaccugcaaggagag

SEQ ID NO: 381175 - RNA, 63 nt, Human
ugccccccucccuuccgcuccugcccagccugggggaaggagaaaggaggggagaaagcgggc

SEQ ID NO: 381176 - RNA, 63 nt, Human
cucuguccgagugugccacacgagaaccugaaggggaaggaaauagcuuggguagcgcacucu

SEQ ID NO: 381177 - RNA, 63 nt, Human
augaccugccgcccugaccaggauagggcgggugggaaggagaggggugcaacaggaccgccu

SEQ ID NO: 381178 - RNA, 63 nt, Human
auuuaauguaauuugaauuuaauuucuguaauugggaaggaggguaauaaugaacaaaaaguu

SEQ ID NO: 381179 - RNA, 63 nt, Human
accauacuacacaaugaucucugauuuugcugagggaaggaauuauauaugugccacuuuuuc

SEQ ID NO: 381180 - RNA, 63 nt, Human
gugcauuuugggaguuggggugggaagggguaugggaaggauagacucauaauuaaaaugucu

SEQ ID NO: 381181 - RNA, 63 nt, Human
cucugaguguccuaccuccuuggagaugagauagggaaggagcagggaugagacuggcaaugg

SEQ ID NO: 381182 - RNA, 63 nt, Human
guagcagcuguugaguaacuuucauuggagguugggaaggaagugaggagaaaguguucuugu

SEQ ID NO: 381183 - RNA, 63 nt, Human
cgccaccgcccaucccagaccauggagcgcgcugggaaggacgcaccaaagccgggagcucug

SEQ ID NO: 381184 - RNA, 63 nt, Human
gcuacugcugcugcugccuuaaguaggaagagagggaaggacaccaagcaaaaaauguuccag

SEQ ID NO: 381185 - RNA, 63 nt, Human
ggaaauugauuaucuacacucaguuucauuacagggaaggaacccaugaaaacaucaguguua

SEQ ID NO: 381186 - RNA, 63 nt, Human
caguagccaggccaguaggcaguuggggaaggugggaaggauccagcgaggccccugagccug

SEQ ID NO: 381187 - RNA, 63 nt, Human
uccugccuucuuugugggggaggggggagagaggggaaggaaauggaacaaguuguguuugug

SEQ ID NO: 381188 - RNA, 63 nt, Human
gaucuuccccauucuggccagagcagggcuggagggaaggagccaggagggagagagccuccc

SEQ ID NO: 381189 - RNA, 63 nt, Human
gguggugucccuuucacacuguggugucucuuggggaaggaucuccccgaaucucaauaaacc

SEQ ID NO: 381190 - RNA, 63 nt, Human
aggugggacucccuggagcuaucuguggucuuagggaaggauccagacauacacggcuuuggg

SEQ ID NO: 381191 - RNA, 63 nt, Human
ccgaggcacagcccagcuggggcuaggcccggugggaaggagagcgucguuaauuuauuucuu

SEQ ID NO: 381192 - RNA, 63 nt, Human
cccaggaggcugagccugauuguccugagaaaugggaaggaucagauaugacuccuccuuggc

SEQ ID NO: 381193 - RNA, 63 nt, Human
uggccagggguaggauaguauaggaaguagaaggggaaggaggguuagauagagaaugcugaa

SEQ ID NO: 381194 - RNA, 63 nt, Human
cugcagguaccuugauagcccacagagagaucugggaaggaagggcuccuccucaggcugcug

SEQ ID NO: 381195 - RNA, 63 nt, Human
cagaaugcagcagcagcugagcauguuaaaauggggaaggaugauagcuacauguaugccggu

SEQ ID NO: 381196 - RNA, 63 nt, Human
auauugaaaaucaaaggaggcaaaauuuugacagggaaggaaguaacugcaaaacacuaggcu

SEQ ID NO: 381197 - RNA, 63 nt, Human
gaaacaggaaagaagagagggagagagaggaaagggaaggaagaaaggaaggagggagaaggg

SEQ ID NO: 381198 - RNA, 63 nt, Human
aaaagaaugaaggaaauaauaaagugauagacagggaaggauagaaaagacuuaacaauauac

SEQ ID NO: 381199 - RNA, 63 nt, Human
caaaagguguagcuuuuauaagagugcagaaaagggaaggauguguuuuuuucucucacuaua

SEQ ID NO: 381200 - RNA, 63 nt, Human
ucagagagaaauagauaaaacacgccacagccugggaaggagcgugcucuacccugugcuaag

SEQ ID NO: 381201 - RNA, 63 nt, Human
cugagugcugggagugaguugguaauaugagaugggaaggaauguugacuugcuaacauuccu

SEQ ID NO: 381202 - RNA, 63 nt, Human
auaguuaauuuuuuucuaaccuugccacuuugagggaaggaaggguugggggaagggcaagcu

SEQ ID NO: 381203 - RNA, 63 nt, Human
uguguagucaaucuuuuaagcuuugacuguuuugggaaggaagaguaccucuuaucgagguag

SEQ ID NO: 381204 - RNA, 63 nt, Human
ugaaggucacucuuccugcaaggacuacguuaagggaaggaacucuggcuuccagguaucucc

SEQ ID NO: 381205 - RNA, 63 nt, Human
agauucaaaaguggguaaguaaaauggaucagugggaaggauaagguguccaacagaaagugu

SEQ ID NO: 381206 - RNA, 53 nt, Human
aagcuucccugagaauguagucagggaaggaaggagggcagguggcccuuuga

SEQ ID NO: 381207 - RNA, 63 nt, Human
gugaggauggaaggauggagaaaaacagacugugggaaggaucagaaggaauccgccgaggca

SEQ ID NO: 381208 - RNA, 63 nt, Human
aguuccagcuguucuggccacacugggcugguggggaaggagcggcggccucuuuccuuggag

SEQ ID NO: 381209 - RNA, 63 nt, Human
caacuggaacuggaaauuauacaaaaguaaauugggaaggauacuccagcaucugacacuggc

SEQ ID NO: 381210 - RNA, 63 nt, Human
ugaucucacagaggagggccaugccgcugaaaagggaaggagauugaaacauuugauugccuu

SEQ ID NO: 381211 - RNA, 63 nt, Human
cucugggaucccgcugugggucugagauggccugggaaggaccuuguggacaaugguuuuauc

SEQ ID NO: 381212 - RNA, 63 nt, Human
ugccccuugggaaggggcagugaugccuuugaggggaaggaggagccccucuuucucccaugc

SEQ ID NO: 381213 - RNA, 63 nt, Human
caggaaauccacagcuccuccugcacccagaaugggaaggaaagaaggccaagggaauucaga

SEQ ID NO: 381214 - RNA, 63 nt, Human
aaagaaagcccucuccuuagcugagcagaggaagggaaggaguguggcuaugagaauaugauu

SEQ ID NO: 381215 - RNA, 59 nt, Human
uacuguauggcuuggaaugaggcaggagugggaaggagauggcauagagaagaucuaau

SEQ ID NO: 381216 - RNA, 63 nt, Human
guaacagcagggcuggacuuccuccagcguuuugggaaggaaagagauguuccccugagcuga

SEQ ID NO: 381217 - RNA, 63 nt, Human
ucuggggagccagggagcucaggggacagauaagggaaggacgcccccugacuccaggccccu

SEQ ID NO: 381218 - RNA, 63 nt, Human
gacacagccuuauuacugcuggggugggauaaggggaaggagaagagggagaauggagcagga

SEQ ID NO: 381219 - RNA, 63 nt, Human
guccccagagggaggagcaggcaggagagagaggggaaggagguaugaaucccaguccccagg

SEQ ID NO: 381220 - RNA, 63 nt, Human
gaaaagcagucggacucuaccuuaaggagggaugggaaggaaagaguugaguugguuucuuuc

SEQ ID NO: 381221 - RNA, 63 nt, Human
ugggaauuuaguuacagugcuuggaaugagaaggggaaggaaagaauuaacaaaugccaagau

SEQ ID NO: 381222 - RNA, 63 nt, Human
acuaauaaauggacuacaguagcucacguuacagggaaggaggguaggcagggaggcucugug

SEQ ID NO: 381223 - RNA, 63 nt, Human
uaggauugaaguggcuggaaagagugaugccuggggaaggagauggaguuaugaggguacugu

SEQ ID NO: 381224 - RNA, 63 nt, Human
ugucaggcacugaaugucaggcauugagacauagggaaggaaugguuuguacuaauacagacg

SEQ ID NO: 381225 - RNA, 63 nt, Human
ccccuucccacuccuuccggaguaagguuagaagggaaggaaggaaagaucaaggaaccaagc

SEQ ID NO: 381226 - RNA, 63 nt, Human
ugugguggaugggcacccaggaaggguugaccagggaaggaggcagcuaggcuguagauggaa

SEQ ID NO: 381227 - RNA, 63 nt, Human
ugugaagcaauuacugagcagaucaagaucuuugggaaggaacacuaaagauguuuugaauga

SEQ ID NO: 381228 - RNA, 63 nt, Human
uuaaauggcccaccccaggcagacucagacacagggaaggaggcuuggaauuaggaugggauc

SEQ ID NO: 381229 - RNA, 63 nt, Human
acucaaaugcugacaggggccagaggagauauggggaaggagcaucagaaaugaggcaagcua

SEQ ID NO: 381230 - RNA, 63 nt, Human
cccguagcgggaugaucucgguuggugagugcagggaaggaggauguaauuccaucauauaua

SEQ ID NO: 381231 - RNA, 63 nt, Human
ugacucauguuucccuguuucaaagggauccuggggaaggaggggaacaugcuugcaguaucu

SEQ ID NO: 381232 - RNA, 63 nt, Human
cccagcauguauguaugcacacauugugugugugggaaggacaaagccacucucacaagaaag

SEQ ID NO: 381233 - RNA, 63 nt, Human
guagggcgauaauuuauauauuuuccacagucagggaaggacucucacuuauuuguuucaaau

SEQ ID NO: 381234 - RNA, 63 nt, Human
ccuucauuuugcuacugauuuuccuuaauuugugggaaggaguaggcaaagaauaugcuuaca

SEQ ID NO: 381235 - RNA, 63 nt, Human
ugugaacccuggaagacagaaggccacuccaaggggaaggaucccucuccucucugccauuuc

SEQ ID NO: 381236 - RNA, 63 nt, Human
ugacaucaaagccuugucaagaugguucauauugggaaggagacaguauuuuaagccauuuuc

SEQ ID NO: 381237 - RNA, 63 nt, Human
aacagcccagagcucaggacacuuggcuuuggggggaaggaaacugaggcccagagaggggca

SEQ ID NO: 381238 - RNA, 63 nt, Human
ccugccucagccucucugguagcugggauuacagggaaggaaaauagcuggcauuucuugcug

SEQ ID NO: 381239 - RNA, 63 nt, Human
gaaaagucaggaagguagagagagaaaaagggagggaaggagaaagaaugggaauaaaauaag

SEQ ID NO: 381240 - RNA, 63 nt, Human
gcagccagggcugggguugccagaggcccuggagggaaggacagucccugcuggggaagaaca

SEQ ID NO: 381241 - RNA, 63 nt, Human
auuucaugaucaguguuaagcauuuuccuccaugggaaggaagcaugggauauagaaaagcga

SEQ ID NO: 381242 - RNA, 63 nt, Human
cuuuucuccacgagcccucuggccacugugggagggaaggacaaggguucccuuggaaaugug

SEQ ID NO: 381243 - RNA, 63 nt, Human
auucagucgcuccucucacgcggcugccuuaucgggaaggaaauuuguuugccaaauaaagac

SEQ ID NO: 381244 - RNA, 63 nt, Human
ggcgaagggcagagcguuuguguguucuggggagggaaggaaaagguguuggaggccuuaauu

SEQ ID NO: 381245 - RNA, 63 nt, Human
agcaguuagucuucauccccacgugaacaaaaugggaaggagccgugaggagaggagugaggc

SEQ ID NO: 381246 - RNA, 63 nt, Human
uggaaguauaggacguugcuuauuuuaaaacaagggaaggacacaaaauggaaugacugcuua

SEQ ID NO: 381247 - RNA, 63 nt, Human
guggggaaguguagcaaggacggcugguggagggggaaggagggugcgaggugucugucugau

SEQ ID NO: 381248 - RNA, 63 nt, Human
cuggccuucucuuggcucaaaggcugggagggagggaaggagagaagaguuccaggcaauccc

SEQ ID NO: 381249 - RNA, 63 nt, Human
cacaccucuucucauccucagugaugugaaggugggaaggaaaggagcuuggcauugggagcc

SEQ ID NO: 381250 - RNA, 63 nt, Human
cggcccuccgcacccuggaagcacacggccucugggaaggacagcccugaccuucgguuuucc

SEQ ID NO: 381251 - RNA, 63 nt, Human
cggggugugggaccccagcccggagagaacagagggaaggagccgcgcccccaccuggagcug

SEQ ID NO: 381252 - RNA, 63 nt, Human
ggugucggccugcagccaaguucacugucacgggggaaggagccaccagccaguccucagauu

SEQ ID NO: 381253 - RNA, 63 nt, Human
ugguuauuguucagacauuccauggugauuccugggaaggaagcuuggcugcucaguuucuga

SEQ ID NO: 381254 - RNA, 63 nt, Human
aauuaguguucccugugaauucccccccucuaugggaaggaugccuuuacucuuuaucaguaa

SEQ ID NO: 381255 - RNA, 63 nt, Human
cugacuauccauccaucauaaccaccccagccugggaaggagagcuugcuuuuguugcuucag

SEQ ID NO: 381256 - RNA, 63 nt, Human
aaagcacaccuacccuuuggcguaauccugccugggaaggagagagguuuagugccauguuca

SEQ ID NO: 381257 - RNA, 50 nt, Human
ggacccagcaggaaucaugagggaaggaaaaugcagcacucuaaauggcc

SEQ ID NO: 381258 - RNA, 63 nt, Human
cugaccaguggggccuuagcaauuugaaggguugggaaggaggaauuauauuugcaaaggggc

SEQ ID NO: 381259 - RNA, 63 nt, Human
uucgauuucggcaaagccugggcaggugccaccgggaaggaauggcauccgagaugcugggcg

SEQ ID NO: 381260 - RNA, 63 nt, Human
uucaaccugcuuacucauuucucaggggauuuugggaaggaaucagcaggugacaguugcuaa

SEQ ID NO: 381261 - RNA, 63 nt, Human
caucuuaugaaacagucuuagcagugguagguugggaaggagauagcugcaaccaaaaaagaa

SEQ ID NO: 381262 - RNA, 63 nt, Human
uauuuuuuacuuuucacacugucuucccgaugagggaaggagcccagccagaaagcacuacaa

SEQ ID NO: 381263 - RNA, 63 nt, Human
aacagggaaggggccucucuugaaacaguaguugggaaggaggcagacaugcaccagugaugu

SEQ ID NO: 381264 - RNA, 63 nt, Human
ugcuuccuauuauaaaauggcguggggggaagggggaaggauggagaugggaggagaggguaa

SEQ ID NO: 381265 - RNA, 63 nt, Human
cgggauagggcagaggaggugcuggcggccccagggaaggaggguguguaccccaaggccccc

SEQ ID NO: 381266 - RNA, 63 nt, Human
gagccucgcuuuccccacuguucuggagggaaggggaaggagggggucuucaggcuggagcca

SEQ ID NO: 381267 - RNA, 63 nt, Human
accccacaaagccuucuggaccuggaaagccuggggaaggacugacagaccccaggaccagcc

SEQ ID NO: 381268 - RNA, 63 nt, Human
cucaacgagaaggaggcccagcaaguguauggugggaaggaggccaggacgugaguggggcug

SEQ ID NO: 381269 - RNA, 63 nt, Human
uuggagggcagugccagggcauuugcagaagcugggaaggaccaagccucagcaccccagggc

SEQ ID NO: 381270 - RNA, 63 nt, Human
uuuagaaaaggaaaacgugaacaaacuuagaaagggaaggaaaucccaucagugaauccugaa

SEQ ID NO: 381271 - RNA, 63 nt, Human
guguguaggugguaaaaccuguucuccauaggagggaaggagcagucacugggagagguuacc

SEQ ID NO: 381272 - RNA, 63 nt, Human
aacguggggugauuguauugaucaaaacccacugggaaggacaaagaguuugccgccuuucgg

SEQ ID NO: 381273 - RNA, 63 nt, Human
gcagcaguccuacuuauugccauguggacuugugggaaggacacgugugacccuuaagaaucc

SEQ ID NO: 381274 - RNA, 63 nt, Human
caccagugagaccacggggccacuguggggugagggaaggagcgcuuggagucagagcucuag

SEQ ID NO: 381275 - RNA, 63 nt, Human
gcucagcgaugcucugggaacccuugggguuuggggaaggacaguguggugugacuauuggcu

SEQ ID NO: 381276 - RNA, 63 nt, Human
ggcuggagcuccaugcacguaguccagaugccugggaaggaacaucucccuuccagcaucugc

SEQ ID NO: 381277 - RNA, 63 nt, Human
acaguucugaccuuuuuuguccaguuucuuugggggaaggaagacaaagaagguaggaacgga

SEQ ID NO: 381278 - RNA, 63 nt, Human
gauggcuguggcauuuccaaacauccaaaaaaagggaaggauuuaaggaggugaagucggguc

SEQ ID NO: 381279 - RNA, 63 nt, Human
ggucaccccacugaggaugcugcuggcagccuggggaaggagccaguuuuuuuugguuuuuuu

SEQ ID NO: 381280 - RNA, 63 nt, Human
cccuacaguuugcugcugagcuggaagcugugggggaaggaguugacaggugggcccagugaa

SEQ ID NO: 381281 - RNA, 63 nt, Human
ugguggggcugccaggggagaccccgggagccggggaaggaggccguccaucccgucgacgua

SEQ ID NO: 381282 - RNA, 63 nt, Human
uuuggagguauagaaggaaggaugugguccaacgggaaggaagugaagagucuauugguuuuu

SEQ ID NO: 381283 - RNA, 63 nt, Human
cacagauuuuggaaacgaccuggacacacuauugggaaggagauguggacggccugucuccuc

SEQ ID NO: 381284 - RNA, 63 nt, Human
ggccagcucgcuccaaaacccuuggggaguagagggaaggagcaggccgcgugucacacccau

SEQ ID NO: 381285 - RNA, 63 nt, Human
gaggauuucaguuaggucucccauuuggcugaugggaaggaggcccaguguugcagggaggca

SEQ ID NO: 381286 - RNA, 63 nt, Human
ggcaggggauuguaguagcagcugaccugaguggggaaggaaggaggauuucaguuaggucuc

SEQ ID NO: 381287 - RNA, 63 nt, Human
uucccucgucccugcccaggucucuugucucuugggaaggaacugauaggucgggccauuguu

SEQ ID NO: 381288 - RNA, 63 nt, Human
ggguggggguuguuaaggaugcuggggggccuggggaaggaaggaguucagaggaaggguguc

SEQ ID NO: 381289 - RNA, 63 nt, Human
aaaguagaagucuguccgucuaugaacaugcgggggaaggauccggaaccaggacccagaagc

SEQ ID NO: 381290 - RNA, 63 nt, Human
aauuagaagaaucaaaaagugauagaauauugggggaaggagggcagacuccaucguuuccuc

SEQ ID NO: 381291 - RNA, 63 nt, Human
ucacuccccacaguggaugccuuagaagggagagggaaggagggaggcaggcauagcaucuga

SEQ ID NO: 381292 - RNA, 63 nt, Human
cuuucuccuuuuugcuuucuuaccccugaaagagggaaggacaagucaccucauaacuucugc

SEQ ID NO: 381293 - RNA, 63 nt, Human
uugcugguggucaggaggcauagggaggcaggagggaaggaagcuuuaccuguaaaauggugu

SEQ ID NO: 381294 - RNA, 63 nt, Human
auaacucuguacuuugguuucagggugacauuugggaaggauuuuguuuagaauuaauggagu

SEQ ID NO: 381295 - RNA, 63 nt, Human
aggauuucuugagauuugauggaagugggaguugggaaggauucaccauacuuguguucuccu

SEQ ID NO: 381296 - RNA, 63 nt, Human
guugggaaaggccacuuugcucgcaggggugaggggaaggauagagaaucuauuuuuaauaaa

SEQ ID NO: 381297 - RNA, 63 nt, Human
agaagccaauggaaaugaaagagauuggcaaaggggaaggaugaugccauguagauccuguuu

SEQ ID NO: 381298 - RNA, 63 nt, Human
gggagaggugagucuggaauuuuggucacaagagggaaggacuuggagaggagaauuaguuuu

SEQ ID NO: 381299 - RNA, 63 nt, Human
cgguggcggucacucccucugccacuauccccagggaaggaaaggcuccgccauuugggaaag

SEQ ID NO: 381300 - RNA, 63 nt, Human
acauaauuuauaccaaguuaugccaguuggggagggaaggacuaaaaauaauauugcaggcag

SEQ ID NO: 381301 - RNA, 63 nt, Human
cccuuccuacuccuuuugguuuuguggggagaggggaaggaucagggggccaggccagcagcu

SEQ ID NO: 381302 - RNA, 63 nt, Human
gcugaggucgccggcgccuuuuucuuuuuagaugggaaggaggccaggaaagggucagcuuaa

SEQ ID NO: 381303 - RNA, 63 nt, Human
cuuggcuuccuuccuggcaaggaccaggcaguggggaaggaggagguccuccgugguacauac

SEQ ID NO: 381304 - RNA, 63 nt, Human
gugugccaugucacagcauggccucucggccuugggaaggaaggcagugccugcucugcugug

SEQ ID NO: 381305 - RNA, 63 nt, Human
uggggucacaggagaagaaagcgggacuuuggugggaaggagucacacgguaaaugggcgaaa

SEQ ID NO: 381306 - RNA, 63 nt, Human
gguccaggggaugggagguugugggcauugauggggaaggaggcuggcuuguccccuccucac

SEQ ID NO: 381307 - RNA, 63 nt, Human
acuugaugccuucucugugagcaguggcucugugggaaggagggagccgggagccugguggga

SEQ ID NO: 381308 - RNA, 63 nt, Human
cuggaagucccauuauggauguugaaauggacagggaaggacucuggaagucucuuccuccuc

SEQ ID NO: 381309 - RNA, 63 nt, Human
uuguuuuuguuuuguuuuguucuguuuagguuugggaaggauuuuguauauuuuucccccugg

SEQ ID NO: 381310 - RNA, 63 nt, Human
uugccgcagugucaccucaguggaccagccugggggaaggagcuuaauugcugagacauuaau

SEQ ID NO: 381311 - RNA, 63 nt, Human
aggcucugaccaggcagaacaggcaagaggggagggaaggagaccccugcaggcucccuccac

SEQ ID NO: 381312 - RNA, 63 nt, Human
guauaucaaaaucauguaguuuguauaaaaugugggaaggauuuauuuacaguguguuguaau

SEQ ID NO: 381313 - RNA, 63 nt, Human
acuccccuguuucaaucacuguccuccacacaagggaaggacagaaaggagaguggccauucu

SEQ ID NO: 381314 - RNA, 63 nt, Human
ucccacguauuuucuuuuuugucaguauuguuugggaaggagacaugccgggaugugucaucg

SEQ ID NO: 381315 - RNA, 63 nt, Human
aguagaaaaguggcauuuucuugauuggaaagggggaaggaucuuauugcacuugggcuguuc

SEQ ID NO: 381316 - RNA, 63 nt, Human
gcugccaguggccucuucugggugccaggagaggggaaggaccuuugucugggcguuaccaag

SEQ ID NO: 381317 - RNA, 63 nt, Human
cggaguucaguuuuaccagaugaugggggaggggggaaggaguuuuauguuaaaccauccaug

SEQ ID NO: 381318 - RNA, 63 nt, Human
ccuugauugguguugccaguuguccuccuuccggggaaggauuuugcaguucuuuggcugaaa

SEQ ID NO: 381319 - RNA, 63 nt, Human
caaagugggggguggacacagaagucccuaggagggaaggagcuguuggggcagggguguaaa

SEQ ID NO: 381320 - RNA, 63 nt, Human
gguacuuggcgcuuuguuuccuggcugaggucugggaaggaauagaaaggggcccccaauuuu

SEQ ID NO: 381321 - RNA, 63 nt, Human
uaaggggguaguuuuauuuuggugggguugggugggaaggaaggcuggggguuuuguaaagug

SEQ ID NO: 381322 - RNA, 63 nt, Human
cuaauuccaaaaaguaauuccacuggagcugcugggaaggaaaacgagcucuucugaugcaaa

SEQ ID NO: 381323 - RNA, 63 nt, Human
agcacuacauuuuaaauucagcauuagugcauugggaaggaucuuuacugcuuugugcuuggc

SEQ ID NO: 381324 - RNA, 63 nt, Human
uugggaguugugcagggacucuggcccaggcaggggaaggaagaccaggcgguaggggacugg

SEQ ID NO: 381325 - RNA, 63 nt, Human
gggcuggguacacuggggaauguuagcaagacugggaaggaggccacauuccugucugcagca

SEQ ID NO: 381326 - RNA, 63 nt, Human
uucucaauacuugaauauggaacauaugcacaggggaaggaaauaacauugcacuuuauaaac

SEQ ID NO: 381327 - RNA, 63 nt, Human
gguucccuccaagaagacaaggacaggagacuugggaaggaccaaugguaauuuaaguggcuc

SEQ ID NO: 381328 - RNA, 63 nt, Human
gccacagaagcuauuaauacacgacagcauguggggaaggacuuauggugggccagguggacc

SEQ ID NO: 381329 - RNA, 63 nt, Human
cggauggggcgcgccugcgcccucagaacgugugggaaggagggggcguggacaggacacggg

SEQ ID NO: 381330 - RNA, 63 nt, Human
cgccagccuugcucagcuguggguugcccugcugggaaggagggaaucacguccaccuggguc

SEQ ID NO: 381331 - RNA, 63 nt, Human
caagaaggaauugaaauaaggagggacaugauggggaaggaguacaaaacaaucucucaacau

SEQ ID NO: 381332 - RNA, 63 nt, Human
uuuccuccuuauccuuauuaagucaucugccuggggaaggaguuccacuguuucuuuccuucu

SEQ ID NO: 381333 - RNA, 63 nt, Human
aaucaugaaagucugggaagcauauggaccagugggaaggauaggauuagcacugcaccucua

SEQ ID NO: 381334 - RNA, 63 nt, Human
gaggugaaggacauggagcagcugcuggcccuugggaaggaggcccgggccugucccuauuac

SEQ ID NO: 381335 - RNA, 63 nt, Human
uggcagaugggagccaaccuggauggggguuuggggaaggagggcauguguagcagagaacuu

SEQ ID NO: 381336 - RNA, 63 nt, Human
ugugggugccaguccuccucaggagaaggggaagggaaggaggccacuuugagagggcugaag

SEQ ID NO: 381337 - RNA, 63 nt, Human
uacuagaaucauuucauuauuucugcuuccugggggaaggaugcagaaggagucugaugcuca

SEQ ID NO: 381338 - RNA, 63 nt, Human
uuaucugaucuuccucaaacuucagauagguuagggaaggacaaaggcccccagccaugaagg

SEQ ID NO: 381339 - RNA, 63 nt, Human
aauuccuagauccuaggaauucagugagacccugggaaggaccagcaugcuaaucagugucag

SEQ ID NO: 381340 - RNA, 63 nt, Human
gccaaaaugugaggguggugggugggaugggcagggaaggaauccugguggaagucuugggug

SEQ ID NO: 381341 - RNA, 63 nt, Human
agucuugggaagaaaaguuucuacucagaacuggggaaggaguggaacuuaugacuugggccu

SEQ ID NO: 381342 - RNA, 63 nt, Human
ccccaacccuaucccuccuaccucacccgcagggggaaggagggaggcugacaagccuugaau

SEQ ID NO: 381343 - RNA, 63 nt, Human
cuuagauuaaagacguugccuuuaauaucuguugggaaggaaauguccagacuuuucaaaucu

SEQ ID NO: 381344 - RNA, 52 nt, Human
agaagcgcaaguucucuuaaaggggaaggaggcuuguagaaagcaaaguaca

SEQ ID NO: 381345 - RNA, 63 nt, Human
ccuccugccccuuuugcuuuuuuaaagaaacuggggaaggauuuaugaauacaccaccaccag

SEQ ID NO: 381346 - RNA, 63 nt, Human
cauuuaggaacccagaccgaaaaguugcugaaagggaaggagacacauucacaaagaaacguu

SEQ ID NO: 381347 - RNA, 63 nt, Human
agaaagaacuccucauaggaauacugaagaagugggaaggaaccaagcugacacaggccucac

SEQ ID NO: 381348 - RNA, 63 nt, Human
ucuguguuuuacuugagacauguaaauaugauagggaaggaacugaauuucuccauucauauu

SEQ ID NO: 381349 - RNA, 63 nt, Human
cagcauagugagaauuauuuaaaauccuucguagggaaggacagcugucuuugcaggggaaau

SEQ ID NO: 381350 - RNA, 63 nt, Human
cugcauugucuuggaauguaagcacugucuugagggaaggaagaggucuguucuguauugccu

SEQ ID NO: 381351 - RNA, 52 nt, Human
guccucugggggggcccugagagggaaggagagguuucucacaccaaggcag

SEQ ID NO: 381352 - RNA, 63 nt, Human
gcaaagcuucuaaaacugggggucggugcucaagggaaggauuugcuaugaccucauagaacc

SEQ ID NO: 381353 - RNA, 63 nt, Human
ggucuggcgucccaaaugaaagaagcaggcaaagggaaggagccccugagaacaaccaaucuc

SEQ ID NO: 381354 - RNA, 63 nt, Human
cucucaaccaucccacuaaguuauagccaagaagggaaggagacacggggauuugggguucuc

SEQ ID NO: 381355 - RNA, 63 nt, Human
aaucagcagguucucugcccucccuagggguuggggaaggacccaccccggucagcacagugc

SEQ ID NO: 381356 - RNA, 63 nt, Human
acacggagcugggccaucgucagaacuaagucagggaaggagauggaugagaaggccagaauc

SEQ ID NO: 381357 - RNA, 63 nt, Human
gaaaacagcaaacaagggcaagaaggucugagagggaaggagaaugacauuuacacauuuuac

SEQ ID NO: 381358 - RNA, 63 nt, Human
aaaagaagaggucucccucaauccuccccuuuagggaaggagucaacaguguaacuaaauuuc

SEQ ID NO: 381359 - RNA, 63 nt, Human
caaggagaugccacucugcucugccuuacuguugggaaggagagaggaacccacucacucuua

SEQ ID NO: 381360 - RNA, 63 nt, Human
cugacccuggccugugguggucugagcuggggagggaaggacaccaaugaaucagcuugggac

SEQ ID NO: 381361 - RNA, 63 nt, Human
aagacccagcaccagugaccuccagcugggggugggaaggaaaaaacuggacacugccaucug

SEQ ID NO: 381362 - RNA, 63 nt, Human
cgccaggccaaggaacaccggccuguuuaugaggggaaggaugguaccaucgaggacaucauc

SEQ ID NO: 381363 - RNA, 63 nt, Human
gcccuaaggaagcugugaucaucccuagaaagagggaaggagcaggagacgacaggggagggg

SEQ ID NO: 381364 - RNA, 63 nt, Human
uucuugauuugggccuggugacccaccuggaaugggaaggaugucagcugaccucucaccucc

SEQ ID NO: 381365 - RNA, 63 nt, Human
ccagccuaccccuccugcgcugccccagagccugggaaggaggccgcuaugcaggguagcacu

SEQ ID NO: 381366 - RNA, 63 nt, Human
cuguagcccccacccuccugccaagcugccucugggaaggaagaaacaggagcuaggcagaag

SEQ ID NO: 381367 - RNA, 54 nt, Human
ucaccagccucuuccccugaugcagggaaggaagaagagaaaacauauuuccgg

SEQ ID NO: 381368 - RNA, 63 nt, Human
caacucauguccaauacugcuuugccugguguggggaaggauugggucuugucccccaacaca

SEQ ID NO: 381369 - RNA, 63 nt, Human
uccucaccaccuagccauagucucaaaccuguggggaaggagguuuucucccugcccgggaag

SEQ ID NO: 381370 - RNA, 63 nt, Human
acccuugacauacaaggaguuugaaaagcagaagggaaggacaauucaguaucuacaccaguu

SEQ ID NO: 381371 - RNA, 63 nt, Human
ccaguugugcuggcguaaguggcccacaucauggggaaggagugcugugauugacuaguaaug

SEQ ID NO: 381372 - RNA, 63 nt, Human
uccugaugaguacauguggacucaccugaggaagggaaggaagggaauaaucuuuuauguuuc

SEQ ID NO: 381373 - RNA, 63 nt, Human
uuccucggagaccccuggggauggggaucuucagggaaggaacucuggccacccaaacaggac

SEQ ID NO: 381374 - RNA, 63 nt, Human
accucugagccacccaucaccgccaaagugugggggaaggauagcugcagauugacaggcgag

SEQ ID NO: 381375 - RNA, 63 nt, Human
uugucaggacuuccugaaggauuagauguggaagggaaggauaagaaacagaccaaggauaac

SEQ ID NO: 381376 - RNA, 63 nt, Human
uuaauacuuuaauguuuuaagugugggggguuugggaaggaaggaauguaauauuauggauuu

SEQ ID NO: 381377 - RNA, 63 nt, Human
ggaaagugcuauuuccuauuuucaccaaaauuggggaaggagugccacuuuccagcuccacuu

SEQ ID NO: 381378 - RNA, 63 nt, Human
aaaucagugacccaagggagggggggauuuaaagggaaggagugggcaaaacacauaaaauga

SEQ ID NO: 381379 - RNA, 63 nt, Human
uuauagcuuuggagacgccuccccaauuccccagggaaggaaacuguuguguccaauccccau

SEQ ID NO: 381380 - RNA, 63 nt, Human
ccacgggauggggugggggagccccaugggccugggaaggagggugcuguggagggggcugca

SEQ ID NO: 381381 - RNA, 63 nt, Human
ggacaaagguagcaagaggauuuccuggcgggugggaaggaauggcuggggcggccaguuuug

SEQ ID NO: 381382 - RNA, 63 nt, Human
acuguuuuuuucacacaucguugccgcagcggugggaaggaaaggcagauguaaaugaugugu

SEQ ID NO: 381383 - RNA, 63 nt, Human
uacuacuugggagacaguggaaggaaagauagagggaaggaaguucacucacuugaauuugaa

SEQ ID NO: 381384 - RNA, 63 nt, Human
aagccccucuguccuaugcagaagggcgcucaagggaaggaagugucguugcuguuagagccu

SEQ ID NO: 381385 - RNA, 63 nt, Human
ggauuggagcaaaagagaacuggcaauaaguaggggaaggaagaauuucauuuugcauuggga

SEQ ID NO: 381386 - RNA, 63 nt, Human
uugcaaaauguuacgcuuuggaccauuuuuccggggaaggagauccagaacuuuuuaccagau

SEQ ID NO: 381387 - RNA, 63 nt, Human
accucucaacauuaccaaaaucauuucuuuagagggaaggaauaaucauucaaaugaacuuua

SEQ ID NO: 381388 - RNA, 63 nt, Human
cuccauuuccagugauuuguuccuaagguagaagggaaggaggauugcagcugggauuaaugu

SEQ ID NO: 381389 - RNA, 63 nt, Human
cccagaaacguguaaaugaccccgagugugacugggaaggagaacuuauuccuuaccaggaaa

SEQ ID NO: 381390 - RNA, 63 nt, Human
aauuaaagcuuagacuaaauaguaauauaucgugggaaggauuuugguuuugugauauuucug

SEQ ID NO: 381391 - RNA, 63 nt, Human
agggggggagcauucgggggaguggggaguggggggaaggaaagcggagacccgagcaggggu

SEQ ID NO: 381392 - RNA, 63 nt, Human
ucaaauuguauucaucauuauuaacauguccuggggaaggaagggaaacuuucuaggacagaa

SEQ ID NO: 381393 - RNA, 63 nt, Human
gcccucaggccuggugcugccuuggagggcugggggaaggaguguguggaggagggaggaggg

SEQ ID NO: 381394 - RNA, 63 nt, Human
cacacacacaauggaaugcuauuaagccuuaacgggaaggaaauccuuuuaaagauuuaaacu

SEQ ID NO: 381395 - RNA, 63 nt, Human
gcuacaauuuccuuuaaggcagccccuagcucugggaaggaauacugguagccaguggccagu

SEQ ID NO: 381396 - RNA, 63 nt, Human
aagagcaacaucauagagugugaauuucuauuugggaaggagaaaauacaagagaaaauuaua

SEQ ID NO: 381397 - RNA, 63 nt, Human
uuccuuaggaagaaaauaacauucuuggguugagggaaggaaugccauacacuacugucucuu

SEQ ID NO: 381398 - RNA, 63 nt, Human
uuuaaauuaacaauggagagaaugauaagaugagggaaggaaaaggcauucauuauugacuua

SEQ ID NO: 381399 - RNA, 63 nt, Human
gugauagucagagagugguguuuuuguucaggugggaaggauuggaaacucuagucuuuucua

SEQ ID NO: 381400 - RNA, 63 nt, Human
uggagagcuguccaaccaagagagcgggagggagggaaggagggagggagagagauagagaga

SEQ ID NO: 381401 - RNA, 63 nt, Human
ggaaugggaguuggcgggcagugaacgaguguggggaaggauuggugcuggggcaacaggaag

SEQ ID NO: 381402 - RNA, 63 nt, Human
agaaacgaaaaagaaagcccaaggcaaagaagggggaaggaaaacaaacuucgccacucucuc

SEQ ID NO: 381403 - RNA, 63 nt, Human
gaagaaaauggccagggggaaggaaaggugagugggaaggagcagaaagcugggaaaggggau

SEQ ID NO: 381404 - RNA, 63 nt, Human
uuuuagacucugaugaggaagaaaauggccagggggaaggaaaggugagugggaaggagcaga

SEQ ID NO: 381405 - RNA, 63 nt, Human
cagccacauaaaggcaguguacugggggugggagggaaggaaacaaucacauaaaaucagcug

SEQ ID NO: 381406 - RNA, 63 nt, Human
uccgugcccuacagaccuuuucucaacgaaugugggaaggaccuggcuuuaaaacacgcacac

SEQ ID NO: 381407 - RNA, 63 nt, Human
cugaaugccucgcucccuucaagacgaggggcagggaaggacaggacccucaggaauucagug

SEQ ID NO: 381408 - RNA, 63 nt, Human
gucugggccacuugcuuaauugcauuucuggcagggaaggagaggagggauggagaagcucug

SEQ ID NO: 381409 - RNA, 63 nt, Human
cuccagcuuggaccacacauugcccuuuucucagggaaggaaauggaaacaaaaagccaacag

SEQ ID NO: 381410 - RNA, 63 nt, Human
ccccuaagccagcacugcugcucccuggagcccgggaaggaggcugccuggcuggaggcccga

SEQ ID NO: 381411 - RNA, 63 nt, Human
gcgcuggggucugggcugugcucccucacuaaagggaaggaaaggaagcugggcguccucugg

SEQ ID NO: 381412 - RNA, 63 nt, Human
uauugauuuuugcuaggguccccgagguaaguggggaaggaaccucccuccuccuuucucccg

SEQ ID NO: 381413 - RNA, 63 nt, Human
gaagccaguucuaggcuuccaggcgaaagcugagggaaggaagaaacuccccuccccguuccc

SEQ ID NO: 381414 - RNA, 63 nt, Human
gagggugcguggggccugccccuuggaagggaagggaaggacgguguccuguggagaccagac

SEQ ID NO: 381415 - RNA, 63 nt, Human
uaaaauaugaauacuguaaaggaaauaaauggugggaaggaaaaguagagaaagaaaugccaa

SEQ ID NO: 381416 - RNA, 63 nt, Human
aaaaaugcauuaacgucuuuuuauauccaucaagggaaggaugaaauguugaauuugaagacu

SEQ ID NO: 381417 - RNA, 63 nt, Human
gagcuacacuuuuuuuuuuccuaaauggaaaaugggaaggagauacugucucugaacaaaaau

SEQ ID NO: 381418 - RNA, 63 nt, Human
cugagggaaauggggcccuaggagggugggggcgggaaggaggggcaaggucuuucaggaacc

SEQ ID NO: 381419 - RNA, 63 nt, Human
uuuguuguuguuuauuuuugcuuuugugguugagggaaggacaagagauaagagguuguuacc

SEQ ID NO: 381420 - RNA, 63 nt, Human
aauuugcccuugaauuggaaggaauggagauuagggaaggaaaacuacucuagaggccauuua

SEQ ID NO: 381421 - RNA, 63 nt, Human
uuccuauggaaguccugcuuuauuccaggugaagggaaggaaguguauauacuuuuggcaagu

SEQ ID NO: 381422 - RNA, 63 nt, Human
caauaagcaacagaugauauugagugucggguggggaaggaggcccagacucugcuucggcca

SEQ ID NO: 381423 - RNA, 51 nt, Human
ggaaggcucggaagcugugaugggaaggaggccugcacuuggaccugaccu

SEQ ID NO: 381424 - RNA, 63 nt, Human
cccuccccucggagaggcugauucacugggucugggaaggagccuggggauuuuaauuuuuca

SEQ ID NO: 381425 - RNA, 63 nt, Human
gggaaacaguuuauuaaauagaaggauguuuuggggaaggaacuggauaucucuccugcagcc

SEQ ID NO: 381426 - RNA, 63 nt, Human
uaaaauaugaauacuguaaaggaaauaaacggugggaaggaaaaguagagaaagaaaugccaa

SEQ ID NO: 381427 - RNA, 63 nt, Human
ugacuuacuguacaugaaaacacauuuuucuuagggaaggauacaaaagcaugugagacuggu

SEQ ID NO: 381428 - RNA, 63 nt, Human
uauaaauccuguaguuuaaaaggaagaaauggugggaaggaaaaguagagaaagaaaugccaa

SEQ ID NO: 381429 - RNA, 63 nt, Human
acuuaaccacgaauacccuugaguguccaaauugggaaggaacuuguuucuucuguuauacua

SEQ ID NO: 381430 - RNA, 63 nt, Human
gcauccugagucagaaguggaaauguccagcaggggaaggacaggcagguggauggugugagc

SEQ ID NO: 381431 - RNA, 63 nt, Human
ccugggacagacgagagggcuccucgcugucuagggaaggacacugaggggcucagggugagg

SEQ ID NO: 381432 - RNA, 63 nt, Human
gcaguccaggcccgugcuggcgggauugggcaugggaaggagcagggccugcugcuucccugg

SEQ ID NO: 381433 - RNA, 63 nt, Human
cccaaaggguuuuggguauagccugcccuggaggggaaggaaguccaugcaagcaaagacaug

SEQ ID NO: 381434 - RNA, 63 nt, Human
gcgauguccuaggggugcugcauuuugcuuccggggaaggauggacacuuuucagaagucacu

SEQ ID NO: 381435 - RNA, 63 nt, Human
gcucccagacccucaccucggacaugguggugggggaaggacgggugggcaaggcuggugcgu

SEQ ID NO: 381436 - RNA, 63 nt, Human
cggccaaaucugucucccuucaugggccucccagggaaggaggaagcccugcugugcagacac

SEQ ID NO: 381437 - RNA, 63 nt, Human
gaccccaaggagcugcagcugaacugcaggggagggaaggaggagcagccugggcugccccuu

SEQ ID NO: 381438 - RNA, 63 nt, Human
aacaggcugaggagguuccgaggcucaaaggaggggaaggagccccgaggaggcucugaguug

SEQ ID NO: 381439 - RNA, 63 nt, Human
uuccugcagcucgcuaccuaaguguuucuguaggggaaggagccaauuaagaaaaaguguugg

SEQ ID NO: 381440 - RNA, 56 nt, Human
gacaacauucauuaggauaaaauggggggaaggauuauuauucauguuauuuuccc

SEQ ID NO: 381441 - RNA, 63 nt, Human
gaggacugaugcagcucuuuacgggucuugagagggaaggacucuuccaaagccccaaagccg

SEQ ID NO: 381442 - RNA, 63 nt, Human
guccucaaaauacuuccagaagaacaaccagaugggaaggaccuugguugggacucuuuccag

SEQ ID NO: 381443 - RNA, 63 nt, Human
uuaauugggaucagggcuggggcggggaaacaagggaaggaccuuggaaggggcugcucccag

SEQ ID NO: 381444 - RNA, 63 nt, Human
caggagucagcguucaaucuugaccuugaagaugggaaggauguucuuuuuacguaccaauuc

SEQ ID NO: 381445 - RNA, 63 nt, Human
gucugccacccaggauccccaaggcacuugagggggaaggauucugcuggccucugcgagugg

SEQ ID NO: 381446 - RNA, 63 nt, Human
uggagaaguggcaucagucaacagagaggggcagggaaggagacaccaagcucacccuucguc

SEQ ID NO: 381447 - RNA, 63 nt, Human
gcaugauggcccauacuuguaaucccagcuauugggaaggaugagaugggaggauggcuugag

SEQ ID NO: 381448 - RNA, 63 nt, Human
cccaagagaguuuuuaauuguaaaugcauacuugggaaggacuuagaguuuuaaacuguuuuu

SEQ ID NO: 381449 - RNA, 63 nt, Human
ccaggcuugugagaugagaccaagagggaggaggggaaggacuccaugggccaucgugggcca

SEQ ID NO: 381450 - RNA, 63 nt, Human
accaggacccaggguccccuccccagcucccuugggaaggacacagcaguauuggacgguuuc

SEQ ID NO: 381451 - RNA, 63 nt, Human
gccagccacaccaaccacgccagggggaggaaagggaaggacugggagagacacaaagaccag

SEQ ID NO: 381452 - RNA, 63 nt, Human
uucuuggcucagggccuggguugagggagcuuagggaaggacguccgucugggugcuuuuccu

SEQ ID NO: 381453 - RNA, 53 nt, Human
agaggggcaacgcccauuagaaggggaaggacugccuacguucauuucauuuu

SEQ ID NO: 381454 - RNA, 63 nt, Human
ccugugucuugaagaaguuggcuuucuuuacaugggaaggaaaucaugccaaaaaaauccaaa

SEQ ID NO: 381455 - RNA, 63 nt, Human
cguucauuucauuuuauggagggucccagaaaagggaaggaggagccccaggucauacagggc

SEQ ID NO: 381456 - RNA, 63 nt, Human
aauguagucccaagcuuucacucgcgaguggaggggaaggauuuaugucaccaguggggauca

SEQ ID NO: 381457 - RNA, 63 nt, Human
gauuggccuguccccuuucccuuucucggcuaugggaaggaaggauugcucauugguugccuu

SEQ ID NO: 381458 - RNA, 63 nt, Human
cuucugugggucgcucccagagccauggcccaugggaaggacagaguguguguguccuugggg

SEQ ID NO: 381459 - RNA, 53 nt, Human
ucggggauguaaagaacugaguggggaaggaggaggcucccacuggauccauc

SEQ ID NO: 381460 - RNA, 63 nt, Human
ucauucuuuaucccacucaaucaaaggaacucugggaaggagguugugauugcuggcaagucc

SEQ ID NO: 381461 - RNA, 63 nt, Human
cuggaaaggcugucuggggucuucugacugcaggggaaggauguacuuuccaaacaaaugaua

SEQ ID NO: 381462 - RNA, 63 nt, Human
agaaggaguaggagcugcugcuggcgcccgagagggaaggagccggccugcugggcagcgugg

SEQ ID NO: 381463 - RNA, 63 nt, Human
cauuguggcccuggagagucaccagcagcucuugggaaggacuugcugggaggcugagagagg

SEQ ID NO: 381464 - RNA, 63 nt, Human
gauuauuaccuccggugagaguaauugccugcagggaaggaugaugccagccccggauccggg

SEQ ID NO: 381465 - RNA, 63 nt, Human
ccccggcaggcaccuguggggggugcagcucccgggaaggaggcaacugccucacuuaacauc

SEQ ID NO: 381466 - RNA, 63 nt, Human
ccauccaggcccuggccagugugggaccgggacgggaaggaagaaggaggcuaggagcagggg

SEQ ID NO: 381467 - RNA, 63 nt, Human
ccuccucugcccgggagcucaggaaccgaggcagggaaggaucccaugagcuccuuaaggcuc

SEQ ID NO: 381468 - RNA, 63 nt, Human
agggcccucccagcccauugcugccaagguggagggaaggauaaagccacuucuggcuucagc

SEQ ID NO: 381469 - RNA, 63 nt, Human
gauaaagccacuucuggcuucagcccccaccaggggaaggaaggagggcacauuaacucccuc

SEQ ID NO: 381470 - RNA, 63 nt, Human
uaguauuucuggggcuggggggcggggcuggaggggaaggaguguccacgcaucaauaaagau

SEQ ID NO: 381471 - RNA, 63 nt, Human
cucgggaauuuucaucuaggauuuuaagggaaggggaaggauagggugauguuccgaagguga

SEQ ID NO: 381472 - RNA, 63 nt, Human
gcccucugagaaaaggcaugguuucuuaauugagggaaggaagcagauucggagggguggaga

SEQ ID NO: 381473 - RNA, 63 nt, Human
caugggaucuugagggaccaagcugcugggauugggaaggaguuucacccugaccauugcccu

SEQ ID NO: 381474 - RNA, 63 nt, Human
cagccuggccagcagcucagagugcaccgaggagggaaggauggcuaagcugggaccggcagu

SEQ ID NO: 381475 - RNA, 63 nt, Human
ggcuuccugggagaugagccgcgaccagguccugggaaggacuauggacucuuguugugugga

SEQ ID NO: 381476 - RNA, 63 nt, Human
gaggccuggguuacacagccugagucacaacgugggaaggaaucucugccacgggaaaggugg

SEQ ID NO: 381477 - RNA, 63 nt, Human
aaaccuugagaaucuccaagagaaaaauauuuggggaaggagggaggaaauaugucccuugca

SEQ ID NO: 381478 - RNA, 63 nt, Human
gcaggguccuggccagcagugugggagcaggaggggaaggauaguucuguguacuccuuuagg

SEQ ID NO: 381479 - RNA, 63 nt, Human
ggauugagaagggacaagccaccuugaccguaggggaaggaggaaugugggcugggggaagau

SEQ ID NO: 381480 - RNA, 63 nt, Human
auguaauuuuugcucuagagagaagcaaguggugggaaggagguagcaugacguguggugugc

SEQ ID NO: 381481 - RNA, 63 nt, Human
ccaccgccucaguguagggaaggguccaggccagggaaggagcacccucuaguggaggcgggg

SEQ ID NO: 381482 - RNA, 63 nt, Human
gauggaauugauuuucccugaguggagugcugggggaaggaggagguccaggccgguaguggc

SEQ ID NO: 381483 - RNA, 63 nt, Human
uagaggagcuauguggagcaaaggccgacagaggggaaggaauggaccugugagaggaaggga

SEQ ID NO: 381484 - RNA, 63 nt, Human
aaaaaagaguguccuggcaguuaucuugagguggggaaggaggugaugaaacauuaguuugug

SEQ ID NO: 381485 - RNA, 63 nt, Human
ggguucugccuuaaauugggaggacuccaagccgggaaggaaaauucccuuuuccaaccugua

SEQ ID NO: 381486 - RNA, 63 nt, Human
ccagcacggggugaacggaggcccagaguacuagggaaggaggaagggaggacaugccucuuc

SEQ ID NO: 381487 - RNA, 63 nt, Human
augaaugaagcaaaugucaugcugccuuauucagggaaggaggagccuguccugccuguggcc

SEQ ID NO: 381488 - RNA, 63 nt, Human
acugaucuggagaucugcagaucuggaggagacgggaaggagucgauucuuaaauaaggauca

SEQ ID NO: 381489 - RNA, 63 nt, Human
aaguuagauguagccaaggaaaguagugaucacgggaaggacugcucugagccggguaggaug

SEQ ID NO: 381490 - RNA, 63 nt, Human
cugcuuucuuuccccagggcugggccauggggagggaaggacuuucucccaggggaagccccc

SEQ ID NO: 381491 - RNA, 63 nt, Human
ggaaccuugagaacccagggacgagccagugccgggaaggaacugccgggacucaccgagcug

SEQ ID NO: 381492 - RNA, 63 nt, Human
gggcucuggaccucaggagggcaggcugagguggggaaggagggacuuggcuguccuuccccu

SEQ ID NO: 381493 - RNA, 63 nt, Human
uuaaagcagcagugccaauaaugagacccagcugggaaggacucggugauacccacugggauc

SEQ ID NO: 381494 - RNA, 63 nt, Human
agccaggccccgagggugagcgagauggagaaggggaaggaaggggcuuugggaucuggaaac

SEQ ID NO: 381495 - RNA, 63 nt, Human
guccuuuggagggugucuucuggguagagggaugggaaggaagggacccuuacccccggcucu

SEQ ID NO: 381496 - RNA, 63 nt, Human
ucccagaggaacgcuggagccaagagaagcccugggaaggagggguggggaacgacaugcaug

SEQ ID NO: 381497 - RNA, 63 nt, Human
guguggguucuaaguacaggcauucaaggcugggggaaggaaagcuacgccauccuuccuuag

SEQ ID NO: 381498 - RNA, 63 nt, Human
ggaaucagaccuacuccccuaggucacaacucugggaaggauacagagcccccacccuucacu

SEQ ID NO: 381499 - RNA, 63 nt, Human
agcccagacucugagcugcucaccggagucauugggaaggaaaaguggagaaauggcaagucu

SEQ ID NO: 381500 - RNA, 63 nt, Human
cucugccuugcaucacccucagccuaagggagugggaaggaaaugggguguuuucuugcugac

SEQ ID NO: 381501 - RNA, 63 nt, Human
ccugaaccacugugugcccauuuccuagggaaggggaaggagaauaaacagaauauuuauuac

SEQ ID NO: 381502 - RNA, 63 nt, Human
ccuuccccggggcugagagggugaaaguguguggggaaggagaggacugguuuccuggguucu

SEQ ID NO: 381503 - RNA, 63 nt, Human
ggagcagcagcugaggccccagggcuguggguggggaaggaaggcguguccaggagaccuucc

SEQ ID NO: 381504 - RNA, 63 nt, Human
gccacgaagagcugggcaggccugcaggguguggggaaggaggacacaaccucaagaaaggaa

SEQ ID NO: 381505 - RNA, 63 nt, Human
cugucacaucugacuguggguuucaagugggaagggaaggaguucuacuugucuugacaccau

SEQ ID NO: 381506 - RNA, 63 nt, Human
gccuguggggagccgagggcgucagagagacccgggaaggaaggcucucgggugggggagcca

SEQ ID NO: 381507 - RNA, 63 nt, Human
ggggugguagucagaggagggaggaggaauaaggggaaggaagagagagggagcaggcggagc

SEQ ID NO: 381508 - RNA, 63 nt, Human
gacugcccuucucacgggcucuaugccugcacugggaaggaaacaaauguguauaaacugcug

SEQ ID NO: 381509 - RNA, 63 nt, Human
ggagauacuacaugggagggggacacagaaaaagggaaggaaauuggcuagucuggcuuuuuu

SEQ ID NO: 381510 - RNA, 63 nt, Human
ggcuuaaaagcaggauugaagaaaagggacugggggaaggaaacuuauuggaaaacuugaugc

SEQ ID NO: 381511 - RNA, 63 nt, Human
ggaaggggaaaagucagggccuucccggcgggggggaaggaggugggcaucgggggcaugggg

SEQ ID NO: 381512 - RNA, 63 nt, Human
cagcuaagcauaguaagaaguccagccuaggaagggaaggauuuuggagguagguggcuuugg

SEQ ID NO: 381513 - RNA, 63 nt, Human
caggcccugggaggcucagccaccuccucuugugggaaggaggucucagccccaccucgcauc

SEQ ID NO: 381514 - RNA, 63 nt, Human
cuccacucccgaguggccacaggcucgcgggcugggaaggauucacucucuuuagccccaggg

SEQ ID NO: 381515 - RNA, 63 nt, Human
ccuuguguuuccagcggccucugauaagaggcagggaaggaccugaaggauuuggaguugauu

SEQ ID NO: 381516 - RNA, 63 nt, Human
ucauuuguaagaauagcuacacacuaacauuuugggaaggagaggcacauaacuuuuuuuaac

SEQ ID NO: 381517 - RNA, 63 nt, Human
cacugagauuuuaaaaauuucaccuuuauucgagggaaggaucaaugcuuauuaccauuugga

SEQ ID NO: 381518 - RNA, 63 nt, Human
auccggggacccacuguugcccuggaccucagcgggaaggagcaggagagagcugcugucagu

SEQ ID NO: 381519 - RNA, 63 nt, Human
ucuccaugugcauuggggacaguuuuuauaagugggaaggacucaguauuauuauauuugaga

SEQ ID NO: 381520 - RNA, 63 nt, Human
agagagggagcuggcggugcccagcgcaagggcgggaaggaggggcccaggcugcggagaacc

SEQ ID NO: 381521 - RNA, 63 nt, Human
guuuuuaaaaugacuacccagaagggcacaagggggaaggaaaugguauuuguauauguauau

SEQ ID NO: 381522 - RNA, 63 nt, Human
auuguaaauaaauuaaacuuuucugguuucugugggaaggaaauagggaauccaauggaacag

SEQ ID NO: 381523 - RNA, 63 nt, Human
cacgacccuucuuaagacauguaucacuguagagggaaggaacagaggcccugggcccuuccu

SEQ ID NO: 381524 - RNA, 63 nt, Human
gcccuugcuugacucaguuucccuccuuugaaagggaaggagcaaaacggccauuugggaugc

SEQ ID NO: 381525 - RNA, 63 nt, Human
ucggggugggggcgucaggugagaacguuugcugggaaggagaggacuuggggcauggccucu

SEQ ID NO: 381526 - RNA, 63 nt, Human
cuaaguuauucaucuccucuccgccugcugcucgggaaggacagacgccggccgcccgcccgc

SEQ ID NO: 381527 - RNA, 63 nt, Human
caccuggcccaguccacguugagguccaggacugggaaggaccgggugagugcaccggggacc

SEQ ID NO: 381528 - RNA, 63 nt, Human
ugcccuucccuggcugacccagucgggaagguagggaaggaggucucccguugggagagucuc

SEQ ID NO: 381529 - RNA, 63 nt, Human
gucucccaccagcggggcccuccuggcaggguagggaaggaggaccccgggcaccccccucag

SEQ ID NO: 381530 - RNA, 63 nt, Human
gugugugugcccaggugggggugucuccuggcugggaaggagggaaagggagggagaguuuug

SEQ ID NO: 381531 - RNA, 63 nt, Human
ccuuccucccccugaccccgccccggccuucuggggaaggaacaaaguccccaaacaaagcaa

SEQ ID NO: 381532 - RNA, 63 nt, Human
gucucguuucuuugccccugaagucaguuucaggggaaggaugugaaauuuuuccguguagag

SEQ ID NO: 381533 - RNA, 63 nt, Human
gccuuaggagaauuguuuuguuucacaaaagcugggaaggaagaaguccauucugcagcuguu

SEQ ID NO: 381534 - RNA, 63 nt, Human
ugcucucuggagguacugagacagggugcugaugggaaggaggggagccuuuggggggccacc

SEQ ID NO: 381535 - RNA, 63 nt, Human
aggcccugggcaggauguucacucuauuuauuggggaaggagggaggggggggacacuuaacu

SEQ ID NO: 381536 - RNA, 63 nt, Human
ugggaggggcggggcuaagaaugggggcagugggggaaggaaggggagaggugguuagaggga

SEQ ID NO: 381537 - RNA, 63 nt, Human
ggagcgucccugaagcccccagcccuggggauggggaaggacauggagccugagccagagaac

SEQ ID NO: 381538 - RNA, 63 nt, Human
ggagaguccccaaggcccccagcccuggggauggggaaggacaugaagccugagccagagaac

SEQ ID NO: 381539 - RNA, 63 nt, Human
gggaucuagggcccugggaggagguugagccuggggaaggaaaaagcaggaaacugaaggaag

SEQ ID NO: 381540 - RNA, 63 nt, Human
gcuggggaugcaccaaugaaccccacaggaagggggaaggaaggagggaauuucacauucccu

SEQ ID NO: 381541 - RNA, 63 nt, Human
cuucucauccacccucuggcacccagccucugagggaaggagggauggggcauagugggagac

SEQ ID NO: 381542 - RNA, 63 nt, Human
guccugcagaggcccuaccacugcgaggccugcgggaaggacuuccucuuuacacccacagag

SEQ ID NO: 381543 - RNA, 63 nt, Human
uggggagggacugaaggaugcaugcaagguucugggaaggagugagaaguagugaaggccaag

SEQ ID NO: 381544 - RNA, 63 nt, Human
gggcgcccgcaguggacaggacccgcguggguugggaaggaaagcaguggaacuggccggacc

SEQ ID NO: 381545 - RNA, 63 nt, Human
gcggagagcgcugaaccuggacaagcagcggcugggaaggacagguccaauaaacgcccucug

SEQ ID NO: 381546 - RNA, 63 nt, Human
acccaaagguccugacgguugcguccgggggaggggaaggaagggccgcugucgccaagguuu

SEQ ID NO: 381547 - RNA, 63 nt, Human
gcaggaaggaauggggggccccagccccaggccgggaaggagccagcggccgacaaagcagaa

SEQ ID NO: 381548 - RNA, 63 nt, Human
caaggccaacagggcaggggaggggaagaccuggggaaggaagaaugaggacagucccgucgu

SEQ ID NO: 381549 - RNA, 63 nt, Human
cugagcguuccagguaaacugaggcucggggaggggaaggacaggcuggccucuccuucacug

SEQ ID NO: 381550 - RNA, 63 nt, Human
gccaggcagaggucucaucugaaggccugaucggggaaggauuugcuucuuagaagcucaugu

SEQ ID NO: 381551 - RNA, 63 nt, Human
ugggccucacccggagcagacgagggcagggcugggaaggauggggagggacauagaggauuc

SEQ ID NO: 381552 - RNA, 63 nt, Human
cccagcuguccagagaagggggauucuggaacugggaaggacugauccccagaagcgauggcu

SEQ ID NO: 381553 - RNA, 63 nt, Human
agcgccaaccuuccuuucggaguaauccugccugggaaggagagauuuuuagugacauguuca

SEQ ID NO: 381554 - RNA, 63 nt, Human
ugacaugaaauugcauggucgagggagucuguggggaaggaagcccagguccuggcugcaacc

SEQ ID NO: 381555 - RNA, 63 nt, Human
acaugccuguagucccagcuacucaggaggcuggggaaggaagaucacuuaaggccaugaguu

SEQ ID NO: 381556 - RNA, 63 nt, Human
ccagggcugaggucucaucugaaggcucaacuggggaaggauccacauccagacuaacauagu

SEQ ID NO: 381557 - RNA, 63 nt, Human
aagcugaagaugccuuccuuugggcuggcucgagggaaggaagcagaaguucaaggugaucgu

SEQ ID NO: 381558 - RNA, 63 nt, Human
ggagcguccccaaagcucccagcccuggggacggggaaggacauggagccugagccagagaac

SEQ ID NO: 381559 - RNA, 63 nt, Human
ucaggaauccuguggggaaggggggugauuauagggaaggacgcaggcauuccuaggucccca

SEQ ID NO: 381560 - RNA, 63 nt, Human
ggacagagaagggacgggguggcugggcagucagggaaggagggucgcccggauccgacauuu

SEQ ID NO: 381561 - RNA, 63 nt, Human
cagaacauguugugugcuggggaugagaaguacgggaaggauuccugccaggugaggugaccc

SEQ ID NO: 381562 - RNA, 63 nt, Human
ggauggcugggcuauggguccugcccuugagcagggaaggaacuuacugucuaauauaggaaa

SEQ ID NO: 381563 - RNA, 63 nt, Human
uuucaggacagagugcacaguuuccucuccugugggaaggagaguugacucuugaggaccccc

SEQ ID NO: 381564 - RNA, 63 nt, Human
agcaugguuucaggaguuuauuuuaagacugcugggaaggaaacaggccccauuuuguauaua

SEQ ID NO: 381565 - RNA, 63 nt, Human
agcugcaccccucccuuccuggagggauggccagggaaggagaaaacagagaacugacaccuu

SEQ ID NO: 381566 - RNA, 63 nt, Human
ugucucugccuucucugaugggacuggaguugagggaaggagcuguauuguggcacuucugaa

SEQ ID NO: 381567 - RNA, 63 nt, Human
augacaagagauuuugcguuugacauugugucugggaaggaagggccagaccuuggaaccuuu

SEQ ID NO: 381568 - RNA, 63 nt, Human
uggggaagacagcauuccacagccuggucaggagggaaggaccucacuuguuucaucaaaugg

SEQ ID NO: 381569 - RNA, 63 nt, Human
agagugcacugcaugauagcguucuggugagcugggaaggacccaccacugccacugaggauu

SEQ ID NO: 381570 - RNA, 63 nt, Human
agggguucuugagccagccaggcccugccaguggggaaggaggccaagcagugccugccuaug

SEQ ID NO: 381571 - RNA, 63 nt, Human
acgugaugccaggaccagucccagagcaggaaugggaaggaugaagggcccgagaacauggcc

SEQ ID NO: 381572 - RNA, 63 nt, Human
gccaccuacugccccaccucagagaagugcagcgggaaggaggcuggagguggugcggcgcug

SEQ ID NO: 381573 - RNA, 63 nt, Human
cuugcugccuuaucgucugcaaguguucuccaagggaaggaggaggaaacugugguguuccuu

SEQ ID NO: 381574 - RNA, 63 nt, Human
cacugugaggagagggguugccccagaaggcaggggaaggaccugaugagaacagaauagcug

SEQ ID NO: 381575 - RNA, 63 nt, Human
gugccauguaaauccccacugggaccaacccuggggaaggagccaguuugccggauacaaacu

SEQ ID NO: 381576 - RNA, 63 nt, Human
cuacaucuuguuuucuaggaagagggggaugcugggaaggaaugggugcuuugugauggauaa

SEQ ID NO: 381577 - RNA, 63 nt, Human
ccacuguacaaaugacacugcacuaggauuauugggaaggaaucauuguuccaggcauccauc

SEQ ID NO: 381578 - RNA, 63 nt, Human
uuugccaugggccugcugcgucagaccaguacugggaaggaggacgguuguaagcaguuguua

SEQ ID NO: 381579 - RNA, 63 nt, Human
auaaaauuggaacgaagaaagguuaggagaguagggaaggaacaggacugcaaaaauccuucu

SEQ ID NO: 381580 - RNA, 63 nt, Human
uaauuuggcacccuuccaaccugaguauuguaggggaaggaaauuuacaagauuuaauaggaa

SEQ ID NO: 381581 - RNA, 63 nt, Human
cccgccuuucccuguucccuucuaagcacguuugggaaggaacagccuaaagaugcuuuguaa

SEQ ID NO: 381582 - RNA, 63 nt, Human
acauguggggugcccucuguaggccuucacacagggaaggaagcccuacccuuucaacuccug

SEQ ID NO: 381583 - RNA, 63 nt, Human
ucugucucuuuuccuuaaaauuggggguaaggagggaaggaagagggaaagagaugacuaacu

SEQ ID NO: 381584 - RNA, 63 nt, Human
ccugcuaggcaugcaggggcuggcgguuggcaggggaaggaggcccagugagccgggucccuu

SEQ ID NO: 381585 - RNA, 63 nt, Human
uggcuaccgcuaggaggcugagcaagccaggaagggaaggagucugugugguguguaugugca

SEQ ID NO: 381586 - RNA, 63 nt, Human
gagaucacagccuccagggccccccaaaucccagggaaggacuuggagagaaucaugcuguug

SEQ ID NO: 381587 - RNA, 63 nt, Human
ucuccacacucauuucagagccuccuaugguuugggaaggaauaacacacuggcccauuagua

SEQ ID NO: 381588 - RNA, 63 nt, Human
gagagaaagggcuuccaggccccuccaagccuggggaaggacguggcauccaagcugagccag

SEQ ID NO: 381589 - RNA, 63 nt, Human
aaacucuucagcgggguagcaucaaaguucuuggggaaggaucguauaugugggucccuuccc

SEQ ID NO: 381590 - RNA, 63 nt, Human
aucucugggccaagaucacaugcaggauaccaugggaaggagccaucuccacucuccuucucc

SEQ ID NO: 381591 - RNA, 63 nt, Human
aacaggagucagcaaucaaagaugaguccuggagggaaggaggaugaguccugggaggaagua

SEQ ID NO: 381592 - RNA, 63 nt, Human
ccuuucacagccggucucucugccaggaaaugggggaaggaacuagaaccaccugcaccuuga

SEQ ID NO: 381593 - RNA, 63 nt, Human
ggcaacccucagcugccucaucguggcugggaagggaaggaagcaagccggcagaaauagcua

SEQ ID NO: 381594 - RNA, 63 nt, Human
aaaugcaaaaacucuuugagaggguaggagggugggaaggaaacaaccaugucauuucagaag

SEQ ID NO: 381595 - RNA, 63 nt, Human
aagauggaaggccuuuugcccguugagguagaggggaaggaaaucuccucuuuuguacccaau

SEQ ID NO: 381596 - RNA, 63 nt, Human
agagguccucaguguguuuuuggucugguuguagggaaggacucaaguccuggaauguccucc

SEQ ID NO: 381597 - RNA, 63 nt, Human
cagggaaaggugcccccacuccccgagagccaggggaaggaguggcucugggcagagagggac

SEQ ID NO: 381598 - RNA, 63 nt, Human
ucaagaggaaugaaaaaagcuuuacuggggcuggggaaggaagccggggaagagauccaaaga

SEQ ID NO: 381599 - RNA, 63 nt, Human
agaagguacauuuucuuucuacucugaugcauggggaaggauguuuuuggacauuaucaacug

SEQ ID NO: 381600 - RNA, 63 nt, Human
gauguuaaauuaacucacuaugguuuuucaccugggaaggaaacaaauuacguacuagagggc

SEQ ID NO: 381601 - RNA, 63 nt, Human
agggcauugacugguuaaaaacuuguguaucccgggaaggaccugcgguacaggagucagcca

SEQ ID NO: 381602 - RNA, 63 nt, Human
acaccuucugugcucauguuuggaaagcugaaagggaaggacagcugugcccuccugggagcu

SEQ ID NO: 381603 - RNA, 63 nt, Human
uccugaugauucauggaguuugccccuuccuaagggaaggagaucuuuaucuuucugguuggc

SEQ ID NO: 381604 - RNA, 58 nt, Human
ugguuuguuauugcagaugaaguggaaagggaaggaccucuuugauuuggugugccgg

SEQ ID NO: 381605 - RNA, 63 nt, Human
ugucugucugugucugcauguaagagugagggagggaaggaaggaacuacaagagagucggag

SEQ ID NO: 381606 - RNA, 63 nt, Human
auaggggccgcccaccuucagcugcccugggaugggaaggacccagcccgaccccugggcaua

SEQ ID NO: 381607 - RNA, 63 nt, Human
gagggagagagaaggugacacggauggaagagugggaaggagcuggccuggcucagcccuagg

SEQ ID NO: 381608 - RNA, 63 nt, Human
agaauccucggggcggucaggggaugucaggaggggaaggagccgcccucccuaucuugcugc

SEQ ID NO: 381609 - RNA, 63 nt, Human
auuccagcgggccccucucuuuaccuuuguugggggaaggaggcaagagagaaauuccuucuu

SEQ ID NO: 381610 - RNA, 63 nt, Human
uagucuugaggcccagccuaggaugguagucaggggaaggagcgagauuccaacuucaacauc

SEQ ID NO: 381611 - RNA, 63 nt, Human
uguguccuccccagcuucaugccucugucaugggggaaggaauagcuuauguucugcucuggu

SEQ ID NO: 381612 - RNA, 63 nt, Human
gucccaugaccagcauuaugaaaaugcgagagugggaaggacacagugugagacuuccacuag

SEQ ID NO: 381613 - RNA, 63 nt, Human
aaagucacucgacauuggucucuuguguugauagggaaggaaaucaggcauuccuauuucuuu

SEQ ID NO: 381614 - RNA, 63 nt, Human; identical to SEQ ID NO: 381610

SEQ ID NO: 381615 - RNA, 63 nt, Human
gcgugggaugcuguagcccccgggguugggcaagggaaggaugguggcccuccagaggucaug

SEQ ID NO: 381616 - RNA, 63 nt, Human
aggugaggucugaggacagcaggccuucccuaggggaaggagcugggagugccaaggccccag

SEQ ID NO: 381617 - RNA, 63 nt, Human
uccuggcuucccuugggcuccucagagcuaguggggaaggaggcagucuaggcuguuuugaag

SEQ ID NO: 381618 - RNA, 63 nt, Human
gaacuugcucugaacugcacccaggaggugacugggaaggagaaaaccagcaaaggaagcucu

SEQ ID NO: 381619 - RNA, 63 nt, Human
aggggugagguucuuggccucagcuccucccuggggaaggaacuagucuuucuccaagaagaa

SEQ ID NO: 381620 - RNA, 63 nt, Human
auggacgugaggacguguccagcucugcucugugggaaggaguuggaauguucgacagcagug

SEQ ID NO: 381621 - RNA, 63 nt, Human
uggagaaacgcccuccagucugagagcaggggagggaaggaggcagcagaguuggggcagcug

SEQ ID NO: 381622 - RNA, 63 nt, Human
ucuuggggaggcagagaagccaccuucaggccugggaaggaagacacugggaggaggagaggc

SEQ ID NO: 381623 - RNA, 63 nt, Human
auaugcagucugggaggccccacugcucucacugggaaggaccaauguugcaccucuguuaau

SEQ ID NO: 381624 - RNA, 63 nt, Human
gauagaaugguuuccacugaggacauucagccugggaaggaggaagucaccagcucgaggcgu

SEQ ID NO: 381625 - RNA, 63 nt, Human
caccaucaccuuugaaagugcuuguuugggggagggaaggacauacggguaacuagaacuacc

SEQ ID NO: 381626 - RNA, 63 nt, Human
uacucuuuuagucaggauuucggucuuuucugcgggaaggaauuaagcuauguauuaggucca

SEQ ID NO: 381627 - RNA, 63 nt, Human
gucacguggcucccccuagccgcacacuagugugggaaggaaaauauugagcuaggcacauua

SEQ ID NO: 381628 - RNA, 63 nt, Human
ucuacuaccccuaguguagcuuugacagagccugggaaggagagacgaggaggcaugccuuca

SEQ ID NO: 381629 - RNA, 63 nt, Human
gccuuucccaucugucuaucuaucuggcuggcagggaaggaaagaacuugcauguuggugaag

SEQ ID NO: 381630 - RNA, 63 nt, Human
cuucuccacauguuggguguccauccuggggcagggaaggacagaguguuggauggcugggac

SEQ ID NO: 381631 - RNA, 63 nt, Human
gauuacaacucagcuauaauccugagggaacaugggaaggaaucaaagguaaagcccauucag

SEQ ID NO: 381632 - RNA, 63 nt, Human
acgaguucagcccauuguacgugcaggucccgugggaaggaggcaaaagccccugcuucuuac

SEQ ID NO: 381633 - RNA, 63 nt, Human
cgccugcuucucccaucgccugucuggcuggcagggaaggaaaauagcuugaauguuggugaa

SEQ ID NO: 381634 - RNA, 63 nt, Human
augggcaacuuucgccccuguggggaggggacggggaaggaagaaagaauuuaaaggaccgga

SEQ ID NO: 381635 - RNA, 63 nt, Human
ucaacuagaaucauagaguucuggauguaaagcgggaaggacauuacagaccauggauauguu

SEQ ID NO: 381636 - RNA, 63 nt, Human
auaugcccaccccugccaaaagcccugaccccagggaaggaggcugcucacccagccuuggcc

SEQ ID NO: 381637 - RNA, 63 nt, Human
gggaagggacugggaggggagagaagagaaggagggaaggauuuaggaugguaaaguuaggua

SEQ ID NO: 381638 - RNA, 63 nt, Human
uccauuuauugcuuuugguauaauuuuucccuggggaaggaggggaaauuaugaaagaacuag

SEQ ID NO: 381639 - RNA, 63 nt, Human
ucuuuaucauuccaguggguaggguuuagcugggggaaggacauuucauaaggguuaguugga

SEQ ID NO: 381640 - RNA, 63 nt, Human
gcugagguuggcucuuagcucauugcuggggaugggaaggagaagcaguggcuuuugugggca

SEQ ID NO: 381641 - RNA, 63 nt, Human
gccugugucuagagcucugggccucagggguaagggaaggaagccagccuuucagcaccccuu

SEQ ID NO: 381642 - RNA, 63 nt, Human
aagcagcaguggcagcuugggaaaugugaggaagggaaggagggagagacgggagggaggaga

SEQ ID NO: 381643 - RNA, 63 nt, Human
uccaccuaugucuuuguaucuacauucuugacggggaaggaacuuccucugggaaccuuuggg

SEQ ID NO: 381644 - RNA, 63 nt, Human
agccaaaauguuucccgguguuugcugguuucagggaaggaguuugauauagcagauuaacca

SEQ ID NO: 381645 - RNA, 63 nt, Human
cccucugcccuacccgcucagcaacauagaagagggaaggaaagagagaaggaaagagagaga

SEQ ID NO: 381646 - RNA, 63 nt, Human
acgcaaacugcgccugcuccugaaaagcucucugggaaggaaugggccuggcuuuccguuccu

SEQ ID NO: 381647 - RNA, 63 nt, Human
gcucauuagcuggcuacaugcuucgcaggaagugggaaggacucacaucauaaaaaggaccau

SEQ ID NO: 381648 - RNA, 63 nt, Human
caauuguucaguuggaagacguauuaauauuuggggaaggaaaagaaaguaguuguuuuacaa

SEQ ID NO: 381649 - RNA, 63 nt, Human
gagucaucucuuccuauauuugguggggugggugggaaggaagggauuugggggggaaucuuc

SEQ ID NO: 381650 - RNA, 63 nt, Human
auucuggugagaagaaccuuacuuccauaauuugggaaggaauggaagauggacaccaccgga

SEQ ID NO: 381651 - RNA, 63 nt, Human
cugccccugugggacucauccuugcccaggugagggaaggagacaggaugaggucucgacccu

SEQ ID NO: 381652 - RNA, 63 nt, Human
ugcuuuuucuuaaacuuggccaauuuggaaagggggaaggagccaccccaaaacggugguuca

SEQ ID NO: 381653 - RNA, 63 nt, Human
accuggaccccagugagaggcggugggcugacugggaaggagaggcccccaaccuccucagga

SEQ ID NO: 381654 - RNA, 64 nt, Human
cccauugcucuccuccaggggcagaacauggggaggggacuagaugggcaaggggcagcacugc

SEQ ID NO: 381655 - RNA, 64 nt, Human
uuuaccccacagcuuaguggccaguaaacacccuggggacuaggaaaaggaaccaacuguaggc

SEQ ID NO: 381656 - RNA, 64 nt, Human
gucugagggauaauaauuuaauuguucuagacaaggggacuauagggacugacuguuauuaaaa

SEQ ID NO: 381657 - RNA, 64 nt, Human
cugcccaacccucauccccaucuucucaggggcaggggacuaccuuccagugucucccuccagc

SEQ ID NO: 381658 - RNA, 64 nt, Human
cacacacacacacacacacacacacacucuuuuaggggacuaagagagagaagcauguuauuac

SEQ ID NO: 381659 - RNA, 64 nt, Human
cuggcaguugaaaucucuggaagagggaacauguggggacuacucagaggcaaagaggagcugc

SEQ ID NO: 381660 - RNA, 64 nt, Human
uuuauuuuuguauaauuuaaggaagguaaaguuaggggacuagaagacucuaaauuggcuucua

SEQ ID NO: 381661 - RNA, 64 nt, Human
uauagaauugaagguucuuaucagaugggauacuggggacuauaaacaauggaaauaaagccac

SEQ ID NO: 381662 - RNA, 64 nt, Human
uguuuuaagucuucauggauguucugcaugucauggggacuaaaacucacccaacagaucuuuc

SEQ ID NO: 381663 - RNA, 64 nt, Human
cacucucuuccuuggguguuuggugcuggcuccuggggacuacaaaucccagagugcggugugc

SEQ ID NO: 381664 - RNA, 64 nt, Human
agcccaggagagagaaagccaggcagguagccagggggacuagccccuguggagacuggggggc

SEQ ID NO: 381665 - RNA, 64 nt, Human
gacccuugguaaaccccugauucgggguggggugggggacuaggcucagccggaaccagcaccu

SEQ ID NO: 381666 - RNA, 64 nt, Human
gccuggagaguguucuugucucuagcagcugguuggggacuauauucugucacuggaguuuuga

SEQ ID NO: 381667 - RNA, 64 nt, Human
cuuggaaagguagucaucaaaugagacuauuugaggggacuauuugaaaugauucugguauuuc

SEQ ID NO: 381668 - RNA, 51 nt, Human
cucggauaccaugguccuagaggggacuacccaaggauggagcuccguggg

SEQ ID NO: 381669 - RNA, 54 nt, Human
ucggugaggcaccccuguaacccuggggacuaggaggaagggggcagagagagu

SEQ ID NO: 381670 - RNA, 64 nt, Human
caucaccugagcaaccaaaaauuccucugcgcugggguccgacugcccucugguggccauuugg

SEQ ID NO: 381671 - RNA, 64 nt, Human
uauacaaaagacaugauagagaaaagaugagagaggggacuaauuauuuuguuuaugaaaaugg

SEQ ID NO: 381672 - RNA, 64 nt, Human
gguguguuuuggggcauuuguggaacuuacccauggggacuaauauggaaaaggucuguccaua

SEQ ID NO: 381673 - RNA, 64 nt, Human
aacuuuuaugagagagauccuggacuucuuuuugggggacuauuuuuguacagagaaaaccugg

SEQ ID NO: 381674 - RNA, 64 nt, Human
ccagcgacccugugacaccggucugcagggaguuggggacuaagggcuuccagagaguggcugg

SEQ ID NO: 381675 - RNA, 64 nt, Human
auggccuuguugcuggcaucccggccaggugggcggggacuaacaaagacagcuguuuaggguc

SEQ ID NO: 381676 - RNA, 64 nt, Human
gaaauagugguuguggaacaguagaaaaccauauggggacuauagugcaaccuauuuggguaaa

SEQ ID NO: 381677 - RNA, 64 nt, Human
cugccuucuugggauacuaagacuugaauuuuuuggggacuauuaaggguguuagucuuggaga

SEQ ID NO: 381678 - RNA, 64 nt, Human
auacauuguuauauguaccccaguuguuguuaguggggacuaugauacuguaauaauauuuuua

SEQ ID NO: 381679 - RNA, 64 nt, Human
ugaaccuucggaucuaugaaagaaaauauaguagggggacuaaggaacauagaauuuuauuagc

SEQ ID NO: 381680 - RNA, 64 nt, Human
cuauaucuuguucugaacaacacacugugauaaaggggacuagaguggaagauucccuauuuaa

SEQ ID NO: 381681 - RNA, 64 nt, Human
ucggguggccaacuugcuaucuggugggugacuuggggacuagaaagaauaaagccuuuucuaa

SEQ ID NO: 381682 - RNA, 64 nt, Human
auggaggagcuugggggaugacuagaggcagggaggggacuauuuaugaaggcaaaaaaauuaa

SEQ ID NO: 381683 - RNA, 64 nt, Human
ucaucauugcucagcuccucagagugggccgggaggggacuagaagagcugcaugaugguggcu

SEQ ID NO: 381684 - RNA, 64 nt, Human
uucuacugcuuacacuuuagaauguuuauuuuauggggacuaagggauuaggagugugaacuaa

SEQ ID NO: 381685 - RNA, 64 nt, Human
auggaaaccaaggaaagugaaacuuuggauaaguggggacuaguguauuuauauauuuaauuga

SEQ ID NO: 381686 - RNA, 64 nt, Human
ggaggggcgaagcuuuggugacagacggagagugggggacuagcugugcauggcaccugcucug

SEQ ID NO: 381687 - RNA, 64 nt, Human
cccugagccgggccuucuagucguagugccuucaggguccgaggagcaucaggcuccugcagag

SEQ ID NO: 381688 - RNA, 64 nt, Human
ugugugauguagcuuucucucccucagccugcaaggguccgauuugccaucgaaaaagacaacc

SEQ ID NO: 381689 - RNA, 64 nt, Human
cuuagucccuguuauccaguagggguggguauuuggguccgacugagacuuggccugugaccau

SEQ ID NO: 381690 - RNA, 64 nt, Human
ucauaucaucacauugagcugauauaaauucuguggguccgauaauaucuuugugauaauuuaa

SEQ ID NO: 381691 - RNA, 64 nt, Human
agaggcucaaaugcuguccccggcagcuuuccugggggacuagagcuccuucuggccauguuau

SEQ ID NO: 381692 - RNA, 64 nt, Human
gaauguuuaugucuucaagugaccuguacugcuuggggacuauuggagaaaauaagguggaguc

SEQ ID NO: 381693 - RNA, 64 nt, Human
agaaaauuguuaggauuuuggaguauuuggggagggggacuacuggaaugcuguccaaguuuua

SEQ ID NO: 381694 - RNA, 64 nt, Human
cuccaaaggccccaccuccuaauaccaucacucuggggacuaggugucagcaugugaauuuugg

SEQ ID NO: 381695 - RNA, 64 nt, Human
gggaaagcaaagaagcugcuuuaaaaaauaaaaaggggacuaaaaauuuguuuuguauaaagag

SEQ ID NO: 381696 - RNA, 64 nt, Human
auugccaacuaggcaggcacaaaucuugggucuuggggacuaacccaaugccugugaagcaguc

SEQ ID NO: 381697 - RNA, 64 nt, Human
uggugacugauggauggguagugggcugagaagaggggacuaggaagggcuauuccaggcucag

SEQ ID NO: 381698 - RNA, 64 nt, Human
gcaaaucacauggccaagucuagagucagaaugaggggacuacacaagcugacagcggauggua

SEQ ID NO: 381699 - RNA, 64 nt, Human
cauggcaauaaauauucuagcaucccuaacuaaaggggacuagacaguuagagacucugucacc

SEQ ID NO: 381700 - RNA, 64 nt, Human
gguuuccugcaccccaaagugagccgcacucucaggggacuagccaccuccuucuuaagagggu

SEQ ID NO: 381701 - RNA, 64 nt, Human
ugccacuggggcuuugauuuggaggaauggggcaggggacuaucugaagcgcuuccauccuaaa

SEQ ID NO: 381702 - RNA, 64 nt, Human
cggacgcagcggcuucgggaacaaguuagcgcugggggacuaucugggcucgucucucucugcu

SEQ ID NO: 381703 - RNA, 64 nt, Human
uuaccaaguugccuuuugccacuguagcugaccaggggacuagguuguagaggugggaaggccc

SEQ ID NO: 381704 - RNA, 64 nt, Human
ugaggaguacccccagcccaagagaugaacaucuggggacuaauaucauagacccaucuggagg

SEQ ID NO: 381705 - RNA, 64 nt, Human
cagaacacuaaucagauuucaaggcccacaacuuggggacuagaccaccuuauguugagggaac

SEQ ID NO: 381706 - RNA, 64 nt, Human
acaauuuuaaauaagauggagaauaaauuauugaggggacuaggcuauaugcauuugccuucau

SEQ ID NO: 381707 - RNA, 64 nt, Human
ugggacucaguggugguguugugacuuugaccuaggguccgagugucacagcugaucuuggcac

SEQ ID NO: 381708 - RNA, 64 nt, Human
agaaggagagccaggugugccgagaccauccuaaggguccgaugugacagcaagcaagugaaau

SEQ ID NO: 381709 - RNA, 64 nt, Human
ucaucccucuugugucaucacugggguuagagguggguccgaaauaaucuucuguguccuucag

SEQ ID NO: 381710 - RNA, 64 nt, Human
guccucguggcggggcagcaggagcgguagaaagggguccgauguuugaggaggcccuuaaggg

SEQ ID NO: 381711 - RNA, 64 nt, Human
ccuguuccaaucuucugccucccagucacucccuggggacuaugggaucacuguccccccaccu

SEQ ID NO: 381712 - RNA, 64 nt, Human
uuauaagugagagaaaugaaguuuauauuaucaaggggacuaaagucacacggcuugugggcac

SEQ ID NO: 381713 - RNA, 64 nt, Human
uucuugaggacagggacuucggcauuuacuaaugggggacuacugugggguaagggggcgccug

SEQ ID NO: 381714 - RNA, 64 nt, Human
cuggggucaggccagaccauguuucgucagccuuggggacuaggccaguguugggcaccuccag

SEQ ID NO: 381715 - RNA, 64 nt, Human
aaguaucuguuaucuccugcguaguaccaagguaggggacuaguggaucuuaucauaguuuugg

SEQ ID NO: 381716 - RNA, 64 nt, Human
ugagcaguucuacaaaagaauggccagcacgagcggggacuagaggguccugauuuugugucug

SEQ ID NO: 381717 - RNA, 64 nt, Human
uguggggaacgggggcucuugaagccagguagcuggggacuauggugucugcccuuccaaucac

SEQ ID NO: 381718 - RNA, 64 nt, Human
gugagaggaagggugggucuguaagaccuugguaggggacuaauucacuggcgaggugcggcca

SEQ ID NO: 381719 - RNA, 64 nt, Human
uucagcagcuugcccagcucuugaguacagugguggggacuaaaaaugugggcauguggagagg

SEQ ID NO: 381720 - RNA, 64 nt, Human
acuuaagucucagacugauuucuugcgggaggagggggacuaaacucaaccuaacacauuaaau

SEQ ID NO: 381721 - RNA, 64 nt, Human
ccagggaacuuccaaggaaggagccugagccacuggggacuaagugggcagaagaaacccuugg

SEQ ID NO: 381722 - RNA, 64 nt, Human
agauuacauuuugaaaaggaaaucuagcaugugaggggacuaaguguucucagagugauguuuu

SEQ ID NO: 381723 - RNA, 64 nt, Human
agucuaucugcagagguauucaguuccuggcacaggggacuaggggcauguagaguauaugagg

SEQ ID NO: 381724 - RNA, 64 nt, Human
ucccucucuauuuucagguuugcagagcaugccaggggacuacguuucucagggugguccuaug

SEQ ID NO: 381725 - RNA, 64 nt, Human
cuuugaugauguucccagccauacuccagucaacggggacuacuagucccucacucuuagguuu

SEQ ID NO: 381726 - RNA, 64 nt, Human
acggacucccgggcugggcuuuugaauuggccuuggggacuacucggcucucacucagcuccca

SEQ ID NO: 381727 - RNA, 64 nt, Human
gcucccagcagccgguagggaaagguguuuccagggguccgagggccguggccugcguggccau

SEQ ID NO: 381728 - RNA, 64 nt, Human
auggaucuuucuccccaaggagggacgucuugagggguccgagccucaggccaaggaccccuga

SEQ ID NO: 381729 - RNA, 64 nt, Human
auguccugauuucauauaguagaaaacaaacauuggguccgacuucaaaauguguuguauuguc

SEQ ID NO: 381730 - RNA, 64 nt, Human
ucugcccaccacuguccccuugcugauggcauggggguccgaccaggcacugacaccgcaggca

SEQ ID NO: 381731 - RNA, 64 nt, Human
uauuacugaaagcuaaauccucaaaaccuaguaaggggacuaaugauucauuaaaguaaauuga

SEQ ID NO: 381732 - RNA, 64 nt, Human
uucaacaauaagucaguucuaguggcugucgccuggggacuagugagaaagcuacucuucuccc

SEQ ID NO: 381733 - RNA, 64 nt, Human
gaaggacuauggacucuuguuguguggaauggaaggggacuagccagcucucugcauggcacau

SEQ ID NO: 381734 - RNA, 64 nt, Human
auucuucggaggagguggacauuucggaagugguggggacuaagggaagaacucucuaguuccc

SEQ ID NO: 381735 - RNA, 64 nt, Human
ggaaggauaguucuguguacuccuuuagggagugggggacuagaacugggaugucuuggcuugu

SEQ ID NO: 381736 - RNA, 64 nt, Human
acaacaaauuucugcucaacugacucaucuuuugggggacuaauuuaauuugcugcugacagcc

SEQ ID NO: 381737 - RNA, 64 nt, Human
acaacaacuuucugcucaacugacuuaucuuuugggggacuaauuuaauuugcugcugacagcc

SEQ ID NO: 381738 - RNA, 64 nt, Human
aagccaagagggaaagccagaguucccuguucuaggggacuagccaaaugccuacaucagcugu

SEQ ID NO: 381739 - RNA, 64 nt, Human
ccccaccacgucaugauggauggggcaaggugguggggacuaggggagccugguauacaugcgg

SEQ ID NO: 381740 - RNA, 64 nt, Human
aguaagcagagcugccaggcucccaggagagcauggggacuaggaggaaggguguggcauggcu

SEQ ID NO: 381741 - RNA, 64 nt, Human
auccugccaccaccuucucuucucuugucacuagggggacuaggggguccccaaaguggcccac

SEQ ID NO: 381742 - RNA, 64 nt, Human
ccggcucugcccaccaccacugccaggcugaacaggggacuagugcccaggugacacugcacac

SEQ ID NO: 381743 - RNA, 64 nt, Human
auuauucuucucauguuaaacccaccaaaauaaaggggacuaaauagguaaugauuuuccuagu

SEQ ID NO: 381744 - RNA, 64 nt, Human
uguguccucauuauagcaaaggguuacuggugcaggggacuaggaaaaacccguccaguguggu

SEQ ID NO: 381745 - RNA, 64 nt, Human
cacccccagcccugucccugccaccccuccuaguggggacuagugaaugacuugaccugugacc

SEQ ID NO: 381746 - RNA, 64 nt, Human
cccugcgccugggggcugggguaggcgaggccguggggacuacccauuuuauagcuggggaaac

SEQ ID NO: 381747 - RNA, 64 nt, Human
ccaccccccacccaccaccuggggcuuccucuggggguccgagggucuucccaucacaugaaga

SEQ ID NO: 381748 - RNA, 64 nt, Human
guggaugugugugcaugaaucugucauauagaggggguccgagcuggaauccuagagcauugcu

SEQ ID NO: 381749 - RNA, 64 nt, Human
accagcugcugcuggagauucaaagcccaacuguggguccgagagggaagcuggcugggcuggc

SEQ ID NO: 381750 - RNA, 64 nt, Human
cccacugcccuaggcucuuaaauacucauugggaggguccgaguccuuaccuggccuagccccc

SEQ ID NO: 381751 - RNA, 64 nt, Human
cccuggggacagaggucagccuaaggugacacacggggacuacugugcuuccggaggcucccug

SEQ ID NO: 381752 - RNA, 64 nt, Human
cuguucuuuuauuucuuuuucucuuugauugaaaggggacuacgucuuagcaggaaaaaaaacu

SEQ ID NO: 381753 - RNA, 64 nt, Human
gacccuccugccucagccuccugaguacccuccuggggacuacaggugcgugcuaccauaccca

SEQ ID NO: 381754 - RNA, 64 nt, Human
ugucccccaccugugguucuggccucugagguugggggacuacuuguuucccaccccagguucc

SEQ ID NO: 381755 - RNA, 64 nt, Human
cugcugcccauucuccauuucugugugugucaaaggggacuaacagcagaaucuaccucccaac

SEQ ID NO: 381756 - RNA, 64 nt, Human
cucccuugacucuggggguccacauccacuccaaggggacuauucccccgaccccaccccaguc

SEQ ID NO: 381757 - RNA, 64 nt, Human
gagacuggccccgucugaaccuucucugggcacuggggacuaagguugcaggccuuagccucgu

SEQ ID NO: 381758 - RNA, 64 nt, Human
caaaguggauaaacuaguacgagauauuuauggaggggacuaugagagguuuggacugccaggc

SEQ ID NO: 381759 - RNA, 64 nt, Human
aggcaugugccuucugccaccugacuuuccgugaggggacuaaaauuuacuaauuguaguugcu

SEQ ID NO: 381760 - RNA, 64 nt, Human
ucaauuuucauagaccuaauuugcaaacucaaucggggacuaaaauuucccacugaaaauguua

SEQ ID NO: 381761 - RNA, 64 nt, Human
cugccacuggcggcuucccuucuuggcucuugggggggacuagauccuguggagaagaugacuu

SEQ ID NO: 381762 - RNA, 64 nt, Human
ggggcugcuuacuucugggguauuggaaauguuuggggacuagguagaggugaauguacuaaau

SEQ ID NO: 381763 - RNA, 64 nt, Human
ugaaacaaacagucacaagcaaaggaagaggcugggggacuagaaagaggcccugcccucuaga

SEQ ID NO: 381764 - RNA, 64 nt, Human
ggagggaggcaggcugcagcuucagccacagaauggggacuauggaagacagcaggagcucauu

SEQ ID NO: 381765 - RNA, 64 nt, Human
cucucccaugugggaacccagccuccgaugccccggggacuaggggaaacaguuggagguucgu

SEQ ID NO: 381766 - RNA, 64 nt, Human
agagacacaugucuuacuuucagaauuuccacggggggacuaggagggcagcauugcuggggag

SEQ ID NO: 381767 - RNA, 64 nt, Human
agaggucuucggagaugccagaggagcccucuagggguccgaugccugggaggaccagaagcca

SEQ ID NO: 381768 - RNA, 64 nt, Human
cauaacgcguuagccaugaaggagucggagcccuggguccgaauggacccgccugcggucugca

SEQ ID NO: 381769 - RNA, 64 nt, Human
gaaaaggacuagguggcugccaacgcgcacgcucggguccgaggcugcuccccuggagcggcgc

SEQ ID NO: 381770 - RNA, 64 nt, Human
uugauguagcuuuaagucacacuagacugcagagggguccgaggccagaaaccccuguccugca

SEQ ID NO: 381771 - RNA, 64 nt, Human
cucccaucuguuuauucuuugggcucugggaacaggggacuacuuuggggcuuucuccagacuu

SEQ ID NO: 381772 - RNA, 64 nt, Human
aauggaccccuggguuccuugagagccuuucaggggggacuaugagaucaaaauauuuuuauua

SEQ ID NO: 381773 - RNA, 64 nt, Human
cccccgcccgccauccccaguugcagggggaucuggggacuaccagagacucugggaaauggac

SEQ ID NO: 381774 - RNA, 64 nt, Human
uuaccuaagagccacaauaagccacugguaucugggggacuagaacacaaauccaacgcuuuuc

SEQ ID NO: 381775 - RNA, 64 nt, Human
auuuuuaauuuaaaaaaaauuuccaaauauuuguggguccgacaguaaugaucaaaauaugaau

SEQ ID NO: 381776 - RNA, 64 nt, Human
auuaagcucauuaaaaacaaacuggcuugcagaaggguccgaugugccaagugaucaugauucu

SEQ ID NO: 381777 - RNA, 64 nt, Human
ugaugccagcugggagucuugcugacccugccccggguccgagggugucaauaaagugcugucc

SEQ ID NO: 381778 - RNA, 64 nt, Human
cugccgcccagcaugcagguggccucgcuuugccggguccgagaggcuccccgucaauuuugca

SEQ ID NO: 381779 - RNA, 64 nt, Human
uuucccaaaguucugaagugccuugagaacauguggguccgaguguuauaacagacuccucccc

SEQ ID NO: 381780 - RNA, 64 nt, Human
cgacccagccuggccacacacuguggugccaucuggguccgaugcccucucuggagauaggccu

SEQ ID NO: 381781 - RNA, 64 nt, Human
ccgggcagugucacacccugccugcucaguccugggguccgagaugcuagggacgcuugaguga

SEQ ID NO: 381782 - RNA, 64 nt, Human
ucuuccuggcucaggagaaagaagaggcuguugaggguccgacucccuacuuggacuucuggca

SEQ ID NO: 381783 - RNA, 64 nt, Human
gcucucccgccuccagugugggccggcuccugcaggguccgagggcugcaucucuaccagccag

SEQ ID NO: 381784 - RNA, 64 nt, Human
acguggagguccaggccgggguggggacguggguggguccgagguguguguggggucggggugg

SEQ ID NO: 381785 - RNA, 64 nt, Human
gaaauaacaucauccauugggguagaaaaggagaggguccgaggguggugggagggauagaaau

SEQ ID NO: 381786 - RNA, 64 nt, Human
cauguuccucgggguggcguguuccuugcucccuggguccgacauguguucccgcaccugcaug

SEQ ID NO: 381787 - RNA, 64 nt, Human
aggcgaauaguccccagagcuguguuccuccaagggguccgaggaaucacucacuccuggaggc

SEQ ID NO: 381788 - RNA, 64 nt, Human
cugcccagaugggagaauagggggcuggaccccaggguccgaaugagcccugugaggcccacac

SEQ ID NO: 381789 - RNA, 64 nt, Human
ggcugcugcaggcccucgaggccccggagggcugggguccgacaccaagggcgggccgcgcggc

SEQ ID NO: 381790 - RNA, 64 nt, Human
auucccaaucuugacacggugaaauccaggucucggguccgauuaauuuaugguuucugcgugc

SEQ ID NO: 381791 - RNA, 64 nt, Human
gcacucgcugucccccuccggccacccuagaccaggguccgagaggcaggcaggagccacucau

SEQ ID NO: 381792 - RNA, 64 nt, Human
ugcugcccaaagcagaggaagccgggcuggcugaggguccgaaaagccugcaggggcccggcga

SEQ ID NO: 381793 - RNA, 64 nt, Human
ccggcagccugagcagcuccaaagcacuggcuugggguccgagaccuucaaaguaaagcaggcg

SEQ ID NO: 381794 - RNA, 54 nt, Human
cagcaccccucauccgcugaggcgggguccgaggucguaccccacagugcaccu

SEQ ID NO: 381795 - RNA, 64 nt, Human
aaaagcaagcaucagcgaauaguauagugucucaggguccgaagcaaguuuaaaugccaccuag

SEQ ID NO: 381796 - RNA, 64 nt, Human
gcccugagggucgaaggucgagcaggccggggguguccgggaggucuuugggcaucgcggucug

SEQ ID NO: 381797 - RNA, 64 nt, Human
gcgggcuccgcuauuugcaaauggaugccccaguguccgggauguguggccagcugcugcaggc

SEQ ID NO: 381798 - RNA, 54 nt, Human
cgcucaaccugcagcaguaggaggguccgggaggcccugccguccugucuccug

SEQ ID NO: 381799 - RNA, 64 nt, Human
uuaggggaccauucuguucagugcgauccugaugguccgggagaugaggguuuccggggcuagu

SEQ ID NO: 381800 - RNA, 64 nt, Human
ggagcaggggguggcagagggcacccgggcgguaguccgggacgcgcaaggcagagcccugacg

SEQ ID NO: 381801 - RNA, 64 nt, Human
ggcccccuguccucucuggcuggggagcagggagguccgggagggugcggcugugcagccuguc

SEQ ID NO: 381802 - RNA, 64 nt, Human
gaagugaggagcgucuccgcccggcagccacccaguccgggagggaggugggggggucaguccc

SEQ ID NO: 381803 - RNA, 64 nt, Human
gggggggucagucccccguccggccagccgccccguccgggaggugaggggcgccucugcccag

SEQ ID NO: 381804 - RNA, 64 nt, Human
aagugaggagccccucugccccgccagccaccccguccgggagggaggugggggggucagcccc

SEQ ID NO: 381805 - RNA, 64 nt, Human
gggggggucagccccccgcccggccagccgccccguccgggagggaggugggggaucagccccc

SEQ ID NO: 381806 - RNA, 64 nt, Human
ugggggaucagccccccgcccggcuagccgccccguccgggaggcgaggggcgccucugcccgg

SEQ ID NO: 381807 - RNA, 64 nt, Human
gggggggucagccccccgcccggccagccgcccgguccgggagggaggugggggggucagcccc

SEQ ID NO: 381808 - RNA, 64 nt, Human
gggggggucagccccccgcccggccagccgccccguccgggagguuaggggcgccucugcccgg

SEQ ID NO: 381809 - RNA, 64 nt, Human
gacuaggcucagccggaaccagcaccuccaaggaguccgggaggugccugugguuugcacccac

SEQ ID NO: 381810 - RNA, 64 nt, Human
cacuuuuugaggccaagguaggaggauugcuugaguccgggagcucaaggcaaagcugcacaac

SEQ ID NO: 381811 - RNA, 64 nt, Human
ggacuuugggaccugcuuugugagccagcagcgaguccgggaggucuaccugaugaaccugagc

SEQ ID NO: 381812 - RNA, 64 nt, Human
uuucauggcagucaaguccaauggcagcgucuucguccgggacuccucucaggugcacccgcua

SEQ ID NO: 381813 - RNA, 64 nt, Human
gaggggcugggggccccacgaccugcagcgucgaguccgggagagagcccggagcggcgugcca

SEQ ID NO: 381814 - RNA, 64 nt, Human
uuucuaguuccaaguuuuaaauacauggaaggaaguccgggagaaccauaugaaggagcaggag

SEQ ID NO: 381815 - RNA, 64 nt, Human
ccucucggagaaaaaaaucacaaggcaacugugaguccgggaaucucuucucugauccuucuuc

SEQ ID NO: 381816 - RNA, 64 nt, Human
gcacagugaucagagagaggcugggguguguccuguccgggacccccccugccuuccugcucac

SEQ ID NO: 381817 - RNA, 64 nt, Human
aaucaugacagacuaaggcaguggcuguggggcuguccgggaguucucuacagaaaacaucuaa

SEQ ID NO: 381818 - RNA, 64 nt, Human
auucaucauuucaguuccguaggucaguguugcgguccgggaagcguaucauaaccaccuggga

SEQ ID NO: 381819 - RNA, 64 nt, Human
ugccccccuccuccccgcgccccagucacuuccuguccgggagcaguagucauuguuguuuuaa

SEQ ID NO: 381820 - RNA, 64 nt, Human
cuaguuuaccucaguuccgcaggcaggacagccgguccgggaacccugagugagaaugagugug

SEQ ID NO: 381821 - RNA, 64 nt, Human
uccuggagcgcagggcuggugaauccaugacaagguccgggagcagcagaccaaaaccacagca

SEQ ID NO: 381822 - RNA, 64 nt, Human
agccccccucggcguccucucucgcggccgcucuguccgggagccauccccacccgccgggugu

SEQ ID NO: 381823 - RNA, 64 nt, Human
ugccguccagaaagcuagcugcaguguucaggacguccgggaggaagcaagcaugugggggaca

SEQ ID NO: 381824 - RNA, 64 nt, Human
uccauguuaguaauggcagagcagucuaaacagaguccgggagaaugcuggcaaaggcuggcug

SEQ ID NO: 381825 - RNA, 52 nt, Human
gcacagaggcaagcagcuaagaguccgggauccccagccuacugccucucca

SEQ ID NO: 381826 - RNA, 64 nt, Human
cauggagcaaggugggucugggagguagauauggguccgggaugugcuaucguaguuaucagag

SEQ ID NO: 381827 - RNA, 64 nt, Human
acuuuccccaggacgcaagacucuccccuccacuguccgggacagcguucgcccuuuagcgggg

SEQ ID NO: 381828 - RNA, 64 nt, Human
ggaccgggcucugacagcccugcggagacccugaguccgggaggcaccguccggcggcgagcuc

SEQ ID NO: 381829 - RNA, 64 nt, Human
aaauuuuuaaaaauccuaaguugaaucauuguuaguccgggaccuucaguacugccaaguccca

SEQ ID NO: 381830 - RNA, 64 nt, Human
acuuuguguauuuuaaguuuacaguuuuuuauuaguccgggaaaagaaggcacaauaguuuucg

SEQ ID NO: 381831 - RNA, 64 nt, Human
gagacagccccugucuucuuggcgugguuuauauguccgggaucuggaucagauucugggggcu

SEQ ID NO: 381832 - RNA, 64 nt, Human
gcgcccauggauggcugagcaccacuacgacuuaguccgggauaagggccuccccaguccucuc

SEQ ID NO: 381833 - RNA, 64 nt, Human
ccaucccggugacaugcucacccccaacccccguguccgggaccccggucuuguguggucccug

SEQ ID NO: 381834 - RNA, 64 nt, Human
cagggguggaggguccugggagauagucccagggguccgggacagaguggagucaagagcugga

SEQ ID NO: 381835 - RNA, 64 nt, Human
aggccacauucccucgacaacggcugcacgggcuguccgggauccggggugucuguccgcagac

SEQ ID NO: 381836 - RNA, 64 nt, Human
aagugaggagcgucuacgcccgggcagcugccccguccgggagggaggugggggggucagcccc

SEQ ID NO: 381837 - RNA, 64 nt, Human
gggggggucagccccccgcccggccagccgccccguccgggagggaggugggggggaucagccc

SEQ ID NO: 381838 - RNA, 64 nt, Human
ggggggaucagccccccgcccggccagccgccccguccgggagggagguggggggcgccucugc

SEQ ID NO: 381839 - RNA, 64 nt, Human
ggggugcugggcucuggccuucucaugcagagagguccgggacagggucaguaucgugggcaug

SEQ ID NO: 381840 - RNA, 64 nt, Human
cugggugcaucugcuaaugggagaccaaaucuuuguccgggaagcaagaagugggugggagaau

SEQ ID NO: 381841 - RNA, 64 nt, Human
auuuauuucuucaaugccucgaccugccgcagggguccgggauugggaauccgcccaucugggg

SEQ ID NO: 381842 - RNA, 64 nt, Human
agggaggguggggggcaggggucgggggucggguguccgggagccagggaagacuggaaaugcu

SEQ ID NO: 381843 - RNA, 64 nt, Human
accucguucuuccacacccuguccugguggggcuguccgggaagacaccuacccugugggcacu

SEQ ID NO: 381844 - RNA, 64 nt, Human
cccgagagucuccagaugggggcaucagggugagguccgggacucuugggucaucgucccacag

SEQ ID NO: 381845 - RNA, 64 nt, Human
cuccccacccccggcacccagcucucuacggcagguccgggagggcuggggcuucggggagccc

SEQ ID NO: 381846 - RNA, 64 nt, Human
ggaagaugaggucaucugccacuuucaggacauuguccgggagcccuucauuuaggacaaaacg

SEQ ID NO: 381847 - RNA, 64 nt, Human
uccaccaacuaagccagcugccacuguguacucgguccgggacccuuggcgacagaagacagcc

SEQ ID NO: 381848 - RNA, 64 nt, Human
gcaguuaccucaugucggugcccgcuggggagggguccgggaagaaggggaaggggugccuggc

SEQ ID NO: 381849 - RNA, 64 nt, Human
cuggaaaccuggaguucagggcccagacuuugggguccgggagcugauggccccucucucccgg

SEQ ID NO: 381850 - RNA, 64 nt, Human
gcacuggauugcggaggagccucccgcagcacugguccgggacaagaugauggagugccacuuc

SEQ ID NO: 381851 - RNA, 64 nt, Human
uuuauucuacuccaagagauucugccucccuuguguccgggagaacaucaaugcuuuuccucag

SEQ ID NO: 381852 - RNA, 64 nt, Human
acagguaaugacgggcacggccuccccacggccuguccgggaaagaccaggaccugcucgagcc

SEQ ID NO: 381853 - RNA, 64 nt, Human; identical to SEQ ID NO: 364936

SEQ ID NO: 381854 - RNA, 64 nt, Human; identical to SEQ ID NO: 364937

SEQ ID NO: 381855 - RNA, 64 nt, Human; identical to SEQ ID NO: 364938

SEQ ID NO: 381856 - RNA, 64 nt, Human; identical to SEQ ID NO: 363320

SEQ ID NO: 381857 - RNA, 64 nt, Human; identical to SEQ ID NO: 363321

SEQ ID NO: 381858 - RNA, 64 nt, Human; identical to SEQ ID NO: 363158

SEQ ID NO: 381859 - RNA, 64 nt, Human; identical to SEQ ID NO: 363571

SEQ ID NO: 381860 - RNA, 64 nt, Human; identical to SEQ ID NO: 363572

SEQ ID NO: 381861 - RNA, 64 nt, Human; identical to SEQ ID NO: 364878

SEQ ID NO: 381862 - RNA, 64 nt, Human; identical to SEQ ID NO: 364879

SEQ ID NO: 381863 - RNA, 64 nt, Human; identical to SEQ ID NO: 363159

SEQ ID NO: 381864 - RNA, 64 nt, Human; identical to SEQ ID NO: 363586

SEQ ID NO: 381865 - RNA, 64 nt, Human; identical to SEQ ID NO: 363369

SEQ ID NO: 381866 - RNA, 56 nt, Human; identical to SEQ ID NO: 363370

SEQ ID NO: 381867 - RNA, 64 nt, Human; identical to SEQ ID NO: 363173

SEQ ID NO: 381868 - RNA, 64 nt, Human; identical to SEQ ID NO: 363636

SEQ ID NO: 381869 - RNA, 64 nt, Human; identical to SEQ ID NO: 363637

SEQ ID NO: 381870 - RNA, 64 nt, Human; identical to SEQ ID NO: 363287

SEQ ID NO: 381871 - RNA, 64 nt, Human; identical to SEQ ID NO: 363288

SEQ ID NO: 381872 - RNA, 64 nt, Human; identical to SEQ ID NO: 363174

SEQ ID NO: 381873 - RNA, 64 nt, Human; identical to SEQ ID NO: 363702

SEQ ID NO: 381874 - RNA, 64 nt, Human; identical to SEQ ID NO: 363703

SEQ ID NO: 381875 - RNA, 64 nt, Human; identical to SEQ ID NO: 363704

SEQ ID NO: 381876 - RNA, 64 nt, Human; identical to SEQ ID NO: 364918

SEQ ID NO: 381877 - RNA, 64 nt, Human; identical to SEQ ID NO: 364919

SEQ ID NO: 381878 - RNA, 64 nt, Human; identical to SEQ ID NO: 363175

SEQ ID NO: 381879 - RNA, 64 nt, Human; identical to SEQ ID NO: 364880

SEQ ID NO: 381880 - RNA, 64 nt, Human; identical to SEQ ID NO: 363619

SEQ ID NO: 381881 - RNA, 64 nt, Human; identical to SEQ ID NO: 363620

SEQ ID NO: 381882 - RNA, 64 nt, Human; identical to SEQ ID NO: 363189

SEQ ID NO: 381883 - RNA, 64 nt, Human; identical to SEQ ID NO: 363190

SEQ ID NO: 381884 - RNA, 64 nt, Human; identical to SEQ ID NO: 363191

SEQ ID NO: 381885 - RNA, 64 nt, Human; identical to SEQ ID NO: 363205

SEQ ID NO: 381886 - RNA, 64 nt, Human; identical to SEQ ID NO: 363206

SEQ ID NO: 381887 - RNA, 64 nt, Human; identical to SEQ ID NO: 363207

SEQ ID NO: 381888 - RNA, 64 nt, Human; identical to SEQ ID NO: 363336

SEQ ID NO: 381889 - RNA, 55 nt, Human; identical to SEQ ID NO: 363337

SEQ ID NO: 381890 - RNA, 64 nt, Human; identical to SEQ ID NO: 363338

SEQ ID NO: 381891 - RNA, 64 nt, Human; identical to SEQ ID NO: 363354

SEQ ID NO: 381892 - RNA, 64 nt, Human; identical to SEQ ID NO: 363355

SEQ ID NO: 381893 - RNA, 64 nt, Human; identical to SEQ ID NO: 363371

SEQ ID NO: 381894 - RNA, 64 nt, Human; identical to SEQ ID NO: 363385

SEQ ID NO: 381895 - RNA, 64 nt, Human; identical to SEQ ID NO: 363386

SEQ ID NO: 381896 - RNA, 64 nt, Human; identical to SEQ ID NO: 363387

SEQ ID NO: 381897 - RNA, 64 nt, Human; identical to SEQ ID NO: 363401

SEQ ID NO: 381898 - RNA, 64 nt, Human; identical to SEQ ID NO: 363402

SEQ ID NO: 381899 - RNA, 64 nt, Human; identical to SEQ ID NO: 363403

SEQ ID NO: 381900 - RNA, 64 nt, Human; identical to SEQ ID NO: 364900

SEQ ID NO: 381901 - RNA, 64 nt, Human; identical to SEQ ID NO: 364901

SEQ ID NO: 381902 - RNA, 64 nt, Human; identical to SEQ ID NO: 364902

SEQ ID NO: 381903 - RNA, 64 nt, Human; identical to SEQ ID NO: 364939

SEQ ID NO: 381904 - RNA, 64 nt, Human; identical to SEQ ID NO: 364940

SEQ ID NO: 381905 - RNA, 64 nt, Human; identical to SEQ ID NO: 364941

SEQ ID NO: 381906 - RNA, 64 nt, Human; identical to SEQ ID NO: 364942

SEQ ID NO: 381907 - RNA, 64 nt, Human; identical to SEQ ID NO: 364943

SEQ ID NO: 381908 - RNA, 64 nt, Human; identical to SEQ ID NO: 364944

SEQ ID NO: 381909 - RNA, 64 nt, Human; identical to SEQ ID NO: 364945

SEQ ID NO: 381910 - RNA, 64 nt, Human; identical to SEQ ID NO: 364946

SEQ ID NO: 381911 - RNA, 64 nt, Human; identical to SEQ ID NO: 364947

SEQ ID NO: 381912 - RNA, 64 nt, Human; identical to SEQ ID NO: 364948

SEQ ID NO: 381913 - RNA, 54 nt, Human; identical to SEQ ID NO: 364949

SEQ ID NO: 381914 - RNA, 55 nt, Human; identical to SEQ ID NO: 364950

SEQ ID NO: 381915 - RNA, 64 nt, Human; identical to SEQ ID NO: 364951

SEQ ID NO: 381916 - RNA, 64 nt, Human; identical to SEQ ID NO: 364952

SEQ ID NO: 381917 - RNA, 64 nt, Human
uuucauuucaaaauuguucaaaauucaaaagacacagaacgauaaacagugaagucuccuuccc

SEQ ID NO: 381918 - RNA, 64 nt, Human
gggaacacagaccaggaagcucggugagugauggcagaacgaugccugcaggcauggaacuuuu

SEQ ID NO: 381919 - RNA, 64 nt, Human
uaucaguaggacuucuuuccuaggauuucuuuaacagaacgaguugugguucgagaaggauuuc

SEQ ID NO: 381920 - RNA, 64 nt, Human
cuaaacuuuguucuguucaguucuagaguguauacagaacgaauugauguguaacuguaugcag

SEQ ID NO: 381921 - RNA, 64 nt, Human
gugugggcgcacucuacagugacuucagucugcucagaacgaauguggaggccggccgaaacug

SEQ ID NO: 381922 - RNA, 64 nt, Human
cuaaaagguaccuuugucugccauugauccagcucagaacgauuggaaauaaauuugaaaugua

SEQ ID NO: 381923 - RNA, 64 nt, Human
aauauaggauuaauaucuguguuccagcuucagccagaacgauaugucuguccaucuuucuccu

SEQ ID NO: 381924 - RNA, 64 nt, Human
uuguuuaucuggguuagggaugggggacagauaacagaacgagcaaaguaaccuauacaggcca

SEQ ID NO: 381925 - RNA, 64 nt, Human
uaugcugguaguaaaugggacucugagucaaauucagaacgagaugucacuaaaaacaguaaaa

SEQ ID NO: 381926 - RNA, 64 nt, Human
ccaagaucgcaccacugcacuacagccugggcgacagaacgagacccugucuccaaaggaaaaa

SEQ ID NO: 381927 - RNA, 64 nt, Human
ccugacuuguagccagcuuguguaagaucccuugcagaacgagaaaguuaaaaacaagcccacc

SEQ ID NO: 381928 - RNA, 64 nt, Human
gcagcccaguccccacagucacggccaagccacgcagaacgaacaugacuccagaggaccucgc

SEQ ID NO: 381929 - RNA, 64 nt, Human
uugaaugaaugucacauagguauccucaguaacacagaacgaaauuaccuuuguauuauuguga

SEQ ID NO: 381930 - RNA, 64 nt, Human
ccacuuggccugggccugccaccaccacguccugcagaacgagcccugccuuggcuguggagaa

SEQ ID NO: 381931 - RNA, 64 nt, Human
aggcaccacacaacccagaaaggagcugauggggcagaacgaacuuuaaguaugagaaaaguuc

SEQ ID NO: 381932 - RNA, 64 nt, Human
aaaggcugaaaaaauagggaggaaauuccuucaucagaacgacuucaaguggauaacaauauuu

SEQ ID NO: 381933 - RNA, 64 nt, Human
uuuuauucucagggucgcuggucauccucuggcacagaacgaacguugucuucacauguuuuua

SEQ ID NO: 381934 - RNA, 64 nt, Human
uucaggcagagagcuauauuuggaggaagcauuacagaacgaaagagaucuuuuaggaacaguu

SEQ ID NO: 381935 - RNA, 64 nt, Human
gcuccguucugucagaugcuacuccaaauguuaccagaacgaugacaaaaggggagacgcucua

SEQ ID NO: 381936 - RNA, 64 nt, Human
agcaccucccagccaccguccccucaagagcccccagaacgagacccuguacucugucuuaaag

SEQ ID NO: 381937 - RNA, 64 nt, Human
ucguacuacuggccgugaccagagagugcauuuacagaacgaggaggaagaggugaguccuggg

SEQ ID NO: 381938 - RNA, 64 nt, Human
uucuggggaguggggauauauauuuguugaauaacagaacgaguguaaaauuuuaacaacggaa

SEQ ID NO: 381939 - RNA, 64 nt, Human
gcagcucaaucuccuuacacacauagaaaaugugcagaacgaaguuaccagcaggauggaccua

SEQ ID NO: 381940 - RNA, 64 nt, Human
gaagcauucguccagcagcaccaggcugaaaaaacagaacgagagaaucggcuuaaagaguuuu

SEQ ID NO: 381941 - RNA, 64 nt, Human
cuccuguauguaagacacaaggccaaccacaacacagaacgauguugaccuguuaaguauucuc

SEQ ID NO: 381942 - RNA, 64 nt, Human
ucucuuagaagggaaauaauguaucaccucuuuccagaacgaagcaaaguugcuggcuuaguag

SEQ ID NO: 381943 - RNA, 64 nt, Human
augucuuacuggguugcugguuuucaucguaacacagaacgagguuaucuaggguuguagcuuu

SEQ ID NO: 381944 - RNA, 64 nt, Human
gcgagaucacaccacugcacuccagugugagcaacagaacgagacucugucucaaaaaaaaaaa

SEQ ID NO: 381945 - RNA, 64 nt, Human
ccgagaucacaccacugcacuccagccugggagacagaacgagacuccuaaucaaaaaaaaaac

SEQ ID NO: 381946 - RNA, 64 nt, Human
ucucugucaaaacagccccacugauaauauuagacagaacgagaaugcaggggucucuucccuc

SEQ ID NO: 381947 - RNA, 64 nt, Human
uagccaaucagaggcuuaguucagccauuuuguucagaacgaucauccagccccucuuagaacu

SEQ ID NO: 381948 - RNA, 64 nt, Human
acuuccccggagggcugcggcguacaggcuggcgcagaacgaaccuuggccugggccguaucuc

SEQ ID NO: 381949 - RNA, 64 nt, Human
aaguacaggcuuuuucuucauuaccuuuuuuauucagaacgaggaagagaacacaaggaaugau

SEQ ID NO: 381950 - RNA, 64 nt, Human
cuaugaucaugucucagcacuccagcuuuggcaacagaacgagaucccaucucuuagaaaaaca

SEQ ID NO: 381951 - RNA, 64 nt, Human
acagaggcaggucaggguuguccgcucugauuagcagaacgacagccccuuccuccuccucccu

SEQ ID NO: 381952 - RNA, 64 nt, Human
cugcugggcugggucgcguagcccaggguggaggcagaacgaugcugcugugguagcccuuugc

SEQ ID NO: 381953 - RNA, 64 nt, Human
aaagaggguggcugugaggugaccccagacacugcagaacgaugugcacccucugcguuuugga

SEQ ID NO: 381954 - RNA, 64 nt, Human
uccacugacaaacgggaaacaagaguugaaaggccagaacgaucugggagagaaguaucagggc

SEQ ID NO: 381955 - RNA, 64 nt, Human
uuguucaggugacaaaugagaucagcucuccuuccagaacgaaagggcugauaauuuuuggccu

SEQ ID NO: 381956 - RNA, 64 nt, Human
cagaauauuauguaaagaccaccccuccucauuccagaacgaacagccugacacauacgcacgg

SEQ ID NO: 381957 - RNA, 64 nt, Human
caugagacagugcucaugaagccagugcguuucccagaacgaacacuaggcggcaccguugguc

SEQ ID NO: 381958 - RNA, 64 nt, Human
ccaugaaugccccacugcacuccagccugggcgacagaacgagaccccaucucaaaaaaaauaa

SEQ ID NO: 381959 - RNA, 64 nt, Human
aggaaaccaggcagaggaggcacagggugcucuccagaacgagaagccagcuccuggaguuguu

SEQ ID NO: 381960 - RNA, 64 nt, Human
caaggaguaucaggaggaccuggcccugcgggcucagaacgauguggcugcccggcagacgaca

SEQ ID NO: 381961 - RNA, 64 nt, Human
cuaugauuguaucacugcacuccagccuagaugacagaacgagaccccaucucuaaugaauaaa

SEQ ID NO: 381962 - RNA, 64 nt, Human
gcuaagacugcaccacugcacuccagccuggugacagaacgagacucugucuuaaaaacaaaca

SEQ ID NO: 381963 - RNA, 64 nt, Human
uacuauguacuuucauuuuagaccaaacuagagucagaacgaauacuagcaucaguggggaaga

SEQ ID NO: 381964 - RNA, 64 nt, Human
ucccucgucaugcauuuccacauauccacaaacacagaacgacuuuagacaagcacauguuaca

SEQ ID NO: 381965 - RNA, 64 nt, Human
accacaugggugcaagucagcauuguaaguuuucucagguuauuauuauuagagagguuggaaa

SEQ ID NO: 381966 - RNA, 64 nt, Human
uauugcaauaauaaaaauauuuuuaaaauuauguucagguuauuuauugacagguacuacuuac

SEQ ID NO: 381967 - RNA, 64 nt, Human
uuccacaccuuuuuuuuuuuuucugaugcagaguucagguuaauauuuuacugcaucugauaau

SEQ ID NO: 381968 - RNA, 64 nt, Human
uuuacagcucuuugcauuuuguagaccuuaauacucagguuaaauauucauugcauuuauaaga

SEQ ID NO: 381969 - RNA, 64 nt, Human
aggaguacagugcucuuguugaucuuguauucagucagguuaaaacaacggacaauaaaagaau

SEQ ID NO: 381970 - RNA, 64 nt, Human
uacuucuacaguggaagagauugaaaagcauuugucagguuaaugcuaaaucagugcggaaaua

SEQ ID NO: 381971 - RNA, 64 nt, Human
cauuaguaagaaaugacauaaaauacgugcuuucucagguuacuguauaacuguuauaauauau

SEQ ID NO: 381972 - RNA, 64 nt, Human
cucucuccagacagagucucagggcccagcaaggucagguuaucugcuuucauucagggcaaca

SEQ ID NO: 381973 - RNA, 64 nt, Human
ccaguuuguguuuuucuauagaaaaaguaaaagaucagguuauacuuuagguuagggguucuau

SEQ ID NO: 381974 - RNA, 64 nt, Human
uuauaaauuuagcaguggcagggcccguggagaaucagguuaaugagguaaaggcuuucugggu

SEQ ID NO: 381975 - RNA, 64 nt, Human
ccuguuuaaacuguagaauaaccagauauucccaucagguuaaagacuucaucuagaugaugcc

SEQ ID NO: 381976 - RNA, 64 nt, Human
gaaauaaauguaccugauguaccugaugcuauggucagguuauacuccuccucccccagcuauc

SEQ ID NO: 381977 - RNA, 64 nt, Human
gcaaggcaaauuuuacauggauuuagagccuaggucagguuauuaggauuauaaauuuuccacu

SEQ ID NO: 381978 - RNA, 52 nt, Human
gaauuuacuacagcaugugauuucagguuaaugacuccagagaguaagauca

SEQ ID NO: 381979 - RNA, 64 nt, Human; identical to SEQ ID NO: 186585

SEQ ID NO: 381980 - RNA, 64 nt, Human; identical to SEQ ID NO: 186590

SEQ ID NO: 381981 - RNA, 64 nt, Human
gcaggacucacuggauagauguuauucgacuccuucagguuaucuugaacugccugacuuaggc

SEQ ID NO: 381982 - RNA, 64 nt, Human
ugugaaauacuaaacacuauggauuuuguaggugucagguuaaauggucaagggauaccuacau

SEQ ID NO: 381983 - RNA, 64 nt, Human
gagagggagaggaaaggguucuguccaagacaguucagguuaauuaauuuucuucuccauugcu

SEQ ID NO: 381984 - RNA, 64 nt, Human
aucaaaauagaguggagaauuugggcuccaaaaaucagguuaguaggcucauuuccaugugcuu

SEQ ID NO: 381985 - RNA, 64 nt, Human
aggaugaugcuauuuuuuauuuuuaaauauaucuucagguuauuuucuuacuguugcuucagau

SEQ ID NO: 381986 - RNA, 64 nt, Human
cacuaauuuauauuguucuuuccucugauuuuuuucagguuagugauuuuuuuguauacaauuu

SEQ ID NO: 381987 - RNA, 64 nt, Human
uaacaaagauuucaaauguuaaaagagauaaaagucagguuaauacuaucuuaaacacugaguc

SEQ ID NO: 381988 - RNA, 64 nt, Human
auuuacagaauaauaaacauucauguacccacuaucagguuaagaaauagaacauuuauuaaua

SEQ ID NO: 381989 - RNA, 64 nt, Human
aggcagcagaugcccagggagacccaagaaagagucagguuagggagcagugaaagugaggagg

SEQ ID NO: 381990 - RNA, 64 nt, Human
uacugggcagcugguggcggugcagaaaagagucucagguuauuuuuuguuuuuaguuauuucu

SEQ ID NO: 381991 - RNA, 64 nt, Human
uugcuacagcauacaaagccucuacuagugauuaucagguuauuucugacagacaaacgccaaa

SEQ ID NO: 381992 - RNA, 64 nt, Human
gugagaagauaaaaacugcccauuguaacuuauuucagguuaaauuaaaccaaggagucugauu

SEQ ID NO: 381993 - RNA, 64 nt, Human
aaagacuuaacuagacuucugaacuugaacaguuucagguuauauuuuaauuuuuuuuuuuuug

SEQ ID NO: 381994 - RNA, 64 nt, Human
acgucuuggaggcagcuggaauggaaaggagaauucagguuaaagugggagggguggguagaga

SEQ ID NO: 381995 - RNA, 64 nt, Human
caaguauaaugggaauuucuuuucuugguucuuuucagguuaugagguuuggucagugacaaaa

SEQ ID NO: 381996 - RNA, 64 nt, Human
gacccuugcugacugcagccugguugugauuaguucagguuacuagguguucugauggaguggg

SEQ ID NO: 381997 - RNA, 64 nt, Human
gaggggaaggaacagcaaaagaggcccuucuuccucacccaagaugcagggugguuggggccag

SEQ ID NO: 381998 - RNA, 64 nt, Human
gggccaccgcagcauuggccccaucaccacguccucacccaacucucccugaugaauagaauau

SEQ ID NO: 381999 - RNA, 64 nt, Human
aggaggguccuacagacaagguggcaucucaaccucacccaagaaacccccgggacuuuacccc

SEQ ID NO: 382000 - RNA, 64 nt, Human
ugaacugagaccagugaguaaguuggugucugggucagguuaaugguggugaacuaugugccug

SEQ ID NO: 382001 - RNA, 64 nt, Human
acugaauugagagacauacucugcuacuauguccucagguuaauuuuugucugaucuuacgaug

SEQ ID NO: 382002 - RNA, 64 nt, Human
uauuuuuauuuuuacagauuuugcacuucugaauucagguuaaaaacuaacuuguauuuagucu

SEQ ID NO: 382003 - RNA, 64 nt, Human
auuuuuuuucaagcuuauuuugaaaucuuaaaaaucagguuacaccauagcuacucaaaaguuu

SEQ ID NO: 382004 - RNA, 64 nt, Human
gcggccggaacagggugguugacaucaguuuucuucagguuacuuuuuaauaaugauuaaaacg

SEQ ID NO: 382005 - RNA, 64 nt, Human
uuuccaagugcuuuucucuguugccacauuuuccucagguuacucaggaaaaugcuccagcaug

SEQ ID NO: 382006 - RNA, 64 nt, Human
gguucaaagaccacccuaccagccccuauuugcuucagguuauccuguugagggugggugggaa

SEQ ID NO: 382007 - RNA, 64 nt, Human
aguagaacgugugagaaguuggccuucaaggggcucagguuaauaauagagagcuauggaguca

SEQ ID NO: 382008 - RNA, 64 nt, Human
ggggccuucgaccucacuuugagaaauaccuucuucagguuauucuuuauguuuguccuguggu

SEQ ID NO: 382009 - RNA, 64 nt, Human
uucccccaaacccuaaaauucuaccuauuaggugucagguuaaaguucuaauuuaucuuuagaa

SEQ ID NO: 382010 - RNA, 64 nt, Human
ugucauuaaugacccaguguuagaaugcaagaggucagguuauucuagcccucauggcugaagg

SEQ ID NO: 382011 - RNA, 64 nt, Human
aaggugauucuccuaaagagcagugaaggaaaugucagguuagcaggacccaaguuuugggugu

SEQ ID NO: 382012 - RNA, 64 nt, Human
uaccauggacaauacaugcaaagcaauaucuuguucagguuaguacccgcaaaacgggacauag

SEQ ID NO: 382013 - RNA, 64 nt, Human
aucaaaacuagcuuuuuuccccacaaauaaauuaucagguuaaacuuucaccaaugucugcucu

SEQ ID NO: 382014 - RNA, 64 nt, Human
ugauccaaggccccggaccaaggggauacuguaaucagguuauguacaccaaccucugcaucag

SEQ ID NO: 382015 - RNA, 64 nt, Human
ccacgcaggaagccuacuauuuaaauccuuggcuucagguuagugacauuuaaugccaucuagc

SEQ ID NO: 382016 - RNA, 64 nt, Human
uggagccuuuccaauagccccaugaaaagaagcaucacccaaggauauuguaaaaaggauguaa

SEQ ID NO: 382017 - RNA, 64 nt, Human
aucuguauguacuuggaaauacagaauaacuuuaucacccaaaucacuggcauugacauuauug

SEQ ID NO: 382018 - RNA, 64 nt, Human
ggucagggauugaaaauaguacagugacucugucucacccaaaugggaccacgucuguuaccag

SEQ ID NO: 382019 - RNA, 64 nt, Human
uucuacauguuaacugcacuguagauguaaaaauucagguuauauauaggauugccaucuucag

SEQ ID NO: 382020 - RNA, 64 nt, Human
gguaugaugugcugcugggaauggauuuuuuuuuucagguuaaauuauugauacaacaggauuu

SEQ ID NO: 382021 - RNA, 64 nt, Human
cuuacaaacuuuguuuucccucauaaccaaagcuucagguuagaaguuuagaaaaauagaaugg

SEQ ID NO: 382022 - RNA, 64 nt, Human
ucucggaaaaaaaauauuucuguucacuuuacuuucagguuaaaaauguuucuaacacgcuugc

SEQ ID NO: 382023 - RNA, 64 nt, Human
aauauuuaaagacagccucucaacagauuguaucucagguuaaaugcuaacuaauuaugucugu

SEQ ID NO: 382024 - RNA, 64 nt, Human
auucucucaaaccuggguaauaguuucucaguguucagguuaccuugagaaaggccaugcuuag

SEQ ID NO: 382025 - RNA, 64 nt, Human
ugagauagacauguuuaguugaaguuauuucauuucagguuauauuaucuugggucagagaaug

SEQ ID NO: 382026 - RNA, 64 nt, Human
uuagggguauuaaggucagccucucacucuuccuucagguuacuaacaaaauuucguagcuaaa

SEQ ID NO: 382027 - RNA, 64 nt, Human
augccugauaaucacagaggacuugaucuauuucucagguuauaaauucagcucuaaggaaaua

SEQ ID NO: 382028 - RNA, 64 nt, Human
gagggcauaacuaugaaacuggacaccuugguugucagguuagaaggaugggguguaggguugg

SEQ ID NO: 382029 - RNA, 64 nt, Human
aaugagggagugaaauguuacccaauuaggcuugucagguuaguaauaaacugaacaguaauaa

SEQ ID NO: 382030 - RNA, 64 nt, Human
gaaaaaaagcugcuacuccuaguaggccaaacgcucagguuaaacaacugacgaguguuacugu

SEQ ID NO: 382031 - RNA, 64 nt, Human
cauguuggccaggcuggucuugaacuuccugaccucagguuauccacccaccucagccucccaa

SEQ ID NO: 382032 - RNA, 64 nt, Human
auuaaaaggaaaggcagauuuugaaaucugacucucagguuagcuggaguuacaaggcagccaa

SEQ ID NO: 382033 - RNA, 64 nt, Human
cugcuaauggugugaugucauuuuucccccugcuucagguuaauuuuuuggauauuucagaaac

SEQ ID NO: 382034 - RNA, 64 nt, Human
cuugcucccuggcuuucccugagagaaguagcacucagguuagcaauauauauauauaauuuau

SEQ ID NO: 382035 - RNA, 64 nt, Human
acauuuugagauugggcauucagaugaugggguuucacccaaccuuggggcagguuuuuaaaaa

SEQ ID NO: 382036 - RNA, 64 nt, Human
cucucagcacgggcggaagaaacucccggagagcucacccaaaaaacaaggagaucccaucuag

SEQ ID NO: 382037 - RNA, 64 nt, Human
gagccagcaucccccaacucccaccccucugccaucacccaacccaaacacaucagcuuucaaa

SEQ ID NO: 382038 - RNA, 64 nt, Human
acaucuaaauagcaauauuuugaauacuggaaacucagguuaaagauuuuguuuccaaguagaa

SEQ ID NO: 382039 - RNA, 64 nt, Human
aaacucaaaggacagauuagggaucgagauugggucagguuagcaugggguugugguugaaaua

SEQ ID NO: 382040 - RNA, 64 nt, Human
uaucaucaaaugcauuuuugaagacaucaaagacucagguuaaaacuauuuugguaagugcagc

SEQ ID NO: 382041 - RNA, 64 nt, Human
cacgcugguuucugugcaguguuaggaaaaccaaucagguuauugcauugacuucacucccaag

SEQ ID NO: 382042 - RNA, 63 nt, Human
aaguccaucagcugccuugaucagagagagaauucagguuaccaagacggaaggugucuugaa

SEQ ID NO: 382043 - RNA, 64 nt, Human
guaauuucacaacaccuaaggauuuuuugguugaucagguuacuguagauuuuuacugauuguc

SEQ ID NO: 382044 - RNA, 64 nt, Human
agguccuaagugaucucuuuuucugagcaggauaucagguuaaaaaaaaaaaguuacuggcugg

SEQ ID NO: 382045 - RNA, 64 nt, Human
cagcaagcaaucagguaaugaugugcgaguccccucagguuauagaaauuauguuguauuuagu

SEQ ID NO: 382046 - RNA, 64 nt, Human
acuggauugaccuacuagguacccaguggcagucucagguuaagaaggaaaugcagccucagua

SEQ ID NO: 382047 - RNA, 64 nt, Human
agacaaauaauuuguuuucauuaucauuguauaaucagguuaaugauuuauuuuuugacuaaau

SEQ ID NO: 382048 - RNA, 64 nt, Human
uucccucccuaauaacuguaaauauauaaauaugucagguuaaagggaaaagguguucagggca

SEQ ID NO: 382049 - RNA, 64 nt, Human
aggcuaagccgcagagacccucucagcccccaccucagguuagggcucugcccgcagccugacc

SEQ ID NO: 382050 - RNA, 64 nt, Human
ugagaagaauuaucguauuccacguuuuuagcccucagguuaccaagauaaauauauguauaua

SEQ ID NO: 382051 - RNA, 64 nt, Human
aucuuugucaucuguuuuuuuccccuagacaauaucagguuaccgucaacauuaauccauuuaa

SEQ ID NO: 382052 - RNA, 64 nt, Human
gagaggaugagagcccagagguaacagaacagcuucagguuaucgaaauaacaauguuaaggaa

SEQ ID NO: 382053 - RNA, 64 nt, Human
gaagucuuagucuuucccucaguagcgguuucuuucagguuaacaagaggcauuugugcacaca

SEQ ID NO: 382054 - RNA, 64 nt, Human
gcuuuccgggcacccauccauccaggcacccaacucacccaagcagcaacgagcaacaaucgga

SEQ ID NO: 382055 - RNA, 64 nt, Human
cucuguagccuggcagucugacccaaaguugcccucacccaaagguucuggcucuucccucccu

SEQ ID NO: 382056 - RNA, 64 nt, Human
ccaucauucagcuggucaucugguggcccaaaggucacccaaagagucagcaaucagcaugucc

SEQ ID NO: 382057 - RNA, 64 nt, Human
gauguggaaggcaccuucuagaagagagcgugccucagguuacuugaacuugaacggagacugu

SEQ ID NO: 382058 - RNA, 64 nt, Human
ggguggggaccagcuggccacauggugcugcuuuucagguuaggggagagguggcccugaggga

SEQ ID NO: 382059 - RNA, 64 nt, Human
ugacugacauacuggaagagaacaccauuuuaucucagguuagugaagaaucagugcagguccc

SEQ ID NO: 382060 - RNA, 64 nt, Human
uaacguggcgguguggcugccuggaccuccucuuucagguuaacgcugacagaauggaggcuca

SEQ ID NO: 382061 - RNA, 64 nt, Human
gcaacauaacuaccaucucucucuuaaaacgagaucagguuagcaaaugauguaaaagaagcuu

SEQ ID NO: 382062 - RNA, 64 nt, Human
uggaauggcaguguagguagcuucaggaaauggcucagguuaauucucaaaacacaaauuguug

SEQ ID NO: 382063 - RNA, 64 nt, Human
ccagucaaaucuguagagaagcagugugacaucuucagguuaccauuauuuuuuaaugagcagg

SEQ ID NO: 382064 - RNA, 64 nt, Human
cuuggcuguaaccuauagaaucucuauccacguaucagguuauagacugguuuuucaaaaguga

SEQ ID NO: 382065 - RNA, 64 nt, Human
ucagaucuuaauaaaaagaaaaaaaaaaacgcauucagguuaaauuuggccuuaauuuaauaua

SEQ ID NO: 382066 - RNA, 64 nt, Human
accuacauauuuauuacuauaauuugcuaugacuucagguuaauuuauuuguguuugcauaguu

SEQ ID NO: 382067 - RNA, 64 nt, Human
uguacaauauugauucccaucuggcauauucuaaucagguuauaggucaauaaaguuuuugaau

SEQ ID NO: 382068 - RNA, 64 nt, Human
ggagcugguugaacuacaugugacuacuuaaguuucagguuaccagcaaaagccggguuucauu

SEQ ID NO: 382069 - RNA, 64 nt, Human
auguauugugaaacgaacacaagauuaagcuuugucagguuaauguagcauguuaaggacucua

SEQ ID NO: 382070 - RNA, 64 nt, Human
cugaucgugacuaucagugaaagaaguuuaauuuucagguuagaaaaugugaucuggcaguuua

SEQ ID NO: 382071 - RNA, 64 nt, Human
aaauguaauuaaagucuauguuuucaguuaugacucagguuaagaaauguguuuuaggaucuac

SEQ ID NO: 382072 - RNA, 64 nt, Human
uucuuaaaaauuuauaugauucaaaaccauuucuucagguuaaauugaggcauuuuaaucugca

SEQ ID NO: 382073 - RNA, 64 nt, Human
caacaaggcccucugcccacccucucacuaggccucacccaacaccaguggaacuggagccucu

SEQ ID NO: 382074 - RNA, 64 nt, Human
uugcauaguggugaaaucugggcuuaguauacccucacccaaauaguauacauuguaccuagua

SEQ ID NO: 382075 - RNA, 64 nt, Human
aaccuuugaacagcccagagcuugcaaccuagccucacccaagaagacuggaaagagacauauc

SEQ ID NO: 382076 - RNA, 64 nt, Human
caccucucuguacucugggcucuaaaguuggaggucagguuaccugagguuugcaauuugcaac

SEQ ID NO: 382077 - RNA, 64 nt, Human
accaauaaguuaaaugaaguuagaguuauggucuucagguuagauuauggaccagaucugugag

SEQ ID NO: 382078 - RNA, 64 nt, Human
acacaauacuaaacugcuaaacaacuagauguaaucagguuaucaaaggcaaguagaguaauaa

SEQ ID NO: 382079 - RNA, 64 nt, Human
agcaucugccuaagucgugagucuguggguuggcucagguuaagcugagcuuggcugggcuugg

SEQ ID NO: 382080 - RNA, 64 nt, Human
cgacuguacuugauuaccagugaaguaagaugggucagguuacgacuuacaacuuuuguucuau

SEQ ID NO: 382081 - RNA, 64 nt, Human
agaugguuccugcacacagaaguuaccacaggggucagguuacuuucuucaaauagcagauuuc

SEQ ID NO: 382082 - RNA, 64 nt, Human
cucccuauauacccccaccccacaaagauuuucuucagguuaaaaaaaaaguuuaaaaaaaaga

SEQ ID NO: 382083 - RNA, 64 nt, Human
cugugacagcugugauuugacacguuuuaauugcucagguuaaaugaaauaguuuuccggcguc

SEQ ID NO: 382084 - RNA, 64 nt, Human
acaagucaaucagugacuagcuuccuguagccaaucagguuaaagagugcguugguaacuuugc

SEQ ID NO: 382085 - RNA, 64 nt, Human
ggcagauuccaggaaugaagaauuaggcuugguuucagguuacauaaauaauagagcagauggu

SEQ ID NO: 382086 - RNA, 64 nt, Human
cugcuaggaugaagcccuaaagaaugcaaccuagucagguuagcugaaccgacacucaaaacgc

SEQ ID NO: 382087 - RNA, 64 nt, Human
gguuugcuuuugccacuuucaagauuuuaacuucucagguuauuaaucaaaauuauuguauaag

SEQ ID NO: 382088 - RNA, 61 nt, Human
uauaugaccccagggccugagaccugcaggaucagguuagggcgagcgcuaccucuccagc

SEQ ID NO: 382089 - RNA, 64 nt, Human
cagaagauuuccccucaguuuccauugacuuagaucagguuacagagaaaggcaaugucugaca

SEQ ID NO: 382090 - RNA, 64 nt, Human
ccuuuauagccauuacugucuuguuucuuguaacucagguuagguuuuggucucucuugcucca

SEQ ID NO: 382091 - RNA, 64 nt, Human
ugaaaucaguuugcaucucuucaaaagaaaccucucagguuagcuuugaacugccucuuccuga

SEQ ID NO: 382092 - RNA, 64 nt, Human; identical to SEQ ID NO: 186594

SEQ ID NO: 382093 - RNA, 64 nt, Human; identical to SEQ ID NO: 186598

SEQ ID NO: 382094 - RNA, 64 nt, Human; identical to SEQ ID NO: 186604

SEQ ID NO: 382095 - RNA, 64 nt, Human
ccacacaguuguugcugccuauuguggugccgccucagguuaggggcucucagccaucucuaac

SEQ ID NO: 382096 - RNA, 64 nt, Human
aagaaacuccuaauuaaaagguuuuuuccaaaauucagguuauugaaaacuuuucauuuuauuc

SEQ ID NO: 382097 - RNA, 64 nt, Human
ggguccuucuuuccagcacauuuuuuuuaaaaacucagguuagaacaaaaaugucauaaagggc

SEQ ID NO: 382098 - RNA, 64 nt, Human
cuuggggagguugggcugguaaauauuugcaaggucagguuaagcagacagacaauugaaaaua

SEQ ID NO: 382099 - RNA, 64 nt, Human
cugcccagguggaacacuggcauuuuguugacugucagguuaggugucccuuagucgucaucag

SEQ ID NO: 382100 - RNA, 64 nt, Human
cuaaacaccuaagagcugaagucaggucuuuuaaucagguuagaauucuaaaugaugccagaga

SEQ ID NO: 382101 - RNA, 64 nt, Human
aagcaccacaaggaaaaaaaaaauuauuaauagcucagguuaaaaacacccauuuaaacaaaaa

SEQ ID NO: 382102 - RNA, 64 nt, Human
cuuuaaaagaaggaugaacaauuauauuuauauuucagguuauauccaauaguagaguuggcuu

SEQ ID NO: 382103 - RNA, 64 nt, Human
gacagugagaaaaugauaagcauaaagagaaguaucagguuauuugcuuuuuccaaacuuuuca

SEQ ID NO: 382104 - RNA, 64 nt, Human
aaauuaaggaucuuugaagcucugaaauaggugaucagguuaguggugucugucagcugucuaa

SEQ ID NO: 382105 - RNA, 64 nt, Human
acuaguuuuauaugaaacuagauuuuuauugcgcucagguuauguuccuuuuaccuccuuccuu

SEQ ID NO: 382106 - RNA, 64 nt, Human
agaauuugucgagggagagaauaaccugguguguucagguuauucuuagagacuacacauuugg

SEQ ID NO: 382107 - RNA, 64 nt, Human
uuuucaaagagauauauauaaugcauuuauucugucagguuaaaauguaaaguaugaucuuuau

SEQ ID NO: 382108 - RNA, 64 nt, Human
uccacugccccaccccuuagacaccaugaccccaucagguuaauccccuguugccaugguuaug

SEQ ID NO: 382109 - RNA, 64 nt, Human
ucacccacaccccccuggggacuucaguuccauuucagguuaccugggguauaccuugaucccu

SEQ ID NO: 382110 - RNA, 64 nt, Human
ugcuuugggacagauuuuauauuaugucaauugaucagguuaaaauuuucaguguguaguuggc

SEQ ID NO: 382111 - RNA, 64 nt, Human; identical to SEQ ID NO: 186608

SEQ ID NO: 382112 - RNA, 64 nt, Human; identical to SEQ ID NO: 186614

SEQ ID NO: 382113 - RNA, 64 nt, Human; identical to SEQ ID NO: 186618

SEQ ID NO: 382114 - RNA, 64 nt, Human
ucaggccucaugagggucuccacagggccggagcucagguuacaccacuccuucguccuuacag

SEQ ID NO: 382115 - RNA, 64 nt, Human
cagcgagccucccuucuuuguuugaauucucuaauaagagcaacagcagcucccauuucuagaa

SEQ ID NO: 382116 - RNA, 64 nt, Human
guuauucuuucuaaucucaauccuguucuuuguuuaagagcaauacuugucgugauuacaggga

SEQ ID NO: 382117 - RNA, 60 nt, Human
cugaaagcagauucaauuagucuucaaaccuaagagcauuuacacaauacacaaggugua

SEQ ID NO: 382118 - RNA, 64 nt, Human
uaauuuuacacaaauauuuaagaggaaagaguauuaagagcaauucaaaaaaaguaaccuuaua

SEQ ID NO: 382119 - RNA, 64 nt, Human
auuucagauuguauuuaauuuaaauauuuguauauaagagcaaaugucugaauguggccugaau

SEQ ID NO: 382120 - RNA, 64 nt, Human
uaacacaguuuaaauuguuaugauaacaaguaaauaagagcaaagaauguauuucuuaauucaa

SEQ ID NO: 382121 - RNA, 64 nt, Human
uaaugauaaauguaaaauaucuaaagcaugaaucuaagagcacgcaauauauaauuuuaaagaa

SEQ ID NO: 382122 - RNA, 64 nt, Human
uggaagaucaaaaucaugucucuugcugauaaccuaagagcauuaagcucugaguccagugagg

SEQ ID NO: 382123 - RNA, 64 nt, Human
aggauucuguggauguuacuuaaagagaaaagcauaagagcaugaagcauaucugggaauaucu

SEQ ID NO: 382124 - RNA, 64 nt, Human
cucugcagauucccuuuauuuaggaaaacaggaauaagagcaaaauuaucaccaaaaagugcuu

SEQ ID NO: 382125 - RNA, 64 nt, Human
uguaaagaauauguauaaauguuuuacacgaauguaagagcauguagaagccaacauauaaaua

SEQ ID NO: 382126 - RNA, 64 nt, Human
gacccugaaaaagcccauuuuagaaccuguuuaauaagagcaaauauaggggaaaaucuuugaa

SEQ ID NO: 382127 - RNA, 64 nt, Human
auuacagggaaggaacccaugaaaacaucaguguuaagagcaugaugaaaggugucaauaaagc

SEQ ID NO: 382128 - RNA, 64 nt, Human
aaaagcuuaggcugauagacaaguaguuaagagcuaagagcaguacucugaaggaauaggcaaa

SEQ ID NO: 382129 - RNA, 64 nt, Human; identical to SEQ ID NO: 186621

SEQ ID NO: 382130 - RNA, 64 nt, Human; identical to SEQ ID NO: 186627

SEQ ID NO: 382131 - RNA, 64 nt, Human; identical to SEQ ID NO: 186631

SEQ ID NO: 382132 - RNA, 64 nt, Human
uccuggcugcaagcacaauagccugaaugggauuucagguuaggcagggugggaggggaggcuc

SEQ ID NO: 382133 - RNA, 64 nt, Human
gagaaauuccuggaaucuggaccccauggcccagucagguuacacaaaacugaucaucacagau

SEQ ID NO: 382134 - RNA, 64 nt, Human
cuaggccugauauccaacagaaagcauagacgucucagguuauucguuacucuaagguaaaacc

SEQ ID NO: 382135 - RNA, 64 nt, Human
accuuuuuuuuucuuuuaauccuuuugguagaaaucagguuacaaagcaaaaccacaauaucag

SEQ ID NO: 382136 - RNA, 64 nt, Human
ugagacccccauaucccagaguccccagccucccucagguuacucugcaccccacagaugguuu

SEQ ID NO: 382137 - RNA, 64 nt, Human
cccauugacaccuuuguuucgugugcuuuuaaauucagguuaaauguugcaauaaucugaugca

SEQ ID NO: 382138 - RNA, 64 nt, Human
ugguuuugauuguucacauuucuauucuaaaaucucagguuaucuccugaacacuuuugggcag

SEQ ID NO: 382139 - RNA, 64 nt, Human
uaguuuguaaguaaaaguuuuuaguuuucaguguucagguuauagaauauaacugaccauaaaa

SEQ ID NO: 382140 - RNA, 64 nt, Human
ccagccccuauugggaaaaauuacccaguauaguucagguuaugaggaggaucagccacacaau

SEQ ID NO: 382141 - RNA, 64 nt, Human
ucugagcucuguacccaaauuaaaauccugauguucagguuaauccaagcaacacgcauugggu

SEQ ID NO: 382142 - RNA, 64 nt, Human
agccaugguugugccugccguucaugguggucuuucagguuaucuuggcaacauguacauugcu

SEQ ID NO: 382143 - RNA, 64 nt, Human
ggggggcugagggugggauucucgcuccuucauuucagguuacucguucuucagcaaguuggca

SEQ ID NO: 382144 - RNA, 64 nt, Human
uucagauaaucacaaccacuuugcccccaaguuuucagguuaaguagcaugaauuuggucauuc

SEQ ID NO: 382145 - RNA, 64 nt, Human
cgaaaacugggggcaaggcagaggacagguuuucucagguuaagagaaaaacgaaauuuuaaaa

SEQ ID NO: 382146 - RNA, 64 nt, Human
ccgcguccugaauuucuucacuagagcuuccucaucagguuacccagaagugggucccauccac

SEQ ID NO: 382147 - RNA, 64 nt, Human
uuauuggguuuugauuugauuuuuuguaagccagucagguuauuuaaugaugagguaauaauca

SEQ ID NO: 382148 - RNA, 64 nt, Human; identical to SEQ ID NO: 186637

SEQ ID NO: 382149 - RNA, 64 nt, Human; identical to SEQ ID NO: 357803

SEQ ID NO: 382150 - RNA, 63 nt, Human; identical to SEQ ID NO: 357806

SEQ ID NO: 382151 - RNA, 64 nt, Human
uccccaaagugauccuaagaauguacaguugagcucagguuagauauuucgacccuggggcgug

SEQ ID NO: 382152 - RNA, 64 nt, Human
agcuguuucucucuuuaaucucacguagccuuuuucagguuaguacguguucuucugucagggc

SEQ ID NO: 382153 - RNA, 64 nt, Human
guguauauauacacauauguguguaugcaguuugucagguuauauauagaauuucuauuaagga

SEQ ID NO: 382154 - RNA, 64 nt, Human
uaagaaucucuucaguucauauuucauuuccaacucagguuaaguguuucuggggagagauguu

SEQ ID NO: 382155 - RNA, 64 nt, Human
aaggacagaaaauucccugacaggugggcaaguaucagguuaccuauuuuuuauuccuuuggua

SEQ ID NO: 382156 - RNA, 64 nt, Human
gccccauucugaagaauuauucuuucccaguuacucagguuaugaaugaauuagguuuucaaca

SEQ ID NO: 382157 - RNA, 64 nt, Human
cugagauuuugugccauuccuuuuaaaauauucaucagguuagguggggcugugggggaaaagc

SEQ ID NO: 382158 - RNA, 64 nt, Human
uucccccaaaaguacaaguuuuugaguagcaaugucagguuaaguaaagaaacuucaucacauc

SEQ ID NO: 382159 - RNA, 64 nt, Human
uguaagaagccaauuuuuguguauuguuacaguuucagguuauuuauauucgauguuuuguaaa

SEQ ID NO: 382160 - RNA, 64 nt, Human
ggggcuggcacagagcugagcugcucagccaccaucagguuaauuggauggcgccagucuggcu

SEQ ID NO: 382161 - RNA, 64 nt, Human
ucaugcaccccuuuuuuccccagaggggcuggacucagguuaguuugggggugggggcuccugc

SEQ ID NO: 382162 - RNA, 54 nt, Human
cccuucaacgacaguauugaguggucagguuacaauaaaccggagagaaaaggu

SEQ ID NO: 382163 - RNA, 64 nt, Human
augauacaaaaauauuuucauuuaauaaagauugucagguuauauuuaauaagaaagaaaguau

SEQ ID NO: 382164 - RNA, 64 nt, Human
ggagccucccccagcuuccugcagccccgaccucucagguuagacccugggcccuggagcuuag

SEQ ID NO: 382165 - RNA, 64 nt, Human
aggucaaaggacauuuggaaauggcuacuuaccuucagguuauaaaaucuuuuauuccauuguu

SEQ ID NO: 382166 - RNA, 64 nt, Human
uaccaaaaccacagugccgacagcucuccaauacucagguuaaugcugaaaaaucauccaagac

SEQ ID NO: 382167 - RNA, 64 nt, Human; identical to SEQ ID NO: 357810

SEQ ID NO: 382168 - RNA, 64 nt, Human; identical to SEQ ID NO: 357816

SEQ ID NO: 382169 - RNA, 64 nt, Human; identical to SEQ ID NO: 357822

SEQ ID NO: 382170 - RNA, 64 nt, Human
ggcccuuagggaccacugaaugccccgaucccaaucagguuaaucagaaucacuuagagaacuu

SEQ ID NO: 382171 - RNA, 64 nt, Human
gaucuuauuugcucugcaaagaugaaucccugccucagguuagggugagacaaaaucggucugg

SEQ ID NO: 382172 - RNA, 64 nt, Human
auauuuaagaacuuuuuauuaaaaguuucaaauuucagguuacugcugcgauugauguagugga

SEQ ID NO: 382173 - RNA, 64 nt, Human
aaaagaaagauacucauuuauaguuacguucauuucagguuaaacaugaaagaagccugguuac

SEQ ID NO: 382174 - RNA, 64 nt, Human
aaauuuauauuaauaaauuacuaaacuaagaguaucagguuauuuauauauuugcaagcaaagg

SEQ ID NO: 382175 - RNA, 64 nt, Human
aaauagaaaauucugccgucugagguuuuauacuucagguuaguuaguuuuuggaaggaagaac

SEQ ID NO: 382176 - RNA, 64 nt, Human
auuuagugcucaauuuacuaaccuuacuucacauucagguuagauguuaccuccaccuauauga

SEQ ID NO: 382177 - RNA, 64 nt, Human
gggcaaggcccccgcggaauccugcagagcaaacucagguuaacuuggguccaugaccguuugc

SEQ ID NO: 382178 - RNA, 64 nt, Human
uucuaaguugaacagaacuuuguccuuuuuucuuucagguuaucugaguucauuggagugggug

SEQ ID NO: 382179 - RNA, 64 nt, Human
acacacacacacguacaugcacacauuuuuccugucagguuaacuuauuuguagguucugcauu

SEQ ID NO: 382180 - RNA, 64 nt, Human
ggagaaagaggcccuggacuucccaaggaaagggucagguuagggcuccuguacccauucuguu

SEQ ID NO: 382181 - RNA, 64 nt, Human
aggagaccuggaggagcagaggauaauuagcaucucagguuaagugugaguaaucugagaaaca

SEQ ID NO: 382182 - RNA, 64 nt, Human
uauuguuuuaucuaucugucuuugcaagcagucuucagguuaaagauacuucuaacagguuaca

SEQ ID NO: 382183 - RNA, 64 nt, Human
gcaugcuuuccauauuuuuuuccuuacauaaacaucagguuaggcaguauaaagaauaggacuu

SEQ ID NO: 382184 - RNA, 64 nt, Human
ugggaaggugauggguauuagugggggacugaguucagguuaccagaaccaguaccucaguauu

SEQ ID NO: 382185 - RNA, 64 nt, Human
ugccacuacauuguuauuccaccuuaucuuugcgucagguuaacauaucuuaacauauuuuuuu

SEQ ID NO: 382186 - RNA, 64 nt, Human
guuguuguuguuuuugagacagggucuugcucugucacccaagcuggaauacaguggcaugauu

SEQ ID NO: 382187 - RNA, 64 nt, Human
uccucgaaaugauaauaucuccagaauauuguuuucacccaaauuugaguagauauuuuaaaca

SEQ ID NO: 382188 - RNA, 64 nt, Human
cccagagccgcaggacggagacugggggcagcccucacccaacucacaacaggcuggaugggug

SEQ ID NO: 382189 - RNA, 64 nt, Human
ccugaagcacccugcuguggcaccagcaggaagcucagguuaauuuuacacuagcuugcucacu

SEQ ID NO: 382190 - RNA, 64 nt, Human
aagacauugagcucaaaugaugcagauguuguuuucagguuaauggacacgcaaagaaaccaca

SEQ ID NO: 382191 - RNA, 64 nt, Human
aaacuuugaaaaagauauuuaugauguuaacauuucagguuaagccucauacguuuaaaauaaa

SEQ ID NO: 382192 - RNA, 64 nt, Human
aaucccagcacuuugggaggcugagguagguggaucacccaaggucaggaguuugagaccagcc

SEQ ID NO: 382193 - RNA, 64 nt, Human
cuuugcaagugaacccugcagcucacccauucauucacccaacuuccuucauucagcaggaggu

SEQ ID NO: 382194 - RNA, 64 nt, Human
gccucucuagccugcacaaaugauugacaagagaucacccaaaggauuauuucugaagguguuu

SEQ ID NO: 382195 - RNA, 64 nt, Human
aagaagcaguauguauagaggccuguggcuuaugucacccaacagagggguccugagaagucug

SEQ ID NO: 382196 - RNA, 64 nt, Human
gcacaagcagugaaagaggauccagcccugagcaucacccaagugccugaugccucaggugaca

SEQ ID NO: 382197 - RNA, 52 nt, Human
aaaugcguaggcugacauaguaucacccaaucccugaagcaagaauacaaag

SEQ ID NO: 382198 - RNA, 64 nt, Human
uuaucuacaugauguuuauaguuccugugguuuuucacccaagaagcagaaucucauucaguac

SEQ ID NO: 382199 - RNA, 64 nt, Human
ggaauagugaacuggggccaugucaguuugucacucacccaaacugaccaauaaaaccuuuauu

SEQ ID NO: 382200 - RNA, 64 nt, Human
ugauaagcaagaaagcgucacagccagcgucuguucacccaagguugacaagugaaguuucucu

SEQ ID NO: 382201 - RNA, 64 nt, Human
ugugucuuaaauacucauaggggaaaaaaacagcucacccaagguguuagguuucacauauaua

SEQ ID NO: 382202 - RNA, 64 nt, Human
uucauuuuuuuuuuugagauggagucucucucugucacccaaguuggagugcaguggccccgca

SEQ ID NO: 382203 - RNA, 64 nt, Human
gcuggcugugaagucgggauaaucaguagaauucucacccaaacagcaacauuucuaaggaacu

SEQ ID NO: 382204 - RNA, 64 nt, Human
ucauggagaguaacaggccugcuggugaaacaggucacccaaaauggagauggcaucaaacuag

SEQ ID NO: 382205 - RNA, 64 nt, Human
agcauugguccccaagccagagagccagaagccaucacccaaugaccgccccuuccuuccgguc

SEQ ID NO: 382206 - RNA, 64 nt, Human
gacaccccacuggcuauugcccuauaccugccaaucacccaaagaaaauaauagcuucugagaa

SEQ ID NO: 382207 - RNA, 64 nt, Human
ccccaggccacagcaggacaggccgggacaggccucacccaaggccaaggcuggcaucagccaa

SEQ ID NO: 382208 - RNA, 64 nt, Human
uccguggaagaacacauggaucucucuggcuuucucacccaaguuggccacuuacgcuaauccu

SEQ ID NO: 382209 - RNA, 64 nt, Human
ugccccugcucaucugguccugaaguaguaacauucacccaaaugaggauauagucauuauucc

SEQ ID NO: 382210 - RNA, 64 nt, Human
cuucuuggggcccagugcaugguggccagaggugucacccaaaccggcaggugcgauuuuguua

SEQ ID NO: 382211 - RNA, 64 nt, Human
gaugguauaaaaauggcucugguucaauaagcagucacccaaaguaaagacucuaucuugaaag

SEQ ID NO: 382212 - RNA, 64 nt, Human
cuuuccaaaguuaacagauuuugggguuguguugucacccaagagauuguuguuugccauacuu

SEQ ID NO: 382213 - RNA, 64 nt, Human
gaguuagcaacacuguuuucuuuacgagagggucucacccaaauuuauggggagaaaucuauuu

SEQ ID NO: 382214 - RNA, 64 nt, Human
uauuucgcuguccugaaacuuucagugaaagagaucacccaacaucaauaacuugucauaauau

SEQ ID NO: 382215 - RNA, 64 nt, Human
uuauuuacccuuguaauugugcauagggaagcacucacccaaugagacuuucuccaauguggac

SEQ ID NO: 382216 - RNA, 64 nt, Human
auguggcaccaacuaauuagcaagcaugaauuuuucacccaagagugaaaaaaggaaaaucuac

SEQ ID NO: 382217 - RNA, 64 nt, Human
auuucacugccuuaauguguucuggagagcgugcucacccaagucuauggacauguaccagagc

SEQ ID NO: 382218 - RNA, 64 nt, Human
guccaggugcacacuaagaacagccuggucuucaucacccaaagugccucauaggcaaugcuca

SEQ ID NO: 382219 - RNA, 64 nt, Human
augauuuuagcaauacccaugucuacacagauguucacccaaccacaucccacucacaacagcu

SEQ ID NO: 382220 - RNA, 64 nt, Human
aggcccuaucuaagaagcucaugguauacaagggucacccaaauagcugagugcaguccuugcu

SEQ ID NO: 382221 - RNA, 64 nt, Human
cuauuaauaaaaauggaaucauuaaauacucucuucacccaaauaugcuugauuauucugcaaa

SEQ ID NO: 382222 - RNA, 64 nt, Human
aaguuguaauuacuauauaggaaaaacuaaguugucacccaauaucuuagacacuuugagagca

SEQ ID NO: 382223 - RNA, 64 nt, Human
ugaggaggaugaauuucagcaaauuuugaacugcucacccaacuucugcuaucuugcucccucc

SEQ ID NO: 382224 - RNA, 64 nt, Human
cucucucucuggccucugggccguuugguaguaaucacccaagggcugguaaagccccuccucu

SEQ ID NO: 382225 - RNA, 64 nt, Human
ucuagaaaguuauuuucaacugauaaaucuauauucacccaaauaaucaagggugaagguaaaa

SEQ ID NO: 382226 - RNA, 64 nt, Human
aagaaccaaaaguuuuccugagaauaagaaaguuucacccaauaaaauauuuuugaaaggcaug

SEQ ID NO: 382227 - RNA, 64 nt, Human
aauacuacuaauuauuguagguuuuuuuaacguaucacccaaagcauguaugugaucuuucccc

SEQ ID NO: 382228 - RNA, 64 nt, Human
uccagucaacuaugggacugaagguccuaauugcucacccaagggggcugcuuaacacaaacag

SEQ ID NO: 382229 - RNA, 64 nt, Human
uuacgccuuuauaaggccuuagauguaaauaaacucacccaaacaaaaaaacuuuuugagacua

SEQ ID NO: 382230 - RNA, 64 nt, Human
uauaugcuucuuuauuucuugcaaggggcaaguuucacccaaaugccugagacugcuugaaaga

SEQ ID NO: 382231 - RNA, 64 nt, Human
uuguuagacaacuguugaaaacuccagaaauacaucacccaagguggcaguucucaguauuugg

SEQ ID NO: 382232 - RNA, 64 nt, Human
aagugcauuuaguugaaugaagucuucuuggauuucacccaacuaaaaggauuuuuaaaaauaa

SEQ ID NO: 382233 - RNA, 64 nt, Human
uuacuccucagagaaugaaaaaaacugcaucccaucacccaaaguucugugcaauagaaauuuc

SEQ ID NO: 382234 - RNA, 64 nt, Human
uguuaggggagcuugggucccugaacacugucauucacccaauaaauuacuauuugaccccaga

SEQ ID NO: 382235 - RNA, 64 nt, Human
gccuuuuuuuuuuuugagacggaguguugcucugucacccaagcuggagugcaguggcacgauc

SEQ ID NO: 382236 - RNA, 64 nt, Human
ccucaaugaaugggaugucuaauguauuucaaaaucacccaaaacuuuuggcaaauaaaagcau

SEQ ID NO: 382237 - RNA, 64 nt, Human
augcauauguaaauuuuuuuuuguuuuuaagcauucacccaaacaaaaaaaucacagguaaacc

SEQ ID NO: 382238 - RNA, 64 nt, Human
uauucaucgcaaagucucuagcgucauauuuuucucacccaaauuacguuuccacgagauuauu

SEQ ID NO: 382239 - RNA, 64 nt, Human
cugucccacuuaacugaccucacuggaggcuacaucacccaaaguagauguuagaaaaccuaaa

SEQ ID NO: 382240 - RNA, 64 nt, Human
ugcacugcccggccuucagaaagacagaauuucaucacccaaugcagggggagcucuuccugga

SEQ ID NO: 382241 - RNA, 64 nt, Human
gagcucuuccuggaccaagggaggagccgcucauucacccaacaaaacugugucuuaucugcca

SEQ ID NO: 382242 - RNA, 64 nt, Human
uugcaugccaaauuguaguucuugucugauuggcucacccaagcaaggccaaaauuaccaaaaa

SEQ ID NO: 382243 - RNA, 64 nt, Human
cucagcccugacuggugcuauaggcuggagaagcucacccaauaaacauuaagauugaggccug

SEQ ID NO: 382244 - RNA, 64 nt, Human
gugaccgaguaaagugagaggcaggugagacgguucacccaaucacacgggaaggggcgcgcgc

SEQ ID NO: 382245 - RNA, 64 nt, Human
ccccccuucccccaacaggcaaugccucuaaaaaucacccaauaaagacaggcuucucaacauc

SEQ ID NO: 382246 - RNA, 64 nt, Human
uucggacguaugguccaaauucagauuaagguggucacccaacccgagaugucaggaaaggccu

SEQ ID NO: 382247 - RNA, 64 nt, Human
uguauuggcuugaaugugauuuucauuccuugauucacccaacaaauaccgacuggcugagcac

SEQ ID NO: 382248 - RNA, 64 nt, Human
agaauaaggaacaaaauaaacccuuguguauguaucacccaacucacuaauuaucaacuuaugu

SEQ ID NO: 382249 - RNA, 64 nt, Human
guaaccaccaccgccagaaccaaaaacguuucugucacccaaagaaguucccuuuugccuuuuc

SEQ ID NO: 382250 - RNA, 64 nt, Human
ugguguguauguaaagagauaggggagaaaaaccucacccaaguucuuauacguuauuuuaaac

SEQ ID NO: 382251 - RNA, 64 nt, Human
ugucuucccaguacguaaguuaaaaaauaccaguucacccaaguugcuucuagccuacugagau

SEQ ID NO: 382252 - RNA, 64 nt, Human
aucccaaaugugauaguagcuucaguauguuuccucacccaaaaaccauuuggcuggcagaaau

SEQ ID NO: 382253 - RNA, 64 nt, Human
uuuccaggcgaugcucgugugccccuggcguggcucacccaaguuccucgacugagggccggug

SEQ ID NO: 382254 - RNA, 64 nt, Human
caaaaaaucuuccuucuuauaacugagaaauguuucacccaaauuuccuuuguuauuauauauu

SEQ ID NO: 382255 - RNA, 64 nt, Human
gagccaggcuuggauggaacaugcccacaacuugucacccaaagccugucccaggacucacccu

SEQ ID NO: 382256 - RNA, 64 nt, Human
gugauaagaaauuucuagacacaacagcuuaaaaucacccaaauuucaguucuuuaccuacugc

SEQ ID NO: 382257 - RNA, 64 nt, Human
uuuggaaugagcuuccacacuucagucuaaaaucucacccaaacuuauggcuacauauuuuucu

SEQ ID NO: 382258 - RNA, 64 nt, Human
gauuggguaggugaaggggucaggggacugguagucacccaaucuuggagaggugcaaaaagca

SEQ ID NO: 382259 - RNA, 64 nt, Human
cucagauaauaaauaagagaccaaaaguaggcuaucacccaaagcaaacauccuuaacugaccc

SEQ ID NO: 382260 - RNA, 64 nt, Human
caggcugacuuacaugcuccacaugggaccugugucacccaaugagauguuuguuacucuggua

SEQ ID NO: 382261 - RNA, 64 nt, Human
augugguaaguggccaaccaagcccuacccagggucacccaacacacucugccuugagccucuc

SEQ ID NO: 382262 - RNA, 64 nt, Human
aaguccagaaggcaguagggaucccaagacgaccucacccaaagggcucccuggcucuccucug

SEQ ID NO: 382263 - RNA, 64 nt, Human
caaaaagcaaauacuagaacagcuagcucaucguucacccaauguacuugguauuuuucugcac

SEQ ID NO: 382264 - RNA, 64 nt, Human
ccuacccugccugcacuccuccaccaucacaaucucacccaaacuccugcucacucaagcaaaa

SEQ ID NO: 382265 - RNA, 64 nt, Human
gagaacguggaaucccacggguuuuuacugcccuucacccaaccucucccaccuccaccccaca

SEQ ID NO: 382266 - RNA, 64 nt, Human
ccuucguaccugcaauaugucaggagccucacgcucacccaagauccugcaggggccaggcucc

SEQ ID NO: 382267 - RNA, 64 nt, Human
uuuaaaccuaggcuuaauauaggcguuuccccuuucacccaagugaugucacaguucgaugcaa

SEQ ID NO: 382268 - RNA, 64 nt, Human
gagacucugucggaugaagaaguacuucugugucucacccaagugcuccggagagugacaggua

SEQ ID NO: 382269 - RNA, 64 nt, Human
gcacauuuaacugcuuagaagguacucuuuaaugucacccaauuaaaaagaacaaauuguaaaa

SEQ ID NO: 382270 - RNA, 64 nt, Human
cuccuuugcaacaggaaaagucuguuuuguguucucacccaaagguuuuaaauaaggugacucu

SEQ ID NO: 382271 - RNA, 64 nt, Human
ccaauccauacacauacauaccuaggucauccuaucacccaaaagagggacaaacaucugacuu

SEQ ID NO: 382272 - RNA, 64 nt, Human
uguccuugauccacacugcuccuggcagagugagucacccaaaggccccuucggccuccuugua

SEQ ID NO: 382273 - RNA, 64 nt, Human
cgugguugcccaugagaaguguccuuguucauuuucacccaaaugaagugugaacgugauguuu

SEQ ID NO: 382274 - RNA, 64 nt, Human
aaaagaauuuuuuuugagacaaagucucgcucugucacccaagcaggauugcaguggcauaacu

SEQ ID NO: 382275 - RNA, 64 nt, Human
gcucucugcagccuccuccacuggcuucucuggcucacccaagcucucccuuacagaggcaaca

SEQ ID NO: 382276 - RNA, 64 nt, Human
gguuugcucuuugacaauaaauggagaaggaaggucacccaacuccauugggccacuccccucc

SEQ ID NO: 382277 - RNA, 64 nt, Human
uuuccugcgcgcacugcggagggcgcccuaagcgucacccaagcacacucacuuaaagaaaaaa

SEQ ID NO: 382278 - RNA, 64 nt, Human
aacuggaacauugauuguaaggccagugaaguuuucacccaacuggaauuugauggaaagaagg

SEQ ID NO: 382279 - RNA, 64 nt, Human
gacaauggcccuccuggugccucaccacagacccucacccaaaggaaccgcuccuugucccucc

SEQ ID NO: 382280 - RNA, 64 nt, Human
ccgcuauuuagguauuacuucugccagauauuuaucacccaauugccucugacacugacuaaga

SEQ ID NO: 382281 - RNA, 64 nt, Human
agaugaugaaauagccucugagagguuaagucacucacccaaaauuuccacugccaggaagugg

SEQ ID NO: 382282 - RNA, 64 nt, Human
cagggguacaaacauuggcucccaaggaacuggaucacccaacagccagccagccacauuuccc

SEQ ID NO: 382283 - RNA, 64 nt, Human
agcaucgagugucuucuuugucuucuuucucuccucacccaacucccuuugccucuccccaaac

SEQ ID NO: 382284 - RNA, 64 nt, Human
agcaguuaccuagacugaggcaagcuguguggacucacccaaguauauuucaguacugucaggc

SEQ ID NO: 382285 - RNA, 64 nt, Human
cccacucacugccccagggaccaacuuccuacccucacccaaggcuuuagaggaccuguagcau

SEQ ID NO: 382286 - RNA, 64 nt, Human
auucaaccaccgaugcccaccguggucuuugaacucacccaagcacccaccaggcaggcuacaa

SEQ ID NO: 382287 - RNA, 64 nt, Human
ggccaucagauuagcagggacgggguguagggcaucacccaagguuccuucucuuaaacuaagg

SEQ ID NO: 382288 - RNA, 54 nt, Human
uaacucggcauuugaccugaaguaucacccaaggaaaaugucauacauguguaa

SEQ ID NO: 382289 - RNA, 64 nt, Human
uuuuuuuuuuucauguuagcagguaaaaaaucauucacccaauuugaagcauagaagaaaauag

SEQ ID NO: 382290 - RNA, 64 nt, Human
cagacaucuccucaccccagugccugucuggagcucacccaaggucaccaaacaacuugguugu

SEQ ID NO: 382291 - RNA, 64 nt, Human
guugcuaggauuagagccucucagucuggccucuucacccaagugcaagaacucagucucuuac

SEQ ID NO: 382292 - RNA, 64 nt, Human
ugggggcuucugggaacccccguauucuucccccucacccaagggcagugggcaugaaucuacu

SEQ ID NO: 382293 - RNA, 64 nt, Human
aaaguacuacagcaaagccuagccugcauaucauucacccaaaacaaaguaauagcgccucuuu

SEQ ID NO: 382294 - RNA, 64 nt, Human
uagugcaucacaaugacaaaggggugguuuucuuucacccaagaaugugcuuuccuggaaauuu

SEQ ID NO: 382295 - RNA, 64 nt, Human
uuuuuuuuuuuuuuugagacaaggucucacucugucacccaagguggagugcagugacgacauc

SEQ ID NO: 382296 - RNA, 64 nt, Human
cucucccuccgagauacccacccagcuuugucaaucacccaagcacuuuaugcauauagagaca

SEQ ID NO: 382297 - RNA, 64 nt, Human
ggucgaaggcucugcugacugcuguccuuguccaucacccaauaccaccccaaacacaacucaa

SEQ ID NO: 382298 - RNA, 64 nt, Human
caauguccagcuuuuaccccuacucucuacuuuuucacccaaacugauaacauuuaucucauuu

SEQ ID NO: 382299 - RNA, 64 nt, Human
uggucccuagaacaagaggcuuaaaaccgggcuuucacccaaccugcucccucugauccuccau

SEQ ID NO: 382300 - RNA, 64 nt, Human
agaggcgcuagagcccauuccucuuucuccaccgucacccaacaucaauccuuuaccacucuac

SEQ ID NO: 382301 - RNA, 64 nt, Human
cucauucaggaaaacugacagaggagggcgugacucacccaagcauauauaacuagcuagaagu

SEQ ID NO: 382302 - RNA, 64 nt, Human
aacagaguuugaggguuucugggcggccuccgugucacccaaagucaugaucaauucaggagac

SEQ ID NO: 382303 - RNA, 64 nt, Human
ugaauuuucccucgacuuucacuuuguggguaaaucacccaauuuuaggcucuuuucugcaagg

SEQ ID NO: 382304 - RNA, 64 nt, Human
ucacagugugguaagguugcaaauucaaaacaugucacccaagcucuguucauguuuuugugaa

SEQ ID NO: 382305 - RNA, 64 nt, Human
agauaucauagagcugaacaaggaaacugaggaaucacccaaaugagugccaccaaguucuagg

SEQ ID NO: 382306 - RNA, 64 nt, Human
agccaagagaaccccacggacaagauuuuucauuucacccaauguucacaucugcacucaaggu

SEQ ID NO: 382307 - RNA, 64 nt, Human
ccuggaccacccaucugaccaucuccuuaagguuucacccaaagcccccagugucagagacuug

SEQ ID NO: 382308 - RNA, 64 nt, Human
cuuaguguccuuuucucauuuguggcuuucugcaucacccaaucaauaaaaaacaaauauauau

SEQ ID NO: 382309 - RNA, 64 nt, Human
caauacuauguuuugguuguaauauucaguucacucacccaauguacaaccaaugaaauaaaag

SEQ ID NO: 382310 - RNA, 64 nt, Human
gagcuggaaugaaggauuuauaaccuuucagucaucacccaauuuaauuagccauuugcaugau

SEQ ID NO: 382311 - RNA, 64 nt, Human
aaaaccccaaaacuaucacuuggaauuagcaauaucacccaacuggcuuuaaaauugaaaauuu

SEQ ID NO: 382312 - RNA, 64 nt, Human
uuguuaaaauguuaccuaugguaaugagcaaagcucacccaaacugugccccagauggaguaaa

SEQ ID NO: 382313 - RNA, 64 nt, Human
acgcaggaccaguuugauugaggagcugcacugaucacccaaugcaucacguaccccacugggc

SEQ ID NO: 382314 - RNA, 64 nt, Human
uauccgggaggauggccgcaccccuuccugcugaucacccaaacguggucucccguccagcccu

SEQ ID NO: 382315 - RNA, 64 nt, Human
ucguuuccucaaguuugacuguuuuaaugggguuucacccaaauuguuuaaugcuucugcugua

SEQ ID NO: 382316 - RNA, 64 nt, Human
guugcagggcugcagcccgccuuggcuuucucccucacccaaguuuccggaggagccgaccuaa

SEQ ID NO: 382317 - RNA, 64 nt, Human
auagauauauaaaccuuaaaaauaauaaaauaucucacccaagacuuaaaggaagaauucucug

SEQ ID NO: 382318 - RNA, 64 nt, Human
aaaaagcagcugcauuuuuuauuuaguuggaauaucacccaauuuuuuauuuuuauugcuauua

SEQ ID NO: 382319 - RNA, 64 nt, Human
uguuuucaucucuuaggcuugcugucuccuaaggucacccaagcagugguuggauuuuauacac

SEQ ID NO: 382320 - RNA, 64 nt, Human
accggcucacucugcggcgccgugcucccgcugcucacccaaagaaguuguuuccauuuuaaac

SEQ ID NO: 382321 - RNA, 64 nt, Human
uaacauaaauggcugguaugguuugucuguguccucacccaaauuucaucucgaauuguaaucc

SEQ ID NO: 382322 - RNA, 64 nt, Human
gagaggcagcaucaggaccuaagccccaggaacuucacccaacuuaggcccuggcaauuaacug

SEQ ID NO: 382323 - RNA, 64 nt, Human
cccaagcugugcugggaagcccggacugaccaaaucacccaaucccaguucuuccugcaaccac

SEQ ID NO: 382324 - RNA, 64 nt, Human
cagugggguaaggaggccaagcccauuuguguaaucacccaaaaccccccggccugugccuguu

SEQ ID NO: 382325 - RNA, 64 nt, Human
cacucggcaccccagucuaacaccacaacuaauuucacccaagguuuuaagcacguucuuucau

SEQ ID NO: 382326 - RNA, 64 nt, Human
uggauaaagcaagauuuccuuucaauaaacgcugucacccaaugggaauuuugacucuccugug

SEQ ID NO: 382327 - RNA, 64 nt, Human
auggaauguccuggcuccacccuccagcauguucucacccaacaaugacaguugaguggagugg

SEQ ID NO: 382328 - RNA, 64 nt, Human
uucaguggugauuucugagauuuuggugcacccaucacccaaggguagucuuuuuuauccauca

SEQ ID NO: 382329 - RNA, 64 nt, Human
auucugcaggaacaugacccguacacaccacgcgucacccaacgacccaugaccguucucugag

SEQ ID NO: 382330 - RNA, 64 nt, Human
uucuuccuugcccacuugagaagugcacgcccacucacccaacauccuggucucuaggaaagcc

SEQ ID NO: 382331 - RNA, 64 nt, Human
agguuccccugaggucacucugaggccagggacgucacccaaggcugguggucagugugaaggg

SEQ ID NO: 382332 - RNA, 64 nt, Human
aaaagcaucaggaaaucggauggagaaccaccauucacccaagggucagaggagguuucaaaga

SEQ ID NO: 382333 - RNA, 64 nt, Human
ccuccugcucagacuaaaggcaccuccucuggccucacccaagccucuucuaaaaaccauguug

SEQ ID NO: 382334 - RNA, 64 nt, Human
uacccucguuauuuuguaaccuuccaauuccugaucacccaaggguuuuuuugugucggacuau

SEQ ID NO: 382335 - RNA, 64 nt, Human
uuauguuucugccuucuccaccagggucgcuccaucacccaaacaaaagaacaagguuugccag

SEQ ID NO: 382336 - RNA, 64 nt, Human
guauaggagaagaaugacagcuuccugagagguuucacccaaguuccaagugagaagcaggugu

SEQ ID NO: 382337 - RNA, 64 nt, Human
ugagaccgcacuccuuggcuuguuccugcguguuucacccaaaggagaaaaugcuaggaugaag

SEQ ID NO: 382338 - RNA, 64 nt, Human
ucuucagcggaaauucuccaggcaaaugaccuccucacccaaggaguucugcuguacaaacagg

SEQ ID NO: 382339 - RNA, 64 nt, Human
gccacgcuguagccacagaccccuugcucgggccucacccaaggccaaacuccaaacacaauca

SEQ ID NO: 382340 - RNA, 64 nt, Human
uucuuuaugucguuagucccuguaaaauguuaggucacccaaggaaaggggagaaauagcaaug

SEQ ID NO: 382341 - RNA, 64 nt, Human
agccagcuacuggagucauuccguuuccacucauucacccaaccucaggguucuccccaucuga

SEQ ID NO: 382342 - RNA, 64 nt, Human
cgcccggccuucaguuucuuccuaggccguucugucacccaaauagcugcuacccagaggggcg

SEQ ID NO: 382343 - RNA, 64 nt, Human
gggcccacuagcauccacugauuggaccuuauggucacccaacucaaggacagccaccaagaag

SEQ ID NO: 382344 - RNA, 64 nt, Human
uuuugcuggucagagauucccugagugucuguccucacccaagccugcucugugucuguguugu

SEQ ID NO: 382345 - RNA, 64 nt, Human
cuaauuuaauuugcugcugacagccaccaugcucucacccaaauuuuuaugaauucucuacaug

SEQ ID NO: 382346 - RNA, 64 nt, Human
cuaauuuacuuugcugcugacagccaccaugcucucacccaaauuuuuaugaauucucuacaug

SEQ ID NO: 382347 - RNA, 64 nt, Human
cuaauuuaauuugcugcugacagccaccaugcucucacccaaauuuuuaugaauucucuaccug

SEQ ID NO: 382348 - RNA, 64 nt, Human
uucuuauuaggccucagaaagaagucaguuaacgucacccaaaagcacaaaauggauuuuaguc

SEQ ID NO: 382349 - RNA, 64 nt, Human
ggguggcagagugugggugcagccuggcuguugcucacccaagugcuagcucugcacuucgugu

SEQ ID NO: 382350 - RNA, 64 nt, Human
acagacugauaagaagcuggccuuucagccugcuucacccaaguuauggaggagguuaagucua

SEQ ID NO: 382351 - RNA, 64 nt, Human
aagcgucgccacccuuugguuauuucagcccccaucacccaagccacaagcugaccccuucgug

SEQ ID NO: 382352 - RNA, 64 nt, Human
uuggacaccugguucucagagaacccugugaugaucacccaagccccaggcugucuuagccccu

SEQ ID NO: 382353 - RNA, 64 nt, Human
cauuccucaagucaccagagagaauggaagcucaucacccaacauucagcuucuaagaaguagg

SEQ ID NO: 382354 - RNA, 64 nt, Human
ggcuggaguugcccgcguaaggcagccaagaaacucacccaaagccuguagccuccccaacuac

SEQ ID NO: 382355 - RNA, 64 nt, Human
ccugucagauucuaacaacaaaagcugaauuucuucacccaacuuaaauguucuugagaugaaa

SEQ ID NO: 382356 - RNA, 64 nt, Human
ccugugauaaaggcaauacaaaauauuaguaaagucacccaaagagucaggcacuggguauugu

SEQ ID NO: 382357 - RNA, 64 nt, Human
acccaccucuaaagcuggcaguggagucucugccucacccaaagacuuuucccuuccagacuuu

SEQ ID NO: 382358 - RNA, 64 nt, Human
uuuccuucuguggucauuuuucuugcugccuuuuucacccaagauucagcagucagauguuuac

SEQ ID NO: 382359 - RNA, 64 nt, Human
aacagcgauugaccaguaacugugagaucagaauucacccaaaggaagacauuuucaucucugu

SEQ ID NO: 382360 - RNA, 64 nt, Human
aaauucuguuuacggugaaaaaggauuuuguuuuucacccaauuugggaggcgggagggggggg

SEQ ID NO: 382361 - RNA, 64 nt, Human
aaaaaugaaaaaacacucaugagauaacugcauuucacccaacaaaagcaggguauaaggcgau

SEQ ID NO: 382362 - RNA, 64 nt, Human
ccuggccuagggugccggggccugaaggucagggucacccaagcaacaaagucccgagcaauga

SEQ ID NO: 382363 - RNA, 64 nt, Human
gagccugauuccucagucucaccagaauucuggaucacccaagaggaaaagacuggcaguucua

SEQ ID NO: 382364 - RNA, 64 nt, Human
gucucaucucaguggccgcuccugggccacccugucacccaagcuuuccugauugcccagcccu

SEQ ID NO: 382365 - RNA, 64 nt, Human
agagcaauugccaagggcacaggagaggucauugucacccaagcagaggccaccuucuccugag

SEQ ID NO: 382366 - RNA, 64 nt, Human
gaaagagaaagccugugaaauaggcagggccagaucacccaaaacuccucaggacugggaucug

SEQ ID NO: 382367 - RNA, 64 nt, Human
uccacauaaugcauuacaacagaacauucuugaaucacccaacccuggaucagaaaccucccca

SEQ ID NO: 382368 - RNA, 64 nt, Human
caccccugggauagaaagacccuuagaugucuuuucacccaaccccaaacucccuguacagaag

SEQ ID NO: 382369 - RNA, 53 nt, Human
gaccucgggcccagcgcugagggucacccaaccgccggccuuagugaccccau

SEQ ID NO: 382370 - RNA, 64 nt, Human
gucaucacccagccucugagagcaguuacuggggucacccaaccugacuuccucugccacuccc

SEQ ID NO: 382371 - RNA, 64 nt, Human
cuaaaaucugauuugcagccaggaaagaauuuucucacccaaggaacauuugaucuagcagcag

SEQ ID NO: 382372 - RNA, 64 nt, Human
caaagggggcuuauuaauacccucagcauguuuuucacccaaaugaugcaaaacaugcagauuc

SEQ ID NO: 382373 - RNA, 64 nt, Human
ggaccuagaaauauugugugaaaauauauaaauaucacccaaaaggcuuucugcccuauauuuu

SEQ ID NO: 382374 - RNA, 64 nt, Human
uguuauaaaagcaaaucccaagcaucauaucauuucacccaaguauuuuaaaguaugugucucu

SEQ ID NO: 382375 - RNA, 64 nt, Human
cuugaugguuuuuuuuaauacugagugcaaaaggucacccaaauuccuaugaugaaauuuuaaa

SEQ ID NO: 382376 - RNA, 64 nt, Human
uagcugaucaccaccaacaucauaggucuauaaaucacccaacuaagaucagggguguuucaug

SEQ ID NO: 382377 - RNA, 64 nt, Human
uaagcaaauuuauuauuaaaugugcacaucuuauucacccaagggaauaaaagcuacuucguaa

SEQ ID NO: 382378 - RNA, 64 nt, Human
ggggugcaggcagccuugaccacggcuguuccccucacccaaaagaauuaucaucccaacagcc

SEQ ID NO: 382379 - RNA, 64 nt, Human
gggagaugcugcuguuuccagaggcgucuuagucucacccaaugugauuuguagaagcacgaga

SEQ ID NO: 382380 - RNA, 64 nt, Human
gaaugcuucugccucuuuaagacaaagaagaaugucacccaaaauugucauuuuuuucuuaaug

SEQ ID NO: 382381 - RNA, 64 nt, Human
cuguacaaggcugauaaccuauaugugauggagaucacccaaugccaagggcagaaagcaaacc

SEQ ID NO: 382382 - RNA, 64 nt, Human
gaucuaguugagaugaggucauuggggugggcccucacccaauaugacuggaguccuuaucgga

SEQ ID NO: 382383 - RNA, 64 nt, Human
ccgguggguuagacaggaaguaacugauaucacuucacccaaauauauaaccgugaugguuauc

SEQ ID NO: 382384 - RNA, 64 nt, Human
auaugagcuauuuauuuugugaaaugaaaauuguucacccaaaugauucucuuauaaacuauuu

SEQ ID NO: 382385 - RNA, 64 nt, Human
uaaccugaaguuuuaugaucccugaacauaguuuucacccaagagcuguccuggugaccaaaaa

SEQ ID NO: 382386 - RNA, 64 nt, Human
cuccaaugcuguuaucccugccugguccucacacucacccaacaaucccaaggcccuuuuuaua

SEQ ID NO: 382387 - RNA, 64 nt, Human
ucuccugguuccggucaaagccuuuccucagccuucacccaaccuuuccaguuuccacuggccc

SEQ ID NO: 382388 - RNA, 64 nt, Human
gcaaaauuagaguagugaaagucaugcuaguccaucacccaaauauguuauagacgccauagac

SEQ ID NO: 382389 - RNA, 64 nt, Human
gacccagguagggccaccacuacgccuucacuugucacccaagcuccaaccacagagaguuuga

SEQ ID NO: 382390 - RNA, 64 nt, Human
ucuuugucuuauuucugccuucaucucccacuucucacccaacucugccacuguucaggagcag

SEQ ID NO: 382391 - RNA, 64 nt, Human
guuguguccacuguuuaauuccagagaauuuuuaucacccaaauaagaaacaaagcaccaauua

SEQ ID NO: 382392 - RNA, 64 nt, Human
ccuccaggugcuguugaauucuucuagcaguccuucacccaaaaguucaaauuugucagugaca

SEQ ID NO: 382393 - RNA, 64 nt, Human
gagcacagugucuguggggagcccaggaagcugcucacccaagauuuggugcaggaaaacuacc

SEQ ID NO: 382394 - RNA, 64 nt, Human
gauggucaaucugauaauaggaucagauuuacgucuacccuaauucuuaacauugcagcuuucu

SEQ ID NO: 382395 - RNA, 64 nt, Human
gagcuaaacucucgagacuucucugugaacuucccuacccuacccccacaacacaagcacccca

SEQ ID NO: 382396 - RNA, 64 nt, Human
gaaaacaguuuaucugcuguaauugaacauucagcuacccuauaacccaguuaauccaauacug

SEQ ID NO: 382397 - RNA, 64 nt, Human
ccaaugagaggcuccuauuucccaucauagcucccuacccuagggaggccuccaucuggaaaug

SEQ ID NO: 382398 - RNA, 64 nt, Human
gccuucaaccucugccugcaucugccacuuucugcuacccuagggaggccaggaggagcuucgg

SEQ ID NO: 382399 - RNA, 64 nt, Human
uccacauuggauuugguccaaacauguaagacuucuacccuaaucaguauccuucagcuuuuua

SEQ ID NO: 382400 - RNA, 64 nt, Human
acccacagaguguggucccuccacuaggaguuaacuacccuacaccucugggcccugcaggagg

SEQ ID NO: 382401 - RNA, 64 nt, Human
gaaggaauaguaguccccacucuuuccaucagcccuacccuacccucauuccccgacacccucu

SEQ ID NO: 382402 - RNA, 64 nt, Human
gggcugcaccccuugcccuuucucugccccaucccuacccuagccuugcucucagccaccuuga

SEQ ID NO: 382403 - RNA, 64 nt, Human
agugcugaauuucccucucucauacccucccucccuacccuaaccaaguuccuuggccaugcag

SEQ ID NO: 382404 - RNA, 64 nt, Human
aucuagccuaauuuauuuuuccccuuauauuucccuacccuacccuccccccaaaaaaaagcaa

SEQ ID NO: 382405 - RNA, 64 nt, Human
ucugcagauaggcguggccccucuucagaggacacuacccuagggcacuuucucuuugaggugg

SEQ ID NO: 382406 - RNA, 64 nt, Human
gagcuccucaacaauaacuuugcaauaauuaaaacuacccuaaguaacuuuggcuuauauggca

SEQ ID NO: 382407 - RNA, 64 nt, Human
cggcccaggccuugaagccgcggcgaaccucuuccuacccuaccucggggaccugguggcagcg

SEQ ID NO: 382408 - RNA, 64 nt, Human
guaagaaaacggauuuaggaugaaaacucuagaacuacccuaugcuguuuauacugggaaaugc

SEQ ID NO: 382409 - RNA, 64 nt, Human
aaagagagcaacugauuucagccagguuuugccacuacccuauaauuagugcagucuuauguua

SEQ ID NO: 382410 - RNA, 64 nt, Human
acuuuuuaaaaugcuuccaagguaagucugaugccuacccuagguugggaaccacucuuucaaa

SEQ ID NO: 382411 - RNA, 64 nt, Human
cuacaaaauauuuuauuugcuuuaaauuugcuggcuacccuagauguguuuuuauuccugguaa

SEQ ID NO: 382412 - RNA, 64 nt, Human
aguaagaaggagugaccgguauccuccccuuccccuacccuaagcuguagccugggugacugac

SEQ ID NO: 382413 - RNA, 64 nt, Human
gugucaaauaggaguugaggaauugagcaggauucuacccuaguccgauuguauagaaaacacc

SEQ ID NO: 382414 - RNA, 64 nt, Human
ugucaucaggauaguguaagugguaggguagagacuacccuagacaucugcaucuuuguaaguu

SEQ ID NO: 382415 - RNA, 64 nt, Human
aaugacccacuccccuuggaaaugcauguaugaacuacccuaugaaauguaagcugcagaauag

SEQ ID NO: 382416 - RNA, 64 nt, Human
auuucagaucgccaacacauucgccacugggcaacuacccuacaaguuuguacuuucauuuuaa

SEQ ID NO: 382417 - RNA, 64 nt, Human
agagaggauggacgugggagaaagcaagcaaaagcuacccuagggaagagccggugacgugcac

SEQ ID NO: 382418 - RNA, 64 nt, Human
cucuccaggcccaagucgugcucuccuuccaggccuacccuacugcccgcugcguccugcugga

SEQ ID NO: 382419 - RNA, 64 nt, Human
agagagccacugcccagcagcaugcucacaccaccuacccuaguguagguaauaggucuacgcu

SEQ ID NO: 382420 - RNA, 64 nt, Human
uccuuucacuggggauugaaaagcaccuccaccccuacccuagugauguccccugaggacccgg

SEQ ID NO: 382421 - RNA, 64 nt, Human
uaccacucaggcauuugacugaagaugcagcucacuacccuauucucucuuuacgcuuaguuau

SEQ ID NO: 382422 - RNA, 64 nt, Human
acaaaagcaguuauuuuaaaaucugauccccucucuacccuaccacuuugguuugaauuaucuc

SEQ ID NO: 382423 - RNA, 64 nt, Human
cgcccuuucauuguaaaacauugugcuuuaccuacuacccuagccuugucuuuaccgagggaug

SEQ ID NO: 382424 - RNA, 64 nt, Human
uacugauuaauugauuuauaagguucaacacugucuacccuaaauaauuuuuauaugcucaagg

SEQ ID NO: 382425 - RNA, 64 nt, Human
ccuguggaacccagcaguucuguuauauccccugcuacccuagaugaauuaagacgguuaaaua

SEQ ID NO: 382426 - RNA, 64 nt, Human
gaaaggguaucagagcugcagccagcucugcccucuacccuagggaggccagaaagacacaaac

SEQ ID NO: 382427 - RNA, 64 nt, Human
cuccugagacuggcacuguguaaguuuuaguugccuacccuagcucuuuucucguacaauuuug

SEQ ID NO: 382428 - RNA, 64 nt, Human
aaaauuacuuuuauuugcaguaauucagucaauucuacccuaaagauguguuuuauuauaaaua

SEQ ID NO: 382429 - RNA, 64 nt, Human
gaauuauuacuggccauuucuaaauagacaaaaacuacccuaaaauguggagauuuacuccuuu

SEQ ID NO: 382430 - RNA, 64 nt, Human
agauguuuucccuuguggcagucuucagccuccucuacccuacaugaucuggagcaacagcugg

SEQ ID NO: 382431 - RNA, 64 nt, Human
agaugccuuccccuguagcagucuucagccuccucuacccuacaagaucuggagcaacagcuag

SEQ ID NO: 382432 - RNA, 64 nt, Human
agaugccuucccuuguagcaguuuucagccuccucuacccuacaugaucuggagcaacagcuag

SEQ ID NO: 382433 - RNA, 64 nt, Human
guaguggaagugauaauccuuaaaugaacauuuucuacccuaauuucacuggagugacuuauuc

SEQ ID NO: 382434 - RNA, 64 nt, Human
cuccuuaccaauauuauuaaaaucuuauuaaaaucuacccuaccaaagcauguacauuuuuaug

SEQ ID NO: 382435 - RNA, 64 nt, Human
gcauaaagacuaauuagcaaccauaauauggucacuacccuaauagacuaaaugaaaucuugca

SEQ ID NO: 382436 - RNA, 64 nt, Human
agaaaguuacugacacaguaaaacaaggaaaguucuacccuaagagccgccaucacuucaggcc

SEQ ID NO: 382437 - RNA, 64 nt, Human
uuccugaguugauuagaaagcuguaugaguguaccuacccuagucucagaagcauagacuguag

SEQ ID NO: 382438 - RNA, 64 nt, Human
uuucugaguugauuagaaugcuguucgaguauaccuacccuaguuucagaagcauagauuguag

SEQ ID NO: 382439 - RNA, 64 nt, Human
caagugcuguaauuugacauuuucagaaauuauucuacccuagucaucuucacucguguauuaa

SEQ ID NO: 382440 - RNA, 64 nt, Human
aaaaaaccaaaaaggacuuuuuguauagaaagcacuacccuaagccaugaagaacuccaugcuu

SEQ ID NO: 382441 - RNA, 64 nt, Human
gcaauuuugguuucugaaaaauuacaaaacuuuucuacccuacagaugcccagguucuuuaguu

SEQ ID NO: 382442 - RNA, 64 nt, Human
ucgugcauauuuuauuucuguaguuucugguuagcuacccuaaagugauuuaaaaauuuagaau

SEQ ID NO: 382443 - RNA, 64 nt, Human
cuucaugggaauuuugguuuuaucuucccuucuucuacccuaaaucuuaacuuuauggaagggc

SEQ ID NO: 382444 - RNA, 64 nt, Human
ucucuaguuccccuuggccugcauguacaaacuucuacccuagaagcucucugccaucgaugua

SEQ ID NO: 382445 - RNA, 64 nt, Human
aucagcaauagauuucaaagauaaguauuaagcgcuacccuaaaguguguaaguuuuucauuuu

SEQ ID NO: 382446 - RNA, 64 nt, Human
uuaauuuuauguggacguauguuaaauuauccaacuacccuauuguuaagcauuugguuuuaaa

SEQ ID NO: 382447 - RNA, 64 nt, Human
ugguaggccauuagcauugauaucuuuaaaacaucuacccuaaaccaucugcuauggacccaua

SEQ ID NO: 382448 - RNA, 64 nt, Human
ugauaauggagagagagacagaggacccuccucacuacccuauauaaaaaucauuggcacaguu

SEQ ID NO: 382449 - RNA, 64 nt, Human
ccaggaugggggggccacacgcugcaccuaaagccuacccuauucuauccaucuccugguguuc

SEQ ID NO: 382450 - RNA, 64 nt, Human
cucucccacaugcucuguuaugggagagaauccccuacccuacucugauguauagaccauucuc

SEQ ID NO: 382451 - RNA, 64 nt, Human
cacaccaacaguguggcaucucauaaguuaacugcuacccuaagguaaucuaagauuaaaaugu

SEQ ID NO: 382452 - RNA, 64 nt, Human
cuuuuugaggaagguuucuuuauaagugcaagggcuacccuaauaaaggaauguauauacuuac

SEQ ID NO: 382453 - RNA, 64 nt, Human
gaaguguccuucccacuucagcccuccggagagacuacccuagucuuucugggguguuuauguc

SEQ ID NO: 382454 - RNA, 64 nt, Human
uucaggcugaucagcagaugggaugugaaaaauacuacccuauucuaucauuugcuguugcuug

SEQ ID NO: 382455 - RNA, 64 nt, Human
uugaaaccugacucugcuucucucauuugucuuccuacccuacucacauaauucacucauugac

SEQ ID NO: 382456 - RNA, 64 nt, Human
cuggcgcccaggagcggugggccgaagacgugcccuacccuaccacaagggcugugucucuacc

SEQ ID NO: 382457 - RNA, 64 nt, Human
cccagcacuaacguaaauacacaacacacacacucuacccuauacaacuggacauugucugcgu

SEQ ID NO: 382458 - RNA, 64 nt, Human
gagguggaacauccaguuccuaaaguugcuucuccuacccuaucccauccccugucacgcaucu

SEQ ID NO: 382459 - RNA, 64 nt, Human
gucuuugggcagacuuccuucuaacaugugucagcuacccuaccacacaccuggccuaggagac

SEQ ID NO: 382460 - RNA, 64 nt, Human
guagacgggcugucuugccaggccucagccccgucuacccuaagccuggccccaaagguuucuc

SEQ ID NO: 382461 - RNA, 64 nt, Human
agugucucagugccuucaaaacccacccccaccccuacccuaccccaccacaccccaucccaga

SEQ ID NO: 382462 - RNA, 64 nt, Human
acacagccauggcccagccccaaggccaggcugucuacccuauggccacagcaggaggucagcc

SEQ ID NO: 382463 - RNA, 64 nt, Human
cucuccugggaccuugcucuagggcacucugccucuacccuaggacacuggaaugcccugggag

SEQ ID NO: 382464 - RNA, 64 nt, Human
uuuguaaccgcuuggugccucuuaggacuuaagacuacccuacaggaacccuguacucaaggcc

SEQ ID NO: 382465 - RNA, 64 nt, Human
ucugaggagcaggagggagccacccucccugcagcuacccuagcugaggagccuguugugaggg

SEQ ID NO: 382466 - RNA, 64 nt, Human
aguucugcaauuuagucuguagccuccucguucccuacccuaaaauucuaaggggaagggaccc

SEQ ID NO: 382467 - RNA, 64 nt, Human
gaagugucuuuggcccauuuguaaguccccaucccuacccuacacaaaguaaaagcagaagaua

SEQ ID NO: 382468 - RNA, 64 nt, Human
gucucccagugaggagcccuaagcauugacuucucuacccuaaaacuguuugagagagggagag

SEQ ID NO: 382469 - RNA, 64 nt, Human
uggcauuauuuuuaguggccucuacugauaauaccuacccuagaguacauaaaaauuauauuaa

SEQ ID NO: 382470 - RNA, 64 nt, Human
gaaucaccuuuaauuacaugucagaaugccuuaacuacccuaacuugacaaaacagaauucuuu

SEQ ID NO: 382471 - RNA, 64 nt, Human
gauuucuugggaauuuugcuuuuugucuucccuucuacccuacaucuuaaacuuuauggaagaa

SEQ ID NO: 382472 - RNA, 64 nt, Human
uaaacuguuuuagaacucuccuuaacaaucucaacuacccuauuuuucccuguucccuggugcc

SEQ ID NO: 382473 - RNA, 64 nt, Human
aucccuacccacguuugagcuggaaaggaugucccuacccuaggcaugagguauauuuuauucu

SEQ ID NO: 382474 - RNA, 64 nt, Human
gaucaugcggggagaugaccuugaucuuugauugcuacccuaaccuugaccuuuaacccgugau

SEQ ID NO: 382475 - RNA, 64 nt, Human
caugguucuugaccagcacauucaauccuccaaccuacccuacugccaugaccuuccgcacauc

SEQ ID NO: 382476 - RNA, 64 nt, Human
guuguaugguaaacacauauauuuuuguaagaaacuacccuacucuuuuuccagaguggcucua

SEQ ID NO: 382477 - RNA, 64 nt, Human
uaaguugagauguuguguggcaaugggauuugggcuacccuaaagggagaaggaagggcagaga

SEQ ID NO: 382478 - RNA, 64 nt, Human
aacacuaacuucacugggauaaucagcagcguaacuacccuaaaagcauaucacuagccaaaga

SEQ ID NO: 382479 - RNA, 64 nt, Human
gcugcuggguuaaagcagaggccaccugucagaucuacccuacccuuauuugguuacauggcac

SEQ ID NO: 382480 - RNA, 64 nt, Human
aguccccucccaucugggaguccccuuuucuuuucuacccuagccauuccugguacccagccau

SEQ ID NO: 382481 - RNA, 64 nt, Human
uauucuuuguauuaccaaagcaagguacaggugacuacccuaguucaaaacaaccacuuucuca

SEQ ID NO: 382482 - RNA, 64 nt, Human
uccuaacccuaaggaaaauuccccaggcugugaucuacccuagagaaggcucgcucccugccua

SEQ ID NO: 382483 - RNA, 64 nt, Human
ugguuuggcaccaguuucuaaccaucuguuuuuucuacccuagcuaucuuuuauugguaaaaua

SEQ ID NO: 382484 - RNA, 64 nt, Human
gagaggugacgucauuugcuuaaaguuuuccaagcuacccuauccuaaaauaguuuguguggau

SEQ ID NO: 382485 - RNA, 64 nt, Human
agucacuucccauagaagcaaaaguacuuauuuucuacccuagcugggugcaugugugugcaca

SEQ ID NO: 382486 - RNA, 64 nt, Human
cuuucuccaagacagauuuucggaacacauuucccuacccuaaagcgacaucccaguaguguuu

SEQ ID NO: 382487 - RNA, 64 nt, Human
caggagguugauaaucuccuugacccaugucuuucuacccuaauccccacuucccugcagaauc

SEQ ID NO: 382488 - RNA, 64 nt, Human
aaccacacaguccuggaggcagagaugcaguuaccuacccuagcuuuugauggguucucuuacc

SEQ ID NO: 382489 - RNA, 64 nt, Human
cggaaccuccucagcucucccucugcagaguucccuacccuaagagaauguuaccaccugaaca

SEQ ID NO: 382490 - RNA, 64 nt, Human
gcccuccaaaugcucguuuuauagcaaccucucucuacccuaguucuccaaauucacuucugcc

SEQ ID NO: 382491 - RNA, 64 nt, Human
cuccggcuccgaccccacacacccugagggagcccuacccuagccucagccgcuccuggugggg

SEQ ID NO: 382492 - RNA, 64 nt, Human
guacacugcaggggacagaaggggggccccaucccuacccuacucccuggccgccugccccugu

SEQ ID NO: 382493 - RNA, 64 nt, Human
uuccugaugucuccucccuugucuuauugucccccuacccuaaaugccccccugccauaacuug

SEQ ID NO: 382494 - RNA, 64 nt, Human
aggguugggugguccugucccuccauaucauguccuacccuaugguccuguuccuagucauuua

SEQ ID NO: 382495 - RNA, 64 nt, Human
cccuccugccucccugccucccacccucaucucucuacccuaccccucccaucggggcugugcu

SEQ ID NO: 382496 - RNA, 64 nt, Human
ugggagacagagcuacagcugggacagcuccaagcuacccuaaccccuccuuucccagguuucu

SEQ ID NO: 382497 - RNA, 64 nt, Human
aacacgcaaguuccuucuugaacccuggugccuccuacccuauggcccugaauggugcacuggu

SEQ ID NO: 382498 - RNA, 64 nt, Human
agagaaagauguuggcucuuguaauaaaugcuuucuacccuauagguucuaggcuagacagagu

SEQ ID NO: 382499 - RNA, 64 nt, Human
ugauuuagggcccuucucuaggaugccccagccccuacccuaagaccuauugccggggaggauu

SEQ ID NO: 382500 - RNA, 64 nt, Human
ccuuguaugcaaaugaguucaggacuacaauacccuacccuauggggaggcccugccuccggga

SEQ ID NO: 382501 - RNA, 64 nt, Human
gauggggucagggauauuuugaguucuguucauccuacccuaaugccaguuccagcuucaucua

SEQ ID NO: 382502 - RNA, 64 nt, Human
aggugacucugccaagcagcuguggcccccagggcuacccuacacaacgcccuccccaggcccc

SEQ ID NO: 382503 - RNA, 64 nt, Human
acuguggaucccuuacuucagcaacucaagucugcuacccuaaccacaagauucaagauuaucc

SEQ ID NO: 382504 - RNA, 64 nt, Human
gugggccagaaguccugggugccuccuacuagggcuacccuacugcaccccaucaggggccuga

SEQ ID NO: 382505 - RNA, 64 nt, Human
accaguaugagccauaccugcgggacccuguggccuacccuaaggugcaggugagaggggagcg

SEQ ID NO: 382506 - RNA, 64 nt, Human
ccgacaacuccccggcuuccagacccuaccagcacuacccuaacccucagccgacagucucagc

SEQ ID NO: 382507 - RNA, 64 nt, Human
gccucucccuccagccaauaggcagcuuucuuaacuacccuaacaagccuuggaccaaauggaa

SEQ ID NO: 382508 - RNA, 64 nt, Human
agguguggcuccagagcccauccucuucccacugcuacccuaacucaaacugccacaugcucgu

SEQ ID NO: 382509 - RNA, 64 nt, Human
cuguccagaggcagaacugaagcccucucggccccuacccuaagccagccaccccucuucacag

SEQ ID NO: 382510 - RNA, 64 nt, Human
ucaucagggaacuuuccugaaguucagcucaagacuacccuaccugcuguguuugugagaagag

SEQ ID NO: 382511 - RNA, 64 nt, Human
auuccuuccuccaaaggcccaggacaggacagugcuacccuagauucugugagauucugcaagc

SEQ ID NO: 382512 - RNA, 64 nt, Human
aacaucuuuguguugcuuucaccaggcugagacccuacccuaugggguauaugggcuuuuaccu

SEQ ID NO: 382513 - RNA, 64 nt, Human
ugauuucuuaaaaugaaaaucugggcccacuuaacuacccuagauaaaacgcuucaauggcuuc

SEQ ID NO: 382514 - RNA, 64 nt, Human
uguccacucagcaauaagagggaucucuucccaccuacccuaccuacuccuacccccaaccccc

SEQ ID NO: 382515 - RNA, 64 nt, Human
auagcaaaaugaauccccuagccuuuguccucaccuacccuaaggcagguguguaugcuugaau

SEQ ID NO: 382516 - RNA, 64 nt, Human
acgcuggagcuguguuguacaggugcugugagaccuacccuauucagaauuaaaccucacugca

SEQ ID NO: 382517 - RNA, 64 nt, Human
cuguugccuuauaaaacuguuaggguaggucugucuacccuagcaaaagaaacacagaaauuua

SEQ ID NO: 382518 - RNA, 64 nt, Human
gcuaaaacucaucaaaaacacuacuccuuuuccucuacccuauuccucaaucuuuuaccuuuuc

SEQ ID NO: 382519 - RNA, 64 nt, Human
ucucacuggcugcauucccuacacagggaauuuacuacccuauaugugaauaucccuguaugua

SEQ ID NO: 382520 - RNA, 64 nt, Human
auuuuauuuugcacggcgcccucccucuaaauaccuacccuagaugauuucauccugccccuca

SEQ ID NO: 382521 - RNA, 64 nt, Human
cauuucugguguguaucugaaaggaagacauuuucuacccuagauccaauugcauuuauuuauc

SEQ ID NO: 382522 - RNA, 64 nt, Human
gacuugaaauaguuuaaggagcuaaacagccauaaacggaaacgccuccuucaugcagcggcgg

SEQ ID NO: 382523 - RNA, 64 nt, Human
cuggacuugucaagugaauucuuugcauguucaaaacggaaaccauugauuagaacuacauucu

SEQ ID NO: 382524 - RNA, 64 nt, Human
ccuuccagcucugcagcuaaugagguccugccacaacggaaagagggaguuaauaaagccauug

SEQ ID NO: 382525 - RNA, 64 nt, Human
guuuagguaauuuucaaacauuaaauccaacuucaacggaaacaaauacacucaagggaaguua

SEQ ID NO: 382526 - RNA, 64 nt, Human
gugucacacacugagagaaguccuauuguaaagaaacggaaaaagucacaaaaaaguuuguaua

SEQ ID NO: 382527 - RNA, 64 nt, Human
cucaucuguugugauauacaccaauggauaaacuaacggaaacugcuuuuugacauuaaaagac

SEQ ID NO: 382528 - RNA, 64 nt, Human
gucgcuuugccaucaagaaacauucagaccagggaacggaaagaagagagaccgagcuaauuaa

SEQ ID NO: 382529 - RNA, 64 nt, Human
gauuaaacugguugucuuauuucuucucaucauuaacggaaaaaaaaucaguauuucuaucuuu

SEQ ID NO: 382530 - RNA, 64 nt, Human
uuuaauauaaagcacugauguaacuugcuagguaaacggaaagauaaguucuaacugccuacua

SEQ ID NO: 382531 - RNA, 64 nt, Human
uauauggguacuuuguaauaucuaaaaacuuagaaacggaaauggaauccugcucacaaaauca

SEQ ID NO: 382532 - RNA, 64 nt, Human
ucacaagacuaugccauugggguaguuguguuucaacggaaagugcugucuuaaacuaaaugug

SEQ ID NO: 382533 - RNA, 64 nt, Human
auuugcccggugaacucacuuuaagcauuggauuaacggaaacucccgaacuacagaccccucc

SEQ ID NO: 382534 - RNA, 64 nt, Human
uugauguggacaugagccauuugaggggagagggaacggaaauaaaggaguuauuuguaaugac

SEQ ID NO: 382535 - RNA, 64 nt, Human
ucuugacuacacuaauucuuuauauuauagaaccaacggaaauaugggcacuauuuugaauucu

SEQ ID NO: 382536 - RNA, 64 nt, Human
ucaacuuuggcauuucauucauacuucuguagagaacggaaaacuauuguccauuaacaugaua

SEQ ID NO: 382537 - RNA, 64 nt, Human
uugauuuuaagcucuaaguuucacuuuuccauuaaacggaaagccucccugacauuaacugaau

SEQ ID NO: 382538 - RNA, 64 nt, Human
ucugccaaaggcagugcaaagaaggaaggcuccaaacggaaaaucaacaugaguggcuacaucc

SEQ ID NO: 382539 - RNA, 64 nt, Human
accuggauuuguacugcaagaccugacuauucauaacggaaaacgauuucuaaagcaacagcag

SEQ ID NO: 382540 - RNA, 64 nt, Human
acucauguuugaauauaacaaaauaucaauacuuaacggaaaauaaggugacacgaagaaagua

SEQ ID NO: 382541 - RNA, 64 nt, Human
uggauuuuuuuaagguauuugcuaagucuuuguaaacggaaauugaaaaugaccugguaucuug

SEQ ID NO: 382542 - RNA, 64 nt, Human
aacugguuuuuuuaggacuugugaggaacacagcaacggaaauccauccacaaaggaugcagug

SEQ ID NO: 382543 - RNA, 64 nt, Human
ccauuucacaaacuccuccaaaccccaaaccccaaacggaaaucucugggacaauggcuccucc

SEQ ID NO: 382544 - RNA, 64 nt, Human
cuuuauuacaaaguauuagauuuuucuucuauuuaacggaaaacuugacuuuggugaaugugca

SEQ ID NO: 382545 - RNA, 64 nt, Human
gaaugguguuagggggaugagcaugcuguuuaugaacggaaaucaugauuucccuuguagaaag

SEQ ID NO: 382546 - RNA, 64 nt, Human
uugacaaaaagucaaauguguauguucuaccuccaacggaaauguuuacaaggucaagacuuaa

SEQ ID NO: 382547 - RNA, 64 nt, Human
guuggcggggcggucgcagacuucaggguccccuaacggaaaggccaggcuccgcguggacggc

SEQ ID NO: 382548 - RNA, 64 nt, Human
gggguuucaauuccucagaaacaacuuuuuucacaacggaaaggaaagaacacuaguguucuuu

SEQ ID NO: 382549 - RNA, 64 nt, Human
augcaauaggcuuuaggaaaaaaagacugcaaccaacggaaaucaauaggaguugaagagauua

SEQ ID NO: 382550 - RNA, 64 nt, Human
uuguugaauaacagaacgaguguaaaauuuuaacaacggaaaggguuaaauuaacucuuugaca

SEQ ID NO: 382551 - RNA, 64 nt, Human
gucaccagcccucagcagaaaccgaaagagaaagaacggaaacacggaguuugggcucuguugg

SEQ ID NO: 382552 - RNA, 64 nt, Human
augauaagaaagucugucacagugcuauuuggaaaacggaaaauuuacaagcaaccuagagguc

SEQ ID NO: 382553 - RNA, 64 nt, Human
aguagccacccaaagccuagccgcuguucuagggaacggaaaagaguucauggccaagcgucua

SEQ ID NO: 382554 - RNA, 64 nt, Human
uuugugaaguccuuauuucuucacaaagaagaggaacggaaaugggacgucuuccuuaacaucu

SEQ ID NO: 382555 - RNA, 64 nt, Human
uuuaauguguuugcaaucgcuccgcuccaggaagaacggaaaugcugucuugugagcaugaagu

SEQ ID NO: 382556 - RNA, 50 nt, Human
augaccacucugugguuuagaacggaaacugagaugaggaaccagccguc

SEQ ID NO: 382557 - RNA, 64 nt, Human
agaaaacaagugcuuuuuaucuugaaauucaaccaacggaaagaauaugcauagaauaaugcau

SEQ ID NO: 382558 - RNA, 64 nt, Human
uaauuugucaaaaugcagagaauggaaaacagugaacggaaaacacagaguaaacccuaguguc

SEQ ID NO: 382559 - RNA, 64 nt, Human
uuugguguguccucuuaucaguuaguggaaauagaacggaaagagugcucuuuaaacaaugagg

SEQ ID NO: 382560 - RNA, 64 nt, Human
gcuguggaaaugaaaaaaaugauugaagagguggaacggaaaugaccuuagggggaaaaaaaag

SEQ ID NO: 382561 - RNA, 64 nt, Human
aagaagaagaaaaagaaaaaagaagaggauccugaacggaaaaggaagaagaaagagaagaaga

SEQ ID NO: 382562 - RNA, 64 nt, Human
gauuauuaaagagaacaagugauacauccaaugcaacggaaagcagaagggauuuaggacuacg

SEQ ID NO: 382563 - RNA, 64 nt, Human
cugagcccuacaugugggguuggaggagaacuauaacggaaaaaccucugaguuucaccuuagg

SEQ ID NO: 382564 - RNA, 64 nt, Human
gaggcaaguaccuuaauuaguuuuauauagucacaacggaaauauauuuucuagugaauucuua

SEQ ID NO: 382565 - RNA, 64 nt, Human
caauagaaagagucugaggcaaguggaaaugaggaacggaaacuuagguugggagaauauuuuu

SEQ ID NO: 382566 - RNA, 64 nt, Human
auaacugaaguauaacagaagauauauuuuuuaaaacggaaagccuuuguacaguuccugggau

SEQ ID NO: 382567 - RNA, 64 nt, Human
uauguuuacaggcuuccuguuugaugaagauagcaacggaaaacucaaaaugguggcaguucuu

SEQ ID NO: 382568 - RNA, 64 nt, Human
ggagaauucuggaguuguuaugaacaugaauaccaacggaaaaccuuaacugaaucuaaaagaa

SEQ ID NO: 382569 - RNA, 64 nt, Human
auagucaaaaauguucugcuuaaguguuaaauaaaacggaaacacuuauucgugcuugguaaua

SEQ ID NO: 382570 - RNA, 64 nt, Human
uaccaauuuaugaauucuuguaagcggaauguaaaacggaaauacugaaagacuuuugccuaaa

SEQ ID NO: 382571 - RNA, 64 nt, Human
ccuguucucccuuucucucuccucucugcuucauaacggaaaaauaauugccacaaguccagcu

SEQ ID NO: 382572 - RNA, 64 nt, Human; identical to SEQ ID NO: 382570

SEQ ID NO: 382573 - RNA, 64 nt, Human
ugaaugucaaucuggaaaauaaauugacuguauuaacggaaauaccacucuuuguguagauauu

SEQ ID NO: 382574 - RNA, 64 nt, Human
uaccaauguaugaguucuuguuaacagaauguguaacggaaauacugaaagacuuuugcuuaaa

SEQ ID NO: 382575 - RNA, 64 nt, Human
auuuaacauuuucagaccacaguugaccacagguaacggaaaccucaaucacagaaaguaaagc

SEQ ID NO: 382576 - RNA, 64 nt, Human
auauaaagcauauuuuauucuauauuauuacaaaaacggaaauguauaaacaugucaaaaagaa

SEQ ID NO: 382577 - RNA, 64 nt, Human
gcccccccggcagcucccggcacugcccccgacgaacggaaacucuucugugaaauagcaauaa

SEQ ID NO: 382578 - RNA, 64 nt, Human
ucccggcggacacgccaaauugcgaggcgacggaaacggaaagacucuuuucuccucucuccgc

SEQ ID NO: 382579 - RNA, 64 nt, Human
acaauuauuggcaaaguuuaaauguauuuuacauaacggaaaguuuuuagaauguugaaaagua

SEQ ID NO: 382580 - RNA, 64 nt, Human
agaggaagaggcucucaguccccaccuguacaacaacggaaagguguguggccacacgaagaag

SEQ ID NO: 382581 - RNA, 64 nt, Human
aagauaaccuaggcaauaccauucuggacauaggaacggaaaaagauuucaugacaaagauccc

SEQ ID NO: 382582 - RNA, 64 nt, Human
agacccugucuccgaaaaaaaaaaaaaaaaaaagaacggaaaaagaaaugcuuacauugucagg

SEQ ID NO: 382583 - RNA, 55 nt, Human
aaggcaucgaguucauuuaacucaaaacggaaacacugagcaaggccaucaggac

SEQ ID NO: 382584 - RNA, 58 nt, Human
cucugucacacugugccuaagaacuccaaacggaaagcgccaaauggcuguuuaaaaa

SEQ ID NO: 382585 - RNA, 64 nt, Human
gucaacacauggaccacacuuuauauagcacuguaacggaaaaugauucuguuaauguaaugaa

SEQ ID NO: 382586 - RNA, 64 nt, Human
aaagacuuuuuguuuuccuuucccaaagaaauaaaacggaaaaagccucuugagugguauucuu

SEQ ID NO: 382587 - RNA, 64 nt, Human
uaggaucuguggcucugcaccuaagcuggggaccaacggaaagaguucacgaugggaggccugg

SEQ ID NO: 382588 - RNA, 64 nt, Human
cugaauacaaauauaccuuauauucuuuaaggaaaacggaaaggaaagaucagcagaaauaggg

SEQ ID NO: 382589 - RNA, 64 nt, Human
uuuuuuuuuuuuaaagaaaaguucuuaaaacacuaacggaaacccauggaguuuguccuuugua

SEQ ID NO: 382590 - RNA, 64 nt, Human
gguuuaacaauaaaggcaauuuguuuaaucaguuaacggaaauuucuuggcuuaugaaagugaa

SEQ ID NO: 382591 - RNA, 64 nt, Human
gccaauguucucuucuauugcaaguucagccagacuccaugacucaucugaucccuuuuauggc

SEQ ID NO: 382592 - RNA, 64 nt, Human
aagacaaaguauuuuguccauuugagauucugcacuccaugaaaaguucacuuggacgcugggg

SEQ ID NO: 382593 - RNA, 64 nt, Human
uugggugaccuguuucaccagcaggccuguuacucuccaugacuaacuguguaagugcuuaaaa

SEQ ID NO: 382594 - RNA, 64 nt, Human
ugugguuaucccuagguggcucucgaggaguuaacuccaugagcccagggauccuagggccugg

SEQ ID NO: 382595 - RNA, 64 nt, Human
gggagggcauuccaucccuuccugaagggggacacuccaugagugucugugagaggcagcuauc

SEQ ID NO: 382596 - RNA, 64 nt, Human
guguauuaaaaugacugaauaugaacauuaaggacuccaugaaccugggcuaaugggagacugu

SEQ ID NO: 382597 - RNA, 64 nt, Human
acagaggcuggugcacaguuucugccucauuccucuccaugaugcccccugcucugggcuucuc

SEQ ID NO: 382598 - RNA, 64 nt, Human
aagucccaugucugguucugugucuaaaggccugcuccaugacacaggaugcuacaugcacucc

SEQ ID NO: 382599 - RNA, 64 nt, Human
aagcagaccccuuuagucacuccacaagcaauagcuccaugagaggcauggacugugagacuac

SEQ ID NO: 382600 - RNA, 64 nt, Human
aauuagucccugcuuccaggccugaagucuucuccuccaugaacaucauggacugagcuggggg

SEQ ID NO: 382601 - RNA, 64 nt, Human
gacccagggccccaaaccugggcucuuacagagccuccaugagucaagcccccuccccacaccu

SEQ ID NO: 382602 - RNA, 64 nt, Human
aguuuaccguuccucccucagggccuccgugacacuccaugaaaagaaguucuugcauaccgga

SEQ ID NO: 382603 - RNA, 64 nt, Human
ucaaacucugugagguagaauccuuugucuauaccuccaugaacauugacucguguguucagag

SEQ ID NO: 382604 - RNA, 64 nt, Human
gcuugaaaaggcgcagagcccuauaccucauuuccuccaugauaaaaggauccaagugaggccc

SEQ ID NO: 382605 - RNA, 64 nt, Human
cauggccuuccagcugugccaggcugucaaguuccuccaugauaacaagcugacacauacagac

SEQ ID NO: 382606 - RNA, 64 nt, Human
gcauaaaaccucgagacaugguuuuuggcaaaaacuccaugacuuuaaacuagcucuuuuacua

SEQ ID NO: 382607 - RNA, 64 nt, Human
uauucauccagggccuucucaaugagcacauuaccuccaugaucaauaaccaagaggcugcagu

SEQ ID NO: 382608 - RNA, 64 nt, Human
auuuacuaccaugagaacaguaugggggaaacaacuccaugauucaguuaucucccaccagguu

SEQ ID NO: 382609 - RNA, 64 nt, Human
ucucuuuuuuucccuuuucauuugguuguccuaacuccaugaauagaaaagaaaauguauuaau

SEQ ID NO: 382610 - RNA, 64 nt, Human
augcuggguggcccugcagccuccuccaccucaccuccaugacagcgcuaaacguuggugacgg

SEQ ID NO: 382611 - RNA, 64 nt, Human
gcagaaguuggggagaaggauacuuuugcacagccuccaugaugucuuuauugcaaauauggau

SEQ ID NO: 382612 - RNA, 64 nt, Human
aucuguuugacagucugcucaacacgacugcaagcuccaugagggcagggacaucaucucuucc

SEQ ID NO: 382613 - RNA, 64 nt, Human
uuauucuguaacucuccauucacuggucaaauaacuccaugaggcuaucaguggcuacagugga

SEQ ID NO: 382614 - RNA, 64 nt, Human
ugauuagacaggaucaauuguaaagugagggcuucuccaugacaccauaguucugcccaauacu

SEQ ID NO: 382615 - RNA, 64 nt, Human
auaaagcuugugauaaagagaggagaauaugggacuccaugaaccaguguugauauguuugauu

SEQ ID NO: 382616 - RNA, 64 nt, Human
ggcuguuuagacuguccguaauggaaugguaaaacuccaugaauuugcacuuugguuuuugaua

SEQ ID NO: 382617 - RNA, 64 nt, Human
ucaguuaagguguuacuuaauaauaguuuuuaggcuccaugaauuggcuccuguaaauacuaac

SEQ ID NO: 382618 - RNA, 64 nt, Human
uauuuagguauuuuucuuuaaccaaacaauauugcuccaugaugacuuaguacaaaguuucaau

SEQ ID NO: 382619 - RNA, 64 nt, Human
gaguggcaccaaggauagcaaugucuggauuggccuccaugacccccaccggaucagucugcug

SEQ ID NO: 382620 - RNA, 64 nt, Human
guggggaauggggagggaagggcauagccugcuccuccaugagucugacaucucggaaacugag

SEQ ID NO: 382621 - RNA, 64 nt, Human
uuccucaauaugggguuccguuggauuggggcuccuccaugacuagugggaauuacuguggguu

SEQ ID NO: 382622 - RNA, 64 nt, Human
gggggugcgaggggcucaguggggcuucucuucccuccaugagccuggagaccccaggggagga

SEQ ID NO: 382623 - RNA, 64 nt, Human
uucagcuggaccacucaggccuggacagccucaucuccaugaggcuggugcuucggguaaaucu

SEQ ID NO: 382624 - RNA, 64 nt, Human
aauuauauacauacaauucuuguguggaauuuaacuccaugacugaauagcauaaggaagaggu

SEQ ID NO: 382625 - RNA, 64 nt, Human
cacacacacccuuccucuugcucaaaagaucucacuccaugauacuguguaaaauauuuuugca

SEQ ID NO: 382626 - RNA, 64 nt, Human
uccuugggguggcuucagugggguggagaguggccuccaugauggaagaugauaggggacucag

SEQ ID NO: 382627 - RNA, 64 nt, Human
gaugcacgccaccaccaugccuguguuacagcagcuccaugaugguuguugcccgagguuaaug

SEQ ID NO: 382628 - RNA, 64 nt, Human
gccucagacucuuaccaucccggugcaugcaggucuccaugaagaagcugggacucauucacau

SEQ ID NO: 382629 - RNA, 64 nt, Human
guguguauauauguauauguauguuuguacaaaucuccaugauguuugccaaguuugaaugcgc

SEQ ID NO: 382630 - RNA, 64 nt, Human
agcagagcaagucugcaggugcaccacuucccgccuccaugacucgugcucccuccuuuuuaug

SEQ ID NO: 382631 - RNA, 64 nt, Human
acuuggagcugggaagccuggguucuggucccaucuccaugacugauucacgugugaccucaga

SEQ ID NO: 382632 - RNA, 64 nt, Human
agcuguugugcugggcacagucuggggcacaggccuccaugaugaagacgcgugggcugucggu

SEQ ID NO: 382633 - RNA, 64 nt, Human
caacaguaaauuuuuuuauaagugcuucucccuucuccaugaugugacuuccggagauaaagga

SEQ ID NO: 382634 - RNA, 64 nt, Human
caugacaagaguuugcauuuucuugaugauucaucuccaugagugcacaaucccugaacucacu

SEQ ID NO: 382635 - RNA, 64 nt, Human
uuuugcgaggcgauuugacauaggaacuuugagacuccaugagaaagucccuuucugaggccca

SEQ ID NO: 382636 - RNA, 64 nt, Human
ccaggggcugacaaugcgaggucgcaacugagaucuccaugacuguguguugugaaauaaaaug

SEQ ID NO: 382637 - RNA, 64 nt, Human
cuuguucugucccuuccacuucuaacuccacuggcuccaugauucucugaguggugguuccuuu

SEQ ID NO: 382638 - RNA, 64 nt, Human
ucuuuuuugggaaauacuuguguuuuugauacaucuccaugaaguucuuuugagaggagaggcu

SEQ ID NO: 382639 - RNA, 64 nt, Human
gaggcaauuucacauuuauaaauauuuuuuuuuccuccaugaaacuuacgcaguaaucacuacc

SEQ ID NO: 382640 - RNA, 64 nt, Human
cagacuaaggagauggcaggcauugacagcuucacuccaugaaggccaucucuguuucucuccu

SEQ ID NO: 382641 - RNA, 64 nt, Human
uuggcacauuuuugaguuuucccacauuauuugucuccaugauaccacucaagcagugugcugg

SEQ ID NO: 382642 - RNA, 64 nt, Human
cccagucaaugaaaacugaaucaagaaaugaaugcuccaugaaaugcacgaagucuguuuuaau

SEQ ID NO: 382643 - RNA, 64 nt, Human
caugaauguuucugugagcucuggugucacucaucuccaugaucaucucagccaacaugcauca

SEQ ID NO: 382644 - RNA, 64 nt, Human
guucagguggcuccaucgucuauucugugguccccuccaugagccuuugccccagggugggugc

SEQ ID NO: 382645 - RNA, 64 nt, Human
ggcaggagccucuacauccccuucccccuccucucuccaugacucuugacauccuagcuucuuc

SEQ ID NO: 382646 - RNA, 64 nt, Human
uaccaccuguccuaaggaagaccagaucaauagacuccaugauggaugcuuguuucaaaggguu

SEQ ID NO: 382647 - RNA, 64 nt, Human
gauaguauauagguuuaugccuguguuucuuuuucuccaugagaaagcuaaacaugaaauauaa

SEQ ID NO: 382648 - RNA, 64 nt, Human
uaguaguucuggcccaccucuuuccccacccuggcuccaugacccaccccacucuggaugccag

SEQ ID NO: 382649 - RNA, 64 nt, Human
gaaccugauacacaauuaugaccagaaaauauggcuccaugaaggugcuacuuuuaaguaaugu

SEQ ID NO: 382650 - RNA, 64 nt, Human
uucugccacucuaagcuguuguggauuuuccugucuccaugaaccacucccauucccccguccc

SEQ ID NO: 382651 - RNA, 64 nt, Human
agguugagacuagaaaaugccucuuucuuccuuucuccaugaaauguguuugaaacaaauccug

SEQ ID NO: 382652 - RNA, 64 nt, Human
agagcaaaagacagugguaaauguuuuauuccgucuccaugaggaauugaaggaguuggucucc

SEQ ID NO: 382653 - RNA, 64 nt, Human
gccacccccggcauggcuccagguggccuggugacuccaugauggacgaucuugcucccaggac

SEQ ID NO: 382654 - RNA, 64 nt, Human
caaaaaccauaaaaucacuggguuccacaucagccuccaugaggccaagccuuguaccugcaag

SEQ ID NO: 382655 - RNA, 64 nt, Human
uuuggguaguccuaggguaacacccugcccuaaacuccaugauuucauaggcuuuucuucccuu

SEQ ID NO: 382656 - RNA, 64 nt, Human
uguuuuauugacugucuuuccuauagacuguaagcuccaugagggcaggcacauguuguucuca

SEQ ID NO: 382657 - RNA, 64 nt, Human
aaaucucaugugaauuuccaaguuuuaauucguucuccaugaaggauuuucauuucagugaaag

SEQ ID NO: 382658 - RNA, 64 nt, Human
gcagaaaccccaccucacaugaagggaagggcaucuccaugaugguggaucccaaaaccccucu

SEQ ID NO: 382659 - RNA, 64 nt, Human
aaaggguauccacagcaggaaguccccaguucaccuccaugacuacagggcagcuuugcacagc

SEQ ID NO: 382660 - RNA, 64 nt, Human
ucuucacaauauccaaugaagaaggucucauuaucuccaugauaaagauggggaaacuaagguc

SEQ ID NO: 382661 - RNA, 64 nt, Human
aaauaaauauaccacucuuuaccuuuauugauaucuccaugaugauaguugaauguugcaaugu

SEQ ID NO: 382662 - RNA, 64 nt, Human
cucacuagauaaggggccgccggcuggcugccggcuccaugacgcccguggggucaccccccgg

SEQ ID NO: 382663 - RNA, 64 nt, Human
gcuugugugcaaauuuugucucaaucuuuuuucccuccaugauuuuccuaugugcuuccucugg

SEQ ID NO: 382664 - RNA, 64 nt, Human
ccaaggacaucgcaucagggauggccuaccuccacuccaugaacaucauccaccgagaccucaa

SEQ ID NO: 382665 - RNA, 64 nt, Human
gguccuuuccauuccuauuuagagggaguccuggcuccaugacccccucccgaguggacugucc

SEQ ID NO: 382666 - RNA, 64 nt, Human
acacacacacacacacacacacuccauucacugucuccaugacucuggaguaaacuaacgucuc

SEQ ID NO: 382667 - RNA, 64 nt, Human
uuuguacacuuugucucacagaauaguucugaggcuccaugacaggguuuugucauuguugaug

SEQ ID NO: 382668 - RNA, 64 nt, Human
aaauccccguggugcgcaacagcaccgugcugcucuccaugacccaugaagaccaaaagcugca

SEQ ID NO: 382669 - RNA, 64 nt, Human
gcucuguaggauaaucacacuuagaaaacaucugcuccaugacauucacaauaccagggaccau

SEQ ID NO: 382670 - RNA, 64 nt, Human
gacaccccccaccauggugggcuugugguggcugcuccaugagggugggggugauacuacuaga

SEQ ID NO: 382671 - RNA, 64 nt, Human
gccugcgcaggcgggacuaucaggaguccacugccuccaugaugcaagccagcuuccugugcag

SEQ ID NO: 382672 - RNA, 64 nt, Human
uguccccuccccagccauccucccgccuugggggcuccaugaaggaugcaggcuuccaggccug

SEQ ID NO: 382673 - RNA, 64 nt, Human
uaugaaucagauggaacaaucugaaugugauaugcuccaugaugcuguguguuuugguaguaag

SEQ ID NO: 382674 - RNA, 64 nt, Human
agaaaccccagggaugauucuucaaagcccccuccuccaugagaggggacugaaaugcugcagc

SEQ ID NO: 382675 - RNA, 64 nt, Human
ccuggccccagcgcgccccgacacacaugcuuuucuccaugacacgaggccaguccccaggagc

SEQ ID NO: 382676 - RNA, 64 nt, Human
uucacuuauuuuauugucuuauuuuaaacccugucuccaugacuucauuugcacuuugacagag

SEQ ID NO: 382677 - RNA, 64 nt, Human
agcaagccagguaugucuugcuuaaguauuucuucuccaugaauggccuuaacauuauuuugua

SEQ ID NO: 382678 - RNA, 64 nt, Human
uuuauagaaaagaucaaggcugucuggcgcgggacuccaugagccccaggcgcuggucagaaac

SEQ ID NO: 382679 - RNA, 64 nt, Human
cuaucuggaguuaacuugcaagcauauuggugcccuccaugaccaccucuggcuuaggacuugg

SEQ ID NO: 382680 - RNA, 64 nt, Human
uuauugaagguucuuuggguaaauauuagucucccuccaugacacugcaguauuuuuuuuaauu

SEQ ID NO: 382681 - RNA, 64 nt, Human
ugagaaaguguugguugguuuuaaaaucugguaacuccaugaugaaaagaaauuuauuuuauac

SEQ ID NO: 382682 - RNA, 64 nt, Human
gcgaaggcgccuggccacagcugcccucuggccucuccaugaugaggugccuccacaacuuccu

SEQ ID NO: 382683 - RNA, 64 nt, Human
gaugcugccauauauuaagauagaauauaauuaacuccaugagaaugguuacucaggaacuagu

SEQ ID NO: 382684 - RNA, 64 nt, Human
gagguggguucuguuuuccaggugaaacuuuuagcuccaugacagaccagccuguaguuaucug

SEQ ID NO: 382685 - RNA, 64 nt, Human
uauuuucacaauagcucugugauguaagugcuaucuccaugagaaaauucauaaaggguguuuu

SEQ ID NO: 382686 - RNA, 64 nt, Human
uucaguucuauuuaaaauggugaaugacacuaaacuccaugauauuuaaggauagugugaagau

SEQ ID NO: 382687 - RNA, 64 nt, Human
uugugcuaagccugaugaaaugugcuccuucaaucuccaugaaaccaucguaacauggaggccu

SEQ ID NO: 382688 - RNA, 64 nt, Human
ugugguggucuuggacaguauguggaaacagaagcuccaugacgguagaagacuucucauuggg

SEQ ID NO: 382689 - RNA, 64 nt, Human
ucugacguagaaagauccuucgggugcuggaagucuccaugaagagcuuguguccuguccuuuc

SEQ ID NO: 382690 - RNA, 64 nt, Human
uaccuuuucagaugccauuuuacaggcggaaaugcuccaugaaacaggaagccacuugcaagca

SEQ ID NO: 382691 - RNA, 64 nt, Human
gcaaagcgcccacccaggucccccgacugccugucuccaugagguacuggucccuuccuuuugu

SEQ ID NO: 382692 - RNA, 64 nt, Human
gucacuuaagaaaaaaaaguguaacaaauucucgcuccaugaaccugguuuuuuuuuauucugu

SEQ ID NO: 382693 - RNA, 64 nt, Human
cuuugaagauggcgcucugggcaugagcauggggcuccaugacuucccuucuauccccaugagc

SEQ ID NO: 382694 - RNA, 64 nt, Human
uagagcgugggaggugccuuugagaacugcuugacuccaugaucuccuagaacaaaaccgcccu

SEQ ID NO: 382695 - RNA, 64 nt, Human
ugcaccggggggucaccuuuucacaaauguagaccuccaugaacucauuggaugacccuggaca

SEQ ID NO: 382696 - RNA, 64 nt, Human
ucucaccagcucagccccggccacucccugccaacuccaugaccaggccaccaucuguacccug

SEQ ID NO: 382697 - RNA, 64 nt, Human
aaccuggguguugcuuccgggccagucugcguggcuccaugaaaagcucacugcugccccagcc

SEQ ID NO: 382698 - RNA, 64 nt, Human
uugggggugaugaccccuucccugagguggcugucuccaugaggaggccaacccuugccauuga

SEQ ID NO: 382699 - RNA, 64 nt, Human
gacuuccaggggauugccaucuuaccugucucuucuccaugagggagaaggaagcagcuagcua

SEQ ID NO: 382700 - RNA, 64 nt, Human
agugaaacaggugcuucuugcuccuggguuuucucuccaugauguuaugcccaauuggaaauau

SEQ ID NO: 382701 - RNA, 64 nt, Human
ggccauuuuguucuuggagggacaaaauugaccucuccaugaaauugcaaaaacccaucuucau

SEQ ID NO: 382702 - RNA, 64 nt, Human
uuguacacgccucagcuccuggcaauuagcuggacuccaugacccaccccuggugcagcauaga

SEQ ID NO: 382703 - RNA, 64 nt, Human
gucaggaaaaauaauccuaaauguuugauuaccucuccaugaagcggccacagaaacuguuggu

SEQ ID NO: 382704 - RNA, 64 nt, Human
uggggaaaagacaaauuguccgaagugcuaagaacuccaugagagaagaugccauaaaauaaac

SEQ ID NO: 382705 - RNA, 64 nt, Human
cuaguacuaacuccuaggaaaauacuauucugaccuccaugacugcacaguaauuucgucuguu

SEQ ID NO: 382706 - RNA, 64 nt, Human
gucuuaacuuucaggaguuuacaauugacuaacacuccaugauugauucagucaugaaccucau

SEQ ID NO: 382707 - RNA, 64 nt, Human
ggcuucccuguaaccacauggggcuuggccauuucuccaugaugagaaggacuggaaugcuucu

SEQ ID NO: 382708 - RNA, 64 nt, Human
uguugaaagggauuuuugaaggacagaacaauuacuccaugaugaaucuuccuuucucugccuu

SEQ ID NO: 382709 - RNA, 64 nt, Human
ccuggguccagggcaucuuaaguucauccagcagcuccaugagccacacagauauccuagaaaa

SEQ ID NO: 382710 - RNA, 64 nt, Human
cccuccacagcucucaccucaugucguggcugggcuccaugagguugcccgauguguggaugca

SEQ ID NO: 382711 - RNA, 64 nt, Human
cccuguuaggguucuacucgggggagggagggggcuccaugaaagguacgucugaaaaguuucu

SEQ ID NO: 382712 - RNA, 64 nt, Human
acuucuuuggccagugauggggaaucagugagugcuccaugauggucauguuccaggugcuagu

SEQ ID NO: 382713 - RNA, 64 nt, Human
guuguucccuucccggugccagguccagauuucccuccaugauuugggaaccagcuuaggcaaa

SEQ ID NO: 382714 - RNA, 64 nt, Human
cugcuuaucagcuauucagacaucuccaugguuucuccaugaaacucugugguuucaucauucc

SEQ ID NO: 382715 - RNA, 64 nt, Human
uugucuuucuaaauuucaacuucaaugucaucuucuccaugaagaccacugaaugaacaccuuu

SEQ ID NO: 382716 - RNA, 64 nt, Human
uuauaugcccagccucauuuaauccucagaaugacuccaugagguagcuacuaaaaccccccac

SEQ ID NO: 382717 - RNA, 64 nt, Human
gaagcaggauguugucacucccgucugaauaaagcuccaugagcuggguuggaaagcugaacau

SEQ ID NO: 382718 - RNA, 64 nt, Human
aguugcuggcugugccugagcagcucugggugcucuccaugagaauggggccaucugucuucuc

SEQ ID NO: 382719 - RNA, 64 nt, Human
agaaugagugggucaucuuauaaccuuucugaagcuccaugaggacauguauagaaugcugcac

SEQ ID NO: 382720 - RNA, 64 nt, Human
auuugucaaaacucaguguuuucuccaucagauacuccaugaaaggucacaauuucucuugaua

SEQ ID NO: 382721 - RNA, 64 nt, Human
guucauucuccuuccuuuuuccucccgcuucccucuccaugaagugauucuguugacaauaaug

SEQ ID NO: 382722 - RNA, 64 nt, Human
aucacuucagugacaauacccauuaaugaaucuucuccaugauuugggguuuuuuuucguuguu

SEQ ID NO: 382723 - RNA, 64 nt, Human
uggaguuggagcaaggagaaaauugcacuaggcacuccaugaucugcagagcauguugcuuuug

SEQ ID NO: 382724 - RNA, 64 nt, Human
ggaauugugcuuuggcucauaacuuggccauguucuccaugaauuaguucuccuauuuuuuuuu

SEQ ID NO: 382725 - RNA, 64 nt, Human
aacucuuuuguacaaaugaaacuauuuucuucuucuccaugaagccagggcacaaagaauuuga

SEQ ID NO: 382726 - RNA, 64 nt, Human
cagagaagaccagccgugcuccugcauuccgucacuccaugacuucaucucagugucacagaca

SEQ ID NO: 382727 - RNA, 60 nt, Human
ugaugaagauccacuuaugaacugaacauucuccaugaacaggugguuggauugguaucu

SEQ ID NO: 382728 - RNA, 64 nt, Human
cugcacuugcuccccagauccacuucacuggcugcuccaugaauccagcccgcuccuucggccc

SEQ ID NO: 382729 - RNA, 64 nt, Human
ggacuucacagauuuguccaggcugccccuggcccuccaugacacacccccgauuccuggacaa

SEQ ID NO: 382730 - RNA, 64 nt, Human
uuuguagacagucacgucauguuagguguuuguacuccaugaggaugagaacucuaaaugaggu

SEQ ID NO: 382731 - RNA, 64 nt, Human
cugaggacuccgaucgcgaugucucaucugacagcuccaugagauagagaccugccucccccuu

SEQ ID NO: 382732 - RNA, 64 nt, Human
augcugcuacuugauuucuuucucaucccacgcacuccaugagcaccccaaggcugcaguuugu

SEQ ID NO: 382733 - RNA, 64 nt, Human
augcugcuacuuaauuccuuucucaucccacgcacuccaugagcaccccaaggcugcgguuugu

SEQ ID NO: 382734 - RNA, 64 nt, Human
gcuuucauguuguuauucuguacccuauaguagccuccaugagaaucugguauuucuugcugcu

SEQ ID NO: 382735 - RNA, 64 nt, Human
aaaugagcuugaccuuuaagagaaaugagcugcacuccaugagugcagcucuggagguacgaaa

SEQ ID NO: 382736 - RNA, 64 nt, Human
auuaaggccuuaaucuguuuagauuaucuuuaaucuccaugaaaucgugaaauaagacaagaau

SEQ ID NO: 382737 - RNA, 64 nt, Human
uguuaaugcguuuuguacaucagccuucuccugucuccaugauaacugcauuugguaggaagcc

SEQ ID NO: 382738 - RNA, 64 nt, Human
ugaaacugaugauuuuauaagguauuuuucaccccuccaugaagugagguggaggccuuuagca

SEQ ID NO: 382739 - RNA, 64 nt, Human
cccuaaccauaagauuuacugcugcuguggauaucuccaugaaguuuucccacugagucacauc

SEQ ID NO: 382740 - RNA, 64 nt, Human
cuuagguuucaugcccauuuucuaucacacugggcuccaugauauucuguucccuaagaacugc

SEQ ID NO: 382741 - RNA, 64 nt, Human
uuauuucaaaugucugcuaaugcagaguaggcuacuccaugauaguguuaaaaaacaaaauuug

SEQ ID NO: 382742 - RNA, 64 nt, Human
augggucuuucagucuuggcauuucauuuaggaucuccaugagaaaugggcuucuugagcccug

SEQ ID NO: 382743 - RNA, 64 nt, Human
uuuuaaaggggacaaaaaaaaaaaaaggacuugacuccaugacgucgaccguggccgcuggcug

SEQ ID NO: 382744 - RNA, 64 nt, Human
guagaucucucgguuucaguugacaccauucccucuccaugaucuucagacuuaacuacuacug

SEQ ID NO: 382745 - RNA, 64 nt, Human
aguauuucaguaucacaguguuucaguaauuugccuccaugauucuagugcuucugccuuaccg

SEQ ID NO: 382746 - RNA, 64 nt, Human
gacagagccauuuggauauuuuccccuugaacuucuccaugaccugaagcguuccuucccugga

SEQ ID NO: 382747 - RNA, 64 nt, Human
ucugucccguaauuguguaugucuuucuuuccagcuccaugaugcguuaucugggucuggaaac

SEQ ID NO: 382748 - RNA, 64 nt, Human
uuuauauuuguuccuugagucuucagggcagugucuccaugaggguuuuccuguugaggggcac

SEQ ID NO: 382749 - RNA, 64 nt, Human
cauuccauuaagcuuccuugcaggguggggcccacuccaugaagacagcagucaugccuuaaga

SEQ ID NO: 382750 - RNA, 64 nt, Human
uaaaaaagucccaaggguguuuuguuacuguuuucuccaugaauaaacucacuugauuuuaaau

SEQ ID NO: 382751 - RNA, 64 nt, Human
aaauuuucccagugaauaaauauuuuaggaaacucuccaugauuauuaguugaccaacuauauu

SEQ ID NO: 382752 - RNA, 64 nt, Human
cucucugcucaagcacagcagaaucauggccccucuccaugaauuggaacuugguacagguuaa

SEQ ID NO: 382753 - RNA, 64 nt, Human
aucccaauagggugggggccugugggccagaggacuccaugacaguagccauggagucccaccu

SEQ ID NO: 382754 - RNA, 64 nt, Human
gguagucauucuuacaauugcacugcuguuccugcuccaugacuggcugucugccuguauuuuc

SEQ ID NO: 382755 - RNA, 64 nt, Human
uauauaguucaugcccugccaaggcauuguucgacuccaugauacuaaaacauaaugaaagaaa

SEQ ID NO: 382756 - RNA, 64 nt, Human
gaggaggacgaggacgacugggaauccuagggggcuccaugacaccuucccccccagacccaga

SEQ ID NO: 382757 - RNA, 64 nt, Human
ucuuauuuguccaggucaguuccagaacuucucccuccaugacccacucuaugggaaacucuuc

SEQ ID NO: 382758 - RNA, 64 nt, Human
gcucaauacagccuccgauccucacucuugaaagcuccaugauaagcacagagaugggcagugu

SEQ ID NO: 382759 - RNA, 64 nt, Human
uggucgccacugggcagcagcagccuuaccaguccuccaugaucacacccagggaccugcaugg

SEQ ID NO: 382760 - RNA, 64 nt, Human
agguuuuaauuaauucccauacugauaaaaauaacuccaugaauucuguaaaccauugcauaaa

SEQ ID NO: 382761 - RNA, 64 nt, Human
cucugggagguaggcuaugcccauccaaauaaaucuccaugagaaacuugaggagacuucauaa

SEQ ID NO: 382762 - RNA, 64 nt, Human
ggaacugaagauuguccuggccgcgaccugagaccuccaugaguggagggaagagugaucuaug

SEQ ID NO: 382763 - RNA, 64 nt, Human
cuacagguccccuccccagggcaggggauuugggcuccaugagcuccuugaggggcucuucugg

SEQ ID NO: 382764 - RNA, 64 nt, Human
cggccugcuggagccugcgcagcuuggauggagacuccaugagaagccguggguggaaccagga

SEQ ID NO: 382765 - RNA, 64 nt, Human
cgugcacacccacccauggugcacaccuguaguccuccaugaggacaugggaagguaggaguug

SEQ ID NO: 382766 - RNA, 64 nt, Human
gacaggucagacacccaggcccaccccagagacccuccaugaacugugcucccagccuucccgg

SEQ ID NO: 382767 - RNA, 64 nt, Human
uucuugauauuuucuacccucacuagaauguaaacuccaugaaggcacagacuuuucuuguucu

SEQ ID NO: 382768 - RNA, 64 nt, Human
aucacugcguucuucaagggaugaauccagagcccuccaugaggccaagcuuguccuucaauca

SEQ ID NO: 382769 - RNA, 64 nt, Human
cugugcauguccuucaugguaggugagcaccagucuccaugaucaaaaaugccccaguuuccuu

SEQ ID NO: 382770 - RNA, 64 nt, Human
ggaaauggugaagucuauuaggagccacuugugacuccaugaccuguuaaaaccagcaauguga

SEQ ID NO: 382771 - RNA, 64 nt, Human
uucucgccauucuuuagcuguagucaugaauagucuccaugauuuucaaaauugauucccuuua

SEQ ID NO: 382772 - RNA, 64 nt, Human
ccucucucuccccuccacuuuuuuuuuuugucagcuccaugacaacaugaccagcucagcaaag

SEQ ID NO: 382773 - RNA, 64 nt, Human
ggaggaaacccccuugggugccccacacagggcucuccaugaugggaaccagugguuaguggcu

SEQ ID NO: 382774 - RNA, 64 nt, Human
uugcauuuaauuuauugaggcuuuaaaacuuauccuccaugaauaucaguuauuuuuaaacugu

SEQ ID NO: 382775 - RNA, 64 nt, Human
gucuucagggaaggucaccugagcccggaugcuucuccaugagacacaucuccuccauacucag

SEQ ID NO: 382776 - RNA, 64 nt, Human
gucuucagggaaggucaccugagccuggaugcuucuccaugagccgcaucuccuccauacucag

SEQ ID NO: 382777 - RNA, 64 nt, Human
gucugugugucugucucccccaccagacugugagcuccaugagggcagggaccgugucuugucc

SEQ ID NO: 382778 - RNA, 64 nt, Human
uaucugagaggaauuuuuaacugacggcuucugucuccaugaaucauuaucagcaugaugaaag

SEQ ID NO: 382779 - RNA, 64 nt, Human
cacacacacacacaggaggagaaaucucacuuuucuccaugaguuuuuucucuugggcugagac

SEQ ID NO: 382780 - RNA, 64 nt, Human
ccgcauugauggccucaauguggcagacaucggccuccaugaccugcgcucucagcugaccauc

SEQ ID NO: 382781 - RNA, 64 nt, Human
ugcuuuuucuggaaaaucuuucuuucucuucucucuccaugaaaauuaaaacacacaagugaau

SEQ ID NO: 382782 - RNA, 64 nt, Human
ggcaagcacaaugguuucaaagaaagacuguaagcuccaugauuagcauaaagcacuaaccaug

SEQ ID NO: 382783 - RNA, 64 nt, Human
augguagccucuggguuguuguuuuuuucuuuuccuccaugauguuaauggguuaucucaaauu

SEQ ID NO: 382784 - RNA, 64 nt, Human
cgggaagaccuucaggaguggggaaggguuucuccuccaugaucgacccuccucguccaccuac

SEQ ID NO: 382785 - RNA, 64 nt, Human
agguuccccucucagucuuccuccagggaauggccuccaugaggggcagggccagcuuccaucc

SEQ ID NO: 382786 - RNA, 64 nt, Human
agaggcacaugguucuagccuggaccuggcugggcuccaugagaaugaguugccuccaaccugu

SEQ ID NO: 382787 - RNA, 64 nt, Human
cucaggcaccuuuccuccccuggacacccauggucuccaugagugcucccucugcugccccuga

SEQ ID NO: 382788 - RNA, 64 nt, Human
gauuccguggccuugggggcaggagagagacacucuccaugaacacuucuccagccaccucaua

SEQ ID NO: 382789 - RNA, 64 nt, Human
guucuuagaugcuggugggcauuugaacaugcuccuccaugauucugaagcaugcacaccucug

SEQ ID NO: 382790 - RNA, 64 nt, Human
cuggacuuauaaugccaccuucugucuccuacgacuccaugagcagcgccagcccagcucuccc

SEQ ID NO: 382791 - RNA, 64 nt, Human
ccaccccucucagcuugagguccuaccugguguccuccaugagaaucauacaagccccgcuaca

SEQ ID NO: 382792 - RNA, 64 nt, Human
cagcucagcggaucccccagaguggaggaggccucuccaugaggaggggagcagcccaaggcac

SEQ ID NO: 382793 - RNA, 64 nt, Human
agccacagaguggaguuuuauugcuucuuugccucuccaugaauggccaauuuggaaaagcaga

SEQ ID NO: 382794 - RNA, 64 nt, Human
ucagauuuccuggaggcaaagucuaucucugaaacuccaugaagacuuuugcagccaguuccca

SEQ ID NO: 382795 - RNA, 59 nt, Human
ugagcucagccgagaaauagccacagaugcuccaugaggaaaaucccuguccacauugg

SEQ ID NO: 382796 - RNA, 64 nt, Human
aacugauaccuugagagauggcuggaccaauucucuccaugacaaauguuuaaucauuaguuac

SEQ ID NO: 382797 - RNA, 64 nt, Human
gugguuggcuugggguggccaaugggcugggacccuccaugagaguuuuggacacuugggucac

SEQ ID NO: 382798 - RNA, 64 nt, Human
cgagggcgucccgugcccacguacauacguaugucuccaugaguucugggcuccacugguucca

SEQ ID NO: 382799 - RNA, 64 nt, Human
aaugcugcccuggcucguccuagaaucauuucuccuccaugauggaagcccagugauuguucag

SEQ ID NO: 382800 - RNA, 64 nt, Human
ugcacauauccuuagcccaucuuucaagggaccucuccaugaucccaccucccauucacagaua

SEQ ID NO: 382801 - RNA, 64 nt, Human
ccccagccuccaggaacuauccauccacucuuaucuccaugaguucaauuguuuugauuuuuag

SEQ ID NO: 382802 - RNA, 64 nt, Human
acuucaugaucugaauccccccgagucauucauucuccaugaagucaucgauuuuccagguguu

SEQ ID NO: 382803 - RNA, 64 nt, Human
cuuuugggaccuaagauaagugacuuuccugaaccuccaugaccuccucauauguaaaccaggg

SEQ ID NO: 382804 - RNA, 64 nt, Human
cggagagggaccucccagccgagcccucaaagaacuccaugaaaucaggaacugcuugaugaaa

SEQ ID NO: 382805 - RNA, 64 nt, Human
uuuuacuguagaagggacaauuaacuccauccuucuccaugacucugaaauccaaggggggguu

SEQ ID NO: 382806 - RNA, 64 nt, Human
uggccuccuuccagcccagugccagaaaccagcacuccaugaagauaaacucugggcccgccca

SEQ ID NO: 382807 - RNA, 64 nt, Human
ucuggauagaggauucccccaacuccccaacuuucuccaugagggucacgcccccugaggaccu

SEQ ID NO: 382808 - RNA, 64 nt, Human
cugcauggagucgagguggaggucacgugcagagcuccaugaggucccggagccccccucucaa

SEQ ID NO: 382809 - RNA, 64 nt, Human
ccccugaaauuucugccccucucuaccacccucacuccaugaccugugagaucacaaagugaag

SEQ ID NO: 382810 - RNA, 64 nt, Human
ugccugcaugcugcuugaauugcuccacccacaccuccaugaccaagggcgccagagugcugca

SEQ ID NO: 382811 - RNA, 64 nt, Human
cuggaaacaguccccugcccagaguccccucagccuccaugacaggucccucccuggcccccca

SEQ ID NO: 382812 - RNA, 64 nt, Human
caacuccuuaucaaaauuguuuauacacucuuuccuccaugagcucuggaagguauaugcaucu

SEQ ID NO: 382813 - RNA, 64 nt, Human
gccggggcugauggacaguggggacuuuccuucucuccaugauggcuuugcaggggcuccaugg

SEQ ID NO: 382814 - RNA, 64 nt, Human
ugugucccuagaauucccacugcugggccucuaucuccaugacaacaaaauaaaaacagagguu

SEQ ID NO: 382815 - RNA, 64 nt, Human
gccguggggacuguucuggggaggcucaugcugucuccaugacgucuguggcaggagucccuga

SEQ ID NO: 382816 - RNA, 64 nt, Human
aucaccgauccacccugcagcccucgcugcaguccuccaugaccuaccucuaugaggacagcaa

SEQ ID NO: 382817 - RNA, 64 nt, Human
ucccccuccccugguugcagauacaguaccuggacuccaugaacggggaggaucugcuucugac

SEQ ID NO: 382818 - RNA, 60 nt, Human
uucugguguucccccuauaggauucaauuucuccaugauguucauccaggugagggauga

SEQ ID NO: 382819 - RNA, 64 nt, Human
cuuccccuugggaugggcacaggcugccccaccccuccaugauuccaagggcccagaggggcgg

SEQ ID NO: 382820 - RNA, 64 nt, Human
cccaagauucuauggagguuggccacagucaccacuccaugacaucccugucuuccucaacgac

SEQ ID NO: 382821 - RNA, 64 nt, Human
uuaacccauguaggugccagagaaaccacccccacuccaugagaagaggcucagacagcaggcu

SEQ ID NO: 382822 - RNA, 64 nt, Human
cccacaagaaagagggcaaggaaaaaaggcuggacuccaugacuauauauacauacaucuaucu

SEQ ID NO: 382823 - RNA, 64 nt, Human
uggaugugugagucaugaagccagagaagccccgcuccaugagcagugacuccccagguaagac

SEQ ID NO: 382824 - RNA, 64 nt, Human
ggcugugggagaguugaccguauucugggcaagacuccaugaccccucugauucugcaguguac

SEQ ID NO: 382825 - RNA, 64 nt, Human
ugagaaacagcccccaguccuccuccacuacaaccuccaugaccuugagacgcaucccaggagg

SEQ ID NO: 382826 - RNA, 64 nt, Human
gaagaguugggcuguggaaggacaucuucaccgucuccaugaaugagaaguuugacuuggugua

SEQ ID NO: 382827 - RNA, 64 nt, Human
ugcagagaagaauaagacauaaaauagcuccgaccuccaugauccgagagugggaaaaggcccg

SEQ ID NO: 382828 - RNA, 64 nt, Human
uucaaaucucuaauaauuuaaacuuuccucagugcuccaugauacuuuuuuugagacuccauau

SEQ ID NO: 382829 - RNA, 64 nt, Human
uccuuauacuccccuaucuuguccuagcccaggccuccaugaaggagaaccugguggcauugcc

SEQ ID NO: 382830 - RNA, 64 nt, Human
auguuuagaguuaagcaagacuuuuuuucuuccucuccaugaguugugaaauuuaaugcacaac

SEQ ID NO: 382831 - RNA, 64 nt, Human
uaugaaugaaauucuuauucaugguuuuuauucucuccaugauuuuauuauaauuuugacacua

SEQ ID NO: 382832 - RNA, 64 nt, Human
ucacuaucaugagaauagcaugggaaagaccugccuccaugauucaguuaccucccacuggguc

SEQ ID NO: 382833 - RNA, 64 nt, Human
gcaguucuuaacccaguguccauggacucagaaacuccaugaugccccugagaugguaugcaca

SEQ ID NO: 382834 - RNA, 64 nt, Human
ccccuccuucaaggcccaguauaaaugccaccuccuccaugaagccuucccuaauuccacccca

SEQ ID NO: 382835 - RNA, 64 nt, Human
gcacuguuuuguggcccaugcuaggcaguggcugcuccaugagcccuuuguggaccacauguua

SEQ ID NO: 382836 - RNA, 64 nt, Human
uguaugaccccaccugagcaaccacaaauaggcucuccaugaaacugcaaaggaacugaugugu

SEQ ID NO: 382837 - RNA, 64 nt, Human
guugguuuuguggagagagguagauacuaacuuccuccaugaauuuuuugagguauucaaagga

SEQ ID NO: 382838 - RNA, 64 nt, Human; identical to SEQ ID NO: 382837

SEQ ID NO: 382839 - RNA, 64 nt, Human
gugugugugugaaacguagucugcaacucugccucccggcaauuauacaugugucaggauguca

SEQ ID NO: 382840 - RNA, 64 nt, Human
uucaguaccaccccucucuccccaccuucccucucccggcaacaucucugggaaucaacagcau

SEQ ID NO: 382841 - RNA, 64 nt, Human
caaacaccacagccuucuccagagccggcacugucccggcaaccaggggugccccaggcuagcu

SEQ ID NO: 382842 - RNA, 64 nt, Human
ugaccuagucaccuggaaccagcuccugacagaccccggcaacuucuagaugaacccaagugaa

SEQ ID NO: 382843 - RNA, 64 nt, Human
cuugucuuaaauuguccaacaaggugacucauugcccggcaaacacuuuuacccucagauguua

SEQ ID NO: 382844 - RNA, 64 nt, Human
ugacagguauggaguucacacugugugcugccgacccggcaaguuugacagcacccaaacuggc

SEQ ID NO: 382845 - RNA, 64 nt, Human
cccaaagauuaggucguuuuccaaagagccgcgucccggcaaguccggcggaauucaccagugu

SEQ ID NO: 382846 - RNA, 64 nt, Human
acccugggagguggcagacagaagcacccccugccccggcaagaaacucccaggcucaaucaag

SEQ ID NO: 382847 - RNA, 64 nt, Human
acuugaccccggcucauccugucucuggcuguggcccggcaaagcacugaaaaccccucugguc

SEQ ID NO: 382848 - RNA, 64 nt, Human
aggcccgcccugcccgcgcccgccgccucccucacccggcaaggggcgcgcgcccccaggaccc

SEQ ID NO: 382849 - RNA, 64 nt, Human
ugaaguaaaauaaaggcucaaaacgugacggcaacccggcaaaaggguagggagccaggccgaa

SEQ ID NO: 382850 - RNA, 64 nt, Human
cucuuuccccacacuucgcgacccuccucccgcgcccggcaaaaaguauccuucccgccauuuu

SEQ ID NO: 382851 - RNA, 64 nt, Human
caaagcacugggauuacaggugugagccacugugcccggcaaauuuuuuuaccuuuacagaagg

SEQ ID NO: 382852 - RNA, 64 nt, Human
acaauaagggugauuggggucccugucgcccacccccggcaauccuauuugcuuaccugucacc

SEQ ID NO: 382853 - RNA, 64 nt, Human
cagcuggguacggugccacguucaggcacgugcacccggcaagguucagggcacauaccuaccu

SEQ ID NO: 382854 - RNA, 64 nt, Human
acggaacugccauccugugagggcagcgguggcgcccggcaaaguuggagcccuugcgguacca

SEQ ID NO: 382855 - RNA, 64 nt, Human
gaagcuggcuuugaaaccucagggcugucccagccccggcaagccacaggaaggaggggagaga

SEQ ID NO: 382856 - RNA, 64 nt, Human
gccugcuggagguugccauggagggccauuccugcccggcaacagcaccguccugcagggagcc

SEQ ID NO: 382857 - RNA, 64 nt, Human
acagaaguaccugaaaacagcugugcauggcaggcccggcaauagcuucugacccacagcaccc

SEQ ID NO: 382858 - RNA, 64 nt, Human
gaggaacacgagacuuucuuugacacccagaagacccggcaacgaggaggaaggccucgcggug

SEQ ID NO: 382859 - RNA, 64 nt, Human
ggcccuaaacauccaccuaauccuuucaaaucagcccggcaaaagcuagacucuccucgugucu

SEQ ID NO: 382860 - RNA, 64 nt, Human
ccacccacacuccagaucgagaccccugccuccccccggcaaauguccucccgcugccuugcag

SEQ ID NO: 382861 - RNA, 64 nt, Human
gcaggaggcccucccuccacccccccacccucagcccggcaacuucuggguuccauggguuuua

SEQ ID NO: 382862 - RNA, 64 nt, Human
auuaauugcccacucucccacccuaccagugcagcccggcaagggcaggaauugggaggccuag

SEQ ID NO: 382863 - RNA, 64 nt, Human
cucugcuaucgcuugcaugcucgguguacagucucccggcaacuguuuuguuccaaucaacuua

SEQ ID NO: 382864 - RNA, 64 nt, Human
gcaaaaauuucuggcuucucuuaccccuauugcccccggcaauaaauuguuucuauaugccaga

SEQ ID NO: 382865 - RNA, 64 nt, Human
cccccagucucaauugccugauggcugaugccggcccggcaaauaggcaccgcacuuuacucuu

SEQ ID NO: 382866 - RNA, 64 nt, Human
ggagaggaaaggagccacaggagcgggugcuacacccggcaagacagagcgucuccaucuaaaa

SEQ ID NO: 382867 - RNA, 64 nt, Human
agcacuuuaagccugcuccauggaggcagagaggcccggcaagcacagccacugugacggggag

SEQ ID NO: 382868 - RNA, 64 nt, Human
aaguaguugugccuccuaggcacacaacacuaugcccggcaaauuuuuuguauuuuguauuuuu

SEQ ID NO: 382869 - RNA, 64 nt, Human
auguagcuagcauuuugaaaccauaugggcaaaacccggcaaccagaaggggacagauaaggac

SEQ ID NO: 382870 - RNA, 64 nt, Human
cuguugcaccaagccacugcaagagaaacccccacccggcaagcccgccccaucccagacagga

SEQ ID NO: 382871 - RNA, 64 nt, Human
auagugaggaucccaucucuacgcccacccuccccccggcaaaaaaaaaaagcuggguauggug

SEQ ID NO: 382872 - RNA, 64 nt, Human
guguucuuugcagaaugucuccuucagccugucccccggcaaggugacggcccugguggggccc

SEQ ID NO: 382873 - RNA, 64 nt, Human
aagggcgcugggcaguguggccgccaacuuccaccccggcaagccccucuguccuaugcagaag

SEQ ID NO: 382874 - RNA, 64 nt, Human
agcucccggugcccccagaccccgcagcucugugcccggcaagaagcagcuagacacacgccag

SEQ ID NO: 382875 - RNA, 64 nt, Human
uagaguugaaaggauugacauuucucaguaacuacccggcaaaauauauauuuucauaauguug

SEQ ID NO: 382876 - RNA, 64 nt, Human
uccaagaugggaaacaugucgugugucugcacgccccggcaaacugccgccacucguucugcug

SEQ ID NO: 382877 - RNA, 64 nt, Human
gagaguugugcugggauagcgcaggaaggugggucccggcaacacgcaggggaugaguggaccu

SEQ ID NO: 382878 - RNA, 64 nt, Human
agcagaacuuccaaagagaguuaaaagcagcagccccggcaacucuggcuccaggcagaaggag

SEQ ID NO: 382879 - RNA, 64 nt, Human
guuccauuccccucuucuuccuucuaucuccuuccccggcaaaaaccaaacaaacuggcagaca

SEQ ID NO: 382880 - RNA, 64 nt, Human
ccagcacccaggagagccuugcugugucugucugcccggcaagaguccauucucacugcuggga

SEQ ID NO: 382881 - RNA, 64 nt, Human
cugcagcugcugcugauggcugccagccaggcugcccggcaagcggcgcccccucuccugcugu

SEQ ID NO: 382882 - RNA, 64 nt, Human
ugggcacggagcuuccugccucucugcuccgacacccggcaagcagccggagacaaaacgccuu

SEQ ID NO: 382883 - RNA, 64 nt, Human
gaggaggggagaauucuuggggcugagcugggagcccggcaacucuaguauuuaggauaaccuu

SEQ ID NO: 382884 - RNA, 64 nt, Human
ccaggccaguccggcucuggggagcaggggccuccccggcaacagccccaggggccuugagggu

SEQ ID NO: 382885 - RNA, 64 nt, Human
gugugucagucauuauuccugugagguagcuaagcccggcaagcucagugcugggguaggaggg

SEQ ID NO: 382886 - RNA, 64 nt, Human
guaagagaagagguuugcaagacagagcgcgcagcccggcaaggggcaugugaccccgaaggaa

SEQ ID NO: 382887 - RNA, 64 nt, Human
uguaauugcugccuuuucucauucuguuaauagucccggcaaccagauuucaguggggcaugac

SEQ ID NO: 382888 - RNA, 64 nt, Human
cacugcuaaacucagcugugagcugcggauaccgcccggcaaugggaccugcucuuaaccucaa

SEQ ID NO: 382889 - RNA, 64 nt, Human
guguugaagacaagcugcuugucaagaagcauuucccggcaagagaggggcaagucuggggcuc

SEQ ID NO: 382890 - RNA, 64 nt, Human
ggacccggccucccggggcugcggcgccaccgagcccggcaaaugcgcacgaccuacauuaauu

SEQ ID NO: 382891 - RNA, 64 nt, Human
gcacuguucaucucagcuuuucugucccuuugcucccggcaagcgcuucugcugaaaguucaua

SEQ ID NO: 382892 - RNA, 64 nt, Human
cugggugacagaguuagauuccacccucucccaccccggcaaaaaaaaaaaaaaaagaugcaau

SEQ ID NO: 382893 - RNA, 64 nt, Human
gcaaggccaggggucuuggugcuccccgacggggcccggcaaguucucuuucuucucucuggga

SEQ ID NO: 382894 - RNA, 64 nt, Human
auuuggauacccgacguucucccuggacacuuggcccggcaauaguuggggucuccugggaagc

SEQ ID NO: 382895 - RNA, 61 nt, Human
caaacagccaggacgcauuggagaggaauuugccaaagaucuacccugagauaacgccugu

SEQ ID NO: 382896 - RNA, 61 nt, Human
augguauauuacuauuuccacauaaugaggagccaaagaaaucugauguuuuuaacaauua

SEQ ID NO: 382897 - RNA, 61 nt, Human
ucugccugggcuuugugccacccucucccuugccaaagaagaaacucuccccccaaauccu

SEQ ID NO: 382898 - RNA, 61 nt, Human
ccucccuauuccauccaagggaagcagaacugccaaagacucaagucuuuucauauuuauu

SEQ ID NO: 382899 - RNA, 61 nt, Human
aacaugguauucuuuaagaagaaaaaacaaagccaaagaaaacucauuaucuggcauguuc

SEQ ID NO: 382900 - RNA, 61 nt, Human
cccaaggacucacauacagugccuggagaaagccaaagaccuuuauuucuuccugccuccc

SEQ ID NO: 382901 - RNA, 61 nt, Human
gcagccaugauuuugucacugacaucugugagccaaagacugagccuuuuuggcaggaaua

SEQ ID NO: 382902 - RNA, 61 nt, Human
gacaguccuuucccaccauuccugccuuuaagccaaagaaacaagcugugcaggcaugguc

SEQ ID NO: 382903 - RNA, 61 nt, Human
cugcccugcacgucaugggagggggcuugaagccaaagaaaaauaacccuuugguuuuuuu

SEQ ID NO: 382904 - RNA, 61 nt, Human
auuguaugaaguuuuaaaaaaaacuacagcagccaaagaaacuauauauauauauauauau

SEQ ID NO: 382905 - RNA, 61 nt, Human
gggaauaucauagaguaacaagugcuggucagccaaagaaacauucacugcuggugaacca

SEQ ID NO: 382906 - RNA, 61 nt, Human
ggggaaugaguguucagaagccuugggagaggccaaagagccauucuagcaugaucugaga

SEQ ID NO: 382907 - RNA, 61 nt, Human
uugaaauuuuauguuuaguugcacaaauugggccaaagaaacauugccuugaggaagauau

SEQ ID NO: 382908 - RNA, 61 nt, Human
uuaggucaggaguugugucuaggcuggaagagccaaagaauauuccauuuuccuuuccuug

SEQ ID NO: 382909 - RNA, 61 nt, Human
ccuuuaguugucccaugguguuaauaaaguugccaaagaagauguauuaugaacaauucag

SEQ ID NO: 382910 - RNA, 61 nt, Human
uauaaggggaagaggggugcugaauuuuuaggccaaagacugauauuaauacaaaucacuc

SEQ ID NO: 382911 - RNA, 61 nt, Human
ucugcacuuuuugaucuccaaacaaccuucagccaaagaaucugucuaccaacuccucaua

SEQ ID NO: 382912 - RNA, 61 nt, Human
agccagauaguagaaccagugaggagaugcggccaaagauucuuuauaucugaaccaagau

SEQ ID NO: 382913 - RNA, 61 nt, Human
agagaagguuuuacaaauuggaucagcaaaagccaaagaauuagcauacacugugugccag

SEQ ID NO: 382914 - RNA, 61 nt, Human
aucuuccagguauuuuccacuuaguauugcagccaaagaauauuuaaauaaacgucuuugc

SEQ ID NO: 382915 - RNA, 61 nt, Human
ugaauauuugagggauaaaaauuguguaagagccaaagaauugguaguagggggagaacag

SEQ ID NO: 382916 - RNA, 61 nt, Human
agcagcucucauuaacagugaaaugacagaggccaaagauggccaagugaagacccaaguc

SEQ ID NO: 382917 - RNA, 61 nt, Human
aagggccuccacucaggcuccaaauguggcagccaaagagaacaauccagggaaccuacau

SEQ ID NO: 382918 - RNA, 61 nt, Human
ucuaaauagcauucucaugacacaugggggcgccaaagagaaguaagagagauagcuagau

SEQ ID NO: 382919 - RNA, 61 nt, Human
uggccagaugcacugcccaguaaggcaggaagccaaagaggcagugcccagccccacaaag

SEQ ID NO: 382920 - RNA, 61 nt, Human
ggguccgguggagacugaccacccugcuugagccaaagacaaggugaugagagauggggag

SEQ ID NO: 382921 - RNA, 61 nt, Human
ucaaaugcauucuugugucuuugcuugagcugccaaagaagggucacaaaguguucuuccu

SEQ ID NO: 382922 - RNA, 61 nt, Human
ggacacucggugccccacacccagugaaccugccaaagaaaccgugagagcucuucggggc

SEQ ID NO: 382923 - RNA, 61 nt, Human
uuuacuaaaaagauuccucguuauuguuguugccaaagagaaacaaaaaugauuuugcuuu

SEQ ID NO: 382924 - RNA, 61 nt, Human
aaggcccacuguccagcugcagaaauucguugccaaagauuggacagagacaccgaaggaa

SEQ ID NO: 382925 - RNA, 61 nt, Human
ugcuccuccuguugccugagccccaucucaagccaaagaugagucagugguucugcuagga

SEQ ID NO: 382926 - RNA, 61 nt, Human
uaggagaagagacauccccuccuucucacuugccaaagagauucaaagacagccccuaucc

SEQ ID NO: 382927 - RNA, 61 nt, Human
auuuauguacagauaagaaaaccauaugucagccaaagauuuuaucucuucuucuaacuuu

SEQ ID NO: 382928 - RNA, 61 nt, Human
aacuguuuaugguauuuucgugcauuugugagccaaagagaaaagauuaaaauuagugaga

SEQ ID NO: 382929 - RNA, 61 nt, Human
cuuuacaaaccauuuuguuauugacuaacaggccaaagagucuccaguuuacccuucaggu

SEQ ID NO: 382930 - RNA, 61 nt, Human
uuugcuuacagaaaaacggggggagaauuaagccaaagaaguauauuuaugaaucagcaaa

SEQ ID NO: 382931 - RNA, 61 nt, Human
ucugaugcauuaauaaaagcagccaaauagggccaaagagaaaaauaacaggacucuguac

SEQ ID NO: 382932 - RNA, 61 nt, Human
gagauagaagaacugcaaagguaauaauacagccaaagauaaucucucagcuuuuaaaugg

SEQ ID NO: 382933 - RNA, 61 nt, Human
aguaguugguuuguaugagaugguuaaaaaggccaaagauaaaagguuucuuuuuuuuucc

SEQ ID NO: 382934 - RNA, 61 nt, Human
gugaauuuuaaaaagcuaucccauaucgauugccaaagagcaucuaccuuaccuccuaaga

SEQ ID NO: 382935 - RNA, 61 nt, Human
uucuagaucgucuagaucuacuagaccaugggccaaagagggucgaccugcaaacuugcaa

SEQ ID NO: 382936 - RNA, 61 nt, Human
uucuaagagucaaccacaggcauuuaagucagccaaagaauauuguuaccuuaaagcacua

SEQ ID NO: 382937 - RNA, 54 nt, Human
gcgcugauacuggucgcugacagcgccaaagagaccaacaagaugauuuuagcg

SEQ ID NO: 382938 - RNA, 61 nt, Human
cacagacugcgagacugaaccgccgcuacaagccaaagauuuuauuauguucagaaaccug

SEQ ID NO: 382939 - RNA, 61 nt, Human
uccaagauaacaaagaagaagcaauggucgugccaaagagguccacaaccaggugugcacu

SEQ ID NO: 382940 - RNA, 61 nt, Human
cuugcauuuaaagugaggggaaacauuuugagccaaagaaacaaauuggagauuucaagcg

SEQ ID NO: 382941 - RNA, 61 nt, Human
agucucucugggauggagaggaccccaacucgccaaagaaaagauucaccauugcccgccu

SEQ ID NO: 382942 - RNA, 61 nt, Human
cuguugcuucuauuggccuaaacccacuacugccaaagaacccagcaacaaaccucccggc

SEQ ID NO: 382943 - RNA, 61 nt, Human
ggccgaggcccagaguggccugcccccgggagccaaagaccccaguggccacacugggaua

SEQ ID NO: 382944 - RNA, 61 nt, Human
ucagauaggggcacccaagcuaaggguauuagccaaagaugccaggauggguagcuagccc

SEQ ID NO: 382945 - RNA, 61 nt, Human
aaauucugcaguggcgagcaguuucccacuugccaaagaucccuuuuaaccaacacuagcc

SEQ ID NO: 382946 - RNA, 61 nt, Human
uuauggaucagaauuugucuacagugaucaugccaaagaacuuauuguaggggagauuuuu

SEQ ID NO: 382947 - RNA, 61 nt, Human
cgcccccccaccucaggugcugcuggugugagccaaagacuggaguuuuuccagcuggggu

SEQ ID NO: 382948 - RNA, 61 nt, Human
guuucauaaauguugugaaacuccacuugaagccaaagaaagaaacucacacuuaaaacac

SEQ ID NO: 382949 - RNA, 61 nt, Human
uuuaggaguaaaguuugaagagauaaaaauagccaaagauaggagacgucugaauuuugaa

SEQ ID NO: 382950 - RNA, 61 nt, Human
auuacauuuacaauagugcuuguacaagcuugccaaagauagaauauggaucgccagucuu

SEQ ID NO: 382951 - RNA, 61 nt, Human
uuucucacauuggccaagcaugaggccucuugccaaagaucagcugucccccuaaagccac

SEQ ID NO: 382952 - RNA, 61 nt, Human
uuuuuuacacgagauuucuuuuuuaugugaugccaaagauguuugaaaaugcucuuaaaau

SEQ ID NO: 382953 - RNA, 61 nt, Human
cucauugcugaacaaaggagcaaauguagaugccaaagauaaguggggaaggacagcguug

SEQ ID NO: 382954 - RNA, 61 nt, Human
gugggucugggaccccaauucauucuuaucugccaaagaauuaucuagaagcacaucaaau

SEQ ID NO: 382955 - RNA, 61 nt, Human
aucaccuccccccccccgccacccucccacugccaaagaacuuggaaauagugauuuccac

SEQ ID NO: 382956 - RNA, 61 nt, Human
acagugucaucucuuccuuuguugauaaauugccaaagagugggaacagguggggucaggg

SEQ ID NO: 382957 - RNA, 61 nt, Human
uaaaguauuuuuugugcugugaacauuuucugccaaagaccaugaugugugucuguauguu

SEQ ID NO: 382958 - RNA, 61 nt, Human
uuuuaauuauacugcugaagcaaaugugaaugccaaagacuacguuuugcaguuuugcuuu

SEQ ID NO: 382959 - RNA, 61 nt, Human
cuuuuugacauacgaaaaugucaagagaaaggccaaagauuuguacuuuuucacuuacaaa

SEQ ID NO: 382960 - RNA, 61 nt, Human
uugucaagcuagcagaaacuccauuuucaaugccaaagaagaacuguaaugcuguuuugga

SEQ ID NO: 382961 - RNA, 61 nt, Human
cagugucauuuaugaaaagaggggaccagaagccaaagacuuaguauauuuucuuuuccuc

SEQ ID NO: 382962 - RNA, 61 nt, Human
guuugagguagucaccugcuuacagauaacagccaaagauagaauuccaaguuauaaagca

SEQ ID NO: 382963 - RNA, 61 nt, Human
ccggcacugcugcuuagaguggaggaggcuggccaaagagacugugggcuguuuucaguca

SEQ ID NO: 382964 - RNA, 61 nt, Human
uaaaauaacagcucuauuauuauucagcaaggccaaagacuuuugagaauguguauggaaa

SEQ ID NO: 382965 - RNA, 61 nt, Human
cugaaaagaaaaagccaccuagcccuaucaagccaaagauuccccuuucugcaccucggaa

SEQ ID NO: 382966 - RNA, 61 nt, Human
uuuaaauacuguggagugacaccagaacacagccaaagaggcuagaagcaagaaaggaucu

SEQ ID NO: 382967 - RNA, 61 nt, Human
uuuugucaaaaacucauauugaauuuucaaugccaaagauguagcuauugauguuaucaga

SEQ ID NO: 382968 - RNA, 61 nt, Human
auuuucucuucuaucuuugaaauuauucuaagccaaagaaaacuaugaaugaaaguauaug

SEQ ID NO: 382969 - RNA, 61 nt, Human
ccugcaucugggccaggcuggggugcacccagccaaagacaaagcugccuccacgugccca

SEQ ID NO: 382970 - RNA, 61 nt, Human
ccugucuaggcacuaagggaguuuggggaaagccaaagaagaccuaggccauagagcacag

SEQ ID NO: 382971 - RNA, 61 nt, Human
ucuugggccacucugauuggcagccugcuuugccaaagagaacugugugagguuuuggugg

SEQ ID NO: 382972 - RNA, 61 nt, Human
cccguugaguuuguggguaaccagcaggcaggccaaagacuggugcuuuucauuucauccu

SEQ ID NO: 382973 - RNA, 61 nt, Human
uacauaugaagguuuaaaaauacaucauguggccaaagaaugagaaaggacagaauuaacc

SEQ ID NO: 382974 - RNA, 61 nt, Human
uauuacuuaaaaaguagaacagucaaugcaugccaaagaaccauaaacuagcagaggacau

SEQ ID NO: 382975 - RNA, 61 nt, Human
acuaauauaaauuauuccaagucuuuaaggagccaaagaaaaaaaagauuucucacagcuu

SEQ ID NO: 382976 - RNA, 61 nt, Human
uauuuuuccucauuucucaugggcaacagaggccaaagaaacgaagcaagacaaacagcaa

SEQ ID NO: 382977 - RNA, 61 nt, Human
gcuaauuugucuggccuugccauuuacguaagccaaagaaagucacucaugaguaaacuau

SEQ ID NO: 382978 - RNA, 61 nt, Human
aguuuggacugaaucacaucuguaguacuuagccaaagacaauuuggaggagaauaucagc

SEQ ID NO: 382979 - RNA, 61 nt, Human
ucaaaaaguauauucacuagaagacaguggagccaaagaaaagcaaguugaaaaagaaaga

SEQ ID NO: 382980 - RNA, 61 nt, Human
uccagugaaucagucgaaucauucuguggaugccaaagaauauuuugaccauaauacagca

SEQ ID NO: 382981 - RNA, 61 nt, Human
caggggugguagauuuauucccuugugucaggccaaagaaguucuuacaaaguacaguggg

SEQ ID NO: 382982 - RNA, 61 nt, Human
gaaauagccccucaauuccaggagucaacaugccaaagaaugaggcuggagacagguagcu

SEQ ID NO: 382983 - RNA, 61 nt, Human
aaacucaagauugggagcucuuugugaucaagccaaagaauucucauguacucuaccuuca

SEQ ID NO: 382984 - RNA, 61 nt, Human
ugaggggggcacucagucacauguggcugaggccaaagagaaugaagauauauuuuaaaau

SEQ ID NO: 382985 - RNA, 61 nt, Human
cacagggagggauaauuuagacucugguauggccaaagauuugagcacaaaggcaaccgug

SEQ ID NO: 382986 - RNA, 61 nt, Human
uagaaaguugagacuaaacugguuuguugcagccaaagauuuuggaggagaaggacauuuu

SEQ ID NO: 382987 - RNA, 61 nt, Human
gagaaccuggggguggauuuggguggguggggccaaagaggaggcuucuauugauaaaucc

SEQ ID NO: 382988 - RNA, 61 nt, Human
acugagucacagguuugagauucccagagaggccaaagacagcuacaggaaguacccuggg

SEQ ID NO: 382989 - RNA, 61 nt, Human
uuuuccccagacacuacauuuggauacaggugccaaagaacauuauuaaggaauuauuuag

SEQ ID NO: 382990 - RNA, 61 nt, Human
acuacucugaaaguauugauuauacuugaaugccaaagaacuuguccagaagaaaaaccug

SEQ ID NO: 382991 - RNA, 61 nt, Human
cccuagggugauucuaacagcccaggguccugccaaagaagccuuugauuuacaggcuuaa

SEQ ID NO: 382992 - RNA, 61 nt, Human
caaggaaagaggccaagggccaagcugcuaagccaaagauggccccugacaccucccccag

SEQ ID NO: 382993 - RNA, 61 nt, Human
gauuacaaauugaaacaaccauugcaauacagccaaagauuugggaaaaugugcaacugug

SEQ ID NO: 382994 - RNA, 61 nt, Human
ggcagccacaggacugagcccucucacuccagccaaagaaaugggccugccugccuccacc

SEQ ID NO: 382995 - RNA, 61 nt, Human
caauauuauugauuaccagacuuuuaugaaagccaaagacugcuugcuaguaggaaaaaau

SEQ ID NO: 382996 - RNA, 61 nt, Human
ccaacauuuggugaggaauuagcaauuucuugccaaagaaaauugauucugcccaauuauu

SEQ ID NO: 382997 - RNA, 61 nt, Human
guuaugcaaugcuggagacauggugaaauaggccaaagauuucuucuucguucaagaugaa

SEQ ID NO: 382998 - RNA, 61 nt, Human
ccauugaauguauauccugagaaaaauuggggccaaagaagcaggaaaaucucaaagcucu

SEQ ID NO: 382999 - RNA, 61 nt, Human
aaguccaaggagaagaagaggccuagccugagccaaagagagaguacgggcucagcagcca

SEQ ID NO: 383000 - RNA, 61 nt, Human
ggaagcuugaaccaggcuagaacagcugucugccaaagauacaagaauaugcaaagucccu

SEQ ID NO: 383001 - RNA, 61 nt, Human
uccuaggugaauuuggccuugguugggcucugccaaagacuaauggacuaaaaugugaaac

SEQ ID NO: 383002 - RNA, 61 nt, Human
gaggacuagaggcuggaggccaagcagcugagccaaagaagaucaccugggccagggccua

SEQ ID NO: 383003 - RNA, 61 nt, Human
uggaacaaugcuaauuaggauugcauuccuggccaaagacaugacaucaaauaaguaauag

SEQ ID NO: 383004 - RNA, 61 nt, Human
cauuuaaaguucuuuuuagaaaauaacauaagccaaagacucaaguguaaauaugucuaua

SEQ ID NO: 383005 - RNA, 61 nt, Human
agcgagacauagaauaguauucugaucaguugccaaagaaucuaggaaauuaguuguauuu

SEQ ID NO: 383006 - RNA, 61 nt, Human
aacuguuucauauuuuucuuuugacaaaguagccaaagacaaucagcagaaagcauuuucu

SEQ ID NO: 383007 - RNA, 61 nt, Human
ucguauagguugaugaaacgucauguguuuugccaaagacuguaaauauuuauuuaugugu

SEQ ID NO: 383008 - RNA, 61 nt, Human
cucuaagcugcuggccgaagaugucaccaaggccaaagacacaguauuaugaagguuugga

SEQ ID NO: 383009 - RNA, 61 nt, Human
agaugugguguuccucauauuaugguacagggccaaagacuugagacgugguguuuuacau

SEQ ID NO: 383010 - RNA, 61 nt, Human
ggagggucugcaagugcagacagcagcuggggccaaagagguguuagguucaaaggcugcg

SEQ ID NO: 383011 - RNA, 61 nt, Human
gucuuuucaaauaaugcuuuucuaauuaauagccaaagauuucauaucuaacuuuguaacc

SEQ ID NO: 383012 - RNA, 61 nt, Human
uucagaggcacaagaaaaagcauuggcaugagccaaagagucugucuuaauguuacuuuug

SEQ ID NO: 383013 - RNA, 61 nt, Human
gugaccugggauuuuauuuaacacaacuguugccaaagaguuggcuuuguuuauuugguuu

SEQ ID NO: 383014 - RNA, 61 nt, Human
cgcagggcuugaauuguuagucccaacucuggccaaagauacuuuuuuccagagacagagg

SEQ ID NO: 383015 - RNA, 52 nt, Human
agcucaguuugccagcauaagugccaaagaccaucaccagcaucuguccuuc

SEQ ID NO: 383016 - RNA, 61 nt, Human
uggagcuggauaacuaaaaauaaaaauauaugccaaagauuuucuuggaaauuagaagagc

SEQ ID NO: 383017 - RNA, 61 nt, Human
aguauuucuauuguuuaacauaaaauaguuugccaaagaaguuucugaagucuucacagcu

SEQ ID NO: 383018 - RNA, 61 nt, Human
gaugcuguuucaacuugaaacaacaacuauagccaaagaagauggagacucuuaggcaaga

SEQ ID NO: 383019 - RNA, 61 nt, Human
gcuuuucagagggaaaagaaguuagaacagugccaaagaaccugggccuaucagcguguaa

SEQ ID NO: 383020 - RNA, 61 nt, Human
auauauauauauagauuuguguauguuauuugccaaagacagauauaaauuaccugguuua

SEQ ID NO: 383021 - RNA, 53 nt, Human
ccacugccauuguccugugagcugccaaagaccccacggggugcccgcauguc

SEQ ID NO: 383022 - RNA, 61 nt, Human
ccuuuuagcaguagccuucuucccucggggagccaaagagugugguguguggcgcuauauu

SEQ ID NO: 383023 - RNA, 61 nt, Human
gcuggggaaaggggagggagggaaugaaagugccaaagaaaacauguuuuuaagaacucgg

SEQ ID NO: 383024 - RNA, 61 nt, Human
agcaccugguuaugccuccuuucaucucaaagccaaagagcugccagguaaaugguuaugu

SEQ ID NO: 383025 - RNA, 61 nt, Human
gccuuuugagauucuccaacuugacaaaugugccaaagaucaacagacagaaaauaucauc

SEQ ID NO: 383026 - RNA, 61 nt, Human
gcccccauuccaucccccagaucccacugcugccaaagagaugggacaaggaaccucucuc

SEQ ID NO: 383027 - RNA, 59 nt, Human
aggaagaggccuccagguaaagccuagaggccaaagaacuuuccaggucagccggacag

SEQ ID NO: 383028 - RNA, 61 nt, Human
acucaaagaaugaugaagguauuugguguaugccaaagaauaaaggcguuuuauuucacag

SEQ ID NO: 383029 - RNA, 61 nt, Human
gcaggcaccuguagucuuagcuacucgagaggccaaagaaggaggauggcuugagcccagg

SEQ ID NO: 383030 - RNA, 61 nt, Human
aagucacucaauuguuuuuguuguggucugagccaaagagaaugccauucucuuggguggg

SEQ ID NO: 383031 - RNA, 61 nt, Human
ccuaguggguauauuugcugccaagccacuugccaaagaagaggaaccacagaaagagaga

SEQ ID NO: 383032 - RNA, 61 nt, Human
ugcuagucaccaacuucugggucuaaccccagccaaagaugacagcagaacaacauaauuu

SEQ ID NO: 383033 - RNA, 61 nt, Human
uggcaauggcuuugugggaucauaugucuuggccaaagaugggaaaaccuauguugaagag

SEQ ID NO: 383034 - RNA, 61 nt, Human
gugcuuucauguuuaagaaaugagaaauugugccaaagauagcagaagaguagauaagugc

SEQ ID NO: 383035 - RNA, 61 nt, Human
ggguggaggguaaucucuacuuuccuauacugccaaagaaugugaggaagaaaugggacuc

SEQ ID NO: 383036 - RNA, 61 nt, Human
uaaaugaagaccauggaagaaaagaaggaaugccaaagaucgaggaaaucuaccaagacua

SEQ ID NO: 383037 - RNA, 61 nt, Human
auuauuccaagcgcagggcccaaauguuauagccaaagaaagucuuaugauaaaagugagg

SEQ ID NO: 383038 - RNA, 61 nt, Human
caccugaauagaggaaagaucacucaccagggccaaagagagugcucagcgggagaugcuu

SEQ ID NO: 383039 - RNA, 61 nt, Human
agaucacccaggagcuugugcccccagaugggccaaagaaagagccuaugaaggagaagca

SEQ ID NO: 383040 - RNA, 61 nt, Human
acaaaccccaggacacccacccacccaaagagccaaagaauaguuccugugacauuccgcc

SEQ ID NO: 383041 - RNA, 61 nt, Human
agauuguucucaagagggccaucagaaggaagccaaagaguucacagccucagcaccaaca

SEQ ID NO: 383042 - RNA, 61 nt, Human
ggugaaacuggccaaacagaacaccaacaaggccaaagacucuuuacggaagguucgcacc

SEQ ID NO: 383043 - RNA, 52 nt, Human
aggcuccaacaauggagugagagccaaagaaacaaaguaaaagcagcuuauu

SEQ ID NO: 383044 - RNA, 61 nt, Human
gggcagggacagugguagcauccaucugguggccaaagagaaucguagccccagagcugcc

SEQ ID NO: 383045 - RNA, 61 nt, Human
ccucccugcugagaauauucucccuuuagcagccaaagauucgcuggaacggaggcugccc

SEQ ID NO: 383046 - RNA, 61 nt, Human
uuaaagggugauuaaaaucugaagcaaagaggccaaagauuggaaaccccccacccccacc

SEQ ID NO: 383047 - RNA, 61 nt, Human
cccuuugcuucugcuuuuuuucagggaagcugccaaagaaugucgacgucgaaagaaagaa

SEQ ID NO: 383048 - RNA, 61 nt, Human
caauauuaaugccuuuaaaguaugaaucuaugccaaagaucacuuguuguuuuacuaaaga

SEQ ID NO: 383049 - RNA, 61 nt, Human
agggugcaggacuccacugaugagagauccagccaaagagcugcccccagggguaugaggg

SEQ ID NO: 383050 - RNA, 61 nt, Human
ccguccucaguuuccuuucaugaggcuucuagccaaagaugauaaagggggaaaugguuuu

SEQ ID NO: 383051 - RNA, 61 nt, Human
agagguucauugaaauaaucaugcaugaagcgccaaagaugcaccauguagaauuuucacu

SEQ ID NO: 383052 - RNA, 61 nt, Human
ugcaucggaggaccacaaucaguucuaugcugccaaagauuaaaaauaaauaaaaacauaa

SEQ ID NO: 383053 - RNA, 61 nt, Human
uauacaguuucaaaaaaggagaucagagaaagccaaagaaugucagaaauuuguagaaaau

SEQ ID NO: 383054 - RNA, 61 nt, Human
agccaccucucaggagaagccagaggcccuggccaaagauaggaggaagaaagagaacucu

SEQ ID NO: 383055 - RNA, 61 nt, Human
gcagaaaagacauauguugcuuuacaagaaggccaaagaacuauggggccuucccagcauu

SEQ ID NO: 383056 - RNA, 61 nt, Human
cuuuuccuggcccuuccuuccccacuucuaagccaaagaaaggagaggcaggugcuccugu

SEQ ID NO: 383057 - RNA, 61 nt, Human
cccuuucaugccagcaguggucauauugagugccaaagagaagagcuuacuggguaguuag

SEQ ID NO: 383058 - RNA, 61 nt, Human
cacacauaaauggcuguguguggaauugcuugccaaagaaguuucuagccuuucccuuucc

SEQ ID NO: 383059 - RNA, 61 nt, Human
uucuaaaagacaaauuaugguaccauaagcugccaaagauccccuccugccucagaccccu

SEQ ID NO: 383060 - RNA, 61 nt, Human
uuacccugccccagcuggggaaaucaaaagggccaaagaaccaaagaagaaaguccacccu

SEQ ID NO: 383061 - RNA, 61 nt, Human
aacgucaggauagagauaccacauguggcaagccaaagaucuaugccucuguuuuuucagu

SEQ ID NO: 383062 - RNA, 61 nt, Human
gaaacucagcggaaucaaucagcuguguuaugccaaagaauaguaagguuuucuuauuuau

SEQ ID NO: 383063 - RNA, 61 nt, Human
gaccaaaagugagaugggaagggcuuaucuagccaaagagcucuuuuuuagcucucuuaaa

SEQ ID NO: 383064 - RNA, 61 nt, Human
ccuggauuccugcaucugcauaugcguauuugccaaagacgacagggugggcuggggugcg

SEQ ID NO: 383065 - RNA, 61 nt, Human
uuccaggugaaguucugacccuaccuguuuggccaaagacguaaauugagaggaaaggccu

SEQ ID NO: 383066 - RNA, 61 nt, Human
cagagaagaagaaaggagcugaggaggagaagccaaagaggaggaggcaggagaagcaggc

SEQ ID NO: 383067 - RNA, 61 nt, Human
uucacuaauuccuaauaugaaauguaugauggccaaagacaaauuguauugauuauaaucc

SEQ ID NO: 383068 - RNA, 61 nt, Human
cauggccucuggaaaaaggaaaucuuugguggccaaagauuuccuuucuguggugagggag

SEQ ID NO: 383069 - RNA, 61 nt, Human
cuggggcagggggagagccaggcaaucgggggccaaagaugggggugcucgccuacagucu

SEQ ID NO: 383070 - RNA, 61 nt, Human
cugggauuacaggcaugagccaccaugcccagccaaagaucauuuuuuuauauagacuuca

SEQ ID NO: 383071 - RNA, 61 nt, Human
cgccgcauuacauuuccuaaaacauacugcugccaaagaccaacuguagaauccuuaaguc

SEQ ID NO: 383072 - RNA, 61 nt, Human
ccuuugagcccccgucacguugggcacugcugccaaagacucccuccucccugaugcuggg

SEQ ID NO: 383073 - RNA, 61 nt, Human
uuccuuugcuccaauaagcuuugcaaucaaggccaaagaaaaugaucugcuuccccuggaa

SEQ ID NO: 383074 - RNA, 61 nt, Human
gaauccuuuccuccacaccacccgugcacuugccaaagacagggaugaggcaagugguucu

SEQ ID NO: 383075 - RNA, 61 nt, Human
caggucaggagcuggaaguucaccugcaggugccaaagagcaggccggccagggcuggggc

SEQ ID NO: 383076 - RNA, 61 nt, Human
gggcaggaaauggggggaucacuuuccaagugccaaagagcccagagggacucuaagaacc

SEQ ID NO: 383077 - RNA, 61 nt, Human
ugaagacuaauucaauuuugcauauagaggagccaaagagagauuucagcucuguauuugu

SEQ ID NO: 383078 - RNA, 61 nt, Human
cgugaaagcaaaacaauaggggaagccuggagccaaagaugacacaaggggaaggguacug

SEQ ID NO: 383079 - RNA, 61 nt, Human
aucugccuuggaaugcaaauaguucuuauuugccaaagaacagugaauugggcccaaagau

SEQ ID NO: 383080 - RNA, 61 nt, Human
agaggcaagacacagucaccaaugauaucucgccaaagaaaccacgcccacaccaaugcca

SEQ ID NO: 383081 - RNA, 61 nt, Human
acggcgcuaaugcauuaaguugaagucgacugccaaagaggcccagcagagggcagcaccc

SEQ ID NO: 383082 - RNA, 61 nt, Human
ggugcagggcgugacucaccgcugggugcuugccaaagagauagggacgcauaugcuuuuu

SEQ ID NO: 383083 - RNA, 61 nt, Human
aucaguguuuucuuuucuaaaacaucaaaaugccaaagauuaaucugugauuggugauaac

SEQ ID NO: 383084 - RNA, 61 nt, Human
cugggauuacaggugugagccaccgugcccagccaaagacugcucuuaaagcaccuuuuug

SEQ ID NO: 383085 - RNA, 61 nt, Human
aaagucaaaauuuuuugacuuucuuuuuaaagccaaagaccauaguuuuaguuuuaagcca

SEQ ID NO: 383086 - RNA, 61 nt, Human
accauuuugcuuugcuuuuuuaacacacugagccaaagaugcaguguaauuauugggcuuu

SEQ ID NO: 383087 - RNA, 61 nt, Human
auuccuugaaguaaaucccaggagaaucuaggccaaagagaugagccaagguuagugagac

SEQ ID NO: 383088 - RNA, 61 nt, Human
accaucugaauuguugcagguccacauuuuugccaaagauacacucuauagaugcuuagua

SEQ ID NO: 383089 - RNA, 61 nt, Human
aaguaggaaucugugaagcaaaauguuugcugccaaagacaaaucagacugucagucauua

SEQ ID NO: 383090 - RNA, 61 nt, Human
uuuguaugaaccuuagaaaaguuauuaaagugccaaagaauguuucccuuuccuaaggcua

SEQ ID NO: 383091 - RNA, 61 nt, Human
gcuccccucacugauggacaaggaggucugugccaaagaagaauccaauaagcacauauug

SEQ ID NO: 383092 - RNA, 61 nt, Human
cuggggcagcccguguugccggagccucuaagccaaagagcccguuggccgugguuggugg

SEQ ID NO: 383093 - RNA, 61 nt, Human
uuaguuuaaaugugaauucagugacucuagggccaaagaauauuagguauguuuggaaaga

SEQ ID NO: 383094 - RNA, 61 nt, Human
ggauuuuucucugucagcacgcgugucagcugccaaagaauagacuuaaugaagaagugcc

SEQ ID NO: 383095 - RNA, 61 nt, Human
aaauauugcauguccagcuggauucuggccugccaaagaagaugaugauuaaaaacauaga

SEQ ID NO: 383096 - RNA, 61 nt, Human
guaggacuaaauaaugaucuuccaaauauuagccaaagaggcauucagcaauuaaagacau

SEQ ID NO: 383097 - RNA, 61 nt, Human
ucugugauugugaugaguucagaaagaucaagccaaagaaugcgaagcaaccagagcguga

SEQ ID NO: 383098 - RNA, 61 nt, Human
gcagcguaacuacccuaaaagcauaucacuagccaaagagggaaauaucuguucuucuuac

SEQ ID NO: 383099 - RNA, 61 nt, Human
gguucuuuugcuuucaagauuuggaagcauugccaaagacagccaugaagaaggaagcugu

SEQ ID NO: 383100 - RNA, 61 nt, Human
agacucgcuuguauuuuaagagaaccaaguggccaaagaaacucuuucuaacuuuggcaac

SEQ ID NO: 383101 - RNA, 61 nt, Human
guacaaaguuuaaauaccccuuucuaguaaugccaaagacauacaguguuuuacauucucu

SEQ ID NO: 383102 - RNA, 61 nt, Human
accuaucgaagaauaauggcuuguuccacuggccaaagaugggacaauuugaacaucaaaa

SEQ ID NO: 383103 - RNA, 61 nt, Human
uuuagucacagguuuuuacaguccagcaagggccaaagagguauaguauacaaguuaauag

SEQ ID NO: 383104 - RNA, 61 nt, Human
cuauggcugcauagcaaguaguaggcaggaggccaaagacuucugagaccuggggcacccg

SEQ ID NO: 383105 - RNA, 61 nt, Human
gccuggccuuccugucuagucucuccuguaagccaaagaaaugaacauuccaaggaguugg

SEQ ID NO: 383106 - RNA, 61 nt, Human
auaacugcaaggagaggaggaauuccuaggagccaaagaguuuuguggggugaggguaaau

SEQ ID NO: 383107 - RNA, 61 nt, Human
gaauuacaggaagaaagugguuuggaagacagccaaagaaauaaaagcagauuaaacugua

SEQ ID NO: 383108 - RNA, 61 nt, Human
uguguccgaaguugagauggccugcccuacugccaaagaggugacaggaaggcugggagca

SEQ ID NO: 383109 - RNA, 61 nt, Human
cagggaacccucgugcagcugagcuggggccgccaaagaccggggcugccaaaggggcaga

SEQ ID NO: 383110 - RNA, 61 nt, Human
uuacagaguagucuuagguaguagcaaaagagccaaagaagagauuuguauugcugagcuc

SEQ ID NO: 383111 - RNA, 61 nt, Human
gagugucaaggcuggacagcuacugccagaugccaaagauaggagaaagugccagcccuga

SEQ ID NO: 383112 - RNA, 61 nt, Human
gccagaaguggcggcagcagcagccgcagcagccaaagagaggcaagagaaagagaaagcg

SEQ ID NO: 383113 - RNA, 61 nt, Human
cuacgugacuguggcacacgccuuguucuuggccaaagaccaaauuccuuggcaugccuuc

SEQ ID NO: 383114 - RNA, 61 nt, Human
uuugccucuuuuauuuaaugccaaaguuuuagccaaagacaucuuccuacuuuuguugugu

SEQ ID NO: 383115 - RNA, 61 nt, Human
caggacuuagaauagugccuaaagugcugcagccaaagacagagcggaacuaugaaaagug

SEQ ID NO: 383116 - RNA, 61 nt, Human
gcucugcuguuucucacccuuggaugauggagccaaagaggggaugcuuugagauucugga

SEQ ID NO: 383117 - RNA, 61 nt, Human
aagcccgugcccccgggagggcugccgcacugccaaagagucucccuccuccuggggaagg

SEQ ID NO: 383118 - RNA, 61 nt, Human
agccaguagagguggagggacccuggcaugugccaaagaagaggcccucugggugaugaag

SEQ ID NO: 383119 - RNA, 61 nt, Human
caucagaguuugcaauuuuguauguuucauugccaaagaaggcuuagugguuguugacugu

SEQ ID NO: 383120 - RNA, 61 nt, Human
caaggccaaacuccaaacacaaucagaaccagccaaagaagcacuuccugggcacggccac

SEQ ID NO: 383121 - RNA, 61 nt, Human
agcagcaggggauagacuacgcacaauuucugccaaagauugauggcaaaaagauggcaga

SEQ ID NO: 383122 - RNA, 61 nt, Human
cacuaagaggggcuggaccuggcggcaggaagccaaagagacugggccuaggccaggaguu

SEQ ID NO: 383123 - RNA, 61 nt, Human
ccaacucaaggacagccaccaagaaguggcugccaaagagacugggcgcaguggcucaugc

SEQ ID NO: 383124 - RNA, 61 nt, Human
uugggaacaggaaugagcaggaagccaaucagccaaagaaaauggugaucuggacccaaga

SEQ ID NO: 383125 - RNA, 61 nt, Human
cuggcucuguggcgagccauuugucccaagugccaaagaagcagaccauuggggcucccag

SEQ ID NO: 383126 - RNA, 61 nt, Human
uuuguaaugugguuuaacauccuuguuguuugccaaagaaauuucauuuggcugugaauau

SEQ ID NO: 383127 - RNA, 61 nt, Human
cuguuucugcaggggaugauauuggugaguugccaaagaagcaauacagcauaucugcuuu

SEQ ID NO: 383128 - RNA, 61 nt, Human
uuccagccaugcuguccucacauacgguaaagccaaagagcugucacaugggccagaaaca

SEQ ID NO: 383129 - RNA, 61 nt, Human
ugcuuaccaaaagcucagggcccugugccaggccaaagauccccccagacccccauucuga

SEQ ID NO: 383130 - RNA, 61 nt, Human
gacaaguggugcccuguccccugcuccccuggccaaagaaagcuguccuugaggcugagcc

SEQ ID NO: 383131 - RNA, 61 nt, Human
accuaccuucaaagcugaagccgccaggaccgccaaagaaugccuugaagauauuguuugg

SEQ ID NO: 383132 - RNA, 61 nt, Human
uguggcagucugaacgcccccagaaaauugugccaaagaguuuagaaaaauaaauauacaa

SEQ ID NO: 383133 - RNA, 61 nt, Human
ucuaguugguucuguguccauuuuccucugugccaaagacagacagacagaggcugagaga

SEQ ID NO: 383134 - RNA, 61 nt, Human
cgugucucagccucugccagcgccaaaacaagccaaagagccucccaccagagccgggagg

SEQ ID NO: 383135 - RNA, 61 nt, Human
ucugcccucuucucaucccccagccacaguggccaaagaggcccccacuaggcacuguggc

SEQ ID NO: 383136 - RNA, 61 nt, Human
gguaaugguuagggcuuuccagaucucagcagccaaagacaguuauuguuggaagacuguc

SEQ ID NO: 383137 - RNA, 61 nt, Human
gccgugggagccgcuauuaucugcguucucugccaaagacucgugggggccaucacaccug

SEQ ID NO: 383138 - RNA, 61 nt, Human
ucucacgcauaaaauggagaguggauuaaucgccaaagauucuucugaucugacauuuuga

SEQ ID NO: 383139 - RNA, 61 nt, Human
cggggagagggggagguugguuccuuggggggccaaagaaggcagggaaugccuggagggu

SEQ ID NO: 383140 - RNA, 61 nt, Human
augcugguagugaugcuggcuguucggauaugccaaagagaaaccguaaggugcuuccuuu

SEQ ID NO: 383141 - RNA, 61 nt, Human
cucaaccuuggcugagccuaccccuuacuuugccaaagacuugaggacccuguaugucugg

SEQ ID NO: 383142 - RNA, 61 nt, Human
augcuagucacuuccugcccccaggcaccgugccaaagacuggaugcccccuacuccucag

SEQ ID NO: 383143 - RNA, 61 nt, Human
guccuuacuguccacggucccuguucaauaagccaaagacccuggugccccgcccagaccc

SEQ ID NO: 383144 - RNA, 61 nt, Human
uuccacaaggccuuuuccugcccccugccuugccaaagacauuuaaucagcacacagcugc

SEQ ID NO: 383145 - RNA, 61 nt, Human
gucuucuggagaugacauuugaggacugauggccaaagagcaugggggacugaagcccugg

SEQ ID NO: 383146 - RNA, 61 nt, Human
gaauucagaguugugaugcucucuucugacagccaaagaugaaaaacaaacagaaaaaaaa

SEQ ID NO: 383147 - RNA, 61 nt, Human
aaguagaagcugggaugggcagugucugacagccaaagaauugaguuuuggcuugcagggg

SEQ ID NO: 383148 - RNA, 61 nt, Human
ggauugcauccugcuggggcugaacaugccugccaaagacguguccgaccuacguuccugg

SEQ ID NO: 383149 - RNA, 61 nt, Human
caggcccugggggaccugggguucucagacugccaaagaagccuugccaucuggcgcuccc

SEQ ID NO: 383150 - RNA, 61 nt, Human
agagucuccuggaaaagggagaggggacccugccaaagaugaggcuccagcugcccugggg

SEQ ID NO: 383151 - RNA, 61 nt, Human
ucuacaaguuaugaagcuaagggaagaaaaugccaaagauaccucuaguuauguugaacac

SEQ ID NO: 383152 - RNA, 61 nt, Human
aaauguuuaauuggcauuuuuuaaugacuuagccaaagaagugcagcuauuauuccauauu

SEQ ID NO: 383153 - RNA, 61 nt, Human
gugacagguguuaaaggcccaggugugcugugccaaagagcucagcagaggcucacguggc

SEQ ID NO: 383154 - RNA, 61 nt, Human
uuuuugucauuuuaccgacauaauacauggagccaaagaaaacaauaaugguacuaauaaa

SEQ ID NO: 383155 - RNA, 50 nt, Human
auuuuggucaagaaggcuaagccaaagacaaggaagaugcuuaccauaug

SEQ ID NO: 383156 - RNA, 61 nt, Human
ccuucgcccaugcccgccccugcccgcaguugccaaagagccgccuugucgcugugggcgu

SEQ ID NO: 383157 - RNA, 61 nt, Human
ggugcaggggaggaaacuccucaccaggagagccaaagacaggguugugccuuaccccagg

SEQ ID NO: 383158 - RNA, 61 nt, Human
augaguggaauuacugccuuuauaagaagaagccaaagagccagcuagcucuuucaaccac

SEQ ID NO: 383159 - RNA, 61 nt, Human
cugguauuuugaugccaaggagcgggcagcagccaaagacaaguaucagcuagguaccugc

SEQ ID NO: 383160 - RNA, 61 nt, Human
ugggggcuguggggccgaugagguggacucagccaaagacucagcagcacauggggcaggu

SEQ ID NO: 383161 - RNA, 61 nt, Human
cagaccucacccccagugacuuccgauugaggccaaagaccccaagcugcccgccagcucu

SEQ ID NO: 383162 - RNA, 61 nt, Human
cuuugaguuccggaagcaccuggggaaucccgccaaagauggagggugagaaugguuuggu

SEQ ID NO: 383163 - RNA, 61 nt, Human
gcaggaguagugaugcuggugauucggauaugccaaagagaagccacaaagugcuuccuuu

SEQ ID NO: 383164 - RNA, 61 nt, Human
aggcaggcucaccauaguaaaaaugcugaaagccaaagacaaaauugggagaacaaaagaa

SEQ ID NO: 383165 - RNA, 61 nt, Human
acaccuucuguuucuuugcuuauuuuuuaacgccaaagaaagacucucagagaauagacaa

SEQ ID NO: 383166 - RNA, 61 nt, Human
gccaggcugugggcagggcggggccagggacgccaaagagagguugcagucagaaccgugg

SEQ ID NO: 383167 - RNA, 61 nt, Human
cugcucaccucccuggcuccuggagcugauugccaaagaguuuuuucuuccucauccaccg

SEQ ID NO: 383168 - RNA, 61 nt, Human
aaagccagacaaagcagcugccccucucccugccaaagaggagucaucccccaaaaagaca

SEQ ID NO: 383169 - RNA, 61 nt, Human
cucugucuuugcugcaauuuugaaauaaaaugccaaagaacacacauugucgggcuucuuc

SEQ ID NO: 383170 - RNA, 61 nt, Human
ggugcuuuuagcgcuaaauugugccucgugugccaaagaaacauagacaacuguagaggca

SEQ ID NO: 383171 - RNA, 61 nt, Human
aagcuugugaaaggaaaauaaaaauuacuaagccaaagagaaaagucaaucugggaacugc

SEQ ID NO: 383172 - RNA, 61 nt, Human
gaguuuaacaugccaagagaugugaaauguggccaaagagaugugaggguaaggggaaagc

SEQ ID NO: 383173 - RNA, 61 nt, Human
cuuuguuuguucaaaggaccaguuuuccuaggccaaagaagucucuuccccauguuagucc

SEQ ID NO: 383174 - RNA, 61 nt, Human
gcuccgggauugcaaacuccucuucucaccugccaaagauggagaagagugccagggaccc

SEQ ID NO: 383175 - RNA, 61 nt, Human
cugugccacccccggucuaugucgagagcuggccaaagagccuuuccaaagaggagcgaug

SEQ ID NO: 383176 - RNA, 61 nt, Human
gucgccugcuccccguaucccauggcuccucgccaaagacugaaauuguggagcuggaggg

SEQ ID NO: 383177 - RNA, 61 nt, Human
gacccgucuuuuugcagugccaggcaggguggccaaagaggacuggacucuggaccuggag

SEQ ID NO: 383178 - RNA, 61 nt, Human
ucugacuucaaucaacgguuagugugauacugccaaagaacuguauacuguguuaauauau

SEQ ID NO: 383179 - RNA, 61 nt, Human
guuucauguaauccucaagaaauaaaaggaagccaaagaguguauuuuuuuaaaaguuuaa

SEQ ID NO: 383180 - RNA, 61 nt, Human
aaguaucuuauuuuagaaugaauggagaaaugccaaagaugaauccuucacugcauuauga

SEQ ID NO: 383181 - RNA, 61 nt, Human
uucuggaugggcuuggccaaaacaggcucaggccaaagaccucccaagcuguauguacuuc

SEQ ID NO: 383182 - RNA, 61 nt, Human
gcauuuauacacuacgaguugaucucggccagccaaagacacacgacaaaagagacaaucg

SEQ ID NO: 383183 - RNA, 61 nt, Human
auguagaagcaugaagucuuaaggacaaagugccaaagaaaguggucuuaagaaauguaua

SEQ ID NO: 383184 - RNA, 61 nt, Human
ugagaaaggggaaaggcggguauuuuuaaaagccaaagauugacccaguuacuugagggua

SEQ ID NO: 383185 - RNA, 52 nt, Human
ugcacaccucccccuccuagaagccaaagacccgcgggcgcccucugccacc

SEQ ID NO: 383186 - RNA, 61 nt, Human
agaaacugaugaaugaugaaugaaugaaugagccaaagaacaaauaaaugagcccacacac

SEQ ID NO: 383187 - RNA, 61 nt, Human
guaaggcagggagaaaggaacauccggaacagccaaagaaacucagaagagucccggagcu

SEQ ID NO: 383188 - RNA, 61 nt, Human
acugaagauggcugaggagucagagaggagggccaaagaggcagaucagcugaagcaggac

SEQ ID NO: 383189 - RNA, 61 nt, Human
cuuccuccucagggaccucugacugcucugggccaaagaaucucuuguuucuucuccgagc

SEQ ID NO: 383190 - RNA, 61 nt, Human
uucaacaacagaaccggccacaccgcugaaggccaaagaggccacaaagaagaaaaagaaa

SEQ ID NO: 383191 - RNA, 61 nt, Human
uggagcgcuccgaccagacagcgucucauuggccaaagaugggaggguuccgcuuaaagac

SEQ ID NO: 383192 - RNA, 61 nt, Human
accugcugagaccuagguugccacgguaacagccaaagacaucaacccaagugcuggguca

SEQ ID NO: 383193 - RNA, 61 nt, Human
ccgaucccgccagaacggccuuuugcuuccagccaaagaacaccgccaacacgcacaccuc

SEQ ID NO: 383194 - RNA, 61 nt, Human
acccacuaacaauuuuagcaaaacaguccaggccaaagaggaagcauuucauguucaauaa

SEQ ID NO: 383195 - RNA, 61 nt, Human
ugaugaggaauauuaccgcauggaguugcuggccaaagaauuccaggacaagacugccccc

SEQ ID NO: 383196 - RNA, 61 nt, Human
uuguauuuauagucuguuuaugcuaaaucuggccaaagaugagcauuguccaccacuaaaa

SEQ ID NO: 383197 - RNA, 61 nt, Human
uuuccaguucuucuggaauugggggacccccgccaaagacugagcccccugucuccuccau

SEQ ID NO: 383198 - RNA, 61 nt, Human
ccacucuugcccuggagaucuuggccuuggggccaaagacauuuccauuuccgaucuccau

SEQ ID NO: 383199 - RNA, 61 nt, Human
uacauguaaacaaauauuuucuuuauuuguagccaaagaaauuucaacaguuauugggcuu

SEQ ID NO: 383200 - RNA, 61 nt, Human
agaggcuuugaauggaagcaggcugagaguagccaaagaggcaagggguauuagcccaguu

SEQ ID NO: 383201 - RNA, 58 nt, Human
gagcuaucucaucuaagugauuccugaugccaaagaauaugaaaauauuuaaguaaaa

SEQ ID NO: 383202 - RNA, 61 nt, Human
auucuuauuccauauuagaaaacuuuguuaggccaaagacaaauaguaggcaagauggcac

SEQ ID NO: 383203 - RNA, 61 nt, Human
aggagugcggacaccauguucccagcucagugccaaagaggggucaccagggggagcuguc

SEQ ID NO: 383204 - RNA, 61 nt, Human
ugaaaaauuauugcauuaccaagaaacaguagccaaagauauuugaagaucauguuccucg

SEQ ID NO: 383205 - RNA, 61 nt, Human
gccgggcugcagagccgggccacaccucagugccaaagaccccaugggagugggagggaug

SEQ ID NO: 383206 - RNA, 61 nt, Human
uauaggcaguauacacagcacuacucaagaagccaaagaaacacuugugcagugcuaagug

SEQ ID NO: 383207 - RNA, 61 nt, Human
cuccuccuaguuaaguuuccacuaaaucaucgccaaagaggacuucagagcccuggggagg

SEQ ID NO: 383208 - RNA, 61 nt, Human
cugccuuugcucuggucuauaccuuaagaaugccaaagaaugaauuucaacgccugccuuu

SEQ ID NO: 383209 - RNA, 61 nt, Human
gccugccucaugugaugauuuguauacaguggccaaagacaugcuucugcuuuucugcugu

SEQ ID NO: 383210 - RNA, 61 nt, Human
gauggccuuagguguccugacugucuaggcagccaaagagcacacguuaagcaauccagag

SEQ ID NO: 383211 - RNA, 61 nt, Human
gcaaaggccauggccauaucuguugucccaggccaaagacuaacaacugccuugggaaucc

SEQ ID NO: 383212 - RNA, 61 nt, Human
cucuccuuucugggaugacaucucagaaucagccaaagacuucauccggcaccuucuggag

SEQ ID NO: 383213 - RNA, 61 nt, Human
uuuacugauuuuuuauucuccagcuuucagugccaaagaggccaugcugaguuagguaggu

SEQ ID NO: 383214 - RNA, 54 nt, Human
ccagaagcucaccggaauagcccagccaaagaaaaaggucaagauuucuaucac

SEQ ID NO: 383215 - RNA, 61 nt, Human; identical to SEQ ID NO: 383200

SEQ ID NO: 383216 - RNA, 61 nt, Human
augguauuuauagucucuugugcuaaauuuggccaaagaugauuguccaccacuaaaaaug

SEQ ID NO: 383217 - RNA, 61 nt, Human
ucaaagauuacugcauuaccaagaaacaguagccaaagauguuugaagaucaugucccuua

SEQ ID NO: 383218 - RNA, 61 nt, Human
guagagcuauuaagggaguauuuucacuugugccaaagaggguaagcguuuauuagccuua

SEQ ID NO: 383219 - RNA, 61 nt, Human
gaggggguggggagguaaauuccucugacuugccaaagaaaaagaagggaaccacagugga

SEQ ID NO: 383220 - RNA, 64 nt, Human
gaaggcagggccuuggccacguccugggucucccaccucccaccugaccccagcggcuccggug

SEQ ID NO: 383221 - RNA, 64 nt, Human
uggggcagggccuccccacugggggucuuccuccaccucccacuuuccaagggcuccaggaauc

SEQ ID NO: 383222 - RNA, 64 nt, Human
gaguaugguaggggguuugaagaauccccuguccaccucccaaauccaggcccggcccccucug

SEQ ID NO: 383223 - RNA, 64 nt, Human
cucaaucuccugaccucgugauccacccaccucgaccucccaaagugcugagauuacaggcgug

SEQ ID NO: 383224 - RNA, 64 nt, Human
ugcuauggcucgaucuuggcucacugcaaccuccaccucccagguucaagcaauucucuugccu

SEQ ID NO: 383225 - RNA, 64 nt, Human
agccgcgggcaggcgagacuggcggagcccccagaccucccaguggggacggggcagggccugg

SEQ ID NO: 383226 - RNA, 64 nt, Human
gcuauuccgcagcuugcagcaagcacagagugugaccucccaggauuugcugacagcgguagau

SEQ ID NO: 383227 - RNA, 64 nt, Human
auggcugcuaggaccuuuagugcucccugcaccaaccucccaucccccugccaagauccuugaa

SEQ ID NO: 383228 - RNA, 64 nt, Human
cauggaggacugagcguugccuuuucucccagcuaccucccaaagcagccugaccugcguggga

SEQ ID NO: 383229 - RNA, 64 nt, Human
auugacuccccuuucccuucccaaagaggauaggaccucccaggaugcuucccagccucuccuc

SEQ ID NO: 383230 - RNA, 64 nt, Human
ugucuaguacgcacauaugcacacaggcagacauaccucccaucaugacaugguccccaggcug

SEQ ID NO: 383231 - RNA, 64 nt, Human
uguaaagguuuuugggggauaaggguguuuaaccaccucccagcuuucuucuucuuuuuuuuuu

SEQ ID NO: 383232 - RNA, 64 nt, Human
caggaccccgaguuccuucagaguguccuagagaaccucccagguguggaucccaacaaugaag

SEQ ID NO: 383233 - RNA, 64 nt, Human
ucugcuguuuagccucuuugguuucuguacaacuaccucccaaccccagugccucagucaauaa

SEQ ID NO: 383234 - RNA, 64 nt, Human
cuugaauuccugaccuccugaccugcccaccucaaccucccaaagugcugagauuacaggcgug

SEQ ID NO: 383235 - RNA, 64 nt, Human
cacagccucugaaaaccaauguucucucuucuccaccucccacaaaggagagcuagcagcaggg

SEQ ID NO: 383236 - RNA, 64 nt, Human
acccuucuuuccucuuccccuugcccuugcccugaccucccagcccuauggauguggggucccc

SEQ ID NO: 383237 - RNA, 64 nt, Human
acaaaagacaagcauugggucagacccauaaaccaccucccaaaggcugucauuucauugcacu

SEQ ID NO: 383238 - RNA, 64 nt, Human
ucuuuuuuccaguucaccugugcgaauccgacccaccucccagagccuggcugaaacgucacuc

SEQ ID NO: 383239 - RNA, 64 nt, Human
uggggaaaaggcagacuaaggccuccuuucucugaccucccaggaagaaaauagcuucuccuac

SEQ ID NO: 383240 - RNA, 64 nt, Human
ucuguguaggggccaguucaugucccugacucucaccucccauuagauaaaugaagcccacccc

SEQ ID NO: 383241 - RNA, 64 nt, Human
ugcaauuuccaaaagauauuuugguaagacaacaaccucccagugauaugccaccuuucaauuu

SEQ ID NO: 383242 - RNA, 64 nt, Human
aguggccccgcaaucucggcucacugcaaccucuaccucccagguucaagcuauucuacugccu

SEQ ID NO: 383243 - RNA, 64 nt, Human
gaaaacuaauuuuucccagagaauuuccuuucaaaccucccaguaucuauaugaucacucccaa

SEQ ID NO: 383244 - RNA, 64 nt, Human
ccccacagcguccugaaggaccacugugugcagcaccucccagacggcucugugacuguggagu

SEQ ID NO: 383245 - RNA, 64 nt, Human
gcgcucccucucugccccucagcgagagccucggaccucccaaccccuugugucugguggggau

SEQ ID NO: 383246 - RNA, 64 nt, Human
aacuggaccccucuccagcaacaccaccgccaccaccucccacaucccugagguuggcgacugu

SEQ ID NO: 383247 - RNA, 64 nt, Human
gucccuuucacaccuugccuggccaaggggcuagaccucccaggcuaagccucagauucagugc

SEQ ID NO: 383248 - RNA, 64 nt, Human
ccaacuccuagccucaagugauccuccugucucaaccucccaaguaggauuacaagcaugcgcc

SEQ ID NO: 383249 - RNA, 64 nt, Human
caccaccugucaaagcugccuuucacaggguuccaccucccagacucacucugggacccagaau

SEQ ID NO: 383250 - RNA, 64 nt, Human
agacagguccuccaguacccugucuucuagccccaccucccacuuggccagaaccaauguccau

SEQ ID NO: 383251 - RNA, 64 nt, Human
aggggcagggucccuggccagaaggggcauggccaccucccaaccugaugaccucucuggcugg

SEQ ID NO: 383252 - RNA, 64 nt, Human
guucuguguuacguugaagccagagucuuauaacaccucccaagaaagauaggggaagaagcca

SEQ ID NO: 383253 - RNA, 64 nt, Human
gucugaacaccccaacaucccugaaucuccacccaccucccaaacuccugccugcccuccagac

SEQ ID NO: 383254 - RNA, 64 nt, Human
agaagagccuucuggagaggacagucagcugagcaccucccauccugcucacacguccuucccc

SEQ ID NO: 383255 - RNA, 64 nt, Human
ugcaguggcaugaucucagcucgcugcaacccccaccucccagguucaagcgauucuccugugu

SEQ ID NO: 383256 - RNA, 64 nt, Human
agagcugaaaggcccccuugacacauccaggccaaccucccauggaauagguaggcaagccagg

SEQ ID NO: 383257 - RNA, 64 nt, Human
ugcaguagcacaaacaugggucauuguagccucaaccucccaggcucaagcaguccuuucaccu

SEQ ID NO: 383258 - RNA, 64 nt, Human
caaacuucugaccucaggugauccacccacuuugaccucccaaagugcugggauuacuagacgu

SEQ ID NO: 383259 - RNA, 64 nt, Human
ugaggugguacaaucucggcucacugcaaccuccaccucccagguucaagagauucuccugccu

SEQ ID NO: 383260 - RNA, 64 nt, Human
ugagccuuccccuggugucugccuggcagcccccaccucccaccuaucaccccucacccauaac

SEQ ID NO: 383261 - RNA, 64 nt, Human
cucccacaaagccagggccaggcuccccaucccuaccucccacugcaucagcaguggguguucc

SEQ ID NO: 383262 - RNA, 64 nt, Human
agccuacuccaagaauggaggcuguaggaauauaaccucccacccugcaaagggaaucucuugc

SEQ ID NO: 383263 - RNA, 64 nt, Human
aacucuguggcuggcagccacuauucucaguuacaccucccagugcccuucugaaaagugccag

SEQ ID NO: 383264 - RNA, 64 nt, Human
aggaccaugugguuggaaggauagacugcccccuaccucccaccaccaccaugaaguuugguga

SEQ ID NO: 383265 - RNA, 64 nt, Human
ucucccucuguccacucuuccuuuaauuuauuugaccucccacuacccagaaugggagacgugc

SEQ ID NO: 383266 - RNA, 64 nt, Human
cugccaguauguuccaaacccuccugggaaggccaccucccacuccugcugcacaggcccuggg

SEQ ID NO: 383267 - RNA, 64 nt, Human
caccaucugccaaugccaugacugcucaggccucaccucccagggcuacacagacccugcccac

SEQ ID NO: 383268 - RNA, 64 nt, Human
gagggcucagcaugaccaaaguccuaaagauuuuaccucccagcuuugguuguauguguuccca

SEQ ID NO: 383269 - RNA, 64 nt, Human
ugguugcaccccgaggggagaugccuucucccccaccucccaggaccugcaucccagcucagaa

SEQ ID NO: 383270 - RNA, 64 nt, Human
aagaagacuauaacuuuugaugccauugagauucaccucccacaaacugacaaauuaaggaggu

SEQ ID NO: 383271 - RNA, 64 nt, Human
agugagcaguagaagccugcagcggcacaaaugcaccucccaguuugcuggguuuauuuuagag

SEQ ID NO: 383272 - RNA, 64 nt, Human
gcgugcggccgggcggggaggcuggcucccccacaccucccaccugcauugcucucccucgugc

SEQ ID NO: 383273 - RNA, 64 nt, Human
uuuucccaauacuagccccccaguggugaacagaaccucccaaauuugaguugcacccuucccu

SEQ ID NO: 383274 - RNA, 64 nt, Human
guugcuaaccguuuugcucuuguuggggaaaagaaccucccauuucacuucguuuuaacguggg

SEQ ID NO: 383275 - RNA, 64 nt, Human
uguccuuacucaacagugguccucaucccuccccaccucccacugcuuccugcaagggcaccag

SEQ ID NO: 383276 - RNA, 64 nt, Human
uccaaugacauauuauaguaaaugaguaucuguaaccucccacugcaucagaagcagguuaaau

SEQ ID NO: 383277 - RNA, 64 nt, Human
ccaccucaccaaccccaucucccacucagaaaucaccucccagccucaggaagaguagaaauug

SEQ ID NO: 383278 - RNA, 64 nt, Human
cauggggcagagccccaggcguccccagcuguucaccucccagagaguccccagagccccaaag

SEQ ID NO: 383279 - RNA, 64 nt, Human
uacaguggcaugauuucaguucacugcagccucgaccucccaggcucaagugauccucccaccu

SEQ ID NO: 383280 - RNA, 64 nt, Human
ugccgcucuucugucaucccgcuccugcugaaacaccucccaggggcuccaccuguucaggagc

SEQ ID NO: 383281 - RNA, 64 nt, Human
ccauucaugaugaacucacccccaugauccaaucaccucccaccaggcuccaccucgaauacug

SEQ ID NO: 383282 - RNA, 64 nt, Human
aucugugaaauuagaauuuauaauaauugcaccuaccucccagggguaacuaaaugaauaaaua

SEQ ID NO: 383283 - RNA, 64 nt, Human
ugcaguggcgugaucuccgcucgcuacaaccuccaccucccagcugccugccuuggccucccga

SEQ ID NO: 383284 - RNA, 64 nt, Human
gaacuucacgauuccuucccacggucaacucgggaccucccagcgaccacugcagccugcggac

SEQ ID NO: 383285 - RNA, 64 nt, Human
ggauuacacagcuaugaauguauuugcuucuaaaaccucccaaagugaaucuaaucuuaaaacu

SEQ ID NO: 383286 - RNA, 64 nt, Human
ugcaggggggcaaucacggcucacuguagucucgaccucccaggcucaagcuguccucccgccu

SEQ ID NO: 383287 - RNA, 64 nt, Human
uugaaauaguuuaucuuguaaugaaauauaaggcaccucccacuuuuauguauagaaagagguc

SEQ ID NO: 383288 - RNA, 64 nt, Human
uguccuggcaggugaugugcuggguauagcauggaccucccagagaagcucaagcuauguggca

SEQ ID NO: 383289 - RNA, 64 nt, Human
guccugagcaggcggcagugaacagcacuggcccaccucccacucacagccccucuguccccuc

SEQ ID NO: 383290 - RNA, 64 nt, Human
ugucugccuagcccuguuggcgggcugacccucgaccucccagacaccacaauugugccuucug

SEQ ID NO: 383291 - RNA, 64 nt, Human
cgaacuccugaccugaagugauccacccgccucgaccucccaaagugcugggaugacaggcaug

SEQ ID NO: 383292 - RNA, 64 nt, Human
ugccacauuuguucauucuguucaaccuguuuugaccucccaggcaucugaacaggaugacauc

SEQ ID NO: 383293 - RNA, 64 nt, Human
auacucuguacuagggccgaaguaaaaaaccaucaccucccauucccaggggcaucaucauguu

SEQ ID NO: 383294 - RNA, 64 nt, Human
cgaacucuugagcucaagcagucuacccaccuugaccucccaaagugcugggauuacaggcuug

SEQ ID NO: 383295 - RNA, 64 nt, Human
cugccuucugggcucaagcaauccucccacuucaaccucccaaguagcugggacuauaggcaug

SEQ ID NO: 383296 - RNA, 64 nt, Human
cuuucucucuguguucucuguauuguacuaaccaaccucccaaaucgcugagcugcuuguuuaa

SEQ ID NO: 383297 - RNA, 64 nt, Human
caacguuaaguaaaaagcuucuuuuaccuaacccaccucccaagggcuccauuuguaaaaguac

SEQ ID NO: 383298 - RNA, 64 nt, Human
auuaagcaaaugcugcacagauggauuuguuuggaccucccaaucuagggagccuagauacucu

SEQ ID NO: 383299 - RNA, 64 nt, Human
ccagauggguugcauaagaaucagguccuuaaauaccucccaaucugaugaaacgauagaauaa

SEQ ID NO: 383300 - RNA, 64 nt, Human
ccuaauggguccaccucucaucugcaucuuucacaccucccagcuucugcccaaccuucagcag

SEQ ID NO: 383301 - RNA, 64 nt, Human
ccucccuccccaaacucacuuggcauaauucacaaccucccacccaaacaaugggccuggugga

SEQ ID NO: 383302 - RNA, 64 nt, Human
cggaguuugugcagcccaugccuagcgaugcugcaccucccaugauguccuggcuuuguggcaa

SEQ ID NO: 383303 - RNA, 64 nt, Human
uguuuaccccaacagcaugcucugucuagacuggaccucccagccccuuguguugggaaggcaa

SEQ ID NO: 383304 - RNA, 64 nt, Human
cccugcuagccuugaggcgcggacccucccccauaccucccacaguaucccagcgccucaugcc

SEQ ID NO: 383305 - RNA, 64 nt, Human
ugaagcaggugcucaggacccggaagaaucaucuaccucccagcuuugugagacagaaccaagu

SEQ ID NO: 383306 - RNA, 64 nt, Human
ccauucaugagggauccaccuuugugcuccaaacaccucccaccaggccccaccuccaguauug

SEQ ID NO: 383307 - RNA, 64 nt, Human
ugaacuccugaccuccagugauccgccugccuugaccucccaaagugcugggauuacagacaug

SEQ ID NO: 383308 - RNA, 64 nt, Human
ugcagcucaccggguuagccguggcaccguugggaccucccaccaggacuccaaucacccaccu

SEQ ID NO: 383309 - RNA, 64 nt, Human
ugcaguggugagaucacggcucauugcagccucgaccucccaggugauccucccaccucagcuu

SEQ ID NO: 383310 - RNA, 64 nt, Human
ggaaucauugcagauuuuuuuuuauucugcucccaccucccacccgggacuacuugcuggugac

SEQ ID NO: 383311 - RNA, 64 nt, Human
ucauggagugcaauaauacuguauagcuuuccccaccucccacaaaaucacccaguuaaugugu

SEQ ID NO: 383312 - RNA, 64 nt, Human
uugcauuaaggcacauagugggauuacaucauaaaccucccauaauuuuugucauucuguguua

SEQ ID NO: 383313 - RNA, 64 nt, Human
agaggccccgccucuggugggcuuggccuccaccaccucccacgcuucugagaagagguuccaa

SEQ ID NO: 383314 - RNA, 64 nt, Human
ucgaacuccuggccuaggugauccacccgccucgaccucccaaagugcugggauuacaggcaug

SEQ ID NO: 383315 - RNA, 64 nt, Human
uuugccauggaugagaguccugggugugaggaacaccucccaccaggcuagaggcaacugccca

SEQ ID NO: 383316 - RNA, 64 nt, Human
cuuagaucagagcccuccagcccuucuuuuugaaaccucccaauggcauuucagaagugagcag

SEQ ID NO: 383317 - RNA, 64 nt, Human
gaggacccagccgccaucagcccaacgggaagcaaccucccaacccagaggaggcagaauaaga

SEQ ID NO: 383318 - RNA, 64 nt, Human
ugcaguggcaggaucacagcuuacugcagccuugaccucccaggcucaggucccaucugagccu

SEQ ID NO: 383319 - RNA, 64 nt, Human
gugggggaugcaugggaaagccaggagggcccugaccucccacugcccaggaggcaguggcggg

SEQ ID NO: 383320 - RNA, 64 nt, Human
uggagcccuagcccuccauucucgacauuccccaaccucccagccccuuccaagcaggacuagg

SEQ ID NO: 383321 - RNA, 64 nt, Human
cccccucuccucccaaaccaaaaaccauugucuuaccucccaacuggaagacagcucgagaucc

SEQ ID NO: 383322 - RNA, 64 nt, Human
gagagggggccugggacuuccaugccuuaaaccuaccucccacacucccaagguuggagcccag

SEQ ID NO: 383323 - RNA, 64 nt, Human
aacacaagaaauuugaauaguuccugcuuucugcaccucccaccaaaacaaacuuuucaaugau

SEQ ID NO: 383324 - RNA, 64 nt, Human
ggggcccccucccucuugagccugggugcacagcaccucccaccuggggggcuaguggaagccc

SEQ ID NO: 383325 - RNA, 64 nt, Human
gacgagacccccucaucucagaguaaugggaagaaccucccacaucucccuggcagcagaugag

SEQ ID NO: 383326 - RNA, 64 nt, Human
ccaaggaaggccuaugaaaagguccugaugcccaaccucccaccccuucaauguggggacgaga

SEQ ID NO: 383327 - RNA, 64 nt, Human
gccuccugaacccgccuccugaaccugccuccuuaccucccacuuccugagcccugaguggaag

SEQ ID NO: 383328 - RNA, 64 nt, Human
acugcuagugacauuccucaaugaccucucccaaaccucccaugaugccuuacccuugcuguca

SEQ ID NO: 383329 - RNA, 64 nt, Human
ugccguggcacgaucucagcucacugcaaccuccaccucccagguucaagcgauucucgugccu

SEQ ID NO: 383330 - RNA, 64 nt, Human
aaagucucaccuggggguagggagggguaggccuaccucccaccucuauacuaucauuuuagga

SEQ ID NO: 383331 - RNA, 64 nt, Human
ugcaguggcacaaucauagcucacugcagcuuugaccucccagacccaagugauccucccaccu

SEQ ID NO: 383332 - RNA, 64 nt, Human
ugcaguggugugaucucagcucacugcaaccuccaccucccagguucaagcaauucuucugccu

SEQ ID NO: 383333 - RNA, 64 nt, Human
cgcaguggugacaucucggcucacugcaaccuccaccucccagguucaagugauucuccugccu

SEQ ID NO: 383334 - RNA, 64 nt, Human
ugggggcccgugcuaggagucaccacaugcuccaaccucccacugcucccugucaggggcccag

SEQ ID NO: 383335 - RNA, 64 nt, Human
uuacuagaaaauggcaggaaucaacaaaauggagaccucccacuguuuuugcuaaaguuacagg

SEQ ID NO: 383336 - RNA, 64 nt, Human
uaguauagaauaggacuacauacuuugucuuuggaccucccaugaacuuauuacccugacaaau

SEQ ID NO: 383337 - RNA, 64 nt, Human
gugugaaaaccaucuaaguuugcuuuugaccaucaccucccaguagcaauuugcuuucauaauc

SEQ ID NO: 383338 - RNA, 64 nt, Human
aguuuguauuccaucucugagauauguggucuugaccucccagcaugaagugugcauggcuuug

SEQ ID NO: 383339 - RNA, 64 nt, Human
ggaacuccugaccucaagcgaucuuccugccuugaccucccaaagugcugggauuauagccaug

SEQ ID NO: 383340 - RNA, 64 nt, Human
cguauaagugacucauccugucugcuaacuccagaccucccagcuugaagccaaaucuuuccau

SEQ ID NO: 383341 - RNA, 64 nt, Human
ugcgguggcgcgaucuugacucacugcaaucuccaccucccacagguucaggcgauucccgugc

SEQ ID NO: 383342 - RNA, 64 nt, Human
uuauuaaaaacccauaacuaccaggaauaaugauaccucccaccccuugauucccauaacauaa

SEQ ID NO: 383343 - RNA, 64 nt, Human
ugcaguggcgcaaucuuggcucacugcaaccuccaccucccagguucaagugauucuccugucu

SEQ ID NO: 383344 - RNA, 64 nt, Human
auauacacaugacgcacacgaugccagggccuagaccucccaagggcugugcuccugcucccag

SEQ ID NO: 383345 - RNA, 64 nt, Human
acacaauaauagggagacaaggauuaggagccauaccucccagagcaagguaucuuucuagagc

SEQ ID NO: 383346 - RNA, 64 nt, Human
caccuguggccgagggcucucagagacccccuuaaccucccaaauacuaagaagcuaaaauauu

SEQ ID NO: 383347 - RNA, 64 nt, Human
aacaugguccuuggugaagaccugcaccccuggaaccucccaccaucaucacaacuguagucuc

SEQ ID NO: 383348 - RNA, 64 nt, Human
caguucuggugugcuuaaccaugcaagcccucccaccucccagggcuccuugccuuagguggcu

SEQ ID NO: 383349 - RNA, 64 nt, Human
cuccauccagcuaagcgaucuugaacaagucacaaccucccaggcuccucauuugcuagucacg

SEQ ID NO: 383350 - RNA, 64 nt, Human
ccguccucacuagcugcacccuguuugcucgcagaccucccauugccacagcccaagcaccuuc

SEQ ID NO: 383351 - RNA, 64 nt, Human
guuggcagcgcugccauggaacaccccagcaagcaccucccagccugccuuucggagcagcacc

SEQ ID NO: 383352 - RNA, 64 nt, Human
uggaaggggggcauucucugucaaugaugcacuaaccucccaaccugauuuccccgaaucugag

SEQ ID NO: 383353 - RNA, 64 nt, Human
ccuggguuggcaaacagcugaccaaacugccaucaccucccacuuggaaguguauggccgacag

SEQ ID NO: 383354 - RNA, 64 nt, Human
ugaacuccugggcucaagccaucugccugccuccaccucccaaaaugcugagauuacaggugug

SEQ ID NO: 383355 - RNA, 64 nt, Human
auacauuucucaaauguacacuuguauuauaauaaccucccaguucuaggggauauuugugcaa

SEQ ID NO: 383356 - RNA, 64 nt, Human
ugaacuccugaacucaagugauccaccugccucgaccucccaaaguacugggauuacaggcgug

SEQ ID NO: 383357 - RNA, 64 nt, Human
uccaucuccugggcucgagugauccuccugucucaccucccaaguagcugagacuacaguacag

SEQ ID NO: 383358 - RNA, 64 nt, Human
caagaggauuuuaacagcaaagaagagaggcagcaccucccauuggcagaaugaccgcugagcc

SEQ ID NO: 383359 - RNA, 64 nt, Human
ggaucugcaagugcaggguguugguuaaaguuguaccucccaaguauuugggggauauauuuau

SEQ ID NO: 383360 - RNA, 64 nt, Human
uuuuucucauaaguacuccugaguacaaguggucaccucccauaguauucauuuggcuucgcug

SEQ ID NO: 383361 - RNA, 64 nt, Human
acugggcgaccacgggggccugcucagcacccucaccucccacccccugagagcuggggcaggc

SEQ ID NO: 383362 - RNA, 64 nt, Human
cgaacuucugagcucgagcgauccuccugccuccaccucccaaaguguucggauuacaaacgug

SEQ ID NO: 383363 - RNA, 64 nt, Human
uuuucuccgccacuucaccaguuucugaaauccaaccucccagacuucacaggaagauagauau

SEQ ID NO: 383364 - RNA, 64 nt, Human
guauuuccacaacccaaguuuagaguuggcccccaccucccaugccauggacugagcagcaggg

SEQ ID NO: 383365 - RNA, 64 nt, Human
ugaguggccuuguugccuugggcguguguucagcaccucccaucccauggauacaguggagauu

SEQ ID NO: 383366 - RNA, 64 nt, Human
cagcacaggaaaguucugcccccgugauucaauuaccucccacuuggucccacccacgacacgu

SEQ ID NO: 383367 - RNA, 64 nt, Human
gcccacaaccuaugacccccucccccaggacaccaccucccacccacagaccuucccuuuagcu

SEQ ID NO: 383368 - RNA, 64 nt, Human
caaacucccagccucaagcgaugcucccaccuccaccucccaaagugcugggauuacaggcgug

SEQ ID NO: 383369 - RNA, 64 nt, Human
uacaguagugcaaucucagcucacugcaaccuccaccucccagacucaagccauccucccaccu

SEQ ID NO: 383370 - RNA, 64 nt, Human
ccaccucccagacucaagccauccucccaccucaaccucccaaguagcugggacuacaggcaua

SEQ ID NO: 383371 - RNA, 64 nt, Human
ccguccucccucagccuccccuucuucccgccccaccucccauuucuguugcuggaggggcugu

SEQ ID NO: 383372 - RNA, 64 nt, Human
aguuaaguuuaguguugauguuccaucauucuggaccucccaggaguuguuuaagaaugaaucu

SEQ ID NO: 383373 - RNA, 64 nt, Human
gcagucucacuguccuaagguaugucuucuuuccaccucccacugccccuccccugccaccuau

SEQ ID NO: 383374 - RNA, 64 nt, Human
ucccaucaugaggccccguccuuaugaccucaucaccucccaaaggacccccuccuaauaccau

SEQ ID NO: 383375 - RNA, 64 nt, Human
auaauaaccacuuugcauccaacacucuucacccaccucccauacgcaaggggauguggauacu

SEQ ID NO: 383376 - RNA, 64 nt, Human
uucccucccucaaagaaauccuccaaucaaaaucaccucccaccauaaucccugucuucuuucc

SEQ ID NO: 383377 - RNA, 64 nt, Human
ugggcagccgggcagaagggaauccaggcuauggaccucccaaguccccgcuccccgcuccccu

SEQ ID NO: 383378 - RNA, 64 nt, Human
cccguuagagagcugagacccuuauuuaaaacucaccucccaaucaccccaaacaaauggaaga

SEQ ID NO: 383379 - RNA, 64 nt, Human
cccaccuggaaucccacaacaucagcucugugccaccucccaagagggcuccucacuaucuagg

SEQ ID NO: 383380 - RNA, 64 nt, Human
ggaguggacaagccucuugguuaaggcuccucuuaccucccaagcucauggacaaguggcaauc

SEQ ID NO: 383381 - RNA, 64 nt, Human
cucgaucuccugaccucgugauccacccuccuccaccucccaaaguacugggauuacaggcaug

SEQ ID NO: 383382 - RNA, 64 nt, Human
auggcaagaugccauauccuggaaacauauuacgaccucccauguuuguuacaugcauccaguu

SEQ ID NO: 383383 - RNA, 64 nt, Human
cuguuauacagaauugaaagccuucguaucuugaaccucccaacauuuuucuuauggcuguuga

SEQ ID NO: 383384 - RNA, 64 nt, Human
cucgaucucuugaccucaugauccacccgccucgaccucccaaagugcugugauuacaggugug

SEQ ID NO: 383385 - RNA, 64 nt, Human
ugcgguggugcaaucucggcucacugcaaccuccaccucccagguucaagcaauucuccugccu

SEQ ID NO: 383386 - RNA, 64 nt, Human
gcacucuguguauuuaugcguuccagcaucuggaaccucccaucccugcccuccuccuguguag

SEQ ID NO: 383387 - RNA, 64 nt, Human
cucuaucuccugaccuugugauccgccccccuccaccucccaaagugcugggauuacaggcgug

SEQ ID NO: 383388 - RNA, 64 nt, Human
cgaacuccuggccucaagcgauccucccaccucgaccucccaaagugcugggauuacaggugug

SEQ ID NO: 383389 - RNA, 64 nt, Human
acaguauuaugaagguuuggaaaccccucuccucaccucccaccgugaccuugggcaaacccug

SEQ ID NO: 383390 - RNA, 64 nt, Human
cccuugcccucuccagcuccaccucacccagagcaccucccagccaccguccccucaagagccc

SEQ ID NO: 383391 - RNA, 64 nt, Human
ggggaggccuguguauggagccucgagaugcgccaccucccagaaagccaggugagggcaucgu

SEQ ID NO: 383392 - RNA, 64 nt, Human
ugcaguggugugaucauagcucacugcaaccuccaccucccaggcucaagccucccgaauagcu

SEQ ID NO: 383393 - RNA, 64 nt, Human
aagacuauuuggauaacuuauaggaaagccuagaaccucccaguagaguggggauuuuuuucuu

SEQ ID NO: 383394 - RNA, 64 nt, Human
gcaggagcucugacuaagguugacauaauaguccaccucccauuacuuugauaucugaucaaau

SEQ ID NO: 383395 - RNA, 64 nt, Human
ggcccugcagccccagccgcagugucugaaggccaccucccaaagggagcacguugccuuuuca

SEQ ID NO: 383396 - RNA, 64 nt, Human
uuucuaccucguuuuuucaccacucccaaacauaaccucccaaucuuuuuuguuaguccggccg

SEQ ID NO: 383397 - RNA, 64 nt, Human
uuaguaugauaucaaaagaauaaucaauuuaguuaccucccaacuaaaaaguaaaaaugaaaaa

SEQ ID NO: 383398 - RNA, 64 nt, Human
uuccccggggucuucuaccucagacacucugacuaccucccacugaggcggcuccagccccaga

SEQ ID NO: 383399 - RNA, 64 nt, Human
auccugcaauucucaaucuugcacugcagccucgaccucccaggcuccagugacucucccaccu

SEQ ID NO: 383400 - RNA, 64 nt, Human
ccaggcaaaccugccccaucuugucgcuuuuaggaccucccacaaccugguuccccacacaucc

SEQ ID NO: 383401 - RNA, 62 nt, Human
auggcacagccgaggaguaggcugagggcugcaccucccacgguggucaccaugccaaugaa

SEQ ID NO: 383402 - RNA, 64 nt, Human
ccauuguccccaaguaugaggugaacggggugaaaccucccauuggccaaaggacacggcucag

SEQ ID NO: 383403 - RNA, 64 nt, Human
caaguucugugguucugagaagcccgaggucaucaccucccaguacaacaacaugcgcguggag

SEQ ID NO: 383404 - RNA, 64 nt, Human
ugcagugguacaaucuuagcucacugcagccuccaccucccaggcucaagagauccucccacag

SEQ ID NO: 383405 - RNA, 64 nt, Human
acgguguuuuccucccuugccccauuaucuuuucaccucccaggucuaccauuucauggugguc

SEQ ID NO: 383406 - RNA, 64 nt, Human
caagauuauugucaaucccugaaugucuggaguuaccucccauggauuuuuuuuuccuuuggcc

SEQ ID NO: 383407 - RNA, 64 nt, Human
cggggaguguuccucgacauguuucuccagugacaccucccagagaaguuguaaguauaaaaug

SEQ ID NO: 383408 - RNA, 64 nt, Human
uuuuggugaggguuggcuguggcugucguuuugcaccucccagauuucaaagaauuacugguuu

SEQ ID NO: 383409 - RNA, 64 nt, Human
ugcaauggcgugaucucggcucacugcaaccuccaccucccagauucaagcaacucucugccuc

SEQ ID NO: 383410 - RNA, 64 nt, Human
cauacuccucaguucacgcauuccucccaccuccaccucccaaacugcugggauuacaggugug

SEQ ID NO: 383411 - RNA, 64 nt, Human
uguagaacaugagagacccccucccucaauuuccaccucccaagggaaguuuauguauuuuucu

SEQ ID NO: 383412 - RNA, 64 nt, Human
ggagggugcgggaaguccagcgacucucagacgcaccucccagaggaccggugggaauuguuca

SEQ ID NO: 383413 - RNA, 64 nt, Human
uugauguguuugucaaaacauuuggaaaaagucaaccucccaguuuaaaggaugggaagacccc

SEQ ID NO: 383414 - RNA, 64 nt, Human
aaucauccgguccaaucucuuuccucuuucugccaccucccaaggcagaaauccccucuucagc

SEQ ID NO: 383415 - RNA, 64 nt, Human
gaagccaagcgggaggggagcugcgcccucccugaccucccaggcugcggcucagguggccaac

SEQ ID NO: 383416 - RNA, 64 nt, Human
cuugugcuuggauuuuccagauuaauuugaaaagaccucccauuuguggcuuuguacauaacca

SEQ ID NO: 383417 - RNA, 64 nt, Human
aucuucuuuucuugccucccugaccagcagacucaccucccaagaacgccugcccgcccacccg

SEQ ID NO: 383418 - RNA, 64 nt, Human
ugcugggaaaaaauucaguuuauagcauuccugcaccucccaaaguagauaaccuggaggucau

SEQ ID NO: 383419 - RNA, 64 nt, Human
uaguucugcuuucugccucuccuccacagccccaaccucccaccccugauacaugagccaguga

SEQ ID NO: 383420 - RNA, 64 nt, Human
cccguggaugccgucaccaccagcacacggaacuaccucccacccccuuuuuguacaaaacaca

SEQ ID NO: 383421 - RNA, 64 nt, Human
uaaggcugucgcuuauugaauccacuuguguccaaccucccaggauuguuuuauccuaauguca

SEQ ID NO: 383422 - RNA, 64 nt, Human
aaaacaaggacaaaaccaaccagcguucaaaggaaccucccaucagaguccccuaaaguauuuu

SEQ ID NO: 383423 - RNA, 64 nt, Human
cauggaaguuucauuuguugcggaauauggaagcaccucccaaugguacggugcacccuguggu

SEQ ID NO: 383424 - RNA, 64 nt, Human
agguuuaguuuacagucucugaacuaaaguaguaaccucccaaauuguuuuuucuaauaagcug

SEQ ID NO: 383425 - RNA, 64 nt, Human
gcucuggacacucuagaaaucacuccucagugugaccucccaggccucuuccccguguacguca

SEQ ID NO: 383426 - RNA, 64 nt, Human
ugcaauggugcgaucuuggcucacugcaaccuccaccucccaguucaagugauuccccugccuc

SEQ ID NO: 383427 - RNA, 64 nt, Human
uucuuaccaagauggccaguaucauuuuacccccaccucccaagccccaagagguguaccuuuu

SEQ ID NO: 383428 - RNA, 64 nt, Human
gugugucccuucccccuccagcucgcccucuucuaccucccagcgagaccuggcccagaaaggg

SEQ ID NO: 383429 - RNA, 64 nt, Human
ugguggaggucgagugggugcaagggcccucaggaccucccacauguacaguuccccugccucu

SEQ ID NO: 383430 - RNA, 64 nt, Human
uucaacgcuuuuauuuuuucucccgucuucaaugaccucccauuuggacccauaguuuauuuau

SEQ ID NO: 383431 - RNA, 64 nt, Human
ccacugcugcaaagcuuucuuugacccucuggccaccucccaagccagaaguuaucuucccccu

SEQ ID NO: 383432 - RNA, 64 nt, Human
uacauucugaauggggagcagguaagagcagagcaccucccacugggggugggguauuuaaaaa

SEQ ID NO: 383433 - RNA, 64 nt, Human
cgauucacguaggaucugccccugugaccaaaacaccucccauugggccccacuuccaacacug

SEQ ID NO: 383434 - RNA, 64 nt, Human
ccaaggccucugccccuaaccacugugccauaccaccucccaauaaucaacagcaaaauuauag

SEQ ID NO: 383435 - RNA, 64 nt, Human
ucuagcuccucugugacucagaggggaaauaccaaccucccagucuuccacugcccacagggau

SEQ ID NO: 383436 - RNA, 64 nt, Human
caccccguacucccaccccucccacaaccccuguaccucccaccccuguauccccaccccucca

SEQ ID NO: 383437 - RNA, 64 nt, Human
auauuggguccucugggcaguagaggcaaagcucaccucccauguagcacaugaaaugcuugug

SEQ ID NO: 383438 - RNA, 64 nt, Human
gggacaccaaccuugacuccugccacuagguuucaccucccaaacccagccucuagaacagcca

SEQ ID NO: 383439 - RNA, 64 nt, Human
gccagugccaaaacccagccaugggcucuuugcaaccucccagcugcgcucauuccagcugaca

SEQ ID NO: 383440 - RNA, 64 nt, Human
uagacuuuaucccuccuucuuacucugggccaagaccucccacuccgcccucugaggaugguac

SEQ ID NO: 383441 - RNA, 64 nt, Human
cgcaauggcgcgaucucugcucacugcaacauccaccucccagguucaagcaauucuccugccu

SEQ ID NO: 383442 - RNA, 64 nt, Human
ugccacccucaguaagaacacacgaggaggcaggaccucccaccuucaggucugcaucauccuu

SEQ ID NO: 383443 - RNA, 64 nt, Human
aguaccuguuugaccaagguguuaaggggauaguaccucccaauucaagcagagaaacugaccu

SEQ ID NO: 383444 - RNA, 64 nt, Human
uuugcccagucagggaaagcugacuguaagucccaccucccacuccguccacccuucuaguggu

SEQ ID NO: 383445 - RNA, 64 nt, Human
uggaguggcacaaucuuggcucacugcaaccuccaccucccagguccaagcgauucucuugccu

SEQ ID NO: 383446 - RNA, 64 nt, Human
ccagacaccaugucugcuggcaccuugaucuuggaccucccagccuccagaacugugagaaaua

SEQ ID NO: 383447 - RNA, 64 nt, Human
agaugaaaacuccagaaacgcacaggaacgaaauaccucccagaaacaugaagcaaucaucgaa

SEQ ID NO: 383448 - RNA, 64 nt, Human
ugcaauggcgugaucucggcucacugcacccuccaccucccagguucaagcgauucuccugccu

SEQ ID NO: 383449 - RNA, 64 nt, Human
gaccugaggagccgagcgaauagcaucuccucccaccucccaccagagacguccuguuugagcu

SEQ ID NO: 383450 - RNA, 64 nt, Human
cccugucuucuuccccaggccucugacuucccucaccucccaaccaucauuacaggaaagacug

SEQ ID NO: 383451 - RNA, 64 nt, Human
aacuguuuguuauaaaguggcuagaacaucaauuaccucccauguguggacauccugggacuug

SEQ ID NO: 383452 - RNA, 64 nt, Human
ugaagaaccuugacugcuugguccucagguaucuaccucccaccuucuccucaucuguggagca

SEQ ID NO: 383453 - RNA, 64 nt, Human
auccaccguccugcccacgccgccucagccugccaccucccaccuagaggagaccaugggcccu

SEQ ID NO: 383454 - RNA, 64 nt, Human
cacacaagcagccguggacacaacgcccacuaccaccucccacauggaaauguauccucaaacc

SEQ ID NO: 383455 - RNA, 64 nt, Human
ccucuugcauaccuccagggacagagagcuuacuaccucccaaggcagccuccugccuuuggac

SEQ ID NO: 383456 - RNA, 64 nt, Human
accgaagagcccugagcucaggcugagcccagccaccucccaaggacuuuccagugaggaaaug

SEQ ID NO: 383457 - RNA, 64 nt, Human
aggauccagggugcagggaacuccagagcugcccaccucccacugcccccucagcacacacaca

SEQ ID NO: 383458 - RNA, 64 nt, Human
uacaguggugcgaucucagcucacugcaacuuccaccucccagguucaagcgauucuuaugccu

SEQ ID NO: 383459 - RNA, 64 nt, Human
ggccccuguggcuuaagccuaagucucuucagccaccucccaggaagaucuggccuccguccua

SEQ ID NO: 383460 - RNA, 64 nt, Human
ugcaguggugggaucgcggcucacugcaaccuccaccucccagguucaagcaguucuccugucu

SEQ ID NO: 383461 - RNA, 64 nt, Human
cgugaacuccugaccucaugaucugcccgccucaaccucccaaagugcugggauuauaggcgug

SEQ ID NO: 383462 - RNA, 64 nt, Human
cucagcuccgccccauacccgucacuacagccucaccucccaccccugucacuacggccucacc

SEQ ID NO: 383463 - RNA, 64 nt, Human
cagccucaccucccaccccugucacuacggccucaccucccaccccugucacuacagccucacc

SEQ ID NO: 383464 - RNA, 64 nt, Human
agaaugcaggguuuccugccugacaacccuucucaccucccaagucccacuuuugaacaagcug

SEQ ID NO: 383465 - RNA, 64 nt, Human
cguguugcccucgugcccaucaagugcagucgggaccucccaggacaagcacgaggccucaggu

SEQ ID NO: 383466 - RNA, 64 nt, Human
ugauguguagcccccuccaccuuuccacucaacaaccucccaccccuguccugcugcauggucc

SEQ ID NO: 383467 - RNA, 64 nt, Human
ugcaguggugugaucaugguucacugcagucuugaccucccaggcuuaggugauccuucugucu

SEQ ID NO: 383468 - RNA, 64 nt, Human
ugccacagacccagcacccagcaaaucccucucuaccucccaaggugauaugggcagcugccca

SEQ ID NO: 383469 - RNA, 64 nt, Human
aucugcaccccccugggcugagagaaccucacgcaccucccauccuaaucauccaaugcucaag

SEQ ID NO: 383470 - RNA, 64 nt, Human
cgguucaugagaggucugcucucaugaccuaaucaccucccaaaggccccaccucccaauacca

SEQ ID NO: 383471 - RNA, 64 nt, Human
ugcucucaugaccuaaucaccucccaaaggccccaccucccaauaccaucacauuagggguuag

SEQ ID NO: 383472 - RNA, 64 nt, Human
ggaaugggugggugcccuccagagaggggcugcuaccucccagcaggcaugggaagagcacugg

SEQ ID NO: 383473 - RNA, 64 nt, Human
uuccuggccuacucccaaucacacugugcccugcaccucccaccaagggggaaccccagcagcu

SEQ ID NO: 383474 - RNA, 64 nt, Human
ggccaccaggagcugagacagugccaccaccagcaccucccacaagcccaccgcugugcguguu

SEQ ID NO: 383475 - RNA, 64 nt, Human
cucucagccgaugccccccgguaugggaaccagcaccucccaccaaccaaccacacccgguggg

SEQ ID NO: 383476 - RNA, 64 nt, Human
cucucagccgaugccccccaguaugggaaccagcaccucccaccaaccagccacacccgguggg

SEQ ID NO: 383477 - RNA, 64 nt, Human
cucucagccgaugccccccggugugggaaccagcaccucccaccaaccagccacacccaguggg

SEQ ID NO: 383478 - RNA, 64 nt, Human
cacacccggggggcccccgggugcagaaaacagcaccucccaccaaccagccacucccgguggg

SEQ ID NO: 383479 - RNA, 64 nt, Human
gccccucagagucccccaaacacaagcacaucacaccucccagugagagagcuguccauugacc

SEQ ID NO: 383480 - RNA, 64 nt, Human
caaaaaaaugcucacacuccacaucccgugaugcaccucccaggccccgcucauucuuugggcg

SEQ ID NO: 383481 - RNA, 64 nt, Human
uuucccucucacguauugacgguuuauuucuuugaccucccagagggcugaacucuuucaacuc

SEQ ID NO: 383482 - RNA, 64 nt, Human
aucagagcaggaccucccuuccgacccucugggaaccucccagagguccagcccaucucggagc

SEQ ID NO: 383483 - RNA, 64 nt, Human
caaggcugcugucuccaucccugagccgccugccaccucccacuccugaagauccaucucuugg

SEQ ID NO: 383484 - RNA, 64 nt, Human
gggcgugugaugcgaucagcccugucuccuccccaccucccaaaggucuaccgagcuggggagg

SEQ ID NO: 383485 - RNA, 64 nt, Human
ugauccccuccagggacacuucccugcccaggccaccucccacagcccuccacuggucuggcca

SEQ ID NO: 383486 - RNA, 64 nt, Human
uggauacuuuggaaugucuuuauauaggaaauagaccucccauuucuuaagcaaguugcuucug

SEQ ID NO: 383487 - RNA, 64 nt, Human
ugaccucccgaccucaagugaucugccugccccgaccucccaaagugcugggauuacaggcuug

SEQ ID NO: 383488 - RNA, 64 nt, Human
uuacuuugucccagguuggagucccuacccucccaccucccaccugauaugcagugcuuuugac

SEQ ID NO: 383489 - RNA, 64 nt, Human
ucucccccuccuaccugagaggcugcacccuccaaccucccauuggcucgcuccccccccccca

SEQ ID NO: 383490 - RNA, 64 nt, Human
uggacuccuguacugaagcgauccucccaccuugaccucccaaagugcugggacuauaggugug

SEQ ID NO: 383491 - RNA, 64 nt, Human
ggggcugacaacaggccccugacucaccccggucaccucccaggguccauggccagggccucug

SEQ ID NO: 383492 - RNA, 64 nt, Human
ugcaauggcacaauuuuggcucacugcaaccuccaccucccagguucaagcuauucuccugccu

SEQ ID NO: 383493 - RNA, 64 nt, Human
ucagagaagcuggaaaccuagauauuuaugugaaaccucccaguguauugccaacuaaaucaaa

SEQ ID NO: 383494 - RNA, 64 nt, Human
acaucucccugcuguguccccugggcauuucucuaccucccagguggaaguccuucagggucca

SEQ ID NO: 383495 - RNA, 64 nt, Human
uuuuguuguuguuguucuuucucuucuuuuucuuaccucccacuaaagggguuccaaauuaucc

SEQ ID NO: 383496 - RNA, 64 nt, Human
guuaaugccagagagguauaaugaagcaugucccaccucccacuuuccaucauggccugaaccc

SEQ ID NO: 383497 - RNA, 64 nt, Human
ucauuuuuuccugagaugcuucugagggaugcugaccucccacuauggggaaaaggguugcuug

SEQ ID NO: 383498 - RNA, 64 nt, Human
ugugucauuggggggaccgucuuuaccccugcugaccucccaccuauccgcccugcagcagaac

SEQ ID NO: 383499 - RNA, 64 nt, Human
uuaucaucaucuuaaguucuucaugcuacucuuaaccucccaaaaagcaguaucuaagucacau

SEQ ID NO: 383500 - RNA, 64 nt, Human
cccagagccuccaccaaacccucuccaugucuuuaccucccagucgcucuaagaaucugcuuga

SEQ ID NO: 383501 - RNA, 64 nt, Human
ugcacuggcuugaucucggcucacugcaagcuccaccucccagguucacgccauucuccugccu

SEQ ID NO: 383502 - RNA, 64 nt, Human
aaaaacguaucuaguguauuauuuuuaaaauuguaccucccaagaagaacacuuuaauugaaag

SEQ ID NO: 383503 - RNA, 64 nt, Human
cucaaacuccuaaccucgugauccgccugccucgaccucccaaagugcugggauuacaggcaug

SEQ ID NO: 383504 - RNA, 64 nt, Human
cuuguugaggcacugguaacccugauuaaccagaaccucccauucccaguaucgcuguuccuac

SEQ ID NO: 383505 - RNA, 64 nt, Human
cggaaggcuguggaccgauuccucuaggguggugaccucccauuagcaaacggugucaugguuu

SEQ ID NO: 383506 - RNA, 64 nt, Human
cgcuagcacuuuacaaaaauauugugcaagaccuaccucccacuccgucaaaguuccauuacau

SEQ ID NO: 383507 - RNA, 64 nt, Human
aggagcucauagauggaggaggugugggcugacuaccucccagaagccccucaugccaagccug

SEQ ID NO: 383508 - RNA, 64 nt, Human
caccuggaaugggaaggaugucagcugaccucucaccucccauggacagagaagaaaaugacca

SEQ ID NO: 383509 - RNA, 63 nt, Human
ucauccucuuugccaugugaaggagccgucuccaccucccauaguucucccgcgucugguugg

SEQ ID NO: 383510 - RNA, 64 nt, Human
ucccuucccugcuucucgcugucuuucuuuucccaccucccaccccccaguuuucagauuuucu

SEQ ID NO: 383511 - RNA, 64 nt, Human
ccgaagaauacaagaucccguccuccaggcagugaccucccaaaccagccugccuggucacuga

SEQ ID NO: 383512 - RNA, 64 nt, Human
ucauuuuaugaagcuaggucuuaaugcguaggcaaccucccagcucacuaugaacgcugacaga

SEQ ID NO: 383513 - RNA, 64 nt, Human
guuuucccugaugcucccgacuccccuccccaccaccucccaagguauuucugaugacuccgcc

SEQ ID NO: 383514 - RNA, 64 nt, Human
acaggaaaugccuuacuucacucuggcccggcggaccucccaccacccagcagugcacugggga

SEQ ID NO: 383515 - RNA, 64 nt, Human
gaggccucuggaaugggacuccuucucccucccuaccucccagccauccuaacuccuacaggcc

SEQ ID NO: 383516 - RNA, 64 nt, Human
agcgccuauguaggacggguguucucagugaccuaccucccaggcuccucugcaccugcaaagg

SEQ ID NO: 383517 - RNA, 64 nt, Human
ccuuacgaccagagaaggauuucagcaaaccaccaccucccacucaguguccccuccaaacuuc

SEQ ID NO: 383518 - RNA, 64 nt, Human
ggaccaccagccccaggauggcagagggaccagaaccucccacucagacuggcccgggagguuc

SEQ ID NO: 383519 - RNA, 64 nt, Human
uuaaaaauauaauuuguaacagugcuuaccauucaccucccaaagccaaggaacuugagugagc

SEQ ID NO: 383520 - RNA, 64 nt, Human
uauucuuaucaguauaaaaacacugagauugcuuaccucccaaauugcuuuauuguauuaacuc

SEQ ID NO: 383521 - RNA, 64 nt, Human
ugcagugaugcaaucuuggcucacugcagccucuaccucccagguucaagugauuauccugccu

SEQ ID NO: 383522 - RNA, 64 nt, Human
agacuuuaucuacacacuuucgggucugaccacuaccucccacaauaccuagccauuuuggaag

SEQ ID NO: 383523 - RNA, 64 nt, Human
gccaaugucuuuggacuguaaucagugcauccacaccucccaggauccagugcucccucucagc

SEQ ID NO: 383524 - RNA, 64 nt, Human
accuauuuaggacaaccucucuauccccagggagaccucccaaauggcuuugacccucagacau

SEQ ID NO: 383525 - RNA, 64 nt, Human
cucgaacuccugaccucaugauccgcccgccuugaccucccaaagugcugggauuacaggcaug

SEQ ID NO: 383526 - RNA, 64 nt, Human
ggugugaacccagggggccuuucccucuucccugaccucccaacucuaaagccaagcacuuuau

SEQ ID NO: 383527 - RNA, 64 nt, Human
aaaagacaacuuacaauuuaaauccuuaaaaguuaccucccauaacaaaagcauguauauguau

SEQ ID NO: 383528 - RNA, 64 nt, Human
agagcacauccagcauuugcaucaccucccuggcaccucccauaguuacagccacuacaucccc

SEQ ID NO: 383529 - RNA, 64 nt, Human
caggagaugauuguguggggcucuuccugcugucaccucccaucaucccacucucucaccagga

SEQ ID NO: 383530 - RNA, 64 nt, Human
uugucccacagagcagaaacagcuucacaaaaggaccucccagaguuaugagcccugauuuugu

SEQ ID NO: 383531 - RNA, 64 nt, Human
aggccugagaucagagccagaucagccuuaagucaccucccauccaagaacuuggccuaaaaau

SEQ ID NO: 383532 - RNA, 64 nt, Human
cugggccuccagaccugcacagggugcuccugccaccucccaccucucugagggcugaggugag

SEQ ID NO: 383533 - RNA, 64 nt, Human
ccccgcccuccauccuccccacaucccugcagccaccucccagcagagcaggcuacguccucac

SEQ ID NO: 383534 - RNA, 64 nt, Human
ggguggcagggauaaaaagucaccuccauucucuaccucccaugcagcaugaacacaauuucuc

SEQ ID NO: 383535 - RNA, 64 nt, Human
agcaacgacagcaacagacaaacaaaaagcucccaccucccaccccguuagcuguccuccuccu

SEQ ID NO: 383536 - RNA, 64 nt, Human
cuugcauuugauuuaggaccuuggaucaguggucaccucccagaagaggcacggcacaaggaag

SEQ ID NO: 383537 - RNA, 64 nt, Human
ugcaguggugccaucucagcucacugcaaccuccaccucccagguucaagcgauucuccugccu

SEQ ID NO: 383538 - RNA, 64 nt, Human
guuuuguuuuuuuuuuuuuuuuuuuuugcuuuugaccucccauuuuuacuauuugccaauaccu

SEQ ID NO: 383539 - RNA, 64 nt, Human
gacucugugcccuugcucucuaacuucugagcccaccucccaggguaggcaccugggggcaugc

SEQ ID NO: 383540 - RNA, 64 nt, Human
cccaggguaggcaccugggggcaugcaggugcccaccucccaggguaggcaccugggggcaugc

SEQ ID NO: 383541 - RNA, 64 nt, Human
auggguguggcccacuugugggagucuccuguccaccucccagagacggccacccagcgggucu

SEQ ID NO: 383542 - RNA, 64 nt, Human
aaaaucacuguugugaggacuuaaauuuuguguuaccucccaagagauacuuuuugagaguaua

SEQ ID NO: 383543 - RNA, 64 nt, Human
uauuucuggcugccucagccuucucugauuucccaccucccaaccuuguuccagguggccauag

SEQ ID NO: 383544 - RNA, 64 nt, Human
guggguguccagcuuccuccaggguuccccagccaccucccagcucagggcacaguguaucgac

SEQ ID NO: 383545 - RNA, 64 nt, Human
agcagcgucccagcgccuccacauugccccucucaccucccagcucuccacgccacuuggcucu

SEQ ID NO: 383546 - RNA, 64 nt, Human
caccuaccugcgccccccacacaccucucgaggcaccucccagacaccaaaugccucaucccca

SEQ ID NO: 383547 - RNA, 64 nt, Human
ccuucucuugcucaauccgagguggaaaaagaucaccucccagugaccucccucagcccccagg

SEQ ID NO: 383548 - RNA, 64 nt, Human
ugaaauccugaccucaagugauccacacaugucuaccucccaaagugcugggauuacagucgug

SEQ ID NO: 383549 - RNA, 64 nt, Human
aagugaaccuugggugugagggaccaauccugugaccucccagaaccauggaagccaggacguc

SEQ ID NO: 383550 - RNA, 64 nt, Human
gcaggcucugaaugccuggcauuucagcugcaucaccucccagcuccuuauugcccaaauagag

SEQ ID NO: 383551 - RNA, 64 nt, Human
auaucgcccaggcucaagugauucuccugccucaaccucccaaguagcugggauuacagaaagc

SEQ ID NO: 383552 - RNA, 64 nt, Human
cuggucacauucuuccauaccgaccucagcgguuaccucccacagaacgugguggacuccuucu

SEQ ID NO: 383553 - RNA, 64 nt, Human
cucuucagcuuugcagugguuugugggaagacauaccucccagaggggcauggacugccaccag

SEQ ID NO: 383554 - RNA, 64 nt, Human
cagucuaguuccugaugacccaggcugccugagcaccucccagccccugccccucaugccaacc

SEQ ID NO: 383555 - RNA, 64 nt, Human
ucuuggagucucagggcaaacccuuucgagcagcaccucccaguggccagaagcugaaaugaca

SEQ ID NO: 383556 - RNA, 64 nt, Human
ugcuuucaucacagcuaaaccugguucccuccaaaccucccagccacucgggcuuguaacuguc

SEQ ID NO: 383557 - RNA, 64 nt, Human
uccagcagggucagccauucacacccauccacucaccucccauucccagccacauggcagagaa

SEQ ID NO: 383558 - RNA, 64 nt, Human
gcccaggaaguggggcucggcacccauaacuaacaccucccacccuuggaaaccaugucuucug

SEQ ID NO: 383559 - RNA, 64 nt, Human
cccguagccccuggcuaggucgaaacagcccuccaccucccagccaagaucugucuuccuucau

SEQ ID NO: 383560 - RNA, 64 nt, Human
cccagccugagucagcaccaaucccgcauucagaaccucccagugaaagggcagccuucauuuu

SEQ ID NO: 383561 - RNA, 64 nt, Human
cauccccucuaaucuuggaaccucugaauaugggaccucccacagcaaagggugacuuuuguca

SEQ ID NO: 383562 - RNA, 64 nt, Human
ugcaacaugcuuggggucccuuaagcucccuccgaccucccagaagccuccaguccccaccagg

SEQ ID NO: 383563 - RNA, 64 nt, Human
ugcaguggcacgaucucagcucacugcaaccuccaccucccagguucaagcgauucuccugccu

SEQ ID NO: 383564 - RNA, 64 nt, Human
gcauucacacucuuguucccuagaaagccugggcaccucccacucgauuccugcuccucagacc

SEQ ID NO: 383565 - RNA, 64 nt, Human
cagacccagcuaauggauuaaaaaacugcccuucaccucccaaauccccaaggguuccucaugu

SEQ ID NO: 383566 - RNA, 64 nt, Human
ucacaucuccugagcuuaguguccguggcuguccaccucccagccauacuugacuguccccaaa

SEQ ID NO: 383567 - RNA, 64 nt, Human
gaauccucuucauucauugcuagugcuuccccucaccucccacucuccacuucccaguuugcaa

SEQ ID NO: 383568 - RNA, 64 nt, Human
uccuuggccagcacacuaucuaccacucuaccccaccucccacugccugccuugcuccccuuuc

SEQ ID NO: 383569 - RNA, 64 nt, Human
ccaccuccuggguucaagcgauucucuugccucaaccucccaagcaguugggacuacaggcgug

SEQ ID NO: 383570 - RNA, 64 nt, Human
cgaggccuccuuccucagguuccuccugcuccugaccucccagugugauguccggguccuuuau

SEQ ID NO: 383571 - RNA, 64 nt, Human
gagacaaaacuccuacucucaaccucacaccaacaccucccauuaucacucucucugcccccau

SEQ ID NO: 383572 - RNA, 64 nt, Human
ugcaguggcgugaucucggcucacuacaaccuccaccucccagccaccugccuuggccucccaa

SEQ ID NO: 383573 - RNA, 64 nt, Human
ccagaagauguauucagagccacccaggccacugaccucccacuuuggggaacucaaaggacug

SEQ ID NO: 383574 - RNA, 64 nt, Human
cuuccugugaacauuuguaaccacugcuucagucaccucccaccucuugccaccugcugcugcu

SEQ ID NO: 383575 - RNA, 64 nt, Human
ccaacccaugaacucuucacuccuuggggaagccaccucccaucacaccccugagcagaguuag

SEQ ID NO: 383576 - RNA, 64 nt, Human
cgcaguggucagaugaagcagcgccagagaggggaccucccagcucuuauuugcacccucccca

SEQ ID NO: 383577 - RNA, 51 nt, Human
aggaagagaccaagaaauaaaaccucccacuuugucuguacauacuggccu

SEQ ID NO: 383578 - RNA, 64 nt, Human
uaacaauccuagaaccaagcuucagagccuagccaccucccaccccacuccagcccuguccccu

SEQ ID NO: 383579 - RNA, 64 nt, Human
cuggggcuauuuaccaggguagaaaaaggagcuuaccucccaccuuugguccuaagucccugcc

SEQ ID NO: 383580 - RNA, 64 nt, Human
cuauguucuccagcaaguaaacauuccucugcucaccucccaacaagacuaacagucuuuuuag

SEQ ID NO: 383581 - RNA, 64 nt, Human
ucccucccucccucccauaaaaugccugcucuucaccucccaccuuuguggggggcuuuugagg

SEQ ID NO: 383582 - RNA, 64 nt, Human
ggaauaggaggaggcagcaugccgagccccugggaccucccaggcaggcuccgguucucuccug

SEQ ID NO: 383583 - RNA, 64 nt, Human
aaaauucccuuccuguucccuccugguccuggacaccucccaggggacuguuccuuauuucucu

SEQ ID NO: 383584 - RNA, 64 nt, Human
gaaagcaaggacugcccuucauucagccuugcugaccucccagccuuucuaaggcucagcccca

SEQ ID NO: 383585 - RNA, 64 nt, Human
ccccagccagggacggaaugccuggucuugagcaaccucccacugcuggagugcgagugggaau

SEQ ID NO: 383586 - RNA, 64 nt, Human
aaggagggguauguaugagagccgcucuccugcuaccucccaccacugucccagcagucccucg

SEQ ID NO: 383587 - RNA, 64 nt, Human
agcagaacuccgcagcccagcccagaggagugucaccucccaccuuuggagaggaauccuuccc

SEQ ID NO: 383588 - RNA, 64 nt, Human
gagagaagaagaagaagaagagacacaaaucucuaccucccauguuaagcuuugcaggacaggg

SEQ ID NO: 383589 - RNA, 64 nt, Human
uuggcucacuugaucuuggcucacuguaaccuccaccucccaggcucaagugauccucccaccc

SEQ ID NO: 383590 - RNA, 64 nt, Human
ugcaguggugugaucuaggcucacugcaaccuccaccucccagguucaagcaauuauccugccu

SEQ ID NO: 383591 - RNA, 64 nt, Human
gugcaguggugugauuacagcucauguagccuggaccucccaagcucaagcaauccuccugccu

SEQ ID NO: 383592 - RNA, 64 nt, Human
uuuuaugaagcuaucuuagguggagcuacuccccaccucccaccaacauauacauuuuguugca

SEQ ID NO: 383593 - RNA, 64 nt, Human
ucugagagaacugaguucccaggcuaaaucacuuaccucccacccccucuccaauuuuuuuuuu

SEQ ID NO: 383594 - RNA, 64 nt, Human
cucaggaggguaaggccagggugugaagggacuuaccucccaaagguucugcaggggaaucugg

SEQ ID NO: 383595 - RNA, 64 nt, Human
guuucaccauggcuucuauucaaguccaguuaaaaccucccagcugaccucagacuaggcauau

SEQ ID NO: 383596 - RNA, 64 nt, Human
gggugggugucugguguguguguuuucccuacgcaccucccauagcuauuaacaacugaggaag

SEQ ID NO: 383597 - RNA, 64 nt, Human
caccccagaauuacggucagccuuauuccccuucaccucccagugaacgcuaagaaguuucaga

SEQ ID NO: 383598 - RNA, 64 nt, Human
ugcaguggugccaucaugacucacugcagccuugaccucccaggcgcacaaaauccuccucuca

SEQ ID NO: 383599 - RNA, 64 nt, Human
ggguaucaaaugggucaaaaccaugggaccugccaccucccaucagcaauucuggaaaugcacu

SEQ ID NO: 383600 - RNA, 64 nt, Human
ucaccccuuuaguucucuggguguagaccacaccaccucccacugggcaccccccaacacggug

SEQ ID NO: 383601 - RNA, 64 nt, Human
aucacgcccacagacuacacccucuccaagugcuaccucccacgugaggaugugguuuugauca

SEQ ID NO: 383602 - RNA, 64 nt, Human
ggcccugugauuuugccucccacacccagccacuaccucccagcuuggagaacaccucagaauu

SEQ ID NO: 383603 - RNA, 61 nt, Human
cgggaccggggccagccuaggggggccugugaccucccauggagcccagccccgcccucca

SEQ ID NO: 383604 - RNA, 64 nt, Human
gccccgcccuccacaccuccggcgcuccgcacccaccucccacggccccgccccugcccccgcu

SEQ ID NO: 383605 - RNA, 64 nt, Human
ugaccuugccaaguuguucgagguggaauuaaacaccucccagaccucuggcuugucuuuucug

SEQ ID NO: 383606 - RNA, 64 nt, Human
ucagaugucaagccaccgggcaaaccccgucaauaccucccaccaaggaaugagauauguggac

SEQ ID NO: 383607 - RNA, 64 nt, Human
gggggccccagggguucucaggaccccucccaccaccucccagugcuuccacgucuccaaaagc

SEQ ID NO: 383608 - RNA, 64 nt, Human
ccccaagagcagcuagaagagauuugaggucaugaccucccacugccgcucaggggcugacccu

SEQ ID NO: 383609 - RNA, 64 nt, Human
ccuccgcugggccuggauggcugccucaccucucaccucccaacgucccuagcccuuacguccu

SEQ ID NO: 383610 - RNA, 64 nt, Human
uagcccaucuuucaagggaccucuccaugaucccaccucccauucacagauaccucucuuguag

SEQ ID NO: 383611 - RNA, 64 nt, Human
cucgaacuccugaccucgugauccaccugccuugaccucccaaagugcuaggauaacaggugug

SEQ ID NO: 383612 - RNA, 64 nt, Human
guccuggguaggaggggcguuagagccagcagggaccucccaugucuccagauuccaggugcag

SEQ ID NO: 383613 - RNA, 64 nt, Human
cuucaccucaacuagcuacaaccuuccacuccuaaccucccaagcuucucacuuaaagaggacu

SEQ ID NO: 383614 - RNA, 64 nt, Human
cuggcauuuaucacccccaccuggguccccugcaaccucccaucaaaggaugaccccuaaacac

SEQ ID NO: 383615 - RNA, 64 nt, Human
acaauuggugguggaguccugaccccaauccccaaccucccaggacuguguucuuucuggaguu

SEQ ID NO: 383616 - RNA, 64 nt, Human
ccucuccccagccugggaagaugucucacuguccaccucccaacgggcuaggggagcacggggu

SEQ ID NO: 383617 - RNA, 64 nt, Human
ugcaguggcacggucuuggcucacugcaaccuccaccucccagguuccagcaauucuccugccu

SEQ ID NO: 383618 - RNA, 64 nt, Human
ggucccugacccccaugccuccugacggggagacaccucccagcagggguccacagacaccuca

SEQ ID NO: 383619 - RNA, 64 nt, Human
ugcuaaucccagucacaagggcccugaccucaugaccucccaaagguccucccucuucauacug

SEQ ID NO: 383620 - RNA, 64 nt, Human
uaacuccuuaccaaauauaugcuuuuuacauauuaccucccaguccauagguugcuuuuucgcu

SEQ ID NO: 383621 - RNA, 64 nt, Human
accagguccggcacuuggagccccccggagagggaccucccagccgagcccucaaagaacucca

SEQ ID NO: 383622 - RNA, 64 nt, Human
cagagccugguguggggucugagacggccggagaaccucccaggcagggcucuguguuuugucu

SEQ ID NO: 383623 - RNA, 64 nt, Human
gcuauguucccgccgcaguggggcccugacgcccaccucccaggugccccucgagcaaaaaccu

SEQ ID NO: 383624 - RNA, 64 nt, Human
cugugugugucaaaggggacuaacagcagaaucuaccucccaacugccaugugauuaagaaaug

SEQ ID NO: 383625 - RNA, 64 nt, Human
aacuucccgugacuuggagcucucaccucgagacaccucccagaccccacauccccucagaacg

SEQ ID NO: 383626 - RNA, 64 nt, Human
uccucaacuuucuguccauucgggccuccuccccaccucccacgccccagccccucccuccuug

SEQ ID NO: 383627 - RNA, 64 nt, Human
acgagucugcugugaaccccgcaaccuccuccccaccucccaucucuccuuccaggcccauccc

SEQ ID NO: 383628 - RNA, 64 nt, Human
uacaauggcacaaacacugcucacugcagccucgaccucccaaggccuaagcaauccuccugcc

SEQ ID NO: 383629 - RNA, 64 nt, Human
cuucccugggauuuuugucuccuuuuaaaggcaaaccucccagcuucuuuagccucuugguacc

SEQ ID NO: 383630 - RNA, 64 nt, Human
cgaacuccugggcucaagugauccacccaucuccaccucccaaagugcuaggauuacaggcgug

SEQ ID NO: 383631 - RNA, 64 nt, Human
caagucuccaucugagacucccaaauugcuccccaccucccaucccuguuuuuuuuuguuguug

SEQ ID NO: 383632 - RNA, 64 nt, Human
ggcccagauugugaagacggacccauauaucccuaccucccaccaccuaguggccaaacacccc

SEQ ID NO: 383633 - RNA, 64 nt, Human
ccccaagucuucaaccagauauccucggcaacccaccucccacccuccuccucuucuccuucaa

SEQ ID NO: 383634 - RNA, 64 nt, Human
uccccccaccccccaaacguccuggacugcacagaccucccacuccagaccauccaggccuggu

SEQ ID NO: 383635 - RNA, 64 nt, Human
ugcaguggugucaucucagaucacugcaaccuccaccucccagguucaagcgauuccccugccu

SEQ ID NO: 383636 - RNA, 64 nt, Human
cccaaggugccugaaauggccgugcccgaugugcaccucccagaggugcagcugcccaaagucu

SEQ ID NO: 383637 - RNA, 64 nt, Human
ccgaaggugcccgagauggccgugcccgaugugcaccucccagaagugcagcuuccaaaagucc

SEQ ID NO: 383638 - RNA, 64 nt, Human
cucuaucuucugacuuuaugauccacccgacuccaccucccaaagugcugagauuacaggagug

SEQ ID NO: 383639 - RNA, 64 nt, Human
ugcagugaugugaucucgguucacugcaacauucaccucccagguucaugcaauucuccugccu

SEQ ID NO: 383640 - RNA, 64 nt, Human
gggcgcugagaaaggcaccagcuccuuggaccccaccucccaugcucucacucucauccccguu

SEQ ID NO: 383641 - RNA, 64 nt, Human
cucgcggagccccgggucucgguuauccaccccuaccucccagugucuaagccacgaauaaugg

SEQ ID NO: 383642 - RNA, 64 nt, Human
gugcaguguugcaguccggcucacugcaguuuugaccucccaggcucaagcgauccuccugccu

SEQ ID NO: 383643 - RNA, 64 nt, Human
aaucaaauguuugggaauggugcccuuggaggcaaccucccauuuuagauguuuaaaggacccu

SEQ ID NO: 383644 - RNA, 64 nt, Human
ggcugcccagcuggugguguuaagccagaauuugaccucccagagccaguuuccauuagcugcc

SEQ ID NO: 383645 - RNA, 64 nt, Human
ucccacugcacugcgaauuucucaguuccauuuuaccucccaguccuccuucuaaaccaguuaa

SEQ ID NO: 383646 - RNA, 64 nt, Human
gucagagcaagcaauuaggggccagccugccuccaccucccacccccuuccaccuccaucaguc

SEQ ID NO: 383647 - RNA, 64 nt, Human
cccugaccugcgcaccuagcuugacaucucacgcaccucccagagcuggcgccacugaguaauc

SEQ ID NO: 383648 - RNA, 64 nt, Human
caaacucccgaccucaaguagucugccugccucaaccucccaaagugcugggauuacaggcgug

SEQ ID NO: 383649 - RNA, 64 nt, Human
ggaacugggcgcuugcagugcguugcacacccucaccucccacccacugauuauuaauaaaguc

SEQ ID NO: 383650 - RNA, 64 nt, Human
ccaucguggguucccugagcccagccagccugggaccucccaaaguggguggcuuaccagacca

SEQ ID NO: 383651 - RNA, 64 nt, Human
agaagguugcucuagauugagagaagagacaaacaccucccaggagacaguucaagaaagcuuc

SEQ ID NO: 383652 - RNA, 64 nt, Human
ccgggcuggccugugccuaucaccucuuaugcacaccucccacccccuguauucccaccccugg

SEQ ID NO: 383653 - RNA, 64 nt, Human
gccagagguaccagcuucgccuggggcuucaagaaccucccaucuauccccauuccugagacag

SEQ ID NO: 383654 - RNA, 64 nt, Human
uuuacaaguuguagcaguugggggaaaacagucaaccucccaguguaaaaccaagauucccagu

SEQ ID NO: 383655 - RNA, 64 nt, Human
guccugcuggcuccucgggggcaggguucccuggaccucccaguucugcgccuuggggccagcc

SEQ ID NO: 383656 - RNA, 64 nt, Human
aggagccagugaugcucggccuugcgcccguuccaccucccaggccacccuuccugggcuucug

SEQ ID NO: 383657 - RNA, 64 nt, Human
cuacaccaccacccgcgcggcccccgcagccuagaccucccaggccugugacccuccacaccag

SEQ ID NO: 383658 - RNA, 64 nt, Human
cgggcucaggccccaccucccugccaguccuuggaccucccagcccacccagccucagcacagc

SEQ ID NO: 383659 - RNA, 64 nt, Human
gaugugauccggagucccuucccaccaggggcugaccucccagcugccccagcaagcucugccc

SEQ ID NO: 383660 - RNA, 64 nt, Human
ggcugauguucucugggacauuuucggaaauuugaccucccacuugucaugagcuacuuuugaa

SEQ ID NO: 383661 - RNA, 64 nt, Human
ggaugggcuuggccaaaacaggcucaggccaaagaccucccaagcuguauguacuuccaguauc

SEQ ID NO: 383662 - RNA, 64 nt, Human
caggcuggagugaucucagcucacugcaaccuccaccucccagguucaagcgacucuccugccu

SEQ ID NO: 383663 - RNA, 64 nt, Human; identical to SEQ ID NO: 383658

SEQ ID NO: 383664 - RNA, 64 nt, Human; identical to SEQ ID NO: 383659

SEQ ID NO: 383665 - RNA, 64 nt, Human
aggccaugacccugaaagccuagcccuggccuugaccucccaggagcgcccuccccgcccucuc

SEQ ID NO: 383666 - RNA, 64 nt, Human
caggacccaggucugcugcccaggaacccuccagaccucccagagagugaauaaagugugacuu

SEQ ID NO: 383667 - RNA, 64 nt, Human
gagauagcucccugagcugggccaucugacuucuaccucccauguuugcucucccaacucauua

SEQ ID NO: 383668 - RNA, 64 nt, Human
acucaagcuuagggaaacuucuuagggcaaacccaccucccacucuauucaaaguuaucucucu

SEQ ID NO: 383669 - RNA, 64 nt, Human
ugagagucccaucgccugcagcaccuggagacccaccucccaccccagugcacucuuuugggcc

SEQ ID NO: 383670 - RNA, 64 nt, Human
gggcagggaguguaccacacagggccauugucucaccucccaaagggaccgccugcccccagcu

SEQ ID NO: 383671 - RNA, 64 nt, Human
gagggggaaaaaaaccgccaccgggcugacuuccaccucccaguggugagcagugggggcccaa

SEQ ID NO: 383672 - RNA, 64 nt, Human
ugcccagcaggugccucgauucccugcccuugugaccucccaggaaacagaacugaucugggac

SEQ ID NO: 383673 - RNA, 64 nt, Human
cucuaggaaguguagaucagaaagugagguggugaccucccaccucuggucugguuaagagucu

SEQ ID NO: 383674 - RNA, 64 nt, Human
ucccucagcuucgcagcgccgcccgccaccccacaccucccacgcuaccgggcacgggcggccu

SEQ ID NO: 383675 - RNA, 64 nt, Human
cucgaucucuugaccucgugaucugcccgccuugaccucccaaagugccgggauuacaggcaug

SEQ ID NO: 383676 - RNA, 64 nt, Human
uggcggucaggagugagggcccagccuucccggcaccucccagccagguggcccugcccgaccu

SEQ ID NO: 383677 - RNA, 64 nt, Human
agguguacacggaggucucuguaaaagcagacccaccucccagcgccgggaagcccgucuuggg

SEQ ID NO: 383678 - RNA, 64 nt, Human
ucagucccugacuaacagccucagcacauccgacaccucccagcgugggaccccaagugaagac

SEQ ID NO: 383679 - RNA, 64 nt, Human
cucacagccccggcccccugugcagggccguaguaccucccagcagggugaagaguccaagaag

SEQ ID NO: 383680 - RNA, 64 nt, Human
ccuaguggugggcccugaugcugccaggccugggaccucccacugcccccuccacuggaggggu

SEQ ID NO: 383681 - RNA, 64 nt, Human
ccuuuauuccagcugccugccaccccagacccccaccucccacccugacccccgaccccugggu

SEQ ID NO: 383682 - RNA, 64 nt, Human
cccuuccacagcuggccugguuuccucgagaggcaccucccacacuccuauggucacagacuuc

SEQ ID NO: 383683 - RNA, 64 nt, Human
ggccaccggaucugagaggggggagccucaggacaccucccagccagaaggcucugagacauag

SEQ ID NO: 383684 - RNA, 64 nt, Human
ucgaaccaccuguaaucuaggcaccuuugccaacaccucccaaggauggaggacugggcgaggg

SEQ ID NO: 383685 - RNA, 64 nt, Human
ggggauaaaaagauguucagucauuuuuguuucuaccucccagaucggaucuguugcaaacuca

SEQ ID NO: 383686 - RNA, 64 nt, Human
cgcugcucggccugcugaugccacauaccaggcaaccucccaucccacccccgacccugcccug

SEQ ID NO: 383687 - RNA, 64 nt, Human
ucacccuucagcaacaugcagagucccugagcccaccucccagcccucuccucauucucugaac

SEQ ID NO: 383688 - RNA, 64 nt, Human
ucuggccucccugucucaagauacugagccucucaccucccagcccucagccacccccaucccu

SEQ ID NO: 383689 - RNA, 64 nt, Human
uccccacccucuaguguauuucacagaaaacaaaaccucccaauaaaacgguugaaaccugaau

SEQ ID NO: 383690 - RNA, 64 nt, Human
uagcaugggaaagaccugccuccaugauucaguuaccucccacugggucccucccacaacgugu

SEQ ID NO: 383691 - RNA, 64 nt, Human
aggaccacaucgauaguauuuaauaauuuguuuuaccucccaaaacacaguucuucuuucagcu

SEQ ID NO: 383692 - RNA, 64 nt, Human
uauugccaaggaccgggcccugccccgccacccuaccucccaccccagcagcccucucuucccc

SEQ ID NO: 383693 - RNA, 64 nt, Human
cguggauugucuccauuguccagacagugcccccaccucccaccgccuugccucacuggcaauc

SEQ ID NO: 383694 - RNA, 64 nt, Human
cucuguaacugccucccuuuaguucaauggacagaccucccaaggcaaaaacuaccuucugacu

SEQ ID NO: 383695 - RNA, 64 nt, Human
gaucagaggauaugacagcuuaccagcuaagaguaccucccaggaaacagucugacuaaugugg

SEQ ID NO: 383696 - RNA, 64 nt, Human
auuaacucuuccucucuucugauaaauuccccauaccucccaauccaaguagcaucuguagcua

SEQ ID NO: 383697 - RNA, 64 nt, Human
cagaucuuggggagagucccuuccuaccugacugaccucccauaaggcugaugcugauuuggcc

SEQ ID NO: 383698 - RNA, 64 nt, Human
gcgggcuuuggaaagggaggggagggagacccgaaccucccacguugggacucccacguuccgg

SEQ ID NO: 383699 - RNA, 64 nt, Human
uuaaagucccaguugaaauuuuuugaaaaaauacaccucccacaguucacaaauaacuuuuaag

SEQ ID NO: 383700 - RNA, 64 nt, Human; identical to SEQ ID NO: 200815

SEQ ID NO: 383701 - RNA, 60 nt, Human; identical to SEQ ID NO: 200819

SEQ ID NO: 383702 - RNA, 64 nt, Human; identical to SEQ ID NO: 200820

SEQ ID NO: 383703 - RNA, 64 nt, Human; identical to SEQ ID NO: 200821

SEQ ID NO: 383704 - RNA, 64 nt, Human; identical to SEQ ID NO: 200822

SEQ ID NO: 383705 - RNA, 64 nt, Human; identical to SEQ ID NO: 200823

SEQ ID NO: 383706 - RNA, 64 nt, Human; identical to SEQ ID NO: 200824

SEQ ID NO: 383707 - RNA, 64 nt, Human; identical to SEQ ID NO: 200825

SEQ ID NO: 383708 - RNA, 64 nt, Human; identical to SEQ ID NO: 200826

SEQ ID NO: 383709 - RNA, 64 nt, Human; identical to SEQ ID NO: 200827

SEQ ID NO: 383710 - RNA, 64 nt, Human; identical to SEQ ID NO: 200828

SEQ ID NO: 383711 - RNA, 64 nt, Human; identical to SEQ ID NO: 200829

SEQ ID NO: 383712 - RNA, 64 nt, Human; identical to SEQ ID NO: 200830

SEQ ID NO: 383713 - RNA, 64 nt, Human; identical to SEQ ID NO: 200831

SEQ ID NO: 383714 - RNA, 64 nt, Human; identical to SEQ ID NO: 200832

SEQ ID NO: 383715 - RNA, 64 nt, Human; identical to SEQ ID NO: 200833

SEQ ID NO: 383716 - RNA, 64 nt, Human; identical to SEQ ID NO: 200834

SEQ ID NO: 383717 - RNA, 64 nt, Human; identical to SEQ ID NO: 200838

SEQ ID NO: 383718 - RNA, 64 nt, Human; identical to SEQ ID NO: 200839

SEQ ID NO: 383719 - RNA, 64 nt, Human; identical to SEQ ID NO: 200840

SEQ ID NO: 383720 - RNA, 64 nt, Human; identical to SEQ ID NO: 200841

SEQ ID NO: 383721 - RNA, 64 nt, Human; identical to SEQ ID NO: 200842

SEQ ID NO: 383722 - RNA, 60 nt, Human; identical to SEQ ID NO: 200843

SEQ ID NO: 383723 - RNA, 64 nt, Human; identical to SEQ ID NO: 200844

SEQ ID NO: 383724 - RNA, 64 nt, Human; identical to SEQ ID NO: 200845

SEQ ID NO: 383725 - RNA, 64 nt, Human; identical to SEQ ID NO: 200846

SEQ ID NO: 383726 - RNA, 64 nt, Human; identical to SEQ ID NO: 200847

SEQ ID NO: 383727 - RNA, 52 nt, Human; identical to SEQ ID NO: 200848

SEQ ID NO: 383728 - RNA, 64 nt, Human; identical to SEQ ID NO: 200849

SEQ ID NO: 383729 - RNA, 64 nt, Human; identical to SEQ ID NO: 200850

SEQ ID NO: 383730 - RNA, 64 nt, Human; identical to SEQ ID NO: 200851

SEQ ID NO: 383731 - RNA, 64 nt, Human; identical to SEQ ID NO: 200852

SEQ ID NO: 383732 - RNA, 55 nt, Human; identical to SEQ ID NO: 200853

SEQ ID NO: 383733 - RNA, 64 nt, Human; identical to SEQ ID NO: 200857

SEQ ID NO: 383734 - RNA, 64 nt, Human; identical to SEQ ID NO: 200858

SEQ ID NO: 383735 - RNA, 64 nt, Human; identical to SEQ ID NO: 200859

SEQ ID NO: 383736 - RNA, 62 nt, Human
ccugagggucgaaggucgagcaggccggggguguccgggaggucuuugggcaucgcggucug

SEQ ID NO: 383737 - RNA, 62 nt, Human
gggcuccgcuauuugcaaauggaugccccaguguccgggauguguggccagcugcugcaggc

SEQ ID NO: 383738 - RNA, 54 nt, Human; identical to SEQ ID NO: 381798

SEQ ID NO: 383739 - RNA, 62 nt, Human
aggggaccauucuguucagugcgauccugaugguccgggagaugaggguuuccggggcuagu

SEQ ID NO: 383740 - RNA, 62 nt, Human
agcaggggguggcagagggcacccgggcgguaguccgggacgcgcaaggcagagcccugacg

SEQ ID NO: 383741 - RNA, 62 nt, Human
cccccuguccucucuggcuggggagcagggagguccgggagggugcggcugugcagccuguc

SEQ ID NO: 383742 - RNA, 62 nt, Human
agugaggagcgucuccgcccggcagccacccaguccgggagggaggugggggggucaguccc

SEQ ID NO: 383743 - RNA, 62 nt, Human
gggggucagucccccguccggccagccgccccguccgggaggugaggggcgccucugcccag

SEQ ID NO: 383744 - RNA, 62 nt, Human
gugaggagccccucugccccgccagccaccccguccgggagggaggugggggggucagcccc

SEQ ID NO: 383745 - RNA, 62 nt, Human
gggggucagccccccgcccggccagccgccccguccgggagggaggugggggaucagccccc

SEQ ID NO: 383746 - RNA, 62 nt, Human
ggggaucagccccccgcccggcuagccgccccguccgggaggcgaggggcgccucugcccgg

SEQ ID NO: 383747 - RNA, 62 nt, Human
gggggucagccccccgcccggccagccgcccgguccgggagggaggugggggggucagcccc

SEQ ID NO: 383748 - RNA, 62 nt, Human
gggggucagccccccgcccggccagccgccccguccgggagguuaggggcgccucugcccgg

SEQ ID NO: 383749 - RNA, 62 nt, Human
cuaggcucagccggaaccagcaccuccaaggaguccgggaggugccugugguuugcacccac

SEQ ID NO: 383750 - RNA, 62 nt, Human
cuuuuugaggccaagguaggaggauugcuugaguccgggagcucaaggcaaagcugcacaac

SEQ ID NO: 383751 - RNA, 62 nt, Human
acuuugggaccugcuuugugagccagcagcgaguccgggaggucuaccugaugaaccugagc

SEQ ID NO: 383752 - RNA, 62 nt, Human
ucauggcagucaaguccaauggcagcgucuucguccgggacuccucucaggugcacccgcua

SEQ ID NO: 383753 - RNA, 62 nt, Human
ggggcugggggccccacgaccugcagcgucgaguccgggagagagcccggagcggcgugcca

SEQ ID NO: 383754 - RNA, 62 nt, Human
ucuaguuccaaguuuuaaauacauggaaggaaguccgggagaaccauaugaaggagcaggag

SEQ ID NO: 383755 - RNA, 62 nt, Human
ucucggagaaaaaaaucacaaggcaacugugaguccgggaaucucuucucugauccuucuuc

SEQ ID NO: 383756 - RNA, 62 nt, Human
acagugaucagagagaggcugggguguguccuguccgggacccccccugccuuccugcucac

SEQ ID NO: 383757 - RNA, 62 nt, Human
ucaugacagacuaaggcaguggcuguggggcuguccgggaguucucuacagaaaacaucuaa

SEQ ID NO: 383758 - RNA, 62 nt, Human
ucaucauuucaguuccguaggucaguguugcgguccgggaagcguaucauaaccaccuggga

SEQ ID NO: 383759 - RNA, 62 nt, Human
ccccccuccuccccgcgccccagucacuuccuguccgggagcaguagucauuguuguuuuaa

SEQ ID NO: 383760 - RNA, 62 nt, Human
aguuuaccucaguuccgcaggcaggacagccgguccgggaacccugagugagaaugagugug

SEQ ID NO: 383761 - RNA, 62 nt, Human
cuggagcgcagggcuggugaauccaugacaagguccgggagcagcagaccaaaaccacagca

SEQ ID NO: 383762 - RNA, 62 nt, Human
ccccccucggcguccucucucgcggccgcucuguccgggagccauccccacccgccgggugu

SEQ ID NO: 383763 - RNA, 62 nt, Human
ccguccagaaagcuagcugcaguguucaggacguccgggaggaagcaagcaugugggggaca

SEQ ID NO: 383764 - RNA, 62 nt, Human
cauguuaguaauggcagagcagucuaaacagaguccgggagaaugcuggcaaaggcuggcug

SEQ ID NO: 383765 - RNA, 52 nt, Human; identical to SEQ ID NO: 381825

SEQ ID NO: 383766 - RNA, 62 nt, Human
uggagcaaggugggucugggagguagauauggguccgggaugugcuaucguaguuaucagag

SEQ ID NO: 383767 - RNA, 62 nt, Human
uuuccccaggacgcaagacucuccccuccacuguccgggacagcguucgcccuuuagcgggg

SEQ ID NO: 383768 - RNA, 62 nt, Human
accgggcucugacagcccugcggagacccugaguccgggaggcaccguccggcggcgagcuc

SEQ ID NO: 383769 - RNA, 62 nt, Human
auuuuuaaaaauccuaaguugaaucauuguuaguccgggaccuucaguacugccaaguccca

SEQ ID NO: 383770 - RNA, 62 nt, Human
uuuguguauuuuaaguuuacaguuuuuuauuaguccgggaaaagaaggcacaauaguuuucg

SEQ ID NO: 383771 - RNA, 62 nt, Human
gacagccccugucuucuuggcgugguuuauauguccgggaucuggaucagauucugggggcu

SEQ ID NO: 383772 - RNA, 62 nt, Human
gcccauggauggcugagcaccacuacgacuuaguccgggauaagggccuccccaguccucuc

SEQ ID NO: 383773 - RNA, 62 nt, Human
aucccggugacaugcucacccccaacccccguguccgggaccccggucuuguguggucccug

SEQ ID NO: 383774 - RNA, 62 nt, Human
gggguggaggguccugggagauagucccagggguccgggacagaguggagucaagagcugga

SEQ ID NO: 383775 - RNA, 62 nt, Human
gccacauucccucgacaacggcugcacgggcuguccgggauccggggugucuguccgcagac

SEQ ID NO: 383776 - RNA, 62 nt, Human
gugaggagcgucuacgcccgggcagcugccccguccgggagggaggugggggggucagcccc

SEQ ID NO: 383777 - RNA, 62 nt, Human
gggggucagccccccgcccggccagccgccccguccgggagggaggugggggggaucagccc

SEQ ID NO: 383778 - RNA, 62 nt, Human
ggggaucagccccccgcccggccagccgccccguccgggagggagguggggggcgccucugc

SEQ ID NO: 383779 - RNA, 62 nt, Human
ggugcugggcucuggccuucucaugcagagagguccgggacagggucaguaucgugggcaug

SEQ ID NO: 383780 - RNA, 62 nt, Human
gggugcaucugcuaaugggagaccaaaucuuuguccgggaagcaagaagugggugggagaau

SEQ ID NO: 383781 - RNA, 62 nt, Human
uuauuucuucaaugccucgaccugccgcagggguccgggauugggaauccgcccaucugggg

SEQ ID NO: 383782 - RNA, 62 nt, Human
ggaggguggggggcaggggucgggggucggguguccgggagccagggaagacuggaaaugcu

SEQ ID NO: 383783 - RNA, 62 nt, Human
cucguucuuccacacccuguccugguggggcuguccgggaagacaccuacccugugggcacu

SEQ ID NO: 383784 - RNA, 62 nt, Human
cgagagucuccagaugggggcaucagggugagguccgggacucuugggucaucgucccacag

SEQ ID NO: 383785 - RNA, 62 nt, Human
ccccacccccggcacccagcucucuacggcagguccgggagggcuggggcuucggggagccc

SEQ ID NO: 383786 - RNA, 62 nt, Human
aagaugaggucaucugccacuuucaggacauuguccgggagcccuucauuuaggacaaaacg

SEQ ID NO: 383787 - RNA, 62 nt, Human
caccaacuaagccagcugccacuguguacucgguccgggacccuuggcgacagaagacagcc

SEQ ID NO: 383788 - RNA, 62 nt, Human
aguuaccucaugucggugcccgcuggggagggguccgggaagaaggggaaggggugccuggc

SEQ ID NO: 383789 - RNA, 62 nt, Human
ggaaaccuggaguucagggcccagacuuugggguccgggagcugauggccccucucucccgg

SEQ ID NO: 383790 - RNA, 62 nt, Human
acuggauugcggaggagccucccgcagcacugguccgggacaagaugauggagugccacuuc

SEQ ID NO: 383791 - RNA, 62 nt, Human
uauucuacuccaagagauucugccucccuuguguccgggagaacaucaaugcuuuuccucag

SEQ ID NO: 383792 - RNA, 62 nt, Human
agguaaugacgggcacggccuccccacggccuguccgggaaagaccaggaccugcucgagcc

SEQ ID NO: 383793 - RNA, 64 nt, Human; identical to SEQ ID NO: 200815

SEQ ID NO: 383794 - RNA, 60 nt, Human; identical to SEQ ID NO: 200819

SEQ ID NO: 383795 - RNA, 64 nt, Human; identical to SEQ ID NO: 200820

SEQ ID NO: 383796 - RNA, 64 nt, Human; identical to SEQ ID NO: 200821

SEQ ID NO: 383797 - RNA, 64 nt, Human; identical to SEQ ID NO: 200822

SEQ ID NO: 383798 - RNA, 64 nt, Human; identical to SEQ ID NO: 200823

SEQ ID NO: 383799 - RNA, 64 nt, Human; identical to SEQ ID NO: 200824

SEQ ID NO: 383800 - RNA, 64 nt, Human; identical to SEQ ID NO: 200825

SEQ ID NO: 383801 - RNA, 64 nt, Human; identical to SEQ ID NO: 200826

SEQ ID NO: 383802 - RNA, 64 nt, Human; identical to SEQ ID NO: 200827

SEQ ID NO: 383803 - RNA, 64 nt, Human; identical to SEQ ID NO: 200828

SEQ ID NO: 383804 - RNA, 64 nt, Human; identical to SEQ ID NO: 200829

SEQ ID NO: 383805 - RNA, 64 nt, Human; identical to SEQ ID NO: 200830

SEQ ID NO: 383806 - RNA, 64 nt, Human; identical to SEQ ID NO: 200831

SEQ ID NO: 383807 - RNA, 64 nt, Human; identical to SEQ ID NO: 200832

SEQ ID NO: 383808 - RNA, 64 nt, Human; identical to SEQ ID NO: 200833

SEQ ID NO: 383809 - RNA, 64 nt, Human; identical to SEQ ID NO: 200834

SEQ ID NO: 383810 - RNA, 64 nt, Human; identical to SEQ ID NO: 200838

SEQ ID NO: 383811 - RNA, 64 nt, Human; identical to SEQ ID NO: 200839

SEQ ID NO: 383812 - RNA, 64 nt, Human; identical to SEQ ID NO: 200840

SEQ ID NO: 383813 - RNA, 64 nt, Human; identical to SEQ ID NO: 200841

SEQ ID NO: 383814 - RNA, 64 nt, Human; identical to SEQ ID NO: 200842

SEQ ID NO: 383815 - RNA, 60 nt, Human; identical to SEQ ID NO: 200843

SEQ ID NO: 383816 - RNA, 64 nt, Human; identical to SEQ ID NO: 200844

SEQ ID NO: 383817 - RNA, 64 nt, Human; identical to SEQ ID NO: 200845

SEQ ID NO: 383818 - RNA, 64 nt, Human; identical to SEQ ID NO: 200846

SEQ ID NO: 383819 - RNA, 64 nt, Human; identical to SEQ ID NO: 200847

SEQ ID NO: 383820 - RNA, 52 nt, Human; identical to SEQ ID NO: 200848

SEQ ID NO: 383821 - RNA, 64 nt, Human; identical to SEQ ID NO: 200849

SEQ ID NO: 383822 - RNA, 64 nt, Human; identical to SEQ ID NO: 200850

SEQ ID NO: 383823 - RNA, 64 nt, Human; identical to SEQ ID NO: 200851

SEQ ID NO: 383824 - RNA, 64 nt, Human; identical to SEQ ID NO: 200852

SEQ ID NO: 383825 - RNA, 55 nt, Human; identical to SEQ ID NO: 200853

SEQ ID NO: 383826 - RNA, 64 nt, Human; identical to SEQ ID NO: 200857

SEQ ID NO: 383827 - RNA, 64 nt, Human; identical to SEQ ID NO: 200858

SEQ ID NO: 383828 - RNA, 64 nt, Human; identical to SEQ ID NO: 200859

SEQ ID NO: 383829 - RNA, 62 nt, Human; identical to SEQ ID NO: 383736

SEQ ID NO: 383830 - RNA, 62 nt, Human; identical to SEQ ID NO: 383737

SEQ ID NO: 383831 - RNA, 54 nt, Human; identical to SEQ ID NO: 381798

SEQ ID NO: 383832 - RNA, 62 nt, Human; identical to SEQ ID NO: 383739

SEQ ID NO: 383833 - RNA, 62 nt, Human; identical to SEQ ID NO: 383740

SEQ ID NO: 383834 - RNA, 62 nt, Human; identical to SEQ ID NO: 383741

SEQ ID NO: 383835 - RNA, 62 nt, Human; identical to SEQ ID NO: 383742

SEQ ID NO: 383836 - RNA, 62 nt, Human; identical to SEQ ID NO: 383743

SEQ ID NO: 383837 - RNA, 62 nt, Human; identical to SEQ ID NO: 383744

SEQ ID NO: 383838 - RNA, 62 nt, Human; identical to SEQ ID NO: 383745

SEQ ID NO: 383839 - RNA, 62 nt, Human; identical to SEQ ID NO: 383746

SEQ ID NO: 383840 - RNA, 62 nt, Human; identical to SEQ ID NO: 383747

SEQ ID NO: 383841 - RNA, 62 nt, Human; identical to SEQ ID NO: 383748

SEQ ID NO: 383842 - RNA, 62 nt, Human; identical to SEQ ID NO: 383749

SEQ ID NO: 383843 - RNA, 62 nt, Human; identical to SEQ ID NO: 383750

SEQ ID NO: 383844 - RNA, 62 nt, Human; identical to SEQ ID NO: 383751

SEQ ID NO: 383845 - RNA, 62 nt, Human; identical to SEQ ID NO: 383752

SEQ ID NO: 383846 - RNA, 62 nt, Human; identical to SEQ ID NO: 383753

SEQ ID NO: 383847 - RNA, 62 nt, Human; identical to SEQ ID NO: 383754

SEQ ID NO: 383848 - RNA, 62 nt, Human; identical to SEQ ID NO: 383755

SEQ ID NO: 383849 - RNA, 62 nt, Human; identical to SEQ ID NO: 383756

SEQ ID NO: 383850 - RNA, 62 nt, Human; identical to SEQ ID NO: 383757

SEQ ID NO: 383851 - RNA, 62 nt, Human; identical to SEQ ID NO: 383758

SEQ ID NO: 383852 - RNA, 62 nt, Human; identical to SEQ ID NO: 383759

SEQ ID NO: 383853 - RNA, 62 nt, Human; identical to SEQ ID NO: 383760

SEQ ID NO: 383854 - RNA, 62 nt, Human; identical to SEQ ID NO: 383761

SEQ ID NO: 383855 - RNA, 62 nt, Human; identical to SEQ ID NO: 383762

SEQ ID NO: 383856 - RNA, 62 nt, Human; identical to SEQ ID NO: 383763

SEQ ID NO: 383857 - RNA, 62 nt, Human; identical to SEQ ID NO: 383764

SEQ ID NO: 383858 - RNA, 52 nt, Human; identical to SEQ ID NO: 381825

SEQ ID NO: 383859 - RNA, 62 nt, Human; identical to SEQ ID NO: 383766

SEQ ID NO: 383860 - RNA, 62 nt, Human; identical to SEQ ID NO: 383767

SEQ ID NO: 383861 - RNA, 62 nt, Human; identical to SEQ ID NO: 383768

SEQ ID NO: 383862 - RNA, 62 nt, Human; identical to SEQ ID NO: 383769

SEQ ID NO: 383863 - RNA, 62 nt, Human; identical to SEQ ID NO: 383770

SEQ ID NO: 383864 - RNA, 62 nt, Human; identical to SEQ ID NO: 383771

SEQ ID NO: 383865 - RNA, 62 nt, Human; identical to SEQ ID NO: 383772

SEQ ID NO: 383866 - RNA, 62 nt, Human; identical to SEQ ID NO: 383773

SEQ ID NO: 383867 - RNA, 62 nt, Human; identical to SEQ ID NO: 383774

SEQ ID NO: 383868 - RNA, 62 nt, Human; identical to SEQ ID NO: 383775

SEQ ID NO: 383869 - RNA, 62 nt, Human; identical to SEQ ID NO: 383776

SEQ ID NO: 383870 - RNA, 62 nt, Human; identical to SEQ ID NO: 383777

SEQ ID NO: 383871 - RNA, 62 nt, Human; identical to SEQ ID NO: 383778

SEQ ID NO: 383872 - RNA, 62 nt, Human; identical to SEQ ID NO: 383779

SEQ ID NO: 383873 - RNA, 62 nt, Human; identical to SEQ ID NO: 383780

SEQ ID NO: 383874 - RNA, 62 nt, Human; identical to SEQ ID NO: 383781

SEQ ID NO: 383875 - RNA, 62 nt, Human; identical to SEQ ID NO: 383782

SEQ ID NO: 383876 - RNA, 62 nt, Human; identical to SEQ ID NO: 383783

SEQ ID NO: 383877 - RNA, 62 nt, Human; identical to SEQ ID NO: 383784

SEQ ID NO: 383878 - RNA, 62 nt, Human; identical to SEQ ID NO: 383785

SEQ ID NO: 383879 - RNA, 62 nt, Human; identical to SEQ ID NO: 383786

SEQ ID NO: 383880 - RNA, 62 nt, Human; identical to SEQ ID NO: 383787

SEQ ID NO: 383881 - RNA, 62 nt, Human; identical to SEQ ID NO: 383788

SEQ ID NO: 383882 - RNA, 62 nt, Human; identical to SEQ ID NO: 383789

SEQ ID NO: 383883 - RNA, 62 nt, Human; identical to SEQ ID NO: 383790

SEQ ID NO: 383884 - RNA, 62 nt, Human; identical to SEQ ID NO: 383791

SEQ ID NO: 383885 - RNA, 62 nt, Human; identical to SEQ ID NO: 383792

SEQ ID NO: 383886 - RNA, 64 nt, Human
cacaccacuggguuugccagaaacagggaaggagggcguuaagggaaaaaaaaaauccucaaau

SEQ ID NO: 383887 - RNA, 64 nt, Human
uucaguaguacauuugggaaaagaaggggcugauggcguuaaccagguucucaauauagaacug

SEQ ID NO: 383888 - RNA, 64 nt, Human
gccacagggaugggguaucuucagcaagagagagggcguuaaagauguaaaaugcuuuguccau

SEQ ID NO: 383889 - RNA, 64 nt, Human
auaguguuugcugaauuaagccgaugggggcaguggcguuaagugguggaaaaaggaaaguaua

SEQ ID NO: 383890 - RNA, 64 nt, Human
ggaaaguagaaauuuaccaagguuguuggcccagggcguuaaauucacagauuuuuuuaacgag

SEQ ID NO: 383891 - RNA, 64 nt, Human
gaggauuucagcuauaacugaggacaaucaccagggcguuaagggggcuuuaguguuuuggcug

SEQ ID NO: 383892 - RNA, 64 nt, Human
aagccuuuuugagguguagagauucucagguccaggcguuaaaaaauaauggucaaaagaauaa

SEQ ID NO: 383893 - RNA, 64 nt, Human
caugagggagggggcgggggacugaaggggaaagggcguuaaagugauacauuuuuauaccaaa

SEQ ID NO: 383894 - RNA, 64 nt, Human
uguuucugauuugaccuucaucccuuaguuuacuggcguuaaaaaaagucucagcaauuuucau

SEQ ID NO: 383895 - RNA, 64 nt, Human
cccagguggccccgcuuucuccauucugcccuguggcguuaacagacagcaagcagcugaacaa

SEQ ID NO: 383896 - RNA, 64 nt, Human
acuucguacuucuguauagaacuaacagcaaaaaggcguuaaacagcaagugucaucuacaucc

SEQ ID NO: 383897 - RNA, 64 nt, Human
acaaacuguuucugcaucccagggcucugacgaaggcguuaagaaacagaugcuguucccgcgu

SEQ ID NO: 383898 - RNA, 64 nt, Human
agcgcuggguucugcagcagggcucagccucaggggcguuaagacccuggaugacaucaauaaa

SEQ ID NO: 383899 - RNA, 64 nt, Human
gcuauuguuuuaaaaaaauaauuaaaaaacaguuggcguuaauaaaaaugucaaugugaaacug

SEQ ID NO: 383900 - RNA, 64 nt, Human
uggauauggaggaacaagcaaucuuauuuuggaaggcguuaaaaaauuaucugacaguuacaug

SEQ ID NO: 383901 - RNA, 64 nt, Human
uguaaaucauucuacuuuugcacuuugaaagaaaggcguuaaucauaaagaagcaagaaugguc

SEQ ID NO: 383902 - RNA, 64 nt, Human
caguauucagauaccccuucugcucagccugcuuggcguuaaaauacaaaucauugaacugagg

SEQ ID NO: 383903 - RNA, 64 nt, Human
uuagaagcuaacuucccugagacugcauggcucaggcguuaauaauggacauaaaaagucauaa

SEQ ID NO: 383904 - RNA, 64 nt, Human
ugguaucugucaaugaggauccuugcccucacagagcacgcagccuagaugcagagagcugcua

SEQ ID NO: 383905 - RNA, 64 nt, Human
aagacaguaccuuuuccucucacauuggcagaauagcacgcacuagaugccugaccuugagcuc

SEQ ID NO: 383906 - RNA, 64 nt, Human
cacaaggccggggacacccaugccaagcagugggagcacgcaggacagacacagcaggggucug

SEQ ID NO: 383907 - RNA, 64 nt, Human
uucuuacugaaugguucauguaggcuugcugaacagcacgcauuacuugcuuccugaagaguuc

SEQ ID NO: 383908 - RNA, 64 nt, Human
agaggcugcagccuaacgugugguuuuaaugaccagcacgcaaggcaaaagcauuuugcacagu

SEQ ID NO: 383909 - RNA, 64 nt, Human
cccgucucuacauaaaaaauuagcugggugugguagcacgcaccuguagucccagcuacuuggg

SEQ ID NO: 383910 - RNA, 64 nt, Human
ucuucugcauaaaauuaccuacuuaaucaagauaagcacgcauuuuuguugccuugguuuuacc

SEQ ID NO: 383911 - RNA, 64 nt, Human
ugcuucucaucagaugacguggcuuugucuagacagcacgcaguucagaaagaaaugucuuuau

SEQ ID NO: 383912 - RNA, 64 nt, Human
cggauagggcacugagggguggcgcgcggccaggagcacgcaugguauugacuuaaaagguuca

SEQ ID NO: 383913 - RNA, 64 nt, Human
cugggggccaccucagaagugucaucucucucugagcacgcauuccccugcagcagucgaggac

SEQ ID NO: 383914 - RNA, 64 nt, Human
ugcagagcaugguuuguauaccacaagcccucuuagcacgcaaaagccaaaaucuaaagaucaa

SEQ ID NO: 383915 - RNA, 64 nt, Human
cucauggaucugcauaaccgcacagacauugacaagcacgcacacacacgcaaauacaugccuu

SEQ ID NO: 383916 - RNA, 64 nt, Human
ugggcagcagcgagcuggcaggugaagugugagcagcacgcaaagugucacgugggccuuagcc

SEQ ID NO: 383917 - RNA, 62 nt, Human
guggaaacaaggaaaacugauuaagagaaaugagcacgcauggaaaaguuucccagucuuca

SEQ ID NO: 383918 - RNA, 64 nt, Human
cgacccggcucucggggcgcuagugacggaaagcagcacgcauaucuuugcgggaagaaucuag

SEQ ID NO: 383919 - RNA, 64 nt, Human
caacacacuuaggggaggaguggccccagaauucagcacgcacacaacacacaagggagagaac

SEQ ID NO: 383920 - RNA, 64 nt, Human
cuccacagcaaccaaucacaaccauaaagcuacaagcacgcacugaagcacuuuacugauacuc

SEQ ID NO: 383921 - RNA, 64 nt, Human
ccccuugauuucucaggagcgucugggggggcucagcacgcacaaacuccuucuccuucuacca

SEQ ID NO: 383922 - RNA, 64 nt, Human
gauaaauguaaaauaucuaaagcaugaaucuaagagcacgcaauauauaauuuuaaagaaaaua

SEQ ID NO: 383923 - RNA, 64 nt, Human
agagaaccuuguuucugcaggaagccuagcuccaagcacgcagucuguagacauuuuugccuuu

SEQ ID NO: 383924 - RNA, 64 nt, Human
agggaacagaaguggaggaaacaaaagaagcagcagcacgcacaguccugucgcugggugcgga

SEQ ID NO: 383925 - RNA, 64 nt, Human
ugccccuguugacguggaaugcugugucugcuuuagcacgcacgcuccgaaugacuccuggugc

SEQ ID NO: 383926 - RNA, 64 nt, Human
gcuguugcucucguccgccucccuuccacagguaagcacgcaagacacagguaccgugugcccc

SEQ ID NO: 383927 - RNA, 64 nt, Human
ccuagcccuuuccugcccugcagucugcagugccagcacgcaaaucccuucaccacaggguuuc

SEQ ID NO: 383928 - RNA, 64 nt, Human
aagcagaaagcucuauaccaagaaguccaaacccagcacgcaacagcccaacauaaccuagaau

SEQ ID NO: 383929 - RNA, 64 nt, Human
uguagacaguucccauaacuguccacggcccuggagcacgcacccaggggcagagccugcccuu

SEQ ID NO: 383930 - RNA, 64 nt, Human
aaacucuaauacccauccauugugcaaaaccacaagcacgcaaguauuaaauaagagcaagcug

SEQ ID NO: 383931 - RNA, 64 nt, Human
ggggaagaaagcagcccagggugccaugccugacagcacgcaucucccugaccccugcacuucc

SEQ ID NO: 383932 - RNA, 64 nt, Human
gcagugcugcuggaaauggcuucuuuaaacugugagcacgcagagcaccccuucuccagcggug

SEQ ID NO: 383933 - RNA, 52 nt, Human
cccagcgcuacuccagauaaagagcacgcaucagcaucgcagccacuccagc

SEQ ID NO: 383934 - RNA, 64 nt, Human
uuguugguauaccaaugcaauacuaaguugaugaagcacgcagcucaaaugaucacauuagaug

SEQ ID NO: 383935 - RNA, 63 nt, Human
cugcaaauggucaguuguaguauuugcuaaaaaagcacgcaggacauggcuaaagaccuuaac

SEQ ID NO: 383936 - RNA, 64 nt, Human
gaagcccagccagccccagacuccagugcaccagagcacgcacaggagccugggcgcgcugcug

SEQ ID NO: 383937 - RNA, 64 nt, Human
gagcuccagcuguugggacaccaaggagccugggagcacgcagaggccuguguucacucuuugg

SEQ ID NO: 383938 - RNA, 64 nt, Human
cuccuguccucaggccgugcggcacgacauggccagcacgcagaaggagcccucccgggaccca

SEQ ID NO: 383939 - RNA, 64 nt, Human
aacacucugcuguguggcauggcagaaggaggccagcacgcagccccuccagcuccacguggag

SEQ ID NO: 383940 - RNA, 64 nt, Human
gucuucaauguuaauaaguuucuguacaguaauaagcacgcagaauucuuuagagaaaaagaaa

SEQ ID NO: 383941 - RNA, 64 nt, Human
aaugaauugaaauggggcgcuggacaccuacagcagcacgcaugucccuccaaggcugucuucu

SEQ ID NO: 383942 - RNA, 64 nt, Human
ccugccaccacagcacgcggccuccugauccggaagcacgcagcauguucccugcugagcggag

SEQ ID NO: 383943 - RNA, 64 nt, Human
aaaaggaauggaaaguacccagaacuaugccuggagcacgcacgacacacguacagugaguugg

SEQ ID NO: 383944 - RNA, 64 nt, Human
uggcagagugagaaggccacugguucugugccgcagcacgcaaaauuuagaauucuacagacua

SEQ ID NO: 383945 - RNA, 64 nt, Human
ugcuggaguuccggccugggcaccagcauuuggcagcacgcaggcggggcaguaugugauggac

SEQ ID NO: 383946 - RNA, 64 nt, Human
cagcgugaagggccacagccccucuuggcugccaagcacgcagaucccauggacauuuggggaa

SEQ ID NO: 383947 - RNA, 64 nt, Human
gaggcauagagggcccugggggucaugggaagcgagcacgcagcaggcgugcccaggagcgugu

SEQ ID NO: 383948 - RNA, 64 nt, Human
gcugcccucccuccccagcuuacaccucaagcccagcacgcagugcaccuugaacagagggagg

SEQ ID NO: 383949 - RNA, 64 nt, Human
cccaggggcuggucccagaacaggcagucucacaagcacgcagcacacuggaguggacgccugu

SEQ ID NO: 383950 - RNA, 64 nt, Human
ggaggaggauggugaccuugggagucgcccugucagcacgcacaugcuugggacccacuccaca

SEQ ID NO: 383951 - RNA, 64 nt, Human
ucugagaaagggaggcuagcauguguucaagguuagcacgcaacagaauuuccuaaaaucagaa

SEQ ID NO: 383952 - RNA, 64 nt, Human
accggcuucuucgcgcacgcugguuucugcuuggagcacgcaucguguccaccuggugccggcg

SEQ ID NO: 383953 - RNA, 64 nt, Human
accugugguauuggccaggaggccugagaaagcaagcacgcacucucagucaacaugacagauu

SEQ ID NO: 383954 - RNA, 64 nt, Human
ucuugucucagccuccugaguagcugagauuauaagcacgcaccaucauacccgacuaauuuuu

SEQ ID NO: 383955 - RNA, 64 nt, Human
uauuauaguacugcuuuacuguguaucucaauaaagcacgcaguuauguuacaaaaaaguauug

SEQ ID NO: 383956 - RNA, 64 nt, Human
cugccucagugucuuugccagaaaaaggcaaagaggcggacagugcagggcuccucccuccuac

SEQ ID NO: 383957 - RNA, 58 nt, Human
agucauauaugcacaguuagaccacuccggcggacaucacagugacaagauuaacaag

SEQ ID NO: 383958 - RNA, 64 nt, Human
cccaagaauuguaggacagagaccacacugggucggcggacacaaaguccauccaggacccagg

SEQ ID NO: 383959 - RNA, 64 nt, Human
aaacaggugaggucaggucacugcggacaucaagggcggacaccaccaaggggcccucuggaac

SEQ ID NO: 383960 - RNA, 64 nt, Human
uaggccagcaaccagggaagcucuuagaaucccaggcggacacccuuucucaaaagauaucccc

SEQ ID NO: 383961 - RNA, 64 nt, Human
ggcagcuucaugaccgaugucuggcugaggcuguggcggacacucucgggguugucugcaggag

SEQ ID NO: 383962 - RNA, 64 nt, Human
ccuuguuucagugguccuacaaagguagauggugggcggacaccgaagucaacuugacuguaaa

SEQ ID NO: 383963 - RNA, 64 nt, Human
cagcucgggugaggggugaguggaggagacccauggcggacaaucacucucucugcucucagga

SEQ ID NO: 383964 - RNA, 64 nt, Human
cuaacgugcugcccaggauggccuccucuugacaggcggacagggggugagggggccagggggc

SEQ ID NO: 383965 - RNA, 64 nt, Human
ggguacauuaaaggaacaugcugcccagggccugggcggacagcucagugggcaggaugugugc

SEQ ID NO: 383966 - RNA, 64 nt, Human
ucacgccuguaaccucagcacuuugggaggccgaggcggacagaucacgaggucaggaguucga

SEQ ID NO: 383967 - RNA, 64 nt, Human
gacaguaugauccagaaugucagguguggaguugggcggacaagagucugcugaugaggacaac

SEQ ID NO: 383968 - RNA, 64 nt, Human
ggacgauggcuuugccagcuuaaaguaaccggauggcggacaccuggcccccgaggucccccgg

SEQ ID NO: 383969 - RNA, 64 nt, Human
cagauaaaguauuacauguguuugauuuuaaaagggcggacauuuuauuaaaaucaauauuguu

SEQ ID NO: 383970 - RNA, 64 nt, Human
guguggaagccacgggcucaagcagccaaggcagggcggacagugugagagagcuaguguaagc

SEQ ID NO: 383971 - RNA, 64 nt, Human
gugcugugacgacugucaaagaguaucuggccauggcggacacucagcauuuguugauugaaua

SEQ ID NO: 383972 - RNA, 64 nt, Human
cuuggugacuagauuucagccuaugaauucuggaggcggacacaaaaauucagauuaaacuacu

SEQ ID NO: 383973 - RNA, 64 nt, Human
ucauucacugucuuucuccaagaaaaguauuuugggcggacagucagaucaagcaguaaaauua

SEQ ID NO: 383974 - RNA, 64 nt, Human
aaauggcuuccaggacagagcaugcucauuugcuggcggacaguuccagaaacagacccuguua

SEQ ID NO: 383975 - RNA, 64 nt, Human
uaugacuaacucaccaaacaaugccaaggagaaaggcggacaggucaccaucaccuuucaucga

SEQ ID NO: 383976 - RNA, 64 nt, Human
accuacccccugccgcacagcccagcaggagggaggcggacagccagaugcagagcgaguggau

SEQ ID NO: 383977 - RNA, 64 nt, Human
ugauccugcuggugcugcuggaggcucuggcccaggcggacacacagaagaugguggaagccca

SEQ ID NO: 383978 - RNA, 64 nt, Human
ugguucauuccuuucagccaucguccuuuccuccggcggacagcugcuuacauguucaucucuu

SEQ ID NO: 383979 - RNA, 64 nt, Human
aacuccagcaugcaaguccacgagguggggugcaggcggacaggcgggcuuugcaaugaucccc

SEQ ID NO: 383980 - RNA, 64 nt, Human
aaggugcuuuaaaugucacauuuguaaaggggaaggcggacaagauuuggaaguuuagucaccu

SEQ ID NO: 383981 - RNA, 64 nt, Human
ccgccuccccgcguagcuggagcagcccaggcccggcggacagccucuuccugcagcgccggua

SEQ ID NO: 383982 - RNA, 64 nt, Human
aacgagauugcuggaaaccaagucaggccaggugggcggacaaaagggccaggugcggccuggg

SEQ ID NO: 383983 - RNA, 64 nt, Human
ccauacgugacagccagaggcccagcguuaucaaggcggacaauuagacucuugagaacacacu

SEQ ID NO: 383984 - RNA, 64 nt, Human
aaugucuuuggaaugguguuuaacuaaugcugcuggcggacauccuaaaaccagaugcauccuc

SEQ ID NO: 383985 - RNA, 64 nt, Human
cucccgcccucaccugcagagaaacgcgcuccuuggcggacacugggggaggagaggaagaagc

SEQ ID NO: 383986 - RNA, 64 nt, Human
ccccacaauguuaaauucuguagaucccaauguuggcggacagguuauggacauucaugcccaa

SEQ ID NO: 383987 - RNA, 64 nt, Human
cagaccacacagaccgucugaaaugcgcccgccuggcggacagcucccuucugaagcagagaag

SEQ ID NO: 383988 - RNA, 64 nt, Human
agagaaaggacgucgcuguugaaaugugaaucccggcggacacgccaaauugcgaggcgacgga

SEQ ID NO: 383989 - RNA, 64 nt, Human
ugcagggagcaggaaaucagugcuggggguggugggcggacaauaggaucacugccugccagau

SEQ ID NO: 383990 - RNA, 64 nt, Human
aauagaggugaugcugcuaaagggagaaaugccaggcggacaaaguucagugucgggaauuuuc

SEQ ID NO: 383991 - RNA, 64 nt, Human
cucaugccuguaauccagcacuuugggaggccaaggcggacagaccaccugaggucaggaguuc

SEQ ID NO: 383992 - RNA, 64 nt, Human
uuuugcaggaaucucucccguuacuugaaaccugggcggacagaugaggggaaggcugaggucc

SEQ ID NO: 383993 - RNA, 64 nt, Human
uguggagcgccagcucugcccaaggcgccaccugggcggacagccaggagcucuccauggccag

SEQ ID NO: 383994 - RNA, 50 nt, Human
aggaugaaauccgugugugaggcggacaguggguggccaccgggagcucu

SEQ ID NO: 383995 - RNA, 64 nt, Human
caggagagaguccuguagcucuggggggaaagagggcggacaggccccucccucugcccucucc

SEQ ID NO: 383996 - RNA, 64 nt, Human
gacuccacucacaagccuccugaugucaaggacaggcggacagggcuggccucccccagucccc

SEQ ID NO: 383997 - RNA, 64 nt, Human
auagccaggucuuccuggcccuugaggcugggcuggcggacaggcaccuaccucuuccuuaagc

SEQ ID NO: 383998 - RNA, 64 nt, Human
gagccuuuggacuucucuccaagccccugugggaggcggacagcagugaccaccuccccuucuu

SEQ ID NO: 383999 - RNA, 64 nt, Human
cuggugcaguagcuaccgccugacagccccuagaggcggacacacagcgacccccaucccugca

SEQ ID NO: 384000 - RNA, 64 nt, Human
uccccuagugugcccaagucagccucauauucugggcggacagcuugucuggacuucggaguug

SEQ ID NO: 384001 - RNA, 64 nt, Human
gaggaggucgugggacggggagggugggauggacggcggacaggcaguccccacgcugcugggu

SEQ ID NO: 384002 - RNA, 60 nt, Human
ggaccccucugcacgucuaggcugggaguaggcggacagccagggcgcuugaccacuggu

SEQ ID NO: 384003 - RNA, 64 nt, Human
gugucuuaaggcaggacgacuuggaaaaaaaggcggcggacaguuggccagagggauggagacu

SEQ ID NO: 384004 - RNA, 64 nt, Human
ggcuguggccugccaccuuccuuagagugaauagggcggacacuccucucuuuuccuguagcgu

SEQ ID NO: 384005 - RNA, 64 nt, Human
ccaacacagagcucacacaggucacugcucucuaggcggacacacccugggcccugagcaucca

SEQ ID NO: 384006 - RNA, 58 nt, Human
gggaaccugcuggcuacugauugcuccaggcggacaaggcugacaagcaauccaggaa

SEQ ID NO: 384007 - RNA, 64 nt, Human
gacggucugggacguggcagacggacggacccucggcggacagguggucggcgucggggugcgg

SEQ ID NO: 384008 - RNA, 64 nt, Human
cguggagucaccgucuacugccagccgggagcugggcggacaggaccgucccucgcaggguccc

SEQ ID NO: 384009 - RNA, 64 nt, Human
accgaagucuaaaggucccaguccaucuccuggaggcggacagauggccuggaaaccucuggcu

SEQ ID NO: 384010 - RNA, 64 nt, Human
uauauaucgacauacauauauauuuuugggggggggcggacaggagaugggugcaacucccucc

SEQ ID NO: 384011 - RNA, 64 nt, Human
cacggacgagggcgacacagacacgggaccgaggggcggacaccggagagacacgggaaagggg

SEQ ID NO: 384012 - RNA, 64 nt, Human
ggaggccagaccaagggaggcacgcgcgcugccgggcggacagaggcugaggcucacaccccac

SEQ ID NO: 384013 - RNA, 64 nt, Human
cauuauuuaccccacaacuucaaauaguuucuucacggacuaggcaugcagaaauaagcagugg

SEQ ID NO: 384014 - RNA, 64 nt, Human
uacacucauucuuaacuuuucgcaaacguuucacacggacuaaucuuucugaacuguaaauauu

SEQ ID NO: 384015 - RNA, 64 nt, Human
gagcauguuacagauaauauagaguuauaauaaaacggacuaugacucuuuucauuggauuuug

SEQ ID NO: 384016 - RNA, 64 nt, Human
acagguuguugaaauggccaacacugguacagacacggacuauaaaaaucuccaagcuugugcu

SEQ ID NO: 384017 - RNA, 64 nt, Human
ccucaggagcagugggaccaccugaugcugaaggacggacuaaugauguuuccucuugccuucu

SEQ ID NO: 384018 - RNA, 64 nt, Human
uuuuuucccaugagaugaagcacaugugacgaauacggacuagauaaccucuaagaauuuucca

SEQ ID NO: 384019 - RNA, 64 nt, Human
agaaacguuuauauccugugauuacucuaggaaaggggcguauuaacgguccuuugcuuccccg

SEQ ID NO: 384020 - RNA, 64 nt, Human
auuaaggaaaaaagcaaguuugaagagaccacauggggcguacuauuuuuauugagcccaaaaa

SEQ ID NO: 384021 - RNA, 64 nt, Human
aguucagcggggcagcuugucucccuugucagcaggggcguaagggcuggguuuggccauacaa

SEQ ID NO: 384022 - RNA, 64 nt, Human
ugugagugugcaccacgcauuggcauccaaggccacggacuaugagaagaaaccaaacguguuu

SEQ ID NO: 384023 - RNA, 64 nt, Human
ucucccaguuguucaguuucugagacagagagguacggacuaggcugcaccugagugugccccu

SEQ ID NO: 384024 - RNA, 64 nt, Human
aauuuaguuuggguguuccucaucacauguauauacggacuauccauugaacuuaaucugugug

SEQ ID NO: 384025 - RNA, 62 nt, Human
ugaaacuugauauaaaaugaaggagggagaugacggacuagaagacuguaaauaagauacca

SEQ ID NO: 384026 - RNA, 64 nt, Human
ugcaggcuuggaguccagaguuggugcugugggaacggacuagagagaguugcgggagagagaa

SEQ ID NO: 384027 - RNA, 64 nt, Human
uguuuauaaaccacaggugccauaagauccccaaacggacuaaaguuaucucugcucuuccaug

SEQ ID NO: 384028 - RNA, 64 nt, Human
uaagaccuauguaaaaggaaagcuguuccaacacacggacuauuuuuguacuagaauuugcuaa

SEQ ID NO: 384029 - RNA, 64 nt, Human
auguguaagugaaaucaguugugugcaauagacaggggcguauucaugggagcaucagccaguu

SEQ ID NO: 384030 - RNA, 64 nt, Human
uugaugggaggagagacgaggcauucgggccgguggggcguaaggguuaucguuaagcacaaga

SEQ ID NO: 384031 - RNA, 64 nt, Human
acuuuggcuucuccugugaccccaccuugacgguggggcguagacuugacaacaucccacagug

SEQ ID NO: 384032 - RNA, 64 nt, Human
uucccaagauggagaugcuaacgaaacugagaagggggcguauguuugacgaagguuugugcaa

SEQ ID NO: 384033 - RNA, 64 nt, Human
cugcgccugugaugcugggcacuucaucugaucgggggcguagcaucauaguaguuuuuacagc

SEQ ID NO: 384034 - RNA, 64 nt, Human
uggcugauuaaauggccaucugauggcugaaagaggggcguauuuuucacucuguagugaaagg

SEQ ID NO: 384035 - RNA, 64 nt, Human
ggagaccuauuuuuguacaaagaacccuugaccuggggcguaauaaagaugaccuggaccccug

SEQ ID NO: 384036 - RNA, 64 nt, Human
uuuggaauuugacuuuccauuucugagacccaagggggcguagauguaguggcaaguguggcga

SEQ ID NO: 384037 - RNA, 64 nt, Human
aucucucucucauauauacauaugaaaggcacucggggcguaucgaggcugcugcuggcuguga

SEQ ID NO: 384038 - RNA, 64 nt, Human
ggugcagcccacggagggugagcugaagcaggguggggcguaaccucaccugggaagugcaagg

SEQ ID NO: 384039 - RNA, 64 nt, Human
aucacggugcugcaaugaccggaagucgccccugggggcguagcacagcgucuucucggaggcu

SEQ ID NO: 384040 - RNA, 64 nt, Human
caggggccacccgggguuggggugggagugugguggggcguagugguggcaggacaagagaagg

SEQ ID NO: 384041 - RNA, 64 nt, Human
gcaacaaggaacgaaugguagcagccagcuuugcggggcguauguguggccagcucuuaaccau

SEQ ID NO: 384042 - RNA, 64 nt, Human
agugaggcugggcagauggucucggagccuccauggggcguagcaggaaccgggcuuggcuucc

SEQ ID NO: 384043 - RNA, 64 nt, Human
aggggugagguggggacaggccucagcagggaauggggcguauauguuaguguugcugcaacaa

SEQ ID NO: 384044 - RNA, 64 nt, Human
cugacuuccgucggcugugaauccuugucugucaggggcguauccacaaaaucaccgaauucau

SEQ ID NO: 384045 - RNA, 64 nt, Human
gggagggagggaggagggagaaaaacagaauccagccgcuuaggcuuugaugaacucccaggcc

SEQ ID NO: 384046 - RNA, 64 nt, Human
ccuccuccaagcucccacaaugcuucauggcucugccgcuuaccuagcuuggccuagaguggca

SEQ ID NO: 384047 - RNA, 64 nt, Human
aguggaauuugucagcagauaucaguaacuuauugccgcuuauauuguacaauguuaaacuuca

SEQ ID NO: 384048 - RNA, 64 nt, Human
aggcccauuuaccuuccccuguacuggcaguucagccgcuuacaugcacucacccuguuugugg

SEQ ID NO: 384049 - RNA, 64 nt, Human
uuuuuaccuauguauuuaucguucuugaucauaagccgcuuauuuauaucauguaucucuaagg

SEQ ID NO: 384050 - RNA, 64 nt, Human
uggaggaaagggaacucacccaacucuaaauugugccgcuuagacuuagcugucagugugacuu

SEQ ID NO: 384051 - RNA, 55 nt, Human
uucaccugaaaagcaugugacugaagccgcuuagugcuguggccucacugcaggc

SEQ ID NO: 384052 - RNA, 64 nt, Human
ucugggcaucguucccagugucccucacacuaaaacggcguagauggcaaccccccacccccac

SEQ ID NO: 384053 - RNA, 64 nt, Human
aaguaagcuuuauuuguagcuucugccuuguuugacggcguaucuauucagggaagcgcacagu

SEQ ID NO: 384054 - RNA, 64 nt, Human
acaaguuccaagaagaagaugaagcuccgccuccgccgcuuagucccaacccugcccaggaaga

SEQ ID NO: 384055 - RNA, 64 nt, Human
gggcagcuguccugaaccgacugacccugaggaggccgcuuagugcugcuuugcuuuucaucac

SEQ ID NO: 384056 - RNA, 64 nt, Human
aggaccuuucagaggagcuaagcauuuaucagcugccgcuuauucauugccuugauuuucuuca

SEQ ID NO: 384057 - RNA, 64 nt, Human
cauuucuccagggcggggugggaaucgguugagagccgcuuagcccgagccuuggaggagccgg

SEQ ID NO: 384058 - RNA, 64 nt, Human
ccuuugcuggugggaggagcucgugugcuccuuggccgcuuacuggaagggcguuuuucagagc

SEQ ID NO: 384059 - RNA, 64 nt, Human
cucacuuugaagagugugaggaaaaccuauguuugccgcuuaagcuuucagcucagcuaaugaa

SEQ ID NO: 384060 - RNA, 64 nt, Human
uugaaaauaaacuggaaugaucaucuuggcuugggccgcuuaggaacaagaaccggagagaagu

SEQ ID NO: 384061 - RNA, 64 nt, Human
uuggagaucauauuggugaagccaugcuccaacugccgcuuacaauuugucagagggaugcguc

SEQ ID NO: 384062 - RNA, 64 nt, Human
gugcuucauugaggcuaagucucaggguguuucugccgcuuaguaucuuuuuguucagauugag

SEQ ID NO: 384063 - RNA, 64 nt, Human
gccccgcugcucccggugugcagcgggugcgggugccgcuuaaacauuucccugcugaguggcu

SEQ ID NO: 384064 - RNA, 64 nt, Human
cuccacccugcccugcugagcacagacggaggaagccgcuuauccuguuuucauggacagcuga

SEQ ID NO: 384065 - RNA, 64 nt, Human
ugaaagagugauagggagagggagcgaggcuggugccgcuuauuuugaagcuggugcccucccu

SEQ ID NO: 384066 - RNA, 64 nt, Human
aauacaccaucucucuucuagucaugcugugcaugccgcuuacucuguuggggucuauauaaau

SEQ ID NO: 384067 - RNA, 64 nt, Human
uuucauaagcagaucuggcauuuauuacagggcugccgcuuaagagaacucauuauaaugaacg

SEQ ID NO: 384068 - RNA, 64 nt, Human
aaacaccuccuguuguggauggugagccccugaugccgcuuauuugccgugaguuuggacggca

SEQ ID NO: 384069 - RNA, 64 nt, Human
ggggcuccugggcauccucucuggggagcugcuggccgcuuagcguuguuugauuuuugaccuu

SEQ ID NO: 384070 - RNA, 64 nt, Human
ugacuugcguuuugaguagaggggaaggcugauaacggcguaagaugaaguggcccuccacaaa

SEQ ID NO: 384071 - RNA, 64 nt, Human; identical to SEQ ID NO: 186557

SEQ ID NO: 384072 - RNA, 64 nt, Human; identical to SEQ ID NO: 186558

SEQ ID NO: 384073 - RNA, 64 nt, Human; identical to SEQ ID NO: 357828

SEQ ID NO: 384074 - RNA, 64 nt, Human
ggcggaggcccaggagaccaaagggaggggcucugccgcuuagcagagaagaaagggccuggga

SEQ ID NO: 384075 - RNA, 64 nt, Human
ccuuccgccucucaagauccccccagccugacgggccgcuuaccauccccucugcccugcagag

SEQ ID NO: 384076 - RNA, 64 nt, Human
cccuuacaacaccucaguguaugguugguauaaggccgcuuacaaacacgcagauggcaagaag

SEQ ID NO: 384077 - RNA, 64 nt, Human
auuugcauuuguccccaaauacgcuuagcugugugccgcuuagaacgaugcgaaaccaucccuc

SEQ ID NO: 384078 - RNA, 64 nt, Human
ggaggggagguuacccaagaaacaaagccuacaugccgcuuacagcccccguuggaugguugcu

SEQ ID NO: 384079 - RNA, 64 nt, Human
cuuuucucaccccguccccaugcugguguccgacgccgcuuacucagagcccuggccucccucc

SEQ ID NO: 384080 - RNA, 64 nt, Human
ggcugcugguccuguucaggcccgugcuggggacgccgcuuagacaauguugcccagaguccug

SEQ ID NO: 384081 - RNA, 64 nt, Human
ucaguucuguacgcaucugcggguugcagcccacgccgcuuacucucagcggaugcagcugcuc

SEQ ID NO: 384082 - RNA, 64 nt, Human
gacuucggcuucccagagaucucuccgccuuaguuaagagcaugugucgggaaauuccucagag

SEQ ID NO: 384083 - RNA, 64 nt, Human
guaggagggccaggcaaaguucaccagcuugcucuaagagcaagcaggcaaugccguaaagccu

SEQ ID NO: 384084 - RNA, 64 nt, Human; identical to SEQ ID NO: 357832

SEQ ID NO: 384085 - RNA, 64 nt, Human; identical to SEQ ID NO: 357838

SEQ ID NO: 384086 - RNA, 64 nt, Human; identical to SEQ ID NO: 357844

SEQ ID NO: 384087 - RNA, 64 nt, Human
uggggaaaaugccgcaguuuguugccuugaaaccuaagagcaauccuugguuuuguugcuacau

SEQ ID NO: 384088 - RNA, 64 nt, Human
cuuuuauuuugcagcauuugguuuguuauuaguguaagagcaaguauaggauauggagaggccc

SEQ ID NO: 384089 - RNA, 64 nt, Human
cacaaucaauaaaaauggcauuuuuuuaguaaauuaagagcauaaacaauauugcuagaggugg

SEQ ID NO: 384090 - RNA, 64 nt, Human
uuccugaaaugaagucaguagaaauggcaugggauaagagcagagcucacacuuuuacaguugc

SEQ ID NO: 384091 - RNA, 64 nt, Human
cuuuguugaauaauacguguguaccuaaaagagguaagagcaaaaaguguaauuccacaucaug

SEQ ID NO: 384092 - RNA, 64 nt, Human
uguaagaaugugaauuugaauguauuuugaauuguaagagcaaaagaacguuuuuguacaauuu

SEQ ID NO: 384093 - RNA, 64 nt, Human
cucaguccccagaggaaggaagcacugcagagauuaagagcagaaauugaaguuuuaacagauu

SEQ ID NO: 384094 - RNA, 64 nt, Human
cugguacucaguaaauauuuguugaaaugaaugauaagagcauugguccccaagccagagagcc

SEQ ID NO: 384095 - RNA, 64 nt, Human
uuugcauuugccucugccaucuaggaaagacauguaagagcauggacauuuuacuuuggagaaa

SEQ ID NO: 384096 - RNA, 64 nt, Human
cuuaagccuuauucuucaacuaaaagaugaggauuaagagcaagaaguugggggggaugugaaa

SEQ ID NO: 384097 - RNA, 64 nt, Human
uguggacuuacuaaauggcuuuuaauuccuauuauaagagcauauuuuagguaccuaucugcuc

SEQ ID NO: 384098 - RNA, 64 nt, Human
ucuuauucaaaaggaccgcacauauuaguacucuuaagagcaucuuccaagacuccagcaguga

SEQ ID NO: 384099 - RNA, 64 nt, Human
cuccccaccccaacccugccccuauguacaggaauaagagcaaaggacccacaggcuacagaga

SEQ ID NO: 384100 - RNA, 64 nt, Human
auuuuguuuugaaaaugaugucuaacaaccaugauaagagcaaggcuguuaaauaauaucuucc

SEQ ID NO: 384101 - RNA, 64 nt, Human
cucaagacaaaugacccccaucccauggggguaauaagagcaguagcagcagcaucucugaaca

SEQ ID NO: 384102 - RNA, 64 nt, Human; identical to SEQ ID NO: 357848

SEQ ID NO: 384103 - RNA, 64 nt, Human; identical to SEQ ID NO: 357854

SEQ ID NO: 384104 - RNA, 64 nt, Human; identical to SEQ ID NO: 357858

SEQ ID NO: 384105 - RNA, 64 nt, Human
gaccuaugaacguaaucccuuugcuacaaauauuuaagagcagcucagcuugguugaaacugag

SEQ ID NO: 384106 - RNA, 64 nt, Human
ugugauuggacuccauuuuucugugaguugagaguaagagcauaagucaguuugaaagcauuua

SEQ ID NO: 384107 - RNA, 64 nt, Human
uuaaucuuuuaguaacauauagggguuuuuguauuaagagcauuauuucauaaaaugcuaucuu

SEQ ID NO: 384108 - RNA, 64 nt, Human
gguggaaggaaccugccuaaccaggcaccuguguuaagagcaugaugguuaggaaaucccccaa

SEQ ID NO: 384109 - RNA, 64 nt, Human
acuggaaaauuacagcaauuuauuaaaaccucaguaagagcaaaacaaggaagaagauuccuua

SEQ ID NO: 384110 - RNA, 64 nt, Human
agccagugagcuaaauauggcuaagcacaggucauaagagcaccuaaggccagcauauaagcca

SEQ ID NO: 384111 - RNA, 64 nt, Human
guauacuuggaaagauagucauggcccaauaugauaagagcaauaaaggaaguggguaugugua

SEQ ID NO: 384112 - RNA, 64 nt, Human
aaauugaacuauuuucagaaaaagggcaguauauuaagagcagggacuguucucuaguuauuga

SEQ ID NO: 384113 - RNA, 64 nt, Human
auucuuccaaggaaauacauaugcagauacuuauuaagagcaaacuuuagugucucuaaguuau

SEQ ID NO: 384114 - RNA, 64 nt, Human
agaguacuguauuuuugaauagccuacucccaaguaagagcaaaucuguaugauaacauuuuuu

SEQ ID NO: 384115 - RNA, 64 nt, Human
aaaugggacuaaugggagaagcuguuugucacucuaagagcauccaagcccuggcccgucugug

SEQ ID NO: 384116 - RNA, 64 nt, Human
ccgcuggggcaggcagggcagggucugugaagcuuaagagcagauggugacaaguucucugggc

SEQ ID NO: 384117 - RNA, 64 nt, Human
accauuggaaagaggaaucugcaaucugggagcuuaagagcaaaugaugaccauagaaagcuau

SEQ ID NO: 384118 - RNA, 64 nt, Human
uuuaaagaaaccacuguuucccccuaaaaugucauaagagcacugaagaacuugaaauauuuuu

SEQ ID NO: 384119 - RNA, 64 nt, Human
auauuacuaggugacaugucuacuuuuuaauuuuuaagagcauccggccaaaugcaaaauuagu

SEQ ID NO: 384120 - RNA, 64 nt, Human; identical to SEQ ID NO: 357864

SEQ ID NO: 384121 - RNA, 64 nt, Human; identical to SEQ ID NO: 357869

SEQ ID NO: 384122 - RNA, 64 nt, Human; identical to SEQ ID NO: 357872

SEQ ID NO: 384123 - RNA, 64 nt, Human
cuuaguauuagaagcagaucauuucccaaaauucuaagagcagcagcauauguuguugcuugua

SEQ ID NO: 384124 - RNA, 64 nt, Human
aagcccuguucuggaucccccauccccuccagaauaagagcauguucugcauguauuaaucuuu

SEQ ID NO: 384125 - RNA, 64 nt, Human
acugaauuccaauuucauuucugcuuccgcuaaguaagagcaccucauuccuguguuuucucua

SEQ ID NO: 384126 - RNA, 64 nt, Human
auuuuauauguaugcuauuuguuguauuuaugcuuaagagcaaaaaaguuuugaugggauuuua

SEQ ID NO: 384127 - RNA, 64 nt, Human
cuuuaucaccuggcuuguuuauuuugugggaauuuaagagcaguccauuucuaccaaggcauau

SEQ ID NO: 384128 - RNA, 64 nt, Human
ugaaugaggaggcccuauagcagaagucugauucuaagagcaguagaaacuuguaccagaagca

SEQ ID NO: 384129 - RNA, 64 nt, Human
gucagcuuugcuugucacauugcaaaaccuagcuuaagagcauuaaaaaaaaaaacuuaaguag

SEQ ID NO: 384130 - RNA, 64 nt, Human
acuccuccucacuggaaagaggaaaugcagagauuaagagcauauagaccaccuaguggagaaa

SEQ ID NO: 384131 - RNA, 64 nt, Human
uuaagugaaaauaaaccaguuaaaacagaaccuuuaagagcaaccauggcacaaaaugaaaaug

SEQ ID NO: 384132 - RNA, 64 nt, Human
guaccagaugaaucaggacaacuaugcacucuuauaagagcauuuaggguauuauuggguaaag

SEQ ID NO: 384133 - RNA, 64 nt, Human
caaaucaggcuacuagaauucuguauuggauauauaagagcaugaaauuuuuaaaaauacacuu

SEQ ID NO: 384134 - RNA, 64 nt, Human
ucuucauaugugaacgugccauucaguugguaguuaagagcauucaacuucaaauauauagaag

SEQ ID NO: 384135 - RNA, 64 nt, Human
ucauaacugcauacucaacucugccguuguaggguaagagcagcacucgaugacacagaaauga

SEQ ID NO: 384136 - RNA, 64 nt, Human
gagcccauggucccagcuacucgagaggcugagguaagagcaucccuugagccacagaggucga

SEQ ID NO: 384137 - RNA, 64 nt, Human
accaaagccagauaggcccccuaggaaacugagguaagagcagucucuaaaaacuacccacagc

SEQ ID NO: 384138 - RNA, 64 nt, Human; identical to SEQ ID NO: 357875

SEQ ID NO: 384139 - RNA, 64 nt, Human; identical to SEQ ID NO: 357876

SEQ ID NO: 384140 - RNA, 64 nt, Human; identical to SEQ ID NO: 357877

SEQ ID NO: 384141 - RNA, 64 nt, Human
uuuuacaugcugaauuagccucgaucuuuuugauuaagagcacaaacuuuuuuuuguaaaacau

SEQ ID NO: 384142 - RNA, 64 nt, Human
cuggucuugagaaguagaagcaucuuaacugucauaagagcauagauuuuuuguuuuucacaac

SEQ ID NO: 384143 - RNA, 64 nt, Human
uccauguauuuugaauaugagcaaaaacugaucuuaagagcagacuuaaaguagcuuuguacgc

SEQ ID NO: 384144 - RNA, 64 nt, Human
aaucuucugacauuuucuuauguuuuuaaaaagauaagagcaucuagugcauuaaaugccaaaa

SEQ ID NO: 384145 - RNA, 64 nt, Human
gacuuuucucucaaugaaacucgcuugaguuuacuaagagcauuucaaaaauagguucucuuug

SEQ ID NO: 384146 - RNA, 64 nt, Human
agaaaacccacacacaaagcaaaaacucaaguauuaagagcacauauuuuugacccaguggagg

SEQ ID NO: 384147 - RNA, 64 nt, Human
uacuugacugacaaaaugaucugacuacuccauuuaagagcaaagguaacucauguuuagguaa

SEQ ID NO: 384148 - RNA, 64 nt, Human
acauucaugacacacaaaacuggcuggaaggagauaagagcacuggguuugagauucccuccau

SEQ ID NO: 384149 - RNA, 64 nt, Human
uuuuuauauuagagauucugcagcucuuugcucuuaagagcaaaucacaacaggauucuuaaug

SEQ ID NO: 384150 - RNA, 64 nt, Human
aaacuuaacagaaauguguuugguuacugaugcauaagagcaagcaccaauaaaauggcauaaa

SEQ ID NO: 384151 - RNA, 64 nt, Human
gguuacucuguguaaauggagugcuguacagauuuaagagcaaugcguaauaacaaguuaagcu

SEQ ID NO: 384152 - RNA, 64 nt, Human
ugaggcaguacaggggagaggcuggaaaacauauuaagagcauaaauuggagagaaucaaagcc

SEQ ID NO: 384153 - RNA, 64 nt, Human
cuuugaaucuaagagauccugauagcuucauguuuaagagcauugacagguggggcaccucuga

SEQ ID NO: 384154 - RNA, 64 nt, Human
gcagucaaaggaacgccuuccccucaguuguuucuaagagcagagucucccgcugcaaucuggg

SEQ ID NO: 384155 - RNA, 64 nt, Human
ccauagccauaucuagagugaucucucgcugugcuaagagcaagccuacuucgcauuucuuccu

SEQ ID NO: 384156 - RNA, 64 nt, Human; identical to SEQ ID NO: 357880

SEQ ID NO: 384157 - RNA, 64 nt, Human; identical to SEQ ID NO: 357881

SEQ ID NO: 384158 - RNA, 64 nt, Human; identical to SEQ ID NO: 357882

SEQ ID NO: 384159 - RNA, 64 nt, Human
cugcaucuagauuggagugcugcacaaacaaacauaagagcaaagcaaaacuguaucacauagg

SEQ ID NO: 384160 - RNA, 64 nt, Human
gggccaaucagucaaugauaaucugaacaaauuuuaagagcagauuuuagauuaauaauguuuu

SEQ ID NO: 384161 - RNA, 64 nt, Human
uugugccccucgggccgucccccuggccaguccuuaagagcagcaggcucccuggugugucccu

SEQ ID NO: 384162 - RNA, 64 nt, Human
uuucucuguauuuuaaaucuaagucugugggcuuuaagagcaauggcacaauugcauguuuacu

SEQ ID NO: 384163 - RNA, 64 nt, Human
aucuucuguuguagaauaauaauaaaaagacuauuaagagcaauaaauuauuuuuaagaaaucg

SEQ ID NO: 384164 - RNA, 64 nt, Human
aaggagcacuguaaaacugguaggagcuaugguuuaagagcauuggaaguaguuacaacucaag

SEQ ID NO: 384165 - RNA, 64 nt, Human
auuucuguugauacauguuuuuuaaaaguaauuuuaagagcauuauuagguuaauuaauccaau

SEQ ID NO: 384166 - RNA, 64 nt, Human
gauaauagccuuacacugaguacaaauaauacuuuaagagcaugugaagaugugaucauuugug

SEQ ID NO: 384167 - RNA, 64 nt, Human
uuaaacaacauauguaauuuugaaaauuuuuaaauaagagcauuaaaagacuuuaaugauuugg

SEQ ID NO: 384168 - RNA, 64 nt, Human
guugaggaaucuguagcguaugcauucguucuguuaagagcaaaucuaggagaagugcuucagc

SEQ ID NO: 384169 - RNA, 64 nt, Human
uacaauggcuauuuagacuuucccugcuucaaaauaagagcaguauccuuagcucuagccaagc

SEQ ID NO: 384170 - RNA, 64 nt, Human
guuauauaccuaaucugguuuuuuauaacuucuguaagagcauaaucaaacaggaauuuucuuu

SEQ ID NO: 384171 - RNA, 64 nt, Human
ggggggggguccuaaauguaaucacgaguaagauuaagagcaaaucaauucuagucauauauua

SEQ ID NO: 384172 - RNA, 64 nt, Human
aguaauuuuauugaacaaguuagaggcauaagcuuaagagcauuuccaugaaacaacacaugca

SEQ ID NO: 384173 - RNA, 64 nt, Human
caaggcuccaccucagaaauucugaaauggguaguaagagcaaauuuucauuuuaaagcacacc

SEQ ID NO: 384174 - RNA, 64 nt, Human; identical to SEQ ID NO: 357883

SEQ ID NO: 384175 - RNA, 64 nt, Human; identical to SEQ ID NO: 357884

SEQ ID NO: 384176 - RNA, 64 nt, Human; identical to SEQ ID NO: 357885

SEQ ID NO: 384177 - RNA, 64 nt, Human
ccgagauugcaccauuguacuccagccugggcaauaagagcaaaacuccaucaaaauaaaauaa

SEQ ID NO: 384178 - RNA, 64 nt, Human
cguucuuccuagcaguguuaauacaugcaagaaguaagagcauuuguggcuugaacuugccaga

SEQ ID NO: 384179 - RNA, 64 nt, Human
uucaacccacaaugaucaggucaaucaaaaucccuaagagcagaacuccuaccccaaaagaagc

SEQ ID NO: 384180 - RNA, 64 nt, Human
ccuaaggguagugagaucacaaacagaauaaaaauaagagcaaucaaccauauaaaucaaguac

SEQ ID NO: 384181 - RNA, 64 nt, Human
cugagaugacgccauugcacuccagccuaggcaauaagagcaaaacucugccucaaaaaaaaaa

SEQ ID NO: 384182 - RNA, 64 nt, Human
guuuucuugauuacaucugaagucucuucucuuuuaagagcaaagacauuguuucaguuucuga

SEQ ID NO: 384183 - RNA, 64 nt, Human
auguacauuaauguugggauauggaaugaagacuuaagagcaggagaagauggggagggggugg

SEQ ID NO: 384184 - RNA, 64 nt, Human
auagcaagaguaaaaaagucucaaagucaucaaauaagagcaagaguugauagagcuuuuacaa

SEQ ID NO: 384185 - RNA, 64 nt, Human
ccagguugugcagugcuguguauggauuuuacucuaagagcaaaggaaagccacugaagaguau

SEQ ID NO: 384186 - RNA, 64 nt, Human
uuagcaacaacaugcuaaugacgacaccuagcucuaagagcaauucugggagaaugaaaggaag

SEQ ID NO: 384187 - RNA, 64 nt, Human
ucauuuaaaaagauauuguaccaggaugugcuauuaagagcacguauccauuauucuucucaac

SEQ ID NO: 384188 - RNA, 64 nt, Human
cuagaauucaaaaguuucuaaauguuuuacauuguaagagcauagagaauauuaauaauggcuu

SEQ ID NO: 384189 - RNA, 64 nt, Human
ucguaauaacacauggaagcaaacccuggguuuuuaagagcaaauucugucccccccucacucc

SEQ ID NO: 384190 - RNA, 64 nt, Human
acagacaggcugaauuagaagccccuauuacaaauaagagcaccacgagcuaaaauuuaccaac

SEQ ID NO: 384191 - RNA, 64 nt, Human
cuaagugguaaagccugaagccuccacugaggauuaagagcaacagccccagagccugggcucu

SEQ ID NO: 384192 - RNA, 64 nt, Human; identical to SEQ ID NO: 357886

SEQ ID NO: 384193 - RNA, 64 nt, Human; identical to SEQ ID NO: 357887

SEQ ID NO: 384194 - RNA, 64 nt, Human; identical to SEQ ID NO: 357888

SEQ ID NO: 384195 - RNA, 64 nt, Human
cuuuaaauagaaaaagaauuugguuuugcucguuuaagagcaaugagaaaaugauggaauguug

SEQ ID NO: 384196 - RNA, 64 nt, Human
gcccucacucaagaccaggcugcagccuccacuucccucguaguuggcaggagcuccuggaagc

SEQ ID NO: 384197 - RNA, 64 nt, Human
agaaaagguucugugcccucagguggggcuuacccccucguauuuauaaucuuaauuuauauag

SEQ ID NO: 384198 - RNA, 64 nt, Human
ugauagaguuauuuaaccucucugagccucaguucccucguauguaaaaugaugauaauaauac

SEQ ID NO: 384199 - RNA, 64 nt, Human
caccugcacuaccacuuuuuagaggaaauucacucccucguaagcauuggaaggucaaauuauu

SEQ ID NO: 384200 - RNA, 64 nt, Human
caacaggugccaccacccacaaaagacaacacuacccucguaacuacugcuucuacuacccaaa

SEQ ID NO: 384201 - RNA, 64 nt, Human
gcggcgggcggcgggcaggcgggugggggcacaccccucguaccugucacugggaugcagacuc

SEQ ID NO: 384202 - RNA, 64 nt, Human
guuuuuuuucauuccuguguuuggauacuaaucacccucguaucugcagccugagguagucagg

SEQ ID NO: 384203 - RNA, 64 nt, Human
gagacuauugucuccuaaacccaggacuagaguucccucguacugucacuccuuuggucauuaa

SEQ ID NO: 384204 - RNA, 64 nt, Human
uaaucaucauuuacauuguuuucuuccaaaggcccccucguauacccucccuaacccacaaacc

SEQ ID NO: 384205 - RNA, 64 nt, Human
ccugaauacaucauccgcagccugggaaccuucucccucguacagcacaggaaccugacacaua

SEQ ID NO: 384206 - RNA, 64 nt, Human
ggccucucgagcauccaaacccucacgaccugcaaggggccagcagggacguggccccacgcca

SEQ ID NO: 384207 - RNA, 64 nt, Human
gugcugcggcggaccugccacguuccaggugccgaggggccacugcuggggguucaugggaucc

SEQ ID NO: 384208 - RNA, 64 nt, Human
uggcagagccauccacccugaggagugaugggcaaggggccaggaaggggacaggauugucugc

SEQ ID NO: 384209 - RNA, 64 nt, Human
aguaguucaagagugagaaagaauaaauuguuauuaagagcaaaagaaaaauaaagugauugau

SEQ ID NO: 384210 - RNA, 64 nt, Human
agcuaauaaauugggaaugggagaagggaggauauaagagcacuaaugcccucuuauuuucaua

SEQ ID NO: 384211 - RNA, 64 nt, Human
guauuuuguuguuuuaauuaauaggcuuuauuuguaagagcaguuuuauguuuacagaaaaauu

SEQ ID NO: 384212 - RNA, 64 nt, Human
uagagguuuuugaugucaucuuaagaaacacacuuaagagcaucagauuuacugauugcauuuu

SEQ ID NO: 384213 - RNA, 64 nt, Human
acauuuuuguuuauaacuaaguuuggagggauccuaagagcauuuuuguggguaaaaaaaaaac

SEQ ID NO: 384214 - RNA, 64 nt, Human
cauccaaacuuuauaucaagaaacaggacaaaguuaagagcaaucacaaacuggaauaucgccu

SEQ ID NO: 384215 - RNA, 64 nt, Human
acaacuugauaucauucagcuguccaaaaaauaauaagagcauucauuaaauacugauuuucuu

SEQ ID NO: 384216 - RNA, 64 nt, Human
acacaucugugauggaguauacaacaaugcauuuuaagagcaaaugcaacaaaacaaaucugga

SEQ ID NO: 384217 - RNA, 64 nt, Human
guguccuuugguacuaugguguguuguaucuuuguaagagcaaaagccucagaaagggauugcu

SEQ ID NO: 384218 - RNA, 64 nt, Human
gagcuauaaauggcagagcuauguguaaauauuuuaagagcaugcagccaucuuggugugugca

SEQ ID NO: 384219 - RNA, 64 nt, Human
caguauacagacaccuuguacuuuuccucaacuguaagagcagacuuucaauguuagcaauuaa

SEQ ID NO: 384220 - RNA, 64 nt, Human
gcucagugguuacucaagcucaaaaggguuuuuuuaagagcaagcauugguuaagucuguguau

SEQ ID NO: 384221 - RNA, 64 nt, Human
guuguuuugugugcucauugaaauauucaugauuuaagagcaguuuuguaaaaaauucauuagc

SEQ ID NO: 384222 - RNA, 64 nt, Human
caaggacaaaagaugucauugacguagucagugcuaagagcagaaaugcaauucuuuguuauga

SEQ ID NO: 384223 - RNA, 64 nt, Human
ucuacuuuugaaguaauuaaaugucaguacauuuuaagagcauaaaaaucggcgauuuuguacu

SEQ ID NO: 384224 - RNA, 64 nt, Human; identical to SEQ ID NO: 357889

SEQ ID NO: 384225 - RNA, 64 nt, Human; identical to SEQ ID NO: 357890

SEQ ID NO: 384226 - RNA, 64 nt, Human; identical to SEQ ID NO: 357891

SEQ ID NO: 384227 - RNA, 64 nt, Human
cuugucacugaaauaaaagauggcauuaugugguuaagagcauggggcgaggggucagacauga

SEQ ID NO: 384228 - RNA, 64 nt, Human
cucauuccguugucuguggauggucauugcaguuuaagagcagaacagaucuuuuacuuuggcc

SEQ ID NO: 384229 - RNA, 64 nt, Human
aaccccagcagugugaacgcaucccaacauagguuaagagcaaguugaaaacaaaggccauggc

SEQ ID NO: 384230 - RNA, 64 nt, Human
uuauuuuuuucuguuaaaauguuuuugacaguuuuaagagcagucuuuuggcucugaccauuuc

SEQ ID NO: 384231 - RNA, 61 nt, Human
uugaaaaacugagcacauagguggaaagaguuaagagcaagauggaaugauuuuuucuguu

SEQ ID NO: 384232 - RNA, 64 nt, Human
aauguaaaauacuucaucauauucuuucuuuuaauaagagcauuguccuauaaaucugcaauau

SEQ ID NO: 384233 - RNA, 64 nt, Human
ugguuuuccccccuaagaacauuuauuuacgucuuaagagcagauaagugacuaagacugaaca

SEQ ID NO: 384234 - RNA, 64 nt, Human
gugguguuucccaacugucuugggacaaaaaggguaagagcacccuuagauccagauguugcca

SEQ ID NO: 384235 - RNA, 64 nt, Human
ucauaagaucauuccucccuuuaaauugagccccuaagagcacuggccugggagucagacagac

SEQ ID NO: 384236 - RNA, 64 nt, Human
guucuggaucucugacuccauccugacuguuuaguaagagcaugcuuacacccuacugugaaaa

SEQ ID NO: 384237 - RNA, 64 nt, Human
uagauuuauuccuacauucugaauggggagcagguaagagcagagcaccucccacugggggugg

SEQ ID NO: 384238 - RNA, 64 nt, Human
aaaugcaaaguggaacuaggaguuuggaaugcauuaagagcagacaagcuuggucauaauagau

SEQ ID NO: 384239 - RNA, 64 nt, Human
auguuacaguucaaacaugucuccacuacccuguuaagagcagccugggaacguacaggccauc

SEQ ID NO: 384240 - RNA, 64 nt, Human
auuccagucuaggcagagacagaagaauguugaauaagagcacgauuagaguccugucugguua

SEQ ID NO: 384241 - RNA, 64 nt, Human
gaaaucaaauacaaauuauuuauaugcauuaauuuaagagcaucuacuuagaagaaaccaaaua

SEQ ID NO: 384242 - RNA, 64 nt, Human
agugcgcagaucugugccugggaucgugcauuugaggggccaggggcaggcagggcugcagagg

SEQ ID NO: 384243 - RNA, 64 nt, Human
cagagggaugacugcuggggguagacugggugccaggggccaugggcccaggacccagucuugg

SEQ ID NO: 384244 - RNA, 64 nt, Human
aaacguuagcauacccaguaaggaaaaugagugcaggggccaggggaacccgugaggaucacuc

SEQ ID NO: 384245 - RNA, 64 nt, Human
augagacaaagggaauaaauggcuguauuugugcuaagagcaaaggaugcaucuucccacagcc

SEQ ID NO: 384246 - RNA, 64 nt, Human
cuucaaucauuuucacaggcagccaacaagcaauuaagagcaguuauaauagaggaagcugggg

SEQ ID NO: 384247 - RNA, 64 nt, Human
gcuguucugcugcuguuucugugcucucccugauuaagagcauucaguuccugggcucucccuu

SEQ ID NO: 384248 - RNA, 62 nt, Human
acauugaucaagauuuguaggaccaaccaaccuaagagcaauaaauguuuuuguuuguuuca

SEQ ID NO: 384249 - RNA, 64 nt, Human
agaccuguuguuuuggaaggucugcuccaccaucuaagagcacuguuuuuuuuuuuuuguuguu

SEQ ID NO: 384250 - RNA, 64 nt, Human
uaacacuguaggaacuauuuugaaugcaugugacuaagagcaugauuuauagcacaaccuuucc

SEQ ID NO: 384251 - RNA, 64 nt, Human
gucacgccguagccuguuaguccuccuaaccucuuaagagcagucucuucugagccagccucug

SEQ ID NO: 384252 - RNA, 64 nt, Human
cuggcaaaaaggagccuuuugcucucugugacccuaagagcacacugcacagggaaaauugccc

SEQ ID NO: 384253 - RNA, 64 nt, Human
accaauguuaccuuuuuauuuuuuguuuuagauguaagagcaugcucauauguuagguacuuac

SEQ ID NO: 384254 - RNA, 64 nt, Human
guccuuuagccagcaccaagauagcuauggaucuuaagagcaccagauccagaggggguugggu

SEQ ID NO: 384255 - RNA, 64 nt, Human
acguaucccaccugacauguccuucugagcccgguaagagcaaaagaauggcagaaaaguuuag

SEQ ID NO: 384256 - RNA, 64 nt, Human
aaacaguaauguggcuacacaguuuuuuuaacuguaagagcaucagcuggcucuuuaauauaug

SEQ ID NO: 384257 - RNA, 64 nt, Human
cuguccuacgcugcuucccucacuccccuucuccuaagagcacuccaucaauaaaccacuugca

SEQ ID NO: 384258 - RNA, 64 nt, Human
gccaaaguugagauagaauagagggugaugacgguaagagcaagugucccaugaaugugauuuc

SEQ ID NO: 384259 - RNA, 64 nt, Human
cauugugcaaaaccacaagcacgcaaguauuaaauaagagcaagcuguccugagcccauaccua

SEQ ID NO: 384260 - RNA, 64 nt, Human
gugugcuguguggccuuauuuugcuucuugauacaggggccaaagccaggcacccucccaguua

SEQ ID NO: 384261 - RNA, 64 nt, Human
caggccacccacuguggggcaagccugaguggugaggggccacugggccccauucucccuccau

SEQ ID NO: 384262 - RNA, 64 nt, Human
agaaaacuucaguuuucggccagcgcgucgagggaggggccagcgacacauggccuaguaaccg

SEQ ID NO: 384263 - RNA, 64 nt, Human
ccagcccccuccccugauuuagggaugcguaggguaagagcacgggcaguggucuucagucguc

SEQ ID NO: 384264 - RNA, 64 nt, Human
gaggacaaagaauguggggcugguuucugcccuuuaagagcacccggucagucagagaacagag

SEQ ID NO: 384265 - RNA, 64 nt, Human
uucugaagaaucacaaagacagaagaccucuggcuaagagcaggcuucaaacgaugugaaauaa

SEQ ID NO: 384266 - RNA, 64 nt, Human
uaauaagcaucuucuuuaugccuaguauuugugauaagagcacaaaacaauuuucuaaucucaa

SEQ ID NO: 384267 - RNA, 64 nt, Human
ccccacuagagccuuccagccuucugguguguucuaagagcaggcuccaccugggagccagccc

SEQ ID NO: 384268 - RNA, 64 nt, Human
acaaguuauugcagagucagggugcuuuuauauauaagagcagcagccgccuuuguaaagugug

SEQ ID NO: 384269 - RNA, 64 nt, Human
cuuuggauuagaaaaggcuuauguuagcauagcuuaagagcaaccucagagauuugagcccuac

SEQ ID NO: 384270 - RNA, 64 nt, Human
uacauaugaguguggaagccggaggguguuuauguaagagcaccuuccucacuuccauacagcu

SEQ ID NO: 384271 - RNA, 64 nt, Human; identical to SEQ ID NO: 384270

SEQ ID NO: 384272 - RNA, 64 nt, Human
auuauuauuuaauuguacuugucuuuuuuuacuuuaagagcauaaacucguuuuuauuuugcac

SEQ ID NO: 384273 - RNA, 64 nt, Human
uagaaaugaaaauaauuacuuugaaacuuggcuuuaagagcacauuuaucguacgucacagugu

SEQ ID NO: 384274 - RNA, 64 nt, Human
gagggugauggggcugagcaggaggggggcuggguaagagcacagguuagggcauggaaggcuu

SEQ ID NO: 384275 - RNA, 64 nt, Human
gugagcguuuaaaucuucucauuuuauugaaaacuaagagcagaaaauguaaaaugcucaugaa

SEQ ID NO: 384276 - RNA, 64 nt, Human
cauucauuuuccaacgccuacauuuaauuccugguaagagcagugcucgucaaguuucugguuu

SEQ ID NO: 384277 - RNA, 64 nt, Human
ucuguuaccuaaauauaguucaaguuuaauucuguaagagcaaagaaaugaauuugaugaggaa

SEQ ID NO: 384278 - RNA, 64 nt, Human
ccucaaugcucaauggcuccccugaaaucaagacaggggccacccgagauggucugagggugga

SEQ ID NO: 384279 - RNA, 64 nt, Human
uggugacaaguucucugggcagguggccauggggaggggccauggcuuggcauguccaacagaa

SEQ ID NO: 384280 - RNA, 64 nt, Human
auccugaguggagccuuaaaguggcuucaccuggaggggccagagggucaccuggagcugggga

SEQ ID NO: 384281 - RNA, 64 nt, Human
uggagaaacagggccuuuauuccauucauauucauaagagcauauuuauccugcauugaaaaug

SEQ ID NO: 384282 - RNA, 64 nt, Human
uuuuuuauaaauuaucuuucaagcucagauagcuuaagagcaguuuauauuaaggagacccuuu

SEQ ID NO: 384283 - RNA, 64 nt, Human
gaguuucaucauguguguccguugagcuugcuuuuaagagcaauguuuugcuuugcucucuggu

SEQ ID NO: 384284 - RNA, 64 nt, Human
ggaaaaucaccuggggggaggggacuucuugugguaagagcaagugcagguaugaaaugcgaag

SEQ ID NO: 384285 - RNA, 64 nt, Human
cagcaagccuugggcacaccccgcugggagcuguuaagagcagcgcugguucucgguuccuccc

SEQ ID NO: 384286 - RNA, 64 nt, Human
aaguaaauaugaccucaguguccuauaaauaauguaagagcaggauuugaaacuuggagagcug

SEQ ID NO: 384287 - RNA, 64 nt, Human
uagcuucuaucucuuaguguaacuucaaaacuuuuaagagcagugaaguuggucagggacaugu

SEQ ID NO: 384288 - RNA, 64 nt, Human
ugugaauuaugacuauucauuuguuaaaaauaccuaagagcaauuauagugggacaucuaaggu

SEQ ID NO: 384289 - RNA, 64 nt, Human
uuggaaaugaaggacuagcuccuauguaucagguuaagagcaagggagagcuggccagggacag

SEQ ID NO: 384290 - RNA, 64 nt, Human
uuugcagguaaguaggaaccccuagggcuugagcuaagagcaagcccagcuucugggaagggag

SEQ ID NO: 384291 - RNA, 64 nt, Human
caccugucucagguccguuuccuagcuaaaaauguaagagcaucaggccagaugauaugagggc

SEQ ID NO: 384292 - RNA, 64 nt, Human
aaucacuucggcagguugaacaacuccauguagauaagagcaaguguaggcaaagguuuagaaa

SEQ ID NO: 384293 - RNA, 64 nt, Human
ucccuccaacacagauccgcaagaguaaaggaaauaagagcagucacaacagagugaaaaaucu

SEQ ID NO: 384294 - RNA, 64 nt, Human
cagccaaauuagcaguguauaaauggcaccuagguaagagcagagcugcggcucggugacuuga

SEQ ID NO: 384295 - RNA, 64 nt, Human
cuuggggacacagggcuccuagcaagcaggaaguuaagagcaggaggaagcguugcuaccuuca

SEQ ID NO: 384296 - RNA, 64 nt, Human
aggacacuguauauugcaaauugcugauuauggaaggggccaguugcuguuuuuucaugcagug

SEQ ID NO: 384297 - RNA, 64 nt, Human
cuugaauuugacacaagagaaaagcaggaggaaaaggggccauucuccaaaggaccugaaagag

SEQ ID NO: 384298 - RNA, 64 nt, Human
auaucuguggcaucaugggcuauggcugcuggaaaggggccagugggauccuagauuugucuuc

SEQ ID NO: 384299 - RNA, 64 nt, Human
auuugugugcucucccuugacugucagauugaaguaagagcaguucucuccguugccucucgag

SEQ ID NO: 384300 - RNA, 64 nt, Human
aaauguaucacuuaaauguuaccaaaaauaaauauaagagcaagaucuaggauuuacuguauuu

SEQ ID NO: 384301 - RNA, 64 nt, Human
cuuuggcucgggacuucaaaaucagugaugggaguaagagcaaauuucaucuuuccaaauugau

SEQ ID NO: 384302 - RNA, 64 nt, Human
gacuuugacaaaacacgaaaugguaaugugaagcuaagagcagagagugaccaacaguaaacaa

SEQ ID NO: 384303 - RNA, 64 nt, Human
ggcccaagucugcaggucuggaagcaucuuccuauaagagcacuuucgccuucugggucaggac

SEQ ID NO: 384304 - RNA, 64 nt, Human
uauauauauaaauauauaguaaguuuuuuuuuuuuaagagcaacagagagaagcagccuccucc

SEQ ID NO: 384305 - RNA, 64 nt, Human
gucuacccauguuuguggcagcaaaugagcacaguaagagcaaagcugaacaacuugccuccuc

SEQ ID NO: 384306 - RNA, 64 nt, Human
aacuuucuucugcagauguaagcacuggcuuuuauaagagcagcagccaacacguuuagcagac

SEQ ID NO: 384307 - RNA, 64 nt, Human
uguuaauuacaaauagucuucauaugccagaauauaagagcaaguguuaucuacuuuuuagaug

SEQ ID NO: 384308 - RNA, 64 nt, Human
auaacaaaauauuuucauugugaccacucugaaguaagagcaaugggaauggcauuauuguaga

SEQ ID NO: 384309 - RNA, 64 nt, Human
auuuguuuucucggcagaucugcaaggcuggcuuuaagagcacaaggagggaaaguaacgaaag

SEQ ID NO: 384310 - RNA, 64 nt, Human
uucaaaaaauguuaugugcaaugaacacuaaauuuaagagcaguuacagugugacucacucaug

SEQ ID NO: 384311 - RNA, 64 nt, Human
auuuugugaguuuaguacucuacagauugccccauaagagcaguagcuuuugaaacucauaauu

SEQ ID NO: 384312 - RNA, 64 nt, Human
cucagccaggcuccagcagggucagacgugcuguuaagagcaaagccacagacgaugacuuguc

SEQ ID NO: 384313 - RNA, 64 nt, Human
agcuccuguguuuucuugaggguggcagaggagcuaagagcagugcccagggucugagggggcu

SEQ ID NO: 384314 - RNA, 64 nt, Human; identical to SEQ ID NO: 357856

SEQ ID NO: 384315 - RNA, 64 nt, Human; identical to SEQ ID NO: 357857

SEQ ID NO: 384316 - RNA, 64 nt, Human; identical to SEQ ID NO: 357868

SEQ ID NO: 384317 - RNA, 64 nt, Human
uugaugcaacuuggcauuugguuaccccugcugauaagagcagccguuaccugccacugggacc

SEQ ID NO: 384318 - RNA, 64 nt, Human
uacguauuugauggaaccacacaaauguaauguguaagagcauccugaagcucuuacucuaaga

SEQ ID NO: 384319 - RNA, 64 nt, Human
ggcuccugagguagaggaguggagaacuggcucuuaagagcacaguuuucuuuucuuuuuucuu

SEQ ID NO: 384320 - RNA, 64 nt, Human
aguauuaaaagauuguguggucaaauauucaauuuaagagcaaggaaauucuuauaaauauaac

SEQ ID NO: 384321 - RNA, 64 nt, Human
uguucaaaggcccagaucagcuaaagcauguauauaagagcacguuguaaacuugaaagagaca

SEQ ID NO: 384322 - RNA, 64 nt, Human
aacuuggggauggucuccccugccccagggcacauaagagcaaaggcuccaauggucaguggau

SEQ ID NO: 384323 - RNA, 64 nt, Human
ucuccaugucaagcaggaggguaaagaagggaacuaagagcaggucuuucaagccacaccccca

SEQ ID NO: 384324 - RNA, 64 nt, Human
ggugcccaagccuggauuaaaaaggaucaguucuuaagagcagccccgguaacuggaggaaugg

SEQ ID NO: 384325 - RNA, 64 nt, Human
acagcuuagcuugugcuucucaacaccaagucuuuaagagcaauaaaaacuacaccaugaaugu

SEQ ID NO: 384326 - RNA, 64 nt, Human
aaacuaaugaguaugaacuugagaucuguauaaauaagagcaugauuugaaaaaaagcauggua

SEQ ID NO: 384327 - RNA, 64 nt, Human
ggucuucguccaucugcuuuuuucugaaauacacuaagagcagccacaaaacuguaaccucaag

SEQ ID NO: 384328 - RNA, 64 nt, Human
agggaaaccuuugcuuaccuuguuuugccagugauaagagcaguggguuggagggcacuuggcc

SEQ ID NO: 384329 - RNA, 64 nt, Human
uauuauuccauaucuuuguuuuaaccaguacuucuaagagcauagaacucaaaugcugggggua

SEQ ID NO: 384330 - RNA, 64 nt, Human
aacaaacaccucagcaaugaaaccuguucaugucuaagagcagcugggcugggaaucuuccccu

SEQ ID NO: 384331 - RNA, 64 nt, Human
uauuuuauacacugaggguagcccauuuauaaauuaagagcacauuauauucagaagguucuaa

SEQ ID NO: 384332 - RNA, 64 nt, Human
ucuggccgugugaugaggugguugcugucuccauaggggccagcuccccagggcagacucacgu

SEQ ID NO: 384333 - RNA, 64 nt, Human
agacacagccucaccuucucacuugcugugggugaggggccauuuaaguggacugggagacagu

SEQ ID NO: 384334 - RNA, 64 nt, Human
gccugugcaggcuggggaucucaggcugaucaguaggggccagcuuuggagccagccaagcuga

SEQ ID NO: 384335 - RNA, 64 nt, Human
caggcccccugggcaccaagggagcgagggggaauaagagcagggcagcccccugggugccgcu

SEQ ID NO: 384336 - RNA, 64 nt, Human
ugucucagucaaacuuaauugggaaaaggaggaguaagagcaggcccuuucugacaugcuuuag

SEQ ID NO: 384337 - RNA, 64 nt, Human
uugucaguuguauuuacaaagaaagguacuuucuuaagagcauauauguuauuaauauuugaua

SEQ ID NO: 384338 - RNA, 64 nt, Human
caguaagauuuuuuuuaauccuauuauguuuaguuaagagcauguuacuaaaaugcugaggauu

SEQ ID NO: 384339 - RNA, 64 nt, Human
auuuuuaaaguucaugauuuguaggcaaagauguuaagagcauuguuuccauuaaaaucaauaa

SEQ ID NO: 384340 - RNA, 64 nt, Human
uuuuuuaauuuuugacuuuucacaaaugaguaaauaagagcaaccuauuuuucaagcagauugc

SEQ ID NO: 384341 - RNA, 64 nt, Human
aaguagcuauauguuacuguauugcaaaaucuguuaagagcaggaccacaucgauaguauuuaa

SEQ ID NO: 384342 - RNA, 64 nt, Human
aaugacaauuuuuuguauuugcuuuuucucccuuuaagagcacauucuucuguaaggagaaagg

SEQ ID NO: 384343 - RNA, 64 nt, Human; identical to SEQ ID NO: 311398

SEQ ID NO: 384344 - RNA, 64 nt, Human; identical to SEQ ID NO: 311415

SEQ ID NO: 384345 - RNA, 64 nt, Human; identical to SEQ ID NO: 311416

SEQ ID NO: 384346 - RNA, 64 nt, Human; identical to SEQ ID NO: 311417

SEQ ID NO: 384347 - RNA, 64 nt, Human; identical to SEQ ID NO: 311452

SEQ ID NO: 384348 - RNA, 64 nt, Human; identical to SEQ ID NO: 311453

SEQ ID NO: 384349 - RNA, 64 nt, Human; identical to SEQ ID NO: 311454

SEQ ID NO: 384350 - RNA, 64 nt, Human; identical to SEQ ID NO: 357836

SEQ ID NO: 384351 - RNA, 64 nt, Human; identical to SEQ ID NO: 357837

SEQ ID NO: 384352 - RNA, 64 nt, Human
uuugaagaccaagugaaguuguugguguuuguuuaggggccauuuuguuaaaaaaaaaaaaaaa

SEQ ID NO: 384353 - RNA, 64 nt, Human; identical to SEQ ID NO: 311528

SEQ ID NO: 384354 - RNA, 64 nt, Human; identical to SEQ ID NO: 311529

SEQ ID NO: 384355 - RNA, 64 nt, Human; identical to SEQ ID NO: 311530

SEQ ID NO: 384356 - RNA, 64 nt, Human; identical to SEQ ID NO: 311763

SEQ ID NO: 384357 - RNA, 64 nt, Human; identical to SEQ ID NO: 311764

SEQ ID NO: 384358 - RNA, 64 nt, Human; identical to SEQ ID NO: 310643

SEQ ID NO: 384359 - RNA, 64 nt, Human; identical to SEQ ID NO: 310644

SEQ ID NO: 384360 - RNA, 64 nt, Human; identical to SEQ ID NO: 310645

SEQ ID NO: 384361 - RNA, 64 nt, Human; identical to SEQ ID NO: 311886

SEQ ID NO: 384362 - RNA, 64 nt, Human; identical to SEQ ID NO: 311887

SEQ ID NO: 384363 - RNA, 64 nt, Human; identical to SEQ ID NO: 311888

SEQ ID NO: 384364 - RNA, 64 nt, Human; identical to SEQ ID NO: 311889

SEQ ID NO: 384365 - RNA, 64 nt, Human; identical to SEQ ID NO: 311890

SEQ ID NO: 384366 - RNA, 64 nt, Human; identical to SEQ ID NO: 311891

SEQ ID NO: 384367 - RNA, 64 nt, Human; identical to SEQ ID NO: 311892

SEQ ID NO: 384368 - RNA, 64 nt, Human; identical to SEQ ID NO: 357833

SEQ ID NO: 384369 - RNA, 64 nt, Human; identical to SEQ ID NO: 357834

SEQ ID NO: 384370 - RNA, 64 nt, Human; identical to SEQ ID NO: 357835

SEQ ID NO: 384371 - RNA, 64 nt, Human; identical to SEQ ID NO: 311893

SEQ ID NO: 384372 - RNA, 64 nt, Human; identical to SEQ ID NO: 311894

SEQ ID NO: 384373 - RNA, 64 nt, Human; identical to SEQ ID NO: 311895

SEQ ID NO: 384374 - RNA, 64 nt, Human; identical to SEQ ID NO: 311896

SEQ ID NO: 384375 - RNA, 64 nt, Human; identical to SEQ ID NO: 311897

SEQ ID NO: 384376 - RNA, 64 nt, Human; identical to SEQ ID NO: 311898

SEQ ID NO: 384377 - RNA, 64 nt, Human; identical to SEQ ID NO: 311899

SEQ ID NO: 384378 - RNA, 64 nt, Human; identical to SEQ ID NO: 311900

SEQ ID NO: 384379 - RNA, 64 nt, Human; identical to SEQ ID NO: 311901

SEQ ID NO: 384380 - RNA, 64 nt, Human; identical to SEQ ID NO: 311902

SEQ ID NO: 384381 - RNA, 64 nt, Human; identical to SEQ ID NO: 311903

SEQ ID NO: 384382 - RNA, 64 nt, Human; identical to SEQ ID NO: 311904

SEQ ID NO: 384383 - RNA, 64 nt, Human; identical to SEQ ID NO: 311905

SEQ ID NO: 384384 - RNA, 64 nt, Human; identical to SEQ ID NO: 311906

SEQ ID NO: 384385 - RNA, 64 nt, Human; identical to SEQ ID NO: 311907

SEQ ID NO: 384386 - RNA, 64 nt, Human; identical to SEQ ID NO: 357839

SEQ ID NO: 384387 - RNA, 64 nt, Human; identical to SEQ ID NO: 357840

SEQ ID NO: 384388 - RNA, 64 nt, Human; identical to SEQ ID NO: 357841

SEQ ID NO: 384389 - RNA, 64 nt, Human; identical to SEQ ID NO: 311908

SEQ ID NO: 384390 - RNA, 64 nt, Human; identical to SEQ ID NO: 311909

SEQ ID NO: 384391 - RNA, 64 nt, Human; identical to SEQ ID NO: 311910

SEQ ID NO: 384392 - RNA, 64 nt, Human; identical to SEQ ID NO: 311911

SEQ ID NO: 384393 - RNA, 64 nt, Human; identical to SEQ ID NO: 311912

SEQ ID NO: 384394 - RNA, 64 nt, Human; identical to SEQ ID NO: 311913

SEQ ID NO: 384395 - RNA, 64 nt, Human; identical to SEQ ID NO: 311914

SEQ ID NO: 384396 - RNA, 64 nt, Human; identical to SEQ ID NO: 311915

SEQ ID NO: 384397 - RNA, 64 nt, Human; identical to SEQ ID NO: 311916

SEQ ID NO: 384398 - RNA, 64 nt, Human; identical to SEQ ID NO: 311917

SEQ ID NO: 384399 - RNA, 64 nt, Human; identical to SEQ ID NO: 311918

SEQ ID NO: 384400 - RNA, 64 nt, Human; identical to SEQ ID NO: 311919

SEQ ID NO: 384401 - RNA, 64 nt, Human; identical to SEQ ID NO: 311920

SEQ ID NO: 384402 - RNA, 64 nt, Human; identical to SEQ ID NO: 311921

SEQ ID NO: 384403 - RNA, 64 nt, Human; identical to SEQ ID NO: 311922

SEQ ID NO: 384404 - RNA, 64 nt, Human; identical to SEQ ID NO: 357842

SEQ ID NO: 384405 - RNA, 64 nt, Human; identical to SEQ ID NO: 357843

SEQ ID NO: 384406 - RNA, 50 nt, Human; identical to SEQ ID NO: 357845

SEQ ID NO: 384407 - RNA, 64 nt, Human; identical to SEQ ID NO: 311923

SEQ ID NO: 384408 - RNA, 64 nt, Human; identical to SEQ ID NO: 311924

SEQ ID NO: 384409 - RNA, 64 nt, Human; identical to SEQ ID NO: 311925

SEQ ID NO: 384410 - RNA, 64 nt, Human; identical to SEQ ID NO: 311926

SEQ ID NO: 384411 - RNA, 64 nt, Human; identical to SEQ ID NO: 311927

SEQ ID NO: 384412 - RNA, 64 nt, Human; identical to SEQ ID NO: 311928

SEQ ID NO: 384413 - RNA, 64 nt, Human; identical to SEQ ID NO: 311929

SEQ ID NO: 384414 - RNA, 64 nt, Human; identical to SEQ ID NO: 311930

SEQ ID NO: 384415 - RNA, 64 nt, Human; identical to SEQ ID NO: 311931

SEQ ID NO: 384416 - RNA, 64 nt, Human; identical to SEQ ID NO: 311932

SEQ ID NO: 384417 - RNA, 64 nt, Human; identical to SEQ ID NO: 311933

SEQ ID NO: 384418 - RNA, 64 nt, Human; identical to SEQ ID NO: 311934

SEQ ID NO: 384419 - RNA, 64 nt, Human; identical to SEQ ID NO: 311935

SEQ ID NO: 384420 - RNA, 64 nt, Human; identical to SEQ ID NO: 311936

SEQ ID NO: 384421 - RNA, 64 nt, Human; identical to SEQ ID NO: 311937

SEQ ID NO: 384422 - RNA, 64 nt, Human; identical to SEQ ID NO: 357820

SEQ ID NO: 384423 - RNA, 64 nt, Human; identical to SEQ ID NO: 357821

SEQ ID NO: 384424 - RNA, 64 nt, Human
ccacugucaccuguaccaagugccaaaacagcagaggggccaguuagagcaagagcucuggggg

SEQ ID NO: 384425 - RNA, 64 nt, Human; identical to SEQ ID NO: 311938

SEQ ID NO: 384426 - RNA, 64 nt, Human; identical to SEQ ID NO: 311939

SEQ ID NO: 384427 - RNA, 64 nt, Human; identical to SEQ ID NO: 311940

SEQ ID NO: 384428 - RNA, 64 nt, Human; identical to SEQ ID NO: 311941

SEQ ID NO: 384429 - RNA, 64 nt, Human; identical to SEQ ID NO: 311942

SEQ ID NO: 384430 - RNA, 64 nt, Human; identical to SEQ ID NO: 311943

SEQ ID NO: 384431 - RNA, 64 nt, Human; identical to SEQ ID NO: 311944

SEQ ID NO: 384432 - RNA, 64 nt, Human; identical to SEQ ID NO: 311945

SEQ ID NO: 384433 - RNA, 64 nt, Human; identical to SEQ ID NO: 311946

SEQ ID NO: 384434 - RNA, 64 nt, Human; identical to SEQ ID NO: 311947

SEQ ID NO: 384435 - RNA, 64 nt, Human; identical to SEQ ID NO: 311948

SEQ ID NO: 384436 - RNA, 64 nt, Human; identical to SEQ ID NO: 311949

SEQ ID NO: 384437 - RNA, 64 nt, Human; identical to SEQ ID NO: 311950

SEQ ID NO: 384438 - RNA, 64 nt, Human; identical to SEQ ID NO: 311951

SEQ ID NO: 384439 - RNA, 64 nt, Human; identical to SEQ ID NO: 311952

SEQ ID NO: 384440 - RNA, 64 nt, Human; identical to SEQ ID NO: 357849

SEQ ID NO: 384441 - RNA, 64 nt, Human; identical to SEQ ID NO: 357850

SEQ ID NO: 384442 - RNA, 64 nt, Human; identical to SEQ ID NO: 357851

SEQ ID NO: 384443 - RNA, 64 nt, Human; identical to SEQ ID NO: 311953

SEQ ID NO: 384444 - RNA, 64 nt, Human; identical to SEQ ID NO: 311954

SEQ ID NO: 384445 - RNA, 64 nt, Human; identical to SEQ ID NO: 311955

SEQ ID NO: 384446 - RNA, 64 nt, Human; identical to SEQ ID NO: 311956

SEQ ID NO: 384447 - RNA, 64 nt, Human; identical to SEQ ID NO: 311957

SEQ ID NO: 384448 - RNA, 64 nt, Human; identical to SEQ ID NO: 311958

SEQ ID NO: 384449 - RNA, 64 nt, Human; identical to SEQ ID NO: 311959

SEQ ID NO: 384450 - RNA, 64 nt, Human; identical to SEQ ID NO: 311960

SEQ ID NO: 384451 - RNA, 64 nt, Human; identical to SEQ ID NO: 311961

SEQ ID NO: 384452 - RNA, 64 nt, Human; identical to SEQ ID NO: 311962

SEQ ID NO: 384453 - RNA, 64 nt, Human; identical to SEQ ID NO: 311963

SEQ ID NO: 384454 - RNA, 64 nt, Human; identical to SEQ ID NO: 311964

SEQ ID NO: 384455 - RNA, 64 nt, Human; identical to SEQ ID NO: 311965

SEQ ID NO: 384456 - RNA, 64 nt, Human; identical to SEQ ID NO: 311966

SEQ ID NO: 384457 - RNA, 64 nt, Human; identical to SEQ ID NO: 311967

SEQ ID NO: 384458 - RNA, 64 nt, Human; identical to SEQ ID NO: 357846

SEQ ID NO: 384459 - RNA, 64 nt, Human; identical to SEQ ID NO: 357847

SEQ ID NO: 384460 - RNA, 64 nt, Human; identical to SEQ ID NO: 357855

SEQ ID NO: 384461 - RNA, 64 nt, Human; identical to SEQ ID NO: 311968

SEQ ID NO: 384462 - RNA, 64 nt, Human; identical to SEQ ID NO: 311969

SEQ ID NO: 384463 - RNA, 64 nt, Human; identical to SEQ ID NO: 311970

SEQ ID NO: 384464 - RNA, 64 nt, Human; identical to SEQ ID NO: 311971

SEQ ID NO: 384465 - RNA, 64 nt, Human; identical to SEQ ID NO: 311972

SEQ ID NO: 384466 - RNA, 64 nt, Human; identical to SEQ ID NO: 311973

SEQ ID NO: 384467 - RNA, 64 nt, Human; identical to SEQ ID NO: 311974

SEQ ID NO: 384468 - RNA, 64 nt, Human; identical to SEQ ID NO: 311975

SEQ ID NO: 384469 - RNA, 64 nt, Human; identical to SEQ ID NO: 311976

SEQ ID NO: 384470 - RNA, 64 nt, Human; identical to SEQ ID NO: 311977

SEQ ID NO: 384471 - RNA, 64 nt, Human; identical to SEQ ID NO: 311978

SEQ ID NO: 384472 - RNA, 64 nt, Human; identical to SEQ ID NO: 311979

SEQ ID NO: 384473 - RNA, 64 nt, Human; identical to SEQ ID NO: 311980

SEQ ID NO: 384474 - RNA, 64 nt, Human; identical to SEQ ID NO: 311981

SEQ ID NO: 384475 - RNA, 64 nt, Human; identical to SEQ ID NO: 311982

SEQ ID NO: 384476 - RNA, 64 nt, Human; identical to SEQ ID NO: 357859

SEQ ID NO: 384477 - RNA, 64 nt, Human; identical to SEQ ID NO: 357860

SEQ ID NO: 384478 - RNA, 64 nt, Human; identical to SEQ ID NO: 357861

SEQ ID NO: 384479 - RNA, 64 nt, Human; identical to SEQ ID NO: 311983

SEQ ID NO: 384480 - RNA, 64 nt, Human; identical to SEQ ID NO: 311984

SEQ ID NO: 384481 - RNA, 64 nt, Human; identical to SEQ ID NO: 311985

SEQ ID NO: 384482 - RNA, 64 nt, Human; identical to SEQ ID NO: 311986

SEQ ID NO: 384483 - RNA, 64 nt, Human; identical to SEQ ID NO: 311987

SEQ ID NO: 384484 - RNA, 64 nt, Human; identical to SEQ ID NO: 311988

SEQ ID NO: 384485 - RNA, 64 nt, Human; identical to SEQ ID NO: 311989

SEQ ID NO: 384486 - RNA, 64 nt, Human; identical to SEQ ID NO: 311990

SEQ ID NO: 384487 - RNA, 64 nt, Human; identical to SEQ ID NO: 311991

SEQ ID NO: 384488 - RNA, 64 nt, Human; identical to SEQ ID NO: 311992

SEQ ID NO: 384489 - RNA, 64 nt, Human; identical to SEQ ID NO: 311993

SEQ ID NO: 384490 - RNA, 64 nt, Human; identical to SEQ ID NO: 311994

SEQ ID NO: 384491 - RNA, 64 nt, Human; identical to SEQ ID NO: 311995

SEQ ID NO: 384492 - RNA, 64 nt, Human; identical to SEQ ID NO: 311996

SEQ ID NO: 384493 - RNA, 64 nt, Human; identical to SEQ ID NO: 311997

SEQ ID NO: 384494 - RNA, 64 nt, Human; identical to SEQ ID NO: 357814

SEQ ID NO: 384495 - RNA, 64 nt, Human; identical to SEQ ID NO: 357815

SEQ ID NO: 384496 - RNA, 64 nt, Human; identical to SEQ ID NO: 357878

SEQ ID NO: 384497 - RNA, 64 nt, Human; identical to SEQ ID NO: 311998

SEQ ID NO: 384498 - RNA, 64 nt, Human; identical to SEQ ID NO: 311999

SEQ ID NO: 384499 - RNA, 64 nt, Human; identical to SEQ ID NO: 312000

SEQ ID NO: 384500 - RNA, 64 nt, Human; identical to SEQ ID NO: 312001

SEQ ID NO: 384501 - RNA, 64 nt, Human; identical to SEQ ID NO: 312002

SEQ ID NO: 384502 - RNA, 64 nt, Human; identical to SEQ ID NO: 312003

SEQ ID NO: 384503 - RNA, 64 nt, Human; identical to SEQ ID NO: 312004

SEQ ID NO: 384504 - RNA, 64 nt, Human; identical to SEQ ID NO: 312005

SEQ ID NO: 384505 - RNA, 64 nt, Human; identical to SEQ ID NO: 312006

SEQ ID NO: 384506 - RNA, 64 nt, Human; identical to SEQ ID NO: 312007

SEQ ID NO: 384507 - RNA, 64 nt, Human; identical to SEQ ID NO: 312008

SEQ ID NO: 384508 - RNA, 64 nt, Human; identical to SEQ ID NO: 312009

SEQ ID NO: 384509 - RNA, 64 nt, Human; identical to SEQ ID NO: 312010

SEQ ID NO: 384510 - RNA, 64 nt, Human; identical to SEQ ID NO: 312011

SEQ ID NO: 384511 - RNA, 64 nt, Human; identical to SEQ ID NO: 312012

SEQ ID NO: 384512 - RNA, 64 nt, Human; identical to SEQ ID NO: 357865

SEQ ID NO: 384513 - RNA, 64 nt, Human; identical to SEQ ID NO: 357866

SEQ ID NO: 384514 - RNA, 64 nt, Human; identical to SEQ ID NO: 357867

SEQ ID NO: 384515 - RNA, 64 nt, Human; identical to SEQ ID NO: 312013

SEQ ID NO: 384516 - RNA, 64 nt, Human; identical to SEQ ID NO: 312014

SEQ ID NO: 384517 - RNA, 64 nt, Human; identical to SEQ ID NO: 312015

SEQ ID NO: 384518 - RNA, 64 nt, Human; identical to SEQ ID NO: 312016

SEQ ID NO: 384519 - RNA, 64 nt, Human; identical to SEQ ID NO: 312017

SEQ ID NO: 384520 - RNA, 64 nt, Human; identical to SEQ ID NO: 312018

SEQ ID NO: 384521 - RNA, 64 nt, Human; identical to SEQ ID NO: 312019

SEQ ID NO: 384522 - RNA, 64 nt, Human; identical to SEQ ID NO: 312020

SEQ ID NO: 384523 - RNA, 64 nt, Human; identical to SEQ ID NO: 312021

SEQ ID NO: 384524 - RNA, 64 nt, Human; identical to SEQ ID NO: 312022

SEQ ID NO: 384525 - RNA, 64 nt, Human; identical to SEQ ID NO: 312023

SEQ ID NO: 384526 - RNA, 64 nt, Human; identical to SEQ ID NO: 312024

SEQ ID NO: 384527 - RNA, 64 nt, Human; identical to SEQ ID NO: 312025

SEQ ID NO: 384528 - RNA, 64 nt, Human; identical to SEQ ID NO: 312026

SEQ ID NO: 384529 - RNA, 64 nt, Human; identical to SEQ ID NO: 312027

SEQ ID NO: 384530 - RNA, 64 nt, Human; identical to SEQ ID NO: 357862

SEQ ID NO: 384531 - RNA, 64 nt, Human; identical to SEQ ID NO: 357863

SEQ ID NO: 384532 - RNA, 64 nt, Human; identical to SEQ ID NO: 357879

SEQ ID NO: 384533 - RNA, 64 nt, Human; identical to SEQ ID NO: 312028

SEQ ID NO: 384534 - RNA, 64 nt, Human; identical to SEQ ID NO: 312029

SEQ ID NO: 384535 - RNA, 64 nt, Human; identical to SEQ ID NO: 312030

SEQ ID NO: 384536 - RNA, 64 nt, Human; identical to SEQ ID NO: 312031

SEQ ID NO: 384537 - RNA, 64 nt, Human; identical to SEQ ID NO: 312032

SEQ ID NO: 384538 - RNA, 64 nt, Human; identical to SEQ ID NO: 312033

SEQ ID NO: 384539 - RNA, 64 nt, Human; identical to SEQ ID NO: 312034

SEQ ID NO: 384540 - RNA, 64 nt, Human; identical to SEQ ID NO: 312035

SEQ ID NO: 384541 - RNA, 64 nt, Human; identical to SEQ ID NO: 312036

SEQ ID NO: 384542 - RNA, 64 nt, Human; identical to SEQ ID NO: 312037

SEQ ID NO: 384543 - RNA, 64 nt, Human; identical to SEQ ID NO: 312038

SEQ ID NO: 384544 - RNA, 64 nt, Human; identical to SEQ ID NO: 312039

SEQ ID NO: 384545 - RNA, 64 nt, Human; identical to SEQ ID NO: 312040

SEQ ID NO: 384546 - RNA, 64 nt, Human; identical to SEQ ID NO: 312041

SEQ ID NO: 384547 - RNA, 64 nt, Human; identical to SEQ ID NO: 312042

SEQ ID NO: 384548 - RNA, 64 nt, Human; identical to SEQ ID NO: 357852

SEQ ID NO: 384549 - RNA, 64 nt, Human; identical to SEQ ID NO: 357853

SEQ ID NO: 384550 - RNA, 64 nt, Human; identical to SEQ ID NO: 357870

SEQ ID NO: 384551 - RNA, 64 nt, Human; identical to SEQ ID NO: 312043

SEQ ID NO: 384552 - RNA, 64 nt, Human; identical to SEQ ID NO: 312044

SEQ ID NO: 384553 - RNA, 64 nt, Human; identical to SEQ ID NO: 312045

SEQ ID NO: 384554 - RNA, 64 nt, Human; identical to SEQ ID NO: 312046

SEQ ID NO: 384555 - RNA, 64 nt, Human; identical to SEQ ID NO: 312047

SEQ ID NO: 384556 - RNA, 64 nt, Human; identical to SEQ ID NO: 312048

SEQ ID NO: 384557 - RNA, 64 nt, Human; identical to SEQ ID NO: 312049

SEQ ID NO: 384558 - RNA, 64 nt, Human; identical to SEQ ID NO: 312050

SEQ ID NO: 384559 - RNA, 64 nt, Human; identical to SEQ ID NO: 312051

SEQ ID NO: 384560 - RNA, 64 nt, Human; identical to SEQ ID NO: 312052

SEQ ID NO: 384561 - RNA, 64 nt, Human; identical to SEQ ID NO: 312053

SEQ ID NO: 384562 - RNA, 64 nt, Human; identical to SEQ ID NO: 312054

SEQ ID NO: 384563 - RNA, 64 nt, Human; identical to SEQ ID NO: 312055

SEQ ID NO: 384564 - RNA, 64 nt, Human; identical to SEQ ID NO: 312056

SEQ ID NO: 384565 - RNA, 64 nt, Human; identical to SEQ ID NO: 312057

SEQ ID NO: 384566 - RNA, 64 nt, Human; identical to SEQ ID NO: 186622

SEQ ID NO: 384567 - RNA, 64 nt, Human; identical to SEQ ID NO: 186623

SEQ ID NO: 384568 - RNA, 64 nt, Human; identical to SEQ ID NO: 186624

SEQ ID NO: 384569 - RNA, 64 nt, Human; identical to SEQ ID NO: 312058

SEQ ID NO: 384570 - RNA, 64 nt, Human; identical to SEQ ID NO: 312059

SEQ ID NO: 384571 - RNA, 64 nt, Human; identical to SEQ ID NO: 312060

SEQ ID NO: 384572 - RNA, 64 nt, Human; identical to SEQ ID NO: 312061

SEQ ID NO: 384573 - RNA, 64 nt, Human; identical to SEQ ID NO: 312062

SEQ ID NO: 384574 - RNA, 64 nt, Human; identical to SEQ ID NO: 312063

SEQ ID NO: 384575 - RNA, 54 nt, Human; identical to SEQ ID NO: 312064

SEQ ID NO: 384576 - RNA, 64 nt, Human; identical to SEQ ID NO: 312065

SEQ ID NO: 384577 - RNA, 64 nt, Human; identical to SEQ ID NO: 312066

SEQ ID NO: 384578 - RNA, 64 nt, Human; identical to SEQ ID NO: 312067

SEQ ID NO: 384579 - RNA, 64 nt, Human; identical to SEQ ID NO: 312068

SEQ ID NO: 384580 - RNA, 64 nt, Human; identical to SEQ ID NO: 312069

SEQ ID NO: 384581 - RNA, 64 nt, Human; identical to SEQ ID NO: 312070

SEQ ID NO: 384582 - RNA, 64 nt, Human; identical to SEQ ID NO: 312071

SEQ ID NO: 384583 - RNA, 64 nt, Human; identical to SEQ ID NO: 312072

SEQ ID NO: 384584 - RNA, 64 nt, Human; identical to SEQ ID NO: 186625

SEQ ID NO: 384585 - RNA, 64 nt, Human; identical to SEQ ID NO: 186626

SEQ ID NO: 384586 - RNA, 64 nt, Human; identical to SEQ ID NO: 186628

SEQ ID NO: 384587 - RNA, 64 nt, Human; identical to SEQ ID NO: 312073

SEQ ID NO: 384588 - RNA, 64 nt, Human; identical to SEQ ID NO: 312074

SEQ ID NO: 384589 - RNA, 64 nt, Human; identical to SEQ ID NO: 312075

SEQ ID NO: 384590 - RNA, 64 nt, Human; identical to SEQ ID NO: 312076

SEQ ID NO: 384591 - RNA, 64 nt, Human; identical to SEQ ID NO: 312077

SEQ ID NO: 384592 - RNA, 64 nt, Human; identical to SEQ ID NO: 312078

SEQ ID NO: 384593 - RNA, 64 nt, Human; identical to SEQ ID NO: 312079

SEQ ID NO: 384594 - RNA, 64 nt, Human; identical to SEQ ID NO: 312080

SEQ ID NO: 384595 - RNA, 64 nt, Human; identical to SEQ ID NO: 312081

SEQ ID NO: 384596 - RNA, 64 nt, Human; identical to SEQ ID NO: 312082

SEQ ID NO: 384597 - RNA, 64 nt, Human; identical to SEQ ID NO: 312083

SEQ ID NO: 384598 - RNA, 64 nt, Human; identical to SEQ ID NO: 312084

SEQ ID NO: 384599 - RNA, 64 nt, Human; identical to SEQ ID NO: 312085

SEQ ID NO: 384600 - RNA, 64 nt, Human; identical to SEQ ID NO: 312086

SEQ ID NO: 384601 - RNA, 64 nt, Human; identical to SEQ ID NO: 312087

SEQ ID NO: 384602 - RNA, 64 nt, Human; identical to SEQ ID NO: 186632

SEQ ID NO: 384603 - RNA, 64 nt, Human; identical to SEQ ID NO: 186633

SEQ ID NO: 384604 - RNA, 64 nt, Human; identical to SEQ ID NO: 186634

SEQ ID NO: 384605 - RNA, 64 nt, Human; identical to SEQ ID NO: 312088

SEQ ID NO: 384606 - RNA, 64 nt, Human; identical to SEQ ID NO: 312089

SEQ ID NO: 384607 - RNA, 64 nt, Human; identical to SEQ ID NO: 312090

SEQ ID NO: 384608 - RNA, 64 nt, Human; identical to SEQ ID NO: 312091

SEQ ID NO: 384609 - RNA, 64 nt, Human; identical to SEQ ID NO: 312092

SEQ ID NO: 384610 - RNA, 64 nt, Human; identical to SEQ ID NO: 312093

SEQ ID NO: 384611 - RNA, 64 nt, Human; identical to SEQ ID NO: 312094

SEQ ID NO: 384612 - RNA, 64 nt, Human; identical to SEQ ID NO: 312095

SEQ ID NO: 384613 - RNA, 64 nt, Human; identical to SEQ ID NO: 312096

SEQ ID NO: 384614 - RNA, 64 nt, Human; identical to SEQ ID NO: 312097

SEQ ID NO: 384615 - RNA, 64 nt, Human; identical to SEQ ID NO: 312098

SEQ ID NO: 384616 - RNA, 64 nt, Human; identical to SEQ ID NO: 312099

SEQ ID NO: 384617 - RNA, 64 nt, Human; identical to SEQ ID NO: 312100

SEQ ID NO: 384618 - RNA, 64 nt, Human; identical to SEQ ID NO: 312101

SEQ ID NO: 384619 - RNA, 64 nt, Human; identical to SEQ ID NO: 312102

SEQ ID NO: 384620 - RNA, 64 nt, Human; identical to SEQ ID NO: 186629

SEQ ID NO: 384621 - RNA, 64 nt, Human; identical to SEQ ID NO: 186630

SEQ ID NO: 384622 - RNA, 62 nt, Human; identical to SEQ ID NO: 357871

SEQ ID NO: 384623 - RNA, 64 nt, Human; identical to SEQ ID NO: 312103

SEQ ID NO: 384624 - RNA, 64 nt, Human; identical to SEQ ID NO: 312104

SEQ ID NO: 384625 - RNA, 64 nt, Human; identical to SEQ ID NO: 312105

SEQ ID NO: 384626 - RNA, 64 nt, Human; identical to SEQ ID NO: 312106

SEQ ID NO: 384627 - RNA, 64 nt, Human; identical to SEQ ID NO: 312107

SEQ ID NO: 384628 - RNA, 64 nt, Human; identical to SEQ ID NO: 312108

SEQ ID NO: 384629 - RNA, 64 nt, Human; identical to SEQ ID NO: 312109

SEQ ID NO: 384630 - RNA, 64 nt, Human; identical to SEQ ID NO: 312110

SEQ ID NO: 384631 - RNA, 64 nt, Human; identical to SEQ ID NO: 312111

SEQ ID NO: 384632 - RNA, 64 nt, Human; identical to SEQ ID NO: 312112

SEQ ID NO: 384633 - RNA, 64 nt, Human; identical to SEQ ID NO: 312113

SEQ ID NO: 384634 - RNA, 64 nt, Human; identical to SEQ ID NO: 312114

SEQ ID NO: 384635 - RNA, 64 nt, Human; identical to SEQ ID NO: 312115

SEQ ID NO: 384636 - RNA, 64 nt, Human; identical to SEQ ID NO: 312116

SEQ ID NO: 384637 - RNA, 64 nt, Human; identical to SEQ ID NO: 312117

SEQ ID NO: 384638 - RNA, 64 nt, Human; identical to SEQ ID NO: 186638

SEQ ID NO: 384639 - RNA, 64 nt, Human; identical to SEQ ID NO: 186639

SEQ ID NO: 384640 - RNA, 64 nt, Human; identical to SEQ ID NO: 357804

SEQ ID NO: 384641 - RNA, 64 nt, Human; identical to SEQ ID NO: 312118

SEQ ID NO: 384642 - RNA, 64 nt, Human; identical to SEQ ID NO: 312119

SEQ ID NO: 384643 - RNA, 64 nt, Human; identical to SEQ ID NO: 312120

SEQ ID NO: 384644 - RNA, 64 nt, Human; identical to SEQ ID NO: 312121

SEQ ID NO: 384645 - RNA, 64 nt, Human; identical to SEQ ID NO: 312122

SEQ ID NO: 384646 - RNA, 64 nt, Human; identical to SEQ ID NO: 312123

SEQ ID NO: 384647 - RNA, 64 nt, Human; identical to SEQ ID NO: 312124

SEQ ID NO: 384648 - RNA, 64 nt, Human; identical to SEQ ID NO: 312125

SEQ ID NO: 384649 - RNA, 64 nt, Human; identical to SEQ ID NO: 312126

SEQ ID NO: 384650 - RNA, 64 nt, Human; identical to SEQ ID NO: 312127

SEQ ID NO: 384651 - RNA, 64 nt, Human; identical to SEQ ID NO: 312128

SEQ ID NO: 384652 - RNA, 64 nt, Human; identical to SEQ ID NO: 312129

SEQ ID NO: 384653 - RNA, 64 nt, Human; identical to SEQ ID NO: 312130

SEQ ID NO: 384654 - RNA, 64 nt, Human; identical to SEQ ID NO: 312131

SEQ ID NO: 384655 - RNA, 64 nt, Human; identical to SEQ ID NO: 312132

SEQ ID NO: 384656 - RNA, 64 nt, Human; identical to SEQ ID NO: 186606

SEQ ID NO: 384657 - RNA, 64 nt, Human; identical to SEQ ID NO: 186607

SEQ ID NO: 384658 - RNA, 64 nt, Human; identical to SEQ ID NO: 357805

SEQ ID NO: 384659 - RNA, 64 nt, Human; identical to SEQ ID NO: 312133

SEQ ID NO: 384660 - RNA, 64 nt, Human; identical to SEQ ID NO: 312134

SEQ ID NO: 384661 - RNA, 64 nt, Human; identical to SEQ ID NO: 312135

SEQ ID NO: 384662 - RNA, 64 nt, Human; identical to SEQ ID NO: 312136

SEQ ID NO: 384663 - RNA, 64 nt, Human; identical to SEQ ID NO: 312137

SEQ ID NO: 384664 - RNA, 64 nt, Human; identical to SEQ ID NO: 312138

SEQ ID NO: 384665 - RNA, 64 nt, Human; identical to SEQ ID NO: 312139

SEQ ID NO: 384666 - RNA, 64 nt, Human; identical to SEQ ID NO: 312140

SEQ ID NO: 384667 - RNA, 64 nt, Human; identical to SEQ ID NO: 312141

SEQ ID NO: 384668 - RNA, 64 nt, Human; identical to SEQ ID NO: 312142

SEQ ID NO: 384669 - RNA, 64 nt, Human; identical to SEQ ID NO: 312143

SEQ ID NO: 384670 - RNA, 64 nt, Human; identical to SEQ ID NO: 312144

SEQ ID NO: 384671 - RNA, 64 nt, Human; identical to SEQ ID NO: 312145

SEQ ID NO: 384672 - RNA, 64 nt, Human; identical to SEQ ID NO: 312146

SEQ ID NO: 384673 - RNA, 64 nt, Human; identical to SEQ ID NO: 312147

SEQ ID NO: 384674 - RNA, 64 nt, Human; identical to SEQ ID NO: 186635

SEQ ID NO: 384675 - RNA, 64 nt, Human; identical to SEQ ID NO: 186636

SEQ ID NO: 384676 - RNA, 64 nt, Human; identical to SEQ ID NO: 357807

SEQ ID NO: 384677 - RNA, 64 nt, Human; identical to SEQ ID NO: 312148

SEQ ID NO: 384678 - RNA, 64 nt, Human; identical to SEQ ID NO: 312149

SEQ ID NO: 384679 - RNA, 64 nt, Human; identical to SEQ ID NO: 312150

SEQ ID NO: 384680 - RNA, 64 nt, Human; identical to SEQ ID NO: 312151

SEQ ID NO: 384681 - RNA, 64 nt, Human; identical to SEQ ID NO: 312152

SEQ ID NO: 384682 - RNA, 64 nt, Human; identical to SEQ ID NO: 312153

SEQ ID NO: 384683 - RNA, 64 nt, Human; identical to SEQ ID NO: 312154

SEQ ID NO: 384684 - RNA, 64 nt, Human; identical to SEQ ID NO: 312155

SEQ ID NO: 384685 - RNA, 64 nt, Human; identical to SEQ ID NO: 312156

SEQ ID NO: 384686 - RNA, 64 nt, Human; identical to SEQ ID NO: 312157

SEQ ID NO: 384687 - RNA, 64 nt, Human; identical to SEQ ID NO: 312158

SEQ ID NO: 384688 - RNA, 64 nt, Human; identical to SEQ ID NO: 312159

SEQ ID NO: 384689 - RNA, 64 nt, Human; identical to SEQ ID NO: 312160

SEQ ID NO: 384690 - RNA, 64 nt, Human; identical to SEQ ID NO: 312161

SEQ ID NO: 384691 - RNA, 64 nt, Human; identical to SEQ ID NO: 312162

SEQ ID NO: 384692 - RNA, 64 nt, Human; identical to SEQ ID NO: 357808

SEQ ID NO: 384693 - RNA, 64 nt, Human; identical to SEQ ID NO: 357809

SEQ ID NO: 384694 - RNA, 64 nt, Human; identical to SEQ ID NO: 357873

SEQ ID NO: 384695 - RNA, 64 nt, Human; identical to SEQ ID NO: 312163

SEQ ID NO: 384696 - RNA, 64 nt, Human; identical to SEQ ID NO: 312164

SEQ ID NO: 384697 - RNA, 64 nt, Human; identical to SEQ ID NO: 312165

SEQ ID NO: 384698 - RNA, 64 nt, Human; identical to SEQ ID NO: 312166

SEQ ID NO: 384699 - RNA, 64 nt, Human; identical to SEQ ID NO: 312167

SEQ ID NO: 384700 - RNA, 64 nt, Human; identical to SEQ ID NO: 312168

SEQ ID NO: 384701 - RNA, 64 nt, Human; identical to SEQ ID NO: 312169

SEQ ID NO: 384702 - RNA, 64 nt, Human; identical to SEQ ID NO: 312170

SEQ ID NO: 384703 - RNA, 64 nt, Human; identical to SEQ ID NO: 312171

SEQ ID NO: 384704 - RNA, 64 nt, Human; identical to SEQ ID NO: 312172

SEQ ID NO: 384705 - RNA, 64 nt, Human; identical to SEQ ID NO: 312173

SEQ ID NO: 384706 - RNA, 64 nt, Human; identical to SEQ ID NO: 312174

SEQ ID NO: 384707 - RNA, 64 nt, Human; identical to SEQ ID NO: 312175

SEQ ID NO: 384708 - RNA, 63 nt, Human; identical to SEQ ID NO: 312176

SEQ ID NO: 384709 - RNA, 64 nt, Human; identical to SEQ ID NO: 312177

SEQ ID NO: 384710 - RNA, 64 nt, Human; identical to SEQ ID NO: 357811

SEQ ID NO: 384711 - RNA, 64 nt, Human; identical to SEQ ID NO: 357812

SEQ ID NO: 384712 - RNA, 64 nt, Human; identical to SEQ ID NO: 357813

SEQ ID NO: 384713 - RNA, 64 nt, Human; identical to SEQ ID NO: 312178

SEQ ID NO: 384714 - RNA, 64 nt, Human; identical to SEQ ID NO: 312179

SEQ ID NO: 384715 - RNA, 64 nt, Human; identical to SEQ ID NO: 312180

SEQ ID NO: 384716 - RNA, 64 nt, Human; identical to SEQ ID NO: 312181

SEQ ID NO: 384717 - RNA, 64 nt, Human; identical to SEQ ID NO: 312182

SEQ ID NO: 384718 - RNA, 64 nt, Human; identical to SEQ ID NO: 312183

SEQ ID NO: 384719 - RNA, 64 nt, Human; identical to SEQ ID NO: 312184

SEQ ID NO: 384720 - RNA, 64 nt, Human; identical to SEQ ID NO: 312185

SEQ ID NO: 384721 - RNA, 64 nt, Human; identical to SEQ ID NO: 312186

SEQ ID NO: 384722 - RNA, 64 nt, Human; identical to SEQ ID NO: 312187

SEQ ID NO: 384723 - RNA, 64 nt, Human; identical to SEQ ID NO: 312188

SEQ ID NO: 384724 - RNA, 64 nt, Human; identical to SEQ ID NO: 312189

SEQ ID NO: 384725 - RNA, 64 nt, Human; identical to SEQ ID NO: 312190

SEQ ID NO: 384726 - RNA, 64 nt, Human; identical to SEQ ID NO: 312191

SEQ ID NO: 384727 - RNA, 64 nt, Human; identical to SEQ ID NO: 312192

SEQ ID NO: 384728 - RNA, 64 nt, Human; identical to SEQ ID NO: 357817

SEQ ID NO: 384729 - RNA, 57 nt, Human; identical to SEQ ID NO: 357818

SEQ ID NO: 384730 - RNA, 64 nt, Human; identical to SEQ ID NO: 357819

SEQ ID NO: 384731 - RNA, 64 nt, Human; identical to SEQ ID NO: 312193

SEQ ID NO: 384732 - RNA, 64 nt, Human; identical to SEQ ID NO: 312194

SEQ ID NO: 384733 - RNA, 64 nt, Human; identical to SEQ ID NO: 312195

SEQ ID NO: 384734 - RNA, 64 nt, Human; identical to SEQ ID NO: 312196

SEQ ID NO: 384735 - RNA, 64 nt, Human; identical to SEQ ID NO: 312197

SEQ ID NO: 384736 - RNA, 64 nt, Human; identical to SEQ ID NO: 312198

SEQ ID NO: 384737 - RNA, 64 nt, Human; identical to SEQ ID NO: 312199

SEQ ID NO: 384738 - RNA, 64 nt, Human; identical to SEQ ID NO: 312200

SEQ ID NO: 384739 - RNA, 64 nt, Human; identical to SEQ ID NO: 312201

SEQ ID NO: 384740 - RNA, 64 nt, Human; identical to SEQ ID NO: 312202

SEQ ID NO: 384741 - RNA, 54 nt, Human; identical to SEQ ID NO: 312203

SEQ ID NO: 384742 - RNA, 64 nt, Human; identical to SEQ ID NO: 312204

SEQ ID NO: 384743 - RNA, 64 nt, Human; identical to SEQ ID NO: 312205

SEQ ID NO: 384744 - RNA, 64 nt, Human; identical to SEQ ID NO: 312206

SEQ ID NO: 384745 - RNA, 64 nt, Human; identical to SEQ ID NO: 186616

SEQ ID NO: 384746 - RNA, 64 nt, Human; identical to SEQ ID NO: 186617

SEQ ID NO: 384747 - RNA, 64 nt, Human
gaggcugggaugggaagugugccugcccucgugugacauggaauuggugucaggaccgccacgu

SEQ ID NO: 384748 - RNA, 64 nt, Human
accggaaggcugguucuccugccagggucccuuugacauggacagcugcuuaucaagacacucc

SEQ ID NO: 384749 - RNA, 64 nt, Human
ccacccagagcgagcaaacgcugagaccugaaaggacauggaugagaagaggagcccgcuuccu

SEQ ID NO: 384750 - RNA, 64 nt, Human
uccucaucuuuuuguuguugucauugauuuuggugacauggacuuguuuguagaggacagguca

SEQ ID NO: 384751 - RNA, 64 nt, Human
uccugcuuucuuuuuggagcuucuuugggucaaagacauggaaguugcuucagauaucugauac

SEQ ID NO: 384752 - RNA, 64 nt, Human
caggcaagagcacucuggguuccacagcacagcagacauggaacgcugaagucucugaaaguga

SEQ ID NO: 384753 - RNA, 64 nt, Human
agguacuuguccuuucccuuuguaaacuacauuugacauggauuaaaccaguauaaacaguugc

SEQ ID NO: 384754 - RNA, 64 nt, Human
gauuuauccaauguugggucaagaacauugcuucgacauggaaauuaacauggaacauugcuuu

SEQ ID NO: 384755 - RNA, 64 nt, Human
uauauucaccucaugguagguuauauugaaggcugacauggagaauguuuacuuuucuauuugg

SEQ ID NO: 384756 - RNA, 64 nt, Human
cagacccucccucacacgcccagagccuucugcugacauggacuggacagccccgcugggagac

SEQ ID NO: 384757 - RNA, 64 nt, Human
aaauaggggcacacacagaugauucauggauggggacauggaaaugagaauagguuaaauggug

SEQ ID NO: 384758 - RNA, 64 nt, Human
cggguucccaugaaucuucugcucuuguuugugugacauggaacaaauaacuucuuugccacca

SEQ ID NO: 384759 - RNA, 64 nt, Human
ucagcucuagggugaaaggcgagagguugcacaggacauggacagagcagcccuuggguuugua

SEQ ID NO: 384760 - RNA, 64 nt, Human
gccugugggagccugcaaacucacugcucaagaagacauggagacuccugcccuguuguguaua

SEQ ID NO: 384761 - RNA, 64 nt, Human
uuaauguuaugcuguucuuucaugugaaugucaagacauggaggguguuuguaauuuuauggua

SEQ ID NO: 384762 - RNA, 64 nt, Human; identical to SEQ ID NO: 186581

SEQ ID NO: 384763 - RNA, 64 nt, Human; identical to SEQ ID NO: 186582

SEQ ID NO: 384764 - RNA, 64 nt, Human; identical to SEQ ID NO: 186583

SEQ ID NO: 384765 - RNA, 64 nt, Human
guguuacugguauacccaguauguucucacugaagacauggacuuuauauguucaagugcagga

SEQ ID NO: 384766 - RNA, 64 nt, Human
uccucaucuuuuuguuguugucauggaugguggugacauggacuuguuuauagaggacagguca

SEQ ID NO: 384767 - RNA, 64 nt, Human
cucauuugaggaacagcacaucagcuuugcccuugacauggacaauagguuuuuuacuuugacg

SEQ ID NO: 384768 - RNA, 64 nt, Human
cguauuggagcaacagcguauuggcuuggcuguugacauggauggugaguaccuuucuaugaag

SEQ ID NO: 384769 - RNA, 64 nt, Human
gccaucuacugcugcuguacccuaggaauauggggacauggacauggugucccaugcccagaug

SEQ ID NO: 384770 - RNA, 64 nt, Human
gagggguaaguuuaggcuuucgcggaggggaggagacauggagccugggaacuccuuguucucc

SEQ ID NO: 384771 - RNA, 64 nt, Human
augacaaaccccuggcuuuccugccagaugguaggacauggaccuugaccugggaaagccauua

SEQ ID NO: 384772 - RNA, 64 nt, Human
ugcugcagguuuccauaaacacccaugaaucaaagacauggaauuaccuuagauuagcucugga

SEQ ID NO: 384773 - RNA, 64 nt, Human
uccaaaaacaaucagggucauaaccauccaugcagacauggaggcucggcugaaccaggacucc

SEQ ID NO: 384774 - RNA, 64 nt, Human
aagcagucugggccagaugcccugccaggaaagggacauggacccacgugcuugaggccuggca

SEQ ID NO: 384775 - RNA, 64 nt, Human
cagaauaacagcacgugacgaguggguauuugcugacauggaccuacugcauaaaguuguagcu

SEQ ID NO: 384776 - RNA, 64 nt, Human
uugaaacugugucuugaagcuaauguauuaaugugacauggaggaacucaauaaaacuccugcu

SEQ ID NO: 384777 - RNA, 64 nt, Human
aacaaagauacgcuuuccauuugaugauggaguugacauggaggcagugcuugcauugcuuugu

SEQ ID NO: 384778 - RNA, 64 nt, Human
ucagaaucccaaaagaaaaccuuguggaccaugugacauggaauauuugggauaauguaucaaa

SEQ ID NO: 384779 - RNA, 64 nt, Human
uuuauugccaaucuuugaacucauucaacuccaggacauggaagaggccucucucugcccuuug

SEQ ID NO: 384780 - RNA, 64 nt, Human; identical to SEQ ID NO: 357823

SEQ ID NO: 384781 - RNA, 64 nt, Human; identical to SEQ ID NO: 357824

SEQ ID NO: 384782 - RNA, 64 nt, Human; identical to SEQ ID NO: 357825

SEQ ID NO: 384783 - RNA, 64 nt, Human
gccaucagcagcuagagguggcuggcuuuggccagacauggacccuaaaucaacagacaauggc

SEQ ID NO: 384784 - RNA, 64 nt, Human
cuggaggcaagguggugacaggcagcaggguggcgacauggagagagggaagcucaauaaauca

SEQ ID NO: 384785 - RNA, 64 nt, Human
uucagacaggguugauaaagugaggacgaucauagacauggaguacuuagacauauuaauaaac

SEQ ID NO: 384786 - RNA, 64 nt, Human
gagcaccgagugagcacacucaccacucagucaggacauggacuuggaacucaggauggggcug

SEQ ID NO: 384787 - RNA, 64 nt, Human
ugagucugccccucaggggaauucggagcuagaggacauggaaaauaaagccaggaaagucaaa

SEQ ID NO: 384788 - RNA, 64 nt, Human
caucugcgaaugugcccuaggugcugcugcuggggacauggaugccaagcggaggccugcgugg

SEQ ID NO: 384789 - RNA, 64 nt, Human
aacuuuucuagagaagacaaaagcuuacacuggugacauggauaagugagauggugucuaacga

SEQ ID NO: 384790 - RNA, 64 nt, Human
aaaaugagcuugauuaaaucaaccaccuauuuuugacauggaaaugaagcaggguuucuuuucu

SEQ ID NO: 384791 - RNA, 64 nt, Human
ccaugucuugucuguacauaugaccauguuucuugacauggaaauaccagucaguguuccuaug

SEQ ID NO: 384792 - RNA, 64 nt, Human
cauaaaucccugauacucaaagucuaacaagaaagacauggaaaauuagcagcccauuuucaga

SEQ ID NO: 384793 - RNA, 64 nt, Human
gagagaaaaaucccggugcuugguguccuugcaugacauggaguuuugcauguagaucaauuua

SEQ ID NO: 384794 - RNA, 64 nt, Human
cccucuaucacugacacaucagugacgaugggaagacauggaaaacaaggagaagaaaaugaug

SEQ ID NO: 384795 - RNA, 64 nt, Human
agguugcuguuucaaauaacucacaggcccaggugacauggaaucuuggagcagccuugugcag

SEQ ID NO: 384796 - RNA, 64 nt, Human
uaguacuuugaaauuaucacccauauaaaagagggacauggacuauaacguugauuucuuauug

SEQ ID NO: 384797 - RNA, 64 nt, Human
aguacucggguuucauauuuugcuguuuuugauggacauggaggaauucgagccucaaaauuug

SEQ ID NO: 384798 - RNA, 64 nt, Human; identical to SEQ ID NO: 186586

SEQ ID NO: 384799 - RNA, 64 nt, Human; identical to SEQ ID NO: 186587

SEQ ID NO: 384800 - RNA, 64 nt, Human
gcucaaaaugauauguuugaguagacgaacagcugacauggaguucccgugcaccuacggaagg

SEQ ID NO: 384801 - RNA, 64 nt, Human
uggaacacaagcuccucuggauccugcagcuggugacauggaacuguuuucugguccacaugaa

SEQ ID NO: 384802 - RNA, 64 nt, Human
ucugauguguguugucagccugugcuguggcauagacauggaugcgaggaccacuuuggagacu

SEQ ID NO: 384803 - RNA, 64 nt, Human
ugucaaggagcacuugcaggcagaaugggaggaggacauggagcugauggaguccaggcugugc

SEQ ID NO: 384804 - RNA, 64 nt, Human
gcccuagcaaggggagacauugugguagcuaucagacauggacagaaacugacuuagugcucac

SEQ ID NO: 384805 - RNA, 64 nt, Human
ucuuuccaguaaucccuugugucuguugcaugaggacauggacaauaaaguaguauaugauccu

SEQ ID NO: 384806 - RNA, 64 nt, Human
auuagaagaugaacagguauuuugaaucugaucugacauggaacaguuuaccucauuguaggua

SEQ ID NO: 384807 - RNA, 64 nt, Human
agugugggaguuguaauuaggaucauccaccccagacauggaauccccccucccugguggucuu

SEQ ID NO: 384808 - RNA, 64 nt, Human
uccucuagggccaccaggcugaggacucgcccaggacauggacuggucucucagaccccugggc

SEQ ID NO: 384809 - RNA, 64 nt, Human
auauaaauauuugguaauucuguguaacaagagagacauggaaaaggaaaaaaauccacuauau

SEQ ID NO: 384810 - RNA, 64 nt, Human
uuucccaaaacaagcccuuccuggcucccacccagacauggaccagccaugcacccgcccagcc

SEQ ID NO: 384811 - RNA, 64 nt, Human
caccagcaagccugugagcauuguguauauagcagacauggagguccugcagcaggaggugcuc

SEQ ID NO: 384812 - RNA, 64 nt, Human
cacuuuguggagagggcauuacuuguucguuauagacauggacguuaagagauauucaaaacuc

SEQ ID NO: 384813 - RNA, 64 nt, Human
cugaacaaagguuaucaaccacacauccaguccugacauggagcuuuucaguguuuggagacau

SEQ ID NO: 384814 - RNA, 64 nt, Human
ugauuguucaaccaugggagaguugaguaauugugacauggaccauaggcccuaaagagccaaa

SEQ ID NO: 384815 - RNA, 64 nt, Human; identical to SEQ ID NO: 186588

SEQ ID NO: 384816 - RNA, 64 nt, Human; identical to SEQ ID NO: 186589

SEQ ID NO: 384817 - RNA, 64 nt, Human; identical to SEQ ID NO: 186591

SEQ ID NO: 384818 - RNA, 64 nt, Human
uguuaccuuccucagggcuuagggagggagggaggacauggacagggccuuccacccuggcucc

SEQ ID NO: 384819 - RNA, 64 nt, Human
agcauguucaaugaugguuacucgccuaguacaagacauggagaagaaaccuuuggacacagag

SEQ ID NO: 384820 - RNA, 64 nt, Human
ucuagcuccauacuucugauugccuaauaaauaugacauggauguucaguggaacuucccaucu

SEQ ID NO: 384821 - RNA, 64 nt, Human
gaguuuguuuggacaaccuaacucagcuuuauuugacauggaaccuaaaauagaagauaagauc

SEQ ID NO: 384822 - RNA, 64 nt, Human
ucuuuuaaauaugagcccauuuagaucaagugcagacauggaucauuguccuaugagaguguaa

SEQ ID NO: 384823 - RNA, 64 nt, Human
acuugaagauagcuuaguguaaacacaagccuaggacauggacuagguaaagacaaaguccuug

SEQ ID NO: 384824 - RNA, 64 nt, Human
uuccaaagaaacauguuaaaaaaaaaaauuauaagacauggacuaguccucauuagcauguuug

SEQ ID NO: 384825 - RNA, 64 nt, Human
augauuuuacagauagaugcuuccccuuggcuaugacauggagaaagauuuucccauaauaaua

SEQ ID NO: 384826 - RNA, 64 nt, Human
ucaaaagaaaauuuucuuucaacauuucuugaaggacauggaguggagauuggaucauuuaaca

SEQ ID NO: 384827 - RNA, 64 nt, Human
cuaagacuggcaggguauuaacuccauuccaggugacauggauaaagagccccauuauuuucac

SEQ ID NO: 384828 - RNA, 64 nt, Human
ugauaccauggaauauuucaucucaccaagaugugacauggauuauuuuucccuuggacacaaa

SEQ ID NO: 384829 - RNA, 64 nt, Human
uuuucuaggccaaguacuucacuuccauuugucugacauggagauugagggagaaauguauuug

SEQ ID NO: 384830 - RNA, 64 nt, Human
agagaaauaauuauaucagaaacucacaaaccuagacauggaaaaacagauuacugucuauugu

SEQ ID NO: 384831 - RNA, 52 nt, Human
ccacugggccugauacuuagcugacauggauuugcagaccccagggugggca

SEQ ID NO: 384832 - RNA, 64 nt, Human
uugcuuuucuguugguagagcucucccauuuggugacauggaaaauaccuuuccauuaucacaa

SEQ ID NO: 384833 - RNA, 64 nt, Human; identical to SEQ ID NO: 186602

SEQ ID NO: 384834 - RNA, 64 nt, Human; identical to SEQ ID NO: 186603

SEQ ID NO: 384835 - RNA, 64 nt, Human; identical to SEQ ID NO: 357802

SEQ ID NO: 384836 - RNA, 64 nt, Human
auguuaugauaggacauaguaguagcgguggucagacauggaaaugguggggagacaaaaauau

SEQ ID NO: 384837 - RNA, 64 nt, Human
ucuuugucuugacaaccgggugguccuguuucuagacauggaagcuuagaaaagccuggagucu

SEQ ID NO: 384838 - RNA, 64 nt, Human
aaggauuacauguuauguaaauuuuuaugugacugacauggagccuggaugacuaucguguacu

SEQ ID NO: 384839 - RNA, 64 nt, Human
gcacagcacacacgugcagugcacacaaagaaaugacauggaaauagaugcaggcaggcugguc

SEQ ID NO: 384840 - RNA, 64 nt, Human
agacccccaucucuaaaaaaaaaaaaauuaauaagacauggauacaaccagggagggagguuau

SEQ ID NO: 384841 - RNA, 64 nt, Human
ucaaacagcgacauagccauacaucugacugccugacauggacuccugcccacuugggggaaac

SEQ ID NO: 384842 - RNA, 64 nt, Human
gaacuuaacauuuauuccaugugaaagaaagugagacauggacaagacucuagucauaaauuac

SEQ ID NO: 384843 - RNA, 64 nt, Human
gggggagggaugcagggacauuuacugaaggagggacauggacaaaacaacauugaauucccag

SEQ ID NO: 384844 - RNA, 64 nt, Human
ccugucuuuggugagcagcagcccuggggucacagacauggaagggaccacccuggggcugacu

SEQ ID NO: 384845 - RNA, 64 nt, Human
uagagaaaauuuacuuagcauuuuagauucuagagacauggaaaugaaaauuauuuuaugucua

SEQ ID NO: 384846 - RNA, 64 nt, Human
auagccauugcucccuugucaagugucucacaaggacauggaagaauguguuauguucaucuug

SEQ ID NO: 384847 - RNA, 64 nt, Human
uccuaagugguaaaaaaucaaaucaagaaaaagugacauggauuuuuaaaaaccaaggauccug

SEQ ID NO: 384848 - RNA, 64 nt, Human
cauaaagaaagaacaagaucaugcccuuugcagggacauggauggagcuggaggccauuauccu

SEQ ID NO: 384849 - RNA, 64 nt, Human
guggcuuugccagaagggagccagaaguggggcagacauggagccccucccuuggucagacucu

SEQ ID NO: 384850 - RNA, 64 nt, Human
cuuucaggucccuggaccccagaaacccaggguagacauggacucuacucuccuucucugguuc

SEQ ID NO: 384851 - RNA, 64 nt, Human; identical to SEQ ID NO: 186562

SEQ ID NO: 384852 - RNA, 64 nt, Human; identical to SEQ ID NO: 186563

SEQ ID NO: 384853 - RNA, 56 nt, Human; identical to SEQ ID NO: 186595

SEQ ID NO: 384854 - RNA, 64 nt, Human
uucuagaggucacugaaaggcccuguaaagagaggacauggauacgggaccuggcccugagguu

SEQ ID NO: 384855 - RNA, 64 nt, Human
gcccaaagacacacacccccuuggugaaagagaagacauggacaauuauggcugugacugcaca

SEQ ID NO: 384856 - RNA, 64 nt, Human
uauuguaaauuaccuacuaaacagugguagccaugacauggaaagucaacugauucuacaauug

SEQ ID NO: 384857 - RNA, 64 nt, Human
aggacaguaaacucacuagaauauuccuuauguugacauggauuggauuucaguucaaucaaac

SEQ ID NO: 384858 - RNA, 51 nt, Human
gcaccuuuggacuugagugaggacauggaaccucgccugacauuuuccugg

SEQ ID NO: 384859 - RNA, 64 nt, Human
cacugcaggugagaaccccgcccauccgugcuaugacauggaggcacugaagcccgaggaaggu

SEQ ID NO: 384860 - RNA, 64 nt, Human
caauuggugcuaucuguuacugcccgugcucacggacauggauacagacccugcugugcuccac

SEQ ID NO: 384861 - RNA, 64 nt, Human
aucagguuaccgucaacauuaauccauuuaaaaggacauggacuguugccauuaauacuuuugg

SEQ ID NO: 384862 - RNA, 64 nt, Human
ucagaccagccagccagcgagcucuaggcaaaaggacauggaaacugucacguuagcuacugaa

SEQ ID NO: 384863 - RNA, 64 nt, Human
uuugcucagauugagaacugcagcauuuaugccagacauggacagaggaaugccuguggucaua

SEQ ID NO: 384864 - RNA, 64 nt, Human
ggcuuagggucagaaguaccucacagugguuguggacauggaagaguuuugucaacacaacacu

SEQ ID NO: 384865 - RNA, 64 nt, Human
ucggcucugcauguuuuccaggguguagccuacagacauggaacaguguaaaucccagacugac

SEQ ID NO: 384866 - RNA, 64 nt, Human
aggucugaugucagugaacggaacugaagagcaagacauggagccuggcuggggcuaagcagcc

SEQ ID NO: 384867 - RNA, 64 nt, Human
uuguuuguguugaacugaaggcuaagucucaguggacauggaaaagacuuuugggugauuuauu

SEQ ID NO: 384868 - RNA, 64 nt, Human
ggacuggagacuuuuuaaauuugaguccacuauugacauggaaaccccaguggaaucagauuuu

SEQ ID NO: 384869 - RNA, 64 nt, Human; identical to SEQ ID NO: 186599

SEQ ID NO: 384870 - RNA, 64 nt, Human; identical to SEQ ID NO: 186600

SEQ ID NO: 384871 - RNA, 64 nt, Human; identical to SEQ ID NO: 186601

SEQ ID NO: 384872 - RNA, 64 nt, Human
uaugaugcugugauugcccuggaguuccugccaugacauggaaaccuggugguauggaagcaug

SEQ ID NO: 384873 - RNA, 64 nt, Human
gcucucugucuuagcaggagaauggcccaaaccugacauggacaagcauuguuuggaaaguuca

SEQ ID NO: 384874 - RNA, 64 nt, Human
ucacacuaucuagaacacuuuaccagcacccagggacauggacuuggguguucuuauuuauggu

SEQ ID NO: 384875 - RNA, 64 nt, Human
cucuugguaaguguggcccacacccagccugguggacauggaaaggcuucucagccucuguagu

SEQ ID NO: 384876 - RNA, 64 nt, Human
uuacugagcuguccaguggagggcucaugggugggacauggaaaagaaggcagccuaggcccug

SEQ ID NO: 384877 - RNA, 64 nt, Human
uggccguucugaccuguugccagcagauacacaggacauggaugaaauucccguuuccucuagu

SEQ ID NO: 384878 - RNA, 64 nt, Human
ccagcaggaggcacuuaggggagacucggauggggacauggagaacaacccaagcuccuuaaac

SEQ ID NO: 384879 - RNA, 58 nt, Human
uccaucaagcuuuucaguaggauucugggacauggauucauuacagaaauguaugugu

SEQ ID NO: 384880 - RNA, 64 nt, Human
auugaauuguuuauaucuacugucaaguuguuuugacauggaagauuuucaaguaacauuggca

SEQ ID NO: 384881 - RNA, 64 nt, Human
auggaggcuggaaggaaauaaacauuacgguacagacauggagauguaaaaugaguuuguauua

SEQ ID NO: 384882 - RNA, 64 nt, Human
gguauagauauauuuuuuaauaaugaaaaaagaugacauggauaauaauaaaacauugauugau

SEQ ID NO: 384883 - RNA, 64 nt, Human
cuggugaggaacgugcaggcacugaggcuggagggacauggagcccccucuuccagacacuaua

SEQ ID NO: 384884 - RNA, 64 nt, Human
ucugcuucaaugccagcagaaggucccccagguagacauggagaagcacuuuguuuuaaauagg

SEQ ID NO: 384885 - RNA, 64 nt, Human
uuuuuuacauaaaaauaugguagaauuaauuuaugacauggaaaugccuuacgugguaucacac

SEQ ID NO: 384886 - RNA, 64 nt, Human
ccugcccgacugccggccccugacugugcucugugacauggacacggacggagggggcuggacc

SEQ ID NO: 384887 - RNA, 64 nt, Human; identical to SEQ ID NO: 186592

SEQ ID NO: 384888 - RNA, 64 nt, Human; identical to SEQ ID NO: 186593

SEQ ID NO: 384889 - RNA, 64 nt, Human; identical to SEQ ID NO: 186605

SEQ ID NO: 384890 - RNA, 64 nt, Human
gacggcaccauccagcaccuccgucauucacagggacauggaaaaagcuccccaccccugcaga

SEQ ID NO: 384891 - RNA, 64 nt, Human
gguuuuuuuugguaugacaacuaauuaagcaacugacauggaacugagaauucuacaaacuaua

SEQ ID NO: 384892 - RNA, 64 nt, Human
uuugcggaaugaaugaacacccugucugcagcaggacauggacaaauaggcucugccaucagga

SEQ ID NO: 384893 - RNA, 63 nt, Human
caacacgcaggaucuacuagaccuccaggaacagacauggaccuucucuccagagcuccugag

SEQ ID NO: 384894 - RNA, 64 nt, Human
uuuaaccccuuuugaggugggauugccucuuggagacauggaauugaagagcacuagaaacaac

SEQ ID NO: 384895 - RNA, 64 nt, Human
agccaagagauaccacucagguaacuuuuuucaggacauggaagaucuguuucaaggagauuua

SEQ ID NO: 384896 - RNA, 64 nt, Human
cgacguggaacgcugccucagggcccaccggaacgacauggagaccaucuaccccuuccuuuuc

SEQ ID NO: 384897 - RNA, 64 nt, Human
caguggaaggauuuuuauuaaaaagaagcuaauugacauggaaaugucagugaaauuucuuacc

SEQ ID NO: 384898 - RNA, 64 nt, Human
uguuguauaaucauguguuuacuaacaaguugaugacauggauguauucauaagaccauguaau

SEQ ID NO: 384899 - RNA, 64 nt, Human
ugauugugcuuaacuugguuguauuuuucgauuugacauggaaggccuguugcuuugcucuuga

SEQ ID NO: 384900 - RNA, 64 nt, Human
caugaguccagcuacccucauuucuuuuuuaugugacauggagcacaaagaacugaaaauaugu

SEQ ID NO: 384901 - RNA, 64 nt, Human
agccaccagucucccccagggagcaucaggaagggacauggaugugcuccugccacagggcccu

SEQ ID NO: 384902 - RNA, 64 nt, Human
aagaacauccugguguagccagaccucucugagagacauggauaucacaggaugaagguagaac

SEQ ID NO: 384903 - RNA, 64 nt, Human
ucagaacaaaaagacagucaucugauaagaguaugacauggaugaaaugcccuacaggggccuu

SEQ ID NO: 384904 - RNA, 64 nt, Human
ccuuccgcaggaaggaaauucugacauaugcggugacauggaugaaccuugaguacauuaugcg

SEQ ID NO: 384905 - RNA, 64 nt, Human; identical to SEQ ID NO: 357830

SEQ ID NO: 384906 - RNA, 64 nt, Human; identical to SEQ ID NO: 357831

SEQ ID NO: 384907 - RNA, 64 nt, Human; identical to SEQ ID NO: 357874

SEQ ID NO: 384908 - RNA, 64 nt, Human
cagauucucucucucuugagagcaugaauuaagagacauggagacugcagucacuugggaguag

SEQ ID NO: 384909 - RNA, 64 nt, Human
cuuuucucaggagcuucaaugaguauggccgacagacauggacaaggagcuguguucaccaucg

SEQ ID NO: 384910 - RNA, 64 nt, Human
ggcaacagggugaccagcuguccugguuucccaggacauggaacuuucaaugcuaaaacuggga

SEQ ID NO: 384911 - RNA, 64 nt, Human
agugaguccuauccuuugaggaaauuugaaaaaagacauggagugguuugaaagcuacucuuca

SEQ ID NO: 384912 - RNA, 64 nt, Human
caagcuguccucucacaggauaaaguggaauucugacauggauuauggacuucuucuaacuccc

SEQ ID NO: 384913 - RNA, 64 nt, Human
aggccaccagguccagagaaccuggcaugcaauggacauggaagcugaaaauuacuuggguauu

SEQ ID NO: 384914 - RNA, 64 nt, Human
gaggcugagccccccaacauccaaggacaggagagacauggaguggcgcuggacagucacgaca

SEQ ID NO: 384915 - RNA, 64 nt, Human
cgccaucaggaggagagaagcuaaaccuaggggggacauggagggcgguuguugccucucccgg

SEQ ID NO: 384916 - RNA, 64 nt, Human
gauuggccgguucgcuuuccauuuccugacacuugacauggaaugccuuugaccauuggugcuc

SEQ ID NO: 384917 - RNA, 59 nt, Human
gcuuccccuacgcggccugacuucagccugacauggacccacuacccuucuccuuuccu

SEQ ID NO: 384918 - RNA, 64 nt, Human
uuccggggcauucagguggggaugcuggugguuugacauggagagaaccuugacuguguuuuau

SEQ ID NO: 384919 - RNA, 64 nt, Human
guucauuuauuagggugguuccugaugggaaaaggacauggauuaggacuuuaaaacacuggac

SEQ ID NO: 384920 - RNA, 64 nt, Human
agguggaguaacugguuuuucuuggguggcugaugacauggaugcagcacagacucagccuugg

SEQ ID NO: 384921 - RNA, 64 nt, Human
ggaagcacaugagaggugggcacccggugccgaggacauggacgagggacugguggcugggagg

SEQ ID NO: 384922 - RNA, 64 nt, Human
ucauguuauccuaaaagugagaagacauaaccaagacauggaaauaaaugugaaagcuggagcc

SEQ ID NO: 384923 - RNA, 64 nt, Human; identical to SEQ ID NO: 186608

SEQ ID NO: 384924 - RNA, 64 nt, Human; identical to SEQ ID NO: 186610

SEQ ID NO: 384925 - RNA, 64 nt, Human; identical to SEQ ID NO: 186611

SEQ ID NO: 384926 - RNA, 64 nt, Human
aagugugugcucuccugacgcagcacaagcucaggacauggaggugccggaugcaggaaggagg

SEQ ID NO: 384927 - RNA, 64 nt, Human
uuguccuccccuugggcggcugagagccccagcugacauggaaauacaguuguuggccuccggc

SEQ ID NO: 384928 - RNA, 64 nt, Human
gcagccacuugauugaacgguguugcaauguggagacauggaguuuuauugagguagcuacgug

SEQ ID NO: 384929 - RNA, 64 nt, Human
gcccccuccaucuccccugggguuuggcauauuugacauggagccccaugccaagggaugcagc

SEQ ID NO: 384930 - RNA, 64 nt, Human
aaaagacauggaagguuagguuugucaacacaaagacauggaagauuagagguuugucaacaca

SEQ ID NO: 384931 - RNA, 64 nt, Human
aagacauggaagguuagagguuugucaacaaaaagacauggaagguuagguuugucaacacaaa

SEQ ID NO: 384932 - RNA, 64 nt, Human
augcaccacccauggagagguuugucaacacaaagacauggaagguuagagguuugucaacaaa

SEQ ID NO: 384933 - RNA, 64 nt, Human
aaacuuggagaaauggggguugggaacuuaugcagacauggauuuauuuuucaacauuuuuuaa

SEQ ID NO: 384934 - RNA, 64 nt, Human
ccugacccaugaucuggcaaguuaggcacagucagacauggacaguugauccaugaggaaaaga

SEQ ID NO: 384935 - RNA, 64 nt, Human
ucuugcuuuuguguucccgucuuuuugaaauauagacauggauuuauaauggcauuuuauauuu

SEQ ID NO: 384936 - RNA, 64 nt, Human
ggaucuuaauucccaucucuauacuucuccuuuggacauggaaagaaaaguuauugcuggugca

SEQ ID NO: 384937 - RNA, 64 nt, Human
aagugugugucgccacccgauggaagauucgauggacauggacaugagcccccugaggccccag

SEQ ID NO: 384938 - RNA, 64 nt, Human
acuuugugucacuuccugauaaauaagaggugaugacauggauauacaacagaaaacacuuuga

SEQ ID NO: 384939 - RNA, 64 nt, Human
auacugacuucuguugaaaccauucaaagcuaaagacauggaccuucagcaguguaagaagaua

SEQ ID NO: 384940 - RNA, 64 nt, Human
ccuucuccgggaugaggcccuggcagaggugaaggacauggagcagcugcuggcccuugggaag

SEQ ID NO: 384941 - RNA, 64 nt, Human; identical to SEQ ID NO: 186612

SEQ ID NO: 384942 - RNA, 64 nt, Human; identical to SEQ ID NO: 186613

SEQ ID NO: 384943 - RNA, 64 nt, Human; identical to SEQ ID NO: 186615

SEQ ID NO: 384944 - RNA, 64 nt, Human
uaaccccgggaugcaagguagcauggguccaagagacauggaagagagagccaugaagcauuaa

SEQ ID NO: 384945 - RNA, 64 nt, Human
cauacaaugcacugaauugacagguuaaucauaagacauggaaagagaagugucuaaaagcuuc

SEQ ID NO: 384946 - RNA, 64 nt, Human
ccucuuuggaugagaucaguguccacaaguggccgacauggaacaugcugagcaguggcuccuc

SEQ ID NO: 384947 - RNA, 64 nt, Human
uuagcagaugcuugguuaguuugggacauggggggacauggaccacauugagaccuuagucauc

SEQ ID NO: 384948 - RNA, 64 nt, Human
ggcuaguauuauuuuucuaguuaguagaucccuagacauggaaucagggcagccaagcuugagu

SEQ ID NO: 384949 - RNA, 64 nt, Human
auggucuuucccagggacacaaagggagaaaugggacauggauucuugaucuuccuuuacacau

SEQ ID NO: 384950 - RNA, 64 nt, Human
ccauaaagaaggaugaguuuaugcccuuuguagggacauggaugaagcuggaaaccaucauucu

SEQ ID NO: 384951 - RNA, 64 nt, Human
gaaagauguuaacaccuuugacgucuuuggaguugacauggaacagcagguaguuguuauguag

SEQ ID NO: 384952 - RNA, 64 nt, Human
ugacugagggggaaggggugggagagaagauacagacauggaggaggggaggcugcucuggcaa

SEQ ID NO: 384953 - RNA, 64 nt, Human
auuccuucuucauucuuugcaaaacagugguacagacauggagucuagaauugacccagaugga

SEQ ID NO: 384954 - RNA, 64 nt, Human
caguacucucgggacucgaggaaauuauuccugagacauggaguaauucuuacaaauuuaaacu

SEQ ID NO: 384955 - RNA, 64 nt, Human
agcuccuuguggucugguaagaggggugcuggaggacauggacagcgacaaaccugaggccgug

SEQ ID NO: 384956 - RNA, 64 nt, Human
uuuguauauauaaaaagaagacugaaagucuuuugacauggauauugugaaugguaugaacuuu

SEQ ID NO: 384957 - RNA, 64 nt, Human
acuaaaugaauaaaaacucggaauuaggccaggagacauggaauaccauucaugggaugguuau

SEQ ID NO: 384958 - RNA, 64 nt, Human
uugaugcuuaauuguagcuguuauucuaauuugugacauggaacuaacucaugcuucaauccuu

SEQ ID NO: 384959 - RNA, 64 nt, Human; identical to SEQ ID NO: 357826

SEQ ID NO: 384960 - RNA, 64 nt, Human; identical to SEQ ID NO: 357827

SEQ ID NO: 384961 - RNA, 64 nt, Human; identical to SEQ ID NO: 357829

SEQ ID NO: 384962 - RNA, 64 nt, Human
agagacagagagagacugagggagagacucugaggacauggagagagacucaaagagacuccaa

SEQ ID NO: 384963 - RNA, 64 nt, Human
caguuugauuuugaaaugcuuugauauucuaauugacauggaacaaguuuuuucccugcucccc

SEQ ID NO: 384964 - RNA, 64 nt, Human
gaauaacaacacuuaaaaacucaucacaccuaaagacauggaaagcugccaauuaccuauaugu

SEQ ID NO: 384965 - RNA, 64 nt, Human
agcaggcgucgguucaaggccugagcagcacagggacauggacccagccacgcugcagcagcuc

SEQ ID NO: 384966 - RNA, 64 nt, Human
acuuuuaggaccauaaacguuguguucauauauggacauggaaauauuuauauaauuuuauaga

SEQ ID NO: 384967 - RNA, 64 nt, Human
ucuugagcaguugaaaggagagaccaauauuugugacauggauaguuucaugaccacaacucau

SEQ ID NO: 384968 - RNA, 64 nt, Human
uuucaaaguuccugauaagcauuggaaagaaaucgacauggauaaugaagauuuccuuuuuccu

SEQ ID NO: 384969 - RNA, 64 nt, Human
uuugggugcauucuaguguaguuacuagucuuuugacauggaugauucugaggaggaagcuguu

SEQ ID NO: 384970 - RNA, 64 nt, Human
aauccuuauuuuucuguucaaauuaggaauuagggacauggaugaaauuggaaaucuucauucu

SEQ ID NO: 384971 - RNA, 64 nt, Human
gacacucccaccagcaccgugacaguuuacaaaugacauggacacaucaggaaguuacccuaua

SEQ ID NO: 384972 - RNA, 64 nt, Human
auuguccauuagaaaaucacuuccauugagaccagacauggagcaacacuuuuuuucuuccagg

SEQ ID NO: 384973 - RNA, 64 nt, Human
ggcaauuuguaagcucaauuucucugacagccaagacauggagcaucucugcuaagaagccaaa

SEQ ID NO: 384974 - RNA, 64 nt, Human
cacggaugcuuuugaacaguagagcgaaaugcuagacauggagaaucugcucuguuuguccuuu

SEQ ID NO: 384975 - RNA, 64 nt, Human
ugaagaagagaugugguuuaacacagaugaagaugacauggaagauggagaagcuguagugucu

SEQ ID NO: 384976 - RNA, 64 nt, Human
cugagggcaagagaccuguuuuagugcugcauucgacauggaaaaguccuuuuaaccugugcuu

SEQ ID NO: 384977 - RNA, 52 nt, Human; identical to SEQ ID NO: 186578

SEQ ID NO: 384978 - RNA, 64 nt, Human; identical to SEQ ID NO: 186579

SEQ ID NO: 384979 - RNA, 64 nt, Human; identical to SEQ ID NO: 186584

SEQ ID NO: 384980 - RNA, 64 nt, Human
auuccggaacauuuucaagcagauagcaggagaugacauggagaucugugcagaugagcucaag

SEQ ID NO: 384981 - RNA, 64 nt, Human
gacaaauggaccgaugcagauuuuagagagugacgacauggaaaaugaauuuaaccacuuucuu

SEQ ID NO: 384982 - RNA, 64 nt, Human
gucaggaaagggggugauaaaugacaaucaaaucgacauggagguugagcaccucuguacucag

SEQ ID NO: 384983 - RNA, 64 nt, Human
ugaauuuacuguuaucuuauuguaguacuugcaugacauggauuccugauaucugaugagaggu

SEQ ID NO: 384984 - RNA, 64 nt, Human
guggguagggaaagcagaaaaacguacgcaagaggacauggauccaaaaugaugaugaagcauc

SEQ ID NO: 384985 - RNA, 64 nt, Human
cugccugcuguuuucuaagcauugcuccugcacagacauggagucccagccccagcaaggcucu

SEQ ID NO: 384986 - RNA, 64 nt, Human
cugugccgugggacauauguaauuugugcagugugacauggacuugcuguccuaauggaugugu

SEQ ID NO: 384987 - RNA, 64 nt, Human
uuaaaagaaagguuaccucaguuuucacuccuuagacauggauguagcuaccuuuuuuuguaug

SEQ ID NO: 384988 - RNA, 64 nt, Human
uucccccccagacccagacuugggccguugcucugacauggacacagccaggacaagcugcuca

SEQ ID NO: 384989 - RNA, 64 nt, Human
ccuccccagaugaccccacacccuacucaauuaagacauggacccccaaugcauucauauuugc

SEQ ID NO: 384990 - RNA, 64 nt, Human
ggccccauuuuaugcuaaagguuuuguccuguaggacauggagaacuucugaagaauuuucaag

SEQ ID NO: 384991 - RNA, 64 nt, Human
ggagagagagcuagagggacaaagagaaugagaagacauggaugaucugggagagucucacuuu

SEQ ID NO: 384992 - RNA, 64 nt, Human
cauucccacgucuucuugcugcagccugccccuagacauggacgcaccggccuggcugcagcug

SEQ ID NO: 384993 - RNA, 64 nt, Human
ugaaaauguuuuucuuguguuuuaagaauuaggagacauggaagaggaagaacaaaguccccuc

SEQ ID NO: 384994 - RNA, 64 nt, Human
ugggggcaggaaugagggaaggucuugggucaaggacauggaccuacauccccagcagaugggg

SEQ ID NO: 384995 - RNA, 64 nt, Human; identical to SEQ ID NO: 186560

SEQ ID NO: 384996 - RNA, 64 nt, Human; identical to SEQ ID NO: 186561

SEQ ID NO: 384997 - RNA, 64 nt, Human
cagaucuagucaggaccaccagccauggucuaaggacauggaucgggugcccccagacgugugc

SEQ ID NO: 384998 - RNA, 64 nt, Human
uauaauguaaagagauucaagccuuguaaauaaugacauggaagacccugugcugcacuuaaaa

SEQ ID NO: 384999 - RNA, 64 nt, Human
cccuuccauggacuuuguuaguuucuccaagcaggacauggacaaggaugaucuaggaagacuu

SEQ ID NO: 385000 - RNA, 64 nt, Human
auuuucuacgccucuacuuggucaguuucuagaagacauggaagcauaugcugaggugaguaua

SEQ ID NO: 385001 - RNA, 64 nt, Human
auuuccuacgacucuucuuggucaguuucuagaagacauggaagcauaugcugaggugaguaua

SEQ ID NO: 385002 - RNA, 64 nt, Human
cucggugcuggcucucugucacaaugccucaaaagacauggaacccaggccuacaaccguccca

SEQ ID NO: 385003 - RNA, 64 nt, Human
caauuucagucccagccaaagcagaagggguaaugacauggacuuggcggggggacaagacaaa

SEQ ID NO: 385004 - RNA, 64 nt, Human
ggaggucagagaaagggacuuggaccaauaaaaugacauggaggccuaacagguugccugaaug

SEQ ID NO: 385005 - RNA, 64 nt, Human
ugacaaagccuccagaaaaauccuugaaagacaggacauggagagcugcuggguuggcgaacac

SEQ ID NO: 385006 - RNA, 64 nt, Human
guugaggacuuggagaggagggcagagugagaaagacauggagggaaauaagggagaccaagag

SEQ ID NO: 385007 - RNA, 64 nt, Human
aguggcauggcuccagucugcugcccuccaucccgacauggacccggagcuaacacuggccccu

SEQ ID NO: 385008 - RNA, 64 nt, Human
gccuguggguuugggugccuccugcaguuugggagacauggaccagcaucuggucuuguuucca

SEQ ID NO: 385009 - RNA, 64 nt, Human
caucuuugcucaacuccugggacugaaccauauagacauggacauaucauuuguaccuggaaac

SEQ ID NO: 385010 - RNA, 64 nt, Human
cggaucccauccaggcgcaaagaggaauaggagggacauggaaccauuugccucuggcuguguc

SEQ ID NO: 385011 - RNA, 64 nt, Human
aaugauuguauuuuguguccauggaacguuuauagacauggaggcaggcaauaaauuccuccaa

SEQ ID NO: 385012 - RNA, 64 nt, Human; identical to SEQ ID NO: 186572

SEQ ID NO: 385013 - RNA, 64 nt, Human; identical to SEQ ID NO: 186573

SEQ ID NO: 385014 - RNA, 64 nt, Human; identical to SEQ ID NO: 186619

SEQ ID NO: 385015 - RNA, 64 nt, Human
acgggccuuuuuacaggaacugagguccagagaggacauggacacccccagcucugucagaguc

SEQ ID NO: 385016 - RNA, 64 nt, Human
uucccugucugucccuccagagucccucaccuuugacauggaguugaccucggagugcgcuacc

SEQ ID NO: 385017 - RNA, 64 nt, Human
caagaacuacgggcugcucuacugcuucaggaaggacauggacaaggucgagacauuccugcgc

SEQ ID NO: 385018 - RNA, 64 nt, Human; identical to SEQ ID NO: 385017

SEQ ID NO: 385019 - RNA, 64 nt, Human; identical to SEQ ID NO: 385017

SEQ ID NO: 385020 - RNA, 64 nt, Human; identical to SEQ ID NO: 385017

SEQ ID NO: 385021 - RNA, 64 nt, Human
ccauagaaaaggaugaguucauauucuucacagggacauggaugaagcuggaaaccaucauccu

SEQ ID NO: 385022 - RNA, 64 nt, Human
gcccgauccucaugugucacaugugaaccugacggacauggacgcccugagcugugaguccacg

SEQ ID NO: 385023 - RNA, 64 nt, Human
aguggcaggcuguguccuauggacaucuuggcaggacauggaauuuggccucaugacaggccca

SEQ ID NO: 385024 - RNA, 64 nt, Human
gcacuguucccuuccacuuccucauccucuuugugacauggaaguucauugucauagcuucagc

SEQ ID NO: 385025 - RNA, 64 nt, Human
cauuccuuaggggacggcuuugggggucccacgagacauggacuaggaguuuaagcaggacagu

SEQ ID NO: 385026 - RNA, 64 nt, Human
uuacauucaacucugaucccugggccuuagguuugacauggagguggaggaagauagcgcauau

SEQ ID NO: 385027 - RNA, 64 nt, Human
caaaaaguaacauauuuucaucauugcuucauacgacauggaguuaggacagggaaaaaucauu

SEQ ID NO: 385028 - RNA, 64 nt, Human
uagcauguccugaggcgacgugagcauaacaaaggacauggaagaagauuccagaugccagaaa

SEQ ID NO: 385029 - RNA, 64 nt, Human
acccugaaauagcagcuucucuugagaggagagugacauggaagcaacuccgucugcugcagcu

SEQ ID NO: 385030 - RNA, 64 nt, Human; identical to SEQ ID NO: 186565

SEQ ID NO: 385031 - RNA, 64 nt, Human; identical to SEQ ID NO: 186566

SEQ ID NO: 385032 - RNA, 64 nt, Human; identical to SEQ ID NO: 186567

SEQ ID NO: 385033 - RNA, 64 nt, Human
cugugcaccagcagccaagcagaaagaaacacgcgacauggacucugucaaguagaggacagaa

SEQ ID NO: 385034 - RNA, 64 nt, Human
uaagauuauagauucuaaagauucuauaguucuagacauggagguucuaaggccuaggauucua

SEQ ID NO: 385035 - RNA, 64 nt, Human
gucccugaagcccccagcccuggggauggggaaggacauggagccugagccagagaaccagcuc

SEQ ID NO: 385036 - RNA, 64 nt, Human
ugagaagaugccaggacuuauaguacccccucaggacauggacaguaugugggggcaggaaggu

SEQ ID NO: 385037 - RNA, 64 nt, Human
uuuuuccuuauugauaccauauuaugguaggaaagacauggaauaaaaaauuuagauaguaugu

SEQ ID NO: 385038 - RNA, 64 nt, Human
agggagggcuuccuggaggagaaggagccagcuagacauggauaggagugcguuuuaggcacag

SEQ ID NO: 385039 - RNA, 64 nt, Human
aagccauuguauggcccaugugggagacugaugggacauggagaaugacaguagauuaucagga

SEQ ID NO: 385040 - RNA, 64 nt, Human
agcuaucuuugaaccgggaagcaggcccuuaccagacauggacuaugccagugccuugauauug

SEQ ID NO: 385041 - RNA, 64 nt, Human
cuuugggaugagaugaauauauuuuacaugugaugacauggauuuugggggccagagguguaau

SEQ ID NO: 385042 - RNA, 64 nt, Human
ccauaaaacccaaagggacuuggugucaggagaggacauggagggggcugagugacagagaugg

SEQ ID NO: 385043 - RNA, 64 nt, Human
aaaaagccauuuuggagacagugagggaaguguggacauggacuaaauauuaaaugauauuuac

SEQ ID NO: 385044 - RNA, 64 nt, Human
uuuaaggaucauauuauuaaauaauauaugcacagacauggagagaauuaguuuuuacuaaaac

SEQ ID NO: 385045 - RNA, 64 nt, Human
guccccaaagcucccagcccuggggacggggaaggacauggagccugagccagagaaccagcuc

SEQ ID NO: 385046 - RNA, 64 nt, Human
uucacucccauucuccccuacaguuuuaugcucagacauggaggucagagccacaagggaaagg

SEQ ID NO: 385047 - RNA, 64 nt, Human
cagaagcccccacagcuggccagcagccccgccugacauggaacagaacggagccaucccccaa

SEQ ID NO: 385048 - RNA, 64 nt, Human; identical to SEQ ID NO: 186596

SEQ ID NO: 385049 - RNA, 64 nt, Human; identical to SEQ ID NO: 186597

SEQ ID NO: 385050 - RNA, 64 nt, Human; identical to SEQ ID NO: 186620

SEQ ID NO: 385051 - RNA, 64 nt, Human
gugguggcucaugccuauaaucccaguacuuuaggacauggaagggggaggaucacuugagacc

SEQ ID NO: 385052 - RNA, 64 nt, Human
ccugggaaacccucuccaucucccaaggcugccagacauggaccuccaggcuccagcacauccc

SEQ ID NO: 385053 - RNA, 64 nt, Human
ccugaagaucagaaggggcuucacgcuucuccuggacauggacuagcuugagccaaggcagugg

SEQ ID NO: 385054 - RNA, 64 nt, Human
uuggcauuccaccuccuagggauauaauucuggagacauggaguguuacugaucauaaaacuuu

SEQ ID NO: 385055 - RNA, 64 nt, Human
uauuguuuaaaaugauaauuuuccuucuucaaaugacauggaaagcaaaacuuucuuuuuuaaa

SEQ ID NO: 385056 - RNA, 64 nt, Human
uuugggucccagccuuguuggguugucagccauggacauggauuucaaccccuggagaaaacga

SEQ ID NO: 385057 - RNA, 64 nt, Human
uggagcagcuguggcuuccccguggcugcuuggugacauggauuagcgcuacgugggcugcagc

SEQ ID NO: 385058 - RNA, 64 nt, Human
guagguucagguugaccaggaagcugccaaaagggacauggauaugaggauacaucuggacgug

SEQ ID NO: 385059 - RNA, 64 nt, Human
agggucaucugccccccaacuccccuccgucugugacauggaggguguucggggcccaucccuc

SEQ ID NO: 385060 - RNA, 64 nt, Human
uguugaggccagcggugagagccguguuagccaagacauggaacuguguucucaaggguuaugu

SEQ ID NO: 385061 - RNA, 64 nt, Human
cuguuggcaugaaggaccauuuucuacauaauaugacauggauacuugacccaaaaaaaaaugu

SEQ ID NO: 385062 - RNA, 64 nt, Human
cugccuuugccuguguguguucugggggaggggggacauggaaaaauauuguuuggacauuacu

SEQ ID NO: 385063 - RNA, 64 nt, Human
agcuuacuugacaagcuuccuuuaauuacacacagacauggagguugggguaagaagauggugg

SEQ ID NO: 385064 - RNA, 64 nt, Human
gccuguuuaaguagguuguaaguuugaauaguuagacauggaaauuauuuuauaagcacacacc

SEQ ID NO: 385065 - RNA, 64 nt, Human
cugcccucucucaguuauucagauugacaagguagacauggauuugaugaaagugcaaagugcc

SEQ ID NO: 385066 - RNA, 64 nt, Human; identical to SEQ ID NO: 186568

SEQ ID NO: 385067 - RNA, 64 nt, Human; identical to SEQ ID NO: 186569

SEQ ID NO: 385068 - RNA, 64 nt, Human; identical to SEQ ID NO: 186571

SEQ ID NO: 385069 - RNA, 64 nt, Human
ucagcugcuggaugacuugagaugaaaaaggagagacauggaaagggagacagccagguggcac

SEQ ID NO: 385070 - RNA, 64 nt, Human
agcagccacuuuccacaucugcuagaggaacagugacauggacaccugugacagagagaggaca

SEQ ID NO: 385071 - RNA, 64 nt, Human
aauacugauggaagcacacaaguggagagaaguugacauggaaagggucuuccuucucauugcu

SEQ ID NO: 385072 - RNA, 64 nt, Human
cccaggcccucccgcaucucagguuggggauggggacauggagaggaaggggccgccuacuccu

SEQ ID NO: 385073 - RNA, 64 nt, Human
uguuugacacaggguaucuaggaggggcggggaagacauggauaguauaggaagacauuaaucc

SEQ ID NO: 385074 - RNA, 64 nt, Human
aggcacuggcacccuuggguuggcaauagaaggugacauggaauggagaaaaccaagauuccag

SEQ ID NO: 385075 - RNA, 64 nt, Human
ugccaccaggaccugaugggccaggaagggcguggacauggaggcuguuuuuacaguuuuuuuu

SEQ ID NO: 385076 - RNA, 64 nt, Human
uauguaagggucauuagacaaaugucuugaaguagacauggaauuuaugaaugguucuuuauca

SEQ ID NO: 385077 - RNA, 64 nt, Human
aacaaacaaacaaacaaauaaagaaagaacauuggacauggagagguggggccuggcaugggua

SEQ ID NO: 385078 - RNA, 64 nt, Human
guuguuguuuugauuuguuuuuggcuaaguagaggacauggacuaguuguagcaaacagaacau

SEQ ID NO: 385079 - RNA, 64 nt, Human
uguuuauuuagaguugggaucuaugucuaugagcgacauggaucacacauuuauuggugcugcc

SEQ ID NO: 385080 - RNA, 64 nt, Human
ccuaaagagcauccugauaccauucuauucuccagacauggaggggaugauaaaggaaauagga

SEQ ID NO: 385081 - RNA, 64 nt, Human
uuaaugauagaauacuaucgagccaacauguacugacauggaaagaugucaaagauauguuaag

SEQ ID NO: 385082 - RNA, 64 nt, Human
gcuaguggcaacugcuggggccccagguacuugggacauggaaacucguuggauggcugggcag

SEQ ID NO: 385083 - RNA, 64 nt, Human
auuggucuuuacaagacuuggauacauuacagcagacauggaaauauaauuuuaaaaaauuucu

SEQ ID NO: 385084 - RNA, 52 nt, Human; identical to SEQ ID NO: 186575

SEQ ID NO: 385085 - RNA, 64 nt, Human; identical to SEQ ID NO: 186576

SEQ ID NO: 385086 - RNA, 64 nt, Human; identical to SEQ ID NO: 186577

SEQ ID NO: 385087 - RNA, 64 nt, Human
uauuuucuuaaauuggaauacucuaagagaauaggacauggauauguuacaagaagaaguguau

SEQ ID NO: 385088 - RNA, 64 nt, Human
cccuuauuuggaaaggugaauuaacuuuggucacgacauggacugucagacaaaauggcaguau

SEQ ID NO: 385089 - RNA, 64 nt, Human
guguaugauauguacaacugagugguacagauaugacauggaagaucugggggaggaaguucaa

SEQ ID NO: 385090 - RNA, 64 nt, Human
uuggagcuucuuggaagacauggauuguccggaagacauggauugucuggaagauguggauuuu

SEQ ID NO: 385091 - RNA, 64 nt, Human
cuugauuuacuggaagacuuggagcuucuuggaagacauggauuguccggaagacauggauugu

SEQ ID NO: 385092 - RNA, 64 nt, Human
cuguauuugauggaagaccuugaaauuauuggaagacauggauuuccuggaagacguggauuuu

SEQ ID NO: 385093 - RNA, 64 nt, Human
uuggauuugguggaagacacagauuuuucuggaagacauggauuagcuggaagaucuguauuug

SEQ ID NO: 385094 - RNA, 64 nt, Human
uuuaucuguauggcaaaccacugcaauccugaaugacauggaaagcaucacaaucuuuugcccu

SEQ ID NO: 385095 - RNA, 64 nt, Human
aggugucauacugauaugcagcauuaacuuuacugacauggagugaagugcaauauuauaaaua

SEQ ID NO: 385096 - RNA, 64 nt, Human
uuaagauggaaaacuuuacuucuguucuuggcaggacauggagagagggagggauuccaaaaag

SEQ ID NO: 385097 - RNA, 64 nt, Human; identical to SEQ ID NO: 186552

SEQ ID NO: 385098 - RNA, 64 nt, Human; identical to SEQ ID NO: 186553

SEQ ID NO: 385099 - RNA, 57 nt, Human; identical to SEQ ID NO: 186554

SEQ ID NO: 385100 - RNA, 64 nt, Human; identical to SEQ ID NO: 186555

SEQ ID NO: 385101 - RNA, 64 nt, Human; identical to SEQ ID NO: 186556

SEQ ID NO: 385102 - RNA, 64 nt, Human; identical to SEQ ID NO: 357789

SEQ ID NO: 385103 - RNA, 64 nt, Human; identical to SEQ ID NO: 357790

SEQ ID NO: 385104 - RNA, 64 nt, Human; identical to SEQ ID NO: 357791

SEQ ID NO: 385105 - RNA, 64 nt, Human; identical to SEQ ID NO: 357792

SEQ ID NO: 385106 - RNA, 64 nt, Human; identical to SEQ ID NO: 357793

SEQ ID NO: 385107 - RNA, 64 nt, Human; identical to SEQ ID NO: 357794

SEQ ID NO: 385108 - RNA, 64 nt, Human; identical to SEQ ID NO: 357795

SEQ ID NO: 385109 - RNA, 64 nt, Human; identical to SEQ ID NO: 357796

SEQ ID NO: 385110 - RNA, 64 nt, Human; identical to SEQ ID NO: 357797

SEQ ID NO: 385111 - RNA, 64 nt, Human; identical to SEQ ID NO: 357798

SEQ ID NO: 385112 - RNA, 64 nt, Human; identical to SEQ ID NO: 357799

SEQ ID NO: 385113 - RNA, 64 nt, Human; identical to SEQ ID NO: 357800

SEQ ID NO: 385114 - RNA, 64 nt, Human; identical to SEQ ID NO: 357801

SEQ ID NO: 385115 - RNA, 64 nt, Human; identical to SEQ ID NO: 357892

SEQ ID NO: 385116 - RNA, 64 nt, Human; identical to SEQ ID NO: 357893

SEQ ID NO: 385117 - RNA, 64 nt, Human; identical to SEQ ID NO: 357894

SEQ ID NO: 385118 - RNA, 50 nt, Human; identical to SEQ ID NO: 357895

SEQ ID NO: 385119 - RNA, 64 nt, Human; identical to SEQ ID NO: 357896

SEQ ID NO: 385120 - RNA, 64 nt, Human; identical to SEQ ID NO: 357897

SEQ ID NO: 385121 - RNA, 64 nt, Human; identical to SEQ ID NO: 357898

SEQ ID NO: 385122 - RNA, 64 nt, Human; identical to SEQ ID NO: 357899

SEQ ID NO: 385123 - RNA, 64 nt, Human; identical to SEQ ID NO: 357900

SEQ ID NO: 385124 - RNA, 64 nt, Human; identical to SEQ ID NO: 357901

SEQ ID NO: 385125 - RNA, 64 nt, Human; identical to SEQ ID NO: 357902

SEQ ID NO: 385126 - RNA, 64 nt, Human; identical to SEQ ID NO: 357903

SEQ ID NO: 385127 - RNA, 64 nt, Human; identical to SEQ ID NO: 357904

SEQ ID NO: 385128 - RNA, 64 nt, Human; identical to SEQ ID NO: 357905

SEQ ID NO: 385129 - RNA, 64 nt, Human; identical to SEQ ID NO: 357906

SEQ ID NO: 385130 - RNA, 64 nt, Human; identical to SEQ ID NO: 357907

SEQ ID NO: 385131 - RNA, 64 nt, Human; identical to SEQ ID NO: 357908

SEQ ID NO: 385132 - RNA, 64 nt, Human; identical to SEQ ID NO: 357909

SEQ ID NO: 385133 - RNA, 64 nt, Human; identical to SEQ ID NO: 357910

SEQ ID NO: 385134 - RNA, 64 nt, Human; identical to SEQ ID NO: 357911

SEQ ID NO: 385135 - RNA, 64 nt, Human; identical to SEQ ID NO: 357912

SEQ ID NO: 385136 - RNA, 64 nt, Human; identical to SEQ ID NO: 357913

SEQ ID NO: 385137 - RNA, 64 nt, Human; identical to SEQ ID NO: 357914

SEQ ID NO: 385138 - RNA, 64 nt, Human; identical to SEQ ID NO: 357915

SEQ ID NO: 385139 - RNA, 64 nt, Human; identical to SEQ ID NO: 357916

SEQ ID NO: 385140 - RNA, 64 nt, Human; identical to SEQ ID NO: 357917

SEQ ID NO: 385141 - RNA, 64 nt, Human; identical to SEQ ID NO: 357918

SEQ ID NO: 385142 - RNA, 64 nt, Human; identical to SEQ ID NO: 357919

SEQ ID NO: 385143 - RNA, 64 nt, Human; identical to SEQ ID NO: 357920

SEQ ID NO: 385144 - RNA, 64 nt, Human; identical to SEQ ID NO: 357921

SEQ ID NO: 385145 - RNA, 64 nt, Human; identical to SEQ ID NO: 357922

SEQ ID NO: 385146 - RNA, 64 nt, Human; identical to SEQ ID NO: 357923

SEQ ID NO: 385147 - RNA, 64 nt, Human; identical to SEQ ID NO: 357924

SEQ ID NO: 385148 - RNA, 64 nt, Human; identical to SEQ ID NO: 357925

SEQ ID NO: 385149 - RNA, 64 nt, Human; identical to SEQ ID NO: 357926

SEQ ID NO: 385150 - RNA, 64 nt, Human; identical to SEQ ID NO: 357927

SEQ ID NO: 385151 - RNA, 64 nt, Human; identical to SEQ ID NO: 357928

SEQ ID NO: 385152 - RNA, 64 nt, Human; identical to SEQ ID NO: 357929

SEQ ID NO: 385153 - RNA, 64 nt, Human; identical to SEQ ID NO: 357930

SEQ ID NO: 385154 - RNA, 64 nt, Human; identical to SEQ ID NO: 357931

SEQ ID NO: 385155 - RNA, 64 nt, Human; identical to SEQ ID NO: 357932

SEQ ID NO: 385156 - RNA, 64 nt, Human; identical to SEQ ID NO: 357933

SEQ ID NO: 385157 - RNA, 64 nt, Human; identical to SEQ ID NO: 357934

SEQ ID NO: 385158 - RNA, 64 nt, Human; identical to SEQ ID NO: 357935

SEQ ID NO: 385159 - RNA, 64 nt, Human; identical to SEQ ID NO: 357936

SEQ ID NO: 385160 - RNA, 64 nt, Human; identical to SEQ ID NO: 357937

SEQ ID NO: 385161 - RNA, 64 nt, Human; identical to SEQ ID NO: 357938

SEQ ID NO: 385162 - RNA, 64 nt, Human; identical to SEQ ID NO: 357939

SEQ ID NO: 385163 - RNA, 64 nt, Human; identical to SEQ ID NO: 357940

SEQ ID NO: 385164 - RNA, 64 nt, Human; identical to SEQ ID NO: 357941

SEQ ID NO: 385165 - RNA, 64 nt, Human; identical to SEQ ID NO: 357942

SEQ ID NO: 385166 - RNA, 64 nt, Human; identical to SEQ ID NO: 357943

SEQ ID NO: 385167 - RNA, 64 nt, Human; identical to SEQ ID NO: 357944

SEQ ID NO: 385168 - RNA, 64 nt, Human; identical to SEQ ID NO: 357945

SEQ ID NO: 385169 - RNA, 64 nt, Human; identical to SEQ ID NO: 357946

SEQ ID NO: 385170 - RNA, 64 nt, Human; identical to SEQ ID NO: 357947

SEQ ID NO: 385171 - RNA, 64 nt, Human; identical to SEQ ID NO: 357948

SEQ ID NO: 385172 - RNA, 64 nt, Human; identical to SEQ ID NO: 357949

SEQ ID NO: 385173 - RNA, 64 nt, Human; identical to SEQ ID NO: 357950

SEQ ID NO: 385174 - RNA, 64 nt, Human; identical to SEQ ID NO: 357951

SEQ ID NO: 385175 - RNA, 64 nt, Human; identical to SEQ ID NO: 357952

SEQ ID NO: 385176 - RNA, 64 nt, Human; identical to SEQ ID NO: 357953

SEQ ID NO: 385177 - RNA, 64 nt, Human; identical to SEQ ID NO: 357954

SEQ ID NO: 385178 - RNA, 64 nt, Human; identical to SEQ ID NO: 357955

SEQ ID NO: 385179 - RNA, 64 nt, Human; identical to SEQ ID NO: 357956

SEQ ID NO: 385180 - RNA, 64 nt, Human; identical to SEQ ID NO: 357957

SEQ ID NO: 385181 - RNA, 64 nt, Human; identical to SEQ ID NO: 357958

SEQ ID NO: 385182 - RNA, 64 nt, Human; identical to SEQ ID NO: 357959

SEQ ID NO: 385183 - RNA, 64 nt, Human; identical to SEQ ID NO: 357960

SEQ ID NO: 385184 - RNA, 64 nt, Human; identical to SEQ ID NO: 357961

SEQ ID NO: 385185 - RNA, 64 nt, Human; identical to SEQ ID NO: 357962

SEQ ID NO: 385186 - RNA, 64 nt, Human; identical to SEQ ID NO: 357963

SEQ ID NO: 385187 - RNA, 64 nt, Human; identical to SEQ ID NO: 357964

SEQ ID NO: 385188 - RNA, 64 nt, Human; identical to SEQ ID NO: 357965

SEQ ID NO: 385189 - RNA, 64 nt, Human; identical to SEQ ID NO: 357966

SEQ ID NO: 385190 - RNA, 64 nt, Human; identical to SEQ ID NO: 357967

SEQ ID NO: 385191 - RNA, 64 nt, Human; identical to SEQ ID NO: 357968

SEQ ID NO: 385192 - RNA, 64 nt, Human; identical to SEQ ID NO: 357969

SEQ ID NO: 385193 - RNA, 64 nt, Human; identical to SEQ ID NO: 357970

SEQ ID NO: 385194 - RNA, 64 nt, Human; identical to SEQ ID NO: 357971

SEQ ID NO: 385195 - RNA, 64 nt, Human; identical to SEQ ID NO: 357972

SEQ ID NO: 385196 - RNA, 64 nt, Human; identical to SEQ ID NO: 357973

SEQ ID NO: 385197 - RNA, 64 nt, Human; identical to SEQ ID NO: 357974

SEQ ID NO: 385198 - RNA, 64 nt, Human; identical to SEQ ID NO: 357975

SEQ ID NO: 385199 - RNA, 64 nt, Human; identical to SEQ ID NO: 357976

SEQ ID NO: 385200 - RNA, 51 nt, Human; identical to SEQ ID NO: 357977

SEQ ID NO: 385201 - RNA, 64 nt, Human; identical to SEQ ID NO: 357978

SEQ ID NO: 385202 - RNA, 64 nt, Human; identical to SEQ ID NO: 357979

SEQ ID NO: 385203 - RNA, 64 nt, Human; identical to SEQ ID NO: 357980

SEQ ID NO: 385204 - RNA, 64 nt, Human; identical to SEQ ID NO: 357981

SEQ ID NO: 385205 - RNA, 64 nt, Human; identical to SEQ ID NO: 357982

SEQ ID NO: 385206 - RNA, 64 nt, Human; identical to SEQ ID NO: 357983

SEQ ID NO: 385207 - RNA, 64 nt, Human; identical to SEQ ID NO: 357984

SEQ ID NO: 385208 - RNA, 64 nt, Human; identical to SEQ ID NO: 357985

SEQ ID NO: 385209 - RNA, 64 nt, Human; identical to SEQ ID NO: 357986

SEQ ID NO: 385210 - RNA, 64 nt, Human; identical to SEQ ID NO: 357987

SEQ ID NO: 385211 - RNA, 64 nt, Human; identical to SEQ ID NO: 357988

SEQ ID NO: 385212 - RNA, 64 nt, Human; identical to SEQ ID NO: 357989

SEQ ID NO: 385213 - RNA, 54 nt, Human; identical to SEQ ID NO: 357990

SEQ ID NO: 385214 - RNA, 64 nt, Human; identical to SEQ ID NO: 357991

SEQ ID NO: 385215 - RNA, 64 nt, Human; identical to SEQ ID NO: 357992

SEQ ID NO: 385216 - RNA, 64 nt, Human; identical to SEQ ID NO: 357993

SEQ ID NO: 385217 - RNA, 64 nt, Human; identical to SEQ ID NO: 357994

SEQ ID NO: 385218 - RNA, 64 nt, Human; identical to SEQ ID NO: 357995

SEQ ID NO: 385219 - RNA, 64 nt, Human; identical to SEQ ID NO: 357996

SEQ ID NO: 385220 - RNA, 64 nt, Human; identical to SEQ ID NO: 357997

SEQ ID NO: 385221 - RNA, 64 nt, Human; identical to SEQ ID NO: 357998

SEQ ID NO: 385222 - RNA, 64 nt, Human; identical to SEQ ID NO: 357999

SEQ ID NO: 385223 - RNA, 64 nt, Human; identical to SEQ ID NO: 358000

SEQ ID NO: 385224 - RNA, 64 nt, Human; identical to SEQ ID NO: 358001

SEQ ID NO: 385225 - RNA, 64 nt, Human; identical to SEQ ID NO: 358002

SEQ ID NO: 385226 - RNA, 64 nt, Human; identical to SEQ ID NO: 358003

SEQ ID NO: 385227 - RNA, 64 nt, Human; identical to SEQ ID NO: 358004

SEQ ID NO: 385228 - RNA, 64 nt, Human; identical to SEQ ID NO: 358005

SEQ ID NO: 385229 - RNA, 64 nt, Human; identical to SEQ ID NO: 358006

SEQ ID NO: 385230 - RNA, 64 nt, Human; identical to SEQ ID NO: 358007

SEQ ID NO: 385231 - RNA, 64 nt, Human; identical to SEQ ID NO: 358008

SEQ ID NO: 385232 - RNA, 64 nt, Human; identical to SEQ ID NO: 358009

SEQ ID NO: 385233 - RNA, 64 nt, Human; identical to SEQ ID NO: 358010

SEQ ID NO: 385234 - RNA, 64 nt, Human; identical to SEQ ID NO: 358011

SEQ ID NO: 385235 - RNA, 64 nt, Human; identical to SEQ ID NO: 358012

SEQ ID NO: 385236 - RNA, 64 nt, Human; identical to SEQ ID NO: 358013

SEQ ID NO: 385237 - RNA, 64 nt, Human; identical to SEQ ID NO: 358014

SEQ ID NO: 385238 - RNA, 64 nt, Human; identical to SEQ ID NO: 358015

SEQ ID NO: 385239 - RNA, 64 nt, Human; identical to SEQ ID NO: 358016

SEQ ID NO: 385240 - RNA, 64 nt, Human; identical to SEQ ID NO: 358017

SEQ ID NO: 385241 - RNA, 64 nt, Human; identical to SEQ ID NO: 358018

SEQ ID NO: 385242 - RNA, 64 nt, Human; identical to SEQ ID NO: 358019

SEQ ID NO: 385243 - RNA, 64 nt, Human; identical to SEQ ID NO: 358020

SEQ ID NO: 385244 - RNA, 64 nt, Human; identical to SEQ ID NO: 358021

SEQ ID NO: 385245 - RNA, 64 nt, Human; identical to SEQ ID NO: 358022

SEQ ID NO: 385246 - RNA, 64 nt, Human; identical to SEQ ID NO: 358023

SEQ ID NO: 385247 - RNA, 64 nt, Human; identical to SEQ ID NO: 358024

SEQ ID NO: 385248 - RNA, 64 nt, Human; identical to SEQ ID NO: 358025

SEQ ID NO: 385249 - RNA, 64 nt, Human; identical to SEQ ID NO: 358026

SEQ ID NO: 385250 - RNA, 64 nt, Human; identical to SEQ ID NO: 358027

SEQ ID NO: 385251 - RNA, 64 nt, Human; identical to SEQ ID NO: 358028

SEQ ID NO: 385252 - RNA, 64 nt, Human; identical to SEQ ID NO: 358029

SEQ ID NO: 385253 - RNA, 64 nt, Human; identical to SEQ ID NO: 358030

SEQ ID NO: 385254 - RNA, 52 nt, Human; identical to SEQ ID NO: 358031

SEQ ID NO: 385255 - RNA, 64 nt, Human; identical to SEQ ID NO: 358032

SEQ ID NO: 385256 - RNA, 64 nt, Human; identical to SEQ ID NO: 358033

SEQ ID NO: 385257 - RNA, 64 nt, Human; identical to SEQ ID NO: 358034

SEQ ID NO: 385258 - RNA, 64 nt, Human; identical to SEQ ID NO: 358035

SEQ ID NO: 385259 - RNA, 64 nt, Human; identical to SEQ ID NO: 358036

SEQ ID NO: 385260 - RNA, 64 nt, Human; identical to SEQ ID NO: 358037

SEQ ID NO: 385261 - RNA, 64 nt, Human; identical to SEQ ID NO: 358038

SEQ ID NO: 385262 - RNA, 64 nt, Human; identical to SEQ ID NO: 358039

SEQ ID NO: 385263 - RNA, 64 nt, Human
aaauguggcaaaccaaccccaggcccacccagagcgagcaaacgcugagaccugaaaggacaug

SEQ ID NO: 385264 - RNA, 64 nt, Human
ucugggccguggacuaucugaucuugguccuggccgagcaaacagcccggagguaagguucaga

SEQ ID NO: 385265 - RNA, 64 nt, Human
uuuuaaaacucagaauucuuuccuaagagcccuucgagcaaagcgugccgaaguuaguugucuu

SEQ ID NO: 385266 - RNA, 64 nt, Human
gaaugugcugauuguguucccuauggcuuuaucucgagcaaaauacacucuacauauuuuaaua

SEQ ID NO: 385267 - RNA, 64 nt, Human
cagugccuucugagaaggaagaucaaguuuacaucgagcaaagugaccuuggaagacagggcac

SEQ ID NO: 385268 - RNA, 64 nt, Human
ccaaucucaccauugcacuucagccugagcaacacgagcaaaacuccgucucaaaaguaaauaa

SEQ ID NO: 385269 - RNA, 64 nt, Human
gaugccggaaaaugaccuguaguuaccagugcaacgagcaaagccccacaguuuaguccuuugg

SEQ ID NO: 385270 - RNA, 64 nt, Human
augggucagugcccagggcuuuaaaaagaaugaacgagcaaaagguauccccgccgugaccccu

SEQ ID NO: 385271 - RNA, 64 nt, Human
uaucuggguuagggaugggggacagauaacagaacgagcaaaguaaccuauacaggccagcaug

SEQ ID NO: 385272 - RNA, 64 nt, Human
acacaaggagaauaauagaugggguuuauuaaagcgagcaaagucugcauuuuaccuggugcgc

SEQ ID NO: 385273 - RNA, 64 nt, Human
aggagaggcugccgcauucugcugcuccucacagcgagcaaagcugcacccacuuacauucagu

SEQ ID NO: 385274 - RNA, 64 nt, Human
auuuuuuauuccuuccuuucuacccccaaccagucgagcaaaugagcaauuuuguguuucuaau

SEQ ID NO: 385275 - RNA, 64 nt, Human
gcagggauuugaggagcagcuucaguuguuuucccgagcaaagucuaaaguuuacaguaaauaa

SEQ ID NO: 385276 - RNA, 64 nt, Human
gggcucugcuauuuguuugcagaacacccaagagcgagcaaacaugcucucuucacagcaguac

SEQ ID NO: 385277 - RNA, 61 nt, Human
augcugcaggguacccauagcaaguuauagccgagcaaaugaaccguccuccugccucugu

SEQ ID NO: 385278 - RNA, 64 nt, Human
aauauuuuguaaauacacuuuuuuacuuuucaaacgagcaaaauaaugugcaaugauuuuuaua

SEQ ID NO: 385279 - RNA, 64 nt, Human
ccgcaggaugaaaaugaagaaaaucaacaaagaccgagcaaaagacgagugaugccauuugggc

SEQ ID NO: 385280 - RNA, 64 nt, Human
cugagaacgcacaacugcacuccagccugggugacgagcaaaacuccaucucaaaacaaaaguu

SEQ ID NO: 385281 - RNA, 64 nt, Human
aaaaaaaggaaaggaaacuuugaaccuuauguaccgagcaaaugccaggucuagcaaacauaau

SEQ ID NO: 385282 - RNA, 64 nt, Human
ccgagauugcaccuuuguacuccagccugggcaacgagcaaaaaacucugucucaaaaaaaaaa

SEQ ID NO: 385283 - RNA, 64 nt, Human
gcgacauuugugagagauuauuguaaaaugagagcgagcaaauaaaacuuaauuuaaucuuugc

SEQ ID NO: 385284 - RNA, 64 nt, Human
ugccuccguggcuccaaggugagggucaucuucacgagcaaagagaaccaauaaagugacaacg

SEQ ID NO: 385285 - RNA, 64 nt, Human
agaacgagagcaaagcaugaugggugaagagaaccgagcaaagaucaaaauaaaaagugacaca

SEQ ID NO: 385286 - RNA, 64 nt, Human
ugacagaauuucuggauaguaggauuuuaauaggcgagcaaauaaaauucaaaucaauuucaag

SEQ ID NO: 385287 - RNA, 64 nt, Human
uggauaaggucacuguccuaggugcuagguggaccgagcaaaagacucaguggaugaacuggug

SEQ ID NO: 385288 - RNA, 64 nt, Human
accuuucagcuucgagccagggggcgggggaucccgagcaaaagccuuccguggacaucaggcc

SEQ ID NO: 385289 - RNA, 64 nt, Human
ccuacuuuagaaguuaaaccacccgauaggccuucgagcaaaagcaaagauccaccgagagaag

SEQ ID NO: 385290 - RNA, 64 nt, Human
acauuuaugggcaaauuguguucuuuaucacuuccgagcaaauacucagauuuaaaauuacuuu

SEQ ID NO: 385291 - RNA, 64 nt, Human
agggcucggucggcgaccucugaagagagugcaccgagcaaaccaagugccggagcaccagcgc

SEQ ID NO: 385292 - RNA, 64 nt, Human
aaaaaauggaaaggaaacuuugaaccuuauguaccgagcaaaugcaaggucuagcaaauauaau

SEQ ID NO: 385293 - RNA, 64 nt, Human
aaaaaacuuucagaaaaagcuguguuuuuguuaacgagcaaaauugccuaguugaguugaugca

SEQ ID NO: 385294 - RNA, 64 nt, Human
gccccucacacccccaggaugucagugcucaccucgagcaaagcgccccagcucggccuuggga

SEQ ID NO: 385295 - RNA, 64 nt, Human
cuucagauguuuccaagaugucccauugauaauucgagcaaacaacuuucuggaaaaacaggau

SEQ ID NO: 385296 - RNA, 64 nt, Human
ugaaggggugcacccaccuguuuucugaaacacacgagcaaacccagagguggauguuaugaac

SEQ ID NO: 385297 - RNA, 64 nt, Human
gagaucaugccauugcauuccagccuaggcaacacgagcaaaacuuccucucaaaaaaaaaaaa

SEQ ID NO: 385298 - RNA, 64 nt, Human
aaagggaccuaccugagccaccguccuagccaagcgagcaaaccugcaggggguuuggaagugg

SEQ ID NO: 385299 - RNA, 64 nt, Human
uagugcccuauuuuacaauuguaaaacugaggcacgagcaaagugaagacacuggcucauauuc

SEQ ID NO: 385300 - RNA, 64 nt, Human
uucuccuugcucuguuuugcuuuuccauauagcucgagcaaaauucaaaaagaacuaaauaugc

SEQ ID NO: 385301 - RNA, 64 nt, Human
guuggagcccgauuuuauuuguaaaguugacagucgagcaaauguuccuauuuucgugggaucu

SEQ ID NO: 385302 - RNA, 64 nt, Human
accaucgagacuaggaagaaacugcaugaacuaacgagcaaaauaaccagcuaacaucauaaug

SEQ ID NO: 385303 - RNA, 64 nt, Human
guggggcccugacgcccaccucccaggugccccucgagcaaaaaccucuggcgccuccaaucca

SEQ ID NO: 385304 - RNA, 64 nt, Human
gaugccccgccuuaguuuuccccgauuuggggcucgagcaaaggaaguugcugaggccaaggua

SEQ ID NO: 385305 - RNA, 64 nt, Human
cuugccaggaggcuggcaguacagagugcagcagcgagcaaauccuggcaagugacccagcucu

SEQ ID NO: 385306 - RNA, 64 nt, Human
cugcagagccacagucagccugcccacaugccaccgagcaaacgcaucuugcuuuucacaucuc

SEQ ID NO: 385307 - RNA, 64 nt, Human
uuuuuauauauuugcagauuacgccuuuuuguaacgagcaaaugggauauuguuuaaaaaacag

SEQ ID NO: 385308 - RNA, 64 nt, Human
agaaaaauagauggguuacaaauacaucagauaucgagcaaaugguuugaguuacaucuagcag

SEQ ID NO: 385309 - RNA, 64 nt, Human
ucuugcugcguguugauuuggaggcacugcaguccaggccgaguccucagugcggggagcaggc

SEQ ID NO: 385310 - RNA, 64 nt, Human
uuuuuuaguagagacaggguuucgcaauguuggccaggccgaucucgaacuucuggccucuagc

SEQ ID NO: 385311 - RNA, 64 nt, Human
gccccauauggaacauguuaaaaaaaaaaaaagccaggccgagcguguuggcucacgcuuguaa

SEQ ID NO: 385312 - RNA, 64 nt, Human
uccucuguccccaaaaggaacugaccagaggggucaggccgacgccucgagucagggccccagc

SEQ ID NO: 385313 - RNA, 64 nt, Human
acauuauagucaugugccaccaccuuccugcccacaggccgagggacagggugaggguauaccc

SEQ ID NO: 385314 - RNA, 64 nt, Human
accuauuuauugacuguccugagggccuugaaaacaggccgaaccuggagggccuggauuucuu

SEQ ID NO: 385315 - RNA, 64 nt, Human
cacccugcccaagacucaccucccuuccccucugcaggccgacggcaggaggacagucggguga

SEQ ID NO: 385316 - RNA, 64 nt, Human
uaaccuaggccuacccugaaugcuucuugcuaaccaggccgagaggccacacacuugccccccc

SEQ ID NO: 385317 - RNA, 64 nt, Human
ugccaagucagagcugugagcggggggcgccguccaggccgagcgcagacuguuuaggacucag

SEQ ID NO: 385318 - RNA, 64 nt, Human
agccugagccauggcccugcccucaccccacugccaggccgaggcucagccccagacucucagc

SEQ ID NO: 385319 - RNA, 64 nt, Human
gugggggaccccuucuccacccucucccugagcacaggccgauggaggugguucaaauccucug

SEQ ID NO: 385320 - RNA, 64 nt, Human
gcugcggcuccagauagauggggaugccgggcuccaggccgaccagcacuugggaucugauggg

SEQ ID NO: 385321 - RNA, 64 nt, Human
aaaagcuacccuagggaagagccggugacgugcacaggccgagcagcacggcuggugagcugca

SEQ ID NO: 385322 - RNA, 64 nt, Human
gccacagcucacauuccacugcugggagaagaaacaggccgaggcccagaguggccugcccccg

SEQ ID NO: 385323 - RNA, 64 nt, Human
gugaacaggcugggcugcuggagguggggcgaggcaggccgacuguacuaaaguaacgcaauaa

SEQ ID NO: 385324 - RNA, 64 nt, Human
aggaggacacgcaccugugagcgcagccgaggcgcaggccgagugggccgccaggaccaagcga

SEQ ID NO: 385325 - RNA, 64 nt, Human
aucugagauucucagaucacaggccccugugcuccaggccgaggcugggcuacccucagggaga

SEQ ID NO: 385326 - RNA, 64 nt, Human
ccaucuugagggguuuucuaacccccaggucucccaggccgaaggucagccuugagucccguuu

SEQ ID NO: 385327 - RNA, 64 nt, Human
uuuaaagagauggagcaagagaguggucagaacacaggccgaauccaggcucuaucacuuacua

SEQ ID NO: 385328 - RNA, 64 nt, Human
gacagacagacguauuccccaaaaagggauaccccaggccgaugguguucagccauuuagcagc

SEQ ID NO: 385329 - RNA, 64 nt, Human
gucuguguguguucuucaagccagcucuaggcuucaggccgagccagguucacacucagaaaga

SEQ ID NO: 385330 - RNA, 64 nt, Human
ccauauuuuaauacgaagaggacacucccgugugcaggccgaaucagacccggcgugggcgaau

SEQ ID NO: 385331 - RNA, 64 nt, Human
gcgguggcucacgccuguaaucccagcacuuuggcaggccgaggcagguggaucaccugacguc

SEQ ID NO: 385332 - RNA, 64 nt, Human
aacgugacggcaacccggcaaaaggguagggagccaggccgaaggggccucacugaccaauugu

SEQ ID NO: 385333 - RNA, 64 nt, Human
gaccauccuggacugauggccacccgcccacagccaggccgagagcagacaccagcagcccugu

SEQ ID NO: 385334 - RNA, 64 nt, Human
ucucggugaccuccguccucuccccagccuggcacaggccgaggcaggaggagcccggacggcg

SEQ ID NO: 385335 - RNA, 64 nt, Human
ccgacucuuucugcggcagaacacucagggcgcccaggccgaguuccucuuccgcacggagacu

SEQ ID NO: 385336 - RNA, 64 nt, Human
uucuuuggccgaagacgugggucugcguggaauucaggccgaggcgagccggcagagcaggccg

SEQ ID NO: 385337 - RNA, 64 nt, Human
cacauggugccccuagcuuuauauauggacauggcaggccgauuugggaaccaagcuauuccuu

SEQ ID NO: 385338 - RNA, 64 nt, Human
uccagugugugguauucuuucgagguauucuuuccaggccgagauugagcaccucauguaccua

SEQ ID NO: 385339 - RNA, 62 nt, Human
cgcccuguugggcuuccugaugacggggacgacaggccgaggauucacgcuggaagcccacc

SEQ ID NO: 385340 - RNA, 64 nt, Human
caaaugcgggcucaucagcccccccagagagggucaggccgaaccccauuucuccuccucuuag

SEQ ID NO: 385341 - RNA, 64 nt, Human
ucccuuuuuuguuccuccaaacaaaaacaaaaugcaggccgagcgcgguggcucacgccuguaa

SEQ ID NO: 385342 - RNA, 64 nt, Human
ugucagucuguccacguggagagaaguugcccuccaggccgacaggaggccaugcccaccgccc

SEQ ID NO: 385343 - RNA, 64 nt, Human
ccggggacaggagggauguccugccgcccccagccaggccgaacuccgcacucgcucucccggc

SEQ ID NO: 385344 - RNA, 64 nt, Human
ggugccagcugcccuugcagggugggugagcucucaggccgagagccuuauuuaccuagugcaa

SEQ ID NO: 385345 - RNA, 64 nt, Human
cuuuggggggcgugcauguguuggugcugaccuccaggccgagaugugcaacacucagguaggc

SEQ ID NO: 385346 - RNA, 64 nt, Human
gcaggagcgcagacaggcacagcccuggagcaggcaggccgagggcugcggcacuggagcaggc

SEQ ID NO: 385347 - RNA, 64 nt, Human
cgccacuaguuaccgcggggaccacaucaagcuucaggccgacagcuucggccuccacaucguc

SEQ ID NO: 385348 - RNA, 64 nt, Human
cagugagucccggcugcggccagucuccccucuccaggccgaggccccuccgcccugaccccuc

SEQ ID NO: 385349 - RNA, 64 nt, Human
ugaggggcuguccaggccuucucccccacacccucaggccgagauccgugagagacccacuuug

SEQ ID NO: 385350 - RNA, 64 nt, Human
caccgugggggcaccucuggccucccgugacccccaggccgaggguccccgggcacccaggucg

SEQ ID NO: 385351 - RNA, 64 nt, Human
caccuuguacaaaauuaugaauucauuuuuccuccaggccgacaaggaguuguagaaugaaaau

SEQ ID NO: 385352 - RNA, 64 nt, Human
gccguuggcuuaugccuguaaucccagcacuuugcaggccgagguagacagauggcuugagcuc

SEQ ID NO: 385353 - RNA, 64 nt, Human
ccccaugaccuuccuucugcuggugaagggccaacaggccgaccuugcccgcuacucagugacc

SEQ ID NO: 385354 - RNA, 64 nt, Human
gccucugcugcuccugcuccuggguuugaagaugcaggccgaucgccagcuccguggcagcggu

SEQ ID NO: 385355 - RNA, 64 nt, Human
gcugacugagaugcaaggucugaccccacaaggccaggccgacguuucugagugaucacuaaga

SEQ ID NO: 385356 - RNA, 64 nt, Human
agggaaaagggaacaggaaaagaaaccccaaacucaggccgaaugaucaaggggacccauagga

SEQ ID NO: 385357 - RNA, 64 nt, Human
uagaggugcaggauuagcaagcccaccuggcuaccaggccgacagcuacauccuccaacugacc

SEQ ID NO: 385358 - RNA, 64 nt, Human
gccggguacugagagucugcacuuaacaagcucccaggccgagaagccagugcggcagguucac

SEQ ID NO: 385359 - RNA, 64 nt, Human
aggggucaguucccacccccacccgucccaggcccaggccgaagccagcgcccagcuuuccuca

SEQ ID NO: 385360 - RNA, 64 nt, Human
gcugacugagaugcuaggucugaccccacaaggccaggccgacauuccugagugaucacuaaga

SEQ ID NO: 385361 - RNA, 64 nt, Human
gcaguggcucacgccuguaaucccagcacuuuggcaggccgagaugggcggaucuuuugagguc

SEQ ID NO: 385362 - RNA, 64 nt, Human
ggagagcagccgauggggcucagacuacauauggcaggccgaucagagcucuuguggagcgagg

SEQ ID NO: 385363 - RNA, 64 nt, Human
cuuccgcucugacgcagggccgaggugggcaguccaggccgagaggccggcggcccugaaggug

SEQ ID NO: 385364 - RNA, 64 nt, Human
caaucagguuucuucaggcugaggaggacuugcucaggccgauuccaaacauugugcucguuca

SEQ ID NO: 385365 - RNA, 64 nt, Human
agcccuggagaggagggcagggcugcggggaggccaggccgagccccuggaaccaucccguccu

SEQ ID NO: 385366 - RNA, 64 nt, Human
cagaaaccgggcucagucaaucaaugcuuuauuucaggccgaaugaggcucuuuagauugggau

SEQ ID NO: 385367 - RNA, 64 nt, Human
uuuugaucucugcuuaccguucaagaggcgugugcaggccgacagucggugaccccaucacucg

SEQ ID NO: 385368 - RNA, 64 nt, Human
agcugaaaccucaaugaauaacaagaaaagacuccaggccgacucaugauacucugcaucuuuc

SEQ ID NO: 385369 - RNA, 64 nt, Human
aaaacccccucugauggccucaaggcagugccugcaggccgaggcccuucuggggguuucuauc

SEQ ID NO: 385370 - RNA, 64 nt, Human
cagaauggaaaaacaguguaugaaagucauguuacaggccgagugcgguggcucacaccuguaa

SEQ ID NO: 385371 - RNA, 64 nt, Human
uggagcagguuaggcuggggcucaucgagggucucaggccgaggccacugcggugccagugccc

SEQ ID NO: 385372 - RNA, 64 nt, Human
cuggcuuugcugcgucucuagaggguuaggauaccaggccgaguucaggccacugcuagcuuuc

SEQ ID NO: 385373 - RNA, 64 nt, Human
ucauggcaguaggcucuaagugggugacuggccacaggccgagaaaaggguacagccucuaggu

SEQ ID NO: 385374 - RNA, 64 nt, Human
gugauuuauuuuuugcucccccuuuuuugagucacaggccgagcugcagccuaggaaacccaaa

SEQ ID NO: 385375 - RNA, 64 nt, Human
ggccuugcaugggcccugcccacaagcacacccucaggccgagggugcagacugaugcucuucc

SEQ ID NO: 385376 - RNA, 64 nt, Human
ggucaucuguaccucugccuccuuuccccucccucaggccgaaggaggagucagggagagcuga

SEQ ID NO: 385377 - RNA, 64 nt, Human
cacagagagaugcuggguccccgaggccugugggcaggccgaucaguguggccccagaucaagu

SEQ ID NO: 385378 - RNA, 64 nt, Human
aggccagcccugucaccaccuccacugccaugaccaggccgaaggcagggaacgcccuccccag

SEQ ID NO: 385379 - RNA, 64 nt, Human
gcagugaaaggaauucccaucaggacucagaccccaggccgagaucuugcccugaauguacccu

SEQ ID NO: 385380 - RNA, 64 nt, Human
gucucagcucagugccgaggaggaggaagaaaaacaggccgagugaaggugcuggaaagggagg

SEQ ID NO: 385381 - RNA, 64 nt, Human
acaaguuuucuaagcuuuugauaaugugaagcuccaggccgagaggaugcuguugagcacauug

SEQ ID NO: 385382 - RNA, 64 nt, Human
guaccacuguugaugugaagcaccucuucugagccaggccgagccccuggccgacuugggagcc

SEQ ID NO: 385383 - RNA, 64 nt, Human
gugagaaguagugaaggccaaggggcccccaucacaggccgaugggguaagacuucgagagagc

SEQ ID NO: 385384 - RNA, 64 nt, Human
ucagugacugacccucuguauucuguauagacaccaggccgauacacaguggaguucccaggcc

SEQ ID NO: 385385 - RNA, 64 nt, Human
ucuccugguucagaagacaggcuggaugagaucucaggccgagcucugaaauagggagguaauc

SEQ ID NO: 385386 - RNA, 64 nt, Human
ucggccaggauugccacuccuguuucagaggaagcaggccgagagacuugcaccuuggccaagc

SEQ ID NO: 385387 - RNA, 64 nt, Human
gccccacuggguguuacugcagcagggcguggcccaggccgagggauggugccagcagggugga

SEQ ID NO: 385388 - RNA, 64 nt, Human
gugugacugcacagcgaggugccggaucugugagcaggccgacuccacucccacgccgcaggua

SEQ ID NO: 385389 - RNA, 64 nt, Human
gugucguaacagcaggagcauggccgcaacuucccaggccgaggaagggcccccggcucggccu

SEQ ID NO: 385390 - RNA, 64 nt, Human
aagggguuccccugcggaguuccccugucugucccaggccgacccaagggagugucagccuugg

SEQ ID NO: 385391 - RNA, 64 nt, Human
cgguaccugcugaacguguauccagauggacugacaggccgagagcggauggacuacaugaaac

SEQ ID NO: 385392 - RNA, 64 nt, Human
gggacugcucacucugcagagccaacgggcuugccaggccgacugcagcagcuccagcuuccag

SEQ ID NO: 385393 - RNA, 64 nt, Human
uaaaagccuguucuguugggcagccugaggcuguugcccgaauccuaguucaguuuuuugacuu

SEQ ID NO: 385394 - RNA, 64 nt, Human
cuggaaacaguguguaaaaugacugaagugaugaugcccgaagaugaaauagaugccaaauuag

SEQ ID NO: 385395 - RNA, 64 nt, Human
ucacaguugagacuuaauuucuccuaauuucuucugcccgaaggguaaguggugcguccagcuu

SEQ ID NO: 385396 - RNA, 64 nt, Human
gggugaauggggcuauugucgacggcacagcuaaugcccgaacccagccccugucggcagagac

SEQ ID NO: 385397 - RNA, 64 nt, Human
gcauuauuacauuaggcugagagguaaaauaauuugcccgaagacauacagcuagugacgaaug

SEQ ID NO: 385398 - RNA, 64 nt, Human
uuuacuagagaaccugugacuguugaauaacaugugcccgaacauacacacacacauauguaca

SEQ ID NO: 385399 - RNA, 64 nt, Human
ugugguccggcuuugggagaguggugaauugcgcugcccgaacucggagcggagcaggguaggg

SEQ ID NO: 385400 - RNA, 64 nt, Human
ucuucggcugagaagugugcgccacuccccuugcugcccgaaugcucggaaacaggagccuuuc

SEQ ID NO: 385401 - RNA, 64 nt, Human
cgaagcugucccuuaaugcugguccuucagacccugcccgaacucccaccucuccauggccugc

SEQ ID NO: 385402 - RNA, 64 nt, Human
uuuuuuuuuuuuggaaauugaagcuguagagugcugcccgaaaucucuaggaaguugguggcaa

SEQ ID NO: 385403 - RNA, 64 nt, Human
ccaucaacaucgcagaugagcugccccgcucccgugcccgaaaacuggcggaugaacagcucag

SEQ ID NO: 385404 - RNA, 64 nt, Human
gcaaaguguuucugaaggcaauuucuuuuuaauaugcccgaaugaaugaggcuucauccuuucc

SEQ ID NO: 385405 - RNA, 64 nt, Human
uccuguguuuaucuaacuucauaauagcaauuauugcccgaagcuauaguggcauauuuacaaa

SEQ ID NO: 385406 - RNA, 64 nt, Human
gaccgccuggggugagcaaggcgaccugggcugcugcccgaagguuuggccgccgcgggacacc

SEQ ID NO: 385407 - RNA, 64 nt, Human
gccccagccugggccaucucuuaggugagacaguugcccgaaacuaagccaggccuggcuggag

SEQ ID NO: 385408 - RNA, 64 nt, Human
gggccugcuuggccuccugggggcaaagccccucugcccgaagcaauaacaacagcagcagaag

SEQ ID NO: 385409 - RNA, 64 nt, Human
cuugccuguaugaaugcaucaaguauucauuuauugcccgaauaggcauugcauuaaguccucu

SEQ ID NO: 385410 - RNA, 64 nt, Human
caaacucuuaauuagaccuaggccucagcugcacugcccgaaaagcauuugggcagacccugag

SEQ ID NO: 385411 - RNA, 64 nt, Human
cuuuaagccaagagagccucuuguggaccccgccugcccgaaugaaauccgaacaguuggggcu

SEQ ID NO: 385412 - RNA, 64 nt, Human
gaucucauggugaccaacucucagaaacuccagcugcccgaaaacuucgauauccacccugugg

SEQ ID NO: 385413 - RNA, 64 nt, Human
agcccuucugaggucauuauugagguucauauaaugcccgaagaugcagcauuuggugcuuugu

SEQ ID NO: 385414 - RNA, 64 nt, Human
agggccacgaccugccugccugggcuggagcucuugcccgaagccugaagcuuccuucggcgcc

SEQ ID NO: 385415 - RNA, 64 nt, Human
ccucuuuacucuuacuuuaacuauuuugcuggcuugcccgaaaauuugccuggcaagucuuccu

SEQ ID NO: 385416 - RNA, 64 nt, Human
ugaguagucccacgcuguuguugagcugacucugugcccgaaugguggugcaggcgcccugucc

SEQ ID NO: 385417 - RNA, 64 nt, Human
caaauauccccaaagcuuuuggguccucaagucaugcccgaauuuagaugcuggucauuuucug

SEQ ID NO: 385418 - RNA, 64 nt, Human
gugauguccaggcaaaaauugacaauacauuucuugcccgaaauaagaacccauuauuuccagu

SEQ ID NO: 385419 - RNA, 64 nt, Human
ugggugacccagugcauccaacagaaacagccgcugcccgaaccucugugugaagcuuuacgcg

SEQ ID NO: 385420 - RNA, 64 nt, Human
aacugaagguguccccaggccuacaccacugccaugcccgaacacuauccaugcuauggugggc

SEQ ID NO: 385421 - RNA, 64 nt, Human
cucccccagaucaagcgacgugccucagaggcuuugcccgaauugcuucguccugucaccccca

SEQ ID NO: 385422 - RNA, 64 nt, Human
uugaacaugcugaaaaccaccuggucugcauguaugcccgaauuuguaauucuuuucucucaaa

SEQ ID NO: 385423 - RNA, 64 nt, Human
ggaugugccacugagagccccgcgggucucccggugcccgaaccgccgcuggggccucggagac

SEQ ID NO: 385424 - RNA, 64 nt, Human
aggaaugugggaaagccuuuuauuguugcaguucugcccgaagacaugaaaggaugcacacugc

SEQ ID NO: 385425 - RNA, 64 nt, Human
cugucuccugauaagauguuaucaaugacaauggugcccgaaaccucauuagcaauuuuaauuu

SEQ ID NO: 385426 - RNA, 64 nt, Human
cuccaccaaggaggggggcuugggggggcccuccugcccgaagucauacucuugcucccacccc

SEQ ID NO: 385427 - RNA, 64 nt, Human
auucuaguagacucucgaugguggucuccgcucuugcccgaaggaccucugaaguacgcuggag

SEQ ID NO: 385428 - RNA, 64 nt, Human
aauuacauugaaacaucaaacuuaaacauugaauugcccgaacuucuuugggggaaaacuggau

SEQ ID NO: 385429 - RNA, 64 nt, Human
ccacauuucaagugcucaaagccacgugcuggcuaggggccacagcguuagacagugcagagag

SEQ ID NO: 385430 - RNA, 64 nt, Human
agagcuggggagaggguaggggaaagguuuuuccaggggccacuggguuugagcccugcuucug

SEQ ID NO: 385431 - RNA, 64 nt, Human
gagcaagggggcccaaaucgaccauaaaggguguaggggccaccuccucccccuguucuguugg

SEQ ID NO: 385432 - RNA, 64 nt, Human
cccacugacuggcaucugccggcuuugugcaggcagccccgacgguuuccacagcgagcgccag

SEQ ID NO: 385433 - RNA, 64 nt, Human
aaagggccugccuggccccucgccuguggagcucagccccgagcuguccccguguugcaugaag

SEQ ID NO: 385434 - RNA, 64 nt, Human; identical to SEQ ID NO: 385433

SEQ ID NO: 385435 - RNA, 64 nt, Human
cucuggugggaacuuacuucucuauagcccacugagccccgagacagagaaccugcccacagcu

SEQ ID NO: 385436 - RNA, 64 nt, Human
cagcuccccuaccaucaugcggaaaagcagcggcagccccgacucucagcacugguacgucugc

SEQ ID NO: 385437 - RNA, 64 nt, Human
gcugaugcaagauggcagaucugauacccauuagagccccgagaauuccucuucuggaucccag

SEQ ID NO: 385438 - RNA, 64 nt, Human
caguucccuccugcccaggacugcauuguuuucuagccccgaggugguggcacgggcccucccu

SEQ ID NO: 385439 - RNA, 64 nt, Human
uuugcucacacagcagcuuuugcacgccccaggcagccccgacugcugaaauccaacuugagcu

SEQ ID NO: 385440 - RNA, 64 nt, Human
acauuucuaggcacaugugaggcaucuuuccuggagccccgagccagcccugucccuccccagu

SEQ ID NO: 385441 - RNA, 64 nt, Human
ggguggcaucaccugguggcauuuccagaaccucagccccgauuccagcacccaccaccgccug

SEQ ID NO: 385442 - RNA, 64 nt, Human
cuguuggaagguagagcccacugcucauuguauaagccccgaggccuagaguggcagccaagag

SEQ ID NO: 385443 - RNA, 64 nt, Human
ccccccaaccuuucccucacccccucccacccccagccccgacuccagccagcgccucccucca

SEQ ID NO: 385444 - RNA, 64 nt, Human
cccacuaacuggcuaauuagcauggccacaucugagccccgaaucugacauuagaugagagaac

SEQ ID NO: 385445 - RNA, 64 nt, Human
uguggcugggacccagggcccuuccccacucuucagccccgagucaugugucugaggugacgga

SEQ ID NO: 385446 - RNA, 64 nt, Human
acccccaagccccacugaggccccuacugaggccagccccgagccagccccagacccagccccg

SEQ ID NO: 385447 - RNA, 64 nt, Human
uccuaccaccuaccucauucugccuacucaccccaggggccacagccacagccugcuggacuca

SEQ ID NO: 385448 - RNA, 64 nt, Human
ccccuacguccccccacaccuggaggcuggagccaggggccacuucugaacugcaccagcacca

SEQ ID NO: 385449 - RNA, 64 nt, Human
aaccccagccuugaaaauaguggggggcacucagaggggccaccuccucagccguggguggugg

SEQ ID NO: 385450 - RNA, 64 nt, Human
agucugaccaaaaauggagcccgcucuguggggaagccccgacucccccacgagaaacgguccc

SEQ ID NO: 385451 - RNA, 64 nt, Human
ggagggugacuggcagcuucuccuccagacuccuagccccgaggugcugauggagaugcucaag

SEQ ID NO: 385452 - RNA, 64 nt, Human
agcuggacauuggaaccuuggagaaugucuucacagccccgacaucaacuccuucuagcaucca

SEQ ID NO: 385453 - RNA, 64 nt, Human
caggcaucacggugcgacgugagaugccugcgccagccccgagcccacuggcagccacugccau

SEQ ID NO: 385454 - RNA, 64 nt, Human
aaggaaggagcuggguggccuugagggagaccccagccccgaggaggaugagggcauccagaag

SEQ ID NO: 385455 - RNA, 64 nt, Human
uggagggagggagccccccaaccucagugaggagagccccgagccggccccggggcaaagaggg

SEQ ID NO: 385456 - RNA, 64 nt, Human
gugugcgaagaucgccuugcuuuacugugaccacagccccgacgcggggcuguuuaacaagaac

SEQ ID NO: 385457 - RNA, 64 nt, Human
cccaggacaucuggccugaggggauuugaaucacagccccgaagguccugccuucaccccauug

SEQ ID NO: 385458 - RNA, 64 nt, Human
gggacagcguccacacucagagggccugggccacagccccgauguuucuuuucagaacucagcc

SEQ ID NO: 385459 - RNA, 64 nt, Human
uaguuagagccuuggcuccauuuuuggaugauuuagccccgaguuccugagucuauuuuaugcc

SEQ ID NO: 385460 - RNA, 64 nt, Human
uggguggcggugcggacugauguggagaugugacagccccgaugagcaccuggcuggcugcagg

SEQ ID NO: 385461 - RNA, 64 nt, Human
ccugaauucucaccaaguuuugaauuccuaagguagccccgaucuaggaugugaaggcugccca

SEQ ID NO: 385462 - RNA, 64 nt, Human
gacuccccccagguacagugccuucgagccuacaagccccgagagaaugaugaauuggcacugg

SEQ ID NO: 385463 - RNA, 64 nt, Human
cccagggcccucgucccgaggccgugcugccccgagccccgagccccucugcagcucacccuug

SEQ ID NO: 385464 - RNA, 64 nt, Human
guucuauagagccuggcgucuggacgccgagggcagccccgaccccuguccagcgcggcucccg

SEQ ID NO: 385465 - RNA, 64 nt, Human
gaauuuauugucauguaaauaguugagcuaagcaagccccgaauuugauaguguauaaggugcu

SEQ ID NO: 385466 - RNA, 64 nt, Human
aaggucucugcuggaagagacugggagaguggggaggggccagggaccuauuucguugacagaa

SEQ ID NO: 385467 - RNA, 64 nt, Human
caggucagaagagggagaggaggggcugggggugaggggccaggccauggccaaggggccagcu

SEQ ID NO: 385468 - RNA, 64 nt, Human
cccauggacacuccagugccagcaaugacaucucaggggccagaggaacuguccagagagcaac

SEQ ID NO: 385469 - RNA, 64 nt, Human
cgcugacagcuuucuugcgucucauuugucgccgagccccgagcgcacggugaugcucgggucu

SEQ ID NO: 385470 - RNA, 64 nt, Human
ccagaccucuguccuuccaccaaucgccucccgcagccccgagccgccacucccagucccccga

SEQ ID NO: 385471 - RNA, 64 nt, Human
aguccccgcccacccccauggcccuaugcggcccagccccgaaugccuugaagaagugcccccu

SEQ ID NO: 385472 - RNA, 64 nt, Human
ggggcaggacuugggagguuccagcaggcgggggagccccgaccaguggggacacuccucccuc

SEQ ID NO: 385473 - RNA, 64 nt, Human
ucuccuguccucguccuggccugcagcucuucccagccccgagagagcuucccgaccugucccc

SEQ ID NO: 385474 - RNA, 64 nt, Human
gcuucacggcgucuccacugugcgauuggcccggagccccgaagacucggagggagcugcucag

SEQ ID NO: 385475 - RNA, 64 nt, Human
gccugcccgcgccaggauguuuggcacaaagagcagccccgaagcccgcucaaugcucucgaug

SEQ ID NO: 385476 - RNA, 64 nt, Human
cuggcucagccugucuccagggcugcugcggcccagccccgagccugccucccucuuggccucu

SEQ ID NO: 385477 - RNA, 64 nt, Human
accgcccuuucccagcugcacucgcccuguggacagccccgacacaccacuuuccugaggcugu

SEQ ID NO: 385478 - RNA, 64 nt, Human
gaacugcaagugccugaggaccagaguggccucuagccccgaauugaacacuuuuaaaccuaaa

SEQ ID NO: 385479 - RNA, 64 nt, Human
acgaagguacagcucgccugccugccccaaucccagccccgacaaucacaugcagcugacucgg

SEQ ID NO: 385480 - RNA, 64 nt, Human
auucggcccagcucgucccggccuccaccaagccagccccgaagcccgccagccacccugccgg

SEQ ID NO: 385481 - RNA, 64 nt, Human
caaaagaaugucuguuucuaacaaauccacaaauagccccgagauucaccguccuagagcuuag

SEQ ID NO: 385482 - RNA, 64 nt, Human
gcuggagcggcacgucauccaggcugucaacaccagccccgagcggggaggcgaggaggcccug

SEQ ID NO: 385483 - RNA, 64 nt, Human
aggagaagguuguaggcauggaagagagccaggcagccccgaaagaagagccugggccacggcc

SEQ ID NO: 385484 - RNA, 64 nt, Human
caucuuucagaaggccucaucuccacuugccaggagccccgacaccacccuuggagacacggcu

SEQ ID NO: 385485 - RNA, 64 nt, Human
agguguuuguggggcuggaaggaccugcucccacaggggccauguccucucuuaauagguggca

SEQ ID NO: 385486 - RNA, 64 nt, Human
cagauggugcucggcuggacaaggggacugggggaggggccaaagcagggacaguggccccucc

SEQ ID NO: 385487 - RNA, 64 nt, Human
caaagaaauauaggaugcuuagaaagcauacaggaggggccaggcgugguggcucaugccugua

SEQ ID NO: 385488 - RNA, 64 nt, Human
cauugcacagugaaagaauucuggauaucucaggagccccgaaauucuagcucugacuuugcug

SEQ ID NO: 385489 - RNA, 64 nt, Human
caagggucgccuuccccagcuugugcuccaggggagccccgacgccggcggggaggcagggaug

SEQ ID NO: 385490 - RNA, 64 nt, Human
gaccgccccucuccucgcaguuuagagcccaaagagccccgagggaaccugccggggcagcgga

SEQ ID NO: 385491 - RNA, 64 nt, Human
caccccagcagcagugagugggcagguuuggaggagccccgaguggcccaggaguccccccaca

SEQ ID NO: 385492 - RNA, 64 nt, Human
cugcaauugcauaguucagaagcccucacuuuucagccccgaggaugguuuuguucaucuucca

SEQ ID NO: 385493 - RNA, 64 nt, Human
aggacucaucucccuuccuucucagggggucccgagccccgacuagcuuugcccuaacuccuuc

SEQ ID NO: 385494 - RNA, 64 nt, Human
uuuuaagauguaugugguggccggcgggaagaccagccccgacagcaccuccugagaaagucag

SEQ ID NO: 385495 - RNA, 64 nt, Human
ggagcccccuuucugaugaugaaacugaugcuugagccccgaccguagaacccacgugccugag

SEQ ID NO: 385496 - RNA, 64 nt, Human
ugaggugcagggcccaggugugcuggggugacaaagccccgagcuguggugaugggagggagga

SEQ ID NO: 385497 - RNA, 64 nt, Human
gggugugugaggggugaggaggcaucagcaguugagccccgaaggagaucaggcagccccaccu

SEQ ID NO: 385498 - RNA, 64 nt, Human
gcuggagugcaguggcacaaucauggcucacugcagccccgaacuacugggcucaagccuuccu

SEQ ID NO: 385499 - RNA, 64 nt, Human
gguuuuuguuaaaaugcaucugagcaagucagccagccccgaaguccccucagugugugugucu

SEQ ID NO: 385500 - RNA, 64 nt, Human
ucucugaacaaagcaguuccuccccuaccagcucagccccgagcugccgcagccucaggcagaa

SEQ ID NO: 385501 - RNA, 64 nt, Human
gugacgcacagccccgccccccggagguggcagcagccccgagggacgcccccagaggaccggg

SEQ ID NO: 385502 - RNA, 64 nt, Human
ggugugcgcagagcugucauagggucccuuugucagccccgaguucagcuucccaaacaccagu

SEQ ID NO: 385503 - RNA, 64 nt, Human
augguugaacucuguacugccuugugugcacuucagccccgacccccucugauucucuguugaa

SEQ ID NO: 385504 - RNA, 64 nt, Human
cugccuuccccagggugucucuaugaaaagcacaaggggccaaggucagggagcaagaggugug

SEQ ID NO: 385505 - RNA, 64 nt, Human
ucacuuuugggcucaaggacugugugaaccaacaaggggccaguuuuccauuguuguggugaac

SEQ ID NO: 385506 - RNA, 64 nt, Human
aaaccaucccaccgaagauauugucuaucaccccaggggccaucugaaggucucuuugcauuuc

SEQ ID NO: 385507 - RNA, 64 nt, Human
aggcauuuccugcugaacguuuccccgaagagucagccccgacuuccugacucucaccuguacu

SEQ ID NO: 385508 - RNA, 64 nt, Human
cacgguggcggcugcacaacagcccugccugagaagccccgacacacggggcucgggccuuuaa

SEQ ID NO: 385509 - RNA, 64 nt, Human
ccaccuugcuagggcccagaaccaagcgucccccagccccgagagggagccugucgucucccag

SEQ ID NO: 385510 - RNA, 64 nt, Human
caccuggaggguuggacccacucaccuccacucuagccccgaacccuccugccccaggcuucca

SEQ ID NO: 385511 - RNA, 64 nt, Human
ucuccucuugcugcucagcacagcccuggauugcagccccgaggcugagaccagacaaagcccg

SEQ ID NO: 385512 - RNA, 64 nt, Human
agagcacgagggccccgucagcucagucugugucagccccgauggccuccgugugcugucugcc

SEQ ID NO: 385513 - RNA, 64 nt, Human
ggccccaggagaagcugggcugugugguaccaacagccccgagggguggccuugcccugcuccc

SEQ ID NO: 385514 - RNA, 64 nt, Human
cugaggagguuccgaggcucaaaggaggggaaggagccccgaggaggcucugaguugaugucac

SEQ ID NO: 385515 - RNA, 64 nt, Human
guggaugccugguggcagcugcgguccacccaggagccccgaggccuucucugaaggacauugc

SEQ ID NO: 385516 - RNA, 64 nt, Human
uuagaaaaacaugaccagaaaucaaagaugucagagccccgaagcagcuaauguaauaagcacu

SEQ ID NO: 385517 - RNA, 64 nt, Human
guggcugcagcucugaccgucccgccagcacgccagccccgacucagcuccucgcggggcuggg

SEQ ID NO: 385518 - RNA, 64 nt, Human
cuugaggccccgauggacuccugaccauaauccuagccccgagacaccauccugagccagggaa

SEQ ID NO: 385519 - RNA, 64 nt, Human
uuauggcugcuguggggugaggggagggaggggcagccccgaggcagucucuucccuuugagaa

SEQ ID NO: 385520 - RNA, 64 nt, Human
aacuuauaaagugcaccucgcccccgcaagccccagccccgaggaccguccauggaccuuauuu

SEQ ID NO: 385521 - RNA, 64 nt, Human
uggggucuacgugaccuuuaguccucuaccucagagccccgagucauuucugaccaccccguuc

SEQ ID NO: 385522 - RNA, 64 nt, Human
acugacuuuagugggucuugauguagggugggcaagccccgacacuggagcuuagccugagagg

SEQ ID NO: 385523 - RNA, 64 nt, Human
gcuaugaggggaggaggaaugggagagggggcucaggggccaauaaacucugccuugaguccuc

SEQ ID NO: 385524 - RNA, 56 nt, Human
agcacaaggagcagaucugagugggcaggggccaucuccccacuccgcugcccugg

SEQ ID NO: 385525 - RNA, 64 nt, Human
cacgcagugcacaaucauuuaucuauguuuugccaggggccagggcucggggugggggagggcu

SEQ ID NO: 385526 - RNA, 64 nt, Human
ccaucuccuucccccagcccaauaaaggucccuuagccccgaguuuaaaauuauuguucugacu

SEQ ID NO: 385527 - RNA, 64 nt, Human
cccugccugcaccuccgcgggcugacugggccacagccccgaugauucuuaacacagccuuccu

SEQ ID NO: 385528 - RNA, 64 nt, Human
acacaaugggggaggggcuucggaccacagcaggagccccgacugcccaccugagggcagggag

SEQ ID NO: 385529 - RNA, 64 nt, Human
auguuaagauaaugcggguaacagacaauauaauagccccgaccuuaaacgaagcuuuuguacu

SEQ ID NO: 385530 - RNA, 64 nt, Human
ccccucuccugcugucccuccugguggaacugggagccccgaaccgggcagcgugggguccugg

SEQ ID NO: 385531 - RNA, 64 nt, Human
agguguugcuggagaacccugagggcagggcccgagccccgacacaucccuucccccaaaaagc

SEQ ID NO: 385532 - RNA, 64 nt, Human
gcccgccccggagcagggaggguggcuggggccaagccccgagggccccugcaagcacuuuacu

SEQ ID NO: 385533 - RNA, 64 nt, Human
gccuccccaccucccucucggcugugccuuacggagccccgauccaggccuccuguggcuguug

SEQ ID NO: 385534 - RNA, 64 nt, Human
caggguccucucuuccacaguggcgggcccacucagccccgagaccacccaaccucacccuccu

SEQ ID NO: 385535 - RNA, 64 nt, Human
aggcuccuccucgcauggccugcagucuggcagcagccccgaguuguuuccucgcugaucgauu

SEQ ID NO: 385536 - RNA, 64 nt, Human
ggggugggcagggggccaguugagccaagcccccagccccgaucugcagauccugccccaagaa

SEQ ID NO: 385537 - RNA, 64 nt, Human
ccuugccgggcuguuucccgaggcugcuccagggagccccgaggcccgcuggaggccgaucccg

SEQ ID NO: 385538 - RNA, 64 nt, Human
caauaaccacagggccugcagcagugccccugccagccccgaaucccacccccgggaccagcca

SEQ ID NO: 385539 - RNA, 64 nt, Human
gugcccaggacggccccgucccagagaacaauccagccccgaaugucagcaccuucccccuacc

SEQ ID NO: 385540 - RNA, 64 nt, Human
uggccccagccaucuccucuagaccaaggcaggcagccccgacaucugcuuccucuaucgccca

SEQ ID NO: 385541 - RNA, 64 nt, Human
ccagugaggcacuuugucccgcccagcgcuggccagccccgaggagccgcugccuucaccgccc

SEQ ID NO: 385542 - RNA, 64 nt, Human
acuauaaaguacguggcauguguaggugaauuacaggggccauggauguggacaccauggaggg

SEQ ID NO: 385543 - RNA, 64 nt, Human
cgccgucggaaggcgcuggagccugcggggcagcaggggccaagcaggcacucuggggcuggca

SEQ ID NO: 385544 - RNA, 64 nt, Human
augucaggagccucacgcucacccaagauccugcaggggccaggcuccaucucacuggcucuga

SEQ ID NO: 385545 - RNA, 64 nt, Human
auuuuuugaagagguuauguccugucagggaaccagccccgauauucacauagguucuuuucua

SEQ ID NO: 385546 - RNA, 64 nt, Human
aggcaagcgagcucucccucugcuucccugggggagccccgacggccacaggacuccagcucca

SEQ ID NO: 385547 - RNA, 64 nt, Human
gccuaccugcaccuccgugaggcaacugggccacagccccgaugauucguaacaccaccuuucg

SEQ ID NO: 385548 - RNA, 64 nt, Human
cccccagccccgggagccucccccagcuuccugcagccccgaccucucagguuagacccugggc

SEQ ID NO: 385549 - RNA, 64 nt, Human
guuaucuccucucuguccuccuuuucuucucuauagccccgauucaccaucucuccuccauuuu

SEQ ID NO: 385550 - RNA, 64 nt, Human
gccugcagggcgggguaggggagggcaggggcugagccccgaagccagcucaguaccugagggg

SEQ ID NO: 385551 - RNA, 64 nt, Human
ucugaucuggacaaagucgggacagcaccaucccagccccgaagccagggccaugccagcaggc

SEQ ID NO: 385552 - RNA, 64 nt, Human
gcagggagcccucugcccuguccuccgggccuucagccccgaacuuggagcucagcuauucggc

SEQ ID NO: 385553 - RNA, 64 nt, Human
cuagcucucccgggguguccucucccuuaggggaagccccgagugagagucccccagcacacac

SEQ ID NO: 385554 - RNA, 64 nt, Human
aacaaggccgggaggguggggggggugcacagguagccccgacccucucaggcauuccagccac

SEQ ID NO: 385555 - RNA, 64 nt, Human
ugacaaucucccugggugaggagugggugcacccagccccgaggccagugguugcucggggccu

SEQ ID NO: 385556 - RNA, 64 nt, Human
cgggcccugucgcgcucccgccccgguccugcacagccccgaaguucgccgggcccggccaccc

SEQ ID NO: 385557 - RNA, 64 nt, Human
gacgguggccccugcagaauguucauagguucccagccccgaccccacccaaaggggccuggag

SEQ ID NO: 385558 - RNA, 64 nt, Human
ggggguccagggaauggagcucaggucccaggccagccccgaagucgccacguggccuggggca

SEQ ID NO: 385559 - RNA, 64 nt, Human
ucaugccccaaaguguggggacagagccucagggagccccgagcaugguccagccccauuugag

SEQ ID NO: 385560 - RNA, 64 nt, Human
cacguguccaucgagcacgucugaaaccccugguagccccgacuucuuuuuaauuaaaauaagg

SEQ ID NO: 385561 - RNA, 64 nt, Human
agauuaaaaauaaauaaaaacauaaaaaauuaagaggggccaagaggaagacauucuuucugca

SEQ ID NO: 385562 - RNA, 64 nt, Human
uggcccaguggcaugccauuaggugauuuugcauaggggccauaucauucauggccaaaaaaaa

SEQ ID NO: 385563 - RNA, 64 nt, Human
uguaauuuacaucuguaacuuucauauuucuaaaaggggccaaugcaaaaggagagagaaggac

SEQ ID NO: 385564 - RNA, 64 nt, Human
auaggggcuaguaccacagaggccuccuguggugcccucguaucauaccaccuguuccugugga

SEQ ID NO: 385565 - RNA, 64 nt, Human
cuacuccugagcuuccccaacaggagcagguuugaggggccaggccucuuggaggccccuccug

SEQ ID NO: 385566 - RNA, 64 nt, Human
agugcuggaaggagcaugccuggguuagugggccaggggccaggcagcugggggccuuugggga

SEQ ID NO: 385567 - RNA, 51 nt, Human
aucuuggcucaguauguuaggaggggccaggcagcggggcagggacaggga

SEQ ID NO: 385568 - RNA, 64 nt, Human
cuuugagcauauggguccagccacucagaaguguaggggccaugccuugguguuccaauaagug

SEQ ID NO: 385569 - RNA, 64 nt, Human
aagcuugugggcucugaggaggggguaaggaugcaggggccaugcauucaucccagcacaggca

SEQ ID NO: 385570 - RNA, 64 nt, Human
uuugaagggggcaagggcugagaugugguccccaaggggccagaaauucccaaguuggucacag

SEQ ID NO: 385571 - RNA, 64 nt, Human
gaguccagaacucagggcauggaagcccuuuggcaggggccagccuugcacugagugaaacuug

SEQ ID NO: 385572 - RNA, 64 nt, Human
gcagacagaacggggaagacuccacucugucccgaggggccagccgcaggcguccccagggcca

SEQ ID NO: 385573 - RNA, 64 nt, Human
gcaugguagcucaugccuguaacccuggcacuuaaggggccaaggcaggaggaucacuugaggc

SEQ ID NO: 385574 - RNA, 64 nt, Human
aaagaaaacauuuguucccuguucauuuuauuuuaggggccagaucuaacauuguagugucuuu

SEQ ID NO: 385575 - RNA, 64 nt, Human
aaggagcagcagcuggggcagaggagcuggggucaggggccaccccucucugccgaucucccug

SEQ ID NO: 385576 - RNA, 64 nt, Human; identical to SEQ ID NO: 163559

SEQ ID NO: 385577 - RNA, 64 nt, Human; identical to SEQ ID NO: 163560

SEQ ID NO: 385578 - RNA, 54 nt, Human; identical to SEQ ID NO: 163561

SEQ ID NO: 385579 - RNA, 56 nt, Human; identical to SEQ ID NO: 163562

SEQ ID NO: 385580 - RNA, 64 nt, Human; identical to SEQ ID NO: 163563

SEQ ID NO: 385581 - RNA, 64 nt, Human; identical to SEQ ID NO: 240458

SEQ ID NO: 385582 - RNA, 64 nt, Human; identical to SEQ ID NO: 242568

SEQ ID NO: 385583 - RNA, 64 nt, Human; identical to SEQ ID NO: 242573

SEQ ID NO: 385584 - RNA, 57 nt, Human
accccuucaccuuugagugaucuuacucccucguacaugcacaaauacacacucaug

SEQ ID NO: 385585 - RNA, 64 nt, Human
uauaguuauaaauuguaagguaauuuuaaauugucccucguauuauuucuccacgucuguuuua

SEQ ID NO: 385586 - RNA, 64 nt, Human
gggacugaggaugggucucagagagcaaccuccucccucguagagggagauuauauccccaacu

SEQ ID NO: 385587 - RNA, 64 nt, Human
gaacucagguuuacacaaacugagggggccccagcccucguaccaccccuguuaccccaggauc

SEQ ID NO: 385588 - RNA, 64 nt, Human
ccucuuucuugugccuuguucacuucuguugaaccccucguacugccgggcauuuauuauacua

SEQ ID NO: 385589 - RNA, 64 nt, Human
guuacacccucccaugcagugggagaaacacagacccucguacccaaaggccccugccccacuu

SEQ ID NO: 385590 - RNA, 64 nt, Human
gcagggcaaaggcuuacugauaaacuugagucugcccucguaugaggguguauaccuggccucc

SEQ ID NO: 385591 - RNA, 64 nt, Human
cccccucaccuccauucauaacccagucucaaugcccucguaucaauaagaccgggguaagggg

SEQ ID NO: 385592 - RNA, 64 nt, Human
uuguaaaaauauaaacacauggggcuaugacuuucccucguaauacuccuuuagcugcauccug

SEQ ID NO: 385593 - RNA, 64 nt, Human
guggcagcauugagggaaaccaggucaccauccacccucguaacaacagucucccugggugggu

SEQ ID NO: 385594 - RNA, 64 nt, Human
gaugaggugagggaggagcaggucaggaggggggcccucguagggacgcguacacucacacgga

SEQ ID NO: 385595 - RNA, 64 nt, Human
cccgauuuucggaguuggggaagggccaugaccacccucguagacuuuuuccaugggauacagu

SEQ ID NO: 385596 - RNA, 64 nt, Human
ccccacuggcugcugagcagguggccuccuaugacccucguaggugcgaggucagaagccagca

SEQ ID NO: 385597 - RNA, 64 nt, Human
ccaaccugccccacugggucccggcaggggccaugccuaccaagcucgagcuggcccuugaccc

SEQ ID NO: 385598 - RNA, 64 nt, Human
gguucucauggaggggauaggaaguagguuuaaagccuaccaguguaaccuaccaguacaacug

SEQ ID NO: 385599 - RNA, 64 nt, Human
cugcguggggagaacuugguauccaugacuguggaggggccaccccccaaagauguaaggaaga

SEQ ID NO: 385600 - RNA, 64 nt, Human
uuuuguaaaggcucaaguuugguugccaaauggaaggggccauagcugcagcaauugcugacau

SEQ ID NO: 385601 - RNA, 64 nt, Human
ugaugcagaagaaccggcggaaggaccggaagcuaggggccagucucuucaccauuggcuucgc

SEQ ID NO: 385602 - RNA, 64 nt, Human
aucuccagaucuguucuucaccagauuagguuaggccuaccaugugccacagggugugugugug

SEQ ID NO: 385603 - RNA, 64 nt, Human
cagcuucacuccucaggaaguaccauggacagacgccuaccaggggugacaaagcagugcaguu

SEQ ID NO: 385604 - RNA, 64 nt, Human
aagggcuuccaagauggggcagguaguccguacagccuaccaggaacauguuguguuuucuuua

SEQ ID NO: 385605 - RNA, 64 nt, Human
uuuguauagcagcccuauacuuuggggaucauuugccuaccauggcauauauuugaaauugcuu

SEQ ID NO: 385606 - RNA, 64 nt, Human
gggugucuccugaagauacuuagggaaaacaggagccuaccacaaggcuccugaucauucugga

SEQ ID NO: 385607 - RNA, 64 nt, Human
caguuaugaaggaaauauugcuaaaaugaucugggccuaccauaaauaaauaucuccuuuucug

SEQ ID NO: 385608 - RNA, 64 nt, Human
cugagguaacucucagcccagaugugaaaugggagccuaccagcugguauagaagggaaugggu

SEQ ID NO: 385609 - RNA, 64 nt, Human
cguuccacagcuccaccuucaucuucucaucaaagccuaccauggauacacagggagcuucuuu

SEQ ID NO: 385610 - RNA, 64 nt, Human
cccaacuucugucgcaugcagugccuguacuggugccuaccauacacggaaagcaaaacagaaa

SEQ ID NO: 385611 - RNA, 64 nt, Human
aagggguggggugaggggauggagagggagggcugccuaccauggucuggggcuugaggaagau

SEQ ID NO: 385612 - RNA, 64 nt, Human
aaaaaaccaugcuuccuuuggauagacuucuccagccuaccaauauauauccaugugccuggau

SEQ ID NO: 385613 - RNA, 64 nt, Human
acuauuuuuguuuuuauuaaaaggaagcuuacaugccuaccaauauuuaaucuuuuaugauugc

SEQ ID NO: 385614 - RNA, 64 nt, Human
ggcaaaagcacagguccuuuccauaucaaguuuagccuaccaggguuguuuuuuguuuuaaccc

SEQ ID NO: 385615 - RNA, 64 nt, Human
accacacaagacauuuuucuacaguauuucaggugccuaccacacaggaaaccuugaagaaaau

SEQ ID NO: 385616 - RNA, 64 nt, Human
aagcccaggccauacucccugccuccuuucuucugccuaccagaggcuccagaguugagcuugu

SEQ ID NO: 385617 - RNA, 64 nt, Human
uuggacccaccuguggggccuggggagcccacugaggggccagggaggaaggaggccacggagc

SEQ ID NO: 385618 - RNA, 64 nt, Human
cgugacaccuuuugauugucacugaccacucagaaggggccacggccuccuggcuguguuccug

SEQ ID NO: 385619 - RNA, 64 nt, Human
acucagcucuuuguaaauguugugcucaacuucuaggggccaguucuagacuuuggagaugcag

SEQ ID NO: 385620 - RNA, 64 nt, Human
ccuuguaggauuuucuaaaauuacagauuguugagccuaccauaggucaaaaggacuggaauuu

SEQ ID NO: 385621 - RNA, 64 nt, Human
ucccuucagccaccuccuuccugcuaaaagcuuagccuaccacacuaccagucauucccaucgc

SEQ ID NO: 385622 - RNA, 64 nt, Human
ggguaccuggaauguaggaucucccccaugccuggccuaccacccuaaugugucuggaauuggu

SEQ ID NO: 385623 - RNA, 64 nt, Human
ggaaauccucaaagcuuucagaagcauccagaaugccuaccaucagcuccugaaucagggauuu

SEQ ID NO: 385624 - RNA, 64 nt, Human
ugccucagccucccgaguagcugggaccacaggugccuaccaccaugccaggcuaauuuuugua

SEQ ID NO: 385625 - RNA, 64 nt, Human
gauuauucuuuuaaauucaaacuaguaugucaaugccuaccauuacucugauuauauuaaaaca

SEQ ID NO: 385626 - RNA, 64 nt, Human
agcaaacccuucauuuaaagcaaacccuugucaagccuaccagagcagcugauacgugugcaua

SEQ ID NO: 385627 - RNA, 64 nt, Human
uaggaccagaacaucuuuggggugcuguuauucugccuaccacaccuuccugccacugacuccc

SEQ ID NO: 385628 - RNA, 64 nt, Human
uuccagaccagauacuaccuguggcaagaaugcugccuaccaguuaacugcugguccuaccaca

SEQ ID NO: 385629 - RNA, 64 nt, Human
aacacccuaaggcuggugccaguaguuaugaguagccuaccacccccucccuuacaguaacccc

SEQ ID NO: 385630 - RNA, 64 nt, Human
gucugagcacaaaaagauaaugcacgaugagauugccuaccauuuuauaggauauuuacuaugu

SEQ ID NO: 385631 - RNA, 64 nt, Human
guggguuaaaguccuaggugggguucucuuuguugccuaccaggagaaagcaguaggcuuccuu

SEQ ID NO: 385632 - RNA, 64 nt, Human
acuuauugcuaaagaaagggagaucaauggaguugccuaccagcacccauucucuuuuaguuca

SEQ ID NO: 385633 - RNA, 64 nt, Human
acaagggcagccaagcagggcuuaggauaucccagccuaccaauaugcucauucgacuaacuag

SEQ ID NO: 385634 - RNA, 64 nt, Human
aagcaguugcaauaaacucagucaaauguacccagccuaccagagauggaccaacgauccuaug

SEQ ID NO: 385635 - RNA, 64 nt, Human; identical to SEQ ID NO: 240459

SEQ ID NO: 385636 - RNA, 64 nt, Human; identical to SEQ ID NO: 240475

SEQ ID NO: 385637 - RNA, 64 nt, Human; identical to SEQ ID NO: 240476

SEQ ID NO: 385638 - RNA, 64 nt, Human
uuaggcuuauaacaucacauuuaaaagcaucucagccuaccaugagaauaagagaaagaaaaug

SEQ ID NO: 385639 - RNA, 64 nt, Human
gaaagccaucagguccuagacguggaagaaaggagccuaccaaaguguuggaguaaacaguggc

SEQ ID NO: 385640 - RNA, 64 nt, Human
aaaguacuacacuaaauucacucaacuauuguaugccuaccauaugccagauuuuauccuagac

SEQ ID NO: 385641 - RNA, 64 nt, Human
cuaccuaaugagcucaagugauccucccaccucagccuaccaaguagccaggaccacaggcaag

SEQ ID NO: 385642 - RNA, 64 nt, Human
cucuccacaggagcuguaaaagucaugguugacugccuaccaaccauauuuguuagcagagccc

SEQ ID NO: 385643 - RNA, 64 nt, Human
gcguccucuccaguggggggagaaaaggaacugugccuaccaaagguacucucuugucagcaau

SEQ ID NO: 385644 - RNA, 64 nt, Human
ucuguaaugacucuacguuauccuguuucccugugccuaccaaacacugucaauguuuauuaca

SEQ ID NO: 385645 - RNA, 64 nt, Human
cccacuugauuagagcaaugggaagcauacuguggccuaccagcaucuggaagugugugcucga

SEQ ID NO: 385646 - RNA, 64 nt, Human
ucaucccaguugagcccuguccgcagaucaaccagccuaccaacuuccagacacgaguaaagcc

SEQ ID NO: 385647 - RNA, 64 nt, Human
ccacuuuuguucggugagccuggcacugcuccuugccuaccagcacccgacuuuuaauuauaug

SEQ ID NO: 385648 - RNA, 64 nt, Human
uuggagaaggugaagaacccucccauucacgcccgccuaccaacaacaaacgugcuuuuuuccu

SEQ ID NO: 385649 - RNA, 64 nt, Human
aguaauaauaaugacaauaaacaaaccccugugugccuaccacccaccuuauugccuuuccuuu

SEQ ID NO: 385650 - RNA, 64 nt, Human
caaaaccugcugaaucagaagcucugagaguaaggccuaccaaucugguuuaacaagcccguca

SEQ ID NO: 385651 - RNA, 64 nt, Human
uggugaagucuucuguaccaaugcaccagagaaugccuaccauccaaaaaagcagucagcugau

SEQ ID NO: 385652 - RNA, 64 nt, Human
accuuacauuuauauagugcaccuaugagcaguugccuaccauguguccaccagaggcuauuua

SEQ ID NO: 385653 - RNA, 64 nt, Human; identical to SEQ ID NO: 242579

SEQ ID NO: 385654 - RNA, 64 nt, Human; identical to SEQ ID NO: 242585

SEQ ID NO: 385655 - RNA, 64 nt, Human; identical to SEQ ID NO: 242590

SEQ ID NO: 385656 - RNA, 64 nt, Human
gaacaaugccaauguauaaaaccccaagucaagggccuaccaaggcaauuggaucucucaaguc

SEQ ID NO: 385657 - RNA, 64 nt, Human
uccugacucaaauaaauaaauaagaagagcaguugccuaccacauaguacuuauucagucagug

SEQ ID NO: 385658 - RNA, 64 nt, Human
gaccucuucuuggagcccagaacuuuauagaguugccuaccaggguuacuguaauggaauuuau

SEQ ID NO: 385659 - RNA, 64 nt, Human
acacaaguggucuggacaugaggguacaguuucugccuaccaagacacuacuugcacuggaucu

SEQ ID NO: 385660 - RNA, 64 nt, Human
auuacagacucuagcugcugccugggggcgagcagccuaccagaugucgauuugcacuacgugg

SEQ ID NO: 385661 - RNA, 64 nt, Human
cuuuuccagcucaucacaccccgccccacuaugggccuaccauuaauaguguauaacuuggagg

SEQ ID NO: 385662 - RNA, 64 nt, Human
uugucacuucccagagauugcagagguguguccugccuaccaucugccuguccagcuugguggg

SEQ ID NO: 385663 - RNA, 64 nt, Human
uauauacgauaaguuguauauaugaucacugguagccuaccaaagcuguagaaaucuaggacug

SEQ ID NO: 385664 - RNA, 64 nt, Human
uugccaagcuacaucaagaacucagcugugcugugccuaccaggggucuccuuucuuacccagg

SEQ ID NO: 385665 - RNA, 64 nt, Human
cuuuuccagcucaucacaccccgccccacuaugggccuaccauuaauaguguauaucuuggagg

SEQ ID NO: 385666 - RNA, 64 nt, Human
ccucacgcuagaguaaaagucccaguuaagugaagccuaccagaagaacuaguagaagaagcuu

SEQ ID NO: 385667 - RNA, 64 nt, Human
cagggcacgugugcauacaagcagauucagcacugccuaccaggcucuccuguuaccuugccuc

SEQ ID NO: 385668 - RNA, 64 nt, Human
agggcagaggugaggagggggaagauguuucugggccuaccaagguucaacaagagaacggagc

SEQ ID NO: 385669 - RNA, 64 nt, Human
ucccuguccccuuuccugcuggcaggagccggcugccuaccaggggccuuccuguguggccugc

SEQ ID NO: 385670 - RNA, 64 nt, Human
caugaaugugauuaauaaugcugaaaaaguauuagccuaccaaagacacacucaggcuuuagug

SEQ ID NO: 385671 - RNA, 64 nt, Human; identical to SEQ ID NO: 242594

SEQ ID NO: 385672 - RNA, 64 nt, Human; identical to SEQ ID NO: 242600

SEQ ID NO: 385673 - RNA, 64 nt, Human
uccugaguaccagcaggucccuuuuugucucucaugggccuagcauagguaugagccagggauc

SEQ ID NO: 385674 - RNA, 64 nt, Human
aaauuucaguaacugacugucccucauguccauggccuaccaucccuucugacccuggcuucca

SEQ ID NO: 385675 - RNA, 64 nt, Human
gagcagcuccacacucuucuugaggugucuagaagccuaccagcuuagcuccuggaguaggaau

SEQ ID NO: 385676 - RNA, 64 nt, Human
cccuguuccuaggcucugccccagccaguccagagccuaccacagcaauacccccaacacucac

SEQ ID NO: 385677 - RNA, 64 nt, Human
agaaaugugugauuugggugggcuuuuacaucuugccuaccauugcaugaaacauugggguuuc

SEQ ID NO: 385678 - RNA, 64 nt, Human
uugugaauugugcugguuuccugggcauugccacgccuaccacagguggguacauuagaagcca

SEQ ID NO: 385679 - RNA, 64 nt, Human
uccuccagcaacucccucaccaccacgccucccugccuaccauccccggaagggugcuuauucu

SEQ ID NO: 385680 - RNA, 64 nt, Human
uugauguagugagaaaugcauuaacauguugaaugccuaccauguaccaaauuuugugcauaua

SEQ ID NO: 385681 - RNA, 64 nt, Human
uuggugcagaggcgcucauggccuccugcuucuugccuaccacuuggccagugcccacccagcc

SEQ ID NO: 385682 - RNA, 64 nt, Human
uuuuaucuccugugauccuuugauggcuuuuuuugccuaccauuucacagagguuuagacagca

SEQ ID NO: 385683 - RNA, 64 nt, Human
cccgcuuuggaugugauucccucuccccaaaugggccuaccaagggggcgggcugaugaccaua

SEQ ID NO: 385684 - RNA, 64 nt, Human
gugcuggaauuacaggugugagccacucugccuggccuaccacuaacuugaauacauucagaau

SEQ ID NO: 385685 - RNA, 64 nt, Human
cagaacucauuuauucagcaaauauuuauugagugccuaccagaugccagucaccacacaaggc

SEQ ID NO: 385686 - RNA, 64 nt, Human
uuuguuagaauuuguuagauuuuauugcaaugaugccuaccaaacauuuccagacuuaacauuu

SEQ ID NO: 385687 - RNA, 64 nt, Human
cuuuuccugcagggguugagagcuuucugccuuagccuaccaugugaaacucuacccugaagaa

SEQ ID NO: 385688 - RNA, 64 nt, Human
gacuuuuaaaacaagcaucccaggggauuccggugccuaccagaagucgcaagcugcuuggcuc

SEQ ID NO: 385689 - RNA, 64 nt, Human
aauaggagaccuggggccuggccaggccaggguuugggccuaauggcuuugacuaaauuacccc

SEQ ID NO: 385690 - RNA, 64 nt, Human
gcaaaugucuuaggugauuuaaauaaaugaguauugggccuaauugcaacaccagucuguuuuu

SEQ ID NO: 385691 - RNA, 64 nt, Human
cugacuuauuaugagaugaaaaaccaaaggagagugggccuaacucaugugagcuugauaacug

SEQ ID NO: 385692 - RNA, 64 nt, Human
ucaugugaaauuuauuuugguuccuaaaauggaagccuaccacauugcauuguaauacagugua

SEQ ID NO: 385693 - RNA, 64 nt, Human
uguuugauuuugcuaauaauauuugaaggagauugccuaccaaggacaaaacaauaaauuuaaa

SEQ ID NO: 385694 - RNA, 64 nt, Human
cccaucuuggcacccugauuauucauacaugucugccuaccacacacaaaauauauccuugguu

SEQ ID NO: 385695 - RNA, 64 nt, Human
agcacuguggcagcgcccaggagggcauagggcagccuaccaccuccaagggggcaggcgcccu

SEQ ID NO: 385696 - RNA, 64 nt, Human
caggacaggagugggggccagccugaggacccccgccuaccaccucgagaacuggaagccaacc

SEQ ID NO: 385697 - RNA, 64 nt, Human
ccagccuuacccccuaccacauguccggcacauggccuaccagcucugccacgcccuuagaugu

SEQ ID NO: 385698 - RNA, 59 nt, Human
cguacuccaaugagaugugaaccagccacgccuaccagguggcagagcuggggccauug

SEQ ID NO: 385699 - RNA, 64 nt, Human
acccaccugcccaucugugcugaggcauguuccugccuaccauccuccucccuccccggcucuc

SEQ ID NO: 385700 - RNA, 64 nt, Human
cucagacucaggucugaaacccacccacccgcaagccuaccagccuuguggccacgcccccacc

SEQ ID NO: 385701 - RNA, 64 nt, Human
gccuuaggcuccugaguagcuggggauuacaggugccuaccagcaugcucggcuaauuuuuuug

SEQ ID NO: 385702 - RNA, 64 nt, Human
gggccugugucccucccgaacccagggucaaccugccuaccacaggcacuagaaggacgaaucu

SEQ ID NO: 385703 - RNA, 64 nt, Human
ggcccccuacagccucagguucugccugagcccagccuaccaggcuugccccucagcucagcac

SEQ ID NO: 385704 - RNA, 64 nt, Human
uucugcccagagcucggcugaaccagccuuuagugccuaccauuaucuuauccgucucuucccg

SEQ ID NO: 385705 - RNA, 64 nt, Human
acugcucguggccuacgggcagagggaccccagcgccuaccaccucaacagacaccuccagcac

SEQ ID NO: 385706 - RNA, 64 nt, Human
aacaaucuagauuauuccuuuucauccuaaauaagccuaccaaauuucaugcuguugguuugcc

SEQ ID NO: 385707 - RNA, 64 nt, Human
gauggcacucagcgcucuccccugagggagucccugggccuagccauccccucacuauucccga

SEQ ID NO: 385708 - RNA, 64 nt, Human
uugguguuucccuguugacccagcaccauuucugugggccuagaauauggcccucaacccuuag

SEQ ID NO: 385709 - RNA, 64 nt, Human
uggauuaccacaugcauuaaaaaauuuuucaagcugggccuaguggcgcacaccugcaauccca

SEQ ID NO: 385710 - RNA, 64 nt, Human
gaacuguuugcuguguggagguguuaguucugcugccuaccaucuucaucucuagcaccucccc

SEQ ID NO: 385711 - RNA, 64 nt, Human
aaguguugaagccagagccaccuccaacucuggagccuaccaagagaacuguggggauguggga

SEQ ID NO: 385712 - RNA, 64 nt, Human
agaccugguuaguguauguucucauuuaccacaggccuaccagcccugggcacagcagcuucau

SEQ ID NO: 385713 - RNA, 64 nt, Human
caacacuggggagucacccuucccucgggccucugccuaccaacaacugggcuuaucacuggga

SEQ ID NO: 385714 - RNA, 64 nt, Human
ucacaggccaacauguguuccauggcugggaauugccuaccacccacaucagcuucuguuuacc

SEQ ID NO: 385715 - RNA, 64 nt, Human
cgucaugugcuugcucuuacagugccugggcucagccuaccagcugcugccauacaggagauug

SEQ ID NO: 385716 - RNA, 64 nt, Human
gucaggacacagagugggagggagacugaugcaggccuaccagucccuggcuuuuugucugggg

SEQ ID NO: 385717 - RNA, 64 nt, Human
cauguuguuuacuuccacaaaccuagaugguauagccuaccaguacaccuaggcuauaugguau

SEQ ID NO: 385718 - RNA, 64 nt, Human
accauuaucguaauacaaugaaccuuuauuuauugccuaccacauguuaugggcugaauaaugg

SEQ ID NO: 385719 - RNA, 64 nt, Human
aacuuuugagggucguugcaagacuguguagcaggccuaccaggucccuuucaucuugagaggg

SEQ ID NO: 385720 - RNA, 64 nt, Human
gccacagucagcgucugcugcuugugaagaaauagccuaccagguagcuggcgucucugggaac

SEQ ID NO: 385721 - RNA, 64 nt, Human
aguggggggugcccacccaccccccccgccccgggccuaccaagcccccgcccuucccaccccg

SEQ ID NO: 385722 - RNA, 64 nt, Human
ggggggccugauagcccagcacccaugauacagggccuaccaaugcuuaaaaccacacccaggg

SEQ ID NO: 385723 - RNA, 64 nt, Human
cuggacuuaaggauugcugggccaccgccucucugccuaccaccauuccauauuuaaguggagc

SEQ ID NO: 385724 - RNA, 64 nt, Human
ugaacuccugaccucagguaauccaccugcuucagccuaccaaagugcugggauuacaggcgug

SEQ ID NO: 385725 - RNA, 64 nt, Human
uguccguccaugccaugaaugagugggcuguaguugggccuaaauaaaugagcuguuggaagaa

SEQ ID NO: 385726 - RNA, 64 nt, Human
aagucauggcaacaggcuggagcagcccaggagaugggccuaaaauguucuggaucccuugggu

SEQ ID NO: 385727 - RNA, 64 nt, Human
augcuuuuccagcucaucacaccccgccccacuaugggccuaccauuaauaguguauaucuugg

SEQ ID NO: 385728 - RNA, 64 nt, Human
gugacacuggguccaggagcucccuggggcccuggccuaccacucacuggccucgcucccccug

SEQ ID NO: 385729 - RNA, 64 nt, Human
ugccaaaucagaucccguccaaagugccucccaugccuaccaccaucaucacaucccccagcaa

SEQ ID NO: 385730 - RNA, 64 nt, Human
aguucugaugggagagguacagguuggguucucugccuaccauugcugucucugacuuccagag

SEQ ID NO: 385731 - RNA, 64 nt, Human
uucauggucuagaaaugcggucuggucucgccucgccuaccaaucucugcucucuauguaugua

SEQ ID NO: 385732 - RNA, 64 nt, Human
uggagaaagcucaagagggaaucaucuggccugagccuaccaugaggcuguuugugguccuggc

SEQ ID NO: 385733 - RNA, 64 nt, Human
agucagguagagguuacaaaccguuucaggcccugccuaccacauucacuguuugaaucuuuaa

SEQ ID NO: 385734 - RNA, 64 nt, Human
augcacggacucguuuccagagguaauuaugagcgccuaccagccaggccacccagccguggga

SEQ ID NO: 385735 - RNA, 64 nt, Human
uggacccuugaugggaccucggcuucugcucgaagccuaccaggcucccggugugugcagggag

SEQ ID NO: 385736 - RNA, 64 nt, Human
aucuuccuccucuacugguaaccaaggcaaucaggccuaccagaaucgcccaguggcugcuaau

SEQ ID NO: 385737 - RNA, 64 nt, Human
uuggccuuauggauuuggacucgaaauuagaagagccuaccauuucagaugcaaucacuuuugg

SEQ ID NO: 385738 - RNA, 64 nt, Human
ugccuuggccucccaaguagcugggacuacaggcgccuaccaccaugcccagcuaauuuuugua

SEQ ID NO: 385739 - RNA, 64 nt, Human
ugcaauggcuugaucuuggcucacugcaaacucugccuaccagguucaagcgauucuccugccu

SEQ ID NO: 385740 - RNA, 64 nt, Human
gcccugucugccuccaccucugggugcacccccugccuaccacccucccuucuagagagcacau

SEQ ID NO: 385741 - RNA, 64 nt, Human
ccggucccaguccggugccuuccacccugcccuggccuaccacagcugccuccgggccucggcc

SEQ ID NO: 385742 - RNA, 64 nt, Human
uaccucaucaugaacccuuggguagcuugauucugccuaccauccaggaaaacuugugcuggaa

SEQ ID NO: 385743 - RNA, 64 nt, Human
gggguugggggugguagggauagggcaugaucaaaggggccauuucuugcuuuucuuuccucau

SEQ ID NO: 385744 - RNA, 64 nt, Human
uaggcaaggcuaugugauuacaaggcuuuaucucaggggccaacuaggcagccaaccuaagcaa

SEQ ID NO: 385745 - RNA, 64 nt, Human
cggccugugacaccugaagccgccagcucgccacaggggccagggagcuggagauggccuccag

SEQ ID NO: 385746 - RNA, 64 nt, Human
cggugggcuggugguuucauagccgacacacagcgccuaccaugugcagcugccuguccgaccc

SEQ ID NO: 385747 - RNA, 64 nt, Human
ucaaugaugcaggcaauaaaccgccuuuuuggcagccuaccaaugccaaaaggauaaaugucuu

SEQ ID NO: 385748 - RNA, 64 nt, Human
gaacguccucaaaugugacauuaacauucccaucgccuaccauuuucugcgcagauaugcuagg

SEQ ID NO: 385749 - RNA, 64 nt, Human
agccuccccuauccccacccuguccccguccccagccuaccaaagaguauucacaccuuuccau

SEQ ID NO: 385750 - RNA, 64 nt, Human
gcuugggaggaagcccaguagccauuuuguaacugccuaccagucgcccucugugccuaauaaa

SEQ ID NO: 385751 - RNA, 64 nt, Human
ugcuaccucucuuccuggauagcccaaaguguccgccuaccaacacuggagccgcugggaguca

SEQ ID NO: 385752 - RNA, 64 nt, Human
caugagugggacccaagauaucacugacuucaacccagaggaucgagccccugcacccugccug

SEQ ID NO: 385753 - RNA, 64 nt, Human
gaaucauuucuuauaccuucugacagcccaacuuccagaggacagcucugggguacucguugga

SEQ ID NO: 385754 - RNA, 64 nt, Human
uacagaauuggacaacccgaacugcuuuucaaaaccagaggaaggagguucuuagccguuacuc

SEQ ID NO: 385755 - RNA, 64 nt, Human
uuucccaagugcauccucagaagcucugggugugccagaggacccccagaacuaagaagggagg

SEQ ID NO: 385756 - RNA, 64 nt, Human
agaagcuagauggguaccaggugggguuagguucccagaggacugagggaauccuguacaggau

SEQ ID NO: 385757 - RNA, 64 nt, Human
acacuggcuguagccacuucaguccaucugcccuccagaggagggguuucuuccugauuuuuag

SEQ ID NO: 385758 - RNA, 64 nt, Human
ccugcccuuugucccccaggccuaggaucagggaccagaggauccuaucuucucagcacccagc

SEQ ID NO: 385759 - RNA, 64 nt, Human
uuggcuuuguguucuugcauggauuugggguuggaggggccauuccggaggcuaaauaaagucu

SEQ ID NO: 385760 - RNA, 64 nt, Human
aaaccagcuggguacaguuucuuggcacucuguaaggggccaccuuaaucauaccaaauauugg

SEQ ID NO: 385761 - RNA, 64 nt, Human
ccaaaccaaaaagaagaaaacagaugcccccagaaggggccagugcgggcagccagggccuagu

SEQ ID NO: 385762 - RNA, 64 nt, Human
acagucauaagagccaucugucacggacccacgcccagaggaacgugcagaaaaaagcagagcu

SEQ ID NO: 385763 - RNA, 64 nt, Human
uagccucagcagaccuaaggcaucucuacucccuccagaggagccgcccagauuccugcagugg

SEQ ID NO: 385764 - RNA, 64 nt, Human
gguacugggggcccucuggccuuuugcagcugauccagaggaacccagagccaacuuaccccaa

SEQ ID NO: 385765 - RNA, 64 nt, Human
gcuuuccaagccccaggagcugugccacccaaauccagaggaagcaaggaggagggaggugggg

SEQ ID NO: 385766 - RNA, 64 nt, Human
auacagccccaggcaaugggcacagccuuccuccccagaggacccggccgaccucagcgccucc

SEQ ID NO: 385767 - RNA, 64 nt, Human
auggacagaggcucucggugccgaagauugccugccagaggacugaccacagccuggcuggcag

SEQ ID NO: 385768 - RNA, 61 nt, Human
cugaaaagcagucauccugauggcucuggcuccagaggaccugagacucacacucucugca

SEQ ID NO: 385769 - RNA, 64 nt, Human
augggagacuguagagaaaaugaaaaaagauccaccagaggacaucuuggggagggggagggag

SEQ ID NO: 385770 - RNA, 64 nt, Human
agcacauccgagucaagacuguuaauuucugacuccagaggaguuggcagcuguugauauuauc

SEQ ID NO: 385771 - RNA, 64 nt, Human
cucaacccgcagacccuugacugaaugagagaggccagaggaugcuccccaugcugccacuauu

SEQ ID NO: 385772 - RNA, 64 nt, Human
ucuugcuguucccaguagaaucgcuagcucuucuccagaggaaaaguacuaggauucuuaagau

SEQ ID NO: 385773 - RNA, 64 nt, Human
ggcccaacaagaagguuucuguccuaaucauauaccagaggaaagaccaugugguuugcuguua

SEQ ID NO: 385774 - RNA, 64 nt, Human
gagaaccuggacccuggaaucagcauggaugagaccagaggagguauggauggaaacaagcucu

SEQ ID NO: 385775 - RNA, 64 nt, Human
gugaagacuuaccaaaugaauuuuagaucauucuccagaggagauuuuuuuugcucuucucauc

SEQ ID NO: 385776 - RNA, 64 nt, Human
auacagcagucucaacugggggcaauuuugccccccagaggacauugggcaauguuuggagaca

SEQ ID NO: 385777 - RNA, 64 nt, Human
agaacugcuaagugaugacagguggagccccagcaggggccacucuauugaauggcauggccca

SEQ ID NO: 385778 - RNA, 64 nt, Human
gcuuuguguuuacuuuuuggcuggagcggagaugaggggccaccccgugccccugugcugcggg

SEQ ID NO: 385779 - RNA, 64 nt, Human
ccuccuaugccucauguccagccagguugagccuaggggccaguugggggaccacaggacaauu

SEQ ID NO: 385780 - RNA, 64 nt, Human
gaagcuuuugcagcacuuuaccucucugaaagccccagaggaccagagcccccagccuuaccuc

SEQ ID NO: 385781 - RNA, 64 nt, Human
gccuuaagucucuuggagaagcuggugcugugagccagaggaugucagcugccaauuguguuuu

SEQ ID NO: 385782 - RNA, 64 nt, Human
guuugcaggcuggugggcuuucaaauugguacuuccagaggaaagccaagcugcuucuguugug

SEQ ID NO: 385783 - RNA, 64 nt, Human
gcuuggucuuggcccucaacuggggcaagugaagccagaggagggucccccagcugggugggcu

SEQ ID NO: 385784 - RNA, 64 nt, Human
guauugcaaacugugaaucaaaggcuucacagccccagaggauuccauauaaaagacauuguaa

SEQ ID NO: 385785 - RNA, 64 nt, Human
gccacaaggacugagguuggguaggugugggguuccagaggacagcaggacacucucgcauacu

SEQ ID NO: 385786 - RNA, 64 nt, Human
agguuucaggggccuccuuuguugucaucagaacccagaggaauucuucuccuaaaaaauacgu

SEQ ID NO: 385787 - RNA, 64 nt, Human
uugauagaagaguuacuccgagcuuuaucauggaccagaggaaaaccagaaaacugaaaacauu

SEQ ID NO: 385788 - RNA, 64 nt, Human
uggaugccuccuccuacuggugccuucuuuucuuccagaggauuucucucuccuuccuccuccu

SEQ ID NO: 385789 - RNA, 64 nt, Human
ucuuccaccuuucuguucaaggcuguuugucuacccagaggaaggaggcacugcugaauggcua

SEQ ID NO: 385790 - RNA, 64 nt, Human
caguucuggguuaucuccucucauacaucaagccccagaggaggcggcaagaggaacagccaca

SEQ ID NO: 385791 - RNA, 64 nt, Human
ggaauagaaaguaaauuggaaugugguucuaguuccagaggaagacacagcuuaguagcuuaag

SEQ ID NO: 385792 - RNA, 64 nt, Human
aauuuccuggcaagaggaagacucaagacuuccuccagaggaauuugucuucucugccuucacu

SEQ ID NO: 385793 - RNA, 64 nt, Human
acagcgaugcgggcagcuggggggcugagagcacccagaggaccgaggacaggggccggacauu

SEQ ID NO: 385794 - RNA, 64 nt, Human
agcauaaaagcaacguggguggucuccucaguccccagaggaaggaagcacugcagagauuaag

SEQ ID NO: 385795 - RNA, 64 nt, Human
cagguacagcagcugaggcugcccugaggaaucaaggggccauuaccaaggggcaggaaaagga

SEQ ID NO: 385796 - RNA, 64 nt, Human
ccucccucagcucacuccgagccuggagaacugcaggggccaagguggaggcaggcuuaaguuc

SEQ ID NO: 385797 - RNA, 64 nt, Human
caguagggggaggcgccacccauggcugcaguggaggggccagggcugagccggcggguccucc

SEQ ID NO: 385798 - RNA, 64 nt, Human
aacaauuagaagaucugacugauguuaagaguggccagaggaaagugagaggcguccauuucca

SEQ ID NO: 385799 - RNA, 64 nt, Human
gaguggccacagaaaauucuucuccacuuucuagccagaggagagaggacccccugaauuucuc

SEQ ID NO: 385800 - RNA, 64 nt, Human
aagcaggggaauuucccaguguccuaguuuuccaccagaggaauauguguaaguagcaaaguau

SEQ ID NO: 385801 - RNA, 64 nt, Human
ccagacccucuccaguguacuuccccagauaggaccagaggaugucuaguucuaggcugagcug

SEQ ID NO: 385802 - RNA, 50 nt, Human
ugagccagagccugcacugaccagaggagguaggggggaagccauggcuu

SEQ ID NO: 385803 - RNA, 50 nt, Human
aggggaaaggagcagugugaccagaggauugcuucaucugauacguaggc

SEQ ID NO: 385804 - RNA, 64 nt, Human
ccuuauacagagaucuagaaucucuuuauguucuccagaggaagguggaagaaaccaugggcag

SEQ ID NO: 385805 - RNA, 64 nt, Human
ggacauagcccugugauacugcaucucacuggggccagaggaagggagggaggguggggggguc

SEQ ID NO: 385806 - RNA, 64 nt, Human
caugcccuuccugcauccuucccccaaccacccaccagaggaguucugguccccaaaccaaaga

SEQ ID NO: 385807 - RNA, 64 nt, Human
cuuuuaaagcugcaggcagcaccacuugagauuuccagaggacccagaccuucguucauucuaa

SEQ ID NO: 385808 - RNA, 64 nt, Human
ugacaaacuggccaccguccgaauaacagacagcccagaggagauagugcagaaauuccgcaag

SEQ ID NO: 385809 - RNA, 64 nt, Human
uccuuuccaguucauaaacaacaggcacccacaaccagaggaaucuauaguuuaagcuccagac

SEQ ID NO: 385810 - RNA, 64 nt, Human
aggcagcaggacugaucaagugacuacugguuagccagaggagcucagcugaagcccuggaaac

SEQ ID NO: 385811 - RNA, 64 nt, Human
ccggcccuacugagggcccccaggucuggagaucccagaggaaggggcgccucacacccucuuc

SEQ ID NO: 385812 - RNA, 64 nt, Human
uuaguuuuuggagucaaguguuaaagguuucuggccagaggaauuggggucuugccaucccugc

SEQ ID NO: 385813 - RNA, 64 nt, Human
agaaacggcucuuccugccuggaugcaggagggcaggggccaccacagauuaaagcuguuacug

SEQ ID NO: 385814 - RNA, 64 nt, Human
cgugcggcugcuggcuucuguagaggcugcccagaggggccagguggcacaaauaagagagggg

SEQ ID NO: 385815 - RNA, 64 nt, Human
gaggccccaaggcagagucggcugggcguggaccaggggccauggacacgugaugugcugcucu

SEQ ID NO: 385816 - RNA, 64 nt, Human
ucucuggacaggaauuaacaaacgcuggagcagcccagaggaaauucgugugaaagaggaggga

SEQ ID NO: 385817 - RNA, 64 nt, Human
agauaaaagaaagacaucccaggagaaggacaaaccagaggagugaaccaacaaagaguaccua

SEQ ID NO: 385818 - RNA, 64 nt, Human
gaaauccauuuggcuucuucauagaaguggcuucccagaggaagaggccucucagaaaccaugu

SEQ ID NO: 385819 - RNA, 64 nt, Human
auuuuuaaguauuuucuuaauuugaauaauaaaaccagaggaaaugcauacagggcaugagcaa

SEQ ID NO: 385820 - RNA, 64 nt, Human
gcugaccaagacaccugaggacacaucuuggcacccagaggagcagcagcaacaggcuggaggg

SEQ ID NO: 385821 - RNA, 64 nt, Human
ccugucaccccagucaccuaagcaaucacugggcccagaggagaggagacagacacacacuggc

SEQ ID NO: 385822 - RNA, 64 nt, Human
acuaaggaugucaguguacgagacggugcgaagcccagaggaggcggcuugggauccucugggc

SEQ ID NO: 385823 - RNA, 64 nt, Human
ccgcagggagccaggcuggggccaugggcugcugccagaggaccguggauaccucaguguccac

SEQ ID NO: 385824 - RNA, 64 nt, Human
gccagcuuggcuguguucucugaucuaggccuucccagaggaggcgagcagaagcugugccacu

SEQ ID NO: 385825 - RNA, 64 nt, Human
caacuuugaauccuugucagccuggagaccagcaccagaggaaucuacaaggcaaacucccaua

SEQ ID NO: 385826 - RNA, 64 nt, Human
uggugcuauugugcaguaacuaauaguacucuuaccagaggagaaauuauauuaacgacccugc

SEQ ID NO: 385827 - RNA, 64 nt, Human
uguccauuccccaaauuaaccucuccgcccaggcccagaggaggggcugccugggcuagagcag

SEQ ID NO: 385828 - RNA, 64 nt, Human
guaaucuccacugcuuggaugucugcccucuaccccagaggaauuuacagaaacuugcccugug

SEQ ID NO: 385829 - RNA, 64 nt, Human
guagcugaggguccuuucugugcccuuaaaccgcccagaggagcccuauuccacucugguuuua

SEQ ID NO: 385830 - RNA, 64 nt, Human
gaagccaaauggcugcacuggccgauucuggucuccagaggaccuugguguuugcucucccuug

SEQ ID NO: 385831 - RNA, 64 nt, Human
accccuuuuggccagggccaggggggcaccagcaaggggccacccuuucccuuuucaauaaaua

SEQ ID NO: 385832 - RNA, 64 nt, Human
uaugcuguguugugggcuuugguucggcuuuaucaggggccaggcauauggguucuagaguacc

SEQ ID NO: 385833 - RNA, 64 nt, Human
accgauggccugaaccccauggguagagucacuuaggggccacuuccuaaguugcuguccagcc

SEQ ID NO: 385834 - RNA, 64 nt, Human
acaagugaugagaaggauucuuuuucgaauauaaccagaggaaaaaaggauggagaaauaucua

SEQ ID NO: 385835 - RNA, 64 nt, Human
acagaagacugacaagagucuuuuuauuugggagccagaggagggaaguguuacuugugcuaua

SEQ ID NO: 385836 - RNA, 64 nt, Human
caaucucaauugcuuuguaagugaaaaacaugacccagaggacagcacagacuauggccauggc

SEQ ID NO: 385837 - RNA, 53 nt, Human
uugaguauauugaugauuaagggccagaggaucucacuugcuuaucugaagaa

SEQ ID NO: 385838 - RNA, 64 nt, Human
gaagcccucagugagcugccacugagucgggagcccagaggaacggcgugaagccacuggaccc

SEQ ID NO: 385839 - RNA, 64 nt, Human
gcaggcagugucuggccauuauugcguucuacagccagaggauagaauucuauacccccaaccc

SEQ ID NO: 385840 - RNA, 64 nt, Human
uggcugaggcgccacccuucuucaggcccaggcuccagaggaagacuccugaaacccuccccag

SEQ ID NO: 385841 - RNA, 64 nt, Human
uccuguucuuaaacacaagugguuuuuccuaauuccagaggaacuggacgucaccaaacaaggu

SEQ ID NO: 385842 - RNA, 64 nt, Human
aaaaauaggucacggucuagaucacauucucgauccagaggaaggcgauacucucgcucacgca

SEQ ID NO: 385843 - RNA, 55 nt, Human
ccuuccugccaguggucugaagagcccagaggaggaguuuggccagguggacugu

SEQ ID NO: 385844 - RNA, 64 nt, Human
cuucacccagcacccaugccccacucugcugaggccagaggaagggaggccugaggggcagauu

SEQ ID NO: 385845 - RNA, 64 nt, Human
accagucuuagcccuaguaguuuuuuagguuggaccagaggaagcagguuaaaugagaccuguc

SEQ ID NO: 385846 - RNA, 64 nt, Human
aaaaaaaaaaaaaaaaaaaauuucauuuuugaguccagaggacccuccuauuacucuugauuuc

SEQ ID NO: 385847 - RNA, 64 nt, Human
aggugugcuguccccuguagccucgugagucagcccagaggaggguacaugcgacuguggccug

SEQ ID NO: 385848 - RNA, 64 nt, Human
agugauacuuuggaaagaugcaugccaguggaugccagaggaccaggcuaaugacuugugugug

SEQ ID NO: 385849 - RNA, 64 nt, Human
cccccucagcacacacacaguccccaggcggccuaggggccaaggcuggggcggcuuugguccc

SEQ ID NO: 385850 - RNA, 64 nt, Human
ucccgguccagcucagggaugcuccugccagcacaggggccagggacuccuggagcaggcacau

SEQ ID NO: 385851 - RNA, 64 nt, Human
cugccucccaucacugccugcuggcugcucucccaggggccagguggagagcagugccccccga

SEQ ID NO: 385852 - RNA, 64 nt, Human
gagaagauucccgagaguaaaucaucuuuccaauccagaggaacaagcaugucucucugccaag

SEQ ID NO: 385853 - RNA, 64 nt, Human
uaugaaaaccacuucccacagccagugggaacugccagaggaagaucuggcgucacauggcucc

SEQ ID NO: 385854 - RNA, 64 nt, Human
ucuccccugcccugguuacagacagcuucgagaaccagaggagaagagcauagggucauggagc

SEQ ID NO: 385855 - RNA, 64 nt, Human
ucccaugagguggggagaggcaacagggcagcccccagaggaguguccuggccgcuguccuccc

SEQ ID NO: 385856 - RNA, 64 nt, Human
ggccacgaaggucaggcucuuuauauuaaguuccccagaggaagaguaaguugagaagguauca

SEQ ID NO: 385857 - RNA, 64 nt, Human
cuggaaaagagaggcuuuucuucaucgagagcuaccagaggagauauuaucuguccucugugug

SEQ ID NO: 385858 - RNA, 64 nt, Human
uuguaaguuugccuaggcuguugguguacagagaccagaggagagagacacacuaggacuaaca

SEQ ID NO: 385859 - RNA, 64 nt, Human
ugugguccgagauccuguacuaaggagggucuggccagaggaacagaccagcuuuugcacaaug

SEQ ID NO: 385860 - RNA, 64 nt, Human
ggcuggggacagaguccagcucccuuggaucagcccagaggauucaggauaggacaaaggcccu

SEQ ID NO: 385861 - RNA, 64 nt, Human
gugccucccauuuccuuccccuuucucugucaucccagaggaacauaggcaucaugugucugga

SEQ ID NO: 385862 - RNA, 64 nt, Human
caugaagcaaagagcugagugaguccucugcucuccagaggaccaagaaauaccugugugacac

SEQ ID NO: 385863 - RNA, 64 nt, Human
agccuucuccucacugcccuuuaggcucccagggccagaggagccagggacuauuuucugcacc

SEQ ID NO: 385864 - RNA, 64 nt, Human
aggaauguaucauuuugucaucaauggcagcauuccagaggaucaugaagacugggcuuccaau

SEQ ID NO: 385865 - RNA, 64 nt, Human
auuugaguuggaugauuguuuuugcucaaggcaaccagaggaaacuugcauacagagacagaua

SEQ ID NO: 385866 - RNA, 64 nt, Human
cccuucucacugagacagcaacauuuaaaccaaaccagaggaaguauuuguggaacucacugcc

SEQ ID NO: 385867 - RNA, 64 nt, Human
cugaggguggccaggaucuggagcugcaucucuaaggggccaggcuuuggggaccauugccaaa

SEQ ID NO: 385868 - RNA, 64 nt, Human
cuacuaugaugacuucagaagauacaauggucccaggggccaaguagaaagcauuuuuaaagau

SEQ ID NO: 385869 - RNA, 64 nt, Human
cucugagcagggcccaaggcagccaggggccuggaggggccagaggaggguggggucagggccg

SEQ ID NO: 385870 - RNA, 64 nt, Human
uggccuagaaaugagagaagagagagguauuuacccagaggauuuuccuaugguuggggaugca

SEQ ID NO: 385871 - RNA, 64 nt, Human
agauaauccuauugaagagauuucgguucuaagcccagaggaucuugaagcgaucaagaaucca

SEQ ID NO: 385872 - RNA, 64 nt, Human
gaggagcuaagcaggcccggcaguuggaggaaggccagaggaacagcuuugugcuccggcuuuc

SEQ ID NO: 385873 - RNA, 64 nt, Human
gaaucccacggaccucucgcgugucaacagacgaccagaggagugcuggagcuccagcagcccc

SEQ ID NO: 385874 - RNA, 64 nt, Human
aguggcuuucaacuagaggcaguaaccugucauuccagaggaugcugagaaauguguaggggca

SEQ ID NO: 385875 - RNA, 64 nt, Human
gucauauugucaguccuacaaaaauaaaaggcuuccagaggagaguggccugggucccagggcu

SEQ ID NO: 385876 - RNA, 64 nt, Human
ccgccaucagcccaacgggaagcaaccucccaacccagaggaggcagaauaagaaaacaaucac

SEQ ID NO: 385877 - RNA, 64 nt, Human
guggguucugccgaacccuccucucacaggaaguccagaggaagggggaguaucugugggcaac

SEQ ID NO: 385878 - RNA, 64 nt, Human
agagugagcuuggccaagccagcugcaaaccuggccagaggaguucuauugcaucucucaccug

SEQ ID NO: 385879 - RNA, 64 nt, Human
aauggcguguacugcaagaccucuugaacacuuuccagaggauaggauauuuaagucaugcccu

SEQ ID NO: 385880 - RNA, 64 nt, Human
uggggugcucaggcugggaggguagaaugccauuccagaggacaagccacaaaaaugccuuaau

SEQ ID NO: 385881 - RNA, 64 nt, Human
ugcucuuuucuccucacuguauccagguucccucccagaggagccaccaguucucauggguggc

SEQ ID NO: 385882 - RNA, 64 nt, Human
caggaucaagacaacccguuggagccccuguguuccagaggaccugaugccaagggguaauggg

SEQ ID NO: 385883 - RNA, 64 nt, Human
gauuucuuauugaggccaagagauguuuccugucccagaggaaccauuaggagucgcuuuuagg

SEQ ID NO: 385884 - RNA, 64 nt, Human
uuggccccccuagcuuccagcaguccacuaucugccagaggagcaagggugccuuagaccgaag

SEQ ID NO: 385885 - RNA, 64 nt, Human
aggaggauaugugggugggugggagggcuggggcaggggccagauagaaauuauugguuuuguu

SEQ ID NO: 385886 - RNA, 64 nt, Human
uuuccaacaagagcugucacaguggcagcaaagcaggggccacccgucuccacaguccuucaga

SEQ ID NO: 385887 - RNA, 64 nt, Human
auuugggcuuccggggccccugagaccaaagaagaggggccaaguacccugggaaaucagcuga

SEQ ID NO: 385888 - RNA, 64 nt, Human
ggucugugggcucuaggcagcccggcagcagcccccagaggaacugcucccaccucuccuucuc

SEQ ID NO: 385889 - RNA, 64 nt, Human
gagcgucacaaauaucccccauccugggcuuuucccagaggagaugggggcuucugaagaugga

SEQ ID NO: 385890 - RNA, 64 nt, Human
cccacucugucccucaggggucuggaauaacaauccagaggacgacuucaggaugcccaauggc

SEQ ID NO: 385891 - RNA, 64 nt, Human
gguuggguucuagggcugaaccaggcgccaggcuccagaggacgaagggacucuguugccccac

SEQ ID NO: 385892 - RNA, 64 nt, Human
gccaggucccuggaccagccuccuguuugcaggcccagaggagccaagucauuaaaauggaagu

SEQ ID NO: 385893 - RNA, 64 nt, Human
ggagauaaccaccuuugcgauaaugagagacagaccagaggacugcuacucuuuuuauaggagc

SEQ ID NO: 385894 - RNA, 64 nt, Human
gaauguuucaggaaacaaauaggauaagacaaugccagaggaaggauagaaacaugggaaguuu

SEQ ID NO: 385895 - RNA, 64 nt, Human
uaucauuacaaugaaaggaauucacaaacuacugccagaggaaguuuguuuuuuaauuuaagag

SEQ ID NO: 385896 - RNA, 64 nt, Human
uuuaggauaccuuuacuuuaaggaccacacagucccagaggacacaucccucgggaacucugcc

SEQ ID NO: 385897 - RNA, 64 nt, Human
aaaauaucugcugcauaaaaaacuaagacaaagaccagaggaaauaucuucccuuucuuauguu

SEQ ID NO: 385898 - RNA, 64 nt, Human
gaaagaugagaaagugaaccaaaaaggcuagaaaccagaggaaaaccuggacaaccucucucuu

SEQ ID NO: 385899 - RNA, 64 nt, Human
gcuguuucaugggccccuucaaaccucauagcaaccagaggaagaaaaugagccauuuuuugag

SEQ ID NO: 385900 - RNA, 64 nt, Human
gcaaaaaguauuuguuacauaaucaaaaggugaaccagaggaaauauugaacaagguuuuagau

SEQ ID NO: 385901 - RNA, 64 nt, Human
gcuugguaaauuuuucuaaacacaauuguuauagccagaggaacaaagaugauauaaaauauug

SEQ ID NO: 385902 - RNA, 64 nt, Human
ucucuaauuaugcaauuagccucauaguuauuauccagaggacccaacugaacugaacuaaucc

SEQ ID NO: 385903 - RNA, 64 nt, Human
cuagccuucauauaugccuuauacuuggagucacaggggccaaaggccugagaccccacccugc

SEQ ID NO: 385904 - RNA, 64 nt, Human
uugccccauuggccugggccaguucuccacuccuaggggccaagccaccccuagccuugguggg

SEQ ID NO: 385905 - RNA, 64 nt, Human
cucuccuccaucacacucucccggcuugcgcaggaggggccagcagccccaggagucccagacc

SEQ ID NO: 385906 - RNA, 64 nt, Human
auuggccauaauuaugaauaggaauauuaaugaaccagaggacauacuagucacauguuauuau

SEQ ID NO: 385907 - RNA, 64 nt, Human
uguaaaaucccaucugcuagaagcccauccugugccagaggaaggaaaaggaggaaauuuccuu

SEQ ID NO: 385908 - RNA, 64 nt, Human
uucuccuccauacauccccaucccucuacuuuccccagaggaccacaccuuccucccuggaguu

SEQ ID NO: 385909 - RNA, 64 nt, Human
caaaaacaaaaccagcugcuacucauaaguuggaccagaggaagccccuuacuaugaucucagg

SEQ ID NO: 385910 - RNA, 64 nt, Human
cccgccaggcugcccaucagggcccagggagcccccagaggacuuuauucggaccaagcagagc

SEQ ID NO: 385911 - RNA, 64 nt, Human
ggaagaagagggcaggguggggaggagcucugggccagaggaugcugagcugccugggcagaga

SEQ ID NO: 385912 - RNA, 64 nt, Human
gcucuuucagaagacccaggaagggcagcuccagccagaggaccuuccuggcuaugcaggugca

SEQ ID NO: 385913 - RNA, 64 nt, Human
ucucuuuccuuugugccacugagucguucccuggccagaggacauaaauggugcugguaggagg

SEQ ID NO: 385914 - RNA, 64 nt, Human
cucucucuaggaacagacaacucuaaacucguccccagaggaggacuugaaugaggaaaccaac

SEQ ID NO: 385915 - RNA, 64 nt, Human
cuugccuccaccaugauauuugaauaagagauggccagaggauaacacuugucucuuaaaaacu

SEQ ID NO: 385916 - RNA, 64 nt, Human
ucuaccagaggcucagaauacgcugagccugugaccagaggaugauggauggucgggauugagg

SEQ ID NO: 385917 - RNA, 64 nt, Human
agucacggccaagccacgcagaacgaacaugacuccagaggaccucgcccuggagcugagccug

SEQ ID NO: 385918 - RNA, 64 nt, Human
caggcggacggcgccgacucuuuucacugaguuuccagaggaagacuagcgcggccaccgcgaa

SEQ ID NO: 385919 - RNA, 64 nt, Human
ugcauguaaauugguagcaaguaaugauuacaacccagaggauuaagaauuuuguaacagaaag

SEQ ID NO: 385920 - RNA, 64 nt, Human
ugguaucuuuccuggccaugacagugugauucccccagaggaagcagaaggaaguuaaagguug

SEQ ID NO: 385921 - RNA, 64 nt, Human
ugacaauggggaggacaguucuuuuggagguuggaggggccaagccaaggacaggagcaagugu

SEQ ID NO: 385922 - RNA, 64 nt, Human
uccuacacauugccaagauuucacacaugugaccaggggccaccaaagucccugugaccuuugu

SEQ ID NO: 385923 - RNA, 64 nt, Human
ccaucacaaagcaguggggcaugagcuguguuucaggggccacuaaauaacagcugguacugac

SEQ ID NO: 385924 - RNA, 64 nt, Human
ccauaccucucuaggaacuuggucugcagaccauccagaggaauaaaaagguuggccuuaguag

SEQ ID NO: 385925 - RNA, 64 nt, Human
gauucuuaaauucucucuguugagagcauuucagccagaggacuuuggaacugugaauauacuu

SEQ ID NO: 385926 - RNA, 64 nt, Human
ucaucauggaaaugcauccaucaaagagagccacccagaggaagaggauugauguccuugcaaa

SEQ ID NO: 385927 - RNA, 64 nt, Human
cccgaccuaagguuuggaagacaacugcuuguucccagaggauucugauuuugcauauguuugu

SEQ ID NO: 385928 - RNA, 64 nt, Human
ggcugaacuggggagccccuuucccugggagcucccagaggaaacucuugaccaccaguggcuc

SEQ ID NO: 385929 - RNA, 64 nt, Human
cacuggggaugccgaggcaaugcuguacuugaagccagaggacccaaauugccgcccuggcugu

SEQ ID NO: 385930 - RNA, 64 nt, Human
aguuccuuucccucuuuggagcuugguuucccugccagaggaaacugagcuggaggagccugag

SEQ ID NO: 385931 - RNA, 64 nt, Human
ucaaucaucaagucccucacagccauuucuguucccagaggagccaggccugcagcuggcugcu

SEQ ID NO: 385932 - RNA, 64 nt, Human
auggacuccugcccacuugggggaaaccuuauacccagaggaaaauacacaccuggggaguaca

SEQ ID NO: 385933 - RNA, 64 nt, Human
acagcagauacuguuucucuguguccugaagucgccagaggagaagggaaucauuguuuacaca

SEQ ID NO: 385934 - RNA, 64 nt, Human
acgcgggcccgcgcgcggacuuugcacuuugaauccagaggaagaugaauuuuuaaaaucucca

SEQ ID NO: 385935 - RNA, 64 nt, Human
cuggaagaaaaugaugugaauuucauguaaaugaccagaggaaagauggauaagaugauaauuu

SEQ ID NO: 385936 - RNA, 64 nt, Human
ccuucucuuucuccuucacugccucaaguuacagccagaggaaaggaggaacuaaaacuuagca

SEQ ID NO: 385937 - RNA, 64 nt, Human
cuuccuccuaacugucaggguggggagcugguucccagaggauugucuacccugaaguccauca

SEQ ID NO: 385938 - RNA, 64 nt, Human
aacaaaaaaucugugagggucugacuugcucaaaccagaggaggaaacagaaaccccugcacau

SEQ ID NO: 385939 - RNA, 64 nt, Human
gaauggccucagcucuuguuuugcugcugguuuuaggggccaaaguaaauggguggauucugga

SEQ ID NO: 385940 - RNA, 64 nt, Human
gaugaaucaaaugacugccggcugggcugguagcaggggccaguccuccccucuugauugcugg

SEQ ID NO: 385941 - RNA, 64 nt, Human
gguagcccggguuuggacucuuccuccuggcaucaggggccaugaagcccccuggagagagaug

SEQ ID NO: 385942 - RNA, 64 nt, Human
guguauacugccacaucaguguuugagucaguccccagaggagaggggaacccuccuccaucuu

SEQ ID NO: 385943 - RNA, 64 nt, Human
accaaggauccaaagugaccccaccaggggacagccagaggaaggggaccaugggguaucccug

SEQ ID NO: 385944 - RNA, 64 nt, Human
caggcgcagccaucgggaaggucauucagccaacccagaggauguagacccuguccucaagaag

SEQ ID NO: 385945 - RNA, 64 nt, Human
ccagccuuccugcugccaccaucucugcuucuccccagaggaacuuagggauuucaccccuggc

SEQ ID NO: 385946 - RNA, 64 nt, Human
ugcagagagccuuuggaagaggucuucggagaugccagaggagcccucuagggguccgaugccu

SEQ ID NO: 385947 - RNA, 64 nt, Human
cucucacaaggcgacuugaagaggacgcaggcuuccagaggacaaaccccaauacaggagaagc

SEQ ID NO: 385948 - RNA, 64 nt, Human
agccugagccaaagagagaguacgggcucagcagccagaggaggccggugaagugcaucuucug

SEQ ID NO: 385949 - RNA, 64 nt, Human
caguuuugaaagaggugcauaauaaaacuacuaaccagaggagucuaugccauuuuaagaaaaa

SEQ ID NO: 385950 - RNA, 64 nt, Human
guuggccccagccacguuuacaggaaggugugccccagaggaggaggaaucagcucccucgcuc

SEQ ID NO: 385951 - RNA, 64 nt, Human
agugccacacuccuucaauaaacguggcugcuggccagaggacgugagcgugugacgggcgccu

SEQ ID NO: 385952 - RNA, 64 nt, Human
ccugcugcugcccauuuucucuggguacugcuggccagaggacuuuagccuaccccugaagagc

SEQ ID NO: 385953 - RNA, 64 nt, Human
caacugugagcaaggagcacaagccacaagucuuccagaggaugcuugauuccagugguucugc

SEQ ID NO: 385954 - RNA, 64 nt, Human
guuuuaugauagaucuuauuguacacauuuuguaccagaggaaaacccuaaagcauuaguugcu

SEQ ID NO: 385955 - RNA, 64 nt, Human
ugaugaaggagcugauccgguucgacgaggagacccagaggacguuccucaaggaggucaguga

SEQ ID NO: 385956 - RNA, 64 nt, Human
ggacacuccagugccagcaaugacaucucaggggccagaggaacuguccagagagcaacucuga

SEQ ID NO: 385957 - RNA, 64 nt, Human
caggaauggagaagcugacccugcuggccaggcaaggggccagaccccccccaacccccagcug

SEQ ID NO: 385958 - RNA, 64 nt, Human
cagaucaauucaaagcuaaauacuucuuucagaaaggggccacuguggaaagugcugguggggu

SEQ ID NO: 385959 - RNA, 64 nt, Human
uuggggauucaguaguccagaucucuggagcugaaggggccagagagugggcagagugcaucuc

SEQ ID NO: 385960 - RNA, 64 nt, Human
uauggaaggggcuuccuggccaaggcccccucuuccagaggaggagcagggaucuggguuuccu

SEQ ID NO: 385961 - RNA, 64 nt, Human
ucagguucaucacaaaccugguaccuguugcuucccagaggauggagaaguguaguuaaucaca

SEQ ID NO: 385962 - RNA, 64 nt, Human
gaagcccugucaccccaccccaggccacccucucccagaggacgccaucucccuuacuguugcu

SEQ ID NO: 385963 - RNA, 64 nt, Human
cgcugugucuccuguguguguuagaauccagagcccagaggaagugcaagcggguccuccgcca

SEQ ID NO: 385964 - RNA, 64 nt, Human
uauguguaacuggcucugagucucugcuugaggaccagaggaaaaugguuguuggaccugacuu

SEQ ID NO: 385965 - RNA, 64 nt, Human
gcgggaggaugggggcuacaccuucacagccaccccagaggacuucccuaaaaagcacaaggcg

SEQ ID NO: 385966 - RNA, 64 nt, Human
uauaagugguuuagugcucaguuggcucuaguaaccagaggacacagaaaguaucuuuuggaaa

SEQ ID NO: 385967 - RNA, 64 nt, Human
ggugagggcgccuuucccucaggacugggugugaccagaggaaaaggaagugcccaacaucucc

SEQ ID NO: 385968 - RNA, 64 nt, Human
uucugacuucacugaaauuauggaagaaagacacccagaggaggccucuuugguugguucuuuu

SEQ ID NO: 385969 - RNA, 64 nt, Human
uuaggcagaguagacacaauuaaagguacaaagcccagaggaagugguagagcagcaccgugcc

SEQ ID NO: 385970 - RNA, 64 nt, Human
aaaaaaauugguguucaugacucuguggucggugccagaggaaaauaggaacgacucuaauuaa

SEQ ID NO: 385971 - RNA, 64 nt, Human
aaaccaaacauucaacacaaaauaaacuagaaggccagaggauaauggaauaaaagaucauugc

SEQ ID NO: 385972 - RNA, 64 nt, Human
gggcgucauucacccacuaccccuagugcuagucccagaggaugcugcggagggggcagccuca

SEQ ID NO: 385973 - RNA, 64 nt, Human
acugucuaggaggacugggcagggugggggcaacccagaggacccauggcuagcagggaagggc

SEQ ID NO: 385974 - RNA, 64 nt, Human
cacuguggcagccuccucccuggauccuuagaucccagaggagggaagaaaauuugcagugacu

SEQ ID NO: 385975 - RNA, 64 nt, Human
cagcagcagaggcuggaagagaagcucugucuucaggggccagcugggaaaugcuaaggagcug

SEQ ID NO: 385976 - RNA, 64 nt, Human
ccccucagguggcacaucuggagggcagggguugaggggccaccaccacacaugccuuucuggg

SEQ ID NO: 385977 - RNA, 64 nt, Human
caacacaaacuguaugaagccaugaaggaaacagaggggccaaagggugggacagaaaagacau

SEQ ID NO: 385978 - RNA, 64 nt, Human
gacuaaggaagagcacuuccuugccuccguaaggccagaggaagaaccaucccaaucauuugau

SEQ ID NO: 385979 - RNA, 64 nt, Human
agacuguuuauuaccagauucacuucugaauuggccagaggaaaucugaauguauuauccugug

SEQ ID NO: 385980 - RNA, 64 nt, Human
gugcgggaaguccagcgacucucagacgcaccucccagaggaccggugggaauuguucauagug

SEQ ID NO: 385981 - RNA, 64 nt, Human
accacauuaaagucaaggaaauaaaauaauuugaccagaggauaaaggacaugagagaguauuu

SEQ ID NO: 385982 - RNA, 64 nt, Human
agcaggagccccucuggugcuccuagaggguggcccagaggagcugugccagggcguggagagg

SEQ ID NO: 385983 - RNA, 64 nt, Human
cgacuggagggucuugcuuuuucaaacucagagcccagaggaaaugcaaggguggauaaacaaa

SEQ ID NO: 385984 - RNA, 64 nt, Human
caggcagcccagcaguguggagacccugccacagccagaggagggcagagggagaauccaaggg

SEQ ID NO: 385985 - RNA, 64 nt, Human
aaauagcugaaaacuaauguacuguacauaaauuccagaggacucugcuuaaacaaagcaguau

SEQ ID NO: 385986 - RNA, 64 nt, Human
uucaucauggaaagccacaagccucagaaggcagccagaggacaggaagagucugugaugcuca

SEQ ID NO: 385987 - RNA, 64 nt, Human
auacuaguuugcuuugcugaccaaaugccugguaccagaggauggugaggcgaaggccagguug

SEQ ID NO: 385988 - RNA, 64 nt, Human
gaacaaggucuccugauccguccgaggcugcuucccagaggagcagcucuccccaggcauuugc

SEQ ID NO: 385989 - RNA, 64 nt, Human
ggacauguggauauccagccagaaugcccucucuccagaggacacacagcucuggauuucuacc

SEQ ID NO: 385990 - RNA, 64 nt, Human
ggaucgcgagagagaugaaacuuggaaaauucagccagaggaccuguucgguuccccugggagu

SEQ ID NO: 385991 - RNA, 64 nt, Human
ugaucaggguagcaaacucaaaugcugacaggggccagaggagauauggggaaggagcaucaga

SEQ ID NO: 385992 - RNA, 64 nt, Human
aguacggaugggaaacuauugugcacaagucuuuccagaggaguuucuuaaugagauauuugua

SEQ ID NO: 385993 - RNA, 61 nt, Human
gccagcugugcccccugugauucaggggggcaggggccagucuugugcuccuggacaugcg

SEQ ID NO: 385994 - RNA, 64 nt, Human
uacuguuaagugugugggaggcagagagaggagcaggggccaugggcuucacagcauggcacac

SEQ ID NO: 385995 - RNA, 64 nt, Human
uucucuccuuggagugccccaauuuuauauucucaggggccaaggcuaggucugcaacccucug

SEQ ID NO: 385996 - RNA, 64 nt, Human
agagguggggugagggugagcuuacucagggcccccagaggaagcccucagccucugcccuccc

SEQ ID NO: 385997 - RNA, 64 nt, Human
cuuugaucacaggagcaaucacaggaaaauguauccagaggaauugauugucagccaccucccu

SEQ ID NO: 385998 - RNA, 64 nt, Human
cugccuucuuguuucaacuguuacacagagaugaccagaggauggggccacugcagugcaguuc

SEQ ID NO: 385999 - RNA, 64 nt, Human
agcacacaagagcaaccugaaaggcugcuccuggccagaggacucugucccgggggaccguguc

SEQ ID NO: 386000 - RNA, 64 nt, Human
cugguggcuccccagagccucagacccacacagcccagaggacgaggccuucaagccugccccu

SEQ ID NO: 386001 - RNA, 64 nt, Human
guccugggcagcccacaguagugcuagcugaggcccagaggaacgggaggaaagggaggcagcg

SEQ ID NO: 386002 - RNA, 64 nt, Human
ggacaagccggacaaaugagcgacuucugugcuuccagaggaagacgagggagcaggagcuugg

SEQ ID NO: 386003 - RNA, 64 nt, Human
auccgugcccggacccuugggaaugcccgcggcuccagaggaaaaagcccagggacggggccuc

SEQ ID NO: 386004 - RNA, 64 nt, Human
gccacccagggcaggggaucuucugccggcugccccagaggacaguggguggagugguaccuac

SEQ ID NO: 386005 - RNA, 64 nt, Human
ccgcugcuucauguucugcuuuaucccaucacgcccagaggaggugggugaguucuggcucaag

SEQ ID NO: 386006 - RNA, 64 nt, Human
auaauuuugugauuauaacaguaagccagguucaccagaggaaauguggaauaccuaaguauaa

SEQ ID NO: 386007 - RNA, 64 nt, Human
uuuuccucaccagucccaugcuggcugaagaggaccagaggagcagaccagcacuucaaccuag

SEQ ID NO: 386008 - RNA, 64 nt, Human
aucgaugauggcucaggcucagccugggcacgccccagaggagagagauggaguggggccucaa

SEQ ID NO: 386009 - RNA, 64 nt, Human
gaggacccucagugucauaucaggaagcccagugccagaggacagacagguucaaaacuggcuu

SEQ ID NO: 386010 - RNA, 64 nt, Human
cuccugagggagcuccaacucagaagggagcuagccagaggacugugaugcccugcccuuggca

SEQ ID NO: 386011 - RNA, 64 nt, Human
uuauugcuaagggaauaugagauuaacuuccuacaggggccaaaaccagagaaaggcuuccagc

SEQ ID NO: 386012 - RNA, 56 nt, Human
acaucuaccacccccaguagggcuccaggggccaucacugcccccgcccuguccca

SEQ ID NO: 386013 - RNA, 64 nt, Human
aaggauuuuguauauuuuucccccuggagugaguaggggccauuuuuggguguuuucuaccaca

SEQ ID NO: 386014 - RNA, 64 nt, Human
auccauuuaacugguguucuuaaaaucagagcguccagaggaaauucuuccuaaaacuaggauu

SEQ ID NO: 386015 - RNA, 64 nt, Human
cagcccugcauccuccgugcccuagaccugcuccccagaggaggggccuugacccacaggacgu

SEQ ID NO: 386016 - RNA, 64 nt, Human
gagccugccuccuccucccagccugccccgcugcccagaggaccccacgccucucagaggcaga

SEQ ID NO: 386017 - RNA, 64 nt, Human
acucgcugccuuaggugccuucugcucucuggaaccagaggacuagcugacuuuugccaaggag

SEQ ID NO: 386018 - RNA, 64 nt, Human
gcgucugugugcgcucuguggaugccagggccgaccagaggagccuuuuuaaaacacauguuuu

SEQ ID NO: 386019 - RNA, 64 nt, Human
ccucucaaccucaacccaccugcaugcaucucccccagaggaaacacugaggguaggggacagg

SEQ ID NO: 386020 - RNA, 64 nt, Human
cagcuuucccaaagcgauacacuugcuuuggucaccagaggaggacagagcuuagagcagcugu

SEQ ID NO: 386021 - RNA, 64 nt, Human
gcguggugaugugacaacuguuuccucccugaccccagaggaucuggcucuagguugggaucaa

SEQ ID NO: 386022 - RNA, 64 nt, Human
agaaugauuagguugccuuaccugcaugguuuccccagaggaugugugccccaagguggcugga

SEQ ID NO: 386023 - RNA, 64 nt, Human
agguuugguuuccuguguccaguagugggaucauccagaggagcuggaaccauggugggggcug

SEQ ID NO: 386024 - RNA, 64 nt, Human
ggcaaguaacugugcacccuccaacaucccaaccccagaggaaccagugggauugaaaaccagc

SEQ ID NO: 386025 - RNA, 64 nt, Human
uucuuccuuucagauuuuugacuuugaguugacuccagaggacaugaaagccauugauggccuc

SEQ ID NO: 386026 - RNA, 61 nt, Human
aagcaaaaggccuguucugaguggggagacgccagaggagccucacggucacguccaacaa

SEQ ID NO: 386027 - RNA, 64 nt, Human
ugaacagagccugaggcggaugcagcccgcgacgccagaggaagcacgugcacuaacuggguuu

SEQ ID NO: 386028 - RNA, 64 nt, Human
ucagaggcccucgcugccagcucuguaucaggacccagaggaaggggccagaggcucguugacu

SEQ ID NO: 386029 - RNA, 64 nt, Human
cagccauuggggcagggacccuccuacacuacagaggggccaggggaucccucucucccuagug

SEQ ID NO: 386030 - RNA, 64 nt, Human
uuuaggagaagccaggaauuucccaggacccugaaggggccaugauggcaacagaucuggaacc

SEQ ID NO: 386031 - RNA, 64 nt, Human
agcacaagucaccaacugcuucagggauaccuggaggggccagcaaguagaguguugguggccc

SEQ ID NO: 386032 - RNA, 64 nt, Human
gcccaagggaauucggugugcaccaggguugaccccagaggauugcugccccaucagugcuccc

SEQ ID NO: 386033 - RNA, 64 nt, Human
uaauccauagucagcagaaaacaacagcagugagccagaggagcacaggcgggcaggucacugc

SEQ ID NO: 386034 - RNA, 64 nt, Human
ggugucaugccagaaucuaccaggacugagggagccagaggaguccuauaggcaggcuacugug

SEQ ID NO: 386035 - RNA, 64 nt, Human
gccucaccaaggcccugacucagauggaggaagcccagaggaaacggacacaacuccgggaagc

SEQ ID NO: 386036 - RNA, 64 nt, Human
aaaugauuccucuauuugggagagaucuuccaauccagaggagccccucuuggacugccugggu

SEQ ID NO: 386037 - RNA, 64 nt, Human
aaagguuauauuuuuuacagaucagaauguggcaccagaggacugugucucauuaaagugauug

SEQ ID NO: 386038 - RNA, 64 nt, Human
cccugcgcucccagccccucgugggagaccugcgccagaggauggacaaguuugucaagaaucg

SEQ ID NO: 386039 - RNA, 64 nt, Human
ccuggaaagaagccccagcccccaggggaaaccuccagaggaacaaggucaaugcaucuuuccc

SEQ ID NO: 386040 - RNA, 64 nt, Human
guggcagccaccagguccacagaacuacugcagcccagaggacagcuuugaaguuugcgucuuu

SEQ ID NO: 386041 - RNA, 64 nt, Human
acauuacgucccuuuucuuuuuggggagggguagccagaggagugaguuuuucauuuagaucaa

SEQ ID NO: 386042 - RNA, 64 nt, Human
cagagcccuacgugaagguccagcucaugcugaaccagaggaaguggaagaagagaaagacagc

SEQ ID NO: 386043 - RNA, 64 nt, Human
aacacuaagccugaccucucccaaauugggaagaccagaggagaaagugcaaaacuguccccau

SEQ ID NO: 386044 - RNA, 64 nt, Human
auaaccauuuuaagaacagaugacucagaaaccuccagaggaaucuguuugcuuccugauuaga

SEQ ID NO: 386045 - RNA, 64 nt, Human
uguggcacugcuugaggaggggcaccugccaccgccagaggacaaggaagugggggccgcuggc

SEQ ID NO: 386046 - RNA, 64 nt, Human
agcagggcccaaggcagccaggggccuggaggggccagaggaggguggggucagggccgccccu

SEQ ID NO: 386047 - RNA, 64 nt, Human
gcauaaauccauccauccaaaggcagagaaccaaaggggccauggaagguucucugugcuccuc

SEQ ID NO: 386048 - RNA, 64 nt, Human
uuugugaaugugaagccccaggccgcagggggcaaggggccaggugccccccaccagcugagaa

SEQ ID NO: 386049 - RNA, 64 nt, Human
aauucuaauucgggacugggcaauugagcuguauaggggccaccuugcagggaggacagaaaac

SEQ ID NO: 386050 - RNA, 64 nt, Human
acaccguggggaaggggugcagguggggugauggccagaggaaugaugggcuuuuguucugagg

SEQ ID NO: 386051 - RNA, 64 nt, Human
caggcacugugugccuggcagcaggacuuccuacccagaggagguucgagcuaggaucccacug

SEQ ID NO: 386052 - RNA, 64 nt, Human
uaugcgauagggucucccuucccuccagcccaugccagaggagcuuguaacucuuuauccucau

SEQ ID NO: 386053 - RNA, 64 nt, Human
gacuguccuugggccuccucuggaagcagcacccccagaggacagggcuccuccugcuugccuc

SEQ ID NO: 386054 - RNA, 64 nt, Human
aguuccugcaccucagcagccagggaagcagggcccagaggagacccaucaacucaucugguuc

SEQ ID NO: 386055 - RNA, 64 nt, Human
ugcuuguguuugcugcuaauguccagcuacagacccagaggauaagccacugggcacugggcug

SEQ ID NO: 386056 - RNA, 64 nt, Human
auuccuauaagagacccucgcagcccagaggcgcccagaggaagucagcagcccuagcucggcc

SEQ ID NO: 386057 - RNA, 64 nt, Human
ggccucagacaggucccugaaggagucugaggcuccagaggaugucauaugggaguuuuagaga

SEQ ID NO: 386058 - RNA, 64 nt, Human
agggcaggagggagccccaaagcauaaccaguggccagaggagugggagggccugaggcaucac

SEQ ID NO: 386059 - RNA, 64 nt, Human
cagccagggucuucccugccugguguuuugggcuccagaggacuuaccuacaaaauacuccuuu

SEQ ID NO: 386060 - RNA, 64 nt, Human
agaagagaacauuuuguuuguggggcuaaugggcccagaggaggguaagacucugcugucuaag

SEQ ID NO: 386061 - RNA, 64 nt, Human
uggcaagguagggggcagauggggcauggagaacccagaggaucuaggcccuguuggggagggg

SEQ ID NO: 386062 - RNA, 64 nt, Human
uuucuggguuucugccacggccacagguucauauccagaggaauggcagaucugagacgaucca

SEQ ID NO: 386063 - RNA, 64 nt, Human
gcaggcccuuuugggcaaaggggcccauccuagaccagaggagcccaggcccuggcccugcugg

SEQ ID NO: 386064 - RNA, 64 nt, Human
cacuaaaucagagacaaaauauuucccauuugugccagaggaauccuggcagcccagagacuuu

SEQ ID NO: 386065 - RNA, 64 nt, Human
aguauugaucaggguagcaaacucaaaugcugacaggggccagaggagauauggggaaggagca

SEQ ID NO: 386066 - RNA, 64 nt, Human
uuugacuuccccuuuauuuauuuguugucuaauuaggggccaagucuguaaaguuuugucaaag

SEQ ID NO: 386067 - RNA, 64 nt, Human
ucuggacauccagaaaaccaaguguccggauggcaggggccagcggccaccaagcucaugggac

SEQ ID NO: 386068 - RNA, 64 nt, Human
cuccccgaccacugcccagcccucugcucccuccccagaggaggcgggagggugggcucuauau

SEQ ID NO: 386069 - RNA, 64 nt, Human
aggaggugcauggccugagcauuguuugucuggcccagaggagagagcuuggguucccauaguc

SEQ ID NO: 386070 - RNA, 54 nt, Human
acuuccuccccaggcugugacccuccagaggacccuugccucagccucgggaag

SEQ ID NO: 386071 - RNA, 64 nt, Human
uccaggacugggucugaccuggugggagcaccugccagaggaugcucuuucccaggacggaugg

SEQ ID NO: 386072 - RNA, 64 nt, Human
gcagaaagcucuagcaacaugaucuuaauuguauccagaggauuugccaauguauguucagucu

SEQ ID NO: 386073 - RNA, 64 nt, Human
cuccaccccauuuuacagaggagaacaccaaggcccagaggaaguuaagggagagucaaugggc

SEQ ID NO: 386074 - RNA, 64 nt, Human
aaacaaacaaacacguuuguagguucuuacuggaccagaggagucaagaaaccaagaugguuug

SEQ ID NO: 386075 - RNA, 64 nt, Human
augcauuuucuucuggagccucuuagaaucuccuccagaggacucauagagcugccucccccag

SEQ ID NO: 386076 - RNA, 64 nt, Human
aaggauucucacucguauuucccaccccuaguggccagaggagggaggggcacagugaagaagg

SEQ ID NO: 386077 - RNA, 64 nt, Human
cagcauggggcaguggcuggauuucugcccaagaccagaggagugugcugugcuggcaagugua

SEQ ID NO: 386078 - RNA, 64 nt, Human
ccaucucccauucacauggcccaccuccugcuucccagaggacuggcccuacgugcucucucuc

SEQ ID NO: 386079 - RNA, 64 nt, Human
uugcgggccucccugcuggcuacugaugccaguaccagaggagccccaaaacuuugacagccuc

SEQ ID NO: 386080 - RNA, 64 nt, Human
cuuagcucuuagucucuuugguaggaguuuuguuccagaggagcucucccccuuggauuugaac

SEQ ID NO: 386081 - RNA, 64 nt, Human
caggucaggggcacacauggcuuaagugacaaagccagaggagaagacaacccugacagcauca

SEQ ID NO: 386082 - RNA, 64 nt, Human
cuccuucaucccccgcugguggcagaaucuguuaccagaggacaaagccuuuggcucuucuaau

SEQ ID NO: 386083 - RNA, 62 nt, Human
ucuccuggugcagccugugaggcucuuaagacaggggccacuccucccucccgcucccaccc

SEQ ID NO: 386084 - RNA, 64 nt, Human
gccaggccgaacuccgcacucgcucucccggcagaggggccagaaucgcccggcccagcccugg

SEQ ID NO: 386085 - RNA, 64 nt, Human
ccugagaagaauauuucuuuggaccccaggcacuaggggccaccugccugggagucucccugcc

SEQ ID NO: 386086 - RNA, 64 nt, Human
uaauauugaaggauauuguacuucacuagugcugccagaggaauuguuaauaaaagcaccuucu

SEQ ID NO: 386087 - RNA, 64 nt, Human
gaggugucagcugggccccuccugugcuaucuccccagaggacaucccugacuccaccccuuuc

SEQ ID NO: 386088 - RNA, 64 nt, Human
guuuagguguauguaguugggccauguuacuuguccagaggaagagacuaaagauauaagaaua

SEQ ID NO: 386089 - RNA, 64 nt, Human
gaaugacuccucacacuuucaccuuuacugauuuccagaggaaagcuagaggaucuaguucaag

SEQ ID NO: 386090 - RNA, 64 nt, Human
caucccccaucuaguaacaucucagaaauuucauccagaggaacaaaaaaauuaaaaauagaac

SEQ ID NO: 386091 - RNA, 64 nt, Human
ucugagugauggaaucuuagucauucauguuucaccagaggacagcaagcaaaagguaauugac

SEQ ID NO: 386092 - RNA, 64 nt, Human
caccuaggaagagcccgcaugcccuagacucacuccagaggaaggauugauuugcaaccagaaa

SEQ ID NO: 386093 - RNA, 64 nt, Human
uugagaaucagcauaguaaauuacauuucuaaucccagaggacuuaauauuuucuuuugucacc

SEQ ID NO: 386094 - RNA, 64 nt, Human
ggcccuccaugacacacccccgauuccuggacaaccagaggagauacagcugcuuagaaaggag

SEQ ID NO: 386095 - RNA, 64 nt, Human
ccuuugggacacucugccauggcuggcgugaggcccagaggaccacgcagaggcaaugguagua

SEQ ID NO: 386096 - RNA, 64 nt, Human
ccgccggcgaccagacuccugccacgccuuccauccagaggagaaugcccaggacugcggcggc

SEQ ID NO: 386097 - RNA, 64 nt, Human
uaagaaaugagccuagucaccaagaacuccacccccagaggaaguggaucugcuucuccaguuu

SEQ ID NO: 386098 - RNA, 64 nt, Human
ugaaucaguuauuauuucuucauuuuuuuuucuaccagaggacagauuaauagauuuaacccuu

SEQ ID NO: 386099 - RNA, 64 nt, Human
aacacagagagaggaauguccaggucaucuucacccagaggagaagccucaucauugaauggag

SEQ ID NO: 386100 - RNA, 64 nt, Human
uggagggggcgacuaccccagugccccccccgcuccagaggaaggaaagcugugggggacgggg

SEQ ID NO: 386101 - RNA, 64 nt, Human
aaugaucugugugagccgaugccugcccuuccagaggggccacuguccccagccgcagccaacu

SEQ ID NO: 386102 - RNA, 64 nt, Human
uuuuuggcuuuccugguucugucuagacuggccuaggggccagggcuuugggaugggaggccgg

SEQ ID NO: 386103 - RNA, 64 nt, Human
ccugcccucuaaaagaauccuuccaacuuccuauaggggccauuucaugcagauauacucacuu

SEQ ID NO: 386104 - RNA, 64 nt, Human
acuggucuaaugaguucaagggccugaggcagauccagaggacaagccugccucaccuccagca

SEQ ID NO: 386105 - RNA, 64 nt, Human
ggaagugggagggcagggcaaagaaaggauuagaccagaggauuuaggaugccuccuucuaaga

SEQ ID NO: 386106 - RNA, 64 nt, Human
aggggggaugcugcuuagcugaucccgcccugacccagaggaagccucuauuuauuuauuagcu

SEQ ID NO: 386107 - RNA, 64 nt, Human
accgccagaaguggaguugggcagcccugugaagccagaggagauggacuggucugagcuauac

SEQ ID NO: 386108 - RNA, 64 nt, Human
ugcuuugaguuggacgugauacuguccauauucuccagaggauuaccuggcugaaccauuggcu

SEQ ID NO: 386109 - RNA, 64 nt, Human
cucacauggcaagaguugcucuggagagguagggccagaggaaugcugcugcacugccaacuca

SEQ ID NO: 386110 - RNA, 64 nt, Human
agacugaggcagcguggaugggaaguaaacgcuuccagaggaacucagaaaaaauuaugugcca

SEQ ID NO: 386111 - RNA, 64 nt, Human
caaugaucuacucaaacauuggagaaaaaaacugccagaggaggaguugccaauuggcagugug

SEQ ID NO: 386112 - RNA, 64 nt, Human
uccaccuggcugggggucugcgccacaguuugguccagaggagggaggaggaagggaagacccc

SEQ ID NO: 386113 - RNA, 64 nt, Human
cagugucuagaggccugaaggaaccgcugaagaaccagaggagaucuccucuuccaagacacgu

SEQ ID NO: 386114 - RNA, 64 nt, Human
acuugaacagcccaaaagcauuaaaaaucuauuuccagaggaauguuuugcuauguagggaaau

SEQ ID NO: 386115 - RNA, 64 nt, Human
gcaccauuucacacacacuccuuguagaugggagccagaggaaaccugaacguggguggagcgu

SEQ ID NO: 386116 - RNA, 64 nt, Human
cccccggagguggcagcagccccgagggacgcccccagaggaccgggaggcaccccacccuccc

SEQ ID NO: 386117 - RNA, 64 nt, Human
uucgucuucuuuggaccuccugaaccgagagaacccagaggaacccccaccccacccccaccua

SEQ ID NO: 386118 - RNA, 64 nt, Human
gucugagagggacccuggugguaccugugcuuucccagaggacaccuaaugucccgaugccucc

SEQ ID NO: 386119 - RNA, 51 nt, Human
auccugucacgucgggcuaggaggggccaagccgaagagccacccaggcca

SEQ ID NO: 386120 - RNA, 64 nt, Human
gccugugcccuccccacucccaggcggggcaggaaggggccaagggggcuugcccacccacccc

SEQ ID NO: 386121 - RNA, 64 nt, Human
auccccauggaacagcccugcacgcccaggaugaaggggccagaccacgccccugccugagacc

SEQ ID NO: 386122 - RNA, 64 nt, Human
gugcuccaggauguggcuucucaugaagcucuggccagaggaggggaacuuauugggggagggg

SEQ ID NO: 386123 - RNA, 64 nt, Human
gaaagaaacccugcggauaagaagguuaggcgagccagaggauugugcuggcaucgugucuuuc

SEQ ID NO: 386124 - RNA, 64 nt, Human
auccccuaaaauucucccuguagucaauguuccaccagaggagcggacagugaaauguaauauc

SEQ ID NO: 386125 - RNA, 64 nt, Human
uaugaguggaaagugacccucuaguucaacugugccagaggaaacagcccuccagugcccaccu

SEQ ID NO: 386126 - RNA, 64 nt, Human
auaacuuagguugguuaaguugacaagauuuacuccagaggaucaucucuuuguauuugccaaa

SEQ ID NO: 386127 - RNA, 64 nt, Human
gagaacaccuucccuuuccuugccaugucacccuccagaggaagucacaccucagcgagguggu

SEQ ID NO: 386128 - RNA, 64 nt, Human
caaucccugaaagggaugagguugggggaguugcccagaggaaucccuguucccacugauuuuu

SEQ ID NO: 386129 - RNA, 64 nt, Human
auaccuggggugaaauauaccaaauucugcaucuccagaggaaaauaagaaauaaagaugaauu

SEQ ID NO: 386130 - RNA, 64 nt, Human
ugaggcagaggaagauauuucuaaucggucuugcccagaggaucacagugcugagaccccccac

SEQ ID NO: 386131 - RNA, 64 nt, Human
aaaugggagggaaguuggggugucugcuuugggaccagaggaagauagcuugagaggcauuggc

SEQ ID NO: 386132 - RNA, 64 nt, Human
gucacaaaggcuuaaaggaagugaaaauagccagccagaggaaaugucucaagaaccagaaaua

SEQ ID NO: 386133 - RNA, 64 nt, Human
ucugucacagagacagcccuuuucucagaacuacccagaggaggccgggcaugguggcucacgc

SEQ ID NO: 386134 - RNA, 64 nt, Human
acgugcacacgcgcacaaaagagagaaacggacaccagaggaaugaacuaaagaaaaacguaaa

SEQ ID NO: 386135 - RNA, 64 nt, Human
aagcucacccacuuuggagcagcauuucuccuccccagaggaccucgaaggcugcaacggcccu

SEQ ID NO: 386136 - RNA, 64 nt, Human
uuuguuuugaauauacagagccuugauccagaagccagaggauggacuaagugggagaaauuag

SEQ ID NO: 386137 - RNA, 64 nt, Human
cucccuucccccuauccaaccuggguagguggguaggggccacaguugcuggauguuuauauag

SEQ ID NO: 386138 - RNA, 64 nt, Human
uagaccaaauggagcaccaaggccaagcggacagaggggccauggguuguaggauugaggaacg

SEQ ID NO: 386139 - RNA, 64 nt, Human
guggacaugguggcagcagggaaccccuagagagaggggccacugggaccaggccuccuguugu

SEQ ID NO: 386140 - RNA, 64 nt, Human
gccuggugugcagcuaaccccucccuccccacagccagaggaggccacagaccccucaggggag

SEQ ID NO: 386141 - RNA, 64 nt, Human
acgcagccaggacaccgggcagggccgcccgggcccagaggagcugggagccgggccgcagacu

SEQ ID NO: 386142 - RNA, 64 nt, Human
ccauccuagggaucuugucaggguuccuuacugaccagaggagcccgcagcaaucuccacagcc

SEQ ID NO: 386143 - RNA, 64 nt, Human
ugucugucuggcaucagauuggcagcugcaccaaccagaggaacagaagagaagagagaugcca

SEQ ID NO: 386144 - RNA, 64 nt, Human
ucuuggacagaggaucugggagguggaagccaggccagaggacuuggggaaaaugagauggagg

SEQ ID NO: 386145 - RNA, 64 nt, Human
ccccaaccaucccaauagggugggggccugugggccagaggacuccaugacaguagccauggag

SEQ ID NO: 386146 - RNA, 64 nt, Human
cuuccuuggcccuuuuucuuuauugacuagaccaccagaggaggaugugugggauuguaggcaa

SEQ ID NO: 386147 - RNA, 64 nt, Human
gcuggaccucacgcagacuggcauggccauggguccagaggauacuacugggaaggggauggca

SEQ ID NO: 386148 - RNA, 64 nt, Human
agggguuuggucacaaaggauggacucuucccacccagaggaugcagggaaagcacacuguguc

SEQ ID NO: 386149 - RNA, 64 nt, Human
auuuucaagacaaacuggaguaagaauuaaagccccagaggauuuaauuauccugguuugcaaa

SEQ ID NO: 386150 - RNA, 64 nt, Human
gagguuuacucuaaugaugguggcccagcugugcccagaggacagccaggcaggcccugggagg

SEQ ID NO: 386151 - RNA, 60 nt, Human
uccgugacucuguggugugagagcugacuuccagaggacgcugcccuggcuucaggggcu

SEQ ID NO: 386152 - RNA, 64 nt, Human
ggguggacugcucgggggugauccugccagauucccagaggauucucacgccaccauuaccuca

SEQ ID NO: 386153 - RNA, 64 nt, Human
cagaugauccuugcacagacaaccuaccuucuuuccagaggaugucuuucuccucuggagagua

SEQ ID NO: 386154 - RNA, 64 nt, Human
ugaacaugaaaugauuaguauuacuugaaugcauccagaggauauuuaaaccaaaaugaaaaac

SEQ ID NO: 386155 - RNA, 64 nt, Human
ggguugggggcagccaggcacagccggcucacggaggggccaccacgcugggccagggucucac

SEQ ID NO: 386156 - RNA, 64 nt, Human
gcauggcagauucaccuguaaauauuuagccuugaggggccauugauguaaaacaauuguauug

SEQ ID NO: 386157 - RNA, 64 nt, Human
ucuucccccuuuucagccccacagcugcugccacaggggccaacuagggccagguggaagggga

SEQ ID NO: 386158 - RNA, 64 nt, Human
agugauguucucugggaaguggacugugguuuuuccagaggaacucaguuaagaaaucgagagu

SEQ ID NO: 386159 - RNA, 64 nt, Human
gaggucugggaggaccaggaaacagccucaguggccagaggaucaccagugcauccuucaucac

SEQ ID NO: 386160 - RNA, 64 nt, Human
ggggccggccaagccauucagagagaacauggguccagaggacauucucaguggaaagaguuug

SEQ ID NO: 386161 - RNA, 56 nt, Human
cggucuccuccucugccuagcucuucccagaggaugugguuuggggcaggcaggua

SEQ ID NO: 386162 - RNA, 54 nt, Human
cccccaaagugcuggagugaggcuccagaggagacuuugaguugaugggggcca

SEQ ID NO: 386163 - RNA, 64 nt, Human
uacucuguccaguuccuuuagaaaaaauggaugcccagaggacucccaacccuggcuugggguc

SEQ ID NO: 386164 - RNA, 64 nt, Human
cugccuuuucucacucagauggggacaccgagguccagaggaaaagacaccugucaaaugucac

SEQ ID NO: 386165 - RNA, 64 nt, Human
gggcguuuggggcccucuaugcuggcuuuucaccccagaggacacaggcagcuuccaaaauaua

SEQ ID NO: 386166 - RNA, 64 nt, Human
gucucccugcaggcuccacagacuguccuggggcccagaggagcuggugcugaccuagcuaggg

SEQ ID NO: 386167 - RNA, 64 nt, Human
gccaaggcaucacugggcaucuacuuaacacugaccagaggaugugaagccacugaaagcuuga

SEQ ID NO: 386168 - RNA, 64 nt, Human
ggaacagggagcgaggagccccucggaggagccuccagaggaggaaauccccaaggaggauggg

SEQ ID NO: 386169 - RNA, 64 nt, Human
cuuacuucccuguucaccucugccccaccccagcccagaggaguuugagccaccaacuucagug

SEQ ID NO: 386170 - RNA, 64 nt, Human
uuugccuuguuuuguuuuguuguuuuguauuuagccagaggaugccaaaauuagucuucucaaa

SEQ ID NO: 386171 - RNA, 64 nt, Human
ucuugggacacacugugggauuuguggcccuuccccagaggaauuguggagacugucccaugga

SEQ ID NO: 386172 - RNA, 64 nt, Human
ccccucaaacuucugugcacaaagugcucccuucccagaggaggggccccaucgguguguaagg

SEQ ID NO: 386173 - RNA, 64 nt, Human
uccaccugcauguucucugcuucgcugccuuggaaggggccacauuccccauuccucuucuccu

SEQ ID NO: 386174 - RNA, 64 nt, Human
gcagcccccucccgggcagcuucaccccacacccaggggccaggcucucccggggucucaugcu

SEQ ID NO: 386175 - RNA, 64 nt, Human
auguuuuacucaaaauaaacauggccaugaacucaggggccauugggauucuccccucuggcag

SEQ ID NO: 386176 - RNA, 64 nt, Human
aaaaauaaacagcucuggagucuuguuccugacuccagaggaacgagagcauuccaggaaagag

SEQ ID NO: 386177 - RNA, 64 nt, Human
cagaaggaaggagaaaacucuugucaagaauggcccagaggaaugccucgcacaaaaggucuuc

SEQ ID NO: 386178 - RNA, 64 nt, Human
ggggaguuccugcauuuccugccagggcagaggcccagaggagcgacccccugcuuccacugcu

SEQ ID NO: 386179 - RNA, 64 nt, Human
gcuucgagugcgugcggggccgcuaugaggcccgccagaggaagugccccaagugcaacgcggc

SEQ ID NO: 386180 - RNA, 64 nt, Human
gacuucucccaggauccucucuuugggagcgaagccagaggaucccuacagcacucaagcuuca

SEQ ID NO: 386181 - RNA, 64 nt, Human
cuccccggccugcauccggcuuggguacacaggcccagaggacuggggugacucacgggcccug

SEQ ID NO: 386182 - RNA, 64 nt, Human
cacgagucaaguggcucacaaccuccucagggcaccagaggacucacucacugguugcugugau

SEQ ID NO: 386183 - RNA, 64 nt, Human
gcuguguuucuggaguccuuuggaaacaugugucccagaggagaagagguuugacuugcgugua

SEQ ID NO: 386184 - RNA, 64 nt, Human
cugaaccuacagaaguuggguauugucugaaaucccagaggacccauaagugccggugacaagc

SEQ ID NO: 386185 - RNA, 64 nt, Human
gaaagccgucucccugcuugacucgacugcugucccagaggagaguccugugcgaccugagcgg

SEQ ID NO: 386186 - RNA, 64 nt, Human
ggggcuuuagccggaagucaguccuccucauucaccagaggacacacaggggagacgccccagu

SEQ ID NO: 386187 - RNA, 64 nt, Human
agggcuuuagccggaagucagaccuccucagucaccagaggacacacacaggggagaagccuua

SEQ ID NO: 386188 - RNA, 64 nt, Human
gugagaagaaucaucucugcaccucgggucucugccagaggaagacuuaagcaucccugcgacc

SEQ ID NO: 386189 - RNA, 64 nt, Human
ucugcuuccagaugagccagugccucgcaugauaccagaggaggcgagggacagagacagcaag

SEQ ID NO: 386190 - RNA, 64 nt, Human
ccaguccaacugauggcccagaugcagcaggaggccagaggacagagcagaggaucuuuccaac

SEQ ID NO: 386191 - RNA, 64 nt, Human
ucccaggaccuggagacaggauugucuggggccgaggggccagggugugagguuucaccuccgu

SEQ ID NO: 386192 - RNA, 64 nt, Human
gccuuugccugaauaccacguccccaagaaucagaggggccacagcccuucuccuccaugggag

SEQ ID NO: 386193 - RNA, 64 nt, Human
guggguggucccugcagucauggccugagugcgcaggggccaccgcguggcugcugcuguccuc

SEQ ID NO: 386194 - RNA, 64 nt, Human
gcugguuuuguugguuauguggaaaucacaaacuccagaggagcaaagggguuuuucaaugucu

SEQ ID NO: 386195 - RNA, 64 nt, Human
uguugggauuauaggcaugagccaccacgacuggccagaggacaaaauuuuaauaaaggucuua

SEQ ID NO: 386196 - RNA, 64 nt, Human
uauucagauguacacccacccacauaucuuacagccagaggaaccagcacuccaucacugagag

SEQ ID NO: 386197 - RNA, 64 nt, Human
gucugagggggggggaaggggacugcgguggacaccagaggaagcuguuuccuguugugauguu

SEQ ID NO: 386198 - RNA, 64 nt, Human
uuccucagguuugauaucuggcagguuugacuauccagaggaaauuaaauauuuuuauauaaaa

SEQ ID NO: 386199 - RNA, 64 nt, Human
ggacauuuggcuccucuuagcuggcucugcucauccagaggauauucccccaucccccccccau

SEQ ID NO: 386200 - RNA, 64 nt, Human
cagacagacgcguuggcacaguucaugguuuccuccagaggagacauuggcuuaucauggggaa

SEQ ID NO: 386201 - RNA, 64 nt, Human
ccugaagagaagggcagggcugaggccucucauuccagaggaagggacaccaagccuuggcucu

SEQ ID NO: 386202 - RNA, 64 nt, Human
cuuccuaggagccagucagcagggugggguggggccagaggagcucuccagcccugccuagugg

SEQ ID NO: 386203 - RNA, 64 nt, Human
agguuccuugagcacccggaaacggucacgagacccagaggaagaauuauaacccagaaacaaa

SEQ ID NO: 386204 - RNA, 64 nt, Human
cuuagacccgguccugcccuuccugaagaagaucccagaggaugucacaaagaucaugaaaguc

SEQ ID NO: 386205 - RNA, 64 nt, Human
gcuuccuggggccacagggccuauggcagucagaccagaggaagcgguccgggggcugggggcu

SEQ ID NO: 386206 - RNA, 64 nt, Human
uccugagggccgggaagccgaagaguccacaggcccagaggaagcagaagcccccgaguccuuu

SEQ ID NO: 386207 - RNA, 64 nt, Human
guggaguuggcuguuacgacaucccugugugaucccagaggaggggcaguagcugggcagaaac

SEQ ID NO: 386208 - RNA, 64 nt, Human
uuauuuccguuuuuguuucugguuacugugaaucccagaggagucucucccugugcccacauga

SEQ ID NO: 386209 - RNA, 64 nt, Human
guuuccuuuuuuuuuucuguuuuggguguacucuaggggccagguugggagggggaaggugagg

SEQ ID NO: 386210 - RNA, 64 nt, Human
ugccugucaaaaaguccaacauuucauagguaguaggggccacauauuacauucaguugcuaua

SEQ ID NO: 386211 - RNA, 64 nt, Human
gaaaggagaguuuguuacuuacgguucugagaggaggggccacauaggaaagccccacgguggg

SEQ ID NO: 386212 - RNA, 64 nt, Human
uuagggagcagagagcagaacuccgcagcccagcccagaggagugucaccucccaccuuuggag

SEQ ID NO: 386213 - RNA, 62 nt, Human
agccaccccagucagaguaaaguugcaggaagccagaggaggcaauacagugggacaguuag

SEQ ID NO: 386214 - RNA, 64 nt, Human
acaacccaaagucucccaggaagcuguggggagaccagaggaucaagcugaagugaagccagug

SEQ ID NO: 386215 - RNA, 64 nt, Human
caugcccgcuagaaaccugcugcgagggccccucccagaggagccccgccccuguaagauuucc

SEQ ID NO: 386216 - RNA, 64 nt, Human
cccaugggauagagcggggaaggugauggcucuuccagaggauucccucagauggggaggcagc

SEQ ID NO: 386217 - RNA, 64 nt, Human
gaauuaggaaccuuauuuccuaaaagaaacagggccagaggaaaaaaaacuauugauaaguuua

SEQ ID NO: 386218 - RNA, 63 nt, Human
gcaauuccuucgugcgcuagaaccuagggaaugccagaggagcaaggaugcagggcccaggac

SEQ ID NO: 386219 - RNA, 64 nt, Human
ucugccuggcguccccucccucugucuucagcacccagaggaggagagagccggcaguucccug

SEQ ID NO: 386220 - RNA, 64 nt, Human
cgcgaccucuccaucuucagcuucuucaucuucaccagaggaaucacucuuguggauguuuuaa

SEQ ID NO: 386221 - RNA, 64 nt, Human
ggggguccagcacaggcuguaucugcagagggucccagaggaacgcuggagccaagagaagccc

SEQ ID NO: 386222 - RNA, 64 nt, Human
cuguccucccgugggccaucccagccuccuucccccagaggagcgcagucacuccacuuggccc

SEQ ID NO: 386223 - RNA, 56 nt, Human
gcagcgccuuccagcccugagcccgcccagaggagcccagcggcccaagagcccgu

SEQ ID NO: 386224 - RNA, 64 nt, Human
cccgcacucccuucuagcacccccaaaggaaaagccagaggaacaaucgccuccuggugguggu

SEQ ID NO: 386225 - RNA, 64 nt, Human
gaaaagguguccuuuuguaaaaaucagcaauucuccagaggacuaucucacauaagucaucuua

SEQ ID NO: 386226 - RNA, 64 nt, Human
aauuaucaagguuuuaacaauuuauaauucuaaaccagaggauuauaaagaagugcaaauugac

SEQ ID NO: 386227 - RNA, 64 nt, Human
uguauguccagaagaaagagaaagaccaucaaucaggggccauaguacaggagcccaccagcag

SEQ ID NO: 386228 - RNA, 64 nt, Human
agaugagcacccacaggaagccgacccaggccugaggggccaggaacuugcugggucagaucug

SEQ ID NO: 386229 - RNA, 64 nt, Human
ccauucccaucuacugaaacagggucuccacaagaggggccagggaauauggguuuuuaacaag

SEQ ID NO: 386230 - RNA, 52 nt, Human
aacagugggggaaccuaugaccccagaggacgcugugaucuccaccuugaag

SEQ ID NO: 386231 - RNA, 64 nt, Human
agggccgcucgaugccuuugcuguuuagcuuccuccagaggaggggacuuguaggaaucugccu

SEQ ID NO: 386232 - RNA, 64 nt, Human
gucuggaagugacagaagucagaucuacagccacccagaggaaagucagcuccugaaacgcugc

SEQ ID NO: 386233 - RNA, 64 nt, Human
cuucuagggaucucagccguggcugaggccacccccagaggagccccugguccacagaagcagg

SEQ ID NO: 386234 - RNA, 64 nt, Human
aauaacaauuaauaauagguuacaggaaagccagccagaggaagugucagcacuuuaaaauucu

SEQ ID NO: 386235 - RNA, 64 nt, Human
uccaguguccuuaaaacucuggagugagaggaugccagaggaucaagaaaaggaucacaguuuc

SEQ ID NO: 386236 - RNA, 64 nt, Human
cccgccacgaagguugagaacaaagccagggggcccagaggagcaauagcccugggccacaagc

SEQ ID NO: 386237 - RNA, 50 nt, Human
cagaagauggagaggauugaccagaggaauaacuuagcuugcacaugaau

SEQ ID NO: 386238 - RNA, 64 nt, Human
aaucugguccccagucgcacaacuucccacauacccagaggagagcauaugccugugggggcag

SEQ ID NO: 386239 - RNA, 64 nt, Human
cagacgccgggccggcugacauuuggaccccaucccagaggagaugcuggcuaccagcuggggc

SEQ ID NO: 386240 - RNA, 64 nt, Human
ugcaggcuccgcccccacccaaggccgggcccagccagaggaggggcagggcagggcaggaggu

SEQ ID NO: 386241 - RNA, 64 nt, Human
gguucccgugacucaggguaaggugcuggggcugccagaggaccugccccagcaagauuuuugu

SEQ ID NO: 386242 - RNA, 64 nt, Human
agggcucccugcagggucagggaccagaccacgcccagaggaggggaggcacuggcccccgcca

SEQ ID NO: 386243 - RNA, 64 nt, Human
ggccugagauuucaucugcucuccuuccuggagcccagaggagggcagcagaaggggguggugu

SEQ ID NO: 386244 - RNA, 64 nt, Human
gccgacaguuuugaugagcagggaagucugaggcccagaggacggggggcccagcgguaaggga

SEQ ID NO: 386245 - RNA, 64 nt, Human
cccgguucccaaccuuucacgccggccagcggucaggggccagggcuggaggcgccuuccccuc

SEQ ID NO: 386246 - RNA, 64 nt, Human
auguacuuuggcuucaaugauuggcaacuucuacaggggccagucuuuugaacuggacaaccuu

SEQ ID NO: 386247 - RNA, 64 nt, Human
gaugaccaagaccucuucccagacccacagcugcaggggccaaguaauaacagcucuuaauagu

SEQ ID NO: 386248 - RNA, 64 nt, Human
uuuagcuagugggcaugugaagauauuuagucacccagaggagccaguaaauguuauaauguua

SEQ ID NO: 386249 - RNA, 64 nt, Human
cagccuuuagccaggagucauacuucaucagacaccagaggacacacacagugcuguggcuuuu

SEQ ID NO: 386250 - RNA, 64 nt, Human
auggcuucagagagggagaagcacugugaggccuccagaggauguggcagugagggacgauggg

SEQ ID NO: 386251 - RNA, 60 nt, Human
cggggccugaagccacguagccccgcgaugccagaggaggggcacuggguggggagggag

SEQ ID NO: 386252 - RNA, 64 nt, Human
caaggacagggaagagaccacugugggaugacagccagaggaauaagaacuugcucccucccca

SEQ ID NO: 386253 - RNA, 64 nt, Human
uccaggggagcucgggccugacggcccugacgguccagaggaaaagggccgggaucgugaccgg

SEQ ID NO: 386254 - RNA, 64 nt, Human
gaggauacugaggcacacagaggggagucaccagccagaggaugcauagccuggacacagagga

SEQ ID NO: 386255 - RNA, 64 nt, Human
acacccccaaccccagggaggggcugucauagucccagaggauaagcaauaccuauuucugacu

SEQ ID NO: 386256 - RNA, 64 nt, Human
gaaacuggacauggggccuggggaggggagcuggccagaggaggaccccuuucccguggcauua

SEQ ID NO: 386257 - RNA, 64 nt, Human
ggcaucuggugggugccccucugggacaaagcuuccagaggaaggaacaggcagcaaucuuugc

SEQ ID NO: 386258 - RNA, 64 nt, Human
ccccaggaccugaucugaguucugcuggcagcuuccagaggauugccuuuuuugaggacauugu

SEQ ID NO: 386259 - RNA, 64 nt, Human
aagcuuucauccagaggucuccccucaucaugcaccagaggacgcaugucggugggaagagcua

SEQ ID NO: 386260 - RNA, 64 nt, Human
ggcacugcugccaugcugccuccccaggcuggccccagaggagcgagcaccagcacccgacgcc

SEQ ID NO: 386261 - RNA, 64 nt, Human
uucucgccggccggucucaggccgcacagacguuccagaggaggagggugacauuuuuacuccc

SEQ ID NO: 386262 - RNA, 64 nt, Human
gcuggugcccggggaggagcagcuauccuugcccccagaggagcagucauugcccucugcggag

SEQ ID NO: 386263 - RNA, 64 nt, Human
uaccccucaguacuguagcaugaaacaaaggcuuaggggccaacaaggcuuccagcuggaugug

SEQ ID NO: 386264 - RNA, 64 nt, Human
uccuaccccuguccuaccucaccggggcacuuucaggggccaggggccucugaagucucuaggc

SEQ ID NO: 386265 - RNA, 64 nt, Human
agcccuaccaaucaugaacuggaacuccauaaggaggggccaaauugggaggccuuuuggcaaa

SEQ ID NO: 386266 - RNA, 64 nt, Human
agcuggcaagaggagcugcuuguucccaccaggaccagaggaggcugcguuuccccguuuccau

SEQ ID NO: 386267 - RNA, 64 nt, Human
ggagcccugaccccacccgguggggcccuuggccccagaggaccgagagaguggagagugcggc

SEQ ID NO: 386268 - RNA, 64 nt, Human
ggggauggugagcaaauaggagugcuccccagaaccagaggaggguggggcacagaccauagac

SEQ ID NO: 386269 - RNA, 64 nt, Human
cagagaccuggaacagaugcuuucauuauggccuccagaggaaaccaacccugucuccaccuug

SEQ ID NO: 386270 - RNA, 64 nt, Human
cggugauaaaugccuguagucccagccacugaagccagaggaucgauugaaccagggagaucau

SEQ ID NO: 386271 - RNA, 64 nt, Human
agcucuauuugggggaaguguagugaggaggagcccagaggaccccaggggagugaggagggag

SEQ ID NO: 386272 - RNA, 64 nt, Human
ccaggaccgguuugaaguuaauguggcagaacuuccagaggaaaucgacaucuccacauacagu

SEQ ID NO: 386273 - RNA, 64 nt, Human
gaagucgcaggcagccucucagaaaguuucacccccagaggacgaagaggucaagaaccuugca

SEQ ID NO: 386274 - RNA, 64 nt, Human
ccacaccgugcuggacuucuacgagccgcggcggccagaggacgaugacccuacagaacaggug

SEQ ID NO: 386275 - RNA, 64 nt, Human
uccugaguccugccgucagacucuggcagggcucccagaggagcaucaacuccaggagaacagg

SEQ ID NO: 386276 - RNA, 64 nt, Human
aaaaaaaaaaaaagaccagcuuugcagccagaagccagaggauacccagggacaguagggcucc

SEQ ID NO: 386277 - RNA, 64 nt, Human
ggggagaggcugaggacaaauaccugcugucacuccagaggacauuuuuuuuagcaauaaaauu

SEQ ID NO: 386278 - RNA, 64 nt, Human
ccgggcaggacccucgaagaggagaccgagggucccagaggaccaaugcuacaagccagcaaau

SEQ ID NO: 386279 - RNA, 64 nt, Human
acgcggaugccgccucaagggucuucaggggaggccagaggagagcugcugggccccgagccac

SEQ ID NO: 386280 - RNA, 64 nt, Human
cguguaugaugggguucucaggcccaggcuucgaccagaggacccucugccaccaccguuucuu

SEQ ID NO: 386281 - RNA, 64 nt, Human
gcaggccuucucuugucccuuauagguaccuuggaggggccaggggcugaggaaggccggaccc

SEQ ID NO: 386282 - RNA, 64 nt, Human
cuaaguguaaccucaguauuuauguaauuuguacaggggccaugccccaccccccuccuccccc

SEQ ID NO: 386283 - RNA, 64 nt, Human
auggguggcuuucaaggcuggggcauggcaaaucaggggccagagagcaggggagcuugggacu

SEQ ID NO: 386284 - RNA, 64 nt, Human
gaugaguuaggccauggaccugacccaguuuggcccagaggacucugcuggugaccugaaaaga

SEQ ID NO: 386285 - RNA, 64 nt, Human
guucuggaaguaaaccuugguugucuuucguuggccagaggaauuggugaguagucucagcugu

SEQ ID NO: 386286 - RNA, 64 nt, Human
gcccagaaagucugaucucuccagaaugaucagcccagaggaaugcugagaaaucaccuggagg

SEQ ID NO: 386287 - RNA, 64 nt, Human
auuccucgggacccacagucucaccacgucuccuccagaggacggcagaggguacagguggugg

SEQ ID NO: 386288 - RNA, 64 nt, Human
cuaaauguuuacuuaagaaacacccuguuuacagccagaggagaaacacccaacacugagugga

SEQ ID NO: 386289 - RNA, 64 nt, Human
ggagggggauggagaagggccuacauuucucaauccagaggaagugagcugguuuaaaugaaag

SEQ ID NO: 386290 - RNA, 64 nt, Human
cccuuagccuaaaauccacaccaaagggagaguuccagaggaauccaugaagaauucccaugcc

SEQ ID NO: 386291 - RNA, 64 nt, Human
ccucuucugccaagagagggccaugcaauucaucccagaggaaccugaggccugaaggagguga

SEQ ID NO: 386292 - RNA, 64 nt, Human
uuuacagcacaaauaaauaaugacugucauacauccagaggagaccgaaccugcccagcugaug

SEQ ID NO: 386293 - RNA, 64 nt, Human
gcacccaacccuggaugccaccccccagcggguaccagaggaaagcuggcagcaggcgccuccu

SEQ ID NO: 386294 - RNA, 64 nt, Human
ucuuugaaggaguaaauguguuuuguuccuagggccagaggagcuugucuuccuuguccucugu

SEQ ID NO: 386295 - RNA, 64 nt, Human
uuucugggucucagcccucucugcgguugagggcccagaggacagagagauggacaugcguccc

SEQ ID NO: 386296 - RNA, 64 nt, Human
cgcgcaggaaugugggguccccuguguucccucgccagaggagcacuuggcaaggucagugagg

SEQ ID NO: 386297 - RNA, 64 nt, Human
caaucuugaccacacuuaccugcaagaggaguaaccagaggacacacuuccuuccuucuuuggu

SEQ ID NO: 386298 - RNA, 64 nt, Human
ugggcuuuucccugugggccagggaugcucggucccagaggaggaccuagugacaucaugggac

SEQ ID NO: 386299 - RNA, 64 nt, Human
guguuuuuuaagccauauacaagaguaaguuaaaaggggccaaguaaauguugcuuguuauuug

SEQ ID NO: 386300 - RNA, 64 nt, Human
uuguagcaucaaauccacaccuagucauugcuugaggggccaaauuguguucugucccaugcac

SEQ ID NO: 386301 - RNA, 64 nt, Human
aggcuggcucccgggggucucugauggccaaccaaggggccacccagggaccucuaacuccaca

SEQ ID NO: 386302 - RNA, 64 nt, Human
cucuguucuagagggaaaguuaggaauaggccucccagaggauacuccagacaguugacaagca

SEQ ID NO: 386303 - RNA, 64 nt, Human
cuaaaagucuucauacagaguacaagugcagccgccagaggagaaaauugagauucuugacccu

SEQ ID NO: 386304 - RNA, 64 nt, Human
agggcagggcagggaagcugccaagcuccgcaccccagaggaguguucuggacuacagccuugu

SEQ ID NO: 386305 - RNA, 64 nt, Human
gaaaggagagacggggccuccaucacgccuguuaccagaggauccccgagagccacaccagcuc

SEQ ID NO: 386306 - RNA, 64 nt, Human
acugucucccugccugucaaucaccaccuuuccuccagaggaggaaaauuaucuccccugcaaa

SEQ ID NO: 386307 - RNA, 64 nt, Human
acaggaaggggcaugugagcguaaauagaggugaccagaggagagcaugagggguggggcuuug

SEQ ID NO: 386308 - RNA, 64 nt, Human
ugggcccgagggucccaaggcgugcaggggcgguccagaggaggugcccgggcaggggccgcuu

SEQ ID NO: 386309 - RNA, 64 nt, Human
gugcugcccuucccucccacagccuggcagccauccagaggaggggcucuaccagaugccaagg

SEQ ID NO: 386310 - RNA, 64 nt, Human
ggccgagcaaggaaagcauuucgaaccuuccaguccagaggaagggacugucgggcacccccuu

SEQ ID NO: 386311 - RNA, 64 nt, Human
gggaggugugauuuacccauuacacaaugagaaaccagaggagccgaugaguuacuuaauugag

SEQ ID NO: 386312 - RNA, 64 nt, Human
uuuggggcaugcaaguugggguuauaguggagacccagaggaugagaaaacuucucugccucag

SEQ ID NO: 386313 - RNA, 64 nt, Human
uuaucaguggucccugucucccuucuuguacaauccagaggaauauuuuuaucaacuauuuugu

SEQ ID NO: 386314 - RNA, 64 nt, Human
agcacccucuaaguugugagaacucaaaauguccccagaggaugccagauguccccuggggugg

SEQ ID NO: 386315 - RNA, 62 nt, Human
uucuagacugccauuacuaagagaggcugguuccagaggaugcaucuggcucaccggguguu

SEQ ID NO: 386316 - RNA, 64 nt, Human
aggaggggcacgugcaccugauucuccuuggggcccagaggaagcugaugucauggcuggacaa

SEQ ID NO: 386317 - RNA, 64 nt, Human
gagugacacagccaggacccugguggacagccagaggggccacuucaggauggauguggggaga

SEQ ID NO: 386318 - RNA, 64 nt, Human
cugguccucaccuccagagccagccagccccgucaggggccaaacuuacuaccuugacuucauc

SEQ ID NO: 386319 - RNA, 64 nt, Human
cccccagcaaggcugcacccuccuugaucaucacaggggccauuucugccuugugauggaccca

SEQ ID NO: 386320 - RNA, 64 nt, Human
ucacacagauaaggaccaagggcuggcgguguggccagaggacaggggaagcugaaggccccgu

SEQ ID NO: 386321 - RNA, 64 nt, Human
uacccaggucaggcuguccacaccacaugggagcccagaggaggaggggcccgccuuagccaug

SEQ ID NO: 386322 - RNA, 64 nt, Human
gcccucgaacuucccaggcacccuccuuucugccccagaggaaggagcuguaguguccugcugc

SEQ ID NO: 386323 - RNA, 64 nt, Human
cuacgugcacuacaggaaggggugaggagagcagccagaggaaaaccagccccagaaugcugca

SEQ ID NO: 386324 - RNA, 64 nt, Human
gccagggggaaguggucuaagagaccuggaacugccagaggauggcggccugggcuuccccaga

SEQ ID NO: 386325 - RNA, 64 nt, Human
ccucacuuuauggaagaguuaaaacauuucuaaaccagaggacaaaagggguuaauguuacuuu

SEQ ID NO: 386326 - RNA, 64 nt, Human
aggcagcgcugccugggggcuggggaggggaggcccagaggagggcuggccaugugagcacccc

SEQ ID NO: 386327 - RNA, 64 nt, Human
gagaugugugggacugggacgcuuccuuuggggaccagaggaacauuaggggccggucagacac

SEQ ID NO: 386328 - RNA, 64 nt, Human
cagcacugccgcuccccaccccugagccaggaccccagaggauggccaugccccgugccuggca

SEQ ID NO: 386329 - RNA, 64 nt, Human
cuguuacaggaggauagagauuugauccuguuggccagaggauguuugacacccagccgugacu

SEQ ID NO: 386330 - RNA, 64 nt, Human
agccaaaauguuuagaaacacucagucucuggucccagaggauggcuucucagggcaugccaca

SEQ ID NO: 386331 - RNA, 64 nt, Human
ccagccccuagcagcuggauguggcagaggcaggccagaggaccuaagugugauggaccagagu

SEQ ID NO: 386332 - RNA, 64 nt, Human
gggugacaccgcuguggcuuagcccaagacacucccagaggaaaacacugcagaaggaacuggu

SEQ ID NO: 386333 - RNA, 64 nt, Human
ucccacuuaugugagugaccccauccauccaugaccagaggauuauuuuccugccuuggcagag

SEQ ID NO: 386334 - RNA, 64 nt, Human
aagcucuuggcuuggagucccgugucgucuccacccagaggaaguucuccagaguucaccuuuc

SEQ ID NO: 386335 - RNA, 64 nt, Human
gcccugcuggaggccccagcccuccguggacagcaggggccacguggagcccgggccgcucacc

SEQ ID NO: 386336 - RNA, 64 nt, Human
uuccagcuucucaguuucugccugggcaauggccaggggccaggaguggggagaguugugaugg

SEQ ID NO: 386337 - RNA, 64 nt, Human
gaggggcugggggugaggggccaggccauggccaaggggccagcugccccucauuuaucacucu

SEQ ID NO: 386338 - RNA, 64 nt, Human
agauugagaaagugccugaugcccgcgucagagaccagaggagccaacugagaugauggggugg

SEQ ID NO: 386339 - RNA, 64 nt, Human
aaaguaaaacuuuuuuuuuucauuaaaagaugucccagaggaaaggcccugugcagccaguaua

SEQ ID NO: 386340 - RNA, 64 nt, Human
gcugguuuccucugcagcgcgagggcuccggcgaccagaggauucuucccggaaggcauuccug

SEQ ID NO: 386341 - RNA, 64 nt, Human
gucugcucaagccucaggaucuggagaugcaguuccagaggauccuggacgaccccuccccacc

SEQ ID NO: 386342 - RNA, 64 nt, Human
guccuaacgagaagagauaauuacaaucaggcuaccagaggaagccuuugguccuaacgagaag

SEQ ID NO: 386343 - RNA, 64 nt, Human
acauacggguaacuagaacuacccagcgagucguccagaggagaggaucagguuugagucagga

SEQ ID NO: 386344 - RNA, 64 nt, Human
uccgcucagcucaugagggcacagagcauggccuccagaggaggggugguguccuucuccucuu

SEQ ID NO: 386345 - RNA, 64 nt, Human
augugcaguuuggaauuauguuggugugaauuugccagaggaccaaugcuugcauggagaaugg

SEQ ID NO: 386346 - RNA, 64 nt, Human
gaggggcaggggaggacuggggagggcuggcuagccagaggaguuggcuguaucaccccugguu

SEQ ID NO: 386347 - RNA, 64 nt, Human
uucagagccaagcaagaaguugaaguugccuagaccagaggacauaaguaucaugucuccuuua

SEQ ID NO: 386348 - RNA, 64 nt, Human
aaugcuacucuuaaaaagaugcuaugccacacaaccagaggacuuucuuguuagcaucccuuuc

SEQ ID NO: 386349 - RNA, 64 nt, Human
cucuauaaauuaugauuuacaaaagacacccaagccagaggaacucaaugaaauaagcugcuaa

SEQ ID NO: 386350 - RNA, 64 nt, Human
ccagcagcaucauaagauaaccaaacucguccucccagaggaucugaaacaguuucuccuacau

SEQ ID NO: 386351 - RNA, 64 nt, Human
ccagaggaugccaccuccgcccccacccccgccgccagaggaguacaagagccagaggcccguc

SEQ ID NO: 386352 - RNA, 64 nt, Human
uccaggggucuguuauuagcaguccacgcccucaccagaggaugccaccuccgcccccaccccc

SEQ ID NO: 386353 - RNA, 64 nt, Human
guccgcagccucccuucacuggugccuugaugcuaggggccaggccuccucugugacucugggc

SEQ ID NO: 386354 - RNA, 64 nt, Human
ucacaguccuguauuuggcagguuugggagccugaggggccaucucccugacacucagaggcac

SEQ ID NO: 386355 - RNA, 64 nt, Human
cugggacaggggagaaccuagggugauauuaaccaggggccaugaaucaccuuuuggucuggag

SEQ ID NO: 386356 - RNA, 64 nt, Human
acccuacagauggggcauauccuaucccaucccaccagaggauugauucuccauuucacaagga

SEQ ID NO: 386357 - RNA, 54 nt, Human
gcaucucccucuugagcuaggaacccagaggaggaggccucaauagagcacugc

SEQ ID NO: 386358 - RNA, 64 nt, Human
gaugaacuugaagauuacauaaaagugcagaaagccagaggacuagagccaaaaacuuguuuca

SEQ ID NO: 386359 - RNA, 64 nt, Human
gaugaacuugaagauuacaucaaaguacagaaagccagaggacuagauccaaagacuuguuuca

SEQ ID NO: 386360 - RNA, 64 nt, Human
aaugagugugcagauuacaucaaugugcagaaagccagaggacuagaggccaagacuuguuuca

SEQ ID NO: 386361 - RNA, 64 nt, Human
aauguaaaccucaaauuaccucuggaucucuuagccagaggaauaaacuggcaauuauuacaga

SEQ ID NO: 386362 - RNA, 64 nt, Human
aaguugaggaaguggaggcugguaaagagcaggaccagaggaagaauccagauuuccuuaugcu

SEQ ID NO: 386363 - RNA, 64 nt, Human
gucaaaaguucacaaugccauacaggcucuucacccagaggaucuggaaagaagaaagauauaa

SEQ ID NO: 386364 - RNA, 64 nt, Human
uaucacuuccccgucuucuccagaacuugugucuccagaggaguacgccgacuucagcagcuuc

SEQ ID NO: 386365 - RNA, 64 nt, Human
cacugccagaggggcccuggguucugccauauacccagaggagccuuucucaguguguuucuaa

SEQ ID NO: 386366 - RNA, 64 nt, Human
uccuuuuucucagaucaucugggaggaauucaccccagaggaagggaaaggcuaccgcgaagag

SEQ ID NO: 386367 - RNA, 64 nt, Human
uaccagagcccaguaagaacugcugucaugaaggaggggccaccuuguaagagacaucauuacu

SEQ ID NO: 386368 - RNA, 64 nt, Human
ccucgcugccagcucuguaucaggacccagaggaaggggccagaggcucguugacuggcugugu

SEQ ID NO: 386369 - RNA, 64 nt, Human
aacuaauucauuguuaggagaucaaucaggaauuaggggccaucuuaccuaucuccugacauuc

SEQ ID NO: 386370 - RNA, 64 nt, Human
ccaggucucccuggggagguagaggcacgggauaaggggccagggucagagguccagccucuau

SEQ ID NO: 386371 - RNA, 64 nt, Human
uccauuuccucucauuccauucauggguggacagcgaccacaaagacucauggggcuucccugg

SEQ ID NO: 386372 - RNA, 64 nt, Human
cggccucccaaaguucugggauuacaggugugagcgaccacauccggucaaguucugacuuuuc

SEQ ID NO: 386373 - RNA, 64 nt, Human
auggaacaaagacagauaccuucagaggguuuugcgaccacaagcuucaugaugucuuaauugc

SEQ ID NO: 386374 - RNA, 64 nt, Human
gacaaaaucagcuuuacaacaaucccuagaggcucgaccacagaauaaugccagucaccacccu

SEQ ID NO: 386375 - RNA, 64 nt, Human
ggcacggugguacugggggugcggcagggacacccgaccacaccagagcgugggagacgguggg

SEQ ID NO: 386376 - RNA, 64 nt, Human
ucuuacugcaucagaccuuccuuaagaaugaaaccgaccacauggagggaaaaagaaaacaauu

SEQ ID NO: 386377 - RNA, 64 nt, Human
uugcuguagugaagagacccacuccaaauaaaaaaggggccacacggggcuucuaaguuagguu

SEQ ID NO: 386378 - RNA, 64 nt, Human
gcaccugcuccauagcuccgggcgcugcgucccgaggggccacagucuccauuucagcgucuug

SEQ ID NO: 386379 - RNA, 64 nt, Human
uccuagccuccuauaaggcccaggaagagggcagaggggccagaaggacuccauggcccaaaga

SEQ ID NO: 386380 - RNA, 64 nt, Human
guugccacagccugugcuccugguccucaccuggaggggccagcaggcugccgucccaccacac

SEQ ID NO: 386381 - RNA, 64 nt, Human
aagugcugggauuccaggugugagccgcugcggccgaccacauuugauguuugaaguuguaauc

SEQ ID NO: 386382 - RNA, 64 nt, Human
caacaaaaugaaacgcaaccaccaccaaccacugcgaccacaagaaggaugauucaacagguuu

SEQ ID NO: 386383 - RNA, 64 nt, Human
gucccccagccggcuggguggcucuggggccaaccgaccacaggugucacugaucacagguguc

SEQ ID NO: 386384 - RNA, 64 nt, Human
ugcugugauuaacgaguaacuccaaguacaaggccgaccacaauggaugcugcaaaaacguuga

SEQ ID NO: 386385 - RNA, 64 nt, Human
ugucagcaauagugaccucauuaccaagggguggcgaccacauuaccaagcgcaauuccccauu

SEQ ID NO: 386386 - RNA, 64 nt, Human
cugucuugcccgccugcccgccugccccuccugccgaccacacggaguucagugccuggguguu

SEQ ID NO: 386387 - RNA, 64 nt, Human
ccugcgcuaccgucuguggucucaauaaagaaaccgaccacauggccccggacuccuacgugcc

SEQ ID NO: 386388 - RNA, 64 nt, Human
gguguugccaacucuuggcagcacugggccaaaccgaccacauaccaugagcucccaaauggcg

SEQ ID NO: 386389 - RNA, 64 nt, Human
caaaaucugaaagcuaacaccccacuuugacccucgaccacaccugaaaaugucucaaaucucc

SEQ ID NO: 386390 - RNA, 64 nt, Human
uguagugauugauccuuaccuuguauaucaucuucgaccacaucagaaagaaggaaucauauuc

SEQ ID NO: 386391 - RNA, 64 nt, Human
ggugcuuuggcccuaauagcacuggacaacaccacgaccacauggaaacauauuuuuggaagca

SEQ ID NO: 386392 - RNA, 64 nt, Human
uguugacagggagccaaggcgaggcggcugucugcgaccacagcagccucgaaacaccaggcag

SEQ ID NO: 386393 - RNA, 64 nt, Human
cuuuaacagggauccaagaucuuugcaguucaaucgaccacauaggaauuuccaggcaccaaaa

SEQ ID NO: 386394 - RNA, 64 nt, Human
ggagguuaagugacuugcccaguuucagggcuaacgaccacagggucugcacucuaacccuagg

SEQ ID NO: 386395 - RNA, 64 nt, Human
ccugagcuuacaaagcauggcaggccaagggccucgaccacaggccagcauuagcagaacauau

SEQ ID NO: 386396 - RNA, 64 nt, Human
caucaagccaagccuccugugguccugagcaugaaggggccaggggaccuccugggagaugcag

SEQ ID NO: 386397 - RNA, 64 nt, Human
aagccuuucuuaguggugcccacaguuggagcccaggggccauguuugcaaacugauucaugug

SEQ ID NO: 386398 - RNA, 64 nt, Human
cuuccugaagccaggacuuccccaugggaagugcaggggccacugggcagccugagggcugacc

SEQ ID NO: 386399 - RNA, 64 nt, Human
gugcuuaugguggguguuuuugcggggcugcaauaggggccaaaagucagggaaaggggcacug

SEQ ID NO: 386400 - RNA, 64 nt, Human
ggcccucccuggcucccugucccugggcucagcacgaccacacaggacacccagccagggaauu

SEQ ID NO: 386401 - RNA, 64 nt, Human
ggagagacacccccauccccacgcgggccgggcacgaccacaccgggcggaccgcuggacagac

SEQ ID NO: 386402 - RNA, 64 nt, Human
agcgacguauuuccuguuguagucauuuuuagcucgaccacaucaucaggucuuugccaccgag

SEQ ID NO: 386403 - RNA, 64 nt, Human
gggugcugcuggacggcaagcccaucagcgccuacgaccacaaguacuugcaccgugugguaug

SEQ ID NO: 386404 - RNA, 64 nt, Human
guaaaaucugguauuuacuggcuuacacucaaaacgaccacaguccuaccucaguucaagguaa

SEQ ID NO: 386405 - RNA, 51 nt, Human
cugaugaucauguuuuaugaccgaccacacguguccuaagcagauugcuua

SEQ ID NO: 386406 - RNA, 64 nt, Human
ggugaagaaaagugaacgcccuuguagagcagcccgaccacaggagcauggccgcugccagccc

SEQ ID NO: 386407 - RNA, 64 nt, Human
ugggucucccuccgagucacucugcagcuuggcccgaccacaaacaggacagagccaggcuguu

SEQ ID NO: 386408 - RNA, 64 nt, Human
cuccagcuuuccugguuagcgcaacgcggcuccacgaccacacgcacuucaggguggaagcugg

SEQ ID NO: 386409 - RNA, 64 nt, Human
gcggcuucucugccauuagcagcccugggcgggccgaccacacucgaggcugcggugcuacggg

SEQ ID NO: 386410 - RNA, 64 nt, Human
gccuguguccaggccuacucccuggucucaccuccgaccacagucggcggcaccuucucagagu

SEQ ID NO: 386411 - RNA, 64 nt, Human
ccucuaccaucuguaaacaacugggugccuuccccgaccacaccccaaugccuucccagcuugg

SEQ ID NO: 386412 - RNA, 64 nt, Human
guucugaaaggagacauugcucuaugucugccuucgaccacagcaagccaucauccuccauugc

SEQ ID NO: 386413 - RNA, 64 nt, Human
aguggacuuuuugcgggguguggcggccgggucucgaccacagcguggaucaccggcuguuuag

SEQ ID NO: 386414 - RNA, 64 nt, Human
cgauuuuuccccaggcuuuccuguagcccauguucgaccacaugcaccucgagcaacacuugug

SEQ ID NO: 386415 - RNA, 64 nt, Human
cagagauggugccgucauugcuggcuuaaagacaaggggccaggagccaacaccagaggccacu

SEQ ID NO: 386416 - RNA, 64 nt, Human
gcuggcccgcagacacguggguuucaucacucugaggggccacgucuguuaguuuccuaucauu

SEQ ID NO: 386417 - RNA, 64 nt, Human
uuuuuaaccaaaaagagaugacaaaacuaaguucaggggccauggaaaaugaaaaaguccgcua

SEQ ID NO: 386418 - RNA, 64 nt, Human
gguuuccauagugauaaagacaaggaaacgcugcaggggccacaggcacaggcugauauuuaaa

SEQ ID NO: 386419 - RNA, 64 nt, Human
cacccagcaggcgcaaccagagucucgugugugccgaccacaggagccaagccuuuuccacugu

SEQ ID NO: 386420 - RNA, 64 nt, Human
cccugauggcucucaccaccauggcgucacuccgcgaccacagcacaccagaaacacucagcau

SEQ ID NO: 386421 - RNA, 64 nt, Human
uucagagagagagagggagucaaggugugaccgucgaccacagccagugucaggccucugccuc

SEQ ID NO: 386422 - RNA, 64 nt, Human
ugcuacacucugacacaaacauuuacugcuggaucgaccacaaagcagauguggcuucuuaggu

SEQ ID NO: 386423 - RNA, 64 nt, Human
uugcuugaggcuccagacauacucaccucuaccucgaccacaucaaccccaucaccaagaggag

SEQ ID NO: 386424 - RNA, 64 nt, Human
gccuuccucccuggguuugucuggacaccgagagcgaccacauccuggagaagccaggagaaaa

SEQ ID NO: 386425 - RNA, 64 nt, Human
cuaagcauuuucacagccguuucuucauauaauccgaccacagugggaggugugauuuacccau

SEQ ID NO: 386426 - RNA, 64 nt, Human
gcauugcuguugaauggugagcacgugaccaugccgaccacaaaggugucugcggaaacucgag

SEQ ID NO: 386427 - RNA, 64 nt, Human
cacugaacacgcgugugugcaucgcacgcggccacgaccacagacacgcaugcacacacgcaga

SEQ ID NO: 386428 - RNA, 64 nt, Human
uguuccucugccuggccauccugcuggagcaccgcgaccacaucaugcgcaaugggcuggauua

SEQ ID NO: 386429 - RNA, 64 nt, Human
uuggccacgucuuccuucugccugagcuuccccccgaccacaggcccuuuccucaggcaagguc

SEQ ID NO: 386430 - RNA, 64 nt, Human
acucagugcaaauauagcugcauuuauaccucagaggggccaaguguuaaugcccaugcccucc

SEQ ID NO: 386431 - RNA, 64 nt, Human
ggagucuagacuggaccuaggagcuugaguugucaggggccaggacuggccccacugcagugcc

SEQ ID NO: 386432 - RNA, 64 nt, Human
agucuccagagauggggccuggaggccuggaggaaggggccaggccucacauucguggggcucc

SEQ ID NO: 386433 - RNA, 64 nt, Human
cauaaauaagcaaauguggcaggcuuugcuuucuggaucccaggauuaaaacuaaccgugacca

SEQ ID NO: 386434 - RNA, 64 nt, Human
cccuccugcacuccuccagcuggagucucaccgcggaucccaggaauaccugcuguucccacag

SEQ ID NO: 386435 - RNA, 64 nt, Human
ggggcuuguacagaagagacaguccaaggggacuggaucccagcagugauguugguugaggcag

SEQ ID NO: 386436 - RNA, 64 nt, Human
uggcuugacccccuguggaggggagugccugguuggaucccacacuggcagagauggggccacc

SEQ ID NO: 386437 - RNA, 64 nt, Human
cuggggcucucugagacucuuuagagcagcuuugggaucccacccuggggacccccacgauugg

SEQ ID NO: 386438 - RNA, 64 nt, Human
ugguccuuccccugcccauggagagcucuuuaagggaucccagccugccccuccacuucucucc

SEQ ID NO: 386439 - RNA, 64 nt, Human
agggacuggcagagcugaggccaccuggggcuggggaucccacucuucuugcagcuguugagcg

SEQ ID NO: 386440 - RNA, 64 nt, Human
accucuuaaugccuguggagggacuggagcugcuggaucccaguguggugguguaggaggccac

SEQ ID NO: 386441 - RNA, 64 nt, Human
caacugacuagcagccccagagcccucacccugcggaucccagccuaaaagacaccagagaccu

SEQ ID NO: 386442 - RNA, 64 nt, Human
agcagggggucuuuauauucccugcagaaacccuggaucccacuccacugaggaaaauccuuuc

SEQ ID NO: 386443 - RNA, 64 nt, Human
gcgugccuucaucucagauuuguucaucacagguggaucccaugugucuucaguagacaaguca

SEQ ID NO: 386444 - RNA, 64 nt, Human
ugugucucaggggacuccaggaggagcagaagagggaucccacgaaguuauucuuacgcagcug

SEQ ID NO: 386445 - RNA, 64 nt, Human
uccuucagaguguccuagagaaccucccagguguggaucccaacaaugaagccauucgaaaugc

SEQ ID NO: 386446 - RNA, 64 nt, Human
cuggugaccugcagaauccuaagcgagccagacaggaucccacauagcagcagcgggaagugug

SEQ ID NO: 386447 - RNA, 64 nt, Human
cugccauaaacugauacaucgcaccccucuuuuaggaucccauaguuucaauucauguaaguuc

SEQ ID NO: 386448 - RNA, 64 nt, Human
ugagaacaugccauacccuggugcugaaucccugaggggccagcuugccaggcuuaagccaaau

SEQ ID NO: 386449 - RNA, 64 nt, Human
ucuaguuuugaagcaaagauggacuucaguggggaggggccaaaaccguuguuguguuaaaauu

SEQ ID NO: 386450 - RNA, 64 nt, Human
aguccugccuggcccuacgaugaggccacucaugugggccuagguaggggaggauggugccugg

SEQ ID NO: 386451 - RNA, 64 nt, Human
gggcugaggcugaguuguuccccgccacuguugaggaucccaucugacauuuggggauucacug

SEQ ID NO: 386452 - RNA, 64 nt, Human
ugauacccauuagagccccgagaauuccucuucuggaucccaguuugcagcaaaccccacaccc

SEQ ID NO: 386453 - RNA, 64 nt, Human
agacccucuguuuggagcauuauuaguagagugaggaucccaccaguucugccuggcuuccucc

SEQ ID NO: 386454 - RNA, 64 nt, Human
gggacuggccugagaccggggcacaggguaggggggaucccaacacuccucccuguggaggagg

SEQ ID NO: 386455 - RNA, 64 nt, Human
uuucuuggcguguuuaaauccucaugucuuugagggaucccaccacaggugaaggaaguaaaga

SEQ ID NO: 386456 - RNA, 64 nt, Human
gccccccagggccuaucgugggagagccugggcaggaucccaucagaaaggugcugacuaaacu

SEQ ID NO: 386457 - RNA, 64 nt, Human
caugccucagcacugucacuuuuaaaaccugucaggaucccacuguaaaauuggaaaugggcag

SEQ ID NO: 386458 - RNA, 64 nt, Human
accaguacagacaugccaguuaguuuuacuagugggaucccaaauccaaagcaguguaguggug

SEQ ID NO: 386459 - RNA, 64 nt, Human
cccucacacacuugucugugcuaugauguaugcaggaucccagcauugauacccaaugacaaac

SEQ ID NO: 386460 - RNA, 64 nt, Human
uuccuggaggagccugcugcauucuccugcugagggaucccagagagggcaggugcccacccca

SEQ ID NO: 386461 - RNA, 64 nt, Human
cucccuuccuccuccuccuccuccuccggaggugggaucccagagccugccaguggaggcuuau

SEQ ID NO: 386462 - RNA, 64 nt, Human
uagcaucauuuugcuguugugccaguuaaucauaggaucccauuaaauaagugugcuaacaucg

SEQ ID NO: 386463 - RNA, 64 nt, Human
uugcacaauuugaaaguaaugcuuuuccugagcuggaucccaguguugccuuaacagggugucu

SEQ ID NO: 386464 - RNA, 64 nt, Human
cuucuguugcgccacugagacggcagagaccccaggaucccagagcuucccaggaucccuccca

SEQ ID NO: 386465 - RNA, 64 nt, Human
gaaccuacggccgagaaggaauguugcaugagucggaucccaguccauugucaguggaggguga

SEQ ID NO: 386466 - RNA, 64 nt, Human
ccugcugucuuccccucccucaaccccaauaggaggaucccaggauaaacacugcugggcaggc

SEQ ID NO: 386467 - RNA, 64 nt, Human
gauaaauugccaaagagugggaacagguggggucaggggccagagugcaggggagggggcaaug

SEQ ID NO: 386468 - RNA, 64 nt, Human
aucacagugacaaaagagccagggcuagggcuggaggggccaggugaucuuccuuagccaaucc

SEQ ID NO: 386469 - RNA, 64 nt, Human
cuggccugaacccgccggugugggccacaguaggaggggccagcaguccucccugucccaugcc

SEQ ID NO: 386470 - RNA, 61 nt, Human
aggaaccauccauaugcugaagcuucuacuaggaucccaguuuugccgcagauaauuaaug

SEQ ID NO: 386471 - RNA, 64 nt, Human
cugaagggcugcccacccacagccagaauccacaggaucccaccgagaaggagagccaggugug

SEQ ID NO: 386472 - RNA, 64 nt, Human
uuguggacacaggagcuccuccaggagcaggcugggaucccaacuaucgcuuguugccucuuuu

SEQ ID NO: 386473 - RNA, 64 nt, Human
cagcaguaggacuauaaaccacagcugucccccaggaucccacuccuuuccugucuguguggug

SEQ ID NO: 386474 - RNA, 56 nt, Human
ccgaagucucccuggucugaccaccaggaucccaggggcccaaggcggccccuccc

SEQ ID NO: 386475 - RNA, 64 nt, Human
gugccucccaggccugcugugguucugacacacaggaucccaggcaaggcaccacuuccucaca

SEQ ID NO: 386476 - RNA, 64 nt, Human
cuaacuggagaagggcgguauccaccccacauucggaucccaggguccugaggccucgcauuga

SEQ ID NO: 386477 - RNA, 64 nt, Human
gaaagagcaaaagaggugggagcgaaagccuuaaggaucccacgacuuuuuacugccaucugag

SEQ ID NO: 386478 - RNA, 64 nt, Human
ugcaggaggcccacagauaagcuggcaagaggaaggaucccaggcacaugguucaucacgagca

SEQ ID NO: 386479 - RNA, 64 nt, Human
uacacuagaaaucagccagaaggaagcguccuugggaucccagaucacucuuuuuuuuuuuuuu

SEQ ID NO: 386480 - RNA, 64 nt, Human
guuacccaccagguuaucccaugcaggccuauguggaucccagcaacccuaaugcuggaaaggu

SEQ ID NO: 386481 - RNA, 64 nt, Human
guccacagguggacucuggggaagccaggccccuggaucccaaguccuuuguguccggagccuu

SEQ ID NO: 386482 - RNA, 64 nt, Human
gcagccacccugucaccuagcucaauggagccccggaucccaagcccugcauuguaagcccaca

SEQ ID NO: 386483 - RNA, 64 nt, Human
gugucccagugggguuggggugagcaggcugcugggaucccauggccugagcagagcauguggg

SEQ ID NO: 386484 - RNA, 64 nt, Human
aagagaucuaaugaggaggcacagaccagugucuggaucccagcaucuucuccacuucagcgcu

SEQ ID NO: 386485 - RNA, 64 nt, Human
cuugagcccaggagugcaaggcugcaaugagccaggaucccaugaucacacaucuguauuccag

SEQ ID NO: 386486 - RNA, 64 nt, Human
ggccuuuucgugugaaacaucuucagggcgggaaaggggccacuucuggcuuuguuagcaauaa

SEQ ID NO: 386487 - RNA, 64 nt, Human
uggcucauuuucuggcaaauggaggcacgaacgcaggggccaaauagcaauaaauggguuuugu

SEQ ID NO: 386488 - RNA, 64 nt, Human
cugcacagggcauucaggcaagugcaagugguucaggggccagcgcagagcagagugcugagua

SEQ ID NO: 386489 - RNA, 64 nt, Human
gagggagcacuggugggugcucugaaaacccacaggaucccaccuccaggcccaccuggguccc

SEQ ID NO: 386490 - RNA, 64 nt, Human
uuggagcuuugcaauucuuuuuggaaaagagcugggaucccacagcccuaguaugaaagcuggg

SEQ ID NO: 386491 - RNA, 64 nt, Human
ggaauuuaucuucaggugaagaagagaggaagcaggaucccacugagcaccucuugcagaaggc

SEQ ID NO: 386492 - RNA, 64 nt, Human
caaaaccauagggaaaaaguucacugcuacaaagggaucccaacccacuggaggcuuugaagua

SEQ ID NO: 386493 - RNA, 56 nt, Human
aggacgugccccuucaguagagucggggaucccagccccagagcgggggagggcgc

SEQ ID NO: 386494 - RNA, 64 nt, Human
auugaccaagccagacccgguucacccagcucgaggaucccagguugaagaguggccccuugag

SEQ ID NO: 386495 - RNA, 64 nt, Human
cucagauccugggcaugaugggccgagccaccucggaucccacugauuggccagccgagcgaga

SEQ ID NO: 386496 - RNA, 64 nt, Human
cguggucagggcagggcucauucauugcccacuaggaucccacuggcgaagauggucuccauau

SEQ ID NO: 386497 - RNA, 64 nt, Human
cagauagcacuacgauguauuccgcuucugaacaggaucccaugccaguguggaacaccuuccc

SEQ ID NO: 386498 - RNA, 64 nt, Human
aguagagugaggcugccucucccgccaggcauugggaucccauuuagaaacggcauucacuuca

SEQ ID NO: 386499 - RNA, 64 nt, Human
guaaaggaugucugcucuguucaaaaggcagcugggaucccagcccacaagugaucagcagagu

SEQ ID NO: 386500 - RNA, 64 nt, Human
aaugaccaccacagggagcucagaccccaacccuggaucccaggagaaaggaguggaccgagga

SEQ ID NO: 386501 - RNA, 64 nt, Human
uaauauagguauuuuagaaugugaauugaagaauggaucccaaaaacuucagaaagaggauagc

SEQ ID NO: 386502 - RNA, 64 nt, Human
auaaucuccaggaugccugugaagaaagaucccuggaucccaggaugauuauaggacaaguugu

SEQ ID NO: 386503 - RNA, 64 nt, Human
gaggugagcgugugugcucucagggaagggcccaggaucccaugccugggaggagcugccagag

SEQ ID NO: 386504 - RNA, 64 nt, Human
ucguggccgcgggacuggccccggggggcccccuggaucccaggccagcgcuuugcucuccugc

SEQ ID NO: 386505 - RNA, 60 nt, Human
agaaaacucaagcagugugaauggguucccaggggccauuggagucccugaaggacccag

SEQ ID NO: 386506 - RNA, 64 nt, Human
gcuagccucccugcagggaccccgggccggcugcaggggccaacaagaggucagcuuugcccag

SEQ ID NO: 386507 - RNA, 64 nt, Human
uuauugcaauuaagugaucaaguacagacacaauaggggccaguuuuguuuaaggaucaaagag

SEQ ID NO: 386508 - RNA, 64 nt, Human
uguucgccuuuuacauauauuugcucuucaguauggaucccaauuugaauguuacauguucgga

SEQ ID NO: 386509 - RNA, 64 nt, Human; identical to SEQ ID NO: 386502

SEQ ID NO: 386510 - RNA, 64 nt, Human
ccuccucuucuggucuggcggcugugcaucagugggaucccagacauuuguuucuguaagauuu

SEQ ID NO: 386511 - RNA, 64 nt, Human
aaccuggcuacagcguuuucuaugaaaucuacuuggaucccaugccugaaauuuggaagcauau

SEQ ID NO: 386512 - RNA, 64 nt, Human
aauacaacccuuuugcccauuuacccuucuccccggaucccaagguggucuguugcucuggcuu

SEQ ID NO: 386513 - RNA, 64 nt, Human
acuugggaaggugagggauucaggggaggucagaggaucccacuuccugagcaugggccaucac

SEQ ID NO: 386514 - RNA, 64 nt, Human
caucugagaaccgcugcucugagauggcaggaauggaucccacgcaaaugaaucgcaccccaag

SEQ ID NO: 386515 - RNA, 64 nt, Human
gaaguccuucaccucacugaaaacaucuggaaggggaucccaccccauuuucugugggcaggcc

SEQ ID NO: 386516 - RNA, 64 nt, Human
uuaggaagucucaucugccugaaaaugacuguguggaucccacccaaauccaacucauccuggu

SEQ ID NO: 386517 - RNA, 64 nt, Human
cacaugaagguggagugugaccuugaugugaccgggaucccacucugauugcauccauuucucu

SEQ ID NO: 386518 - RNA, 64 nt, Human
aaauuucaaacagaaguagagaagauccucuaauggaucccagugugcccaucccucaaccucc

SEQ ID NO: 386519 - RNA, 64 nt, Human
ccucacaugaagggaagggcaucuccaugaugguggaucccaaaaccccucugggucgcacccu

SEQ ID NO: 386520 - RNA, 64 nt, Human
cccacagguccaugggagcuugaggcaguaagggggaucccaggcacccaucucaaggaguggc

SEQ ID NO: 386521 - RNA, 64 nt, Human
uggggacucugcugucccugggcuugcaucccagggaucccagaguggccugccuaucacaacc

SEQ ID NO: 386522 - RNA, 64 nt, Human
ugaggagagcaaagcacaagcuugccugaagaauggaucccaacuucuccccggcagcucugcc

SEQ ID NO: 386523 - RNA, 64 nt, Human
cuagagaugguauugucuacagucaugucuuaauggaucccagcucugucauggugcuaucuau

SEQ ID NO: 386524 - RNA, 64 nt, Human
ucugccccuuccagcuggagccgcccgugccuccaggggccaagaggaugaugucguggccucc

SEQ ID NO: 386525 - RNA, 64 nt, Human
gaccggugucuugcucuagggcaacccagggcagaggggccaggucugcccagcguuuaccacu

SEQ ID NO: 386526 - RNA, 64 nt, Human
aagagaggaagagagggaggagggguaggacugcaggggccacuccaaacucgcuuagguagaa

SEQ ID NO: 386527 - RNA, 64 nt, Human
aacccaaauuggacauuccagacuaccaccaacuggaucccagcugccuuccugggcuugugcc

SEQ ID NO: 386528 - RNA, 64 nt, Human
uugcuuguggcgccuuccucaucucuauauaggaggaucccaugaaugaugguuuauugggaac

SEQ ID NO: 386529 - RNA, 64 nt, Human
cagauccuguggaaggcccuugguguuacacgauggaucccaaagucagaugggaguacugcaa

SEQ ID NO: 386530 - RNA, 64 nt, Human
cggauuguucggcaggcccuugguguuauacaacggaucccaaagucaggugggaguacugcaa

SEQ ID NO: 386531 - RNA, 64 nt, Human
auagagcaagaccccaacucaaaaaaaaaaaaaaggaucccacgguucaccuugugcugccacg

SEQ ID NO: 386532 - RNA, 64 nt, Human
uucaaaaguugacucuccuguggcucaugccacaggaucccagcacuuugggaggccgaggcag

SEQ ID NO: 386533 - RNA, 64 nt, Human
ucuuuccuccaauaaagacagaugucaucacaauggaucccaaagacaauuguucaaaagaugc

SEQ ID NO: 386534 - RNA, 64 nt, Human
gcugggcugguccucccaucuucaccucgggccuggaucccaggccucaaaccagcccaacccg

SEQ ID NO: 386535 - RNA, 64 nt, Human
aagaaaggccaaggugcuggacuguuacugacuuggaucccaaagcaaggagaucauuuggagc

SEQ ID NO: 386536 - RNA, 64 nt, Human
cuccugguuuguccaucuacugcuuugauuccuuggaucccacccauucuuucacuuuaagaaa

SEQ ID NO: 386537 - RNA, 64 nt, Human
ugaagccaccaucgaggccacacucagcacuccaggaucccagcgaugucagacacucuugagu

SEQ ID NO: 386538 - RNA, 64 nt, Human
caguaauuuuaaaauauauuauucauaaguucaaggaucccauauaguauaagaauauaauuuc

SEQ ID NO: 386539 - RNA, 64 nt, Human
agaaacagaacuguuauuugcaguguuaggucuaggaucccaguucuaguaggacagcccugca

SEQ ID NO: 386540 - RNA, 64 nt, Human
ccuuuccagacuccagggcuccccgggcugcucuggaucccaggacuccggcuuucgccgagcc

SEQ ID NO: 386541 - RNA, 64 nt, Human
gucgaguaauuaucaauaauuuuuuuuaaaaagaggaucccaaacuguaaaagauugaaauaau

SEQ ID NO: 386542 - RNA, 64 nt, Human
gcagauggacuucuucaguguccuucacggcacuggaucccaucaaagaaccuugaagaagugg

SEQ ID NO: 386543 - RNA, 64 nt, Human
aaaaagaaaaucuggacaauagauguggacuccaaggggccacugccaucccuuccugugugcu

SEQ ID NO: 386544 - RNA, 64 nt, Human
gucuccaguggggucagugagcacaauuccagccaggggccacuuggaccaagcuccagucagu

SEQ ID NO: 386545 - RNA, 64 nt, Human
ucagaguuucagggcuaacccccagaauacugguaggggccaaggccaugcuccccuugggaaa

SEQ ID NO: 386546 - RNA, 64 nt, Human
cccccagcucaggaaggaaagcccagcccuuucuggaucccacaguguaugggagccccugacu

SEQ ID NO: 386547 - RNA, 64 nt, Human
gcccuggaccugccauccucccacuugcagugcaggaucccacugcugccaaagagaugggaca

SEQ ID NO: 386548 - RNA, 64 nt, Human
uuguguugagauccagugcaguugugauuucuguggaucccagcuugguuccaggaauuuugug

SEQ ID NO: 386549 - RNA, 64 nt, Human
gggccccugcgcagacugucagagucauuaagcgggaucccagcaucucagaguccagucaagu

SEQ ID NO: 386550 - RNA, 64 nt, Human
gccucugugcagacagugucagagucauuaagcgggaucccagcaucucagaguccagucaagu

SEQ ID NO: 386551 - RNA, 64 nt, Human
cacucccugaucagccagcacucuggaagcuuugggaucccaggaaccauggaauuauucccaa

SEQ ID NO: 386552 - RNA, 64 nt, Human
gggccuguugccagcuaugccuuugagaaccucgggaucccaaagaaugaggggaauuucuuca

SEQ ID NO: 386553 - RNA, 64 nt, Human
caccgcuuuguacauagcaccgugcuaggcucugggaucccaaauggacccuuuuaacuuucug

SEQ ID NO: 386554 - RNA, 64 nt, Human
ggggccagcaauacuccagagcccaguuucugcuggaucccauggguggcacauugggacuucu

SEQ ID NO: 386555 - RNA, 64 nt, Human
accugucuuucaucgggagaaaccacucagagauggaucccauucccuaaaggucucacagcaa

SEQ ID NO: 386556 - RNA, 64 nt, Human
auggucucacguggcaagaagugccuuuagcucuggaucccaaccguuuggcacagcuuuggcc

SEQ ID NO: 386557 - RNA, 64 nt, Human
agcucccgagcacagccgcacuccuguugacccuggaucccacccuuugagccugaccccacug

SEQ ID NO: 386558 - RNA, 64 nt, Human
ugauauuaagggaaacuaaagaaaauguuauuguggaucccacaguacuauauuacacuguuuu

SEQ ID NO: 386559 - RNA, 64 nt, Human
ucuuccucuuaugaccagaguucugugcauaacaggaucccauaccaaagcccugugaguucau

SEQ ID NO: 386560 - RNA, 64 nt, Human
gaccuaaguccaccucaccuagagccuggaauuaggaucccagaguucagccagccuggggucc

SEQ ID NO: 386561 - RNA, 64 nt, Human
aacuuucaacucuuugccuuuccuggccuuuacuggaucccaaaagcauuuaagguacauguuc

SEQ ID NO: 386562 - RNA, 64 nt, Human
guuaagguggaggcugauucuaauugucugguugaggggccacaccaccuauuccccccaccua

SEQ ID NO: 386563 - RNA, 64 nt, Human
caccccgcuucccuuggaaucccugagggguagaaggggccagaaaaaacgcuuauaaaaccag

SEQ ID NO: 386564 - RNA, 64 nt, Human
aucucacucaggaagggaggcucaauguaaccucaggggccaguuuuagcauuugaaaugguuc

SEQ ID NO: 386565 - RNA, 64 nt, Human
uagauauuauuugaaaugcuggcacugucuaucuggaucccagggcuugaacuaggauuugagg

SEQ ID NO: 386566 - RNA, 64 nt, Human
ucaguaccucacgcaugguccccagcuucuccuaggaucccaguggcguuuaucaguggccagc

SEQ ID NO: 386567 - RNA, 64 nt, Human
gcugaaagguuaauucucuagggcuaguagaacuggaucccaacaccaaacucuuaauuagacc

SEQ ID NO: 386568 - RNA, 50 nt, Human
uaaaguccagaaggcaguagggaucccaagacgaccucacccaaagggcu

SEQ ID NO: 386569 - RNA, 64 nt, Human
ggagcgggggcuggcuagcgggccccccagccagggaucccagaggcugaggguuggggagagg

SEQ ID NO: 386570 - RNA, 64 nt, Human
cacuggauucguauggcuaacgucagugaaucaaggaucccaggggaugccaauggcagggcac

SEQ ID NO: 386571 - RNA, 64 nt, Human
auccauuguuccuggaaaggugaucccuaccacgggaucccaaacuuggauagagccaguucaa

SEQ ID NO: 386572 - RNA, 64 nt, Human
ugugccucagcugcugucacaaauacccaucuuaggaucccaucagcuucccaucccccaccag

SEQ ID NO: 386573 - RNA, 64 nt, Human
ccuccacucuaaagagacaucaucuuacagauugggaucccagccuucucaccagguaagaccu

SEQ ID NO: 386574 - RNA, 64 nt, Human
agcaggacuuccuacccagaggagguucgagcuaggaucccacugcccccgccucucagcacag

SEQ ID NO: 386575 - RNA, 64 nt, Human
ggcccucagauuagaugaaaaacuugcuccugguggaucccaagggacccucaaggaccucgag

SEQ ID NO: 386576 - RNA, 64 nt, Human
ugcuggugggaggacagugccaaccuccuccuggggaucccauguuggagacucuaaggauaag

SEQ ID NO: 386577 - RNA, 64 nt, Human
ucugucaaguacaauaacauuuuuaaaagaaaauggaucccacuguuccucuuugccacagaga

SEQ ID NO: 386578 - RNA, 64 nt, Human
acucugaaccaccuuugucucugcagaggcauccggaucccagcaagcgagcuuuagcagggaa

SEQ ID NO: 386579 - RNA, 64 nt, Human
cugcccccuuccugccagaccggaggggcuggggggaucccagcagggggagggcaaucccuuc

SEQ ID NO: 386580 - RNA, 64 nt, Human
acauuugacagugugggaggccucguaccagccaggaucccaagcgucccgucccuuggaaagu

SEQ ID NO: 386581 - RNA, 64 nt, Human
auaggauguggggaaguuaggaacuggugucuucaggggccacaccaaccuucugaggagcugu

SEQ ID NO: 386582 - RNA, 64 nt, Human
uugucauuucaaggcugcugaaaugcugcauuucaggggccaccauggagcagccguuauuuau

SEQ ID NO: 386583 - RNA, 64 nt, Human
gaggagaaggaggaggaggagagcgcgagugagcaggggccaaggcgccagaugcagacccagg

SEQ ID NO: 386584 - RNA, 64 nt, Human
uggagauggccaaaagagugagcucaggacuacuggaucccaugcccagguguccagcagaccu

SEQ ID NO: 386585 - RNA, 64 nt, Human
agugaggacugacucaaggucacacagugauccgggaucccagaacucuggucuccaaauuaca

SEQ ID NO: 386586 - RNA, 64 nt, Human
cauuggaaaagcaaaacgcucucacugagaucagggaucccaaauucaugggacuuauauaaga

SEQ ID NO: 386587 - RNA, 64 nt, Human
ucugguucacguuuacagagcauaaggcugucuuggaucccaacaggcacccagcccugcaugg

SEQ ID NO: 386588 - RNA, 64 nt, Human
uauuucucucugacccucuccccacugcucauuuggaucccaggggaguguucagggccagccc

SEQ ID NO: 386589 - RNA, 64 nt, Human
uggucuccacuggacacagagcuuuggagacggaggaucccagagggcagucucaguugcaauc

SEQ ID NO: 386590 - RNA, 64 nt, Human
cauuucauuauggauuuuggaguugugagugauaggaucccaaaauucaucucuaaugugguuu

SEQ ID NO: 386591 - RNA, 64 nt, Human
ccauaauuauuauuuccaguguuugggaugaccaggaucccaagccuccugcugccacaauguu

SEQ ID NO: 386592 - RNA, 64 nt, Human
ugcggggaccccagacugucagcacagggaagauggaucccauccuaauuuuuaucaccugaag

SEQ ID NO: 386593 - RNA, 64 nt, Human
cagggauggccagcugccagagcugcgggaagacggaucccaccucccuuucuuagcagaaucu

SEQ ID NO: 386594 - RNA, 64 nt, Human
aacauuuuaaagaugacguggagguggugaugagggaucccauauuguuuggagacuuccagau

SEQ ID NO: 386595 - RNA, 64 nt, Human
ucuguuuguacaaagguuuuccauucuauggagaggaucccagucuucagauucucugguaagu

SEQ ID NO: 386596 - RNA, 64 nt, Human
cgcagcuuccucccccgaccaaaccccaagaccuggaucccaggagacaacagucuccacagug

SEQ ID NO: 386597 - RNA, 64 nt, Human
guguccaccccucugauguguuggauaugccuguggaucccaacgaacccaccuauugccuuug

SEQ ID NO: 386598 - RNA, 64 nt, Human
uucccagugaacaagggggcauaggcuccucucuggaucccaccuuuucaucccuucugagaaa

SEQ ID NO: 386599 - RNA, 64 nt, Human
caggaguucaagaccggccugagcaacauagugaggaucccaucucuacgcccacccucccccc

SEQ ID NO: 386600 - RNA, 64 nt, Human
caaguggacagucuggccacugucaaggcagggaaggggccaugacuuuucugcccugcccuca

SEQ ID NO: 386601 - RNA, 64 nt, Human
auggagugcagggagccagcuggaagggaaggagaggggccagggaggccacaggcccggccau

SEQ ID NO: 386602 - RNA, 64 nt, Human
uggacauuucccuguuucgagccaggcucuuccaaggggccagcuggguccccggagucagucc

SEQ ID NO: 386603 - RNA, 64 nt, Human
ccccgggccccgccucauuccaugacccggcucuggaucccacacuguacuucccacagcccac

SEQ ID NO: 386604 - RNA, 64 nt, Human
accuucccuccccgcagagcacaaacacaaaguaggaucccagugcauuaggcagccagucucg

SEQ ID NO: 386605 - RNA, 64 nt, Human
uagaaaaaaaugcaagcaagcuguuaaagaucuuggaucccauuauauaguauguauagcugaa

SEQ ID NO: 386606 - RNA, 64 nt, Human
ucgggcugacggggguggcacacaggacacggguggaucccaacaggcagcaccgcaccucugc

SEQ ID NO: 386607 - RNA, 64 nt, Human
cagcucagaagaaugcagggcccauucagcauggggaucccagcacaucacuguagaauuugag

SEQ ID NO: 386608 - RNA, 64 nt, Human
uugaaccgugcaaccacaucugggucuaguagguggaucccauccaguugguuuccaaggguga

SEQ ID NO: 386609 - RNA, 64 nt, Human
gcccagccccgccuguccucagccagcacugcagggaucccaggcccagacucuggaggccuuc

SEQ ID NO: 386610 - RNA, 64 nt, Human
ccaguaauguaugucuacuggugggagacugugaggaucccaggauucaguauuccuggcccag

SEQ ID NO: 386611 - RNA, 64 nt, Human
cagagccucagcacugucugacuuugggaaccagggaucccacagaaauguuuuggagagcggg

SEQ ID NO: 386612 - RNA, 64 nt, Human
gagacauccagauggcacaccagaacuuaaugcuggaucccaugggaucgaugucugagguccc

SEQ ID NO: 386613 - RNA, 64 nt, Human
gauaguguccagccuuguauauuucugaagagguggaucccagaguggcucugauguccacauu

SEQ ID NO: 386614 - RNA, 64 nt, Human
caucucaguggaccaggaagcaagaggggaagcgggaucccagcuagacuuagaacuuggacuu

SEQ ID NO: 386615 - RNA, 64 nt, Human
gaacaagggccaggccccgcggagugucuuugguggaucccagauaacuccuaggugcugcucu

SEQ ID NO: 386616 - RNA, 64 nt, Human
auggaauaccaaggcacaacauaucaaacacauuggaucccacgauguuagacauagccauauc

SEQ ID NO: 386617 - RNA, 64 nt, Human
ggggccugggcuguccucucugaaugccuuggagggaucccaggaagccccaguaggagggagc

SEQ ID NO: 386618 - RNA, 64 nt, Human
ucuuggguccuguggauggugguucuucgugucaggaucccagcccgauucugcaaaugccucc

SEQ ID NO: 386619 - RNA, 64 nt, Human
ucugcaagugcaaagaccuugacaggaaagagggaggggccaagguaagaacugagaagggagg

SEQ ID NO: 386620 - RNA, 64 nt, Human
ccaaaggaggagauggcucagcggggcugcaccaaggggccaagaggcccuacccgugucuaaa

SEQ ID NO: 386621 - RNA, 64 nt, Human
acagagcgagacuucaucucagaaaauaaaaaauaggggccaggcacaguggcucauaccugua

SEQ ID NO: 386622 - RNA, 64 nt, Human
uccugauuaaacuucacuguguguuuucuaucucggaucccagucucugaagacaacuugcuuu

SEQ ID NO: 386623 - RNA, 64 nt, Human
uaaagaagccauuuccacuacagugagaaagcccggaucccaacaguugucaaauugauuaguu

SEQ ID NO: 386624 - RNA, 64 nt, Human
uugccuccagugcuguuagcuuaggcaaacagguggaucccauggcauccccauggaggaacca

SEQ ID NO: 386625 - RNA, 64 nt, Human
gaaaacgcuucuuucuccuccagcugaaucagcuggaucccaguguccuggcuguuuggugauu

SEQ ID NO: 386626 - RNA, 64 nt, Human
ugcaaucucucaacucaaaaauguauuaaaaauaggaucccaugagaacauuauacuggaaguu

SEQ ID NO: 386627 - RNA, 64 nt, Human
ccacguugcuggccuuuggggucaagaggaguagggaucccaggcugcccuggacuuagaccag

SEQ ID NO: 386628 - RNA, 64 nt, Human
gcagccuggggcugaugaagcagagauguucgcuggaucccaggcccuggcaccccucaggaaa

SEQ ID NO: 386629 - RNA, 64 nt, Human
aagccaauaaauagcauuaguagcuucuguggggggaucccagagccccuguauuuauuuuccc

SEQ ID NO: 386630 - RNA, 64 nt, Human
cuuggaaaccaggccugggccucaaaauggagauggaucccaggucuugugggacccugggaug

SEQ ID NO: 386631 - RNA, 64 nt, Human
aaauggagaaccagcccaugccucacagacaguaggaucccaguaaauauggguugaauaaaau

SEQ ID NO: 386632 - RNA, 64 nt, Human
gaccacagggccucccagcccaacaucuccagcuggaucccagggaaauaucagccuugggcaa

SEQ ID NO: 386633 - RNA, 64 nt, Human
cucugcccgggagcucaggaaccgaggcagggaaggaucccaugagcuccuuaaggcucuuuug

SEQ ID NO: 386634 - RNA, 64 nt, Human
gggcagaguggcagcauccuuuguaccuacagguggaucccacaacucauuugaccuuuaaccu

SEQ ID NO: 386635 - RNA, 52 nt, Human
ugaucuguauagacgacugacuggaucccaggccugcccuucacccaggccc

SEQ ID NO: 386636 - RNA, 64 nt, Human
gagagguguguguccacaggaaggggcuccguggggaucccaugaagggauuugagcucuuuca

SEQ ID NO: 386637 - RNA, 64 nt, Human
aguggaaggcgggggggcccuggccucugcaccgggaucccagugggaaccuucaugccuuauu

SEQ ID NO: 386638 - RNA, 64 nt, Human
gccugcaagggaugaggccaugggaauggagagaaggggccacccacugggcaccuaacaggac

SEQ ID NO: 386639 - RNA, 64 nt, Human
caaaccaagccaagagcacccuguccccauuccaaggggccagcagcacuuuggcccaaaguau

SEQ ID NO: 386640 - RNA, 64 nt, Human
gcccuugugggcggaccuccccugagccugucugaggggccagcccuuagugcauucaggcuaa

SEQ ID NO: 386641 - RNA, 64 nt, Human
ggggagagcaguggguucugggggggccugggcaggaucccagcucccuccccucugaggcuuc

SEQ ID NO: 386642 - RNA, 64 nt, Human
gcagaaacauccauuugaguuggcaucccuguagggaucccagagcguuguaagccuucuugug

SEQ ID NO: 386643 - RNA, 64 nt, Human
agaauucuacaucggucuaaucuacuuuaggacuggaucccauaaaaguuauaaguuccuuaag

SEQ ID NO: 386644 - RNA, 64 nt, Human
cugguggccacagcagccaagccuagagcccuccggaucccauccaggcgcaaagaggaauagg

SEQ ID NO: 386645 - RNA, 64 nt, Human
guuggggccagagcuagguuuuagagauccuacaggaucccacaugggacggcuaccuaggugg

SEQ ID NO: 386646 - RNA, 64 nt, Human
cagcagcagucaugacugucugucacuacacuggggaucccaauuccacauaagcacuuuugga

SEQ ID NO: 386647 - RNA, 64 nt, Human
gcaaauguggaauuaauucuugauauugcuaaaaggaucccaguacaaguaagagaugccaaug

SEQ ID NO: 386648 - RNA, 64 nt, Human
uacaauaaucagaacauccaaaccucaaggcucaggaucccauagaccagagcccaccuuuuug

SEQ ID NO: 386649 - RNA, 64 nt, Human
ugguuauaaagguuuggauuggagagggcucacuggaucccaauccuuggagcuggaucauugg

SEQ ID NO: 386650 - RNA, 64 nt, Human
accaagauggguggcaccaaccuugcugggacuuggaucccaggggcuuaucucuucaagugug

SEQ ID NO: 386651 - RNA, 64 nt, Human
caaggacccccucugugaaggcucagcagaggugggaucccacgcccccucccggccccucccu

SEQ ID NO: 386652 - RNA, 64 nt, Human
uguguaaugauauuuagcagaugcauacaggacuggaucccagggcacugucaguucuucccuc

SEQ ID NO: 386653 - RNA, 64 nt, Human
gacacuccuuagagcccggauucggaccacuuggggaucccagaaccucccugacgauauccug

SEQ ID NO: 386654 - RNA, 64 nt, Human
gugaacuguggggguugcgcacagccagccgcguggaucccacgcagcgcugaaccgaaccgag

SEQ ID NO: 386655 - RNA, 64 nt, Human
gucccagucccaguccucggccacccccagcucuggaucccagggccagcugcccucuggcucu

SEQ ID NO: 386656 - RNA, 64 nt, Human
ccugaaaucucuucucagcuuaacauggaaaugaggaucccaccagccccagaacccucugggg

SEQ ID NO: 386657 - RNA, 64 nt, Human
gggguggccucaagagcacacagagaagggaagaaggggccaucacaggaugccagccccugcc

SEQ ID NO: 386658 - RNA, 64 nt, Human
ugccacuuugacucagaggcugggagcauagcagaggggccaggcccaggcagagcugacggga

SEQ ID NO: 386659 - RNA, 64 nt, Human
ccgauguaucugugacaagcaugccagaaguggcaggggccaucagggcuaaccacuucacacc

SEQ ID NO: 386660 - RNA, 64 nt, Human
uuuugcacuguuuucugucguguguguugggaugggaucccaggccagggaaagcccgugucaa

SEQ ID NO: 386661 - RNA, 64 nt, Human
uggaagugagaagaacccuucagccaaaccuuugggaucccauuuugaaguccagagcuggagc

SEQ ID NO: 386662 - RNA, 64 nt, Human
ccaggaguuugggaccagccugggcaacauagggggaucccaucucuacacacaaaaaaauuuu

SEQ ID NO: 386663 - RNA, 64 nt, Human
cucugggcugugauggggaugugcagggacagugggaucccaggaaacagaccuccaugguggg

SEQ ID NO: 386664 - RNA, 64 nt, Human
gucuuggguuuaaaacugcaagucuccuacccugggaucccauccaguuccacacgaacuaggg

SEQ ID NO: 386665 - RNA, 64 nt, Human
gucagugugcucgugggcuggugacugggucuugggaucccaggccacgcgccagccaggcugu

SEQ ID NO: 386666 - RNA, 64 nt, Human
auuucaagcacuacgccuuccacccccaggcacuggaucccagauucccaagccuucacccacc

SEQ ID NO: 386667 - RNA, 64 nt, Human
accacaaugccuggauccuggggcccccaucacuggaucccagauccccucacuccacccacug

SEQ ID NO: 386668 - RNA, 64 nt, Human
ucuuaaccacuggaucccacacaaaucagugaauggaucccaacaccccaaccacaggagcacg

SEQ ID NO: 386669 - RNA, 64 nt, Human
cuacuggauccuggaccucuacgucuuaaccacuggaucccacacaaaucagugaauggauccc

SEQ ID NO: 386670 - RNA, 64 nt, Human
aaucacuggauccugcagccccacauccuaagguggaucccacgcuucccugugcccccuacug

SEQ ID NO: 386671 - RNA, 64 nt, Human
uccuagacuccuaugccccaaccauugggucaugggaucccagcauccagauccuggauccuag

SEQ ID NO: 386672 - RNA, 64 nt, Human
uggcguguaaugauggcaguagaaucugaaucucggaucccaggcaggguucacauuuccaaac

SEQ ID NO: 386673 - RNA, 64 nt, Human
gaacucuugaaucgcucauaggcaugggacuccuggaucccacacaagcgcaccuaugggugcc

SEQ ID NO: 386674 - RNA, 64 nt, Human
ccccgacccuggcacacgggccaagguacccacaggaucccauccccucccgcacagcccuggg

SEQ ID NO: 386675 - RNA, 64 nt, Human
cccaaaauuuggaggccccauucuaggacucuggggaucccaaacccuagaguacacacguccc

SEQ ID NO: 386676 - RNA, 64 nt, Human
ugggggcugucagggagggccuggggugggggccaggggccaucugcuaugucagggcccuucu

SEQ ID NO: 386677 - RNA, 64 nt, Human
gguauggggcagcagaggcagccagccagcaaagaggggccacugagcaccagggcccuggugg

SEQ ID NO: 386678 - RNA, 64 nt, Human
cgccgcugccucagaucccgcaggcggagcugccaggggccacccugcaggugcagcuuuucaa

SEQ ID NO: 386679 - RNA, 64 nt, Human
auggagaagcuggcagaugaagggugggggcugcggaucccagggacugccccagaacacaaac

SEQ ID NO: 386680 - RNA, 64 nt, Human
guccagcugcugcccuccacagcgguucuucacaggaucccagcaaugaacuguucuagggaaa

SEQ ID NO: 386681 - RNA, 64 nt, Human
cagggaugcaaagguugcagugaguugagucaugggaucccagacuuuuuuaaauguuugcaau

SEQ ID NO: 386682 - RNA, 64 nt, Human
ccggggcucaagugcgggaagggggcuggcccgaggaucccauggcucucacaccauguuuuug

SEQ ID NO: 386683 - RNA, 64 nt, Human
cggaccucaguggaagcccguuccccccaucccuggaucccaagaguggugcgauccaccagga

SEQ ID NO: 386684 - RNA, 64 nt, Human
agacacucaccagguuaucugugaagagacucugggaucccaucaccucaaagccagagggucc

SEQ ID NO: 386685 - RNA, 64 nt, Human
uuccuugugagcagaagguuggcugcuguuagcaggaucccacagugauaaccaggcccuuccc

SEQ ID NO: 386686 - RNA, 64 nt, Human
cauacaguccuaggauuaagcuguuuaacugcuuggaucccaguuggucucuggcagugggauc

SEQ ID NO: 386687 - RNA, 64 nt, Human
auucagguauuguacucgggaggcugaggugggaggaucccaggaguucaaauccugccugggc

SEQ ID NO: 386688 - RNA, 64 nt, Human
uccucuuuccccucucccaguucccuaccacguuggaucccauucgucacccaugcuagggucc

SEQ ID NO: 386689 - RNA, 64 nt, Human
aaguaguuugacuuucuucuguauacauccagauggaucccaggcauccgggcaccacccuggu

SEQ ID NO: 386690 - RNA, 64 nt, Human
gcagguguuggccagaaaaguccagauuccucugggaucccacccuggccucuccuggaacucu

SEQ ID NO: 386691 - RNA, 64 nt, Human
ucuguggccaccucagauagucaucucaguccaaggaucccaaaacacaaaucuagaauugcaa

SEQ ID NO: 386692 - RNA, 64 nt, Human
caucuugaugcgaucgcacuuucugaagaaggaaggaucccaaaugccccuccaguucugguuc

SEQ ID NO: 386693 - RNA, 64 nt, Human
aguaccgggagcccugaaccgcccgcugcucggcggaucccagcugcgguggcgacggcgggaa

SEQ ID NO: 386694 - RNA, 64 nt, Human
ucagugagacacagaguggagcccucaguuuuauggaucccaauucauuucaucuacuacaggg

SEQ ID NO: 386695 - RNA, 64 nt, Human
uuucacugaugauucccugguaagugcuccugugaggggccacuucccuaguaugugagagaga

SEQ ID NO: 386696 - RNA, 53 nt, Human
agcgcagcgucagccuguagccgaggggccaggguuccuggcuugaaucugcc

SEQ ID NO: 386697 - RNA, 64 nt, Human
cuaggcuucuucuuucauguaguuccucauaagcaggggccagaauaucucagccaccugcagu

SEQ ID NO: 386698 - RNA, 64 nt, Human
agcacuuggggcagcccccagaaggaccacugcuggaucccagggagaaccugcuggcguuggc

SEQ ID NO: 386699 - RNA, 64 nt, Human
ugcugggccaggccugguuuucacaggggcugaaggaucccaguccaccugugugcaugucagg

SEQ ID NO: 386700 - RNA, 64 nt, Human
ggaccuggcaugcagcgaagcagcccagcccggcggaucccaggccagcacgccugccggcuuc

SEQ ID NO: 386701 - RNA, 64 nt, Human
cugggaguggguagccgucauguugucccccgugggaucccauuuuuaacuugacccagauugu

SEQ ID NO: 386702 - RNA, 64 nt, Human
uacacuaaucagcgugaccuggaccugcugggcaggaucccagggugaaccugccugugaacuc

SEQ ID NO: 386703 - RNA, 64 nt, Human
cuucccuggugauucuugaucuucaaagccucggggaucccagguuuccccauguaacugagac

SEQ ID NO: 386704 - RNA, 64 nt, Human
auugcuguguagugaccccugccugugacguggaggaucccagccucugagcugaguugguuuu

SEQ ID NO: 386705 - RNA, 64 nt, Human
cuggcugcagaggacgaagcaggaagcaugccguggaucccacaugcacuggggcagggcagcc

SEQ ID NO: 386706 - RNA, 64 nt, Human
aucugccugcauucccacccccuugggccuggcuggaucccaggcagagggaccuugcugcugu

SEQ ID NO: 386707 - RNA, 64 nt, Human
gccccgaccccacccaaaggggccuggagcugcaggaucccaggggaagggucucucucugcau

SEQ ID NO: 386708 - RNA, 64 nt, Human
cuaucaccucucuccaggaucucugcugucucuuggaucccaucugccuagauggaagaggauc

SEQ ID NO: 386709 - RNA, 64 nt, Human
cuuagguugggacuuaggugggccagaggggcuaggaucccaaaggacuccuuguccccuagaa

SEQ ID NO: 386710 - RNA, 64 nt, Human
gggcaguaacuccccaacucccucguuaaucacaggaucccacgaauuuaggcucagaagcauc

SEQ ID NO: 386711 - RNA, 64 nt, Human
cucuacccccuauucccugugucugccaaccccaggaucccagggcucccugccauuuuagugu

SEQ ID NO: 386712 - RNA, 64 nt, Human
ggaggaggaggagagggggguccaggucuuuucaggaucccagcugugggugcuucuguugggc

SEQ ID NO: 386713 - RNA, 64 nt, Human
cuccgcacccaccuaaagacauguauaugucuugggaucccagagauuggguccuugggccugg

SEQ ID NO: 386714 - RNA, 64 nt, Human
ggaagcauguccuccuccaggugcugcaggccugaggggccagguccaccaggccuacagucaa

SEQ ID NO: 386715 - RNA, 64 nt, Human
cagccauaauaagagucuucagagagaugaugggaggggccagugaggacaggaacagagagua

SEQ ID NO: 386716 - RNA, 64 nt, Human
gaguucccuggggacaacugagcagccucuggagaggggccauuaauaaagcucaacaucauug

SEQ ID NO: 386717 - RNA, 64 nt, Human
cucuggucugcugugugggguuggggaguaggggggaucccacauugccugggacaucugaaug

SEQ ID NO: 386718 - RNA, 64 nt, Human
acuauuuaagaaaaaaaaaaucaauuccuagccuggaucccaaaaagguacaggcagcaguugc

SEQ ID NO: 386719 - RNA, 64 nt, Human
ccuucaggaagggugugugccaccucguugcacuggaucccaguggcugcuugggggagaggcg

SEQ ID NO: 386720 - RNA, 64 nt, Human
ugagaagggacaguaugugguucguauugaucaaggaucccaaauaaugcaaucauucucaucu

SEQ ID NO: 386721 - RNA, 64 nt, Human
cucuuuuauacaugugauaauuucauaaagugagggaucccaaaaaaagaguuucauccaacau

SEQ ID NO: 386722 - RNA, 64 nt, Human
cuagccaagauucuacguuacuuuucccuugacuggaucccaaguagcuuggaaguuuuugugc

SEQ ID NO: 386723 - RNA, 64 nt, Human
uuuugucugugcauguguaucuccauuuguuuugggaucccaguuuuuguuuuaagagaguaua

SEQ ID NO: 386724 - RNA, 64 nt, Human
ugcuguggguuuuuaauugaucaguuuucaugugggaucccaucuuuuuaaccucuguucagga

SEQ ID NO: 386725 - RNA, 64 nt, Human
uggaaaacaggagauccuaauaugaaagaaaaauggaucccaaucugagaaaaggcaaaagaau

SEQ ID NO: 386726 - RNA, 64 nt, Human
acucuccaggggugcugggacaucacguggaauuggaucccaggcucucuugggcgagaaagac

SEQ ID NO: 386727 - RNA, 64 nt, Human
ucccaguggggcugccucaguccuacccccagcacccucaaaagcuggggugucugcauguccc

SEQ ID NO: 386728 - RNA, 64 nt, Human
agggguggggggaacaacuggcuauucaguaccaaggggccagaguggaggguaggagugccac

SEQ ID NO: 386729 - RNA, 64 nt, Human
cugugccgcaccauugaacuguaccaugugcuacaggggccagaagaugaacagacugaccuug

SEQ ID NO: 386730 - RNA, 64 nt, Human
agaugguuagaaccagcagaagccagagggugggaggggccaugcugugugagaccaggggacc

SEQ ID NO: 386731 - RNA, 64 nt, Human
gccggguauagguaacccacaggcccagugccagcccucaaaggacauagacuuugaaacaagc

SEQ ID NO: 386732 - RNA, 64 nt, Human
acuuauuucuggccaaaugaaucugcuucucugccccucaaacuuuuaguucacaauucaucuu

SEQ ID NO: 386733 - RNA, 64 nt, Human
ggagcacaagauucuaaaucagugguucccugaucccucaaaaauccauuuguuuuuggauuuc

SEQ ID NO: 386734 - RNA, 64 nt, Human
ugucccacggccagacacaugcacacacaucacacccucaaacacccagcucagccacacacaa

SEQ ID NO: 386735 - RNA, 64 nt, Human
acuuuuguggaguuugacaccuuagagaagcuaccccucaaacugcacaucuacacacaaacaa

SEQ ID NO: 386736 - RNA, 64 nt, Human
uaauaaauaaagacaccauuggccugacgcagcucccucaaacucugcuugaagagaugacucu

SEQ ID NO: 386737 - RNA, 64 nt, Human
uuuauaucuguaaugauacugauuaugaaauguccccucaaacucauugcagcagauaacuuuu

SEQ ID NO: 386738 - RNA, 64 nt, Human
ugcccuggaauggguguugcucuuaggauguauccccucaaaccuaccuggugguucugugccu

SEQ ID NO: 386739 - RNA, 64 nt, Human
cauuggaaugggucuacaguguaucaugagccaacccucaaaggacccguauuacagugccacg

SEQ ID NO: 386740 - RNA, 64 nt, Human
gccuaaggacuuucagguaaucagaguucaugggcccucaaagguaaauugcaguuguagacac

SEQ ID NO: 386741 - RNA, 64 nt, Human
ugcuauggucuguucuuuaguucuaguuuguauccccucaaaagccauuauguugaaauccuaa

SEQ ID NO: 386742 - RNA, 64 nt, Human
ccaguuuucuucugauguuuccaucuuccagaaucccucaaaaaacauuguuugccaaauccug

SEQ ID NO: 386743 - RNA, 64 nt, Human
uuauaagauucaguuggcuguccuuuuccugcuccccucaaaagauuuuuagucauacagaaug

SEQ ID NO: 386744 - RNA, 64 nt, Human
ccacagaacuuccggcugguguccucagagcaagcccucaaagagcugggucuggcugagcacc

SEQ ID NO: 386745 - RNA, 64 nt, Human
aacaucaacacauugcuuaaaaugaugaaaccaacccucaaaaaacagucuccuaaccagccau

SEQ ID NO: 386746 - RNA, 64 nt, Human
agccccuggguuucucuuggaaauggucaguuuccccucaaaguacccaaaguagccuuggcuu

SEQ ID NO: 386747 - RNA, 64 nt, Human
gccugaucaacaauuugggcuuccuguuuguacaaggggccauuuggcauaccuuucacagcuu

SEQ ID NO: 386748 - RNA, 64 nt, Human
cuuugcagcuguuuguucccaaagguugguaauaaggggccacuggggaagccugggucaguau

SEQ ID NO: 386749 - RNA, 64 nt, Human
uugcuguggcagauuccccagauaaccaaggaaaaggggccacccauaccuggaaauaggccau

SEQ ID NO: 386750 - RNA, 64 nt, Human
uguauuuuaaagauugagagggcuaagaaaguagcccucaaauaaacuguuauugcauuauagg

SEQ ID NO: 386751 - RNA, 64 nt, Human
auaguuuguagguauaauuauauagugcuuuucucccucaaaguauuuuucuagccuugaauuc

SEQ ID NO: 386752 - RNA, 64 nt, Human
ucucaucuggaucgggccccucagaagcaggaaacccucaaacccagccagaccccaggccggg

SEQ ID NO: 386753 - RNA, 64 nt, Human
uaaaaguaacuacuaaggaaagguuaaaaacuuccccucaaaaaggaaucaaccccaggaagua

SEQ ID NO: 386754 - RNA, 50 nt, Human
aaaacagcuuucgaaagugacccucaaagaaugagaaccucaagcaucug

SEQ ID NO: 386755 - RNA, 64 nt, Human
ugcuuguguccccaggcaccaguaguuugagccccccucaaaagacaugaaggggguugggguc

SEQ ID NO: 386756 - RNA, 64 nt, Human
ugucaccguggaccuuccugccaccagucacugucccucaaaugacccaaagaccaauauucaa

SEQ ID NO: 386757 - RNA, 64 nt, Human
gggauaagguggggaaaaagacuaaccuguccuacccucaaagccauaugcaaauacugaaaag

SEQ ID NO: 386758 - RNA, 64 nt, Human
uuuguuuugccaauuugcacauuaaaugacucuucccucaaauguguacuaugggguaaaaggg

SEQ ID NO: 386759 - RNA, 64 nt, Human
auaugguaacucaucauuaaccagaacaccucuccccucaaauuccgugaccaaguugugcagc

SEQ ID NO: 386760 - RNA, 64 nt, Human
uuuccaaagcugcacuucucuuaauaauucucuccccucaaaagaaagauuaugauaaagaaua

SEQ ID NO: 386761 - RNA, 64 nt, Human
ccccacuuuauuaguuaauuuaaauuggaaaaaacccucaaacuaauauucuugucuguuccag

SEQ ID NO: 386762 - RNA, 64 nt, Human
auuauauuguauuuaacccauuauuccucaccuacccucaaaguagguauacaaaagacuaguu

SEQ ID NO: 386763 - RNA, 64 nt, Human
cuaagaaggcugcuguacugguugaauugugucccccucaaauucacauccuucuuggaaucuc

SEQ ID NO: 386764 - RNA, 64 nt, Human
ucuaaauggaacuuuuuaaaaccuacauuauuuucccucaaacaauuuauuuucacaauucaua

SEQ ID NO: 386765 - RNA, 64 nt, Human
cgcauggauuuauauuuauuauaauuauguaguacccucaaaucauuuugucaguuacaucaag

SEQ ID NO: 386766 - RNA, 64 nt, Human
gacagggcuggguccucuggcuauuuggcugagaaggggccaggccaagggccggguggggaug

SEQ ID NO: 386767 - RNA, 64 nt, Human
uagggggagaaaagggaggaaaaaaguaauuuuaaggggccaaagcuuucccugaagcaaccaa

SEQ ID NO: 386768 - RNA, 64 nt, Human
augcugggcccccgccagggccuaucccaaaagcaggggccagggagggggcgacuugccugcc

SEQ ID NO: 386769 - RNA, 64 nt, Human
aaauuaaugaaaaugugacuuagaguagggguagcccucaaaaauagauuuaucauuuacucau

SEQ ID NO: 386770 - RNA, 64 nt, Human
ugaccaaaugagggauuuggucaaaugagggauucccucaaagcaauaucagguaaaccaaguu

SEQ ID NO: 386771 - RNA, 64 nt, Human
ccuugucugccuggcaaguucaucucucacgauccccucaaaggcccccuccuccaggaaggca

SEQ ID NO: 386772 - RNA, 64 nt, Human
ccaugucuauuagcuccacaaagccaaucucaaucccucaaaacaaucuugucauacuugaaaa

SEQ ID NO: 386773 - RNA, 64 nt, Human
aagaaggugucuccuaggggcagccugaaugccucccucaaaggaccugcaggcagagacugaa

SEQ ID NO: 386774 - RNA, 64 nt, Human
ccccauguccccagagggcucaccuuccaagucucccucaaagaagaaaaagaaauuccgaacc

SEQ ID NO: 386775 - RNA, 64 nt, Human
uccuuugccuuaucuugugcugguggugaagaggcccucaaagccaggccucucuauuccuuug

SEQ ID NO: 386776 - RNA, 64 nt, Human
cuugcuuuaaugaaauggaugugccuaaaagcuccccucaaaaaacugcagauuuugccuugca

SEQ ID NO: 386777 - RNA, 64 nt, Human
cggugauucagauugagcaccaacuuguuuccuccccucaaaguucugccuaagccguucaguu

SEQ ID NO: 386778 - RNA, 64 nt, Human
ugggguaaguggucuugaaggauucauuuagucacccucaaauuaagauuuuuacuucaucuuu

SEQ ID NO: 386779 - RNA, 64 nt, Human
gccuggggagcccccagcucacccaucuguagcucccucaaagucagggcccaccccaucugag

SEQ ID NO: 386780 - RNA, 64 nt, Human
agguuuuuauuguugaauguacaucuaccccagccccucaaaagaaaaacuguuuacauagaaa

SEQ ID NO: 386781 - RNA, 64 nt, Human
gggucuauagaccauuugucagaaaucagaucagcccucaaagaauggggucugugggcuaguu

SEQ ID NO: 386782 - RNA, 64 nt, Human
uccugggucaccagcagacacacugggcauggaccccucaaagcaggcacacccaaaacacaag

SEQ ID NO: 386783 - RNA, 64 nt, Human
ggcucucuugaucuccucaaucuggaguccccugcccucaaaacacagugauguucagaacaga

SEQ ID NO: 386784 - RNA, 64 nt, Human
aauuuggccauuaauuauuuaaaaacuaaauauucccucaaaagggcucccuagaauuaucaag

SEQ ID NO: 386785 - RNA, 64 nt, Human
agaccugcagugaggggcccuccaugcgcagaugaggggccacugacccaccugcgcuucugcu

SEQ ID NO: 386786 - RNA, 64 nt, Human
agaggcagaaaguaggaaccagauagagaugaaaaggggccacugaaaagugaauuugauagcu

SEQ ID NO: 386787 - RNA, 64 nt, Human
ccccugcagauagcaccggucuuugauccgcagcaggggccagacccugcccacaagucccagc

SEQ ID NO: 386788 - RNA, 64 nt, Human
acaaaauggcaaacauuuagcuagauugaccacccccucaaaagacucaaauuacuagaaucag

SEQ ID NO: 386789 - RNA, 64 nt, Human
uaggguaggaaagcgugguuccaagaaagauccacccucaaaugucagagcuauguucccucca

SEQ ID NO: 386790 - RNA, 64 nt, Human
ugcugcccuuuccuggcagggcugguggagucuucccucaaagcaugccuuacccagcugggaa

SEQ ID NO: 386791 - RNA, 64 nt, Human
gccuuuugcuuggauacauaugaaugaugcuuuccccucaaauaaaacaucugcauuauucuga

SEQ ID NO: 386792 - RNA, 64 nt, Human
guuuuuguacuugcuugguauccguacaagggggcccucaaacaugauagcaggaacuacgcgu

SEQ ID NO: 386793 - RNA, 64 nt, Human
cuacaaagcuguaguucacaauucuaauaaccuucccucaaaaugcagagaaaauauaaguugu

SEQ ID NO: 386794 - RNA, 64 nt, Human
aaggagcagaaauaguuauuuucguaucuucuaucccucaaagcaucagacaugggaaaauugg

SEQ ID NO: 386795 - RNA, 64 nt, Human
uucauauuguggcacaagcaaaagggugucugagcccucaaagugaggggaaaccagggccuga

SEQ ID NO: 386796 - RNA, 64 nt, Human
ucuauagacuuaguuguuacucuuuggaccacuccccucaaaacuuggaauucucucaccucua

SEQ ID NO: 386797 - RNA, 64 nt, Human
uaugcaccaggcacuuuauguaucuuauugcuaacccucaaaacaagcccuucccaacauaagc

SEQ ID NO: 386798 - RNA, 64 nt, Human
agcugauuguaguacaccugcuagcucuguugcccccucaaaacugcacccagagcagggccac

SEQ ID NO: 386799 - RNA, 64 nt, Human
ggacgagugacggcaggaggaccacgaggaaauacccucaaaacuaacuuguuuacaacaaaau

SEQ ID NO: 386800 - RNA, 64 nt, Human
uacacagcgugaaccucacagggggcuucugauacccucaaacauggagaacaguaagggagca

SEQ ID NO: 386801 - RNA, 64 nt, Human
ucuuucuacuguuucauccccuaacuucccccaacccucaaauuaaaacuagaacuauagaucc

SEQ ID NO: 386802 - RNA, 64 nt, Human
guguagauuuuugcaugaaaaaaaucauaaauuucccucaaaauagacuguguugcaguacaca

SEQ ID NO: 386803 - RNA, 64 nt, Human
accgcagucgucgcacagucucucucucucucuccccucaaagucugcaacuuuaagcagcucu

SEQ ID NO: 386804 - RNA, 64 nt, Human
ccucaaccaacuggacaagggauggcggcagaccaggggccaggccaaagcacuggcaggacuc

SEQ ID NO: 386805 - RNA, 64 nt, Human
guuucucaaaaaagaaaaacaaaaaacaaaaaacaggggccaauaaauucccuaacauccacag

SEQ ID NO: 386806 - RNA, 64 nt, Human
uccaagcaaguacacacagaucucugguaggauuaggggccacuuguguuuccggcuuauuuua

SEQ ID NO: 386807 - RNA, 64 nt, Human
gccuaacaaggccauccuuaugcuuugcaaagcacccucaaaagcugcaccacagccuggagaa

SEQ ID NO: 386808 - RNA, 64 nt, Human
cucuuguuugugcuauggcuugacccagcauguccccucaaaugaaaguucuccccuugauuuu

SEQ ID NO: 386809 - RNA, 64 nt, Human
ucuuucuuuauguacaagauggaaaauccccuaccccucaaaaacagguugaguuuaugggcca

SEQ ID NO: 386810 - RNA, 64 nt, Human
aaauaacuaucaauauccauuuccauucaucucccccucaaaucauagccuaacagaacacuuu

SEQ ID NO: 386811 - RNA, 64 nt, Human
caguaguccuuggcucugcacggaauaaaugauacccucaaaucuaauuggaugugcuuucgcc

SEQ ID NO: 386812 - RNA, 64 nt, Human
ucacagaaggacaaaauauuccuagacgagucuacccucaaaccaguagugucuuuuacaugaa

SEQ ID NO: 386813 - RNA, 64 nt, Human
aacaguugacaacaaagggcccccauacacuuaucccucaaauuuuaagugauaugaaauacuu

SEQ ID NO: 386814 - RNA, 64 nt, Human
cccaucccaucccgcucuuuuccuacuuuuccuucccucaaagcuuccauuccacauccggagg

SEQ ID NO: 386815 - RNA, 64 nt, Human
gacauugcuuuagaaucuugccccuccaaaucuucccucaaagaucuuaaugaguaaaacaacu

SEQ ID NO: 386816 - RNA, 64 nt, Human
uaagcaaaagucagucuuauagcaagacuguuagcccucaaacuugacucuacugaucugacca

SEQ ID NO: 386817 - RNA, 64 nt, Human
gaagaagggccccaugauuucauuuugugcugagcccucaaaauuaugucuguuucgugguggg

SEQ ID NO: 386818 - RNA, 64 nt, Human
uauuuggagagaaaacuguccuaauuuagaauuucccucaaaucugagggacuuuuaagaaaug

SEQ ID NO: 386819 - RNA, 64 nt, Human
aaaaaaaaaaagggcuguccauguauucacacaccccucaaaaaaagccuuuaguuccuacuuu

SEQ ID NO: 386820 - RNA, 64 nt, Human
cugaggguauaaagacaucuccaccaagucugagcccucaaaauguccugauuacaaugcuguc

SEQ ID NO: 386821 - RNA, 64 nt, Human
cagagggcagaggguagcccuugguacugugggucccucaaagaggagaguggggugcagaaau

SEQ ID NO: 386822 - RNA, 64 nt, Human
uaaguuucucaauguacaucuuuuuaucccaacacccucaaacuagaauauuugucagugguca

SEQ ID NO: 386823 - RNA, 64 nt, Human
gaaaggaaaagcaucuggcauguguuucuuggauaggggccagugcagugccauccuacaggug

SEQ ID NO: 386824 - RNA, 64 nt, Human
ccauuuguaucccugcugguguugacuucuguguaggggccaguucaugucccugacucucacc

SEQ ID NO: 386825 - RNA, 64 nt, Human
aguuuaguccccucacccccagcacugcccaaacaggggccaagugcgccccaauuccaagaau

SEQ ID NO: 386826 - RNA, 64 nt, Human
uucaggguuuugaggcugaacauaauuucauuaucccucaaaaaguuaccaccacaucagaaaa

SEQ ID NO: 386827 - RNA, 64 nt, Human
agccccuaggaggggguggggcaucccuggucaacccucaaacauuccggacuccccucauaac

SEQ ID NO: 386828 - RNA, 64 nt, Human
aaaguuugguauuguaaaacauucacaccucugucccucaaaauugauaauuacguuuaaagug

SEQ ID NO: 386829 - RNA, 64 nt, Human
uuguaauuguggauuaaugucaauguuaaucagccccucaaagggagagaaaagcuggaccuuu

SEQ ID NO: 386830 - RNA, 64 nt, Human
auuuuuuuauuguugaaucauuuugugaaugucccccucaaaaaaagcuaauggaauauuuggc

SEQ ID NO: 386831 - RNA, 64 nt, Human
ugcauugcagccguucaccggacaccgcaccagacccucaaaacccauccaagacugugggagg

SEQ ID NO: 386832 - RNA, 64 nt, Human
guaaugaaugguuaaaaauaaggguuauauuuuacccucaaaugcguuuuuguacuuucagagc

SEQ ID NO: 386833 - RNA, 64 nt, Human
gauuugguuucaugcucaugugucagauaugcuucccucaaaccuuguuacagcaucaucacau

SEQ ID NO: 386834 - RNA, 64 nt, Human
uuucugcgaggccucagaacuucccagggccccucccucaaauugucuccaugggaaacuugac

SEQ ID NO: 386835 - RNA, 64 nt, Human
uucugugcacagccacaccacccucucccgacagcccucaaagacguagcaacucuuucucuca

SEQ ID NO: 386836 - RNA, 64 nt, Human
uccaguuuggcuccacaaguccuccaggacagagcccucaaagcaacucccaacgaguucucag

SEQ ID NO: 386837 - RNA, 64 nt, Human
ggggaguagaucuuucuaggagggagacacuggccccucaaaucguccagcgaccuuccucauc

SEQ ID NO: 386838 - RNA, 64 nt, Human
gcaucauggagacccgcaggcggggcuuagccaccccucaaacccagggcccccuggcaccugg

SEQ ID NO: 386839 - RNA, 64 nt, Human
cagacugggaaucccugaagauggggccgugucucccucaaaguggggcucccucaggacagcg

SEQ ID NO: 386840 - RNA, 64 nt, Human
ggaucacugaggaaggggaagugggcaaagcagacccucaaacugacacaagaccuacagagaa

SEQ ID NO: 386841 - RNA, 64 nt, Human
uucugagaccuuguuucaaucuuugcuguauauccccucaaaauccaaguuauuaaucuuaugu

SEQ ID NO: 386842 - RNA, 64 nt, Human
gcuugcaaacuacacaaugcugcaggugcuucccaggggccacaggcugucaggaaacguguuu

SEQ ID NO: 386843 - RNA, 64 nt, Human
ccuggggcccaaaagccgggcaaccucuggcuacaggggccauugggugcccucccaguugaga

SEQ ID NO: 386844 - RNA, 64 nt, Human
gucaauuuuggacucugcacucccucuccucuucaggggccagacuuggcagcaugugcaccag

SEQ ID NO: 386845 - RNA, 64 nt, Human
guaacugguuccuaauaaaaagaauuauaaaauacccucaaauuaacaauucaauugcauauaa

SEQ ID NO: 386846 - RNA, 64 nt, Human
caccguagggccugacuccuucugccaguucccucccucaaagaaauccuccaaucaaaaucac

SEQ ID NO: 386847 - RNA, 64 nt, Human
ucucucaauacugcuuccuggauuucugcaaugacccucaaaacagagggcucuauacuccuua

SEQ ID NO: 386848 - RNA, 64 nt, Human
aacgccggacccucagucgcuccaggcccccucacccucaaaguguagcgcccccaaccgagca

SEQ ID NO: 386849 - RNA, 64 nt, Human
auaucauaaaugcagcuugggguuggagcaggggcccucaaaggcccagcuccugcucaaaaaa

SEQ ID NO: 386850 - RNA, 64 nt, Human
ucugcacuucaggaauggucacaacaggggguagcccucaaaagcacuccuuuuucuauaccuc

SEQ ID NO: 386851 - RNA, 64 nt, Human
uucuuuccagagaacgugguuuucauuuauuuuucccucaaaagagagucaaauacugacagau

SEQ ID NO: 386852 - RNA, 64 nt, Human
gaugacccaaaucuuucacuaugugcaccccagccccucaaaaauggggaagggcugaaagaau

SEQ ID NO: 386853 - RNA, 64 nt, Human
guugggaacaaagccuuuuuaacacacguaagggcccucaaaccgugggaccucuaaggagacc

SEQ ID NO: 386854 - RNA, 58 nt, Human
gacuaagcauagcuaugugaaaaagaaacccucaaaaauacuuucuuaauuucacauu

SEQ ID NO: 386855 - RNA, 64 nt, Human
ugggguaccaauacgaguucccauaggggcugcucccucaaaaagggaggggacagauggggag

SEQ ID NO: 386856 - RNA, 64 nt, Human
agcucucucccuucucuauccuguuucauucccucccucaaaggcguuucccaaauaaaucaca

SEQ ID NO: 386857 - RNA, 64 nt, Human
gaaguacuucagaaagccuagagagaagagagggcccucaaaucccauuccagccccuaaauga

SEQ ID NO: 386858 - RNA, 64 nt, Human
agcauuguguugugggugucugugugugaggucacccucaaacugcaccgccggccagauaccc

SEQ ID NO: 386859 - RNA, 64 nt, Human
ugccacauggguuccugugccacccuuuccccgccccucaaaucguccuuuaagucuuccuucc

SEQ ID NO: 386860 - RNA, 64 nt, Human
uccuugacaguugauagauuauauauucuuccaucccucaaacuugcauuccacuauauuuauu

SEQ ID NO: 386861 - RNA, 64 nt, Human
uccugcugggcugccucgugcagagacacaguguaggggccaugcagcuggcguagguggcagu

SEQ ID NO: 386862 - RNA, 64 nt, Human
gugucucccaggcaggccaugguaggggccucgcaggggccauuggggagcacagggccaggcu

SEQ ID NO: 386863 - RNA, 64 nt, Human
ugaaagcauaacuuuuuuggcacagaaagucuaaaggggccacugauuuucaaagagaucugug

SEQ ID NO: 386864 - RNA, 64 nt, Human
gagaauggaaaacuuauacagcuucauucuguugcccucaaaugggcauagcccuauguacuaa

SEQ ID NO: 386865 - RNA, 64 nt, Human
guauguaaugguacaggcaaaugugacuggauuucccucaaaaaaguaacuauuaaacagucuu

SEQ ID NO: 386866 - RNA, 64 nt, Human
uauuuuuaaauagaugaaaauucuaaaugauuuucccucaaaucuaucuagauuauuuuaagau

SEQ ID NO: 386867 - RNA, 64 nt, Human
uauugacauggaaaccccaguggaaucagauuuucccucaaagaccaugaugguaucggacuag

SEQ ID NO: 386868 - RNA, 64 nt, Human
uuauuuugcaugaguuugguaacugauuacucuccccucaaagaaaagacauucagguguuucu

SEQ ID NO: 386869 - RNA, 64 nt, Human
ccauucaagagggcacugccugcauucccuuccccccucaaaggcccggcccugcuauuaucgu

SEQ ID NO: 386870 - RNA, 64 nt, Human
uuauaauacuugucuuucucuccucucccuccaucccucaaaagaucuuuaugcauuucccacu

SEQ ID NO: 386871 - RNA, 64 nt, Human
uucaagaagccucuauuguuccccagauaauguucccucaaauagcacggggaagcaacugccu

SEQ ID NO: 386872 - RNA, 64 nt, Human
ucuaaauggaacuuuuuaaaaccuacguuauuuucccucaaacaauuuauuuucacaauucaua

SEQ ID NO: 386873 - RNA, 64 nt, Human
uguguccacaagccucaagccuuguuucaggucacccucaaaucacacucucuuuaggcaaaac

SEQ ID NO: 386874 - RNA, 64 nt, Human
gacagagugggggucuccaucuguuuucucuucucccucaaauacaggcuguuuucaucguguc

SEQ ID NO: 386875 - RNA, 64 nt, Human
cuaauauuauauguuacaauaagccuccauuagucccucaaaacgaugauauaaauaagucugu

SEQ ID NO: 386876 - RNA, 64 nt, Human
uuggacuggcacagggacccucgauggagcgaagcccucaaacgggaugcuuucugguauucua

SEQ ID NO: 386877 - RNA, 64 nt, Human
auccuaaauguuauaaauccuuaggagaaauauucccucaaaaccuagucaagaaagugccaca

SEQ ID NO: 386878 - RNA, 64 nt, Human
gauuucaggagccacagaagaaccuuaccagcuucccucaaaucaguccuuauccucuuucuau

SEQ ID NO: 386879 - RNA, 64 nt, Human
augucaccggucagugccuuuuggaacuguccuucccucaaagaggccuuagagcgagcagagc

SEQ ID NO: 386880 - RNA, 64 nt, Human
augguuuuguguauauagaguuggcuugcauuuuaggggccauuuuguauaaaaagugcauaug

SEQ ID NO: 386881 - RNA, 64 nt, Human
agcaugucaguggcauuuaaagccaugcagcuggaggggccacugagauugucucugaguauua

SEQ ID NO: 386882 - RNA, 64 nt, Human
cuuaagccaucaccaguggguguacucagagcagaggggccaggacuucugccagccaagggaa

SEQ ID NO: 386883 - RNA, 64 nt, Human
caucucugaccagcugggaaccugcuuggggucccccucaaaccugugucuggggugugggcuc

SEQ ID NO: 386884 - RNA, 64 nt, Human
uaaaaaucauuauuuguucaaaauguaugucccacccucaaagauaugcacuuuuaagugaaga

SEQ ID NO: 386885 - RNA, 64 nt, Human
aauugucaucuuugguguuuuuuuaacccccagccccucaaaaaaauaaggccuccagguauca

SEQ ID NO: 386886 - RNA, 64 nt, Human
augugggaaauuaagauuacagaugcuuugggcccccucaaacaguacauugcuacaguucacu

SEQ ID NO: 386887 - RNA, 64 nt, Human
uuaaucuuugcaacaggguggaaguuuuuuucuucccucaaaauuuucauggacaugcaaucuu

SEQ ID NO: 386888 - RNA, 64 nt, Human
guugaaauuuuuaaagagccugcaucauuugguucccucaaagggaagcccuugccaguggggg

SEQ ID NO: 386889 - RNA, 64 nt, Human
accccugugccugugucucuacacacuccacacccccucaaacucuguuuaucuguucucugac

SEQ ID NO: 386890 - RNA, 64 nt, Human
caccccagcuugccucccucccuggcuucucugacccucaaaggagaugccacgcaggacagac

SEQ ID NO: 386891 - RNA, 64 nt, Human
cacauaguggcacaaccaggccuagcacccaaggcccucaaaugaauuccucacuauuaaucuu

SEQ ID NO: 386892 - RNA, 64 nt, Human
cgaagcaggcguccaucuguguccuccuggcagccccucaaacacacaccaccccaugucacac

SEQ ID NO: 386893 - RNA, 64 nt, Human
aaugacuagcagccaauugguuuuacuuaacauacccucaaacugaggcuuaaaguauucccuu

SEQ ID NO: 386894 - RNA, 64 nt, Human
cucauaucccaacugaaucugagguuuuauaaaucccucaaacgauugcugagagccugauugu

SEQ ID NO: 386895 - RNA, 64 nt, Human
ccauaggcagaggcaugagcuggacuucauguuucccucaaagacucucccguggaugacggau

SEQ ID NO: 386896 - RNA, 64 nt, Human
ugcugaauugugaaugaauuaugagauuaauagacccucaaaugcuagugacugaggugucaau

SEQ ID NO: 386897 - RNA, 64 nt, Human
cucgggcacucccaagucugccucuuggcucccacccucaaagcccauguucugugaggcccaa

SEQ ID NO: 386898 - RNA, 64 nt, Human
gccgggagccguagaggguggccgacggcggcggcccucaaaagcacuuguuccuucugcuucu

SEQ ID NO: 386899 - RNA, 64 nt, Human
uugagggguuucauuauaggccuugguucucuccaggggccagaugaguuuauuguggaaucuu

SEQ ID NO: 386900 - RNA, 64 nt, Human
gucuggacuguugagccccuggcugggcagccccaggggccaggagcucucuuggagacaagca

SEQ ID NO: 386901 - RNA, 64 nt, Human
ugcucuguucagcaguucuaaaaauugcugaaguaggggccaggucacugguaguuauaguaug

SEQ ID NO: 386902 - RNA, 64 nt, Human
ccccacacugccuuucgcccuacugagacugguccccucaaaagguagacaaaacagcagcucc

SEQ ID NO: 386903 - RNA, 64 nt, Human
auaauggaggagcaauuggucauggccuugguuucccucaaaacaacgcugcagauuuaucugc

SEQ ID NO: 386904 - RNA, 64 nt, Human
ucauuuaacuuuucucauuaucaguaccacgguucccucaaaguuuguugaauaaagcaacuuu

SEQ ID NO: 386905 - RNA, 64 nt, Human
ugaauuccugccccucuuuaccaccucuuccucccccucaaaggaaaaacauuucauccaagua

SEQ ID NO: 386906 - RNA, 64 nt, Human
guauaugucgugggacuggggugugggugaccugcccucaaaccuugccugccaccuccccauu

SEQ ID NO: 386907 - RNA, 64 nt, Human
gcuaggcugcagacugccuuguacucccuggacacccucaaaugggguuuucuguguuauuuca

SEQ ID NO: 386908 - RNA, 64 nt, Human
uugcuauuuaggaugaguuaagugccuggggagucccucaaaagguuaaagggauucccaucau

SEQ ID NO: 386909 - RNA, 64 nt, Human
ggagugugauaccuuccuugguuuuuuuuugcagcccucaaauccuaucuuccugccccacaau

SEQ ID NO: 386910 - RNA, 64 nt, Human
gaggaggaaaaggauugccaaggcuccagggcaccccucaaagcagcgccugccuccucccucc

SEQ ID NO: 386911 - RNA, 64 nt, Human
uccuaugauugucauguccuccuuuaaggcuuuucccucaaauuuauuacaaauuuaguauuuu

SEQ ID NO: 386912 - RNA, 64 nt, Human
gaggaaguuagugcuuacauuuuagucuuuuucucccucaaaaaaauagguuaaguuucagugc

SEQ ID NO: 386913 - RNA, 64 nt, Human
agaauuguuccuuauuaccaaacucccaguaacccccucaaagaauaauugccccuugcuuaau

SEQ ID NO: 386914 - RNA, 64 nt, Human
auuuccugauagcaaaaggaaaaaaaacacccaucccucaaaaaggccaaggucccgucccccu

SEQ ID NO: 386915 - RNA, 64 nt, Human
cugcaugcuguguauccuaacucccuacaacagccccucaaauaaaucacaucuagugacuggu

SEQ ID NO: 386916 - RNA, 64 nt, Human
augcgguaucacaugaggccugucccuaacagugcccucaaagugaagguccucaaggaggauc

SEQ ID NO: 386917 - RNA, 64 nt, Human
gagaggacauuuccuccuuccugauuuggauauucccucaaaucccuccucuuacuccaugcug

SEQ ID NO: 386918 - RNA, 64 nt, Human
uucccacaggaaacaucaagaagccccagccaggaggggccaggcugccaaggcggcuccccug

SEQ ID NO: 386919 - RNA, 64 nt, Human
gggggcaacagccaaaauagggggguaaugauguaggggccaagcagugcccagcuggggguca

SEQ ID NO: 386920 - RNA, 64 nt, Human
gcuauacugaauucccauucauguuagguaacuuaggggccagaaucuccaugcacuuuguaga

SEQ ID NO: 386921 - RNA, 64 nt, Human
aacaggaaggaugugcuuuaaaaaaagguggaaucccucaaaaaauucuauagggagacagcag

SEQ ID NO: 386922 - RNA, 64 nt, Human
acuucucugagucagcugacccccuccccccaaucccucaaaccuugaggagaaguggggaccc

SEQ ID NO: 386923 - RNA, 64 nt, Human
auuagaaauauauaauggagcaauuguggauuuccccucaaaucagaugccucuaaggacuuuc

SEQ ID NO: 386924 - RNA, 64 nt, Human
uggagcaugccauuggaaaacccacccccacccccccucaaaaaaacagaacaguaaaccaaaa

SEQ ID NO: 386925 - RNA, 64 nt, Human
aaucauguggguaucccuaggauggccuucagagcccucaaacuuacaagcaccugguaguuga

SEQ ID NO: 386926 - RNA, 64 nt, Human
ccugccucacaggauugugacuccccagccccugcccucaaagcuucagaccccucagguagca

SEQ ID NO: 386927 - RNA, 64 nt, Human
agggagcauuaguaccuggugcuagagaauagaacccucaaauaauuuuuagaauucuuaccua

SEQ ID NO: 386928 - RNA, 64 nt, Human
acaaucuggauaauuccauuucuuuuuucccaaacccucaaacagagugccuuaaaaaauuguu

SEQ ID NO: 386929 - RNA, 64 nt, Human
uuccuguacauugcaaacaaauacagaaugcaaacccucaaagcuguauuaucugguguguuug

SEQ ID NO: 386930 - RNA, 64 nt, Human
cacucaauuccaaagccuuccuauugggcgaauucccucaaacucuauuugaccugacagccau

SEQ ID NO: 386931 - RNA, 64 nt, Human
ccgccccacuuucccuucuucaaaggacaaagugcccucaaagggaauugaauuuuuuuuuuac

SEQ ID NO: 386932 - RNA, 64 nt, Human
gaacguaaaaggaaagcggcguuauuuuuacagacccucaaaaauccucugccggaagcagaag

SEQ ID NO: 386933 - RNA, 64 nt, Human
auacuacaauuaagagagugaacauauccaucaucccucaaagugucacaaugcuccuccugau

SEQ ID NO: 386934 - RNA, 64 nt, Human
acuuccacaggugcagcccucccaauccagucuacccucaaaggagcuggggcuuguggagggc

SEQ ID NO: 386935 - RNA, 64 nt, Human
gaacugaacuagacuccccuaccuuagacugguacccucaaacacaggacugaagcuuaauugg

SEQ ID NO: 386936 - RNA, 64 nt, Human
cacuugacuacauauggcuuuagaaauaaaauaacccucaaaacuaccauuuauugagugcuua

SEQ ID NO: 386937 - RNA, 64 nt, Human
ggacaagguaggaagagaagcuucccuuaaccagaggggccauuuuuccuuuuggcuuucgagg

SEQ ID NO: 386938 - RNA, 64 nt, Human
aauucaaagccauauuuagggaacauuuuuucugaggggccaaaagaauaaaggaccaaauuuc

SEQ ID NO: 386939 - RNA, 64 nt, Human
gagcaggacccccaccugaaguagaacuuaagagaggggccaaguguaggauuggggaccaugg

SEQ ID NO: 386940 - RNA, 64 nt, Human
uuuuuuauggaaauaauacucaagguuguaaaaccccucaaagccuagaaauuuaauuguuaug

SEQ ID NO: 386941 - RNA, 64 nt, Human
caauauagcccccuacccuuuucccaauccuuugcccucaaaucagugacccaagggagggggg

SEQ ID NO: 386942 - RNA, 64 nt, Human
uucccauugucacggaaaacauuggcugcaaagccccucaaagcccucaagugccuucugugag

SEQ ID NO: 386943 - RNA, 64 nt, Human
cugcccgugugacccguuccagguccccugggcucccucaaaugacagaccuaacuauuccugu

SEQ ID NO: 386944 - RNA, 64 nt, Human
guuacaaaucaaagcaaagaaaaaucccaaaguucccucaaaacugaugugggcacuuggccca

SEQ ID NO: 386945 - RNA, 64 nt, Human
aggggguggggagcugagcaggcugggcaauuugcccucaaacagaacagcuccccuuguagcu

SEQ ID NO: 386946 - RNA, 64 nt, Human
gagauauguuugauuauagagagacucugggccacccucaaacaccgucagaugcauuagcagc

SEQ ID NO: 386947 - RNA, 64 nt, Human
ugacuuuaccuugagaucugucuucauacccuuccccucaaacuaacaaaaacauuuccaauaa

SEQ ID NO: 386948 - RNA, 64 nt, Human
aaacauggcaaaaaauaaaauaacuccuauacugcccucaaaauggaguuugcaauuaauauca

SEQ ID NO: 386949 - RNA, 64 nt, Human
gaaacccagaauauacauacuuugcuguuuucuucccucaaauauuuuacuauuuguuuuauuu

SEQ ID NO: 386950 - RNA, 64 nt, Human
agacccaacaggcccuucuguagccucccccuugcccucaaagggggagugggggccagcuuua

SEQ ID NO: 386951 - RNA, 64 nt, Human
agccugggcucugguccacuacugccccagaccacccucaaagcuggucuucagaaaucaauaa

SEQ ID NO: 386952 - RNA, 64 nt, Human
uugguuaccagugugucaggcaaucuggacuuugcccucaaaagagcagugguuccuguuucua

SEQ ID NO: 386953 - RNA, 64 nt, Human
uauaaauauauuuuauuugaaaggcugaguguugcccucaaacacuugcuaaaacugccuaggg

SEQ ID NO: 386954 - RNA, 64 nt, Human
accuuuaacucaggauuguacaguauguuuaggucccucaaaaagugaccuaagcuaauguuau

SEQ ID NO: 386955 - RNA, 64 nt, Human
uauuguagaaccugaaaacagcaauguauggaaacccucaaagcagaaaagggaggaagauccu

SEQ ID NO: 386956 - RNA, 64 nt, Human
agugggccugguagcacaugucuguccucagagcaggggccagaugauuuuccucccugguuug

SEQ ID NO: 386957 - RNA, 64 nt, Human
cccccucacccagaagucugagcccagccucaggaggggccaagaaccagggggccaucaaaag

SEQ ID NO: 386958 - RNA, 64 nt, Human
uucaggcugcacccgggcaggccucagaacggugaggggccagggcaaagggugugccucgucc

SEQ ID NO: 386959 - RNA, 64 nt, Human
acuuugccuacuguuagguuccugggguacgggucccucaaacacaagucuugaaucaguccuc

SEQ ID NO: 386960 - RNA, 64 nt, Human
cuugccccuccucccugucuucucugauucuuuucccucaaaauaguccugagaacuaauuguc

SEQ ID NO: 386961 - RNA, 64 nt, Human
ggacaaguuuaaaaucaaaguagugcccggaauucccucaaaccacccaacuucauccaggaau

SEQ ID NO: 386962 - RNA, 64 nt, Human
gcccugguggagaaagcacugaccugucaugccccccucaaaccuccucuucugacgugccuuu

SEQ ID NO: 386963 - RNA, 64 nt, Human
cagaccucagggaggguugaguuucucuaaggaccccucaaacaugucgcaaaaugaaccaaac

SEQ ID NO: 386964 - RNA, 64 nt, Human
agaggugguucucugcagugaucguuuaguguggcccucaaacauuaaauaucccgaggucucc

SEQ ID NO: 386965 - RNA, 64 nt, Human
augcccaucucuuccugccugcuagccugcuagacccucaaacuggguggguucugugucaaua

SEQ ID NO: 386966 - RNA, 64 nt, Human
cucacuacccagcagcaggcuggggaccuccucccccucaaaaaagguauuuuuuuauucuaac

SEQ ID NO: 386967 - RNA, 64 nt, Human
uuuacaggcaugagccaccacacccagcuccucccccucaaacuucugugcacaaagugcuccc

SEQ ID NO: 386968 - RNA, 64 nt, Human
uucucuacaaaugugccguuuuaagaauaaaacccccucaaaucucucccccgaggccuguuuc

SEQ ID NO: 386969 - RNA, 64 nt, Human
cacaucuuucacacuuccaccagccugcacuacucccucaaagcacacgucauguuucuucauc

SEQ ID NO: 386970 - RNA, 64 nt, Human
uccccucagcucuucuccuggaaugacuggcuuccccucaaauuggcacugagauuugcuacac

SEQ ID NO: 386971 - RNA, 64 nt, Human
aaaaugagcauguaauaauacaagaacuguuucccccucaaaaccugaaccugaauuauuugua

SEQ ID NO: 386972 - RNA, 60 nt, Human
acaagaaaaaggccaccuaggcaauggaagcccucaaagaagucggaaugucauagucuu

SEQ ID NO: 386973 - RNA, 64 nt, Human
ucucgaggccucuucugaccucaagggucacacccccucaaagauccucucacccaugguaguu

SEQ ID NO: 386974 - RNA, 64 nt, Human
gagacccuccccugccuccgaggccuaccugcuccccucaaaagcuucgugccaacagagaggu

SEQ ID NO: 386975 - RNA, 64 nt, Human
uggucccuuaaggcacagugggagcugagcuggaaggggccacguggaugggcaaagcuuguca

SEQ ID NO: 386976 - RNA, 64 nt, Human
caugggggaacccugaggguguggguagaguagcaggggccaccuaagagauuaaaaacagucu

SEQ ID NO: 386977 - RNA, 64 nt, Human
aggguaccgguaccggcaagcucacaucucagccaggggccaugccccacuuccccugacccca

SEQ ID NO: 386978 - RNA, 64 nt, Human
ccuuuacagaccuguguuccugaaugcacucauccccucaaaguggggaccugucccaaggacu

SEQ ID NO: 386979 - RNA, 64 nt, Human
ggcgagaguggaggcucuucuucugccccgucuccccucaaagaugagaaacauguucagaagg

SEQ ID NO: 386980 - RNA, 64 nt, Human
aggccagcuuucugcauggauggucagucucuugcccucaaacacuacagcaaacaagcuaccc

SEQ ID NO: 386981 - RNA, 64 nt, Human
ccuuggaguugguuuuuuuuuuuuuuuuuuucuucccucaaagaaccugcgguugcgcuuugug

SEQ ID NO: 386982 - RNA, 64 nt, Human
gguuuuuuuuugccacccuggacacauguuggcccccucaaagaauuucuguggggauuuguac

SEQ ID NO: 386983 - RNA, 64 nt, Human
guauaggaucaucaugugguuacaaaaaauacuucccucaaaaaaauucuuuuaauguggaaac

SEQ ID NO: 386984 - RNA, 64 nt, Human
augaucugcugucuguaguucugugagcucaggucccucaaaggccucggagcacccccuuccu

SEQ ID NO: 386985 - RNA, 64 nt, Human
uucauacauccaucuaaauggauaccuuuccauccccucaaacgagaacaaaaaguauucccug

SEQ ID NO: 386986 - RNA, 64 nt, Human
caccauugcagucucauacagaauaguuucaccacccucaaaauccugugcuucacuuauuuau

SEQ ID NO: 386987 - RNA, 64 nt, Human
cugaguccugucucugccugcggcccagaaguuucccucaaaugcgcgugugcacgugugcgug

SEQ ID NO: 386988 - RNA, 64 nt, Human
cacagacaaaccacccccacuccuacccagccagcccucaaaacacaaaggaacaaagacaguc

SEQ ID NO: 386989 - RNA, 64 nt, Human
agugcccaaguugacucauccuuacucacucauucccucaaaauauuuauugagcaccaacaau

SEQ ID NO: 386990 - RNA, 64 nt, Human
auuuaaugcugaauuacauuugguugggaaaugucccucaaaauccugggcacuaugaaggaac

SEQ ID NO: 386991 - RNA, 64 nt, Human
uccucacucuccccgucaugcucccucugccccgcccucaaaaaaaaaaaaaaaaaaaaaaaaa

SEQ ID NO: 386992 - RNA, 64 nt, Human
uugggcugaccacccacugggccugccugccccucccucaaaaggccccuggaguuguucaggc

SEQ ID NO: 386993 - RNA, 64 nt, Human
uccaaagaagacagagaggucagccccacccgaucccucaaaugggcucuuggaggcaccccca

SEQ ID NO: 386994 - RNA, 64 nt, Human
cacugcgcacaugcuggugcccgucuuccuccuaaggggccaggccacauccaagugggccucu

SEQ ID NO: 386995 - RNA, 64 nt, Human
gcuucugccauuauaggguugugccuugcuagucaggggccaaaauguccccuggcucugcucc

SEQ ID NO: 386996 - RNA, 64 nt, Human
uucuuauugcugcucagagggggguaaggaauggaggggccaucagaacuugaauccuuuaaca

SEQ ID NO: 386997 - RNA, 64 nt, Human
aacccggaaacagacaagcaacccaaacugaacccccucaaaagccaaaaaaugggagacaauu

SEQ ID NO: 386998 - RNA, 64 nt, Human
uuauguccuaaaauucaaaucacuauuugagaaacccucaaauuggugcuuucauuauauaaug

SEQ ID NO: 386999 - RNA, 64 nt, Human
uggggcccccauggcuggggcaggggaaagagagcccucaaaggccucuuucuggucugucugg

SEQ ID NO: 387000 - RNA, 64 nt, Human
gucuugcugugcccucccaggcuuaguguucccucccucaaagacugacagccaucguucugca

SEQ ID NO: 387001 - RNA, 64 nt, Human
uuuuuagaauauuuuaagaauuucacaagcuauucccucaaaucugagggagcugaguaacacc

SEQ ID NO: 387002 - RNA, 64 nt, Human
guagagagacacccggcacccaguccgaagcccucccucaaaggaccggcucauggcguugguc

SEQ ID NO: 387003 - RNA, 64 nt, Human
uacuggcauuuuccugucuucucuuuaguaugaucccucaaaaccucacuaacuggaaggauga

SEQ ID NO: 387004 - RNA, 64 nt, Human
uagguaaccuuauauuuacaauaaaugaagauuacccucaaaugcuagaagcugucuagguccg

SEQ ID NO: 387005 - RNA, 64 nt, Human
ggguaucaaacgguugaucuguuuucagugcacacccucaaaugcaccacaccaguuuuacgau

SEQ ID NO: 387006 - RNA, 64 nt, Human
gcccgguuuuggaaaaaaacaauaaaggacuguccccucaaaaccagccgggggacuguuaaau

SEQ ID NO: 387007 - RNA, 64 nt, Human
caaaggcuuaguaacuugagcaggagagaaaacucccucaaagucauaaauccugagugacaac

SEQ ID NO: 387008 - RNA, 64 nt, Human
cccuagcucccuccaggugucugcagugguuguccccucaaagcugucccacacccuccuccga

SEQ ID NO: 387009 - RNA, 64 nt, Human
cccagggggccucugacgcucgugaccaccaccucccucaaaccuugagauaggcugggugcgg

SEQ ID NO: 387010 - RNA, 64 nt, Human
agcgcuucugcagccucggccuaggucacguuggcccucaaagcgagccguugaauuggaaacu

SEQ ID NO: 387011 - RNA, 64 nt, Human
gacauuaccaccaaccccacagaaauacgaaaaacccucaaagauuacuauaaacaccuguaug

SEQ ID NO: 387012 - RNA, 64 nt, Human
ccaggauguguccuaugcccagcugcacagcuuacccucaaacagaaaauaaugaagccuucuu

SEQ ID NO: 387013 - RNA, 64 nt, Human
gccaugugcuugucccugugcucccacgguucccaggggccaggcugggagcccacagccaccc

SEQ ID NO: 387014 - RNA, 64 nt, Human
auuccccacaaagccguucgcagcuuccgggagaaggggccagagcccgguggggccaguuucu

SEQ ID NO: 387015 - RNA, 64 nt, Human
ccggugccaugcuccucccugugucuuguaugaaaggggccacugugugucuuccuccccggcg

SEQ ID NO: 387016 - RNA, 64 nt, Human
uuggagccccccggagagggaccucccagccgagcccucaaagaacuccaugaaaucaggaacu

SEQ ID NO: 387017 - RNA, 64 nt, Human
gacaauccaaagcgccgagacgagggugcugugucccucaaacccagaguggugggcgccucug

SEQ ID NO: 387018 - RNA, 64 nt, Human
accaaaaccuuugauuuguaguuuuaaagauuaacccucaaaguucucuucauaacugccuuga

SEQ ID NO: 387019 - RNA, 64 nt, Human
agccaccgaauccaaucaugguaaaaauguguuucccucaaaucaugggaaccaucgcaaaauu

SEQ ID NO: 387020 - RNA, 64 nt, Human
cccacccgcccccgccaccccuccacgccagggucccucaaagcuucuguggcuucguggucac

SEQ ID NO: 387021 - RNA, 64 nt, Human
acagugaaauaaaaugaaaacaauuuccucccuucccucaaaucucugagauaaccaguaugug

SEQ ID NO: 387022 - RNA, 64 nt, Human
cugucccuuggcaaauggacaccaggggcuucuccccucaaagccauaccccgccucugggcgg

SEQ ID NO: 387023 - RNA, 64 nt, Human
gcagagcgggacucuguccaacaagccccacagccccucaaagacuuuuuuuuguuuguuuuga

SEQ ID NO: 387024 - RNA, 64 nt, Human
ucaggcccaggaguccaggcccccagccccuccucccucaaaccaaggguacagauccccagcc

SEQ ID NO: 387025 - RNA, 64 nt, Human
aauggcugugcggugcgggacggaagacuggaaacccucaaagcaucugacucaccugcaugau

SEQ ID NO: 387026 - RNA, 64 nt, Human
uugcacggcuuuaucacagcauuuuuaaagcuuucccucaaaaauccugaucugcaugaucuca

SEQ ID NO: 387027 - RNA, 64 nt, Human
guugaauugaagcaaaucagauuuucuguggggacccucaaaugcaacugaagaaauagauugu

SEQ ID NO: 387028 - RNA, 64 nt, Human
cugcauuccagccugggugacagagugagacucccccucaaaaaaaaaaaaaaaaaaaaaaaaa

SEQ ID NO: 387029 - RNA, 64 nt, Human
aggagugugaagcaaggagcuuagauaagacacccccucaaacccauucccucuccaggagacc

SEQ ID NO: 387030 - RNA, 64 nt, Human
ggccugaugauggugggugggugggaugaguacccccucaaacccugcccuccuuagaccugag

SEQ ID NO: 387031 - RNA, 64 nt, Human
gcgccuccagcugggccugacccuccauguccugcccucaaaaaacuggguggagaaauaauug

SEQ ID NO: 387032 - RNA, 64 nt, Human
augggcagccugugaccgggucuggggcgaggccaggggccaucaaaaacaggcugaucaccaa

SEQ ID NO: 387033 - RNA, 64 nt, Human
gaacucgacucuccaacccuccugagcagccggcaggggccaggaucacacauucuucucaccc

SEQ ID NO: 387034 - RNA, 64 nt, Human
augccgagucccugaauucacccaggaccauccaaggggccaccgcagcauuggccccaucacc

SEQ ID NO: 387035 - RNA, 64 nt, Human
gguucaccuugccgagagaggcgcgucugccccacccucaaacccuguggggccugauggugcu

SEQ ID NO: 387036 - RNA, 64 nt, Human
augauucucuuuccucuuuguccaagcauccuaucccucaaacccaaaaagaaagaagcucucc

SEQ ID NO: 387037 - RNA, 64 nt, Human
auccucugaguguuuggaaauaaacugugcaauccccucaaaaaaauaaaaauaaaaaaaauaa

SEQ ID NO: 387038 - RNA, 64 nt, Human
gcagaagcagggcugaugcucagggaccccccaacccucaaaccuugccuccgaggcugggccu

SEQ ID NO: 387039 - RNA, 64 nt, Human
agggggaaaaaaagauagccagagagagaccuggcccucaaaaaggugugaacaagacugaaaa

SEQ ID NO: 387040 - RNA, 64 nt, Human
aauuugugccucuuuguuuuuccccaaaccaaagcccucaaauuguagucucugucggcuucug

SEQ ID NO: 387041 - RNA, 64 nt, Human
caugucaccgaagcaaguguacccuuuauaggaacccucaaauuaaaaaaaaaugucuuuuaau

SEQ ID NO: 387042 - RNA, 64 nt, Human
acagguugaugcugcacagccccauugacacaaacccucaaagcagacgugagagggacgguuc

SEQ ID NO: 387043 - RNA, 64 nt, Human
gcuggcauuugagcuggucuggagcagaguuucucccucaaagaacacagagaaaucagagagu

SEQ ID NO: 387044 - RNA, 64 nt, Human
aagaucuguuccacagggcuaaugccaccaucuccccucaaaauuuuguagagguucuaaaaag

SEQ ID NO: 387045 - RNA, 64 nt, Human
cauuuuuaauaugguuuaucaaugauucauguuucccucaaauagugaugguuuacaccuguca

SEQ ID NO: 387046 - RNA, 64 nt, Human
uuuugugauuauucuguaucagaaaugaaacagacccucaaauuaacuuuccuuccucauuucu

SEQ ID NO: 387047 - RNA, 64 nt, Human
gucaccaauuaaccagaaauccaguuauuuuccgcccucaaaaugacagccauggccggccggg

SEQ ID NO: 387048 - RNA, 64 nt, Human
caagcccaaggcagaagaccuaucugcauuugagcccucaaacucaccuugcagagcgccaagu

SEQ ID NO: 387049 - RNA, 64 nt, Human
ucccugucguucaugauagacacaaugaaauccacccucaaagagguaaggcggggcucaggca

SEQ ID NO: 387050 - RNA, 64 nt, Human
aggaggggaccuucgagggccucugccccaugugcccucaaagcugucccacaaucauggagcc

SEQ ID NO: 387051 - RNA, 64 nt, Human
ggaggguggcugugggggcucaggaagcucgcccaggggccaaugugggagguuggggguaguu

SEQ ID NO: 387052 - RNA, 64 nt, Human
gaaacaagcgaauuaacuaucuacgcugccugcaaggggccacuuagggcacugcuagcagggc

SEQ ID NO: 387053 - RNA, 64 nt, Human
agcaugcauaaaucaaugguucaagucuucuguuaggggccaauaaaauguaucugcauauguu

SEQ ID NO: 387054 - RNA, 64 nt, Human
uuuguuuggcagagcuuuuaccuguuauucuuugcccucaaauacaguauuguggucauuuuga

SEQ ID NO: 387055 - RNA, 64 nt, Human
ccagcuccccuucccugagcugccuccugcuucucccucaaagucuccuacccuucucuuccuc

SEQ ID NO: 387056 - RNA, 64 nt, Human
gaauggagagguagggagccaggugcagcaggaucccucaaaucaauaaagcauuaccagagau

SEQ ID NO: 387057 - RNA, 63 nt, Human
cugaaagaccuaaaaaguagcaagaagcuacaucccucaaacuucggcaaugaaaauaaaguu

SEQ ID NO: 387058 - RNA, 64 nt, Human
cccccagcagugggguaagauugcgcgcuucauccccucaaaaugcaguucagccccacucccu

SEQ ID NO: 387059 - RNA, 64 nt, Human
uagcguucuguuucaccaguuuccaaguuuauugcccucaaaaucuuuagaauaguuaaauugg

SEQ ID NO: 387060 - RNA, 64 nt, Human
ggggccugaguuccccaaacuaccccacagcagucccucaaagacagcccucaauccauguagg

SEQ ID NO: 387061 - RNA, 64 nt, Human
gucaaauaugaagcugcuggggaagcugugaaaacccucaaaaagacccagccaacugucauua

SEQ ID NO: 387062 - RNA, 64 nt, Human
gaggcucuccucuccucuccucucccccgauguacccucaaaaaaaaaaaaaugcuaaccaguu

SEQ ID NO: 387063 - RNA, 64 nt, Human
uuaaaucguguugcauuugauuccugagcaaauucccucaaagugaacucuuguucuuaaauuu

SEQ ID NO: 387064 - RNA, 64 nt, Human
auaaaguauaaaacauuuccaaucacuuaguagccccucaaaguaguuagaaaauaaacagauu

SEQ ID NO: 387065 - RNA, 64 nt, Human
gucacuuuauuucauucgggccccaccugcagcucccucaaagaggcaguugcccagccucuuu

SEQ ID NO: 387066 - RNA, 64 nt, Human
acgaggucugcagacggagggcagaggugguggaaggggccaggggccugcaggccucccccug

SEQ ID NO: 387067 - RNA, 64 nt, Human
cgucagugaaagucguccuugucucagaaugaccaggggccagccagugucugaccaaggucaa

SEQ ID NO: 387068 - RNA, 64 nt, Human
uggggcggccugaacccugcuuccagccauggccaggggccacggaacccggcaggggugucug

SEQ ID NO: 387069 - RNA, 64 nt, Human
uuccccacucggaugggcuuuaaauuauucccauaggggccaauuucaaauaauaauuuuuuuc

SEQ ID NO: 387070 - RNA, 64 nt, Human
uuuucugcuccaaccugccccacugggucccggcaggggccaugccuaccaagcucgagcuggc

SEQ ID NO: 387071 - RNA, 64 nt, Human
ggauguucccggcgugugccgggccugaauggacaggggccacuucacagcaugucagggaaaa

SEQ ID NO: 387072 - RNA, 64 nt, Human
gagcgcggcgaguacugacagaggggacguugggaggggccacccugcacaggacccuggcaag

SEQ ID NO: 387073 - RNA, 64 nt, Human
uuuacuuuuacucucacccugcuccuguaccagcaggggccacuucaaagccaagguacagggu

SEQ ID NO: 387074 - RNA, 64 nt, Human
gccccucaugccuggagcaaugagggucuaguccaggggccaaaagcagucugagguauugggu

SEQ ID NO: 387075 - RNA, 64 nt, Human
guugcuugcuugcccuccaaauguccuuucucagaggggccagcuaacccgugcagaaccagca

SEQ ID NO: 387076 - RNA, 64 nt, Human
ggagucauugugcuggaccucugaaaagaucugcaggggccaagauguugcagccaccggaggc

SEQ ID NO: 387077 - RNA, 64 nt, Human
uuuauuguaaauguuuuuugugcuuugcaugaacaggggccacguuguugcaauuguuucagua

SEQ ID NO: 387078 - RNA, 64 nt, Human
uggggagguuguggggccucaggcuccgggcaccaggggccaaccucaggcuccuaaagagaca

SEQ ID NO: 387079 - RNA, 64 nt, Human
ggggucaccuguuguuucuauacaacagcagggaaggggccauggagcuuuucccugcugggug

SEQ ID NO: 387080 - RNA, 64 nt, Human
gcucagugugguguuuggugcacagggguuggucaggggccauggccaaggcccugccacgcac

SEQ ID NO: 387081 - RNA, 64 nt, Human
cagauagacagugcugcccugcgaaguggcucucaggggccagugagggcugggcccacagaga

SEQ ID NO: 387082 - RNA, 64 nt, Human
gacucccggcagugcugacccugcagggcaagucaggggccaggaugcccucggaucagggccg

SEQ ID NO: 387083 - RNA, 64 nt, Human
ugcagaggaagcuucuacgcgcuagagaggaucaaggggccacacuggaccaugugaacagcca

SEQ ID NO: 387084 - RNA, 64 nt, Human
cgagguggcuggugcaggggugagggguccaugcaggggccacauccaaaaaggggagagggaa

SEQ ID NO: 387085 - RNA, 64 nt, Human
gaaccggacggcacagggcguucuugcccaccccaggggccaggcuugcggagggggagcccgc

SEQ ID NO: 387086 - RNA, 64 nt, Human
aucacugaaccucucaggaucaaugaccccuguaaggggccagagccuuggaggacacuaagag

SEQ ID NO: 387087 - RNA, 64 nt, Human
aggugaggccaagggcuuucuggccaucucagggaggggccaccagguuccuccccucacccca

SEQ ID NO: 387088 - RNA, 64 nt, Human
gagcaggggagugaagggguaugucaggcggggaaggggccaaggacacgucauuguacccuga

SEQ ID NO: 387089 - RNA, 64 nt, Human
acagaugauguccugugacugccccacagagauaaggggccaggagggauugaaaggcauccca

SEQ ID NO: 387090 - RNA, 64 nt, Human
cuauuuaucauaaguuaugccucugacaguccacaggggccaccaccuuuggcugguagcagca

SEQ ID NO: 387091 - RNA, 64 nt, Human
gggcccagcggucccugcagaagccagaaggugcaggggccaggggugggagcaucggagggag

SEQ ID NO: 387092 - RNA, 64 nt, Human
uuauugagaggguuuuauaaugguugauuuacucaggggccagguggggaguucucucccaugg

SEQ ID NO: 387093 - RNA, 64 nt, Human
uagauuguggcaaagaaugcucuggcugguuaccaggggccaacuccuucuccucuuccugacc

SEQ ID NO: 387094 - RNA, 54 nt, Human
ugaagaaggccaagcagugaccugaggggccacccuaggacuugaaaggaccgu

SEQ ID NO: 387095 - RNA, 64 nt, Human
cgggaggcagccccgggaugcugagaguugguggaggggccaggcuggacgcuuccugugggag

SEQ ID NO: 387096 - RNA, 64 nt, Human
agcucuuaggagcaaguugugggggcuuuucaagaggggccaggcuuccuggagggugacugau

SEQ ID NO: 387097 - RNA, 64 nt, Human
caccuccugcccaucccucucuugagggagcagcaggggccaggagcuaccccaggagugggcc

SEQ ID NO: 387098 - RNA, 64 nt, Human
uggucugggacugggucagcccugggggaucagaaggggccaucugggcccagcuguguacagc

SEQ ID NO: 387099 - RNA, 64 nt, Human
gucauuucuuaaugaaugaaucauaguuauaaccaggggccaagcugcccaagaggcucuucag

SEQ ID NO: 387100 - RNA, 64 nt, Human
agaaagugaacaggaagcaaacaggaagugagcaaggggccacuuccuacuuccuccuuuagcc

SEQ ID NO: 387101 - RNA, 64 nt, Human
cugggcccuaggccuagccccaucccuccccaugaggggccaagacacugccuaagguguggga

SEQ ID NO: 387102 - RNA, 64 nt, Human
cccugugggacagcccuagccccugcugucaugaaggggccaggcauuggucaccugugggacc

SEQ ID NO: 387103 - RNA, 64 nt, Human
gugcuccaagcccggaauugucuucaucaccaaaaggggccauuccgucuguaccaaccccagu

SEQ ID NO: 387104 - RNA, 64 nt, Human
ugauuuugaagauucugcacacguuccuuguccaaggggccauguuauugcugcucggaucacu

SEQ ID NO: 387105 - RNA, 64 nt, Human
agaugggggucaaaccacugccuuggccccaggaaggggccauagguaggucugaacaacugcc

SEQ ID NO: 387106 - RNA, 55 nt, Human
gaggcgucuacauucgcugagaggcaggggccacacggcgggaggaagggcucug

SEQ ID NO: 387107 - RNA, 64 nt, Human
ggucuuacuguuccaggguggccccagggcaggcaggggccacacuaugccugcgcccugguaa

SEQ ID NO: 387108 - RNA, 64 nt, Human
aaaguccagaaacuguucccaccugcuggagugaaggggccaaggagggugagugcaaggggcg

SEQ ID NO: 387109 - RNA, 64 nt, Human
ucccucucacugucugagaguuuaguuguagcagaggggccacagacagaagcuguggugguuu

SEQ ID NO: 387110 - RNA, 64 nt, Human
ucacccauacacauuuggcucaggguuaccgaagaggggccaagaaauuagaguccucagaaga

SEQ ID NO: 387111 - RNA, 64 nt, Human
aggucagcccugcuccccacagggccaggcuggcaggggccagugggcucagcccagguagggg

SEQ ID NO: 387112 - RNA, 64 nt, Human
guggggaaggagaggacugguuuccuggguucucaggggccaggaggaguaacagaaccagguc

SEQ ID NO: 387113 - RNA, 64 nt, Human
ugaaaggccaagccaagccaugcuuggcagggugaggggccaguugaguucugggagcugggca

SEQ ID NO: 387114 - RNA, 64 nt, Human
ggcuccggcuggauuuggguuuugugggaggugcaggggccaagagagacgugguaggucucca

SEQ ID NO: 387115 - RNA, 64 nt, Human
ugaugauggaaguggacgugggugugacgugagcaggggccaugaaugccgcagccuucagaug

SEQ ID NO: 387116 - RNA, 64 nt, Human
aagggaggugacagggugaagagggauccugugcaggggccaccugggagauagcagggggcac

SEQ ID NO: 387117 - RNA, 64 nt, Human
gcagcagcuggagcuaaaggaagggcaggcccacaggggccaccgcagagccgagucggggcgg

SEQ ID NO: 387118 - RNA, 64 nt, Human
caucuguuuuaccugcaucugcaggcgauggggcaggggccacggaaagagucugagggcugcu

SEQ ID NO: 387119 - RNA, 64 nt, Human
uaaacugggggaggcagggcacagggagaugcucaggggccagucccugugucucuggugccca

SEQ ID NO: 387120 - RNA, 64 nt, Human
gcaugagguucagucauuccagugagcuccaaagaggggccaccuguucucaaaagcauguugg

SEQ ID NO: 387121 - RNA, 64 nt, Human
ggaaggcccaagcagcucaucugcucuugggaccaggggccaguuggguugggucuggucacgg

SEQ ID NO: 387122 - RNA, 64 nt, Human
gcugggucaaggcagaaggccuuggugcacacccaggggccauagucaaugaagcaugcaggug

SEQ ID NO: 387123 - RNA, 64 nt, Human
ucagcgcaggggccagccagggacauagccagggaggggccacaucacuucccacuggaaaucu

SEQ ID NO: 387124 - RNA, 64 nt, Human
aaaguggcccacuuucuguggcucugaucagcgcaggggccagccagggacauagccagggagg

SEQ ID NO: 387125 - RNA, 64 nt, Human
gagacuuucuacuagaggacuugaaagagaacugaggggccacaaaauaaacuucaccuuccau

SEQ ID NO: 387126 - RNA, 64 nt, Human
acuaauuuuggcucaaacuuaugaggcaggaaauaggggccaacaguaaaugggggaggccucc

SEQ ID NO: 387127 - RNA, 64 nt, Human
cuuccucucugaaccaacaguucccuucucugacaggggccauccucuaucuuccauccagcgg

SEQ ID NO: 387128 - RNA, 64 nt, Human
ugcucuccaguaauugucuuuucauuuugaugguaggggccagacugaaugaauaaugcauucu

SEQ ID NO: 387129 - RNA, 64 nt, Human
ucccccacuauauuugaugggaacccagugagccaggggccaguuuugacaggucaguguccca

SEQ ID NO: 387130 - RNA, 64 nt, Human
cuuuacuuuguuuuaaaacugaucaguuuugccaaggggccagaauuauuccuuguuagaauug

SEQ ID NO: 387131 - RNA, 64 nt, Human
aacagaauauauguuggaccucugaaaaguuguaaggggccaauucuaaguauucuucacggca

SEQ ID NO: 387132 - RNA, 64 nt, Human
cauaauucagggcaauugucagucuuuuuagagaaggggccaggguggaacaaucccagugagu

SEQ ID NO: 387133 - RNA, 64 nt, Human
cagucaccaccugcagccucggcagggcagguacaggggccaccucagaugggagccugggucc

SEQ ID NO: 387134 - RNA, 64 nt, Human
gccggccugggcaggggguccaggugggccacacaggggccaggauggcggaagauacgggugg

SEQ ID NO: 387135 - RNA, 64 nt, Human
gacuaguccuggaaauguuugaggcuagacggggaggggccaggacccacccacugcuccuggg

SEQ ID NO: 387136 - RNA, 64 nt, Human
cugagagcugggccuccucuccagaaucauguggaggggccagaggccugccagacccccagcu

SEQ ID NO: 387137 - RNA, 64 nt, Human
gcgcgacaguggagccaaggguuagggcaccaggaggggccagguggcgucggcagcaucuguc

SEQ ID NO: 387138 - RNA, 64 nt, Human
auucagccgcagccucugggccggggcggcccccaggggccaggagagagcccuggagucccgc

SEQ ID NO: 387139 - RNA, 64 nt, Human
aagccaccuucucuugccccuuggccccuuugucaggggccaggggucugccgggugggggugc

SEQ ID NO: 387140 - RNA, 64 nt, Human
guggccguucccugccugggcaggggcuccaaggaggggccaucuggaaacuuguggacagaga

SEQ ID NO: 387141 - RNA, 64 nt, Human
caaaugugcaaccuguaaaaggucucuccacaccaggggccaggauccaguucccucaucucug

SEQ ID NO: 387142 - RNA, 64 nt, Human
auauguaugauguguugugcuuuuuuaaccaaggaggggccaguggauucccacagcacaaccg

SEQ ID NO: 387143 - RNA, 64 nt, Human
augugccuuguccaggaacugccugggccaugcgaggggccagcagagggcgccaccaccaccu

SEQ ID NO: 387144 - RNA, 64 nt, Human
guuaucuggggcuaagggaagggacuucauuuccaggggccacagccaagcccagaguccccca

SEQ ID NO: 387145 - RNA, 64 nt, Human
cacuagacccaguggaagggguuagagaccaaguaggggccaguuuccaauucacccugucagg

SEQ ID NO: 387146 - RNA, 64 nt, Human
ugucucuuuuccacccccugccauccucacuuagaggggccauggcacuagauggcacuagucc

SEQ ID NO: 387147 - RNA, 64 nt, Human
ucucccuugucgccuucacuucuacaggaggggaaggggccagggaggggauucucccuuuauc

SEQ ID NO: 387148 - RNA, 64 nt, Human
cucccucccuuucccccccaagcacagaggggagaggggccagggaaguggaugucuccucccc

SEQ ID NO: 387149 - RNA, 64 nt, Human
cccuuccuccccagggagcaaagccauaaggggcaggggccaccccacggcaucuccccagaag

SEQ ID NO: 387150 - RNA, 64 nt, Human
gccuuuuccaaggauaccauaaacuccugagagcaggggccaugucuuacucucaguaucuaca

SEQ ID NO: 387151 - RNA, 64 nt, Human
ucaacccacugccucuguucauccaagacuuccuaggggccagccuagcagacaagagaccaca

SEQ ID NO: 387152 - RNA, 64 nt, Human
uuuuauuuaaguucaagagaaaaaguguacacacaggggccacccgggguuggggugggagugu

SEQ ID NO: 387153 - RNA, 64 nt, Human
agggggacuuggggcuuccacgucccuggggggcaggggccaggccaggggggagggggcucag

SEQ ID NO: 387154 - RNA, 64 nt, Human
gguagccggagaagggccucuggagcaggucuggaggggccauggggaaguccugggugugggg

SEQ ID NO: 387155 - RNA, 64 nt, Human
aauucacccccauccacaguugucaguugugaagaggggccagaugacacccuaaagcaggcug

SEQ ID NO: 387156 - RNA, 64 nt, Human
gagaccaggugaagguagaauguaagaagaggccaggggccaagggcgaugcaggaccccccgg

SEQ ID NO: 387157 - RNA, 64 nt, Human
gugagggcccagaggucugggucccccagggggcaggggccaaagguccagaccccccaagucc

SEQ ID NO: 387158 - RNA, 64 nt, Human
ggaguggcuucccaaggucucacagcuuguccccaggggccaggcaggcugucugucugcuuca

SEQ ID NO: 387159 - RNA, 64 nt, Human
ugucuuuucuucccuggggcucccccucgaggcgaggggccaugcaugucugggggaccccugc

SEQ ID NO: 387160 - RNA, 64 nt, Human
gcugguuccgucugcucugcugccagcaggggagaggggccaucugaugcuuccccugggaauc

SEQ ID NO: 387161 - RNA, 64 nt, Human
caaggugagauuauggaauccagaaucuuuuuucaggggccacaugcccauuuccccacuugca

SEQ ID NO: 387162 - RNA, 64 nt, Human
ccggagggcuggggcggugcaggcucugggacccaggggccaggguggcucuucucuccccacc

SEQ ID NO: 387163 - RNA, 64 nt, Human
uggucccugcuuuucugaguaccauguuuccaggaggggccaugggggucagggugguuuugag

SEQ ID NO: 387164 - RNA, 64 nt, Human
ucagggcuauuuuuucccccacaaacccaagggcaggggccacucuuagcuaaaucccuccccg

SEQ ID NO: 387165 - RNA, 64 nt, Human
ggacuggacauuuugacuccaaggagacaaccccaggggccaacagccccagcugugaccccca

SEQ ID NO: 387166 - RNA, 64 nt, Human
gggaaccugaaucccugggggagacagaaggggcaggggccaccagccuccccuucuuguggug

SEQ ID NO: 387167 - RNA, 64 nt, Human
ucccucgccagaggagcacuuggcaaggucagugaggggccaguagacccccggagaagcagua

SEQ ID NO: 387168 - RNA, 64 nt, Human
cccuccuuagacugagcugucagagcaagcaauuaggggccagccugccuccaccucccacccc

SEQ ID NO: 387169 - RNA, 64 nt, Human
agagagcuguuuagguuuuccgaucuuuuugcucaggggccaaacacugaaggcacguacugcc

SEQ ID NO: 387170 - RNA, 64 nt, Human
gucacccaugcuaggguccccaaagcacuggggcaggggccagagcagcagcacccagugcucc

SEQ ID NO: 387171 - RNA, 64 nt, Human
ggagaagggcaggggcaggagagggcugcggaggaggggccacggugcagcaggccguggggac

SEQ ID NO: 387172 - RNA, 64 nt, Human
cuggcaccaacaagccccccaggugccggggaagaggggccaggccugggggccgcccagcucc

SEQ ID NO: 387173 - RNA, 64 nt, Human
ugcccuaaagggcucuugagccucugggaaugggaggggccaagagaaggaaaacccugucuuu

SEQ ID NO: 387174 - RNA, 64 nt, Human
cuuggggauggcacuccacacacgacagagaugcaggggccagggaagcccagcgcucggugcc

SEQ ID NO: 387175 - RNA, 64 nt, Human
ccccaaagcagugucucuauucacgguccugagcaggggccaugggauugggcucugggcacug

SEQ ID NO: 387176 - RNA, 64 nt, Human
cuuuccuuccaucccuacccccuaagagccauuuaggggccacuuuugacuagggauucaggcu

SEQ ID NO: 387177 - RNA, 64 nt, Human
ccuugacaccuguaaggacaggaucugcccuguaaggggccagccgucaggaaucuggccauga

SEQ ID NO: 387178 - RNA, 64 nt, Human
agaaagaacagagaagugacagcuagggguugagaggggccagaaaaacaugaaugcaggcaga

SEQ ID NO: 387179 - RNA, 64 nt, Human
uggucucagggggaccccagggaugccccagaucaggggccagaggggaugcuuagcaaaccca

SEQ ID NO: 387180 - RNA, 64 nt, Human
cuagaccuugaugccuggguggagggcccuuguaaggggccauagccucuucaggaccaacugg

SEQ ID NO: 387181 - RNA, 64 nt, Human
gcacuguuugaagaggagcagagaggcuggcacuaggggccacuggggggcuggggucuccagg

SEQ ID NO: 387182 - RNA, 64 nt, Human
gagaggccuuggccaggagcggcgggcuuucccgaggggccacugucccugcagaguggaugcu

SEQ ID NO: 387183 - RNA, 64 nt, Human
ccgcgcccuccagggucgucccuggcccaaggccaggggccacaaguuaguuggaagccggcgu

SEQ ID NO: 387184 - RNA, 64 nt, Human
ggaagggcggcacuggagagaugggcccaucauuaggggccagcaucccaggaacuggaccuuu

SEQ ID NO: 387185 - RNA, 64 nt, Human
agcugggcggccggggcaggcuuagggcacaguuaggggccaaggagagggaaggccagggccc

SEQ ID NO: 387186 - RNA, 64 nt, Human
gguguggcugggcugcucucacauacagaggccgaggggccaauucguucucugccacagggac

SEQ ID NO: 387187 - RNA, 64 nt, Human
ucaggagagagcuuccuguuucuaaguggccugcaggggccacucucuacugguaggaagaggu

SEQ ID NO: 387188 - RNA, 64 nt, Human
ugccccauugagaucuuccugcugaguccuuuccaggggccaauuuuggaugagcauggagcug

SEQ ID NO: 387189 - RNA, 64 nt, Human
cugcucacagagcccccucaccucccuggggaugaggggccaggccaugacccugaaagccuag

SEQ ID NO: 387190 - RNA, 64 nt, Human
caagggcaagcaaggaauacguucccccagccccaggggccaccgcggcucuccccuuccccag

SEQ ID NO: 387191 - RNA, 64 nt, Human
cucuacgggaggccucccggaacaaaagcggaagaggggccagccucaucccacugccagcuga

SEQ ID NO: 387192 - RNA, 64 nt, Human
gggcagggcagccaccaggagagauaugccuggcaggggccaggacaaaaugcaaacuuuuuuu

SEQ ID NO: 387193 - RNA, 64 nt, Human
gagcauguugguggcagugaucuggagaggcugcaggggccacgaguuugcagaugcuguacuu

SEQ ID NO: 387194 - RNA, 64 nt, Human
aaugcagccauccuugugugauuaggaggguuucaggggccacuggacuauuugcaaggugaca

SEQ ID NO: 387195 - RNA, 64 nt, Human
uauaccauggccugcgcacguggcgacgucccugaggggccagucuccucacugguggggaacg

SEQ ID NO: 387196 - RNA, 64 nt, Human
ccaccacagccccucucagcccucaguaggugggaggggccagcugccucuuuaggccaguugc

SEQ ID NO: 387197 - RNA, 64 nt, Human
cccucagcccagcagagagggcaucaaccaaggaaggggccaugcuggggugcugcucagcugu

SEQ ID NO: 387198 - RNA, 64 nt, Human
gaacccugugccccaccaggauuggccugcugcuaggggccaggggcccugaccaggaagacag

SEQ ID NO: 387199 - RNA, 64 nt, Human
uuguaggcucaccuggcacaguggccaagcaggaaggggccaccagugcauagcccaugcugaa

SEQ ID NO: 387200 - RNA, 64 nt, Human
ggacuugucccaagucugacagccagagcguuagaggggccagcggcccucccaggcgaucuug

SEQ ID NO: 387201 - RNA, 64 nt, Human
aagauguugaggcgagcagggcaggcccccggggaggggccagaguuuucuaugaaucuauuuu

SEQ ID NO: 387202 - RNA, 64 nt, Human
cagcccugagugcuuccgagcuggcggacugcccaggggccaucagaggaugguggugcugcug

SEQ ID NO: 387203 - RNA, 64 nt, Human
ggcuggguaguuggggucccagaaagccggggguaggggccacccuggaauggggcaggggaag

SEQ ID NO: 387204 - RNA, 64 nt, Human
ucagcccagcaccaucuguuccccuagacuucucaggggccagcccagucugggccacccuuug

SEQ ID NO: 387205 - RNA, 64 nt, Human
aggcugcggcaucacccucagaccuuggagcccaaggggccacugcccuugaaguggagugggc

SEQ ID NO: 387206 - RNA, 64 nt, Human
cacaauaugcuguguaucucaccagguagcugucaggggccaccgagagugucguuaaaaaugg

SEQ ID NO: 387207 - RNA, 64 nt, Human
cuuuucuguucuuuucggaggagagggcccgagaaggggccauaccagggcgcggcgcuggguu

SEQ ID NO: 387208 - RNA, 64 nt, Human
uacuguuugucuucuccccaggguucaguccucaaggggccauccugucccaccaugcagugcc

SEQ ID NO: 387209 - RNA, 64 nt, Human
gagaaggaaugucuuugguccucuugccaucuauaggggccaaauauauucucuuugguguaca

SEQ ID NO: 387210 - RNA, 56 nt, Human
gccugacaggguaugugugaagaaccaggggccagagcugggggguggcugggucu

SEQ ID NO: 387211 - RNA, 64 nt, Human
cccacacagccgcugcuacuuugggggguggggaaggggccaagcugcagacacacacagucau

SEQ ID NO: 387212 - RNA, 64 nt, Human
aguuugcugcagcauuuacaucugcccuaaucagaggggccaccucuaacuccuccuccuccuc

SEQ ID NO: 387213 - RNA, 64 nt, Human
gaccucaagaucaaggaaaggaggauggacgaacaggggccaaacuggugggaggcagaggugg

SEQ ID NO: 387214 - RNA, 64 nt, Human
uuagcccauuugcuuucucuaccuuggggaccccaggggccaagcaguucuccaucuagucaca

SEQ ID NO: 387215 - RNA, 64 nt, Human
gcccaacucacagggcugacucucauccuuccaaaggggccaguuguucugugcacuuguccac

SEQ ID NO: 387216 - RNA, 64 nt, Human
gucucuagccuggagaagagcaaaauggagggggaggggccagaaauaggaggagguuuugaag

SEQ ID NO: 387217 - RNA, 64 nt, Human
agcacccucuccccgggaggcccuagcuuccgugaggggccaucaccagccauuccuuggaggg

SEQ ID NO: 387218 - RNA, 64 nt, Human
gcucagccucaggcccaggcacugauuguggcagaggggccacuacccaaggucuagcuaggcc

SEQ ID NO: 387219 - RNA, 64 nt, Human
uggaagagaccauaaaggcuucaaaacuagaagugcgcaugaaggaugcuucaugcccuguucc

SEQ ID NO: 387220 - RNA, 64 nt, Human
ugauaauaugguguuaugggaaaacacauuuugugcgcaugaugaagagagcaccgugaaucua

SEQ ID NO: 387221 - RNA, 64 nt, Human
agauccggaacgucagccagcucccagccacauggcgcaugaaggagagcccagucucccucca

SEQ ID NO: 387222 - RNA, 64 nt, Human
gcuuugugggcuccaggccuguacucaucggcaggcgcaugaguaucugugggaguccucuaga

SEQ ID NO: 387223 - RNA, 64 nt, Human
uauuaaagcgagcaaagucugcauuuuaccuggugcgcaugaguggggucuuuaagaguuuugg

SEQ ID NO: 387224 - RNA, 64 nt, Human
gaugaaauuuuaaaggaguuucaguuuuaaaagugcgcaugauucuacauaugagaauucuuua

SEQ ID NO: 387225 - RNA, 64 nt, Human
cugggcacgccagucugcaccaugugucccugcggcgcaugagugacuggcguauuuagcccgu

SEQ ID NO: 387226 - RNA, 64 nt, Human
gguguuuggugaugguuauugacgacaauguguagcgcaugauuguuuuuauaccaagaacauu

SEQ ID NO: 387227 - RNA, 64 nt, Human
auuuaauucauguugccuugcauaauggucagaggcgcaugaauuugugaagguggaaauaaac

SEQ ID NO: 387228 - RNA, 64 nt, Human
ucucuucuaacauuuaaggaauagagccuaauuagcgcaugaauacguguugaacugugaauga

SEQ ID NO: 387229 - RNA, 64 nt, Human
uguuuguugcuuacaguuugacaacuuaaaugcugcgcaugaaaccucuaaguuggaaauugaa

SEQ ID NO: 387230 - RNA, 64 nt, Human
ucugcuaggacuuaccccagccacugaguggcaggcgcaugagauuuguggcuguuccugaugc

SEQ ID NO: 387231 - RNA, 64 nt, Human
ccagaaagaaacaacagaaaccaaaacucacaaggcgcaugauuacuuguuuuauauuucaugu

SEQ ID NO: 387232 - RNA, 64 nt, Human
ucuugagcagguggagccauggugcucugugguggcgcaugauucacugagcaaacagcacuuu

SEQ ID NO: 387233 - RNA, 64 nt, Human
ccucugaagcagugaagucugugccuaugccgagcgcgcuaagaagucucccuuccagcuguuc

SEQ ID NO: 387234 - RNA, 64 nt, Human
cucguguucaccauccccuugaucaguguccauccgcgcuaauuugcaucaugaacugaacagu

SEQ ID NO: 387235 - RNA, 64 nt, Human
ugccauggcuuuuucauugagggccuaaaguaaucgcgcuaagaauaaagggaaaacggcgucg

SEQ ID NO: 387236 - RNA, 64 nt, Human
cccuggucuuguuaccugugugugugcuggugcugcgcaugaggacugucugccuuugagggcu

SEQ ID NO: 387237 - RNA, 64 nt, Human
auaacucagaggaacagacacucaaacucccaaagcgcaugauugcugggaaacaguagaaacc

SEQ ID NO: 387238 - RNA, 64 nt, Human
guaagugcaguggggguaagcaguccugugaguggcgcaugaacgcuggagcuuauuccgccgc

SEQ ID NO: 387239 - RNA, 64 nt, Human
ucuuccuccucuacuacaugguggugcagggcaagcgcaugaguaaagagacguggggcuauuu

SEQ ID NO: 387240 - RNA, 64 nt, Human
auccccaggaccccauccuguucucggggacccugcgcaugaaccuggaccccuucggcagcua

SEQ ID NO: 387241 - RNA, 64 nt, Human
cgacaagcuggacccccugcucccgggggggcgagcgcaugacccccccgcccucgcgcugccu

SEQ ID NO: 387242 - RNA, 64 nt, Human
uuuagucugacuugacuauuguuuuuccuuucuggcgcaugaauccauacaucauuccuggaag

SEQ ID NO: 387243 - RNA, 64 nt, Human
gggucagucaggguucgggggcugcagcagccaagcgcaugagagguguuuccuuggccuucca

SEQ ID NO: 387244 - RNA, 64 nt, Human
gugugugcucacaaccacucucaccuguucgugagcgcaugaggcgaaguuaucuuauauuucc

SEQ ID NO: 387245 - RNA, 64 nt, Human
gcggcggcccguguuguguuuugugcuguguccacgcgcuaaggcgacccccucccccguacug

SEQ ID NO: 387246 - RNA, 64 nt, Human
guagggcggggggcauggaggccaggucucaguccgcgcuaaacaaugcaauaauuuaaaauca

SEQ ID NO: 387247 - RNA, 64 nt, Human
agccgagcgaggaggaccaggcagccgccgcugccgcgcuaagccaccaccugcgcuuagguag

SEQ ID NO: 387248 - RNA, 64 nt, Human
ggcagaguagacaucuagccucccuaaggguaugcgcgcuaaagcccagcucucgaucucaccu

SEQ ID NO: 387249 - RNA, 64 nt, Human
uucauuuucaaaugccaaggcaagugacuagacucgcgcuaauacagugcuggacaacacauuc

SEQ ID NO: 387250 - RNA, 64 nt, Human
ggugauuucugccgugaucuguuugauauuucuucgcgcuaauguguucagauuucguuugggu

SEQ ID NO: 387251 - RNA, 64 nt, Human; identical to SEQ ID NO: 387233

SEQ ID NO: 387252 - RNA, 64 nt, Human; identical to SEQ ID NO: 387234

SEQ ID NO: 387253 - RNA, 64 nt, Human; identical to SEQ ID NO: 387235

SEQ ID NO: 387254 - RNA, 64 nt, Human; identical to SEQ ID NO: 387245

SEQ ID NO: 387255 - RNA, 64 nt, Human; identical to SEQ ID NO: 387246

SEQ ID NO: 387256 - RNA, 64 nt, Human; identical to SEQ ID NO: 387247

SEQ ID NO: 387257 - RNA, 64 nt, Human; identical to SEQ ID NO: 387248

SEQ ID NO: 387258 - RNA, 64 nt, Human; identical to SEQ ID NO: 387249

SEQ ID NO: 387259 - RNA, 64 nt, Human; identical to SEQ ID NO: 387250

SEQ ID NO: 387260 - RNA, 64 nt, Human
cccaucagcaucccacgaucggccuugguaaccgccgcgguagaucauuuuuaucccgccaggg

SEQ ID NO: 387261 - RNA, 64 nt, Human
caugguucaaagaggggcuaggcugauggggaagggggcugagcagcucccaggcagacugccu

SEQ ID NO: 387262 - RNA, 64 nt, Human
uuguagcguguggcugggccaggccccagcgggaggggcugagcuggggcugugugcuugcuag

SEQ ID NO: 387263 - RNA, 64 nt, Human
ucacugaggcaacaugaagcccgaggcccagaugggggcugaacagguagggcacaucaguuaa

SEQ ID NO: 387264 - RNA, 64 nt, Human
gacgccuuagcagccccgcagcuggugcucugccccgcgguacuggcgccaucagggccucccu

SEQ ID NO: 387265 - RNA, 64 nt, Human
gggagaagcacuuaugacaaggcuauuuuuuaaaccgcgguauuauccuaauuuaaaagaagau

SEQ ID NO: 387266 - RNA, 64 nt, Human
gaugaguauuuuaccagaguguuuccauucauauccgcgguauggaggauuugaggaacaguaa

SEQ ID NO: 387267 - RNA, 64 nt, Human
aggcuuuaaaagccuauuaacuguuucagggcaaccgcgguacagacguggucucugugagacu

SEQ ID NO: 387268 - RNA, 64 nt, Human
uuuagacuauuuauuaccgggaucacaggccuggccgcgguaacagacuuuuacauggaauugu

SEQ ID NO: 387269 - RNA, 64 nt, Human
ugcccgcagagcccacgcccgacuagcaggcaugccgcgguagguaagggccgccggaccgcgu

SEQ ID NO: 387270 - RNA, 64 nt, Human
gcgggucguggggaccaagcacauugguccuaaaggggcugaagagccugaacugcaccuaacg

SEQ ID NO: 387271 - RNA, 64 nt, Human
agagauuucggaggccauccugccaggggcggacggggcugacuccugcucucuggaggacggu

SEQ ID NO: 387272 - RNA, 64 nt, Human
ccugcaagccggcccagccuguccaggauacaguggggcugagcacccccaggccuuccacucc

SEQ ID NO: 387273 - RNA, 64 nt, Human
cgggauguggagggugagcgcugugggcagcucgggggcugaaagcugggaagagaaaucugaa

SEQ ID NO: 387274 - RNA, 64 nt, Human
caacuagccccuguuuuuuccucccugaacucuuggggcugagcugcaaccacccaacuuucuu

SEQ ID NO: 387275 - RNA, 64 nt, Human
ugcagggcgguguggcagguggagagguccuacaggggcugagugaccccacucugaguucacu

SEQ ID NO: 387276 - RNA, 64 nt, Human
ggcacguggcagcagucgcugaucucccagcugaggggcugagcacuggaaugcuguggcugca

SEQ ID NO: 387277 - RNA, 64 nt, Human
uccuccuccaccaccucaucccgcccaccuguguggggcugaccaaugcaaacucaaauggugc

SEQ ID NO: 387278 - RNA, 64 nt, Human
ucccaggaugggugucuggggagggucaagggcuggggcugagcuuuaaaaugguuccgacuug

SEQ ID NO: 387279 - RNA, 64 nt, Human
acacugaugcaaggauuacagaaacugaugccaaggggcugagugaguucaacuacauguucug

SEQ ID NO: 387280 - RNA, 64 nt, Human
uuauuugaaaugugcuggguaguguucucauuugggggcugaaguuagcaacugggccuucagc

SEQ ID NO: 387281 - RNA, 64 nt, Human
guugucaucucuucccagcucuuugguccaagagggggcugaguuuggugccagcuggcaaaug

SEQ ID NO: 387282 - RNA, 64 nt, Human
auuggggugggagcaagggacagggagcagggcaggggcugaaaggggcacugauucagaccag

SEQ ID NO: 387283 - RNA, 64 nt, Human
gugguagagugugccugaagucccagauacuuggggggcugaggugggaggaucucuugagccu

SEQ ID NO: 387284 - RNA, 64 nt, Human
uucuuaaggggaugggggucaggggcuaggggagggggcugaguuuccccacuuuaggaggagg

SEQ ID NO: 387285 - RNA, 64 nt, Human
agauggggcuucaccccuccccagaguaagagcuggggcugacagucccacccugucauuccua

SEQ ID NO: 387286 - RNA, 64 nt, Human
ggaccaguggccccuuguuugccaaaggcagaguggggcugagaaacaggcugcggugauugca

SEQ ID NO: 387287 - RNA, 64 nt, Human
cugcccugggaaccaggcagccuuccagaccucaggggcugaggcagacuauuagggcagggcu

SEQ ID NO: 387288 - RNA, 64 nt, Human
uggcgcgugaguuagauguggucccugcccucauggggcugacaguccuaaaaucaagugcuag

SEQ ID NO: 387289 - RNA, 64 nt, Human
gaucuggaggaggaggaaaaagauacacucccuuggggcugagcaugccccacacucuuggauc

SEQ ID NO: 387290 - RNA, 64 nt, Human
ucugcccagaggggcagccaggcugcucagggaaggggcugaaagcggcagaggagugcccugg

SEQ ID NO: 387291 - RNA, 64 nt, Human
uugugcuacuccuuuguaaagucacugccuuaagggggcugauggcgccaccugugccuuacau

SEQ ID NO: 387292 - RNA, 64 nt, Human
gggaggggugggcuacuagagucagagcggguuuggggcugaccaguuugggagaggagaaaag

SEQ ID NO: 387293 - RNA, 64 nt, Human
guggucgugggcaccuguagucccagcuacucagggggcugaggcaggagaauggcgugaaucc

SEQ ID NO: 387294 - RNA, 64 nt, Human
ugccauuuguguguggcuagcuguuuccagccagggggcugaggcaccugcagucacccacacu

SEQ ID NO: 387295 - RNA, 64 nt, Human
acgaagcggagagagccaagacggaggaggggaaggggcugaggacgagacccccauccagccu

SEQ ID NO: 387296 - RNA, 64 nt, Human
aucagaaauugaggacagcgaugcgggcagcuggggggcugagagcacccagaggaccgaggac

SEQ ID NO: 387297 - RNA, 64 nt, Human
aguccugcaucauagccaccaaauagugaggaccggggcugaggccacacagauaggggccuga

SEQ ID NO: 387298 - RNA, 64 nt, Human
acaggggcauauaccuguaauccuagcuauucaaggggcugaggugggaggaucgccugagccc

SEQ ID NO: 387299 - RNA, 64 nt, Human
ugcagcaagucccaggcaaugccagcauuucaugggggcugaggcagaacccaggagcuccaag

SEQ ID NO: 387300 - RNA, 64 nt, Human
cucacagucucaugcucgguaccaucagcuugcaggggcugaagcaugggcugcccagaacccc

SEQ ID NO: 387301 - RNA, 64 nt, Human
uaauuucugugaaauaaagacuuuuuguauuucuggggcugaggcucagcaacagccccucagg

SEQ ID NO: 387302 - RNA, 63 nt, Human
agcaguugcaaacauuuugaagagagaccgucgggggcugaggggcaacgaagaaaaaaaaua

SEQ ID NO: 387303 - RNA, 64 nt, Human
cgugaaccaccaugcccagccgaaaagcuuuugaggggcugacuucaauccauguaggaaagua

SEQ ID NO: 387304 - RNA, 50 nt, Human
ggccaggcaguuacuccugaggggcugaacaccaucccucccacuagccu

SEQ ID NO: 387305 - RNA, 56 nt, Human
aggaggaaaguccagucugaauccauggggcugaaggguaaauugagcaguucaug

SEQ ID NO: 387306 - RNA, 64 nt, Human
gaaagaggaagaaggguaaacugagcuagccccuggggcugaguacuccugcagggcuggagga

SEQ ID NO: 387307 - RNA, 64 nt, Human
cuaggagugagcuggggccugcugagguggggguggggcugacucugcaaaauggggguguccc

SEQ ID NO: 387308 - RNA, 64 nt, Human
ucagguggggacgcaucucagccuggaaccaacaggggcugaggagagagggcacaggagagag

SEQ ID NO: 387309 - RNA, 64 nt, Human
aaauugguugauacugacccccaggcccugcaguggggcugacuccagaucucuccugcccucc

SEQ ID NO: 387310 - RNA, 64 nt, Human
gcccugggaggcagugauggguuaguggauggaaggggcugacagacagcccuccaucuaaacu

SEQ ID NO: 387311 - RNA, 50 nt, Human
gugaauucuguguccuuugaggggcugauggcaauaucuaaaaccaggca

SEQ ID NO: 387312 - RNA, 64 nt, Human
uggcuuuucgaccacccuagcacuggcccuaggaggggcugaguuaucagagcagcaacccuuc

SEQ ID NO: 387313 - RNA, 64 nt, Human
gagaggcaugggggcccaaaggggagcguggggaggggcugaggauaccccaaaguccaggcua

SEQ ID NO: 387314 - RNA, 64 nt, Human
aaguuucuagaagccacuccagccacuccuuccuggggcugacaaaagggugauuccaagauca

SEQ ID NO: 387315 - RNA, 64 nt, Human
uuuguggcaggaaccccuggcugugcaaauaaauggggcugaggccccugugugauauugaaag

SEQ ID NO: 387316 - RNA, 64 nt, Human
gguugccacugaagaccucauucuccugucuggaggggcugauaggacccccuuccgggggucc

SEQ ID NO: 387317 - RNA, 64 nt, Human
cgcuacauccccuaacugcaugcagauguggaaaggggcugauccagauugggucuuccugcac

SEQ ID NO: 387318 - RNA, 64 nt, Human
aaccaugcaaguuacugcaguucaucucaugggaggggcugaaauacacgcuaguaacuccucu

SEQ ID NO: 387319 - RNA, 64 nt, Human
ccaucagauuucaguaguacauuugggaaaagaaggggcugauggcguuaaccagguucucaau

SEQ ID NO: 387320 - RNA, 64 nt, Human
agaauugagaagcauuucuccccugccccaccccggggcugacauuucuaagcaagauaggaag

SEQ ID NO: 387321 - RNA, 64 nt, Human
gcuaaggggaaggcugaugucaggagagggagagggggcugaggagguagugcuguaggcccag

SEQ ID NO: 387322 - RNA, 64 nt, Human
uucuggagauggggcagcagguggcucuucugcuggggcugacuuguccagaaggggacaaagu

SEQ ID NO: 387323 - RNA, 64 nt, Human
acuuuguaugaccguuugcagucugagcaggccaggggcugacagcuaaugucaggacccucag

SEQ ID NO: 387324 - RNA, 64 nt, Human
gugaaugugucuugcggcagcugcagcaaguggaggggcugaacuacuggccagcucacuggau

SEQ ID NO: 387325 - RNA, 64 nt, Human
gucuuggagaaaccagaauuuuggaagagcaaauggggcugagugcaguggcucaugccuguaa

SEQ ID NO: 387326 - RNA, 64 nt, Human
caucugggcuggcagaggggacagaguucagggaggggcugagucuggcuaggggccgagucca

SEQ ID NO: 387327 - RNA, 64 nt, Human
cucaugugaauuccugcccuggcgccucuucccuggggcugaaucaggcccugcugcaaaacuc

SEQ ID NO: 387328 - RNA, 64 nt, Human
uuauuuuuguuucucuuugcagagagccaaauauggggcugaugggaacugcaacgucauuaag

SEQ ID NO: 387329 - RNA, 64 nt, Human
auuaauguaacgggccaugggguauguacauguaggggcugagguuggaggccuacuaauuucc

SEQ ID NO: 387330 - RNA, 64 nt, Human
gcuggggcuggagaaugagagacugcgcucucuuggggcugagggagcaccaugcagcuucacc

SEQ ID NO: 387331 - RNA, 64 nt, Human
cuccuuccaggccccaggcuggaugcuggguucuggggcugagaguggggcuagacugggcugg

SEQ ID NO: 387332 - RNA, 64 nt, Human
ugcugggcuggcucccucuuggucuucccaggcuggggcugaccuuccucgcagagaggccagg

SEQ ID NO: 387333 - RNA, 64 nt, Human
ucuccaccugucuucuccagggagcucccauguuggggcugaagacgagcaggggcaaccugcc

SEQ ID NO: 387334 - RNA, 64 nt, Human
auuggcucuuacagacaagaaaacuagacucagaggggcugaguccacaucccagacagcucac

SEQ ID NO: 387335 - RNA, 64 nt, Human
cauccccaggcauaacaccaccuucccacugucuggggcugacuugcacagaaauucuguugaa

SEQ ID NO: 387336 - RNA, 64 nt, Human
aaaggaguuaguuuugagguaacugcauucauuaggggcugaaaauaaauguuaaaaauguuua

SEQ ID NO: 387337 - RNA, 64 nt, Human
cgauguggggaggaacagagggcugaagggagagggggcugacuguuccauucuagcuuuggca

SEQ ID NO: 387338 - RNA, 64 nt, Human
augguggcaggugccuguaaucccagcuacucagggggcugaggcaggggaauggcuugaaccc

SEQ ID NO: 387339 - RNA, 64 nt, Human
ggucccuggaguccccagcaccuggggcccugguggggcugaugucacagguguuuacugugcu

SEQ ID NO: 387340 - RNA, 64 nt, Human
gccacccucauccccugccugggaggcucucccaggggcugauggggggguucugugagggaga

SEQ ID NO: 387341 - RNA, 64 nt, Human
uagaauggaccacugagagccacaggaccguuuuggggcugaccugucuuauuacguauguacu

SEQ ID NO: 387342 - RNA, 64 nt, Human
gcgaugaugagaccaucugagauggccccgcuguggggcugacuucuccccggccgccugcuga

SEQ ID NO: 387343 - RNA, 64 nt, Human
aaaaggaugcuccggggccauuguuaguggguuuggggcugagaugagugauccugccucuggu

SEQ ID NO: 387344 - RNA, 64 nt, Human
cuccuaugaucucagguucuccuugauugggacuggggcugaagguugaagaggugagcacggc

SEQ ID NO: 387345 - RNA, 64 nt, Human
ucuucuggauuucaucagagauuacagccagaugggggcugaagaccauccucuugaccacaga

SEQ ID NO: 387346 - RNA, 64 nt, Human
aaggguccugaagccccagaacuggcauguggaaggggcugaggccuaauugagguugguggau

SEQ ID NO: 387347 - RNA, 57 nt, Human
ggauccucacagucaagugacgaggcuggggcugaaagcagaagcaugcacagggag

SEQ ID NO: 387348 - RNA, 64 nt, Human
acuuuuauugcuugucuggguggauggggcaggaggggcugagggccugucccagacaauaaag

SEQ ID NO: 387349 - RNA, 64 nt, Human
auucauuuuauacaaagcccuccagccuguuuguggggcugaaaccccaucccuaaaauauugc

SEQ ID NO: 387350 - RNA, 64 nt, Human
auuggagaaucuuaagaaaugcaagcuuguucagggggcugagaagauccugaguacacuaggu

SEQ ID NO: 387351 - RNA, 64 nt, Human
caguggccuucaugggagaagggcugaccucugaggggcugaggggugaggccagggcccucca

SEQ ID NO: 387352 - RNA, 64 nt, Human
acgcccugugggugauggucacggugggugggugggggcugaccccagcuuccaggggacuguc

SEQ ID NO: 387353 - RNA, 64 nt, Human
ggagacaggccacugcgucaccugugaguggucaggggcugauguggcaacacccucugccaag

SEQ ID NO: 387354 - RNA, 64 nt, Human
uugccccuccguaguccugcaaaguguccuuuguggggcugaugcccugaucccaguccagacg

SEQ ID NO: 387355 - RNA, 64 nt, Human
cuugcaccuccaguuugcacagggauuuguucugggggcugagggcccuguccccacccccgcc

SEQ ID NO: 387356 - RNA, 64 nt, Human
agccccaccuucagggaccaccuggaaugugugaggggcugacagcacaguaacgugcauacau

SEQ ID NO: 387357 - RNA, 64 nt, Human
gaaccccuguagcagagccucccguccacccucaggggcugagacagcucucgaggaguggugc

SEQ ID NO: 387358 - RNA, 64 nt, Human
uggucaaggcagaggaggagaggaggaaaggaugggggcugaagagcagaagggaggggagaca

SEQ ID NO: 387359 - RNA, 64 nt, Human
agcuccugccugacuuaggagucagagcccggcaggggcugaggaggaggagcagggggugcug

SEQ ID NO: 387360 - RNA, 64 nt, Human
guaaaaggcagaauguuugggccaugaagaaguaggggcugaagaggaagguggaaggagauaa

SEQ ID NO: 387361 - RNA, 64 nt, Human
uguacgcccuguauaacaguguccgcagaagcaaggggcugaaaagaucugaagguagccuccg

SEQ ID NO: 387362 - RNA, 64 nt, Human
uagguggaaggaguuugggguucuuccuggugcaggggcugaaauaacccagaugcccccaccc

SEQ ID NO: 387363 - RNA, 64 nt, Human
uggggcugaaguuucuggggucacauggucagaaggggcugagcuggucuuucacugcaggccc

SEQ ID NO: 387364 - RNA, 64 nt, Human
cagugccuuccuccagccucacaaccuuucugcuggggcugaaguuucuggggucacaugguca

SEQ ID NO: 387365 - RNA, 64 nt, Human
cacuguguacccgggcugugugggccagaacuggggggcugagucuucccuggccccuuggaag

SEQ ID NO: 387366 - RNA, 64 nt, Human
uaugugaacgcaugcaagcuugauucaccuucagggggcugauaaccuaguaaaucaucaaaau

SEQ ID NO: 387367 - RNA, 64 nt, Human
aauuauaucucaauaaaguuguuaguaaauaaauggggcugaagauguuauccuucauuguggu

SEQ ID NO: 387368 - RNA, 64 nt, Human
aguaccuucuaauuuccaauaguccgugaaaguuggggcugaaguaccuaagugugaaugucuc

SEQ ID NO: 387369 - RNA, 64 nt, Human
ggagcagggacucagcacagaauucacuuuagacggggcugaaggagugucccuccucuaugug

SEQ ID NO: 387370 - RNA, 64 nt, Human
caguggccaggcagggagugucugcaguccugguggggcugagccugaggccuuccagaaagca

SEQ ID NO: 387371 - RNA, 64 nt, Human
aaucccuggcccaaaggccugucugggcccaucuggggcugaggacacacagauacauaaugac

SEQ ID NO: 387372 - RNA, 64 nt, Human
cuggcugaagcccgcuuucagcacgccguaaccaggggcugacaaugcgaggucgcaacugaga

SEQ ID NO: 387373 - RNA, 64 nt, Human
aggucuccccauccccauucggggcugacgauggggggcugauggcugccccugcguggccuga

SEQ ID NO: 387374 - RNA, 64 nt, Human
ucacacucagaaagaggucuccccauccccauucggggcugacgauggggggcugauggcugcc

SEQ ID NO: 387375 - RNA, 64 nt, Human
ccuggucagcuugcuuggaauccagcaggcagcuggggcugagugaaaacaucugcacaacugg

SEQ ID NO: 387376 - RNA, 64 nt, Human
guuucccuuuuguugaucuacuugaccaagcaaaggggcugaaaaacugaauaaggaaacaacu

SEQ ID NO: 387377 - RNA, 64 nt, Human
auggaggcccaagauucuacagcauauuccuggcggggcugaaauuggaaccugggccuccuga

SEQ ID NO: 387378 - RNA, 64 nt, Human
cugcagcugggggcucuuuuccuggucauuggguggggcugagugccacauguucccacauuaa

SEQ ID NO: 387379 - RNA, 64 nt, Human
guggcagggagggaggcuguguccucaguggccuggggcugagcagaccuuaggaaggggcccu

SEQ ID NO: 387380 - RNA, 64 nt, Human
ccugcagugucuguggggguuucucugccagcagggggcugagcagagcccauccaggacacuc

SEQ ID NO: 387381 - RNA, 64 nt, Human
ugagaagaaaagaacauuuaauaaauguauguguggggcugagguucuaaaggaauugaaaaga

SEQ ID NO: 387382 - RNA, 64 nt, Human
ugguaaagagugaaugauaguagugaauauaaauggggcugaggaaacuuuaagcauaaaagau

SEQ ID NO: 387383 - RNA, 64 nt, Human
cugagcaugggccaucacugccagucaggggcugggggcugagcccucaccccccccuccccua

SEQ ID NO: 387384 - RNA, 64 nt, Human
gugagugguagagagggggucucugaaggcccuuggggcugacagggccaggcagccuccccag

SEQ ID NO: 387385 - RNA, 64 nt, Human
gaggagcucuagagggcugcguggcauccuccuaggggcugagaggugagcagcaggggagcgg

SEQ ID NO: 387386 - RNA, 64 nt, Human
cuuuaagcuuggugcugcaaagagucuuuaaaugggggcugauuucaaguaaccuaaaagacug

SEQ ID NO: 387387 - RNA, 64 nt, Human
gaaccagugcaccucaggugcacuuacauaugguggggcugaggcaaagcagcccuguaggcuu

SEQ ID NO: 387388 - RNA, 64 nt, Human
caccguagcccacuguggcaucagaaaauucuugggggcugaguuggaggcucccugccucuau

SEQ ID NO: 387389 - RNA, 64 nt, Human
cccuccccaaucaucuuuccuguuccagagagguggggcugaggugucuccaucucugucucaa

SEQ ID NO: 387390 - RNA, 64 nt, Human
ccugcagguggggcccuuuccuucccgccagaguggggcugagugggcgcugagccaggccggg

SEQ ID NO: 387391 - RNA, 64 nt, Human
cacaggaggccgggagacagggacuggugagaauggggcugaguggaggagguggugauauuua

SEQ ID NO: 387392 - RNA, 64 nt, Human
gcccuggggucacagacauggaagggaccacccuggggcugacugcuuuucugugcuguugguu

SEQ ID NO: 387393 - RNA, 64 nt, Human
ucucuugucccuuauagguaccuuggaggggccaggggcugaggaaggccggacccagguucca

SEQ ID NO: 387394 - RNA, 64 nt, Human
augcaggaaacaccuagagcagccccagagucacggggcugagggggcgggagcugccccuguc

SEQ ID NO: 387395 - RNA, 64 nt, Human
ccuauuacggccugagucuggaugugucggggcuggggcugaacguguaccagacacagcuguu

SEQ ID NO: 387396 - RNA, 64 nt, Human
aguuguacccuacggugcucagacagacagggauggggcugacugcacuggugggccggcuggg

SEQ ID NO: 387397 - RNA, 64 nt, Human
uucuagaauuugccucuuugggacugaagucuaaggggcugagaccaagaagggagagcacaag

SEQ ID NO: 387398 - RNA, 64 nt, Human
cuuuguguuuggaggauaggagggagagagggaaggggcugaggaaaucucugggguaagagua

SEQ ID NO: 387399 - RNA, 64 nt, Human
cacagccuccugggaggaucccgaaguagggacuggggcugagagcagagaggagggucgggca

SEQ ID NO: 387400 - RNA, 64 nt, Human
cagcaaagcucccgcggaaaacugcuccugugucggggcugaccucucacugccucucggugac

SEQ ID NO: 387401 - RNA, 64 nt, Human
augcugaccuggaggccaccgagaggcuggggcuggggcugaccacaacauccuuccugugguu

SEQ ID NO: 387402 - RNA, 64 nt, Human
uccuucucugguucucagcuguggcuuuuguucuggggcugaguccccuccccaacccccugac

SEQ ID NO: 387403 - RNA, 64 nt, Human
acgguggcucaugccuguaaucccagcacuuuggggggcugaggugggcgaaucaugagaucag

SEQ ID NO: 387404 - RNA, 64 nt, Human
gaucuaaaucauauauaauaaauuaagggacaauggggcugacagcacuaaacuuggugcuuau

SEQ ID NO: 387405 - RNA, 64 nt, Human
gagagggcggaagguggacuccagcgcagcuugaggggcugaggacggaggcugcagcaucugu

SEQ ID NO: 387406 - RNA, 64 nt, Human
agagcugguguuuaucgaugcuacgugccagaauggggcugagcacggcgccucacuguauccu

SEQ ID NO: 387407 - RNA, 64 nt, Human
gcuguguuuuuuuguuuuuuuagaacuggguuugggggcugauuuuuauuucuuugggggcuuu

SEQ ID NO: 387408 - RNA, 64 nt, Human
cugcugccgucagaggcagcccccugcacagggaggggcugauccugccucagcuguguggcca

SEQ ID NO: 387409 - RNA, 64 nt, Human
ccaugaaucaccuuuuggucuggagggaagccuuggggcugaugcaguuguugcccacagcugu

SEQ ID NO: 387410 - RNA, 64 nt, Human
ggcugcgaggccagggaagcccugaguuucuggcggggcugagcagugggggagcauuguguug

SEQ ID NO: 387411 - RNA, 64 nt, Human
cgaucacggaucagucagagcagggucaggagacggggcugacggcacggguggcggggacaga

SEQ ID NO: 387412 - RNA, 64 nt, Human
ggaaacccuuuguguaucuuuucagacuggggugggggcugagcaugcuugugcagaaagaagc

SEQ ID NO: 387413 - RNA, 64 nt, Human
ucacauagccaacucucccaaagggcacaccccuggggcugagucuccagggccccccaacugu

SEQ ID NO: 387414 - RNA, 64 nt, Human
cagcagacccccugccaucccccccaguuguccuggggcugaaugggcaaaucuguccaaacag

SEQ ID NO: 387415 - RNA, 64 nt, Human
ugugguacccaggccacacguugugcccgcucuuggggcugaccggcuguagggaccaccagcc

SEQ ID NO: 387416 - RNA, 64 nt, Human
gaccccggaggcugucgguggaugugccgaugauggggcugacaguaugggcucugggcauccc

SEQ ID NO: 387417 - RNA, 64 nt, Human
ggaauauaaaaauauugcacccacaugucuuaauggggcugaauuucagauuauuuguuacaua

SEQ ID NO: 387418 - RNA, 64 nt, Human
aggaaaaccaccaaaauucaaacgaacccuuaaaggggcugagucuuuguccaugugcacaagu

SEQ ID NO: 387419 - RNA, 64 nt, Human
gcuuuuguuacagaagauucucaggaugaaggcaggggcugaggccucugcuacuggcugcccc

SEQ ID NO: 387420 - RNA, 64 nt, Human
augugagaaggcaccaccucaagaggggaggagcggggcugauccuggucgggcggaccugagu

SEQ ID NO: 387421 - RNA, 64 nt, Human
cugcucuucaagaaacagcgagagggagacccagggggcugaaacuugaacucugguucuuuua

SEQ ID NO: 387422 - RNA, 64 nt, Human
acgcggcgggaggcccacgguucggggcuucugcggggcugagacgccggcuuccuccuuccag

SEQ ID NO: 387423 - RNA, 64 nt, Human
gagagaaugaggaagcaaagagugagaaagaauaggggcugaagacgccacucccagauggcuc

SEQ ID NO: 387424 - RNA, 64 nt, Human
caaggaagcagaguuguuaaagaguacuggaauaggggcugaaggaucuauauucccuuauugc

SEQ ID NO: 387425 - RNA, 64 nt, Human
agaagaguaugaugugaacaaguaaagacugaauggggcugagaugaaggcaauguuuccaagg

SEQ ID NO: 387426 - RNA, 64 nt, Human
ccuucuggagcccgaggccuggccugucuucguuggggcugauaaauugccucucccagggccu

SEQ ID NO: 387427 - RNA, 64 nt, Human
uacaaucaacaaagcaaacagagagccugugggaggggcugacagcagcagccggcuguuuggg

SEQ ID NO: 387428 - RNA, 64 nt, Human
aagcuucgucuuguguuugcugcagagugauucgggggcugaccuagaccaguuugcaugauuc

SEQ ID NO: 387429 - RNA, 64 nt, Human
caaucagccuuuaggucuuuaguccgggggacuuggggcugagagaguauaaauaacccugggc

SEQ ID NO: 387430 - RNA, 64 nt, Human
ccuagcuaggagcaggcuuguggcagccugauucggggcugaccuuucaaacccagaggguugc

SEQ ID NO: 387431 - RNA, 64 nt, Human
ggauaaugagaaaccacaaggccugccucugacuggggcugacacggaggugcauuagcccagg

SEQ ID NO: 387432 - RNA, 64 nt, Human
caugacucacccauggcaggcggagggucccagaggggcugaguccucaaauccggcugaggca

SEQ ID NO: 387433 - RNA, 64 nt, Human
agccuguggcuuugcccaccaggacuuuugagcuggggcugacuccugcaggggaagcccuggu

SEQ ID NO: 387434 - RNA, 64 nt, Human
ccgguagugaaggaaccccccgucuccugagaguggggcugacccugccuugggcgccgagggg

SEQ ID NO: 387435 - RNA, 64 nt, Human
cagggauucucaaccugugguuuagggguucaucggggcugagcgugacaagaggaaggaaugg

SEQ ID NO: 387436 - RNA, 64 nt, Human
cagggucuccucccuggaggccagcucugccccaggggcugagcugccaccagagguccuggga

SEQ ID NO: 387437 - RNA, 64 nt, Human
ucaagaggcagagggacuugggaccugggagaauggggcugagaggaggcuucggguuggggcc

SEQ ID NO: 387438 - RNA, 64 nt, Human
uguggaaaaaucccaauaugccguuuauucagguggggcugaccaugggauguggugcuaauga

SEQ ID NO: 387439 - RNA, 64 nt, Human
gauuagguuuuugacaaaacaaacaggccaaaagggggcugaccuggagcagagcauggugaga

SEQ ID NO: 387440 - RNA, 64 nt, Human
caaaacacuggccaggaugcagcaagcagcagcaggggcugacagcaggcuuacugccaucaac

SEQ ID NO: 387441 - RNA, 64 nt, Human
ccaccuccaggucugucaaguggccuuugucccuggggcugauggcccccaacucaccagcauc

SEQ ID NO: 387442 - RNA, 64 nt, Human
gugggucaucccagcaccugccagggcccgaccuggggcugagugcagaggcugagcaggacgu

SEQ ID NO: 387443 - RNA, 64 nt, Human
cgagaggagggaacgagcgggcgccgggccacucggggcugagcugggggcgagcgggggcagg

SEQ ID NO: 387444 - RNA, 64 nt, Human
ccacaguagugaugcagacgugacgugggggaagggggcugagcccuguggcuggguucugaca

SEQ ID NO: 387445 - RNA, 64 nt, Human
aggggcagcuuuuucauaccaauuccaacuuucaggggcugacucuccagggagcugaugucau

SEQ ID NO: 387446 - RNA, 64 nt, Human
acccucgugucugacgcggccaccucuuucuggaggggcugaggacagaugugccugcuugugg

SEQ ID NO: 387447 - RNA, 64 nt, Human
gccucccacugccgaccgcacagcucccucucugggggcugagggacccaccuggccccuccuc

SEQ ID NO: 387448 - RNA, 64 nt, Human
ucuuggccugagaucucugugcaggaaccaagauggggcugaagccucuggaggcaguugguug

SEQ ID NO: 387449 - RNA, 64 nt, Human
ccaucguguacugcagaguugagcuggcaggggaggggcugagagggugggggcuggaaccccu

SEQ ID NO: 387450 - RNA, 64 nt, Human
ccgucucccgggacaagcgcaggcugcgauccgaggggcugacacacacucgcagacgagccgc

SEQ ID NO: 387451 - RNA, 64 nt, Human
agucaugggcugccugggacccaggacccaugagggggcugagagguuucuacacucgaggagc

SEQ ID NO: 387452 - RNA, 64 nt, Human
gguuugagcucugcagccucucuccuggagugagggggcugaagucagaccaaaggaagaacuc

SEQ ID NO: 387453 - RNA, 64 nt, Human
aacaaguuaacuugcauuccuauguaagauaggaggggcugaggggauccccaguguuuggaac

SEQ ID NO: 387454 - RNA, 64 nt, Human
ugcagccuggaagacauggcagcggguagcuccuggggcugagccagaagcaucacugcaguga

SEQ ID NO: 387455 - RNA, 64 nt, Human
agcagggagaaaaccugaaggucggugccccuauggggcugaccaguagagaauuuccuuuacu

SEQ ID NO: 387456 - RNA, 64 nt, Human
uacagagaggcaaaccaagccuccuuagugcccuggggcugauggucacccagagccauagagc

SEQ ID NO: 387457 - RNA, 64 nt, Human
uucuagcucacggguagugggauucugcauuaguggggcugagagaugugggggccccuccagc

SEQ ID NO: 387458 - RNA, 64 nt, Human
accuccugagaaaaaagguuccgcuuggagcagaggggcugaauagcagaagguugcaccuccc

SEQ ID NO: 387459 - RNA, 64 nt, Human
gaagcugacuucccucagucgggcacuucucaugggggcugaacaugguuccugccauucuguu

SEQ ID NO: 387460 - RNA, 64 nt, Human
uaccgaguucaucuguggguguugggggcaagugggggcugaaguccugugcaggcugcgcugg

SEQ ID NO: 387461 - RNA, 64 nt, Human
agagcucccacuacaugcaguggcccagggcagaggggcugauacauggccuuuuucagggggu

SEQ ID NO: 387462 - RNA, 64 nt, Human
gcuuugaggagaggguaaacauaggcccggagauggggcugacaccucgaguggccagaauaug

SEQ ID NO: 387463 - RNA, 64 nt, Human
gaacuucuuuggaacuugcauaggcgccuagaauggggcugaugagaacaucgugaccaucaga

SEQ ID NO: 387464 - RNA, 64 nt, Human
guuucuagugacccugagauguaaacagcaagugggggcugaggcagaggcagggauagcuggg

SEQ ID NO: 387465 - RNA, 64 nt, Human
gugcuguagggugaucggcuguucuggguagccuggggcugaggaggugcccuggacucagggc

SEQ ID NO: 387466 - RNA, 64 nt, Human
aauccaaauuucauuuacagcucuggaacacuuuggggcugauuugucucuuuaggggacaucc

SEQ ID NO: 387467 - RNA, 64 nt, Human
aaagcuguugccccaaagugauggcccuggaggcggggcugaggaacagggaaaugccgcugug

SEQ ID NO: 387468 - RNA, 64 nt, Human
uccuggggccuggcuuggacagagaccaggauuuggggcugagcugguuuccccuccuuccucc

SEQ ID NO: 387469 - RNA, 64 nt, Human
gugccugagacacucaccucucugccucgcaguuggggcugaggcuggggcuggcugccagccu

SEQ ID NO: 387470 - RNA, 64 nt, Human
ugcuggggcucaggcuguggggcaggcugggcagggggcugagcuggcagcgauucagagcccu

SEQ ID NO: 387471 - RNA, 64 nt, Human
gauuguccugacucacuaaagaugccaggauauuggggcugaggggaguuugagguguuaaaaa

SEQ ID NO: 387472 - RNA, 64 nt, Human
aguucuaccuccccagaagccuuccuccccagguggggcugauggagcaaggguccagacuagg

SEQ ID NO: 387473 - RNA, 64 nt, Human
cugcccacugcagugccaagacggcagcaggacuggggcugauagcccaccccgcccccacugc

SEQ ID NO: 387474 - RNA, 64 nt, Human
cacugcagcucccacaaagcacucuaagggagauggggcugaggacagcucaaaaaggagagga

SEQ ID NO: 387475 - RNA, 64 nt, Human
ggaagccccuucaggaaggaccccccaaagcugaggggcugaauguagccuuuucaacagagaa

SEQ ID NO: 387476 - RNA, 64 nt, Human
ggcuauuugggaaacuuaaguguuggaggaggcaggggcugaaggugucaaaaccuccucagua

SEQ ID NO: 387477 - RNA, 64 nt, Human
ccuccugccucagaccccuuugccaggggcuuugggggcugagcagagccacauccagaguggg

SEQ ID NO: 387478 - RNA, 64 nt, Human
ucacuuccuuuuuugggucucacagaccccuccaggggcugacaccuagagagaaccaucaccu

SEQ ID NO: 387479 - RNA, 64 nt, Human
ggcacaguguucacaccuguagucccggccacucggggcugaggcaggaggaucacuggaaccu

SEQ ID NO: 387480 - RNA, 64 nt, Human
cacccauggugcaguccucaggcaaggccaggacggggcugaggcccugcguggagaugcugca

SEQ ID NO: 387481 - RNA, 64 nt, Human
ggugcuguggagccuacaccggcagggacagccuggggcugacagggcuccccuccgagggcca

SEQ ID NO: 387482 - RNA, 64 nt, Human
guaucaagacauagcauccaaguggcauaauucaggggcugacacuucaaggugacagaaggac

SEQ ID NO: 387483 - RNA, 64 nt, Human
gugagccaguggcuugagugaauguuaggccuugggggcugagucucugaaaagucuaagaagc

SEQ ID NO: 387484 - RNA, 64 nt, Human
aagcagaggaugugagaggcagaggcaggcuccuggggcugagcuccuuccucugcaucauucu

SEQ ID NO: 387485 - RNA, 64 nt, Human
cuccugccguccacugcgcggccucgucagucccggggcugacugucccucucagcucugcgcc

SEQ ID NO: 387486 - RNA, 64 nt, Human
ccuagaccagaggagcccaggcccuggcccugcuggggcugaaggucagaaguaauccugagaa

SEQ ID NO: 387487 - RNA, 64 nt, Human
cuccuccuucuccuguccuggcccaggcauccuaggggcugaaauccuggaaaccgugggcugg

SEQ ID NO: 387488 - RNA, 64 nt, Human
cucggaaaguuuccucgcguaccagacagcggcgggggcugauagcaauuuuaguuuuuggccu

SEQ ID NO: 387489 - RNA, 64 nt, Human
ggcuguccagaacugcucacccugccuuuuucugggggcugagcccccacaaccugucuuuucc

SEQ ID NO: 387490 - RNA, 64 nt, Human
cuaccagccccgccuggccggccugaccugcucaggggcugagggucuggcccgcccuaagcag

SEQ ID NO: 387491 - RNA, 64 nt, Human
gccauucauuuagaauuagcagagcuaauauggaggggcugaacuaguagccacaucuuguuca

SEQ ID NO: 387492 - RNA, 64 nt, Human
aagucucugcuuacaucauuuugguugucaccuuggggcugagugagaagucuuuuguaaauua

SEQ ID NO: 387493 - RNA, 64 nt, Human
aggaagaggagcgaggacaacguuggcccagaugggggcugaaucauucaacugccuccaucug

SEQ ID NO: 387494 - RNA, 64 nt, Human
guagugucugccugaaaaugggucccagcggacaggggcugacccacguuacuccccaugcggu

SEQ ID NO: 387495 - RNA, 64 nt, Human
uuguccacaggccuuuggguacagaugaggccuuggggcugacugcauguggcagaaaacgggu

SEQ ID NO: 387496 - RNA, 64 nt, Human
ucauuguuagaaaccaaagucuucucugcuggcuggggcugagagagggucuggguuaucuccu

SEQ ID NO: 387497 - RNA, 64 nt, Human
uuguuagugaacuguggacucgcuuucccaggcaggggcugagccacauggccaucugcuccuc

SEQ ID NO: 387498 - RNA, 64 nt, Human
cugccccagaagagcaagcuggagaggcugggcaggggcugauggggcuggguacacuggggaa

SEQ ID NO: 387499 - RNA, 64 nt, Human
gugggcuggaggccucuggagaagaccuggggugggggcugaugggggcaggcccacagugaga

SEQ ID NO: 387500 - RNA, 64 nt, Human
cccaccaacagaggccaguuucaaagucagcugaggggcugagggguggggcuccauggugaau

SEQ ID NO: 387501 - RNA, 64 nt, Human
cggcccaccaucggccagguccagcgcuuccucuggggcugacaacaggccccugacucacccc

SEQ ID NO: 387502 - RNA, 64 nt, Human
gagggcaggggaagaccaccuggcaugagggagaggggcugagggauggacuucagccccucug

SEQ ID NO: 387503 - RNA, 64 nt, Human
cucuguccuauagcuuuauaaaaccagaguguguggggcugaggucaggaguauaaguaccugc

SEQ ID NO: 387504 - RNA, 64 nt, Human
uagcacauaaacuuuggggaagggagggcaggguggggcugaggaacugacguggagcggggua

SEQ ID NO: 387505 - RNA, 64 nt, Human
ucccucccagccucaaccacaauucuuccaugcuggggcugaugugggcuaguaagacuccagu

SEQ ID NO: 387506 - RNA, 64 nt, Human
gagaauuuguagaucauucucacuucaaauuccuggggcugauacuucucucaucuugcacccc

SEQ ID NO: 387507 - RNA, 64 nt, Human
ucaugucuucccugcaaacuaugaccuggugcugggggcugauaucguguaccuggaacccacc

SEQ ID NO: 387508 - RNA, 64 nt, Human
acaauagauguaguguuguaauaaacuguuuaauggggcugauguguaaagcuguucaaguuau

SEQ ID NO: 387509 - RNA, 64 nt, Human
aguggcccuggccuccugggggcgggguugugggggggcugagcgacacucagggacaccucag

SEQ ID NO: 387510 - RNA, 64 nt, Human
aaaccuuuaagggacuguccuuggggaggcaggcggggcugacagcucaggagugucugcacac

SEQ ID NO: 387511 - RNA, 64 nt, Human
aguguuccauugagugguuccauuuugccuguguggggcugacaaccaagccucgggggaaaug

SEQ ID NO: 387512 - RNA, 64 nt, Human
gaggaaaagaaaagaggggaaaaugaguuuuuauggggcugaacggggagaaaaggucaucauc

SEQ ID NO: 387513 - RNA, 64 nt, Human
guuauguucagggcacaagggugagcucuucgcaggggcugaugcacuggguguggagcugagc

SEQ ID NO: 387514 - RNA, 64 nt, Human
accccacauggcauauaccacccaucucuggucuggggcugagggcaaggacugcacuagucca

SEQ ID NO: 387515 - RNA, 64 nt, Human
gauuggacauggucuccucugauuaucagguacuggggcugagggcauuaaaaauaguaagccu

SEQ ID NO: 387516 - RNA, 64 nt, Human
cgcacacacacauacagagcucucugagggugauggggcugagcaggaggggggcuggguaaga

SEQ ID NO: 387517 - RNA, 64 nt, Human
ucuucuguaauacugggggaccuacagcugccguggggcugaccacgguguucccuggcaucgu

SEQ ID NO: 387518 - RNA, 64 nt, Human
uauuauugccugucauguggcacauccauguuaaggggcugaggcgucccuggcacggaaugca

SEQ ID NO: 387519 - RNA, 64 nt, Human
gccaaccuggacuuccugucauuuucacaaucuuggggcugaugaagaaggggguggggggagu

SEQ ID NO: 387520 - RNA, 64 nt, Human
ucagggcuuugcucugacaccaugacagcugcccggggcugagggcagcuggcuccacucaaau

SEQ ID NO: 387521 - RNA, 64 nt, Human
guguaguggcucaugccuguaauccuagcaacucggggcugaggugggaggauugcuucagccc

SEQ ID NO: 387522 - RNA, 64 nt, Human
acagagaaagaaccuugcccaaacucaggcagcuggggcugaggcccaaaggcagaacagccag

SEQ ID NO: 387523 - RNA, 64 nt, Human
agaggguuuugggggggugggggaggguguuguuggggcugagaagaaagagauuuauaugcug

SEQ ID NO: 387524 - RNA, 58 nt, Human
augaaucucgggaccaguaacucuacguggggcugagcuuggaguacguguggucacc

SEQ ID NO: 387525 - RNA, 64 nt, Human
gacccugcguugccaugugaggcaggggugggguggggcugagggcguggcuuuggucccuggc

SEQ ID NO: 387526 - RNA, 57 nt, Human
gccagcgucugacguuaugagcgcaaaggggcugaaagaacauggacuuguauauuu

SEQ ID NO: 387527 - RNA, 64 nt, Human
acccagugaaacucccacagcaacgcagguagauggggcugaccuggccucuccaaugucuccu

SEQ ID NO: 387528 - RNA, 64 nt, Human
gugguggugcgugccuguagucccagcuacuuggggggcugagguggcaggaucgcuugagccu

SEQ ID NO: 387529 - RNA, 64 nt, Human
cacaggggcuuccagggaggccgcgcagggccguggggcugagccacgcucucguuuugucagg

SEQ ID NO: 387530 - RNA, 64 nt, Human
ugucuggcggagaaagccagcucccugcacccucggggcugagucagaucugggucugccgcaa

SEQ ID NO: 387531 - RNA, 64 nt, Human
cuuccacaagggcauaccccugggggcaggggcuggggcugagaacugcagcccugggucuucc

SEQ ID NO: 387532 - RNA, 64 nt, Human
acacucucuggggcuccagugugaagggugcccuggggcugagggccuuguggaggauggucgg

SEQ ID NO: 387533 - RNA, 64 nt, Human
auggugccucacaccuguaaucccagcacuuuggggggcugaggcagguggaucacuugagguc

SEQ ID NO: 387534 - RNA, 64 nt, Human
cucucugcaucuacuggaguggucccugggcucuggggcugaaggauuccagccucucugccag

SEQ ID NO: 387535 - RNA, 64 nt, Human
guagggguaggcaccuggcaucccagcuacuccaggggcugaggugacagcauugcuuaagccc

SEQ ID NO: 387536 - RNA, 64 nt, Human
uuggauaggagagcugggacuccaucucgacccuggggcugaggccugaguccuucuggacucu

SEQ ID NO: 387537 - RNA, 64 nt, Human
ggcugcugggccccagguggcgcacggauggugaggggcugagaaugagggcaccgacugugaa

SEQ ID NO: 387538 - RNA, 64 nt, Human
ccuuucugggccugggucuccccaucucuucaauggggcugauaccuucacagcccacagcaug

SEQ ID NO: 387539 - RNA, 64 nt, Human
uaggccuggcauggcaccugucgcccagugcccuggggcugaucucagggaagcccagcuccag

SEQ ID NO: 387540 - RNA, 64 nt, Human
aguuggugcugcccuguggcauggaggggugggaggggcugagauggcugcuggcccggccucc

SEQ ID NO: 387541 - RNA, 64 nt, Human
ggagcaacagagaggccaccaagcagaggcccguggggcugaggauggagccgcccccagccga

SEQ ID NO: 387542 - RNA, 64 nt, Human
agugacuagacgcacucugcguuuucccguguuuggggcugaggccugcuggacagauggcugg

SEQ ID NO: 387543 - RNA, 64 nt, Human
ucagugcagcagacagggccagacugggguguggggggcugagcugggcacaugagugagggcu

SEQ ID NO: 387544 - RNA, 64 nt, Human
gugguggcgggcgccuguaaucccagcuacugagggggcugaggcaugagaaucacuugaaccu

SEQ ID NO: 387545 - RNA, 64 nt, Human
caggugucagagguaggggaaccaggggcaagcuggggcugagcuggagguggggaugagagca

SEQ ID NO: 387546 - RNA, 64 nt, Human
cgguccuuugaacagaagggccuggaaggccccuggggcugagaaaggguccgcccgguggccu

SEQ ID NO: 387547 - RNA, 64 nt, Human
guuuccaggccagcuggagaauguucacugguucggggcugacuuugagaucuuuguucccuga

SEQ ID NO: 387548 - RNA, 64 nt, Human
cacaccccauagccgccugggcuggggcuuacugggggcugaagguucuggacaugaacaaggg

SEQ ID NO: 387549 - RNA, 64 nt, Human
cauugcucugggggcugggaugccuggcuaagcaggggcugacaggguggcaggugacuuucua

SEQ ID NO: 387550 - RNA, 64 nt, Human
acagacugcuugucuugcuaggagaggaggauggggggcugagcacucaggcuguccauugaaa

SEQ ID NO: 387551 - RNA, 64 nt, Human
gggaccagguuugcaggagccccccuagugguauggggcugagcccuccugagggccgguucua

SEQ ID NO: 387552 - RNA, 64 nt, Human
guguggguuccuguccuguuuccccuuccucuuuggggcugaggaggagguuaaaggccaaaug

SEQ ID NO: 387553 - RNA, 64 nt, Human
acucagaagaaaaagaagcugaggaagcuguuggggggcugagggugggauucucgcuccuuca

SEQ ID NO: 387554 - RNA, 64 nt, Human
uucccccacaagacuggcagaggcugggcagccuggggcugaugaagcagagauguucgcugga

SEQ ID NO: 387555 - RNA, 64 nt, Human
uggucuucagccccucccauccacggagugagcuggggcugaaguuguccccacugccauacuc

SEQ ID NO: 387556 - RNA, 64 nt, Human
guguccuuuccugaggagcccaguggcuggggugggggcugaggggcagccccuaugcccucac

SEQ ID NO: 387557 - RNA, 64 nt, Human
cuaugccuaaaccaccugugccacggcccccucuggggcugaagccgccgcugggucacagagc

SEQ ID NO: 387558 - RNA, 64 nt, Human
gguccgacucccuacuuggacuucuggcacagaaggggcugagugacuccuugaguagcagugg

SEQ ID NO: 387559 - RNA, 64 nt, Human
uguccuggcuguggcccaugccgacagauaucguggggcugacagguccacggcaggcuugcuu

SEQ ID NO: 387560 - RNA, 62 nt, Human
ggaugaaggugaaugacuaaagcuuugcuacuggggcugaggauuccggauaccaagacgca

SEQ ID NO: 387561 - RNA, 64 nt, Human
uuggaugaaggugaaugacuaaagcuuugcuacuggggcugaggauuccggauaccaagacgca

SEQ ID NO: 387562 - RNA, 64 nt, Human
gagcuugggguuggcaccucugccccgacagaauggggcugaaucagcuccaggaggaaccagg

SEQ ID NO: 387563 - RNA, 64 nt, Human
ugaaugcauuagaaccuuccauaggaaaagaaaaggggcugaguuccauucuggguuugcugua

SEQ ID NO: 387564 - RNA, 64 nt, Human
ggucccacuaggugcucuacccugagggagccuaggggcugacugugacuuccgaggcugcuga

SEQ ID NO: 387565 - RNA, 64 nt, Human
cugccacccagccccagccagggcucaaucucugggggcugaggagcagcaggaggggggaggg

SEQ ID NO: 387566 - RNA, 64 nt, Human
ugcuuggcugggcugcagcugcuaccccucgguuggggcugagucagccagauccucccccuac

SEQ ID NO: 387567 - RNA, 64 nt, Human
gugguggcucacaccuguaaucucggcacuuuggggggcugagacaggcggaucaccugaggcc

SEQ ID NO: 387568 - RNA, 64 nt, Human
aggggccucuggagcaggccuggcuuuuaaauggggggcugaauuccagcucacacacaccuca

SEQ ID NO: 387569 - RNA, 64 nt, Human
ugcugguccagauggaggaaaccagugacuuuauggggcugagcuaguagggaagccccuggaa

SEQ ID NO: 387570 - RNA, 64 nt, Human
guggggaggagccuggagagaaggggcagagcugggggcugagggagacccccccacaccccuu

SEQ ID NO: 387571 - RNA, 64 nt, Human
uggguggguguuagggcuaugaaaucuuggauuuggggcugaggggugggagggagggcagagc

SEQ ID NO: 387572 - RNA, 64 nt, Human
accagggucuuaccucucugggaccuagggggacggggcugacaucuacauuuuuuaaaacuga

SEQ ID NO: 387573 - RNA, 64 nt, Human
agaucucaugggauagcacguggagcucuuggcuggggcugacccugggcagggacuuuccugc

SEQ ID NO: 387574 - RNA, 64 nt, Human
uggcccugugccuuggugugcuguauccauccauggggcugauuguauuuaccuucuaccucuu

SEQ ID NO: 387575 - RNA, 64 nt, Human
ugcacauaggugguauugaaugcucagcaggguaggggcugaccacugucccugauucccaucg

SEQ ID NO: 387576 - RNA, 64 nt, Human
uuucgccccaugcugcaucguguuguauugggauggggcugaggaacaugcucccucccucccu

SEQ ID NO: 387577 - RNA, 64 nt, Human
gugacugaaucacagcuuuggucccugucuugcaggggcugaggugucaggaggggacuucugg

SEQ ID NO: 387578 - RNA, 64 nt, Human
gucacauuuggccagagacacaccuggcccucagggggcugagcuggagacugagcuggggcug

SEQ ID NO: 387579 - RNA, 64 nt, Human
ccacugggugccacccagccugugugcccucccuggggcugaggaggcaggcggcugcuaguug

SEQ ID NO: 387580 - RNA, 64 nt, Human
ugcaucuuuugcagcccacucugacuuccaucugggggcugagaccacccuugccugcccccuu

SEQ ID NO: 387581 - RNA, 64 nt, Human
ggcuaugggagugucuagaugccugaaagggccuggggcugagcucagccugugggcagggugc

SEQ ID NO: 387582 - RNA, 64 nt, Human
cuuuagccuagcagauuccuucuagcucccccugggggcugagccuaucagggcacaaagccag

SEQ ID NO: 387583 - RNA, 64 nt, Human
cucauugaaaggugguugcuuggagaagggacauggggcugaaucucagacuucugaggugggg

SEQ ID NO: 387584 - RNA, 64 nt, Human
guaacuguccuuccucugugccaggaaacgggagggggcugauccucugauccucacuccacug

SEQ ID NO: 387585 - RNA, 64 nt, Human
cgccccacccccaugagccaguucagcccuacugggggcugagcgggggcauccccuccuuugu

SEQ ID NO: 387586 - RNA, 64 nt, Human
gguugcccuucugaugagaaaggccugagggcugggggcugacccaaguguugaggggaccaaa

SEQ ID NO: 387587 - RNA, 64 nt, Human
cggggggcggugggugggaugguggagcagcccgggggcugacccaggcuggaggacagggcca

SEQ ID NO: 387588 - RNA, 64 nt, Human
auauuucauuguaaaugccugcaacccagggcagggggcugagaccuuccaggcccugaggaau

SEQ ID NO: 387589 - RNA, 64 nt, Human
cuguaggaaaccaaagaugggaaguggcuccuagggggcugacucuuccuuccuccuccucccc

SEQ ID NO: 387590 - RNA, 64 nt, Human
ccucacacuccucacagccuacuuccccuuccccggggcugagagggugaaaguguguggggaa

SEQ ID NO: 387591 - RNA, 64 nt, Human
aguggaauuccaacuugaaggauugcauccugcuggggcugaacaugccugccaaagacguguc

SEQ ID NO: 387592 - RNA, 64 nt, Human
ggcucccugaugggggacaggauuuggccacacuggggcugacacccaggcccgagcgccugcg

SEQ ID NO: 387593 - RNA, 64 nt, Human
cugguggcucugggcaagccaucccuugcuucucggggcugacgccaccguuguguccgagccc

SEQ ID NO: 387594 - RNA, 64 nt, Human
cagaagccgggcaggcagaauccggccagacgacggggcugagccaucaggagcucuugggaaa

SEQ ID NO: 387595 - RNA, 64 nt, Human
aggugccaugauccaggcugaaccaauauacaguggggcugaagucugcaaggagguugcuggc

SEQ ID NO: 387596 - RNA, 64 nt, Human
uaacaaggagagcaaagcuguuuuagcagaggcuggggcugagguccccaugggguuugggugc

SEQ ID NO: 387597 - RNA, 64 nt, Human
ccucgacaagaccacacuuugggacuugggagcuggggcugaaguugcucuguacccaugaacu

SEQ ID NO: 387598 - RNA, 64 nt, Human
ucagguucuguggguuuggaagcccaucgugaaaggggcugaccuuugccccuuuuuacuuggc

SEQ ID NO: 387599 - RNA, 53 nt, Human
gccuuacugaaugugugugaauuggggcugauacuuggaaagaaugugguaaa

SEQ ID NO: 387600 - RNA, 64 nt, Human
cguggcgaugugcaccuguagucccagcuacucgggggcugagccaggcggauagcuugagcuc

SEQ ID NO: 387601 - RNA, 64 nt, Human
gggccuuuuuuuggaggugggggcuggggaaugaggggcugaggucccggaagggauuuuauuu

SEQ ID NO: 387602 - RNA, 64 nt, Human
uuauuucuguagcagccaaguccugcggcucccuggggcugagaucucccuuuguggaacuccg

SEQ ID NO: 387603 - RNA, 64 nt, Human
ggccacuccagggaucauuguuguccuuuugugaggggcugaggcgacugucccauggaggcau

SEQ ID NO: 387604 - RNA, 64 nt, Human
ugcagggacucccuggagauucaggcccuggaauggggcugaauggaggucccguucgacccuu

SEQ ID NO: 387605 - RNA, 64 nt, Human
cuaggcuucugcccagcgccccugcucagggcgaggggcugaggucacaccucgggcaccugga

SEQ ID NO: 387606 - RNA, 64 nt, Human
gagauuugaggucaugaccucccacugccgcucaggggcugacccuauuuaggaaaccaaagag

SEQ ID NO: 387607 - RNA, 51 nt, Human
uccgcuuccugccccgcugaaggggcugagggaagggggucaaaggauucc

SEQ ID NO: 387608 - RNA, 64 nt, Human
uggggaaggaaaaagcaggaaacugaaggaagcaggggcugaggaacacuuagagggugggcag

SEQ ID NO: 387609 - RNA, 64 nt, Human
ggcagcugcagcaagaggcagcugaagcccucguggggcugaaagauucaucccaggcuccucg

SEQ ID NO: 387610 - RNA, 64 nt, Human
acugcuuuucugaggacucaagggccaagauggaggggcugacucaguccagccaacauuuaau

SEQ ID NO: 387611 - RNA, 64 nt, Human
caccugcccccaggccccacaggaugggcccccaggggcugaggaagcugcccucgaaacccuc

SEQ ID NO: 387612 - RNA, 64 nt, Human
cccaggaggaggccucggugguaccagaagaggaggggcugaugugaacauccggcauucaggc

SEQ ID NO: 387613 - RNA, 64 nt, Human
cugaggcccggcucucccgcccugcacgagcccaggggcugagcguuccuaggcgguuucgggg

SEQ ID NO: 387614 - RNA, 64 nt, Human
augguggugggcaccuguagucucagcuacucagggggcugaggcuggacaauggugugaaccc

SEQ ID NO: 387615 - RNA, 64 nt, Human
ccagugaaacagaaccgcuuacucccuuguuaagggggcugaagccggggagccaagugguucc

SEQ ID NO: 387616 - RNA, 64 nt, Human
caugguggcgugugccuguaaucccagcugcuggggggcugaggcaggaggaucaguugaacgu

SEQ ID NO: 387617 - RNA, 64 nt, Human
gggcaccacgugaggggcacuugguggacagggcggggcugacguggccuccucuggggucgcc

SEQ ID NO: 387618 - RNA, 64 nt, Human
auguacagagccagacaaagcugugaauggccuaggggcugagucccacaccagcugugaauuc

SEQ ID NO: 387619 - RNA, 64 nt, Human
ugaauggccccagacugguugcagcugggcuugaggggcugacaacaggaaguaccaucaucac

SEQ ID NO: 387620 - RNA, 64 nt, Human
ccgggucuagcgcaggccccacggggccccuucaggggcugaacgcggcccggaccgggaacgg

SEQ ID NO: 387621 - RNA, 64 nt, Human
cccgacaccaggaggagggccaggagaguuccagggggcugaggcacacagagaggccaacuuc

SEQ ID NO: 387622 - RNA, 64 nt, Human
guauauugcucuggggacucucgccggggaagauggggcugauuucccaccuagagagguugau

SEQ ID NO: 387623 - RNA, 64 nt, Human
aggaggaucccgugcugacugucaucaccuacguggggcugagcgucucucugcugugccuccu

SEQ ID NO: 387624 - RNA, 64 nt, Human
cucccucccccugugaaccccccagugcccccguggggcugagucugugggcccauucggccaa

SEQ ID NO: 387625 - RNA, 64 nt, Human
uagcagagccaccgccaagguuugcacucagggaggggcugauggagggcugggcgccaugggg

SEQ ID NO: 387626 - RNA, 64 nt, Human
gguggcuucucccugcgaggaggggagaauucuuggggcugagcugggagcccggcaacucuag

SEQ ID NO: 387627 - RNA, 64 nt, Human
ccaaagggacuuggugucaggagaggacauggagggggcugagugacagagaugguucagcugg

SEQ ID NO: 387628 - RNA, 64 nt, Human
cagccgggcagguggucacugagggccaugacgcggggcugaggaugccuccgcugggcaucuc

SEQ ID NO: 387629 - RNA, 64 nt, Human
caaauuugccaucucacuccccaaggcucgggugggggcugaggcugaggccaaaggggcuggg

SEQ ID NO: 387630 - RNA, 64 nt, Human
ggggagcuuggcagaagggguggggugggaggagggggcugaggaaauugggguugugacagug

SEQ ID NO: 387631 - RNA, 64 nt, Human
cgccacgcuggcugggguguagggccgggcagguggggcugaggggacucccagccucgcugga

SEQ ID NO: 387632 - RNA, 64 nt, Human
gugguggugcaucccuauacucccagcaacucagggggcugaggugggagaauggcuugagccu

SEQ ID NO: 387633 - RNA, 64 nt, Human
ugcuccuuugauuuaaugggguguacuggggccaggggcugauucacuuccuugggagauggug

SEQ ID NO: 387634 - RNA, 64 nt, Human
ggccgugcauccugcucaguguggcgucagugucggggcugagccccuugagcugcuucaguga

SEQ ID NO: 387635 - RNA, 64 nt, Human
cggcggccacugcgcccuuaacugcauccagccuggggcugaggcugaggcacuggcgaggaga

SEQ ID NO: 387636 - RNA, 64 nt, Human
gcagcugaagccuggacgcagccacacaguggccggggcugaagccacacagcccagaaggcca

SEQ ID NO: 387637 - RNA, 64 nt, Human
gauacuagugagugcugcuuuuuuguauacucauggggcugauugcaccauagcugagaacgug

SEQ ID NO: 387638 - RNA, 64 nt, Human
gaccuggacucuggguguggguuggcucacaguaggggcugacggguucaguguaguaauacug

SEQ ID NO: 387639 - RNA, 64 nt, Human
ggcccgggccugcagggcgggguaggggagggcaggggcugagccccgaagccagcucaguacc

SEQ ID NO: 387640 - RNA, 64 nt, Human
cuuccuucugcuucugugacgguuuagagucaagggggcugaaacacacugugagcauagacug

SEQ ID NO: 387641 - RNA, 64 nt, Human
cacucugccugccugcuguugguccucucucuguggggcugaauugccaggggcgaggcccuuc

SEQ ID NO: 387642 - RNA, 64 nt, Human
cucuggaagaggaaccaggagaagggcuggggccggggcugagggugcccuuuuccagccucag

SEQ ID NO: 387643 - RNA, 64 nt, Human
gcccagcuguugggaacagcauggaggcagauguggggcugagcuggggaaucaggguaaaagg

SEQ ID NO: 387644 - RNA, 64 nt, Human
ccccgcugccugaagcccggaggccacgccuguuggggcugauucggagagggcgccccgccgc

SEQ ID NO: 387645 - RNA, 64 nt, Human
uagcgcggcccccgcgcgcgucccccugccggccggggcugagacuccggggagcgcccgcgcc

SEQ ID NO: 387646 - RNA, 64 nt, Human
ggguucuacagggguugagggaccaggccuggccggggcugauggacaguggggacuuuccuuc

SEQ ID NO: 387647 - RNA, 64 nt, Human
uaccaccuucucccuccccacccccuccaggcccggggcugaaacagcccgaggacagccccag

SEQ ID NO: 387648 - RNA, 64 nt, Human
cugcagggucugcuuuuacuuggggugggggggcggggcugacccugaacccucccccccgcca

SEQ ID NO: 387649 - RNA, 64 nt, Human
uccugcaacaggcccggucaccucggccgggcccggggcugaggucagccucacugccugcuua

SEQ ID NO: 387650 - RNA, 64 nt, Human
ugauugguuugucagugucccccaucgacucucuggggcugaucacuuaguuuuuggccucugc

SEQ ID NO: 387651 - RNA, 64 nt, Human
aagccuucacccuguggagucaccccaacucuguggggcugagcaacauuuuuacauuuauucc

SEQ ID NO: 387652 - RNA, 64 nt, Human
ccaguuugcugaacuuugccgucuuguaagggugggggcugacggccgacccugggaggaggug

SEQ ID NO: 387653 - RNA, 64 nt, Human
gaggcuuggaccugcuguggagggugcccagcagggggcugagcucugaggggugggugcucag

SEQ ID NO: 387654 - RNA, 64 nt, Human
gugaccccgugaccccgugaccccgaaguggucuggggcugaucuugccuugaggaagacccag

SEQ ID NO: 387655 - RNA, 64 nt, Human
uuacaugacugaaggacaucugacaaugaggcaaggggcugauagagaagagucccccaugaca

SEQ ID NO: 387656 - RNA, 64 nt, Human
ucuguaauucacaacuguggaaaccuacacaaauggggcugaugccauuguuuccucuauuuua

SEQ ID NO: 387657 - RNA, 64 nt, Human
agcccuggaugugauccggagucccuucccaccaggggcugaccucccagcugccccagcaagc

SEQ ID NO: 387658 - RNA, 64 nt, Human
gcucagcauccuccacgggcugcgccgucugcucggggcugagcuggcgggagcaguuugcgug

SEQ ID NO: 387659 - RNA, 64 nt, Human; identical to SEQ ID NO: 387657

SEQ ID NO: 387660 - RNA, 64 nt, Human
ccauggugucgugugacccucagucagguuggugggggcugaguccucacugagcagccacuuu

SEQ ID NO: 387661 - RNA, 64 nt, Human
guggugauaugcgccuguuaucucagcagcucugggggcugaggugggaggauugcuugagccc

SEQ ID NO: 387662 - RNA, 64 nt, Human
accaagcacccuuucgaaucccuggauggcugagggggcugaggccggcucugacugggcagcu

SEQ ID NO: 387663 - RNA, 64 nt, Human
ggucggucgugcugggccaggccugguuuucacaggggcugaaggaucccaguccaccugugug

SEQ ID NO: 387664 - RNA, 64 nt, Human
uggugaucagggcaagcuguggagggccagggguggggcugagacugggcugacaucuagaauc

SEQ ID NO: 387665 - RNA, 64 nt, Human
acagacaauagcuuauuuucuuuccgcccccuccggggcugagccugggucugaagacugaaug

SEQ ID NO: 387666 - RNA, 64 nt, Human
cuggggcccccuaaccccaccccaggcagcggaaggggcugacugggucugguccuuaccaaca

SEQ ID NO: 387667 - RNA, 64 nt, Human
caccucaaccccugucaguguccacuguggggugggggcugaccccugccuuugauugucauuc

SEQ ID NO: 387668 - RNA, 64 nt, Human
guugggacacgugaggauacagccuugacccccaggggcugacauucuagggggagauagaagg

SEQ ID NO: 387669 - RNA, 64 nt, Human
cucugucuccuggccgucugcuccaggcgcagcuggggcugaggaugucucaagaggccaccau

SEQ ID NO: 387670 - RNA, 64 nt, Human
ccaaaaggaccugggagcuggcagccugggcaggggggcugaggcacgugguagcccucuuucu

SEQ ID NO: 387671 - RNA, 64 nt, Human
uuugggcuuuagagaucccuuuauaaaagcucugggggcugagcccugagaauucagugacaac

SEQ ID NO: 387672 - RNA, 64 nt, Human
ccagcggcuugccugccugcucgcucccugcagaggggcugagcaggacgccgcuggugcuggc

SEQ ID NO: 387673 - RNA, 64 nt, Human
cucuccuuagcuggcccguugguuuucugagcagggggcugaacugugaacaagucagacaaau

SEQ ID NO: 387674 - RNA, 64 nt, Human
gcggccuccgcccauuggugcucaugcagacucuggggcugaggugccccggggggugaucucu

SEQ ID NO: 387675 - RNA, 64 nt, Human
gacugugcccggagcuggccgugucucccacucaggggcugagaguagcuuugaggagccucau

SEQ ID NO: 387676 - RNA, 64 nt, Human
agcccagauuucaaaccaaaggggguuacguccaggggcugaguucccacucaccuguguagag

SEQ ID NO: 387677 - RNA, 64 nt, Human
gauguagaacggggacccucgcaggguuggggcgggggcugauacuccucggccccucccuacc

SEQ ID NO: 387678 - RNA, 64 nt, Human
cauccccuccccauccaaccuaaaugccacagcuggggcugagcuguauuccuguggagggacc

SEQ ID NO: 387679 - RNA, 64 nt, Human
aggaggagcuucgggcccagcuucacccugcgguggggcugagggguggccaucuccugcccug

SEQ ID NO: 387680 - RNA, 64 nt, Human
uuucauucugccucaguuugcccaccugugaaauggggcugauaccaccuaccucacugaaguc

SEQ ID NO: 387681 - RNA, 64 nt, Human
ugagccagugggcuuuuugcauggagaacauuuuggggcugaacuuaccauggagaucccucag

SEQ ID NO: 387682 - RNA, 64 nt, Human
aacauccacaguuaagguugggccagcuaccuuuggggcugacccccuccauugccauaacauc

SEQ ID NO: 387683 - RNA, 64 nt, Human
uuaccugcagucagaggugugggacucagaggagggggcugaggccacagccgcaucuugauca

SEQ ID NO: 387684 - RNA, 64 nt, Human
cuccagcccuugcuccacucaugccugggggccuggggcugagugguaucccuaccuggccucc

SEQ ID NO: 387685 - RNA, 64 nt, Human
ugcugccuucuggauucuuggcccgcacagagcuggggcugagggauggacugaugcuuuuagc

SEQ ID NO: 387686 - RNA, 64 nt, Human
cccgcucccccauaucaauuuuccuuuugucuccggggcugaguaaauaaacauguucugucac

SEQ ID NO: 387687 - RNA, 64 nt, Human
ugaucagaaaagcagaaagagagaguggccggauggggcugaggggagaaagaauuauuaaaca

SEQ ID NO: 387688 - RNA, 64 nt, Human
ccauucugaccucuucucagagcaccuaauuaaaggggcugaaagucugacucgcuaguguuga

SEQ ID NO: 387689 - RNA, 64 nt, Human
ugguaaggucacucgaagauaagggauggggaugggggcugacugacaaaaaauuuuagcccca

SEQ ID NO: 387690 - RNA, 64 nt, Human
gcugugggagccggggagggacugagcagugaguggggcugaaggccaggcugagugccugggu

SEQ ID NO: 387691 - RNA, 64 nt, Human
gagagcacgaguuaguuguaguccggcuugcgguggggcugacuuccuguugguuugagccccu

SEQ ID NO: 387692 - RNA, 64 nt, Human; identical to SEQ ID NO: 163445

SEQ ID NO: 387693 - RNA, 64 nt, Human; identical to SEQ ID NO: 163446

SEQ ID NO: 387694 - RNA, 64 nt, Human
uguggaacuccagcagcucugcacuggguagagcugggccuagagcucagucacaggccugggc

SEQ ID NO: 387695 - RNA, 64 nt, Human
cagggagccuuuggccucuccaagggaagccuagugggccuagaccccuccucccauggcuaga

SEQ ID NO: 387696 - RNA, 64 nt, Human
caggacccaccacugaggagaggaucuagacaggugggccuaauuccaaggggcccuuccuggc

SEQ ID NO: 387697 - RNA, 60 nt, Human; identical to SEQ ID NO: 163447

SEQ ID NO: 387698 - RNA, 64 nt, Human; identical to SEQ ID NO: 163448

SEQ ID NO: 387699 - RNA, 64 nt, Human; identical to SEQ ID NO: 163449

SEQ ID NO: 387700 - RNA, 64 nt, Human; identical to SEQ ID NO: 163450

SEQ ID NO: 387701 - RNA, 64 nt, Human; identical to SEQ ID NO: 163451

SEQ ID NO: 387702 - RNA, 64 nt, Human; identical to SEQ ID NO: 163452

SEQ ID NO: 387703 - RNA, 64 nt, Human; identical to SEQ ID NO: 163453

SEQ ID NO: 387704 - RNA, 64 nt, Human; identical to SEQ ID NO: 163454

SEQ ID NO: 387705 - RNA, 64 nt, Human; identical to SEQ ID NO: 163455

SEQ ID NO: 387706 - RNA, 64 nt, Human; identical to SEQ ID NO: 163456

SEQ ID NO: 387707 - RNA, 64 nt, Human; identical to SEQ ID NO: 163457

SEQ ID NO: 387708 - RNA, 64 nt, Human; identical to SEQ ID NO: 163458

SEQ ID NO: 387709 - RNA, 64 nt, Human; identical to SEQ ID NO: 163459

SEQ ID NO: 387710 - RNA, 64 nt, Human; identical to SEQ ID NO: 163460

SEQ ID NO: 387711 - RNA, 64 nt, Human; identical to SEQ ID NO: 163461

SEQ ID NO: 387712 - RNA, 64 nt, Human; identical to SEQ ID NO: 163462

SEQ ID NO: 387713 - RNA, 64 nt, Human; identical to SEQ ID NO: 240404

SEQ ID NO: 387714 - RNA, 64 nt, Human; identical to SEQ ID NO: 240405

SEQ ID NO: 387715 - RNA, 64 nt, Human
ugaggacagaugugccugcuuguggagaccaggcugggccuaagcgaagggucaucgcagcccc

SEQ ID NO: 387716 - RNA, 64 nt, Human; identical to SEQ ID NO: 163463

SEQ ID NO: 387717 - RNA, 64 nt, Human; identical to SEQ ID NO: 163464

SEQ ID NO: 387718 - RNA, 64 nt, Human; identical to SEQ ID NO: 163465

SEQ ID NO: 387719 - RNA, 64 nt, Human; identical to SEQ ID NO: 163466

SEQ ID NO: 387720 - RNA, 64 nt, Human; identical to SEQ ID NO: 163467

SEQ ID NO: 387721 - RNA, 64 nt, Human; identical to SEQ ID NO: 163468

SEQ ID NO: 387722 - RNA, 64 nt, Human; identical to SEQ ID NO: 163469

SEQ ID NO: 387723 - RNA, 64 nt, Human; identical to SEQ ID NO: 163470

SEQ ID NO: 387724 - RNA, 64 nt, Human; identical to SEQ ID NO: 163471

SEQ ID NO: 387725 - RNA, 64 nt, Human; identical to SEQ ID NO: 163472

SEQ ID NO: 387726 - RNA, 64 nt, Human; identical to SEQ ID NO: 163473

SEQ ID NO: 387727 - RNA, 64 nt, Human; identical to SEQ ID NO: 163474

SEQ ID NO: 387728 - RNA, 64 nt, Human; identical to SEQ ID NO: 163475

SEQ ID NO: 387729 - RNA, 61 nt, Human; identical to SEQ ID NO: 163476

SEQ ID NO: 387730 - RNA, 64 nt, Human; identical to SEQ ID NO: 163477

SEQ ID NO: 387731 - RNA, 64 nt, Human; identical to SEQ ID NO: 163478

SEQ ID NO: 387732 - RNA, 64 nt, Human
uuauguagaugauccacaacuucaaaauuuagucugggccuagugcaguggcucacaccuauaa

SEQ ID NO: 387733 - RNA, 64 nt, Human
ucuuaagcacccgcuuccucaccacccccacuguugggccuauaguagcagguuagugaguacc

SEQ ID NO: 387734 - RNA, 64 nt, Human
cccugccccagggagcucacgccaggcaggccagugggccuaagccagaaacagaaagacagca

SEQ ID NO: 387735 - RNA, 64 nt, Human; identical to SEQ ID NO: 163479

SEQ ID NO: 387736 - RNA, 64 nt, Human; identical to SEQ ID NO: 163480

SEQ ID NO: 387737 - RNA, 64 nt, Human; identical to SEQ ID NO: 163481

SEQ ID NO: 387738 - RNA, 64 nt, Human; identical to SEQ ID NO: 163482

SEQ ID NO: 387739 - RNA, 64 nt, Human; identical to SEQ ID NO: 163483

SEQ ID NO: 387740 - RNA, 64 nt, Human; identical to SEQ ID NO: 163484

SEQ ID NO: 387741 - RNA, 64 nt, Human; identical to SEQ ID NO: 163485

SEQ ID NO: 387742 - RNA, 64 nt, Human; identical to SEQ ID NO: 163486

SEQ ID NO: 387743 - RNA, 64 nt, Human; identical to SEQ ID NO: 163487

SEQ ID NO: 387744 - RNA, 64 nt, Human; identical to SEQ ID NO: 163488

SEQ ID NO: 387745 - RNA, 64 nt, Human; identical to SEQ ID NO: 163489

SEQ ID NO: 387746 - RNA, 64 nt, Human; identical to SEQ ID NO: 163490

SEQ ID NO: 387747 - RNA, 64 nt, Human; identical to SEQ ID NO: 163491

SEQ ID NO: 387748 - RNA, 64 nt, Human; identical to SEQ ID NO: 163492

SEQ ID NO: 387749 - RNA, 64 nt, Human; identical to SEQ ID NO: 163493

SEQ ID NO: 387750 - RNA, 64 nt, Human; identical to SEQ ID NO: 163494

SEQ ID NO: 387751 - RNA, 64 nt, Human
cccaacaggcacccagcccugcauggggggagccugggccuaauaggcacccccuguaccucag

SEQ ID NO: 387752 - RNA, 64 nt, Human
uugccuucuccucggcguccucacaacucuuaauugggccuagugaaaaugggggcaggugaga

SEQ ID NO: 387753 - RNA, 64 nt, Human
ugcuuugcuagacgugcuuucugccauguggcuuugggccuagagcuuguugauaauugcagcu

SEQ ID NO: 387754 - RNA, 64 nt, Human; identical to SEQ ID NO: 163495

SEQ ID NO: 387755 - RNA, 64 nt, Human; identical to SEQ ID NO: 163496

SEQ ID NO: 387756 - RNA, 64 nt, Human; identical to SEQ ID NO: 163497

SEQ ID NO: 387757 - RNA, 64 nt, Human; identical to SEQ ID NO: 163498

SEQ ID NO: 387758 - RNA, 64 nt, Human; identical to SEQ ID NO: 163499

SEQ ID NO: 387759 - RNA, 64 nt, Human; identical to SEQ ID NO: 163500

SEQ ID NO: 387760 - RNA, 64 nt, Human; identical to SEQ ID NO: 163501

SEQ ID NO: 387761 - RNA, 64 nt, Human; identical to SEQ ID NO: 163502

SEQ ID NO: 387762 - RNA, 64 nt, Human; identical to SEQ ID NO: 163503

SEQ ID NO: 387763 - RNA, 64 nt, Human; identical to SEQ ID NO: 163504

SEQ ID NO: 387764 - RNA, 64 nt, Human; identical to SEQ ID NO: 163505

SEQ ID NO: 387765 - RNA, 64 nt, Human; identical to SEQ ID NO: 163506

SEQ ID NO: 387766 - RNA, 64 nt, Human; identical to SEQ ID NO: 163507

SEQ ID NO: 387767 - RNA, 64 nt, Human; identical to SEQ ID NO: 163508

SEQ ID NO: 387768 - RNA, 59 nt, Human; identical to SEQ ID NO: 163509

SEQ ID NO: 387769 - RNA, 64 nt, Human; identical to SEQ ID NO: 163510

SEQ ID NO: 387770 - RNA, 64 nt, Human; identical to SEQ ID NO: 242598

SEQ ID NO: 387771 - RNA, 64 nt, Human; identical to SEQ ID NO: 242599

SEQ ID NO: 387772 - RNA, 64 nt, Human
cuagggugggauugucagaggucuaggggcacugugggccuagugaagccuacugugaggaggc

SEQ ID NO: 387773 - RNA, 64 nt, Human; identical to SEQ ID NO: 163511

SEQ ID NO: 387774 - RNA, 64 nt, Human; identical to SEQ ID NO: 163512

SEQ ID NO: 387775 - RNA, 64 nt, Human; identical to SEQ ID NO: 163513

SEQ ID NO: 387776 - RNA, 64 nt, Human; identical to SEQ ID NO: 163514

SEQ ID NO: 387777 - RNA, 64 nt, Human; identical to SEQ ID NO: 163515

SEQ ID NO: 387778 - RNA, 64 nt, Human; identical to SEQ ID NO: 163516

SEQ ID NO: 387779 - RNA, 64 nt, Human; identical to SEQ ID NO: 163517

SEQ ID NO: 387780 - RNA, 64 nt, Human; identical to SEQ ID NO: 163518

SEQ ID NO: 387781 - RNA, 61 nt, Human; identical to SEQ ID NO: 163519

SEQ ID NO: 387782 - RNA, 64 nt, Human; identical to SEQ ID NO: 163520

SEQ ID NO: 387783 - RNA, 56 nt, Human; identical to SEQ ID NO: 163521

SEQ ID NO: 387784 - RNA, 64 nt, Human; identical to SEQ ID NO: 163522

SEQ ID NO: 387785 - RNA, 64 nt, Human; identical to SEQ ID NO: 163523

SEQ ID NO: 387786 - RNA, 64 nt, Human; identical to SEQ ID NO: 163524

SEQ ID NO: 387787 - RNA, 64 nt, Human; identical to SEQ ID NO: 163525

SEQ ID NO: 387788 - RNA, 64 nt, Human; identical to SEQ ID NO: 163526

SEQ ID NO: 387789 - RNA, 64 nt, Human
caacauuuauaucuggaagggacaagucaugccuugggccuagaauacccugaugagaaaagag

SEQ ID NO: 387790 - RNA, 64 nt, Human
cuuggccacaguuuuuuugcugaggguuucugucugggccuaucagguccauacuuagacccug

SEQ ID NO: 387791 - RNA, 64 nt, Human
ccaaauuccaggaagcucuuaggggucauccagcugggccuaggggugcagggucagugcugag

SEQ ID NO: 387792 - RNA, 64 nt, Human; identical to SEQ ID NO: 163527

SEQ ID NO: 387793 - RNA, 64 nt, Human; identical to SEQ ID NO: 163528

SEQ ID NO: 387794 - RNA, 64 nt, Human; identical to SEQ ID NO: 163529

SEQ ID NO: 387795 - RNA, 63 nt, Human; identical to SEQ ID NO: 163530

SEQ ID NO: 387796 - RNA, 64 nt, Human; identical to SEQ ID NO: 163531

SEQ ID NO: 387797 - RNA, 64 nt, Human; identical to SEQ ID NO: 163532

SEQ ID NO: 387798 - RNA, 64 nt, Human; identical to SEQ ID NO: 163533

SEQ ID NO: 387799 - RNA, 64 nt, Human; identical to SEQ ID NO: 163534

SEQ ID NO: 387800 - RNA, 64 nt, Human; identical to SEQ ID NO: 163535

SEQ ID NO: 387801 - RNA, 64 nt, Human; identical to SEQ ID NO: 163536

SEQ ID NO: 387802 - RNA, 64 nt, Human; identical to SEQ ID NO: 163537

SEQ ID NO: 387803 - RNA, 64 nt, Human; identical to SEQ ID NO: 163538

SEQ ID NO: 387804 - RNA, 64 nt, Human; identical to SEQ ID NO: 163539

SEQ ID NO: 387805 - RNA, 64 nt, Human; identical to SEQ ID NO: 163540

SEQ ID NO: 387806 - RNA, 64 nt, Human; identical to SEQ ID NO: 163541

SEQ ID NO: 387807 - RNA, 64 nt, Human; identical to SEQ ID NO: 163542

SEQ ID NO: 387808 - RNA, 59 nt, Human; identical to SEQ ID NO: 242583

SEQ ID NO: 387809 - RNA, 64 nt, Human; identical to SEQ ID NO: 242584

SEQ ID NO: 387810 - RNA, 64 nt, Human
ggggcuggaccuggcggcaggaagccaaagagacugggccuaggccaggaguucccaaauguga

SEQ ID NO: 387811 - RNA, 64 nt, Human; identical to SEQ ID NO: 163543

SEQ ID NO: 387812 - RNA, 64 nt, Human; identical to SEQ ID NO: 163544

SEQ ID NO: 387813 - RNA, 64 nt, Human; identical to SEQ ID NO: 163545

SEQ ID NO: 387814 - RNA, 64 nt, Human; identical to SEQ ID NO: 163546

SEQ ID NO: 387815 - RNA, 64 nt, Human; identical to SEQ ID NO: 163547

SEQ ID NO: 387816 - RNA, 64 nt, Human; identical to SEQ ID NO: 163548

SEQ ID NO: 387817 - RNA, 60 nt, Human; identical to SEQ ID NO: 163549

SEQ ID NO: 387818 - RNA, 64 nt, Human; identical to SEQ ID NO: 163550

SEQ ID NO: 387819 - RNA, 64 nt, Human; identical to SEQ ID NO: 163551

SEQ ID NO: 387820 - RNA, 64 nt, Human; identical to SEQ ID NO: 163552

SEQ ID NO: 387821 - RNA, 64 nt, Human; identical to SEQ ID NO: 163553

SEQ ID NO: 387822 - RNA, 64 nt, Human; identical to SEQ ID NO: 163554

SEQ ID NO: 387823 - RNA, 55 nt, Human; identical to SEQ ID NO: 163555

SEQ ID NO: 387824 - RNA, 64 nt, Human; identical to SEQ ID NO: 163556

SEQ ID NO: 387825 - RNA, 64 nt, Human; identical to SEQ ID NO: 163557

SEQ ID NO: 387826 - RNA, 64 nt, Human; identical to SEQ ID NO: 163558

SEQ ID NO: 387827 - RNA, 64 nt, Human
uucacuagaugucucacucaucagaccaggccauugggccuaagugguaaaugugauuaggaau

SEQ ID NO: 387828 - RNA, 64 nt, Human
acugguguugcccuuuggagcuuggugaggagggugggccuagggcuuggcgagugccacaucu

SEQ ID NO: 387829 - RNA, 64 nt, Human
guagcugccaggcuacuguggagagaauguguuaugggccuagugggccucugguggaccagag

SEQ ID NO: 387830 - RNA, 64 nt, Human; identical to SEQ ID NO: 163564

SEQ ID NO: 387831 - RNA, 64 nt, Human
uccagcugguuuggagucucaucauugcuugcccugggccuaucccaugaggcccagugacucc

SEQ ID NO: 387832 - RNA, 59 nt, Human
auguucuccaaacgcuuugaaccaaagcaugggccuagcccacuggcucccuggaagag

SEQ ID NO: 387833 - RNA, 64 nt, Human
cagcacaccgggaggggaugcuuggacaaguuucugggccuacauuucuugacuaggcccucuc

SEQ ID NO: 387834 - RNA, 64 nt, Human
uugauugggauaguaguuaggauaacuaaaauucugggccuaauuuuuuaaagaauccaagaca

SEQ ID NO: 387835 - RNA, 64 nt, Human; identical to SEQ ID NO: 164771

SEQ ID NO: 387836 - RNA, 64 nt, Human; identical to SEQ ID NO: 164777

SEQ ID NO: 387837 - RNA, 64 nt, Human; identical to SEQ ID NO: 164783

SEQ ID NO: 387838 - RNA, 64 nt, Human; identical to SEQ ID NO: 164789

SEQ ID NO: 387839 - RNA, 64 nt, Human; identical to SEQ ID NO: 164795

SEQ ID NO: 387840 - RNA, 64 nt, Human; identical to SEQ ID NO: 164798

SEQ ID NO: 387841 - RNA, 57 nt, Human; identical to SEQ ID NO: 164802

SEQ ID NO: 387842 - RNA, 64 nt, Human; identical to SEQ ID NO: 164805

SEQ ID NO: 387843 - RNA, 64 nt, Human; identical to SEQ ID NO: 164809

SEQ ID NO: 387844 - RNA, 64 nt, Human; identical to SEQ ID NO: 164812

SEQ ID NO: 387845 - RNA, 64 nt, Human; identical to SEQ ID NO: 164816

SEQ ID NO: 387846 - RNA, 64 nt, Human; identical to SEQ ID NO: 164766

SEQ ID NO: 387847 - RNA, 64 nt, Human; identical to SEQ ID NO: 164772

SEQ ID NO: 387848 - RNA, 64 nt, Human; identical to SEQ ID NO: 163565

SEQ ID NO: 387849 - RNA, 64 nt, Human; identical to SEQ ID NO: 163566

SEQ ID NO: 387850 - RNA, 64 nt, Human; identical to SEQ ID NO: 163567

SEQ ID NO: 387851 - RNA, 64 nt, Human; identical to SEQ ID NO: 163568

SEQ ID NO: 387852 - RNA, 64 nt, Human; identical to SEQ ID NO: 163569

SEQ ID NO: 387853 - RNA, 64 nt, Human; identical to SEQ ID NO: 163570

SEQ ID NO: 387854 - RNA, 64 nt, Human; identical to SEQ ID NO: 163571

SEQ ID NO: 387855 - RNA, 64 nt, Human; identical to SEQ ID NO: 163572

SEQ ID NO: 387856 - RNA, 64 nt, Human; identical to SEQ ID NO: 163573

SEQ ID NO: 387857 - RNA, 64 nt, Human; identical to SEQ ID NO: 163574

SEQ ID NO: 387858 - RNA, 64 nt, Human; identical to SEQ ID NO: 163575

SEQ ID NO: 387859 - RNA, 64 nt, Human; identical to SEQ ID NO: 163576

SEQ ID NO: 387860 - RNA, 64 nt, Human; identical to SEQ ID NO: 163577

SEQ ID NO: 387861 - RNA, 64 nt, Human; identical to SEQ ID NO: 163578

SEQ ID NO: 387862 - RNA, 64 nt, Human; identical to SEQ ID NO: 163579

SEQ ID NO: 387863 - RNA, 64 nt, Human; identical to SEQ ID NO: 163580

SEQ ID NO: 387864 - RNA, 50 nt, Human; identical to SEQ ID NO: 163581

SEQ ID NO: 387865 - RNA, 64 nt, Human; identical to SEQ ID NO: 242569

SEQ ID NO: 387866 - RNA, 64 nt, Human; identical to SEQ ID NO: 242570

SEQ ID NO: 387867 - RNA, 64 nt, Human; identical to SEQ ID NO: 163582

SEQ ID NO: 387868 - RNA, 64 nt, Human; identical to SEQ ID NO: 163583

SEQ ID NO: 387869 - RNA, 64 nt, Human; identical to SEQ ID NO: 163584

SEQ ID NO: 387870 - RNA, 64 nt, Human; identical to SEQ ID NO: 163585

SEQ ID NO: 387871 - RNA, 64 nt, Human; identical to SEQ ID NO: 163586

SEQ ID NO: 387872 - RNA, 64 nt, Human; identical to SEQ ID NO: 163587

SEQ ID NO: 387873 - RNA, 64 nt, Human; identical to SEQ ID NO: 163588

SEQ ID NO: 387874 - RNA, 64 nt, Human; identical to SEQ ID NO: 163589

SEQ ID NO: 387875 - RNA, 64 nt, Human; identical to SEQ ID NO: 163590

SEQ ID NO: 387876 - RNA, 64 nt, Human; identical to SEQ ID NO: 163591

SEQ ID NO: 387877 - RNA, 64 nt, Human; identical to SEQ ID NO: 163592

SEQ ID NO: 387878 - RNA, 64 nt, Human; identical to SEQ ID NO: 163593

SEQ ID NO: 387879 - RNA, 64 nt, Human; identical to SEQ ID NO: 163594

SEQ ID NO: 387880 - RNA, 64 nt, Human; identical to SEQ ID NO: 163595

SEQ ID NO: 387881 - RNA, 64 nt, Human; identical to SEQ ID NO: 163596

SEQ ID NO: 387882 - RNA, 64 nt, Human; identical to SEQ ID NO: 163597

SEQ ID NO: 387883 - RNA, 64 nt, Human; identical to SEQ ID NO: 242574

SEQ ID NO: 387884 - RNA, 64 nt, Human; identical to SEQ ID NO: 242575

SEQ ID NO: 387885 - RNA, 64 nt, Human; identical to SEQ ID NO: 242576

SEQ ID NO: 387886 - RNA, 64 nt, Human; identical to SEQ ID NO: 163598

SEQ ID NO: 387887 - RNA, 64 nt, Human; identical to SEQ ID NO: 163599

SEQ ID NO: 387888 - RNA, 64 nt, Human; identical to SEQ ID NO: 163600

SEQ ID NO: 387889 - RNA, 64 nt, Human; identical to SEQ ID NO: 163601

SEQ ID NO: 387890 - RNA, 64 nt, Human
gcaggcaccucuguucccgcuuugccccuggaggagccacuauuccagaaggcuccacccugcc

SEQ ID NO: 387891 - RNA, 64 nt, Human
aaugauuaaguauaagaccagauucauggagccaagccacuacauucuguggaaggagaucucu

SEQ ID NO: 387892 - RNA, 64 nt, Human
ccccaccugauggaccuccagaaaaacggaucacagccacuauggaugacauguugucuacucg

SEQ ID NO: 387893 - RNA, 64 nt, Human
ggucccaagcgauaacacugucuaagcacccccaagccacuauccacuuugaauccugcuccau

SEQ ID NO: 387894 - RNA, 64 nt, Human
cuggucuagcuagaccugcacuguccaguacaguagccacuaaauacauguggcuaaacuuaaa

SEQ ID NO: 387895 - RNA, 64 nt, Human
acagguauuucacacaauaauuuguucuuaaugcagccacuauaacuugauaagucauugcacu

SEQ ID NO: 387896 - RNA, 64 nt, Human
agugcugagacuacaggugugagccaccgugcucagccacuagcuuugguuuuuuaaacauaga

SEQ ID NO: 387897 - RNA, 64 nt, Human
cggccacggccacagucaugguggccacggccacagccacuaaucaggaggccaggccacccug

SEQ ID NO: 387898 - RNA, 64 nt, Human; identical to SEQ ID NO: 164776

SEQ ID NO: 387899 - RNA, 64 nt, Human; identical to SEQ ID NO: 164782

SEQ ID NO: 387900 - RNA, 64 nt, Human; identical to SEQ ID NO: 164786

SEQ ID NO: 387901 - RNA, 64 nt, Human
gugagguguuugaggguguggacuggcauccagcagccacuaacaaacacacaacuggugugua

SEQ ID NO: 387902 - RNA, 64 nt, Human
ggcauaggaccuaaccagugaagcuagaggcuacagccacuaaacuugcuucaggccaacgaua

SEQ ID NO: 387903 - RNA, 64 nt, Human
guaaauuucuuuuggaauauuuuuaguaacaaauagccacuauaauucuguaggccaaauuuua

SEQ ID NO: 387904 - RNA, 64 nt, Human
accacucugcugccccaccacgcggccugugaggagccacuaaaccuuuccgugccuagaccuc

SEQ ID NO: 387905 - RNA, 64 nt, Human
cccuccaauauagucucggagcuacaaccgcagcagccacuauaaagggcaauauugaucuuuc

SEQ ID NO: 387906 - RNA, 64 nt, Human
guugugaccaggaaagcugcccccaucugcaggaagccacuaugccagaaagcugcugacugca

SEQ ID NO: 387907 - RNA, 64 nt, Human
agaaauaaaaagaaaguaaaaguccccuagugauagccacuauucacagcuucucauuugugua

SEQ ID NO: 387908 - RNA, 64 nt, Human
gguucuucgcucaaccucuucuucccuaggucaaagccacuaucaucugauguguuagggaugg

SEQ ID NO: 387909 - RNA, 64 nt, Human
cuucugacgguagcuuuuggaggaagauuccugcagccacuaaugcauuguguaugauaacaaa

SEQ ID NO: 387910 - RNA, 64 nt, Human
auuauccucauacucauucuggggcucaggcuugagccacuacucccucauccccucaggaguc

SEQ ID NO: 387911 - RNA, 64 nt, Human
aagguuugggcaggagcagaacucuguggcuggcagccacuauucucaguuacaccucccagug

SEQ ID NO: 387912 - RNA, 64 nt, Human
aaaagucaggagaucagaauuuuaaauuugacuuagccacuaacuagccauguaaccuugggaa

SEQ ID NO: 387913 - RNA, 64 nt, Human
ggguucccagaagggagaucugggaggggucaggagccacuaaguugcuucacuccuuuuuucu

SEQ ID NO: 387914 - RNA, 64 nt, Human
ucuuucccaaagugcuuugcaaacauuaaguuuuagccacuagcugccuuuguugaguauaagu

SEQ ID NO: 387915 - RNA, 62 nt, Human
gagacacgguggagaacuaaacaauuuuuuaaagccacuauggauuuagucaucugaauaug

SEQ ID NO: 387916 - RNA, 64 nt, Human
ccuuggucucccaaagugcugggauuacgguguuagccacuacaccuggccuggauuguguauu

SEQ ID NO: 387917 - RNA, 64 nt, Human; identical to SEQ ID NO: 242580

SEQ ID NO: 387918 - RNA, 64 nt, Human; identical to SEQ ID NO: 242581

SEQ ID NO: 387919 - RNA, 64 nt, Human; identical to SEQ ID NO: 242582

SEQ ID NO: 387920 - RNA, 64 nt, Human
agaagaaugagucguucuuggaauaccuaugugcagccacuacccaucucaaugucaccuuguu

SEQ ID NO: 387921 - RNA, 64 nt, Human
cuuggccucccaaagugcugggauuacaggugugagccacuauacccgaccagaucaaaucuuu

SEQ ID NO: 387922 - RNA, 64 nt, Human
ugugucuucagauagcccuguccuggugguauuuagccacuaaccuuugccugguacaguaugg

SEQ ID NO: 387923 - RNA, 64 nt, Human
gaacaugcucucuuuucaccccccaccuccugagagccacuaauguaagauacagaaacauagc

SEQ ID NO: 387924 - RNA, 64 nt, Human
aaacacacucuagagaugcacuguccaauccgguagccacuagccacauguggcuaaauuaaaa

SEQ ID NO: 387925 - RNA, 61 nt, Human
uuucggcgagauacgucuaacccugugcaacagccacuacauuacuucaaacugagauccu

SEQ ID NO: 387926 - RNA, 64 nt, Human
uguggggugcaguuuuuaaaaaucagagcgcucuagccacuacuugguagaaaguagcauuuuu

SEQ ID NO: 387927 - RNA, 64 nt, Human
cagucucaaacgucuacaacuacaauguccaaugagccacuagccacaugaggcuauuuaagua

SEQ ID NO: 387928 - RNA, 64 nt, Human
cagagagaaacuagguccuuggugacaucuuuugagccacuagaccaagcuuuaccugaagcag

SEQ ID NO: 387929 - RNA, 64 nt, Human
cauagucacacauuuacaaauuuuucaagagguuagccacuaagacuuuaauaauuuuacaagg

SEQ ID NO: 387930 - RNA, 64 nt, Human
aaggcauuggccuugaaaaccuggacagcccagcagccacuaaggcucagauuguuaaagcucu

SEQ ID NO: 387931 - RNA, 64 nt, Human
cagaagugaagagugacuaguacaaauuauaaaaagccacuagacucuucacuguuagcuuuuu

SEQ ID NO: 387932 - RNA, 64 nt, Human
cggauacucccauuaaugagaaauaacacuaggaagccacuauuacaggaagaaaagauuuggu

SEQ ID NO: 387933 - RNA, 64 nt, Human
cauggcagucuguuuuuuuaaaaaaaaauuuuugagccacuaucuauuguugaauauuuuaaga

SEQ ID NO: 387934 - RNA, 64 nt, Human
aagucacuggcaccuagauaaguuaggaggguaaagccacuaccucgucugaaggacuggacuu

SEQ ID NO: 387935 - RNA, 64 nt, Human
caaguuucaauuuguuuuuacaaaacauuauucaagccacuagaauuaucaaauaugacgcuau

SEQ ID NO: 387936 - RNA, 64 nt, Human; identical to SEQ ID NO: 242586

SEQ ID NO: 387937 - RNA, 64 nt, Human; identical to SEQ ID NO: 242587

SEQ ID NO: 387938 - RNA, 64 nt, Human; identical to SEQ ID NO: 242588

SEQ ID NO: 387939 - RNA, 64 nt, Human
uuccaaguuccuagaggccuuaauuauucauucuagccacuaggugcauagaauuugagauuuu

SEQ ID NO: 387940 - RNA, 64 nt, Human
augauuuuauagggaaucuaucuucuaggaucuaagccacuaaauaaaaggauaaaugaaugau

SEQ ID NO: 387941 - RNA, 64 nt, Human
cuuggccucccaaagugcugggauuacaggcguaagccacuacaccuggcccucuucaucgaau

SEQ ID NO: 387942 - RNA, 64 nt, Human
gaagucuuuguacagacaacaaaccuguuucugcagccacuauuguuagucucuugauucauaa

SEQ ID NO: 387943 - RNA, 63 nt, Human
auaauaaugaagcucaacacugugguaggaaaauagccacuagaaagaaaauaaaaagcagag

SEQ ID NO: 387944 - RNA, 64 nt, Human
aaaacuuuaugaugauaaauuuguguuggucguaagccacuaaaucacaguaauuuguuauagc

SEQ ID NO: 387945 - RNA, 64 nt, Human
aguuucuucaccgaagaauaucuuucuagcccucagccacuacaaaugacagaagugaucuuga

SEQ ID NO: 387946 - RNA, 64 nt, Human
ugcacucgcucccucucuggcuaaggcaugcauuagccacuacacaagucauuagugaaagugg

SEQ ID NO: 387947 - RNA, 64 nt, Human
guaaaaauaaacaguguucucuucucuaccccaaagccacuacugaccaaggucucuucagugc

SEQ ID NO: 387948 - RNA, 64 nt, Human
gcccucgaugccacauggcggugaacacaucugaagccacuauguuuccuggcucuaaggcucg

SEQ ID NO: 387949 - RNA, 64 nt, Human
gucuuauccgaggggucugugguuguaucagaagagccacuaaaccaaucccccuuuccaaaau

SEQ ID NO: 387950 - RNA, 64 nt, Human
agaauccuggcucacuucuuuggugauacacuguagccacuagaaagagaaauaaacccaaugg

SEQ ID NO: 387951 - RNA, 64 nt, Human
ccuuggccuugcaaagcgcuggauuacaggcaugagccacuacacccagccgauuuuuccuuuu

SEQ ID NO: 387952 - RNA, 64 nt, Human
uauuuuuucagugccgggauauucauauuccuaaagccacuauuguguuuucucuaagaagcac

SEQ ID NO: 387953 - RNA, 64 nt, Human
gugacaggccacgcuggucucagaugcccagugaagccacuaacaugagugaggggagggcugu

SEQ ID NO: 387954 - RNA, 64 nt, Human
ucguauugucuacagcuguaguguucaauacauuagccacuagccacaugugguuauuuaaaua

SEQ ID NO: 387955 - RNA, 64 nt, Human; identical to SEQ ID NO: 240477

SEQ ID NO: 387956 - RNA, 64 nt, Human; identical to SEQ ID NO: 242567

SEQ ID NO: 387957 - RNA, 64 nt, Human; identical to SEQ ID NO: 242591

SEQ ID NO: 387958 - RNA, 64 nt, Human
uuagccaggugugguggcacaugccuguagucccagccacuagggcggcugagacgcaagacuu

SEQ ID NO: 387959 - RNA, 64 nt, Human
cucagccucccaaagugcugggacuacaggcaugagccacuacguccaggccaccucuaccuuc

SEQ ID NO: 387960 - RNA, 64 nt, Human
uguauguagaaaaaagacauaaaaccuuagagaaagccacuaccauuuuucaaguuaucuuuuc

SEQ ID NO: 387961 - RNA, 64 nt, Human
agcauuauucuagugcuguacuguuccguacggcagccacuacccacauguaacuuuuuaagau

SEQ ID NO: 387962 - RNA, 64 nt, Human
gagagaguucuagaacuucgauguccagugcaguagccacuacccauauguagcuguugagcau

SEQ ID NO: 387963 - RNA, 64 nt, Human
uuuauuggguuuugacagauucauaccucugugcagccacuaucacgaucaagauacaaauauu

SEQ ID NO: 387964 - RNA, 64 nt, Human
uuuuaaaacuuguuucauuuaugaucauguagagagccacuaggaggccugcaguuauuuuuga

SEQ ID NO: 387965 - RNA, 64 nt, Human
aaagcagcccuguaggcuucaaagaaucaguguaagccacuaaaaggaacugaaaaccuaggug

SEQ ID NO: 387966 - RNA, 64 nt, Human
uacauuccagaugcccaccucauccaauuuccagagccacuaucucugcuguccacuuuccuuc

SEQ ID NO: 387967 - RNA, 64 nt, Human
acuaccaaauauccaauggguaagcccaugauguagccacuaguacaauaaaaaucugaaguaa

SEQ ID NO: 387968 - RNA, 64 nt, Human
aacagacacuguuggugggaaagcaaacuuguucagccacuauggaaagcaguuuggagauuuc

SEQ ID NO: 387969 - RNA, 64 nt, Human
uuaauuguuuugaacauguaaauauaaaucugucagccacuacagccaucaaaagagagcaucu

SEQ ID NO: 387970 - RNA, 64 nt, Human
uggagagauuauggagauaaucuccuugucuauuagccacuagcauggcuaauugaucauugau

SEQ ID NO: 387971 - RNA, 64 nt, Human
aucaccguuaaacacugaucuuugcuaaugguggagccacuauggccaaugccuggcugcaggc

SEQ ID NO: 387972 - RNA, 64 nt, Human
uauacaauaaauaacggcgcagccagguauucggagccacuacaggucuccauaucuugauggu

SEQ ID NO: 387973 - RNA, 64 nt, Human
aacucacuggcgagaauacagcgugggacccuucagccacuacaacagaauuuuuuaaauugac

SEQ ID NO: 387974 - RNA, 64 nt, Human; identical to SEQ ID NO: 242592

SEQ ID NO: 387975 - RNA, 64 nt, Human; identical to SEQ ID NO: 242593

SEQ ID NO: 387976 - RNA, 64 nt, Human; identical to SEQ ID NO: 164792

SEQ ID NO: 387977 - RNA, 64 nt, Human
guguuacaugggaauaaggaauuucauucacuucagccacuaagaaaaguuuagaaucacgaaa

SEQ ID NO: 387978 - RNA, 64 nt, Human
auucgaggggaaugaggcaggucaagccgaugcuagccacuaguuugauuuuuuuucuguuuua

SEQ ID NO: 387979 - RNA, 64 nt, Human
ggauauuuuguagacuuuugcuguccagugugguagccacuaaccacauguggcuguuaagccc

SEQ ID NO: 387980 - RNA, 64 nt, Human
uucucuuuuuagacacaacagccgcaguuuggccagccacuaagucccaccagcugagguccga

SEQ ID NO: 387981 - RNA, 64 nt, Human
caagucuguaauuuccugacuuuuccuagaugucagccacuacuaugaauucaagcuuguguag

SEQ ID NO: 387982 - RNA, 64 nt, Human
cucugccucccaaagugcugccauuacaggcgugagccacuaggccugaccuccccuuccccuu

SEQ ID NO: 387983 - RNA, 64 nt, Human
gugguuuuugccauuuuuaauuuuuaauggcaaaagccacuauuacuuuugcaccaaccuaaua

SEQ ID NO: 387984 - RNA, 64 nt, Human
uuuauuugcacaccuguauguguggugccacguuagccacuaaaucugaacuuuuacccugcuu

SEQ ID NO: 387985 - RNA, 64 nt, Human
uuuuaauauggaaauguuuggaacaggagaugcaagccacuaacagagaacuuuaauaauucua

SEQ ID NO: 387986 - RNA, 64 nt, Human
uuagccuggugugguggugugugccuauagucccagccacuaggaaagcugaggcagaaggauc

SEQ ID NO: 387987 - RNA, 64 nt, Human
acaaaugcuuucucuucaaggcauggcgcaaaaaagccacuacuuccagaagcaucuccucauu

SEQ ID NO: 387988 - RNA, 64 nt, Human
uccuaugccccagcuucuggcccgcuccucacugagccacuaccugggcaucagucuggaucug

SEQ ID NO: 387989 - RNA, 64 nt, Human
uuucaaggaauagauguaaauuacccuuagggguagccacuauauuuuuuauacuaaaaaagga

SEQ ID NO: 387990 - RNA, 64 nt, Human
ggaggaggugacaaaccauuuccaacagcaacacagccacuaaaacacaaaaagggggauuggg

SEQ ID NO: 387991 - RNA, 64 nt, Human
cauuuaacaauggauuagaaaaauauuuuggucuagccacuaaacauaaugacugaaaaaaauu

SEQ ID NO: 387992 - RNA, 64 nt, Human
gaguuuaagucugaucuugaucuuaaacucaguaagccacuaucugcaauuuuguacauuauau

SEQ ID NO: 387993 - RNA, 64 nt, Human; identical to SEQ ID NO: 242571

SEQ ID NO: 387994 - RNA, 64 nt, Human; identical to SEQ ID NO: 242572

SEQ ID NO: 387995 - RNA, 64 nt, Human; identical to SEQ ID NO: 242589

SEQ ID NO: 387996 - RNA, 64 nt, Human
cauaaugaauauuuuauacugcauccuuuacauuagccacuaaauacguuauugcuugaugaag

SEQ ID NO: 387997 - RNA, 64 nt, Human
gcccagagccacaugcaaaacaccuucaauaaacagccacuauuucacaugcuguauauggacg

SEQ ID NO: 387998 - RNA, 64 nt, Human
cacugcuaauaugaugauaaauaugccugacuaaagccacuacagaaauccagagauuggcugu

SEQ ID NO: 387999 - RNA, 64 nt, Human
caacacaaugacaaugacaucuuccccuuaccuuagccacuaagaagacaagggcuguuacuca

SEQ ID NO: 388000 - RNA, 64 nt, Human
ggaaaggugguuggugaaugaaaaaguugcguagagccacuacuuucuuuuucccugagaauaa

SEQ ID NO: 388001 - RNA, 64 nt, Human
gaagagcaucccuucagcuuccccuccccguagcagccacuaaaagauuauuuaauuccagauu

SEQ ID NO: 388002 - RNA, 64 nt, Human
cccucgggucuguccuccccgucuggacccucccagccacuaucccuugcuggaaggcucagcu

SEQ ID NO: 388003 - RNA, 64 nt, Human
ccuagguucccauuuggggacuucaggaccccagagccacuaggacuuccuugggaagcccguu

SEQ ID NO: 388004 - RNA, 64 nt, Human
cugcugcaacugaccagcugccggaagauucuggagccacuaacauuaguuuugcacauauuuu

SEQ ID NO: 388005 - RNA, 64 nt, Human
gcaucaauaaaauuagaggacacuauugagagugagccacuagcuugauuuucuuucuccucug

SEQ ID NO: 388006 - RNA, 64 nt, Human
ccaccacaucauccucacguguucgguacugagcagccacuaccccugaugagaacaguaugaa

SEQ ID NO: 388007 - RNA, 64 nt, Human
gauuguaaucgaauggagaaauuugcaguauuuuagccacuauuaggaauuuuuuuuuuuugua

SEQ ID NO: 388008 - RNA, 64 nt, Human
gguucuccagggagcaggaguuggaccuccauggagccacuaggccuggccuccucuacacauc

SEQ ID NO: 388009 - RNA, 64 nt, Human
aaggaauccagaagacccucuccacuacucaggcagccacuauucaucuauuuuuaaaguaccc

SEQ ID NO: 388010 - RNA, 64 nt, Human
aucgcuauuuuuccccucugcccuagcccuagacagccacuaauguacuuucugucucuaugga

SEQ ID NO: 388011 - RNA, 64 nt, Human
cccagguguucaaggcugcugugagcuguguucgagccacuacacuccagccuggggacggagc

SEQ ID NO: 388012 - RNA, 64 nt, Human; identical to SEQ ID NO: 242595

SEQ ID NO: 388013 - RNA, 64 nt, Human; identical to SEQ ID NO: 242596

SEQ ID NO: 388014 - RNA, 64 nt, Human; identical to SEQ ID NO: 242597

SEQ ID NO: 388015 - RNA, 64 nt, Human
uaccucuuuguagcacguaguguuguggaaacuaagccacuaauugaguuucuggcuccccucc

SEQ ID NO: 388016 - RNA, 64 nt, Human
ccaacccacccccguucuuuguacgugcugagacagccacuagaagaucuuccuccagcggcgc

SEQ ID NO: 388017 - RNA, 64 nt, Human
ucugaggccccaggcccuaggauuccucccccagagccacuaccuuuguccaggccuggguggu

SEQ ID NO: 388018 - RNA, 64 nt, Human
aagugaguaugguucuaugccuguauuccccagaagccacuagaccuauuuuccccuauuuuau

SEQ ID NO: 388019 - RNA, 64 nt, Human
cuguaaagcuuuggacauacacuuagcugcugugagccacuaauaacauugggcuaauaucugc

SEQ ID NO: 388020 - RNA, 64 nt, Human
gccucugggaucugccaacacacguccacucccaagccacuagcccacuccccaguuggcccuu

SEQ ID NO: 388021 - RNA, 64 nt, Human
ucuauuaacgcugagauacaagucauccaugcacagccacuaucauacccuuuauucucacuga

SEQ ID NO: 388022 - RNA, 64 nt, Human
uuaaagcuucuuggauuucauuucauugauauacagccacuauuuuauuuuugaucaguggccu

SEQ ID NO: 388023 - RNA, 64 nt, Human
cuuuuuugcaggaagguuugcucuucagucaucuagccacuaaauguuaauuaucugauacuuu

SEQ ID NO: 388024 - RNA, 64 nt, Human
ggcugcaucagacccugguagggaggggugccgcagccacuaacgguaugugcucuccuucagc

SEQ ID NO: 388025 - RNA, 64 nt, Human
cccagccuugcccaccauuuaagaaauaucacagagccacuagaucucauaugaucuucuucaa

SEQ ID NO: 388026 - RNA, 64 nt, Human
gaagccagcaggcguggggugugauacucucuauagccacuacagggcgcgcgcaggucgcgga

SEQ ID NO: 388027 - RNA, 64 nt, Human
augugaacuaaguuuuuuacuuccacagaauacaagccacuaccuucugaccuccccacccccc

SEQ ID NO: 388028 - RNA, 64 nt, Human
auaaaaauuaucuauaaucucagaacccagaaauagccacuauuaacauuuccuacguauuuua

SEQ ID NO: 388029 - RNA, 64 nt, Human
ggcugucucauuccuaacauguaauucaugauuuagccacuaaauuucuaaggagaucauaaga

SEQ ID NO: 388030 - RNA, 64 nt, Human
gacuguggggucuguguguguagugagaguguguagccacuauuauaacuggaauuuaauuuac

SEQ ID NO: 388031 - RNA, 54 nt, Human; identical to SEQ ID NO: 242601

SEQ ID NO: 388032 - RNA, 64 nt, Human; identical to SEQ ID NO: 242602

SEQ ID NO: 388033 - RNA, 64 nt, Human; identical to SEQ ID NO: 242603

SEQ ID NO: 388034 - RNA, 64 nt, Human
acuggucauuaagucaucugacauuaaaucauuuagccacuaaguuauuugucuacucucacuu

SEQ ID NO: 388035 - RNA, 64 nt, Human
gaauguugaauauuagcucacugggguggggagaagccacuaccauuuuuuaggugauggggau

SEQ ID NO: 388036 - RNA, 64 nt, Human
cuuuagauagcccuguccuggugguauuuucaauagccacuaaccuugccugguacaguauggg

SEQ ID NO: 388037 - RNA, 64 nt, Human
aaaaaguaggggaagcggauggagaaaaacccaaagccacuaguauuagaagacuucuuuccac

SEQ ID NO: 388038 - RNA, 64 nt, Human
gagucccaaaugucaucagguuuuguuuuuuuucagccacuaagaaccccucugcuuuuaacuc

SEQ ID NO: 388039 - RNA, 64 nt, Human
uacuaugguauauauuuugaaaggagaaaaaaaaagccacuaaggucaguguuauaaaaucugu

SEQ ID NO: 388040 - RNA, 64 nt, Human
cuuuuuaaagccaaagaccauaguuuuaguuuuaagccacuagguagauauuuaggggaauagu

SEQ ID NO: 388041 - RNA, 64 nt, Human
gggcacucaggcagcccuuugcaaucgcgauggcagccacuagauaucacucucaacuugucau

SEQ ID NO: 388042 - RNA, 64 nt, Human
uuugcaucaccucccuggcaccucccauaguuacagccacuacauccccaccgccgccugucau

SEQ ID NO: 388043 - RNA, 64 nt, Human
cauuucccucccuguuucaguaaaagaugaugaaagccacuaucaauccucacugcugaguggc

SEQ ID NO: 388044 - RNA, 64 nt, Human
guccucucgugugaugacccuauugaguaucaguagccacuacucccccugccuggcccugaga

SEQ ID NO: 388045 - RNA, 64 nt, Human
uuuccauuccacuauuucccauaaugcuucugagagccacuaacuugauugauaaagauccugc

SEQ ID NO: 388046 - RNA, 64 nt, Human
gggcaguucaccggguccugcaggaccaggugccagccacuaagggggggcaccgccgaugcca

SEQ ID NO: 388047 - RNA, 64 nt, Human
uaugaauaucuaaaaggccagcuaccugccuaggagccacuauauauauagauagauguagguu

SEQ ID NO: 388048 - RNA, 64 nt, Human
gauacacuuugguaggcugaggccccuguuccacagccacuauuugcauugcugucccugcccc

SEQ ID NO: 388049 - RNA, 64 nt, Human
uccagaacugugagaaagaaaucucuaugguguaagccacuagucuguggcauuguuauagcag

SEQ ID NO: 388050 - RNA, 64 nt, Human; identical to SEQ ID NO: 242577

SEQ ID NO: 388051 - RNA, 64 nt, Human; identical to SEQ ID NO: 242578

SEQ ID NO: 388052 - RNA, 64 nt, Human; identical to SEQ ID NO: 164796

SEQ ID NO: 388053 - RNA, 64 nt, Human
uggcacacaccaaaaaaccgggauuauuuacagcagccacuauucaccccuuuuggcagacucu

SEQ ID NO: 388054 - RNA, 64 nt, Human
cgaacuguguguaugucaguggaaucaaaucaaaagccacuaacauggcugucuguuucauugg

SEQ ID NO: 388055 - RNA, 64 nt, Human
gcugcccuccuguagcauguguccaaguggacauagccacuaaccaacuaguuaccuuuggacu

SEQ ID NO: 388056 - RNA, 64 nt, Human
aaucauuuuucuauaauuuguaaaguugugaaagagccacuaccacaguuuuuacauugauuau

SEQ ID NO: 388057 - RNA, 64 nt, Human
cucggccucccaaagugcuaggauuacaagugugagccacuaugccuggccuucccuaucuucu

SEQ ID NO: 388058 - RNA, 64 nt, Human
cagugggggcacagggagggaacucuugacacugagccacuaaaauauggacuaauuuuuugga

SEQ ID NO: 388059 - RNA, 64 nt, Human
uguauucaaugacauuaucaucauuuuuagaacgagccacuaaccuauuagagaagaggcagau

SEQ ID NO: 388060 - RNA, 64 nt, Human
cgcaagaagcacaggaaagagaaguuucuuuaguagccacuagacaaccacccuuucugaaagc

SEQ ID NO: 388061 - RNA, 64 nt, Human
acuggcauucaaaucuaggucagucugcccccagagccacuacccuuaccccucacugaaucug

SEQ ID NO: 388062 - RNA, 64 nt, Human
ccaugaucaaaaaugccccaguuuccuuugaaaaagccacuaguucugugaauuguccuuuucc

SEQ ID NO: 388063 - RNA, 64 nt, Human
cucggccucccaaagugcugggauuacaggugggagccacuacagcuggcccagcagcucuguu

SEQ ID NO: 388064 - RNA, 64 nt, Human
uugccuccugcaccccacccccaccaaccaggggagccacuaagcugacuaacaacuguccccu

SEQ ID NO: 388065 - RNA, 64 nt, Human
cacagcgucccgcguagcugggacuacaggugcaagccacuauguccagcuagccaacuccucc

SEQ ID NO: 388066 - RNA, 64 nt, Human
gaauuucuuaagcuuucuuuuauuugcaugagagagccacuaccaaggcauguuuuguuaugcu

SEQ ID NO: 388067 - RNA, 64 nt, Human
cccuggaucuguucucccugacugcgggaggagcagccacuaggacuuuagcaggaagcccaca

SEQ ID NO: 388068 - RNA, 64 nt, Human
gguggcucauuguccucagagcccagacaguuccagccacuaggaggccgucuuggaaccagca

SEQ ID NO: 388069 - RNA, 64 nt, Human; identical to SEQ ID NO: 164800

SEQ ID NO: 388070 - RNA, 64 nt, Human; identical to SEQ ID NO: 164804

SEQ ID NO: 388071 - RNA, 64 nt, Human; identical to SEQ ID NO: 164808

SEQ ID NO: 388072 - RNA, 64 nt, Human
aggcacuuauuguaaauuuuagaaaccccucuguagccacuaguaaguaauuaugcacuaaaua

SEQ ID NO: 388073 - RNA, 64 nt, Human
acacaccccuguggcgagcaccgcagaaacgggaagccacuacuuaagaucggaaguuaagaga

SEQ ID NO: 388074 - RNA, 64 nt, Human
augugcuggcccugugauuuugccucccacacccagccacuaccucccagcuuggagaacaccu

SEQ ID NO: 388075 - RNA, 64 nt, Human
gaauuggggcugauacuuggaaagaaugugguaaagccacuacuuccucacacuuacugaacau

SEQ ID NO: 388076 - RNA, 64 nt, Human
cccuuauaaccuggacgugagcugucagagcagaagccacuaggccacugcgcgucugaggcuc

SEQ ID NO: 388077 - RNA, 64 nt, Human
ucgcuuuuucugcccacaaugauaaauuaaaaacagccacuauccauuuggaaaacuuaaaaga

SEQ ID NO: 388078 - RNA, 64 nt, Human
ggucuacgggaccgaggaccuuguccuuccuggaagccacuagaagccggugcugugaaaauac

SEQ ID NO: 388079 - RNA, 64 nt, Human
ccccaaccacugggucaugcgauccccacccuucagccacuagaucccagaucccccuguaacc

SEQ ID NO: 388080 - RNA, 64 nt, Human
agccuccugaguagcugggacuacaggcaugcgcagccacuaugcccggccaauaagcuauauu

SEQ ID NO: 388081 - RNA, 64 nt, Human
uuuagguaaguucaggcauauguaugcaauggaaagccacuagaaaucuucaggcacacagaua

SEQ ID NO: 388082 - RNA, 64 nt, Human
aggggaccugagggcuguccucgcugcugagaagagccacuaacucgugaccuccagccugccc

SEQ ID NO: 388083 - RNA, 64 nt, Human
cuuccucccuugccccaacccugagaaaggguccagccacuacccuguuggcaaacauucccuu

SEQ ID NO: 388084 - RNA, 64 nt, Human
agucuuguaaauguaucuugagagguaggagcagagccacuaucuccauugaagcugaaauggu

SEQ ID NO: 388085 - RNA, 64 nt, Human
cauaucccuacaacuugguacucuaucagauuccagccacuagaagaaccucagugagaaaaca

SEQ ID NO: 388086 - RNA, 64 nt, Human
gcuguaaccaacuuaucuaauaaaauuggcaaccagccacuauuuuguugacuaugagaaaguu

SEQ ID NO: 388087 - RNA, 64 nt, Human
ccuuucagcgaugugcauuuuguaagcacuuuggagccacuaucaaaugcugugaagagaaaug

SEQ ID NO: 388088 - RNA, 64 nt, Human; identical to SEQ ID NO: 164814

SEQ ID NO: 388089 - RNA, 64 nt, Human; identical to SEQ ID NO: 164819

SEQ ID NO: 388090 - RNA, 64 nt, Human
gcaggugccccugggcucagguaguuaguuguucagccacuaaugccuuuuaucccccauaugg

SEQ ID NO: 388091 - RNA, 64 nt, Human
aagcguugagccuuggaaagguagacaagcguugagccacuaagcagaggaccuuggguuccca

SEQ ID NO: 388092 - RNA, 64 nt, Human
guacgugauucccucccuuucacuuuucaaagugagccacuaaacagaaagucuaagaguucag

SEQ ID NO: 388093 - RNA, 64 nt, Human
auggagccaggacagagaucugguuccagcuuucagccacuagcuuccuguugugugcggggug

SEQ ID NO: 388094 - RNA, 64 nt, Human
uccucagaaaccuacucaacacagcacucuaggcagccacuaucaaucaauugaaguugacacu

SEQ ID NO: 388095 - RNA, 64 nt, Human
cuacaccuaacucaccuaacucauacugugcuggagccacuaacuagagcagcccuggagucau

SEQ ID NO: 388096 - RNA, 64 nt, Human
gaauuguuugaauauuaucccauugaauacccagagccacuaaaucuuuuuuuacuagaaaaua

SEQ ID NO: 388097 - RNA, 64 nt, Human
ucacaaacgaugugaaaacauuauugaguguuguagccacuagaauuuuaaaaucaaguuggau

SEQ ID NO: 388098 - RNA, 64 nt, Human
gcgguguaaguggcucuguccucagggugggcagagccacuaaacuuguuuuaccuaguucuuu

SEQ ID NO: 388099 - RNA, 64 nt, Human; identical to SEQ ID NO: 242558

SEQ ID NO: 388100 - RNA, 64 nt, Human; identical to SEQ ID NO: 242559

SEQ ID NO: 388101 - RNA, 64 nt, Human; identical to SEQ ID NO: 242560

SEQ ID NO: 388102 - RNA, 64 nt, Human; identical to SEQ ID NO: 242561

SEQ ID NO: 388103 - RNA, 64 nt, Human; identical to SEQ ID NO: 242562

SEQ ID NO: 388104 - RNA, 64 nt, Human; identical to SEQ ID NO: 242563

SEQ ID NO: 388105 - RNA, 64 nt, Human; identical to SEQ ID NO: 242564

SEQ ID NO: 388106 - RNA, 64 nt, Human; identical to SEQ ID NO: 242565

SEQ ID NO: 388107 - RNA, 64 nt, Human; identical to SEQ ID NO: 242566

SEQ ID NO: 388108 - RNA, 64 nt, Human; identical to SEQ ID NO: 240403

SEQ ID NO: 388109 - RNA, 64 nt, Human
agccucuguguugagguugccggggguagggguggggccacacaaaucuccaggagccaccacu

SEQ ID NO: 388110 - RNA, 64 nt, Human
aguuucagaagcccccacaugggggcucuaggaaugccggcaugcuggucuuuccgaccuggug

SEQ ID NO: 388111 - RNA, 64 nt, Human
ccaagcuuacuuauggggggaucgcccugcuggcugccggcaccgcccuccugcugccagagac

SEQ ID NO: 388112 - RNA, 64 nt, Human
acaaugacuuccuuggcgguuuugguacguucauugccggcaaugggcguuguaacaggaaaag

SEQ ID NO: 388113 - RNA, 64 nt, Human
augcugggugccccgaggcagaacaagaggcgcggggccacacccgugaaccaugcagacggcc

SEQ ID NO: 388114 - RNA, 64 nt, Human
guccccagagaggcacccccaggcaagcucgagggggccacaccgugucccagggagcccagcc

SEQ ID NO: 388115 - RNA, 64 nt, Human
cuaccaccuaccucauucugccuacucaccccaggggccacagccacagccugcuggacucagg

SEQ ID NO: 388116 - RNA, 64 nt, Human
accucagucuuucucgaagcuuggcggacccccagggccacacuguacccuccagcgaguccca

SEQ ID NO: 388117 - RNA, 64 nt, Human
uaaaaacuccauccuuuauaaauagucaagguuugggccacacaaaguauauuuuuaucaugga

SEQ ID NO: 388118 - RNA, 64 nt, Human
gaagaaacucuccccccaaauccuccaaccucuggggccacagcccugccccuccaguuccuug

SEQ ID NO: 388119 - RNA, 64 nt, Human
uaggucuggucaccaauaggguuuggagagcaaagggccacaacucaucagcugccugucucuu

SEQ ID NO: 388120 - RNA, 64 nt, Human
gccauccaccacccugugaggcaccagggcauucgggccacagggcggugcuagcuugacacag

SEQ ID NO: 388121 - RNA, 64 nt, Human
augcaaccccagcuccacuccagccuggcguccagggccacagccauggccugggggccaagcc

SEQ ID NO: 388122 - RNA, 64 nt, Human
ccaguacguacagcaagauuccugcccacaggaagggccacaggcccgcuaagccccaaaggca

SEQ ID NO: 388123 - RNA, 64 nt, Human
acaagucuuuaaucauacagcuaaggaauuccaagggccacaugcgaguauuaauaaauaaaga

SEQ ID NO: 388124 - RNA, 64 nt, Human
ugugggagagggcagcugccuuguguuaugucuggggccacaguugcugcaaaguccuggaucu

SEQ ID NO: 388125 - RNA, 64 nt, Human
agguuaaaguacuugauaccagacugcggcuucugggccacaugcuauggcaugauggggguuu

SEQ ID NO: 388126 - RNA, 64 nt, Human
cugugugcagaacauugucaccuccugaggcugugggccacagccaccucugcaucuucgaacu

SEQ ID NO: 388127 - RNA, 57 nt, Human
uggcaacuguuucaucuuaauaugcaagggccacaauuugcacuguguucauauuaa

SEQ ID NO: 388128 - RNA, 64 nt, Human
gccagggugagguggagccacauggcagggacaaugccggcagccugagcccaggcaccccagu

SEQ ID NO: 388129 - RNA, 64 nt, Human
ccccuguccccugcagcuuccguggugccuuugcugccggcagcccuuggggaccacaggccug

SEQ ID NO: 388130 - RNA, 64 nt, Human
ugagaaccacuacuaucauucacuagcucauaucugccggcagcaauugaagagauccaauauu

SEQ ID NO: 388131 - RNA, 64 nt, Human
cccggaguauuugcagaaggcucaggcaacgagugggccacaucucacuucugcuuccucaucu

SEQ ID NO: 388132 - RNA, 64 nt, Human
ucugcacugcaaccuccaccaggaccaggauccugggccacaggcugggaugguccuuccaaga

SEQ ID NO: 388133 - RNA, 64 nt, Human
ccuccucacuggugaaacccaggauguagauagagggccacacccacccuguccagaguagagg

SEQ ID NO: 388134 - RNA, 64 nt, Human
ccccugcucaggucugaguauggcugggagucgggggccacaggccucuagcugugcugcucaa

SEQ ID NO: 388135 - RNA, 64 nt, Human
aaacugauggaccgggugggccuggccugagcuggggccacaaaucaaagcaagggcuccagca

SEQ ID NO: 388136 - RNA, 64 nt, Human
gaugaagacaugcuugaggagccacggaguuugggggccacagcaccugggcacacacccgagc

SEQ ID NO: 388137 - RNA, 64 nt, Human
cucuuccuauccugcuaacucuaagauuugauaagggccacaucccaguguuuaucuuagcuug

SEQ ID NO: 388138 - RNA, 64 nt, Human
gccugccgcgccagacguggagcaucagugaaucgggccacaucugcagccagauguucgaagg

SEQ ID NO: 388139 - RNA, 64 nt, Human
ggcugcagugagagaccaaccccuaacaagggcugggccacagcagggaguccagcccuaccuu

SEQ ID NO: 388140 - RNA, 64 nt, Human
gucagggcugggcccuguagugcuggacucucccgggccacaauagggacagggcagggacagg

SEQ ID NO: 388141 - RNA, 64 nt, Human
ugggaacccugucugccccuucccaccuguccuugggccacaccaucacacugaaccacaggac

SEQ ID NO: 388142 - RNA, 64 nt, Human
gggaaagcugguccagcagcagggguggaggcuggggccacacugcgggacagcagccccucca

SEQ ID NO: 388143 - RNA, 64 nt, Human
cugggcugccggguucuagucuccuuugcacugagggccacacuauuaccaugagaagagggcc

SEQ ID NO: 388144 - RNA, 64 nt, Human
aacaauccuguuacucugucccacguccaaucaugggccacaaggcacagucuucugagcgagu

SEQ ID NO: 388145 - RNA, 64 nt, Human
uuguagccagccucagcacucagugaguucaucagggccacacccaguagagaaggccaagcaa

SEQ ID NO: 388146 - RNA, 64 nt, Human
gccacuugaguugugggcccaggagcccugcggcugccggcaggugaacugagugcccgacagc

SEQ ID NO: 388147 - RNA, 64 nt, Human
ugcuaauaaaaguccccagcuucuggagacccccugccggcagccccuuucccugccaccccag

SEQ ID NO: 388148 - RNA, 64 nt, Human
gguggccgagcagaucggggagcucuucauccacugccggcacggcugccggguagcgggcagc

SEQ ID NO: 388149 - RNA, 64 nt, Human
caucacccagcccugccucccucccagcagcccugggccacagcccccgccccuggcuuuuccc

SEQ ID NO: 388150 - RNA, 64 nt, Human
gaguccacauugccuguuucuuguguacaugggggggccacagagaccuggaaagagaacucuc

SEQ ID NO: 388151 - RNA, 64 nt, Human
uuuuaggacaaacagcucaguucuagucucucuggggccacacagaaacucuuuuugggcuccu

SEQ ID NO: 388152 - RNA, 64 nt, Human
agggaauugggauaccuggauucugguucugacagggccacaagcuaggaucucuaacaaacgc

SEQ ID NO: 388153 - RNA, 58 nt, Human
ucacccugacggagaucuaaaggccugcgggccacagcuccccaggaguucagugcag

SEQ ID NO: 388154 - RNA, 64 nt, Human
uucugauucaaguacaaugcugccauuuuuuaaagggccacaacuauagaauuaccacuguugg

SEQ ID NO: 388155 - RNA, 64 nt, Human
ugagcacuacccaguggcugaaaacucugcaaaugggccacacuuuugcaaaauacuuguaucu

SEQ ID NO: 388156 - RNA, 64 nt, Human
gaaguuccacccaugaggguccauguggcaaguagggccacagggcagcaccugguuacaacuu

SEQ ID NO: 388157 - RNA, 59 nt, Human
aaaaccagucugcgguuuagggggucagggggccacagagaaggggcagcugagcccca

SEQ ID NO: 388158 - RNA, 64 nt, Human
cugccccaaagcacaagagggaagagcaccgccggggccacaggacgucuguccuccagucaca

SEQ ID NO: 388159 - RNA, 64 nt, Human
cauggaaacauguuugauuucugugucuacaacagggccacauauuaaauuacuucugaauggu

SEQ ID NO: 388160 - RNA, 64 nt, Human
cagccgagcuuaggaauucgcuuccaggccgugggggccacauuucaccuccuuagucccccug

SEQ ID NO: 388161 - RNA, 64 nt, Human
gucuggaagcaccauccccuaucgcaggacuccugggccacaagcagucggucagugcagacuu

SEQ ID NO: 388162 - RNA, 64 nt, Human
uaccuccacacucucccggacuagguggucaacagggccacaggguugcuuucugucuuuggug

SEQ ID NO: 388163 - RNA, 64 nt, Human
aagaaaguuuaaaaauuuguguuggacuucaugcgggccacagguuggacaagcuugcccuagg

SEQ ID NO: 388164 - RNA, 64 nt, Human
uaauaagauuguaagguuugcccuccucaccuguugccggcaugcggguaguauuagccacccc

SEQ ID NO: 388165 - RNA, 64 nt, Human
gacgggagcaggugcagccacaucuuccagggccugccggcaucaccugcggccacaccugaga

SEQ ID NO: 388166 - RNA, 64 nt, Human
uaccagcucucaugcucucggaacaucaccugccugccggcagggcaguccgugcuccuccagc

SEQ ID NO: 388167 - RNA, 64 nt, Human
uagcuucccuggaccgcauuggaagaauuuucuugggccacauguaaaacacacuaacacuaac

SEQ ID NO: 388168 - RNA, 64 nt, Human
cuugaccccgcugccucagccucccaaauaacuggggccacaggugugcaccacaacucucagc

SEQ ID NO: 388169 - RNA, 64 nt, Human
aggauguggggaaguuaggaacuggugucuucaggggccacaccaaccuucugaggagcuguug

SEQ ID NO: 388170 - RNA, 64 nt, Human
uugcaaacuacacaaugcugcaggugcuucccaggggccacaggcugucaggaaacguguuuua

SEQ ID NO: 388171 - RNA, 64 nt, Human
uaggaagcuacugcaagguuccaggcuugggccugggccacagcaacagcaguggucaaauauc

SEQ ID NO: 388172 - RNA, 64 nt, Human
cuacccauuaacacuuguuagagacaccucagucgggccacaacugucucuguuucaacuuuaa

SEQ ID NO: 388173 - RNA, 64 nt, Human
auccuggcuccccaggguggcaggagcugagggagggccacacacuggcaagauuucaagacca

SEQ ID NO: 388174 - RNA, 64 nt, Human
ggcccuaauugugccugagcuugacuuucagucagggccacagugagcauuaaauuauuauucc

SEQ ID NO: 388175 - RNA, 64 nt, Human
cuggggaggcugggacucccccugccacaagccugggccacagcucacauuccacugcugggag

SEQ ID NO: 388176 - RNA, 64 nt, Human
gcaguguuggagagugacacugucggggcagcuggggccacaagcaggagccggccucgggcac

SEQ ID NO: 388177 - RNA, 64 nt, Human
caaggaccauauagacaugucacagguggaaaaagggccacaagccguuuugcacaaaugccug

SEQ ID NO: 388178 - RNA, 64 nt, Human
aggaacaccuguacuugaaguggaggaggcuagggggccacaguugcugcuucauuaacauaga

SEQ ID NO: 388179 - RNA, 64 nt, Human
ugaaucaugaucgugcgcuacugcacuccagccugggccacagagcaagacugucucaagaaaa

SEQ ID NO: 388180 - RNA, 64 nt, Human
cacaaccucaccaccaacaaagaggacuuuuguggggccacaaguaagaggucauuucuggaau

SEQ ID NO: 388181 - RNA, 64 nt, Human
cccuguccccgcaucuccccugggaccagcuggagggccacaugcacacacagccuagcugccc

SEQ ID NO: 388182 - RNA, 64 nt, Human
acugcacucugcucaucacgggaggauaccugugugccggcagccccucagggacucucagccc

SEQ ID NO: 388183 - RNA, 64 nt, Human
caugauaaagauuauaaagcagguccaaggaaagugccgccagugguccaaggagggagacaga

SEQ ID NO: 388184 - RNA, 64 nt, Human
uaagguggaggcugauucuaauugucugguugaggggccacaccaccuauuccccccaccuaac

SEQ ID NO: 388185 - RNA, 64 nt, Human
cauuccaaguguugccugcaugccuguucugucugggccacauucacagauucaggauucucag

SEQ ID NO: 388186 - RNA, 64 nt, Human
auugccaagguuagcacccucuccuuugagccuagggccacacuguucauugucacuuuaggca

SEQ ID NO: 388187 - RNA, 64 nt, Human
ucaagguguggcuuccauugaggagcccaggcuggggccacaacccugaauaaacucuguuggc

SEQ ID NO: 388188 - RNA, 64 nt, Human
uaaaggauaugaagguggcuggcuaggaagggaagggccacagccuucauuucuaggagugcuu

SEQ ID NO: 388189 - RNA, 64 nt, Human
cgcucaugaaaaauaaggccaaaacaagaguucugggccacagcucagcccagaggguuccugg

SEQ ID NO: 388190 - RNA, 64 nt, Human
ccaagacucugcacaaccagauugcuugugcagagggccacaauaaguguauguuuuauauuuu

SEQ ID NO: 388191 - RNA, 64 nt, Human
cuuacuugcugucuucaccagguucaagcuccgugggccacacugcugcugugccaagaaggug

SEQ ID NO: 388192 - RNA, 64 nt, Human
agaaaugagaaagagucugugggugggccucugagggccacagaaaaccagacaccccacaugu

SEQ ID NO: 388193 - RNA, 64 nt, Human
gaagcccugcagaaggugcaauguagggguucuggggccacagaggagaggccacuucccacca

SEQ ID NO: 388194 - RNA, 64 nt, Human
ucacauuccaagacuggccugaacccgccggugugggccacaguaggaggggccagcaguccuc

SEQ ID NO: 388195 - RNA, 64 nt, Human
gcucuguugcccccucaaaacugcacccagagcagggccacaagggugcuuuuuuucuuuaaaa

SEQ ID NO: 388196 - RNA, 64 nt, Human
aaucuccuucucuucgcuccacaggucuauaaaugggccacaguaggcaccccuuuuuaaaucu

SEQ ID NO: 388197 - RNA, 64 nt, Human
ggcagaaucagacuaucaggaaaggagcuggccagggccacagccagucaagaucucugagcaa

SEQ ID NO: 388198 - RNA, 64 nt, Human
uccccgcuccacaagacaccugugacauccuccagggccacaggagcacgugcugaccaguuuu

SEQ ID NO: 388199 - RNA, 64 nt, Human
gacacauggguguccagggagaaggcucugucccugccgccagaccccagugguugccacugaa

SEQ ID NO: 388200 - RNA, 64 nt, Human
cuggugccugcaccugcacucuagugacccugggugccgccagacccuucucuucuacaaagac

SEQ ID NO: 388201 - RNA, 64 nt, Human
gauggcuuggggcugccugggccccccuccaggaugccgccaggugucccucuccucccccugg

SEQ ID NO: 388202 - RNA, 64 nt, Human
uuagggcucuggaggugcuuucacucaaccaagggggccacagcacuggggagugaaacugccc

SEQ ID NO: 388203 - RNA, 64 nt, Human
ccgugcuugucucuagacgaggggaaugggggaagggccacaaccucuguuucugugacccagc

SEQ ID NO: 388204 - RNA, 64 nt, Human
gguguucaaggccacaggacaaggggagcacccugggccacacaggcguggagguguccccacc

SEQ ID NO: 388205 - RNA, 64 nt, Human
ugaauagaggaaaauacugagugcuaauguuacagggccacaaucucauauccacaauuccaaa

SEQ ID NO: 388206 - RNA, 64 nt, Human
uugggcacuagggcagguuccgugccagagucgggggccacacgagggccuggugccggugagg

SEQ ID NO: 388207 - RNA, 64 nt, Human
acaucccucgggaacucugccccucugacaaugagggccacagagaaggugguguuuccauggu

SEQ ID NO: 388208 - RNA, 64 nt, Human
uucccuuaucacugaaggcaagaagaguccagaagggccacagagaacucauguguucagcuca

SEQ ID NO: 388209 - RNA, 64 nt, Human
uaaauacauugggucuauaaaugugcauuuguaagggccacaaaagugaacgugugguacugua

SEQ ID NO: 388210 - RNA, 64 nt, Human
acucaggauggucaucuuggagggaccaaggggugggccacagccauggugggaguggccugga

SEQ ID NO: 388211 - RNA, 64 nt, Human
cacagccauggugggaguggccuggaccugcccugggccacacugacccugauacaggcauggc

SEQ ID NO: 388212 - RNA, 64 nt, Human
agugagcaggacggguaccaugcugcccugaagggggccacagccuggguggaaggcagaccug

SEQ ID NO: 388213 - RNA, 64 nt, Human
uugaggaaaacuaaaacugagaggcuacuuccuggggccacacagacugacucucucauggcua

SEQ ID NO: 388214 - RNA, 64 nt, Human
caugccugaaggcugggccuucgacccuggggaugggccacagggcaccaaacacaucauaugu

SEQ ID NO: 388215 - RNA, 64 nt, Human
acauuucaagugcucaaagccacgugcuggcuaggggccacagcguuagacagugcagagagaa

SEQ ID NO: 388216 - RNA, 64 nt, Human
ccugcgugcaccacccuaagcggcuaggcugacagggccacacgacauagcugaaauuuguucu

SEQ ID NO: 388217 - RNA, 64 nt, Human
ucugaaagugcaguacaucguuuguaccugaaacugccgccacaugcacuccuccaccgcugag

SEQ ID NO: 388218 - RNA, 64 nt, Human
aucaccugacaguaacuuucaugacauaggauucugccgccaaauuuauaucauuaacaaugug

SEQ ID NO: 388219 - RNA, 64 nt, Human
cagcaguugaauguaaugcuggggacaggcaugcugccgccaguagggcggggacccggacagc

SEQ ID NO: 388220 - RNA, 64 nt, Human
ucugaggggcccugcuccaagccugcaggaccgagggccacagccggacaggggguagccccug

SEQ ID NO: 388221 - RNA, 64 nt, Human
ucaccaggaaaguacacgggccugaggcaggauugggccacagacagccucucauugguccggg

SEQ ID NO: 388222 - RNA, 64 nt, Human
aagcacccuuagcccugacaucugucaagcuuuggggccacaaaauaauuuaauauaacccuaa

SEQ ID NO: 388223 - RNA, 64 nt, Human
uccagagguggaaguuacagaagaggagguaccugggccacacgacaugagcuggaaaaucucu

SEQ ID NO: 388224 - RNA, 64 nt, Human
agcuuccaggacuguucaaucuuuuggcuucccugggccacauuggaagaauugucuuggguca

SEQ ID NO: 388225 - RNA, 64 nt, Human
agaaacagacccaagaaaugugcucaauugcaaugggccacauaccuagaucuccagaugucau

SEQ ID NO: 388226 - RNA, 64 nt, Human
gggaggggcagggcaaggcagggcccccagagcugggccacacagugggugcugggccucgccc

SEQ ID NO: 388227 - RNA, 64 nt, Human
auuuuuuaccuggugguuaugagcauggacuugggggccacagugacugaguuugauucccgac

SEQ ID NO: 388228 - RNA, 59 nt, Human
uagccuggcuucagagcugagagugccuggggccacaggaaaggcaggaacaggaccuu

SEQ ID NO: 388229 - RNA, 64 nt, Human
aggaggcucucugaccccucacguuccuaccacagggccacagcccacacagcccugggacacu

SEQ ID NO: 388230 - RNA, 64 nt, Human
ccuucuaccaucucaucucccagugauucuccgugggccacaaugccucuagcuauggugcacu

SEQ ID NO: 388231 - RNA, 64 nt, Human
gaauguuuaacuuaagaauuauuucaguuugucugggccacacuggggcagaggggggagggag

SEQ ID NO: 388232 - RNA, 64 nt, Human
ggagccgugacccuguggaaggugcgucgggccagggccacacccaagggcccagcugucuugc

SEQ ID NO: 388233 - RNA, 64 nt, Human
gaaguggacugaagcuacaguuuuuagcuggugcgggccacaggcagggucagauugagaagaa

SEQ ID NO: 388234 - RNA, 64 nt, Human
uaccacgggucugccaugcucuggaggagcaagggggccacauccccaccccagcuguuaccca

SEQ ID NO: 388235 - RNA, 59 nt, Human; identical to SEQ ID NO: 100970

SEQ ID NO: 388236 - RNA, 64 nt, Human
auaaaagaaaaguagagauaauaaucaguucuuuacaaccgaugguaauuaagcuuguauucac

SEQ ID NO: 388237 - RNA, 64 nt, Human
gaugguaauuagcuggcuucauuauuuuuguaguacaaccgauauguucauuagaauucuuugc

SEQ ID NO: 388238 - RNA, 64 nt, Human
gcagagggaggagaagaaggggugcucaggcugcgggccacaguccagcagcgccagaagcacu

SEQ ID NO: 388239 - RNA, 64 nt, Human
gacacgggggacagcguccacacucagagggccugggccacagccccgauguuucuuuucagaa

SEQ ID NO: 388240 - RNA, 64 nt, Human
cagugagccgagaucgcacugcuguacccagccugggccacagugcaagacuccaucucaaaaa

SEQ ID NO: 388241 - RNA, 64 nt, Human
ccugucaaaaaguccaacauuucauagguaguaggggccacauauuacauucaguugcuauagg

SEQ ID NO: 388242 - RNA, 64 nt, Human
gcuguagugaagagacccacuccaaauaaaaaaggggccacacggggcuucuaaguuagguugc

SEQ ID NO: 388243 - RNA, 64 nt, Human
uucauaggucauagaaggcagcaaugcacugacugggccacaucuugaaaacucguggaaaggg

SEQ ID NO: 388244 - RNA, 64 nt, Human
gcuguggaucauuuccaacuuucaacuucacuccgggccacacuuuccaaccaggagcaccaau

SEQ ID NO: 388245 - RNA, 64 nt, Human
gcccucacaccuccucgagugcccugggaccacugggccacagauggucaucaggggaagccac

SEQ ID NO: 388246 - RNA, 64 nt, Human
accugcuccauagcuccgggcgcugcgucccgaggggccacagucuccauuucagcgucuugca

SEQ ID NO: 388247 - RNA, 64 nt, Human
gcuguggggcauaacgaugaggcgcuggccuugggggccacaccaggucgcagcaaauggcuuc

SEQ ID NO: 388248 - RNA, 64 nt, Human
cgugagagagcccccaccguggacaccggcucuagggccacaggaaaaggaacguuuccaggca

SEQ ID NO: 388249 - RNA, 64 nt, Human
acccuggaacauccccagagugaaagauggagcugggccacaucagaauaaggccuuggcccca

SEQ ID NO: 388250 - RNA, 64 nt, Human
uuuccauagugauaaagacaaggaaacgcugcaggggccacaggcacaggcugauauuuaaaga

SEQ ID NO: 388251 - RNA, 64 nt, Human
aucauuaucauggcuacaaagucuuguguggucugggccacauccugugccaggcucccuuuca

SEQ ID NO: 388252 - RNA, 64 nt, Human
cccccucuuccucccugggggccccaggaugggggggccacacgcugcaccuaaagccuacccu

SEQ ID NO: 388253 - RNA, 64 nt, Human
auagauuuggaauaggaauaagcucuaguucuuaacaaccgacacuccuacaagauuuagaaaa

SEQ ID NO: 388254 - RNA, 64 nt, Human
gcuggcccucaacucuccuuggugcaggguucccacaaccgaguucuaguucccugaggucuuu

SEQ ID NO: 388255 - RNA, 64 nt, Human
guccccuccaccuucccucacagugugucuggugacaaccgaguggcugucaucggccugugua

SEQ ID NO: 388256 - RNA, 64 nt, Human
gaaacuagcucccagcccccauggggcagcagcugggccacaauugccccuuuccguuuucuaa

SEQ ID NO: 388257 - RNA, 64 nt, Human
cagagcucugggacagcaggcagaggccgagccugggccacagcucagccacugacuuggguau

SEQ ID NO: 388258 - RNA, 64 nt, Human
cagucccugagcucagacccccguccccggaacugggccacaccacgugcccucuuggcccagc

SEQ ID NO: 388259 - RNA, 64 nt, Human
aaggagaguuuguuacuuacgguucugagaggaggggccacauaggaaagccccacgguggguc

SEQ ID NO: 388260 - RNA, 64 nt, Human
auauuuuuauaaaaaaguaccacugagucagugagggccacagauugguauuaaugagauacga

SEQ ID NO: 388261 - RNA, 64 nt, Human
ucucugccagaggcuuucaugagccccaaggcuggggccacagcuccuaccccugcccagcagc

SEQ ID NO: 388262 - RNA, 64 nt, Human
acaggagggccgcccgccaccaagccucaccugggggccacagggacacugcucugccugccug

SEQ ID NO: 388263 - RNA, 64 nt, Human
ugcuugcugggacagucaccaggguuggggggaagggccacaaaaugaaaccauuaaagacccu

SEQ ID NO: 388264 - RNA, 64 nt, Human
acccucccuguuguucacagagagggaaggucgugggccacacaaugcugugugacccucuccg

SEQ ID NO: 388265 - RNA, 64 nt, Human
guaaaucacagguguccaaacuuuuggcuucccugggccacauuugaagaagaauuuucuuggg

SEQ ID NO: 388266 - RNA, 64 nt, Human
cuucccugggccacauuugaagaagaauuuucuugggccacauaaaauacacuaacgauagcug

SEQ ID NO: 388267 - RNA, 64 nt, Human
ucugagaacccggagucgcagcgcccucgggccugggccacacgcaggcccuggugggaccacc

SEQ ID NO: 388268 - RNA, 64 nt, Human
gcauuaccuccguguuucucccuuucgagccggcgggccacagacgucggaagaaacucccgua

SEQ ID NO: 388269 - RNA, 64 nt, Human
uuccugaggaccuggggcuguugggagccgcugugggccacaucuucugccccuucucagccuc

SEQ ID NO: 388270 - RNA, 64 nt, Human
caugauaggauuccuuaagauguuaccacccagggggccacaagccagccugcugucucaggaa

SEQ ID NO: 388271 - RNA, 64 nt, Human
acuguauauaucuauaguuuguaaaaagaacaaaacaaccgagacaaacccuugaugcuccuug

SEQ ID NO: 388272 - RNA, 64 nt, Human; identical to SEQ ID NO: 11123

SEQ ID NO: 388273 - RNA, 64 nt, Human; identical to SEQ ID NO: 11129

SEQ ID NO: 388274 - RNA, 64 nt, Human
gaaacuuagaucaucagucaccgaagguccuacagggccacaacugcccccgccacaacccacc

SEQ ID NO: 388275 - RNA, 64 nt, Human
aaguaggguggauguggguagggcugggaggagggggccacagcuuagguuuggagcucuggau

SEQ ID NO: 388276 - RNA, 64 nt, Human
cccuucccccuauccaaccuggguagguggguaggggccacaguugcuggauguuuauauagag

SEQ ID NO: 388277 - RNA, 64 nt, Human
ugcuuugggagguguuaacucaaaggugacuucugggccacagaucaagaaagcauuugaucug

SEQ ID NO: 388278 - RNA, 64 nt, Human
ugugggugcccggcgugagggaucaggcucgccagggccacaggacaggugaugaccuguggcc

SEQ ID NO: 388279 - RNA, 64 nt, Human
gagacagaccaggaccaaaccaugcagaggucaagggccacauucaccuuuucagagugacuca

SEQ ID NO: 388280 - RNA, 64 nt, Human
caccugcauguucucugcuucgcugccuuggaaggggccacauuccccauuccucuucuccuua

SEQ ID NO: 388281 - RNA, 64 nt, Human
cuuugccugaauaccacguccccaagaaucagaggggccacagcccuucuccuccaugggaggc

SEQ ID NO: 388282 - RNA, 64 nt, Human
cuggagggccaggagucccagacucacgcacccugggccacagggagccgggaaucggggccug

SEQ ID NO: 388283 - RNA, 64 nt, Human
ugcuagagaccaagguggccgagcugcuggcccagggccacaccaagccacccgagcgcagugc

SEQ ID NO: 388284 - RNA, 64 nt, Human
aggacucguggugucuccaggcugugugacugcagggccacaugcugccugcaaacagggcaag

SEQ ID NO: 388285 - RNA, 64 nt, Human
ccccaacaacccagagcagguguugcagacaggagggccacagcguguggaaguaaagacuuug

SEQ ID NO: 388286 - RNA, 64 nt, Human
ggcaccaggauucuccacuucuuccagcccugcugggccacaguucuaacugcccuuccuccca

SEQ ID NO: 388287 - RNA, 64 nt, Human
aggcuuuccuugaccccacuucuggcuguccugcgggccacaagcucuucaggccaagucagag

SEQ ID NO: 388288 - RNA, 64 nt, Human
acuggaggccucuccgcguggguacuuggggguggggccacaaaucuggcgaaaaacuucaugc

SEQ ID NO: 388289 - RNA, 64 nt, Human
cuuaaagaggggcaguuucucaaaagcagaaacaugccgccaguucucaaguuuuccuccuaac

SEQ ID NO: 388290 - RNA, 64 nt, Human
aaccauuuucccccucacccuaacucucuuauucugccgccacaaugcaagcauaguuugaugu

SEQ ID NO: 388291 - RNA, 64 nt, Human
ugcccacuggggacacacugugccgugcuccuucugccgccacgcccagcuccccaccugcccu

SEQ ID NO: 388292 - RNA, 64 nt, Human
gugaaggcuucucucugugggaugggaugguggagggccacaugggaggcucacccccuucucc

SEQ ID NO: 388293 - RNA, 64 nt, Human
gaacucuguuuaaaugcucaguucagaacacuuugggccacauagugauuuuggaaaacaggau

SEQ ID NO: 388294 - RNA, 64 nt, Human
agcuaaucaccagcauuuguuccccauagucacagggccacacaagggaacauuuaggacaaac

SEQ ID NO: 388295 - RNA, 64 nt, Human
ucagcccaauccaccuugcagacacgagccacacgggccacacggugacugcugcggcucugag

SEQ ID NO: 388296 - RNA, 64 nt, Human
cgccguccuaugaccaaaggccccugccaggugugggccacagcagcagguaugugugaaagca

SEQ ID NO: 388297 - RNA, 64 nt, Human
ggggcugccguccacccguggggcccaggggcuggggccacagccuugccauuuucguugccau

SEQ ID NO: 388298 - RNA, 64 nt, Human
ccccaucacacccggcaucuacacaagauccgccgggccacagagcucgaggcugucuucacca

SEQ ID NO: 388299 - RNA, 64 nt, Human
gccagccucaguucugggagcgcuggggucgccugggccacaggccacagcagcucaccucagg

SEQ ID NO: 388300 - RNA, 64 nt, Human
gugaguuuaggcagcuucucuguaaccgcuucuggggccacaccccaaaacucuacacccucug

SEQ ID NO: 388301 - RNA, 64 nt, Human
aauaauaacaucaaccaacaucuuuuccaaauuagggccacagaacagcaacauuugucugaca

SEQ ID NO: 388302 - RNA, 64 nt, Human
uggaguggggaggagccugggcagccugcugggugggccacacucagccugacugcccuccaug

SEQ ID NO: 388303 - RNA, 64 nt, Human
ggggaaggaucagggggccaggccagcagcucgggggccacaaggagauggauaaugugccugu

SEQ ID NO: 388304 - RNA, 64 nt, Human
uccucugggggcuggcgcaugcccaggaaagccugggccacacgggacacucucuucuuuaucg

SEQ ID NO: 388305 - RNA, 64 nt, Human
cagggcgcuggcagaccaugcuccgccuccaccagggccacagaggagcggaggggccuauggg

SEQ ID NO: 388306 - RNA, 64 nt, Human
ggccccaccaucuugugacaaaugguguggcccagggccacauaacagacugcuguccugggcu

SEQ ID NO: 388307 - RNA, 64 nt, Human
gugcaaggagaugucugaauacugcagcacucugugccgccaccucuaccuguucccaggacac

SEQ ID NO: 388308 - RNA, 64 nt, Human
gaaugaaaacaacucaaguucauagcagccagccugccgccauuggaccucccuuuuaaaaacu

SEQ ID NO: 388309 - RNA, 64 nt, Human; identical to SEQ ID NO: 11135

SEQ ID NO: 388310 - RNA, 64 nt, Human
agucugcugcaagggugagaccaggcagccugcugggccacacuguccuguuggcaucacagcc

SEQ ID NO: 388311 - RNA, 64 nt, Human
ccucccccaggugcuagagagccaggcagagcuggggccacagcgugucuggagaagccagguc

SEQ ID NO: 388312 - RNA, 64 nt, Human
gcacguggccccuggguugcaccuggagcuucgggggccacagcugugggcccggcgcaugggc

SEQ ID NO: 388313 - RNA, 64 nt, Human
acguuccuauacggccccccagacccagcuguccgggccacagacccccagcagguagcauucc

SEQ ID NO: 388314 - RNA, 64 nt, Human
cugugacggggaguccaggcgcaggagggacccggggccacaaggcgcugcgggcccaggugug

SEQ ID NO: 388315 - RNA, 64 nt, Human
cugccguuaacuagguuaauaaaucacaaccuuggggccacaguugccuuauauguaaaugaag

SEQ ID NO: 388316 - RNA, 64 nt, Human
gauggcaccucccuuucagccauucuucaagaaugggccacacacagcuagaaguccucuccca

SEQ ID NO: 388317 - RNA, 64 nt, Human
uaucuccccaaaguaccauagccaguuuccagaugggccacagacuggggaggagaaucagugg

SEQ ID NO: 388318 - RNA, 64 nt, Human
uccauuaccaugccaucagagcagaccucagccagggccacagaggucccaaccgucucugccc

SEQ ID NO: 388319 - RNA, 64 nt, Human
ccacuccgcagagcccagcugggccugggccccagggccacagcuagccugcauguguguacug

SEQ ID NO: 388320 - RNA, 64 nt, Human
cacuuaugccaaacucuaauaaaauggagucggggggccacauagaagcccucacacacacaug

SEQ ID NO: 388321 - RNA, 64 nt, Human
uauccaguugaucuggcaaugacuuuuugugugugggccacaauauugauuuucccauuaacaa

SEQ ID NO: 388322 - RNA, 64 nt, Human
ggaucggugagacugauacagacuugaccuuucagggccacagagaccagccuccgggaagggg

SEQ ID NO: 388323 - RNA, 64 nt, Human
aaacuucugucauguagcugaccaaaauccugcagggccacagucggcacuguuauuugcuucu

SEQ ID NO: 388324 - RNA, 64 nt, Human
ccugcacaagccaugcuggcucagucugagcugugggccacaucagcuaguggcucuucucaug

SEQ ID NO: 388325 - RNA, 64 nt, Human; identical to SEQ ID NO: 11141

SEQ ID NO: 388326 - RNA, 64 nt, Human; identical to SEQ ID NO: 11147

SEQ ID NO: 388327 - RNA, 52 nt, Human; identical to SEQ ID NO: 11152

SEQ ID NO: 388328 - RNA, 64 nt, Human
cuaugccuuuccaagcauuucuacuuggggaauugggccacagagguagugagccaguguccug

SEQ ID NO: 388329 - RNA, 64 nt, Human
aauuaaguguucugauuaguaagaacuaagcagggggccacaugcucucaauggagacaauaaa

SEQ ID NO: 388330 - RNA, 64 nt, Human
gaguggguguuccuucgagccccuuccacucagagggccacacccagcgaugccagugaaggug

SEQ ID NO: 388331 - RNA, 64 nt, Human
auucuccuuguaagccuugaagaaguaugugagagggccacauuggcuaaaaccuaaagguggc

SEQ ID NO: 388332 - RNA, 64 nt, Human
auggaggacagcuuauggaaaaaguuagggcguggggccacaugugugaauuuuacaaugaaaa

SEQ ID NO: 388333 - RNA, 64 nt, Human
ccagccuccccuccccuggggacgccaaggaggugggccacacccaggaagggaaagcgggcag

SEQ ID NO: 388334 - RNA, 64 nt, Human
accuccuguugggaggcgguggggggccaaaguggggccacacacucgcuguguccccucuccu

SEQ ID NO: 388335 - RNA, 64 nt, Human
agugagcggagaucgcaucauugcacucuagccugggccacagggcgagacuccgucucaaaaa

SEQ ID NO: 388336 - RNA, 64 nt, Human
accccacccuccacaggaaauugccucaugggcagggccacagcagagagacacagcaugggca

SEQ ID NO: 388337 - RNA, 64 nt, Human
ucccuagagcaggggaccccaacccccaggccaugggccacacagcaggaagaggugaguggug

SEQ ID NO: 388338 - RNA, 64 nt, Human
ucccacacaucucacaucauggggaggccagagggggccacacgagagcuccaggcucugggcu

SEQ ID NO: 388339 - RNA, 64 nt, Human
agcaugaacaauugggagcaucagucccccacuugggccacacuacccaccuuucccagaagug

SEQ ID NO: 388340 - RNA, 64 nt, Human
aggucuuuguucucacuguauucuuuuuauccuggggccacaguucuugauuauuccucuugug

SEQ ID NO: 388341 - RNA, 64 nt, Human
gaugguaggaugauuguaucuugaauaugugguagggccacaucuauuguaggaaaaccuugcu

SEQ ID NO: 388342 - RNA, 64 nt, Human
ggucuacgguagagguccaacaacuacagccugugggccacaucuggccacagccugauuugua

SEQ ID NO: 388343 - RNA, 64 nt, Human
gugugggucugcaggugagcagacaggacaggugugccgccacccaagugccaagacacagcag

SEQ ID NO: 388344 - RNA, 64 nt, Human
caaguaaagccuuagcccggaugcccaccccugcugccgccacuggcugugccucccccgccac

SEQ ID NO: 388345 - RNA, 64 nt, Human
ugccaugccgcagaggaugcgccuagcugggcuggggccacacgacuauuauguuggccuugaa

SEQ ID NO: 388346 - RNA, 64 nt, Human
uuccuguugaguuaacucagagguuaaguccaacgggccacaugcagacuucacuguaggcagg

SEQ ID NO: 388347 - RNA, 64 nt, Human
uggagcgcuucaguucagcuuuaaaggccaggacgggccacacguggcuggcggccucguucca

SEQ ID NO: 388348 - RNA, 64 nt, Human
agcaccuuuagaucccuuccccuccaugggcuuugggccacagaaugaaccuuugaggccugua

SEQ ID NO: 388349 - RNA, 64 nt, Human
ccaaauuuuuacuuuguuuuucuuuuaauaggcugggccacauguuggaaauaagcuaguaaug

SEQ ID NO: 388350 - RNA, 64 nt, Human
cuggggccgggcaggccaggccaagccaagcagggggccacagggugggcuguggagcucucag

SEQ ID NO: 388351 - RNA, 64 nt, Human
caaucucauccaauggccacuggagauguguguagggccacaagaaugagaaagggggcaaugg

SEQ ID NO: 388352 - RNA, 64 nt, Human
gggccuagcucccaaauccugccccguuggcacagggccacaggagcagaagcugggugggcug

SEQ ID NO: 388353 - RNA, 64 nt, Human
cuccucuguccucaucauguuccagcucucuacagggccacauacucuucuggcauaucucucc

SEQ ID NO: 388354 - RNA, 64 nt, Human
ggagaugccaaggugcccugcaggaccucccuccgggccacacccucagcugccucuucaggaa

SEQ ID NO: 388355 - RNA, 64 nt, Human
gacuggcugugaaaagucagguggcagaaaccuggggccacauagagccucucucuuuuccugu

SEQ ID NO: 388356 - RNA, 64 nt, Human
aguuccucccaaccaaccagucuucacuucaagagggccacacugcaaccucagcuuaacauga

SEQ ID NO: 388357 - RNA, 64 nt, Human
ucugccacacugaggccagggacgaguguucagugggccacagugaaccaaccaaaccaacccc

SEQ ID NO: 388358 - RNA, 64 nt, Human
uuuugaugcaaaggaacggcccugggaccucagagggccacagaugggcuuccugggccuagcg

SEQ ID NO: 388359 - RNA, 64 nt, Human
gggggcacugcuugaagcacagcacuugguuagggggccacagaggccuaaguuugcuggccug

SEQ ID NO: 388360 - RNA, 64 nt, Human
cgccucaggagguggccgacugcugcuagcggccugccgccacgucagcagcccagggcacagc

SEQ ID NO: 388361 - RNA, 64 nt, Human
ugaaauuggaccugaacuguuggauuuuucuaguugccgccaaacaaggcaaaaaaauuuaaac

SEQ ID NO: 388362 - RNA, 64 nt, Human
ugccaagcauccacccggcccacaggcauguuucugccgccacuccgcaagauggacagggagc

SEQ ID NO: 388363 - RNA, 64 nt, Human
gugcggcaggguccuggaggccacuugcgcggcugggccacagagucuacuuugaaggcaccuc

SEQ ID NO: 388364 - RNA, 64 nt, Human
ccacccaggccagaugguacagccuguugcuccugggccacacaccuguacagcaugugaccgc

SEQ ID NO: 388365 - RNA, 64 nt, Human
uucuucagagagauaaaauugggggaggagcccagggccacauaccaagcuuugggacauggug

SEQ ID NO: 388366 - RNA, 64 nt, Human
cucugcacacccuccagagacaacagguaaaacagggccacauagaugcugauggagccuuccc

SEQ ID NO: 388367 - RNA, 64 nt, Human
cccagccaaaugucugugcucucugugucacugagggccacagguuccucuaacaucugucacu

SEQ ID NO: 388368 - RNA, 64 nt, Human
cagccauccuccugccucagcuucccagauagcugggccacaggcgugugccaccacaccuggc

SEQ ID NO: 388369 - RNA, 64 nt, Human
gaauggacuggccuggggaaggcuuuccccucuugggccacaccugcucacucugggguugggg

SEQ ID NO: 388370 - RNA, 64 nt, Human
aagugcugggauuacaagcgugagccacugcaccgggccacagagaaaguacuucuccacccug

SEQ ID NO: 388371 - RNA, 64 nt, Human
aaagaccaguuacuuggagugggggguggggguggggccacaaaaggaaaaccggaggagcaau

SEQ ID NO: 388372 - RNA, 64 nt, Human
ugaaucuuugugcacuugcaccucuuuuucacaugggccacaguuucaguacuucagccucagu

SEQ ID NO: 388373 - RNA, 64 nt, Human
uggagaugagagaggcuucgagagggugggugcugggccacaggggugcggggccagcucaggc

SEQ ID NO: 388374 - RNA, 64 nt, Human
agcaucgcugaaccuugacaguguggcuggccaugggccacagcugcggccacugcagcagcca

SEQ ID NO: 388375 - RNA, 64 nt, Human
aaagcgaaaggcagcagccuggugugcugauccggggccacacggaggaggagccgccccagcc

SEQ ID NO: 388376 - RNA, 63 nt, Human
uggugggcaccccgacguagcugccccccuggggggccacagcccagagaaccagccuaggaa

SEQ ID NO: 388377 - RNA, 64 nt, Human
auggccggcucagguagcacugggcacgaggagugggccacagcaggaucucaacgggaaagca

SEQ ID NO: 388378 - RNA, 64 nt, Human
acauugaaaugaggauuuugcuuaaaacagcacuugccgccagugggaggagggagguuuuauu

SEQ ID NO: 388379 - RNA, 64 nt, Human
uccacuccuugaaaaacacaggauuauaaaauggugccgccauuucucauuuuuuaacuuuuua

SEQ ID NO: 388380 - RNA, 64 nt, Human
cuuguuauauaaaggguacuuuugggagggugagugccgccauuuaguggcugcuagaaacauu

SEQ ID NO: 388381 - RNA, 64 nt, Human
cggaccacauguugagaaacugcagucacccuuagggccacaccgucccucuccucgcuguccc

SEQ ID NO: 388382 - RNA, 64 nt, Human
gcccuccugcugccaggaccugcuugaacuaccagggccacaggagggggauaaucagagcuug

SEQ ID NO: 388383 - RNA, 64 nt, Human
ggccaaggguccagagaagugauaacuuggcccagggccacacagcagagguagaggguccuug

SEQ ID NO: 388384 - RNA, 64 nt, Human
cauuacguggcccucagccaugcguggacucagugggccacacagacacagugucaccucuccc

SEQ ID NO: 388385 - RNA, 64 nt, Human
caccugggggacagaggcagauaagaaggugcgagggccacagcccugggaggggguccugacu

SEQ ID NO: 388386 - RNA, 64 nt, Human
uucccuuaucacugaaggaaggaagaguccagaagggccacagagaacucaaacguucaguuca

SEQ ID NO: 388387 - RNA, 64 nt, Human
cagaggaagcuucuacgcgcuagagaggaucaaggggccacacuggaccaugugaacagccauc

SEQ ID NO: 388388 - RNA, 64 nt, Human
agguggcuggugcaggggugagggguccaugcaggggccacauccaaaaaggggagagggaagu

SEQ ID NO: 388389 - RNA, 64 nt, Human
ggguauccccaaccccagacccccaucacuugaugggccacacaaguuugagagugguacaagg

SEQ ID NO: 388390 - RNA, 64 nt, Human
cucuccgugcugcagccuauacuaaggugacccagggccacauguagacagcuaggccagugcu

SEQ ID NO: 388391 - RNA, 64 nt, Human
aggaucauuacagagacagacucucccgagacaugggccacacugauagaauagagaauuugag

SEQ ID NO: 388392 - RNA, 64 nt, Human
ccaaagcugacgaggcugggccaagccagggauggggccacagccagaaccccgagcccuacuu

SEQ ID NO: 388393 - RNA, 64 nt, Human
aguuccaguuccacgaaacacugugcaaagccucgggccacauggguccacugcaccaguguga

SEQ ID NO: 388394 - RNA, 64 nt, Human
gaccaggaagaugcucugacagaugccaugguaugggccacaggacacacuugcucgagaacca

SEQ ID NO: 388395 - RNA, 64 nt, Human
aaucagaguucccagggccagacaggcucuuccugggccacagaggggaggcaucaggaaagcu

SEQ ID NO: 388396 - RNA, 64 nt, Human
gcaccuccgccagauccugcagaaguacuccuauugccgccagaagauccaagaggcccugcac

SEQ ID NO: 388397 - RNA, 64 nt, Human
acuucagagauuuguuuucauuaaaaaauaagccugccgccaaaauaaaucacuuaucaaaaug

SEQ ID NO: 388398 - RNA, 64 nt, Human
aaggacugccccccaugcaccauugcagggaggaugccgccaccaugagcuagguggaguaacu

SEQ ID NO: 388399 - RNA, 64 nt, Human
ucucagcucccagcgaagccuccacaacagaauggggccacagggcagccgggacucccugucu

SEQ ID NO: 388400 - RNA, 64 nt, Human
ggggccaggagcuaccccaggagugggccaggccgggccacagcaauaggaaagccagggccag

SEQ ID NO: 388401 - RNA, 64 nt, Human
agccccaacucagccccaaaagcugggcuuccuggggccacagggccuauggcagucagaccag

SEQ ID NO: 388402 - RNA, 64 nt, Human
ccaaguucuugugacugagggagauuuucuggaagggccacaggagguugcggagcuuggaugu

SEQ ID NO: 388403 - RNA, 64 nt, Human
cacacuccaaguaugggcagugauggcgcucugggggccacagugggcuaucuaggcccucccu

SEQ ID NO: 388404 - RNA, 64 nt, Human
ggcccccucgaggagcacccgcugcagggaugcagggccacaggccuccgcucucuccuaaggc

SEQ ID NO: 388405 - RNA, 64 nt, Human
cacaauugcugcagaacucuucucuccccaucaugggccacagugggucucuuaauuugauugu

SEQ ID NO: 388406 - RNA, 64 nt, Human
cugguaguuaccaaaucaggguuaagaaacaucagggccacauuucacuaccuucacagaucaa

SEQ ID NO: 388407 - RNA, 57 nt, Human
gaggcgucuacauucgcugagaggcaggggccacacggcgggaggaagggcucugag

SEQ ID NO: 388408 - RNA, 64 nt, Human
ucuuacuguuccaggguggccccagggcaggcaggggccacacuaugccugcgcccugguaaag

SEQ ID NO: 388409 - RNA, 64 nt, Human
uaggagagcuagugagucgagacuuagaagaauggggccacauagcagcagaggacugguguaa

SEQ ID NO: 388410 - RNA, 64 nt, Human
cuaaggaauuugaagauugccuccaucauuuguagggccacagaucuuaaagccuccaaccuug

SEQ ID NO: 388411 - RNA, 64 nt, Human
ugcagcuggugcaaaagcuguggcugccaggucugggccacauggcagcccagggggcaggaga

SEQ ID NO: 388412 - RNA, 64 nt, Human
gggugaggcucagagagcuaaggacacuuguuuggggccacacagccgggguagaucugagccc

SEQ ID NO: 388413 - RNA, 64 nt, Human
cccaggcuauggggacaaaggccuucaccagcaagggccacaguuggaacaguccccugggugu

SEQ ID NO: 388414 - RNA, 64 nt, Human
ugaugugagugccacuuccccacccgggaaaggcugccgccaccaccaccaccaacacaacagc

SEQ ID NO: 388415 - RNA, 64 nt, Human
ggagggagagcaacccuuugccgaugaccacgcuugccgccaucucuuaguuuucuuuuucaca

SEQ ID NO: 388416 - RNA, 64 nt, Human
uuuucuguguuuuguaagggaacuguuuccuucaugccgccauguuccugauauuaguucugau

SEQ ID NO: 388417 - RNA, 64 nt, Human
ccucucacugucugagaguuuaguuguagcagaggggccacagacagaagcuguggugguuuuu

SEQ ID NO: 388418 - RNA, 64 nt, Human
cuaugacgcccccggcccgugcucaacaccgccugggccacagcuaggcccucccaccggcucg

SEQ ID NO: 388419 - RNA, 64 nt, Human
gaagauagaaauaguugguuccuaagaaugugaugggccacaaggaaagagagaccccagucaa

SEQ ID NO: 388420 - RNA, 64 nt, Human
gggcccacccugccugcaccuccgcgggcugacugggccacagccccgaugauucuuaacacag

SEQ ID NO: 388421 - RNA, 64 nt, Human
ucagcgagauguugggucuggaggugaugagaucgggccacacuugagcugagucaccagaccc

SEQ ID NO: 388422 - RNA, 55 nt, Human
uggaccaggugcugcacugaccgcugggccacacggcugccccucagcccugcug

SEQ ID NO: 388423 - RNA, 64 nt, Human
ccagaggguccaggcaucccaaguccagcgugaagggccacagccccucuuggcugccaagcac

SEQ ID NO: 388424 - RNA, 64 nt, Human
agcgcaggggccagccagggacauagccagggaggggccacaucacuucccacuggaaaucucu

SEQ ID NO: 388425 - RNA, 64 nt, Human
gacuuucuacuagaggacuugaaagagaacugaggggccacaaaauaaacuucaccuuccauua

SEQ ID NO: 388426 - RNA, 64 nt, Human
acaaagccagggggcccagaggagcaauagcccugggccacaagcguggguaggccuuucacgu

SEQ ID NO: 388427 - RNA, 64 nt, Human
cagugcguccaccugcccuggcuagcaugcugcugggccacaccccaagaucaggggcccuggg

SEQ ID NO: 388428 - RNA, 64 nt, Human
cuggagcccgccggccugggcaggggguccaggugggccacacaggggccaggauggcggaaga

SEQ ID NO: 388429 - RNA, 64 nt, Human
agcucacuuucgccuucuccauccccugccgugggggccacagccacaccucaccgcccagucc

SEQ ID NO: 388430 - RNA, 64 nt, Human
ccggugguggccacggaccgccccccuccugccagggccacagaacccguguucaucucauccg

SEQ ID NO: 388431 - RNA, 64 nt, Human
acgcaggaaccgacacucagacacaaggcaaagagggccacaggacccgggaaauacacacaga

SEQ ID NO: 388432 - RNA, 55 nt, Human; identical to SEQ ID NO: 100982

SEQ ID NO: 388433 - RNA, 64 nt, Human
cacuccuccccugcccaagccuacugccucccgcugccgccaguacccccuccagccccacacc

SEQ ID NO: 388434 - RNA, 64 nt, Human
ggcgaaugccagaccaaugauacccagagcuaccugccgccaacuuguugagauguguguuuga

SEQ ID NO: 388435 - RNA, 64 nt, Human
ggguagcuugaggccaggagcucgaaaccaguccgggccacacagcaagaccccaucucuaaaa

SEQ ID NO: 388436 - RNA, 64 nt, Human
uccccuggugggcuccugggcggccugcgcagaugggccacagaagggcaggccggagcugcac

SEQ ID NO: 388437 - RNA, 64 nt, Human
agcugggcuggggcugcugcucuggggucuccgggggccacagcuuggggugaguugaagaccu

SEQ ID NO: 388438 - RNA, 64 nt, Human
ugaagcccugcaguaacccgcccagccucccgcggggccacacacuuccccucccaacacacac

SEQ ID NO: 388439 - RNA, 64 nt, Human
guccccagggccagcacauggaauaaaauagccagggccacacucagcccagcucuguccuguc

SEQ ID NO: 388440 - RNA, 64 nt, Human
uaucuggggcuaagggaagggacuucauuuccaggggccacagccaagcccagagucccccagc

SEQ ID NO: 388441 - RNA, 64 nt, Human
agaugcacaaccgcacacccauacacaacuacaagggccacaaagcaacugcuggguuagcuuu

SEQ ID NO: 388442 - RNA, 64 nt, Human
ugagggcugcaagcuggaggguggugcaggccuugggccacagggaggcgccuguggaauaggg

SEQ ID NO: 388443 - RNA, 64 nt, Human
ucauuacacagguguccaaccuuuugucuucccugggccacauuggaagaagaaaaauugucuu

SEQ ID NO: 388444 - RNA, 64 nt, Human
guaucucugagggagucccagacacaggcagagagggccacauaucgugugccagaggcugaga

SEQ ID NO: 388445 - RNA, 64 nt, Human
cccggcccaccggcccccuggcuugggaaggcgugggccacaugguccccucuggggcgucccc

SEQ ID NO: 388446 - RNA, 64 nt, Human
ccucccccaaugcuggggagcaucccugggccuggggccacaccugcugcccucccucugugug

SEQ ID NO: 388447 - RNA, 64 nt, Human
ggggugggggugggacagaccccagugggggccagggccacacucagcgcagugugggcuggac

SEQ ID NO: 388448 - RNA, 64 nt, Human
ccgcugcugagcgagacaccaguagccaggugaagggccacagcgggccaggccccgacccugu

SEQ ID NO: 388449 - RNA, 64 nt, Human
cccguuuugaacauguguaaccgacagucugccugggccacagcccucucacccugguacugca

SEQ ID NO: 388450 - RNA, 64 nt, Human
auaaaucccucugccgacgcagggagcagagacuugccggcauguuuuggggguaaugaucgug

SEQ ID NO: 388451 - RNA, 64 nt, Human
uggucccaaguguguaaugaggaaaguggccaggugccggcacagugccucucccagagccuca

SEQ ID NO: 388452 - RNA, 64 nt, Human
accuagaauguucugagccgucugagggccuucaugccggcagcagcuagcaaagccagaaagc

SEQ ID NO: 388453 - RNA, 64 nt, Human
cuccauggcaggacagagcgggaggccgggccuugggccacaggagaccagcucagggcggaag

SEQ ID NO: 388454 - RNA, 64 nt, Human
ggcaggggaggcuuggacgccgguggggaauggggggccacagcugcagaccuaagcccucccc

SEQ ID NO: 388455 - RNA, 64 nt, Human
ugcucaugcgugguuugggccucugcuaacagcugggccacaugcguguaucuagagccugggu

SEQ ID NO: 388456 - RNA, 64 nt, Human
ccagggagcagggcuuaggggcuagcagcccacggggccacacagagaaacaaccacgcagaca

SEQ ID NO: 388457 - RNA, 64 nt, Human
ccgagccucuggccggagaucggccgcccacggggggccacagcagcggccgcucgcccaggau

SEQ ID NO: 388458 - RNA, 64 nt, Human
ggccccagccuaccugcaccuccgugaggcaacugggccacagccccgaugauucguaacacca

SEQ ID NO: 388459 - RNA, 64 nt, Human
uggggggcggaggagggugaggggugccgcccaugggccacaaaucucuacaagugccugcuau

SEQ ID NO: 388460 - RNA, 64 nt, Human
cagcugccuaggaggaagggacccagcugggucugggccacaagggaggagacugcaccccacu

SEQ ID NO: 388461 - RNA, 64 nt, Human
gagcuucccuccuuucccaucuggggagugccgcgggccacagugggcagguggcaccgggggu

SEQ ID NO: 388462 - RNA, 64 nt, Human
uggguugaguuggacugugcgaacgaguuccauagggccacaucgggcuguuuugcauuuagug

SEQ ID NO: 388463 - RNA, 64 nt, Human
agugagccgagauggcgccacugcacuccagccugggccacagacccugucucaaaaaaaaaaa

SEQ ID NO: 388464 - RNA, 64 nt, Human
aggugagauuauggaauccagaaucuuuuuucaggggccacaugcccauuuccccacuugcaug

SEQ ID NO: 388465 - RNA, 57 nt, Human
agcaacccauggaaacauaaugguugggggccacaugagucuuccaguucacucuca

SEQ ID NO: 388466 - RNA, 64 nt, Human
ucugugccuuuaaugaggacuaagaagcaagauugggccacacugucuggacucaaagcccagc

SEQ ID NO: 388467 - RNA, 64 nt, Human
agcugucagaacugccacugagcuaaagaugguggggccacaugcugacccagccccacaucca

SEQ ID NO: 388468 - RNA, 64 nt, Human
caugccacugcacuccagccugggcgacggagugagacuccaucucaaaaaaaaaaaaaaaaua

SEQ ID NO: 388469 - RNA, 64 nt, Human
ugugucuccaacguugagacuuugcagauggcacagacuccauggauaauagguaaacuugggg

SEQ ID NO: 388470 - RNA, 64 nt, Human
ugugccacugcacuccagccugggugacacagcaagacuccaucucaaaaaaaaaaaaaaagcu

SEQ ID NO: 388471 - RNA, 64 nt, Human
ugugucuuguguuuugguggaugugacagggcuggggccacagucuacucugucucugcugcua

SEQ ID NO: 388472 - RNA, 64 nt, Human
cuagagugguuuccaucucacagagaaucagacagggccacagcccccucaggcagccagguca

SEQ ID NO: 388473 - RNA, 64 nt, Human
caagguauuuuucuuccaagcugaaauaaaacuggggccacauauuuucagucauuucuucccu

SEQ ID NO: 388474 - RNA, 64 nt, Human
uguagaugacuaggacaagaacaaugaccucucugggccacaguuuccuuauagacaugaugag

SEQ ID NO: 388475 - RNA, 64 nt, Human
aacucuaagggggacggagucaguaccccggacagggccacauuugcaugagacauggcugucu

SEQ ID NO: 388476 - RNA, 64 nt, Human
cccaggcuuggguuuuuucuauagguuuggcggggggccacagggaggggacccugacaauaaa

SEQ ID NO: 388477 - RNA, 64 nt, Human
aggguuugcugggcuggcuuugcuuucccugcuggggccacagcuguguuaaccaaugaggucu

SEQ ID NO: 388478 - RNA, 64 nt, Human
ugggaaggaugaagggcccgagaacauggccuaagggccacaucccacugccacccuugacgcc

SEQ ID NO: 388479 - RNA, 64 nt, Human
ccccagauucucugagcacuuucccccauccccagggccacagauccccuuccuuacuuguugg

SEQ ID NO: 388480 - RNA, 64 nt, Human
cauugcugggaggagcugagggggaacaggagcagggccacagcaccccugaggucuggccagg

SEQ ID NO: 388481 - RNA, 64 nt, Human
cuucacccgcugcagccguuccgucccaaacagagggccacacagauaccccacguucuauaua

SEQ ID NO: 388482 - RNA, 64 nt, Human
ucggucucugaggugacacucuggagugguugaagggccacaaggugcaggguuaauacucuug

SEQ ID NO: 388483 - RNA, 64 nt, Human
cugcccucugacaccauugcagcugccugcaccugggccacauggccuucagaaccuucucucu

SEQ ID NO: 388484 - RNA, 64 nt, Human
caaguccucaauccugugucccagaggucccucugggccacaacccaacccuucucacucuccu

SEQ ID NO: 388485 - RNA, 64 nt, Human
auuggcguauaacauuauuuucaaggaacuccaagggccacaggagcugacagguuuuucaauu

SEQ ID NO: 388486 - RNA, 64 nt, Human
guguggaauacuguggaugucugugcagagccuuugccggcacugaaggcaugcagccugucgg

SEQ ID NO: 388487 - RNA, 64 nt, Human
cucacuuagggccuggggcucaaggagcuguaggugccggcagaggggcagagcuaggcuggga

SEQ ID NO: 388488 - RNA, 64 nt, Human
acauaauuacuucuaccgaugugaaugauacggaugccggcagagcuuccagaucuuucagacu

SEQ ID NO: 388489 - RNA, 64 nt, Human
gaugagaaaacugagaggugaggugacuugccuggggccacauagcucauaagcuguagaacuc

SEQ ID NO: 388490 - RNA, 64 nt, Human
cuggggccgggcuggcuucucccuggacucuguggggccacacguuugccaaauuuuccuuccu

SEQ ID NO: 388491 - RNA, 64 nt, Human
gcgcccuccagggucgucccuggcccaaggccaggggccacaaguuaguuggaagccggcguuc

SEQ ID NO: 388492 - RNA, 64 nt, Human
ucccaccuuaggagggcuaggaggcagcaucguggggccacagaaggccuggguuugcagucag

SEQ ID NO: 388493 - RNA, 64 nt, Human
caccagaccggacuguucccgacccggagacgcggggccacagcccccagcugacccuaauuua

SEQ ID NO: 388494 - RNA, 64 nt, Human
ccuccucuaguuaaagucagucaccuccccagaagggccacacuccaggaggaguguugagagu

SEQ ID NO: 388495 - RNA, 64 nt, Human
cagccaugugggccaggugcauucacucagaguggggccacacacccaucuacccaguuuccac

SEQ ID NO: 388496 - RNA, 64 nt, Human
gccugggcacuugugcacccauguaggagcaugagggccacacucuuuucaccucaaagcccuu

SEQ ID NO: 388497 - RNA, 64 nt, Human
gauguuucaugcugugaggccuugcaccaggugggggccacagcaccagcagcaucuuugcugg

SEQ ID NO: 388498 - RNA, 64 nt, Human
ugucacaggacccaccuccaugccaggcaacagagggccacagaaccacccccacggcucacuc

SEQ ID NO: 388499 - RNA, 64 nt, Human
gggcacccugugccuugagacagcagccuaucuggggccacacagccaacccagcccugguccc

SEQ ID NO: 388500 - RNA, 64 nt, Human
uggcuucccugggccauguuggaagaauugucuugggccacacauaaaauacaguaaccauagc

SEQ ID NO: 388501 - RNA, 64 nt, Human
gccucucccucacuuugagacuuuggcaacuccugggccacacggccugccucuuugauuacua

SEQ ID NO: 388502 - RNA, 64 nt, Human
uggagacccaccucccaccccagugcacucuuuugggccacagacaucauugcuguuccccguu

SEQ ID NO: 388503 - RNA, 64 nt, Human
gagagagggguguacugucuguggcccccagcaugggccacauaccaacccaccauggagcaaa

SEQ ID NO: 388504 - RNA, 64 nt, Human
agaaguucucauggugcacgaguccucagcacucugccggcagugggggugggggcccaugccc

SEQ ID NO: 388505 - RNA, 64 nt, Human
aaguaaaaagccaagcuuucuccccacccucugugggccacacgugcacuugcacccaccacac

SEQ ID NO: 388506 - RNA, 64 nt, Human
uucugcucuuccaggcaggccagcaaguggcgcugggccacacuggcuucuuccugccccaucc

SEQ ID NO: 388507 - RNA, 64 nt, Human
gaaucgcuugagcccaggaauucgagaccagccugggccacaugacaaagccccaucucuacaa

SEQ ID NO: 388508 - RNA, 64 nt, Human
ugaguuauagcccuggagcagcucagggcucagggggccacaaggaggcaggucgggaggaaga

SEQ ID NO: 388509 - RNA, 64 nt, Human
gguggccccacccuccaggggagcuggugaagaugggccacagaccuggucuagggcugacaaa

SEQ ID NO: 388510 - RNA, 59 nt, Human
gcccccacagcuauggcugagguggggccgggccacaccccugcccaucccagccaggg

SEQ ID NO: 388511 - RNA, 64 nt, Human
ccugccccagccugcccuggcugcagcaagggcagggccacacucucgccgcugaugacaugca

SEQ ID NO: 388512 - RNA, 64 nt, Human
accaccaggcuggugcccugcagcugugccaguugggccacagccucccgagugcugacccaca

SEQ ID NO: 388513 - RNA, 64 nt, Human
gggauggagucccaaggcaagcgccccaaaccucgggccacaagacaccacuuccccuuuaccc

SEQ ID NO: 388514 - RNA, 64 nt, Human
caacagcaagacgaggauguggcuguugagaugugggccacacucacccuuguccaggaugcag

SEQ ID NO: 388515 - RNA, 64 nt, Human
cccccaugcaacaggcccaguggcuuccccuucagggccacaacaggcuguagaaggggaugac

SEQ ID NO: 388516 - RNA, 64 nt, Human
gggggaaacgggcuccuuccccugcaccuggccugggccacaccugagcgcuguggacuguccu

SEQ ID NO: 388517 - RNA, 64 nt, Human
aggucugaccccaguccccacucccuuucaggcugggccacagggaguugcuggcuggccacuu

SEQ ID NO: 388518 - RNA, 64 nt, Human
uuguuuccuccuuaaaucguuuagcauggcaugagggccacauuccauggacgggaagaccccu

SEQ ID NO: 388519 - RNA, 64 nt, Human
uucucgaugaggccucgauuugaaucaauggggugggccacaggaaaugucagaggaaccagaa

SEQ ID NO: 388520 - RNA, 64 nt, Human
gugucugcuacugcugggacucaggcccucgcccugccgccaucuaugccaguuacccuggaga

SEQ ID NO: 388521 - RNA, 64 nt, Human
ugagaguauggggaaaagaaucaagagaccugacugccgccaacucacuagugacuuagauaca

SEQ ID NO: 388522 - RNA, 64 nt, Human
gucauuaacuugaucccuuucuccagacuggccaugccgccauauaccuuuccuuuuguauucc

SEQ ID NO: 388523 - RNA, 64 nt, Human
cugggucugugaaaaacaguggacagcaccccgagggccacaggugagggacacuaccacugga

SEQ ID NO: 388524 - RNA, 64 nt, Human
aaugaugauugaugaagcagaugaguuuguagcagggccacaaaacaaagugaaacguccaggg

SEQ ID NO: 388525 - RNA, 64 nt, Human
gguugugggagggccugggccagugcacguuccagggccacauccaccacuuucccugcucugu

SEQ ID NO: 388526 - RNA, 64 nt, Human
gagcuauaauuauugcaccacugaacuccagccugggccacauagcaagacccugucuccaaaa

SEQ ID NO: 388527 - RNA, 64 nt, Human
aguaagccgagaucgugccacugcacuccagccugggccacagagcaagacuccgucucaaaac

SEQ ID NO: 388528 - RNA, 64 nt, Human
gagagugagcuggauguggccgggcugcagagccgggccacaccucagugccaaagaccccaug

SEQ ID NO: 388529 - RNA, 58 nt, Human
ugcucuguacaaagauauaaagucaugugggccacacaagugcaguagugcaguucac

SEQ ID NO: 388530 - RNA, 64 nt, Human
cauuccaccgccucccgccucagccccaccuguggggccacaucgccacuuccacgcccauggc

SEQ ID NO: 388531 - RNA, 64 nt, Human
ucuggguugugaggaaauaggggagagguauccugggccacaucccagccuaacaccugugagg

SEQ ID NO: 388532 - RNA, 64 nt, Human
ugugcagauuuuggccaugaaagcauggcuaauagggccacagucccuuuaaagaaacaugguu

SEQ ID NO: 388533 - RNA, 64 nt, Human
gugacuauucauggcuaccucagaaagauuugaugggccacaacugucuuagacugcuagcuuu

SEQ ID NO: 388534 - RNA, 64 nt, Human
cagcgggcagggaaaugggccaaugcaugcuucagggccacacccagcaguuucccuguccugu

SEQ ID NO: 388535 - RNA, 64 nt, Human
cugccucggccuccugaguagcugggauuacaguugccgccacacccggcuuauuuuuuuguau

SEQ ID NO: 388536 - RNA, 64 nt, Human
ccgaggaggcugcaugcacuuucacuguacccagugccgccaccaguucugcagcggcugcuac

SEQ ID NO: 388537 - RNA, 64 nt, Human; identical to SEQ ID NO: 388109

SEQ ID NO: 388538 - RNA, 64 nt, Human; identical to SEQ ID NO: 388113

SEQ ID NO: 388539 - RNA, 64 nt, Human; identical to SEQ ID NO: 388114

SEQ ID NO: 388540 - RNA, 64 nt, Human; identical to SEQ ID NO: 388115

SEQ ID NO: 388541 - RNA, 64 nt, Human; identical to SEQ ID NO: 388116

SEQ ID NO: 388542 - RNA, 64 nt, Human; identical to SEQ ID NO: 388117

SEQ ID NO: 388543 - RNA, 64 nt, Human; identical to SEQ ID NO: 388118

SEQ ID NO: 388544 - RNA, 64 nt, Human; identical to SEQ ID NO: 388119

SEQ ID NO: 388545 - RNA, 64 nt, Human; identical to SEQ ID NO: 388120

SEQ ID NO: 388546 - RNA, 64 nt, Human; identical to SEQ ID NO: 388121

SEQ ID NO: 388547 - RNA, 64 nt, Human; identical to SEQ ID NO: 388122

SEQ ID NO: 388548 - RNA, 64 nt, Human; identical to SEQ ID NO: 388123

SEQ ID NO: 388549 - RNA, 64 nt, Human; identical to SEQ ID NO: 388124

SEQ ID NO: 388550 - RNA, 64 nt, Human; identical to SEQ ID NO: 388125

SEQ ID NO: 388551 - RNA, 64 nt, Human
cucgcugaguccagccucguggucuucuccaagaugccgccagaugcccagccuacagccucuc

SEQ ID NO: 388552 - RNA, 64 nt, Human
caagguggaggccuugcagugccaggaggagggcugccgccauggggcagagccccaggcgucc

SEQ ID NO: 388553 - RNA, 64 nt, Human
gaaaacugcugccgccgcgccgaggagacucgcaugccgccaccaccucacugggagggcgccg

SEQ ID NO: 388554 - RNA, 64 nt, Human; identical to SEQ ID NO: 388126

SEQ ID NO: 388555 - RNA, 57 nt, Human; identical to SEQ ID NO: 388127

SEQ ID NO: 388556 - RNA, 64 nt, Human; identical to SEQ ID NO: 388131

SEQ ID NO: 388557 - RNA, 64 nt, Human; identical to SEQ ID NO: 388132

SEQ ID NO: 388558 - RNA, 64 nt, Human; identical to SEQ ID NO: 388133

SEQ ID NO: 388559 - RNA, 64 nt, Human; identical to SEQ ID NO: 388134

SEQ ID NO: 388560 - RNA, 64 nt, Human; identical to SEQ ID NO: 388135

SEQ ID NO: 388561 - RNA, 64 nt, Human; identical to SEQ ID NO: 388136

SEQ ID NO: 388562 - RNA, 64 nt, Human; identical to SEQ ID NO: 388137

SEQ ID NO: 388563 - RNA, 64 nt, Human; identical to SEQ ID NO: 388138

SEQ ID NO: 388564 - RNA, 64 nt, Human; identical to SEQ ID NO: 388139

SEQ ID NO: 388565 - RNA, 64 nt, Human; identical to SEQ ID NO: 388140

SEQ ID NO: 388566 - RNA, 64 nt, Human; identical to SEQ ID NO: 388141

SEQ ID NO: 388567 - RNA, 64 nt, Human; identical to SEQ ID NO: 388142

SEQ ID NO: 388568 - RNA, 64 nt, Human; identical to SEQ ID NO: 388143

SEQ ID NO: 388569 - RNA, 64 nt, Human
gguuuuacaagugacgguuuccccggcucccuccugccgccaugugaagaaggucguugcuucc

SEQ ID NO: 388570 - RNA, 64 nt, Human
ucggcaaccuccugggcuuccuagaggacagccuugccgccacacaguuccagcagagccaggc

SEQ ID NO: 388571 - RNA, 64 nt, Human
uaccccgagccgggguucccuccucccggcccgcugccgccacccaccucuccugcaggcugcg

SEQ ID NO: 388572 - RNA, 64 nt, Human; identical to SEQ ID NO: 388144

SEQ ID NO: 388573 - RNA, 64 nt, Human; identical to SEQ ID NO: 388145

SEQ ID NO: 388574 - RNA, 64 nt, Human; identical to SEQ ID NO: 388149

SEQ ID NO: 388575 - RNA, 64 nt, Human; identical to SEQ ID NO: 388150

SEQ ID NO: 388576 - RNA, 64 nt, Human; identical to SEQ ID NO: 388151

SEQ ID NO: 388577 - RNA, 64 nt, Human; identical to SEQ ID NO: 388152

SEQ ID NO: 388578 - RNA, 58 nt, Human; identical to SEQ ID NO: 388153

SEQ ID NO: 388579 - RNA, 64 nt, Human; identical to SEQ ID NO: 388154

SEQ ID NO: 388580 - RNA, 64 nt, Human; identical to SEQ ID NO: 388155

SEQ ID NO: 388581 - RNA, 64 nt, Human; identical to SEQ ID NO: 388156

SEQ ID NO: 388582 - RNA, 59 nt, Human; identical to SEQ ID NO: 388157

SEQ ID NO: 388583 - RNA, 64 nt, Human; identical to SEQ ID NO: 388158

SEQ ID NO: 388584 - RNA, 64 nt, Human; identical to SEQ ID NO: 388159

SEQ ID NO: 388585 - RNA, 64 nt, Human; identical to SEQ ID NO: 388160

SEQ ID NO: 388586 - RNA, 64 nt, Human; identical to SEQ ID NO: 388161

SEQ ID NO: 388587 - RNA, 64 nt, Human
uggccggguaauaggccugggucccacucacccaugccggcagcugucaccaugugauuuauuc

SEQ ID NO: 388588 - RNA, 64 nt, Human
auagacaagcaagcuggaagcuuccacgggugaaugccggcagcugugccaauaggaaaaagcu

SEQ ID NO: 388589 - RNA, 64 nt, Human
ggcacccagggagcaggggcgucagggauccugcugccggcaccccugugccgcuggcaugagg

SEQ ID NO: 388590 - RNA, 64 nt, Human; identical to SEQ ID NO: 388162

SEQ ID NO: 388591 - RNA, 64 nt, Human; identical to SEQ ID NO: 388163

SEQ ID NO: 388592 - RNA, 64 nt, Human; identical to SEQ ID NO: 388167

SEQ ID NO: 388593 - RNA, 64 nt, Human; identical to SEQ ID NO: 388168

SEQ ID NO: 388594 - RNA, 64 nt, Human; identical to SEQ ID NO: 388169

SEQ ID NO: 388595 - RNA, 64 nt, Human; identical to SEQ ID NO: 388170

SEQ ID NO: 388596 - RNA, 64 nt, Human; identical to SEQ ID NO: 388171

SEQ ID NO: 388597 - RNA, 64 nt, Human; identical to SEQ ID NO: 388172

SEQ ID NO: 388598 - RNA, 64 nt, Human; identical to SEQ ID NO: 388173

SEQ ID NO: 388599 - RNA, 64 nt, Human; identical to SEQ ID NO: 388174

SEQ ID NO: 388600 - RNA, 64 nt, Human; identical to SEQ ID NO: 388175

SEQ ID NO: 388601 - RNA, 64 nt, Human; identical to SEQ ID NO: 388176

SEQ ID NO: 388602 - RNA, 64 nt, Human; identical to SEQ ID NO: 388177

SEQ ID NO: 388603 - RNA, 64 nt, Human; identical to SEQ ID NO: 388178

SEQ ID NO: 388604 - RNA, 64 nt, Human; identical to SEQ ID NO: 388179

SEQ ID NO: 388605 - RNA, 64 nt, Human
cccagucugggcgcuucugggagggcucuugcggugccggcacuccuccuuguuagugucuuuc

SEQ ID NO: 388606 - RNA, 64 nt, Human
aaugccucuucuccuccaaaggaucacaacuccuugccggcaagggaacaaaacuggauagaga

SEQ ID NO: 388607 - RNA, 64 nt, Human
ccauagcauggcugcccuguggaugccuugucagugccgccagccugaccagaggggaggugga

SEQ ID NO: 388608 - RNA, 64 nt, Human; identical to SEQ ID NO: 388180

SEQ ID NO: 388609 - RNA, 64 nt, Human; identical to SEQ ID NO: 388181

SEQ ID NO: 388610 - RNA, 64 nt, Human; identical to SEQ ID NO: 388184

SEQ ID NO: 388611 - RNA, 64 nt, Human; identical to SEQ ID NO: 388185

SEQ ID NO: 388612 - RNA, 64 nt, Human; identical to SEQ ID NO: 388186

SEQ ID NO: 388613 - RNA, 64 nt, Human; identical to SEQ ID NO: 388187

SEQ ID NO: 388614 - RNA, 64 nt, Human; identical to SEQ ID NO: 388188

SEQ ID NO: 388615 - RNA, 64 nt, Human; identical to SEQ ID NO: 388189

SEQ ID NO: 388616 - RNA, 64 nt, Human; identical to SEQ ID NO: 388190

SEQ ID NO: 388617 - RNA, 64 nt, Human; identical to SEQ ID NO: 388191

SEQ ID NO: 388618 - RNA, 64 nt, Human; identical to SEQ ID NO: 388192

SEQ ID NO: 388619 - RNA, 64 nt, Human; identical to SEQ ID NO: 388193

SEQ ID NO: 388620 - RNA, 64 nt, Human; identical to SEQ ID NO: 388194

SEQ ID NO: 388621 - RNA, 64 nt, Human; identical to SEQ ID NO: 388195

SEQ ID NO: 388622 - RNA, 64 nt, Human; identical to SEQ ID NO: 388196

SEQ ID NO: 388623 - RNA, 64 nt, Human
gugcugugaaacuggcacccaccuggcgugcugcugccgccacuugcuuccugcagcaccuccu

SEQ ID NO: 388624 - RNA, 64 nt, Human
agggggucgagggggaggaggccaccugaccaaaugccgccaaccccgagggccaguuucuugu

SEQ ID NO: 388625 - RNA, 64 nt, Human
cagaaaacagacaugacagaacuguuccugccguugccgccacugcugccauugcugugguuau

SEQ ID NO: 388626 - RNA, 64 nt, Human; identical to SEQ ID NO: 388197

SEQ ID NO: 388627 - RNA, 64 nt, Human; identical to SEQ ID NO: 388198

SEQ ID NO: 388628 - RNA, 64 nt, Human; identical to SEQ ID NO: 388202

SEQ ID NO: 388629 - RNA, 64 nt, Human; identical to SEQ ID NO: 388203

SEQ ID NO: 388630 - RNA, 64 nt, Human; identical to SEQ ID NO: 388204

SEQ ID NO: 388631 - RNA, 64 nt, Human; identical to SEQ ID NO: 388205

SEQ ID NO: 388632 - RNA, 64 nt, Human; identical to SEQ ID NO: 388206

SEQ ID NO: 388633 - RNA, 64 nt, Human; identical to SEQ ID NO: 388207

SEQ ID NO: 388634 - RNA, 64 nt, Human; identical to SEQ ID NO: 388208

SEQ ID NO: 388635 - RNA, 64 nt, Human; identical to SEQ ID NO: 388209

SEQ ID NO: 388636 - RNA, 64 nt, Human; identical to SEQ ID NO: 388210

SEQ ID NO: 388637 - RNA, 64 nt, Human; identical to SEQ ID NO: 388211

SEQ ID NO: 388638 - RNA, 64 nt, Human; identical to SEQ ID NO: 388212

SEQ ID NO: 388639 - RNA, 64 nt, Human; identical to SEQ ID NO: 388213

SEQ ID NO: 388640 - RNA, 64 nt, Human; identical to SEQ ID NO: 388214

SEQ ID NO: 388641 - RNA, 64 nt, Human
cugccgggguccagcucagaaccacgggggucugugccggcagcaccggugccaucuuggcuuc

SEQ ID NO: 388642 - RNA, 64 nt, Human
uccugagccagggaacagccccaggguuggggggugccggcaucuccccuagcucaccaggccu

SEQ ID NO: 388643 - RNA, 64 nt, Human
ugcccuguaacuuaucuagaaagaaaagacccugagacuccagaaucugcuguugccauagccc

SEQ ID NO: 388644 - RNA, 64 nt, Human; identical to SEQ ID NO: 388215

SEQ ID NO: 388645 - RNA, 64 nt, Human; identical to SEQ ID NO: 388216

SEQ ID NO: 388646 - RNA, 64 nt, Human; identical to SEQ ID NO: 388220

SEQ ID NO: 388647 - RNA, 64 nt, Human; identical to SEQ ID NO: 388221

SEQ ID NO: 388648 - RNA, 64 nt, Human; identical to SEQ ID NO: 388222

SEQ ID NO: 388649 - RNA, 64 nt, Human; identical to SEQ ID NO: 388223

SEQ ID NO: 388650 - RNA, 64 nt, Human; identical to SEQ ID NO: 388224

SEQ ID NO: 388651 - RNA, 64 nt, Human; identical to SEQ ID NO: 388225

SEQ ID NO: 388652 - RNA, 64 nt, Human; identical to SEQ ID NO: 388226

SEQ ID NO: 388653 - RNA, 64 nt, Human; identical to SEQ ID NO: 388227

SEQ ID NO: 388654 - RNA, 59 nt, Human; identical to SEQ ID NO: 388228

SEQ ID NO: 388655 - RNA, 64 nt, Human; identical to SEQ ID NO: 388229

SEQ ID NO: 388656 - RNA, 64 nt, Human; identical to SEQ ID NO: 388230

SEQ ID NO: 388657 - RNA, 64 nt, Human; identical to SEQ ID NO: 388231

SEQ ID NO: 388658 - RNA, 64 nt, Human; identical to SEQ ID NO: 388232

SEQ ID NO: 388659 - RNA, 64 nt, Human; identical to SEQ ID NO: 164815

SEQ ID NO: 388660 - RNA, 64 nt, Human; identical to SEQ ID NO: 164816

SEQ ID NO: 388661 - RNA, 64 nt, Human; identical to SEQ ID NO: 164817

SEQ ID NO: 388662 - RNA, 64 nt, Human; identical to SEQ ID NO: 388233

SEQ ID NO: 388663 - RNA, 64 nt, Human; identical to SEQ ID NO: 388234

SEQ ID NO: 388664 - RNA, 64 nt, Human; identical to SEQ ID NO: 388238

SEQ ID NO: 388665 - RNA, 64 nt, Human; identical to SEQ ID NO: 388239

SEQ ID NO: 388666 - RNA, 64 nt, Human; identical to SEQ ID NO: 388240

SEQ ID NO: 388667 - RNA, 64 nt, Human; identical to SEQ ID NO: 388241

SEQ ID NO: 388668 - RNA, 64 nt, Human; identical to SEQ ID NO: 388242

SEQ ID NO: 388669 - RNA, 64 nt, Human; identical to SEQ ID NO: 388243

SEQ ID NO: 388670 - RNA, 64 nt, Human; identical to SEQ ID NO: 388244

SEQ ID NO: 388671 - RNA, 64 nt, Human; identical to SEQ ID NO: 388245

SEQ ID NO: 388672 - RNA, 64 nt, Human; identical to SEQ ID NO: 388246

SEQ ID NO: 388673 - RNA, 64 nt, Human; identical to SEQ ID NO: 388247

SEQ ID NO: 388674 - RNA, 64 nt, Human; identical to SEQ ID NO: 388248

SEQ ID NO: 388675 - RNA, 64 nt, Human; identical to SEQ ID NO: 388249

SEQ ID NO: 388676 - RNA, 64 nt, Human; identical to SEQ ID NO: 388250

SEQ ID NO: 388677 - RNA, 64 nt, Human; identical to SEQ ID NO: 388251

SEQ ID NO: 388678 - RNA, 64 nt, Human; identical to SEQ ID NO: 388252

SEQ ID NO: 388679 - RNA, 64 nt, Human; identical to SEQ ID NO: 388256

SEQ ID NO: 388680 - RNA, 64 nt, Human; identical to SEQ ID NO: 388257

SEQ ID NO: 388681 - RNA, 64 nt, Human; identical to SEQ ID NO: 388258

SEQ ID NO: 388682 - RNA, 64 nt, Human; identical to SEQ ID NO: 388259

SEQ ID NO: 388683 - RNA, 64 nt, Human; identical to SEQ ID NO: 388260

SEQ ID NO: 388684 - RNA, 64 nt, Human; identical to SEQ ID NO: 388261

SEQ ID NO: 388685 - RNA, 64 nt, Human; identical to SEQ ID NO: 388262

SEQ ID NO: 388686 - RNA, 64 nt, Human; identical to SEQ ID NO: 388263

SEQ ID NO: 388687 - RNA, 64 nt, Human; identical to SEQ ID NO: 388264

SEQ ID NO: 388688 - RNA, 64 nt, Human; identical to SEQ ID NO: 388265

SEQ ID NO: 388689 - RNA, 64 nt, Human; identical to SEQ ID NO: 388266

SEQ ID NO: 388690 - RNA, 64 nt, Human; identical to SEQ ID NO: 388267

SEQ ID NO: 388691 - RNA, 64 nt, Human; identical to SEQ ID NO: 388268

SEQ ID NO: 388692 - RNA, 64 nt, Human; identical to SEQ ID NO: 388269

SEQ ID NO: 388693 - RNA, 64 nt, Human; identical to SEQ ID NO: 388270

SEQ ID NO: 388694 - RNA, 64 nt, Human; identical to SEQ ID NO: 388274

SEQ ID NO: 388695 - RNA, 64 nt, Human; identical to SEQ ID NO: 388275

SEQ ID NO: 388696 - RNA, 64 nt, Human; identical to SEQ ID NO: 388276

SEQ ID NO: 388697 - RNA, 64 nt, Human; identical to SEQ ID NO: 388277

SEQ ID NO: 388698 - RNA, 64 nt, Human; identical to SEQ ID NO: 388278

SEQ ID NO: 388699 - RNA, 64 nt, Human; identical to SEQ ID NO: 388279

SEQ ID NO: 388700 - RNA, 64 nt, Human; identical to SEQ ID NO: 388280

SEQ ID NO: 388701 - RNA, 64 nt, Human; identical to SEQ ID NO: 388281

SEQ ID NO: 388702 - RNA, 64 nt, Human; identical to SEQ ID NO: 388282

SEQ ID NO: 388703 - RNA, 64 nt, Human; identical to SEQ ID NO: 388283

SEQ ID NO: 388704 - RNA, 64 nt, Human; identical to SEQ ID NO: 388284

SEQ ID NO: 388705 - RNA, 64 nt, Human; identical to SEQ ID NO: 388285

SEQ ID NO: 388706 - RNA, 64 nt, Human; identical to SEQ ID NO: 388286

SEQ ID NO: 388707 - RNA, 63 nt, Human; identical to SEQ ID NO: 100955

SEQ ID NO: 388708 - RNA, 64 nt, Human
cuggggcggggagccuucaggagccccgugcgucugccgccacguugcagaaagagccagccaa

SEQ ID NO: 388709 - RNA, 64 nt, Human
ccucccccaaaacacaccuggagccagagccuucugccgccagcccugccccugaauuggaagc

SEQ ID NO: 388710 - RNA, 64 nt, Human; identical to SEQ ID NO: 388287

SEQ ID NO: 388711 - RNA, 64 nt, Human; identical to SEQ ID NO: 388288

SEQ ID NO: 388712 - RNA, 64 nt, Human; identical to SEQ ID NO: 388292

SEQ ID NO: 388713 - RNA, 64 nt, Human; identical to SEQ ID NO: 388293

SEQ ID NO: 388714 - RNA, 64 nt, Human; identical to SEQ ID NO: 388294

SEQ ID NO: 388715 - RNA, 64 nt, Human; identical to SEQ ID NO: 388295

SEQ ID NO: 388716 - RNA, 64 nt, Human; identical to SEQ ID NO: 388296

SEQ ID NO: 388717 - RNA, 64 nt, Human; identical to SEQ ID NO: 388297

SEQ ID NO: 388718 - RNA, 64 nt, Human; identical to SEQ ID NO: 388298

SEQ ID NO: 388719 - RNA, 64 nt, Human; identical to SEQ ID NO: 388299

SEQ ID NO: 388720 - RNA, 64 nt, Human; identical to SEQ ID NO: 388300

SEQ ID NO: 388721 - RNA, 64 nt, Human; identical to SEQ ID NO: 388301

SEQ ID NO: 388722 - RNA, 64 nt, Human; identical to SEQ ID NO: 388302

SEQ ID NO: 388723 - RNA, 64 nt, Human; identical to SEQ ID NO: 388303

SEQ ID NO: 388724 - RNA, 64 nt, Human; identical to SEQ ID NO: 388304

SEQ ID NO: 388725 - RNA, 64 nt, Human
auaaauauauauacauggauauauaaaguuucuuugccggcauguugccuuguuuccgcuuaaa

SEQ ID NO: 388726 - RNA, 64 nt, Human
gccugggggguggcuaacgagagaggccuuacagugccggcaugccuccucuuccacugucguc

SEQ ID NO: 388727 - RNA, 64 nt, Human
ggugcggagcuccguggaacuggagcuagagcggugccggcagcaagcaggccuccuggugacc

SEQ ID NO: 388728 - RNA, 64 nt, Human; identical to SEQ ID NO: 388305

SEQ ID NO: 388729 - RNA, 64 nt, Human; identical to SEQ ID NO: 388306

SEQ ID NO: 388730 - RNA, 64 nt, Human; identical to SEQ ID NO: 388310

SEQ ID NO: 388731 - RNA, 64 nt, Human; identical to SEQ ID NO: 388311

SEQ ID NO: 388732 - RNA, 64 nt, Human; identical to SEQ ID NO: 388312

SEQ ID NO: 388733 - RNA, 64 nt, Human; identical to SEQ ID NO: 388313

SEQ ID NO: 388734 - RNA, 64 nt, Human; identical to SEQ ID NO: 388314

SEQ ID NO: 388735 - RNA, 64 nt, Human; identical to SEQ ID NO: 388315

SEQ ID NO: 388736 - RNA, 64 nt, Human; identical to SEQ ID NO: 388316

SEQ ID NO: 388737 - RNA, 64 nt, Human; identical to SEQ ID NO: 388317

SEQ ID NO: 388738 - RNA, 64 nt, Human; identical to SEQ ID NO: 388318

SEQ ID NO: 388739 - RNA, 64 nt, Human; identical to SEQ ID NO: 388319

SEQ ID NO: 388740 - RNA, 64 nt, Human; identical to SEQ ID NO: 388320

SEQ ID NO: 388741 - RNA, 64 nt, Human; identical to SEQ ID NO: 388321

SEQ ID NO: 388742 - RNA, 64 nt, Human; identical to SEQ ID NO: 388322

SEQ ID NO: 388743 - RNA, 64 nt, Human
aauguucuacuacuugugacugagaaaaguuuaaugccggcaugguaaaaggaagcugucuccc

SEQ ID NO: 388744 - RNA, 64 nt, Human
ucaugccucgcucagucagugcacuaaccccagcugccggcagugcugguucuccaacagagug

SEQ ID NO: 388745 - RNA, 64 nt, Human
agcagaaaagucccucgugcacaggcagcucuugugccggcacuacuugaaaacauggcuacuu

SEQ ID NO: 388746 - RNA, 64 nt, Human; identical to SEQ ID NO: 388323

SEQ ID NO: 388747 - RNA, 64 nt, Human; identical to SEQ ID NO: 388324

SEQ ID NO: 388748 - RNA, 64 nt, Human; identical to SEQ ID NO: 388328

SEQ ID NO: 388749 - RNA, 64 nt, Human; identical to SEQ ID NO: 388329

SEQ ID NO: 388750 - RNA, 64 nt, Human; identical to SEQ ID NO: 388330

SEQ ID NO: 388751 - RNA, 64 nt, Human; identical to SEQ ID NO: 388331

SEQ ID NO: 388752 - RNA, 64 nt, Human; identical to SEQ ID NO: 388332

SEQ ID NO: 388753 - RNA, 64 nt, Human; identical to SEQ ID NO: 388333

SEQ ID NO: 388754 - RNA, 64 nt, Human; identical to SEQ ID NO: 388334

SEQ ID NO: 388755 - RNA, 64 nt, Human; identical to SEQ ID NO: 388335

SEQ ID NO: 388756 - RNA, 64 nt, Human; identical to SEQ ID NO: 388336

SEQ ID NO: 388757 - RNA, 64 nt, Human; identical to SEQ ID NO: 388337

SEQ ID NO: 388758 - RNA, 64 nt, Human; identical to SEQ ID NO: 388338

SEQ ID NO: 388759 - RNA, 64 nt, Human; identical to SEQ ID NO: 388339

SEQ ID NO: 388760 - RNA, 64 nt, Human; identical to SEQ ID NO: 388340

SEQ ID NO: 388761 - RNA, 64 nt, Human; identical to SEQ ID NO: 164794

SEQ ID NO: 388762 - RNA, 64 nt, Human; identical to SEQ ID NO: 164795

SEQ ID NO: 388763 - RNA, 64 nt, Human; identical to SEQ ID NO: 388341

SEQ ID NO: 388764 - RNA, 64 nt, Human; identical to SEQ ID NO: 388342

SEQ ID NO: 388765 - RNA, 64 nt, Human; identical to SEQ ID NO: 388345

SEQ ID NO: 388766 - RNA, 64 nt, Human; identical to SEQ ID NO: 388346

SEQ ID NO: 388767 - RNA, 64 nt, Human; identical to SEQ ID NO: 388347

SEQ ID NO: 388768 - RNA, 64 nt, Human; identical to SEQ ID NO: 388348

SEQ ID NO: 388769 - RNA, 64 nt, Human; identical to SEQ ID NO: 388349

SEQ ID NO: 388770 - RNA, 64 nt, Human; identical to SEQ ID NO: 388350

SEQ ID NO: 388771 - RNA, 64 nt, Human; identical to SEQ ID NO: 388351

SEQ ID NO: 388772 - RNA, 64 nt, Human; identical to SEQ ID NO: 388352

SEQ ID NO: 388773 - RNA, 64 nt, Human; identical to SEQ ID NO: 388353

SEQ ID NO: 388774 - RNA, 64 nt, Human; identical to SEQ ID NO: 388354

SEQ ID NO: 388775 - RNA, 64 nt, Human; identical to SEQ ID NO: 388355

SEQ ID NO: 388776 - RNA, 64 nt, Human; identical to SEQ ID NO: 388356

SEQ ID NO: 388777 - RNA, 64 nt, Human; identical to SEQ ID NO: 388357

SEQ ID NO: 388778 - RNA, 64 nt, Human; identical to SEQ ID NO: 164784

SEQ ID NO: 388779 - RNA, 64 nt, Human; identical to SEQ ID NO: 164785

SEQ ID NO: 388780 - RNA, 64 nt, Human
cuccuuuaaggcacagguuuucuccugcccugcuugccggcaugaucuuggccagaauuacauc

SEQ ID NO: 388781 - RNA, 64 nt, Human; identical to SEQ ID NO: 388358

SEQ ID NO: 388782 - RNA, 64 nt, Human; identical to SEQ ID NO: 388359

SEQ ID NO: 388783 - RNA, 64 nt, Human; identical to SEQ ID NO: 388363

SEQ ID NO: 388784 - RNA, 64 nt, Human; identical to SEQ ID NO: 388364

SEQ ID NO: 388785 - RNA, 64 nt, Human; identical to SEQ ID NO: 388365

SEQ ID NO: 388786 - RNA, 64 nt, Human; identical to SEQ ID NO: 388366

SEQ ID NO: 388787 - RNA, 64 nt, Human; identical to SEQ ID NO: 388367

SEQ ID NO: 388788 - RNA, 64 nt, Human; identical to SEQ ID NO: 388368

SEQ ID NO: 388789 - RNA, 64 nt, Human; identical to SEQ ID NO: 388369

SEQ ID NO: 388790 - RNA, 64 nt, Human; identical to SEQ ID NO: 388370

SEQ ID NO: 388791 - RNA, 64 nt, Human; identical to SEQ ID NO: 388371

SEQ ID NO: 388792 - RNA, 64 nt, Human; identical to SEQ ID NO: 388372

SEQ ID NO: 388793 - RNA, 64 nt, Human; identical to SEQ ID NO: 388373

SEQ ID NO: 388794 - RNA, 64 nt, Human; identical to SEQ ID NO: 388374

SEQ ID NO: 388795 - RNA, 64 nt, Human; identical to SEQ ID NO: 388375

SEQ ID NO: 388796 - RNA, 64 nt, Human
ggcuccuucaccacccccacgauugguaugaugcugccggcacagcugggauacacacggcucc

SEQ ID NO: 388797 - RNA, 64 nt, Human
uguguaaaucagaugccagcuguacugccggcucugccggcacccacagcaacgguacgagcuu

SEQ ID NO: 388798 - RNA, 64 nt, Human
gacucagagaacuagaguuuaagcugaggcagagugccgccacccuggcaugccccacaaacag

SEQ ID NO: 388799 - RNA, 63 nt, Human; identical to SEQ ID NO: 388376

SEQ ID NO: 388800 - RNA, 64 nt, Human; identical to SEQ ID NO: 388377

SEQ ID NO: 388801 - RNA, 64 nt, Human; identical to SEQ ID NO: 388381

SEQ ID NO: 388802 - RNA, 64 nt, Human; identical to SEQ ID NO: 388382

SEQ ID NO: 388803 - RNA, 64 nt, Human; identical to SEQ ID NO: 388383

SEQ ID NO: 388804 - RNA, 64 nt, Human; identical to SEQ ID NO: 388384

SEQ ID NO: 388805 - RNA, 64 nt, Human; identical to SEQ ID NO: 388385

SEQ ID NO: 388806 - RNA, 64 nt, Human; identical to SEQ ID NO: 388386

SEQ ID NO: 388807 - RNA, 64 nt, Human; identical to SEQ ID NO: 388387

SEQ ID NO: 388808 - RNA, 64 nt, Human; identical to SEQ ID NO: 388388

SEQ ID NO: 388809 - RNA, 64 nt, Human; identical to SEQ ID NO: 388389

SEQ ID NO: 388810 - RNA, 64 nt, Human; identical to SEQ ID NO: 388390

SEQ ID NO: 388811 - RNA, 64 nt, Human; identical to SEQ ID NO: 388391

SEQ ID NO: 388812 - RNA, 64 nt, Human; identical to SEQ ID NO: 388392

SEQ ID NO: 388813 - RNA, 64 nt, Human; identical to SEQ ID NO: 388393

SEQ ID NO: 388814 - RNA, 64 nt, Human
gcaccuauaccccaaagcccucaccagaaggaggugccggcaccuguacagcuuguaagaacca

SEQ ID NO: 388815 - RNA, 64 nt, Human
cugaacagugacugguggcucacuucugcccaccugccggcaacaccagugccaggaaaaggcc

SEQ ID NO: 388816 - RNA, 64 nt, Human
aaacuuuggcgcuguuaaaauggaauuucucaucugccggcauuauuaagggugggcuagguug

SEQ ID NO: 388817 - RNA, 64 nt, Human; identical to SEQ ID NO: 388394

SEQ ID NO: 388818 - RNA, 64 nt, Human; identical to SEQ ID NO: 388395

SEQ ID NO: 388819 - RNA, 64 nt, Human; identical to SEQ ID NO: 388399

SEQ ID NO: 388820 - RNA, 64 nt, Human; identical to SEQ ID NO: 388400

SEQ ID NO: 388821 - RNA, 64 nt, Human; identical to SEQ ID NO: 388401

SEQ ID NO: 388822 - RNA, 64 nt, Human; identical to SEQ ID NO: 388402

SEQ ID NO: 388823 - RNA, 64 nt, Human; identical to SEQ ID NO: 388403

SEQ ID NO: 388824 - RNA, 64 nt, Human; identical to SEQ ID NO: 388404

SEQ ID NO: 388825 - RNA, 64 nt, Human; identical to SEQ ID NO: 388405

SEQ ID NO: 388826 - RNA, 64 nt, Human; identical to SEQ ID NO: 388406

SEQ ID NO: 388827 - RNA, 57 nt, Human; identical to SEQ ID NO: 388407

SEQ ID NO: 388828 - RNA, 64 nt, Human; identical to SEQ ID NO: 388408

SEQ ID NO: 388829 - RNA, 64 nt, Human; identical to SEQ ID NO: 388409

SEQ ID NO: 388830 - RNA, 64 nt, Human; identical to SEQ ID NO: 388410

SEQ ID NO: 388831 - RNA, 64 nt, Human; identical to SEQ ID NO: 388411

SEQ ID NO: 388832 - RNA, 64 nt, Human; identical to SEQ ID NO: 164812

SEQ ID NO: 388833 - RNA, 64 nt, Human; identical to SEQ ID NO: 164813

SEQ ID NO: 388834 - RNA, 64 nt, Human
acaaggacaugggcccacacaucugcuuuggcuuugccggcaauucagggcuugggguauucca

SEQ ID NO: 388835 - RNA, 64 nt, Human; identical to SEQ ID NO: 388412

SEQ ID NO: 388836 - RNA, 64 nt, Human; identical to SEQ ID NO: 388413

SEQ ID NO: 388837 - RNA, 64 nt, Human; identical to SEQ ID NO: 388417

SEQ ID NO: 388838 - RNA, 64 nt, Human; identical to SEQ ID NO: 388418

SEQ ID NO: 388839 - RNA, 64 nt, Human; identical to SEQ ID NO: 388419

SEQ ID NO: 388840 - RNA, 64 nt, Human; identical to SEQ ID NO: 388420

SEQ ID NO: 388841 - RNA, 64 nt, Human; identical to SEQ ID NO: 388421

SEQ ID NO: 388842 - RNA, 55 nt, Human; identical to SEQ ID NO: 388422

SEQ ID NO: 388843 - RNA, 64 nt, Human; identical to SEQ ID NO: 388423

SEQ ID NO: 388844 - RNA, 64 nt, Human; identical to SEQ ID NO: 388424

SEQ ID NO: 388845 - RNA, 64 nt, Human; identical to SEQ ID NO: 388425

SEQ ID NO: 388846 - RNA, 64 nt, Human; identical to SEQ ID NO: 388426

SEQ ID NO: 388847 - RNA, 64 nt, Human; identical to SEQ ID NO: 388427

SEQ ID NO: 388848 - RNA, 64 nt, Human; identical to SEQ ID NO: 388428

SEQ ID NO: 388849 - RNA, 64 nt, Human; identical to SEQ ID NO: 388429

SEQ ID NO: 388850 - RNA, 64 nt, Human; identical to SEQ ID NO: 164767

SEQ ID NO: 388851 - RNA, 64 nt, Human; identical to SEQ ID NO: 164768

SEQ ID NO: 388852 - RNA, 64 nt, Human; identical to SEQ ID NO: 164769

SEQ ID NO: 388853 - RNA, 64 nt, Human; identical to SEQ ID NO: 388430

SEQ ID NO: 388854 - RNA, 64 nt, Human; identical to SEQ ID NO: 388431

SEQ ID NO: 388855 - RNA, 64 nt, Human; identical to SEQ ID NO: 388435

SEQ ID NO: 388856 - RNA, 64 nt, Human; identical to SEQ ID NO: 388436

SEQ ID NO: 388857 - RNA, 64 nt, Human; identical to SEQ ID NO: 388437

SEQ ID NO: 388858 - RNA, 64 nt, Human; identical to SEQ ID NO: 388438

SEQ ID NO: 388859 - RNA, 64 nt, Human; identical to SEQ ID NO: 388439

SEQ ID NO: 388860 - RNA, 64 nt, Human; identical to SEQ ID NO: 388440

SEQ ID NO: 388861 - RNA, 64 nt, Human; identical to SEQ ID NO: 388441

SEQ ID NO: 388862 - RNA, 64 nt, Human; identical to SEQ ID NO: 388442

SEQ ID NO: 388863 - RNA, 64 nt, Human; identical to SEQ ID NO: 388443

SEQ ID NO: 388864 - RNA, 64 nt, Human; identical to SEQ ID NO: 388444

SEQ ID NO: 388865 - RNA, 64 nt, Human; identical to SEQ ID NO: 388445

SEQ ID NO: 388866 - RNA, 64 nt, Human; identical to SEQ ID NO: 388446

SEQ ID NO: 388867 - RNA, 64 nt, Human; identical to SEQ ID NO: 388447

SEQ ID NO: 388868 - RNA, 64 nt, Human; identical to SEQ ID NO: 164764

SEQ ID NO: 388869 - RNA, 64 nt, Human; identical to SEQ ID NO: 388448

SEQ ID NO: 388870 - RNA, 64 nt, Human; identical to SEQ ID NO: 388449

SEQ ID NO: 388871 - RNA, 64 nt, Human; identical to SEQ ID NO: 388453

SEQ ID NO: 388872 - RNA, 64 nt, Human; identical to SEQ ID NO: 388454

SEQ ID NO: 388873 - RNA, 64 nt, Human; identical to SEQ ID NO: 388455

SEQ ID NO: 388874 - RNA, 64 nt, Human; identical to SEQ ID NO: 388456

SEQ ID NO: 388875 - RNA, 64 nt, Human; identical to SEQ ID NO: 388457

SEQ ID NO: 388876 - RNA, 64 nt, Human; identical to SEQ ID NO: 388458

SEQ ID NO: 388877 - RNA, 64 nt, Human; identical to SEQ ID NO: 388459

SEQ ID NO: 388878 - RNA, 64 nt, Human; identical to SEQ ID NO: 388460

SEQ ID NO: 388879 - RNA, 64 nt, Human; identical to SEQ ID NO: 388461

SEQ ID NO: 388880 - RNA, 64 nt, Human; identical to SEQ ID NO: 388462

SEQ ID NO: 388881 - RNA, 64 nt, Human; identical to SEQ ID NO: 388463

SEQ ID NO: 388882 - RNA, 64 nt, Human; identical to SEQ ID NO: 388464

SEQ ID NO: 388883 - RNA, 57 nt, Human; identical to SEQ ID NO: 388465

SEQ ID NO: 388884 - RNA, 55 nt, Human; identical to SEQ ID NO: 164770

SEQ ID NO: 388885 - RNA, 64 nt, Human; identical to SEQ ID NO: 164771

SEQ ID NO: 388886 - RNA, 64 nt, Human; identical to SEQ ID NO: 164773

SEQ ID NO: 388887 - RNA, 64 nt, Human; identical to SEQ ID NO: 388466

SEQ ID NO: 388888 - RNA, 64 nt, Human; identical to SEQ ID NO: 388467

SEQ ID NO: 388889 - RNA, 64 nt, Human; identical to SEQ ID NO: 388471

SEQ ID NO: 388890 - RNA, 64 nt, Human; identical to SEQ ID NO: 388472

SEQ ID NO: 388891 - RNA, 64 nt, Human; identical to SEQ ID NO: 388473

SEQ ID NO: 388892 - RNA, 64 nt, Human; identical to SEQ ID NO: 388474

SEQ ID NO: 388893 - RNA, 64 nt, Human; identical to SEQ ID NO: 388475

SEQ ID NO: 388894 - RNA, 64 nt, Human; identical to SEQ ID NO: 388476

SEQ ID NO: 388895 - RNA, 64 nt, Human; identical to SEQ ID NO: 388477

SEQ ID NO: 388896 - RNA, 64 nt, Human; identical to SEQ ID NO: 388478

SEQ ID NO: 388897 - RNA, 64 nt, Human; identical to SEQ ID NO: 388479

SEQ ID NO: 388898 - RNA, 64 nt, Human; identical to SEQ ID NO: 388480

SEQ ID NO: 388899 - RNA, 64 nt, Human; identical to SEQ ID NO: 388481

SEQ ID NO: 388900 - RNA, 64 nt, Human; identical to SEQ ID NO: 388482

SEQ ID NO: 388901 - RNA, 64 nt, Human; identical to SEQ ID NO: 388483

SEQ ID NO: 388902 - RNA, 64 nt, Human; identical to SEQ ID NO: 164806

SEQ ID NO: 388903 - RNA, 64 nt, Human; identical to SEQ ID NO: 164807

SEQ ID NO: 388904 - RNA, 64 nt, Human; identical to SEQ ID NO: 164818

SEQ ID NO: 388905 - RNA, 64 nt, Human; identical to SEQ ID NO: 388484

SEQ ID NO: 388906 - RNA, 64 nt, Human; identical to SEQ ID NO: 388485

SEQ ID NO: 388907 - RNA, 64 nt, Human; identical to SEQ ID NO: 388489

SEQ ID NO: 388908 - RNA, 64 nt, Human; identical to SEQ ID NO: 388490

SEQ ID NO: 388909 - RNA, 64 nt, Human; identical to SEQ ID NO: 388491

SEQ ID NO: 388910 - RNA, 64 nt, Human; identical to SEQ ID NO: 388492

SEQ ID NO: 388911 - RNA, 64 nt, Human; identical to SEQ ID NO: 388493

SEQ ID NO: 388912 - RNA, 64 nt, Human; identical to SEQ ID NO: 388494

SEQ ID NO: 388913 - RNA, 64 nt, Human; identical to SEQ ID NO: 388495

SEQ ID NO: 388914 - RNA, 64 nt, Human; identical to SEQ ID NO: 388496

SEQ ID NO: 388915 - RNA, 64 nt, Human; identical to SEQ ID NO: 388497

SEQ ID NO: 388916 - RNA, 64 nt, Human; identical to SEQ ID NO: 388498

SEQ ID NO: 388917 - RNA, 64 nt, Human; identical to SEQ ID NO: 388499

SEQ ID NO: 388918 - RNA, 64 nt, Human; identical to SEQ ID NO: 388500

SEQ ID NO: 388919 - RNA, 64 nt, Human; identical to SEQ ID NO: 388501

SEQ ID NO: 388920 - RNA, 64 nt, Human; identical to SEQ ID NO: 164777

SEQ ID NO: 388921 - RNA, 64 nt, Human; identical to SEQ ID NO: 164778

SEQ ID NO: 388922 - RNA, 64 nt, Human; identical to SEQ ID NO: 164779

SEQ ID NO: 388923 - RNA, 64 nt, Human; identical to SEQ ID NO: 388502

SEQ ID NO: 388924 - RNA, 64 nt, Human; identical to SEQ ID NO: 388503

SEQ ID NO: 388925 - RNA, 64 nt, Human; identical to SEQ ID NO: 388505

SEQ ID NO: 388926 - RNA, 64 nt, Human; identical to SEQ ID NO: 388506

SEQ ID NO: 388927 - RNA, 64 nt, Human; identical to SEQ ID NO: 388507

SEQ ID NO: 388928 - RNA, 64 nt, Human; identical to SEQ ID NO: 388508

SEQ ID NO: 388929 - RNA, 64 nt, Human; identical to SEQ ID NO: 388509

SEQ ID NO: 388930 - RNA, 59 nt, Human; identical to SEQ ID NO: 388510

SEQ ID NO: 388931 - RNA, 64 nt, Human; identical to SEQ ID NO: 388511

SEQ ID NO: 388932 - RNA, 64 nt, Human; identical to SEQ ID NO: 388512

SEQ ID NO: 388933 - RNA, 64 nt, Human; identical to SEQ ID NO: 388513

SEQ ID NO: 388934 - RNA, 64 nt, Human; identical to SEQ ID NO: 388514

SEQ ID NO: 388935 - RNA, 64 nt, Human; identical to SEQ ID NO: 388515

SEQ ID NO: 388936 - RNA, 64 nt, Human; identical to SEQ ID NO: 388516

SEQ ID NO: 388937 - RNA, 64 nt, Human; identical to SEQ ID NO: 388517

SEQ ID NO: 388938 - RNA, 64 nt, Human; identical to SEQ ID NO: 164774

SEQ ID NO: 388939 - RNA, 64 nt, Human; identical to SEQ ID NO: 164775

SEQ ID NO: 388940 - RNA, 64 nt, Human; identical to SEQ ID NO: 164783

SEQ ID NO: 388941 - RNA, 64 nt, Human; identical to SEQ ID NO: 388518

SEQ ID NO: 388942 - RNA, 64 nt, Human; identical to SEQ ID NO: 388519

SEQ ID NO: 388943 - RNA, 64 nt, Human; identical to SEQ ID NO: 388523

SEQ ID NO: 388944 - RNA, 64 nt, Human; identical to SEQ ID NO: 388524

SEQ ID NO: 388945 - RNA, 64 nt, Human; identical to SEQ ID NO: 388525

SEQ ID NO: 388946 - RNA, 64 nt, Human; identical to SEQ ID NO: 388526

SEQ ID NO: 388947 - RNA, 64 nt, Human; identical to SEQ ID NO: 388527

SEQ ID NO: 388948 - RNA, 64 nt, Human; identical to SEQ ID NO: 388528

SEQ ID NO: 388949 - RNA, 58 nt, Human; identical to SEQ ID NO: 388529

SEQ ID NO: 388950 - RNA, 64 nt, Human; identical to SEQ ID NO: 388530

SEQ ID NO: 388951 - RNA, 64 nt, Human; identical to SEQ ID NO: 388531

SEQ ID NO: 388952 - RNA, 64 nt, Human; identical to SEQ ID NO: 388532

SEQ ID NO: 388953 - RNA, 64 nt, Human; identical to SEQ ID NO: 388533

SEQ ID NO: 388954 - RNA, 64 nt, Human; identical to SEQ ID NO: 388534

SEQ ID NO: 388955 - RNA, 64 nt, Human; identical to SEQ ID NO: 164787

SEQ ID NO: 388956 - RNA, 64 nt, Human; identical to SEQ ID NO: 164788

SEQ ID NO: 388957 - RNA, 64 nt, Human; identical to SEQ ID NO: 164789

SEQ ID NO: 388958 - RNA, 64 nt, Human; identical to SEQ ID NO: 388109

SEQ ID NO: 388959 - RNA, 64 nt, Human; identical to SEQ ID NO: 388113

SEQ ID NO: 388960 - RNA, 64 nt, Human; identical to SEQ ID NO: 388114

SEQ ID NO: 388961 - RNA, 64 nt, Human; identical to SEQ ID NO: 388115

SEQ ID NO: 388962 - RNA, 64 nt, Human; identical to SEQ ID NO: 388116

SEQ ID NO: 388963 - RNA, 64 nt, Human; identical to SEQ ID NO: 388117

SEQ ID NO: 388964 - RNA, 64 nt, Human; identical to SEQ ID NO: 388118

SEQ ID NO: 388965 - RNA, 64 nt, Human; identical to SEQ ID NO: 388119

SEQ ID NO: 388966 - RNA, 64 nt, Human; identical to SEQ ID NO: 388120

SEQ ID NO: 388967 - RNA, 64 nt, Human; identical to SEQ ID NO: 388121

SEQ ID NO: 388968 - RNA, 64 nt, Human; identical to SEQ ID NO: 388122

SEQ ID NO: 388969 - RNA, 64 nt, Human
uccagaccauuagacauuauuacaugcucugucuugggccuaucauuaacauuagcuuagggau

SEQ ID NO: 388970 - RNA, 64 nt, Human; identical to SEQ ID NO: 387834

SEQ ID NO: 388971 - RNA, 64 nt, Human; identical to SEQ ID NO: 164818

SEQ ID NO: 388972 - RNA, 64 nt, Human; identical to SEQ ID NO: 164819

SEQ ID NO: 388973 - RNA, 64 nt, Human; identical to SEQ ID NO: 388123

SEQ ID NO: 388974 - RNA, 64 nt, Human; identical to SEQ ID NO: 388124

SEQ ID NO: 388975 - RNA, 64 nt, Human; identical to SEQ ID NO: 388125

SEQ ID NO: 388976 - RNA, 64 nt, Human; identical to SEQ ID NO: 388126

SEQ ID NO: 388977 - RNA, 57 nt, Human; identical to SEQ ID NO: 388127

SEQ ID NO: 388978 - RNA, 64 nt, Human; identical to SEQ ID NO: 388131

SEQ ID NO: 388979 - RNA, 64 nt, Human; identical to SEQ ID NO: 388132

SEQ ID NO: 388980 - RNA, 64 nt, Human; identical to SEQ ID NO: 388133

SEQ ID NO: 388981 - RNA, 64 nt, Human; identical to SEQ ID NO: 388134

SEQ ID NO: 388982 - RNA, 64 nt, Human; identical to SEQ ID NO: 388135

SEQ ID NO: 388983 - RNA, 64 nt, Human; identical to SEQ ID NO: 388136

SEQ ID NO: 388984 - RNA, 64 nt, Human; identical to SEQ ID NO: 388137

SEQ ID NO: 388985 - RNA, 64 nt, Human; identical to SEQ ID NO: 388138

SEQ ID NO: 388986 - RNA, 64 nt, Human; identical to SEQ ID NO: 388139

SEQ ID NO: 388987 - RNA, 64 nt, Human; identical to SEQ ID NO: 388140

SEQ ID NO: 388988 - RNA, 64 nt, Human
uacauuccaggagaccacugucuccucgcuggccugggccuagauggggcagccuggcucacag

SEQ ID NO: 388989 - RNA, 64 nt, Human
ccaggaacgcugcagggaaaacccagcugaggccugggccuagacuguggugaggucacuagau

SEQ ID NO: 388990 - RNA, 64 nt, Human
aggcgcaugugccaguuggggccccgcggguagaugccggcaggccuuccggaagaaaaagagc

SEQ ID NO: 388991 - RNA, 64 nt, Human; identical to SEQ ID NO: 388141

SEQ ID NO: 388992 - RNA, 64 nt, Human; identical to SEQ ID NO: 388142

SEQ ID NO: 388993 - RNA, 64 nt, Human; identical to SEQ ID NO: 388143

SEQ ID NO: 388994 - RNA, 64 nt, Human; identical to SEQ ID NO: 388144

SEQ ID NO: 388995 - RNA, 64 nt, Human; identical to SEQ ID NO: 388145

SEQ ID NO: 388996 - RNA, 64 nt, Human; identical to SEQ ID NO: 388149

SEQ ID NO: 388997 - RNA, 64 nt, Human; identical to SEQ ID NO: 388150

SEQ ID NO: 388998 - RNA, 64 nt, Human; identical to SEQ ID NO: 388151

SEQ ID NO: 388999 - RNA, 64 nt, Human; identical to SEQ ID NO: 388152

SEQ ID NO: 389000 - RNA, 58 nt, Human; identical to SEQ ID NO: 388153

SEQ ID NO: 389001 - RNA, 64 nt, Human; identical to SEQ ID NO: 388154

SEQ ID NO: 389002 - RNA, 64 nt, Human; identical to SEQ ID NO: 388155

SEQ ID NO: 389003 - RNA, 64 nt, Human; identical to SEQ ID NO: 388156

SEQ ID NO: 389004 - RNA, 59 nt, Human; identical to SEQ ID NO: 388157

SEQ ID NO: 389005 - RNA, 64 nt, Human; identical to SEQ ID NO: 388158

SEQ ID NO: 389006 - RNA, 64 nt, Human; identical to SEQ ID NO: 164790

SEQ ID NO: 389007 - RNA, 64 nt, Human; identical to SEQ ID NO: 164791

SEQ ID NO: 389008 - RNA, 64 nt, Human; identical to SEQ ID NO: 164793

SEQ ID NO: 389009 - RNA, 64 nt, Human; identical to SEQ ID NO: 388159

SEQ ID NO: 389010 - RNA, 64 nt, Human; identical to SEQ ID NO: 388160

SEQ ID NO: 389011 - RNA, 64 nt, Human; identical to SEQ ID NO: 388161

SEQ ID NO: 389012 - RNA, 64 nt, Human; identical to SEQ ID NO: 388162

SEQ ID NO: 389013 - RNA, 64 nt, Human; identical to SEQ ID NO: 388163

SEQ ID NO: 389014 - RNA, 64 nt, Human; identical to SEQ ID NO: 388167

SEQ ID NO: 389015 - RNA, 64 nt, Human; identical to SEQ ID NO: 388168

SEQ ID NO: 389016 - RNA, 64 nt, Human; identical to SEQ ID NO: 388169

SEQ ID NO: 389017 - RNA, 64 nt, Human; identical to SEQ ID NO: 388170

SEQ ID NO: 389018 - RNA, 64 nt, Human; identical to SEQ ID NO: 388171

SEQ ID NO: 389019 - RNA, 64 nt, Human; identical to SEQ ID NO: 388172

SEQ ID NO: 389020 - RNA, 64 nt, Human; identical to SEQ ID NO: 388173

SEQ ID NO: 389021 - RNA, 64 nt, Human; identical to SEQ ID NO: 388174

SEQ ID NO: 389022 - RNA, 64 nt, Human; identical to SEQ ID NO: 388175

SEQ ID NO: 389023 - RNA, 64 nt, Human; identical to SEQ ID NO: 388176

SEQ ID NO: 389024 - RNA, 57 nt, Human; identical to SEQ ID NO: 164802

SEQ ID NO: 389025 - RNA, 64 nt, Human; identical to SEQ ID NO: 164803

SEQ ID NO: 389026 - RNA, 64 nt, Human
acaugauaugcggcuaugccugccucaaagggacugccgccaugcggaacaccaaacgagguuc

SEQ ID NO: 389027 - RNA, 64 nt, Human; identical to SEQ ID NO: 388177

SEQ ID NO: 389028 - RNA, 64 nt, Human; identical to SEQ ID NO: 388178

SEQ ID NO: 389029 - RNA, 64 nt, Human; identical to SEQ ID NO: 388179

SEQ ID NO: 389030 - RNA, 64 nt, Human; identical to SEQ ID NO: 388180

SEQ ID NO: 389031 - RNA, 64 nt, Human; identical to SEQ ID NO: 388181

SEQ ID NO: 389032 - RNA, 64 nt, Human; identical to SEQ ID NO: 388184

SEQ ID NO: 389033 - RNA, 64 nt, Human; identical to SEQ ID NO: 388185

SEQ ID NO: 389034 - RNA, 64 nt, Human; identical to SEQ ID NO: 388186

SEQ ID NO: 389035 - RNA, 64 nt, Human; identical to SEQ ID NO: 388187

SEQ ID NO: 389036 - RNA, 64 nt, Human; identical to SEQ ID NO: 388188

SEQ ID NO: 389037 - RNA, 64 nt, Human; identical to SEQ ID NO: 388189

SEQ ID NO: 389038 - RNA, 64 nt, Human; identical to SEQ ID NO: 388190

SEQ ID NO: 389039 - RNA, 64 nt, Human; identical to SEQ ID NO: 388191

SEQ ID NO: 389040 - RNA, 64 nt, Human; identical to SEQ ID NO: 388192

SEQ ID NO: 389041 - RNA, 64 nt, Human; identical to SEQ ID NO: 388193

SEQ ID NO: 389042 - RNA, 64 nt, Human; identical to SEQ ID NO: 164780

SEQ ID NO: 389043 - RNA, 64 nt, Human; identical to SEQ ID NO: 164781

SEQ ID NO: 389044 - RNA, 64 nt, Human; identical to SEQ ID NO: 164797

SEQ ID NO: 389045 - RNA, 64 nt, Human; identical to SEQ ID NO: 388194

SEQ ID NO: 389046 - RNA, 64 nt, Human; identical to SEQ ID NO: 388195

SEQ ID NO: 389047 - RNA, 64 nt, Human; identical to SEQ ID NO: 388196

SEQ ID NO: 389048 - RNA, 64 nt, Human; identical to SEQ ID NO: 388197

SEQ ID NO: 389049 - RNA, 64 nt, Human; identical to SEQ ID NO: 388198

SEQ ID NO: 389050 - RNA, 64 nt, Human; identical to SEQ ID NO: 388202

SEQ ID NO: 389051 - RNA, 64 nt, Human; identical to SEQ ID NO: 388203

SEQ ID NO: 389052 - RNA, 64 nt, Human; identical to SEQ ID NO: 388204

SEQ ID NO: 389053 - RNA, 64 nt, Human; identical to SEQ ID NO: 388205

SEQ ID NO: 389054 - RNA, 64 nt, Human; identical to SEQ ID NO: 388206

SEQ ID NO: 389055 - RNA, 64 nt, Human; identical to SEQ ID NO: 388207

SEQ ID NO: 389056 - RNA, 64 nt, Human; identical to SEQ ID NO: 388208

SEQ ID NO: 389057 - RNA, 64 nt, Human; identical to SEQ ID NO: 388209

SEQ ID NO: 389058 - RNA, 64 nt, Human; identical to SEQ ID NO: 388210

SEQ ID NO: 389059 - RNA, 64 nt, Human; identical to SEQ ID NO: 388211

SEQ ID NO: 389060 - RNA, 63 nt, Human
ucugucaagaauaaaaguauguagacccagagugugggccuaauggguugucucugagcaaaa

SEQ ID NO: 389061 - RNA, 64 nt, Human
cccuucucuuucccaggagcccugccaggggcugugggccuacaaggcuuccaggggaugccau

SEQ ID NO: 389062 - RNA, 64 nt, Human
aaucaguucuuucagcuaccacccauccaaccuuugggccuaugugaaaagaaaggaacuaagc

SEQ ID NO: 389063 - RNA, 64 nt, Human; identical to SEQ ID NO: 388212

SEQ ID NO: 389064 - RNA, 64 nt, Human; identical to SEQ ID NO: 388213

SEQ ID NO: 389065 - RNA, 64 nt, Human; identical to SEQ ID NO: 388214

SEQ ID NO: 389066 - RNA, 64 nt, Human; identical to SEQ ID NO: 388215

SEQ ID NO: 389067 - RNA, 64 nt, Human; identical to SEQ ID NO: 388216

SEQ ID NO: 389068 - RNA, 64 nt, Human; identical to SEQ ID NO: 388220

SEQ ID NO: 389069 - RNA, 64 nt, Human; identical to SEQ ID NO: 388221

SEQ ID NO: 389070 - RNA, 64 nt, Human; identical to SEQ ID NO: 388222

SEQ ID NO: 389071 - RNA, 64 nt, Human; identical to SEQ ID NO: 388223

SEQ ID NO: 389072 - RNA, 64 nt, Human; identical to SEQ ID NO: 388224

SEQ ID NO: 389073 - RNA, 64 nt, Human; identical to SEQ ID NO: 388225

SEQ ID NO: 389074 - RNA, 64 nt, Human; identical to SEQ ID NO: 388226

SEQ ID NO: 389075 - RNA, 64 nt, Human; identical to SEQ ID NO: 388227

SEQ ID NO: 389076 - RNA, 59 nt, Human; identical to SEQ ID NO: 388228

SEQ ID NO: 389077 - RNA, 64 nt, Human; identical to SEQ ID NO: 388229

SEQ ID NO: 389078 - RNA, 64 nt, Human
uuuuuguaggucaucugcaaguucauggaagagcugggccuagaauguggguuguuuccuggcc

SEQ ID NO: 389079 - RNA, 64 nt, Human
acuaacauuuuuaaguuacucagcucuauccucaugggccuauauauuuaauaccuccaaagau

SEQ ID NO: 389080 - RNA, 64 nt, Human
gugauuuaaccaagaaugcugauguugaauucuuugggccuagaauauacuugagaaagcacua

SEQ ID NO: 389081 - RNA, 64 nt, Human; identical to SEQ ID NO: 388230

SEQ ID NO: 389082 - RNA, 64 nt, Human; identical to SEQ ID NO: 388231

SEQ ID NO: 389083 - RNA, 64 nt, Human; identical to SEQ ID NO: 388232

SEQ ID NO: 389084 - RNA, 64 nt, Human; identical to SEQ ID NO: 388233

SEQ ID NO: 389085 - RNA, 64 nt, Human; identical to SEQ ID NO: 388234

SEQ ID NO: 389086 - RNA, 64 nt, Human; identical to SEQ ID NO: 388238

SEQ ID NO: 389087 - RNA, 64 nt, Human; identical to SEQ ID NO: 388239

SEQ ID NO: 389088 - RNA, 64 nt, Human; identical to SEQ ID NO: 388240

SEQ ID NO: 389089 - RNA, 64 nt, Human; identical to SEQ ID NO: 388241

SEQ ID NO: 389090 - RNA, 64 nt, Human; identical to SEQ ID NO: 388242

SEQ ID NO: 389091 - RNA, 64 nt, Human; identical to SEQ ID NO: 388243

SEQ ID NO: 389092 - RNA, 64 nt, Human; identical to SEQ ID NO: 388244

SEQ ID NO: 389093 - RNA, 64 nt, Human; identical to SEQ ID NO: 388245

SEQ ID NO: 389094 - RNA, 64 nt, Human; identical to SEQ ID NO: 388246

SEQ ID NO: 389095 - RNA, 64 nt, Human; identical to SEQ ID NO: 388247

SEQ ID NO: 389096 - RNA, 64 nt, Human
accacaggaagcgggggcuugcagggaaagugaaugggccuauggcccacccggggucaccugg

SEQ ID NO: 389097 - RNA, 64 nt, Human
ccaacgauucuccugccucagccucccgaguagcugggccuaaaggugcccaccacuauacccg

SEQ ID NO: 389098 - RNA, 64 nt, Human
aacacuggcaucucugagccuccagaagggguucugggccuaguuguccucccucuggagcccc

SEQ ID NO: 389099 - RNA, 64 nt, Human; identical to SEQ ID NO: 388248

SEQ ID NO: 389100 - RNA, 64 nt, Human; identical to SEQ ID NO: 388249

SEQ ID NO: 389101 - RNA, 64 nt, Human; identical to SEQ ID NO: 388250

SEQ ID NO: 389102 - RNA, 64 nt, Human; identical to SEQ ID NO: 388251

SEQ ID NO: 389103 - RNA, 64 nt, Human; identical to SEQ ID NO: 388252

SEQ ID NO: 389104 - RNA, 64 nt, Human; identical to SEQ ID NO: 388256

SEQ ID NO: 389105 - RNA, 64 nt, Human; identical to SEQ ID NO: 388257

SEQ ID NO: 389106 - RNA, 64 nt, Human; identical to SEQ ID NO: 388258

SEQ ID NO: 389107 - RNA, 64 nt, Human; identical to SEQ ID NO: 388259

SEQ ID NO: 389108 - RNA, 64 nt, Human; identical to SEQ ID NO: 388260

SEQ ID NO: 389109 - RNA, 64 nt, Human; identical to SEQ ID NO: 388261

SEQ ID NO: 389110 - RNA, 64 nt, Human; identical to SEQ ID NO: 388262

SEQ ID NO: 389111 - RNA, 64 nt, Human; identical to SEQ ID NO: 388263

SEQ ID NO: 389112 - RNA, 64 nt, Human; identical to SEQ ID NO: 388264

SEQ ID NO: 389113 - RNA, 64 nt, Human; identical to SEQ ID NO: 388265

SEQ ID NO: 389114 - RNA, 64 nt, Human
ugggugccaggaaauggguuuucucaaaguccauugccggcaaugggcaggccugcaaauacug

SEQ ID NO: 389115 - RNA, 64 nt, Human
cgccucacucccuccgucccacuccacuccaggcugccggcaccugccccauucccuggccugg

SEQ ID NO: 389116 - RNA, 64 nt, Human
cagcaguacgauuuugccgauggaauaacagauuugccggcaaucacugaaagagugcaaauau

SEQ ID NO: 389117 - RNA, 64 nt, Human; identical to SEQ ID NO: 388266

SEQ ID NO: 389118 - RNA, 64 nt, Human; identical to SEQ ID NO: 388267

SEQ ID NO: 389119 - RNA, 64 nt, Human; identical to SEQ ID NO: 388268

SEQ ID NO: 389120 - RNA, 64 nt, Human; identical to SEQ ID NO: 388269

SEQ ID NO: 389121 - RNA, 64 nt, Human; identical to SEQ ID NO: 388270

SEQ ID NO: 389122 - RNA, 64 nt, Human; identical to SEQ ID NO: 388274

SEQ ID NO: 389123 - RNA, 64 nt, Human; identical to SEQ ID NO: 388275

SEQ ID NO: 389124 - RNA, 64 nt, Human; identical to SEQ ID NO: 388276

SEQ ID NO: 389125 - RNA, 64 nt, Human; identical to SEQ ID NO: 388277

SEQ ID NO: 389126 - RNA, 64 nt, Human; identical to SEQ ID NO: 388278

SEQ ID NO: 389127 - RNA, 64 nt, Human; identical to SEQ ID NO: 388279

SEQ ID NO: 389128 - RNA, 64 nt, Human; identical to SEQ ID NO: 388280

SEQ ID NO: 389129 - RNA, 64 nt, Human; identical to SEQ ID NO: 388281

SEQ ID NO: 389130 - RNA, 64 nt, Human; identical to SEQ ID NO: 388282

SEQ ID NO: 389131 - RNA, 64 nt, Human; identical to SEQ ID NO: 388283

SEQ ID NO: 389132 - RNA, 64 nt, Human
gggcccgaggugaucccgguggugggauccacgcugggccuaggaugggacguuuuucuucuug

SEQ ID NO: 389133 - RNA, 64 nt, Human
gguggguggugugcaaagggaaugaagagcguccugggccuaaacacagcagccuccucucuuc

SEQ ID NO: 389134 - RNA, 64 nt, Human
uccauucaccccucacuguaccugcccuagaaccugggccuaggccacaggggcagggagaaga

SEQ ID NO: 389135 - RNA, 64 nt, Human; identical to SEQ ID NO: 388284

SEQ ID NO: 389136 - RNA, 64 nt, Human; identical to SEQ ID NO: 388285

SEQ ID NO: 389137 - RNA, 64 nt, Human; identical to SEQ ID NO: 388286

SEQ ID NO: 389138 - RNA, 64 nt, Human; identical to SEQ ID NO: 388287

SEQ ID NO: 389139 - RNA, 64 nt, Human; identical to SEQ ID NO: 388288

SEQ ID NO: 389140 - RNA, 64 nt, Human; identical to SEQ ID NO: 388292

SEQ ID NO: 389141 - RNA, 64 nt, Human; identical to SEQ ID NO: 388293

SEQ ID NO: 389142 - RNA, 64 nt, Human; identical to SEQ ID NO: 388294

SEQ ID NO: 389143 - RNA, 64 nt, Human; identical to SEQ ID NO: 388295

SEQ ID NO: 389144 - RNA, 64 nt, Human; identical to SEQ ID NO: 388296

SEQ ID NO: 389145 - RNA, 64 nt, Human; identical to SEQ ID NO: 388297

SEQ ID NO: 389146 - RNA, 64 nt, Human; identical to SEQ ID NO: 388298

SEQ ID NO: 389147 - RNA, 64 nt, Human; identical to SEQ ID NO: 388299

SEQ ID NO: 389148 - RNA, 64 nt, Human; identical to SEQ ID NO: 388300

SEQ ID NO: 389149 - RNA, 64 nt, Human; identical to SEQ ID NO: 388301

SEQ ID NO: 389150 - RNA, 64 nt, Human
uugagcaagucuuccccucagccucuggaguagcugggccuacagugugugcugccacacccag

SEQ ID NO: 389151 - RNA, 64 nt, Human
gggcggggauggcagauggagcccuugggcuccuugggccuagagccacuucuuaccaggcaac

SEQ ID NO: 389152 - RNA, 64 nt, Human
uugccauguguaggagucugggcacaagugucccugggccuaccuugguccuccuguccucuuc

SEQ ID NO: 389153 - RNA, 64 nt, Human; identical to SEQ ID NO: 388302

SEQ ID NO: 389154 - RNA, 64 nt, Human; identical to SEQ ID NO: 388303

SEQ ID NO: 389155 - RNA, 64 nt, Human; identical to SEQ ID NO: 388304

SEQ ID NO: 389156 - RNA, 64 nt, Human; identical to SEQ ID NO: 388305

SEQ ID NO: 389157 - RNA, 64 nt, Human; identical to SEQ ID NO: 388306

SEQ ID NO: 389158 - RNA, 64 nt, Human; identical to SEQ ID NO: 388310

SEQ ID NO: 389159 - RNA, 64 nt, Human; identical to SEQ ID NO: 388311

SEQ ID NO: 389160 - RNA, 64 nt, Human; identical to SEQ ID NO: 388312

SEQ ID NO: 389161 - RNA, 64 nt, Human; identical to SEQ ID NO: 388313

SEQ ID NO: 389162 - RNA, 64 nt, Human; identical to SEQ ID NO: 388314

SEQ ID NO: 389163 - RNA, 64 nt, Human; identical to SEQ ID NO: 388315

SEQ ID NO: 389164 - RNA, 64 nt, Human; identical to SEQ ID NO: 388316

SEQ ID NO: 389165 - RNA, 64 nt, Human; identical to SEQ ID NO: 388317

SEQ ID NO: 389166 - RNA, 64 nt, Human; identical to SEQ ID NO: 388318

SEQ ID NO: 389167 - RNA, 64 nt, Human; identical to SEQ ID NO: 388319

SEQ ID NO: 389168 - RNA, 64 nt, Human
cagauaacuugggguguguguggggaugugugugugggccuaugcacucacacacugaagaaac

SEQ ID NO: 389169 - RNA, 64 nt, Human
gcgugcuugaaaccuuggccagguuccaugaccaugggccuaacuuaaagaugugaaugagugu

SEQ ID NO: 389170 - RNA, 63 nt, Human
accaguaugagauaguguaacccaauguaucugugggccuauuccucucuaccuuuaaggugc

SEQ ID NO: 389171 - RNA, 64 nt, Human; identical to SEQ ID NO: 388320

SEQ ID NO: 389172 - RNA, 64 nt, Human; identical to SEQ ID NO: 388321

SEQ ID NO: 389173 - RNA, 64 nt, Human; identical to SEQ ID NO: 388322

SEQ ID NO: 389174 - RNA, 64 nt, Human; identical to SEQ ID NO: 388323

SEQ ID NO: 389175 - RNA, 64 nt, Human; identical to SEQ ID NO: 388324

SEQ ID NO: 389176 - RNA, 64 nt, Human; identical to SEQ ID NO: 388328

SEQ ID NO: 389177 - RNA, 64 nt, Human; identical to SEQ ID NO: 388329

SEQ ID NO: 389178 - RNA, 64 nt, Human; identical to SEQ ID NO: 388330

SEQ ID NO: 389179 - RNA, 64 nt, Human; identical to SEQ ID NO: 388331

SEQ ID NO: 389180 - RNA, 64 nt, Human; identical to SEQ ID NO: 388332

SEQ ID NO: 389181 - RNA, 64 nt, Human; identical to SEQ ID NO: 388333

SEQ ID NO: 389182 - RNA, 64 nt, Human; identical to SEQ ID NO: 388334

SEQ ID NO: 389183 - RNA, 64 nt, Human; identical to SEQ ID NO: 388335

SEQ ID NO: 389184 - RNA, 64 nt, Human; identical to SEQ ID NO: 388336

SEQ ID NO: 389185 - RNA, 64 nt, Human; identical to SEQ ID NO: 388337

SEQ ID NO: 389186 - RNA, 64 nt, Human
guauuucuauuccaaugauauuugguaauuagguugggccuauaaauauagaacaaauucaggg

SEQ ID NO: 389187 - RNA, 64 nt, Human
gcaggggcuuuauguguuuuugcuuggggggcgcugggccuagcccagaguagugcuugcuccc

SEQ ID NO: 389188 - RNA, 64 nt, Human; identical to SEQ ID NO: 164796

SEQ ID NO: 389189 - RNA, 64 nt, Human; identical to SEQ ID NO: 388338

SEQ ID NO: 389190 - RNA, 64 nt, Human; identical to SEQ ID NO: 388339

SEQ ID NO: 389191 - RNA, 64 nt, Human; identical to SEQ ID NO: 388340

SEQ ID NO: 389192 - RNA, 64 nt, Human; identical to SEQ ID NO: 388341

SEQ ID NO: 389193 - RNA, 64 nt, Human; identical to SEQ ID NO: 388342

SEQ ID NO: 389194 - RNA, 64 nt, Human; identical to SEQ ID NO: 388345

SEQ ID NO: 389195 - RNA, 64 nt, Human; identical to SEQ ID NO: 388346

SEQ ID NO: 389196 - RNA, 64 nt, Human; identical to SEQ ID NO: 388347

SEQ ID NO: 389197 - RNA, 64 nt, Human; identical to SEQ ID NO: 388348

SEQ ID NO: 389198 - RNA, 64 nt, Human; identical to SEQ ID NO: 388349

SEQ ID NO: 389199 - RNA, 64 nt, Human; identical to SEQ ID NO: 388350

SEQ ID NO: 389200 - RNA, 64 nt, Human; identical to SEQ ID NO: 388351

SEQ ID NO: 389201 - RNA, 64 nt, Human; identical to SEQ ID NO: 388352

SEQ ID NO: 389202 - RNA, 64 nt, Human; identical to SEQ ID NO: 388353

SEQ ID NO: 389203 - RNA, 64 nt, Human; identical to SEQ ID NO: 388354

SEQ ID NO: 389204 - RNA, 64 nt, Human
uggccaagaggacgaggaucuggggguggggaacugggccuagcugugggaggucaucgcgggg

SEQ ID NO: 389205 - RNA, 64 nt, Human
gaccauccccaauguuggugcugccuccgccccgugggccuagggcacaaggagucccagccac

SEQ ID NO: 389206 - RNA, 64 nt, Human; identical to SEQ ID NO: 164799

SEQ ID NO: 389207 - RNA, 64 nt, Human; identical to SEQ ID NO: 388355

SEQ ID NO: 389208 - RNA, 64 nt, Human; identical to SEQ ID NO: 388356

SEQ ID NO: 389209 - RNA, 64 nt, Human; identical to SEQ ID NO: 388357

SEQ ID NO: 389210 - RNA, 64 nt, Human; identical to SEQ ID NO: 388358

SEQ ID NO: 389211 - RNA, 64 nt, Human; identical to SEQ ID NO: 388359

SEQ ID NO: 389212 - RNA, 64 nt, Human; identical to SEQ ID NO: 388363

SEQ ID NO: 389213 - RNA, 64 nt, Human; identical to SEQ ID NO: 388364

SEQ ID NO: 389214 - RNA, 64 nt, Human; identical to SEQ ID NO: 388365

SEQ ID NO: 389215 - RNA, 64 nt, Human; identical to SEQ ID NO: 388366

SEQ ID NO: 389216 - RNA, 64 nt, Human; identical to SEQ ID NO: 388367

SEQ ID NO: 389217 - RNA, 64 nt, Human; identical to SEQ ID NO: 388368

SEQ ID NO: 389218 - RNA, 64 nt, Human; identical to SEQ ID NO: 388369

SEQ ID NO: 389219 - RNA, 64 nt, Human; identical to SEQ ID NO: 388370

SEQ ID NO: 389220 - RNA, 64 nt, Human; identical to SEQ ID NO: 388371

SEQ ID NO: 389221 - RNA, 64 nt, Human; identical to SEQ ID NO: 388372

SEQ ID NO: 389222 - RNA, 64 nt, Human; identical to SEQ ID NO: 164800

SEQ ID NO: 389223 - RNA, 64 nt, Human; identical to SEQ ID NO: 164801

SEQ ID NO: 389224 - RNA, 64 nt, Human; identical to SEQ ID NO: 164803

SEQ ID NO: 389225 - RNA, 64 nt, Human; identical to SEQ ID NO: 388373

SEQ ID NO: 389226 - RNA, 64 nt, Human; identical to SEQ ID NO: 388374

SEQ ID NO: 389227 - RNA, 64 nt, Human; identical to SEQ ID NO: 388375

SEQ ID NO: 389228 - RNA, 63 nt, Human; identical to SEQ ID NO: 388376

SEQ ID NO: 389229 - RNA, 64 nt, Human; identical to SEQ ID NO: 388377

SEQ ID NO: 389230 - RNA, 64 nt, Human; identical to SEQ ID NO: 388381

SEQ ID NO: 389231 - RNA, 64 nt, Human; identical to SEQ ID NO: 388382

SEQ ID NO: 389232 - RNA, 64 nt, Human; identical to SEQ ID NO: 388383

SEQ ID NO: 389233 - RNA, 64 nt, Human; identical to SEQ ID NO: 388384

SEQ ID NO: 389234 - RNA, 64 nt, Human; identical to SEQ ID NO: 388385

SEQ ID NO: 389235 - RNA, 64 nt, Human; identical to SEQ ID NO: 388386

SEQ ID NO: 389236 - RNA, 64 nt, Human; identical to SEQ ID NO: 388387

SEQ ID NO: 389237 - RNA, 64 nt, Human; identical to SEQ ID NO: 388388

SEQ ID NO: 389238 - RNA, 64 nt, Human; identical to SEQ ID NO: 388389

SEQ ID NO: 389239 - RNA, 64 nt, Human; identical to SEQ ID NO: 388390

SEQ ID NO: 389240 - RNA, 64 nt, Human; identical to SEQ ID NO: 164769

SEQ ID NO: 389241 - RNA, 55 nt, Human; identical to SEQ ID NO: 164770

SEQ ID NO: 389242 - RNA, 64 nt, Human; identical to SEQ ID NO: 164806

SEQ ID NO: 389243 - RNA, 64 nt, Human; identical to SEQ ID NO: 388391

SEQ ID NO: 389244 - RNA, 64 nt, Human; identical to SEQ ID NO: 388392

SEQ ID NO: 389245 - RNA, 64 nt, Human; identical to SEQ ID NO: 388393

SEQ ID NO: 389246 - RNA, 64 nt, Human; identical to SEQ ID NO: 388394

SEQ ID NO: 389247 - RNA, 64 nt, Human; identical to SEQ ID NO: 388395

SEQ ID NO: 389248 - RNA, 64 nt, Human; identical to SEQ ID NO: 388399

SEQ ID NO: 389249 - RNA, 64 nt, Human; identical to SEQ ID NO: 388400

SEQ ID NO: 389250 - RNA, 64 nt, Human; identical to SEQ ID NO: 388401

SEQ ID NO: 389251 - RNA, 64 nt, Human; identical to SEQ ID NO: 388402

SEQ ID NO: 389252 - RNA, 64 nt, Human; identical to SEQ ID NO: 388403

SEQ ID NO: 389253 - RNA, 64 nt, Human; identical to SEQ ID NO: 388404

SEQ ID NO: 389254 - RNA, 64 nt, Human; identical to SEQ ID NO: 388405

SEQ ID NO: 389255 - RNA, 64 nt, Human; identical to SEQ ID NO: 388406

SEQ ID NO: 389256 - RNA, 57 nt, Human; identical to SEQ ID NO: 388407

SEQ ID NO: 389257 - RNA, 64 nt, Human; identical to SEQ ID NO: 388408

SEQ ID NO: 389258 - RNA, 64 nt, Human
auccccgcuuuggaugugauucccucuccccaaaugggccuaccaagggggcgggcugaugacc

SEQ ID NO: 389259 - RNA, 64 nt, Human
cacccccauaggaacaggauuuggccuuagcuucugggccuaucggcugccuucccucuacuuc

SEQ ID NO: 389260 - RNA, 64 nt, Human
aaccgcauuuucaaauuuauccccguaaucaaugugggccuauuaaaaaaccaaaucaugauac

SEQ ID NO: 389261 - RNA, 64 nt, Human; identical to SEQ ID NO: 388409

SEQ ID NO: 389262 - RNA, 64 nt, Human; identical to SEQ ID NO: 388410

SEQ ID NO: 389263 - RNA, 64 nt, Human; identical to SEQ ID NO: 388411

SEQ ID NO: 389264 - RNA, 64 nt, Human; identical to SEQ ID NO: 388412

SEQ ID NO: 389265 - RNA, 64 nt, Human; identical to SEQ ID NO: 388413

SEQ ID NO: 389266 - RNA, 64 nt, Human; identical to SEQ ID NO: 388417

SEQ ID NO: 389267 - RNA, 64 nt, Human; identical to SEQ ID NO: 388418

SEQ ID NO: 389268 - RNA, 64 nt, Human; identical to SEQ ID NO: 388419

SEQ ID NO: 389269 - RNA, 64 nt, Human; identical to SEQ ID NO: 388420

SEQ ID NO: 389270 - RNA, 64 nt, Human; identical to SEQ ID NO: 388421

SEQ ID NO: 389271 - RNA, 55 nt, Human; identical to SEQ ID NO: 388422

SEQ ID NO: 389272 - RNA, 64 nt, Human; identical to SEQ ID NO: 388423

SEQ ID NO: 389273 - RNA, 64 nt, Human; identical to SEQ ID NO: 388424

SEQ ID NO: 389274 - RNA, 64 nt, Human; identical to SEQ ID NO: 388425

SEQ ID NO: 389275 - RNA, 64 nt, Human; identical to SEQ ID NO: 388426

SEQ ID NO: 389276 - RNA, 64 nt, Human
gcacaccuguacucccagcuacucgggugggcuuugggccuaguaguucgaguccagccugggc

SEQ ID NO: 389277 - RNA, 64 nt, Human
ugaagaaguagaaagugagucaugcacuagacagugggccuagcucaucaguggcuaaaguuga

SEQ ID NO: 389278 - RNA, 64 nt, Human
aagggggcggccuaugacuugggcacccccagccugggccuauggagagcccugggaccgcuac

SEQ ID NO: 389279 - RNA, 64 nt, Human; identical to SEQ ID NO: 388427

SEQ ID NO: 389280 - RNA, 64 nt, Human; identical to SEQ ID NO: 388428

SEQ ID NO: 389281 - RNA, 64 nt, Human; identical to SEQ ID NO: 388429

SEQ ID NO: 389282 - RNA, 64 nt, Human; identical to SEQ ID NO: 388430

SEQ ID NO: 389283 - RNA, 64 nt, Human; identical to SEQ ID NO: 388431

SEQ ID NO: 389284 - RNA, 64 nt, Human; identical to SEQ ID NO: 388435

SEQ ID NO: 389285 - RNA, 64 nt, Human; identical to SEQ ID NO: 388436

SEQ ID NO: 389286 - RNA, 64 nt, Human; identical to SEQ ID NO: 388437

SEQ ID NO: 389287 - RNA, 64 nt, Human; identical to SEQ ID NO: 388438

SEQ ID NO: 389288 - RNA, 64 nt, Human; identical to SEQ ID NO: 388439

SEQ ID NO: 389289 - RNA, 64 nt, Human; identical to SEQ ID NO: 388440

SEQ ID NO: 389290 - RNA, 64 nt, Human; identical to SEQ ID NO: 388441

SEQ ID NO: 389291 - RNA, 64 nt, Human; identical to SEQ ID NO: 388442

SEQ ID NO: 389292 - RNA, 64 nt, Human; identical to SEQ ID NO: 388443

SEQ ID NO: 389293 - RNA, 64 nt, Human; identical to SEQ ID NO: 388444

SEQ ID NO: 389294 - RNA, 64 nt, Human
cccccagcuccacgccuguugccauguggaaaagugggccuaggguggccacagcuuugauuuu

SEQ ID NO: 389295 - RNA, 64 nt, Human
ucacugaaacugguugaaggguguugcacccuuuugggccuagaauucugaacuuuaucuguuc

SEQ ID NO: 389296 - RNA, 64 nt, Human
cuucccccaggaacacggaggccaccgagggggcugggccuaucaggaggacacaggcugcagc

SEQ ID NO: 389297 - RNA, 64 nt, Human; identical to SEQ ID NO: 388445

SEQ ID NO: 389298 - RNA, 64 nt, Human; identical to SEQ ID NO: 388446

SEQ ID NO: 389299 - RNA, 64 nt, Human; identical to SEQ ID NO: 388447

SEQ ID NO: 389300 - RNA, 64 nt, Human; identical to SEQ ID NO: 388448

SEQ ID NO: 389301 - RNA, 64 nt, Human; identical to SEQ ID NO: 388449

SEQ ID NO: 389302 - RNA, 64 nt, Human; identical to SEQ ID NO: 388453

SEQ ID NO: 389303 - RNA, 64 nt, Human; identical to SEQ ID NO: 388454

SEQ ID NO: 389304 - RNA, 64 nt, Human; identical to SEQ ID NO: 388455

SEQ ID NO: 389305 - RNA, 64 nt, Human; identical to SEQ ID NO: 388456

SEQ ID NO: 389306 - RNA, 64 nt, Human; identical to SEQ ID NO: 388457

SEQ ID NO: 389307 - RNA, 64 nt, Human; identical to SEQ ID NO: 388458

SEQ ID NO: 389308 - RNA, 64 nt, Human; identical to SEQ ID NO: 388459

SEQ ID NO: 389309 - RNA, 64 nt, Human; identical to SEQ ID NO: 388460

SEQ ID NO: 389310 - RNA, 64 nt, Human; identical to SEQ ID NO: 388461

SEQ ID NO: 389311 - RNA, 64 nt, Human; identical to SEQ ID NO: 388462

SEQ ID NO: 389312 - RNA, 64 nt, Human; identical to SEQ ID NO: 164807

SEQ ID NO: 389313 - RNA, 64 nt, Human; identical to SEQ ID NO: 164808

SEQ ID NO: 389314 - RNA, 64 nt, Human; identical to SEQ ID NO: 164810

SEQ ID NO: 389315 - RNA, 64 nt, Human; identical to SEQ ID NO: 388463

SEQ ID NO: 389316 - RNA, 64 nt, Human; identical to SEQ ID NO: 388464

SEQ ID NO: 389317 - RNA, 57 nt, Human; identical to SEQ ID NO: 388465

SEQ ID NO: 389318 - RNA, 64 nt, Human; identical to SEQ ID NO: 388466

SEQ ID NO: 389319 - RNA, 64 nt, Human; identical to SEQ ID NO: 388467

SEQ ID NO: 389320 - RNA, 64 nt, Human; identical to SEQ ID NO: 388471

SEQ ID NO: 389321 - RNA, 64 nt, Human; identical to SEQ ID NO: 388472

SEQ ID NO: 389322 - RNA, 64 nt, Human; identical to SEQ ID NO: 388473

SEQ ID NO: 389323 - RNA, 64 nt, Human; identical to SEQ ID NO: 388474

SEQ ID NO: 389324 - RNA, 64 nt, Human; identical to SEQ ID NO: 388475

SEQ ID NO: 389325 - RNA, 64 nt, Human; identical to SEQ ID NO: 388476

SEQ ID NO: 389326 - RNA, 64 nt, Human; identical to SEQ ID NO: 388477

SEQ ID NO: 389327 - RNA, 64 nt, Human; identical to SEQ ID NO: 388478

SEQ ID NO: 389328 - RNA, 64 nt, Human; identical to SEQ ID NO: 388479

SEQ ID NO: 389329 - RNA, 64 nt, Human; identical to SEQ ID NO: 388480

SEQ ID NO: 389330 - RNA, 64 nt, Human
gaccaauucaaacugucuaugcacaaaauucccgugggccuagauggagauaauuuuuuuuucu

SEQ ID NO: 389331 - RNA, 64 nt, Human
aauguuucucaaucuuguuaaaagcucaaaauuuugggccuauuuguaaugccagugugacacu

SEQ ID NO: 389332 - RNA, 64 nt, Human
gaugcucagggaagugaugcccgcagaaggcgucugggccuaaggauccauggaagucaggagc

SEQ ID NO: 389333 - RNA, 64 nt, Human; identical to SEQ ID NO: 388481

SEQ ID NO: 389334 - RNA, 64 nt, Human; identical to SEQ ID NO: 388482

SEQ ID NO: 389335 - RNA, 64 nt, Human; identical to SEQ ID NO: 388483

SEQ ID NO: 389336 - RNA, 64 nt, Human; identical to SEQ ID NO: 388484

SEQ ID NO: 389337 - RNA, 64 nt, Human; identical to SEQ ID NO: 388485

SEQ ID NO: 389338 - RNA, 64 nt, Human; identical to SEQ ID NO: 388489

SEQ ID NO: 389339 - RNA, 64 nt, Human; identical to SEQ ID NO: 388490

SEQ ID NO: 389340 - RNA, 64 nt, Human; identical to SEQ ID NO: 388491

SEQ ID NO: 389341 - RNA, 64 nt, Human; identical to SEQ ID NO: 388492

SEQ ID NO: 389342 - RNA, 64 nt, Human; identical to SEQ ID NO: 388493

SEQ ID NO: 389343 - RNA, 64 nt, Human; identical to SEQ ID NO: 388494

SEQ ID NO: 389344 - RNA, 64 nt, Human; identical to SEQ ID NO: 388495

SEQ ID NO: 389345 - RNA, 64 nt, Human; identical to SEQ ID NO: 388496

SEQ ID NO: 389346 - RNA, 64 nt, Human; identical to SEQ ID NO: 388497

SEQ ID NO: 389347 - RNA, 64 nt, Human; identical to SEQ ID NO: 388498

SEQ ID NO: 389348 - RNA, 64 nt, Human
cuuuucacucaucauuucaugcuucucugcacucugggccuauuuguauugaaccauuagacaa

SEQ ID NO: 389349 - RNA, 64 nt, Human
auaguccagcuuucuaaaauccaggacucuauccugggccuacuaaacuucuguuuggagacug

SEQ ID NO: 389350 - RNA, 64 nt, Human
ucauucuaaaugaguuaacgacuuaacuugaaauugggccuaaggagugagaacuacaaaaaua

SEQ ID NO: 389351 - RNA, 64 nt, Human; identical to SEQ ID NO: 388499

SEQ ID NO: 389352 - RNA, 64 nt, Human; identical to SEQ ID NO: 388500

SEQ ID NO: 389353 - RNA, 64 nt, Human; identical to SEQ ID NO: 388501

SEQ ID NO: 389354 - RNA, 64 nt, Human; identical to SEQ ID NO: 388502

SEQ ID NO: 389355 - RNA, 64 nt, Human; identical to SEQ ID NO: 388503

SEQ ID NO: 389356 - RNA, 64 nt, Human; identical to SEQ ID NO: 388505

SEQ ID NO: 389357 - RNA, 64 nt, Human; identical to SEQ ID NO: 388506

SEQ ID NO: 389358 - RNA, 64 nt, Human; identical to SEQ ID NO: 388507

SEQ ID NO: 389359 - RNA, 64 nt, Human; identical to SEQ ID NO: 388508

SEQ ID NO: 389360 - RNA, 64 nt, Human; identical to SEQ ID NO: 388509

SEQ ID NO: 389361 - RNA, 59 nt, Human; identical to SEQ ID NO: 388510

SEQ ID NO: 389362 - RNA, 64 nt, Human; identical to SEQ ID NO: 388511

SEQ ID NO: 389363 - RNA, 64 nt, Human; identical to SEQ ID NO: 388512

SEQ ID NO: 389364 - RNA, 64 nt, Human; identical to SEQ ID NO: 388513

SEQ ID NO: 389365 - RNA, 64 nt, Human; identical to SEQ ID NO: 388514

SEQ ID NO: 389366 - RNA, 64 nt, Human
augaauugaauuuuagggaccguuucccauaauuugggccuaugcuauccuguugauuuuuaug

SEQ ID NO: 389367 - RNA, 64 nt, Human
cccugggaccucagagggccacagaugggcuuccugggccuagcgugccuugguuguggccauc

SEQ ID NO: 389368 - RNA, 64 nt, Human
accaguguguguauaacgaaaaccauguauaaaaugggccuaucacccuugucagagauauaaa

SEQ ID NO: 389369 - RNA, 64 nt, Human; identical to SEQ ID NO: 388515

SEQ ID NO: 389370 - RNA, 64 nt, Human; identical to SEQ ID NO: 388516

SEQ ID NO: 389371 - RNA, 64 nt, Human; identical to SEQ ID NO: 388517

SEQ ID NO: 389372 - RNA, 64 nt, Human; identical to SEQ ID NO: 388518

SEQ ID NO: 389373 - RNA, 64 nt, Human; identical to SEQ ID NO: 388519

SEQ ID NO: 389374 - RNA, 64 nt, Human; identical to SEQ ID NO: 388523

SEQ ID NO: 389375 - RNA, 64 nt, Human; identical to SEQ ID NO: 388524

SEQ ID NO: 389376 - RNA, 64 nt, Human; identical to SEQ ID NO: 388525

SEQ ID NO: 389377 - RNA, 64 nt, Human; identical to SEQ ID NO: 388526

SEQ ID NO: 389378 - RNA, 64 nt, Human; identical to SEQ ID NO: 388527

SEQ ID NO: 389379 - RNA, 64 nt, Human; identical to SEQ ID NO: 388528

SEQ ID NO: 389380 - RNA, 58 nt, Human; identical to SEQ ID NO: 388529

SEQ ID NO: 389381 - RNA, 64 nt, Human; identical to SEQ ID NO: 388530

SEQ ID NO: 389382 - RNA, 64 nt, Human; identical to SEQ ID NO: 388531

SEQ ID NO: 389383 - RNA, 64 nt, Human; identical to SEQ ID NO: 388532

SEQ ID NO: 389384 - RNA, 64 nt, Human
cccuucugugcuuguguggcauguguacccaggaugggccuauaggucacagaggucaguuucu

SEQ ID NO: 389385 - RNA, 64 nt, Human
cacagcuggcccugggcccaccccacgaagggccugggccuaaccccuuggccuggcccagcuu

SEQ ID NO: 389386 - RNA, 64 nt, Human
ucagagagguuguccugaggggcugggugauuccugggccuacauucuucccgaggcuccaggc

SEQ ID NO: 389387 - RNA, 64 nt, Human; identical to SEQ ID NO: 388533

SEQ ID NO: 389388 - RNA, 64 nt, Human; identical to SEQ ID NO: 388534

SEQ ID NO: 389389 - RNA, 64 nt, Human; identical to SEQ ID NO: 388109

SEQ ID NO: 389390 - RNA, 64 nt, Human; identical to SEQ ID NO: 388113

SEQ ID NO: 389391 - RNA, 64 nt, Human; identical to SEQ ID NO: 388114

SEQ ID NO: 389392 - RNA, 64 nt, Human; identical to SEQ ID NO: 388115

SEQ ID NO: 389393 - RNA, 64 nt, Human; identical to SEQ ID NO: 388116

SEQ ID NO: 389394 - RNA, 64 nt, Human; identical to SEQ ID NO: 388117

SEQ ID NO: 389395 - RNA, 64 nt, Human; identical to SEQ ID NO: 388118

SEQ ID NO: 389396 - RNA, 64 nt, Human; identical to SEQ ID NO: 388119

SEQ ID NO: 389397 - RNA, 64 nt, Human
cuggggccugggugggcugggggacagcugaggaugggccuagcagaugaagcuugccagcaag

SEQ ID NO: 389398 - RNA, 64 nt, Human
cccgcccugcccacagagcaccugcugguaacccugggccuauugaaagcaggaugagaugaua

SEQ ID NO: 389399 - RNA, 64 nt, Human
uuugaaagagcgcugggcaagcaguuagcacaucugggccuaccuucagcuucuucauuuacaa

SEQ ID NO: 389400 - RNA, 64 nt, Human; identical to SEQ ID NO: 388120

SEQ ID NO: 389401 - RNA, 64 nt, Human; identical to SEQ ID NO: 388121

SEQ ID NO: 389402 - RNA, 64 nt, Human; identical to SEQ ID NO: 388122

SEQ ID NO: 389403 - RNA, 64 nt, Human; identical to SEQ ID NO: 388123

SEQ ID NO: 389404 - RNA, 64 nt, Human; identical to SEQ ID NO: 388124

SEQ ID NO: 389405 - RNA, 64 nt, Human; identical to SEQ ID NO: 388125

SEQ ID NO: 389406 - RNA, 64 nt, Human; identical to SEQ ID NO: 388126

SEQ ID NO: 389407 - RNA, 57 nt, Human; identical to SEQ ID NO: 388127

SEQ ID NO: 389408 - RNA, 64 nt, Human; identical to SEQ ID NO: 388131

SEQ ID NO: 389409 - RNA, 64 nt, Human; identical to SEQ ID NO: 388132

SEQ ID NO: 389410 - RNA, 64 nt, Human; identical to SEQ ID NO: 388133

SEQ ID NO: 389411 - RNA, 64 nt, Human; identical to SEQ ID NO: 388134

SEQ ID NO: 389412 - RNA, 64 nt, Human; identical to SEQ ID NO: 388135

SEQ ID NO: 389413 - RNA, 64 nt, Human; identical to SEQ ID NO: 388136

SEQ ID NO: 389414 - RNA, 64 nt, Human; identical to SEQ ID NO: 388137

SEQ ID NO: 389415 - RNA, 64 nt, Human
aagccugugaucccugaggccagaauugacucuuugggccuaaauagcagcuauaaacaucuuc

SEQ ID NO: 389416 - RNA, 64 nt, Human
augcuuuuccagcucaucacaccccgccccacuaugggccuaccauuaauaguguauaacuugg

SEQ ID NO: 389417 - RNA, 64 nt, Human
accuuuuguuuauauguaaauguuuguaaguauaugggccuaucuguaaguggauaagucugua

SEQ ID NO: 389418 - RNA, 64 nt, Human; identical to SEQ ID NO: 388138

SEQ ID NO: 389419 - RNA, 64 nt, Human; identical to SEQ ID NO: 388139

SEQ ID NO: 389420 - RNA, 64 nt, Human; identical to SEQ ID NO: 388140

SEQ ID NO: 389421 - RNA, 64 nt, Human; identical to SEQ ID NO: 388141

SEQ ID NO: 389422 - RNA, 64 nt, Human; identical to SEQ ID NO: 388142

SEQ ID NO: 389423 - RNA, 64 nt, Human; identical to SEQ ID NO: 388143

SEQ ID NO: 389424 - RNA, 64 nt, Human; identical to SEQ ID NO: 388144

SEQ ID NO: 389425 - RNA, 64 nt, Human; identical to SEQ ID NO: 388145

SEQ ID NO: 389426 - RNA, 64 nt, Human; identical to SEQ ID NO: 388149

SEQ ID NO: 389427 - RNA, 64 nt, Human; identical to SEQ ID NO: 388150

SEQ ID NO: 389428 - RNA, 64 nt, Human; identical to SEQ ID NO: 388151

SEQ ID NO: 389429 - RNA, 64 nt, Human; identical to SEQ ID NO: 388152

SEQ ID NO: 389430 - RNA, 58 nt, Human; identical to SEQ ID NO: 388153

SEQ ID NO: 389431 - RNA, 64 nt, Human; identical to SEQ ID NO: 388154

SEQ ID NO: 389432 - RNA, 64 nt, Human; identical to SEQ ID NO: 388155

SEQ ID NO: 389433 - RNA, 64 nt, Human
gaggacagaaggguccuucuccuuaugugggaaaugggccuaguagaugcagaauucaaagaug

SEQ ID NO: 389434 - RNA, 64 nt, Human
ggcucaggguuauugccaguggagacuggugagcugggccuacucucagcugccuaucuucugc

SEQ ID NO: 389435 - RNA, 64 nt, Human
guguccccagauccccacuacagcuccaagaggaugggccuagaaagccaagugcaaagaugag

SEQ ID NO: 389436 - RNA, 64 nt, Human; identical to SEQ ID NO: 388156

SEQ ID NO: 389437 - RNA, 59 nt, Human; identical to SEQ ID NO: 388157

SEQ ID NO: 389438 - RNA, 64 nt, Human; identical to SEQ ID NO: 388158

SEQ ID NO: 389439 - RNA, 64 nt, Human; identical to SEQ ID NO: 388159

SEQ ID NO: 389440 - RNA, 64 nt, Human; identical to SEQ ID NO: 388160

SEQ ID NO: 389441 - RNA, 64 nt, Human; identical to SEQ ID NO: 388161

SEQ ID NO: 389442 - RNA, 64 nt, Human; identical to SEQ ID NO: 388162

SEQ ID NO: 389443 - RNA, 64 nt, Human; identical to SEQ ID NO: 388163

SEQ ID NO: 389444 - RNA, 64 nt, Human; identical to SEQ ID NO: 388167

SEQ ID NO: 389445 - RNA, 64 nt, Human; identical to SEQ ID NO: 388168

SEQ ID NO: 389446 - RNA, 64 nt, Human; identical to SEQ ID NO: 388169

SEQ ID NO: 389447 - RNA, 64 nt, Human; identical to SEQ ID NO: 388170

SEQ ID NO: 389448 - RNA, 64 nt, Human; identical to SEQ ID NO: 388171

SEQ ID NO: 389449 - RNA, 64 nt, Human; identical to SEQ ID NO: 388172

SEQ ID NO: 389450 - RNA, 64 nt, Human; identical to SEQ ID NO: 388173

SEQ ID NO: 389451 - RNA, 64 nt, Human
aauaccuguuaggauuggagggucugggugggccugggccuagcaaucaagcuucuaccuguac

SEQ ID NO: 389452 - RNA, 64 nt, Human
aaagugcugggguuacaggcgugugucacugugcugggccuauuuuauuuauagaacucauuua

SEQ ID NO: 389453 - RNA, 64 nt, Human
caaaugaucaguccccuguggaacagcucuucccugggccuagcucgccagcgcugugcuccuc

SEQ ID NO: 389454 - RNA, 64 nt, Human; identical to SEQ ID NO: 388174

SEQ ID NO: 389455 - RNA, 64 nt, Human; identical to SEQ ID NO: 388175

SEQ ID NO: 389456 - RNA, 64 nt, Human; identical to SEQ ID NO: 388176

SEQ ID NO: 389457 - RNA, 64 nt, Human; identical to SEQ ID NO: 388177

SEQ ID NO: 389458 - RNA, 64 nt, Human; identical to SEQ ID NO: 388178

SEQ ID NO: 389459 - RNA, 64 nt, Human; identical to SEQ ID NO: 388179

SEQ ID NO: 389460 - RNA, 64 nt, Human; identical to SEQ ID NO: 388180

SEQ ID NO: 389461 - RNA, 64 nt, Human; identical to SEQ ID NO: 388181

SEQ ID NO: 389462 - RNA, 64 nt, Human; identical to SEQ ID NO: 388184

SEQ ID NO: 389463 - RNA, 64 nt, Human; identical to SEQ ID NO: 388185

SEQ ID NO: 389464 - RNA, 64 nt, Human; identical to SEQ ID NO: 388186

SEQ ID NO: 389465 - RNA, 64 nt, Human; identical to SEQ ID NO: 388187

SEQ ID NO: 389466 - RNA, 64 nt, Human; identical to SEQ ID NO: 388188

SEQ ID NO: 389467 - RNA, 64 nt, Human; identical to SEQ ID NO: 388189

SEQ ID NO: 389468 - RNA, 64 nt, Human; identical to SEQ ID NO: 388190

SEQ ID NO: 389469 - RNA, 64 nt, Human
agcaucugagucugcuccuaaguggcuuugcaacugggccuaaguucuguuuccuuuauggauc

SEQ ID NO: 389470 - RNA, 64 nt, Human
auguaaauacagcagcuagugggagagcaccaguugggccuaauccugccucaucauucuuggc

SEQ ID NO: 389471 - RNA, 64 nt, Human
gagggaaaagaaguuagaacagugccaaagaaccugggccuaucagcguguaagggggccugcc

SEQ ID NO: 389472 - RNA, 64 nt, Human; identical to SEQ ID NO: 388191

SEQ ID NO: 389473 - RNA, 64 nt, Human; identical to SEQ ID NO: 388192

SEQ ID NO: 389474 - RNA, 64 nt, Human; identical to SEQ ID NO: 388193

SEQ ID NO: 389475 - RNA, 64 nt, Human; identical to SEQ ID NO: 388194

SEQ ID NO: 389476 - RNA, 64 nt, Human; identical to SEQ ID NO: 388195

SEQ ID NO: 389477 - RNA, 64 nt, Human; identical to SEQ ID NO: 388196

SEQ ID NO: 389478 - RNA, 64 nt, Human; identical to SEQ ID NO: 388197

SEQ ID NO: 389479 - RNA, 64 nt, Human; identical to SEQ ID NO: 388198

SEQ ID NO: 389480 - RNA, 64 nt, Human; identical to SEQ ID NO: 388202

SEQ ID NO: 389481 - RNA, 64 nt, Human; identical to SEQ ID NO: 388203

SEQ ID NO: 389482 - RNA, 64 nt, Human; identical to SEQ ID NO: 388204

SEQ ID NO: 389483 - RNA, 64 nt, Human; identical to SEQ ID NO: 388205

SEQ ID NO: 389484 - RNA, 64 nt, Human; identical to SEQ ID NO: 388206

SEQ ID NO: 389485 - RNA, 64 nt, Human; identical to SEQ ID NO: 388207

SEQ ID NO: 389486 - RNA, 64 nt, Human; identical to SEQ ID NO: 388208

SEQ ID NO: 389487 - RNA, 64 nt, Human
ggagggacacagcuuccccuucccaggaauugagugggccuagccccuccccccuuuucuccau

SEQ ID NO: 389488 - RNA, 64 nt, Human
gugacuuccgaggcugcugagacccuuagaucuuugggccuaggagggagucagagagggggau

SEQ ID NO: 389489 - RNA, 64 nt, Human; identical to SEQ ID NO: 164804

SEQ ID NO: 389490 - RNA, 64 nt, Human; identical to SEQ ID NO: 388209

SEQ ID NO: 389491 - RNA, 64 nt, Human; identical to SEQ ID NO: 388210

SEQ ID NO: 389492 - RNA, 64 nt, Human; identical to SEQ ID NO: 388211

SEQ ID NO: 389493 - RNA, 64 nt, Human; identical to SEQ ID NO: 388212

SEQ ID NO: 389494 - RNA, 64 nt, Human; identical to SEQ ID NO: 388213

SEQ ID NO: 389495 - RNA, 64 nt, Human; identical to SEQ ID NO: 388214

SEQ ID NO: 389496 - RNA, 64 nt, Human; identical to SEQ ID NO: 388215

SEQ ID NO: 389497 - RNA, 64 nt, Human; identical to SEQ ID NO: 388216

SEQ ID NO: 389498 - RNA, 64 nt, Human; identical to SEQ ID NO: 388220

SEQ ID NO: 389499 - RNA, 64 nt, Human; identical to SEQ ID NO: 388221

SEQ ID NO: 389500 - RNA, 64 nt, Human; identical to SEQ ID NO: 388222

SEQ ID NO: 389501 - RNA, 64 nt, Human; identical to SEQ ID NO: 388223

SEQ ID NO: 389502 - RNA, 64 nt, Human; identical to SEQ ID NO: 388224

SEQ ID NO: 389503 - RNA, 64 nt, Human; identical to SEQ ID NO: 388225

SEQ ID NO: 389504 - RNA, 64 nt, Human; identical to SEQ ID NO: 388226

SEQ ID NO: 389505 - RNA, 64 nt, Human
augcucugugacuugggcugauccccacccuuucugggccuacagcaccacaggccgcuguacc

SEQ ID NO: 389506 - RNA, 64 nt, Human
gggagggcagaggugaggagggggaagauguuucugggccuaccaagguucaacaagagaacgg

SEQ ID NO: 389507 - RNA, 64 nt, Human
ucauuaugcuguggcuccaggugagggugaggacugggccuauauagaauccagauaccauugu

SEQ ID NO: 389508 - RNA, 64 nt, Human; identical to SEQ ID NO: 388227

SEQ ID NO: 389509 - RNA, 59 nt, Human; identical to SEQ ID NO: 388228

SEQ ID NO: 389510 - RNA, 64 nt, Human; identical to SEQ ID NO: 388229

SEQ ID NO: 389511 - RNA, 64 nt, Human; identical to SEQ ID NO: 388230

SEQ ID NO: 389512 - RNA, 64 nt, Human; identical to SEQ ID NO: 388231

SEQ ID NO: 389513 - RNA, 64 nt, Human; identical to SEQ ID NO: 388232

SEQ ID NO: 389514 - RNA, 64 nt, Human; identical to SEQ ID NO: 388233

SEQ ID NO: 389515 - RNA, 64 nt, Human; identical to SEQ ID NO: 388234

SEQ ID NO: 389516 - RNA, 64 nt, Human; identical to SEQ ID NO: 388238

SEQ ID NO: 389517 - RNA, 64 nt, Human; identical to SEQ ID NO: 388239

SEQ ID NO: 389518 - RNA, 64 nt, Human; identical to SEQ ID NO: 388240

SEQ ID NO: 389519 - RNA, 64 nt, Human; identical to SEQ ID NO: 388241

SEQ ID NO: 389520 - RNA, 64 nt, Human; identical to SEQ ID NO: 388242

SEQ ID NO: 389521 - RNA, 64 nt, Human; identical to SEQ ID NO: 388243

SEQ ID NO: 389522 - RNA, 64 nt, Human; identical to SEQ ID NO: 388244

SEQ ID NO: 389523 - RNA, 64 nt, Human
gauucucugauaccuucauuuaauauaucaauauugggccuaaaacaguauucuguaaagcuua

SEQ ID NO: 389524 - RNA, 64 nt, Human
ucaagcaauccucccaccucagcccccaaguagcugggccuacaggugcgugcuaccacgccug

SEQ ID NO: 389525 - RNA, 64 nt, Human
gagagacuuggaugaggagugguugggcugugccugggccuagcacggacauggucuguccuga

SEQ ID NO: 389526 - RNA, 64 nt, Human; identical to SEQ ID NO: 388245

SEQ ID NO: 389527 - RNA, 64 nt, Human; identical to SEQ ID NO: 388246

SEQ ID NO: 389528 - RNA, 64 nt, Human; identical to SEQ ID NO: 388247

SEQ ID NO: 389529 - RNA, 64 nt, Human; identical to SEQ ID NO: 388248

SEQ ID NO: 389530 - RNA, 64 nt, Human; identical to SEQ ID NO: 388249

SEQ ID NO: 389531 - RNA, 64 nt, Human; identical to SEQ ID NO: 388250

SEQ ID NO: 389532 - RNA, 64 nt, Human; identical to SEQ ID NO: 388251

SEQ ID NO: 389533 - RNA, 64 nt, Human; identical to SEQ ID NO: 388252

SEQ ID NO: 389534 - RNA, 64 nt, Human; identical to SEQ ID NO: 388256

SEQ ID NO: 389535 - RNA, 64 nt, Human; identical to SEQ ID NO: 388257

SEQ ID NO: 389536 - RNA, 64 nt, Human; identical to SEQ ID NO: 388258

SEQ ID NO: 389537 - RNA, 64 nt, Human; identical to SEQ ID NO: 388259

SEQ ID NO: 389538 - RNA, 64 nt, Human; identical to SEQ ID NO: 388260

SEQ ID NO: 389539 - RNA, 64 nt, Human; identical to SEQ ID NO: 388261

SEQ ID NO: 389540 - RNA, 64 nt, Human; identical to SEQ ID NO: 388262

SEQ ID NO: 389541 - RNA, 64 nt, Human
aauuauuuguuuacuugcuauggucuguucauucugggccuaaccuuaaaggcucaauaacaaa

SEQ ID NO: 389542 - RNA, 64 nt, Human
ggggaagccuggauuugccccuccauguaggagcugggccuagggaccuguugaacucucucag

SEQ ID NO: 389543 - RNA, 64 nt, Human
gcggagagugaauuaccaacagggaauugggccuugggccuaugccauuucuguuguaguuugg

SEQ ID NO: 389544 - RNA, 64 nt, Human; identical to SEQ ID NO: 388263

SEQ ID NO: 389545 - RNA, 64 nt, Human; identical to SEQ ID NO: 388264

SEQ ID NO: 389546 - RNA, 64 nt, Human; identical to SEQ ID NO: 388265

SEQ ID NO: 389547 - RNA, 64 nt, Human; identical to SEQ ID NO: 388266

SEQ ID NO: 389548 - RNA, 64 nt, Human; identical to SEQ ID NO: 388267

SEQ ID NO: 389549 - RNA, 64 nt, Human; identical to SEQ ID NO: 388268

SEQ ID NO: 389550 - RNA, 64 nt, Human; identical to SEQ ID NO: 388269

SEQ ID NO: 389551 - RNA, 64 nt, Human; identical to SEQ ID NO: 388270

SEQ ID NO: 389552 - RNA, 64 nt, Human; identical to SEQ ID NO: 388274

SEQ ID NO: 389553 - RNA, 64 nt, Human; identical to SEQ ID NO: 388275

SEQ ID NO: 389554 - RNA, 64 nt, Human; identical to SEQ ID NO: 388276

SEQ ID NO: 389555 - RNA, 64 nt, Human; identical to SEQ ID NO: 388277

SEQ ID NO: 389556 - RNA, 64 nt, Human; identical to SEQ ID NO: 388278

SEQ ID NO: 389557 - RNA, 64 nt, Human; identical to SEQ ID NO: 388279

SEQ ID NO: 389558 - RNA, 64 nt, Human; identical to SEQ ID NO: 388280

SEQ ID NO: 389559 - RNA, 64 nt, Human
gcaggccuauguggcagcgucaccacaggaguugugggccuaggagaggcuuuggaccugggag

SEQ ID NO: 389560 - RNA, 64 nt, Human
cuucgcgcacacacugguucuccucuuuugggugugggccuaacaaaaagggcucaaggggcug

SEQ ID NO: 389561 - RNA, 64 nt, Human
augccuccuaauguggaacugguuguccauuguuugggccuauggccaagucacccagcugugg

SEQ ID NO: 389562 - RNA, 64 nt, Human; identical to SEQ ID NO: 388281

SEQ ID NO: 389563 - RNA, 64 nt, Human; identical to SEQ ID NO: 388282

SEQ ID NO: 389564 - RNA, 64 nt, Human; identical to SEQ ID NO: 388283

SEQ ID NO: 389565 - RNA, 64 nt, Human; identical to SEQ ID NO: 388284

SEQ ID NO: 389566 - RNA, 64 nt, Human; identical to SEQ ID NO: 388285

SEQ ID NO: 389567 - RNA, 64 nt, Human; identical to SEQ ID NO: 388286

SEQ ID NO: 389568 - RNA, 64 nt, Human; identical to SEQ ID NO: 388287

SEQ ID NO: 389569 - RNA, 64 nt, Human; identical to SEQ ID NO: 388288

SEQ ID NO: 389570 - RNA, 64 nt, Human; identical to SEQ ID NO: 388292

SEQ ID NO: 389571 - RNA, 64 nt, Human; identical to SEQ ID NO: 388293

SEQ ID NO: 389572 - RNA, 64 nt, Human; identical to SEQ ID NO: 388294

SEQ ID NO: 389573 - RNA, 64 nt, Human; identical to SEQ ID NO: 388295

SEQ ID NO: 389574 - RNA, 64 nt, Human; identical to SEQ ID NO: 388296

SEQ ID NO: 389575 - RNA, 64 nt, Human; identical to SEQ ID NO: 388297

SEQ ID NO: 389576 - RNA, 64 nt, Human; identical to SEQ ID NO: 388298

SEQ ID NO: 389577 - RNA, 64 nt, Human
gcugggaagucuggggaagggauacagagcuuggugggccuaacaccauucauauuccuuaccc

SEQ ID NO: 389578 - RNA, 64 nt, Human
uuugccauuuugagauuugaccugugguagcaucugggccuaauguuggcuucuaagucaaaga

SEQ ID NO: 389579 - RNA, 64 nt, Human
cuuccugugagagaggauuagauaggguuccaacugggccuacaagcucaagccauacauaaaa

SEQ ID NO: 389580 - RNA, 64 nt, Human; identical to SEQ ID NO: 388299

SEQ ID NO: 389581 - RNA, 64 nt, Human; identical to SEQ ID NO: 388300

SEQ ID NO: 389582 - RNA, 64 nt, Human; identical to SEQ ID NO: 388301

SEQ ID NO: 389583 - RNA, 64 nt, Human; identical to SEQ ID NO: 388302

SEQ ID NO: 389584 - RNA, 64 nt, Human; identical to SEQ ID NO: 388303

SEQ ID NO: 389585 - RNA, 64 nt, Human; identical to SEQ ID NO: 388304

SEQ ID NO: 389586 - RNA, 64 nt, Human; identical to SEQ ID NO: 388305

SEQ ID NO: 389587 - RNA, 64 nt, Human; identical to SEQ ID NO: 388306

SEQ ID NO: 389588 - RNA, 64 nt, Human; identical to SEQ ID NO: 388310

SEQ ID NO: 389589 - RNA, 64 nt, Human; identical to SEQ ID NO: 388311

SEQ ID NO: 389590 - RNA, 64 nt, Human; identical to SEQ ID NO: 388312

SEQ ID NO: 389591 - RNA, 64 nt, Human; identical to SEQ ID NO: 388313

SEQ ID NO: 389592 - RNA, 64 nt, Human; identical to SEQ ID NO: 388314

SEQ ID NO: 389593 - RNA, 64 nt, Human; identical to SEQ ID NO: 388315

SEQ ID NO: 389594 - RNA, 64 nt, Human; identical to SEQ ID NO: 388316

SEQ ID NO: 389595 - RNA, 64 nt, Human
gccaggauuccaggcagcagguuggagugacuggugggccuagaucacuggugugauaaacccc

SEQ ID NO: 389596 - RNA, 64 nt, Human
ggagcaucggagggagucccagagcccuggaccuugggccuagaccgcgugauaaaacuggguu

SEQ ID NO: 389597 - RNA, 64 nt, Human
gcccucugggcucugaguaccccugcuuugggcuugggccuaggcugcauugaaaagagcugaa

SEQ ID NO: 389598 - RNA, 64 nt, Human; identical to SEQ ID NO: 388317

SEQ ID NO: 389599 - RNA, 64 nt, Human; identical to SEQ ID NO: 388318

SEQ ID NO: 389600 - RNA, 64 nt, Human; identical to SEQ ID NO: 388319

SEQ ID NO: 389601 - RNA, 64 nt, Human; identical to SEQ ID NO: 388320

SEQ ID NO: 389602 - RNA, 64 nt, Human; identical to SEQ ID NO: 388321

SEQ ID NO: 389603 - RNA, 64 nt, Human; identical to SEQ ID NO: 388322

SEQ ID NO: 389604 - RNA, 64 nt, Human; identical to SEQ ID NO: 388323

SEQ ID NO: 389605 - RNA, 64 nt, Human; identical to SEQ ID NO: 388324

SEQ ID NO: 389606 - RNA, 64 nt, Human; identical to SEQ ID NO: 388328

SEQ ID NO: 389607 - RNA, 64 nt, Human; identical to SEQ ID NO: 388329

SEQ ID NO: 389608 - RNA, 64 nt, Human; identical to SEQ ID NO: 388330

SEQ ID NO: 389609 - RNA, 64 nt, Human; identical to SEQ ID NO: 388331

SEQ ID NO: 389610 - RNA, 64 nt, Human; identical to SEQ ID NO: 388332

SEQ ID NO: 389611 - RNA, 64 nt, Human; identical to SEQ ID NO: 388333

SEQ ID NO: 389612 - RNA, 64 nt, Human; identical to SEQ ID NO: 388334

SEQ ID NO: 389613 - RNA, 64 nt, Human
gaaaaaguaauaauuucucaaugaauuuuaaaaaugggccuauuuucuauccccgugguucauc

SEQ ID NO: 389614 - RNA, 64 nt, Human
guuaguccuucaugguauaaucuuacugaugcacugggccuaucuuuuuguuuuccagccaguu

SEQ ID NO: 389615 - RNA, 64 nt, Human
ccuccacagccugcuccaguuccgcagcuagagcugggccuaccuuccccagccagcccugcca

SEQ ID NO: 389616 - RNA, 64 nt, Human; identical to SEQ ID NO: 388335

SEQ ID NO: 389617 - RNA, 64 nt, Human; identical to SEQ ID NO: 388336

SEQ ID NO: 389618 - RNA, 64 nt, Human; identical to SEQ ID NO: 388337

SEQ ID NO: 389619 - RNA, 64 nt, Human; identical to SEQ ID NO: 388338

SEQ ID NO: 389620 - RNA, 64 nt, Human; identical to SEQ ID NO: 388339

SEQ ID NO: 389621 - RNA, 64 nt, Human; identical to SEQ ID NO: 388340

SEQ ID NO: 389622 - RNA, 64 nt, Human; identical to SEQ ID NO: 388341

SEQ ID NO: 389623 - RNA, 64 nt, Human; identical to SEQ ID NO: 388342

SEQ ID NO: 389624 - RNA, 64 nt, Human; identical to SEQ ID NO: 388345

SEQ ID NO: 389625 - RNA, 64 nt, Human; identical to SEQ ID NO: 388346

SEQ ID NO: 389626 - RNA, 64 nt, Human; identical to SEQ ID NO: 388347

SEQ ID NO: 389627 - RNA, 64 nt, Human; identical to SEQ ID NO: 388348

SEQ ID NO: 389628 - RNA, 64 nt, Human; identical to SEQ ID NO: 388349

SEQ ID NO: 389629 - RNA, 64 nt, Human; identical to SEQ ID NO: 388350

SEQ ID NO: 389630 - RNA, 64 nt, Human; identical to SEQ ID NO: 388351

SEQ ID NO: 389631 - RNA, 64 nt, Human
cucauguucaaagugugacauucaguguuagaggugggccuaguaggagguauuugggucaugg

SEQ ID NO: 389632 - RNA, 64 nt, Human
uuuuugcauaauuuuuugaugauuuucagcuuugugggccuauuggguuacauaagugacuuuu

SEQ ID NO: 389633 - RNA, 64 nt, Human
uccagcuugcccuguucuaggugguggcuaaaucugggccuaaucuggguggcucagcuaaccu

SEQ ID NO: 389634 - RNA, 64 nt, Human; identical to SEQ ID NO: 388352

SEQ ID NO: 389635 - RNA, 64 nt, Human; identical to SEQ ID NO: 388353

SEQ ID NO: 389636 - RNA, 64 nt, Human; identical to SEQ ID NO: 388354

SEQ ID NO: 389637 - RNA, 64 nt, Human; identical to SEQ ID NO: 388355

SEQ ID NO: 389638 - RNA, 64 nt, Human; identical to SEQ ID NO: 388356

SEQ ID NO: 389639 - RNA, 64 nt, Human; identical to SEQ ID NO: 388357

SEQ ID NO: 389640 - RNA, 64 nt, Human; identical to SEQ ID NO: 388358

SEQ ID NO: 389641 - RNA, 64 nt, Human; identical to SEQ ID NO: 388359

SEQ ID NO: 389642 - RNA, 64 nt, Human; identical to SEQ ID NO: 388363

SEQ ID NO: 389643 - RNA, 64 nt, Human; identical to SEQ ID NO: 388364

SEQ ID NO: 389644 - RNA, 64 nt, Human; identical to SEQ ID NO: 388365

SEQ ID NO: 389645 - RNA, 64 nt, Human; identical to SEQ ID NO: 388366

SEQ ID NO: 389646 - RNA, 64 nt, Human; identical to SEQ ID NO: 388367

SEQ ID NO: 389647 - RNA, 64 nt, Human; identical to SEQ ID NO: 388368

SEQ ID NO: 389648 - RNA, 64 nt, Human; identical to SEQ ID NO: 388369

SEQ ID NO: 389649 - RNA, 64 nt, Human
guugcuguuuccugaccuguucuugccugucaccugggccuacacaggucccgagccaacgggg

SEQ ID NO: 389650 - RNA, 64 nt, Human
acugaagauaacagccagggaggacaagcagggcugggccuagggacagacugcaagaggcucc

SEQ ID NO: 389651 - RNA, 64 nt, Human
uccgggucacuccuucuccgcuuuuucuugcagaugggccuaggccggugucgguucuguuucu

SEQ ID NO: 389652 - RNA, 64 nt, Human; identical to SEQ ID NO: 388370

SEQ ID NO: 389653 - RNA, 64 nt, Human; identical to SEQ ID NO: 388371

SEQ ID NO: 389654 - RNA, 64 nt, Human; identical to SEQ ID NO: 388372

SEQ ID NO: 389655 - RNA, 64 nt, Human; identical to SEQ ID NO: 388373

SEQ ID NO: 389656 - RNA, 64 nt, Human; identical to SEQ ID NO: 388374

SEQ ID NO: 389657 - RNA, 64 nt, Human; identical to SEQ ID NO: 388375

SEQ ID NO: 389658 - RNA, 63 nt, Human; identical to SEQ ID NO: 388376

SEQ ID NO: 389659 - RNA, 64 nt, Human; identical to SEQ ID NO: 388377

SEQ ID NO: 389660 - RNA, 64 nt, Human; identical to SEQ ID NO: 388381

SEQ ID NO: 389661 - RNA, 64 nt, Human; identical to SEQ ID NO: 388382

SEQ ID NO: 389662 - RNA, 64 nt, Human; identical to SEQ ID NO: 388383

SEQ ID NO: 389663 - RNA, 64 nt, Human; identical to SEQ ID NO: 388384

SEQ ID NO: 389664 - RNA, 64 nt, Human; identical to SEQ ID NO: 388385

SEQ ID NO: 389665 - RNA, 64 nt, Human; identical to SEQ ID NO: 388386

SEQ ID NO: 389666 - RNA, 64 nt, Human; identical to SEQ ID NO: 388387

SEQ ID NO: 389667 - RNA, 64 nt, Human
cugcauggggugcaggcauugcacagagcaugaaugggccuacaccugccaaggcugaaucccu

SEQ ID NO: 389668 - RNA, 64 nt, Human
gugccugggcacagaugucuguucagcaggugugugggccuagaggagagagcagagcccagaa

SEQ ID NO: 389669 - RNA, 64 nt, Human
uuaaccccagaccagagagaacugcagaucugacugggccuaaauuaaguagcuuaaugaaacc

SEQ ID NO: 389670 - RNA, 64 nt, Human; identical to SEQ ID NO: 388388

SEQ ID NO: 389671 - RNA, 64 nt, Human; identical to SEQ ID NO: 388389

SEQ ID NO: 389672 - RNA, 64 nt, Human; identical to SEQ ID NO: 388390

SEQ ID NO: 389673 - RNA, 64 nt, Human; identical to SEQ ID NO: 388391

SEQ ID NO: 389674 - RNA, 64 nt, Human; identical to SEQ ID NO: 388392

SEQ ID NO: 389675 - RNA, 64 nt, Human; identical to SEQ ID NO: 388393

SEQ ID NO: 389676 - RNA, 64 nt, Human; identical to SEQ ID NO: 388394

SEQ ID NO: 389677 - RNA, 64 nt, Human; identical to SEQ ID NO: 388395

SEQ ID NO: 389678 - RNA, 64 nt, Human; identical to SEQ ID NO: 388399

SEQ ID NO: 389679 - RNA, 64 nt, Human; identical to SEQ ID NO: 388400

SEQ ID NO: 389680 - RNA, 64 nt, Human; identical to SEQ ID NO: 388401

SEQ ID NO: 389681 - RNA, 64 nt, Human; identical to SEQ ID NO: 388402

SEQ ID NO: 389682 - RNA, 64 nt, Human; identical to SEQ ID NO: 388403

SEQ ID NO: 389683 - RNA, 64 nt, Human; identical to SEQ ID NO: 388404

SEQ ID NO: 389684 - RNA, 64 nt, Human; identical to SEQ ID NO: 388405

SEQ ID NO: 389685 - RNA, 64 nt, Human
gauaaggggugguccucaccuuccuaauggaagcugggccuagggaggcccauccagucuucug

SEQ ID NO: 389686 - RNA, 64 nt, Human
ccagcuccugggccagcucuggaagggcuguauuugggccuaauccucagcaaauguucuacca

SEQ ID NO: 389687 - RNA, 64 nt, Human
gaagagccacaggccacucuucccucugagccauugggccuaguggugucauguauuguaauug

SEQ ID NO: 389688 - RNA, 64 nt, Human; identical to SEQ ID NO: 388406

SEQ ID NO: 389689 - RNA, 57 nt, Human; identical to SEQ ID NO: 388407

SEQ ID NO: 389690 - RNA, 64 nt, Human; identical to SEQ ID NO: 388408

SEQ ID NO: 389691 - RNA, 64 nt, Human; identical to SEQ ID NO: 388409

SEQ ID NO: 389692 - RNA, 64 nt, Human; identical to SEQ ID NO: 388410

SEQ ID NO: 389693 - RNA, 64 nt, Human; identical to SEQ ID NO: 388411

SEQ ID NO: 389694 - RNA, 64 nt, Human; identical to SEQ ID NO: 388412

SEQ ID NO: 389695 - RNA, 64 nt, Human; identical to SEQ ID NO: 388413

SEQ ID NO: 389696 - RNA, 64 nt, Human; identical to SEQ ID NO: 388417

SEQ ID NO: 389697 - RNA, 64 nt, Human; identical to SEQ ID NO: 388418

SEQ ID NO: 389698 - RNA, 64 nt, Human; identical to SEQ ID NO: 388419

SEQ ID NO: 389699 - RNA, 64 nt, Human; identical to SEQ ID NO: 388420

SEQ ID NO: 389700 - RNA, 64 nt, Human; identical to SEQ ID NO: 388421

SEQ ID NO: 389701 - RNA, 55 nt, Human; identical to SEQ ID NO: 388422

SEQ ID NO: 389702 - RNA, 64 nt, Human; identical to SEQ ID NO: 388423

SEQ ID NO: 389703 - RNA, 64 nt, Human
aacugugugcucaagguguccaggcuuuugggggugggccuaucugggugcauuauggaugguu

SEQ ID NO: 389704 - RNA, 64 nt, Human
ggccaggccccagugcugacgaggagcccagauuugggccuaaucagguggggacgcaucucag

SEQ ID NO: 389705 - RNA, 64 nt, Human
ggccucuggacucaccuugagaagggggagcugcugggccuaaagcccacuccugggggucucc

SEQ ID NO: 389706 - RNA, 64 nt, Human; identical to SEQ ID NO: 388424

SEQ ID NO: 389707 - RNA, 64 nt, Human; identical to SEQ ID NO: 388425

SEQ ID NO: 389708 - RNA, 64 nt, Human; identical to SEQ ID NO: 388426

SEQ ID NO: 389709 - RNA, 64 nt, Human; identical to SEQ ID NO: 388427

SEQ ID NO: 389710 - RNA, 64 nt, Human; identical to SEQ ID NO: 388428

SEQ ID NO: 389711 - RNA, 64 nt, Human; identical to SEQ ID NO: 388429

SEQ ID NO: 389712 - RNA, 64 nt, Human; identical to SEQ ID NO: 388430

SEQ ID NO: 389713 - RNA, 64 nt, Human; identical to SEQ ID NO: 388431

SEQ ID NO: 389714 - RNA, 64 nt, Human; identical to SEQ ID NO: 388435

SEQ ID NO: 389715 - RNA, 64 nt, Human; identical to SEQ ID NO: 388436

SEQ ID NO: 389716 - RNA, 64 nt, Human; identical to SEQ ID NO: 388437

SEQ ID NO: 389717 - RNA, 64 nt, Human; identical to SEQ ID NO: 388438

SEQ ID NO: 389718 - RNA, 64 nt, Human; identical to SEQ ID NO: 388439

SEQ ID NO: 389719 - RNA, 64 nt, Human; identical to SEQ ID NO: 388440

SEQ ID NO: 389720 - RNA, 64 nt, Human; identical to SEQ ID NO: 388441

SEQ ID NO: 389721 - RNA, 64 nt, Human
uucguguuggggagaugcccucgccugagccgucugggccuaccguggucacugcguagccucu

SEQ ID NO: 389722 - RNA, 64 nt, Human
agacuuugcauuaaguucagaguacaauacaaacugggccuagcucuguauuuagucaguaugu

SEQ ID NO: 389723 - RNA, 64 nt, Human
cugugccccuucagagggagugcagggcuuggggugggccuaguccugcuccuagggcugugaa

SEQ ID NO: 389724 - RNA, 64 nt, Human; identical to SEQ ID NO: 388442

SEQ ID NO: 389725 - RNA, 64 nt, Human; identical to SEQ ID NO: 388443

SEQ ID NO: 389726 - RNA, 64 nt, Human; identical to SEQ ID NO: 388444

SEQ ID NO: 389727 - RNA, 64 nt, Human; identical to SEQ ID NO: 388445

SEQ ID NO: 389728 - RNA, 64 nt, Human; identical to SEQ ID NO: 388446

SEQ ID NO: 389729 - RNA, 64 nt, Human; identical to SEQ ID NO: 388447

SEQ ID NO: 389730 - RNA, 64 nt, Human; identical to SEQ ID NO: 388448

SEQ ID NO: 389731 - RNA, 64 nt, Human; identical to SEQ ID NO: 388449

SEQ ID NO: 389732 - RNA, 64 nt, Human; identical to SEQ ID NO: 388453

SEQ ID NO: 389733 - RNA, 64 nt, Human; identical to SEQ ID NO: 388454

SEQ ID NO: 389734 - RNA, 64 nt, Human; identical to SEQ ID NO: 388455

SEQ ID NO: 389735 - RNA, 64 nt, Human; identical to SEQ ID NO: 388456

SEQ ID NO: 389736 - RNA, 64 nt, Human; identical to SEQ ID NO: 388457

SEQ ID NO: 389737 - RNA, 64 nt, Human; identical to SEQ ID NO: 388458

SEQ ID NO: 389738 - RNA, 64 nt, Human; identical to SEQ ID NO: 388459

SEQ ID NO: 389739 - RNA, 64 nt, Human
agcucaccuuuuauauauuaaccucuagaauuaaugggccuaugugguuuuuuuucagucuuau

SEQ ID NO: 389740 - RNA, 64 nt, Human
caccgcucuagcugguuguugccaugccggaaugugggccuaguguugccagaucuucugauuu

SEQ ID NO: 389741 - RNA, 64 nt, Human
ccgugaguccauuccuuuggcauggcacuuucccugggccuacaguugguauuaccucugugcu

SEQ ID NO: 389742 - RNA, 64 nt, Human; identical to SEQ ID NO: 388460

SEQ ID NO: 389743 - RNA, 64 nt, Human; identical to SEQ ID NO: 388461

SEQ ID NO: 389744 - RNA, 64 nt, Human; identical to SEQ ID NO: 388462

SEQ ID NO: 389745 - RNA, 64 nt, Human; identical to SEQ ID NO: 388463

SEQ ID NO: 389746 - RNA, 64 nt, Human; identical to SEQ ID NO: 388464

SEQ ID NO: 389747 - RNA, 57 nt, Human; identical to SEQ ID NO: 388465

SEQ ID NO: 389748 - RNA, 64 nt, Human; identical to SEQ ID NO: 388466

SEQ ID NO: 389749 - RNA, 64 nt, Human; identical to SEQ ID NO: 388467

SEQ ID NO: 389750 - RNA, 64 nt, Human; identical to SEQ ID NO: 388471

SEQ ID NO: 389751 - RNA, 64 nt, Human; identical to SEQ ID NO: 388472

SEQ ID NO: 389752 - RNA, 64 nt, Human; identical to SEQ ID NO: 388473

SEQ ID NO: 389753 - RNA, 64 nt, Human; identical to SEQ ID NO: 388474

SEQ ID NO: 389754 - RNA, 64 nt, Human; identical to SEQ ID NO: 388475

SEQ ID NO: 389755 - RNA, 64 nt, Human; identical to SEQ ID NO: 388476

SEQ ID NO: 389756 - RNA, 64 nt, Human; identical to SEQ ID NO: 388477

SEQ ID NO: 389757 - RNA, 64 nt, Human
agcuugccauauuccaggcacacguuaucaaguuugggccuauuguggccucugacuucucuuu

SEQ ID NO: 389758 - RNA, 64 nt, Human
gaagagcuuagaaacaaagagugggaaauuccacugggccuaccuuccuuggggauguucaugg

SEQ ID NO: 389759 - RNA, 64 nt, Human
cuggauccccucugucuacaaauauaagauuuucugggccuaaaggauagaucaaagucaaaaa

SEQ ID NO: 389760 - RNA, 64 nt, Human; identical to SEQ ID NO: 388478

SEQ ID NO: 389761 - RNA, 64 nt, Human; identical to SEQ ID NO: 388479

SEQ ID NO: 389762 - RNA, 64 nt, Human; identical to SEQ ID NO: 388480

SEQ ID NO: 389763 - RNA, 64 nt, Human; identical to SEQ ID NO: 388481

SEQ ID NO: 389764 - RNA, 64 nt, Human; identical to SEQ ID NO: 388482

SEQ ID NO: 389765 - RNA, 64 nt, Human; identical to SEQ ID NO: 388483

SEQ ID NO: 389766 - RNA, 64 nt, Human; identical to SEQ ID NO: 388484

SEQ ID NO: 389767 - RNA, 64 nt, Human; identical to SEQ ID NO: 388485

SEQ ID NO: 389768 - RNA, 64 nt, Human; identical to SEQ ID NO: 388489

SEQ ID NO: 389769 - RNA, 64 nt, Human; identical to SEQ ID NO: 388490

SEQ ID NO: 389770 - RNA, 64 nt, Human; identical to SEQ ID NO: 388491

SEQ ID NO: 389771 - RNA, 64 nt, Human; identical to SEQ ID NO: 388492

SEQ ID NO: 389772 - RNA, 64 nt, Human; identical to SEQ ID NO: 388493

SEQ ID NO: 389773 - RNA, 64 nt, Human; identical to SEQ ID NO: 388494

SEQ ID NO: 389774 - RNA, 64 nt, Human; identical to SEQ ID NO: 388495

SEQ ID NO: 389775 - RNA, 64 nt, Human
gggcucuucgccuucaguguuguggcccuagcuaugggccuaaauugggcucuaggucucuguc

SEQ ID NO: 389776 - RNA, 64 nt, Human
gcuggcaucagccaaucauucagagcugaggcccugggccuagccugcccuucucaggugccaa

SEQ ID NO: 389777 - RNA, 64 nt, Human
ucagucagucacacagauuuaucacaaucugaggugggccuaggaaucucauuuuuaaauaguc

SEQ ID NO: 389778 - RNA, 64 nt, Human; identical to SEQ ID NO: 388496

SEQ ID NO: 389779 - RNA, 64 nt, Human; identical to SEQ ID NO: 388497

SEQ ID NO: 389780 - RNA, 64 nt, Human; identical to SEQ ID NO: 388498

SEQ ID NO: 389781 - RNA, 64 nt, Human; identical to SEQ ID NO: 388499

SEQ ID NO: 389782 - RNA, 64 nt, Human; identical to SEQ ID NO: 388500

SEQ ID NO: 389783 - RNA, 64 nt, Human; identical to SEQ ID NO: 388501

SEQ ID NO: 389784 - RNA, 64 nt, Human; identical to SEQ ID NO: 388502

SEQ ID NO: 389785 - RNA, 64 nt, Human; identical to SEQ ID NO: 388503

SEQ ID NO: 389786 - RNA, 64 nt, Human; identical to SEQ ID NO: 388505

SEQ ID NO: 389787 - RNA, 64 nt, Human; identical to SEQ ID NO: 388506

SEQ ID NO: 389788 - RNA, 64 nt, Human; identical to SEQ ID NO: 388507

SEQ ID NO: 389789 - RNA, 64 nt, Human; identical to SEQ ID NO: 388508

SEQ ID NO: 389790 - RNA, 64 nt, Human; identical to SEQ ID NO: 388509

SEQ ID NO: 389791 - RNA, 59 nt, Human; identical to SEQ ID NO: 388510

SEQ ID NO: 389792 - RNA, 64 nt, Human; identical to SEQ ID NO: 388511

SEQ ID NO: 389793 - RNA, 64 nt, Human
uggcuuccaaaugugcauggcaaagagagagaugugggccuagagcagauauauucagcaaggu

SEQ ID NO: 389794 - RNA, 64 nt, Human
ccguugccuugcuuaacucuaaagcuccauguccugggccuaaaaucguauaaaaucuggauuu

SEQ ID NO: 389795 - RNA, 64 nt, Human
uuuuccuccacgacauuccuugacuuaauccauuugggccuauuauagacaaaauagagcuucu

SEQ ID NO: 389796 - RNA, 64 nt, Human; identical to SEQ ID NO: 388512

SEQ ID NO: 389797 - RNA, 64 nt, Human; identical to SEQ ID NO: 388513

SEQ ID NO: 389798 - RNA, 64 nt, Human; identical to SEQ ID NO: 388514

SEQ ID NO: 389799 - RNA, 64 nt, Human; identical to SEQ ID NO: 388515

SEQ ID NO: 389800 - RNA, 64 nt, Human; identical to SEQ ID NO: 388516

SEQ ID NO: 389801 - RNA, 64 nt, Human; identical to SEQ ID NO: 388517

SEQ ID NO: 389802 - RNA, 64 nt, Human; identical to SEQ ID NO: 388518

SEQ ID NO: 389803 - RNA, 64 nt, Human; identical to SEQ ID NO: 388519

SEQ ID NO: 389804 - RNA, 64 nt, Human; identical to SEQ ID NO: 388523

SEQ ID NO: 389805 - RNA, 64 nt, Human; identical to SEQ ID NO: 388524

SEQ ID NO: 389806 - RNA, 64 nt, Human; identical to SEQ ID NO: 388525

SEQ ID NO: 389807 - RNA, 64 nt, Human; identical to SEQ ID NO: 388526

SEQ ID NO: 389808 - RNA, 64 nt, Human; identical to SEQ ID NO: 388527

SEQ ID NO: 389809 - RNA, 64 nt, Human; identical to SEQ ID NO: 388528

SEQ ID NO: 389810 - RNA, 58 nt, Human; identical to SEQ ID NO: 388529

SEQ ID NO: 389811 - RNA, 64 nt, Human
auggccuacccgaggagaagaggaguuuguuaacugggccuauguaguagccucauuuaccauc

SEQ ID NO: 389812 - RNA, 64 nt, Human
cagcaguuaugaaggaaauauugcuaaaaugaucugggccuaccauaaauaaauaucuccuuuu

SEQ ID NO: 389813 - RNA, 64 nt, Human
uugauuaggguaguaauuaggauaacuaaaauucugggccuaauuuuuuaaagaauccaagaca

SEQ ID NO: 389814 - RNA, 64 nt, Human; identical to SEQ ID NO: 388530

SEQ ID NO: 389815 - RNA, 64 nt, Human; identical to SEQ ID NO: 388531

SEQ ID NO: 389816 - RNA, 64 nt, Human; identical to SEQ ID NO: 388532

SEQ ID NO: 389817 - RNA, 64 nt, Human; identical to SEQ ID NO: 388533

SEQ ID NO: 389818 - RNA, 64 nt, Human; identical to SEQ ID NO: 388534

SEQ ID NO: 389819 - RNA, 64 nt, Human
agacuuugcuuaauacuuggugaccucacaaucacgucgguaugauugggcacccuugccuacu

SEQ ID NO: 389820 - RNA, 64 nt, Human
auagcacucauugcuucagacagaaaaugaauuccgucgguauguuccaaucgugaugaauuug

SEQ ID NO: 389821 - RNA, 64 nt, Human
uccauucuggccaugcgagcccagcuccuaccaacgucgguaacuugagcagucccuguugcug

SEQ ID NO: 389822 - RNA, 64 nt, Human
gguuuaguucagccauuucaagaaguauauuuaacgucgguaguucugcuuuauuaaaaugcag

SEQ ID NO: 389823 - RNA, 64 nt, Human
uuuggcacuggggcacuuggcagcgcggggagcccgucgguaauuuuaauauuuuauuauauau

SEQ ID NO: 389824 - RNA, 64 nt, Human
ggggguggggggaggcuagacucaaugccggggccgucgguacucuuguuuucauuugugugug

SEQ ID NO: 389825 - RNA, 64 nt, Human
gaaagucuuaucuuaaaaaucgauccgcuuaccaugggccuauucuuguaaguuucaguuagca

SEQ ID NO: 389826 - RNA, 64 nt, Human
cucucccaccuccuuccccccaccagaccuuugcugggccuaaaggucuuggccauggggacgc

SEQ ID NO: 389827 - RNA, 64 nt, Human
uucugacuagcugaaguaauugcagguuucuaacugggccuaaggugagcugagggcuugagcc

SEQ ID NO: 389828 - RNA, 64 nt, Human
ccuaaagccucccccauaaaaagggagcuguggauccacuuagaucagggcggaaccaucuuuc

SEQ ID NO: 389829 - RNA, 64 nt, Human
cucggagcugcugagaugacaggccccuggccuuuccacuuaugccuccuuuucuccuuauucc

SEQ ID NO: 389830 - RNA, 64 nt, Human
gucccuucauuuucccacaaguuugccccccaccuccacuuaccugucugcccucagcuucuuc

SEQ ID NO: 389831 - RNA, 64 nt, Human
aucgucucauacaagggaagagagagccacuggcuccacuuauuucggguccgcuagguggccc

SEQ ID NO: 389832 - RNA, 64 nt, Human
agugauuuuuuuccacaagaucuguaauguuauuuccacuuauaaaggaaauaaaaaaugaaaa

SEQ ID NO: 389833 - RNA, 64 nt, Human
guccaauuugcuugcacuuuuccacaucagaccuuccacuuaaggguaccaauucaauacaaaa

SEQ ID NO: 389834 - RNA, 64 nt, Human
ccggggacccagugagccgagaggcccucugggcuccacuuaugcauaugcaccaaaaaaaaaa

SEQ ID NO: 389835 - RNA, 64 nt, Human
auccgcucuggccccaagcacuauuucuuccuuuuccacuuaggccccuacaugccuguagccu

SEQ ID NO: 389836 - RNA, 64 nt, Human
caaggcuccuuaggggagagguccuuaccucugauccacuuagagcaauaaccacuuuuuaaau

SEQ ID NO: 389837 - RNA, 64 nt, Human
uucuaaaauguuuaugggauuugaguugcagguguccacuuaacugacuagcuuugauaaacaa

SEQ ID NO: 389838 - RNA, 64 nt, Human
cacuuucacucccucuccaagccuugaugggaccuccacuuauuuaggccucaugugcuuugaa

SEQ ID NO: 389839 - RNA, 64 nt, Human
uuugauuucagaaaacaauauuugauguauaacuuccacuuaauuuaaauuuaauaaacuuuua

SEQ ID NO: 389840 - RNA, 64 nt, Human
aagaagaggcuuuaaaauuuaguaauucacaacauccacuuagaaguauuauaguaaucuuuua

SEQ ID NO: 389841 - RNA, 64 nt, Human
guuauuuuucauaucauuuauaaucuugucacaauccacuuaaagaaguuugguuauauuucag

SEQ ID NO: 389842 - RNA, 64 nt, Human
aagaguccuaaggaguuaaaucuuccagguauuuuccacuuaguauugcagccaaagaauauuu

SEQ ID NO: 389843 - RNA, 64 nt, Human; identical to SEQ ID NO: 164793

SEQ ID NO: 389844 - RNA, 64 nt, Human; identical to SEQ ID NO: 164794

SEQ ID NO: 389845 - RNA, 64 nt, Human; identical to SEQ ID NO: 164797

SEQ ID NO: 389846 - RNA, 64 nt, Human
ucccuccagggaccucugcuuccacccacauauguccacuuagucacccacacuugacacaguu

SEQ ID NO: 389847 - RNA, 64 nt, Human
acuaaaacaaaguuacauaaaaaguuauugugacuccacuuaauuuuagugacguauuuuugua

SEQ ID NO: 389848 - RNA, 64 nt, Human
ccccagccacacuuucucccugguuuugcuuaauuccacuuaugcaucagucauuucaacagca

SEQ ID NO: 389849 - RNA, 64 nt, Human
aaugcucuccuuuccccugcccccagaccuuuuauccacuuaccuagauucuacauauucuuua

SEQ ID NO: 389850 - RNA, 64 nt, Human
aaaaggaagagagaaaauauauaugauaaucauuuccacuuaacuaauuuuuacuucuagcagg

SEQ ID NO: 389851 - RNA, 64 nt, Human
uguccuugugaugugcacguaaaguacuuguaguuccacuuauagccucugucuggcaaugcca

SEQ ID NO: 389852 - RNA, 64 nt, Human
gauaguuuugcuagguauaaaaaauaaguaaaguuccacuuagagaacaaagggccaaauagag

SEQ ID NO: 389853 - RNA, 64 nt, Human
ugagguuaaaaaucauauguugaaugcagcaguguccacuuaugacuaacuucuuagaacagca

SEQ ID NO: 389854 - RNA, 64 nt, Human
cuucaacucucaaggacucauguauaccauauguuccacuuauugcuuuguuagucaaaaugca

SEQ ID NO: 389855 - RNA, 64 nt, Human
cuucagacauagaauuaacacaugauccugcaauuccacuuauaggaauugacccacaagaaau

SEQ ID NO: 389856 - RNA, 64 nt, Human
agcaacuauucacaaaauaucaccaaaaaccuauuccacuuacauccaaggcacugucacuacg

SEQ ID NO: 389857 - RNA, 64 nt, Human
aguaguaucaaacaauaaugucuacuguuuauaguccacuuaauaaaaauagaggcauuuacua

SEQ ID NO: 389858 - RNA, 64 nt, Human
uauuuuauguagcuugagacaaagugaaucaacuuccacuuaguuguaccgagcauaaaacaga

SEQ ID NO: 389859 - RNA, 64 nt, Human
uaguaggggaauaaggcauucucugagggggcuuuccacuuagauugagaauuuuauuugaaaa

SEQ ID NO: 389860 - RNA, 64 nt, Human
ugaagucuguauaaacuuguuuugaaauacagucuccacuuacgaaugucauaacaaaauacuu

SEQ ID NO: 389861 - RNA, 64 nt, Human; identical to SEQ ID NO: 164787

SEQ ID NO: 389862 - RNA, 64 nt, Human; identical to SEQ ID NO: 164788

SEQ ID NO: 389863 - RNA, 64 nt, Human; identical to SEQ ID NO: 164813

SEQ ID NO: 389864 - RNA, 64 nt, Human
uuuaaaucuagcuauagaguugggaaaaaauauuuccacuuagauauuuuacaugguuuuguuu

SEQ ID NO: 389865 - RNA, 64 nt, Human
acguuuccugauggucauacuacaauuuuuggaguccacuuaacuccccugcuuuccuaggcca

SEQ ID NO: 389866 - RNA, 64 nt, Human
uguccugcccauuccuccagguguugaucuugauuccacuuagagaagcugaagcugugccucc

SEQ ID NO: 389867 - RNA, 64 nt, Human
cuuccaggaaaauauuuuuagaacuacuagcuuuuccacuuagaagaaaaugaggauucuuaag

SEQ ID NO: 389868 - RNA, 64 nt, Human
auaauaauggguuucuuucagauuuuuugaaccauccacuuacauauauuuuuaaaaaaugaaa

SEQ ID NO: 389869 - RNA, 64 nt, Human
guuacuguguagcaugucuuuugggaggcagauauccacuuaacuuuucuuaaaaauacuuuca

SEQ ID NO: 389870 - RNA, 64 nt, Human
gaaaaucagccuagcaguuuaaaccccacuuuccuccacuuagcaccauaggcaagggggcaga

SEQ ID NO: 389871 - RNA, 64 nt, Human
ucucucagugccugccuacugggcagcucaucuguccacuuauucguauuaaauuugcuuuuua

SEQ ID NO: 389872 - RNA, 64 nt, Human
gucauguuggcacucaaaaagguucaacauugaguccacuuaacacuuagguguuagaagaccu

SEQ ID NO: 389873 - RNA, 64 nt, Human
uauccagaaugucuauuaggauucuaauguuauguccacuuacaaguagagacaguaaaaggau

SEQ ID NO: 389874 - RNA, 64 nt, Human
ugccaacuaaucuuggauagauucuuuaaggcauuccacuuagcuugccaguugagacaaucac

SEQ ID NO: 389875 - RNA, 64 nt, Human
guagaauguuuauacauuuuugcauauuucaauuuccacuuaaauuuuuuaaagcuuuaacugg

SEQ ID NO: 389876 - RNA, 64 nt, Human
ggcuguauaauacauaaccacagcaagacugacauccacuuaggaugauacaaagcaguguaac

SEQ ID NO: 389877 - RNA, 64 nt, Human
agugaauuuucaggaauuuaaaaauuagcuuuuuuccacuuaaaggagaaaaauauuugggacu

SEQ ID NO: 389878 - RNA, 64 nt, Human
aaaccacaugguagugcuuugguggaggacugcuuccacuuagaaacaaacucugagaaguagg

SEQ ID NO: 389879 - RNA, 64 nt, Human; identical to SEQ ID NO: 164814

SEQ ID NO: 389880 - RNA, 64 nt, Human; identical to SEQ ID NO: 164815

SEQ ID NO: 389881 - RNA, 64 nt, Human; identical to SEQ ID NO: 164817

SEQ ID NO: 389882 - RNA, 64 nt, Human
uagugauauaagcauuguuuuuauugcagccauauccacuuauccaucuuaagaucuguagcug

SEQ ID NO: 389883 - RNA, 64 nt, Human
auuguccuacaucaaacuuaguuaaauaauuccauccacuuauggaggaggaggagaaugugga

SEQ ID NO: 389884 - RNA, 64 nt, Human
ccugaaaagaguaacaaaguaugcuuugccuguuuccacuuaccaggaaauuccuucagaacua

SEQ ID NO: 389885 - RNA, 64 nt, Human
uuuucccccuggcauggauguccugcucagacacuccacuuagaagacaguuucccuuuuucac

SEQ ID NO: 389886 - RNA, 64 nt, Human
guuuugcuucaaaggaugucuagauguaagugauuccacuuaaagccaaaauaaaaauuccuaa

SEQ ID NO: 389887 - RNA, 64 nt, Human
uuucuauuagcagugguguuuuaauugguugaauuccacuuaguucuccacaguguuuuguaug

SEQ ID NO: 389888 - RNA, 64 nt, Human
agagucuuaaacaggcccagugcugaguucuuuguccacuuagucacacaucuuuugugggaau

SEQ ID NO: 389889 - RNA, 64 nt, Human
aaaaagaagcaccacgagauggccaggacauuuguccacuuaaacucucaacaacagugugauc

SEQ ID NO: 389890 - RNA, 64 nt, Human
uacuuguuuuucuuacaugugacuagcaacuuucuccacuuaaagacuaaauaccucuuuauau

SEQ ID NO: 389891 - RNA, 64 nt, Human
ugcauuuuuccuuuuggauaagggaaaacauuauuccacuuacuguuuuugcuuuaagcagccu

SEQ ID NO: 389892 - RNA, 64 nt, Human
ucuuucucuuugccuuuuuaaacccaugcuuugauccacuuaucuauggauauuuuucucugug

SEQ ID NO: 389893 - RNA, 64 nt, Human
uaguccaugguacauauauaccacauuuucuuuauccacuuaucaguugauggacacuuagguu

SEQ ID NO: 389894 - RNA, 64 nt, Human
acuguguauguucuuguguaccuacagcuaagcuuccacuuauaagugagaacaugcaguauuu

SEQ ID NO: 389895 - RNA, 64 nt, Human
cugaugucauuucuuucaaguugcccacaguaucuccacuuaaacuaggcuaguaaccaaaaua

SEQ ID NO: 389896 - RNA, 64 nt, Human
aaguguaacacacugaugguuuuaauguaucuuuuccacuuauuauaguuauauuccuacaaua

SEQ ID NO: 389897 - RNA, 64 nt, Human; identical to SEQ ID NO: 164781

SEQ ID NO: 389898 - RNA, 64 nt, Human; identical to SEQ ID NO: 164782

SEQ ID NO: 389899 - RNA, 64 nt, Human; identical to SEQ ID NO: 164801

SEQ ID NO: 389900 - RNA, 64 nt, Human
uucauugcuauuggaaaaaucaguuauuggaauuuccacuuaaauggcuauacaacaauauaac

SEQ ID NO: 389901 - RNA, 64 nt, Human
cuaaauucaucagauggccaaacuguauuuauaauccacuuaggcauuuugaaaaacuuucaac

SEQ ID NO: 389902 - RNA, 64 nt, Human
uaugugauuagcucaucuugauuuuuaauauuuuuccacuuaaacuuuuuuuucuuacuccacu

SEQ ID NO: 389903 - RNA, 64 nt, Human
cugaaucauguuacccacuccccucacaauguuguccacuuagugaguugcauugaucuauccg

SEQ ID NO: 389904 - RNA, 64 nt, Human
uauaccugggaaauauucuuggauccuucacacauccacuuaauuucuugaaggaagaaaacag

SEQ ID NO: 389905 - RNA, 64 nt, Human
aaccacauggaacuuaaaacauaugggugugaaguccacuuauguagacaaaacuuauaauuuc

SEQ ID NO: 389906 - RNA, 64 nt, Human
ucacugagucucauggagagaugucuguucuaaguccacuuaaauaauccucuaugugguugau

SEQ ID NO: 389907 - RNA, 64 nt, Human
uccacauaguauuugcauuguuuuauaaauaaauuccacuuacuaucaauuccccuuugccagu

SEQ ID NO: 389908 - RNA, 64 nt, Human
aaccuuccugcugacaaccaugcagaggaauuuuuccacuuaagucagagccuuccuccccauc

SEQ ID NO: 389909 - RNA, 64 nt, Human
ucugugccaucauggugauuuuauccaagacugcuccacuuaccccagugcuggggacaaguuu

SEQ ID NO: 389910 - RNA, 64 nt, Human
gcuuugaguuugcuuucucaacauuauuguauuuuccacuuauuauuacuguauaacauaugcu

SEQ ID NO: 389911 - RNA, 64 nt, Human
auggccucauuccuccuguucucccaguuugcuuuccacuuaagacaaagccuugucuaugugg

SEQ ID NO: 389912 - RNA, 64 nt, Human
gcaccuuccuuuccccaucucugucuguguagacuccacuuacaucuugugguuauucuggguu

SEQ ID NO: 389913 - RNA, 64 nt, Human
ucucccaccccggccccaggcuggaagcccucccuccacuuaaguuauuguuuuaaaccaaagu

SEQ ID NO: 389914 - RNA, 64 nt, Human
uacaaauguuauuuuucugacuucucgccuccacuccacuuacccugucaggaaaaaauaauuc

SEQ ID NO: 389915 - RNA, 64 nt, Human
uuaaagaacaaaccaugugacaaaauuguuaccuuccacuuacuguagcaaauaauaccuacaa

SEQ ID NO: 389916 - RNA, 64 nt, Human
uauuugcuguuguguaauauccauggacauguaauccacuuacuccaucuuuacaaucccuuuu

SEQ ID NO: 389917 - RNA, 64 nt, Human
acuuugcaucagcuuucccccauuaucucucagauccacuuaaggaauccuuacagcaugccgu

SEQ ID NO: 389918 - RNA, 64 nt, Human
cacccaucacccucagcaccaggccacccugcaguccacuuacuguacuguguuguggaaggau

SEQ ID NO: 389919 - RNA, 64 nt, Human
uaaaucaccuguucccaccuccuuuccccuucacuccacuuauaguaugugucauuuucaaugc

SEQ ID NO: 389920 - RNA, 64 nt, Human
uacuguuuauauuuuguauaccuuuuaauagguauccacuuaaggcauuugcaguacaaauauu

SEQ ID NO: 389921 - RNA, 64 nt, Human
agacaucaaaucugugugcaugacuaugugcuuauccacuuaagacaauagguaaaaggggauc

SEQ ID NO: 389922 - RNA, 64 nt, Human
ugucuuacuucagaaugcauccuuugagauuauguccacuuaagagaaaucaucaguuaagaaa

SEQ ID NO: 389923 - RNA, 64 nt, Human
uuaauauguccaacuccucaugaaauauauucaauccacuuaaauauauuccaucuuuuuaaca

SEQ ID NO: 389924 - RNA, 64 nt, Human
aauucauacagguacuugauacaguuauacauuuuccacuuacaaaaagaagacaauucuguua

SEQ ID NO: 389925 - RNA, 64 nt, Human
uugcuauauaaauuaccgagagaauaguuugucauccacuuaguguguuagcuggugggguaca

SEQ ID NO: 389926 - RNA, 64 nt, Human
cagggucacacccaaguaauugaaaagacacuccuccacuuauccccuccgugauauggcucuu

SEQ ID NO: 389927 - RNA, 64 nt, Human
aguuaauuucauuuauuuacuuuggagcuauauuuccacuuagaaaaacuaagguaauuuuaca

SEQ ID NO: 389928 - RNA, 64 nt, Human
uauuaccuccccuacucccuuauguguuguguauuccacuuaggaagaaaugcccaaaagaggu

SEQ ID NO: 389929 - RNA, 64 nt, Human
aaagcauggcuugaauaaggaaaugacaauuuuuuccacuuaucugaucagaacaaauguuuau

SEQ ID NO: 389930 - RNA, 64 nt, Human; identical to SEQ ID NO: 164765

SEQ ID NO: 389931 - RNA, 64 nt, Human
ugaaggucuuccagaagccacauccgcacaauuuuccacuuaaccaggaaauauuucuccucua

SEQ ID NO: 389932 - RNA, 64 nt, Human
gcugugcuuaugugugguggacugcagagcugcuuccacuuacaggagagcugauaauuuguua

SEQ ID NO: 389933 - RNA, 64 nt, Human
caguccugcuugggggagccuggcuguacccccguccacuuacugcgugaccucagccugucau

SEQ ID NO: 389934 - RNA, 64 nt, Human
aaagguguuuucuucuuugacuacggaguccaaauccacuuaaauucuguuuuccugaaaagag

SEQ ID NO: 389935 - RNA, 64 nt, Human
ugcuaugugggauggaugugugaggaaccccgguuccacuuaacaacuaaauacaacaucuuuu

SEQ ID NO: 389936 - RNA, 64 nt, Human
gccauuaccaacuccaaauaaucucaaauaauuuuccacuuaauaacuguaaaguuuuuuucug

SEQ ID NO: 389937 - RNA, 64 nt, Human
cuauuugcccuuaguuuagaucuccaucaucaauuccacuuacuauuguaauaccuucagcugg

SEQ ID NO: 389938 - RNA, 64 nt, Human
ccuugcuaaggucccauauauugauuuguacagauccacuuagucauuuucuccuuuuuuuaag

SEQ ID NO: 389939 - RNA, 64 nt, Human
aagagaaaaccuaucauaagcccaauuuuuuuuuuccacuuaggguaaauguuuggcuccucuc

SEQ ID NO: 389940 - RNA, 64 nt, Human
gcccccuuucccuccguuuguuuucuuuucauaauccacuuacucccuucccuucuacucugcg

SEQ ID NO: 389941 - RNA, 64 nt, Human
acguguaaaggaaaauaauguuugauaguaaauguccacuuaaaauacaugaaugggcauuucu

SEQ ID NO: 389942 - RNA, 64 nt, Human
uccuguugauuguucaaauauaauuuaagaaaauuccacuuaauaggcuuaccuauuucuaugu

SEQ ID NO: 389943 - RNA, 64 nt, Human
cagguuuugagacugagaugcguguucguauuuuuccacuuaucugucuugucagcuggccgac

SEQ ID NO: 389944 - RNA, 64 nt, Human
gcucaugaguuuguaucaauaauauaauuguugauccacuuauaauucgugcaacacuguaugu

SEQ ID NO: 389945 - RNA, 64 nt, Human
ucgccuguuguccagauuggcacgaaccuuuucuuccacuuaauuauuuuuuuaggauuuugcu

SEQ ID NO: 389946 - RNA, 64 nt, Human; identical to SEQ ID NO: 164775

SEQ ID NO: 389947 - RNA, 64 nt, Human; identical to SEQ ID NO: 164776

SEQ ID NO: 389948 - RNA, 64 nt, Human; identical to SEQ ID NO: 164811

SEQ ID NO: 389949 - RNA, 64 nt, Human
cagagaugguagcuaugaguauacaaaagguaaauccacuuaaucacauacagaagagcaacaa

SEQ ID NO: 389950 - RNA, 64 nt, Human
cagucacaccgacguguccugaagguguaggcucuccacuuaggcgcacaagcugacggcugca

SEQ ID NO: 389951 - RNA, 64 nt, Human
ggucuucucccugccaugucccuugccaggcucuuccacuuagcuaagugggcacacugcaagc

SEQ ID NO: 389952 - RNA, 64 nt, Human
uagcaguaguuuuggugaauucaccaaaucagcuuccacuuagcauuaggaggucaugccauac

SEQ ID NO: 389953 - RNA, 64 nt, Human
uagggagcucugccagaggggcagcagcugcagauccacuuaggccccaggguccacggauggc

SEQ ID NO: 389954 - RNA, 64 nt, Human
acaagaugauuggcagguauuccguuuaucacaguccacuuaaaaaaugaugaugaugauaaaa

SEQ ID NO: 389955 - RNA, 64 nt, Human
guccaaaguuucaucugagacaaggcaagucccuuccacuuaugaaccuguaaaaucaaaagua

SEQ ID NO: 389956 - RNA, 64 nt, Human
aauauuuauacacuugucuugaauuuuuuucagauccacuuaaaauauuuagaaaaacaaguuu

SEQ ID NO: 389957 - RNA, 64 nt, Human
cccagaggccaggagcucugcccuugaccuguauuccacuuacuccaccuuccauuccucgccc

SEQ ID NO: 389958 - RNA, 64 nt, Human
uccuuuuauaugcagcucuuacgugggagacuuuuccacuuaaaggagacauagaaugugugcu

SEQ ID NO: 389959 - RNA, 64 nt, Human
ugcuguccccuucccacccucaucccugaccgacuccacuuaacccccaaacccagccccccuu

SEQ ID NO: 389960 - RNA, 64 nt, Human
ugacuuaaagccugaaauaaugggaguuuucuccuccacuuauuagaauaaggacccucaguga

SEQ ID NO: 389961 - RNA, 64 nt, Human
uugagcacaaccuuguccacagccauuuuaaauauccacuuagcccuguguaguugguaggugg

SEQ ID NO: 389962 - RNA, 64 nt, Human
uccaauuauauuucccaaguauaucuagaacuuauccacuuauauccccacugcuacuaccuua

SEQ ID NO: 389963 - RNA, 64 nt, Human
ggauuuucuggauagaggaagugauuggaaguacuccacuuaaagccauggaauuagcaauagu

SEQ ID NO: 389964 - RNA, 64 nt, Human; identical to SEQ ID NO: 164798

SEQ ID NO: 389965 - RNA, 64 nt, Human; identical to SEQ ID NO: 164799

SEQ ID NO: 389966 - RNA, 64 nt, Human; identical to SEQ ID NO: 164805

SEQ ID NO: 389967 - RNA, 64 nt, Human
agagaaccucaaacuaggaggaaaagacagagccuccacuuaguuuugggaggggauggcagac

SEQ ID NO: 389968 - RNA, 64 nt, Human
uuccuuuaccuuuucuauaaguuguaccaaaacauccacuuaaguucuuugauuuguaccauuc

SEQ ID NO: 389969 - RNA, 64 nt, Human
uuagcucucuuaaaugaagugcccacuaagaaguuccacuuaacacaugaauuucugccauauu

SEQ ID NO: 389970 - RNA, 64 nt, Human
acccuguaaugguugggaccaggccaaucccuucuccacuuacuauaaugguuggaacuaaacg

SEQ ID NO: 389971 - RNA, 58 nt, Human
acucagaaaugcugcagugaaaaauaauuccacuuacacagugggggacucaaaguca

SEQ ID NO: 389972 - RNA, 64 nt, Human
caaguuugagaucuguaaaaugugauuuuuuacuuccacuuauaauacuugugauuggggaggu

SEQ ID NO: 389973 - RNA, 64 nt, Human
ccaagggaccugugguucgugcugcgaagaugcuuccacuuaaagcaugagaaauggggugccg

SEQ ID NO: 389974 - RNA, 64 nt, Human
aagcugagauucugaaggacccagcuuagguucuuccacuuaggccucaauucccuuccuuuuc

SEQ ID NO: 389975 - RNA, 64 nt, Human
guuuuucucaguuacccauuugugugugugugauuccacuuagaaauucuuaaaaccagauuuu

SEQ ID NO: 389976 - RNA, 64 nt, Human
cucagaggggagguaccuuugucuaaucaacguuuccacuuagaucuuuuauuuuuaauaagca

SEQ ID NO: 389977 - RNA, 64 nt, Human
cugacugccugggaggaggguuaggucugcuucuuccacuuauacuuagucucugugcuccaag

SEQ ID NO: 389978 - RNA, 64 nt, Human
acauuuuuacauuguaccuuaggacucagucaucuccacuuaaauugaugacacaagcagcuaa

SEQ ID NO: 389979 - RNA, 52 nt, Human
gauugcucagcuacuccuaaccuccacuuacaaacuguauuguaaguaugaa

SEQ ID NO: 389980 - RNA, 64 nt, Human
cagaaaauugccaggggcuuauuucagaacaacuuccacuuacuuuccacuggcucucaaacuc

SEQ ID NO: 389981 - RNA, 64 nt, Human
ucauaaagguuuuugucuacugucauuuguucuuuccacuuauucuaagcauuuagaguaauag

SEQ ID NO: 389982 - RNA, 64 nt, Human; identical to SEQ ID NO: 164809

SEQ ID NO: 389983 - RNA, 64 nt, Human; identical to SEQ ID NO: 164810

SEQ ID NO: 389984 - RNA, 64 nt, Human; identical to SEQ ID NO: 164811

SEQ ID NO: 389985 - RNA, 64 nt, Human
uucuuguggaaucuuaguguuuuaacauuugaaauccacuuaaacugcaaauuguucuuuauau

SEQ ID NO: 389986 - RNA, 64 nt, Human
ucuauuggccaggcuggaguguaguggcaccaucuccacuuaccacaacuugugccuccugggu

SEQ ID NO: 389987 - RNA, 64 nt, Human
augugcccagaucuaacaaaguaggcuaagaccuuccacuuaaaagcauguuuaacuggaaguu

SEQ ID NO: 389988 - RNA, 64 nt, Human
auaugugauaacaucuuuauacuuugaaaaauguuccacuuacccuucagauauuuguuguaag

SEQ ID NO: 389989 - RNA, 64 nt, Human
gaaagagaaaauguuuguugaaaaaauagucuucuccacuuacuuagauaucugcagggguguc

SEQ ID NO: 389990 - RNA, 64 nt, Human
gagaggaaaaauuagucauaacccuuuuggguuauccacuuaaauuuagguauuuucauauuac

SEQ ID NO: 389991 - RNA, 64 nt, Human
uucuguaucuuucuuuuguaauuuguaacuuuuauccacuuagcacgaaugauucuauuaaaga

SEQ ID NO: 389992 - RNA, 64 nt, Human
gccuccauugauuuccgcucguguuuauaggauuuccacuuagccgugaucaguaguuaagcac

SEQ ID NO: 389993 - RNA, 64 nt, Human
uaaaccaauaaacauuuauacuagauuuuuuauuuccacuuaucauuaaugauuuaauguugga

SEQ ID NO: 389994 - RNA, 64 nt, Human
cccaucaauguguuuuaaagcuagcugucaggguuccacuuaauuuaaagcugggcagggagau

SEQ ID NO: 389995 - RNA, 64 nt, Human
uacagcacuugccuuagccuguuucacagacuuguccacuuaccuugucacuaauuuggggcuu

SEQ ID NO: 389996 - RNA, 64 nt, Human
uuaccuggcccuccucccuagggagcaagugccuuccacuuacuucccauccaggucucagagg

SEQ ID NO: 389997 - RNA, 64 nt, Human
accacgguguccacccggccccggcccguggaacuccacuuagagcguuuuucacgcguccuuc

SEQ ID NO: 389998 - RNA, 64 nt, Human
uuaagauuauagguauuagguuuguuuuuguuuuuccacuuaucuugaguucacuuugauguua

SEQ ID NO: 389999 - RNA, 64 nt, Human
uaaauaaucuauagggauucaaaaggugucacaguccacuuaauuagucaaauuagcaauggcu

SEQ ID NO: 390000 - RNA, 64 nt, Human; identical to SEQ ID NO: 164772

SEQ ID NO: 390001 - RNA, 64 nt, Human; identical to SEQ ID NO: 164773

SEQ ID NO: 390002 - RNA, 64 nt, Human; identical to SEQ ID NO: 164774

SEQ ID NO: 390003 - RNA, 64 nt, Human
gcuuuguuuuuggcauuucgagguuuacuuauuuuccacuuaucuuggaaucaugcaaaaaaaa

SEQ ID NO: 390004 - RNA, 64 nt, Human
cccaugaucccgggauuggcucucuuccccuacuuccacuuauucuugacucugagaacuuuug

SEQ ID NO: 390005 - RNA, 64 nt, Human
uuuuuccaaaaagaucuccagcuccacacauguuuccacuuaauaccagagacccccccccuuc

SEQ ID NO: 390006 - RNA, 64 nt, Human
acuuuguuuuuuucuuugggucuuguuuuuuuuuuccacuuagaaauugcauuuccugacagaa

SEQ ID NO: 390007 - RNA, 64 nt, Human
ccuaguggaugugaucuuggaacuuccaugauuauccacuuaaagaucaaaguauuauaugcug

SEQ ID NO: 390008 - RNA, 64 nt, Human
uugacucauuucaugcagguuuguguuuuaacauuccacuuaugccuugaaacaucauuucuug

SEQ ID NO: 390009 - RNA, 64 nt, Human
gaauucuaccuacacauaggaaggccaagguugauccacuuaaccuuguuauuguaauuuuaaa

SEQ ID NO: 390010 - RNA, 64 nt, Human
cauuuaaauaauuuggcuuuuugguauuauugauuccacuuauuuuguaaaaaugguuauggcu

SEQ ID NO: 390011 - RNA, 64 nt, Human
ccuccgucuguucaucaccuuccuccccaguguuuccacuuaucuuggauguuuuagauugaaa

SEQ ID NO: 390012 - RNA, 64 nt, Human
gguaccuagaggagcccaagccccagcuccauccuccacuuauucugccuguuucccccaaaga

SEQ ID NO: 390013 - RNA, 64 nt, Human
ccuugcauuuucuacugggagguucaucaaaccuuccacuuagcaauagcccugacucaggcag

SEQ ID NO: 390014 - RNA, 63 nt, Human
cacccaaagugugggauuaaaguacuguuuucuuuccacuuaaacugaugaguccccuggguc

SEQ ID NO: 390015 - RNA, 64 nt, Human
auaagaccacagggaagcaaagaaggaagagagcuccacuuacaaagaacugcuucuugcucuu

SEQ ID NO: 390016 - RNA, 64 nt, Human
gugaaguagaacaauugcuaaucauuuccuggguuccacuuacucuugauuuaaaaaaaaaaaa

SEQ ID NO: 390017 - RNA, 64 nt, Human
cuguuuuuccauccaaauauaagccccaggccauuccacuuagugucuuuucaaugauaggcaa

SEQ ID NO: 390018 - RNA, 64 nt, Human; identical to SEQ ID NO: 164778

SEQ ID NO: 390019 - RNA, 64 nt, Human; identical to SEQ ID NO: 164779

SEQ ID NO: 390020 - RNA, 64 nt, Human; identical to SEQ ID NO: 164780

SEQ ID NO: 390021 - RNA, 64 nt, Human
cgauugauuuuccucccuucucuagcccuggauguccacuuagggauaaaaagaauaugguuuu

SEQ ID NO: 390022 - RNA, 64 nt, Human
caguagacguggagccggcaccucuggucuggauuccacuuaaaaccaguugaguggucucaag

SEQ ID NO: 390023 - RNA, 64 nt, Human
caugguacgcccugcccaguuuccaguugcccuguccacuuacccuagguagccccccacccca

SEQ ID NO: 390024 - RNA, 64 nt, Human
ucagcaagccugcuuaccuccagagacacaccguuccacuuacaguaucuagcuuccucgacuc

SEQ ID NO: 390025 - RNA, 64 nt, Human
ucucacagaaggugcaguuuuauaacuaacuacguccacuuauauauauucacacucuacauau

SEQ ID NO: 390026 - RNA, 64 nt, Human
aucuuacugaauucuuaaacuuugaaccaguucuuccacuuacugacuuguuaccacugcugac

SEQ ID NO: 390027 - RNA, 64 nt, Human
acuugggcaacaaaugacccacuggaaaggcaaauccacuuaaaagaucucuguaucuuguucu

SEQ ID NO: 390028 - RNA, 64 nt, Human
aguggaaccaucuaacuggaacuuccucucuccuuccacuuauuuccucaaacuuguugcuuua

SEQ ID NO: 390029 - RNA, 64 nt, Human
ugucccacccuccaccuggggguggggugcagcuuccacuuacugauuagaagacaccacugcc

SEQ ID NO: 390030 - RNA, 64 nt, Human
gcauucuagaaauggcauuucuccuaauuaauuuuccacuuaauggaagauuaucaauuguccu

SEQ ID NO: 390031 - RNA, 64 nt, Human
gagauggaaucugccaguagauuugccuagccuguccacuuagcugaauaccaguuugaaggaa

SEQ ID NO: 390032 - RNA, 64 nt, Human
ccgcgccgcccccgcccgcccgcccacgcuguccuccacuuaggcuccuccacaaacgcuggcg

SEQ ID NO: 390033 - RNA, 64 nt, Human
cacagcaauaaaucuucaguucuuuguuuaugauuccacuuaacaaaaggccugcagaagugau

SEQ ID NO: 390034 - RNA, 64 nt, Human
aaaaugucugccucuccagacauuucuuaaugauuccacuuaauagacucuaugugugcugaau

SEQ ID NO: 390035 - RNA, 64 nt, Human
ggaauucaugaagcaagugguaugugacaaggacuccacuuauaaauauaacuguuuuuauguu

SEQ ID NO: 390036 - RNA, 64 nt, Human; identical to SEQ ID NO: 164784

SEQ ID NO: 390037 - RNA, 64 nt, Human; identical to SEQ ID NO: 164785

SEQ ID NO: 390038 - RNA, 64 nt, Human; identical to SEQ ID NO: 164786

SEQ ID NO: 390039 - RNA, 64 nt, Human
ccagcugcucccgaccaggagggggagagcagccuccacuuaccccaccccacccuugggcuaa

SEQ ID NO: 390040 - RNA, 64 nt, Human
ccucugaucucuucacacaucuccccuuagcaucuccacuuaccuacuuuuuuuuuuuuuuuug

SEQ ID NO: 390041 - RNA, 64 nt, Human
ggaagacccaaggcuggguggcguggcucgugaauccacuuagaauucuuggcuugugucgcau

SEQ ID NO: 390042 - RNA, 64 nt, Human
ccuuaacgagacucuguuucugggagucugauuuuccacuuacacauuucuuccaccuuuccug

SEQ ID NO: 390043 - RNA, 64 nt, Human
ucugcucuggucugggugcuggcuccaaucugcguccacuuaggaggcccaacugcccacccca

SEQ ID NO: 390044 - RNA, 64 nt, Human
agaauaugcaguuugaaaaagccaaacucuucucuccacuuagcuuuugauccccacuguuugc

SEQ ID NO: 390045 - RNA, 64 nt, Human
cagucucacagaaucaccccucuaccuuugauauuccacuuagcuguagaguccaucuguuugu

SEQ ID NO: 390046 - RNA, 64 nt, Human
acucauauucaguucugccuccaaaaugcauguguccacuuacaugagaugguaaauguuuaac

SEQ ID NO: 390047 - RNA, 64 nt, Human
gcgucccugauauagcagcacacauuuucacguuuccacuuaaaucguuuugcacaaagucuug

SEQ ID NO: 390048 - RNA, 64 nt, Human
uuugcugaguaugaaauaagaaaaguuagggcacuccacuuaugauaauccagcucuaagaaua

SEQ ID NO: 390049 - RNA, 64 nt, Human
agaaggacauuuuaacaaucgccuucaauuuuacuccacuuaauuaccgaaaacuuacuggaga

SEQ ID NO: 390050 - RNA, 64 nt, Human
cuggccccuuggaaaauucagauucagauaaaguuccacuuaggucuaauaaaaguacucaauu

SEQ ID NO: 390051 - RNA, 64 nt, Human
aagaagcagcauggucuccacagaaagugccuccuccacuuacgaagaacuggccagggccuac

SEQ ID NO: 390052 - RNA, 64 nt, Human
gaacccgggaugcagagcagcuuuugugcacgguuccacuuacuguaauuguuucugguucuuu

SEQ ID NO: 390053 - RNA, 64 nt, Human
ucacccuaugucuucucagguagcagggcgcguuuccacuuaaggugugucugucacgcaccuc

SEQ ID NO: 390054 - RNA, 64 nt, Human; identical to SEQ ID NO: 164790

SEQ ID NO: 390055 - RNA, 64 nt, Human; identical to SEQ ID NO: 164791

SEQ ID NO: 390056 - RNA, 64 nt, Human; identical to SEQ ID NO: 164792

SEQ ID NO: 390057 - RNA, 64 nt, Human
gugacagaggcagaaguuccuuuaaagcacaucuuccacuuaggaaaggaaggaaaucuuugua

SEQ ID NO: 390058 - RNA, 64 nt, Human
guuucauaaggaaaggaagaauugcacugagcauuccacuuaggaagaggauagagaaggaucu

SEQ ID NO: 390059 - RNA, 64 nt, Human
acagcagccaggggaccagaacuguguggggagguccacuuauccauaggguuggugcugaaau

SEQ ID NO: 390060 - RNA, 64 nt, Human
aauuuacccagucaucagauacugauuccuuuuguccacuuauauaguuauuuucucuuuaaaa

SEQ ID NO: 390061 - RNA, 64 nt, Human
ugaugacaaacagaguauauuaauuuccuuucccuccacuuaaaacuaaagccuguucuugcug

SEQ ID NO: 390062 - RNA, 64 nt, Human
uucacacuggcauuucuagguagugauauuuucuuccacuuaccugcugaagcacauuuaugca

SEQ ID NO: 390063 - RNA, 64 nt, Human
gugacaugaaguggauagauucucaauuguuauguccacuuauucacuagguaaauuuucaguu

SEQ ID NO: 390064 - RNA, 64 nt, Human
gguacuuguuaaagcuaaauuuauuuugcuucccuccacuuagaagugcugcacacuuuacagc

SEQ ID NO: 390065 - RNA, 64 nt, Human
gggacucacguagcuggagagcauuacagccucauccacuuaccuggagcugcucuccuguauu

SEQ ID NO: 390066 - RNA, 64 nt, Human
cucccucaagccagacucugccaaaaccaagauauccacuuaccugaguugaagaggggagcuc

SEQ ID NO: 390067 - RNA, 64 nt, Human
ucuucccucugaugcuggaaacugucgacggccauccacuuauuaauggacccauaacuaagga

SEQ ID NO: 390068 - RNA, 64 nt, Human
agggggaaaaaaagcuacuacugccuuuguaacuuccacuuagccuacuacagggcuaugcaca

SEQ ID NO: 390069 - RNA, 64 nt, Human; identical to SEQ ID NO: 164764

SEQ ID NO: 390070 - RNA, 64 nt, Human; identical to SEQ ID NO: 164765

SEQ ID NO: 390071 - RNA, 64 nt, Human; identical to SEQ ID NO: 164766

SEQ ID NO: 390072 - RNA, 64 nt, Human; identical to SEQ ID NO: 164767

SEQ ID NO: 390073 - RNA, 64 nt, Human; identical to SEQ ID NO: 164768

SEQ ID NO: 390074 - RNA, 64 nt, Human
acgccuguaaucccagcacuuugggaggccaaggugggcggaucgccugaggucaggaguucaa

SEQ ID NO: 390075 - RNA, 64 nt, Human
augccucuaaucucagcacuuugggaggccaaggugggcggaucacuugaggucuggaguuuga

SEQ ID NO: 390076 - RNA, 64 nt, Human
acaccuguaaucccaacaccuugggaggccaaggugggcggaucacuugaggucaggaguucaa

SEQ ID NO: 390077 - RNA, 64 nt, Human
acgccuguaaucccagcacuuugggaggccaaggugggcggaucacaaggucaggagaucgaga

SEQ ID NO: 390078 - RNA, 64 nt, Human
uacaagccccagaaugcugcccggccugcccugcugggcggacugucugugugucugucucucu

SEQ ID NO: 390079 - RNA, 64 nt, Human
acaccuguagucccagcugcucgggaagcugagaugggcggauugcuugagcccagguauucaa

SEQ ID NO: 390080 - RNA, 64 nt, Human
uccucuguggcucuaggacaucuguccaggaggcugggcggaggugggcaggaugugagaggug

SEQ ID NO: 390081 - RNA, 64 nt, Human
acgccuguaaucccagcacuuugggaggcccaggugggcggaucaccugagguuagaaguuuga

SEQ ID NO: 390082 - RNA, 64 nt, Human
ucaucgagaucugagcagcccuggcaccggguacugggcggagagcccccguggcauuuggcuu

SEQ ID NO: 390083 - RNA, 64 nt, Human
ucccuuguuucagugguccuacaaagguagauggugggcggacaccgaagucaacuugacugua

SEQ ID NO: 390084 - RNA, 64 nt, Human
augccuguaaucccagcacucugggaggcugaggugggcggaucacuugagcucaggaauucaa

SEQ ID NO: 390085 - RNA, 64 nt, Human
gagggcucuaggcugacaucgcuggcugccccuuugggcggagaggggaccucaccaguuuuuu

SEQ ID NO: 390086 - RNA, 64 nt, Human
aggccuguaaucccagcacuuugggaggccaagaugggcggaucaugaagucaggaguucgaga

SEQ ID NO: 390087 - RNA, 64 nt, Human
acgccuguaaucccagcacuuugggaggccaaggugggcggaucaccugaugucagggguucga

SEQ ID NO: 390088 - RNA, 64 nt, Human
caccgccgcuguuaccgccgcucagcgccccggcugggcggaggaggagacgcccaugccccuc

SEQ ID NO: 390089 - RNA, 64 nt, Human
aaagcugggcuucccagggugccuggcuggucccugccggcagcuuugugcucuccggcucuuu

SEQ ID NO: 390090 - RNA, 64 nt, Human
agcugugcugcagguucuacucuguuccuggcccugccggcagccacugacaagaggccagugu

SEQ ID NO: 390091 - RNA, 64 nt, Human
acgcccacaggcagggcacacugggcagccagccugccggcaggacuugccugccuccuccucu

SEQ ID NO: 390092 - RNA, 63 nt, Human
augaggaugcugugaucuaaaaauuaaaucucagugggcggagagaauuuguuucugaugccu

SEQ ID NO: 390093 - RNA, 64 nt, Human
guguuuguaaucccagcacuuugggaggccgaggugggcggaucacgaggucaggagauggaga

SEQ ID NO: 390094 - RNA, 64 nt, Human
auggguacauuaaaggaacaugcugcccagggccugggcggacagcucagugggcaggaugugu

SEQ ID NO: 390095 - RNA, 64 nt, Human
acaccuguaauccuagcacuuugggaggccgaggugggcggaucacuugaggucaggaguugga

SEQ ID NO: 390096 - RNA, 64 nt, Human
augccuauaauuccagcacuuugggaggcagaggugggcggaucacaaggucaagagaucaaga

SEQ ID NO: 390097 - RNA, 64 nt, Human
cagacaguaugauccagaaugucagguguggaguugggcggacaagagucugcugaugaggaca

SEQ ID NO: 390098 - RNA, 64 nt, Human
cugccugcagcuccaaucugauucugcuugggaaugggcggagcacgugggcugcuuaacugcu

SEQ ID NO: 390099 - RNA, 64 nt, Human
acaccuguaaucccagcacuuugggaggccgaggugggcggaucaccagaggucaagaguuuga

SEQ ID NO: 390100 - RNA, 64 nt, Human
augccuguaaucccagcacuuugggaggcugaugugggcggauaguugagcccaggaguucgag

SEQ ID NO: 390101 - RNA, 64 nt, Human
acaccuguaaucccagcacuuugggaguccaaggugggcggaucaccugaggucgggaguucga

SEQ ID NO: 390102 - RNA, 64 nt, Human
ggcgucuucaugagggaggggcccaaagcccuugugggcggaccuccccugagccugucugagg

SEQ ID NO: 390103 - RNA, 64 nt, Human
cuguaaucuuugggagcacuuugggaggccgaggugggcggaucacgaggucaggagaucgaga

SEQ ID NO: 390104 - RNA, 64 nt, Human
augccuauaaucccagcacuuugggaggccaaggugggcggaucaccugagcucaggaguuuga

SEQ ID NO: 390105 - RNA, 64 nt, Human
guggcuuuaaucccagcacuuugggaagccgaggugggcggaucaccugaggucaggaguucga

SEQ ID NO: 390106 - RNA, 64 nt, Human
acggcuguaauccuggcacuuugggaggccgaggugggcggaucacaaggucaagagaucgaga

SEQ ID NO: 390107 - RNA, 64 nt, Human
cacaguccuggacuccugccaccagcauccacacugccggcaggaugcagcgccguguccucuc

SEQ ID NO: 390108 - RNA, 64 nt, Human
cagcaguacgauuuugccgauggaauaacagauuugccggcaaucacugaaagagugcaaacau

SEQ ID NO: 390109 - RNA, 64 nt, Human
cagcaauacgauuuugccaauggaauaacagauuugccggcauucacugaaagagggcagauau

SEQ ID NO: 390110 - RNA, 64 nt, Human
ccccuccuugguugucagcucccuguccugugugugggcggaacauaguccagcugcucuauag

SEQ ID NO: 390111 - RNA, 64 nt, Human
accuuuuuugaccuuccacuagaccaugagcaccugggcggaaagccauauaucuuauuaagcu

SEQ ID NO: 390112 - RNA, 64 nt, Human
augccuguaaucccagcacuuugggaggccaaggugggcggaucacgaggucaggaguucgagg

SEQ ID NO: 390113 - RNA, 64 nt, Human
uaggagaaaacuuaauaauugugccuaaaaacuaugggcggauaguauaagacuauacuagaca

SEQ ID NO: 390114 - RNA, 64 nt, Human
accccuguaaucccagcacuuugugaggccaaggugggcggaucacuugaggccaggaauuuga

SEQ ID NO: 390115 - RNA, 64 nt, Human
acacuuguaaucccagcacuuugggaggccaaggugggcggaucaugaggucaggagaucgaga

SEQ ID NO: 390116 - RNA, 64 nt, Human
gcuauaguggcauauuuacaaaaguucuuauuacugggcggacugauaacauuuaaaaaauaau

SEQ ID NO: 390117 - RNA, 64 nt, Human
caucacuucaggguuuuaagagucagugcucaccugggcggagcugguaguacauuuugcuucu

SEQ ID NO: 390118 - RNA, 64 nt, Human
uaucuugaagucagccacacugggccuggagcccugggcggaguccccgggguuccccacacag

SEQ ID NO: 390119 - RNA, 59 nt, Human
caccuuacgugucugccuaagccuucaagugggcggagcugagggcagcagcuugacuu

SEQ ID NO: 390120 - RNA, 64 nt, Human
uccgcccuccucgggccgaggcccagcgggcagaugggcggacggcuguggaccguggacaggc

SEQ ID NO: 390121 - RNA, 64 nt, Human
agcaacacagccacuaaaacacaaaaagggggauugggcggaaagugagagccagcagcaaaaa

SEQ ID NO: 390122 - RNA, 64 nt, Human; identical to SEQ ID NO: 390085

SEQ ID NO: 390123 - RNA, 64 nt, Human
cgggagagcucucucagugugaacaugccuucugugggcggaaaucaggaagccaccagcuguu

SEQ ID NO: 390124 - RNA, 64 nt, Human
ucucauucacugucuuucuccaagaaaaguauuuugggcggacagucagaucaagcaguaaaau

SEQ ID NO: 390125 - RNA, 53 nt, Human
ucauccuuuuucaguacuaacgcugccggcacuuccgcaucugcccgugggcg

SEQ ID NO: 390126 - RNA, 64 nt, Human
acccgugagcggcugccaggggcucugggagggcugccggcagccccgucccccucccgcccuu

SEQ ID NO: 390127 - RNA, 64 nt, Human
ucggugggacccugguuauugauguggcccuggcugccggcacggcccguggcuguugacgcac

SEQ ID NO: 390128 - RNA, 64 nt, Human
augccuguaaucccagcacucugggaggcugaggugggcggauugcuugaggucgggaguuuga

SEQ ID NO: 390129 - RNA, 64 nt, Human
ccgugcccgcagggaggagaugaaguggcggcagugggcggacgacuggcuggugcaccugauc

SEQ ID NO: 390130 - RNA, 64 nt, Human
cugccuguaaucccagcacuuugggaggccgaggugggcggaucaccugaggucgggaguuuga

SEQ ID NO: 390131 - RNA, 64 nt, Human
ucuuacgaugaaggcugaugccgagagcgggcugugggcggagcugggucagucccguauuuau

SEQ ID NO: 390132 - RNA, 64 nt, Human
augccuguaaucccagcacuuugggaggccgaggugggcggaucacgaggucuggaguuugaga

SEQ ID NO: 390133 - RNA, 64 nt, Human
augccuguaaucccagcacuuugggaggccgaggugggcggaucacuugagguugggaguucau

SEQ ID NO: 390134 - RNA, 64 nt, Human
aggagggcagacuccaucguuuccucagggagacugggcggaggugggguuggucuggaagaag

SEQ ID NO: 390135 - RNA, 64 nt, Human
ugcgacugguaccgugagcgccugggaugagguuugggcggauuucggguuuccggagaggcag

SEQ ID NO: 390136 - RNA, 64 nt, Human
ucuguuugaauuaacauuucagcauggaacuaacugggcggaggaaggaucguuauacgucuuc

SEQ ID NO: 390137 - RNA, 64 nt, Human
acgccuguaaucccagcacuuugggagggauaggugggcggaucaccugaggucaggaguuuga

SEQ ID NO: 390138 - RNA, 64 nt, Human
cggcgcaugggcaagugcaagguguacugggaggugggcggacccccaggcuccgccagccccu

SEQ ID NO: 390139 - RNA, 64 nt, Human
aauggcuuugaguggcaucagcuucucacugcugugggcggaugucuuggauagaucacgggcu

SEQ ID NO: 390140 - RNA, 64 nt, Human
ccguucccacugcccugggcagccaucuugaauaugggcggaaguacuucccucaggccuaugc

SEQ ID NO: 390141 - RNA, 64 nt, Human
acgccuguaaucccagcacuuuggcaggccgagaugggcggaucuuuugaggucaggaguuuga

SEQ ID NO: 390142 - RNA, 64 nt, Human
gcuuggccguuuuguuauuuggcuuagucuacauugggcggaagucugugugcacagagugggu

SEQ ID NO: 390143 - RNA, 64 nt, Human
cuggugaggccugccucgucgguggccuggggucugccggcagguucuggcugcaccugaaggc

SEQ ID NO: 390144 - RNA, 64 nt, Human
ggaccggcagagcccaccugggggccccacccuuugccggcaaaugcagggcaugugcccaaga

SEQ ID NO: 390145 - RNA, 64 nt, Human
ucuuauucgagcuggcaguucuguucacguccauugccggcaauggaugucuuuguggugauga

SEQ ID NO: 390146 - RNA, 64 nt, Human
caggcaccaggcaggaggugccuuguaagcuaacugggcggagguggaggugcagugucaacug

SEQ ID NO: 390147 - RNA, 64 nt, Human
gcccuaaauaggaauucccuggauugugggcaagugggcggaaguuauucuggcagguacuggu

SEQ ID NO: 390148 - RNA, 64 nt, Human
caccuuguaaucccagcacuuugggaggccaaggugggcggaucacccugagguuaggaguuca

SEQ ID NO: 390149 - RNA, 64 nt, Human
agcaaaagcugacccgccuuuugcugcgucaggcugggcggauauuuucauaugaucccucccu

SEQ ID NO: 390150 - RNA, 64 nt, Human
ccaacgagauugcuggaaaccaagucaggccaggugggcggacaaaagggccaggugcggccug

SEQ ID NO: 390151 - RNA, 64 nt, Human
cagagugcagcugcagugaccaaacagaagggacugggcggaguucucuucagaccgauuccua

SEQ ID NO: 390152 - RNA, 64 nt, Human
acgccuguaaucccagcacuuugggaggccaaggugggcggaucacaaggucaggaguucgaga

SEQ ID NO: 390153 - RNA, 64 nt, Human
uguguguguguguguauguguguagcgggagaugugggcggagcgagagcaaaaggacugcggc

SEQ ID NO: 390154 - RNA, 64 nt, Human
uaaaaucaaauuugaggccaggugcaguggcucaugggcggaggagggcagauuacuugaggcu

SEQ ID NO: 390155 - RNA, 64 nt, Human
augccuguaaucccagcauuuugggaggccgaggugggcggaucacgaggucaggagaucgaga

SEQ ID NO: 390156 - RNA, 64 nt, Human
ugggcucauggagccccugcccagggcccucaggugggcggaaaguccauccccuccgcccuuc

SEQ ID NO: 390157 - RNA, 64 nt, Human
ugcugggccgcccggguuggaagggagggcagugugggcggagaucugcuccuucggugggggc

SEQ ID NO: 390158 - RNA, 64 nt, Human
agguaacagggaggugcgcggguggggggagggcugggcggaccaaaggccggagggguggggc

SEQ ID NO: 390159 - RNA, 64 nt, Human
gugcuggaaaagcagcgagccagcguugguguggugggcggagcucccagucgcauggagcggu

SEQ ID NO: 390160 - RNA, 64 nt, Human
ugucucucggcuguggcucugagugcaaauugcaugggcggaaaggcggggguggcugcucuuc

SEQ ID NO: 390161 - RNA, 64 nt, Human
cccagcagcugcgggaugagauugaggagcucaaugccgccauuaaguaggcaggguccaggcg

SEQ ID NO: 390162 - RNA, 64 nt, Human
caccucugccccagagcugccuccugccuggcacugccgccacacuccccuccugggauggggc

SEQ ID NO: 390163 - RNA, 64 nt, Human
ugugcagcaggccauggaguguagcgggcaucgcugccgccauuccugcagcaucaccauaagc

SEQ ID NO: 390164 - RNA, 64 nt, Human
ugauggcauucacggcuccaucccgcagggugccugggcggagaugucuuuuaggggcccaaga

SEQ ID NO: 390165 - RNA, 64 nt, Human
cuuaguacacgcuugcuguucugugcccaguaugugggcggaugacgcaagacuacaagauccu

SEQ ID NO: 390166 - RNA, 64 nt, Human
cgugcagggagcaggaaaucagugcuggggguggugggcggacaauaggaucacugccugccag

SEQ ID NO: 390167 - RNA, 64 nt, Human
acaacgugggaaggaaucucugccacgggaaaggugggcggaagcagcuggcagccuggggcgu

SEQ ID NO: 390168 - RNA, 64 nt, Human
acgccuguaaucucagcacauugggaggcugaggugggcggaucaccugaggucaggaguucaa

SEQ ID NO: 390169 - RNA, 64 nt, Human
cgaucauuccauugugcaauuuuacggggaugggugggcggagggacacaacaaaauuuaagaa

SEQ ID NO: 390170 - RNA, 64 nt, Human
acgccuguaaucccagcacuuugggaggcuaaggugggcggaucaccugaugucaggaguucaa

SEQ ID NO: 390171 - RNA, 64 nt, Human
acgccuguaaucccagcacuuugggaggccgaggugggcggaucacgagguagggagaucaaga

SEQ ID NO: 390172 - RNA, 64 nt, Human
uugguuacuacgguaggugccuggcggaagggagugggcggagauauguaaauagaaagugcgu

SEQ ID NO: 390173 - RNA, 64 nt, Human
uuggacaacucauucacuccaccuugucagcggaugggcggaauggucucuuuucggacuuuug

SEQ ID NO: 390174 - RNA, 64 nt, Human
aguuuugcaggaaucucucccguuacuugaaaccugggcggacagaugaggggaaggcugaggu

SEQ ID NO: 390175 - RNA, 64 nt, Human
cuuguggagcgccagcucugcccaaggcgccaccugggcggacagccaggagcucuccauggcc

SEQ ID NO: 390176 - RNA, 64 nt, Human
augccuguaaccccagcacuuugggaggccgaggugggcggaucaccugaagucaggaguucgg

SEQ ID NO: 390177 - RNA, 64 nt, Human
cccaagggcgcugggaaggggugaaguguguggcugggcggauucagcgaagucucaugggaag

SEQ ID NO: 390178 - RNA, 64 nt, Human; identical to SEQ ID NO: 390152

SEQ ID NO: 390179 - RNA, 64 nt, Human
cagcgcucugagggccuacaggagggguuaaagcugccggcacagaacuuaaggauggagccag

SEQ ID NO: 390180 - RNA, 64 nt, Human
cugcacaccgaaagcccaaauugggagcucugccugccggcaacuuugcugauggggugauugc

SEQ ID NO: 390181 - RNA, 64 nt, Human
gcugguucugcuccuggcccccuuguucagccccugccggcacacgggcggcucacccuggaca

SEQ ID NO: 390182 - RNA, 64 nt, Human
gggagacacaaguagaccucagguagaacgacacugggcggagccaccccagggccugcuccca

SEQ ID NO: 390183 - RNA, 64 nt, Human
guaaccauguucccccugcggcggcugucagaccugggcggaggccccuuccacgcggugccgg

SEQ ID NO: 390184 - RNA, 64 nt, Human
acgccugaaaucccagcacuuugggaggccaaggugggcggaucaugaggucaggagaucgaga

SEQ ID NO: 390185 - RNA, 64 nt, Human
cuggcccagggggugcuggugccuccccggggucugggcggagagaacaggaggaauggcuggg

SEQ ID NO: 390186 - RNA, 64 nt, Human
uccccuggggacacaagcaggcgccaaugguaucugggcggagcucacagaguucuuggaauaa

SEQ ID NO: 390187 - RNA, 64 nt, Human
ugauuuggaagccccaacaucuaaggauauacagugggcggauuccccuuaaguuccagguaug

SEQ ID NO: 390188 - RNA, 64 nt, Human
auuccccuagugugcccaagucagccucauauucugggcggacagcuugucuggacuucggagu

SEQ ID NO: 390189 - RNA, 64 nt, Human
acgccuguaaucccagcacuuugggaggcccaggugggcggaucacgaggucaggagaucgaga

SEQ ID NO: 390190 - RNA, 64 nt, Human
guccucgagggccguguacacucuccaggcaccaugggcggaggcgccagaggcugggaagaaa

SEQ ID NO: 390191 - RNA, 64 nt, Human
ugccuguaaucccuaacacuuugggaggccgaggugggcggaucacgaggucaggagaucaaga

SEQ ID NO: 390192 - RNA, 64 nt, Human
cuccucccuuauggggccggcacaaucagugggcugggcggagccgcagcugcaaacucugaca

SEQ ID NO: 390193 - RNA, 64 nt, Human
acaccuguaaucccagcacuuugggaggccaagaugggcggaucacgaggucaggaguucgaga

SEQ ID NO: 390194 - RNA, 64 nt, Human
ggcaggugcccaccuuucagggagucucccagcaugggcggaugccgggcaugagcugcuguaa

SEQ ID NO: 390195 - RNA, 64 nt, Human
cucccccacagagcccccaugacauagucugcucugggcggaagagcuuugcugccagccaggg

SEQ ID NO: 390196 - RNA, 64 nt, Human
uugccuguaaucccagcacuuugggaggccgaggugggcggaucacuugaggucgggaguucaa

SEQ ID NO: 390197 - RNA, 64 nt, Human
agcuacugagcugcuuugugaugcugaaggauacugccggcagcaggcagaggagggagggggc

SEQ ID NO: 390198 - RNA, 64 nt, Human
gcuagguuucuagagucuuccagcugcaucuucaugccggcagcauuuuggauuuugugcaauc

SEQ ID NO: 390199 - RNA, 64 nt, Human
ucuggaaaugucaccuuuucgggcgcagccaucuugccggcaccgccccgccccucuaguugua

SEQ ID NO: 390200 - RNA, 64 nt, Human
gccguggagucaccgucuacugccagccgggagcugggcggacaggaccgucccucgcaggguc

SEQ ID NO: 390201 - RNA, 64 nt, Human
aagccuguaaucccagcacuuugggaggccgaggugggcggaucacgaggucaggagauugaga

SEQ ID NO: 390202 - RNA, 64 nt, Human
uacacuuguaacccuagaacuugggaggcugaggugggcggauuacuugagcccaggaguucgg

SEQ ID NO: 390203 - RNA, 64 nt, Human
uugcacuaugagccuauagacuaucaguucccuuugggcggauuguuguuuaacuuguaaauga

SEQ ID NO: 390204 - RNA, 64 nt, Human
caucccuauaauccuacacuuugggaggccaaggugggcggaucacuugagcucaggaguuuaa

SEQ ID NO: 390205 - RNA, 64 nt, Human
cugggugaagucacagcucaaggaaagauaaagcugggcggaaggaggugugcguggcuucugg

SEQ ID NO: 390206 - RNA, 64 nt, Human
uuguuuuaaucuugcgaugugcuuugcuuguugcugggcggaugauguuuacuaacgaugaauu

SEQ ID NO: 390207 - RNA, 64 nt, Human
cacaugggaagagaagguacagaggcaaggaggaugccggcaaggccuucgccagcuagaagcg

SEQ ID NO: 390208 - RNA, 64 nt, Human
gcaccagcaggagguggacagagucucucauggaugccggcacaaaacugccuuaaaauauuca

SEQ ID NO: 390209 - RNA, 64 nt, Human
ccgacacccucuggcuugaaccauggcugagcagugccggcauacgcuuugcuggcaugcuugg

SEQ ID NO: 390210 - RNA, 64 nt, Human
gaauugaagaggagcugggcagcaaggcuaaguuugccggcaggaacuucagaaaccccccagc

SEQ ID NO: 390211 - RNA, 64 nt, Human
ccaagagacagcagacagccugccuccuggggcgugccggcaccugcuucagcuacugccuccu

SEQ ID NO: 390212 - RNA, 64 nt, Human
cucacaguucugcagucuguacaagaggguguggugccggcaucugcucuuggugagggccuca

SEQ ID NO: 390213 - RNA, 64 nt, Human
aaguagacuccugagcugcagagucccccccgguugccggcaagaccgcacaggcaaggccgau

SEQ ID NO: 390214 - RNA, 64 nt, Human
gugcuaugagggccgcgcccgucgcgccugccccugccggcacggcucccccuccuggaccagu

SEQ ID NO: 390215 - RNA, 64 nt, Human
agaugucugucucuugagaagagagaggcaugugugccggcauccuugauggguucaaagagaa

SEQ ID NO: 390216 - RNA, 64 nt, Human
aagguguuuccugcaccugcugucagccuggcuaugccgccaccggccccgcccaugaggacua

SEQ ID NO: 390217 - RNA, 64 nt, Human
acaggggagccccuguggccuggacucuaggggaugccgccaccagaaaccccucugccaaucc

SEQ ID NO: 390218 - RNA, 64 nt, Human
cauggaauuugggauugaaguuaaacuacaacagugccgccaacaccaagucuugcaggaaaaa

SEQ ID NO: 390219 - RNA, 64 nt, Human
gaaacaugucgugugucugcacgccccggcaaacugccgccacucguucugcugccugacuggu

SEQ ID NO: 390220 - RNA, 64 nt, Human
acacgugagcacuggcucccacggagggugcgccugccgccagcggcccagccuugcugcccug

SEQ ID NO: 390221 - RNA, 64 nt, Human
gccuuugcccgcgugucagacuccaucccuccucugccgccaccgcagcagccacaggcagagg

SEQ ID NO: 390222 - RNA, 64 nt, Human
aaaagcaggugagggugggcugggcugaggccauugccgccacuaucuguguaauaaaauccgu

SEQ ID NO: 390223 - RNA, 64 nt, Human
agcugcuacagagguguugggcaggccaugccugugccgccaucucucccuuccugccucauuu

SEQ ID NO: 390224 - RNA, 64 nt, Human
gcgucggucgucgcccccgucguucccucccggcugccgccagggggcggucggaccccgccuc

SEQ ID NO: 390225 - RNA, 64 nt, Human
agacccuccccugcccccuccacuccggggccugugccgccagaaccgggcucugcccccauac

SEQ ID NO: 390226 - RNA, 64 nt, Human
ucugugggucuguggcacagcaggaagagcccggugccgccagcaccuuguggaagaccacaca

SEQ ID NO: 390227 - RNA, 64 nt, Human
cucauccuccugaguagcugggguuacaggugugugccgccaugcccagucucuuuuuugguag

SEQ ID NO: 390228 - RNA, 64 nt, Human
cugccacaggccccuggaaaugcuaccuacguguugccgccacaggcuccugcucucuggccaa

SEQ ID NO: 390229 - RNA, 64 nt, Human
ccuguggaucccgucaggagggacuuaguggcucugccgccagugagacuucccgccggcagcu

SEQ ID NO: 390230 - RNA, 63 nt, Human; identical to SEQ ID NO: 101001

SEQ ID NO: 390231 - RNA, 64 nt, Human
ucaagacgacguggcacacauuccacgugggugcugccgccaccccagucggucguggcgugca

SEQ ID NO: 390232 - RNA, 59 nt, Human; identical to SEQ ID NO: 101003

SEQ ID NO: 390233 - RNA, 64 nt, Human
cugaagacgaugaccaguuuucaccggaagcagaugccgccaugagcgagaugacggggaauac

SEQ ID NO: 390234 - RNA, 64 nt, Human
cgccguuuccuucauuccucuuagauuccauaguugccgccaugaaaagacugcucuugagccc

SEQ ID NO: 390235 - RNA, 64 nt, Human
ucuccaguaggaaauugauuuugaaaaaguaggcugccgccaccacggcauuaugaucccuucc

SEQ ID NO: 390236 - RNA, 62 nt, Human; identical to SEQ ID NO: 101007

SEQ ID NO: 390237 - RNA, 64 nt, Human
ucuaguacuuuuugucauaaacaaacaggccaucugccgccaaauacauccacuccccaugcca

SEQ ID NO: 390238 - RNA, 56 nt, Human; identical to SEQ ID NO: 101009

SEQ ID NO: 390239 - RNA, 64 nt, Human
ugcagccuauaacaccuuucaccacugugaacagugccgccaguacauggacuucaccucugcc

SEQ ID NO: 390240 - RNA, 64 nt, Human
cgucauauaaagccauugcaaggacucuggaaacugccgccaaugaccaauuucugacuaacca

SEQ ID NO: 390241 - RNA, 64 nt, Human
auauuuauuuaucucucauucuguauagaauucuugccgccaucccaggucuagccuuaggagc

SEQ ID NO: 390242 - RNA, 64 nt, Human
cagcccugaccagccucccccaacagaacgccugugccgccacugucccaaggacuggacauuc

SEQ ID NO: 390243 - RNA, 64 nt, Human
gccaacggccgagcuugugauucugagcuugcaaugccgccaagcgccccccgccagcccgccc

SEQ ID NO: 390244 - RNA, 64 nt, Human
ccccuuccccagcccugcccccgcagacucccccugccgccaagacuuccaauaaaacgugcgu

SEQ ID NO: 390245 - RNA, 64 nt, Human
agacugagcccucccuuggcucacuguccccuucugccgccagcccuagccaguaagagguggg

SEQ ID NO: 390246 - RNA, 64 nt, Human
ucugcgccaggccacagcagccgcccgcugccgcugccgccagccacagccguuccugcuggcc

SEQ ID NO: 390247 - RNA, 64 nt, Human
uucaaggaaaggagaaauaucuucagaggaagacugccgccauacugaggcugagcacagauuu

SEQ ID NO: 390248 - RNA, 64 nt, Human
aaagcaggauguuggcgaacugacaaacucugucugccgccagaaggaaugcugggggcaguca

SEQ ID NO: 390249 - RNA, 64 nt, Human
gcacgggguucagcggcucccccagugcugcaggugccgccaggacgggccacgugggccccca

SEQ ID NO: 390250 - RNA, 64 nt, Human
ccuaacuggccuggcaccuggugccacgugcugcugccgccaggauaugcgccuucccacaggu

SEQ ID NO: 390251 - RNA, 64 nt, Human
cuguuguccgggcugugauccacccugacuaugaugccgccagccaugaccaggacaucaugcu

SEQ ID NO: 390252 - RNA, 64 nt, Human
ucuucuaagcaaagugccccugcaggccggguucugccgccaggacugcccccuucccagagcc

SEQ ID NO: 390253 - RNA, 64 nt, Human
uuucagaaguucagucuauuuuuucagcggauacugccgccaccaagaauccaaaaccuauuuu

SEQ ID NO: 390254 - RNA, 64 nt, Human
acgaagguggcagcugacagacgugggcucugcaugccgccagccuaguagaaaguucucguuc

SEQ ID NO: 390255 - RNA, 64 nt, Human
agggcuuuccaccugcauggaacaagggccugucugccgccagcgcuguggccacagccugcau

SEQ ID NO: 390256 - RNA, 64 nt, Human
ggccgccugagcagguguggugccgucccgccauugccgccaccuauuuauuguguuuuaucug

SEQ ID NO: 390257 - RNA, 64 nt, Human
ggagcccggcauauacccagggcaccccuacggcugccgccagucucaugcccaggugggugcu

SEQ ID NO: 390258 - RNA, 64 nt, Human
guacauuguguuuaagagaaaaaugaaacccacaugccgccauuuuccugaaucaaauucugca

SEQ ID NO: 390259 - RNA, 64 nt, Human
cccacaaucauggagcccugcgaccucccugcccugccgccacaugcaguggaggagaggccug

SEQ ID NO: 390260 - RNA, 64 nt, Human
cccacaaucauggagcccugcgaccuacccgcccugccgccacaugcaguggaggagaggccug

SEQ ID NO: 390261 - RNA, 64 nt, Human
caaaggacaggcgaggagcugugggcgcagggccugccgccacugccuacaucuucucucuucc

SEQ ID NO: 390262 - RNA, 64 nt, Human
acgaaaucagccacaacuaaaucgcucuggacggugccgccaggugacccuacauguccggagc

SEQ ID NO: 390263 - RNA, 64 nt, Human
caucguucccgcuucugcguuuuguuauuccuacugccgccauaggaauuauuucguuggcuga

SEQ ID NO: 390264 - RNA, 61 nt, Human
uuccuuuuuaaaguuggggagcggcagggggagggggaagugccacgcccuuguaguuuca

SEQ ID NO: 390265 - RNA, 61 nt, Human
uggcuuuuuccuaacuagucuuaccaaacuuagggggaaaccugugcuccauuaccacaug

SEQ ID NO: 390266 - RNA, 61 nt, Human
augaaaaaaaaaugggaagauuaaaaagcacagggggaagaagaagagauuucggaggcca

SEQ ID NO: 390267 - RNA, 61 nt, Human
uuuaucuuguugcaagagugggaccuacccaagggggaagacaagaugucauccuuggaaa

SEQ ID NO: 390268 - RNA, 61 nt, Human
aacagacucuguccagguagaaauggugaggagggggaagagaauuacauuuccaggguca

SEQ ID NO: 390269 - RNA, 61 nt, Human
ggagguaugucuagggggcagugucucuuccagggggaauucucagcucuugggaaccccc

SEQ ID NO: 390270 - RNA, 61 nt, Human
cggaggggaaagggagaucccacgugcaaguagggggaauaucucccccuuuucccucaua

SEQ ID NO: 390271 - RNA, 61 nt, Human
auuuccguauauuuuguuucgcgggggagugagggggaagaacacggaugaaaaugucagu

SEQ ID NO: 390272 - RNA, 61 nt, Human
ucuacaccccagggcccugugguggggcugcagggggaagcugugcaccugagaugaggcu

SEQ ID NO: 390273 - RNA, 61 nt, Human
gguggggaguggggccguaacuggguacaauagggggaaccucaccagaugcccaacccga

SEQ ID NO: 390274 - RNA, 64 nt, Human
cacaucacugcacuccagccugggcgacagagcgagacuccaucucaaaaaaaaaaaaaaacuc

SEQ ID NO: 390275 - RNA, 64 nt, Human
auuacagaucucaccuagaggguugauguuaugaagacuccaguggacuguacucacaaauuga

SEQ ID NO: 390276 - RNA, 64 nt, Human
uagccaagucuauaauauaauuaugaucaugaauagacuccagaauccacaaagagaagagggc

SEQ ID NO: 390277 - RNA, 64 nt, Human
ggugccacuguacuccagccugggugauaggaugagacuccaucucaggggaaaaaaaaaaauu

SEQ ID NO: 390278 - RNA, 61 nt, Human
uuauagauuuuagaguuagguaguacagguaagggggaaauuguaaagaauuagcagaauu

SEQ ID NO: 390279 - RNA, 61 nt, Human
uucaaaacaaaaagagauugggggaguggggagggggaagaagaacaggaagaaaaaaagu

SEQ ID NO: 390280 - RNA, 61 nt, Human
gcucuaacaguccagauguacacccagccucagggggaaggcagcucucuccagacagagu

SEQ ID NO: 390281 - RNA, 61 nt, Human
guagcauuuuuuaaauugugcaugagcucaaagggggaacaaaauagauacacccaucaug

SEQ ID NO: 390282 - RNA, 61 nt, Human
aacaucuuccaccgcaacagcuugccucuagagggggaauuguucauccauuuguccucca

SEQ ID NO: 390283 - RNA, 61 nt, Human
uuugacaaucauaguauguuuuauuuuccugagggggaauaacuuauaaugcuguuuaguu

SEQ ID NO: 390284 - RNA, 61 nt, Human
aucacccccauugucccuagggugacaggccagggggaaaaauuauccccggacaacauga

SEQ ID NO: 390285 - RNA, 61 nt, Human
gacucugaagguguccccacgaaggccagaaagggggaaagggaccugggcgaggagagga

SEQ ID NO: 390286 - RNA, 61 nt, Human
ucaacaaaucaagcaaacuggaaucaaggggagggggaagggaaugaaauggaaagggagg

SEQ ID NO: 390287 - RNA, 61 nt, Human
cugucuugggcuuaaauugacugaagacuuuagggggaaagaauaguaaaugcauguaaac

SEQ ID NO: 390288 - RNA, 61 nt, Human
gaaguccagguaccauccccccuuagcauacagggggaagggccugagaggaauguaagga

SEQ ID NO: 390289 - RNA, 61 nt, Human
cagacauugcugugcaauuguuggggaggguagggggaaaggcgagaggagauacuuauug

SEQ ID NO: 390290 - RNA, 61 nt, Human
uagccuuccugcuucccuaaggacuuaguggagggggaaaguuguuuuugguacuacuugg

SEQ ID NO: 390291 - RNA, 61 nt, Human
auaccaguugacuaauauuacaagcucuuguagggggaaaaaggagcuuauuaaaguuguu

SEQ ID NO: 390292 - RNA, 61 nt, Human
uuggcucaucaagaacacaguccccauguugagggggaaaaugcaguaauguuugugggag

SEQ ID NO: 390293 - RNA, 61 nt, Human
acuggacaucuuggucuuuuucucaggccugagggggaaccauuuuuggugugauaaauac

SEQ ID NO: 390294 - RNA, 64 nt, Human
acgggagcagggagaggcucuagaacaagguuucacaaccgagaugccuuugacauuuugggcu

SEQ ID NO: 390295 - RNA, 64 nt, Human
uugucuugaaaaauaaguagcauugcugaaacacacaaccgaauucucuacgauggccauuugc

SEQ ID NO: 390296 - RNA, 64 nt, Human
ugggcuguuuuaccuuucuuuuuuaggucaaucaagacuccaaaauagugauuccuaaccuuuu

SEQ ID NO: 390297 - RNA, 61 nt, Human
gugacauucccuucacuccuuuuccuacccaagggggaagacuggagccuaagcugccugc

SEQ ID NO: 390298 - RNA, 61 nt, Human
aacauuuuuuuaaauacacccgaggagcccaagggggaagggcaaugccuacccccagcgu

SEQ ID NO: 390299 - RNA, 61 nt, Human
aggcccaguggaacagucacccuucugggcaagggggaacaaaucacaccucugggcuuca

SEQ ID NO: 390300 - RNA, 61 nt, Human
uguaacaaaagggcuuauucuuccucaaguaagggggaacuccugcuuugggcugggacau

SEQ ID NO: 390301 - RNA, 61 nt, Human
uuccuucacugccccacuucuggcaugggacagggggaaguucagaagguguguccuugaa

SEQ ID NO: 390302 - RNA, 61 nt, Human
ugcccccucugcccugcgggucacaggagggagggggaaggcagggagggccugggcccca

SEQ ID NO: 390303 - RNA, 61 nt, Human
uccacaauuucagaaugcacgccagagcugaagggggaaacuugguaacuugcccauuauu

SEQ ID NO: 390304 - RNA, 61 nt, Human
cuuucauuuuccuugaauguacauaggaacaagggggaaagucucuuacugaagugccuga

SEQ ID NO: 390305 - RNA, 61 nt, Human
guugucuucuugggucuuugggguugaagggagggggaaggcaggccagaagggaauggag

SEQ ID NO: 390306 - RNA, 61 nt, Human
agagagagagagagauccucagaguggaaggagggggaagcagcaggacacauuggcaagu

SEQ ID NO: 390307 - RNA, 61 nt, Human
aaugccaaggauaaagcuggcugcuuccaggagggggaagaggaguggggagugggcggug

SEQ ID NO: 390308 - RNA, 61 nt, Human
gcaugcccgaccccgggacaggacuaacccaagggggaaagcuaguguugaugaaacuuuu

SEQ ID NO: 390309 - RNA, 61 nt, Human
uuuguuguuuguugaaagaaaaugaaggaacagggggaaaaaaggugcaaaaugcuaaauu

SEQ ID NO: 390310 - RNA, 61 nt, Human
aagcaagcaaagauguaaguuuuuuuaauuuagggggaaaaaaugggagccuugcucucca

SEQ ID NO: 390311 - RNA, 61 nt, Human
gggugugcgugugugcaugugcugguguguaagggggaaagggucuuuccugguuuuauuu

SEQ ID NO: 390312 - RNA, 61 nt, Human
cgccgccgcaguguuugaccucuagcggugaagggggaaggggaagaggaaaggagagaag

SEQ ID NO: 390313 - RNA, 64 nt, Human
uuguuaaacaugaggaaaugccucuuucuuccccagacuccaggaugacuuugcacguuaauuu

SEQ ID NO: 390314 - RNA, 64 nt, Human
aaaccaaggucaugagcauucgugcuaagauaacagacuccagcuccugguccacccggcaugu

SEQ ID NO: 390315 - RNA, 64 nt, Human
ucuauuucauuucuuaguuaugcaucucauaaucagacuccaugcuuuuuaaagacagagauaa

SEQ ID NO: 390316 - RNA, 61 nt, Human
ggaaaugacauguuaaugcuuugcucccugaagggggaaaaaaucuguccuuuaacaagcu

SEQ ID NO: 390317 - RNA, 61 nt, Human
guccagaugcauuacugcuaucuuaguuuaaagggggaaagaaaagggaagaagaaaggaa

SEQ ID NO: 390318 - RNA, 61 nt, Human
cucuugacuagucaaggacugggaacgugccagggggaacaaaguaagcuugaugggcugg

SEQ ID NO: 390319 - RNA, 61 nt, Human
aaaaacauuuaaucugcaucuguuuuagaaaagggggaaaugaagcaacuugucuaaaaau

SEQ ID NO: 390320 - RNA, 61 nt, Human
aagagccaugggacacagaguugacccagccagggggaaagcccagcucucuuuaaaccag

SEQ ID NO: 390321 - RNA, 61 nt, Human
aaccuucaucuaguuaaccaaucgcaaagcaagggggaaggcugcaaaguaugccagggga

SEQ ID NO: 390322 - RNA, 61 nt, Human
cguaauucaauuucucacaauagacagaaacagggggaaaauguuugcccuguucaaagua

SEQ ID NO: 390323 - RNA, 61 nt, Human
agcuuuugaagaaaggccagugauccagcaaagggggaaaaauaugcauuucaccccacau

SEQ ID NO: 390324 - RNA, 61 nt, Human
uaauguuaauagcuuuucuggaucucuuaguagggggaaaguagaaaaucgaguagaauuu

SEQ ID NO: 390325 - RNA, 61 nt, Human
guggucggggagcugggguacagguuuggggagggggaagagaaauuuuuauuuuugaacc

SEQ ID NO: 390326 - RNA, 61 nt, Human
aaccaaaaccagcugggcugagcucagauccagggggaaaugcuggaagucaauaaaacug

SEQ ID NO: 390327 - RNA, 61 nt, Human
uccaaaaugaugccuugggguggggagugguagggggaagagcucccacccuaaggggcac

SEQ ID NO: 390328 - RNA, 61 nt, Human
aaugagacuagaaagagauacacuguaaaggagggggaagggaaggguugaccaguugggu

SEQ ID NO: 390329 - RNA, 61 nt, Human
uccagugucaacugccaugugcucugcuucaagggggaacuagccuuuugugaauuuuuug

SEQ ID NO: 390330 - RNA, 61 nt, Human
agggugaccccucaucugaaaggcccaaaccagggggaagcaccagccucagugcagcccc

SEQ ID NO: 390331 - RNA, 61 nt, Human
uucuuauuacuaugaaauggauggaauaaggagggggaacacaacuagcaagaacaaaaca

SEQ ID NO: 390332 - RNA, 64 nt, Human
aauuaauguagcugcuagcuauuggccucccaaaagacuccaguacuauuuuaauuuguauuga

SEQ ID NO: 390333 - RNA, 64 nt, Human
ccaggcuggaccgcccuaccaggauccgcuucucagacuccaauggcaguguccuguuugagca

SEQ ID NO: 390334 - RNA, 64 nt, Human
uggggacuaagggcuuccagagaguggcuggaagagacuccaggccccuggggagacuguacug

SEQ ID NO: 390335 - RNA, 61 nt, Human
auuacaaguugcaugacugaaaaaaugcuuuagggggaaaaucagucauaucuuuaacacc

SEQ ID NO: 390336 - RNA, 61 nt, Human
cuauuaccacugaugcacaggcgccaggccaagggggaaaugcucuuugaaagcuccaauu

SEQ ID NO: 390337 - RNA, 61 nt, Human
agcaauguuuauaaaguuuuaugguauaacuagggggaaaugagcugcacaaaccucaaug

SEQ ID NO: 390338 - RNA, 61 nt, Human
acaaaaaguauacguuaauauaccguccucaagggggaacuggcacugugaccuuagcauu

SEQ ID NO: 390339 - RNA, 61 nt, Human
gcaugggggauuuuuaacauauuugaaacucagggggaacaugauuaagaacacaaacugg

SEQ ID NO: 390340 - RNA, 61 nt, Human
cuuaagcauaagcuacaguauguaaacuaaaagggggaauauaugcaaugguuggcauuua

SEQ ID NO: 390341 - RNA, 61 nt, Human
cucuuucaaagguagccaucauggaucugguagggggaaaauguguauuuuauuacaucuu

SEQ ID NO: 390342 - RNA, 61 nt, Human
aggaauguugcacaaggguugugaaugugaaagggggaauggaggaauggaaauaaaauug

SEQ ID NO: 390343 - RNA, 61 nt, Human
gagaagguagacaacacuucaguuuuucuugagggggaaaaaauguacccgcuaaccuuuu

SEQ ID NO: 390344 - RNA, 61 nt, Human
uccauucuagcuuuggcacaaagcagcagaaagggggaaaagccaauagaaauuuccuuag

SEQ ID NO: 390345 - RNA, 61 nt, Human
cguggggagagggaagugaauugcagaggggagggggaaaagagagagagagagagagaga

SEQ ID NO: 390346 - RNA, 61 nt, Human
cugaccgcagucccgggaguaagcauuucaaagggggaaggcaguguggucccuacccugu

SEQ ID NO: 390347 - RNA, 61 nt, Human
caggagagaggacccauuagcuggcagacccagggggaagaaaggagggcugugaggagau

SEQ ID NO: 390348 - RNA, 61 nt, Human
acuauguggacacuuguuucauuggaagguuagggggaauaauuucucaucacuaggaaua

SEQ ID NO: 390349 - RNA, 61 nt, Human
ugugaucauuaugaaucccuucagucacauuagggggaaaguaguuggcuauaaguacguc

SEQ ID NO: 390350 - RNA, 61 nt, Human
ggauuauauuuuuauuguauucauuuaucuuagggggaacauuguaaagaaacaaaaaggu

SEQ ID NO: 390351 - RNA, 64 nt, Human
agaucgugcuacuacugccuggguggcaagggugagacuccaucucaaaaaagaaacaaaaaaa

SEQ ID NO: 390352 - RNA, 64 nt, Human
auguggauauuuauauauuacauauauaaccaccagacuccauuuuauauauuagcauuuuccu

SEQ ID NO: 390353 - RNA, 64 nt, Human
ucuguauauaaaagguuuucuccccuccaaagaaagacuccaguacaagauaccuggucccagg

SEQ ID NO: 390354 - RNA, 61 nt, Human
uuuguagucugcucaaucucuguugcaccugagggggaaaaaacaguucaacugcuuacuc

SEQ ID NO: 390355 - RNA, 61 nt, Human
guaauuccagaaaaaaaaagggaauaagcaaagggggaagaauugaaagagagagagaaga

SEQ ID NO: 390356 - RNA, 61 nt, Human
acuuaagagccaaaaagcuuuucaucucuccagggggaaaacugucuaguucccuucugug

SEQ ID NO: 390357 - RNA, 61 nt, Human
cagacagggccagggagaaauuagccagugcagggggaaaauugccucugaauaaugaaug

SEQ ID NO: 390358 - RNA, 61 nt, Human
acuuugauaggauguggauuaagaacuagggagggggaaagaaggaugggacuauuacauc

SEQ ID NO: 390359 - RNA, 61 nt, Human
gccccuguaccaccccugcuguugccugggcagggggaagggggggcacggugccuguaau

SEQ ID NO: 390360 - RNA, 61 nt, Human
caaccucccugucccuugcccgcccccaggaagggggaaauggggcauuuggggcccagac

SEQ ID NO: 390361 - RNA, 61 nt, Human
uaggucuauccacgcacgguucccaaccccaagggggaauuaggggauuagauuaagagua

SEQ ID NO: 390362 - RNA, 61 nt, Human
acagccuuuauuccaggcccagggauguaggagggggaaggaggaaacaggaagcccagag

SEQ ID NO: 390363 - RNA, 61 nt, Human
ggggaccauggucugggagcuguucuggggcagggggaauaugcaagcuaaagccccucua

SEQ ID NO: 390364 - RNA, 61 nt, Human
aaauggauuuaggaagacuguuuuucuuuuaagggggaaacaagguagagaaaaggacgaa

SEQ ID NO: 390365 - RNA, 61 nt, Human
gugacucauguguccucuuagaaucccaaauagggggaaaaaguuuuggugguuuuuguuu

SEQ ID NO: 390366 - RNA, 61 nt, Human
ugaaacuaaaaaggcaauuuuggaaaaagagagggggaaaaguagaucacuuaucuuagca

SEQ ID NO: 390367 - RNA, 61 nt, Human
aaaugguuaucucauuggggaagaaaaggggagggggaaggcaagaaucacugaaaaaucu

SEQ ID NO: 390368 - RNA, 61 nt, Human
aaguuaauuaucccuguccuuucacauuuauagggggaaaauaaauacuuuaauguuguuu

SEQ ID NO: 390369 - RNA, 61 nt, Human
guccuaaugccuuauuucaaaacaauuccucagggggaacagcuuuggcuucaucuuucuc

SEQ ID NO: 390370 - RNA, 64 nt, Human
agaagggccacagagaacucauguguucagcucaagacuccacaggaauucaacccccagaaag

SEQ ID NO: 390371 - RNA, 64 nt, Human
ugccuugacuucccccaccuccuccucaaacaagagacuccacugcauguuccaagacaguaug

SEQ ID NO: 390372 - RNA, 64 nt, Human
agugaaguguuuagaaacugcugcaagacaaacaagacuccagugggguggucaguaggagagc

SEQ ID NO: 390373 - RNA, 53 nt, Human
uaaaaccaccaacauuauaaaacagggggaaagcagacugacccucuuuuuaa

SEQ ID NO: 390374 - RNA, 61 nt, Human
gaugaggauaaaagaaaguuucagauucaacagggggaagaaaauggagauuuaauccuaa

SEQ ID NO: 390375 - RNA, 61 nt, Human
gagcauauauucaguuggugcauguuguggaagggggaauuggaaauuaaaugaaaaccua

SEQ ID NO: 390376 - RNA, 61 nt, Human
gaagguaacuguuauaacccacaccaucagcagggggaaagccaagcugagaauaaaccca

SEQ ID NO: 390377 - RNA, 61 nt, Human
aaaaagggaucaccauucaauuugaguuuccagggggaagugcauguauaaugaaaugaua

SEQ ID NO: 390378 - RNA, 61 nt, Human
gccuggugccggugaggggggcgugcgcuagagggggaaaggggcccccggccaccugucc

SEQ ID NO: 390379 - RNA, 61 nt, Human
acccacaguuuuaguuggugcugauggagggagggggaagucgaaggaugcucuuucccuu

SEQ ID NO: 390380 - RNA, 61 nt, Human
aaacagcacugagauuuauuuuaacaaaaaaagggggaaaagggaaaacagugauuucuaa

SEQ ID NO: 390381 - RNA, 61 nt, Human
uaaaucuaaguaacgaauugaaaguuuaaagagggggaagaguugguuugcaaaggaaaag

SEQ ID NO: 390382 - RNA, 61 nt, Human
uucacagaugcacuuacauauuuugaccacaagggggaaauuuugugcauuauuauuguag

SEQ ID NO: 390383 - RNA, 61 nt, Human
uaaacuguaugucuuauaagaaaacauguaaagggggaauauauggggggagugagcucuc

SEQ ID NO: 390384 - RNA, 61 nt, Human
uauguaaaauagggcacuguuuaauuaugaaagggggaaaaucauuccaaauaagaguuua

SEQ ID NO: 390385 - RNA, 61 nt, Human
aaggacuuggugcaguucgugugaaucucacagggggaaugcaacugguuccugugaucuc

SEQ ID NO: 390386 - RNA, 61 nt, Human
aauugucccugcuccccuucuugaucucuucagggggaauacuaggcaguuuuguaucuuc

SEQ ID NO: 390387 - RNA, 61 nt, Human
uuaaagaaaaauaugauacucucagauuuuaagggggaaaacuguucucuuuaaaauauuu

SEQ ID NO: 390388 - RNA, 61 nt, Human
agacuguggacucaauccagagccagauaguagggggaagccacagcauuuccuuuuaacu

SEQ ID NO: 390389 - RNA, 64 nt, Human
ucaugccacugugcuccagccugguggcacagugagacuccaccucaaaaaaaaaaaaaaaucc

SEQ ID NO: 390390 - RNA, 64 nt, Human
caucugcuuauucuaaugcuagucaccaagagcuagacuccaucuuuccaauaaaaaugagccc

SEQ ID NO: 390391 - RNA, 64 nt, Human
auggcagauguuuugggggaacgccgggacugagagacuccacgcaggcgaauucccguuuggg

SEQ ID NO: 390392 - RNA, 61 nt, Human
auaaagaauugugaacuucuugaaucuagggagggggaauguagugaagggauguaucaag

SEQ ID NO: 390393 - RNA, 61 nt, Human
gauuucacguuaucagugcaguucgguucucagggggaaagguaagcccauagcuaacucc

SEQ ID NO: 390394 - RNA, 61 nt, Human
aauguaaaaaggccacucccagguaaaauccagggggaagagucaucuaaguuuaccaugc

SEQ ID NO: 390395 - RNA, 61 nt, Human
uuccacugcucgccuugguuugggagcagggagggggaaguccuagcccagauggaccaag

SEQ ID NO: 390396 - RNA, 61 nt, Human
ugaaaaugcaugcauggugaauuaaaauaaaagggggaacaaugcacaaauaauaagcguu

SEQ ID NO: 390397 - RNA, 61 nt, Human
ggacaggggauuacaccaucucuguucaaagagggggaaaugugccuaugccuuaagucaa

SEQ ID NO: 390398 - RNA, 61 nt, Human
aucaucacaugcagccaaacuuggccucugaagggggaagguagugggaauagguggugag

SEQ ID NO: 390399 - RNA, 61 nt, Human
ugucagaaggagacagaaugagagagaaaagagggggaagaugguucaaagauacaagaaa

SEQ ID NO: 390400 - RNA, 61 nt, Human
gacuucagaaaccagagcacaagccccacagagggggaacagccagcaccgcucuagcugg

SEQ ID NO: 390401 - RNA, 61 nt, Human
auuucaaucuuguccagcuuuucuuuccuuaagggggaaacuauauuuucuguuuuauaga

SEQ ID NO: 390402 - RNA, 61 nt, Human
agacacccaaaaaaaaaaaugugcuccgacuagggggaaaacaguaguuccgauuuuuucc

SEQ ID NO: 390403 - RNA, 61 nt, Human
uuaacaugcaauaaaagguaccauucaaagcagggggaaagguaggaagaagagguaauuu

SEQ ID NO: 390404 - RNA, 61 nt, Human
agcuucaauaucaaacugguuaggaaagcccagggggaagggagggggcaggggaggaggc

SEQ ID NO: 390405 - RNA, 61 nt, Human
guuggacuucucuucaggaagaaaaagcaucagggggaaauggaaugccccugccccagga

SEQ ID NO: 390406 - RNA, 61 nt, Human
ugaaucacauguuaaaccucaguuuuauaagagggggaaaaaaccgucucuacauaguaaa

SEQ ID NO: 390407 - RNA, 61 nt, Human
ccugagcccgagccaggagcacuagagagggagggggaagagcagaaguuagagaaaaaaa

SEQ ID NO: 390408 - RNA, 64 nt, Human
cuuguggccaccucagacaucacuucucuuuggaagacuccauuaaauauuucucugugagaaa

SEQ ID NO: 390409 - RNA, 64 nt, Human
cgcgccaccgcacuccagccugggcaacagagcgagacuccaucucaaacaaaaacaagaacaa

SEQ ID NO: 390410 - RNA, 64 nt, Human
cgugccauugcacuccagccugggugacaaagcgagacuccaucucaaaaaaaaaaaaaaaaaa

SEQ ID NO: 390411 - RNA, 61 nt, Human
uggccauuucaccuuauuacugauuggguagagggggaaaaggagaaugaugaugauaguu

SEQ ID NO: 390412 - RNA, 64 nt, Human
auccccgcugcagaaggacucaaccacuccccuaagacuccagcuucauagacuccucuguauc

SEQ ID NO: 390413 - RNA, 64 nt, Human
ggccuagaaagacuccuaaaguauaggauuacaaagacuccaggaagcguaagaaagagauugu

SEQ ID NO: 390414 - RNA, 64 nt, Human
ugugccacuguauuccagacugggugacagagugagacuccaucucaaaaaaaaaaaaguugac

SEQ ID NO: 390415 - RNA, 64 nt, Human
cuccaaccugcacuccagccugggcaacagagcgagacuccaucucuaaauaaauaaauaaaua

SEQ ID NO: 390416 - RNA, 64 nt, Human
uuuuuaagcacugauaaauuaaaaaaaaaaaauuagacuccaccuuaaguaguaaaguauaaca

SEQ ID NO: 390417 - RNA, 64 nt, Human
ugcaccacggcacgcuagccugggugacacagcaagacuccaucucaaaaaaaaaaaaaaauua

SEQ ID NO: 390418 - RNA, 64 nt, Human
ucaccgccaccagggugucccgccagacagggagagacuccagccuucugaggccauccugagg

SEQ ID NO: 390419 - RNA, 64 nt, Human
aaggguggugggaggagauaagagauacaaacugagacuccagccucuccuccuggggccaccc

SEQ ID NO: 390420 - RNA, 64 nt, Human
gcucggaaaauucaugcagauauggauggaaagaagacuccaagaggaaaacgaggauggaaaa

SEQ ID NO: 390421 - RNA, 64 nt, Human
ugccggggugcugccugggcaggccauguuggggagacuccagcaccguggggcugcccuccuc

SEQ ID NO: 390422 - RNA, 64 nt, Human
uuggcaccgugcuguguggaaacccuccccucugagacuccacugagacguggcugagugaaau

SEQ ID NO: 390423 - RNA, 64 nt, Human
ucaugaguucaagaccagccugggcaacauagcgagacuccaucucuauaaauaaaaaaaaagg

SEQ ID NO: 390424 - RNA, 64 nt, Human
agcuuacucuuccuccaccugcugagccugugccagacuccauugcucaaaucguuaggguugc

SEQ ID NO: 390425 - RNA, 64 nt, Human
uuucccaccuggggccgccgucuuccguccuaggagacuccaggacacccucugaguccuugac

SEQ ID NO: 390426 - RNA, 64 nt, Human
cugacuauggggaaaucuuuuagcugcuguuuuuagacuccaaggaguggaaauuauguggaag

SEQ ID NO: 390427 - RNA, 64 nt, Human
ugugccacuguacuccagccugggugacagagugagacuccaucucaauaaaauuaauaauaau

SEQ ID NO: 390428 - RNA, 64 nt, Human
guccugauauuuuuuucauucauugacuuugagaagacuccaccugugcuuggaauuccauggg

SEQ ID NO: 390429 - RNA, 64 nt, Human
cacgccacugcauuccagccugggcgacagagcaagacuccaucucaaaaauaaaauaaaaaaa

SEQ ID NO: 390430 - RNA, 64 nt, Human
ucauaccacugcacuccagccuggcgacagagcaagacuccaucucaaaaauaaauaaauaaau

SEQ ID NO: 390431 - RNA, 61 nt, Human
ccggggcuuguauauagauuauaaauauauaagggggaaaggggugggcggggagggguuc

SEQ ID NO: 390432 - RNA, 61 nt, Human
cccagagaugccguggauacgccagggucccagggggaaucuccccaagcucacacucucu

SEQ ID NO: 390433 - RNA, 61 nt, Human
cucuugauaccccccucugucuugugaaggcagggggaaggugggguccuggagcagacca

SEQ ID NO: 390434 - RNA, 61 nt, Human
agggcuaggcgagagccugggguggggcgggagggggaacaguauggaaaagacuggaagg

SEQ ID NO: 390435 - RNA, 61 nt, Human
ccaaaaugcccucaagguguaaaauaauccgagggggaauauuugcugggcgucaggaaag

SEQ ID NO: 390436 - RNA, 61 nt, Human
cuguaauggaauuuugccucuaauaacauaaagggggaagaaacauaaagugguucucuua

SEQ ID NO: 390437 - RNA, 61 nt, Human
uuggcuccuuuucuccauuuccuuugggggaagggggaauugaccaugcuuaagugcaucc

SEQ ID NO: 390438 - RNA, 61 nt, Human
auuuuuuaaaaaacuacuauuugaaaauuggagggggaagaaugggaagggaguuauugcc

SEQ ID NO: 390439 - RNA, 61 nt, Human
ucgugagcugaagugcagaugaccacauucaagggggaaccuucugccccagcuuugcaug

SEQ ID NO: 390440 - RNA, 61 nt, Human
gaucuguagagguaugaaaauacagccccaaagggggaauuugucauggggaagggccagc

SEQ ID NO: 390441 - RNA, 61 nt, Human
ucagucuaacaagucauuaggucacucgggaagggggaaaaaguuuaaaaugggggaaaaa

SEQ ID NO: 390442 - RNA, 61 nt, Human
gcugucucccacguguguauuaugguucaccagggggaacuggcaaaagugugugugggga

SEQ ID NO: 390443 - RNA, 61 nt, Human
ugcauauccuauugccagcauaaggaugaggagggggaaagggucuuaauucuauguacag

SEQ ID NO: 390444 - RNA, 61 nt, Human
ucuaaaauuuaaugcaugauagacacauaugagggggaauagucuagauggcuccucucag

SEQ ID NO: 390445 - RNA, 61 nt, Human
uuuauuuuuaccacaauaguuugaagcaguaagggggaaggagggugauuauauugcuuug

SEQ ID NO: 390446 - RNA, 61 nt, Human
auucuggaaugaucagcagauauagucuacaagggggaagguacuaagccccaggaccaau

SEQ ID NO: 390447 - RNA, 64 nt, Human
ggccaaagcuagcccaaggcuggggaaggggaggagacuccaggucagaaugugaggucucagu

SEQ ID NO: 390448 - RNA, 64 nt, Human
aacuaaacucuuaccauauguuugguaagacuccagacuccagcuaacagucccuauggaaaga

SEQ ID NO: 390449 - RNA, 64 nt, Human
uaugccauugcacuccagccugggugacaaagcaagacuccaucucaaaaaaaaaaaaaaauca

SEQ ID NO: 390450 - RNA, 61 nt, Human
aggggaagagugucacacuccuggcuaucucagggggaauggggaaaagaaucuuucaagg

SEQ ID NO: 390451 - RNA, 61 nt, Human
ucgcacuuggacucugaggguuggguguggaagggggaaaaggagauggagaccugcuccc

SEQ ID NO: 390452 - RNA, 61 nt, Human
uuuuagaaucacugcccuguugagagaaauuagggggaaaugauuacauuuagaagcugcu

SEQ ID NO: 390453 - RNA, 61 nt, Human
ccuuucuuugugcuggugucugggaccaaaaagggggaauaugggagggcagaguggggag

SEQ ID NO: 390454 - RNA, 61 nt, Human
ucgcuccucgcuccucgccccuaggacgccaagggggaaaggagagggcggaaaaggacca

SEQ ID NO: 390455 - RNA, 61 nt, Human
ggauuacaggcgugagccaccgcacccagccagggggaauguucuauaaccagcucuguaa

SEQ ID NO: 390456 - RNA, 61 nt, Human
uaacaugcaccuugcucccaauggugcuuggagggggaagagaucccaggaggugcagugg

SEQ ID NO: 390457 - RNA, 61 nt, Human
gaggcaggagcugggagggguggggagggggagggggaagugucugccuuuauguccuuuc

SEQ ID NO: 390458 - RNA, 61 nt, Human
aaugauaauaguauuuugaauggaagauaugagggggaaaaaaacuuauguguagucaauc

SEQ ID NO: 390459 - RNA, 61 nt, Human
guuuuggguguacucuaggggccagguugggagggggaaggugagggcuucggguggugcu

SEQ ID NO: 390460 - RNA, 61 nt, Human
ucagacgucuuggggacguuccuaaacacugagggggaagacagccaauagcacccauuaa

SEQ ID NO: 390461 - RNA, 61 nt, Human
uuauagcauauauuuuauuuuuaaaaaaacuagggggaaaauagcaaccuuccauuugguu

SEQ ID NO: 390462 - RNA, 61 nt, Human
auccugauauuauaagcuuaaaacuaucuugagggggaaaugacuucuuuucuccuucugu

SEQ ID NO: 390463 - RNA, 61 nt, Human
gagugugggugcucauagaguugcccagcccagggggaaagggagcaagaguuguccagag

SEQ ID NO: 390464 - RNA, 61 nt, Human
gugggcauggugagguuucaucugauugagaagggggaauccuguguggaauguugaacuu

SEQ ID NO: 390465 - RNA, 61 nt, Human
auuauguguuaggcaaauauaacuuaaguggagggggaaguuuaugaauauaauauagcuc

SEQ ID NO: 390466 - RNA, 64 nt, Human
agaucgugucacugcacuccagccugggugacagagacuccauuuaaaaaaaaaaaaaaaaaau

SEQ ID NO: 390467 - RNA, 64 nt, Human
cgcauuacugcacuccagccuggguaacagagugagacuccaucucaaaaaaaaaaaaaauaga

SEQ ID NO: 390468 - RNA, 50 nt, Human
ugccaccaucccaccucugaagacuccagugacugcugccuccccccaca

SEQ ID NO: 390469 - RNA, 61 nt, Human
cagaagcccaugggcagggcuggggggacgaagggggaacccggagcaccuccacuucuag

SEQ ID NO: 390470 - RNA, 61 nt, Human
ccugccuugcuguuggucaugugggucuuccagggggaaggccaaggggagucaccuuccc

SEQ ID NO: 390471 - RNA, 61 nt, Human
aggaugcuguguugucaacaaaccaagcaucagggggaagaagcagagagaugcggccaag

SEQ ID NO: 390472 - RNA, 61 nt, Human
cucaucaccaaggugacagaggacacaggggagggggaaaacccacacacacuccuuggaa

SEQ ID NO: 390473 - RNA, 61 nt, Human
aggagaaaaacuugaaauguugacuuaagugagggggaaauaaaacccagagagagagaga

SEQ ID NO: 390474 - RNA, 61 nt, Human
ugagggcagagaggauggcauguuucaggggagggggaagccuuccucucaauuuguuguc

SEQ ID NO: 390475 - RNA, 61 nt, Human
aucuuguucauugccuuuuucaccuaagcauagggggaaaaacucucagggcccuauuaag

SEQ ID NO: 390476 - RNA, 61 nt, Human
aaaucugucucccacgucugccauggcaucaagggggaagaguagauggugcuugagaaug

SEQ ID NO: 390477 - RNA, 61 nt, Human
gaccagagggagcgggagggcagaggugaggagggggaagauguuucugggccuaccaagg

SEQ ID NO: 390478 - RNA, 61 nt, Human
ucugugaugcucaugucugugucauggcaugagggggaauugacgagugcuugcuuagcau

SEQ ID NO: 390479 - RNA, 61 nt, Human
caggcaagaauuaucaaucaaugcuaaagcuagggggaaauuucgcuuaggagcaggauau

SEQ ID NO: 390480 - RNA, 61 nt, Human
cucaaaaauuauaucuuacaauuucuuauuuagggggaaauuauuugaaucagauucuauu

SEQ ID NO: 390481 - RNA, 61 nt, Human
auaauuuacacugugauuuaucuuuuugcugagggggaaaaaauguaaauguucugaaaau

SEQ ID NO: 390482 - RNA, 61 nt, Human
uguuuaguaaauaaaauuaaugcauuucuagagggggaauaucugccauccagugguggaa

SEQ ID NO: 390483 - RNA, 61 nt, Human
caggcaccucuuuuaaacaggcaaaacaggaagggggaaaaggugggauucaugucgaggc

SEQ ID NO: 390484 - RNA, 61 nt, Human
cucccuucuuuuacaguagcacaaacaaaguagggggaaaagaauaagcaauaauuauguu

SEQ ID NO: 390485 - RNA, 64 nt, Human
cuccucucccuccuccuaccuuccgcccucaaguagacuccagugucuguuauucccuucuuug

SEQ ID NO: 390486 - RNA, 64 nt, Human
cgcgccacugcccuccagccugggcaacagagcaagacuccaucucaaaaaauaaauagauaaa

SEQ ID NO: 390487 - RNA, 64 nt, Human
auguuuuuucauuaugaaaacuuauuuuagcuuuagacuccaguguguucagugaauaaguaga

SEQ ID NO: 390488 - RNA, 61 nt, Human
guauuuaggcuauuucugaagggcacagggaagggggaacaaauaucuucacuucaguuuu

SEQ ID NO: 390489 - RNA, 61 nt, Human
uauuaaaacuauguauauuaaucauuggagaagggggaagaggaaaugaaaauagcacaaa

SEQ ID NO: 390490 - RNA, 61 nt, Human
guaaacaugugggaaaaaauauuacauuuuaagggggaaaaaaaaacccaccauucucuuc

SEQ ID NO: 390491 - RNA, 61 nt, Human
auuuaguuuucuggguacugaaguggaugggagggggaaugauuaaagaacaaauuauaaa

SEQ ID NO: 390492 - RNA, 61 nt, Human
uguggggaaguguagcaaggacggcugguggagggggaaggagggugcgaggugucugucu

SEQ ID NO: 390493 - RNA, 61 nt, Human
ggggcaagcaagcugcccugugcucugagugagggggaagguagccccuuuuuccaaagau

SEQ ID NO: 390494 - RNA, 61 nt, Human
aacccauaugcuucuaaccacuaaugauguaagggggaaaauucucuucuucagaauuucu

SEQ ID NO: 390495 - RNA, 61 nt, Human
cuucccaccauacugcucauaauaacauuuuagggggaaaggggagggaauguuuaaaaag

SEQ ID NO: 390496 - RNA, 61 nt, Human
cuccucaacccagcagcaauuugaggggaugagggggaagaggagcugccuuuuggaggcc

SEQ ID NO: 390497 - RNA, 61 nt, Human
uuuaaggcauguucacacuugcugggcagggagggggaagagagggagaaggaaggguuag

SEQ ID NO: 390498 - RNA, 61 nt, Human
aucuccuagaacaaaaccgcccugacuuuacagggggaacacucaugcugagcugagaaag

SEQ ID NO: 390499 - RNA, 61 nt, Human
gaaauacaacacauguuaaaucuuaaguacaagggggaaaaaauaaaucaguuauugaaac

SEQ ID NO: 390500 - RNA, 61 nt, Human
cuccuucucugaaugacucaggguacccuauagggggaagagcaagucaaaugagcauagu

SEQ ID NO: 390501 - RNA, 61 nt, Human
cugccucaucuggagggaaaccaaaauugggagggggaagaggaccccugauguuuugcug

SEQ ID NO: 390502 - RNA, 61 nt, Human
uugcuuccuauuauaaaauggcguggggggaagggggaaggauggagaugggaggagaggg

SEQ ID NO: 390503 - RNA, 61 nt, Human
auuacaggggccauggauguggacaccauggagggggaaguggagcguuuucaguggaguu

SEQ ID NO: 390504 - RNA, 64 nt, Human
uauaagaaccaagguagcuuagaacguccuggacagacuccacucaucaugcuguguggcacaa

SEQ ID NO: 390505 - RNA, 64 nt, Human
acaggaguucaagaccagcgugggcaauauagcaagacuccaccccuccacaccccaaaaaagu

SEQ ID NO: 390506 - RNA, 64 nt, Human
cugauguagaagugaacaacuugguaacaucccuagacuccacucaugaacgcagaauuauuac

SEQ ID NO: 390507 - RNA, 61 nt, Human
cuuccucuggaagcaucccccguucugggcaagggggaagggcuccuuuaaggggugugcu

SEQ ID NO: 390508 - RNA, 61 nt, Human
ugagaaaucagagucuacguaucauuuacuuagggggaaacuuaggcuggagacagggagg

SEQ ID NO: 390509 - RNA, 61 nt, Human
ucuucuucacaagucaccaagagaggacaugagggggaaaguccuuuuugcccuucuccaa

SEQ ID NO: 390510 - RNA, 61 nt, Human
auuauauacuccuuaauacuagauugaucuaagggggaaagaucauuauuuaaccuaguuc

SEQ ID NO: 390511 - RNA, 61 nt, Human
gguaccugcuguguaagagagcggacuguggagggggaaugagaacaagccagacuuggug

SEQ ID NO: 390512 - RNA, 61 nt, Human
agagucugggcuuggggucuuuaaaaccagcagggggaaaugauaaaaagagagcugcuuu

SEQ ID NO: 390513 - RNA, 61 nt, Human
aaaacugaugagcugucaacugucaaaaaucagggggaagggggaagcauuaguuuggaug

SEQ ID NO: 390514 - RNA, 61 nt, Human
augagcugucaacugucaaaaaucagggggaagggggaagcauuaguuuggauguaggccc

SEQ ID NO: 390515 - RNA, 61 nt, Human
cauguaauucuagcugaacucaggaaaaagaagggggaaaggacucuguccccuuggggcu

SEQ ID NO: 390516 - RNA, 61 nt, Human
cuuucaugaggcuucuagccaaagaugauaaagggggaaaugguuuuuagugcguauauua

SEQ ID NO: 390517 - RNA, 61 nt, Human
gaugccugggggucaaguauuuuaagauaagagggggaaaaacacauaaagucaaacaaau

SEQ ID NO: 390518 - RNA, 61 nt, Human
uuucuaaguguuaauguucuauaugguaauuagggggaagaauuauuucuuuucacaaguu

SEQ ID NO: 390519 - RNA, 61 nt, Human
uugggaugcaaggaggugaugaaaaggagacagggggaaaaauaauccauagucagcagaa

SEQ ID NO: 390520 - RNA, 50 nt, Human
augcaguuaaaguuucauaaagggggaaaaaaaagaucaauaccauugcu

SEQ ID NO: 390521 - RNA, 61 nt, Human
gcaagagacagaagaccguggagaaaucagaagggggaacagucaguuuaguuaaggaugg

SEQ ID NO: 390522 - RNA, 61 nt, Human
ugucuguuuauuggaaacuuguacuucaaguagggggaauccuaauucuaauaacuccuua

SEQ ID NO: 390523 - RNA, 64 nt, Human
uuggaagcaagagauacgcagcucagcaugacagagacuccauuccagguggaaaaagcacaug

SEQ ID NO: 390524 - RNA, 64 nt, Human
cagcaggcucuaggggaauccugugguuauguagagacuccauguccuggugugaugagcagga

SEQ ID NO: 390525 - RNA, 64 nt, Human
caugccacugcacucuagccugggugacagagcgagacuccaucucaaaaaaaaaaaaaaaaaa

SEQ ID NO: 390526 - RNA, 61 nt, Human
augauugaagagguggaacggaaaugaccuuagggggaaaaaaaaggaccaaagaagucug

SEQ ID NO: 390527 - RNA, 61 nt, Human
acuggagcaagaaagagaucucauaggacggagggggaaaugguuucccuccaagcuuggg

SEQ ID NO: 390528 - RNA, 61 nt, Human
gacaauuuuuuuuaaaagaauagaaggcaggagggggaauucgacauuguugaagacauaa

SEQ ID NO: 390529 - RNA, 61 nt, Human
gguucugcccugucccauuccaccccaccccagggggaacaguagcuucaccuuguuauuc

SEQ ID NO: 390530 - RNA, 61 nt, Human
ccuuuuuuaguucuucaaagauagggagggaagggggaacaugagccuuuguugcuaucaa

SEQ ID NO: 390531 - RNA, 61 nt, Human
aguaauugugcuggcacuuaggagagagaggagggggaauaauaguggguuaaaaagcuuu

SEQ ID NO: 390532 - RNA, 61 nt, Human
ccaaucacacugugcccugcaccucccaccaagggggaaccccagcagcuggggcuuuucg

SEQ ID NO: 390533 - RNA, 61 nt, Human
aaauguugaacucuaagauauauuaacuucuagggggaaaaauccauuauuuuagcuaugc

SEQ ID NO: 390534 - RNA, 61 nt, Human
aaguagaaaaguggcauuuucuugauuggaaagggggaaggaucuuauugcacuugggcug

SEQ ID NO: 390535 - RNA, 61 nt, Human
aauggcaagcauagucgccugguuacggcccagggggaagaugccaagggcaccccuuaau

SEQ ID NO: 390536 - RNA, 57 nt, Human
acagcugguuacauugcuaggcgagauagggggaagacagauauggguguuuuuaau

SEQ ID NO: 390537 - RNA, 61 nt, Human
auuauguggaaaacuuaugcugauuuauuuaagggggaaaaagugucaacucuuuguuauu

SEQ ID NO: 390538 - RNA, 61 nt, Human
cauuuguggaaaccagaugugcuggcagcuuagggggaaguggcaguguggggugggggau

SEQ ID NO: 390539 - RNA, 61 nt, Human
cucuacccauccuucucuggggcucccagggagggggaagagaaguccucagcuggggcuc

SEQ ID NO: 390540 - RNA, 61 nt, Human
gugugacuucucccgaucccugagggcggugagggggaauaucaauaauuaaagucugugg

SEQ ID NO: 390541 - RNA, 61 nt, Human
aagcaagguagucaucuuucugcugguugugagggggaaucugaaaauggaguuuuagagg

SEQ ID NO: 390542 - RNA, 64 nt, Human
aucucgccacugcacuccagcuugggcaauagcaagacuccaucucaaaauaaaauaaaauaaa

SEQ ID NO: 390543 - RNA, 64 nt, Human
ugccauugcacuccagccugggcgugacagagugagacuccaucugauuguaaagcaucuagua

SEQ ID NO: 390544 - RNA, 62 nt, Human
ccaguccagggcugucuaagaaauaaagaucaucagacuccaccuggagccccugucugucu

SEQ ID NO: 390545 - RNA, 61 nt, Human
cgcaaccccuccaguacugcacaaauuccuaagggggaagaggagaggguauggggcggca

SEQ ID NO: 390546 - RNA, 61 nt, Human
uucuaucugguuggaugguggcuuuaggggaagggggaaagguguaggcugggggauugag

SEQ ID NO: 390547 - RNA, 61 nt, Human
uuugauccuuccccucuuuuggccaaauccuagggggaagaaauccuaguaugccaaaaau

SEQ ID NO: 390548 - RNA, 61 nt, Human
gcuacuaaggccuacaccucuccccacgcagagggggaauucugcccuggugaaacagaca

SEQ ID NO: 390549 - RNA, 61 nt, Human
augcagggcuuaaaaggccagcgucuguuugagggggaaugaccucuaacaucuguaaaau

SEQ ID NO: 390550 - RNA, 61 nt, Human
guuuuuuuucuuauuuucccaaagaaagaaaagggggaaaauauauuuguauguuuagacc

SEQ ID NO: 390551 - RNA, 61 nt, Human
guacaggaaaaaccgagauaggggaggggggagggggaagcaaaggggggaggucaaaucc

SEQ ID NO: 390552 - RNA, 61 nt, Human
uaaggaaagauaggaccaaauauguaagugcagggggaaacacauuucagaccaggaaucc

SEQ ID NO: 390553 - RNA, 61 nt, Human
cacagcaagggugggagacagcugggcacaaagggggaauuccguucagcaugggcucuaa

SEQ ID NO: 390554 - RNA, 61 nt, Human
cccccaacccuaucccuccuaccucacccgcagggggaaggagggaggcugacaagccuug

SEQ ID NO: 390555 - RNA, 61 nt, Human
guggugugagcaguuggacucaguuuggacaagggggaaagggggacuucccugggaaggu

SEQ ID NO: 390556 - RNA, 50 nt, Human
uaaaguccgcauggaauuagagggggaaagucugcacuggaaccugcugu

SEQ ID NO: 390557 - RNA, 61 nt, Human
uuuuccuauuaauucuuaaguacucugcauaagggggaaaagcuuccagaaagcagccaug

SEQ ID NO: 390558 - RNA, 61 nt, Human
agcucuggggggaggggguuuccacaaugugagggggaaccaagaaaauuuuaaauacagu

SEQ ID NO: 390559 - RNA, 61 nt, Human
caccugugcuguuguggaaggcgugccguugagggggaaaacgaagcccaguauuugcuac

SEQ ID NO: 390560 - RNA, 61 nt, Human
uuuucucuaaaugaaguggcaucaaggacucagggggaaagaaaucaggggacauguuaua

SEQ ID NO: 390561 - RNA, 64 nt, Human
ucaagaagaggauuagcucugauuuugaggugggagacuccauggccucagaggaaguaaagca

SEQ ID NO: 390562 - RNA, 64 nt, Human
auaggcuacaucccaggguuucuggcugcaagugagacuccacccuccccaccuggcucauuuc

SEQ ID NO: 390563 - RNA, 64 nt, Human
cgcaccacugcacuccagccugggugacagagugagacuccaacucaaaaaaaaaaaaaaaaaa

SEQ ID NO: 390564 - RNA, 61 nt, Human
cuaaaauuauuggauuuguauuuuguuauuaagggggaaaaugugauuugugccugaucuu

SEQ ID NO: 390565 - RNA, 61 nt, Human
ccuggaauuguacauggauaucuuuaucccuagggggaaaucaaggagcugggcaccccua

SEQ ID NO: 390566 - RNA, 61 nt, Human
auucccaccccacauaggaguagccugacugagggggaaggggugggagagaagauacaga

SEQ ID NO: 390567 - RNA, 61 nt, Human
aaaguagauucaugcccacugcccuugggugagggggaagaauacggggguucccagaagc

SEQ ID NO: 390568 - RNA, 61 nt, Human
gggguggggguaguuuaagccuauggggcccagggggaaaggccaaacagaaacccaacua

SEQ ID NO: 390569 - RNA, 61 nt, Human
accaggaacagacccugcgcaggagagucagagggggaagaguuagaaugggucaguggcu

SEQ ID NO: 390570 - RNA, 61 nt, Human
uuucuguuuuauuugcuaauuaaaaauggggagggggaaagucgucccuacuuccuccucc

SEQ ID NO: 390571 - RNA, 61 nt, Human
ccaaugaugugacccucaaucccacauacgcagggggaaggcuuggaguagacaaaaggaa

SEQ ID NO: 390572 - RNA, 61 nt, Human
gguaauuggggaggggagagaggugggggcaagggggaaaugcccccccaucuccuuggag

SEQ ID NO: 390573 - RNA, 61 nt, Human
gggccucagaacucuugcucuuccugggcugagggggaaugaguguucuugccauuugcca

SEQ ID NO: 390574 - RNA, 61 nt, Human
auuuguguguggagugggaugugggggguggagggggaaugacagauuucuggaaugcaau

SEQ ID NO: 390575 - RNA, 61 nt, Human
cuuggucucgcugucgguuaacuguaaaguuagggggaagaaagaaaaaaaauuaaaaggg

SEQ ID NO: 390576 - RNA, 61 nt, Human
acgaaaugacaagcugccccugcccugaauuagggggaaacauuccaggccaacucuagcu

SEQ ID NO: 390577 - RNA, 61 nt, Human
ugccuguaaucccagugcuuugaagggccaaagggggaagaucucuugagguaagaauuug

SEQ ID NO: 390578 - RNA, 61 nt, Human
aacuugaaaggaggguaaaaagacuaaaaugagggggaacagaguucacuguacaaauuug

SEQ ID NO: 390579 - RNA, 61 nt, Human
uuaaugcagaaaaggaagauguucuguagcaagggggaauauuuuaaaaauaaaccagauc

SEQ ID NO: 390580 - RNA, 64 nt, Human
ugucuugcuccuggggagaaagaggggccugaugagacuccacucaggugcacacaucaccagg

SEQ ID NO: 390581 - RNA, 64 nt, Human
cgcuccacugcacuccagcccaggugacagugugagacuccaucucaaaaaaaaaaauaagagg

SEQ ID NO: 390582 - RNA, 64 nt, Human
auuuuuugaucuuuuccuuuugcuuuuugaauagagacuccauggaguuggucauggaaugggc

SEQ ID NO: 390583 - RNA, 61 nt, Human
uuuguuucuguuccuaauuccuuuaaaaaauagggggaauaguauuuuagaauuuuaugca

SEQ ID NO: 390584 - RNA, 61 nt, Human
uguuucuguguaacaugauuuguuuaguaauagggggaaaaugucaauuaguagcuuacca

SEQ ID NO: 390585 - RNA, 61 nt, Human
agcuagaauacauaguuuucaccuuaaaagaagggggaaaaucauaaauacaaugaaucaa

SEQ ID NO: 390586 - RNA, 61 nt, Human
uuucuauaccauuucaaaacacauuacacuaagggggaaccaagacuaguuucuucagggc

SEQ ID NO: 390587 - RNA, 61 nt, Human
ccaaaguuguuccucccuuuucggaggaucuagggggaaagaggagcauucaucacaaguu

SEQ ID NO: 390588 - RNA, 61 nt, Human
aagaaacgaaaaagaaagcccaaggcaaagaagggggaaggaaaacaaacuucgccacucu

SEQ ID NO: 390589 - RNA, 61 nt, Human
guuuuagacucugaugaggaagaaaauggccagggggaaggaaaggugagugggaaggagc

SEQ ID NO: 390590 - RNA, 61 nt, Human
ucuucauauauauuaucaucccuaauguagcagggggaaguauuuaauugcccaugauaug

SEQ ID NO: 390591 - RNA, 61 nt, Human
caaaaacagaucugguaggggcggggaaaugagggggaagaaacaaaaacgugauggugcc

SEQ ID NO: 390592 - RNA, 61 nt, Human
gcgcggagggggcgggggugggguggaggggagggggaagagguacaggcgguguccgccu

SEQ ID NO: 390593 - RNA, 61 nt, Human
guaucucacauacucacacggggcaggggggagggggaaacggggaacuauagcaauauuu

SEQ ID NO: 390594 - RNA, 61 nt, Human
auggagagagaggucagacuggcuaggcugcagggggaauuaccuuuggaaggagcuauau

SEQ ID NO: 390595 - RNA, 61 nt, Human
cacucagggcaguguguuggaaauuccacugagggggaaaucaggugcugcggccgccugg

SEQ ID NO: 390596 - RNA, 61 nt, Human
ccaagucuccagagagaaaucaggccugaugagggggaauuccuggaaccuggaccccagc

SEQ ID NO: 390597 - RNA, 61 nt, Human
aucgugcccuccaccuacgagccccaccaggagggggaauucauccuccgggucuucucug

SEQ ID NO: 390598 - RNA, 61 nt, Human
aucuauggaagucgugucuuacuccaggugaagggggaaaaaaaaagccuauacuuuggca

SEQ ID NO: 390599 - RNA, 64 nt, Human
caucagcccucauuucuuauaauacccugaucccagacuccaaagcccugguccuuuccugaug

SEQ ID NO: 390600 - RNA, 64 nt, Human
cgcaccaguacacuccagccuggguaacagagcuagacuccaucucaaaaaaaaaaaaaaaaaa

SEQ ID NO: 390601 - RNA, 64 nt, Human
gggagccggguuucccacagggagcugagucuacagacuccagggcaaucaaaggucaccaccc

SEQ ID NO: 390602 - RNA, 61 nt, Human
aaccuucaucauguaaagcaaucgcaaagcaagggggaaguuugcagagcaugccagggga

SEQ ID NO: 390603 - RNA, 61 nt, Human
cacuguuuucucuuucaguuaguugacucaaagggggaaaacuaaagaaugcaaaacuuuu

SEQ ID NO: 390604 - RNA, 61 nt, Human
cuuaauuuagugggcuuuggcagggcgggggagggggaacguucauuaaucucugaggaaa

SEQ ID NO: 390605 - RNA, 61 nt, Human
aggaaagaccacaugaaggcccaggagugggagggggaauagccaucgacaaacuaagggg

SEQ ID NO: 390606 - RNA, 61 nt, Human
gggcgcugcuagugcgcaccgugcugggggaagggggaaccccuccccacccucuuucccc

SEQ ID NO: 390607 - RNA, 61 nt, Human
uguucucaaguugggggauggguaauaaaggagggggaauucccuugaacaagaagaacug

SEQ ID NO: 390608 - RNA, 61 nt, Human
gccucugucaguuucuuuuccauguaugaggagggggaaauuuguauauuagaaacuuauu

SEQ ID NO: 390609 - RNA, 61 nt, Human
gauucccuggaaaauugaaaaugugaauccuagggggaaauuggggauugugucuuucccu

SEQ ID NO: 390610 - RNA, 61 nt, Human
ccauuaacuacccccagcccgaggcagggugagggggaagggcugucaguuacauuaaggu

SEQ ID NO: 390611 - RNA, 61 nt, Human
cucuggccucucuguggggaaaggggacugcagggggaagagccgggaagggacagucagg

SEQ ID NO: 390612 - RNA, 61 nt, Human
uuaguaguaaagucugcaagggcauaaauuuagggggaaaaagugucccaguucucuccua

SEQ ID NO: 390613 - RNA, 61 nt, Human
cccaggagcuuaguaaaaauugcauaagaccagggggaagagugucagcguggggugggaa

SEQ ID NO: 390614 - RNA, 61 nt, Human
agucugccacccaggauccccaaggcacuugagggggaaggauucugcuggccucugcgag

SEQ ID NO: 390615 - RNA, 61 nt, Human
cugagguugggaaggcaccugcucccacagaagggggaacgcaagaggcaucccaagaccu

SEQ ID NO: 390616 - RNA, 61 nt, Human
cuaaaugacacuggaauauguuuaguagauuagggggaaaaacuauaaagguuuauacaau

SEQ ID NO: 390617 - RNA, 61 nt, Human
gucugccuggagaccagugggcccagggggaagggggaagcugagaaguucgugugacacc

SEQ ID NO: 390618 - RNA, 64 nt, Human
cgugacauucggggccgggcgggacccgccccacagacuccaacuuccccuccaaaccccgaag

SEQ ID NO: 390619 - RNA, 64 nt, Human
agacuucgagagagccugauccuggggucuucugagacuccaccaggagccggagagggcaggg

SEQ ID NO: 390620 - RNA, 64 nt, Human
ucgcaccagugcacuccagccuggcgacagagcaagacuccaucuaaaaaaaaaaaaaauuacc

SEQ ID NO: 390621 - RNA, 61 nt, Human
gggcugggucugccuggagaccagugggcccagggggaagggggaagcugagaaguucgug

SEQ ID NO: 390622 - RNA, 61 nt, Human
uggaguaagcugaggcuuagagcuuggaacaagggggaauaaacccagaaaauacaguuaa

SEQ ID NO: 390623 - RNA, 61 nt, Human
gcaagccaggcacagugaguggcagagcaagagggggaaagcaggaucagugccuggaagg

SEQ ID NO: 390624 - RNA, 61 nt, Human
cgggacgggaaggaagaaggaggcuaggagcagggggaaaaggugcacuuggccaguggcg

SEQ ID NO: 390625 - RNA, 61 nt, Human
gaagaaucccauacugauggcagggcuggccagggggaagaggguaguaucuguggguccu

SEQ ID NO: 390626 - RNA, 61 nt, Human
guugcugagaacuuggggacucgguucugugagggggaaaagagguugaaaagaggguuuc

SEQ ID NO: 390627 - RNA, 61 nt, Human
ggaguagagugaggcugacuuccuuagaaagagggggaagccaauggccugucuccccacu

SEQ ID NO: 390628 - RNA, 61 nt, Human
ugauugggagccgcagccaucucuagaugaaagggggaauguguagaggagaaauugccuc

SEQ ID NO: 390629 - RNA, 61 nt, Human
gacucaggcuggaggcagauagacacaguauagggggaaugggcuugcuucucccaaaccc

SEQ ID NO: 390630 - RNA, 61 nt, Human
ggguggggaauuuaucaccaacauccauuguagggggaaucuaugauucugcuuccccagc

SEQ ID NO: 390631 - RNA, 61 nt, Human
cuucccuugagcuggggggcuggggagggguagggggaauggggacaggcucuuucccccu

SEQ ID NO: 390632 - RNA, 61 nt, Human
gggagguggugcugcuggacugagccaguggagggggaagaucugcagcuagcauaguuuc

SEQ ID NO: 390633 - RNA, 61 nt, Human
guugauccacaaaggugggaggauguggggaagggggaaagcggugaggacgcagagugca

SEQ ID NO: 390634 - RNA, 61 nt, Human
acuccuugaagguucagaaccucugcagggaagggggaagaaaacccucccauuaggaagc

SEQ ID NO: 390635 - RNA, 61 nt, Human
uaagauguuuuauaugaagaaacuguaucaaagggggaagaaaauguauuuaacaggugaa

SEQ ID NO: 390636 - RNA, 61 nt, Human
uauauggggggccaacaccagggaugguacuagggggaagugacaaggccccagagacuca

SEQ ID NO: 390637 - RNA, 64 nt, Human
cgagauugugcacuccagccuggguaacagagcgagacuccaucucaaaaaaaaaaacaaaaca

SEQ ID NO: 390638 - RNA, 64 nt, Human
ggucacaacaucuguaaacuaggagaacuggagaagacuccacgcccuuccagcuuugguaucu

SEQ ID NO: 390639 - RNA, 64 nt, Human
acccagaucucauacucaacagaaggagacucagagacuccagaaggcacaggagcugccccca

SEQ ID NO: 390640 - RNA, 61 nt, Human
cugaguagaguguugguuuuuccauaacuacagggggaaaaaaagucauuaggcuuucccu

SEQ ID NO: 390641 - RNA, 61 nt, Human
cagccccuuucccuuguagcuccuccccuggagggggaauggcagcagggguuggggaaac

SEQ ID NO: 390642 - RNA, 61 nt, Human
aaauugcuuuaguuuuucuuagggagcuaugagggggaaaaaucacuaacaugaaaggcaa

SEQ ID NO: 390643 - RNA, 61 nt, Human
cucuuugagccuuucugucucauuuggaaccagggggaaccaggaaggggcuccuggccuc

SEQ ID NO: 390644 - RNA, 61 nt, Human
acugacguuggagugcuaaaaaugccccuucagggggaaaacugcauuuucucuuccaaaa

SEQ ID NO: 390645 - RNA, 61 nt, Human
cccagcggaucgucgcccgaucaguguuuugagggggaagguggcggggugggaaccgugu

SEQ ID NO: 390646 - RNA, 61 nt, Human
caauucccaggugcuuauuggacauccuucgagggggaagaggagggaagcggccagcuca

SEQ ID NO: 390647 - RNA, 61 nt, Human
cuucccuccaucuccuccugcuccugcguggagggggaaugugugcuggcuaggguggagg

SEQ ID NO: 390648 - RNA, 61 nt, Human
aaaucuuaucauggucucagucauaaucauuagggggaacucuagccaaaugguuuaacuu

SEQ ID NO: 390649 - RNA, 61 nt, Human
gaagucaaauaagaggagagaaaagaacucaagggggaaacugcauuuuuaggcuuugcuc

SEQ ID NO: 390650 - RNA, 61 nt, Human
uuuggucaagguuggcagagcaaggguauaaagggggaaauuguuuggcagcaccaacaga

SEQ ID NO: 390651 - RNA, 61 nt, Human
aagcugggugugguauuuagggcagcucagcagggggaacuuguccccauggucagaggag

SEQ ID NO: 390652 - RNA, 61 nt, Human
agggucccugccuaaaucccacuccugagggagggggaagaagagagggugggagauucuc

SEQ ID NO: 390653 - RNA, 61 nt, Human
augaugucuuuucccugagaugggggcucagagggggaaggccuguggccugcaugcuucc

SEQ ID NO: 390654 - RNA, 61 nt, Human
ggcuccucccacaccagaguacagccuggguagggggaaaaucaguucuuucagcuaccac

SEQ ID NO: 390655 - RNA, 61 nt, Human
cagugccugcagguugccuggccagguggagagggggaaagaggaagggcaccgugggugu

SEQ ID NO: 390656 - RNA, 64 nt, Human
ugcaucacugcacuccagccugggcaacagagcgagacuccaacucagaaaaagcaaaacaaaa

SEQ ID NO: 390657 - RNA, 64 nt, Human
caugcuacugcacuccagccugggugacagagcgagacuccaucucaaaaaaaaaaaaaaaaaa

SEQ ID NO: 390658 - RNA, 64 nt, Human
ccacccuggccauccacuagcccggaggguacgcagacuccacacucaguagaaggagacucag

SEQ ID NO: 390659 - RNA, 61 nt, Human
auugucucgauguacaguuuaacggggauagagggggaauaauguccauaccauugugugu

SEQ ID NO: 390660 - RNA, 61 nt, Human
ccugagagcccagggcccuuccuccguuuuaagggggaagcaacauuuggaggggauggau

SEQ ID NO: 390661 - RNA, 61 nt, Human
aggaguugguugaggcacuucuucaaggccaagggggaacacaguguuuuguuuccagcuc

SEQ ID NO: 390662 - RNA, 61 nt, Human
ugcaucuuuguaccugcaagugccaucuuuaagggggaaacuacaugaagucaccguuaca

SEQ ID NO: 390663 - RNA, 61 nt, Human
aguuuuuaaaaugacuacccagaagggcacaagggggaaggaaaugguauuuguauaugua

SEQ ID NO: 390664 - RNA, 61 nt, Human
aaacacuucucagugaaaaaacaagauuacaagggggaauaauauuuauucagcuaaaaua

SEQ ID NO: 390665 - RNA, 61 nt, Human
uucuugaaguuaaauuuggcagaguaucaaaagggggaaaaugacaaagugagcucuaaga

SEQ ID NO: 390666 - RNA, 61 nt, Human
ggcccaaccaguggacaauggagucugggggagggggaaccccggggacaugcccccaccc

SEQ ID NO: 390667 - RNA, 61 nt, Human
ucucacacuugcuguccccauccauggcccgagggggaaccugguggucucuucugagcuu

SEQ ID NO: 390668 - RNA, 61 nt, Human
uuuuuuuuaaguggagguaguuuguucuccaagggggaaaaauagaccaugaacuauacac

SEQ ID NO: 390669 - RNA, 61 nt, Human
cagugucuccugguaacuggaaccucuccugagggggaauccuggugcucaaauuacccuc

SEQ ID NO: 390670 - RNA, 61 nt, Human
uggcuuuggggcaagacugagccacgggggaagggggaaucccguaccugcugcugcuucc

SEQ ID NO: 390671 - RNA, 61 nt, Human
cacaaaagaagcaaaugcaauuuccaacacaagggggaagggaugcagggggaggcagcgc

SEQ ID NO: 390672 - RNA, 61 nt, Human
gggguggggugauaaaggauacaaccugcacagggggaaguuauuaaagaggcugcaaagu

SEQ ID NO: 390673 - RNA, 61 nt, Human
ugcuggggaugcaccaaugaaccccacaggaagggggaaggaaggagggaauuucacauuc

SEQ ID NO: 390674 - RNA, 61 nt, Human
ugagggguggagggaugucgcggagaggggaagggggaaacugaccaagaaagaaauucua

SEQ ID NO: 390675 - RNA, 64 nt, Human
ccaggaauuggagaccagcgugggcaacuuagcgagacuccaucucuacaaaauguggugacac

SEQ ID NO: 390676 - RNA, 64 nt, Human
uggcgccacugcacuccagccuggcaacagagugagacuccaucucaaaaaaaauaaaaaaaaa

SEQ ID NO: 390677 - RNA, 64 nt, Human
aaugcaugucacacuaauauguaguggccuuuucaaggccuagucccagggaaaacauuuugua

SEQ ID NO: 390678 - RNA, 61 nt, Human
gccuggaccaaaccacaugaacuggacugagagggggaagaagcggggaggaagaaauccc

SEQ ID NO: 390679 - RNA, 61 nt, Human
cgauugccguuucaauuguggaccggcgccgagggggaaagggaggugacuucgcccggug

SEQ ID NO: 390680 - RNA, 61 nt, Human
cugauuggaaacaauuaauugugggugucugagggggaaggucgcagcuuugggcagcuuu

SEQ ID NO: 390681 - RNA, 61 nt, Human
ggaucugcucagaaaggaagaggcaggcgccagggggaacccccuucguguuuugugaccc

SEQ ID NO: 390682 - RNA, 61 nt, Human
caugccgcuccucagcucccucagcuccuagagggggaagaggagagacccccaacaaggg

SEQ ID NO: 390683 - RNA, 61 nt, Human
cugcacccagccccaagggguggccguccugagggggaagugagaagggcucagagaggac

SEQ ID NO: 390684 - RNA, 61 nt, Human
acugaaaccauggaaagcaaagcuguggauaagggggaacuacuauauauaugcaucuacc

SEQ ID NO: 390685 - RNA, 61 nt, Human
cacccugaacaucccgcagggggagggggagagggggaagccgagagggggcugggccacc

SEQ ID NO: 390686 - RNA, 61 nt, Human
cagugcacagguggaggggaaaaaaagggggagggggaagcuuaucuugaaaaagcaucac

SEQ ID NO: 390687 - RNA, 61 nt, Human
agcucugggcaaaguggugguagggggagggagggggaaguuaagggggucaccuccauuc

SEQ ID NO: 390688 - RNA, 61 nt, Human
cuuccccaucucuccuccaggccccccggggagggggaaaggaguuuggggaggauucgug

SEQ ID NO: 390689 - RNA, 61 nt, Human
uugugugucucaaauuuguucuggaaaagaaagggggaaagucuaugaacgacuuuucaac

SEQ ID NO: 390690 - RNA, 59 nt, Human
aggccaaggggaacagcugacggggcucgagggggaaagggggugggacagggacucgg

SEQ ID NO: 390691 - RNA, 61 nt, Human
aguucucacucauugcagaaggauucauaccagggggaaauguggaaggcauuccaucaac

SEQ ID NO: 390692 - RNA, 61 nt, Human
uuuucauuuuauuuuauuuuuuaauucuuggagggggaaauaagggaauaaggccaaggaa

SEQ ID NO: 390693 - RNA, 61 nt, Human
auuauggccaaauaguauagggccacuggggagggggaagggaaucauuuuguguucauuu

SEQ ID NO: 390694 - RNA, 64 nt, Human
auuuuucuaaguaucuugaauucucagacugcaaaaggccuauuuuaacuauugauuuuuuuua

SEQ ID NO: 390695 - RNA, 64 nt, Human
uuacagacauuuaccaccugcggacccaaaagagaaggccuaggagaguuuucuagaagguugg

SEQ ID NO: 390696 - RNA, 64 nt, Human
caguuuuacuuuucucacaaaaacuuguaagguaaaggccuaacuuggucuagaauaugacacu

SEQ ID NO: 390697 - RNA, 61 nt, Human
uuuuuuuuuuucccuaagagauucucuuuuuagggggaaugggaaacggacaccucauaaa

SEQ ID NO: 390698 - RNA, 61 nt, Human
aggagccagcugugugaccauccagggguggagggggaaaaccaggcaauuucguuccugg

SEQ ID NO: 390699 - RNA, 61 nt, Human
gcuggacgagagaccuucuguccccucccagagggggaacccuggcacuggcccagcagcc

SEQ ID NO: 390700 - RNA, 61 nt, Human
ucuuuuuucaacuggcugggacauuuucggaagggggaagucucuuuuuuuacucuuauca

SEQ ID NO: 390701 - RNA, 61 nt, Human
uagaaaguuaaaaauguauaguaacugauugagggggaaaagaaugaucuuuauuaaugac

SEQ ID NO: 390702 - RNA, 61 nt, Human
accuuguggguggcgcccugcauaggggagcagggggaacgggucugaugucccugugcug

SEQ ID NO: 390703 - RNA, 61 nt, Human
acuggaggagacccauugcugggaggagcugagggggaacaggagcagggccacagcaccc

SEQ ID NO: 390704 - RNA, 61 nt, Human
acucacacaagaccccucagcaagggugcaaagggggaagaacuaggggcuccauuguucu

SEQ ID NO: 390705 - RNA, 61 nt, Human
auuccuacagcccacugggugccaagcucagagggggaaaaaaagauagccagagagagac

SEQ ID NO: 390706 - RNA, 61 nt, Human
auacugugucucaugaaggaucacagaguucagggggaaaaugugacagcacacgcacaaa

SEQ ID NO: 390707 - RNA, 60 nt, Human
caaaugacaaaaaaacuugauucacuaauuagggggaaaaaaggugagcauauguuucaa

SEQ ID NO: 390708 - RNA, 61 nt, Human
caggcgaggcuacaguaccugcugucuuuccagggggaaggggcuccccaugagggagggg

SEQ ID NO: 390709 - RNA, 61 nt, Human
gcuuggcguuaaaauacaaaucauugaacugagggggaaaaauguaacuaggaagaaaaac

SEQ ID NO: 390710 - RNA, 61 nt, Human
cccuucccccuacaagauuaugagaccccagagggggaaggucugggucaaauucuucuuu

SEQ ID NO: 390711 - RNA, 61 nt, Human
agaaaaaauauguugguauucucccuuggguagggggaaaugaccuuuuuacaagagagug

SEQ ID NO: 390712 - RNA, 61 nt, Human
gcgaggaaaugucuuuagagcacagggacagagggggaaauaagaggaggagaaagcucuc

SEQ ID NO: 390713 - RNA, 64 nt, Human
gguccaugccuaacucuguaccguuuuauuccucaaggccuauagccugucacuccuugaagcc

SEQ ID NO: 390714 - RNA, 64 nt, Human
ugucuuuuuuuaauuguacuuguauuagauuuuuaaggccuauaaucaugaaauaucacuaguu

SEQ ID NO: 390715 - RNA, 64 nt, Human
cgucauuggagugaaauggaucaaaguuugaauuaaggccuaugguaagguaacauugcuuugu

SEQ ID NO: 390716 - RNA, 61 nt, Human
uuaaugcaauguguggugguuguauuggagcagggggaauugauaaaggagagugguugcu

SEQ ID NO: 390717 - RNA, 61 nt, Human
ugguagggagcagccagccggcaaaggaaggagggggaaaaaaaccgccaccgggcugacu

SEQ ID NO: 390718 - RNA, 61 nt, Human
aagaccccuuugauucucuaaggagcacgaaagggggaaugccccucccaggaguuuaugg

SEQ ID NO: 390719 - RNA, 61 nt, Human
acagaaggggcaggccagguggaaaggagccagggggaaguggucuaagagaccuggaacu

SEQ ID NO: 390720 - RNA, 61 nt, Human
ccucgccccagccccaccccacauggagcucagggggaagcagggagggguucccaaaaga

SEQ ID NO: 390721 - RNA, 61 nt, Human
cccuguguccugggucugacauugccucaggagggggaagcucaucccucccuccaagccc

SEQ ID NO: 390722 - RNA, 61 nt, Human
ggacucugaggggcagugcucaguucagacaagggggaacugaaggcugacaaguucugag

SEQ ID NO: 390723 - RNA, 61 nt, Human
guuaauugguauucauucacaaugcaguugaagggggaaggcuccacugcauucuuuggcu

SEQ ID NO: 390724 - RNA, 61 nt, Human
aauuugucucaaagugggaagguuuugggggagggggaaauacagggaugguccauguuuu

SEQ ID NO: 390725 - RNA, 61 nt, Human
aagcaaaaugcugugauaaaccaaacagggaagggggaaaaacccuccuccuugggauuuu

SEQ ID NO: 390726 - RNA, 61 nt, Human
acccgacacggacuuauuuuugucauuagcaagggggaaaaggccaaaggacaagggccuc

SEQ ID NO: 390727 - RNA, 61 nt, Human
uuuucagucuugucuuuuauauagguagcugagggggaagauuuagaagccuugcacucac

SEQ ID NO: 390728 - RNA, 61 nt, Human
ccucauccaaacaauuuaaaaaugagugugaagggggaacaagucaaaauauuuuuaaaag

SEQ ID NO: 390729 - RNA, 61 nt, Human
ccacccaggcccccugggcaccaagggagcgagggggaauaagagcagggcagcccccugg

SEQ ID NO: 390730 - RNA, 61 nt, Human
uaugauuguauaaugugauuuuuuuuagaauagggggaaccuuauuuauuuguguguuaac

SEQ ID NO: 390731 - RNA, 61 nt, Human
gaucacucaacugcuucuuaacaccuccaccagggggaaggcuggcacaaggagaaaaaaa

SEQ ID NO: 390732 - RNA, 64 nt, Human
cgugccacugcacuccagccugggcgacagagcgagacuccaucucaaaaaaaaaaaaaaaaaa

SEQ ID NO: 390733 - RNA, 64 nt, Human
uauuccucggaguagaaggguguacagggggcccagacuccacagugacuugccacauuugccc

SEQ ID NO: 390734 - RNA, 64 nt, Human
gucaccaccuuugccucaugcuccuuugucugcaaaggccuaggauucuuucuuuaaaugaaau

SEQ ID NO: 390735 - RNA, 61 nt, Human
aaacucccccagcccugagcugggagaugacagggggaaagaggcccucucaagggugcca

SEQ ID NO: 390736 - RNA, 61 nt, Human
ggaggaaggccuguugcugcaaucauuguacagggggaaauggguaugagagacugaggcu

SEQ ID NO: 390737 - RNA, 61 nt, Human
uccucccagaaccuguggucccugauucuggagggggaacuucuugcuucucauuuugcua

SEQ ID NO: 390738 - RNA, 61 nt, Human
cugaucuccagucccuagcugggggcuggacagggggaagggagagaggauuucuauucac

SEQ ID NO: 390739 - RNA, 61 nt, Human
ggugacggcaaggacaugcauugcaauuugcagggggaauugucaagugaggacuucauca

SEQ ID NO: 390740 - RNA, 61 nt, Human
gugcuuuuucuuaaacuuggccaauuuggaaagggggaaggagccaccccaaaacgguggu

SEQ ID NO: 390741 - RNA, 61 nt, Human
aaaguccucuguauccucaugagauaacgagagggggaaaaaaagcuacuacugccuuugu

SEQ ID NO: 390742 - RNA, 61 nt, Human
gaggcaggaaggauccuccccuagagccuccagggggaacuggaggaugcguaagagaccc

SEQ ID NO: 390743 - RNA, 50 nt, Human
gguuugaaaucuccugcugacuggccgaagucuuuuuuaccuccuggggg

SEQ ID NO: 390744 - RNA, 64 nt, Human
guacaucugggccguggacuaucugaucuugguccuggccgagcaaacagcccggagguaaggu

SEQ ID NO: 390745 - RNA, 64 nt, Human
ucccaugcugggcccuccaggccaagagucucagcuggccgagaguccaggccuugccuccccc

SEQ ID NO: 390746 - RNA, 64 nt, Human
aaagugcugggauuaccggcaugagccacugcgccuggccgacaaaggcuuugauaucagaaug

SEQ ID NO: 390747 - RNA, 64 nt, Human
acuucccccaggacuccuacgaucugguuacugccuggccgauccaaggcuguggagucccaga

SEQ ID NO: 390748 - RNA, 64 nt, Human
cgcaccacugcacuccagccugggugacagagcgagacuccauuucaaaaaaaaagacugaaac

SEQ ID NO: 390749 - RNA, 64 nt, Human
aguccuuccuggagaugccuucagccagcaucccagacuccacaguuauuuaugaaugaugucg

SEQ ID NO: 390750 - RNA, 64 nt, Human
cacaaguucauuucuguuguugcggagacacugcagacuccacugugccgagguugaacucuuu

SEQ ID NO: 390751 - RNA, 64 nt, Human
cuacacacaagugacuuuuuuccccaugagcccucuggccgauuuuuuuuuuuuuuuuuuuuuu

SEQ ID NO: 390752 - RNA, 64 nt, Human
aaacaggaaccguguuuuuuuuuuuuuuuuuuuucuggccgaagacauauacccaagaacaaga

SEQ ID NO: 390753 - RNA, 64 nt, Human
ggcugacucugcaaaaugggggugucccccgauccuggccgaggugaggaacagacaggggggg

SEQ ID NO: 390754 - RNA, 64 nt, Human
ccaaagugcugggauuaggugugagccaccgcaccuggccgauauuuucuuuaaugaaauuuau

SEQ ID NO: 390755 - RNA, 64 nt, Human
cagcugguccugaaggagaagccaaauggcugcacuggccgauucuggucuccagaggaccuug

SEQ ID NO: 390756 - RNA, 64 nt, Human
aaagugcugggauuacaggcgugagccaccgcgccuggccgaugguacuauuuagauauaacac

SEQ ID NO: 390757 - RNA, 64 nt, Human
gggaccaagaugucaagcuggccguggagucgagcuggccgacggaccccuuucaccugguuau

SEQ ID NO: 390758 - RNA, 64 nt, Human
cuucagggucugggucugagcccgugggcaagcccuggccgagugagcuccaaugcuaacucau

SEQ ID NO: 390759 - RNA, 64 nt, Human
cugcuuccacccagccaagcccacaucacaucuccuggccgagagcagccacugccacucaguc

SEQ ID NO: 390760 - RNA, 64 nt, Human
ggagcaagaacuuucauauaggaauagaaacaugcuggccgaagauuucauccagaagucaaca

SEQ ID NO: 390761 - RNA, 64 nt, Human
cgacccugaaauccuuggggugccucgaggacgacuggccgaaaagccgcauucccugccucac

SEQ ID NO: 390762 - RNA, 63 nt, Human
aaauggugcagauuggcugauucauccugggcccuggccgaugugcauaucaacauuuauaca

SEQ ID NO: 390763 - RNA, 64 nt, Human
gccucguaucaucaugugaggggaugcaguggggcuggccgagccccgguuuucccaucagcaa

SEQ ID NO: 390764 - RNA, 64 nt, Human
aaagugcugggauuacaggcgugagccacugugccuggccgacaauuuacuugucuuaguauua

SEQ ID NO: 390765 - RNA, 64 nt, Human
agaguccucagagguccaccucuuacccuacagacuggccgagaccauaucaaguauuaaaacc

SEQ ID NO: 390766 - RNA, 64 nt, Human
uuagcuucacagccucuauggcuacaugguucuucuggccgaugguaugacaccuaaguuagaa

SEQ ID NO: 390767 - RNA, 64 nt, Human
uugcaccacugcauuccagccuggcgacagagugagacuccaucucaaaaaaaaaaaaaaagcc

SEQ ID NO: 390768 - RNA, 64 nt, Human
uaauaaugagauguaacucaugaaugucucgauuagacuccauguaguuacuuccuuuaaacca

SEQ ID NO: 390769 - RNA, 64 nt, Human
cccagacagggcuccagccugucggccacaccccagacuccaggcccccguugaagccgcuccc

SEQ ID NO: 390770 - RNA, 64 nt, Human
aaagugcugggauuacaggcgugagccaccgugccuggccgacauuuuuaaaaaaguuuuauuu

SEQ ID NO: 390771 - RNA, 64 nt, Human
guagaucacuugaugccaggaguuccagaccaggcuggccgacauggugaaaccccaucucuac

SEQ ID NO: 390772 - RNA, 64 nt, Human
aggaacuucuuuggacuuggaaggugugcggggacuggccgaggccccugcacccugcgcauca

SEQ ID NO: 390773 - RNA, 64 nt, Human
aguaggaauguggaaaacauccugacuucagugucuggccgaugugggucccucucuugacccu

SEQ ID NO: 390774 - RNA, 64 nt, Human
agccauauaucuuauuaagcuuuauaucugcuaccuggccgagggccuaauucauaguggagaa

SEQ ID NO: 390775 - RNA, 64 nt, Human
aaccuccaaugggugggggacagugagcuucggccuggccgaggugggugggugggcucucaga

SEQ ID NO: 390776 - RNA, 64 nt, Human
ccgaucucuauuaaaggacucccucuuggugggccuggccgagucccuccuuugugcucccagg

SEQ ID NO: 390777 - RNA, 64 nt, Human
ccaccaacaccaacacacacacaccucuaagcugcuggccgaagaugucaccaaggccaaagac

SEQ ID NO: 390778 - RNA, 64 nt, Human
ggcucuugacccgcucagcgcugaccccaccgcccuggccgaggcacuuggccuugcugagcug

SEQ ID NO: 390779 - RNA, 64 nt, Human
guugauggaaagacaaauucaucuguaguaguaacuggccgauugcuaaagaguucauaaggag

SEQ ID NO: 390780 - RNA, 64 nt, Human
gaucccacuuccagccgggccccucauguauccacuggccgaccgcagagugucccuaccuccu

SEQ ID NO: 390781 - RNA, 64 nt, Human
acaugaaaguaagcugaagcagaucaccaccgagcuggccgagcaccgcucauauccccccgac

SEQ ID NO: 390782 - RNA, 64 nt, Human
gugggcuuccugcccuucccucugggcacgccugcuggccgacccacugacccacucggaugga

SEQ ID NO: 390783 - RNA, 64 nt, Human
ugagcugggcgggcuccuuggguggauuagagagcuggccgagcugcaagcaccugaguuaccu

SEQ ID NO: 390784 - RNA, 64 nt, Human
ugccauggccgaggagacaaggcagaagcaacuucuggccgacgagaagaugaagcagcucaca

SEQ ID NO: 390785 - RNA, 64 nt, Human
agcuaguguuccucagaacaaagauuggaaaaagcuggccgagaaccauuuauacauagaggaa

SEQ ID NO: 390786 - RNA, 64 nt, Human
ggugccacugcauuccagccugggcaacagagcgagacuccaucucaaaaaaaaggagacuuca

SEQ ID NO: 390787 - RNA, 64 nt, Human
ugacagcagguugaguauucccacuuucaauaaaagacuccacuuucccggcacuugugacgag

SEQ ID NO: 390788 - RNA, 64 nt, Human
gcgcuauugcacuccagcucgggcgacaacugcaagacuccaucucaaaaaaauaaaaauaaaa

SEQ ID NO: 390789 - RNA, 64 nt, Human
guguucguauuuuuccacuuaucugucuugucagcuggccgacuucucugugauugguuuuuua

SEQ ID NO: 390790 - RNA, 64 nt, Human
ccggggcgucaucccauccacccuggccuucgcgcuggccgacacugucuucagcacccaggac

SEQ ID NO: 390791 - RNA, 64 nt, Human
ccuccucuguacauugccuuuaagcgaccagguccuggccgaguuuccucugccccuucuugcu

SEQ ID NO: 390792 - RNA, 64 nt, Human
cagccaguucuuggccaccacaaugggagcagcccuggccgaguugucucugugguuucuaugc

SEQ ID NO: 390793 - RNA, 64 nt, Human
gucuacacuggccgagucucugggucugucuacacuggccgagucuccgacugucugugcuuuc

SEQ ID NO: 390794 - RNA, 64 nt, Human
cgucgccgggcugcccagccuggcucugucuacacuggccgagucucugggucugucuacacug

SEQ ID NO: 390795 - RNA, 64 nt, Human
guggaucacuagaggucaggaguucaagaccagucuggccgacauggugaaacucagucucuau

SEQ ID NO: 390796 - RNA, 64 nt, Human
guuuuaguccuggccacugaccagcuguguggcccuggccgagucguagcccccuggagcccag

SEQ ID NO: 390797 - RNA, 64 nt, Human
augacauuuuugguuuaaaggagccuucucaucucuggccgagaacacugcugggcucccaggu

SEQ ID NO: 390798 - RNA, 64 nt, Human
aaaguguugggauuacuggugugagcccccacaccuggccgagccagcgcuucucaacucccaa

SEQ ID NO: 390799 - RNA, 64 nt, Human
ugaaccuuguguuagcauucucucucuaucucaucuggccgaguaucuuuuuccuuuuauuuuc

SEQ ID NO: 390800 - RNA, 64 nt, Human
cagaggagaaagccugagugaguaacaccucauucuggccgagaguagggcagcugccuccaga

SEQ ID NO: 390801 - RNA, 64 nt, Human
ugcuuccuuuuugcaccuauuggguauguacacucuggccgaagggaguccuuauguuuaguuu

SEQ ID NO: 390802 - RNA, 64 nt, Human
ucuguaucuaauuuaaacagauguuaauggacgucuggccgaaacuauuauacuuuuauaagau

SEQ ID NO: 390803 - RNA, 64 nt, Human
cccgccccccgacguccagcccgugauugacaagcuggccgaguaugucgccaggaacggccug

SEQ ID NO: 390804 - RNA, 64 nt, Human
gccccagucacccaccuaugugccagagucaggccuggccgacacaaggaucuaugcuuuuucu

SEQ ID NO: 390805 - RNA, 64 nt, Human
ugcgucacugcacuccaaccugggugacagagcgagacuccaccucaaaaaaaaaaaaaaaauu

SEQ ID NO: 390806 - RNA, 64 nt, Human
cgugccacuguacuccagccugggcaacaaggcgagacuccaucucaauaauaauaauaauaau

SEQ ID NO: 390807 - RNA, 64 nt, Human
uggagagagaggcugccucagccaguggcacaggagacuccaaggagcuacugacauuccuaag

SEQ ID NO: 390808 - RNA, 64 nt, Human
uuuaaggaaaauuaauuuuacuuuuuuuuuuguucuggccgaaauuuuuaugagauaucucuca

SEQ ID NO: 390809 - RNA, 64 nt, Human
cugacaucauccuauggacugagccggccacucucuggccgaaguggccgcaggcugugccccc

SEQ ID NO: 390810 - RNA, 64 nt, Human
acggauuaccugaggucaggaguucgagaccaaccuggccgacauggugaaacgcugucucuac

SEQ ID NO: 390811 - RNA, 64 nt, Human
acaggcaccauugccauggggcugguccuagucacuggccgaggauaagcccgucccuguccca

SEQ ID NO: 390812 - RNA, 57 nt, Human
acgagugggaggucaucugaaggagcccuggccgagucacgcggaggggcccggcgu

SEQ ID NO: 390813 - RNA, 64 nt, Human
ugagucagugcaauaaacuagacuuuuuccaaaccuggccgaguguggugccugagcugugaga

SEQ ID NO: 390814 - RNA, 64 nt, Human
cugaaaggcagagguucaacauucaggacuguuucuggccgaggacuucuuccaauuaaaaccc

SEQ ID NO: 390815 - RNA, 64 nt, Human
gauguuagaauuugacccugcccagcgcaucacacuggccgaggcccugcugcaccccuucuuu

SEQ ID NO: 390816 - RNA, 64 nt, Human
gagggcucuccaagcugggcaccgauaacuagggcuggccgaggcccaggccccgcccgugagu

SEQ ID NO: 390817 - RNA, 54 nt, Human
ccgagcugaccccacucugagagccuggccgagcuggcagcauggagcccucgg

SEQ ID NO: 390818 - RNA, 64 nt, Human
ugggcagcuagagugucucagcccggugcugggccuggccgaggggcggaggcacagcugcuuc

SEQ ID NO: 390819 - RNA, 64 nt, Human
guuccacccuacucaggcuguagaagccgcccagcuggccgaggaccugaaggugcagcuggag

SEQ ID NO: 390820 - RNA, 64 nt, Human
guccacuguucucugcagggcugugggcugcauacuggccgagcugcuggcgcacaggccucuu

SEQ ID NO: 390821 - RNA, 63 nt, Human
cggccgcccagggucucugauggccgcauggcucuggccgaggugccgcuguggccaccgucu

SEQ ID NO: 390822 - RNA, 64 nt, Human
uucccucuccuuccacuuucacagcuguccuucccuggccgaggcauugcuuucuggccucagc

SEQ ID NO: 390823 - RNA, 64 nt, Human
uccugcagugucucugacccacgccucccgccuccuggccgacuugcccaggaggugucucugg

SEQ ID NO: 390824 - RNA, 64 nt, Human
uccugcugccacugcacuccagccugggagggugagacuccaucuaaaaaaaauaaaauaaaug

SEQ ID NO: 390825 - RNA, 64 nt, Human
ggaugugcugggccugccuuuggcgccaugcugcagacuccagugggccugguuucugcagaau

SEQ ID NO: 390826 - RNA, 64 nt, Human
gauggcuuauacacacaggccuccuuggagccucagacuccaagcuaggcugaggcucaggcag

SEQ ID NO: 390827 - RNA, 64 nt, Human
gagcgcccuggcgguguuugugaagagggcuguccuggccgaaagggaccuccagcgcugccgg

SEQ ID NO: 390828 - RNA, 64 nt, Human
ggucccaccggcgucgcuggguucuucggugcuucuggccgagcaggcggccuacuugggcagg

SEQ ID NO: 390829 - RNA, 64 nt, Human
cucggcucuugagacagcagucuugcugaugcuccuggccgaauaaaccgcuuccuucuuuaac

SEQ ID NO: 390830 - RNA, 64 nt, Human
ggcacacacugccuucacgacgugacugcuggaccuggccgagcuugaggccacaugugaaggg

SEQ ID NO: 390831 - RNA, 64 nt, Human
gugacgccugcgcgccccucgggcugcaccggcacuggccgagcggagggcggggccguacugc

SEQ ID NO: 390832 - RNA, 64 nt, Human
cacucaaccccaugagcuuccagccaaggaugcccuggccgauuggaaaugcuguaaaaugcaa

SEQ ID NO: 390833 - RNA, 64 nt, Human
cagccuucaccuucucucugggaucaguguccggcuggccgacguggcauuugcugaccgaaug

SEQ ID NO: 390834 - RNA, 64 nt, Human
aauucagugucugaucgauaaccuggagaaccagcuggccgagauccgcugcgaccuggagcga

SEQ ID NO: 390835 - RNA, 64 nt, Human
ugaccuugcugggaacacucugaggacaguguggcuggccgagcgguuggccccauggguggug

SEQ ID NO: 390836 - RNA, 64 nt, Human
gggcgugggaggugacgcuagugucacgcugacgcuggccgauacucaggguaugcuaucugga

SEQ ID NO: 390837 - RNA, 64 nt, Human
gggaguggagggggcugccccugccgugcagguccuggccgauggcgccuuacccugcugcccu

SEQ ID NO: 390838 - RNA, 64 nt, Human
augugaagcaccucuucugagccaggccgagccccuggccgacuugggagccucaggcccacgc

SEQ ID NO: 390839 - RNA, 64 nt, Human
aaagcccuccugcaccccaaagaagccacugaggcuggccgagccacacugucuccccaggggc

SEQ ID NO: 390840 - RNA, 64 nt, Human
gggcucagccccaccacaggggcggguggacgugcuggccgaggaacaagcaaucauguuugcg

SEQ ID NO: 390841 - RNA, 64 nt, Human
gcugcccagggguggccgccuaguacacacccaccuggccgagcuguaccuggcacggcccauc

SEQ ID NO: 390842 - RNA, 64 nt, Human
uucuggccuuagaauuguccuuaaaagcuuucuccuggccgauaggaggaagcauauaucaagg

SEQ ID NO: 390843 - RNA, 64 nt, Human
uaauauccagaagaaucugauaucaucauagugaagacuccauacagacacaugaaugaauuau

SEQ ID NO: 390844 - RNA, 64 nt, Human
caaaggauacugccuucucaagaucauaggccucagacuccaacugguguuaucccaggguucc

SEQ ID NO: 390845 - RNA, 64 nt, Human
cagaaaggcccuguaaagcccucagagagaagagagacuccagagaaggcucccuaagaccuug

SEQ ID NO: 390846 - RNA, 64 nt, Human
ucuggaugcuggacaccugaagcuuggaacucaccuggccgaagcucgagccuccugaguccua

SEQ ID NO: 390847 - RNA, 64 nt, Human
aaacagugcaauaaaucuccgguaacccguccaccuggccgaggcagcccagagcagcgggaug

SEQ ID NO: 390848 - RNA, 64 nt, Human
ccuuguccuuagagcugagcccagaccccggggucuggccgaauccucacccccagggcagugu

SEQ ID NO: 390849 - RNA, 64 nt, Human
cuuccagcugcucccggugugaccgcguccuucccuggccgacccgaaggaagccuucugguug

SEQ ID NO: 390850 - RNA, 64 nt, Human
agccuccucccccgcuccccaacuucucgcccagcuggccgaggcggggcaacacuaaggugcu

SEQ ID NO: 390851 - RNA, 64 nt, Human
gcuacgcccccgggccccugccgccugcgcgcgccuggccgaggccucgcugcugcuggugacc

SEQ ID NO: 390852 - RNA, 64 nt, Human
ccggauccaggauucugggaggcuucaguuaccgcuggccgagcugaagaacuggguaugaggc

SEQ ID NO: 390853 - RNA, 64 nt, Human
cagaaagaaugguucucucaaaauaaccaguggccuggccgaccugcucuggcccuggauuccc

SEQ ID NO: 390854 - RNA, 64 nt, Human
ggucuggaggaggggacaugaggugagagguauccuggccgagggcggggggcagcgggggguc

SEQ ID NO: 390855 - RNA, 64 nt, Human
cugaugcucccuccccugcccugguccagggaagcuggccgaggguccuggcuccugaggggca

SEQ ID NO: 390856 - RNA, 64 nt, Human
gauuauagacacauugauuuugaauaaggaacugcuggccgagcccgcugggagucuagaaaga

SEQ ID NO: 390857 - RNA, 64 nt, Human
cucugggcuuggacacuugccguggugccccuggcuggccgaggagacuggcucuggccagggg

SEQ ID NO: 390858 - RNA, 64 nt, Human
gaaagcggggggcguggcugcaguucuggacgggcuggccgagcugcgcgggauccuugugcag

SEQ ID NO: 390859 - RNA, 64 nt, Human
augagaugauacauccaaagcagacagcuccacccuggccgaguccaagcugggagauucaagg

SEQ ID NO: 390860 - RNA, 64 nt, Human
cccccgccacagccuggacccuucccucagaagccuggccgaugggugcuuuuggggagccucu

SEQ ID NO: 390861 - RNA, 64 nt, Human
auggaggagcaccugaacuuucuggacaagaccucuggccgaccuggggauggccucugauccc

SEQ ID NO: 390862 - RNA, 64 nt, Human
aaaugcagacauuccuugcugaguuuauagcuuaaaggccuaaggagcacuagcaacauuuggc

SEQ ID NO: 390863 - RNA, 64 nt, Human
gggagcaguccaugcaugacagccucuauccuacaaggccuaugaguauggauugggggggcca

SEQ ID NO: 390864 - RNA, 64 nt, Human
gcggagcaguucacuagccaaugaugagagcagaaaggccuagaccugcagccagaagugaagg

SEQ ID NO: 390865 - RNA, 64 nt, Human
aguguaacuauuuugguacuagaaccaguucaugcuggccgaaacgacaaugguuuauggacuu

SEQ ID NO: 390866 - RNA, 64 nt, Human
gaagaacugaggagugguggaccaggcucgaacacuggccgaggaggagcucucugccugccag

SEQ ID NO: 390867 - RNA, 64 nt, Human
cgggccacugcacuccagcuugggugacagagcaagacuccaucucaaaaaaauuauaaauaac

SEQ ID NO: 390868 - RNA, 64 nt, Human
cuguagauguauauauggugcccuucugaugcuaagacuccagaccuuuuguuuuugcuuugca

SEQ ID NO: 390869 - RNA, 64 nt, Human
agacugcacaccuguugaccuaaacucacuggacagacuccagguggacaccaacuccucaaca

SEQ ID NO: 390870 - RNA, 64 nt, Human; identical to SEQ ID NO: 52242

SEQ ID NO: 390871 - RNA, 64 nt, Human; identical to SEQ ID NO: 52243

SEQ ID NO: 390872 - RNA, 64 nt, Human; identical to SEQ ID NO: 52244

SEQ ID NO: 390873 - RNA, 64 nt, Human; identical to SEQ ID NO: 52245

SEQ ID NO: 390874 - RNA, 64 nt, Human; identical to SEQ ID NO: 52246

SEQ ID NO: 390875 - RNA, 64 nt, Human; identical to SEQ ID NO: 52247

SEQ ID NO: 390876 - RNA, 64 nt, Human; identical to SEQ ID NO: 52248

SEQ ID NO: 390877 - RNA, 64 nt, Human; identical to SEQ ID NO: 52249

SEQ ID NO: 390878 - RNA, 64 nt, Human; identical to SEQ ID NO: 52250

SEQ ID NO: 390879 - RNA, 64 nt, Human; identical to SEQ ID NO: 52251

SEQ ID NO: 390880 - RNA, 64 nt, Human; identical to SEQ ID NO: 52252

SEQ ID NO: 390881 - RNA, 64 nt, Human; identical to SEQ ID NO: 52253

SEQ ID NO: 390882 - RNA, 64 nt, Human; identical to SEQ ID NO: 52254

SEQ ID NO: 390883 - RNA, 64 nt, Human
cauacugauauuuagaaaggugcuuuuguucuccagacuccagugauucugcacugggcauuau

SEQ ID NO: 390884 - RNA, 64 nt, Human; identical to SEQ ID NO: 52255

SEQ ID NO: 390885 - RNA, 64 nt, Human; identical to SEQ ID NO: 52256

SEQ ID NO: 390886 - RNA, 64 nt, Human; identical to SEQ ID NO: 52257

SEQ ID NO: 390887 - RNA, 64 nt, Human; identical to SEQ ID NO: 52258

SEQ ID NO: 390888 - RNA, 64 nt, Human; identical to SEQ ID NO: 52259

SEQ ID NO: 390889 - RNA, 64 nt, Human; identical to SEQ ID NO: 52260

SEQ ID NO: 390890 - RNA, 64 nt, Human; identical to SEQ ID NO: 52261

SEQ ID NO: 390891 - RNA, 64 nt, Human; identical to SEQ ID NO: 52262

SEQ ID NO: 390892 - RNA, 64 nt, Human; identical to SEQ ID NO: 52263

SEQ ID NO: 390893 - RNA, 64 nt, Human; identical to SEQ ID NO: 52264

SEQ ID NO: 390894 - RNA, 64 nt, Human; identical to SEQ ID NO: 52265

SEQ ID NO: 390895 - RNA, 64 nt, Human; identical to SEQ ID NO: 52266

SEQ ID NO: 390896 - RNA, 64 nt, Human; identical to SEQ ID NO: 52267

SEQ ID NO: 390897 - RNA, 64 nt, Human; identical to SEQ ID NO: 52268

SEQ ID NO: 390898 - RNA, 64 nt, Human; identical to SEQ ID NO: 52269

SEQ ID NO: 390899 - RNA, 64 nt, Human; identical to SEQ ID NO: 52270

SEQ ID NO: 390900 - RNA, 64 nt, Human; identical to SEQ ID NO: 52271

SEQ ID NO: 390901 - RNA, 64 nt, Human; identical to SEQ ID NO: 52272

SEQ ID NO: 390902 - RNA, 64 nt, Human; identical to SEQ ID NO: 52273

SEQ ID NO: 390903 - RNA, 64 nt, Human
cgugccacugcacuccagccugggcgacagagugagacuccaucucaaaaaaaaaaaaaaaaac

SEQ ID NO: 390904 - RNA, 64 nt, Human; identical to SEQ ID NO: 52274

SEQ ID NO: 390905 - RNA, 64 nt, Human; identical to SEQ ID NO: 52275

SEQ ID NO: 390906 - RNA, 64 nt, Human; identical to SEQ ID NO: 52276

SEQ ID NO: 390907 - RNA, 64 nt, Human; identical to SEQ ID NO: 52277

SEQ ID NO: 390908 - RNA, 64 nt, Human; identical to SEQ ID NO: 52278

SEQ ID NO: 390909 - RNA, 64 nt, Human; identical to SEQ ID NO: 52279

SEQ ID NO: 390910 - RNA, 64 nt, Human; identical to SEQ ID NO: 52280

SEQ ID NO: 390911 - RNA, 64 nt, Human; identical to SEQ ID NO: 52281

SEQ ID NO: 390912 - RNA, 64 nt, Human; identical to SEQ ID NO: 52282

SEQ ID NO: 390913 - RNA, 64 nt, Human; identical to SEQ ID NO: 52283

SEQ ID NO: 390914 - RNA, 64 nt, Human; identical to SEQ ID NO: 52284

SEQ ID NO: 390915 - RNA, 54 nt, Human; identical to SEQ ID NO: 52285

SEQ ID NO: 390916 - RNA, 64 nt, Human; identical to SEQ ID NO: 52286

SEQ ID NO: 390917 - RNA, 64 nt, Human; identical to SEQ ID NO: 52287

SEQ ID NO: 390918 - RNA, 64 nt, Human; identical to SEQ ID NO: 52288

SEQ ID NO: 390919 - RNA, 64 nt, Human; identical to SEQ ID NO: 52289

SEQ ID NO: 390920 - RNA, 64 nt, Human; identical to SEQ ID NO: 52290

SEQ ID NO: 390921 - RNA, 64 nt, Human; identical to SEQ ID NO: 52291

SEQ ID NO: 390922 - RNA, 64 nt, Human
ugcgccaccgcacuccagccugggcgacagagcgagacuccaucuuuaaaaaaaaacaagacgg

SEQ ID NO: 390923 - RNA, 64 nt, Human
cgcgacacugcacuccagccugggugacagagugagacuccaucucaacagaaggaaaaaaaag

SEQ ID NO: 390924 - RNA, 64 nt, Human; identical to SEQ ID NO: 52292

SEQ ID NO: 390925 - RNA, 64 nt, Human; identical to SEQ ID NO: 52293

SEQ ID NO: 390926 - RNA, 64 nt, Human; identical to SEQ ID NO: 52294

SEQ ID NO: 390927 - RNA, 64 nt, Human; identical to SEQ ID NO: 52295

SEQ ID NO: 390928 - RNA, 64 nt, Human; identical to SEQ ID NO: 52296

SEQ ID NO: 390929 - RNA, 64 nt, Human; identical to SEQ ID NO: 52297

SEQ ID NO: 390930 - RNA, 64 nt, Human; identical to SEQ ID NO: 52298

SEQ ID NO: 390931 - RNA, 64 nt, Human; identical to SEQ ID NO: 52299

SEQ ID NO: 390932 - RNA, 64 nt, Human; identical to SEQ ID NO: 52300

SEQ ID NO: 390933 - RNA, 64 nt, Human; identical to SEQ ID NO: 52301

SEQ ID NO: 390934 - RNA, 64 nt, Human; identical to SEQ ID NO: 52302

SEQ ID NO: 390935 - RNA, 64 nt, Human; identical to SEQ ID NO: 52303

SEQ ID NO: 390936 - RNA, 64 nt, Human; identical to SEQ ID NO: 52304

SEQ ID NO: 390937 - RNA, 64 nt, Human; identical to SEQ ID NO: 52305

SEQ ID NO: 390938 - RNA, 64 nt, Human; identical to SEQ ID NO: 52306

SEQ ID NO: 390939 - RNA, 64 nt, Human; identical to SEQ ID NO: 52307

SEQ ID NO: 390940 - RNA, 64 nt, Human; identical to SEQ ID NO: 52308

SEQ ID NO: 390941 - RNA, 64 nt, Human; identical to SEQ ID NO: 52309

SEQ ID NO: 390942 - RNA, 64 nt, Human; identical to SEQ ID NO: 52310

SEQ ID NO: 390943 - RNA, 64 nt, Human; identical to SEQ ID NO: 52311

SEQ ID NO: 390944 - RNA, 62 nt, Human
accgugugauaagguugugugucgugugggaguggggcgauuuuuuaugugccaaauacccc

SEQ ID NO: 390945 - RNA, 62 nt, Human
ugugaaagucagaaaggccagcggggagaggcuggggcgaggggaggagggggaucagcuuc

SEQ ID NO: 390946 - RNA, 62 nt, Human
uguauuuaaagcccucagucuguccuguuguguggggcgaagugauggacucugccaggugg

SEQ ID NO: 390947 - RNA, 62 nt, Human
caaggagcagaggggugcggguaaacgaggaguggggcgaggaaagcgggaugggaacaagu

SEQ ID NO: 390948 - RNA, 62 nt, Human
ccgcuagaugggcauggggugggccucugguuuggggcgaggcagaggacagaucaauggcg

SEQ ID NO: 390949 - RNA, 62 nt, Human
ggcuggugaacaggaagagcacagaaucucuguggggcgaugcugcagcggcugaaaccacg

SEQ ID NO: 390950 - RNA, 62 nt, Human
acuuuuuuuuuuccggggguauaggggagguguggggcgacagggucugucuuguucugucu

SEQ ID NO: 390951 - RNA, 62 nt, Human
aaggcagcuucugacacaccagccccaggaccuggggcgacuggaggaagccaggcgagugg

SEQ ID NO: 390952 - RNA, 62 nt, Human
uguuaagcuuuguggaccagguguuuuucuuuuggggcgaaccccugagcagagaaucuuac

SEQ ID NO: 390953 - RNA, 62 nt, Human
uaucggcaacaugggcagccugugaccgggucuggggcgaggccaggggccaucaaaaacag

SEQ ID NO: 390954 - RNA, 62 nt, Human
cccuggggugcuccaggccagagcucuuucauuggggcgaguguggugaggggacguccuug

SEQ ID NO: 390955 - RNA, 62 nt, Human
gagaauggggagagggucuucagugagguggcuggggcgagagucggccuggacuucccugg

SEQ ID NO: 390956 - RNA, 62 nt, Human
uuggaugaaacuccaccagagcacagcuuagcuggggcgagaugcaugugaaggcaggcagu

SEQ ID NO: 390957 - RNA, 64 nt, Human
aaguguggaguauuaaaaauguucuuugguugguaaggccuaagauaggguuucauuuauuucu

SEQ ID NO: 390958 - RNA, 64 nt, Human
agaccuggcuggcaacgagcagcgcacgcucaucaaggccuauggcauccgcuucgacaucauu

SEQ ID NO: 390959 - RNA, 64 nt, Human
ccauugccaaaccauggccuuuccucaguguuguaaggccuaugccaaggauaaaggaagggua

SEQ ID NO: 390960 - RNA, 62 nt, Human
gugaccuggaagugagaaguucuuugcagauuuggggcgaggggugauuuggaaaagaagac

SEQ ID NO: 390961 - RNA, 62 nt, Human
guccugagucugcuucagucuggagcuguuuguggggcgagugccauguggacaguggugga

SEQ ID NO: 390962 - RNA, 62 nt, Human
ugugcauugacaucacaggcugugccaacauguggggcgaguacugggacaaccucaucugc

SEQ ID NO: 390963 - RNA, 62 nt, Human
auggucuccaggcccuucuccguuucucaagauggggcgagccaggaccacagagcuccugg

SEQ ID NO: 390964 - RNA, 62 nt, Human
agaaagcugugaacaggcugggcugcuggagguggggcgaggcaggccgacuguacuaaagu

SEQ ID NO: 390965 - RNA, 62 nt, Human
gaaguggccacucuuguggcagguguaguaucuggggcgaguguuggggguaaaagcccacc

SEQ ID NO: 390966 - RNA, 62 nt, Human
gaacuacuguccugagucauaaguaauauggguggggcgagggucuuauuucuguagaaauc

SEQ ID NO: 390967 - RNA, 62 nt, Human
ccagcuguguguccuucuccaucuacacggccuggggcgagcacugugagcaccugagcaug

SEQ ID NO: 390968 - RNA, 62 nt, Human
accccauuucuacuaaaaauacaaaaauuagcuggggcgaggggauaggccgaguuccgggu

SEQ ID NO: 390969 - RNA, 62 nt, Human
acuuggacaauggagugccccaacucaacccuuggggcgacuggccauggugacauugugga

SEQ ID NO: 390970 - RNA, 62 nt, Human
uccccucccacaaacuucaacuccuccauggauggggcgacacggggagaacauacaaacuc

SEQ ID NO: 390971 - RNA, 62 nt, Human
aauuuccguaggaagggccgcucacugcacgguggggcgaugcugggcgcgagccguguuuc

SEQ ID NO: 390972 - RNA, 62 nt, Human
ugcuucgggcccgcggugcucggggccugguguggggcgaguagagacuuccccagccugga

SEQ ID NO: 390973 - RNA, 62 nt, Human
ccugggguguguggccuaaagcccaagagcgguggggcgacccuccuuuuggcuuggcccca

SEQ ID NO: 390974 - RNA, 62 nt, Human
cagguguaccccaaacagaaggcacauggaucuggggcgacuguuccagguccucccaaccu

SEQ ID NO: 390975 - RNA, 64 nt, Human
ugcgccacugcgcuccagccugggcaacagagcgagacuccaucucaaaaaaaaaaaaaaaaag

SEQ ID NO: 390976 - RNA, 64 nt, Human
ugcaccauugcauuccagccugggugacagagcgagacuccaucucaaaaaaauaaaaaaauaa

SEQ ID NO: 390977 - RNA, 64 nt, Human
accuguuucauuuuggguuuucuuccucuuccccagacuccaguccucguucuagaggaaggag

SEQ ID NO: 390978 - RNA, 62 nt, Human
uaggaugggguugggggcuaaauuaauuggaguggggcgaggagagagccagaaaacauaga

SEQ ID NO: 390979 - RNA, 62 nt, Human
ugucccugccccccgggcuccuggggaacagcuggggcgaaggagcaccggccugggucuug

SEQ ID NO: 390980 - RNA, 62 nt, Human
acugcucuccuagggaauggggaaaggcccccuggggcgaaggaagcgccccccuugacacu

SEQ ID NO: 390981 - RNA, 62 nt, Human
uuggcugccuccagaagagaugcagagagcuguggggcgaucuuucuuagucccacucaccc

SEQ ID NO: 390982 - RNA, 62 nt, Human
aaauaaaagauggcauuaugugguuaagagcauggggcgaggggucagacaugagucuaagg

SEQ ID NO: 390983 - RNA, 62 nt, Human
ggcacccgguguacucuguaaacgggaggagguggggcgaggcagccagagcccuuggacug

SEQ ID NO: 390984 - RNA, 62 nt, Human
ugccuuuaauuuuacccaggaaggacucacauuggggcgaaugaaccaaguuucgccaugcu

SEQ ID NO: 390985 - RNA, 62 nt, Human
guuagggacgaguuccagcccugccacugcccuggggcgaccccucccugucccugccuccc

SEQ ID NO: 390986 - RNA, 62 nt, Human
uuccccuccacuuggcugcaagucgccugccauggggcgaggaggccugcaccccaguauaa

SEQ ID NO: 390987 - RNA, 62 nt, Human
cggccagcaggaugggcugucguguauauagcuggggcgagggggcaggccccccuugugca

SEQ ID NO: 390988 - RNA, 62 nt, Human
uuuucaguguguggggaagcuguccugggggcuggggcgacagauagcacauaggcuguuuc

SEQ ID NO: 390989 - RNA, 62 nt, Human
gcagcggcggaaacucagcucaagguucccgguggggcgaagcucugagucauucagcccug

SEQ ID NO: 390990 - RNA, 62 nt, Human
gccccaggcccacuccucaugcagcagugugcuggggcgacagcucgucuccccucucuuaa

SEQ ID NO: 390991 - RNA, 62 nt, Human
agcccaggcuccgggguccacagcacaggauguggggcgagggcacagcuggggaacggcaa

SEQ ID NO: 390992 - RNA, 62 nt, Human
caacaggacagaccagacguuucauucuacccuggggcgaacagaacuucuuccucccaaac

SEQ ID NO: 390993 - RNA, 64 nt, Human
agcgacgcucgugggggaaacauacuaaacggacagacuccaagagcugccaccgcuggggcug

SEQ ID NO: 390994 - RNA, 64 nt, Human
aagagcacuagggauggggaacgaaugccaaaucagacuccaccuagagcaccaggaaacagcu

SEQ ID NO: 390995 - RNA, 64 nt, Human
auagacuacucccaugcccacagucacccauuccagacuccaguguccuuaaaacucuggagug

SEQ ID NO: 390996 - RNA, 62 nt, Human
agugggaggggccucuguguccuggucuaugauggggcgaguuggaggggugggcuucucua

SEQ ID NO: 390997 - RNA, 62 nt, Human
gacccuugggaagcugggugggggcugguagguggggcgagacuugcuggcuucgggcccuc

SEQ ID NO: 390998 - RNA, 62 nt, Human
auuggcuugucucagggugggaagugggaggguggggcgaagaaaggauuacaccagaagau

SEQ ID NO: 390999 - RNA, 62 nt, Human
ggccacggugagggcuuggaaggagacaggaauggggcgaggaaggagccaggcccggcaug

SEQ ID NO: 391000 - RNA, 62 nt, Human
ccagggcgggagcccauacccaggcuggcuccuggggcgacgccacgccagagggaggguuu

SEQ ID NO: 391001 - RNA, 62 nt, Human
gacaauuccuggcauauucugucacccucccguggggcgaucacuguguggggaccccauuc

SEQ ID NO: 391002 - RNA, 62 nt, Human
ucggacauccgcaggcaccagggaaagucuccuggggcgaucuguaaauaaaccuuuuuuuc

SEQ ID NO: 391003 - RNA, 62 nt, Human
augaaccguggaggauauaugcccacccccacuggggcgaagguggacuauauucagggaac

SEQ ID NO: 391004 - RNA, 62 nt, Human
cuuugugugcuuauguguacaugcauuuuucuuggggcgaguucauaauuuuaaucaaauuc

SEQ ID NO: 391005 - RNA, 62 nt, Human
ggaccuggagcacaugcccaguggggagagucuggggcgagcagugagcagacggcuggggc

SEQ ID NO: 391006 - RNA, 62 nt, Human
aguccauagaaauguuucuguuucauaucauuuggggcgagucaggcaaaaguauuugauuu

SEQ ID NO: 391007 - RNA, 62 nt, Human
ucuguaaaauggaccaaucagcaggauguggguggggcgagacaagagaauaaaagcaggcu

SEQ ID NO: 391008 - RNA, 62 nt, Human
ggccuugcugaaguuagaaagugcauccacuuuggggcgaaaacuagagacuugcuuggggg

SEQ ID NO: 391009 - RNA, 62 nt, Human
gagaugaagugaaggucugagggagcgggcccuggggcgaggccaucucugccugccucccu

SEQ ID NO: 391010 - RNA, 62 nt, Human
guacccugggaggccuggcuguggggauaguguggggcgaacagccugagcugaggauaccc

SEQ ID NO: 391011 - RNA, 64 nt, Human
ccccacaaccugccccggccaggccugcagacccagacuccagccagaccugccucacccacca

SEQ ID NO: 391012 - RNA, 64 nt, Human
aggaccugccccagcaagauuuuugucaagagcgagacuccaucagcccaggcagacgggagca

SEQ ID NO: 391013 - RNA, 64 nt, Human
gcgucucaauccacuuuuaaccauggaugagagcagacuccauuuacccugaaauagcagcuuc

SEQ ID NO: 391014 - RNA, 62 nt, Human
cgauccgggaauaaagaauguccgccucuccauggggcgaggacuucgcguuucaggggagg

SEQ ID NO: 391015 - RNA, 62 nt, Human
ugaacaugaucacggcagcccuacgccgugccuggggcgacauuucaggcuuuaugauuguc

SEQ ID NO: 391016 - RNA, 62 nt, Human
aacuuaucugaaauuuagagguguuuuggggguggggcgaggguuucuguaguagacucaga

SEQ ID NO: 391017 - RNA, 62 nt, Human
ggggcaacaacaggagaaugggguuccugcuguggggcgaauucauccccuccccgcgcguu

SEQ ID NO: 391018 - RNA, 62 nt, Human
uuccugagcagguggcagaagaugcgauugacuggggcgacuuugggguagaggcagugucu

SEQ ID NO: 391019 - RNA, 62 nt, Human
agcggccagcucacccuuccgggacccuaguguggggcgaaucucacggaccugaccucaga

SEQ ID NO: 391020 - RNA, 62 nt, Human
gcugcuggguuugcauguuuacagacucccccuggggcgagggucagagcuggcucugggga

SEQ ID NO: 391021 - RNA, 62 nt, Human
ugcagcccccuuccccaggagcaaggaccaguuggggcgacuccuuugaaagucugucugca

SEQ ID NO: 391022 - RNA, 62 nt, Human
gaggccauaccuccuuucaagagcuuuggauuuggggcgacuucccugggucuaggggagug

SEQ ID NO: 391023 - RNA, 62 nt, Human
gaaugauggucagagggcagacgaaugugucguggggcgaauugggauuugcugcagcugug

SEQ ID NO: 391024 - RNA, 62 nt, Human
agcgcuggggaggugacggcgcccgccgcagguggggcgaggcugggggagggcggcgccgc

SEQ ID NO: 391025 - RNA, 62 nt, Human
accccaucccagaggagaugcuggcuaccagcuggggcgaccccaagggucgcuggagucag

SEQ ID NO: 391026 - RNA, 62 nt, Human
cugagcagagagcggggaaaaugcaggcugaguggggcgaccuccugccugccaggagcccc

SEQ ID NO: 391027 - RNA, 62 nt, Human
ggcagacgaaggccaguggggccaucgcuuccuggggcgacccuggcagugguugggagacg

SEQ ID NO: 391028 - RNA, 62 nt, Human
aagccgaacacacgcugugagccaccaagaccuggggcgacaggagaaccgguccucucucu

SEQ ID NO: 391029 - RNA, 64 nt, Human
cgcaccacagcgcuccagccuggucgacagagugagacuccaucucaagaaaaaauaaaaauaa

SEQ ID NO: 391030 - RNA, 64 nt, Human
cgcaucacugcaguccagccuggaugacagagugagacuccaucucaaaaaauaaauaaauaaa

SEQ ID NO: 391031 - RNA, 64 nt, Human
gaaacuauauuuuacccuagacugccuugguucaaaggccuaguuucgacauuacuguggcaaa

SEQ ID NO: 391032 - RNA, 62 nt, Human
ugccucccagugcacccaaugacccccucccuuggggcgacuccugaugaagcacaacuccc

SEQ ID NO: 391033 - RNA, 62 nt, Human
aaguucuggaaaccacguggugucccugcgaauggggcgaucaaguccagagccggggcacu

SEQ ID NO: 391034 - RNA, 62 nt, Human
caugucaucaaaggucuuccugcacuugaagcuggggcgauguuugcagucaagaccauucu

SEQ ID NO: 391035 - RNA, 62 nt, Human
gugcagugaugaauguauuuauuucucagacuuggggcgagugagcggguggcaggccgggc

SEQ ID NO: 391036 - RNA, 62 nt, Human
gcugcaagggcaagaagaggaggcuccaggguuggggcgagggccgaccuguccacccuucc

SEQ ID NO: 391037 - RNA, 62 nt, Human
aggaaggggcaggaggaaggguugagguuacuuggggcgagucccuuccccuucagagaggc

SEQ ID NO: 391038 - RNA, 62 nt, Human
ucccagcugacggcaguaaauccacagugaguuggggcgacugugaaacuggaaugcuguua

SEQ ID NO: 391039 - RNA, 62 nt, Human
uugguggaaaguaaacagagaggauggagguuuggggcgaauguccugaggcagagaugguc

SEQ ID NO: 391040 - RNA, 62 nt, Human
caccuguaauccuaaguaacacuuugggaggcuggggcgagaggauugcuugagcccaggag

SEQ ID NO: 391041 - RNA, 64 nt, Human
ucaaaccagagugucucacuccccucugaccuccagaccagauggggcaugagccagccagcuc

SEQ ID NO: 391042 - RNA, 64 nt, Human
uaauucccaugccagagugaaaugauuaaguauaagaccagauucauggagccaagccacuaca

SEQ ID NO: 391043 - RNA, 64 nt, Human
uuucuuuuguauuccccuuccccuauuaccuauuagaccagaucuucuguccuaaaaacuuguc

SEQ ID NO: 391044 - RNA, 64 nt, Human
ggcccuagguaccccagcugaucagugccaggagagaccagagccucuggaggcuacccagggg

SEQ ID NO: 391045 - RNA, 64 nt, Human
caaagaauguuaaguacugaaucaugugugacugagaccagagauggcaaaugaauggcacacc

SEQ ID NO: 391046 - RNA, 64 nt, Human
acccaggaggcacuccagccugggagacagagugagacuccaucucaaaauauauauauauuuc

SEQ ID NO: 391047 - RNA, 64 nt, Human
cacgccacugcauuccagccugggcaacagagcgagacuccaucuuaaaaaaaaaaaaaaaaaa

SEQ ID NO: 391048 - RNA, 64 nt, Human
ucgcaccacugcacuccagucuggcaacagagcaagacuccaucucaaaaagaaaagaaaagaa

SEQ ID NO: 391049 - RNA, 64 nt, Human
gaauacuuuguaauagccacaaguucuuguuuagagaccagagcaggauuaauaauuuauuuua

SEQ ID NO: 391050 - RNA, 64 nt, Human
ucuucucuucuaguuacuacaguguggaguguugagaccagacaccuuuugcugucucaugggg

SEQ ID NO: 391051 - RNA, 64 nt, Human
uguggcucagauugcucuuaggaccuggagggacagaccagaaucaggguccccuccuuuaccc

SEQ ID NO: 391052 - RNA, 64 nt, Human
ccugagaaccuggacccuggaaucagcauggaugagaccagaggagguauggauggaaacaagc

SEQ ID NO: 391053 - RNA, 64 nt, Human
ucuuuucccucagccugcacuuacucuucuauuaagaccagaaaauaaaauaauuuuccguuga

SEQ ID NO: 391054 - RNA, 64 nt, Human
uauuguuaagccauuccagccucuuccucugaauagaccagacgcccuuucacuuaguucagug

SEQ ID NO: 391055 - RNA, 64 nt, Human
cuccuaacuccuuucccauuaaagguguuagaauagaccagagggugucccuuuuccacaguaa

SEQ ID NO: 391056 - RNA, 50 nt, Human
aggcauguaccauaagcuaaagaccagagccuuccugucaccccuaacca

SEQ ID NO: 391057 - RNA, 64 nt, Human
uuguuuauuaauggaagaguacuccccacaccuaagaccagauucuuauaucucccugguuaca

SEQ ID NO: 391058 - RNA, 59 nt, Human
gagaggaagaagaugacuagaucauucuaagaccagauucucuaauguuucugggugug

SEQ ID NO: 391059 - RNA, 64 nt, Human
uauuuuugccaaaaauugggauauguuaucugacagaccagaauauuugaaguuugggcugucc

SEQ ID NO: 391060 - RNA, 64 nt, Human
cuucuuccuccugccccuuuucccagcagcucugagaccagauguuggcugcuguacuuacucc

SEQ ID NO: 391061 - RNA, 64 nt, Human
guauuuagugggguggaauucagaagaaauuugaagaccagaucauggguggucugcaugugaa

SEQ ID NO: 391062 - RNA, 64 nt, Human
gaaccaaagagacuggagcaucugacucacaagaagaccagacuguggagaaauaaaaauaccu

SEQ ID NO: 391063 - RNA, 64 nt, Human
ugccagaguggugggcagaucugaccauccccacagaccagaaacaaggaauuucugggauuac

SEQ ID NO: 391064 - RNA, 64 nt, Human
ggauuuaaguacucuauagaaaauuugugaagucagaccagaauuuucuuugucccaugaggug

SEQ ID NO: 391065 - RNA, 64 nt, Human
ggugccgcugcacuccagucugggugacacagcaagacuccaucucaaaaaaaaaaaaaaaaaa

SEQ ID NO: 391066 - RNA, 64 nt, Human
acaccacuaaccauccccaacuccaugggguucgagacuccaucuugguaguucugugccuccc

SEQ ID NO: 391067 - RNA, 64 nt, Human
ucgcaccacugcucuccagccuggcgacagagggagacuccaucucaaauuaaaaaaaaaaaaa

SEQ ID NO: 391068 - RNA, 64 nt, Human
agggcgcccuugaggcaugcccucugagggagggagaccagagaugcagggauuggccagcugg

SEQ ID NO: 391069 - RNA, 64 nt, Human
uaauaaauugaauacuagguguuguaaggaagugagaccagaaggacaagcuaaauuaugcauu

SEQ ID NO: 391070 - RNA, 64 nt, Human
uacagcuucuuugcguuuaacuuuuucaaaccacagaccagaacugguugcauguuacuuuagg

SEQ ID NO: 391071 - RNA, 64 nt, Human
agaguauuuuauuaaacccuugaaccaguguccuagaccagaugauuuuugcccauguguaucc

SEQ ID NO: 391072 - RNA, 64 nt, Human
cugcccgggguguugaccucgccucaccuuucacagaccagaccggcacaggcuuugagcucau

SEQ ID NO: 391073 - RNA, 64 nt, Human
agagagugggcucauuggccuaaauaaaaagagaagaccagaagucuuugaggucucugucucu

SEQ ID NO: 391074 - RNA, 64 nt, Human
guuuauuucucaugaauucccauuuuguggcuaaagaccagaccuuugcacuauuucaucaaga

SEQ ID NO: 391075 - RNA, 64 nt, Human
agugugugauugaaggugauaagggaaaagauaaagaccagaaauucccuuuucaccuuuucag

SEQ ID NO: 391076 - RNA, 64 nt, Human
uagaaauaauuacccaguaugaucauggcauccaagaccagagucucagaacucauuaagaaac

SEQ ID NO: 391077 - RNA, 64 nt, Human
cgaucgcugcugugagcaccucaguggcucccucagaccagaucccguaggcagccccacagac

SEQ ID NO: 391078 - RNA, 64 nt, Human
cagugauacaaaccuguccuggaauucuaccuggagaccagagcuggccugaaaauuacuggug

SEQ ID NO: 391079 - RNA, 64 nt, Human
aaucuuugcucccaggcccagcaccgagcagaacagaccagagcccaccacaccacaaagagca

SEQ ID NO: 391080 - RNA, 64 nt, Human
uggucuauauucuuuagauaguuguuuagucaaaagaccagacaaguuacaaacuaagagaaac

SEQ ID NO: 391081 - RNA, 64 nt, Human
uuuuaauuucaggguguuuauacuuuuugaaacuagaccagaagauaguagacuuuauagagaa

SEQ ID NO: 391082 - RNA, 64 nt, Human
aucuggaaugcuuuguaauacuugcaugcuucuuagaccagaacauguagguccccuugugucu

SEQ ID NO: 391083 - RNA, 57 nt, Human
ucuucucuugacaguuuuaauugauaaagaccagaguccaaaauggaaaccagcuga

SEQ ID NO: 391084 - RNA, 64 nt, Human
caaccggggagcccccgccccgccccacauuccgacaaccgaugcuccagccaaccccugugga

SEQ ID NO: 391085 - RNA, 64 nt, Human
guccccucccccuucccucacaccgcgucuggugacaaccgaguggcugucaucagccugugua

SEQ ID NO: 391086 - RNA, 64 nt, Human
cgcgccacugcacuccagccugggugacagagccagacuccaucucaaagaaaaaaaaaaaaua

SEQ ID NO: 391087 - RNA, 64 nt, Human
acccaccucccaagggcuccauuuguaaaaguacagaccagaaauucuaccacuucccagaucc

SEQ ID NO: 391088 - RNA, 64 nt, Human
ggacaaccaacacccggguugcuccuuugauuagagaccagaucagauaauuaugcuuuuaaac

SEQ ID NO: 391089 - RNA, 64 nt, Human
uggauguggaggagugaccagaccagaccagaccagaccagagggaucggaggcucaggccccc

SEQ ID NO: 391090 - RNA, 64 nt, Human
ggaaguggauguggaggagugaccagaccagaccagaccagaccagagggaucggaggcucagg

SEQ ID NO: 391091 - RNA, 64 nt, Human
gggguggaaguggauguggaggagugaccagaccagaccagaccagaccagagggaucggaggc

SEQ ID NO: 391092 - RNA, 64 nt, Human
augaagggguggaaguggauguggaggagugaccagaccagaccagaccagaccagagggaucg

SEQ ID NO: 391093 - RNA, 64 nt, Human
gugagaugccuuugcuaagaggauaaaggaacugagaccagaugagaaaaagaaaggauauaga

SEQ ID NO: 391094 - RNA, 64 nt, Human
cuauuguaaguuugccuaggcuguugguguacagagaccagaggagagagacacacuaggacua

SEQ ID NO: 391095 - RNA, 64 nt, Human
uuggccuuacugacacaccuuugcuccauguucaagaccagaaguagcugggauuuguuugcaa

SEQ ID NO: 391096 - RNA, 64 nt, Human
aggucacucuccagcaguuaggcaccuuaacuggagaccagaaaccuuccagagaacacagggc

SEQ ID NO: 391097 - RNA, 64 nt, Human
aaggccuguacugaagacagcaagcuguuaguacagaccagaugcuuucuuggcaggcucguug

SEQ ID NO: 391098 - RNA, 64 nt, Human
gccucauuuuuaacccaguccucuguguaguuucagaccagaccugaauagucuccuaugcccu

SEQ ID NO: 391099 - RNA, 64 nt, Human
ucccgcugcacggcccaccggcggccagccccagagaccagaacugauccagagcuggagaaag

SEQ ID NO: 391100 - RNA, 64 nt, Human
cacaauuacucccucuauuaacccuucacuuacuagaccagaaaagaacuuauuccagauaagc

SEQ ID NO: 391101 - RNA, 64 nt, Human
ggcugaacacccaaaacgccauugccuuccgcagagaccagagaucucuguacuucaaggacag

SEQ ID NO: 391102 - RNA, 64 nt, Human
aggccguuuuuuccuuagccagaccccuguugauagaccagauacuugagggcaaacuguuugc

SEQ ID NO: 391103 - RNA, 64 nt, Human
uuuaaagcagcauuucucucuuaacguuccugggagacuccaacaaauggagaccagaaacaag

SEQ ID NO: 391104 - RNA, 64 nt, Human
acacugaugaaacgccacugggagugaggaagccagacuccagagacacggagaagaucaaacu

SEQ ID NO: 391105 - RNA, 64 nt, Human
caugccacugcacuccagccugggcgauggagugagacuccaucucaaaaaaaaaaaaaaaaga

SEQ ID NO: 391106 - RNA, 64 nt, Human
uuaaaaggauuuggaaauggaacaaguagcuuccagaccagauacuaccuguggcaagaaugcu

SEQ ID NO: 391107 - RNA, 64 nt, Human
cuccuuucucuaaaacugccuuccacaauucacuagaccagaaguggacgcaacuuaagcuggg

SEQ ID NO: 391108 - RNA, 64 nt, Human
cgccacgucgggauuucugacaugcucagcagguagaccagaggccgugugaccagcucagugc

SEQ ID NO: 391109 - RNA, 64 nt, Human
cacaguccugagcuuguaagauggugcagcaugcagaccagacuuguccccaaggucucagcgc

SEQ ID NO: 391110 - RNA, 64 nt, Human
aguggagauaaccaccuuugcgauaaugagagacagaccagaggacugcuacucuuuuuauagg

SEQ ID NO: 391111 - RNA, 64 nt, Human
uuuauacaaagaguuugaacaaaaaaucccuguaagaccagaauuaucuuuguacuaaaagaga

SEQ ID NO: 391112 - RNA, 58 nt, Human
ugccagaucgucagcgcuaagggaacugagaccagagaaagaacccaagagaacuaca

SEQ ID NO: 391113 - RNA, 64 nt, Human
aagcugaaucccacacuccaggucugugcucaagagaccagaugguguauuuccaaaugggccu

SEQ ID NO: 391114 - RNA, 64 nt, Human
aguaaaauaucugcugcauaaaaaacuaagacaaagaccagaggaaauaucuucccuuucuuau

SEQ ID NO: 391115 - RNA, 64 nt, Human
acugagucuuucaauuuacagaucaagaaacugaagaccagagaagagaaaugauuugguuaaa

SEQ ID NO: 391116 - RNA, 64 nt, Human
aauuagaacuucaaaugcgauggucuugacuauuagaccagauuuaguagcuccauaucuaaga

SEQ ID NO: 391117 - RNA, 64 nt, Human
gcacccgggucagcaaagcacacaagcucacucaagaccagauggagaacuuauuuccugcagc

SEQ ID NO: 391118 - RNA, 64 nt, Human
gagccgggaaagcuguuuuuccguggauuuggcgagaccagagcagucugaaggauuccccacc

SEQ ID NO: 391119 - RNA, 64 nt, Human
uuaaucaaauugagcuaugugccauaagguaaucagaccagaguccaaguuguaugcaaaaaau

SEQ ID NO: 391120 - RNA, 64 nt, Human
ugucuuaaauacuugcacuaaauagugcacugcaagaccagaaaauuuuacaauauuuuuucuu

SEQ ID NO: 391121 - RNA, 64 nt, Human
ccccaccagggggcgcgcuuaaauuuccagacagagaccagaaggaagguuuagaaagaaaaga

SEQ ID NO: 391122 - RNA, 64 nt, Human
uccuacuuucuuucucuggaaaggaaagccuccaagacuccaugugcuugggcagcuugagaag

SEQ ID NO: 391123 - RNA, 64 nt, Human
gugaggggcccggaggagccuuugcccgcgugucagacuccaucccuccucugccgccaccgca

SEQ ID NO: 391124 - RNA, 64 nt, Human
agaccugccccucccccccgaccuccacccccucagacuccaucccccacccccaggagccugg

SEQ ID NO: 391125 - RNA, 64 nt, Human
gccgaagucuggucacgcucagacagagcugaccagaccagaccguuugccuuuucaaguuucc

SEQ ID NO: 391126 - RNA, 64 nt, Human
gccuaaccacagauccuggaguucugcaaccuccagaccagagcggucucaugaaccaccuccc

SEQ ID NO: 391127 - RNA, 64 nt, Human
cgugcguguguguguguguuccuguguaaguaacagaccagacuccuuuucucuucugucccgu

SEQ ID NO: 391128 - RNA, 64 nt, Human
auauggaaaugaauugcucugugcugaaauuugaagaccagauaaugaaacugaaaagcaaaca

SEQ ID NO: 391129 - RNA, 53 nt, Human
gcauguaccaccuguccuaaggaagaccagaucaauagacuccaugauggaug

SEQ ID NO: 391130 - RNA, 64 nt, Human
cuucccccagaaggugcaggcuuuccugagucuuagaccagauauggccaguugcgcagguuuc

SEQ ID NO: 391131 - RNA, 64 nt, Human
auauaagaaaaaauucuuucacuugauguuuguuagaccagaaaguguguguguucuguagcuc

SEQ ID NO: 391132 - RNA, 64 nt, Human
acauauaaaucugcuucaaccuuaggauguuuucagaccagaggcaacuuauucaugaauuuuu

SEQ ID NO: 391133 - RNA, 64 nt, Human
uuacaaaaaguuuagggcauguuuucuguuuuaaagaccagaaguuugaaggcacccaaauccu

SEQ ID NO: 391134 - RNA, 64 nt, Human
gggacacuugagccagagaguugaaagcuuggaaagaccagauaagaaaccugcccuuugucuc

SEQ ID NO: 391135 - RNA, 64 nt, Human
acauaaaagcaauguaaaucagaauaaauauguuagaccagaauaaaauuaauuauauucuggu

SEQ ID NO: 391136 - RNA, 64 nt, Human
cucuaagugaaagaacugucaucugcuggugaccagaccagacuuuucagauugcuuccuggaa

SEQ ID NO: 391137 - RNA, 64 nt, Human
ugagccuaaaggaggaaaagucccaccaacuaccagaccagaacacgagccccucugggcagca

SEQ ID NO: 391138 - RNA, 64 nt, Human
uugccauuguaaaugggucugaugugauaugacaagaccagagaaauuggauguaaauuuacau

SEQ ID NO: 391139 - RNA, 64 nt, Human
ccccuccgccccgcccgccccacuaucuuuaaggagaccagagaccgccuacuggagagaaagg

SEQ ID NO: 391140 - RNA, 64 nt, Human
ccauugucucugacugcagguuugaauaaguugaagaccagagaaaaguacacacugggcuaca

SEQ ID NO: 391141 - RNA, 64 nt, Human
cauuauuaauuuuuaggguaugggcacugugcaaagacuccauagcugugccuaggagucuagg

SEQ ID NO: 391142 - RNA, 64 nt, Human
aauggcacaccugagaucaacauucacauaguuuagacuccaaaccauucagucuaaaauacug

SEQ ID NO: 391143 - RNA, 64 nt, Human
cacgccacugcacuugagccugggcgacacagcgagacuccaucucaaaacaaaacaaaacaaa

SEQ ID NO: 391144 - RNA, 64 nt, Human
cacauugggaagaucacuugaggcaaggaguuugagaccagacuggccaacacagcgagacccc

SEQ ID NO: 391145 - RNA, 64 nt, Human
auuccagcaugugagcuucaugcuuccucaccacagaccagacucgcuucccauggugggaaac

SEQ ID NO: 391146 - RNA, 64 nt, Human
gggaacaggaaaugcugaucucuaccccugggugagaccagaaccucagggcugauacuguuga

SEQ ID NO: 391147 - RNA, 64 nt, Human
uuggggggaaauagaagaguacggagaaaggaagagaccagaguucuuuaaagcucacauuuua

SEQ ID NO: 391148 - RNA, 64 nt, Human
acaaaauugggugcauucagggugguauggccauagaccagagcaacacauugaaauguauaca

SEQ ID NO: 391149 - RNA, 64 nt, Human
ccuuucucccaccaguugguggaggcuucagggaagaccagaguccuggacagagaggguaaca

SEQ ID NO: 391150 - RNA, 64 nt, Human
gagauaacgaauucuugaguuuguuuucuaaaggagaccagaaauccacuauuacaaauguauu

SEQ ID NO: 391151 - RNA, 64 nt, Human
uaaaauauggagugccauccugcuaggugaguacagaccagaagaaaauuuaguugggaaaaua

SEQ ID NO: 391152 - RNA, 64 nt, Human
gaaacaaaaauuagcacuaaauuuuuuauaaaauagaccagaugacaaaauuuauuuuauuuuu

SEQ ID NO: 391153 - RNA, 64 nt, Human
gcugaugcaauuccuccaucaucucuggacgugcagaccagauccagaagaaaggccuggcgug

SEQ ID NO: 391154 - RNA, 64 nt, Human
cuccuccuacaguuaaacucauugucuguuuggaagaccagaaugugaagacaaguaguagaag

SEQ ID NO: 391155 - RNA, 64 nt, Human
aagauuccaguuguauuugucaccuggggugacaagaccagacaggcuuucccaggccugggua

SEQ ID NO: 391156 - RNA, 64 nt, Human
accuacgaauuauaacauuagaagccuaguggaaagaccagauaacuuuaaauggcuacuaaag

SEQ ID NO: 391157 - RNA, 64 nt, Human
cagaagacuuaggaagcuuugccaguaguuccugagaccagaaauacauauuaugaagcaggug

SEQ ID NO: 391158 - RNA, 57 nt, Human
cugucucucccccagacugauucuuccagaccagaguuugaugccagcagcuucggc

SEQ ID NO: 391159 - RNA, 64 nt, Human
agcaagguagaggaaggagucccagccucugggcagaccagaggcccagagggagagaguagca

SEQ ID NO: 391160 - RNA, 64 nt, Human
aaugauggucauguugcaguuuuuuccuugaaggacaaccgaaccauagccucuaaaguucaag

SEQ ID NO: 391161 - RNA, 64 nt, Human
cugaccuuguaauguaugaguucacggaagaagcacaaccgaacgucuuguucagugacagcgc

SEQ ID NO: 391162 - RNA, 64 nt, Human
aaaaaaagaggagagagauagaggaaggugaauuagacuccaaaagaugacccugcuguagcug

SEQ ID NO: 391163 - RNA, 64 nt, Human
aacaguccuuuccuguaugucuucuauuacccuaagaccagaguuauuuugguugguuguuuug

SEQ ID NO: 391164 - RNA, 64 nt, Human
gggguauguucugggcuuaauucccccaagcagaagaccagauccaagauguuuggacacccug

SEQ ID NO: 391165 - RNA, 64 nt, Human
uuuuuccaacucaaugaaugacaucacugcacucagaccagaaaucuagaagucagucaugacu

SEQ ID NO: 391166 - RNA, 64 nt, Human
ccuugggaaagacuuggaggguuuggcuuauacaagaccagauuacagagggguauugauuugc

SEQ ID NO: 391167 - RNA, 64 nt, Human
acauuucuucacaaaauuagauaaaguuggucaaagaccagauauucuggaauggaaauuguaa

SEQ ID NO: 391168 - RNA, 64 nt, Human
gcaagcuaauuuaaaaacaugaugggcuguuuuaagaccagaguggaaauucaugagaggaacu

SEQ ID NO: 391169 - RNA, 64 nt, Human
uaauuuguuuccagcaugagguaucuaaggauuuagaccagaggucuagauuaauacucuauuu

SEQ ID NO: 391170 - RNA, 64 nt, Human
auauguuguuaaacccuaugaagaguaacaguguagaccagacugccucucucagauaugugcc

SEQ ID NO: 391171 - RNA, 64 nt, Human
auuacauuuugaugaccuccauuuugauacuuguagaccagaucuaauccgaagauuaaucuuu

SEQ ID NO: 391172 - RNA, 64 nt, Human
agagaagucuuaagagaugacugcucagauggagagaccagagaagagaacaagcuguugauuc

SEQ ID NO: 391173 - RNA, 64 nt, Human
gguauacaacugacaggcauuucauuaagcacauagaccagacuuugugaaugguucagauauu

SEQ ID NO: 391174 - RNA, 64 nt, Human
uagauaugcuuugcugagaaguuaggucugugguagaccagaaaccacaaauugacuuuuuuuc

SEQ ID NO: 391175 - RNA, 64 nt, Human
cuuuuuucuuaugcaaaaauacuccuuuccggugagaccagauuaacuaucuccauguuugucc

SEQ ID NO: 391176 - RNA, 64 nt, Human
cuuuauugccaccuacugacacucgauuuaggccagaccagagguuucuagaggaagggaacuu

SEQ ID NO: 391177 - RNA, 64 nt, Human
acuuaccaccagagcauagaaaagcaugcaaggaagaccagaugggcuuagcauugggaagaca

SEQ ID NO: 391178 - RNA, 64 nt, Human
ucccuccccuggugccugugucugcagaaaaacaagaccagaugugauuuguuaaaaaaaaaca

SEQ ID NO: 391179 - RNA, 64 nt, Human
uuauuuggggacauuauuuuguuauuuagauaccaaggccuaauuaauuaaguaccuauaagaa

SEQ ID NO: 391180 - RNA, 64 nt, Human
uacaguaaguacgugagccagucauccauacacuaaggccuaguugagaaaaaccuuugauuca

SEQ ID NO: 391181 - RNA, 64 nt, Human
gcugauucaaaccaaagcugccugugccaugcccaaggccuagguuauggguacggcaaccaca

SEQ ID NO: 391182 - RNA, 64 nt, Human
cagcagaacaagugccuccuggacuguucacggcagaccagaacguuucuggccuggguuuugu

SEQ ID NO: 391183 - RNA, 64 nt, Human
cccaaauccugauaaauauuaacaucacagaggaagaccagacauuaugggccuggaaguacua

SEQ ID NO: 391184 - RNA, 64 nt, Human
aauggaugugugcacauuuucuguucagggauuaagaccagaauaucaguggauuuguuuuccc

SEQ ID NO: 391185 - RNA, 64 nt, Human
gcuuugaagcggagaccauuuccaggccuuauugagaccagaccccaagucccccacccccauc

SEQ ID NO: 391186 - RNA, 64 nt, Human
gucaccuaaccuugugguuagaauugcaauuuuaagaccagaaaaauuugaagucugaucagag

SEQ ID NO: 391187 - RNA, 64 nt, Human
uaauccuagagaccuuuuuucuaccaaagaucacagaccagaaaaaguuccaucuaaaauauca

SEQ ID NO: 391188 - RNA, 64 nt, Human
uggcucggaccacugcaagggccgaggcagggccagaccagagcauccuggguacaggccuggg

SEQ ID NO: 391189 - RNA, 64 nt, Human
cugugaaauacuuagccaugcagaauaugugaccagaccagagcauguguaggaagacuuuacg

SEQ ID NO: 391190 - RNA, 64 nt, Human
uuguacuuccaauuuucuuuaaauaaucccaaauagaccagaauuggcccauaccauagaagaa

SEQ ID NO: 391191 - RNA, 64 nt, Human
aaaaauacauccaaauaaagacuuuauuauuaacagaccagauagcaucagaaaucaugugacu

SEQ ID NO: 391192 - RNA, 64 nt, Human
cuagagccaccucuuugacccuuuacccacccugagaccagaacuugcagccccucugcagauc

SEQ ID NO: 391193 - RNA, 64 nt, Human
uuccucccaaguggugccuaaaguuuaaccaaaaagaccagacuaauauauuaauauauaucug

SEQ ID NO: 391194 - RNA, 64 nt, Human
gugcuguccuuuggccacguguggggacuugucuagaccagaaugaaagggacagggucccaga

SEQ ID NO: 391195 - RNA, 64 nt, Human
gcacaguccaugcagaggcaaaggagacaaagcaagaccagaagggugggaagcuaccacggau

SEQ ID NO: 391196 - RNA, 64 nt, Human
auaggcucaaacacuagagcugcuaguaaaaagaagaccagaugcuucacagaauuaucauuuu

SEQ ID NO: 391197 - RNA, 64 nt, Human
aucuguaaaagcugcuuugaugauagagcucaguagaccagaaguuugauuucauuuuguaugu

SEQ ID NO: 391198 - RNA, 64 nt, Human
ucuuggcugcuuuuguuacuauacauuuucucugagacuccagcagaguuggggcuggaacuug

SEQ ID NO: 391199 - RNA, 64 nt, Human
ccaggaguuuuagacuagccuggacaacuaagugagacuccaucucuacaaaaaauuaaaaaau

SEQ ID NO: 391200 - RNA, 64 nt, Human
aggugcaccccaggaaggccccguagaccuccgaagacuccacaagaaacuaauggaucacugg

SEQ ID NO: 391201 - RNA, 64 nt, Human
aggggcuccucacagcccgggcuggugggagccaagaccagacagagugggggucuccaucugu

SEQ ID NO: 391202 - RNA, 64 nt, Human
gcuacugccccuuggcccuuagacaacaggacagagaccagagggacugggcggcuugucccag

SEQ ID NO: 391203 - RNA, 64 nt, Human
auuaaagugcaaacaaacucagcaauccuuauguagaccagaagcugcaauauacaaugaugaa

SEQ ID NO: 391204 - RNA, 64 nt, Human
guucuuuugucaugaauuuauaauuccuaaaugaagaccagaaaguacaaauugcugggaggaa

SEQ ID NO: 391205 - RNA, 64 nt, Human
ccccucugcucuguccuccccuauugcgcucucaagaccagagacccaacagcagugaucucag

SEQ ID NO: 391206 - RNA, 64 nt, Human
agaauacccccagggagacagggaugccaagaguagaccagagcugggacccacagacagaacc

SEQ ID NO: 391207 - RNA, 64 nt, Human
gguguucugguuucagacucccgacuccccguucagaccagagugccccggccccuccccagcc

SEQ ID NO: 391208 - RNA, 64 nt, Human
cuguaaacccaacagcucaccuccgccuccaggaagaccagacucccacccuuccacaccucca

SEQ ID NO: 391209 - RNA, 64 nt, Human
ucucacuagaauaggauauuaugcauacugagcuagaccagaagagucuggaacaaaauaaaca

SEQ ID NO: 391210 - RNA, 64 nt, Human
gcuuucaguuuccuuaucugcaaaguggaaggucagaccagaugaugcucugguacuccacagu

SEQ ID NO: 391211 - RNA, 64 nt, Human
gccucaggcuucucagcugggaagagaggaugcaagaccagacugaagaacacgguugaguccc

SEQ ID NO: 391212 - RNA, 64 nt, Human
ggguauaaauuauauccgugaguugggggagggaagaccagaauucccuugaauuguguauuga

SEQ ID NO: 391213 - RNA, 64 nt, Human
agucaucagaucaucagagcccccagauggcuacagaccagagauuccacgcucucaggcugac

SEQ ID NO: 391214 - RNA, 64 nt, Human
ggacgcuguccauugccacggccaugagggcuggagaccagaacagcauggcccgaagcgugcg

SEQ ID NO: 391215 - RNA, 64 nt, Human
gcgcugaccuaagagcucccugugccgucuauccagaccagacuucgguagaugccuuuguuag

SEQ ID NO: 391216 - RNA, 64 nt, Human
acaagcaguaagaaacuucuuuuggagaaacaacagaccagaucuuuacucacaacucaugcua

SEQ ID NO: 391217 - RNA, 64 nt, Human
gcccccacccccaaaggcucagccucuaaaucucagacuccaccaccucuuaauggcucagucc

SEQ ID NO: 391218 - RNA, 64 nt, Human
cugcggccugcuggagccugcgcagcuuggauggagacuccaugagaagccguggguggaacca

SEQ ID NO: 391219 - RNA, 64 nt, Human
gcaaauuuuugauucuccauuuuccaaaaguaagagacuccagcauggccuucuguuugccccg

SEQ ID NO: 391220 - RNA, 64 nt, Human
aggauucucagguccccauagagagggaaagagaagaccagaugugcauagaagccagucucug

SEQ ID NO: 391221 - RNA, 64 nt, Human
ucccuggucuuccuccacacaguuguucaccaacagaccagaccuccuuuaaccacagugucaa

SEQ ID NO: 391222 - RNA, 64 nt, Human
ucuucuagcugcuuccucaaccccuguccccuggagaccagaagcugaggcccucucagggagg

SEQ ID NO: 391223 - RNA, 64 nt, Human
uuggugggguccugccggagaggaagagacacucagaccagagaaggggugugcaugcgccuac

SEQ ID NO: 391224 - RNA, 64 nt, Human
gagaaugugacagcuuuccgccuaacuagaaugcagaccagaaugaguucaacucauucugugc

SEQ ID NO: 391225 - RNA, 64 nt, Human
agacaaauaauccaacgcugcuagucuuaaccccagaccagagagaacugcagaucugacuggg

SEQ ID NO: 391226 - RNA, 64 nt, Human
gguuuauuucacacuuacaggcacacacagacacagaccagagacucccagcagcagagcccaa

SEQ ID NO: 391227 - RNA, 64 nt, Human
cauggggugaaauaggagaugcccuguagccuucagaccagagguuuccuccaggacucaaucu

SEQ ID NO: 391228 - RNA, 64 nt, Human
uauguggaauccaagaauaaccauaggcucuaccagaccagaaggguaaggauggacacuaaaa

SEQ ID NO: 391229 - RNA, 64 nt, Human
cuuccuuagcaucucagcagaaaccuugcucugaagaccagagacagaagggacagaaacagga

SEQ ID NO: 391230 - RNA, 64 nt, Human
ucagagaaguugaagaugaauguugacucccaggagaccagaacuauuuuuuuaaagccugaca

SEQ ID NO: 391231 - RNA, 64 nt, Human
acaaacucucccuuccaccuuuacgacccucuccagaccagaccuggaguccucuucaagcagc

SEQ ID NO: 391232 - RNA, 64 nt, Human
ccuuggaccugcuugguuaaggagggagugggccagaccagagugccaggagcuaauggagcca

SEQ ID NO: 391233 - RNA, 64 nt, Human
caaaacacuaagccugaccucucccaaauugggaagaccagaggagaaagugcaaaacuguccc

SEQ ID NO: 391234 - RNA, 64 nt, Human
aucaagcaaagcaccauuauuucuaacauauaaaagaccagaucaaacacaauggaaauaaagc

SEQ ID NO: 391235 - RNA, 64 nt, Human
ccugaccuaucugcagucccccagcacacaaggaagaccagauguagcuacaggaugaugaaac

SEQ ID NO: 391236 - RNA, 64 nt, Human
caaggagaggccuugggcccagaugagccaguacagacuccagacagaggggcccuuggggccc

SEQ ID NO: 391237 - RNA, 64 nt, Human
uuuuuccagcaaaccacgcuaacuagcugaccacagacuccacaguggggggacgggcgcagua

SEQ ID NO: 391238 - RNA, 64 nt, Human
cugagagcuucugugugucaggcugcuggaaagaagacuccauucccaggacagaggcccuuga

SEQ ID NO: 391239 - RNA, 64 nt, Human
guaggaggcacguucuuggucacuguuccauugcagaccagacuugcuggccugaccacaaggg

SEQ ID NO: 391240 - RNA, 64 nt, Human
cauggcgagaauccagcuuugaccuuuauucaagagaccagauggguugccccaggauccggcu

SEQ ID NO: 391241 - RNA, 64 nt, Human
gagcuucuuuagcaaccaagcaugaacuugauuaagaccagaaguuugggagaugaguccuggc

SEQ ID NO: 391242 - RNA, 64 nt, Human
gugagguuacaagcaggugucauggcaggaaggaagaccagaucuguaugauuuguuccauuuu

SEQ ID NO: 391243 - RNA, 64 nt, Human
uuuagcuuggugaaaaaaaguucacugaacaccaagaccagaauggauuuuuuuaaaaaaauag

SEQ ID NO: 391244 - RNA, 64 nt, Human
aguaggauguucucauuuuaaaaacgaggggaaaagaccagaguuuuucaggagaaaacuggag

SEQ ID NO: 391245 - RNA, 64 nt, Human
ugagguggugaaggcaggaugcucucucuaagccagaccagagggacucagacaccaccgauca

SEQ ID NO: 391246 - RNA, 64 nt, Human
auuuuuugucuagagaccagcauguucuccccaaagaccagaauauucuaccuaaauaucaagg

SEQ ID NO: 391247 - RNA, 64 nt, Human
aaagggagaguggcaucccugcugcugcugugccagaccagaguuuccugaggggcccugaccc

SEQ ID NO: 391248 - RNA, 64 nt, Human
aggaaaacacuacuuccaaaacacugaauucucuagaccagaggugcucugaggauccagggcc

SEQ ID NO: 391249 - RNA, 64 nt, Human
ugcaagcugcuugcccaagucacacagcuagugaagaccagagcaguuucaucugguugugacu

SEQ ID NO: 391250 - RNA, 64 nt, Human
ugguagugaugggauucaaaccuggguggcccugagaccagagcuuccgcucuacccacuucac

SEQ ID NO: 391251 - RNA, 64 nt, Human
ggguuggagugaaauucuggucucagacaccaggagaccagagucucugaggaugaaguuuccu

SEQ ID NO: 391252 - RNA, 64 nt, Human
cagaagggacuagggcucuggcggggucuuuguaagaccagaguuucggacagcccagccccgc

SEQ ID NO: 391253 - RNA, 56 nt, Human
ccccggaugaggccaucugagccuccagaccagaccccaaaccagcccuugagucu

SEQ ID NO: 391254 - RNA, 64 nt, Human
gcugcaggcccuuuugggcaaaggggcccauccuagaccagaggagcccaggcccuggcccugc

SEQ ID NO: 391255 - RNA, 64 nt, Human
acacaacguuuuccucaagaaaaugguacaaaacacaaccgaggagcguauacaguugaaaaca

SEQ ID NO: 391256 - RNA, 64 nt, Human
cacauggcggagaguuuuaauuuuuaacuuauugacaaccgagaagguuuaucccgccgauaga

SEQ ID NO: 391257 - RNA, 64 nt, Human
ccuaaugucccuguggucuaaacggcuugauaauacaaccgagccccugaaguagcugcccucc

SEQ ID NO: 391258 - RNA, 64 nt, Human
gaaaauacugaaagcacaggggcagggacagaccagaccagacccaggagucuccaaagcacag

SEQ ID NO: 391259 - RNA, 64 nt, Human
gaagagaaaauacugaaagcacaggggcagggacagaccagaccagacccaggagucuccaaag

SEQ ID NO: 391260 - RNA, 64 nt, Human
guaacaggauuuaucacaagacacgccugcauguagaccagacacagggcguauggaaagcacg

SEQ ID NO: 391261 - RNA, 64 nt, Human
acuaaauuuucaagaguuucagaagcaacaggacagaccagacguuucauucuacccuggggcg

SEQ ID NO: 391262 - RNA, 64 nt, Human
aaccuucugggggagggggauuagcuagacuaggagaccagaagugaaugggaaagggugagga

SEQ ID NO: 391263 - RNA, 64 nt, Human
uggggcucagauuuuccuggcuuugggagcagacagaccagagccaccagccauucagaaaacu

SEQ ID NO: 391264 - RNA, 64 nt, Human
uggcagcauggggcaguggcuggauuucugcccaagaccagaggagugugcugugcuggcaagu

SEQ ID NO: 391265 - RNA, 64 nt, Human
auucaucuguaaaaaggcaucuuauugugccuuuagaccagaguaagggaaagcaggaguccaa

SEQ ID NO: 391266 - RNA, 64 nt, Human
agaagcauaaugagaaagucagacugagguaauaagaccagaauuaagugauagaagaaacugu

SEQ ID NO: 391267 - RNA, 64 nt, Human
cgaccacacaggacacccagccagggaauucugaagaccagagagcagcccacgggcaucacga

SEQ ID NO: 391268 - RNA, 64 nt, Human
agugacagaacuaagaugaucaucuccaguuuauagaccagaaccagagcucagagaggcuaga

SEQ ID NO: 391269 - RNA, 64 nt, Human
uugagacuauuuagauauuaugugagcaauuuaaagaccagaucuaagcaaauuuugaaauaga

SEQ ID NO: 391270 - RNA, 64 nt, Human
uuaaccucucaacuuuuauugcuguauucuagucagaccagaacauacuuccacuacaucaguu

SEQ ID NO: 391271 - RNA, 64 nt, Human
ucccuggacuagugcaguccuugcccucagccccagaccagagaugggugguauaugccaugug

SEQ ID NO: 391272 - RNA, 64 nt, Human
aagagcugauucaaguaaguagaugccuguuuugagaccagaagguuucauaauugguucuacg

SEQ ID NO: 391273 - RNA, 64 nt, Human
aaacaugaaaauagagaucuccucugcaguguagagaccagagcugggcagugcagggcaugga

SEQ ID NO: 391274 - RNA, 64 nt, Human
cagcgaggaggcaccucgggucuugagguuccugacaaccgaucuggucuguugguuugaggau

SEQ ID NO: 391275 - RNA, 64 nt, Human
ucccacggagugaagagacaugggggacuuuugcacaaccgacgcuuuuccuuaauguuaguga

SEQ ID NO: 391276 - RNA, 64 nt, Human
ucggcagcacugccucugcccaccugccuuuaagagacuccagggcugcuccugucaugcagcg

SEQ ID NO: 391277 - RNA, 64 nt, Human
caaggcgggcggaucacuuaaagucaggaguccaagaccagacucgccaacauggugaaaccgu

SEQ ID NO: 391278 - RNA, 64 nt, Human
cuaccguccccgauauucccuucagagagauuaaagaccagaaaaaagugagccucuucaucug

SEQ ID NO: 391279 - RNA, 64 nt, Human
gcauccuucucauugauguagaaaauucugcgauagaccagaaaaauccuggcagcuuuucucc

SEQ ID NO: 391280 - RNA, 64 nt, Human
uauggagauuacaguguuuuucugaccuaguucaagaccagaacaugggucauaggguuuuuau

SEQ ID NO: 391281 - RNA, 64 nt, Human
gcgggugguucaucugaggucagucgggaguucaagaccagacuggccaacauggugaaacccc

SEQ ID NO: 391282 - RNA, 64 nt, Human
accuagguucccucaucuguaaaacaaagguuucagaccagaugguguuuaagguuucucccca

SEQ ID NO: 391283 - RNA, 64 nt, Human
gauuuggggguuauucagccaaaauuaccguuuuagaccagaaugaauagacuacacugauaaa

SEQ ID NO: 391284 - RNA, 64 nt, Human
cuuauccagcagccauaauuugaauaacucuacgagaccagagagacuguaguucccuauuuua

SEQ ID NO: 391285 - RNA, 64 nt, Human
cugggggugggguuacuuuagaaaaaguggacacagaccagacuaaggaagaagucugaggcag

SEQ ID NO: 391286 - RNA, 64 nt, Human
uccugguucccugucccuccccugcgcuccugcgagaccagauauaaaacuagcugccaaccca

SEQ ID NO: 391287 - RNA, 64 nt, Human
gugggaagugggagggcagggcaaagaaaggauuagaccagaggauuuaggaugccuccuucua

SEQ ID NO: 391288 - RNA, 64 nt, Human
cucuacagcuguuuccucagagggaaaaaucuugagaccagaugguggagcucuggagucagag

SEQ ID NO: 391289 - RNA, 64 nt, Human
ccaacccugagucccagaaggagcugaguucucuagaccagaagaggaugacaauggcaacaag

SEQ ID NO: 391290 - RNA, 64 nt, Human
guuacaaaggaaaccaaugccacuuuuguuuauaagaccagaagguagacuuucuaagcauaga

SEQ ID NO: 391291 - RNA, 64 nt, Human
agacacacugaauucuaaaguaccauuucuuuagagaccagaaaaacuaucuuaauacuguaua

SEQ ID NO: 391292 - RNA, 64 nt, Human
gauacugugaaacaucccauuuuuuccguauuagagaccagauauuuuucuaccuguucaugau

SEQ ID NO: 391293 - RNA, 64 nt, Human
ccuccagucucugccuaauuuuuaguguuuaauaacaaccgaaugucuaguaaaugacucuccu

SEQ ID NO: 391294 - RNA, 64 nt, Human
aaccucagcaguucccaucaaggccaccuccaccacaaccgaaaguaucaucucagggaaacuu

SEQ ID NO: 391295 - RNA, 64 nt, Human
uaaguguuggacugcacaaauuaauguuuuucccacaaccgagacuuuggagauuaagaacuua

SEQ ID NO: 391296 - RNA, 64 nt, Human
ccaagcagcaugcuacaggccagccuucaaagaaagaccagaagccaaguguacucugucauca

SEQ ID NO: 391297 - RNA, 64 nt, Human
gaaguucagcuugcaguguaauucagaagaguuaagaccagaaguacuggaaucauacuuccuu

SEQ ID NO: 391298 - RNA, 64 nt, Human
aagguguuuggagaauucgagugccuaggaugccagaccagaguugagacaaaaagaaauaaga

SEQ ID NO: 391299 - RNA, 64 nt, Human
aacaauacagagccagucaacuuccuggaauccaagaccagauaaagaaguaggacaggugccc

SEQ ID NO: 391300 - RNA, 64 nt, Human
uguuaauuccucugauauguuaaaguaaugggugagaccagaaaaagaaauuucaauaacagau

SEQ ID NO: 391301 - RNA, 64 nt, Human
ugcuacuaccguuauacacauauaguguacagccagaccagauuaaacuucauauguaaucucu

SEQ ID NO: 391302 - RNA, 64 nt, Human
ggcgaugguggggagacucggugggugaauggggagaccagaaagaaagaguccacagagccug

SEQ ID NO: 391303 - RNA, 64 nt, Human
agcuucacccugucugcaaagaaaaguuuuaccaagaccagaaguuaaauaugacauuuccuag

SEQ ID NO: 391304 - RNA, 64 nt, Human
cggcuuauuguccauuagaaaaucacuuccauugagaccagacauggagcaacacuuuuuuucu

SEQ ID NO: 391305 - RNA, 64 nt, Human
gggagccauuuccuaauugaauugcguaauuacuagaccagaaugcauaugcuacuauacauug

SEQ ID NO: 391306 - RNA, 64 nt, Human
uuuuucuaaaaagcuauguaucgcuccuauugaaagaccagauccuuagagaaguuugugguau

SEQ ID NO: 391307 - RNA, 64 nt, Human
gggucacaaaucuugcagcccuuaauuugggauaagaccagauuuuccugacauuuuccucuaa

SEQ ID NO: 391308 - RNA, 64 nt, Human
aaaauaaagugauucuacucuucuaagcuuacagagaccagaccaggugaauguaacuggggaa

SEQ ID NO: 391309 - RNA, 64 nt, Human
gguccacgugccuggcucugaaggcccaacugucagaccagaccccucacucaugguggggaga

SEQ ID NO: 391310 - RNA, 64 nt, Human
ugagaaggaacugauacaucugaugcaugcuuugagaccagaagaaaagacuuaccugaauaau

SEQ ID NO: 391311 - RNA, 64 nt, Human
agagaugcugagaugacuacagaaauuaacuuugagaccagaauuacagagaagaaaaaccaaa

SEQ ID NO: 391312 - RNA, 64 nt, Human; identical to SEQ ID NO: 11122

SEQ ID NO: 391313 - RNA, 64 nt, Human
uugauucuguacucuuaaccuuuggcuacuucacagacuccauuggcaacacuguuauugaaaa

SEQ ID NO: 391314 - RNA, 64 nt, Human
ucucaucccugacccuuccccccccgcaaauguuagaccagagcuguugaucccacacauucau

SEQ ID NO: 391315 - RNA, 64 nt, Human
accuugcaucaaggcuccuugguguggccacagcagaccagaugggaaauuauuuguguugagu

SEQ ID NO: 391316 - RNA, 64 nt, Human
ccuuggaagggaagggaaggacgguguccuguggagaccagacucugcaaguggggagaccacc

SEQ ID NO: 391317 - RNA, 64 nt, Human
agcccagacuggaagugagaggcaugauggggagagaccagacugaaucuacgggugagcccug

SEQ ID NO: 391318 - RNA, 64 nt, Human
gguaccuauuacuugggggaggacauguugcagaagaccagaucauuuuuauacagaaugugaa

SEQ ID NO: 391319 - RNA, 64 nt, Human
uuuucaccuaggucuaaauagcuaacuaacugguagaccagaguauuacaucaucuuauuuugg

SEQ ID NO: 391320 - RNA, 64 nt, Human
agaaaaguaaucaagaccugcuccuaagcauaugagaccagauguaauuaaucaauggcaaugc

SEQ ID NO: 391321 - RNA, 64 nt, Human
ugauucugugacucauagaacaugauguuaaaugagaccagacucaacugccaccaguccccag

SEQ ID NO: 391322 - RNA, 64 nt, Human
caaagcaaaacaugaaaugguuuuagcuagagucagaccagaaugaaaaugccaggagcuggua

SEQ ID NO: 391323 - RNA, 64 nt, Human
cucagcacagcccuggauugcagccccgaggcugagaccagacaaagcccgggaggcagaaaga

SEQ ID NO: 391324 - RNA, 64 nt, Human
caggccccgcccgugagucccaagcgugugugcgagaccagauagcucuaggacguucuucugu

SEQ ID NO: 391325 - RNA, 64 nt, Human
uccugggccugggaaacuagguucccagggguugagaccagaaaggugaccaagacagauuuuu

SEQ ID NO: 391326 - RNA, 64 nt, Human
gcagcaguggcuuagaaaguccaauuccaaagccagaccagaagauucuaucccccgcagcgcu

SEQ ID NO: 391327 - RNA, 64 nt, Human
ggccacugcuagcuuucucauacucccacaggcuagaccagagaugccaagucccaacagcacu

SEQ ID NO: 391328 - RNA, 64 nt, Human
ucuacuaagagaagccacugcuccacccggagccagaccagaaacucaagagauaggguagcca

SEQ ID NO: 391329 - RNA, 64 nt, Human
auuuuuguauauaucacucucucccucuccugaaagaccagagauuguguauuuucaguguccc

SEQ ID NO: 391330 - RNA, 64 nt, Human
aacucaggcuuccuccggcagcuccagguucuggacaaccgacuggggcgggagacggggcggu

SEQ ID NO: 391331 - RNA, 64 nt, Human
aaugggaagagcccauaacagaaugaccuauauuacaaccgauauaaaaccuagguguaggaua

SEQ ID NO: 391332 - RNA, 64 nt, Human
aauggaaacacgagaucaguagugcuaucucaugacaaccgacgaagaaaccgacgacaaaucu

SEQ ID NO: 391333 - RNA, 64 nt, Human
gcaccguguaugcccuggcggucaucucgacgccagaccagaccaaagucuucagugcauccua

SEQ ID NO: 391334 - RNA, 64 nt, Human
ugggaccucuuuacccucugugaccugugggguuagaccagagagggacucuggggucacgucu

SEQ ID NO: 391335 - RNA, 64 nt, Human
ugccuccugagcacugccuuccaugaacagggacagaccagaggcccugcaaggacucccccuc

SEQ ID NO: 391336 - RNA, 64 nt, Human
caucuuggaaccaggaagcccagcuaaagccaagagaccagagagucccugccacuaguuuuca

SEQ ID NO: 391337 - RNA, 64 nt, Human
uggacucuguccccuagggucccuagaagggcaaagaccagagaguugacaagucuguuauuag

SEQ ID NO: 391338 - RNA, 64 nt, Human
cauugcuucuaguuggcagaaauaauugauuaaaagaccagaaacugugauaacuggagguacu

SEQ ID NO: 391339 - RNA, 58 nt, Human
ucugucugucucuccugugaaaccugggagaccagaguccccuuuaggguucccggag

SEQ ID NO: 391340 - RNA, 64 nt, Human
gggggaggaaagggaaggacugggagagacacaaagaccagagccagccucagggacaagagau

SEQ ID NO: 391341 - RNA, 64 nt, Human
cauuucaguagaagauaaucuuaucuaauuuuugagaccagaauaagccuuuuaagguaaaccu

SEQ ID NO: 391342 - RNA, 64 nt, Human
aagcagauuaaguagcagaaaguccaggaaagaaagaccagaaggaguaaugagacaagugaug

SEQ ID NO: 391343 - RNA, 64 nt, Human
aacauggcagcuaacacaugaaugaggccaaucaagaccagaagaaccacucaagcagauccca

SEQ ID NO: 391344 - RNA, 64 nt, Human
accaccgagcagcguucucuugaugccagugcagagaccagagucagaugcccgaggacagugg

SEQ ID NO: 391345 - RNA, 64 nt, Human
cacagcugagagauagaggaggcugugaaugcugagaccagaguuuaucaugcuggacaagccu

SEQ ID NO: 391346 - RNA, 64 nt, Human
gugaccuugauuauuuuggcuuacucuuuggaugagaccagacaagaaaaggauuaaacgggug

SEQ ID NO: 391347 - RNA, 64 nt, Human
uuguccccagagcacccugggccugggcugagccagaccagacccuugggagguggcccuaucc

SEQ ID NO: 391348 - RNA, 64 nt, Human
cccaccacuguaaaaguauuacgucgugcauuaaagaccagaaaagacuugcuuuuacccaggg

SEQ ID NO: 391349 - RNA, 64 nt, Human
augggcauaaguagauaaauaacugugagcucgcacaaccgaaagggccugaccccuuacuuag

SEQ ID NO: 391350 - RNA, 64 nt, Human
ucccaaagugcugggauuacaggcgugagccaccacaaccgacuuuuuuuuuuuuuuuuuuuug

SEQ ID NO: 391351 - RNA, 64 nt, Human
ucuuucacaacacgauuuucuacaaaucuacagcacaaccgaguuuguaacccguggguuagua

SEQ ID NO: 391352 - RNA, 64 nt, Human
aggugaggaucagccuuuuccagcauccugugagagaccagagagagaguuuggauuucaugug

SEQ ID NO: 391353 - RNA, 64 nt, Human
uugcauuaacaaaccuaugagccuucaauggggaagaccagaagggugagaggggcccugaaag

SEQ ID NO: 391354 - RNA, 64 nt, Human
ggauccagcuguucucaccagccuggagguuagcagaccagagugggugggcaggaccuuggcc

SEQ ID NO: 391355 - RNA, 64 nt, Human
agaaggccaggggcuuuugcuaaaaauaguggccagaccagagcucuggagccaccugucccac

SEQ ID NO: 391356 - RNA, 64 nt, Human
ucucuuaacguuccugggagacuccaacaaauggagaccagaaacaaggcaaccacgaccuugc

SEQ ID NO: 391357 - RNA, 64 nt, Human
gcugugcucccuugagugcacuugagcacuccccagaccagaucacuuuuuggacacacccagg

SEQ ID NO: 391358 - RNA, 64 nt, Human
ucuguuucucaggcuccugugagccucaguccugagaccagagucaagaggaaguacacguccc

SEQ ID NO: 391359 - RNA, 64 nt, Human
ugggcuuccuggggccacagggccuauggcagucagaccagaggaagcgguccgggggcugggg

SEQ ID NO: 391360 - RNA, 64 nt, Human
ucuuucugccucuacauauggccuauucugggcuagaccagauuugggggccaggagggaagaa

SEQ ID NO: 391361 - RNA, 64 nt, Human
auuacaacccaaagucucccaggaagcuguggggagaccagaggaucaagcugaagugaagcca

SEQ ID NO: 391362 - RNA, 64 nt, Human
gcgggacuggggagggaacuccgccccucgcgggagaccagaacucuuggagcuuaggggagac

SEQ ID NO: 391363 - RNA, 64 nt, Human
ucaaagacagcuuggccacuuccccuccuugagaagaccagaagucaacccaucccaaagacaa

SEQ ID NO: 391364 - RNA, 64 nt, Human
gaccagcucuuccgaaaaccaggccuuaucuccaagaccagagauaguggggagacuucuuggc

SEQ ID NO: 391365 - RNA, 64 nt, Human
cagaacauccaaaccucaaggcucaggaucccauagaccagagcccaccuuuuugauaaacuua

SEQ ID NO: 391366 - RNA, 64 nt, Human
ucacuugccucaguaguuugccagauguuaagguagaccagaugacccagauaugaagaacuua

SEQ ID NO: 391367 - RNA, 64 nt, Human
uuguuugguaucccacugaaauguucuguguugcagaccagagucuguuuaugucagggggaug

SEQ ID NO: 391368 - RNA, 64 nt, Human
cuguuuguacauggcugacggaaaucucuuugguacaaccgaauaaagccugguggcagugcug

SEQ ID NO: 391369 - RNA, 64 nt, Human
auguccuaaaaugaaagcugcucaaagucacagaacaaccgagggacaaaggagauuggaugac

SEQ ID NO: 391370 - RNA, 64 nt, Human
uuuauagcuggggaaacaggcuccgagaaauugcacaaccgaccucagguggccggcaguggcg

SEQ ID NO: 391371 - RNA, 64 nt, Human
uucugaaaugucccuauaaagaaugagucgaacuagaccagaagccagccuacuccuucuuaca

SEQ ID NO: 391372 - RNA, 64 nt, Human
gggagccagcaagagagcuuggagucgccucucuagaccagaucuagccccacccucacuccag

SEQ ID NO: 391373 - RNA, 64 nt, Human
cccagcaccccucuccuuuggccuccggcagugcagaccagaggggaccuuuuaaggaaagaag

SEQ ID NO: 391374 - RNA, 64 nt, Human
accuuuucucucucuuagcuccacgucagcacugagaccagacucgagcaccccuguccuguaa

SEQ ID NO: 391375 - RNA, 64 nt, Human
guuguuguuguugcuagaaauggauugaauuaguagaccagaaaguaacuucaaauguguauua

SEQ ID NO: 391376 - RNA, 64 nt, Human
gcacuuguuauuuuauuaauuugccugaaugaugagaccagaccagugucuacagauuuucauu

SEQ ID NO: 391377 - RNA, 64 nt, Human
ugcaguguaguaagagaauccaucuuuuacuaggagaccagauuccuuuuauaccucauucauc

SEQ ID NO: 391378 - RNA, 64 nt, Human
gguuugcuguggauucagaagcaccaggagcaagagaccagaaggaugaucugcuccuuuguaa

SEQ ID NO: 391379 - RNA, 64 nt, Human
aagccacuuuaaaaacagcugaagugaccuuagcagaccagagauuuuauuuuuuuaaagagaa

SEQ ID NO: 391380 - RNA, 64 nt, Human
gcccagggaacccagguucaggguaggacaggcaagaccagauacccaaugugcaaagugaaaa

SEQ ID NO: 391381 - RNA, 64 nt, Human
ucuccuucucuggggcuuauuuuuguucagaacuagaccagaguguuugaaccuccuuugcagg

SEQ ID NO: 391382 - RNA, 64 nt, Human
aaauacuugcucuugguaucuauaacuuuugcagagaccagaagcaaacaauuugugggccagu

SEQ ID NO: 391383 - RNA, 64 nt, Human
gcacaaaccuccggcucacucaguuaagggaacaagaccagacacagaaaugccuuuguccuuu

SEQ ID NO: 391384 - RNA, 64 nt, Human
uggguucaaagaccauaaucaugcauaucacauaagaccagaaguggcccagguccagggucag

SEQ ID NO: 391385 - RNA, 64 nt, Human
acaaaaagaaaaacaaauaaaacaaaaccaacucagaccagaacuguuuucucaaccugggacu

SEQ ID NO: 391386 - RNA, 64 nt, Human
agauguggaaucaacguaaaugcccaucagcaguagaccagauaaagaaaauuugguacauaua

SEQ ID NO: 391387 - RNA, 64 nt, Human
uuuauucugcuucgaggguccccagggcccuuguacaaccgacagcucuuacuuuuaaaugcaa

SEQ ID NO: 391388 - RNA, 64 nt, Human
cugcuggggcuggcagagcaguuggcugacagcaacaaccgacaucugaacaccuacauuuccu

SEQ ID NO: 391389 - RNA, 64 nt, Human
ggagccaaacuccucugagaacagucagugcaagagacuccaauaauccauauugaaagaguca

SEQ ID NO: 391390 - RNA, 64 nt, Human
aacagguggacuugucgguugucaccugauaaucagaccagacuacccaccuagguagggcaca

SEQ ID NO: 391391 - RNA, 64 nt, Human
agaggccggcagaucacuugagcccaggaguuggagaccagacuggggaacauggcaagacccc

SEQ ID NO: 391392 - RNA, 52 nt, Human
acccuuuaggaaugaaaugagaagaccagaucagggaagaucaauacgaaag

SEQ ID NO: 391393 - RNA, 64 nt, Human
ggcccuccaagcccaagccuccugcuccgggggcagaccagacucugacucuccucuuggggcu

SEQ ID NO: 391394 - RNA, 64 nt, Human
ccgcgauucccugcgaccaggccccgagagggcgagaccagaggggacggaagcauugcgccug

SEQ ID NO: 391395 - RNA, 64 nt, Human
ccgcgauacagacccacagagugccaucccugagagaccagaccgcuccccaauacucuccuaa

SEQ ID NO: 391396 - RNA, 64 nt, Human
cuuuauaucauauacaaaaauaaaauccaacuaaagaccagaauauaaaaagcaaaauuuuaaa

SEQ ID NO: 391397 - RNA, 64 nt, Human
aaugucugcccucugaauucagacacacuauauuagaccagaccaccaugugucauugugugug

SEQ ID NO: 391398 - RNA, 64 nt, Human
aacugaaacaagaagaaacaucaaauuugcgaugagaccagaugcuguggcucaggccuguaau

SEQ ID NO: 391399 - RNA, 64 nt, Human
gggcagaggcaugcuccuggcaucgaguggguggagaccagagaagccgcucaacauccugcaa

SEQ ID NO: 391400 - RNA, 64 nt, Human
cucucauaaagcuucuuuuucacauuacuguuaaagaccagacguucuagaaaagaccccuccu

SEQ ID NO: 391401 - RNA, 64 nt, Human
agcggggaaauguugagcucaaauggguaaauugagaccagaaaauuauuuuuucaaccuagag

SEQ ID NO: 391402 - RNA, 64 nt, Human
ucuggccaacccucagaaacccucacaauaaaccagaccagaaggaugucccaucugaaugccc

SEQ ID NO: 391403 - RNA, 64 nt, Human
ggggcugauucggagagggcgccccgccgcgcagagaccagagcuccucagugccaguuuggcc

SEQ ID NO: 391404 - RNA, 64 nt, Human
ugccugccccugggcgagugcgggcagggaucugagaccagauuguucucgcaccccugccaga

SEQ ID NO: 391405 - RNA, 64 nt, Human
ucugggcuugggguguggggugggguggagucgcagaccagagcugucugaacucaugugucag

SEQ ID NO: 391406 - RNA, 64 nt, Human
uuucauuuuaaagcacaccugagaugauucucauacaaccgaaauuuuagauccauagcccuau

SEQ ID NO: 391407 - RNA, 64 nt, Human
uaaagucacuuaagggagucguggaggcuaaaauacaaccgagaggggagauuuuuaaaaaaga

SEQ ID NO: 391408 - RNA, 64 nt, Human
ccuuuuuaauaccuauacacacuaaguccaucuuacaaccgacugaagggguguugcaccuaau

SEQ ID NO: 391409 - RNA, 64 nt, Human
gcugguccgaaguuggccacauugcugccagccaagaccagaaauaaacagccgaugcugacau

SEQ ID NO: 391410 - RNA, 64 nt, Human
cgccugaaaauuagcauauugauaguucuuagagagaccagauauaaucuaagaauuuauauga

SEQ ID NO: 391411 - RNA, 64 nt, Human
cgagguggccagaucaccugaggucaggaguuugagaccagacugaccaacauggagaaacccc

SEQ ID NO: 391412 - RNA, 64 nt, Human
ugccacagggucaaaggagguuuucgaucagcccagaccagaggcucugagcccugaaccaaag

SEQ ID NO: 391413 - RNA, 64 nt, Human
cgguaaaacuccuccaggcagcugacagcuuuaaagaccagaccuucuuucucagccagguuuc

SEQ ID NO: 391414 - RNA, 64 nt, Human
ggccaggcccugggagggcaggcaggcaaaggggagaccagagggucuguguucuccaggagaa

SEQ ID NO: 391415 - RNA, 64 nt, Human
agaagauugagaaagugccugaugcccgcgucagagaccagaggagccaacugagaugaugggg

SEQ ID NO: 391416 - RNA, 64 nt, Human
acgacccggggcgggcugaugucuucuugggggcagaccagagagcucaaguuucagagucaga

SEQ ID NO: 391417 - RNA, 64 nt, Human
aagcaguguuggggguagcggcaugcagacccucagaccagaauggggacaucuuguggucugc

SEQ ID NO: 391418 - RNA, 64 nt, Human
guguucagagccaagcaagaaguugaaguugccuagaccagaggacauaaguaucaugucuccu

SEQ ID NO: 391419 - RNA, 64 nt, Human
ggaaucugccuggaacaaagaacugcaccuaagcagaccagaagcaaaaugucuucuucacggc

SEQ ID NO: 391420 - RNA, 64 nt, Human
gauuuguuaaaacaugcuacauguccaaaaauaaagaccagaaugacauuuugauaauuuucug

SEQ ID NO: 391421 - RNA, 64 nt, Human
guggucucccuguccaagcgggaccgcuuugcagagaccagaggcauaucgcggcuugagcuga

SEQ ID NO: 391422 - RNA, 64 nt, Human; identical to SEQ ID NO: 391419

SEQ ID NO: 391423 - RNA, 51 nt, Human
gcuauuuuuuucaggauuaaaagaccagaauaugagacaggaacugaagua

SEQ ID NO: 391424 - RNA, 64 nt, Human
uuuccuccgcgccugaggagugaacugaaauaggacaaccgaaucaggaagcgaagccccagga

SEQ ID NO: 391425 - RNA, 64 nt, Human
cccagcagccuggggucugacaauaccucgagccacaaccgaccagaugccagggacccacgga

SEQ ID NO: 391426 - RNA, 64 nt, Human
uucugccggcuccgcaacugagugacacccagcgacaaccgacuggggagugguagaagcaacu

SEQ ID NO: 391427 - RNA, 64 nt, Human
aagacugaugagacuaggugcuuugcuuccuuucaucagguaucuuucuguggcauuugagaac

SEQ ID NO: 391428 - RNA, 64 nt, Human
cauugcugcugcguggguauuugucuccuuagccaucagguacaguuuacacuacaauguaagc

SEQ ID NO: 391429 - RNA, 64 nt, Human
gggaccaccuguccauccuacuucccucaauugaaucagguaacacuaacggaucaaggcaggg

SEQ ID NO: 391430 - RNA, 64 nt, Human
ucauacuauccauccauaccacacuaucuucuguaucagguagucuaauagaaauauaccuguu

SEQ ID NO: 391431 - RNA, 64 nt, Human
uauaugauugcgaguggaaaaauaggggacagaaaucagguauuggcaguuuuuccauuuucau

SEQ ID NO: 391432 - RNA, 64 nt, Human
uuguuaguauuuaaccaaauaggcuaaaauuuuaaucagguaccuuauguauuaaauagaaauc

SEQ ID NO: 391433 - RNA, 64 nt, Human
agaaaaauuugguaggcgguaguuuagaacucugaucagguacuacaucaaccaaaagaggaaa

SEQ ID NO: 391434 - RNA, 64 nt, Human
aucagcaagacugguuugugcaaagcguugagucaucagguauuuagagccuagccagcuaccc

SEQ ID NO: 391435 - RNA, 64 nt, Human
auucccuucuaauaucuucucaggaguaauacaaaucagguauuucaucaucauuugguaauau

SEQ ID NO: 391436 - RNA, 64 nt, Human
aggucagaugugacuacagaacucuaggugaaaaaucagguaggguucaaauuaaguagaacug

SEQ ID NO: 391437 - RNA, 64 nt, Human
cggaaaccguuuucuuguaagccccuagaggcagaucagguaaagcauacauaguagagggaaa

SEQ ID NO: 391438 - RNA, 64 nt, Human
gaagaccaaccaagagaucaagcuaucucugcgaaucagguaaauaucagcaguaauuauugag

SEQ ID NO: 391439 - RNA, 64 nt, Human
auucugaaauugggaaacauuuauuuuaaaugcaaucagguaguguugcuuuuuacagcauaau

SEQ ID NO: 391440 - RNA, 64 nt, Human
gauuuggucaaaugagggauucccucaaagcaauaucagguaaaccaaguugcuuuccucacuc

SEQ ID NO: 391441 - RNA, 64 nt, Human
gaccccaaggauauauuauuuuauuccaagaaagaucagguaggcgaaaagaugacaggauaca

SEQ ID NO: 391442 - RNA, 64 nt, Human; identical to SEQ ID NO: 11124

SEQ ID NO: 391443 - RNA, 64 nt, Human; identical to SEQ ID NO: 11125

SEQ ID NO: 391444 - RNA, 64 nt, Human; identical to SEQ ID NO: 11126

SEQ ID NO: 391445 - RNA, 64 nt, Human
ccauugccuccucccucuccugucaaaaacccugaucagguagauuuggaggcggccacgauuu

SEQ ID NO: 391446 - RNA, 64 nt, Human
ugagcuauuuguauauucuagacgccagucuuuuaucagguauaugacugguaaaaauguucuc

SEQ ID NO: 391447 - RNA, 64 nt, Human
ccaugauggccauagauuugccuugugguguuggaucagguacugugucugcucauaaguacuu

SEQ ID NO: 391448 - RNA, 64 nt, Human
auauucucuaaagauuugaguccuaaaugcuuucaucagguaaauaaaauguauaauacaaacu

SEQ ID NO: 391449 - RNA, 64 nt, Human
accccacccauggaauaccugccucaucccaaagaucagguaugggcugaaugcagccaucuga

SEQ ID NO: 391450 - RNA, 64 nt, Human
auacuguauucuagccagaauaauuuuagaucugaucagguaguagcuaaaauuagaaaaaaac

SEQ ID NO: 391451 - RNA, 64 nt, Human
uuuaaaaaacagaaaaacagacaaaacaauccccaucagguagcugucuaacccccagcugggu

SEQ ID NO: 391452 - RNA, 64 nt, Human
auugaugcaaguuuuuuuauuguuucuuucuaugaucagguaccugcuuucauuuuagacugcu

SEQ ID NO: 391453 - RNA, 64 nt, Human
guauuaaaacucauguggcaguauccuggucuuaaucagguauugcaguguucaaacaagguau

SEQ ID NO: 391454 - RNA, 64 nt, Human
agcuaauuugguagaagcuaauuugcuucuaaaaaucagguauaaaguucagaugagauuccca

SEQ ID NO: 391455 - RNA, 64 nt, Human
auucagucuuccagauuaugccucacaugcuagcaucagguaaugcugacugaauuucagugaa

SEQ ID NO: 391456 - RNA, 64 nt, Human
acuugggacuuagcccguugguguaaaaguauaaaucagguauuuguauuaaauugauuaaaau

SEQ ID NO: 391457 - RNA, 64 nt, Human
aaguguuauuugcaaaagguagauuauguaaccaaucagguacguaccaggcagugaugugcua

SEQ ID NO: 391458 - RNA, 64 nt, Human
accaucucaagaagccuaagaaguuauauauuuaaucagguagacaaaacaguucaaagcauaa

SEQ ID NO: 391459 - RNA, 64 nt, Human
caccagucauuuuuuaagaaugcaagaugaaaaaaucagguaaaaucuaaccauuuuauucucu

SEQ ID NO: 391460 - RNA, 64 nt, Human; identical to SEQ ID NO: 11130

SEQ ID NO: 391461 - RNA, 64 nt, Human; identical to SEQ ID NO: 11131

SEQ ID NO: 391462 - RNA, 64 nt, Human; identical to SEQ ID NO: 11132

SEQ ID NO: 391463 - RNA, 64 nt, Human
uguuuacauuugauuuauuugggaucuuauugacaucagguauacuuggaagacauuucuuuua

SEQ ID NO: 391464 - RNA, 64 nt, Human
acacaugcucagagcugagauauuucucugauaaaucagguaacaaaauguauuugauugaugg

SEQ ID NO: 391465 - RNA, 64 nt, Human
caaauaaagaugauuagcucaccuugagauaacaaucagguaagaucauaacaaugucucauga

SEQ ID NO: 391466 - RNA, 64 nt, Human
ugguacagauaguuggcacuauccuaguuauggcaucagguaggagaaggagacgaagaugcuu

SEQ ID NO: 391467 - RNA, 64 nt, Human
agguccauguauuucacuuuucuuaaauaaaagaaucagguaaccuuucugugacuugaguccu

SEQ ID NO: 391468 - RNA, 64 nt, Human
gucuucacuagaacaccauugucaucucauauugaucagguauuuuaaucuagcacuuacauau

SEQ ID NO: 391469 - RNA, 64 nt, Human
aaaauaguuaugaaaucuuagccacaaaaaauaaaucagguaaacauuuuaaccugucguuaag

SEQ ID NO: 391470 - RNA, 64 nt, Human
aacugcauugccuauucuuuuuuccugacaugcuaucagguaucaguguguugaauacauacug

SEQ ID NO: 391471 - RNA, 64 nt, Human
ggauagauuaagucaacaaaaugcaauaucagucaucagguaaauugcaagcugaggauaaaua

SEQ ID NO: 391472 - RNA, 64 nt, Human
uggaaagccucauggucacuaauuuucaacuagcaucagguauuuugaaaacgugugucuggau

SEQ ID NO: 391473 - RNA, 64 nt, Human
ucaugaaaccaaucaacagccaagucagcaagcaaucagguaaugaugugcgaguccccucagg

SEQ ID NO: 391474 - RNA, 64 nt, Human
aacaacucagauaaguacaccugagagcauuucuaucagguaaacugucacuuaaauggaggug

SEQ ID NO: 391475 - RNA, 64 nt, Human
ugccuuauuuuucuuccaaacuucauauaugucuaucagguaauaauaggcuugaaaauugaua

SEQ ID NO: 391476 - RNA, 64 nt, Human
ccaaaacuugaauucuggguugaauuuuuuaaaaaucagguaccacuugauuucauaugggaaa

SEQ ID NO: 391477 - RNA, 64 nt, Human
uacgacccaaaugaaccucgauacugcauuuguaaucagguaucuuauggugagauggugggau

SEQ ID NO: 391478 - RNA, 64 nt, Human; identical to SEQ ID NO: 11139

SEQ ID NO: 391479 - RNA, 64 nt, Human; identical to SEQ ID NO: 11140

SEQ ID NO: 391480 - RNA, 64 nt, Human
cccgccacugcacuccagcccaggugacagagcgagacuccaucucaaaaaaaaaaaaaagcaa

SEQ ID NO: 391481 - RNA, 64 nt, Human
cuugagucuuuuuugaauugaacaugcuaggauuaucagguaaaaauuaagccuuuugguacuu

SEQ ID NO: 391482 - RNA, 64 nt, Human
cuacacauaaacuccuaauauugaaucauuaccuaucagguauuaucuuuauggaacuuuucaa

SEQ ID NO: 391483 - RNA, 64 nt, Human
agggauuaagcccacacccuggcuuccauuccauaucagguacaggauuugauguuauuaacau

SEQ ID NO: 391484 - RNA, 64 nt, Human
auagaugaauaaauaaagagugagagaagagagaaucagguaccuuuuuuaaauuaaaggacuu

SEQ ID NO: 391485 - RNA, 64 nt, Human
cauagcacaagauaaauugagcuaguuaaggcaaaucagguaaaauagucaugauucuauguaa

SEQ ID NO: 391486 - RNA, 64 nt, Human
ccugcuggaucuugccuaaaucccaagaaauggaaucagguagacuuuuaauaucacuaauuuc

SEQ ID NO: 391487 - RNA, 64 nt, Human
ccaaacuuauggacacugccuuagccucuuggaaaucagguagaccauauucuaaguuagacuc

SEQ ID NO: 391488 - RNA, 64 nt, Human
agaugggcuaaauaaaagccaaauuaauccuacaaucagguauuauguuuuuaaaccaaguuga

SEQ ID NO: 391489 - RNA, 64 nt, Human
aacaaaaaaacaaaaacaaaaaaacaaaaccagaaucagguaaaacagcuaugugauuaaaaua

SEQ ID NO: 391490 - RNA, 64 nt, Human
cuagggaacuaggaccuaggaagagguaaagauuaucagguaugcaaagcgccccaauucuucu

SEQ ID NO: 391491 - RNA, 64 nt, Human
acauaggcaguuaaguggagaaccagguuucaaaaucagguaagaaaaccaucaucauuaacug

SEQ ID NO: 391492 - RNA, 64 nt, Human
cauuugucuguguuuucuucuugugguuguauauaucagguaaaauauuuuccaaagagccaug

SEQ ID NO: 391493 - RNA, 64 nt, Human
uguaaguccaauaauuuaaguccagugauucaaaaucagguauagaguccagaaacauggacua

SEQ ID NO: 391494 - RNA, 64 nt, Human
gaauuacugguuugauagaguagucuuggaaaccaucagguacugccugcagacuucuccagca

SEQ ID NO: 391495 - RNA, 64 nt, Human
gggggucauuuaccaguuuguuguagaagaaauaaucagguaaguuaaaaguucauuuccagag

SEQ ID NO: 391496 - RNA, 64 nt, Human; identical to SEQ ID NO: 11136

SEQ ID NO: 391497 - RNA, 64 nt, Human; identical to SEQ ID NO: 11137

SEQ ID NO: 391498 - RNA, 64 nt, Human; identical to SEQ ID NO: 11138

SEQ ID NO: 391499 - RNA, 64 nt, Human
aaaauaaaaacuauucgaaugaaaagacaagaaaaucagguauuaaucuuggauagcuaauaau

SEQ ID NO: 391500 - RNA, 64 nt, Human
uguaaguguuuacaacuggcaugugcuuuuaaacaucagguaagaggggaacagcugcuguaca

SEQ ID NO: 391501 - RNA, 64 nt, Human
cuuuucuaucacuuguuaaaagcagaaaacauguaucagguacuuaauugcauagaguuaguuu

SEQ ID NO: 391502 - RNA, 64 nt, Human
guuaauuagagucagagccuguucacauauugugaucagguagcaaugacauguaccacuuaaa

SEQ ID NO: 391503 - RNA, 64 nt, Human
cacugguuagcaaccccaauacagagaccaccagaucagguauagacuccugaaagacaauaua

SEQ ID NO: 391504 - RNA, 64 nt, Human
gaaguggugcuauggucuguuaaacagggcuggcaucagguagagggagcagaguggugaccug

SEQ ID NO: 391505 - RNA, 64 nt, Human
agaaaaaucaagguauuugggaaacaugggcauaaucagguaguuuugcuaaaauuccucuucc

SEQ ID NO: 391506 - RNA, 64 nt, Human
caguuuacuguucuguacuuucuguuguaucacaaucagguaaaagucacuuuaaacugaggaa

SEQ ID NO: 391507 - RNA, 64 nt, Human; identical to SEQ ID NO: 391437

SEQ ID NO: 391508 - RNA, 64 nt, Human
ggauggcagucgagccaaaucgcauggcuuucagaucagguauucugcacauucauuccaaggu

SEQ ID NO: 391509 - RNA, 64 nt, Human
aauguuucuguuguuuacuggugccucccguugcaucagguagagauugccugccucuuuguag

SEQ ID NO: 391510 - RNA, 64 nt, Human
gcuuuucaucuuucagguaccugaaaugagugacaucagguauuuggaaggaguaagaucauaa

SEQ ID NO: 391511 - RNA, 64 nt, Human
ggaagaauaagggaaacagauaaucuucagaguaaucagguaaagcuuaaacaaguguuuuaaa

SEQ ID NO: 391512 - RNA, 64 nt, Human
uuuggaccuugggaucagaucaagaguuuuggagaucagguaccaaggaaauaaggacagucua

SEQ ID NO: 391513 - RNA, 64 nt, Human
uuuaaaauccaggaucaucaaugcuauuaacaguaucagguaaaaaguacacuuuaaaauauuu

SEQ ID NO: 391514 - RNA, 64 nt, Human
gagagacucugaggacauggagagagacucaaagagacuccaagauucaaagagacuaauagag

SEQ ID NO: 391515 - RNA, 64 nt, Human
gcaccacugcaguucagccuggaugaugagagugagacuccaucgcaaaaaaaaaaaaaaaaaa

SEQ ID NO: 391516 - RNA, 64 nt, Human
ucagaaguucaaggccagccuggacgacauagcgagacuccaccucuaccaaaaaauaaaaauu

SEQ ID NO: 391517 - RNA, 64 nt, Human
ccuugggcaucuucaugcaucaaccaaaugggccaucagguacuucauuagucauggcagaagg

SEQ ID NO: 391518 - RNA, 64 nt, Human
auugauucaagauuggacauggucuccucugauuaucagguacuggggcugagggcauuaaaaa

SEQ ID NO: 391519 - RNA, 64 nt, Human
acuucuaaagaaacugcuccagcuuuugcagccaaucagguagcuuaauggauguaauacauuu

SEQ ID NO: 391520 - RNA, 64 nt, Human
ggcucugucagcauuuguaauuguacauuuauucaucagguauuuauagugaaucauacuguaa

SEQ ID NO: 391521 - RNA, 64 nt, Human
cauguagaugggauauugggaugaggaaaggaaaaucagguagauggugcuuuuuuucccccaa

SEQ ID NO: 391522 - RNA, 64 nt, Human
gccagaguggaaacagaguggaaacacauggagcaucagguagaauucucagaaagguuuuguu

SEQ ID NO: 391523 - RNA, 64 nt, Human
aauacauguguaagugccagacagcugaaucuuuaucagguauuguaaagauacacauaugaua

SEQ ID NO: 391524 - RNA, 64 nt, Human
ucuguaaaaagcaggugacuuuccuaugacacucaucagguaaacugaugcuuucagauccauc

SEQ ID NO: 391525 - RNA, 64 nt, Human
aauagaaaaucauguauaguauuucauaguaauaaucagguaccuuacaagcugcugguggauu

SEQ ID NO: 391526 - RNA, 64 nt, Human
uaaaaauccaaaugaaaguaaauggaauaaauguaucagguaaaggacaaguuguaagcuugga

SEQ ID NO: 391527 - RNA, 64 nt, Human
uaccucaaaaucgugcccucuuuacauaugucuuaucagguauaacauguugaaaugucacauu

SEQ ID NO: 391528 - RNA, 64 nt, Human
cagaaguccuacaaccuugacaaagaguaguuuuaucagguaaauccugguaauuaaaaacgca

SEQ ID NO: 391529 - RNA, 64 nt, Human
acucaguucccaaauccccaguuuaugcagcgccaucagguauuuuaagcuaaacuucuucacc

SEQ ID NO: 391530 - RNA, 64 nt, Human
agacagccaaagaaauaaaagcagauuaaacuguaucagguacauuccagccuguuggcaacuc

SEQ ID NO: 391531 - RNA, 64 nt, Human
aaccuagccaaggcugcagcauauagaccaggaaaucagguagcccagacuggugauggagcag

SEQ ID NO: 391532 - RNA, 64 nt, Human; identical to SEQ ID NO: 11142

SEQ ID NO: 391533 - RNA, 64 nt, Human; identical to SEQ ID NO: 11143

SEQ ID NO: 391534 - RNA, 64 nt, Human; identical to SEQ ID NO: 11144

SEQ ID NO: 391535 - RNA, 64 nt, Human
gauauguaguauugucauuauuuccuucuucuacaucagguaguggaggcucagacaaguuauu

SEQ ID NO: 391536 - RNA, 64 nt, Human
aggccuucuuguugcuguuagaauagugcuauauaucagguaugugaccauuuauuucagaagg

SEQ ID NO: 391537 - RNA, 64 nt, Human
guauguuuaauuuuaaagaucauuuaaaauuaacaucagguauauuuuguaaauuuaguuaaca

SEQ ID NO: 391538 - RNA, 64 nt, Human
ggcagaguuuaauugagcaaaggacaauucacaaaucagguagccccugaaccauaauaggcuc

SEQ ID NO: 391539 - RNA, 57 nt, Human
acaguggagaugaagccuaagaauaugaucagguaacuuucgaccgacuuuccccaa

SEQ ID NO: 391540 - RNA, 64 nt, Human
agacugagucauaacugauuuaaaaguuuguguuaucagguaucuuauuugaacauggucauuu

SEQ ID NO: 391541 - RNA, 64 nt, Human
cccuuugcacugcaucacccuggugcccagcaacaucagguaaccuucacugagcaccaagcuu

SEQ ID NO: 391542 - RNA, 64 nt, Human
uaguuccuuacauauuuuugcauauuaacccuuuaucagguauacagcuugcaacuauuuucuc

SEQ ID NO: 391543 - RNA, 64 nt, Human
cgcacgcccccaaaccagcuguuuacauacaggaaucagguauuggggccccucggaggccgag

SEQ ID NO: 391544 - RNA, 64 nt, Human
ccagagcgguaucucuggcaccacacuagggacuaucagguaauaaaagcuuugacucccugag

SEQ ID NO: 391545 - RNA, 64 nt, Human
ggcaggcacccccuauuccugcucccccaacuggaucagguagaacaacaaaagcacuuuucca

SEQ ID NO: 391546 - RNA, 64 nt, Human
guucccaagcuacagguggggugggaaaggcuuuaucagguaucaucaacagguucucaauuaa

SEQ ID NO: 391547 - RNA, 64 nt, Human
cuuccaugacacuuccuugcuuuggccagaagccaucagguaagguuggaaagagccucugacc

SEQ ID NO: 391548 - RNA, 64 nt, Human
uuguuuugaacuguauuuacauacaucauguuuuaucagguacccaccaacuuuauacuuucug

SEQ ID NO: 391549 - RNA, 64 nt, Human
aguuaaggaugccuucaaaauuuuuguuuagaucaucagguaaaugagucagcauauccuugua

SEQ ID NO: 391550 - RNA, 64 nt, Human; identical to SEQ ID NO: 11148

SEQ ID NO: 391551 - RNA, 64 nt, Human; identical to SEQ ID NO: 11149

SEQ ID NO: 391552 - RNA, 64 nt, Human; identical to SEQ ID NO: 11150

SEQ ID NO: 391553 - RNA, 64 nt, Human
ucuuuucaugaauaguaaguugauauauuuauuuaucagguaucuugcaguugucaccaaauac

SEQ ID NO: 391554 - RNA, 64 nt, Human
guaggcuuuuuacucaauuauguacaaaccacaaaucagguacuguauuuuagugaagcauugc

SEQ ID NO: 391555 - RNA, 64 nt, Human
uaagggcccaggucagccacuguuuguuuacaaaaucagguaacuaacugcauacacuuuuucu

SEQ ID NO: 391556 - RNA, 64 nt, Human
gccuaugaggggguuuggcaccaagcucuguccaaucagguaggcugggccugaacuagccaau

SEQ ID NO: 391557 - RNA, 64 nt, Human
aaacuuucaaaaacugcuaaaacaggugccaugaaucagguacaauuacuguagaaacuaacau

SEQ ID NO: 391558 - RNA, 64 nt, Human
ucucaucauuguugcuacuuccuuuuguauuuucaucagguauuuuuuuaacuguaggguuuuu

SEQ ID NO: 391559 - RNA, 64 nt, Human
ugagaccccugaggcaacuagcuuugagggacacaucagguauacuagggaaagauggacaucu

SEQ ID NO: 391560 - RNA, 64 nt, Human
aaaaguuccaaagcuuaucauuuagaucaucuaaaucagguaugagugaaacucuggguauggu

SEQ ID NO: 391561 - RNA, 64 nt, Human
ccggcuugcuccaguguagcuuucuacaucccacaucagguauauuagagcuuauccgaacugg

SEQ ID NO: 391562 - RNA, 64 nt, Human
gcauguacuucgagcaccgacuauagacauuuagaucagguacccagugucugucucccacgac

SEQ ID NO: 391563 - RNA, 64 nt, Human
aaagucuucaccuggaaaucacaacuggguaugcaucagguaucuaauagcagggaggaggaag

SEQ ID NO: 391564 - RNA, 64 nt, Human
gccuaaauguaaaauauaucuuuucauucaucuuaucagguaaaaggaaauucagaaaauuucc

SEQ ID NO: 391565 - RNA, 64 nt, Human; identical to SEQ ID NO: 11153

SEQ ID NO: 391566 - RNA, 64 nt, Human; identical to SEQ ID NO: 11154

SEQ ID NO: 391567 - RNA, 64 nt, Human; identical to SEQ ID NO: 11155

SEQ ID NO: 391568 - RNA, 64 nt, Human; identical to SEQ ID NO: 391427

SEQ ID NO: 391569 - RNA, 64 nt, Human; identical to SEQ ID NO: 391428

SEQ ID NO: 391570 - RNA, 64 nt, Human; identical to SEQ ID NO: 391429

SEQ ID NO: 391571 - RNA, 64 nt, Human; identical to SEQ ID NO: 391430

SEQ ID NO: 391572 - RNA, 64 nt, Human; identical to SEQ ID NO: 391431

SEQ ID NO: 391573 - RNA, 64 nt, Human; identical to SEQ ID NO: 391432

SEQ ID NO: 391574 - RNA, 64 nt, Human; identical to SEQ ID NO: 391433

SEQ ID NO: 391575 - RNA, 64 nt, Human; identical to SEQ ID NO: 391434

SEQ ID NO: 391576 - RNA, 64 nt, Human; identical to SEQ ID NO: 391435

SEQ ID NO: 391577 - RNA, 64 nt, Human; identical to SEQ ID NO: 391436

SEQ ID NO: 391578 - RNA, 64 nt, Human; identical to SEQ ID NO: 391437

SEQ ID NO: 391579 - RNA, 64 nt, Human; identical to SEQ ID NO: 391438

SEQ ID NO: 391580 - RNA, 64 nt, Human; identical to SEQ ID NO: 391439

SEQ ID NO: 391581 - RNA, 64 nt, Human; identical to SEQ ID NO: 391440

SEQ ID NO: 391582 - RNA, 64 nt, Human; identical to SEQ ID NO: 391441

SEQ ID NO: 391583 - RNA, 64 nt, Human; identical to SEQ ID NO: 11145

SEQ ID NO: 391584 - RNA, 64 nt, Human; identical to SEQ ID NO: 11146

SEQ ID NO: 391585 - RNA, 64 nt, Human; identical to SEQ ID NO: 11156

SEQ ID NO: 391586 - RNA, 64 nt, Human; identical to SEQ ID NO: 391445

SEQ ID NO: 391587 - RNA, 64 nt, Human; identical to SEQ ID NO: 391446

SEQ ID NO: 391588 - RNA, 64 nt, Human; identical to SEQ ID NO: 391447

SEQ ID NO: 391589 - RNA, 64 nt, Human; identical to SEQ ID NO: 391448

SEQ ID NO: 391590 - RNA, 64 nt, Human; identical to SEQ ID NO: 391449

SEQ ID NO: 391591 - RNA, 64 nt, Human; identical to SEQ ID NO: 391450

SEQ ID NO: 391592 - RNA, 64 nt, Human; identical to SEQ ID NO: 391451

SEQ ID NO: 391593 - RNA, 64 nt, Human; identical to SEQ ID NO: 391452

SEQ ID NO: 391594 - RNA, 64 nt, Human; identical to SEQ ID NO: 391453

SEQ ID NO: 391595 - RNA, 64 nt, Human; identical to SEQ ID NO: 391454

SEQ ID NO: 391596 - RNA, 64 nt, Human; identical to SEQ ID NO: 391455

SEQ ID NO: 391597 - RNA, 64 nt, Human; identical to SEQ ID NO: 391456

SEQ ID NO: 391598 - RNA, 64 nt, Human; identical to SEQ ID NO: 391457

SEQ ID NO: 391599 - RNA, 64 nt, Human; identical to SEQ ID NO: 391458

SEQ ID NO: 391600 - RNA, 64 nt, Human; identical to SEQ ID NO: 391459

SEQ ID NO: 391601 - RNA, 64 nt, Human
cacaccacugcacuccaaccuggacaacagagcgagacuccaucucaaaaaaaaaaaaaaauug

SEQ ID NO: 391602 - RNA, 64 nt, Human
cuccuaacauguuucuccaaugcaaucaagcccuagacuccaaauguccucccagcucaccucc

SEQ ID NO: 391603 - RNA, 64 nt, Human
cgugccacugcacuccagccuggucaacagagcaagacuccaucucgaagaaaaaaaaaaaaaa

SEQ ID NO: 391604 - RNA, 64 nt, Human; identical to SEQ ID NO: 391463

SEQ ID NO: 391605 - RNA, 64 nt, Human; identical to SEQ ID NO: 391464

SEQ ID NO: 391606 - RNA, 64 nt, Human; identical to SEQ ID NO: 391465

SEQ ID NO: 391607 - RNA, 64 nt, Human; identical to SEQ ID NO: 391466

SEQ ID NO: 391608 - RNA, 64 nt, Human; identical to SEQ ID NO: 391467

SEQ ID NO: 391609 - RNA, 64 nt, Human; identical to SEQ ID NO: 391468

SEQ ID NO: 391610 - RNA, 64 nt, Human; identical to SEQ ID NO: 391469

SEQ ID NO: 391611 - RNA, 64 nt, Human; identical to SEQ ID NO: 391470

SEQ ID NO: 391612 - RNA, 64 nt, Human; identical to SEQ ID NO: 391471

SEQ ID NO: 391613 - RNA, 64 nt, Human; identical to SEQ ID NO: 391472

SEQ ID NO: 391614 - RNA, 64 nt, Human; identical to SEQ ID NO: 391473

SEQ ID NO: 391615 - RNA, 64 nt, Human; identical to SEQ ID NO: 391474

SEQ ID NO: 391616 - RNA, 64 nt, Human; identical to SEQ ID NO: 391475

SEQ ID NO: 391617 - RNA, 64 nt, Human; identical to SEQ ID NO: 391476

SEQ ID NO: 391618 - RNA, 64 nt, Human; identical to SEQ ID NO: 391477

SEQ ID NO: 391619 - RNA, 64 nt, Human
gccagccgagcaggaggccuaggaggguccucugagacuccagaccugaggcgagaagggcugc

SEQ ID NO: 391620 - RNA, 64 nt, Human
uccccugccucccauggcuuacacacuaggauccagacuccaugguuugacaccagccugcguu

SEQ ID NO: 391621 - RNA, 64 nt, Human
cgugccacugcacuccaggcugggugacagagcgagacuccaucucaaaaaaaaaaaaaagaaa

SEQ ID NO: 391622 - RNA, 64 nt, Human; identical to SEQ ID NO: 391481

SEQ ID NO: 391623 - RNA, 64 nt, Human; identical to SEQ ID NO: 391482

SEQ ID NO: 391624 - RNA, 64 nt, Human; identical to SEQ ID NO: 391483

SEQ ID NO: 391625 - RNA, 64 nt, Human; identical to SEQ ID NO: 391484

SEQ ID NO: 391626 - RNA, 64 nt, Human; identical to SEQ ID NO: 391485

SEQ ID NO: 391627 - RNA, 64 nt, Human; identical to SEQ ID NO: 391486

SEQ ID NO: 391628 - RNA, 64 nt, Human; identical to SEQ ID NO: 391487

SEQ ID NO: 391629 - RNA, 64 nt, Human; identical to SEQ ID NO: 391488

SEQ ID NO: 391630 - RNA, 64 nt, Human; identical to SEQ ID NO: 391489

SEQ ID NO: 391631 - RNA, 64 nt, Human; identical to SEQ ID NO: 391490

SEQ ID NO: 391632 - RNA, 64 nt, Human; identical to SEQ ID NO: 391491

SEQ ID NO: 391633 - RNA, 64 nt, Human; identical to SEQ ID NO: 391492

SEQ ID NO: 391634 - RNA, 64 nt, Human; identical to SEQ ID NO: 391493

SEQ ID NO: 391635 - RNA, 64 nt, Human; identical to SEQ ID NO: 391494

SEQ ID NO: 391636 - RNA, 64 nt, Human; identical to SEQ ID NO: 391495

SEQ ID NO: 391637 - RNA, 64 nt, Human
acuccagccugggcaacagagggagacuccaucuagacuccaucucaaaaaaaaaaaaaaaaaa

SEQ ID NO: 391638 - RNA, 64 nt, Human
ucccccacuguacuccagccugggugacagaguaagacuccaucucaaaacaacaaaaacaaca

SEQ ID NO: 391639 - RNA, 64 nt, Human
caacugacauucucuagucgacugccagggccuuagacuccacauguccauuuuuguucaggua

SEQ ID NO: 391640 - RNA, 64 nt, Human; identical to SEQ ID NO: 391499

SEQ ID NO: 391641 - RNA, 64 nt, Human; identical to SEQ ID NO: 391500

SEQ ID NO: 391642 - RNA, 64 nt, Human; identical to SEQ ID NO: 391501

SEQ ID NO: 391643 - RNA, 64 nt, Human; identical to SEQ ID NO: 391502

SEQ ID NO: 391644 - RNA, 64 nt, Human; identical to SEQ ID NO: 391503

SEQ ID NO: 391645 - RNA, 64 nt, Human; identical to SEQ ID NO: 391504

SEQ ID NO: 391646 - RNA, 64 nt, Human; identical to SEQ ID NO: 391505

SEQ ID NO: 391647 - RNA, 64 nt, Human; identical to SEQ ID NO: 391506

SEQ ID NO: 391648 - RNA, 64 nt, Human; identical to SEQ ID NO: 391437

SEQ ID NO: 391649 - RNA, 64 nt, Human; identical to SEQ ID NO: 391508

SEQ ID NO: 391650 - RNA, 64 nt, Human; identical to SEQ ID NO: 391509

SEQ ID NO: 391651 - RNA, 64 nt, Human; identical to SEQ ID NO: 391510

SEQ ID NO: 391652 - RNA, 64 nt, Human; identical to SEQ ID NO: 391511

SEQ ID NO: 391653 - RNA, 64 nt, Human; identical to SEQ ID NO: 391512

SEQ ID NO: 391654 - RNA, 64 nt, Human; identical to SEQ ID NO: 391513

SEQ ID NO: 391655 - RNA, 64 nt, Human
caugccauugcacuccagccugggcaacacagggagacuccaucucaaaaaaaaaaaaaaaaaa

SEQ ID NO: 391656 - RNA, 64 nt, Human
gugggaggggucaggugugggacaugggagcaggagacuccacuuucuuccuuuguacaguaac

SEQ ID NO: 391657 - RNA, 64 nt, Human
uucuucugccaucuuuuaugcaccauagacaucgagacuccaggggguccuggcuccccugucc

SEQ ID NO: 391658 - RNA, 64 nt, Human; identical to SEQ ID NO: 391517

SEQ ID NO: 391659 - RNA, 64 nt, Human; identical to SEQ ID NO: 391518

SEQ ID NO: 391660 - RNA, 64 nt, Human; identical to SEQ ID NO: 391519

SEQ ID NO: 391661 - RNA, 64 nt, Human; identical to SEQ ID NO: 391520

SEQ ID NO: 391662 - RNA, 64 nt, Human; identical to SEQ ID NO: 391521

SEQ ID NO: 391663 - RNA, 64 nt, Human; identical to SEQ ID NO: 391522

SEQ ID NO: 391664 - RNA, 64 nt, Human; identical to SEQ ID NO: 391523

SEQ ID NO: 391665 - RNA, 64 nt, Human; identical to SEQ ID NO: 391524

SEQ ID NO: 391666 - RNA, 64 nt, Human; identical to SEQ ID NO: 391525

SEQ ID NO: 391667 - RNA, 64 nt, Human; identical to SEQ ID NO: 391526

SEQ ID NO: 391668 - RNA, 64 nt, Human; identical to SEQ ID NO: 391527

SEQ ID NO: 391669 - RNA, 64 nt, Human; identical to SEQ ID NO: 391528

SEQ ID NO: 391670 - RNA, 64 nt, Human; identical to SEQ ID NO: 391529

SEQ ID NO: 391671 - RNA, 64 nt, Human; identical to SEQ ID NO: 391530

SEQ ID NO: 391672 - RNA, 64 nt, Human; identical to SEQ ID NO: 391531

SEQ ID NO: 391673 - RNA, 64 nt, Human; identical to SEQ ID NO: 11127

SEQ ID NO: 391674 - RNA, 64 nt, Human; identical to SEQ ID NO: 11128

SEQ ID NO: 391675 - RNA, 64 nt, Human
caggacaaaaugaccaaagacugucagauuucuuagacuccacaggaccaaaccauagaacaau

SEQ ID NO: 391676 - RNA, 64 nt, Human; identical to SEQ ID NO: 391535

SEQ ID NO: 391677 - RNA, 64 nt, Human; identical to SEQ ID NO: 391536

SEQ ID NO: 391678 - RNA, 64 nt, Human; identical to SEQ ID NO: 391537

SEQ ID NO: 391679 - RNA, 64 nt, Human; identical to SEQ ID NO: 391538

SEQ ID NO: 391680 - RNA, 57 nt, Human; identical to SEQ ID NO: 391539

SEQ ID NO: 391681 - RNA, 64 nt, Human; identical to SEQ ID NO: 391540

SEQ ID NO: 391682 - RNA, 64 nt, Human; identical to SEQ ID NO: 391541

SEQ ID NO: 391683 - RNA, 64 nt, Human; identical to SEQ ID NO: 391542

SEQ ID NO: 391684 - RNA, 64 nt, Human; identical to SEQ ID NO: 391543

SEQ ID NO: 391685 - RNA, 64 nt, Human; identical to SEQ ID NO: 391544

SEQ ID NO: 391686 - RNA, 64 nt, Human; identical to SEQ ID NO: 391545

SEQ ID NO: 391687 - RNA, 64 nt, Human; identical to SEQ ID NO: 391546

SEQ ID NO: 391688 - RNA, 64 nt, Human; identical to SEQ ID NO: 391547

SEQ ID NO: 391689 - RNA, 64 nt, Human; identical to SEQ ID NO: 391548

SEQ ID NO: 391690 - RNA, 64 nt, Human; identical to SEQ ID NO: 391549

SEQ ID NO: 391691 - RNA, 64 nt, Human; identical to SEQ ID NO: 11133

SEQ ID NO: 391692 - RNA, 64 nt, Human; identical to SEQ ID NO: 11134

SEQ ID NO: 391693 - RNA, 64 nt, Human; identical to SEQ ID NO: 11151

SEQ ID NO: 391694 - RNA, 64 nt, Human; identical to SEQ ID NO: 391553

SEQ ID NO: 391695 - RNA, 64 nt, Human; identical to SEQ ID NO: 391554

SEQ ID NO: 391696 - RNA, 64 nt, Human; identical to SEQ ID NO: 391555

SEQ ID NO: 391697 - RNA, 64 nt, Human; identical to SEQ ID NO: 391556

SEQ ID NO: 391698 - RNA, 64 nt, Human; identical to SEQ ID NO: 391557

SEQ ID NO: 391699 - RNA, 64 nt, Human; identical to SEQ ID NO: 391558

SEQ ID NO: 391700 - RNA, 64 nt, Human; identical to SEQ ID NO: 391559

SEQ ID NO: 391701 - RNA, 64 nt, Human; identical to SEQ ID NO: 391560

SEQ ID NO: 391702 - RNA, 64 nt, Human; identical to SEQ ID NO: 391561

SEQ ID NO: 391703 - RNA, 64 nt, Human; identical to SEQ ID NO: 391562

SEQ ID NO: 391704 - RNA, 64 nt, Human; identical to SEQ ID NO: 391563

SEQ ID NO: 391705 - RNA, 64 nt, Human; identical to SEQ ID NO: 391564

SEQ ID NO: 391706 - RNA, 64 nt, Human; identical to SEQ ID NO: 11119

SEQ ID NO: 391707 - RNA, 64 nt, Human; identical to SEQ ID NO: 11120

SEQ ID NO: 391708 - RNA, 64 nt, Human; identical to SEQ ID NO: 11121

SEQ ID NO: 391709 - RNA, 64 nt, Human
cacgccacugcacuccagccugggcgacagagagagacuccaucucaaaacaaaaacaaacaaa

SEQ ID NO: 391710 - RNA, 64 nt, Human
gcuugaccugaagaagggccagaccugggcagaaagacuccagcaggugagcucuucaugcgac

SEQ ID NO: 391711 - RNA, 64 nt, Human
uucggcgguugagcuguccccacagcuucucuacagacuccaaaaggcccuuuucagggccccc

SEQ ID NO: 391712 - RNA, 64 nt, Human
gaggguucucauggaggggauaggaaguagguuuaaagccuaccaguguaaccuaccaguacaa

SEQ ID NO: 391713 - RNA, 64 nt, Human
aaaggucaagauacaaauguguauuaaaaaaaaaaaagccuauuaauaggguuucugcgcggug

SEQ ID NO: 391714 - RNA, 64 nt, Human
ccuguggccuggagggacccccucaagaggagacaaagccuaaguuuggggauuggaguggggc

SEQ ID NO: 391715 - RNA, 64 nt, Human
aagaauauucauagcaacccuauucacaaaagcaaaagccuagaaauaacccagaugcccauga

SEQ ID NO: 391716 - RNA, 64 nt, Human
cacacaugcacaagucaugugcgaacagcccuccaaagccuaugccacagacagcucuugcccc

SEQ ID NO: 391717 - RNA, 64 nt, Human
uccagagcucugaugccugugaacacugaaagagaaagccuaauguaaaguagugaugggauuu

SEQ ID NO: 391718 - RNA, 64 nt, Human
uucuugacaaugcagagcaauucugagcagucacaaagccuacucucuguucuugucccugcca

SEQ ID NO: 391719 - RNA, 64 nt, Human
ugaaagugacaggaaucuccucagaaugaagaauaaagccuacuaggucucuaacuguugaacu

SEQ ID NO: 391720 - RNA, 64 nt, Human
uuggaagcccaguuccuuaggugggauaggaaugaaagccuaaaccucuuccuuuagcuuuguu

SEQ ID NO: 391721 - RNA, 64 nt, Human
cccccuuccucgugggacgugucaaguugacuuuaaagccuaagguggcuuguggggacugcac

SEQ ID NO: 391722 - RNA, 60 nt, Human
uguccgccuauccauacuaaggaacucuccaaagccuauuccacauauuuaaaccgcauu

SEQ ID NO: 391723 - RNA, 64 nt, Human
uuaaauuuauuagauaugaguuguuuucagacucagacuccauuuguauuauagucuaauauac

SEQ ID NO: 391724 - RNA, 64 nt, Human
auucaaaaaagugugaugugcugcucagaaggucagacuccaugucugccuugaccucaagguc

SEQ ID NO: 391725 - RNA, 64 nt, Human
uugccacgugcagcugugcucaccccaggucaucagacuccaccgugugcaugugcaucaaugu

SEQ ID NO: 391726 - RNA, 64 nt, Human
uauguuaaacuugauacauuuagaaguuaauguuaaagccuaauccuaaauuuuuaaaagguga

SEQ ID NO: 391727 - RNA, 64 nt, Human
ggacccuggaauccuagguacccacaugugugccaaagccuaccccaccuggcaggugucccac

SEQ ID NO: 391728 - RNA, 64 nt, Human
uaucugguuauugcaucuggugauagaggccuucaaagccuauuauuucuaaccuaaguaaagg

SEQ ID NO: 391729 - RNA, 64 nt, Human
ugaaaucuguaauagcuccccuuuccccaacucuaaagccuagaccuuaaaccuguuccuagag

SEQ ID NO: 391730 - RNA, 64 nt, Human
aaagucaaaaaauuauuugcuauggcaggauaagaaagccuaaaauugaguuuguagaacuuua

SEQ ID NO: 391731 - RNA, 64 nt, Human
gucuuuuuuuuucuguguccccagcacuuacaacaaagccuagcacaaaguagguguucaacaa

SEQ ID NO: 391732 - RNA, 64 nt, Human
agagagcaaauuuucuuuucuuucugaaucccacaaagccuagcaccaaacuucuuuuuuucuu

SEQ ID NO: 391733 - RNA, 64 nt, Human
aaaaacauggguucuuagucuuuagcuaucuguuaaagccuaugaaugccuucuuaaaaucaug

SEQ ID NO: 391734 - RNA, 64 nt, Human
ccucguuccacagcuccaccuucaucuucucaucaaagccuaccauggauacacagggagcuuc

SEQ ID NO: 391735 - RNA, 64 nt, Human
uaagauguauagaguuggggaaucauggagaaggaaagccuauagucgagugccugcuuaggug

SEQ ID NO: 391736 - RNA, 64 nt, Human
acaugcaauccagaucuuuaauuuugccuucacaaaagccuaaugucuguaauuaaccuuuaau

SEQ ID NO: 391737 - RNA, 64 nt, Human
uaauuacaucauaaucauuuauuuuuuaaacuuaaaagccuagaaauuuccuagaaagaaaaua

SEQ ID NO: 391738 - RNA, 64 nt, Human
cauuagccuacaguugggcaaaaucgucuaauacaaagccuauuuuauaauaaaguauguugaa

SEQ ID NO: 391739 - RNA, 64 nt, Human
cagaagcccauggagcagggaugucacgucuugaaaagccuauuagauguuuuacaaauuuaau

SEQ ID NO: 391740 - RNA, 64 nt, Human
uugcuauucagugaaccuuuguacauuucaaagaagacuccauggcugcuccagaugcccccuu

SEQ ID NO: 391741 - RNA, 64 nt, Human
agccacugaguuguguagggaugaagacuauugaagacuccauugccaaaccauggccuuuccu

SEQ ID NO: 391742 - RNA, 64 nt, Human
ggagccaguacugaauuaugccuuggcagaggggagacuccaaaagagucaucgcaggaagaag

SEQ ID NO: 391743 - RNA, 64 nt, Human
uauauuuguuaugauaaaaggaaguagaugugaaaaagccuaagaaaaaggaaauuggacaguu

SEQ ID NO: 391744 - RNA, 64 nt, Human
ccauguucauuugucuaccucuuaacugaauaaaaaagccuacaguuuuuagaaaauuuguucu

SEQ ID NO: 391745 - RNA, 64 nt, Human
acaacaacaauaauuuaucaaaauuggcauauuuaaagccuaacauucuaauaaaggcacaaau

SEQ ID NO: 391746 - RNA, 64 nt, Human
uaacuguugaugagcauuuuggauauucuaggagaaagccuauaauuucacauaguuucucuuu

SEQ ID NO: 391747 - RNA, 64 nt, Human
uuacaagauagauuguauaagaagccaaauaaugaaagccuagaaaaaacuaauuuauacuuau

SEQ ID NO: 391748 - RNA, 64 nt, Human
cuuuucuaaacuaucaaaaacucuagcaguuugaaaagccuaauauuuauuuguaugucaguau

SEQ ID NO: 391749 - RNA, 64 nt, Human
auauaucuacaaaaauauggagaagaguaauuugaaagccuacuuucugaagaaaaugguggga

SEQ ID NO: 391750 - RNA, 64 nt, Human
ggcuggcuucauuaaacccagaaagaauguucagaaagccuauuccaucaacugugaaagcugg

SEQ ID NO: 391751 - RNA, 64 nt, Human
uuuguauguagcaccuuucaugcaaggcaugcaaaaagccuauuuuaaaaucacugugcauauu

SEQ ID NO: 391752 - RNA, 64 nt, Human
uauauuugcaagcaacuaaauuaauugaccugaaaaagccuaucaaauacuaucaaaauguacu

SEQ ID NO: 391753 - RNA, 64 nt, Human
acuucucaguuuaaugugggauuaagagccaagaaaagccuagagagacuggauaucacaauuu

SEQ ID NO: 391754 - RNA, 64 nt, Human
gugacugagcaagacucuuucaaaaaaaaaaaaaaaagccuacauucuccaguugauuauuuca

SEQ ID NO: 391755 - RNA, 64 nt, Human
uuuucauauuucuucacauaucugaaaaauguugaaagccuaagccaggaauaaaagaaaagua

SEQ ID NO: 391756 - RNA, 64 nt, Human
aucugauuucaacagugaaaaacaucccuaugauaaagccuaaugacccauuucacaaaagaug

SEQ ID NO: 391757 - RNA, 64 nt, Human
ucgaagugaccuuccuggaggaggugggcagcucagacuccacaugcugguggugccugagguc

SEQ ID NO: 391758 - RNA, 64 nt, Human
uugcaccacugcacuccagccgggugacagagugagacuccaucucaaaaacaaacaaacuaag

SEQ ID NO: 391759 - RNA, 64 nt, Human
cagggccgggugucuuuagggaucaguuuuuccaagacuccagaaggugccagguucuccccuu

SEQ ID NO: 391760 - RNA, 64 nt, Human
uucuaagagcagcagcauauguuguugcuuguauaaagccuagcgauaauuuuuagacuaacuu

SEQ ID NO: 391761 - RNA, 64 nt, Human
aaugaguaguugcaauagagaugguaaagccuacaaagccuaauuauuuacugucugguuuuug

SEQ ID NO: 391762 - RNA, 64 nt, Human
cugcuuugaaaugaguaguugcaauagagaugguaaagccuacaaagccuaauuauuuacuguc

SEQ ID NO: 391763 - RNA, 64 nt, Human
gcaaaaaaguuuugaugggauuuuaaauucaggcaaagccuacaacgcugagacaauccccuaa

SEQ ID NO: 391764 - RNA, 64 nt, Human
auuuuguugaaaauacuuuaaagaugccuagugaaaagccuacuaaagugcugugagauugggg

SEQ ID NO: 391765 - RNA, 64 nt, Human
accuuuaugcuaauuaugauuggaaugcaucacaaaagccuaacucuguuguuuucaaccucua

SEQ ID NO: 391766 - RNA, 64 nt, Human
ugcaugcugcuagacacuuuucuuucccagccgaaaagccuauuauguaauuuuuacauucaua

SEQ ID NO: 391767 - RNA, 64 nt, Human
auacaggguagaaagaaauuccugcuuuucagauaaagccuacacauugccacugucuccccau

SEQ ID NO: 391768 - RNA, 64 nt, Human
uacuuuaccagggugcuuuuaaguuacuuuaaaaaaagccuacaaaauauuuuuuuucuuuuau

SEQ ID NO: 391769 - RNA, 64 nt, Human
ugauaauaacaguccaaagaaagcagaaagaaggaaagccuagaacagaaauaaaugaaauaga

SEQ ID NO: 391770 - RNA, 64 nt, Human
cauaaauguuugacaaaccaacgaagaaugaaaaaaagccuagucagacucccauccaaaguag

SEQ ID NO: 391771 - RNA, 64 nt, Human
agaucacuguucuuuucuuucuuuuugugauugaaaagccuauacuacaauuugaaguaaauuu

SEQ ID NO: 391772 - RNA, 64 nt, Human
ggaucuuuauugcacaaccagccuggguucuaagaaagccuagagaauuucuuauugcccuguu

SEQ ID NO: 391773 - RNA, 64 nt, Human
aauguaugcacugguauagcacccuuauguuacuaaagccuagucuaacacugaacucauguuc

SEQ ID NO: 391774 - RNA, 64 nt, Human
cauaauuuaaaaaucuuucuagaauaacaacagcagacuccacucuuguuugucuaaaagagcc

SEQ ID NO: 391775 - RNA, 64 nt, Human
caugccacugcacuccagccugggcaacagagcaagacuccaucucgaaaaaaaggaauuccuc

SEQ ID NO: 391776 - RNA, 64 nt, Human
agcgagcaacuggcuugagcagacagaacggggaagacuccacucugucccgaggggccagccg

SEQ ID NO: 391777 - RNA, 64 nt, Human
cuaaguaaaaugaggacgaaagacaaauauuuugaaagccuaguccaucagaauguuucuuuga

SEQ ID NO: 391778 - RNA, 64 nt, Human
aaaguaguggauccaucuugcuuuugccuuauauaaagccuacaguuauggaaguguggaaaac

SEQ ID NO: 391779 - RNA, 64 nt, Human
cccagcagccauucuccccuuucccuugugaacaaaagccuaguuuugugugggcagcaauaua

SEQ ID NO: 391780 - RNA, 64 nt, Human
gcguguuaauggcuguucgagagaaaucggaauaaaagccuaaacaggaacaacuucaucacag

SEQ ID NO: 391781 - RNA, 64 nt, Human
cuuuacucuugucaagguuggguacuucaagcucaaagccuaucuaccuugauccaaaaacuac

SEQ ID NO: 391782 - RNA, 59 nt, Human
auuccuccuccccagaauaaagacaagagaaagccuacguuucaauaugugaugcucau

SEQ ID NO: 391783 - RNA, 64 nt, Human
caccacaugccauuauuaacuucacauucuacaaaaagccuagaaggacaggauacuuugugga

SEQ ID NO: 391784 - RNA, 64 nt, Human
uucuguggcuaaacagauguaaugggaagaaauaaaagccuacguguugguaaauccaacagca

SEQ ID NO: 391785 - RNA, 64 nt, Human
gagaggaaccuaguuuaggaccucuuuuauuaaaaaagccuauuuaaagggcuauuucuguaga

SEQ ID NO: 391786 - RNA, 64 nt, Human
ugcuuacuuaucuuuuaaauguuucuuuuauuacaaagccuauuuugaguagcuuuuaaaacug

SEQ ID NO: 391787 - RNA, 64 nt, Human
uugaccaauaaauaaaaauaccacuuucuuuaaaaaagccuagggaauugaagcucuguacaua

SEQ ID NO: 391788 - RNA, 64 nt, Human
acucugacaaaggcuuuuccuuauagaauaacccaaagccuaggugaggguugauauauaaugu

SEQ ID NO: 391789 - RNA, 64 nt, Human
cuacauggauucccuacuuugaagagugugggggaaagccuacgcuucucccugaaguuuacag

SEQ ID NO: 391790 - RNA, 64 nt, Human
cagaaaaaaaaaaaaaaccauuuuuaaaaagaagaaagccuaaagacucucggccuagggacgu

SEQ ID NO: 391791 - RNA, 64 nt, Human
agugccacugcaauucagccugggugacauagagagacuccaucucaaaaaaaaaaaaaaaaaa

SEQ ID NO: 391792 - RNA, 64 nt, Human
cucagcagugggugacugcuguugccaauaccucagacuccagggaaagagaggaggccaucau

SEQ ID NO: 391793 - RNA, 64 nt, Human
caugccacugcacuccagccugggagacagagcaagacuccaucucaaaaacaaaaacaaaaca

SEQ ID NO: 391794 - RNA, 64 nt, Human
cuauuuuuacaucuuuaaauaccuaucuucuaugaaagccuaugugcauguguguguguguaug

SEQ ID NO: 391795 - RNA, 64 nt, Human
aggagugacauuaacuaaugacaauaaauuaaacaaagccuacauuaguucaauuuaagccuau

SEQ ID NO: 391796 - RNA, 64 nt, Human
uuauauuguuauuuauugugacaaaaggaaauaaaaagccuaaauguucagaaaauuauuuuaa

SEQ ID NO: 391797 - RNA, 64 nt, Human
cuucuuugaauaaggaaguuagccuuuuaacuagaaagccuaagaguucuggcacauuuauuuc

SEQ ID NO: 391798 - RNA, 64 nt, Human
cucuccuuguacagacuagagggucacauuguguaaagccuaacauagcccugcaaagagaucu

SEQ ID NO: 391799 - RNA, 64 nt, Human
aaaaauguuuucaagacuauuuaauggauguaaaaaagccuauuucuacauuauaccaacugag

SEQ ID NO: 391800 - RNA, 64 nt, Human
uuggccugcaacugggaaggggauucagagucauaaagccuaacuuaagaauccuggcucacuu

SEQ ID NO: 391801 - RNA, 64 nt, Human
cucuccauuugcucuucagaugccacuucuaagaaaagccuaaucacaguuuuuccuggaauug

SEQ ID NO: 391802 - RNA, 64 nt, Human
uggaaucaguuagaggaugaaaucagauaaaggaaaagccuauuuuggagcuuccccuguuagg

SEQ ID NO: 391803 - RNA, 64 nt, Human
acacuggcugccagcuauuuuuacuagaacacagaaagccuaucaaagaccuuguguguaugug

SEQ ID NO: 391804 - RNA, 64 nt, Human
cauuuaagaaaaaucauaacucacuuuaaauaugaaagccuaguccagaaaucuauuacaccuu

SEQ ID NO: 391805 - RNA, 64 nt, Human
ugaauucaucugugaagcauucaaaucaaagcuaaaagccuaaaugugaaaugcuaaugacaag

SEQ ID NO: 391806 - RNA, 64 nt, Human
gaaugcugugagggcgggggguucagaucaacauaaagccuaacuugcuggaguuguagucuca

SEQ ID NO: 391807 - RNA, 64 nt, Human
auuuaucugcaaaaggauggaaacugugggagucaaagccuauuuugcugaguguucccacugg

SEQ ID NO: 391808 - RNA, 64 nt, Human
gcgacagaggacagccagaagcccagccagccccagacuccagugcaccagagcacgcacagga

SEQ ID NO: 391809 - RNA, 64 nt, Human
uauccugaugucaugggaguccuagcaaagcuauagacuccaagcaaggcuugggguccuuuau

SEQ ID NO: 391810 - RNA, 64 nt, Human
uggaccacugcccuccagccugggugauagagugagacuccaucucuaaauaaauaaauacaaa

SEQ ID NO: 391811 - RNA, 64 nt, Human
auuugcacagggauuggaacaugauuuauaguuaaaagccuaauaugcagaaaugaauuaagau

SEQ ID NO: 391812 - RNA, 64 nt, Human
caauacaaguuuuagaaaacaaagcauuaaaaaaaaagccuaucaguauuaugggcaauaugua

SEQ ID NO: 391813 - RNA, 64 nt, Human
aaaguugugugaugauuuccgggaauuauuauugaaagccuaugaauuuaaaaccagguuuacc

SEQ ID NO: 391814 - RNA, 64 nt, Human
gcuauguagauauaaguugaggaagcucaccucaaaagccuagaaugcaguuucacaguagcug

SEQ ID NO: 391815 - RNA, 64 nt, Human
cuuuuucuuacagaaugacugaaaauuugaaagaaaagccuauaaaagugcacauacgcaacug

SEQ ID NO: 391816 - RNA, 64 nt, Human
aauauauucugggucaguugguaugagaaaaaaaaaagccuagaauucuuuguugaaaguuuuc

SEQ ID NO: 391817 - RNA, 64 nt, Human
aauaggccuuuucuuccuaauuggccaucaaauuaaagccuauccuuucucaagcaggagcugg

SEQ ID NO: 391818 - RNA, 64 nt, Human
ggugaauaguugcaacagagacuggcuggucugcaaagccuaaaauauguccuguguggcccuu

SEQ ID NO: 391819 - RNA, 64 nt, Human
guugaauaguugggacagggacaguauagccugcaaagccuaaaagauuuacuacuugucuccu

SEQ ID NO: 391820 - RNA, 64 nt, Human
ggaguguugaguuggaaccauuguaaaggugggcaaagccuaguagagaaccagugcaccucag

SEQ ID NO: 391821 - RNA, 64 nt, Human
guauaggaugucagacaauaccacugguuaaaauaaagccuauuuuucaaauuuagugaguuuc

SEQ ID NO: 391822 - RNA, 64 nt, Human
uugcaaacuuuuuuaguuuuggccuuuaauuuaaaaagccuaauuuuaaagugcugccugugag

SEQ ID NO: 391823 - RNA, 64 nt, Human
guguaaacauaauauucuucaagaaauaauguugaaagccuacucaggaauaaucuuccuuaac

SEQ ID NO: 391824 - RNA, 64 nt, Human
uaucaaauuccaguuuuguaugaguucugcaaaaaaagccuaauauucugugguccccucacuc

SEQ ID NO: 391825 - RNA, 64 nt, Human
uuccaggcagcacagacguggggcauccccagaaagacuccaucccaggaccagguuccccugc

SEQ ID NO: 391826 - RNA, 64 nt, Human
caugccguuguacuccagcuugggcaacagagugagacuccaucucaaaacaaaacaaaacaaa

SEQ ID NO: 391827 - RNA, 64 nt, Human
ucacaccacugcacuccagccuggcgacagagagagacuccaucucaaaacaaaacaaaaaaaa

SEQ ID NO: 391828 - RNA, 64 nt, Human
uaauguugaaaaacugcacaaauuuuuaugggacaaagccuagaaaagagaaauguaguuugaa

SEQ ID NO: 391829 - RNA, 64 nt, Human
caucucacacauuugaggcaguggucaaacagguaaagccuaugaugugugucauuuuaaagug

SEQ ID NO: 391830 - RNA, 64 nt, Human
cucauuugaacaaaaaucuaggccaaaauacugaaaagccuauguguuuuuuuaauuggaagua

SEQ ID NO: 391831 - RNA, 64 nt, Human
cauaccuuacuauacagaaauucauacuggagagaaagccuacaauugugaagaauguggcaaa

SEQ ID NO: 391832 - RNA, 64 nt, Human
acuuacugaacauaagaaaauuuacacuagagagaaagccuacaaaugugaagaauguggcaaa

SEQ ID NO: 391833 - RNA, 64 nt, Human
ucauugugaugggagggauaccuuuuuguuguuaaaagccuauuauuguuaaaggccuuuuaug

SEQ ID NO: 391834 - RNA, 64 nt, Human
ccuacuugaacaucagaggguccaucaugaagagaaagccuaugaguaugaugaauauggguug

SEQ ID NO: 391835 - RNA, 64 nt, Human
aaguuauaugauuuauauuaaaacauuuauugacaaagccuaagagcuaaggcaguaaaauuau

SEQ ID NO: 391836 - RNA, 64 nt, Human
uucugggcuccuggcccuuugcgaaguacuucagaaagccuagagagaagagagggcccucaaa

SEQ ID NO: 391837 - RNA, 64 nt, Human
agauuaaaaaaagacuauuuggauaacuuauaggaaagccuagaaccucccaguagagugggga

SEQ ID NO: 391838 - RNA, 64 nt, Human
gaauuuuauuaaugcuaucaucucgaccaagcucaaagccuacuuauuagaaacaaugaaguuc

SEQ ID NO: 391839 - RNA, 64 nt, Human
cauguccaacuucuguccagaugacauuaaaaccaaagccuaauuguuaagccucuuauucuaa

SEQ ID NO: 391840 - RNA, 64 nt, Human
uggagcccuguuugcacguucuaguuguucggagaaagccuagguucugggcucagguccagau

SEQ ID NO: 391841 - RNA, 64 nt, Human
gggccccaggaugggggggccacacgcugcaccuaaagccuacccuauucuauccaucuccugg

SEQ ID NO: 391842 - RNA, 64 nt, Human
cacaaaugaucauccugaggaucugagcuucccuagacuccacacaauaaccuuggggcacccu

SEQ ID NO: 391843 - RNA, 64 nt, Human
gcuguaagcugaaaccucaaugaauaacaagaaaagacuccaggccgacucaugauacucugca

SEQ ID NO: 391844 - RNA, 64 nt, Human
ucauugguugagccacagccuagggguuggaggaagacuccacucuggguacacccuuaggggc

SEQ ID NO: 391845 - RNA, 64 nt, Human
ccuguaagguuaucugguuuuaaaagaaaaaaaaaaagccuacaaacucagugaccuacuacgc

SEQ ID NO: 391846 - RNA, 64 nt, Human
aaacuucccggaaggcaauggggcaaggaaaaagaaagccuaugggaaauggcugugcucccaa

SEQ ID NO: 391847 - RNA, 64 nt, Human
gccacacuuuauugauuaguacuugacaggguguaaagccuauuuuggguuugauuuguuuugg

SEQ ID NO: 391848 - RNA, 64 nt, Human
cauuuugccaccauaaagggcugcauuuuuuuaaaaagccuaggcagcucuaacaucaucugau

SEQ ID NO: 391849 - RNA, 64 nt, Human
auucugauugaucaucuccuucagagaacaugugaaagccuacauccuugaaaacugcacaguc

SEQ ID NO: 391850 - RNA, 64 nt, Human
aaaauucucuuacuuaaauacguuugauuucugaaaagccuacaaauggaggggaaaugagauu

SEQ ID NO: 391851 - RNA, 64 nt, Human
ucgcagcagaagguucuuugugguuaaaaguuuuaaagccuauuucuuuauagguaacccucuc

SEQ ID NO: 391852 - RNA, 64 nt, Human
uuacuuguuucugguaaucaagucuuauuuuuuaaaagccuauuguuuuucagaauugagauau

SEQ ID NO: 391853 - RNA, 64 nt, Human
ugcugagaggguuuuaacaaaucauauuagccaaaaagccuacaacauagaugcauuuagcaaa

SEQ ID NO: 391854 - RNA, 64 nt, Human
auuuagccugcaguugggcaaaaccauuuaacacaaagccuauuuuauaaugaaguguugaaua

SEQ ID NO: 391855 - RNA, 64 nt, Human
uggugggccacccagggccucugaguagccacccaaagccuagccgcuguucuagggaacggaa

SEQ ID NO: 391856 - RNA, 64 nt, Human
gugaaaauaggcuguuuaacaaacagauuggaauaaagccuauucuaccaguuaaacuacuuua

SEQ ID NO: 391857 - RNA, 64 nt, Human
uaggagccaugaaaugaaguuaaacaccuuguagaaagccuacuuucaaguaaauauagcauuc

SEQ ID NO: 391858 - RNA, 64 nt, Human
aaucuguauggauauggaaaugcuugcccuaauaaaagccuacauauaccuucugguucuuuuu

SEQ ID NO: 391859 - RNA, 64 nt, Human
uuuacucgucaccaccucugcaccugcugucuugagacuccauccagccccaggcacgccaccu

SEQ ID NO: 391860 - RNA, 64 nt, Human
uguugagaccgguacaaauuggauuucaggaaggagacuccaucacagccaggaccuuucgugc

SEQ ID NO: 391861 - RNA, 64 nt, Human
cgcaccacugcacuccagcccuggcgacagagugagacuccaucucaaaaaauaaaaaaguuuc

SEQ ID NO: 391862 - RNA, 64 nt, Human
agaguucaaaugcuugacguuggcacuuaacaugaaagccuauaggucauucuugcucugggau

SEQ ID NO: 391863 - RNA, 64 nt, Human
uucuuuaguuccuccuggacaacacuguaaauauaaagccuaaagaugaaguggcuucaggagu

SEQ ID NO: 391864 - RNA, 64 nt, Human
uuauuucaaggguauuucuucuuaaaaaucuuggaaagccuaagagaguuaaaggcauccuggu

SEQ ID NO: 391865 - RNA, 64 nt, Human
cagcuggucagucuuugcucaguguccagcuuccaaagccuagacaaccuuucuguagccuaaa

SEQ ID NO: 391866 - RNA, 64 nt, Human
aggguugcaugauuccuuugaguguuugauuugaaaagccuagucuugucucucaagagcaucu

SEQ ID NO: 391867 - RNA, 64 nt, Human
uacaugacacaggacaugucacucccauggccagaaagccuaaauugggaaacaguuguuagca

SEQ ID NO: 391868 - RNA, 64 nt, Human
acgccugggggugccaggaccagucaaccugggcaaagccuagugaaggcuucucucuguggga

SEQ ID NO: 391869 - RNA, 64 nt, Human
cucugaugaacaagcauuuagaucguaacaugguaaagccuauuaccagccaauguuguuagca

SEQ ID NO: 391870 - RNA, 64 nt, Human
cuuuguagggacaaaugugcauuuguuuguggcaaaagccuacaauugacaaacuuguaaauuu

SEQ ID NO: 391871 - RNA, 64 nt, Human
cuuggcgaaucgauaaucauugcauagugacugaaaagccuaagugcaaaaaaaaaaaaaaaag

SEQ ID NO: 391872 - RNA, 64 nt, Human
acacugaguuugaacacagaucauucuccuuguaaaagccuaugugccuuucacuuuagaggcu

SEQ ID NO: 391873 - RNA, 64 nt, Human
gggccgguggggguaugggcgugugguggggcagaaagccuagacccaggugguccugagcugg

SEQ ID NO: 391874 - RNA, 64 nt, Human
gauggauaaugugccuguuuuuuaacacaacaaaaaagccuaccuccaaaauccccuuuuuguu

SEQ ID NO: 391875 - RNA, 64 nt, Human
ccagcggucacucugccacaucacuuccuucuugaaagccuaagagugcguaugcgugugugug

SEQ ID NO: 391876 - RNA, 64 nt, Human
ugugccauugcacuccaaccugggcgacagagugagacuccaucucaaaaaaaaaaaaaaaaaa

SEQ ID NO: 391877 - RNA, 64 nt, Human
cucaucuccaaggcagggaccaucaagaaccuacagacuccaucucuucugcaagccucaugcc

SEQ ID NO: 391878 - RNA, 64 nt, Human
cgcaccagugcacuccagccuuggugacaaugggagacuccaucucaaaaaaaaaaaaaaaaaa

SEQ ID NO: 391879 - RNA, 64 nt, Human
gguuaaauacagcccaugcacaaagccacaggccaaagccuauggaauuguuuuuaaucaucaa

SEQ ID NO: 391880 - RNA, 64 nt, Human
ccaaagucagaauaggccaaaaaaaaaaaaaaaaaaagccuaaauaguaagcuggugaaacaag

SEQ ID NO: 391881 - RNA, 64 nt, Human
uuugcccagccagauaagcaggacuuuauggggcaaagccuaugucagcucucuccaagggcac

SEQ ID NO: 391882 - RNA, 64 nt, Human
aauugaguaguugugauagagaccuauggccugcaaagccuaauuaauauguagcccuuucaga

SEQ ID NO: 391883 - RNA, 64 nt, Human
ccucccuucccucuccuugagugcauuuugaauuaaagccuauauugaaaagaauggaggugag

SEQ ID NO: 391884 - RNA, 64 nt, Human
uauuagccuacagcugggaaaaaucauuuaacacaaagccuaucuucuaaugaaguauggaaua

SEQ ID NO: 391885 - RNA, 55 nt, Human
guuccuggauugguugcuaaauagaaaagccuagucuucucaagcaaugaggaug

SEQ ID NO: 391886 - RNA, 64 nt, Human
accuggaaaccugugccuuguauucaaauucauuaaagccuaauccugcaaguaucugauuugu

SEQ ID NO: 391887 - RNA, 64 nt, Human
augcaauuuuuaauuuuuguuaauaucaacagcaaaagccuagugcauugggagaugugcaacc

SEQ ID NO: 391888 - RNA, 64 nt, Human
cucuaguauacuuaaaauaagcguccaguuauaaaaagccuauuugcacaacuuuuugggaaua

SEQ ID NO: 391889 - RNA, 64 nt, Human
uugcugcagaaccuuuguguaaaugaagacgugaaaagccuagguucugugcagcuuaucaacg

SEQ ID NO: 391890 - RNA, 64 nt, Human
cuuagaugguguuugugggaucaccugcagauuuaaagccuacucugccacagacucgaguaag

SEQ ID NO: 391891 - RNA, 64 nt, Human
aauaggucauauuccccuaguaauaugaguucucaaagccuacauucaggaucucccucuagga

SEQ ID NO: 391892 - RNA, 64 nt, Human
uuuauaccagcuuaugagcucaaaguacuacagcaaagccuagccugcauaucauucacccaaa

SEQ ID NO: 391893 - RNA, 64 nt, Human
uguguucugugguuucuuaggugaccuuagagcaagacuccagaaugaaauuccuaaagcuuuu

SEQ ID NO: 391894 - RNA, 64 nt, Human
ucaagcagauuuacucccaguucuuuccucaaggagacuccagcaccuaugccacuuuucucuu

SEQ ID NO: 391895 - RNA, 64 nt, Human
gaauugcauuuuuuucuaauacuuaucucuguuaagacuccauugaaaguuaaacaaaaagccg

SEQ ID NO: 391896 - RNA, 64 nt, Human
cuagagugguuuuugcagcauggguugaguguacaaagccuacugugcgugagauccucuccuu

SEQ ID NO: 391897 - RNA, 64 nt, Human
guacguaucagugggaagugcuugccauuacuccaaagccuagaaccuucacgucaugaagguu

SEQ ID NO: 391898 - RNA, 64 nt, Human
ucuuucaugucacaauagcguggagcauuagagaaaagccuagacuuuuaguugauagccaguu

SEQ ID NO: 391899 - RNA, 64 nt, Human
cuucuucaauaugugaauuugggcucacagaaucaaagccuaugcuugguuuaaugcuugcaau

SEQ ID NO: 391900 - RNA, 64 nt, Human
auguagaaagaagaaucaagcaucaauuaauuauaaagccuaaagcaaaguuagauuugggggu

SEQ ID NO: 391901 - RNA, 64 nt, Human
acaauuuuauuuauauccuaaucuuggagcucagaaagccuacauguuuuaacaucuuaaaguu

SEQ ID NO: 391902 - RNA, 64 nt, Human
uuaauuuguuugaaaaauucauuguuauauccucaaagccuagcacauaguagguacugaauga

SEQ ID NO: 391903 - RNA, 64 nt, Human
gacugcuguugaaagaaggaaaagggugugugagaaagccuacugaagcagcagcacugccacu

SEQ ID NO: 391904 - RNA, 64 nt, Human
gguagaucaauccauuguaucauucaguucuucuaaagccuacguugguuaggcugauggcagu

SEQ ID NO: 391905 - RNA, 64 nt, Human
uuucaguuuccaguauccuuuuuaaaaaauggcaaaagccuagauuuacaauuugaugaacacu

SEQ ID NO: 391906 - RNA, 64 nt, Human
uauggaaauaauacucaagguuguaaaaccccucaaagccuagaaauuuaauuguuauggcuga

SEQ ID NO: 391907 - RNA, 64 nt, Human
auguuuauuguucaauauuuuuguauauacuuuuaaagccuauucacuugcugauggaucuuug

SEQ ID NO: 391908 - RNA, 64 nt, Human
aggcaaaauguguaaaaccccuaaaucagauugaaaagccuauuucauugauauccaacauguu

SEQ ID NO: 391909 - RNA, 64 nt, Human
uuuugcaucauacauuuuuugaaagauuuuuaaaaaagccuacaacuuacauauguaguagaau

SEQ ID NO: 391910 - RNA, 64 nt, Human
caugccacugcacuccagccugggcgacagagcgagacuccaucucaaaaaaaaaaaaaacauc

SEQ ID NO: 391911 - RNA, 64 nt, Human
gaugaggacuuaagguugcaagaaugaagauuucagacuccaagaucccuuauucuuugggccu

SEQ ID NO: 391912 - RNA, 64 nt, Human
agcaccacugcacuccaggcugggugacagagcgagacuccaugucaaaaaaaaaagaaugugg

SEQ ID NO: 391913 - RNA, 64 nt, Human
uggccuacaaguauuuuuuuuuuaaaaaagaaaaaaagccuacauuggcaucaaguucuguauc

SEQ ID NO: 391914 - RNA, 64 nt, Human
uguuuuaaaaccuuguuauaucugagaggcuuuaaaagccuauuaacuguuucagggcaaccgc

SEQ ID NO: 391915 - RNA, 64 nt, Human
auauaauuauacaaguaaugccaaaaaccaagucaaagccuaauuaaccaaagcacucauuuaa

SEQ ID NO: 391916 - RNA, 64 nt, Human
ccaaagaaaaguauuguuuggaggagcaaaguuaaaagccuaccuaagcauaucguaaagcugu

SEQ ID NO: 391917 - RNA, 64 nt, Human
aauaaaguaaauacagagcugaaagcugaaggucaaagccuaacaggauuggcuguugugugga

SEQ ID NO: 391918 - RNA, 64 nt, Human
agucgugucuuacuccaggugaagggggaaaaaaaaagccuauacuuuggcagguuaugaacuu

SEQ ID NO: 391919 - RNA, 64 nt, Human
aaguggagguauacuucgaauuuuucuagaagguaaagccuaguuugcugacauugaacccaaa

SEQ ID NO: 391920 - RNA, 64 nt, Human
uccagucuggguaacagagcgagacuuucuagaaaaagccuaacaaacagauaagguaggacuc

SEQ ID NO: 391921 - RNA, 64 nt, Human
uauaauuuuuuuccaaaaacuuacuuacaaacaaaaagccuaaucccucuauuuuaagauuucu

SEQ ID NO: 391922 - RNA, 64 nt, Human
agcucagcuucugcgggcacagacaccagcaugaaaagccuaggccccugagggccuggccaca

SEQ ID NO: 391923 - RNA, 64 nt, Human
gucacaacaacaacaacaaaaagcuuccccaacuaaagccuagaagagcuucugaggcgcugcu

SEQ ID NO: 391924 - RNA, 64 nt, Human
aguuggcauuuuagccccagcuucuguagcucugaaagccuaaagaagguauucucuccaucug

SEQ ID NO: 391925 - RNA, 64 nt, Human
acaaagaaacuuagcucuuuuuucaucucacaguaaagccuauuuccccaggaaaaaaauaaau

SEQ ID NO: 391926 - RNA, 64 nt, Human
uacuuuuucucacuggccucguuuugacccagagaaagccuauggaaguuaugcagugcagacc

SEQ ID NO: 391927 - RNA, 64 nt, Human
auuaguguccccccuugaagcaauaacuccaagcagacuccagccccuggaccccugggguggc

SEQ ID NO: 391928 - RNA, 64 nt, Human
guuuuguuaauuacaccauaaugcuaauuuaaagagacuccaaaucucaaugaagccagcucac

SEQ ID NO: 391929 - RNA, 64 nt, Human
aggcccuucuggggguuucuaucuuucuuccaccagacuccaagcccacucuccuccaagacug

SEQ ID NO: 391930 - RNA, 64 nt, Human
uccagagcuugaacaacaacuuuaggaguaaauaaaagccuaaaauauauuuuaaccauccaga

SEQ ID NO: 391931 - RNA, 64 nt, Human
ugaucauacuuucucauuuuacagaugaggaaauaaagccuacaagugugaaauuaauuuccuu

SEQ ID NO: 391932 - RNA, 64 nt, Human
uguauacgucuaagauuucaaaacaaugggucccaaagccuaaccacuuuaagaguuuauggag

SEQ ID NO: 391933 - RNA, 64 nt, Human
acucuuacuaaacaugagaacacauguggaagauaaagccuacaaauaugaagaaugugacaag

SEQ ID NO: 391934 - RNA, 60 nt, Human
gagaaaucuuacaaguaugaauaaugugccaaagccuaagaaaacccucaauucuuaaua

SEQ ID NO: 391935 - RNA, 56 nt, Human
aaucuuacaaguaugaauaaugugccaaagccuaagaaaacccucaauucuuaaua

SEQ ID NO: 391936 - RNA, 64 nt, Human
cacuuagagaauuguaguguuuuugguccuugauaaagccuagaagacauuugugauguuacaa

SEQ ID NO: 391937 - RNA, 64 nt, Human
ccuuccugcacaccuuccaugaggucaccuuccgaaagccuaccuucugcgacagcugcagugg

SEQ ID NO: 391938 - RNA, 64 nt, Human
uuugauggcuuaagagaaauaaauguuguuuuagaaagccuacucaaugaaaacacauuuuaag

SEQ ID NO: 391939 - RNA, 64 nt, Human
gaaauguuucacugaguuauuugagguuuuuuggaaagccuacuauugcguuucaaugugaacu

SEQ ID NO: 391940 - RNA, 64 nt, Human
agaaggauuaaggaggggagguuacccaagaaacaaagccuacaugccgcuuacagcccccguu

SEQ ID NO: 391941 - RNA, 64 nt, Human
caucaauugcucaaauacucagaaaguacugucaaaagccuaauaaaaaaccuaaaguuugcuc

SEQ ID NO: 391942 - RNA, 64 nt, Human
aaauaauuuccagugaauccacacuugauguugcaaagccuaaguuugcugcagaaauacaauu

SEQ ID NO: 391943 - RNA, 64 nt, Human
ugagaguugggugagguuagucucuccugaagaaaaagccuauaaaaaguggcuaaucuuaucc

SEQ ID NO: 391944 - RNA, 64 nt, Human
cacgccauuguacuccagccugggcgacagagcaagacuccauuucaaaaaaaaaaaaaaaauc

SEQ ID NO: 391945 - RNA, 64 nt, Human
cacgccacuacacuccagccugggcaacagagggagacuccaucucaaaaaaaaaaaaagucac

SEQ ID NO: 391946 - RNA, 64 nt, Human
uaaugaaugauauagaaggugguuucgaaggaggagacuccagacaaggaaaacagaaaucuua

SEQ ID NO: 391947 - RNA, 64 nt, Human
ugggauauuccucaugguggcagcgcucauagcgaaagccuacuguaauaugcacccaucucau

SEQ ID NO: 391948 - RNA, 64 nt, Human
ucuaauuuucuccugaaguuuuggcagcgucuugaaagccuaauaugaccaucuguugcucaac

SEQ ID NO: 391949 - RNA, 64 nt, Human
cucccuggggaugaggggccaggccaugacccugaaagccuagcccuggccuugaccucccagg

SEQ ID NO: 391950 - RNA, 64 nt, Human
aaagaaaaaaaaauaagcucauacccaaauucacaaagccuauuuuuuaaaccaaagcacauuu

SEQ ID NO: 391951 - RNA, 64 nt, Human
guauaguaguagaaauggaaaucauuguacuguaaaagccuagugacucccuccuuggccaggc

SEQ ID NO: 391952 - RNA, 64 nt, Human
acuuguuugaaagagaucauuaaauguauuuugcaaagccuaaaguuauauauuuaacaguuuu

SEQ ID NO: 391953 - RNA, 64 nt, Human
aaaauucuuccacugacccaaaauggaaccguacaaagccuauccguguauauggaaaagucuc

SEQ ID NO: 391954 - RNA, 64 nt, Human
gguagguagugcuuaagaaaagucauggaggacuaaagccuaaguccuuuucacuuuuccucca

SEQ ID NO: 391955 - RNA, 64 nt, Human
cuuaaagguaaucauuucagcuaagauuaaauuuaaagccuaagaauguauagagcuaguuuua

SEQ ID NO: 391956 - RNA, 64 nt, Human
uuuccuuaguuacugcagaacauagagaaaaauaaaagccuaacgaauaguacaucuugcgcau

SEQ ID NO: 391957 - RNA, 64 nt, Human
ugcugauuguguggaaccaguauguagcaaauggaaagccuagaaauaucuuauuuucuaaguu

SEQ ID NO: 391958 - RNA, 64 nt, Human
auguguacuucaagacugcuaauuguuucaucugaaagccuacaaugaaucauuguucaaccuu

SEQ ID NO: 391959 - RNA, 64 nt, Human
ggugguguuuuaucgauugucagaauuguuuuugaaagccuaagaacccagcuuuuuagaaagg

SEQ ID NO: 391960 - RNA, 64 nt, Human
gucagaguccaguguucuagaagaggcagugucuaaagccuaauuuuacuuuucuaauucuggu

SEQ ID NO: 391961 - RNA, 64 nt, Human
accaauaucuguucguguugaggagaugaggugcagacuccacacuggggucuuagaggcacca

SEQ ID NO: 391962 - RNA, 64 nt, Human
uacaccacugcacuccagccugggugacagagugagacuccaucucaaaaacugaaaauaaaaa

SEQ ID NO: 391963 - RNA, 64 nt, Human
ggacagaaacuaaacucuuaccauauguuugguaagacuccagacuccagcuaacagucccuau

SEQ ID NO: 391964 - RNA, 64 nt, Human
caaagaaaauguccccgaaacgaauuuucuuacaaaagccuaaguagcagggguaauuuucugc

SEQ ID NO: 391965 - RNA, 64 nt, Human
uuaggacaaaucugcaaagcauguuuugcauguaaaagccuaggucuauuuggauuauucuuuc

SEQ ID NO: 391966 - RNA, 64 nt, Human
uuuaauugagauauuuaucuuguggaaauauuaaaaagccuaugcuuguguaagugaaaaaaaa

SEQ ID NO: 391967 - RNA, 64 nt, Human
uuuuguuucuucauuuccccucccccaauccaugaaagccuaaauguaaaauauaucuuuucau

SEQ ID NO: 391968 - RNA, 64 nt, Human
uugaaauuuaauugaaagaagaaacaacaacaaaaaagccuaaaccuagccucugaacaacacu

SEQ ID NO: 391969 - RNA, 64 nt, Human
ucuggaaagaaggaugucaagaaggugaaauccuaaagccuagaaauaaaguuuuaaaugggaa

SEQ ID NO: 391970 - RNA, 64 nt, Human
ccuuaccgccccccgccccgggugcuuucugcacaaagccuagagccuggcacucaagcccacc

SEQ ID NO: 391971 - RNA, 64 nt, Human; identical to SEQ ID NO: 391957

SEQ ID NO: 391972 - RNA, 64 nt, Human
agaaauaagcaacaccucucccaaaaagcagcccacaaggcaggggcccagcagcccagccauc

SEQ ID NO: 391973 - RNA, 64 nt, Human
cuuuuucacuaaccaguugacgagcagugcauuuacaaggcacugccaaacaagaugcccuugg

SEQ ID NO: 391974 - RNA, 64 nt, Human
guaucugcucugaggaaccaggucccaccuccccacaaggcaaaucuagacccauuaaauuauu

SEQ ID NO: 391975 - RNA, 64 nt, Human
uuauuagagauuguuugaaugaugcauguuauugacaaggcaaauauauauauauacacagucu

SEQ ID NO: 391976 - RNA, 64 nt, Human
caucccgugugcgcacucugcauccaccuauguaacaaggcaccgcuaagcaagcauugucugu

SEQ ID NO: 391977 - RNA, 64 nt, Human
aagaaagacaagagagucacaucuuagcuuuugcacaaggcauucguggucaggaauagguuag

SEQ ID NO: 391978 - RNA, 64 nt, Human
gcacacagcagucccaggcccugugaggggcuucagacuccagcuacagcgagccugccccuuu

SEQ ID NO: 391979 - RNA, 64 nt, Human
accuuaacccagaagacacuaugaaaaacaagacagacuccacucaaaauuuauaugaacacca

SEQ ID NO: 391980 - RNA, 64 nt, Human
cauuaugggcccgaggaauaggggaggguuaauaagacuccaacccuaauggcccaacagggaa

SEQ ID NO: 391981 - RNA, 64 nt, Human
auuuuuuucuuuuguuuuuuggaaaauggaaagaacaaggcaaggaaggaaaauuaauggggaa

SEQ ID NO: 391982 - RNA, 64 nt, Human
gcuuuuacucugguaggaaugcuuccgagacaccacaaggcagccugaacacucaguugcaggg

SEQ ID NO: 391983 - RNA, 64 nt, Human
auaagcagguuucuguaguacugacugguucaucacaaggcaagucagaaaccaguauccuucu

SEQ ID NO: 391984 - RNA, 64 nt, Human
aggucgcggggugagccucuuagcaggacagaaaacaaggcagcagcgcaccugccaccccuuc

SEQ ID NO: 391985 - RNA, 64 nt, Human
gggagaaacagaccugggcgcaaacaacuccaggacaaggcaggacaugauaaagauuauaaag

SEQ ID NO: 391986 - RNA, 64 nt, Human
ucagcuccuaugcaggcuucucuugagcccagagacaaggcagcuuggucuaguggagauagca

SEQ ID NO: 391987 - RNA, 64 nt, Human
uguagucucauggucuagcaugcaucuuguagaaacaaggcaugcuggcagauugcaggguuga

SEQ ID NO: 391988 - RNA, 64 nt, Human
caagacuucagauucagccgaauuguggugucuuacaaggcaggccuuuccuacagggggugga

SEQ ID NO: 391989 - RNA, 64 nt, Human
cuaauuuucaguauauuacuguuaaauuaccaacacaaggcaauuuauuugaaagauuccguuu

SEQ ID NO: 391990 - RNA, 64 nt, Human
cuuucuguuugccuagucucagcagacugugaucacaaggcauugucugugggauuuuuccuuu

SEQ ID NO: 391991 - RNA, 64 nt, Human
agacuuugggaagccaccuucaacguuuucuggaacaaggcagguacaaauaaaaaaauaaaac

SEQ ID NO: 391992 - RNA, 64 nt, Human
uccuguuacucugucccacguccaaucaugggccacaaggcacagucuucugagcgagugcucu

SEQ ID NO: 391993 - RNA, 64 nt, Human
uggcuuuuccagcucucaugccccgcaguguggaacaaggcagaaaaggauccuaggaaauaag

SEQ ID NO: 391994 - RNA, 64 nt, Human
uuacaauacauaggguuacucaccaaacuuuuugacaaggcaacacauaacuuacacauaaaug

SEQ ID NO: 391995 - RNA, 64 nt, Human
cuugucagccuggagaccagcaccagaggaaucuacaaggcaaacucccauauauuugcuuccc

SEQ ID NO: 391996 - RNA, 64 nt, Human
guaacaaguauuggggccuauuuuuuuuuuuuccacaaggcauucucuaaagcuaugugaaauu

SEQ ID NO: 391997 - RNA, 64 nt, Human
cccaagccacccaaauucucagaucuuuucuggaacaaggcagaauauaaaauaaauauacauu

SEQ ID NO: 391998 - RNA, 64 nt, Human
ggaggaaaggaugguagauucuguuaacucuugaagacuccaguaugaaaaucagcaugcccgc

SEQ ID NO: 391999 - RNA, 64 nt, Human
caguaauucaacuggaaauuaaaaaaaaaaaacuagacuccauugugccuuacuaaauauggga

SEQ ID NO: 392000 - RNA, 64 nt, Human
uccauaaagaugcagaguccgcccagucaugcacagacuccaguggaaguuuugccaaacugaa

SEQ ID NO: 392001 - RNA, 64 nt, Human
aaggcuguccucucaagcuggugcuguguaggccacaaggcaucugcaugagugacuuuaagac

SEQ ID NO: 392002 - RNA, 64 nt, Human
ugucuuuucaauuuuggagaguuuuccuguggcuacaaggcaaguaacggguuggaaaaagucu

SEQ ID NO: 392003 - RNA, 64 nt, Human
aggcagauaggccuaaaucuuucagauucuuucuacaaggcaaauaaccccucucuuguuaauu

SEQ ID NO: 392004 - RNA, 64 nt, Human
gccaccugaagagagagccaauagcaugggguuuacaaggcaaagauagucauucauucaacac

SEQ ID NO: 392005 - RNA, 64 nt, Human
uucucaggaugcuucuuaccugucagaggaggugacaaggcagucucuugcucucuuggacuca

SEQ ID NO: 392006 - RNA, 64 nt, Human
ucucuggaaguggucguauuugagcaggaugugcacaaggcaauugaaaugcccauaauuaguu

SEQ ID NO: 392007 - RNA, 64 nt, Human
ggagucacuaauaaauuugcaaaugaaguuaaagacaaggcaaccaucuggcuuaugcuauaua

SEQ ID NO: 392008 - RNA, 64 nt, Human
ucaccucccauucccaggggcaucaucauguucaacaaggcauggaggcagggccaucuuugca

SEQ ID NO: 392009 - RNA, 64 nt, Human
acgcaaaaauccacaguccaaagucucaucugagacaaggcaagucccuuccaccuaugagccu

SEQ ID NO: 392010 - RNA, 64 nt, Human
aaucuacuuuuagauaaaccagcgcaggccuuaaacaaggcaugccacaccauugcuguucccc

SEQ ID NO: 392011 - RNA, 64 nt, Human
gccaggcccuuuucuccuaugcacaccaggauagacaaggcaggggauacuggcagccugcauc

SEQ ID NO: 392012 - RNA, 64 nt, Human
gccgcguucccucccagggcuggagcagaggaccacaaggcagcagaaagcgcggguccagaug

SEQ ID NO: 392013 - RNA, 64 nt, Human
gugagguguggugugcggcuucacccagggcagaacaaggcagaaucgcaggaaacccgcuucc

SEQ ID NO: 392014 - RNA, 64 nt, Human
auuuagacacaucaauuuguaauuuaggguacuuacaaggcacauauaaaauaauuucccaugc

SEQ ID NO: 392015 - RNA, 64 nt, Human
auccaucugucucccuccccaaauggcugcuuugacaaggcagacgucguacccagccaugugu

SEQ ID NO: 392016 - RNA, 64 nt, Human
cguugagcagagacguuagggaaguggauccuggacaaggcauuccaggcagaggaacaggaug

SEQ ID NO: 392017 - RNA, 64 nt, Human
agcaagacuggucccucuguucuaugauguuuuaacaaggcaucauuuaguugggcagcuacuc

SEQ ID NO: 392018 - RNA, 64 nt, Human
uugccagugaaccccuggacaacugaccacacccacaaggcauccaaagucuguuggcuuccaa

SEQ ID NO: 392019 - RNA, 64 nt, Human
aauuauuucagaaauguacaacuuuuuaccuaguacaaggcaacauauagguuguaaauguguu

SEQ ID NO: 392020 - RNA, 64 nt, Human
agaugaagccaugauagcuacagagaaagguuuuagacuccaguuuaccuuucucuuggagaaa

SEQ ID NO: 392021 - RNA, 64 nt, Human
ugaugcaugggaccaacauaaggcaggcagggauacaaggcagucuggaaagaagggaaggcag

SEQ ID NO: 392022 - RNA, 64 nt, Human
agauuuuaaggcacuucugaaagucaaucccuggacaaggcagucaucacauaagaacagcuac

SEQ ID NO: 392023 - RNA, 64 nt, Human
aaguaguauaugauccucagauacagggagaaggacaaggcauacagcuuauugauuagagcug

SEQ ID NO: 392024 - RNA, 64 nt, Human
aguauuucagaaaaggagagguugacagucauccacaaggcauagccuccaaguauacucucaa

SEQ ID NO: 392025 - RNA, 64 nt, Human
augaagugcugcuggcugggcuugguggcucagaacaaggcacugucacugcccaccuccuugg

SEQ ID NO: 392026 - RNA, 58 nt, Human
aagaggagggaucaaguuaaugaaggccacaaggcacugggcaccaguccuuuuggag

SEQ ID NO: 392027 - RNA, 64 nt, Human
cucccaaacuuaaacagugaucucuucuaaauauacaaggcaucuacccagccccaauagugaa

SEQ ID NO: 392028 - RNA, 64 nt, Human
uccagaagggaagauuuauuacuaccaugugaucacaaggcagacucagugggauccuccuacu

SEQ ID NO: 392029 - RNA, 64 nt, Human
ccaaaaccucuaccgaagaccucaugaauuuagaacaaggcauguccccaauuaccauggcaac

SEQ ID NO: 392030 - RNA, 64 nt, Human
guguuuaaaaaaaaaaaucaaccagguugugguaacaaggcauucuauuucuucaaaaagacug

SEQ ID NO: 392031 - RNA, 64 nt, Human
cugacguuucucuuccuugccuggacugccuuugacaaggcagaaaugaacaugaaaagucccc

SEQ ID NO: 392032 - RNA, 64 nt, Human
guagcauuguguguccaucuguuauauguaaaggacaaggcaccagaaucaggcuuuauuucga

SEQ ID NO: 392033 - RNA, 64 nt, Human
ugauaguuuuagcuagcuuaugaacauuggguucacaaggcauuggguaaguuagauaaaauag

SEQ ID NO: 392034 - RNA, 64 nt, Human
cgguacucccauaauccucucggagaaaaaaaucacaaggcaacugugaguccgggaaucucuu

SEQ ID NO: 392035 - RNA, 64 nt, Human
ucauuuaagaugaccuugaaugaugccaugaggaacaaggcaaggcugucaauuacaggaagua

SEQ ID NO: 392036 - RNA, 64 nt, Human
gaguugauuuagacaacauagcugaccuuuuaugacaaggcaguuugaauagggacuauuguaa

SEQ ID NO: 392037 - RNA, 64 nt, Human
uguauuuaaauaauauaucauguaccuuuauugaacaaggcauccguuauaucuaauuuuguau

SEQ ID NO: 392038 - RNA, 64 nt, Human
ucgcaccacugcacuccagcuuggcaauagagugagacuccaucucaaaaaacaaaacaaaaca

SEQ ID NO: 392039 - RNA, 64 nt, Human
ucaaaaagugauagaauauugggggaaggagggcagacuccaucguuuccucagggagacuggg

SEQ ID NO: 392040 - RNA, 64 nt, Human
ucuaauucguccuggaaguuuccaguggucuuauagacuccauguucuuggaggacaggcugua

SEQ ID NO: 392041 - RNA, 64 nt, Human
uuccaaacugcuaugcccucuauaccaguggcugacaaggcauauagggauauaugccauccug

SEQ ID NO: 392042 - RNA, 64 nt, Human
aaaucuagccauccuacauccuuuggauuucuucacaaggcaguaauuccuuugaacuacugcu

SEQ ID NO: 392043 - RNA, 64 nt, Human
uuccaggguuuuagaguaguugaauguuuauuucacaaggcacccuaaauucuauagaaauaaa

SEQ ID NO: 392044 - RNA, 64 nt, Human
aaauaucuuuuucuccucucagcucauacauaacacaaggcagaaaucuggauaugagauuugc

SEQ ID NO: 392045 - RNA, 64 nt, Human
guauuuuuaauugucacuguaaauaacauuuaccacaaggcagauaaaauaagaaaugcugaca

SEQ ID NO: 392046 - RNA, 64 nt, Human
cguucugauaugugaauuuguuugugacaacuaaacaaggcauucagcaguuucugacaauuaa

SEQ ID NO: 392047 - RNA, 64 nt, Human
cauauuuuaucccaaguuuauaaugguggucugaacaaggcaccuguaaauaaaucagcauuua

SEQ ID NO: 392048 - RNA, 64 nt, Human
uuugaaacuaacccagaacuucuaacuugaccacacaaggcaguugcccaaaccauucuguggg

SEQ ID NO: 392049 - RNA, 64 nt, Human
guuucagagcauaaaaccuaaagguuauaguagaacaaggcaccuucuuaaaagaaaucuugcu

SEQ ID NO: 392050 - RNA, 64 nt, Human
aagcuggccuguuuucuaaaggaaaaugauugccacaaggcaagaggaugcaucuuucuuccug

SEQ ID NO: 392051 - RNA, 64 nt, Human
cucuacacaucaaucacaucuugauucaaaccucacaaggcaauauucugaauuguuaacuagg

SEQ ID NO: 392052 - RNA, 64 nt, Human
auuuugaaaucugacucucagguuagcuggaguuacaaggcagccaacaaugauuauacacaau

SEQ ID NO: 392053 - RNA, 64 nt, Human
agacacacgccuguguccacccuggccugcaggaacaaggcaggccgccuguggaggaccucag

SEQ ID NO: 392054 - RNA, 64 nt, Human
cuccuggcagguggcauucaucucagaugugagcacaaggcauuggcccucuggacuccuuucu

SEQ ID NO: 392055 - RNA, 64 nt, Human
aguaugcaucacuagauaauaaagucuuuugugaacaaggcauuuguagccauuuuuaaaaguu

SEQ ID NO: 392056 - RNA, 64 nt, Human
accacagccccagcugccucagagcaggcacagcacaaggcaggcccagccccaugggccguca

SEQ ID NO: 392057 - RNA, 64 nt, Human
ccaguaaaaaccuuuccauccacccauucucagcagacuccaguauuggcacagucacucacug

SEQ ID NO: 392058 - RNA, 64 nt, Human
cacaccacuacacuccagccugggcgagacggcaagacuccaucucaaaaaaaaaagaaacaaa

SEQ ID NO: 392059 - RNA, 64 nt, Human
ugugccacuguacuccagccugggagauagagcaagacuccaucucuaaaaaaaaaaaaaaaug

SEQ ID NO: 392060 - RNA, 64 nt, Human
aauucuuccaugcuggggcugaugugggcuaguaagacuccaguucuuagaggcgcuguaguau

SEQ ID NO: 392061 - RNA, 64 nt, Human
cugcguccagccaccaucacccggaaggaugcccacaaggcagcugacccugaaagcagccucc

SEQ ID NO: 392062 - RNA, 64 nt, Human
aggaauacuccuuuuccuuuuggaucauagcuuaacaaggcacaggaagggaagggaucuugac

SEQ ID NO: 392063 - RNA, 64 nt, Human
ggaacuccaaaguuacugaaaucucagggcaugaacaaggcaaaggccauauauauauauauau

SEQ ID NO: 392064 - RNA, 64 nt, Human
cuggaccuccugucuguccgugaggcugcagaacacaaggcagcucccaaugccgcuggacucu

SEQ ID NO: 392065 - RNA, 64 nt, Human
uuauguucacugugucgggaaguuccaugaacacacaaggcaacaucauaaguaggaaaaaccu

SEQ ID NO: 392066 - RNA, 64 nt, Human
guccuucagcagacaaagucaagcagcuuuaaguacaaggcagcuugaaaccucucugaugaaa

SEQ ID NO: 392067 - RNA, 64 nt, Human
caaaagggcuguuggcuguaauccuacgccaggcacaaggcaucuuguugccuugccacguccu

SEQ ID NO: 392068 - RNA, 64 nt, Human
ugaaccagccugucaaccaguuguaugacuuuaaacaaggcaucucaccucuuuucaucuuguu

SEQ ID NO: 392069 - RNA, 64 nt, Human
uggccugccuaucacaaccacaucccuuccccccacaaggcaauaaaucucauuucuuuauauc

SEQ ID NO: 392070 - RNA, 64 nt, Human
ugcucccugaucugucagagcuuaccuuccaaccacaaggcaacuuccuggcuuuuuacaagug

SEQ ID NO: 392071 - RNA, 64 nt, Human
aacuagaggucaucagaagucagcagcagaaacgacaaggcacuucaugauucucugggaccgu

SEQ ID NO: 392072 - RNA, 64 nt, Human
auuuuacugagcagacuuuauaaaugagauaucuacaaggcacuuaaaguguuacagauguuuu

SEQ ID NO: 392073 - RNA, 64 nt, Human
gugugacucgggagcugcacacaccuggguggacacaaggcacggccacgucaugucucuaaac

SEQ ID NO: 392074 - RNA, 64 nt, Human
uagaauauaauugauugguuuguuacuuggacuaacaaggcaguagauuugccuguguggaauu

SEQ ID NO: 392075 - RNA, 64 nt, Human
guaaauugguauuuguaaaaagcaaacaaacauuacaaggcaguuaucucauugcuguuuuggg

SEQ ID NO: 392076 - RNA, 64 nt, Human
ggugaaaccaggagagauugcuugcuucacuuguacaaggcaggaacgguggcauggggugggg

SEQ ID NO: 392077 - RNA, 64 nt, Human
cgugccacugcacuccagccugggugacagagugagacuccaucauaaauaaauaaauaaauaa

SEQ ID NO: 392078 - RNA, 64 nt, Human
gcuaaaaccgaccggacaucuagcgggcaggggaagacuccacuaaagacuuccacaaagaccu

SEQ ID NO: 392079 - RNA, 64 nt, Human
ucucagucaacauguggaaauccaaggaggacaaagacuccagccacgcugcuaaauagggcuc

SEQ ID NO: 392080 - RNA, 64 nt, Human
ugcaccacuguacuccagccugggcaacagagggagacuccaucuagacuccaucucaaaaaaa

SEQ ID NO: 392081 - RNA, 64 nt, Human
agauauuggucaaaauuuacaaaauuucaguuagacaaggcaacugaguucaagagaucuguug

SEQ ID NO: 392082 - RNA, 64 nt, Human
ccuggcccagcuucuaaagaggaccuucguagccacaaggcaugcuaaaccucuagggucugau

SEQ ID NO: 392083 - RNA, 64 nt, Human
agacuaaggagaucuguaaagaaugaaccauaccacaaggcauacugaagugaggauuauaaga

SEQ ID NO: 392084 - RNA, 64 nt, Human
uagcuagcuuaguguugaacuaaauuuuuuuuaaacaaggcaaggucuaaugcuguuuugagau

SEQ ID NO: 392085 - RNA, 64 nt, Human
guuauuuuuaucauaaagccacaaauguauuauaacaaggcaaauuguaauauauauaauccug

SEQ ID NO: 392086 - RNA, 64 nt, Human
augacauccguauacuuguacuguauuuuguacuacaaggcagcuguuuuucaauaauguccug

SEQ ID NO: 392087 - RNA, 64 nt, Human
ugagguaggcacaagaaaaagucaggcauaaagcacaaggcagacuguuugaguggauugguug

SEQ ID NO: 392088 - RNA, 64 nt, Human
acuccaucucaaaaaaaaaaaaaaauuacuuucaacaaggcauauagucucuuguaauauauau

SEQ ID NO: 392089 - RNA, 64 nt, Human
gaagcuggcagcacucagugaggccgcccggcacacaaggcacguuuggcauuucucuuugaga

SEQ ID NO: 392090 - RNA, 64 nt, Human
ucaggacaaccaaagucaaggacccagaugaaccacaaggcagcuagucagcuacuuagagguu

SEQ ID NO: 392091 - RNA, 64 nt, Human
gcagcuagcugaggaguuugggguguuggguuggacaaggcagguuaguagacucagauucuug

SEQ ID NO: 392092 - RNA, 64 nt, Human
ugcuccucucagggcaggcacauguacggggcauacaaggcacagcgccuguuggaacaggugg

SEQ ID NO: 392093 - RNA, 64 nt, Human
gcuccugugcggugucacagauugcaggguucugacaaggcaggacagucaagaguggggacac

SEQ ID NO: 392094 - RNA, 64 nt, Human
ggagcaggccauucuggaugccauggccgaggagacaaggcagaagcaacuucuggccgacgag

SEQ ID NO: 392095 - RNA, 64 nt, Human
uucuugagcauccugcccugcuacuaacuuuucaacaaggcaaaauggaguaaaguggcaauuu

SEQ ID NO: 392096 - RNA, 64 nt, Human
gagaagaggaggaucucaucucucaucuguccaaacaaggcaaggagacuuucucucaucuuuc

SEQ ID NO: 392097 - RNA, 64 nt, Human
uuuuaccaaaacaagcuauuugaguuuugacuugacaaggcaaaacaugacaguggauucucuu

SEQ ID NO: 392098 - RNA, 64 nt, Human
cgcgccacugcacuccagccugggcgacagagugagacuccaucucagaaaaaaaaaaaaaaaa

SEQ ID NO: 392099 - RNA, 64 nt, Human
ugugccacugcacuccagccugggugacagagcaagacuccaucucaaaaaaaaaaaaagaagc

SEQ ID NO: 392100 - RNA, 64 nt, Human
cgcaccacugcacuccagccugggucacagagugagacuccaucucaaaaaaaaaaaagagaga

SEQ ID NO: 392101 - RNA, 64 nt, Human
auuacuuugaacucuucagaguagauauuuuuucacaaggcaguuugucauaaauucucucaug

SEQ ID NO: 392102 - RNA, 64 nt, Human
auuuauuaaaguguguuuuuccacaauguaccaaacaaggcauaagcagcuucuccugcugacu

SEQ ID NO: 392103 - RNA, 64 nt, Human
gauacuucuguugcccuugugcuccagucauugcacaaggcagaaaacagcucuggcaggaagg

SEQ ID NO: 392104 - RNA, 64 nt, Human
ccaaggguaagucaguauuaauuaaugcuguauuacaaggcaaugcuaccuucuuuauuccccc

SEQ ID NO: 392105 - RNA, 64 nt, Human
ugaaagaagaucaccacugcuggaggcauaauguacaaggcaggaaaagggauggaauugaugg

SEQ ID NO: 392106 - RNA, 64 nt, Human
ugcuuccuguaucaaagguacguauguggugcaaacaaggcagaaacuuccuuuuaauuuccuu

SEQ ID NO: 392107 - RNA, 64 nt, Human
ucaaacauguacuccuuucauacggguggcuuuuacaaggcaacuuccgucauuuaauguuuuc

SEQ ID NO: 392108 - RNA, 64 nt, Human
uuucaacuaaucuuauguggaauugaauuagagaacaaggcauuauucuuuuagggaaggugag

SEQ ID NO: 392109 - RNA, 64 nt, Human
uggagaauccuuugucuuccacucacugucauucacaaggcacagugccccaugaaauugcccc

SEQ ID NO: 392110 - RNA, 64 nt, Human
uugggagcuauugagccaccugggaugagaugacacaaggcacuccuaccacugagcgccuuug

SEQ ID NO: 392111 - RNA, 64 nt, Human
aggcuccagggcccuaugccaaccugccuuuguuacaaggcagaggaagcuuuguauuuauugg

SEQ ID NO: 392112 - RNA, 64 nt, Human
cacuggaccagaacugggagaggaagagagcaggacaaggcagacagaaggucaggucaggaac

SEQ ID NO: 392113 - RNA, 64 nt, Human
gaaauaaacaggaguucagcggagcuagcagaagacaaggcauguagggggagccauucugucc

SEQ ID NO: 392114 - RNA, 64 nt, Human
uuugugaaagugucaucacggguccccugaggagacaaggcagguccagcgcacaucaggcgga

SEQ ID NO: 392115 - RNA, 64 nt, Human
accugaacuguuggauuuuucuaguugccgccaaacaaggcaaaaaaauuuaaacaugaagcac

SEQ ID NO: 392116 - RNA, 64 nt, Human
ucugucuuacugcaucaccagauagggcuuugcuacaaggcacaaaugauccaaaucaaggagg

SEQ ID NO: 392117 - RNA, 64 nt, Human
uuuuuuuuuuuuuuuuuaagcacuuguuuuggguacaaggcauuucugacauuuuauaaaccua

SEQ ID NO: 392118 - RNA, 64 nt, Human
uaaaagauaaauuuguugaauauugguaauuaaaagacuccacauaaguccauuaacugcuuuc

SEQ ID NO: 392119 - RNA, 64 nt, Human
caugccacugcacuccagccugggcaacagagcgagacuccaucucaaaaaagaaauaaagugc

SEQ ID NO: 392120 - RNA, 64 nt, Human
ugcgccacuguacuccagcuugggcaacagagcaagacuccaucucaaaaaaaaaagaguucua

SEQ ID NO: 392121 - RNA, 64 nt, Human
uguacuuauauacagucuuucaagagagauacaaacaaggcagaaacauuuaaacuaguauuaa

SEQ ID NO: 392122 - RNA, 64 nt, Human
acccaaaaguccgcaguccaaaguuucaucugagacaaggcaagucccuuccacuuaugaaccu

SEQ ID NO: 392123 - RNA, 64 nt, Human
agaaaccuggccuggguugucucaaauccuguccacaaggcaacuccagaagaaagaagcccuu

SEQ ID NO: 392124 - RNA, 64 nt, Human
auaaaaccuuaaaguucuguugguaucacagaagacaaggcagaguuuaaagugaggaauuuua

SEQ ID NO: 392125 - RNA, 64 nt, Human
uucccaugacccucucuucccugugucuccccuaacaaggcaaucuggaagcagaaaugcaaac

SEQ ID NO: 392126 - RNA, 64 nt, Human
caccugggauguggaagcugaggaccagaugcacacaaggcauugcucuguuugcuguucuagu

SEQ ID NO: 392127 - RNA, 64 nt, Human
caugauugaaagcagaacaauggagaugaaauaaacaaggcaaaauagagguggaaacagaagg

SEQ ID NO: 392128 - RNA, 64 nt, Human
ccacaggcuugagguuuuuggcuguuuuuuacuaacaaggcagaauguauguacuaccugaauu

SEQ ID NO: 392129 - RNA, 64 nt, Human
cuuucucacauccucuucaugauugaagcauggcacaaggcaagguguugccugcgagucuggu

SEQ ID NO: 392130 - RNA, 64 nt, Human
ugagcuuggggcccuagggaagauagagaauuauacaaggcaaaguccuucucuuuagggcucu

SEQ ID NO: 392131 - RNA, 64 nt, Human
auuuuucacugaagcugagcaaccacauauugcuacaaggcaaaucaagaagacaucaggaaau

SEQ ID NO: 392132 - RNA, 64 nt, Human
gcagcaaucagagucccagcguuuguacucacagacaaggcaaagguaccagcuuuucuguuuc

SEQ ID NO: 392133 - RNA, 64 nt, Human
cacagaacugggagugagggcuccucaggcagccacaaggcaggaaaacuggcgcaaauuuccu

SEQ ID NO: 392134 - RNA, 64 nt, Human
gcucagccucccccugcugcucauccaggguguuacaaggcacuugucacuaugcuauuucugg

SEQ ID NO: 392135 - RNA, 64 nt, Human
acuagauuagccaaauagucugaauuuccagaaaacaaggcagaaugaucauucccagaaacau

SEQ ID NO: 392136 - RNA, 64 nt, Human
uggacuugcgucggcacccagaggccuuggagggacaaggcacugggcggugugacuggucaug

SEQ ID NO: 392137 - RNA, 64 nt, Human
caauuaacugagaauguaagaaaauugaugcuguacaaggcaaauaaagcuguuuauuaaccuu

SEQ ID NO: 392138 - RNA, 64 nt, Human
aguuuuguuuaugcauuuccuuaaaauuaauuguagacuccaggauacaaaccauaguaggcaa

SEQ ID NO: 392139 - RNA, 64 nt, Human
cuggcauugucuggagacggcuuccuggaagaggagacuccagcagagcccugaaguguggaca

SEQ ID NO: 392140 - RNA, 64 nt, Human
ccagaaguuugagaccagccuaggcaacauugcaagacuccaucucuacaaaaaauauaaaagu

SEQ ID NO: 392141 - RNA, 64 nt, Human
aagcugccauagaaauucugugaaccagaaugagacaaggcagcaggcauacagaagguuuguc

SEQ ID NO: 392142 - RNA, 64 nt, Human
uuggccucagauggacuacaggagauuacaacguacaaggcagauggagcauugacguuuucaa

SEQ ID NO: 392143 - RNA, 64 nt, Human
ugauuuuuuuccuaaauauucuucuuuaccuuuaacaaggcauaggcuguugcaggacaguggu

SEQ ID NO: 392144 - RNA, 64 nt, Human
ggaagagguaugugcugauuuguuuggauauuugacaaggcacucugaugugacuucccugacu

SEQ ID NO: 392145 - RNA, 64 nt, Human
aaaauuuguuccuuuuucacuaugggcaguucacacaaggcaaaaacuauugaacaguugguuu

SEQ ID NO: 392146 - RNA, 64 nt, Human
ccugcccuuguuuggggcaggaguagcugagcucacaaggcagcaaggcccgagcagcugagca

SEQ ID NO: 392147 - RNA, 64 nt, Human
uuuaagagaaauguucugacacccaccuaaacacacaaggcacguuccuggccuguguucaagg

SEQ ID NO: 392148 - RNA, 64 nt, Human
ugacuagauuggauucugaggagaagaaccuacuacaaggcaaggagccguuuuuuggcuuuga

SEQ ID NO: 392149 - RNA, 64 nt, Human
uguaaugaaauggaucacaaugucauuuccuaauacaaggcaggauaugugggaagaauaugua

SEQ ID NO: 392150 - RNA, 64 nt, Human
auuuauugagugccuaccagaugccagucaccacacaaggcacuggguauaugguauccccaaa

SEQ ID NO: 392151 - RNA, 64 nt, Human
uuuuucuauaaaaagaaaaaaauggaaaaaaauuacaaggcaauggaaacuauuauaaggccau

SEQ ID NO: 392152 - RNA, 64 nt, Human
auaugccccauuuggaacaauccucacucuacagacaaggcaaaauguuguauuguaguucauu

SEQ ID NO: 392153 - RNA, 64 nt, Human
ccugccccaccccauuccuuauauucagcaagcaacaaggcaauagaaaagccaggguugucuu

SEQ ID NO: 392154 - RNA, 64 nt, Human
acucuaaaaauugacccuaucaacuggagagcccacaaggcauagggaauagagaaaagggaaa

SEQ ID NO: 392155 - RNA, 64 nt, Human
guaacaagccagaugauuauuuugguauugcuugacaaggcaaauugauugucuugacccaggc

SEQ ID NO: 392156 - RNA, 64 nt, Human
uaacucgcggccuuauuucugccuuuaaucucccacaaggcaucuguugcuuuggguccuccac

SEQ ID NO: 392157 - RNA, 64 nt, Human
ccccgauggcugcgcacacaggaggcggcggagcacaaggcaagugaguuugcacugucagccc

SEQ ID NO: 392158 - RNA, 64 nt, Human
uugccgccgccgcccccacugcuguguccuuuccagacuccagggcuccccgggcugcucugga

SEQ ID NO: 392159 - RNA, 64 nt, Human
guugaugaguugauuaagucuaacagauucaucaagacuccauugcuuuauuauagagacauuu

SEQ ID NO: 392160 - RNA, 64 nt, Human
aucucccaacgauuucagaacucugagcucagagagacuccagauuuuaaaaaauaauuugagu

SEQ ID NO: 392161 - RNA, 64 nt, Human
cuguguaggaccauggggaguucagagucaucauacaaggcagccaagaacugccauaaacacu

SEQ ID NO: 392162 - RNA, 64 nt, Human
caaagggacuuuuguaaaaucaaaucauccugucacaaggcaggaggagcugauaaugaacuuu

SEQ ID NO: 392163 - RNA, 64 nt, Human
gucagagauguacucagaggguuaacagacaagcacaaggcaugcugacuacauugguguaucc

SEQ ID NO: 392164 - RNA, 64 nt, Human
ggaaacuuccaggcucaaacaugucccccgugccacaaggcaaacugcgaugagcucacagucc

SEQ ID NO: 392165 - RNA, 64 nt, Human
gaaacaucuguggacucuguuagaugaggcaccaacaaggcaaggucaccugccucuuucccuu

SEQ ID NO: 392166 - RNA, 64 nt, Human
cauuuaagcuguggucaaggcuacagaugugcugacaaggcacuucauguaaagugucagaagg

SEQ ID NO: 392167 - RNA, 64 nt, Human
ugaccaguuaugauugugaaguuaaugcuccuauacaaggcagcagaaaccuacugcaggguga

SEQ ID NO: 392168 - RNA, 64 nt, Human
aggccuuacuaauccauaccaaauuagccuaaagacaaggcauuuuauauucauuucuauuuuc

SEQ ID NO: 392169 - RNA, 64 nt, Human
uagcccuaaauuaguuucuuguugauugcuggaaacaaggcaguagugauucuccgcugccacu

SEQ ID NO: 392170 - RNA, 64 nt, Human
acagagagaaauaagaggagguuguuugcaucccacaaggcaucguacuaguugggcgagaccu

SEQ ID NO: 392171 - RNA, 64 nt, Human
uuaaaugcuuuguaaagcugagaucuaaauggggacaaggcagguggaggggaggccaguguac

SEQ ID NO: 392172 - RNA, 64 nt, Human
ggucaacccaggaggccucacuacaagagccuugacaaggcacuguuuuuugugggacugggag

SEQ ID NO: 392173 - RNA, 64 nt, Human
auuucuuuauagcaaugcaagaauggccuaaaacacaaggcaaaacaacuuugauaugguacag

SEQ ID NO: 392174 - RNA, 64 nt, Human
ccacaucugcucuagggaaucuggauuauguuauacaaggcaagcauuuuuuuuuuuuuuuuaa

SEQ ID NO: 392175 - RNA, 64 nt, Human
aauacauuaggaaaauguguuuagaaauaaaagcacaaggcagggcagugcucacgccugucau

SEQ ID NO: 392176 - RNA, 64 nt, Human
cuucaaaaaguuauauugcauuuacaaauguuuuacaaggcagaaaguuugacuggauaguuag

SEQ ID NO: 392177 - RNA, 64 nt, Human
aggcuggacagggcgcggaacccugucauggaugacaaggcaagggcagcaauaggcuggagcc

SEQ ID NO: 392178 - RNA, 64 nt, Human
uguuuaaaaacaaaucaaauuuauugaacaaaugacaaggcacaaauacuuucagaauuguauu

SEQ ID NO: 392179 - RNA, 64 nt, Human
caaaaagauauuaccuuauugggcuuaacaauucacaaggcacuuucacacccauuaucuaauu

SEQ ID NO: 392180 - RNA, 64 nt, Human
cuccccaacguuaaaugcucgagaggaaucuuccacaaggcagggccaugcacgcaaccugcac

SEQ ID NO: 392181 - RNA, 64 nt, Human
cagaugcugcugcugauuaagagaauagaugcaaacaaggcaugcauuuggccaaaauaaacaa

SEQ ID NO: 392182 - RNA, 64 nt, Human
uauuuguauuuaguaguguaucucauagauacagacaaggcaagagaugauaagcuguuuaaau

SEQ ID NO: 392183 - RNA, 64 nt, Human
aaugucauuuugauaggagcguuuuguuauuuuuacaaggcagaaugggguguaacaguugaau

SEQ ID NO: 392184 - RNA, 64 nt, Human
aaccuuuauaaaccaguauuucacuuuuaaaaagacaaggcaucucuacccauuaacucugcaa

SEQ ID NO: 392185 - RNA, 64 nt, Human
uuggauggauaagcuugucuaugguacaaaaaucacaaggcauucaaguguacagugaaaaguc

SEQ ID NO: 392186 - RNA, 64 nt, Human
acccugccauaugaaggaccccacccccgacaccacaaggcauuauuauucuauuaauuauugu

SEQ ID NO: 392187 - RNA, 64 nt, Human
uucugaaagcaaacagugcugcucuuuauuccagacaaggcaggaaagucugaguugggaguga

SEQ ID NO: 392188 - RNA, 64 nt, Human
aucagaccuuuggcaaugggguggucacuaccucacaaggcaaaguguuguaugauuagaaauu

SEQ ID NO: 392189 - RNA, 64 nt, Human
aaugggaacuuugacagccaugaccaugaaacucacaaggcaacgcgaugaaacucacaaagca

SEQ ID NO: 392190 - RNA, 64 nt, Human
ugaaaaucucucuugacagggagcucacuaccucacaaggcaggucauuucauugugggaucua

SEQ ID NO: 392191 - RNA, 64 nt, Human
acgaaggugguuaauagaaacucaggcucccgugacaaggcaggacaagagccuguuucgcuuu

SEQ ID NO: 392192 - RNA, 64 nt, Human
agcaaaagcuggagcauuacucuugagaaguagaacaaggcacuucaguccuauucaacauagu

SEQ ID NO: 392193 - RNA, 64 nt, Human
ugagucagaacagucuccucaauccugaaauucaacaaggcaucagaagggcuggcugugguca

SEQ ID NO: 392194 - RNA, 64 nt, Human
uuugccuaaaucugaguugugccuuucuuuacucacaaggcaugggcuuuguccuggugaucag

SEQ ID NO: 392195 - RNA, 64 nt, Human
cuuugacagaagacucaaacacagccucuaagaaacaaggcagcuguuagugugacauagcuuc

SEQ ID NO: 392196 - RNA, 64 nt, Human
ugugccacugcgcuccagcgugggcgacagagugagacuccaucucaaaaaaaaaaaaaaaaaa

SEQ ID NO: 392197 - RNA, 64 nt, Human
aaacgccgcugacugccacccacacgcccuccccagacuccaccgucagcuguaacccucaccc

SEQ ID NO: 392198 - RNA, 64 nt, Human
ggccccuccuucuuaccucagaugccugaacagaacaaggcaaacccguagcagccucucagga

SEQ ID NO: 392199 - RNA, 64 nt, Human
acacuguauuggaugacccuagaucuucuuugagacaaggcaggcuguggccauguagccccau

SEQ ID NO: 392200 - RNA, 64 nt, Human
ucccacaagacugguauucucuuugccugaagaaacaaggcauugaaucucuaaaaugcuguuc

SEQ ID NO: 392201 - RNA, 64 nt, Human
ugcccccacccccacccccgcacccccauucuacacaaggcagaagaggcacggguuuuucugg

SEQ ID NO: 392202 - RNA, 64 nt, Human
guuccugggagacuccaacaaauggagaccagaaacaaggcaaccacgaccuugcuagguucuc

SEQ ID NO: 392203 - RNA, 64 nt, Human
cuuaggggcuggcuuuauggaacuuguaguuugaacaaggcaguggcaauccgcccccuccagc

SEQ ID NO: 392204 - RNA, 64 nt, Human
agcuggagacugagcuggggcuggccgggacgugacaaggcaggacagaggcggccccuccgcu

SEQ ID NO: 392205 - RNA, 64 nt, Human
gaguggaucugcggugaagccaagccgcaagguuacaaggcauccucaccaggggccccgccug

SEQ ID NO: 392206 - RNA, 64 nt, Human
cgaugcugugcagcucacaccacuccagaaccugacaaggcaccagcaggaccccuugccagga

SEQ ID NO: 392207 - RNA, 64 nt, Human
uagcagugucauuuggaaaaguugaauuugcccuacaaggcauguucuccauucaagggucuug

SEQ ID NO: 392208 - RNA, 64 nt, Human
agccccuuccuuucccccgaccuaaacauaaaagacaaggcaaagcccgcauaauuuuaagacg

SEQ ID NO: 392209 - RNA, 64 nt, Human
uuuaggaaacacacuguacccugcucccagcaucacaaggcacuugucuacaagugugucccaa

SEQ ID NO: 392210 - RNA, 64 nt, Human
ucacaaggucaggaguucgagaccagccuggccaacaaggcaaaaccccgucucuacuaaaaau

SEQ ID NO: 392211 - RNA, 64 nt, Human
auucacagcugaagugggugcugcaacgucuugaacaaggcagaaguuggugagaggaucugug

SEQ ID NO: 392212 - RNA, 64 nt, Human
ugcaggaugagccugaacugguugugcagaacaaacaaggcauucaugggaauuguuguauucc

SEQ ID NO: 392213 - RNA, 64 nt, Human
cagccaugcauuuauuauuaaacauuuucuaccgacaaggcacugugcuagguacuguaauccu

SEQ ID NO: 392214 - RNA, 64 nt, Human
uuucuacuaguagauuguguuucuagagaaagauacaaggcauaggugauuguuuaggauuuuc

SEQ ID NO: 392215 - RNA, 64 nt, Human
cacgccauugcacuccagccugggugacacagugagacuccaucucaaaaaaaaaaaaagaacg

SEQ ID NO: 392216 - RNA, 64 nt, Human
uuagaaggaagcauggcccugacuucagaauuccagacuccagaacuggaagaauaaaugucug

SEQ ID NO: 392217 - RNA, 64 nt, Human
uucaccagugcacuccagccugggugacagagcaagacuccaucucaaaaaaaaaauaaauaaa

SEQ ID NO: 392218 - RNA, 64 nt, Human
ugacugaggcccacgcaggaaccgacacucagacacaaggcaaagagggccacaggacccggga

SEQ ID NO: 392219 - RNA, 64 nt, Human
gcacguuguacccuuggcuggacauggccaagacacaaggcauuccacggcggcaagcugaccg

SEQ ID NO: 392220 - RNA, 64 nt, Human
ccacuagugacccucagagucuucuccccuuaggacaaggcagacaccccaccaugcgggccuc

SEQ ID NO: 392221 - RNA, 64 nt, Human
ucaaacguucuacguccuaaagccaggaagagugacaaggcagguggggacagaaggaagaagc

SEQ ID NO: 392222 - RNA, 64 nt, Human
gcacagugggcacuggucacuccuaugugcuaagacaaggcagacaucuguguguucucuuaag

SEQ ID NO: 392223 - RNA, 64 nt, Human
aguuaaggacacucacccccacccacgcacacacacaaggcagcgucgggugggagagagaagg

SEQ ID NO: 392224 - RNA, 64 nt, Human
ugagucaggggucugggcacugcuucaggagcucacaaggcagcagucacagugucuccugggc

SEQ ID NO: 392225 - RNA, 64 nt, Human
agacaucaaguacuuuacaagguaauagaauaucacaaggcaaguggaggcagggcgagaucac

SEQ ID NO: 392226 - RNA, 64 nt, Human
guucacaagccauggaacuaccuugcuucacaucacaaggcaaggugaacucaacucccaauaa

SEQ ID NO: 392227 - RNA, 64 nt, Human
cuaauaaaguguaaaaugguguuaugucuaggaaacaaggcacauacuuuaauuuuaaaacacu

SEQ ID NO: 392228 - RNA, 64 nt, Human
uuguggaaacaacguaaauucuacuuaaguguaaacaaggcaagccucagaccagcaauaaauu

SEQ ID NO: 392229 - RNA, 64 nt, Human
uguaucaaaacugaagaugguuugaaacagcuucacaaggcagaacaguaucaaaagaagaauc

SEQ ID NO: 392230 - RNA, 64 nt, Human
uccauucagccugcccagcucuggcuggucagagacaaggcagaacuuuuggaaaaacaaagac

SEQ ID NO: 392231 - RNA, 64 nt, Human
acugugcccagccaaaagagaaauuucuacaugaacaaggcaauuucagugucuuacagcggcc

SEQ ID NO: 392232 - RNA, 64 nt, Human
gauugaaacaagcacgcgugcucggcucacaccaacaaggcaagccaaaggcgccccuccccag

SEQ ID NO: 392233 - RNA, 54 nt, Human
ugggcagguccucugccuagaaacacaaggcaagcaacaucagguaaaaaccaa

SEQ ID NO: 392234 - RNA, 64 nt, Human
acuuagugacagugaugcucugugcugguaccaaacaaggcagacuugcaagaaccauggcauc

SEQ ID NO: 392235 - RNA, 64 nt, Human
cgcugugcuagcuuuccuuuacagcuguuuacagacaaggcaggccugaggcagauggccacug

SEQ ID NO: 392236 - RNA, 64 nt, Human
uugccaugaagguagauguggguggggagaagacacaaggcaguuuguucuggcuagaugagag

SEQ ID NO: 392237 - RNA, 64 nt, Human
cgcggaagcauggagggaaaggagguuguaaaauagacuccauggagacucuuaggaagcagua

SEQ ID NO: 392238 - RNA, 64 nt, Human
ggucacuaagcccuuaccuagggcuggguggacaacaaggcacagaugagggugugacuggccc

SEQ ID NO: 392239 - RNA, 64 nt, Human
ggugcuuuccuguuucucagucucacauuucucaacaaggcaaaaacaaagagcguugaaguug

SEQ ID NO: 392240 - RNA, 64 nt, Human
uagaagggaggagugguccacccacggucccagcacaaggcagagcugggaugaaaacagggcu

SEQ ID NO: 392241 - RNA, 64 nt, Human
cuguguuuuguuuuguuucgcauuuagagagcagacaaggcacccuucugcugcgcugauacgu

SEQ ID NO: 392242 - RNA, 64 nt, Human
cuggagaaaggggcugugcuggggccagacuggcacaaggcacucgugcccacaccacacccca

SEQ ID NO: 392243 - RNA, 64 nt, Human
agucuuugagcccuuucccagucaaaugcucccaacaaggcaucccuuauucugaccucagagg

SEQ ID NO: 392244 - RNA, 64 nt, Human
aguggccuagucaugcuuucuacucauguccuucacaaggcacauccccuacauuuggaagaau

SEQ ID NO: 392245 - RNA, 64 nt, Human
gacucauggaaauagaaugaauagaggggcauucacaaggcacaccagugcaagcagaugacaa

SEQ ID NO: 392246 - RNA, 64 nt, Human
ggcuauacucauguaagccaugcgagccucucccacaaggcagcuugcuucaucagagcuagca

SEQ ID NO: 392247 - RNA, 64 nt, Human
aguguucucuguauugucuauuauuuagaaaugaacaaggcaggaaacaaaagauucccuugaa

SEQ ID NO: 392248 - RNA, 64 nt, Human
guuauucauacaaauaaugagcccuacacagggaacaaggcaggaaguuagcuguuaacuccuu

SEQ ID NO: 392249 - RNA, 64 nt, Human
auucggaggucaagaaagcaguauauauucuuucacaaggcauccauacuguuuaauauuuaua

SEQ ID NO: 392250 - RNA, 64 nt, Human
ccaggcugaaccugccacugcuggagccauuucaacaaggcauccucacaacaaagaagagaug

SEQ ID NO: 392251 - RNA, 64 nt, Human
caccauuuucaugccugucaauccccaccccaccacaaggcaggaaggggguggugccugcugg

SEQ ID NO: 392252 - RNA, 64 nt, Human
cuuggggaugugaugaaaacacuuggcaggaauuacaaggcaaugaagaauucuuaagguuauc

SEQ ID NO: 392253 - RNA, 64 nt, Human
uaaacauaagacaugcucauuguaaaaaauguacacaaggcagaaggaaguaaaauuuccacag

SEQ ID NO: 392254 - RNA, 64 nt, Human
uuauacugaaguagcucuagaaagacacauguauacaaggcacuauuguacacacuuugcugaa

SEQ ID NO: 392255 - RNA, 64 nt, Human
uggagacgccugaaagacaguuccaucuuccuuuagacuccagccuuggcaaaaucaccuuccc

SEQ ID NO: 392256 - RNA, 53 nt, Human
uggacagauuugugcgcugagccagacuccaggguugccugggaacagucucu

SEQ ID NO: 392257 - RNA, 64 nt, Human
ccagccugcagaacacagaaugaaacaugcugguagacuccacgagggcagggccucuccuguc

SEQ ID NO: 392258 - RNA, 64 nt, Human
uucuccucacucugugcacuuugcuguuggugugacaaggcauuuaaagauguuucuggcauuu

SEQ ID NO: 392259 - RNA, 64 nt, Human
aacuaaaacuucaucuuccccaagugcggggaguacaaggcauggcguagagggugcugcccca

SEQ ID NO: 392260 - RNA, 64 nt, Human
gcuugaggccaggaguuagagaccagccuggccaacaaggcaaaaccccgucucuacuaaaaau

SEQ ID NO: 392261 - RNA, 64 nt, Human
cuuauuacucauuuucaggaaaguuuguaguauuacaaggcagaaggaaacacaguagcaaugg

SEQ ID NO: 392262 - RNA, 64 nt, Human
gcaugccggugcagacggaugcgaggaugcagggacgcgcgacgccggccccggucgcagccga

SEQ ID NO: 392263 - RNA, 64 nt, Human
gauccggccaggaccccggcccccaaugcacuuuacgcgcgaagaaguugccggaugguugucc

SEQ ID NO: 392264 - RNA, 64 nt, Human
acgguagugugacuguggcucaacuuuccaugguacgcgcgaauuguucuggaagucacagaug

SEQ ID NO: 392265 - RNA, 64 nt, Human
aggugacugugugugugugugugugcgcgcgcgcacgcgcgagugugcuguauggcccaggcag

SEQ ID NO: 392266 - RNA, 64 nt, Human
agccaugauacccccucgugggaagaagggaccgacgcgcgagucgcgcuccgcagucgagccg

SEQ ID NO: 392267 - RNA, 64 nt, Human
agaagcggccagaacgcaccuccggcuccggcggacgcgcgaccguugugcaccaccagggacc

SEQ ID NO: 392268 - RNA, 64 nt, Human
agucucccuuccagcuguuccauucucuccaccaccagcguaacuggcaaguuaccaagguugu

SEQ ID NO: 392269 - RNA, 64 nt, Human
ucucagacacucauuccauacugcaccguacaugccagcguacccauugcaccgaaagcaggcc

SEQ ID NO: 392270 - RNA, 64 nt, Human
aucuaggaauucugguuacagcccagugcucaucccagcguaugcugccucuuuagggcagccc

SEQ ID NO: 392271 - RNA, 64 nt, Human
agccugugcccauauggucauccaaauggacuggccagcguaaaugaccccacugcagcagaaa

SEQ ID NO: 392272 - RNA, 64 nt, Human
aaugaacacugacauacuuguuuuaauuuuuuucccagcguaaaaauagaaaaaucaaaauacu

SEQ ID NO: 392273 - RNA, 64 nt, Human
cggagccugcgcagcgagcuggcugcacuuccccccagcguacaggaggagcacgggcagcugc

SEQ ID NO: 392274 - RNA, 64 nt, Human
cuggggagaccucauuugguuuccguucagaagaccagcguagcccuuuugagacuuuugggua

SEQ ID NO: 392275 - RNA, 64 nt, Human
auuagaaucuuaccuugugcagucaucagaaauuccagcguacuauaaugaaaacauccuuguu

SEQ ID NO: 392276 - RNA, 64 nt, Human
uaaggccaaguguuuaagaaguagaguguagcugccagcguagaaacccaugaaaaggaggcca

SEQ ID NO: 392277 - RNA, 64 nt, Human
cacauauaacuggcuguuuucuguucuuguuuauccagcguaggaagaaggaaaagaaaaucuu

SEQ ID NO: 392278 - RNA, 64 nt, Human
gggccaguucugggauuuggcccugggaagcagcccagcguaccccaggccugcucugggaagu

SEQ ID NO: 392279 - RNA, 64 nt, Human
gaaaauaacaugauuuguuccuuauuaaagcuucccagcguaugaaauucuaagcugggugggg

SEQ ID NO: 392280 - RNA, 64 nt, Human
ggugacuggaaccggggcgguggggugaggguggccagcguacaacagguaagcccggcccagu

SEQ ID NO: 392281 - RNA, 51 nt, Human
gguucguguccgccaugugagccagcguagggacgaaaacucauagacaca

SEQ ID NO: 392282 - RNA, 64 nt, Human
ccccugaacuaagacacagggaguauuucagaggccagcguaggagucauugacaacaaaaagc

SEQ ID NO: 392283 - RNA, 64 nt, Human
augcagggcuaaauugcaaaauaaaauaaaauagccagcguacacaaugagauauucuaaacuu

SEQ ID NO: 392284 - RNA, 64 nt, Human
cacgccacugcgcuccagccugggcgaaagagugagacuccaucucaaaaaaaaagaaaauuuc

SEQ ID NO: 392285 - RNA, 64 nt, Human
aaacucuauuucuguucauauuaauucacuugccagacuccaauucugaaaguugucuaguucu

SEQ ID NO: 392286 - RNA, 64 nt, Human
ucccuuuggugccgaguauguuucgguccccuccagacuccaggacacgcccauguaugucccc

SEQ ID NO: 392287 - RNA, 64 nt, Human
cuguagccucugcauacuacuggcugucaucacaccagcguacaguagcuaaauuuuuggugca

SEQ ID NO: 392288 - RNA, 64 nt, Human
aguaaaagaaaccacuucuggucaaucaacacuaccagcguauauauaagaaagacaucuuucu

SEQ ID NO: 392289 - RNA, 64 nt, Human
caugaagacauauguccacuaaguacuccaauuaccagcguaggcaaaaugagcuuccaccucu

SEQ ID NO: 392290 - RNA, 64 nt, Human
agcuuccccagacagcuaaugccgagaucuucuaccagcguagaguugacagaagcaggccagc

SEQ ID NO: 392291 - RNA, 64 nt, Human
uugaaguggguuuuaguuuuguuuaaaauuauaaccagcguauuuucacaucauucuguaaguu

SEQ ID NO: 392292 - RNA, 64 nt, Human
acaaaccauccaguggagguuugucgggcaccagccagcguagcagggucgggaaaggccaccu

SEQ ID NO: 392293 - RNA, 64 nt, Human
cacaguuggcauccuuuauucaggucucuucucuccagcguacacuuaaaauuggugccgagca

SEQ ID NO: 392294 - RNA, 64 nt, Human
ccuccagcuugcacccagcaccaccugagucuaaccagcguauaaugcaauaacagguagagua

SEQ ID NO: 392295 - RNA, 64 nt, Human
gauaugagucucagcaaauucuugaauaaacuccccagcguauccuaugguaacugaugauaua

SEQ ID NO: 392296 - RNA, 64 nt, Human
gggcccccugaaacugcuuauucgugauuccucaccagcguagagcuccaccuccccuuucccc

SEQ ID NO: 392297 - RNA, 64 nt, Human
gcaggcagggccaucaggcaccagaaggauuuugccagcguagugcuccuggaccagcgauaug

SEQ ID NO: 392298 - RNA, 64 nt, Human
aaaucaaaaaaaaaaaaaagaaagaaagaaaccuccagcguauuuuaucacuaccuauagaaag

SEQ ID NO: 392299 - RNA, 64 nt, Human
uugacgacgguguccucgcagugucgccgccaccccagcguaguccaagucagacuauuucaca

SEQ ID NO: 392300 - RNA, 64 nt, Human
uaggcucuuuagacagcaccuaccacuugguucuccagcguagacuccugggagcagccaacug

SEQ ID NO: 392301 - RNA, 52 nt, Human
cuggguuuuucgagugcugaccccagcguagacaguucagaccgcuaacuua

SEQ ID NO: 392302 - RNA, 64 nt, Human
uugguuuucagggucuaacguagcuguccucagcccagcguaguuguaauugcuuuaaaaaaaa

SEQ ID NO: 392303 - RNA, 64 nt, Human
ggaauuuuuccagccucauccuggccugcccucuagacuccaguccccaagcccucagccuagu

SEQ ID NO: 392304 - RNA, 64 nt, Human
ugaguccucaccagcccuccccauuuguccuccaagacuccacucaaacaucuccucuuggugc

SEQ ID NO: 392305 - RNA, 64 nt, Human
uccagcccggcacuccagccuggcgacaagagugagacuccaccucaaaaaaaaaaaaaagaau

SEQ ID NO: 392306 - RNA, 64 nt, Human
gcuucccaugccagcccggagcccacagugcugcccagcguaccucccucaccgucuggggcuc

SEQ ID NO: 392307 - RNA, 64 nt, Human
uucucagcacugagguaaacucugcauugucaucccagcguacaccuuuaauguuuuauugauu

SEQ ID NO: 392308 - RNA, 64 nt, Human
ccaucagcccaggcagacgggagcagguucuuggccagcguagacagcagcaaacagcagcagg

SEQ ID NO: 392309 - RNA, 64 nt, Human
cugauuuuccaguccccaccguccugcgggacagccagcguaugcuaauguugcaaacccauga

SEQ ID NO: 392310 - RNA, 64 nt, Human
agugugggugugggccucugaauauaacccacacccagcguagggggagucugagccgggaggg

SEQ ID NO: 392311 - RNA, 64 nt, Human
aacugaaccccaggaauugcuuacacacuuucuuccagcguagcaucucuucaaacacaaugcu

SEQ ID NO: 392312 - RNA, 64 nt, Human
gcuggugcagggaaagcaagaaggcuggagggauccagcguaucuugccaguaaccagugaggu

SEQ ID NO: 392313 - RNA, 64 nt, Human
agugguauaaaguucacacaguauuaugacacucccagcguaucauagaaaaugugaguaguac

SEQ ID NO: 392314 - RNA, 64 nt, Human
ggaucaaaagagacuugccuuuuaaggaucgaaaguacgccaaugugaauuuccauuauuuuca

SEQ ID NO: 392315 - RNA, 64 nt, Human
ucaggcauucauaaggcaggcacuaucagaaaguguacgccaacuaagggacccacaaagcagg

SEQ ID NO: 392316 - RNA, 64 nt, Human
guuugaggcugcagugaccuaugaccacaucacuguacgccagcccgggugagagagggagacc

SEQ ID NO: 392317 - RNA, 64 nt, Human
ggcagcacugguacaugagccgccucuugcaucaguacgccaaagccaucuuccaggacccaga

SEQ ID NO: 392318 - RNA, 64 nt, Human
cuggggcauuuggauuguaauugggagcucugccguacgccagggcgguuccaaacucuaaacc

SEQ ID NO: 392319 - RNA, 64 nt, Human
ugcuuuagccucccaaguagcugggacuacagguguacgccaccacacccagcuaauuuuugua

SEQ ID NO: 392320 - RNA, 64 nt, Human
cuaaauggguacuagaacaacaacugccccucauguacgccaaggaugagcucuagaucauuug

SEQ ID NO: 392321 - RNA, 64 nt, Human
uccacacucaguggugccccugcaguugggugggguacgccagcaaaggaucaguuuggcugcc

SEQ ID NO: 392322 - RNA, 64 nt, Human
ggcgccacuguacuccaaccugggcgacagagcaagacuccaucucauaaauuaaaaggaaagu

SEQ ID NO: 392323 - RNA, 64 nt, Human
ccugccacugcacuccagucugggugacagagcaagacuccaucucaaaaaauaaauaaauaga

SEQ ID NO: 392324 - RNA, 64 nt, Human
auagccacugcacuccagccugggcaacauagcaagacuccaucucuaaguaaaaaaauacaac

SEQ ID NO: 392325 - RNA, 64 nt, Human
uaugugguuaguagucauggaaaugacacauaaaguacgccagaaguuugauggaacguguuag

SEQ ID NO: 392326 - RNA, 64 nt, Human
guacaagggagcaccccuucccuuuccucugaagguacgccacccaccuccgucgcccaccuca

SEQ ID NO: 392327 - RNA, 64 nt, Human
uccugugcuaucuucucuucuauccaaguagaauguacgccaggagcuccuucccucuagcaau

SEQ ID NO: 392328 - RNA, 64 nt, Human
ccccaaccccuacccaucaccuuuuaagaacauaguacgccaguguaacgugggaaccauugag

SEQ ID NO: 392329 - RNA, 64 nt, Human
cucuuuccuucccuccccucccccucugccuuuuguacgccaguucucagaaauaaagaucuuu

SEQ ID NO: 392330 - RNA, 64 nt, Human
uacacccccuuguaguauaauuucaaggaacuguguacgccauuuauggcaugauuagauugca

SEQ ID NO: 392331 - RNA, 64 nt, Human
ucuuaauuuaucuaucuguaauauacauaaaucgguacgccaugguuugaagaccaccuucuag

SEQ ID NO: 392332 - RNA, 64 nt, Human
auugcuaccaagcaagcaccacaagaaagggaggguacgccaggcgagcccagggcacagaugc

SEQ ID NO: 392333 - RNA, 64 nt, Human
acccccacgaggugaagccagccuaugccaccagguacgccaucacugucugguauuuugaugc

SEQ ID NO: 392334 - RNA, 64 nt, Human
gaagccuuuugauaugcauucgcuauucccagauguacgccaugccuuuuccaugucccuccua

SEQ ID NO: 392335 - RNA, 64 nt, Human
gguguguacacgaacucggcuucuuuuguccuagguacgccaagggcagguuucuggagacucc

SEQ ID NO: 392336 - RNA, 64 nt, Human
caaaguuggugaacuacaggagauguggguauuuagacuccaaaguuuauacugagcucagugc

SEQ ID NO: 392337 - RNA, 64 nt, Human
aucccguccacaccgcuucauugaugaggacaggagacuccaagcgcuaguauugcacgcugca

SEQ ID NO: 392338 - RNA, 64 nt, Human
gagacugccuccaccacaggcauccugcaaaugcagacuccagaauccccagcaucagcgggaa

SEQ ID NO: 392339 - RNA, 64 nt, Human
uguccuggcgcccggcggcagcugcccagaaacuuccugggagaaagagcccucgggcugccuu

SEQ ID NO: 392340 - RNA, 64 nt, Human
cugugagauaacugugccugcuaccaaguguuaauccugggaucguauuuuuauaucauauuca

SEQ ID NO: 392341 - RNA, 64 nt, Human
ucagugcucagacccucucugugucugugugcccuccugggagucagucagcgcucaggccagg

SEQ ID NO: 392342 - RNA, 64 nt, Human
uggaggccagccuggaucugucucucccuuccccuccugggaccauucuaccuguguucuuuga

SEQ ID NO: 392343 - RNA, 64 nt, Human
uccuggggaggagguuagcagggacgguugccuuuccugggaagggcaguuugcagaaccaggg

SEQ ID NO: 392344 - RNA, 64 nt, Human
ccuugaccgcucucugugggccccacccacucuguccugggaaaugaagaagcaucuuccuuag

SEQ ID NO: 392345 - RNA, 64 nt, Human
acaugauggagcgcaccugcccccugguggacaguccugggagaaccucaggcuuccuuggcau

SEQ ID NO: 392346 - RNA, 64 nt, Human
guuuggcaguaaauuggcaccgugucacacuguuuccugggauucaaguaugcaaccagaacac

SEQ ID NO: 392347 - RNA, 64 nt, Human
ggcccuucucugauggggugacauaaucccuuccuccugggaaacaccagcuuuuggggugaua

SEQ ID NO: 392348 - RNA, 64 nt, Human
cuaccaaggcugugccuguauuaaggcuuuuccguccugggaacugucagucugggagagcucu

SEQ ID NO: 392349 - RNA, 64 nt, Human
ucugaacuucuuuaggagucacugcuugugugguuccugggacacuuaaccaaugccuucuggu

SEQ ID NO: 392350 - RNA, 64 nt, Human
gaaaaaaaaagggaaugggaaaaaagaaaacagauccugggagggggcgggaaauacaaggaau

SEQ ID NO: 392351 - RNA, 64 nt, Human
ccguuugagugucugcgccccgccuccccauacuuccugggaugaugugugaaaccugacaccu

SEQ ID NO: 392352 - RNA, 64 nt, Human
gcaaguuucaucagcccuagggaaaacacggcccuccugggaaccuccuuaccuggaguaaccg

SEQ ID NO: 392353 - RNA, 64 nt, Human
cagcacacuccugggcauggcggaagcaggaagcagacuccagagggccucccuguuguccagg

SEQ ID NO: 392354 - RNA, 64 nt, Human
ccugggagccaugcagaggcuguggugcugaguuagacuccagguacuuuguggucaaaggaaa

SEQ ID NO: 392355 - RNA, 64 nt, Human
uuucccacugcacuccagccugagugacagagcgagacuccaucucuuuaaaaacaaacaaaaa

SEQ ID NO: 392356 - RNA, 64 nt, Human
gcaugagccagccagcucagccaggcucccuguguccugggaggaaguguccccaucccccaug

SEQ ID NO: 392357 - RNA, 64 nt, Human
aggugggugacccaggacagagaacgcuacuggauccugggagguucagcaaggugucuagucc

SEQ ID NO: 392358 - RNA, 64 nt, Human
guucauugcacugacucugggaucucagcccugcuccugggagcuggaagagcacuuggagauc

SEQ ID NO: 392359 - RNA, 64 nt, Human
cuuuuccucuuuuccuuccuccucuuuggaauuuuccugggaccuacagaauaaagggggggau

SEQ ID NO: 392360 - RNA, 64 nt, Human
aacuugcaaauguaccagcauuuaaaauuucuuuuccugggaaucaagguaacucacacgacua

SEQ ID NO: 392361 - RNA, 64 nt, Human
uucguguucugucacccuuuggggaggggaguucuccugggacagugggcucugcauguucucc

SEQ ID NO: 392362 - RNA, 64 nt, Human
cacuggcuuuucucagcauuugcugcugggccucuccugggacuaccaguguggcucuuacgug

SEQ ID NO: 392363 - RNA, 64 nt, Human
ggggccgugccucacuuuuauuuauugcugguuuuccugggacagcuggagcugugucccuuag

SEQ ID NO: 392364 - RNA, 64 nt, Human
ugcuccuggccacccagccucugcugagaaccauuccugggauuagagcugccuuucccaggga

SEQ ID NO: 392365 - RNA, 64 nt, Human
cccaccuccacuuaccugucugcccucagcuucuuccugggagagagccccccuuucacguaga

SEQ ID NO: 392366 - RNA, 64 nt, Human
uuuugguuuguugugguuggaacugcuuugagaauccugggauuugugcugcugcuguuauuca

SEQ ID NO: 392367 - RNA, 64 nt, Human
auccacgcuccauagagucucuccuuuucagacauccugggaugaaagaauuuggcuuuuuuuu

SEQ ID NO: 392368 - RNA, 64 nt, Human
uuaaauugggcuucaaucacuguaaccugauucauccugggauguaaaccauucgaagucagcu

SEQ ID NO: 392369 - RNA, 64 nt, Human
cagguauugagggccuccccugcugguggcccuguccugggauccucagaagccugacuguccu

SEQ ID NO: 392370 - RNA, 64 nt, Human
ugugacuuuuauguugugguuggugucuuaacucuccugggaaaaggaggcuggcacacacugg

SEQ ID NO: 392371 - RNA, 64 nt, Human
agacuuagagccccucucuuccagaacuguggauuccugggagcuccucuggcaauaaaaguca

SEQ ID NO: 392372 - RNA, 64 nt, Human
ugcgccacugcacuccagccugggugacagagcaagacuccauuucaaaaaaaaaaaaaaaaag

SEQ ID NO: 392373 - RNA, 64 nt, Human
ggcgccacugcacuccagccugggggacagagcgagacuccaucucaaaaaaaaaaagaaaauu

SEQ ID NO: 392374 - RNA, 64 nt, Human
uauaauccuagaccuggaguugccaaguucugucagacuccaucucccccagguucaaugaagg

SEQ ID NO: 392375 - RNA, 64 nt, Human
uuucaccugaaaggaaaagcagcugcugccucucuccugggaccgugggguuggaaagucagcu

SEQ ID NO: 392376 - RNA, 64 nt, Human
cauuuccagaauccuugagcauggauuagauguuuccugggaggugccuugaguaccauuaugu

SEQ ID NO: 392377 - RNA, 64 nt, Human
gauacucaauaccuaguuaaacucauuucacuucuccugggagacguauuaagacuggaagucc

SEQ ID NO: 392378 - RNA, 64 nt, Human
cuccagcugcuacauuagagcauaagagaugcucuccugggaccucaguacccugccuucuuga

SEQ ID NO: 392379 - RNA, 64 nt, Human
ccuagucucguauauucugaguaaauggaaucaguccugggaauagagaguguccuuugugcca

SEQ ID NO: 392380 - RNA, 64 nt, Human
ccauucuuuuucccuguaauuuuggaauuucugguccugggaagaaucaaacaaaaucuuaagu

SEQ ID NO: 392381 - RNA, 64 nt, Human
cuggaggccucaugcuaugacuuuuuauuucucuuccugggauccaccacccucuacucucagc

SEQ ID NO: 392382 - RNA, 64 nt, Human
ccaaacucacggaccacucgaggccugcaaaccuuccugggaggacaggcaggccagauggccc

SEQ ID NO: 392383 - RNA, 64 nt, Human
agaagcugauguuuugguguauugucagccaucguccugggacucggagacuauggccucgccu

SEQ ID NO: 392384 - RNA, 64 nt, Human
augagguccacuaaaaaggggaggaaggcagaccuccugggagacccacgaaggguuuuuagcc

SEQ ID NO: 392385 - RNA, 64 nt, Human
uuggcucucccucacucucugaggcuccagcugguccugggacaugcagccaggacugugaguc

SEQ ID NO: 392386 - RNA, 64 nt, Human
auaaacucuaucugcugaaagggccugcaggccauccugggaguaaagggcugccuucccaucu

SEQ ID NO: 392387 - RNA, 64 nt, Human
uucauugaacagcaccuugcaaguucaaaugaguuccugggagcggaggcuggaaggccacaag

SEQ ID NO: 392388 - RNA, 64 nt, Human
gccucccagcccccaaccccaagaccaagcuuaguccugggagaggacagggacuucgcagagg

SEQ ID NO: 392389 - RNA, 64 nt, Human
gaccucccaaccccuugugucugguggggaucccuccugggaugaggaagacccccucgggcuc

SEQ ID NO: 392390 - RNA, 64 nt, Human
gaugcgugugacccagaggcgagacgcagcuuuguccugggagacguucauauuggaaucuauu

SEQ ID NO: 392391 - RNA, 64 nt, Human
ggcacuguugcagcuuccucugcccuggcuggaaagacuccagaauccaguguggugcugugga

SEQ ID NO: 392392 - RNA, 64 nt, Human
ugugccacugcaccccagccugggugacagagcaagacuccaucacaaaaaaaaaaaaaaaaaa

SEQ ID NO: 392393 - RNA, 64 nt, Human
accguaaagcucuauacaagggacacuauaaauaagacuccauguuuuaauuuaugauguuuuu

SEQ ID NO: 392394 - RNA, 64 nt, Human
gaccuucccagggaaggugccuuggggugcagaauccugggaauguuaggaaagggcugcguga

SEQ ID NO: 392395 - RNA, 64 nt, Human
gacccaggaggcgcucugcccgcaggugacaugguccugggaccaguugcccagcagagcucuu

SEQ ID NO: 392396 - RNA, 64 nt, Human
gaaccagauuuuuaaaaggccgcaaaaaaucuuuuccugggagucuacaaauuuggaaaugaaa

SEQ ID NO: 392397 - RNA, 64 nt, Human
gcuaggguggugcuggcauccugaguccuggcccuccugggaucuggggcccucgggcccugcc

SEQ ID NO: 392398 - RNA, 64 nt, Human
ggauugucuggguugaaugacacucucaaauuguuccugggaucgggcugaggccaggccucuc

SEQ ID NO: 392399 - RNA, 64 nt, Human
uucagacagaagcugggccagcacuguggacuccuccugggacagggcuggguccucuggcuau

SEQ ID NO: 392400 - RNA, 64 nt, Human
ggguccagccaagcugugccccaucccccaagccuccugggaggauccagccaaaucuugcgac

SEQ ID NO: 392401 - RNA, 64 nt, Human
ccagcuaugcccagugcugcaugggacccaugucuccugggacagaggccaucucucuuccaga

SEQ ID NO: 392402 - RNA, 64 nt, Human
ccgcaucuaguccaggcagaaggagaccacaaccuccugggaccacugccaccugcaagagccc

SEQ ID NO: 392403 - RNA, 64 nt, Human
guucuaaacccaguggauuaaaaagucauuuggguccugggaagcacugggaaagaagggagag

SEQ ID NO: 392404 - RNA, 64 nt, Human
acaacuccuccuccuccuccuccucuccugcugcuccugggauaccaggucagugauguagucu

SEQ ID NO: 392405 - RNA, 64 nt, Human
gagauaguaacugagcaggggcuacaaagaggucuccugggaacccugucugccccuucccacc

SEQ ID NO: 392406 - RNA, 64 nt, Human
aggcuugguuccauuucucaccugaacagaugaguccugggagagacccucagagauccgccca

SEQ ID NO: 392407 - RNA, 64 nt, Human
ugccucuggcagcugugcuaacagcucagugcuguccugggaguccucugacucagaacccucg

SEQ ID NO: 392408 - RNA, 64 nt, Human
gggggccugggguucugguuaggaauucucuugauccugggauuaugcuuuauaggaugugguc

SEQ ID NO: 392409 - RNA, 64 nt, Human
uuugacaaauagaguccagcugccucugagccaauccugggaccauaauaggcucagagugagu

SEQ ID NO: 392410 - RNA, 64 nt, Human
augugcacuccuuccaggaguggguacugauuccagacuccagaugccuauuauuaguuaggcu

SEQ ID NO: 392411 - RNA, 64 nt, Human
gcugcuaauuuuagucccaggaccagacauccccagacuccacagauguaaugaaguccccgaa

SEQ ID NO: 392412 - RNA, 64 nt, Human
cgaagcaccuuccuuuccccaucucugucuguguagacuccacuuacaucuugugguuauucug

SEQ ID NO: 392413 - RNA, 64 nt, Human
cuggguuuauagucuuugggccccuuacucaguauccugggaacccugggccaggagguuacag

SEQ ID NO: 392414 - RNA, 64 nt, Human
accaaggauaucagccuguuuuuucccuuuuuucuccugggaauaauugugggcuucuucccaa

SEQ ID NO: 392415 - RNA, 64 nt, Human
ucuguuggaaaacccaggacuccacacacaaaacuccugggauuuuguuucccaucucuuucua

SEQ ID NO: 392416 - RNA, 64 nt, Human
cagcuucucucagagucucccccucugcagcccauccugggaguguauuaacuggagggaagau

SEQ ID NO: 392417 - RNA, 64 nt, Human
ccugacugaugcaguuuccauagcaacccauguuuccugggaaacccgaaaaagguugucaugg

SEQ ID NO: 392418 - RNA, 64 nt, Human
cuaguacacgcccuauuuaaaaaagagcaguacauccugggaggaaaugaaacuaaagaacagu

SEQ ID NO: 392419 - RNA, 64 nt, Human
cauugcuccaggcacagggacugaaccccaggccuccugggacuggagcagcagugaggcaaaa

SEQ ID NO: 392420 - RNA, 64 nt, Human
uguuuauuuaaguucugcagauccauggaaagcuuccugggaaacguaugcuagcagagcuucu

SEQ ID NO: 392421 - RNA, 64 nt, Human
uggcuuuccauccccauggggcagaaacaguggcuccugggagcagaaaaggaauugagguggg

SEQ ID NO: 392422 - RNA, 64 nt, Human
auuccacuccacucagguucuucagggccaguccuccugggagccaagaggaagucucucggaa

SEQ ID NO: 392423 - RNA, 64 nt, Human
cccaguuccacaagauccaaccaagaauucuguauccugggacagucagauucuucuaaaucag

SEQ ID NO: 392424 - RNA, 64 nt, Human
ccacccccagcaaccccaucccagaauccuauuuuccugggaaguccuuaaagccccuaaccau

SEQ ID NO: 392425 - RNA, 64 nt, Human
augcucaacuuguacaauguuuauuagacacaucuccugggacauacugccuaaccuuuuggag

SEQ ID NO: 392426 - RNA, 64 nt, Human
aaacuguucucccuagcaggccauuuucccuuuuuccugggaguuuagcaaguuuaggagagaa

SEQ ID NO: 392427 - RNA, 64 nt, Human
ucacuucccguagcugccaguauguuccaaacccuccugggaaggccaccucccacuccugcug

SEQ ID NO: 392428 - RNA, 64 nt, Human
cuccugccagucaugguuuccccagaaguguaguuccugggacauucauggauaugagcuauuc

SEQ ID NO: 392429 - RNA, 64 nt, Human
guaaaauaaccaaccacuuacuuagcguuuggauagacuccaugccuucucucucccugcaaag

SEQ ID NO: 392430 - RNA, 64 nt, Human
acuuaguauugguggaaaccauuugugaauuuacagacuccaaaaacaaaaagauaauuuagag

SEQ ID NO: 392431 - RNA, 64 nt, Human
ugcaagucacuuccuauuccugcauuuguaucuaagacuccaaggcaccaaggucucuucucca

SEQ ID NO: 392432 - RNA, 64 nt, Human
uggguacccaggaaacugcaagcauugccuguguuccugggaagaguucuaagaagcuugcauu

SEQ ID NO: 392433 - RNA, 64 nt, Human
aaaagaaugagugggagaaauggaggggacaaucuccugggagcuaugcgcaguaaccuaacuu

SEQ ID NO: 392434 - RNA, 64 nt, Human
acuggaugguggcaccccuaaugugcaugaggcauccugggaauggucuggaguaacgcuucgu

SEQ ID NO: 392435 - RNA, 64 nt, Human
uguccauugagagcugagaggaggagccucgcauuccugggaagagggaccuguccaagcuguc

SEQ ID NO: 392436 - RNA, 64 nt, Human
auuguauacagggggcaccuguggccaggccuccuccugggagcuccaggaccagccagcugug

SEQ ID NO: 392437 - RNA, 64 nt, Human
acaucccuuuaaaaauaacaacagaaaauacaacuccugggaaaaaaggugcugauucuauaag

SEQ ID NO: 392438 - RNA, 64 nt, Human
auugaucuaugcagcauuuaccagaaaagaguauuccugggauagcagaaugcauaacacugag

SEQ ID NO: 392439 - RNA, 64 nt, Human
uuccuaguucccuucuaaaacuuagaaggacccguccugggaaagaacgucauaaaauacgaaa

SEQ ID NO: 392440 - RNA, 64 nt, Human
cagguuguguuuuuauccuguggcuuguguaguguccugggauucucugcccccucugaguaga

SEQ ID NO: 392441 - RNA, 64 nt, Human
cccuccuaguacacaugggcccccgaggccgugguccugggagccaggaagacuccgcaguggg

SEQ ID NO: 392442 - RNA, 64 nt, Human
cuuuuaucuuugugaauaauuuacuguccuuuccuccugggauaugagaaacauuuuaaaaaac

SEQ ID NO: 392443 - RNA, 64 nt, Human
ucugggcauccugagccccuucccugaggcugucuccugggaaugcuggaccagggggauuacu

SEQ ID NO: 392444 - RNA, 64 nt, Human
agaauagugguucucgaagaaugcggccugcagauccugggagucccaagacccuuucagggag

SEQ ID NO: 392445 - RNA, 64 nt, Human
gugcaauuuuucccuuccuauuucaaccucugguuccugggaugagccauacccuggaacuggc

SEQ ID NO: 392446 - RNA, 64 nt, Human
ggaaauucugagaugggagugagaucugaucggauccugggaagauguauacccaguuagaacg

SEQ ID NO: 392447 - RNA, 64 nt, Human
guuucuuuguaugagagaggucaaaggguugguuuccugggagaaauuaguuuugcauuaaagu

SEQ ID NO: 392448 - RNA, 64 nt, Human
gggaagagccggucaccggagagugagcaggcggagacuccaagcugggcugagccagagcaga

SEQ ID NO: 392449 - RNA, 64 nt, Human
uaaaaacacucuuaucagccugggcaacacagugagacuccaucucuuaaaaaaaaaauuagcu

SEQ ID NO: 392450 - RNA, 64 nt, Human
uucagucuuacgaauacuuuugcccuuugauuaaagacuccaguuaaaaaaaauuuuaaugaag

SEQ ID NO: 392451 - RNA, 64 nt, Human
aacugugugcaaauaggagguuugagguccaaauuccugggacucaaauguaugcaguacuauu

SEQ ID NO: 392452 - RNA, 64 nt, Human
cuguagcuggaauacgcaucucuccagcauuccguccugggauccguuucagcuagaauauguu

SEQ ID NO: 392453 - RNA, 64 nt, Human
cuccuccaauuuuguaagaaugcuagcuagguauuccugggauuauuauacugagauauauaua

SEQ ID NO: 392454 - RNA, 64 nt, Human
cggcccggguccugccgggcugaccaucuccggauccugggacacucugccugaccaucugugu

SEQ ID NO: 392455 - RNA, 64 nt, Human
uaccaacugggaggguccccuccuccuucccuacuccugggacggcagcaaggacaugggggcu

SEQ ID NO: 392456 - RNA, 64 nt, Human
cugugacugaaaggacccaggagucugggaccccuccugggauccccagcacauucuccugcuc

SEQ ID NO: 392457 - RNA, 64 nt, Human
gaccccuccugggauccccagcacauucuccugcuccugggagaggccugggggcggugcucac

SEQ ID NO: 392458 - RNA, 64 nt, Human
gccaauuucagcacccaacugagauccgaggagcuccugggaagcccugggugcaggacacugg

SEQ ID NO: 392459 - RNA, 64 nt, Human
ggaagacuccccugccuccccagggccucugcucuccugggagacaaagcaauaauaaaaggaa

SEQ ID NO: 392460 - RNA, 64 nt, Human
cagagugcacucugccccgcugcucugcugccuguccugggaaaguaucuuugccccacuagga

SEQ ID NO: 392461 - RNA, 64 nt, Human
acaaccaucacgucaggcugcccauccaauagacuccugggauggggcagccaacccuggcuca

SEQ ID NO: 392462 - RNA, 60 nt, Human
ccuuuccagguuuccuuuagcuucccugcuuccugggaaucaggagccuggacacugcca

SEQ ID NO: 392463 - RNA, 64 nt, Human
ucaguggaguagugggucccuggucuccuacaaauccugggacauuggauccccaagcugugcc

SEQ ID NO: 392464 - RNA, 64 nt, Human
cucuugaaucucugaauuugagauacaaacauguuccugggaucacugaugacuuuuuauacuu

SEQ ID NO: 392465 - RNA, 64 nt, Human
ucuagauggggguucugaaauuugcagugucugcuccugggaggcagcaccagaaagggcacug

SEQ ID NO: 392466 - RNA, 64 nt, Human
uccacagccaggaccgcugagaacugggacaguuuccugggaugagugccagccugagccugca

SEQ ID NO: 392467 - RNA, 64 nt, Human
guuuaggcccuaggguugagcaauuuuaagguugagacuccaagucuccuaaaauucuaggaga

SEQ ID NO: 392468 - RNA, 64 nt, Human
cguaccacugcacuccagucugggcgacagagugagacuccaucucaaaacaaacaaaaaaagg

SEQ ID NO: 392469 - RNA, 64 nt, Human
acauguacuaacggcggcacccaggccucccugcagacuccaauggggccagcacuggaggggc

SEQ ID NO: 392470 - RNA, 64 nt, Human
uucacucugcugaauaggaggaagcuuuucuuuuuccugggaaaacaacugucucuuggaauua

SEQ ID NO: 392471 - RNA, 64 nt, Human
ugcuaaaggccucugcuucuuacuggaucuucuuuccugggacauggugucguugggaagcuua

SEQ ID NO: 392472 - RNA, 64 nt, Human
agacucagaaauucgucuuugucuugccucugguuccugggauccagugaucucuacuggccca

SEQ ID NO: 392473 - RNA, 64 nt, Human
aacauuuucagucccugaucucuccugucccuuuuccugggaugacagcccuaacaagaacugu

SEQ ID NO: 392474 - RNA, 64 nt, Human
aaugggaguucuggcugagcccaggguggggagauccugggaagggaggcacuggaggaagacg

SEQ ID NO: 392475 - RNA, 64 nt, Human
acuggcuuuugggguacaagggugacuagaaccuuccugggacucuggcuauaguacuuugaaa

SEQ ID NO: 392476 - RNA, 64 nt, Human
gguuucugggcuaccuauggcuucagccuucagcuccugggagucccagcuguuguucccagca

SEQ ID NO: 392477 - RNA, 64 nt, Human
accucagcacguggaggccucucacgguccuccuuccugggaccugagcagguuuggugaaagc

SEQ ID NO: 392478 - RNA, 64 nt, Human
uggggaccccugccagccacuggucccaccgcuuuccugggagaacgucacuguggacguaagu

SEQ ID NO: 392479 - RNA, 64 nt, Human
ccuccaggguccaaagauugaggagcuuucucuuuccugggaggaacugucucagauuuagcuu

SEQ ID NO: 392480 - RNA, 64 nt, Human
gaaaguucuguccaguaaacgcaggauggaauuuuccugggacucuacacccaucuuaaggugg

SEQ ID NO: 392481 - RNA, 64 nt, Human
cucuggucccagcauccagcugccucguugucuauccugggaggguguggugcuucggacacgu

SEQ ID NO: 392482 - RNA, 64 nt, Human
guuuccaaugaugggauaucugaggccauuacauuccugggaauaacauggugaggugcagggu

SEQ ID NO: 392483 - RNA, 64 nt, Human
gagacacugguggggagcuggcaaugaaacccuguccugggacauggguuucauguucuuguac

SEQ ID NO: 392484 - RNA, 64 nt, Human
cacgggagcucuaggugggcacaaccaaccccucuccugggaggccccugccccacuggggaua

SEQ ID NO: 392485 - RNA, 64 nt, Human
uuccuacucaccccuaccccccaaacuacccucuuccugggaaaguaauugcugagccaguaca

SEQ ID NO: 392486 - RNA, 64 nt, Human
acuuuccuuuacacauguggcuugucuugccaauagacuccaggcuuauaccuuccauuuccau

SEQ ID NO: 392487 - RNA, 64 nt, Human
augguaacuuugcaaauggugguuguuucuuccaagacuccagcccugauugcgcaaaacugaa

SEQ ID NO: 392488 - RNA, 64 nt, Human
acaggcauguaucaaaacaccuguggaguacuuuagacuccaacaaauaauaauguaacuaaaa

SEQ ID NO: 392489 - RNA, 64 nt, Human
ucuacauuacccuuguuuuucucuuuggauacuguccugggacuaaguguagauuucugcuuca

SEQ ID NO: 392490 - RNA, 64 nt, Human
auuagagucauagccuuaauagcccuaguugucauccugggagacaggcaacaguagagauauu

SEQ ID NO: 392491 - RNA, 56 nt, Human
cuuucuccacuuacguuuagcgcgcauccugggacuugucccugcagcucaccggg

SEQ ID NO: 392492 - RNA, 64 nt, Human
cagaguccccuggggcuagagguggaggaggcaguccugggaaugggaaaaaccccaacuuugg

SEQ ID NO: 392493 - RNA, 51 nt, Human
auguggcugaccuuauuuaauuccugggaugagaguuuuggaugcagugcu

SEQ ID NO: 392494 - RNA, 64 nt, Human
uucuacacuuacuuuuuuucuccuguguuugcauuccugggauuuauccucaagugcauuucug

SEQ ID NO: 392495 - RNA, 64 nt, Human
accacccacagcugaccggcucgguggaggacacuccugggacaggucucuuugucagugaaca

SEQ ID NO: 392496 - RNA, 64 nt, Human
cuaucugcaugcgcucucaggugcuaccgagccauccugggagagauggaugguccacugcuuu

SEQ ID NO: 392497 - RNA, 64 nt, Human
cuguggcuuuggucccccagaggcauagauccuauccugggagaguuuagauccagaacaucuu

SEQ ID NO: 392498 - RNA, 64 nt, Human
cugugaauccucaggcugugacgcccucagguacuccugggaaaaggagguacacagccaucau

SEQ ID NO: 392499 - RNA, 64 nt, Human
caaagguuuaaacacccaggagaccaucagccucuccugggagcacaguuggcuacaggccucu

SEQ ID NO: 392500 - RNA, 64 nt, Human
auggccauccaguccugaguggucacccuggggguccugggacacaccucaguaaagagcaaag

SEQ ID NO: 392501 - RNA, 64 nt, Human
cuccauguacacacacacaacucagggaaggagguccugggacuccaaguucagcgcuccaggu

SEQ ID NO: 392502 - RNA, 64 nt, Human
cccaccaccccaugcauacucuugggaagcagcuuccugggagauuagaaauucuacuucccug

SEQ ID NO: 392503 - RNA, 64 nt, Human
uaccuuccacucacuaauaauaugaacuuauauuuccugggaguagccagguuaaauuuucuau

SEQ ID NO: 392504 - RNA, 64 nt, Human
acaaugugcagucuuugauuauuuugugguccuuuccugggauuuuuaaaagguccuuugucaa

SEQ ID NO: 392505 - RNA, 64 nt, Human
caugccacugcacuccagccugggcgacagagcgagacuccaccucaaaaaauaaaaucaagau

SEQ ID NO: 392506 - RNA, 64 nt, Human
uagaauucuuucuguauucagauggugcuaauucagacuccagacugaauuuuaauucaaguuc

SEQ ID NO: 392507 - RNA, 64 nt, Human
ggcaccacugcacuccagcuugggugacagagugagacuccaucucaacaaaaaaaaaaucuaa

SEQ ID NO: 392508 - RNA, 64 nt, Human
ggaggagucuaauacaaaaacugaaaaccuuugguccugggaauuuauuuucauggcuguuguc

SEQ ID NO: 392509 - RNA, 64 nt, Human
uccaucaugaagacuugcuuccccaccaaagauguccugggauucugcuggaucucaaagaugu

SEQ ID NO: 392510 - RNA, 64 nt, Human
uuguacaucaaacaaccuugugauuauaaaacgauccugggaaggagccccuaacuagggcaag

SEQ ID NO: 392511 - RNA, 64 nt, Human
gugaggagccgugcuucccgaguguccacugcguuccugggaagggcugcgaggccugcccucc

SEQ ID NO: 392512 - RNA, 64 nt, Human
uggcucauggcguuugcccuacacggaugggcuguccugggagcuacuggacagucaccuuggu

SEQ ID NO: 392513 - RNA, 64 nt, Human
ucagacgaggacacucgcuugccgggccugggccuccugggaaggagggagcugcucagaaugc

SEQ ID NO: 392514 - RNA, 64 nt, Human
ucuccaacucucuaucagcuuucaggguuuucucuccugggaaggguguaaaaucagcuuguca

SEQ ID NO: 392515 - RNA, 64 nt, Human
aucauuuaaaguaauguugccaagagaaaaaauuuccugggagggagguuucccacaagccaaa

SEQ ID NO: 392516 - RNA, 64 nt, Human
auuugugaugccccuucccagaccagguuaggauuccugggaaggccgcggauuccggcccugg

SEQ ID NO: 392517 - RNA, 64 nt, Human
uuacggaagugaugggugccuguccucuccugccuccugggauucagacggugaagacugacuu

SEQ ID NO: 392518 - RNA, 64 nt, Human
ugaguuguugcuggaagaucuaauaagcuguguuuccugggaaguggugcuuuacuuagcccug

SEQ ID NO: 392519 - RNA, 64 nt, Human
ugugagaacugaaaggucucuuucauuuuucucuuccugggauucauuuuuucaaaacacaaug

SEQ ID NO: 392520 - RNA, 64 nt, Human
aaaccaaagggggugaauacuuccccaagauucuuccugggaggauggaaacagugcagcccag

SEQ ID NO: 392521 - RNA, 64 nt, Human
ggaggucacugguucaggcucccuuugggcgaaauccugggagugaugcucuaaaaauccaccu

SEQ ID NO: 392522 - RNA, 64 nt, Human
gcaggcugaguuuggagcaggguccauccggcaguccugggacggcuucccucugcuggugccc

SEQ ID NO: 392523 - RNA, 64 nt, Human
aaauucuaggauguagaaaucuggaaaguucauuuccugggauucacuucuccagggauuuuuu

SEQ ID NO: 392524 - RNA, 64 nt, Human
cacgucacugcacuccagcuugggcaacagagcaagacuccaucucaaaaaaaaaaaaagaaaa

SEQ ID NO: 392525 - RNA, 64 nt, Human
acaggaaagucguacuguucacacacacaguuugagacuccaagccaagagugccacaucccua

SEQ ID NO: 392526 - RNA, 64 nt, Human
cgccuuccucccaccugccagcccaggguaccccagacuccaguuucauccugaaccucucccg

SEQ ID NO: 392527 - RNA, 64 nt, Human
ugccuaacccugaguuuuuggagcaccacaguuguccugggaguugguugcaucuuguaggcca

SEQ ID NO: 392528 - RNA, 64 nt, Human
agaaagucgcagcaggaaagggaguucccuggucuccugggaaguguggcuucuucuccuaaug

SEQ ID NO: 392529 - RNA, 64 nt, Human
cagugagacuggggccacuacauuugcuccauccuccugggauuggcugugaacugaucauguu

SEQ ID NO: 392530 - RNA, 64 nt, Human
cacuuugggaggccaaggugggagcaucacuugauccugggaguucgagaccagccugggcaac

SEQ ID NO: 392531 - RNA, 64 nt, Human
auauguauauaccauguauaugacaggauguuuguccugggacacccaccagauuguacauacu

SEQ ID NO: 392532 - RNA, 64 nt, Human
ucuaaucagcguuauccggguucugaugucagaauccugggaaccugaacacuaaguuuuaggc

SEQ ID NO: 392533 - RNA, 64 nt, Human
cguagaaacccaugaaaaggaggccacaggagauuccugggagcacuggguguagcaaaacaaa

SEQ ID NO: 392534 - RNA, 64 nt, Human
uggcauuugucauugcugagcccauaucaguagguccugggacuugacaaaguaugugggaggg

SEQ ID NO: 392535 - RNA, 64 nt, Human
uaagccaagcuccaguuacaagacaacacuguacuccugggauaugggggcgggggcggggcag

SEQ ID NO: 392536 - RNA, 64 nt, Human
caacccaccggagagggggcuucugaacuuggacuccugggaacauggacaagcccggcgcugc

SEQ ID NO: 392537 - RNA, 64 nt, Human
uacucaggaggcugaggcaggagaauuugcuugauccugggaggcagagguuguagugagccga

SEQ ID NO: 392538 - RNA, 64 nt, Human
ucuauguuauuagauugaguggccugcauucucuuccugggaggaaaucuuucaaaaauugaag

SEQ ID NO: 392539 - RNA, 64 nt, Human
cugaaggagagagaaaagaugugugucugauugguccugggauuuuuugagcugugccauuuau

SEQ ID NO: 392540 - RNA, 64 nt, Human
uggguuuuucuugugguguaaagcuggcccugccuccugggaagaugagguucugagaccagug

SEQ ID NO: 392541 - RNA, 64 nt, Human
guauaaaggggcaagagcagcuccuuuggacuauuccugggaggacucugaugcagggcgucug

SEQ ID NO: 392542 - RNA, 64 nt, Human
gaagcagggagcaaaucccaccuuuaccccaccuuccugggaaaggccuccaaagcaaaggauc

SEQ ID NO: 392543 - RNA, 64 nt, Human
cacgccacugcacuccagccugggcgauggagcgagacuccaacucaaaaaaaaaaaaagaaua

SEQ ID NO: 392544 - RNA, 64 nt, Human
cguguauuagggcaggcuaggccacaggauacguagacuccaaaauguacacaggcucaaauac

SEQ ID NO: 392545 - RNA, 64 nt, Human
ccugguaagaauauucagcuggucuggguccucaagacuccaauagacacucuuagagaaggau

SEQ ID NO: 392546 - RNA, 64 nt, Human
acuggggaugugcuggcuggacggcaccacccuuuccugggaagagaugacucaagccagugga

SEQ ID NO: 392547 - RNA, 64 nt, Human
uacccuaaacuuccauccugggggucagcugggcuccugggagauuccagaucacacaucacac

SEQ ID NO: 392548 - RNA, 64 nt, Human
ggaggcuuaauuacugggagucugucuaaugaaguccugggacuauuguaauggaauaugauuu

SEQ ID NO: 392549 - RNA, 64 nt, Human
uauuauuaaauuuucaugagaauucuaaaaugaauccugggaaaugcacguuuggugauguugc

SEQ ID NO: 392550 - RNA, 64 nt, Human
gccuguuucccagccaggcccagccacccaggacuccugggacaucccaugugugaccccucug

SEQ ID NO: 392551 - RNA, 64 nt, Human
ucugcagugagcagaaucaaaugggcaauauuuguccugggagaccugugccgcacccaggucc

SEQ ID NO: 392552 - RNA, 64 nt, Human
augccaacucuggaaucaaauuuccuuguuugaauccugggacccuauugcauuaaaguacaaa

SEQ ID NO: 392553 - RNA, 64 nt, Human
aggauggcuaagucccaccauaagagcuaaaggguccugggagaugauggcucauuuccaccca

SEQ ID NO: 392554 - RNA, 64 nt, Human
ucccucugagauuuugggcacauucaaaucuauauccugggacccuguaaagguccaugacauc

SEQ ID NO: 392555 - RNA, 64 nt, Human
ugucuuccuuuuguucucacugccaaacugccuguccugggaucuaguuaucuuggcccugcac

SEQ ID NO: 392556 - RNA, 64 nt, Human
cagcacccccuucuccccugugccguaguuugucuccugggacugggggaggaguccgaggugg

SEQ ID NO: 392557 - RNA, 64 nt, Human
aggguggggggaugggggccagcagcugucauccuccugggaagccgagcagugucccuggugg

SEQ ID NO: 392558 - RNA, 64 nt, Human
cccaaacccaucagacagguaaaugggcagugccuccugggaccauggacacauuuucuccuag

SEQ ID NO: 392559 - RNA, 64 nt, Human
ccauuuggugcuugguuuagagccuugggcuggguccugggauggggggcuguguguggcugga

SEQ ID NO: 392560 - RNA, 64 nt, Human
cucccauuucuguugcuggaggggcuguccuccuuccugggacccccucgccagcuuggcucga

SEQ ID NO: 392561 - RNA, 64 nt, Human
uccccccccuccguuuuuuccaccccacaguuccuccugggaucuggcccuccagggaagugga

SEQ ID NO: 392562 - RNA, 64 nt, Human
uuugucagauucacacaugccacuaugagcuuucagacuccagcugugaagagacucuguuugc

SEQ ID NO: 392563 - RNA, 64 nt, Human
ugcaccacugcacucccuccugggcaacagaacaagacuccaucucaaaaaaaaaaaaguacau

SEQ ID NO: 392564 - RNA, 58 nt, Human
ugcaacccaagcaggacugacgcccgacagacuccacccuaacagucucaagccccuu

SEQ ID NO: 392565 - RNA, 60 nt, Human
uuuucuuacauuacagauaaguugcugaauuccugggacucuuaacugauauugcauacu

SEQ ID NO: 392566 - RNA, 64 nt, Human
guaauugccaauguuggacaguugauguguucauuccugggauccuaucauuugaacagcauug

SEQ ID NO: 392567 - RNA, 64 nt, Human
uuacuguuccauuuugcaacauccugcaacaccauccugggagacaagagcauuacccagcuug

SEQ ID NO: 392568 - RNA, 64 nt, Human
uucaccuuaaaaaaaaugcugaaaauacacauucuccugggaagacgauaaacagcuagcuaag

SEQ ID NO: 392569 - RNA, 64 nt, Human
acagggugaaacucucccagagacgaagaaagaguccugggauuuguacuucaugaagacuuuu

SEQ ID NO: 392570 - RNA, 64 nt, Human
uccuagccuggaagcauucaggagagccugccauuccugggaugaucccugcuggguauuugca

SEQ ID NO: 392571 - RNA, 64 nt, Human
guggagcggugguagauccugauagacauggggcuccugggaguagagagacacacuaacagcc

SEQ ID NO: 392572 - RNA, 64 nt, Human
aaacuacaaugcucugucaucucccuacugggucuccugggaggaggggagccauccagggugc

SEQ ID NO: 392573 - RNA, 64 nt, Human
ccauaaucccugucuucuuuccauccccuagaaauccugggaggcaggauccaauaauuuuccu

SEQ ID NO: 392574 - RNA, 64 nt, Human
uugggccucugaccugggcccuuugacuuccccuuccugggaucugcucagaugcagauccuga

SEQ ID NO: 392575 - RNA, 55 nt, Human
uggcaaaggcccucaaauaagccccuccugggacucccucaacccccuccauuuu

SEQ ID NO: 392576 - RNA, 64 nt, Human
ccuauguaaaacuuagcaacuugggggaccucauuccugggacuaugcuguaaccaaauuauug

SEQ ID NO: 392577 - RNA, 64 nt, Human
cucaggucaggaggagugagcagccggcacagccuccugggaggaucccgaaguagggacuggg

SEQ ID NO: 392578 - RNA, 64 nt, Human
accugcaagugcugccaaugggaacucaauuuauuccugggaaccuaacgaggagagcccaggc

SEQ ID NO: 392579 - RNA, 64 nt, Human
acagagcggguggcuguggcuucagccgugguccuccugggaccgguagccuucaagcuugucc

SEQ ID NO: 392580 - RNA, 64 nt, Human
ccccaauuccccaccagccaauccaagcauuuucuccugggacccgcuccauguucagggucua

SEQ ID NO: 392581 - RNA, 64 nt, Human
auccucuucccuuauucuaaagcugccccuugggagacuccagggagaaggcauugcuuccucc

SEQ ID NO: 392582 - RNA, 64 nt, Human
ucuacguuaccaggcaggaaggcugagaggagagagacuccagcuggguuggaaaacaguauuu

SEQ ID NO: 392583 - RNA, 64 nt, Human
gucugguuugcagagcuugaacacagucucacccagacuccaggcugucuuucacugaaugcuu

SEQ ID NO: 392584 - RNA, 64 nt, Human
gcccugcccugacuggggcugcuccucccuccuguccugggaccgcgcagagcccacgcucuca

SEQ ID NO: 392585 - RNA, 64 nt, Human
gcagcacuugaagagagguuuaccuaaacuuuccuccugggagccugucaucauuugaaaguaa

SEQ ID NO: 392586 - RNA, 64 nt, Human
ggacauacaccaccagguccuuuauguguuguucuccugggagacuucuuuuuuuaaaugccag

SEQ ID NO: 392587 - RNA, 64 nt, Human
ccuuaaggagcuugugaucugugacaguaagcccuccugggaugucugugccaugugauugacu

SEQ ID NO: 392588 - RNA, 64 nt, Human
guguccucagcgugcgagcccugcaccccccagguccugggacuccugcagaccccacuccauu

SEQ ID NO: 392589 - RNA, 64 nt, Human
uguucacgucaauauacaaccauuuggcacagcuuccugggaggaauaauaagaaaaacaugcu

SEQ ID NO: 392590 - RNA, 64 nt, Human
cgccugacauuuuccuggccagugacaucacccuuccugggaugauccccuuuucccuuucccu

SEQ ID NO: 392591 - RNA, 64 nt, Human
ucuccaucaucagcaacuccaaaccccagccacuuccugggaguucaggaacuguguuuagcca

SEQ ID NO: 392592 - RNA, 64 nt, Human
acuucgcagguuccugccugucacgccacccccuuccugggagcagcgagcagugccccaggcc

SEQ ID NO: 392593 - RNA, 64 nt, Human
uauacaaguggcaagaagaggacaguggaccagcuccugggaccuuccaaaacauuggcuuuga

SEQ ID NO: 392594 - RNA, 64 nt, Human
cugugucuuaucugccaggaaagaccagccucacuccugggaacugucuggcagguaggcuggg

SEQ ID NO: 392595 - RNA, 64 nt, Human
accaguagcucucaaauuuuaguauaaaaacaauuccugggagcguuuuuuaaaaaucaguugu

SEQ ID NO: 392596 - RNA, 64 nt, Human
aauuagaagauuauauauauuuuuuucugaaauuuccugggagcuuuuguagaagucacauucc

SEQ ID NO: 392597 - RNA, 64 nt, Human
aaaccagaagcgacaggaggccagcuccugggguuccugggagccgggaacagauuggcuacgg

SEQ ID NO: 392598 - RNA, 64 nt, Human
aacagggguccuggggaagguguccagggcaggguccugggaagggugucccgaccgcuuccuc

SEQ ID NO: 392599 - RNA, 64 nt, Human
uaagcuagaaacguagccugagcuccugaagaguuccugggagauuugagcugauuuuggagau

SEQ ID NO: 392600 - RNA, 64 nt, Human
cgugccacugcacucuagccugggcgacagagcgagacuccaucucaaaaaaaaaaaaaaaaaa

SEQ ID NO: 392601 - RNA, 64 nt, Human
augaaugccagcuuuccuugugcuuugauaacaaagacuccaaauauucuggagaaccuggaua

SEQ ID NO: 392602 - RNA, 64 nt, Human
uugcaccagugcacuccagcugggcgacagagcgagacuccaucucggaaaaaaaaaaaaaaaa

SEQ ID NO: 392603 - RNA, 64 nt, Human
gugguauccccaaggccucgugccguggcugggguccugggagguggucgcccugcagugcaag

SEQ ID NO: 392604 - RNA, 64 nt, Human
gaacaucugcacuccugaacacacccugaagaaauccugggaauugaccuuguaaucgauuugu

SEQ ID NO: 392605 - RNA, 64 nt, Human
gacuguugcuauccaagcguuugguguuaccuucuccugggagguccugcugcaacucaaguuc

SEQ ID NO: 392606 - RNA, 64 nt, Human
acagugguggcugacaccccuuguaagaaagcauuccugggaagucuucuguggguccaaacau

SEQ ID NO: 392607 - RNA, 64 nt, Human
gcaaacacagcaucgugaucacugagccaucauuuccugggagaaagaccaugcauuuaaagua

SEQ ID NO: 392608 - RNA, 64 nt, Human
gucuuuuuguggguacugcaguaaagaacaucccuccugggaaugaagcaaugcuucaucccuu

SEQ ID NO: 392609 - RNA, 64 nt, Human
cgugggcgggaugcuguucagcugcagacuuucuuccugggacgaggagacguccucucuguua

SEQ ID NO: 392610 - RNA, 64 nt, Human
cccccucugggagggaaccaacccccacccucccuccugggaccccccagcaguagacggcuug

SEQ ID NO: 392611 - RNA, 64 nt, Human
ugccauugugccuuuuuagggggccuggcccccguccugggaguugggggaugggucucucugu

SEQ ID NO: 392612 - RNA, 64 nt, Human
aguccccacucuuggggacuuagaaccccugcuguccugggaucuggccugccuuucuuugguc

SEQ ID NO: 392613 - RNA, 64 nt, Human
gagacggggguuuggccauguugccgaggcuaacuccugggauuacaggcaugagcugugcugg

SEQ ID NO: 392614 - RNA, 64 nt, Human
guucuuaguacuuugaauuggucuacagguauauuccugggaugaaaggauugccaaacccaaa

SEQ ID NO: 392615 - RNA, 64 nt, Human
gcccgagggaggagggagagaaggagggaggcgcuccugggaccgugggcgcuggccuuuuaua

SEQ ID NO: 392616 - RNA, 64 nt, Human
uguggugccaucgagucccugcugguuccccuuguccugggagggucacccauugcccaaggaa

SEQ ID NO: 392617 - RNA, 64 nt, Human
ggaccuguggggccccagagaggggacauuucccuccugggagagaaggagaucagggcaacuc

SEQ ID NO: 392618 - RNA, 64 nt, Human
ccugugguccugagcaugaaggggccaggggaccuccugggagaugcagcuuuuguuuccgcug

SEQ ID NO: 392619 - RNA, 64 nt, Human
ggaugggauguauagagaaagacaccaagccuuuagacuccagcagaguagcugauauugacau

SEQ ID NO: 392620 - RNA, 64 nt, Human
ugagaagccugccuagucccuuucauggccaaugagacuccaaaauucccuucccaaaacuauc

SEQ ID NO: 392621 - RNA, 64 nt, Human
caggccagggggccagucccugaggcagguccccagacuccaccaagccuggucagcccaaacc

SEQ ID NO: 392622 - RNA, 64 nt, Human
cugccuccugccuggcacugccgccacacuccccuccugggauggggcuucugcucccgggcuc

SEQ ID NO: 392623 - RNA, 64 nt, Human
ggccagguugaucuaccgacaccuuccacuucuuuccugggagagacugcuggcuucauuggug

SEQ ID NO: 392624 - RNA, 64 nt, Human
ggaaccagaugcaacccggcagcccagagaacucuccugggaggcugugggugagccaggccaa

SEQ ID NO: 392625 - RNA, 64 nt, Human
ggaaacaucugaaaugcucuauuuauguuauuauuccugggagcuuauagcccauuauuuuuac

SEQ ID NO: 392626 - RNA, 64 nt, Human
cccuuacuucaaaguugcccuucucuguucugacuccugggacuucugguccugggcacacuuu

SEQ ID NO: 392627 - RNA, 64 nt, Human
guguggagcacuaccaaggggccccucagggccuuccugggaggagucccaccagccaggccuu

SEQ ID NO: 392628 - RNA, 64 nt, Human
gcauccugagggucucuggggguguuugccaggcuccugggaugggccgcuuucagaagcccug

SEQ ID NO: 392629 - RNA, 64 nt, Human
ugaguagaacuggaggacaggagucgacgugaguuccugggagucuccagagauggggccugga

SEQ ID NO: 392630 - RNA, 64 nt, Human
uucccugagcccgcacuccaaccagcagcuggauuccugggaacuggaggaucagguagaggcu

SEQ ID NO: 392631 - RNA, 64 nt, Human
gauuuaguuuuguaacuuagcuuuauuuuucuuuuccugggaauggaauaacuaucucacuucc

SEQ ID NO: 392632 - RNA, 64 nt, Human
gucaggggcucagggaauccuacccagccaccuguccugggauggagugucagcauccaccccu

SEQ ID NO: 392633 - RNA, 55 nt, Human
ccccagacuacuuccuauaaauuucuccugggaaaccugccuuuguauguggaag

SEQ ID NO: 392634 - RNA, 64 nt, Human
ggaaggaggcagcuaggcuguagauggaagaugguccugggauucgaacaccgcugggaucugg

SEQ ID NO: 392635 - RNA, 64 nt, Human
cacuacuucauaaccacuuuacucuacuccuucuuccugggauguuuugguguggaucgauucu

SEQ ID NO: 392636 - RNA, 64 nt, Human
aaaauggaaagaaaagaauguacauuaccugguuuccugggauucaaaccugcauauugugauu

SEQ ID NO: 392637 - RNA, 64 nt, Human
uuguaaagcuuuacaauaaucauucuggauagaguccugggagguccuuggcagaacucaguua

SEQ ID NO: 392638 - RNA, 64 nt, Human
uugauguagggucaagguuuuugugacaacaggcagacuccacacagagaggauaugaugagaa

SEQ ID NO: 392639 - RNA, 64 nt, Human
cccagugacuaccauguccccuucuaaauuccaaagacuccaacgcagcacuagcaagcagguu

SEQ ID NO: 392640 - RNA, 64 nt, Human
cccaccauugcacuccagccugggcaacagagugagacuccaucucaaaaaaaaaaaaaaaaaa

SEQ ID NO: 392641 - RNA, 64 nt, Human
uacaguggaaacuguuaaaugcauaaccuaauuuuccugggacugccauauuuucuuuuaacug

SEQ ID NO: 392642 - RNA, 64 nt, Human
ugaggagaaaggaaacucaagucucaccauucuguccugggagagaagaggaggaucucaucuc

SEQ ID NO: 392643 - RNA, 64 nt, Human
uugucacaggauguuucuguugauuuuauucauuuccugggaauugguaaacaucauguuccug

SEQ ID NO: 392644 - RNA, 64 nt, Human
aaaaaaaaaggccaaugagaacucaacuccuggcuccugggacugcaccagacugcuccaaacu

SEQ ID NO: 392645 - RNA, 64 nt, Human
guuuugguugguguagagaccauaugcauauuauuccugggauaaacacagaguuauuugucaa

SEQ ID NO: 392646 - RNA, 64 nt, Human
gggugagaacgugcccagccacaucaucuuuaucuccugggauuuucauuagggcaaagaucuc

SEQ ID NO: 392647 - RNA, 64 nt, Human
ucuaaucuccugccagcucuucucaagcaggggauccugggagauguaguuuucagauaccugg

SEQ ID NO: 392648 - RNA, 64 nt, Human
cuguacaggcuggauggaaggggcccuccacacuuccugggaggucagagacaaacuguuucag

SEQ ID NO: 392649 - RNA, 64 nt, Human
cucaguguaagacccucgggcgucuacaaaguucuccugggauuagcgugguucugcaucuccc

SEQ ID NO: 392650 - RNA, 64 nt, Human
accucccucugaaaaacacaaagaauggacucucuccugggaugaggacuugcuuucuuuaccu

SEQ ID NO: 392651 - RNA, 64 nt, Human
ugcuuguugguugaugcugccauguaagcuggacuccugggacugcuguuggcuuaucccggga

SEQ ID NO: 392652 - RNA, 64 nt, Human
cugcgguuugcagugccagcugcacguuggagucuccugggaagcuucuaguguugaucucccu

SEQ ID NO: 392653 - RNA, 64 nt, Human
cugcccugcacaccaccacauuggaccugugcuguccugggaggugguguuggaggccccauga

SEQ ID NO: 392654 - RNA, 64 nt, Human
uugggcaaugcauuuguucccaguuucauuuucuuccugggaauuaacucgucauuucauuccu

SEQ ID NO: 392655 - RNA, 64 nt, Human
ugcgggcagugcuaaagguggagcugggggauuuuccugggaaugauuugagggcucuugaaag

SEQ ID NO: 392656 - RNA, 64 nt, Human
gagcaggagggccuggcugggugaggggaggccuuccugggaaggcguguggugcaggccugug

SEQ ID NO: 392657 - RNA, 64 nt, Human
gcugagggcgacagaggaucuaggcuaacaggagagacuccaggagugggggcagaucccaagg

SEQ ID NO: 392658 - RNA, 64 nt, Human
cagggggcugccucugcacccuacccgcccaaggagacuccacccuggggucccaaacgccgcu

SEQ ID NO: 392659 - RNA, 64 nt, Human
aaaucaauagggaugaaaauuuucuuagaacucaagacuccauaacuauggggguaaaugaagu

SEQ ID NO: 392660 - RNA, 64 nt, Human
agcucugccccaggggcugagcugccaccagagguccugggacccucacuuuaguucuugguau

SEQ ID NO: 392661 - RNA, 64 nt, Human
ccaauggaagcugcccuuuggguaggugcugggcuccugggagggcccagaugauggggugagg

SEQ ID NO: 392662 - RNA, 64 nt, Human
gugggggcugugcagggugcagcgcucagguggauccugggaagcagccucuggaugcugagug

SEQ ID NO: 392663 - RNA, 64 nt, Human
guuuucucauugaaugggggugggggcucguguguccugggaaaccccaucagucccuucauuu

SEQ ID NO: 392664 - RNA, 64 nt, Human
accccaucagucccuucauuucuugagacucaacuccugggaggagagggucucaagaguuguc

SEQ ID NO: 392665 - RNA, 64 nt, Human
gucccggcccugcccucagcgagcccggcaggcguccugggacagcucaguguuggagggccac

SEQ ID NO: 392666 - RNA, 64 nt, Human
ggcuggcgagaccgaaggcagcaugugaggccucuccugggaguggggguuguguuucccacag

SEQ ID NO: 392667 - RNA, 64 nt, Human
ccgcggcugcccgugcccccucugacagccauccuccugggagcccaggaaggcauccacgagg

SEQ ID NO: 392668 - RNA, 64 nt, Human
augugggauguauaugaacuucuucauaauguacuccugggaacuggguaggacauauccauau

SEQ ID NO: 392669 - RNA, 64 nt, Human
uuucagggcuggggguucagggagcauuuccuuuuccugggaguuaugaccgcgaaguugucau

SEQ ID NO: 392670 - RNA, 64 nt, Human
uagacucacccacagcccacucucuggacaccaauccugggaggugggagcuggaauggggagc

SEQ ID NO: 392671 - RNA, 64 nt, Human
ugcugccugcucccucuuccugaaacuggacuguuccugggaaaagggugaagccaccucuaga

SEQ ID NO: 392672 - RNA, 64 nt, Human
gggccugguuauuguucagacauuccauggugauuccugggaaggaagcuuggcugcucaguuu

SEQ ID NO: 392673 - RNA, 64 nt, Human
ugccaggccucugcccaugccccuuccuuccuucuccugggacuggugaagcuaggcaucugga

SEQ ID NO: 392674 - RNA, 64 nt, Human
gccacugggaccaggccuccuguuguggagggacuccugggacaguccuccacccuguccugug

SEQ ID NO: 392675 - RNA, 64 nt, Human
uuagacaguguggcaaagugggaaaaagcacagauccugggaccaagguucagauuccaucuca

SEQ ID NO: 392676 - RNA, 64 nt, Human
auuaccauauauucaccaccaggucacugacgagagacuccagugaaucgcuuucccucugcau

SEQ ID NO: 392677 - RNA, 64 nt, Human
cgcaaauugcacuccagccucggugacaagagcgagacuccaucucaaaaaaaaauaaaaagaa

SEQ ID NO: 392678 - RNA, 64 nt, Human
ggcccgcagccucccacgcugucugagagaucucagacuccacuugacccccggagggaaagga

SEQ ID NO: 392679 - RNA, 64 nt, Human
gguaaaugccacacguuaacacaauaacacccauuccugggaccguggggauuuagggcacguc

SEQ ID NO: 392680 - RNA, 64 nt, Human
uggcaaccuucaccagcauuucccaaaaguaugcuccugggaacccuaguuccacaggauaaua

SEQ ID NO: 392681 - RNA, 64 nt, Human
gaaucucugcucuguuccuagguucagugcuggguccugggaauacagcaggacagaccucagc

SEQ ID NO: 392682 - RNA, 64 nt, Human
uacuucguugucagagaaaaacacuugcccuuuuuccugggauguaacuaucuuacauguuuac

SEQ ID NO: 392683 - RNA, 64 nt, Human
ugggccuggcugucgucccuccucagcuucuuguuccugggacaagggucaagccaggaugggc

SEQ ID NO: 392684 - RNA, 64 nt, Human
ggggcuuccgagggucucccucgacccucugucguccugggauggcugucgggagcuguaucac

SEQ ID NO: 392685 - RNA, 64 nt, Human
ccccaggaauggaccccccaaucacuccccacucuccugggauaaugggguccugucccaagga

SEQ ID NO: 392686 - RNA, 64 nt, Human
uccuuguguccugggggaccugcuggcggccucuuccugggagccaugaccucagaccccaccc

SEQ ID NO: 392687 - RNA, 64 nt, Human
uuccugcccucucucugagaggcccuuucuggaguccugggaaggugucugccuggccgcgcug

SEQ ID NO: 392688 - RNA, 64 nt, Human
aauguccagguggacucugaguauuuccuguggauccugggaaaguacuguugcacaaaggcug

SEQ ID NO: 392689 - RNA, 64 nt, Human
ccgggugugguggugggcaccugugaucccagcuuccugggaggcugaggcaagagaaucgcuu

SEQ ID NO: 392690 - RNA, 64 nt, Human
ugaagacuggcauuuugauacuucagcuguuuguuccugggagaauucugagcacagauuccag

SEQ ID NO: 392691 - RNA, 64 nt, Human
cauccauccccucauaguuaaguagccacugguguccugggaauuucugguuggauuuggugcc

SEQ ID NO: 392692 - RNA, 53 nt, Human
ccaccgacggggacugcugagccuccugggacagcgggcuggcagggacuggc

SEQ ID NO: 392693 - RNA, 64 nt, Human
ggaagacugaauauccuuuuuaaugcaccaugaauccugggagacuaagcaaauuaacaguaug

SEQ ID NO: 392694 - RNA, 64 nt, Human
ccuuucucaaguauuuauuuauuuauugcaugguuccugggaacauguggcacaaguaauggga

SEQ ID NO: 392695 - RNA, 64 nt, Human
cucguccccuaucgcaucuuggacucggaaagccagacuccacgcaggaccagggaucucacga

SEQ ID NO: 392696 - RNA, 64 nt, Human
guuuagggaaagaagguugcuguggugaggaacgagacuccauagcagagguaugccaucaugg

SEQ ID NO: 392697 - RNA, 64 nt, Human
ugugccacugcacuccagccuaggcgacagagugagacuccaucucaaauuggaaaaaaaaaaa

SEQ ID NO: 392698 - RNA, 64 nt, Human
uggaagucgaauuuccuuuucuguuaggagcuacuccugggaaccccucucagggcugcagcuu

SEQ ID NO: 392699 - RNA, 64 nt, Human
uacuuaaguaguuuuaaauuuuauuaugauaaauuccugggagggggauuauuuagugaaauaa

SEQ ID NO: 392700 - RNA, 64 nt, Human
ggaaagaagugagaugcaccuuauuuucaagaaguccugggaagcgcucuccuagcacguccau

SEQ ID NO: 392701 - RNA, 64 nt, Human
guuucaacuugucuuaugcaucuuaucuggcauguccugggagauggaugggcaagaacuggcc

SEQ ID NO: 392702 - RNA, 55 nt, Human
ugcagcacgccgacaagugauggccuccugggagagccccgccuccuccaccccu

SEQ ID NO: 392703 - RNA, 63 nt, Human
uggaggcaccgcuguauuaaaggaaguggcaguguccugggaacaagcgugucugcccuuucu

SEQ ID NO: 392704 - RNA, 64 nt, Human
uaagaagcggcauagcacccguggugcaugccuguccugggagcuggagaggaugucagcgagc

SEQ ID NO: 392705 - RNA, 64 nt, Human
acuauaacaagaaaagaaaugaagugcauaagucuccugggaaaagaaccuuaaccccuucucg

SEQ ID NO: 392706 - RNA, 64 nt, Human
agagcuucccugacucauucugaaggagccccauuccugggaaauauucccuagaaacuuccaa

SEQ ID NO: 392707 - RNA, 64 nt, Human
cuuuugcuucuuggccauccacucagcugauguuuccugggaagugcuaauuuuaccuguuucc

SEQ ID NO: 392708 - RNA, 64 nt, Human
ggcuagaacaucaauuaccucccauguguggacauccugggacuuguuuacauuuuaucuguaa

SEQ ID NO: 392709 - RNA, 64 nt, Human
uaacucacuaguuuauaggccugaccuuuuaaauuccugggauaaauuuuagaauauuaaauuc

SEQ ID NO: 392710 - RNA, 64 nt, Human
guaaugcugccccacgugcuggugcaggucaguauccugggacuuggaagcuggcaggauuugc

SEQ ID NO: 392711 - RNA, 64 nt, Human
uggucccuggacuggugggaaccugaacuaggaguccugggagagcuguggugggaauaugggc

SEQ ID NO: 392712 - RNA, 64 nt, Human
uguaacuuguuugauccacccccuucccugaaaauccugggagguuuuauugcugccauuuaac

SEQ ID NO: 392713 - RNA, 64 nt, Human
ggguguccccuguccucuugaugucacccuccgcuccugggacacgugcucucucugucucugg

SEQ ID NO: 392714 - RNA, 64 nt, Human
cuguuuguuguggaacuaggagcucuuugagacgagacuccaaguaguaaucccagaccccacc

SEQ ID NO: 392715 - RNA, 64 nt, Human
aguauguggcccagagugaugguguaguacaccaagacuccagcguugcugucuugccagugcc

SEQ ID NO: 392716 - RNA, 64 nt, Human
ggaugaacugugaaagguucuaggcagcucugugagacuccaagcuccuugaaaguaggaccuu

SEQ ID NO: 392717 - RNA, 64 nt, Human
cugaaccauaucgaugaggucuggcccagccucuuccugggagaugcgugaguaagacccacgu

SEQ ID NO: 392718 - RNA, 64 nt, Human
caucuguguucaaggucacgguuugcugugggguuccugggagagcuuacucaccccggagucu

SEQ ID NO: 392719 - RNA, 64 nt, Human
aacagcuccucuuccagagcugccucugccuuuauccugggagauggggaggaagccccaucuc

SEQ ID NO: 392720 - RNA, 64 nt, Human
ggccaaggcuuucuccaaaagugagcccggauccuccugggagcugcuccaggcaugugggaag

SEQ ID NO: 392721 - RNA, 64 nt, Human
gaagagucccaaaaugauucuuagaggaccagccuccugggacugugacugcuuuugagagcuc

SEQ ID NO: 392722 - RNA, 64 nt, Human
agugcucaggcaccuugcacuagaggcuucugacuccugggacuuuggagcuuaccagagaugc

SEQ ID NO: 392723 - RNA, 64 nt, Human
acuggugggucccugggggccagcugccuucucauccugggagguggcccuucccaagcccauc

SEQ ID NO: 392724 - RNA, 64 nt, Human
gucccagggugcucugccugcucagccaggccucuccugggagccacucgcccagagacucagc

SEQ ID NO: 392725 - RNA, 64 nt, Human
uuuuuccucugccccacucccugccauaccuuuauccugggauccuauuuugggccuggggugg

SEQ ID NO: 392726 - RNA, 64 nt, Human
ccuccacguaaaugaaaccaaaggccucagcauauccugggaggacugggggcuguuaccuaau

SEQ ID NO: 392727 - RNA, 64 nt, Human
ugccuaguccaacauuuuuucccagugagucacauccugggauccaguguauaaauccaauauc

SEQ ID NO: 392728 - RNA, 64 nt, Human
ccuagaaguggaacagacugagaagggcaaacauuccugggagcugggcaaggagauccucccg

SEQ ID NO: 392729 - RNA, 64 nt, Human
auauauuauaaauaucaaagaaauuauauaucuauccugggaugggaaaaugagggagggauac

SEQ ID NO: 392730 - RNA, 64 nt, Human
cgauggucuauacagcaaagucagcccucacagcuccugggaacgcuguccucucagauaagcc

SEQ ID NO: 392731 - RNA, 64 nt, Human
guccccaugugucuccuugaauugaugaggaugcuccugggagggaugcgugacuauguggugu

SEQ ID NO: 392732 - RNA, 64 nt, Human
cagguccuuucuccacgccauuugaugcuguaucuccugggagcacaggcaucaaugguccaag

SEQ ID NO: 392733 - RNA, 64 nt, Human
cugacuaugaugccccugugugcauuuacaauaaagacuccaacggagggagccuguugguguu

SEQ ID NO: 392734 - RNA, 64 nt, Human
cgugccacuggacuccagccugggugacagagcgagacuccauuucaaaaaaaaaaaaaaaaaa

SEQ ID NO: 392735 - RNA, 64 nt, Human
ugcaccacuguacuccagccugggugacaaagucagacuccaucuccaaaaaaaaaagauuaua

SEQ ID NO: 392736 - RNA, 64 nt, Human
ccucagcuuucccuccucgcuggccugggcacccuccugggagcaggccuuccucccucccacc

SEQ ID NO: 392737 - RNA, 64 nt, Human
cuccccacacagcugggacuggccuggauggcuguccugggagccccugcccacccugacagag

SEQ ID NO: 392738 - RNA, 64 nt, Human
ucuggccuuuuaauuccuccucugccaggguggguccugggaccucuaaugugggcaugucguc

SEQ ID NO: 392739 - RNA, 64 nt, Human
aggggacgggcaagugagaggggagggagggaaguccugggaggauccugagcugcuguugcag

SEQ ID NO: 392740 - RNA, 64 nt, Human
ggacccccuacccuguucuccccugaggccccguuccugggaggggcaccccucaacugucacu

SEQ ID NO: 392741 - RNA, 64 nt, Human
ccuccgaggugggugugcgggucucacaggugcuuccugggacuuccuguggcugcacagggcu

SEQ ID NO: 392742 - RNA, 64 nt, Human
ugcacgcgguauggggagggcugagcucagugccuccugggagacuugucccguguacagugac

SEQ ID NO: 392743 - RNA, 64 nt, Human
ucuacauucucgggagcggcgccucccaaggggguccugggaccuucucgcgcuccuccuggcc

SEQ ID NO: 392744 - RNA, 55 nt, Human
gcuaccagcgccgcauguagggccauccugggauggggcaccacagggagggagg

SEQ ID NO: 392745 - RNA, 64 nt, Human
aggcucugccuuaaaaaaaaaaaaaaaaaaaaccuccugggacuguugcaaggaugaaaugaag

SEQ ID NO: 392746 - RNA, 64 nt, Human
cccaaccccacuccugagacauagggcccauccguccugggaaagagcauccucuggcaggugc

SEQ ID NO: 392747 - RNA, 64 nt, Human
acccuccauguuugcuggguauuagccaagcugguccugggagaaugcagauacuguccgugga

SEQ ID NO: 392748 - RNA, 64 nt, Human
ccagaagaagaaaaguagagguggcuuugcugccuccugggagcccagaacuugcaguaacccu

SEQ ID NO: 392749 - RNA, 64 nt, Human
ggcucaggccuggacccccccaguucacgguugcuccugggagcugccccucccgucacaucag

SEQ ID NO: 392750 - RNA, 64 nt, Human
agggcugagggaacucugcuaugugauggggacuuccugggacaagcaaggaaaguacugaggc

SEQ ID NO: 392751 - RNA, 64 nt, Human
agcacuguacacccccaguggagagccaauucaguccugggacgacauagagcgagauaugguc

SEQ ID NO: 392752 - RNA, 64 nt, Human
cgcgccacugcacuccagccugggcgacagagcaagacuccaucucaaaaaaaaaguuaauuaa

SEQ ID NO: 392753 - RNA, 64 nt, Human
guggccagagacugacuucaagguuuuauuccagagacuccagagacuuaagcuaaguauuuuu

SEQ ID NO: 392754 - RNA, 64 nt, Human
cgcgccacugcacuucagccugggugacagagcuagacuccaucucaaaaaaaaaaaagagcua

SEQ ID NO: 392755 - RNA, 64 nt, Human
uucuuccuguuacaaaugaucugaggcaguuuuuuccugggaauccacacguuccaugcuuuuu

SEQ ID NO: 392756 - RNA, 64 nt, Human
uguccccacucuccuggccugacaagaugagcucuccugggaccuugcucuagggcacucugcc

SEQ ID NO: 392757 - RNA, 64 nt, Human
uaugguauaccuccugaccccucucucccucauguccugggauucuggggaagagaccuagaaa

SEQ ID NO: 392758 - RNA, 64 nt, Human
cucuggcugcuccucugucccuugagggaggaaguccugggacccagggaggggaggggccuuu

SEQ ID NO: 392759 - RNA, 64 nt, Human
ucaaaaccacuugccauccuguuagauugccaguuccugggaccaggccucagacugugaagua

SEQ ID NO: 392760 - RNA, 64 nt, Human
ucuuuaugggcuuucucugaggcccagucacugcuccugggacccaguccccuggaggggaggu

SEQ ID NO: 392761 - RNA, 64 nt, Human
auggaggcagcacugagccagcaccacacguccauccugggacagacgggccuggacuucacgg

SEQ ID NO: 392762 - RNA, 64 nt, Human
cuacucugaggcacucuguugggguuugggacccuccugggaaggcaaguggccagugcugcca

SEQ ID NO: 392763 - RNA, 64 nt, Human
agccagguguccugacuguccuacaauaucauuuuccugggagugggagucaagugugccugcu

SEQ ID NO: 392764 - RNA, 64 nt, Human
gcccccggcacugcgccccacugccagcugccccuccugggagggcccgggaggagggugccac

SEQ ID NO: 392765 - RNA, 64 nt, Human
uacucuuucugccaagagccugccccugcauuuguccugggaaacacgguauuuaagagagaac

SEQ ID NO: 392766 - RNA, 64 nt, Human
uccugggggaaggggagaucuaagaugucccagguccugggaaguuuacucaauaaagcuggcu

SEQ ID NO: 392767 - RNA, 64 nt, Human
ucuggcccagaggagagagcuuggguucccauaguccugggagagugucugcagggcggcggag

SEQ ID NO: 392768 - RNA, 64 nt, Human
gagguccuaucaguacugagaggccaugccaugguccugggauugacugagaugcuccggagcu

SEQ ID NO: 392769 - RNA, 64 nt, Human
caagcucucuugccgaggagccaggcaacuucaguccugggagacccauguaaauaccagacug

SEQ ID NO: 392770 - RNA, 64 nt, Human
ccagguggacugccucucucauucccaguagcuguccugggacuuugggauuucuucucagcuu

SEQ ID NO: 392771 - RNA, 64 nt, Human
cccugaacauuucaugguguucaucaacagugagagacuccauaguuugggcuuguaccacuuu

SEQ ID NO: 392772 - RNA, 64 nt, Human
cgcgccacugugcuccagccugggcaacagagcaagacuccaucucaaaaaauaaaaauaaaua

SEQ ID NO: 392773 - RNA, 64 nt, Human
caggccauugcacuucagccugggugacagagugagacuccaucucaaaaaaaaaaaaaaaaga

SEQ ID NO: 392774 - RNA, 64 nt, Human
gcagaugccagcggcccagguggcgccauugcuguccugggauggaucguggguuuugguggau

SEQ ID NO: 392775 - RNA, 64 nt, Human
agaaauaagccuuaggugcugcccaguuuacacuuccugggauggauguuuuuguuuguuuugu

SEQ ID NO: 392776 - RNA, 64 nt, Human
ccagaauccagaaguaagcucugcauguuccccuuccugggaggaaaccaauugucagaaggau

SEQ ID NO: 392777 - RNA, 64 nt, Human
caaacaagagcugagccaccuuugcugucuugucuccugggacgagaaggacucauccagcaaa

SEQ ID NO: 392778 - RNA, 64 nt, Human
uuuccccacauuuucucuggcccucuaccuugcuuccugggaguuugauuuaggauugcuguug

SEQ ID NO: 392779 - RNA, 64 nt, Human
acagucauuucuuuuccucucucuggcccuuggguccugggaaugcugcugcuucaaccccaga

SEQ ID NO: 392780 - RNA, 64 nt, Human
ugugccaccacccauaaugcuuugcauugcugcauccugggaaggggguauauggucucacaag

SEQ ID NO: 392781 - RNA, 64 nt, Human
auaaaugguacugaauggacaagacaguuuccuauccugggagcaggagagugugccuauuuga

SEQ ID NO: 392782 - RNA, 64 nt, Human
aacuauugaggguaaacacaagcuuuccauggaauccugggaaaauuaauaaugauugugagaa

SEQ ID NO: 392783 - RNA, 64 nt, Human
accuccuuucguugauggccaaagcaaaggagaguccugggagcccacaagauccaggcagaag

SEQ ID NO: 392784 - RNA, 64 nt, Human
ucccaugauuuuuccacugagacaaauccuaggcuccugggaggcccuggcagaagccagaaca

SEQ ID NO: 392785 - RNA, 64 nt, Human
ggagccauugugaccaggggcugcgggaggccuuuccugggaccuuccuugggacuggucuggg

SEQ ID NO: 392786 - RNA, 64 nt, Human
acuauugcugcucuucaccagaaccucacaccucuccugggacuggaacccuucagugggugug

SEQ ID NO: 392787 - RNA, 64 nt, Human
caaacaggccuugugcucaaccacuggaaaugccuccugggauaagaauggcagcacuugaaaa

SEQ ID NO: 392788 - RNA, 64 nt, Human
uugcaguucgugaccagcugcuccagacccccgcuccugggauucgccuaccucaagccuccau

SEQ ID NO: 392789 - RNA, 64 nt, Human
ugccagggaccuucagcucccagaggcagugugguccugggaaugugaccaacaugccagguga

SEQ ID NO: 392790 - RNA, 64 nt, Human
caccuccaauucccgugaucccaaaagaagaggaagacuccaggagggguauagauugugccgu

SEQ ID NO: 392791 - RNA, 64 nt, Human
uuuguggcuugaacuugccagaugcaaauaccacagacuccaagaaaacccgaguugggguuug

SEQ ID NO: 392792 - RNA, 61 nt, Human
ccaucguucacacucuaugaugaggagauucagacuccacaguguauauauuuugccauuu

SEQ ID NO: 392793 - RNA, 64 nt, Human
uggcccuggccugggcaucacaagccagugaugcuccugggaagaccagguggcaggucgcagu

SEQ ID NO: 392794 - RNA, 64 nt, Human
ggucugaaguuaugucuagauaagacuucagacguccugggauugaaagaaugugugugaaggg

SEQ ID NO: 392795 - RNA, 64 nt, Human
ggauggcucucaggucccagucacagacgucgcuuccugggauuccagcacgaugccuccauag

SEQ ID NO: 392796 - RNA, 64 nt, Human
acuccccuggagugacgaccaccgccccaccaccuccugggaccacaccacuaccgcccccaac

SEQ ID NO: 392797 - RNA, 64 nt, Human
uauuuauugcuucauggccgacuggaauccugaguccugggaagcuggcacugcggggaucuug

SEQ ID NO: 392798 - RNA, 64 nt, Human
aggggcaccccuuccucugugccaagaggauucauccugggagagggggcaagguggaaugcag

SEQ ID NO: 392799 - RNA, 64 nt, Human
gaagagcuguuaucuauucagcaugucacuaaauuccugggauggaaguaaaagacaaugcugg

SEQ ID NO: 392800 - RNA, 64 nt, Human
aggcugaggaauuuccuggcuuccccagauaguguccugggacaugguaugcuuuggggcuggg

SEQ ID NO: 392801 - RNA, 64 nt, Human
gguucagggcugagcccuucuuuucccucuuuuuuccugggaauauuuuguacaauauuuugua

SEQ ID NO: 392802 - RNA, 64 nt, Human
gaggacggcgugggcccuguccuguaucuggaauuccugggaaggcuggcugcugaagacccuc

SEQ ID NO: 392803 - RNA, 64 nt, Human
ggccacccacuucucccagccugugucuuccugauccugggaaggccuggaugaccaagcuugg

SEQ ID NO: 392804 - RNA, 64 nt, Human
ucccaccuccuucauuaccuccuggccaugauucuccugggagauaauucugcucucuggagau

SEQ ID NO: 392805 - RNA, 64 nt, Human
uaggcucaauuaccacuucuguuugcuuuguggauccugggauaacauguauauguguacacau

SEQ ID NO: 392806 - RNA, 64 nt, Human
aauauucaaaggccaaaacacuacucagacacuuuccugggaagagcaacuaaaaauguaaaau

SEQ ID NO: 392807 - RNA, 64 nt, Human
gauuaguaggaaaggacugagaguauuauauuuuuccugggaugccuaauaguccuuugauaga

SEQ ID NO: 392808 - RNA, 64 nt, Human
aucauucuuucuaaauucuuugcuagucauuucuuccugggaauacagagaaaagagacaacuu

SEQ ID NO: 392809 - RNA, 64 nt, Human
cgcaccacugcacuccagccugggugccagagcaagacuccaucucaaaaaaaaaaaaaaaaaa

SEQ ID NO: 392810 - RNA, 64 nt, Human
auaugggagagauucagugaagauauggacuggaagacuccaaggccgcuugucuuugagaccu

SEQ ID NO: 392811 - RNA, 64 nt, Human
gauggaaccacccuccccagaggcugcauugaggagacuccacagacugaaaagugaguuugca

SEQ ID NO: 392812 - RNA, 64 nt, Human
acaucagaacagucugccaagaaggacauuggcauccugggaaaguccgccuuuucccuugacc

SEQ ID NO: 392813 - RNA, 64 nt, Human
ggcaaccucaucgccuucaucaucuacgaguuuguccugggagauuguauggaggugagaggcc

SEQ ID NO: 392814 - RNA, 64 nt, Human
cggggucaccuacgucaucuauggguucugguaguccugggagaggcagggaaauguccucgaa

SEQ ID NO: 392815 - RNA, 64 nt, Human
aagagaggauuaggcagcagcacugugugugucuuccugggagccgagcuggggguuggggccc

SEQ ID NO: 392816 - RNA, 64 nt, Human
uguuucaccaauauuuaaacaucaguacuaguuguccugggagaaagggaaaggaguuuuaugu

SEQ ID NO: 392817 - RNA, 64 nt, Human
cuuuuaaaccauauuauugaugaugaaaauuauuuccugggaacucaguaggaauaauaccgua

SEQ ID NO: 392818 - RNA, 64 nt, Human
guagauugguugcuucugagaacacauucugccuuccugggaagucggggugucauccuuuccu

SEQ ID NO: 392819 - RNA, 64 nt, Human
cagccauggauacacuauuuaccuuacaguaguuuccugggaaucuaagucugguuuuuguuau

SEQ ID NO: 392820 - RNA, 64 nt, Human
uauuuaaaaaaaaaaaaaaaaaacucacccguuuuccugggauuuguuguaaggaguuuucacu

SEQ ID NO: 392821 - RNA, 64 nt, Human
gugcagagugaacucugaugcaguaucagucuuguccugggagccggguccugcugcucacaag

SEQ ID NO: 392822 - RNA, 64 nt, Human
auauauuuuuuaaaacggaaagccuuuguacaguuccugggauucacagaagcacuacuccaga

SEQ ID NO: 392823 - RNA, 64 nt, Human
aauaccaguuaagcaguauuuggcaacuuaaacuuccugggagccuaacuuuacuauguuaagu

SEQ ID NO: 392824 - RNA, 64 nt, Human
cauagcaucaagucuucucuagagaccucuguaguccugggaggccucauaauguuuguagauc

SEQ ID NO: 392825 - RNA, 64 nt, Human
cuuucuguugaaugaaucaacaaaccacaauacuuccugggaccuuuuguacuuuauuugaacu

SEQ ID NO: 392826 - RNA, 64 nt, Human
cacacuguaccuaugaauuacugugggauagugcuccugggagccauauggcuuggccagacug

SEQ ID NO: 392827 - RNA, 64 nt, Human
gcgccucugggacaguggcccugagcccaccccuuccugggaugggccagacaagcaggugcug

SEQ ID NO: 392828 - RNA, 64 nt, Human
aacauuuaggaaccaauauguauaaguaauucggagacuccaauucaccugccccucccccauc

SEQ ID NO: 392829 - RNA, 64 nt, Human
ugugccacugcacuccagccugggugacagagugagacuccaucucaaaaauaauaauaauaau

SEQ ID NO: 392830 - RNA, 64 nt, Human
auguaccaccuguccuaaggaagaccagaucaauagacuccaugauggaugcuuguuucaaagg

SEQ ID NO: 392831 - RNA, 64 nt, Human
gauggccagagaacaagaugcucccuugcugagcuccugggagcguggaaggagaugcuaggcc

SEQ ID NO: 392832 - RNA, 64 nt, Human
aagucuuugagaggggccugaagagccuccgggcuccugggacauugauguagaguuuuuagug

SEQ ID NO: 392833 - RNA, 64 nt, Human
ccaagauggcaaagcacuugccaggugucaacuuuccugggaaccgguggaauccuguggaagg

SEQ ID NO: 392834 - RNA, 64 nt, Human
uaugucuaaaaaucuuaaggauaguuucagugguuccugggauguaguauaaguuaacucugcu

SEQ ID NO: 392835 - RNA, 64 nt, Human
ccagcccagaggugguuccuuaggcagcaugugcuccugggagccucugacuuuugcuggaagc

SEQ ID NO: 392836 - RNA, 64 nt, Human
ugugcuguuugaugccuccucacugucccgucacuccugggaagaagaaacgggugagaacugc

SEQ ID NO: 392837 - RNA, 64 nt, Human
ggugccaaacauggaggugggcaggcucaccuguuccugggacugucugagauggcagggcacu

SEQ ID NO: 392838 - RNA, 64 nt, Human
uaugcuugccucgucggagucaccccucaggcaguccugggauccucuccuuuagacccacugu

SEQ ID NO: 392839 - RNA, 64 nt, Human
ccucccaccucucugagggcugaggugagacuucuccugggaugacaauuugcugagagagugc

SEQ ID NO: 392840 - RNA, 64 nt, Human
ucugauucugcauaguaaaaugagaaaauaugauuccugggauuuuuaccauaaagcagacagu

SEQ ID NO: 392841 - RNA, 64 nt, Human
cuuaaaucugaguccuuuuuagcagcaacuuuuuuccugggauccuccuucguggucuucuaag

SEQ ID NO: 392842 - RNA, 64 nt, Human
ucucucuauccccacagaagucuacagggcaacuuccugggagcuaaggcuacuaaaagguaga

SEQ ID NO: 392843 - RNA, 64 nt, Human
gaggacugagccuagccuucagcaaccaagguucuccugggacccaaaguuuaugggagaaggg

SEQ ID NO: 392844 - RNA, 64 nt, Human
ccugaaacagccugaagggaauucucccuaggucuccugggagucgagucccaauucuuggcuu

SEQ ID NO: 392845 - RNA, 64 nt, Human
gccccacguggugcugcucagccuucucugccccuccugggaaucugucauucgugggugcuuc

SEQ ID NO: 392846 - RNA, 64 nt, Human
ggccaggccuuacaucuggcuggaaagcagagccuccugggaacacaucuggcugcacaggcug

SEQ ID NO: 392847 - RNA, 64 nt, Human
acagucuuacugcaggcaagugggauaaaggcccagacuccaugguggaaguuaaagggcauuu

SEQ ID NO: 392848 - RNA, 64 nt, Human
ccgcacauauuaguacucuuaagagcaucuuccaagacuccagcagugagcauuuagagagugu

SEQ ID NO: 392849 - RNA, 64 nt, Human
cuccauggggaagacagccaugcucuucaggaggagacuccaagggcaaaggagggugucuugg

SEQ ID NO: 392850 - RNA, 64 nt, Human
ucagaagugcccuuccugcugcgcaguucucccauccugggacggcggcaguauugaagcucgu

SEQ ID NO: 392851 - RNA, 64 nt, Human
ccucaggugauccgccuaucugggccucacaaaguccugggauuauaggcaugagccacugcgc

SEQ ID NO: 392852 - RNA, 64 nt, Human
uggccaguggagugguccaugcuaagucuaacacuccugggagcucaggaggcuucugagcuuc

SEQ ID NO: 392853 - RNA, 64 nt, Human
agggaccucuuuaucucaaucuauuuauuuggcauccugggagggauuuccaauaguaauuuau

SEQ ID NO: 392854 - RNA, 64 nt, Human
cccuccuucccaucccuacucauuagcucccugcuccugggaugcuucccaagcagcccaggcc

SEQ ID NO: 392855 - RNA, 64 nt, Human
gugcuuugcccguggccagaagcucagcagcggcuccugggaaaggccuggaaaggaugaggga

SEQ ID NO: 392856 - RNA, 64 nt, Human
ccccaaguuauccaccugccuuggcuucccaaaguccugggauuacaggugugagccaccacau

SEQ ID NO: 392857 - RNA, 64 nt, Human
gguuaugagcuggaacuguuucuacuuucagucuuccugggaaguaacaguacuuagcacucuu

SEQ ID NO: 392858 - RNA, 64 nt, Human
acucuucuaaaacuaaaugggcacaagagaauuuuccugggaaaguucacaucaaaaagaguga

SEQ ID NO: 392859 - RNA, 64 nt, Human
agugcuucccaaacugaggucccauggcacacuguccugggaggcguucagaggguuccaugau

SEQ ID NO: 392860 - RNA, 64 nt, Human
gcugucuguucugggcacuggcuccgaguuccccuccugggauuugcaggagggcaguacugaa

SEQ ID NO: 392861 - RNA, 64 nt, Human
caccaugcacaccugucucggaguaggcagcucuuccugggagcuccaggcuauuuuugugcuu

SEQ ID NO: 392862 - RNA, 64 nt, Human
gcccucagacccccagggugcacgucuccccagguccugggaguggcuaccgcagguaguuucu

SEQ ID NO: 392863 - RNA, 64 nt, Human
uauuaauagcucuucuacccuugaaggugacugguccugggacaguuagaaucuuucagguuua

SEQ ID NO: 392864 - RNA, 64 nt, Human
guaggcaggagaccaaggagcagaaggcuugccuuccugggagcagguuguuugagcuguuuua

SEQ ID NO: 392865 - RNA, 64 nt, Human
gaccucgugauccacccgccucggccucccaaaauccugggauuacaggcgcgagccaccacac

SEQ ID NO: 392866 - RNA, 64 nt, Human
caggcuccucucccaagaaauccaggugcuuuccagacuccaaaggguaucuuaaaugcaaucu

SEQ ID NO: 392867 - RNA, 64 nt, Human
caccacugcacuccagccugggagagacagagugagacuccaucucgaaaaaaaaaaaaagaua

SEQ ID NO: 392868 - RNA, 64 nt, Human
cuuccgggaccucguuugcugaggagggacuuacagacuccacugguguuuugcuguugcucau

SEQ ID NO: 392869 - RNA, 64 nt, Human
caucucuuuugccgagacuguauauuuaucagacuccugggagaacaccaacauccaugggguu

SEQ ID NO: 392870 - RNA, 64 nt, Human
ugagcaaucugacccuaugggucuaggacacaguuccugggaacaucacauuccucugcccuuc

SEQ ID NO: 392871 - RNA, 64 nt, Human
gcaagagagaccuggagacaccagggguggaggguccugggagauagucccagggguccgggac

SEQ ID NO: 392872 - RNA, 64 nt, Human
ugguucaucgugaguaagaagccugccuugcuguuccugggaagaugccauaguuuucguuacu

SEQ ID NO: 392873 - RNA, 64 nt, Human
ccuguggagagacuccgccugcugacacuaaacguccugggaagugggcccuucccugggucuc

SEQ ID NO: 392874 - RNA, 64 nt, Human
uacugggcaccaguggacucgccccauggcccguuccugggagaugagggccguggccugcaug

SEQ ID NO: 392875 - RNA, 64 nt, Human
gacagcaccuaccacuugguucuccagcguagacuccugggagcagccaacugcagccauugcc

SEQ ID NO: 392876 - RNA, 64 nt, Human
ggcuucacugcuaaucacaucgugcaucuguguguccugggagcugccugcucccggcccaccc

SEQ ID NO: 392877 - RNA, 64 nt, Human
aggaaacugacacagggagcucagcggccucagauccugggaccccugggccgugccugcccuc

SEQ ID NO: 392878 - RNA, 64 nt, Human
uuuccaggaagagccagcuuuucucggagcgcaguccugggacucuccgcagccccgccccgcc

SEQ ID NO: 392879 - RNA, 64 nt, Human
gcucaggccuggucauugccuccucagcacucccuccugggaggccuuagcucuagagugaggg

SEQ ID NO: 392880 - RNA, 64 nt, Human
uuuuccaaaagccagucaagggcauuacauuuguuccugggacuggcagcugggccuccugggu

SEQ ID NO: 392881 - RNA, 64 nt, Human
gaauguuugccucugccucugacacacagcucuguccugggagugagcugguuuuuagcggaga

SEQ ID NO: 392882 - RNA, 64 nt, Human
gagagauugcaaagcugaaagcaccuccggccacuccugggagacagacccuuuggugaugaaa

SEQ ID NO: 392883 - RNA, 64 nt, Human
uucucaggcuccacagcaggccgccugaaucaaauccugggagguggggacagaaaucuguguu

SEQ ID NO: 392884 - RNA, 64 nt, Human
aaugaucucaugcucaggacaguugcgcagggacuccugggagauauucaggagccucacacug

SEQ ID NO: 392885 - RNA, 50 nt, Human
gcaagcuggcgcaaauuuagagacuccagugccuucugagaaggaagauc

SEQ ID NO: 392886 - RNA, 64 nt, Human
ugcacuacugcacuccagccugggugacagaguaagacuccaugucaaaaaaaaaaaaaaaaaa

SEQ ID NO: 392887 - RNA, 64 nt, Human
guuccaaaggccugaaaauaauuuucagauaaagagacuccaagguugacuuuaguuugugagu

SEQ ID NO: 392888 - RNA, 64 nt, Human
uugcagauugggugacugaccagacuuguugggguccugggaugaguugccccgggcugcaaau

SEQ ID NO: 392889 - RNA, 64 nt, Human
gaaaaugaauuuggcauauagaauuauuacaauuuccugggagagauggauauuuaaaccucua

SEQ ID NO: 392890 - RNA, 64 nt, Human
ucugccuacugcccaugaacggggcccucaagcguccugggaucuccuucucccuccuguccug

SEQ ID NO: 392891 - RNA, 64 nt, Human
aaauaggagcaggauuuccccuggggaaaaguucuccugggacaucuucugcucuucuguacau

SEQ ID NO: 392892 - RNA, 64 nt, Human
gguuccuccccuccagcucccugugcccccaggguccugggaggagagacacugguggggauag

SEQ ID NO: 392893 - RNA, 64 nt, Human
gucaccacgaagaugaggaccaacuugaaaagauuccugggagucgaaguugaaaggaagcuuu

SEQ ID NO: 392894 - RNA, 64 nt, Human
uuuaacauuaauauacucuuacaaccuaggaaucuccugggaaucuaucccuaaggaauaaaaa

SEQ ID NO: 392895 - RNA, 64 nt, Human
agccacuuaacagcucugggucccuguuuuaccauccugggagcaaggcccugcagcuccacga

SEQ ID NO: 392896 - RNA, 64 nt, Human
gccuccaguccccaccaggccccacucccaguccuccugggauccugcuggcuugggcccggcu

SEQ ID NO: 392897 - RNA, 64 nt, Human
gugcaguggcaggucccgucagaagagaugaggcuccugggacaggucagcgucaggggcagcc

SEQ ID NO: 392898 - RNA, 64 nt, Human
aggcaucugggaagucucugaguaggcaggguccuccugggaggcacccccaccuguuugaaag

SEQ ID NO: 392899 - RNA, 64 nt, Human
accucaggcuccuaaagagacauuuuccgcccacuccugggacacuccgucugcuccaaugacu

SEQ ID NO: 392900 - RNA, 64 nt, Human
cagguucuccagagagcgggcauccagagaggaguccugggagagcgggcggagcgagcgaggg

SEQ ID NO: 392901 - RNA, 64 nt, Human
agugccaccagguacuaaguccucuccagguugguccugggauaucauguuucaaguggcugug

SEQ ID NO: 392902 - RNA, 64 nt, Human
auggaccagcccauuggccgagcuccuggggagcuccugggacccuuggcuaugaaaaugagcc

SEQ ID NO: 392903 - RNA, 64 nt, Human
auauuuuucucaguuauacuagaaaauuucauaauccugggauauauguaccauugucagcuau

SEQ ID NO: 392904 - RNA, 64 nt, Human
ugcgccacuguacuccaguuuggacuacagagugagacuccaucucaaaacaaaacaaaacaac

SEQ ID NO: 392905 - RNA, 64 nt, Human
ucaggaguucgagaccagccugggcaacaaagugagacuccaucucuauauaaaaacaaaaacc

SEQ ID NO: 392906 - RNA, 64 nt, Human
agugccacagcucuccagccugggcgacagagugagacuccaucucaaacaacaacaacaacaa

SEQ ID NO: 392907 - RNA, 64 nt, Human
uuaaagaaauaaaaaagaacuuuuguaucuuuuauccugggagcacugcguuuuccuagcugug

SEQ ID NO: 392908 - RNA, 64 nt, Human
gcaguaugcagucauguggaaccuugcuuucuaguccugggaaaaaaagaugucucuaauuacu

SEQ ID NO: 392909 - RNA, 64 nt, Human
uaaaauggaagcucugguaccuucaauguaugacuccugggagaaucaaggguccaucugagcc

SEQ ID NO: 392910 - RNA, 64 nt, Human
uucugcuugacugacugggccugcagcucccuucuccugggacuuagagguggccagauuuaag

SEQ ID NO: 392911 - RNA, 64 nt, Human
gagucuggauggccacuugagaaguuuugccaacuccugggaaccucgauauucugacauuugg

SEQ ID NO: 392912 - RNA, 64 nt, Human
uugcccuccacacuaagagaaguuggcgucucccuccugggaauuguuuugccuuucuguucau

SEQ ID NO: 392913 - RNA, 64 nt, Human
uuuauccuguuugaauuuugaugucguccaggcguccugggaucaggguagacacguggagugc

SEQ ID NO: 392914 - RNA, 64 nt, Human
ugugugccuugguguggagaccaaccugaggauguccugggaaauguuuuccugaugaauuucu

SEQ ID NO: 392915 - RNA, 64 nt, Human
gagcuagggagcggauguggugggcuggccggacuccugggacaugugggugguggcuugaccc

SEQ ID NO: 392916 - RNA, 64 nt, Human
acagagucgcagcaggaaagagagcucccuggucuccugggaagugugaccucuucuaauggac

SEQ ID NO: 392917 - RNA, 54 nt, Human
aagccaaaaaggauggcuaaaugcuccugggagucaggcgcagccucacaccag

SEQ ID NO: 392918 - RNA, 64 nt, Human
cagggccugccucaagaagcccagcccagccuuuuccugggaugcagugaaaucccauccauga

SEQ ID NO: 392919 - RNA, 64 nt, Human
ccaauggguaacgugguuuacucucccggacgcguccugggaucucaaccccagcagucuggcu

SEQ ID NO: 392920 - RNA, 51 nt, Human
ccacuuuaccacccgccugaauccugggauucuaguaugcaauaagagaug

SEQ ID NO: 392921 - RNA, 64 nt, Human
ccaaccagagggagacccaguagaaagaaaaacauccugggaaauccagcuaccagggcccucc

SEQ ID NO: 392922 - RNA, 64 nt, Human
ugggcaucugugccccugguggccuccaaauccuuccugggauucccccaaacccacacugaug

SEQ ID NO: 392923 - RNA, 64 nt, Human
ugcuuuugcgaggcgauuugacauaggaacuuugagacuccaugagaaagucccuuucugaggc

SEQ ID NO: 392924 - RNA, 64 nt, Human
ugcgccacugcacuccagccugggcaacaaagugagacuccaucucaaaaaaaaaaaaaaaaaa

SEQ ID NO: 392925 - RNA, 64 nt, Human
ucgcacugcuguacccagccugggccacagugcaagacuccaucucaaaaaaaaaagaaaagaa

SEQ ID NO: 392926 - RNA, 64 nt, Human
cguggauaccaggccaugugccaugguauuuggguccugggagggugggugaaauaaaggcaug

SEQ ID NO: 392927 - RNA, 64 nt, Human
gacuccucagaaaaaacaggcccccaugugccucuccugggacaaccagacucuguaacucacc

SEQ ID NO: 392928 - RNA, 64 nt, Human
ggucuacccuuuguuucccaggcuggucuugaauuccugggaucaagcaauccuuccaccuugc

SEQ ID NO: 392929 - RNA, 64 nt, Human
gaggcgcagaccuguggugaggacacccgaggccuccugggagaccugcagaccacgcccaccu

SEQ ID NO: 392930 - RNA, 64 nt, Human
aauucucccgcuccagacccucaccgaccaccuguccugggaccaggcugggaggggagugugg

SEQ ID NO: 392931 - RNA, 64 nt, Human
uaggaauugcagccacugggcaguugggguggcuuccugggagaugagccgcgaccagguccug

SEQ ID NO: 392932 - RNA, 64 nt, Human
gggguggcuuccugggagaugagccgcgaccagguccugggaaggacuauggacucuuguugug

SEQ ID NO: 392933 - RNA, 64 nt, Human
gacauuccaaauaaagaauaggccccugccuggcuccugggagauaaccucuaagccauuagaa

SEQ ID NO: 392934 - RNA, 64 nt, Human
cugccuugcugcaccugaggcccagcagagccguuccugggacugucagauaaucggugcagcg

SEQ ID NO: 392935 - RNA, 64 nt, Human
uaacugcccagcccugccccuugcccccguggcuuccugggacagccgccuucagugcuguauu

SEQ ID NO: 392936 - RNA, 64 nt, Human
ccuacauuccccagagugggauccacuucuugguuccugggauggcgauggggacucugccgcu

SEQ ID NO: 392937 - RNA, 64 nt, Human
acuucagcuagagcuucaagucugugccuggagcuccugggaaggcuacucaccuugaacacca

SEQ ID NO: 392938 - RNA, 64 nt, Human
cuccuguccuuuucuuggcuggaagaaguuggccuccugggaguguaguuuucuguuuuaaauc

SEQ ID NO: 392939 - RNA, 64 nt, Human
uugugcaugagcuacgccugccuccccugugcaguccugggauguggcugcagcagcgguggcc

SEQ ID NO: 392940 - RNA, 54 nt, Human
ggggcuucucucacaacuaggcgguccugggauggggcauguggccaagggcuc

SEQ ID NO: 392941 - RNA, 64 nt, Human
uucccugguccaggcaccacucagcucuggcucuuccugggaggucagccgaggcuccccccau

SEQ ID NO: 392942 - RNA, 64 nt, Human
auugagcuuuugguucuuuuauaaagacuugucuagacuccacugggaagaguccuuugcuuug

SEQ ID NO: 392943 - RNA, 64 nt, Human
uggacauggcaguuguugcuccacccaaaaaaacagacuccaggugaggcugcugucauuucuc

SEQ ID NO: 392944 - RNA, 64 nt, Human
ucgguucgcauuaucaaacccuuuccugcgccccagacuccaggccgccugcagccugccccug

SEQ ID NO: 392945 - RNA, 64 nt, Human
ggcuguugcuuuugaacagaacccuauauuacucuccugggaucugaguuucugcaggucauuu

SEQ ID NO: 392946 - RNA, 64 nt, Human
aacaguauuuaaagcagcauuucucucuuaacguuccugggagacuccaacaaauggagaccag

SEQ ID NO: 392947 - RNA, 64 nt, Human
aggcggcagcucauuguuuacaggcaagcccugcuccugggagggcuccugccaccccacccuu

SEQ ID NO: 392948 - RNA, 64 nt, Human
cccacccgcaugcacagagcaggggcuaggugucuccugggaggcaugaagggggcaagguccg

SEQ ID NO: 392949 - RNA, 64 nt, Human
uucucaaccuugggguaaacugagguauuuugcuuccugggaagaucuucgcaauuuugagugc

SEQ ID NO: 392950 - RNA, 64 nt, Human
gaccugcuauccacugggagaggcuaucagccaguccugggacuuggagacccagcauccuuug

SEQ ID NO: 392951 - RNA, 64 nt, Human
ccugggaggucuguaauuccugucuccuggacucuccugggaaguucccugcucugcagcucug

SEQ ID NO: 392952 - RNA, 64 nt, Human
aaguuuccagagggaggugcuguuaucucguaccuccugggauggcgaucccuacugaacgcuu

SEQ ID NO: 392953 - RNA, 64 nt, Human
gacuuccaggagcgugaaagcaucuuugcucaacuccugggacugaaccauauagacauggaca

SEQ ID NO: 392954 - RNA, 64 nt, Human
uggaaggucuaaauguggcuuuuuuuuuuuuuuuuccugggaauuuuuuuggggaaaagggagg

SEQ ID NO: 392955 - RNA, 64 nt, Human
caggcugcuuugugugagauguaguuuucccaucuccugggaagggaucuuucgagguuccccu

SEQ ID NO: 392956 - RNA, 64 nt, Human
caaaguaugguguagaaauggccuccucccuccauccugggaagucccagucccauccuggugu

SEQ ID NO: 392957 - RNA, 64 nt, Human
ccacccagagggagacccaguagaaagaaaaacauccugggaaauccagcuaccauggcccucc

SEQ ID NO: 392958 - RNA, 64 nt, Human
uucucccugggcucuccuucuugccugcccugucuccugggaucagaggguaguacagaagccc

SEQ ID NO: 392959 - RNA, 64 nt, Human
ccacagcacuacgauguguugaaugcuuaccaaguccugggaauaugcuagugauguacgagcu

SEQ ID NO: 392960 - RNA, 64 nt, Human
cuucccucucuuccccacucccccgccuugggcuuccugggauggcucccaaauaaaccucuug

SEQ ID NO: 392961 - RNA, 64 nt, Human
ucagaaggcucugguaggccuuccucuggccaggagacuccagcagggaaugcccuucacucug

SEQ ID NO: 392962 - RNA, 64 nt, Human
cacgccacugcacuccagccugggugacagagcaagacuccaucucaaaaaaaauaauaauaau

SEQ ID NO: 392963 - RNA, 64 nt, Human
cgugccacugcacaccauccuggaugacagagcaagacuccaucacaaaaaaaaaaaaaaaaaa

SEQ ID NO: 392964 - RNA, 64 nt, Human
guaucuuuuguacgcuuuucaccccacccccaaguccugggagaaaugcaggcaacacugagac

SEQ ID NO: 392965 - RNA, 64 nt, Human
agggugggagauucuccuccaguccugucucaucuccugggagaggcagacgagugaguuucac

SEQ ID NO: 392966 - RNA, 64 nt, Human
uacucuggagauagauggagaaguguuuucagauuccugggaacagacaccagugcuccagcuc

SEQ ID NO: 392967 - RNA, 64 nt, Human
uucccugacucuuggauaugaaacugcccagcauuccugggagucuuaggauuuucuaggaagu

SEQ ID NO: 392968 - RNA, 64 nt, Human
agggcccagaccuguggugaggaccccugaggccuccugggagaucugccaaccacgcccacgu

SEQ ID NO: 392969 - RNA, 60 nt, Human
ugcucaauuaccccaugugagugcguggacuccugggagcuccugcucccuacagugggc

SEQ ID NO: 392970 - RNA, 64 nt, Human
cagggagaccccaucuuauucaccauguccaagauccugggaucugggcccagcaucucuuccu

SEQ ID NO: 392971 - RNA, 64 nt, Human
gcucccgugaaggaaugcacuuugccuuguaaguuccugggaaagggguauguuuucucuccag

SEQ ID NO: 392972 - RNA, 64 nt, Human
gaaaaauuucaacuguaggugccuuugcaaccuauccugggagacccuaaaacauauuuaguuu

SEQ ID NO: 392973 - RNA, 64 nt, Human
agccuugugggagacccaguagaaagaaacagcauccugggaaauccagcuaccauggcccucc

SEQ ID NO: 392974 - RNA, 64 nt, Human
cugccaccaggccaugguuccuugccccaugguguccugggacccagagcaacaggaucuguca

SEQ ID NO: 392975 - RNA, 64 nt, Human
ucaaucuaugcaagcggcucuggccgccaucaucuccugggaugccagagggcugccucuccag

SEQ ID NO: 392976 - RNA, 64 nt, Human
uuuucuacauugcaguuguguuuugugcugagccuccugggaaacucaccugucuugcuccugg

SEQ ID NO: 392977 - RNA, 64 nt, Human
ugagcccugagguugacugccgguuauuuuucuguccugggaacagccugacccaccucccugu

SEQ ID NO: 392978 - RNA, 64 nt, Human
agcuugucccagccacucuagcugcuggaugugauccugggacauguacuccaagccuccguca

SEQ ID NO: 392979 - RNA, 64 nt, Human
uguuuagaccuggauugaauugggcccuguuguuuccugggaucuuggggcugggggugcccaa

SEQ ID NO: 392980 - RNA, 64 nt, Human
aagcaggaagauucuauauccugaugguagagacagacuccaggcagcccuggacuugcuagcc

SEQ ID NO: 392981 - RNA, 64 nt, Human
uauuugacuuuugcuuuaaacugcaagaggaaaaagacuccacugaaauucuaaguuugccaag

SEQ ID NO: 392982 - RNA, 64 nt, Human
ugguuuagguuuuucauuuguugcaagccuacucagacuccaaacacggaacgaauucagacuu

SEQ ID NO: 392983 - RNA, 64 nt, Human
agaugguguuggguuagguuacaucugguuacuguccugggaaaaucauuuuuauagagauggc

SEQ ID NO: 392984 - RNA, 64 nt, Human
uaaaugugugcagggucauccugucuccuguaccuccugggaaaggggccgcugcugucuggug

SEQ ID NO: 392985 - RNA, 64 nt, Human
aagugaacugucucugaagggugaaggcaggccguccugggaugguacccugugcucucccgug

SEQ ID NO: 392986 - RNA, 64 nt, Human
uggggccuggcccuggcucccuccaaccagcugcuccugggacacaggugcuccugcuucggcu

SEQ ID NO: 392987 - RNA, 64 nt, Human
gggcucggcccucagcuacugguacccaauguguuccugggagccgagagacccauggucacuc

SEQ ID NO: 392988 - RNA, 64 nt, Human
ucccugccagagauggcaggggaaagccagugguuccugggaacgcucuuguugcuuggugcaa

SEQ ID NO: 392989 - RNA, 63 nt, Human
uacuaaaacgugaauccuaaaaugagaagcaguuccugggaccagauugaaaugaauucuguu

SEQ ID NO: 392990 - RNA, 64 nt, Human
ggccuccgaaaugcagauaggcgguugagugggguccugggaagagcgcugaaucccucugcuu

SEQ ID NO: 392991 - RNA, 64 nt, Human
uuuuccauuuaaaacuaauuuauaaacuauguacuccugggaagauuugaaaucuuuuagaagu

SEQ ID NO: 392992 - RNA, 64 nt, Human
auuuaccucagguguuugagucuuugcugaagaauccugggaugaagacuucauugggcaugaa

SEQ ID NO: 392993 - RNA, 64 nt, Human
uauccuucacuuuuuuuuuuucauuucuggauuuuccugggauuucugacaacacaaaaguaga

SEQ ID NO: 392994 - RNA, 64 nt, Human
ggaggggugcuguggagcugucuugcccaggcccuccugggagggggacaggcauuguugccag

SEQ ID NO: 392995 - RNA, 64 nt, Human
ggccaggcuacggacuugcggacgagccccccaguccugggagccggccgcccucggucuggug

SEQ ID NO: 392996 - RNA, 64 nt, Human
cagugcacaacccacaguggccuucagaggcuccuccugggacugggaaccgccgcagggccag

SEQ ID NO: 392997 - RNA, 64 nt, Human
cugccagggccaaguccuucucccgaacccaggguccugggaacugcagaucccggggggauuc

SEQ ID NO: 392998 - RNA, 64 nt, Human
cuguuccugcuguauuauacaaacuguaccauaguccugggaaaaggguggacucaccgcuguu

SEQ ID NO: 392999 - RNA, 64 nt, Human
ucaagaugagaccaaagaaucuggcaaacaucacagacuccaagguauuacuaaauguaucccc

SEQ ID NO: 393000 - RNA, 64 nt, Human
ucaguaaucugaguuuuugauggccuuuuaaacaagacuccaguaugugaaaguuaauugcugu

SEQ ID NO: 393001 - RNA, 64 nt, Human
ucuugacaggacaucucaagucuuuuaaccauuaagacuccauuugugccucuuggauccaagc

SEQ ID NO: 393002 - RNA, 64 nt, Human
cugaggagcgacugcuaaucaggaugggguuuccuccugggauggugaaaauguuccggaccua

SEQ ID NO: 393003 - RNA, 64 nt, Human
uaagcauacuuucuuaagacggaggccauuugguuccugggagaauaggcagccccacacuuug

SEQ ID NO: 393004 - RNA, 64 nt, Human
gucgaacagggucccuucccccacuucacguccuuccugggaccucagaaugugaccuuauuug

SEQ ID NO: 393005 - RNA, 64 nt, Human
ccucuccucuccugccgagaguggaacacgcguguccugggagcugcaucuuguguagggucca

SEQ ID NO: 393006 - RNA, 64 nt, Human
ugcacugcguggcugcccagccagcugccuccuguccugggaggaggccuccuggguguccuca

SEQ ID NO: 393007 - RNA, 64 nt, Human
ugaaagccagagauuccuggcgcaggcuuggacuuccugggagcuccuccaaguacccaggggc

SEQ ID NO: 393008 - RNA, 64 nt, Human
ugcuuccuuccugauugucucuagagcuuccaaguccugggaaugugcggggccagucccugcc

SEQ ID NO: 393009 - RNA, 64 nt, Human
cgauggacgcaaucuuaagccacccuggccuugcuccugggaggugagcgugcacaggugugug

SEQ ID NO: 393010 - RNA, 64 nt, Human
ggcuuuagcauaaauuucuagcugcaucugagucuccugggaugggugcucuuuggcugguuuu

SEQ ID NO: 393011 - RNA, 64 nt, Human
ugcucccgggcauccuccugucccuggcuccucauccugggagcaacagggcucugaggacgug

SEQ ID NO: 393012 - RNA, 64 nt, Human
cugcaccccagacccagggccucaggccuccagcuccugggauccgggaguccaucccggccca

SEQ ID NO: 393013 - RNA, 64 nt, Human
acuggccaucuccacccccagcugcuugugucccuccugggaucugcucgucaucauuuuuccu

SEQ ID NO: 393014 - RNA, 64 nt, Human
ucccaggacaggcuccuuaaagcagaggagccuguccugggagccccuucucaaacuccuaaga

SEQ ID NO: 393015 - RNA, 64 nt, Human
cagacucacgugugacaucuuuccaauggaagaguccugggaucuccaacuugccauaauggau

SEQ ID NO: 393016 - RNA, 64 nt, Human
ggcaccccagacccucuucagcuacagccacagguccugggaaagaagugggaucuagggcccu

SEQ ID NO: 393017 - RNA, 64 nt, Human
ggcugacaguggauauucuuguacccuucuuggguccugggaucucuugaaauccccaauaaag

SEQ ID NO: 393018 - RNA, 64 nt, Human
uuuuuugagaggugaaaaaaagagaaaacaaguuagacuccaaaggugaauuccuggucuuggc

SEQ ID NO: 393019 - RNA, 64 nt, Human
caugccauugcacuccaaccugggugacagagugagacuccaucucaaaaaaaaaaaaaaagag

SEQ ID NO: 393020 - RNA, 64 nt, Human
uuucuagaaugaacucacagagaugugcuggcuuagacuccaaaaggauuauaaaacucccaaa

SEQ ID NO: 393021 - RNA, 64 nt, Human
uuccccucacugcccaggucgaucaaguggcuuuuccugggaccugcccagcuuugagaaucuc

SEQ ID NO: 393022 - RNA, 64 nt, Human
accuccccuucuuuuggacugcgaccuccuucccuccugggagagcccugugaccugcaugcua

SEQ ID NO: 393023 - RNA, 64 nt, Human
accccuuuccuccacagggagaggcuccucccucuccugggacagcucacagguccuagugauu

SEQ ID NO: 393024 - RNA, 64 nt, Human
ccccaagguagcaagauggagggauggggcucucuccugggaugggggcagguguuccugaaua

SEQ ID NO: 393025 - RNA, 64 nt, Human
uguggauuuacuuuuuuuuuuuuuuuuuaaguuuuccugggauagggaugauaguguaauuguu

SEQ ID NO: 393026 - RNA, 64 nt, Human
gggaugauaguguaauuguucaugcccacaguaauccugggaaucuuaguuuuuuccuaugauu

SEQ ID NO: 393027 - RNA, 64 nt, Human
aauugugcaaucucagcucacugcaaccuccgccuccugggaucaagugauucuccugccacag

SEQ ID NO: 393028 - RNA, 64 nt, Human
gccggaggagcugagcugguaucugcugggggcuuccugggaagguuuaccauuuucauggaaa

SEQ ID NO: 393029 - RNA, 64 nt, Human
gauucacccagcgcgaggaggaagaaacagcaguuccugggaaccacaauuauggggggugggg

SEQ ID NO: 393030 - RNA, 64 nt, Human
aaggagucacgcuggcauaucaggaagauguccuuccugggaagaagaagcuccagccaguucu

SEQ ID NO: 393031 - RNA, 64 nt, Human
acauucagcugacuguauccagggcuuccuggacuccugggaccccacguccugcaccccggcu

SEQ ID NO: 393032 - RNA, 64 nt, Human
cccugggccgcgugccgggcccccaccgccgggguccugggaggcugcagccaggccucgccug

SEQ ID NO: 393033 - RNA, 64 nt, Human
gggucccugcucuguugcccgagagcagucugcauccugggaccagaaugcuuuccuggaaaaa

SEQ ID NO: 393034 - RNA, 64 nt, Human
uccugcucacucagucccgggcucugccgagugguccugggaauggcggcgggcccguccagcg

SEQ ID NO: 393035 - RNA, 64 nt, Human
agguagugacuugugaugugagcugagaccucuguccugggaagaccaaaagaaaagcauuuca

SEQ ID NO: 393036 - RNA, 64 nt, Human
gagaaacaaccauaggggcagaucccuucaucuguccugggaauguccucccaagacuggaguc

SEQ ID NO: 393037 - RNA, 64 nt, Human
ugcaccacugcacuccagccugggugacagagcaagacuccaucucaguaaauaaauaaauaaa

SEQ ID NO: 393038 - RNA, 64 nt, Human
cauaguaucacauacuauuauuuaguuguuuacaagacuccaauuugaauucaggauuacagug

SEQ ID NO: 393039 - RNA, 64 nt, Human
cacugacuucuaaguaaaaccacagcaguugaaaagacuccaaagaaauguaagggaaacugcc

SEQ ID NO: 393040 - RNA, 64 nt, Human
cauaaagucucgcaucuacaggccuuugauuaccuccugggaugggugcucacuaucuacccca

SEQ ID NO: 393041 - RNA, 64 nt, Human
ccaugccuggacccagacugaauccccacacccuuccugggaaacagauacggugaggagaaac

SEQ ID NO: 393042 - RNA, 62 nt, Human
gagaccccaaucagauuuuucaaauuaaagccaguccugggaaaucucaaauccgugugcug

SEQ ID NO: 393043 - RNA, 64 nt, Human
auugaucccaccuccaagucuccgggccaccuucuccugggaggacgaccaucucuaccccuag

SEQ ID NO: 393044 - RNA, 64 nt, Human
uccaccagucucgccucuggccuucucuggccacuccugggagggacugccucaccaccccugu

SEQ ID NO: 393045 - RNA, 64 nt, Human
gccucuauuccaaaaagaugcuucaucagauccuuccugggagccucacauucaagggucugac

SEQ ID NO: 393046 - RNA, 64 nt, Human
cgggccugggaugggccaccacaccacuggauauuccugggagucacugcugacaccaucucuc

SEQ ID NO: 393047 - RNA, 64 nt, Human
ccuggccucaggccccuggugcuucccccccuccuccugggagggggcccgugaagagcaaaug

SEQ ID NO: 393048 - RNA, 64 nt, Human
cuggucuccuuuuccccccagacucggccuccucuccugggacucggccucccuucuccgcccc

SEQ ID NO: 393049 - RNA, 64 nt, Human
cauccacaauguggggucggagcuugggggcagguccugggagugggaagccucuuccuugugu

SEQ ID NO: 393050 - RNA, 64 nt, Human
ccagccuggaccccuaacaaagaccaccaggacauccugggaacucugggacucacuagauucu

SEQ ID NO: 393051 - RNA, 64 nt, Human
auaucaacuggaccccaaaucugucucacggucuuccugggagucuauccuucugcugaaacug

SEQ ID NO: 393052 - RNA, 64 nt, Human
gcuccgggcaaaagcgggggcgaguguagagcgauccugggaaauccuuugauccgggagcccu

SEQ ID NO: 393053 - RNA, 64 nt, Human
gggacaggaucccugcugcaccuuccccacccccuccugggaagugcccccucaccucagggca

SEQ ID NO: 393054 - RNA, 64 nt, Human
aagccacgauguucauccaggccaaagcaggguguccugggauagguuuccuaggcaggggcgu

SEQ ID NO: 393055 - RNA, 64 nt, Human
cuauuaaagauucaugcagucccaaaaggcacuguccugggaugaugagagauuauaaggugau

SEQ ID NO: 393056 - RNA, 64 nt, Human
cgcaucauugcacugcagucugagugacagagugagacuccaucucauuaaaaaaaacgaaaac

SEQ ID NO: 393057 - RNA, 64 nt, Human
aacaagccuacauuuuaacuggaaaucuacuugaagacuccagcacuacauguuaugaagcugu

SEQ ID NO: 393058 - RNA, 64 nt, Human
uaugccaccccagguggggagggagggagguuucagacuccaguuucucccuugcccuuuuauu

SEQ ID NO: 393059 - RNA, 64 nt, Human
accaccugucacagcaauaccugggaccaugcucuccugggacugugaggcuccuuuugacgua

SEQ ID NO: 393060 - RNA, 64 nt, Human
cucugugugccccccaggaggaagaggcccugaguccugggaucagacaccccuucacguguau

SEQ ID NO: 393061 - RNA, 64 nt, Human
ugggcgggcagggagagggucuuggggacagcccuccugggaaucuacauuguguucccccgca

SEQ ID NO: 393062 - RNA, 64 nt, Human
gcaagagccccuuccaaagcucagcacaguuuccuccugggaugaggagaggaaucagaaaccc

SEQ ID NO: 393063 - RNA, 64 nt, Human
agguauuuaaaauaauaauaauaaaguguuauuuuccugggauucaugauauuugauauauucg

SEQ ID NO: 393064 - RNA, 64 nt, Human
gcuggguagugcuggccaucccaaaagggcucuguccugggagucuggugugucuccuacaugc

SEQ ID NO: 393065 - RNA, 64 nt, Human
gcuucccacagccccaacgcagucuguguaugauuccugggauccaacgagcccuccuauuuuc

SEQ ID NO: 393066 - RNA, 64 nt, Human
aaaauucccaguuuugccacucucuggagccagauccugggagcugucagcaaggagcagguaa

SEQ ID NO: 393067 - RNA, 64 nt, Human
gcugccuuagauuccgugggucaugagccaugaguccugggacaucugaggauugggauucuuu

SEQ ID NO: 393068 - RNA, 64 nt, Human
gccgucauccccauuucaaagcagggagcugagguccugggaggggaaagugcuugccugaggu

SEQ ID NO: 393069 - RNA, 64 nt, Human
agacgcccccuuuacccaggaggucuucagaguuuccugggaccgcgguggguggaaucccaag

SEQ ID NO: 393070 - RNA, 64 nt, Human
aucaaagaugaguccuggagggaaggaggaugaguccugggaggaaguaccauagcauuguacu

SEQ ID NO: 393071 - RNA, 64 nt, Human
acuucccugcaacccauccaccccugguuucuccuccugggagucaaaguccauagccugagcu

SEQ ID NO: 393072 - RNA, 64 nt, Human
gaaccaacaaagaccuauccugguggagcugaccuccugggaaaagagucaauaaacaaauaaa

SEQ ID NO: 393073 - RNA, 64 nt, Human
aaagcugucugcaagacuuauucugaauuucauuuccugggauuacugaauuaguuacagaugu

SEQ ID NO: 393074 - RNA, 64 nt, Human
gaugaagaagaaaacaugucugugaacuugauguuccugggauguuuaaucaagagagacaaaa

SEQ ID NO: 393075 - RNA, 64 nt, Human
gcuucugucacagcacugaucacacugagauggaagacuccagggggcaaggaccaagggccau

SEQ ID NO: 393076 - RNA, 64 nt, Human
uuggaaagauauaauuugagcaguggcuuuaugcagacuccaagaacaaaaccaccagguauuu

SEQ ID NO: 393077 - RNA, 64 nt, Human
ccuuaaaauuacauccuucacuguguggaccuagagacuccaacuugaauuccuaguaacuuuc

SEQ ID NO: 393078 - RNA, 64 nt, Human
ccuguguuuggucugcccuggaggugcugggcccuccugggauggguggcucagccucgaaucc

SEQ ID NO: 393079 - RNA, 64 nt, Human
agucucugggcccugggaagagggaaggugcacguccugggaugguugcggggcccuguuuugg

SEQ ID NO: 393080 - RNA, 64 nt, Human
gguggguagggggcugcuugaguguggccccaccuccugggaccugagcccaagcccuccccug

SEQ ID NO: 393081 - RNA, 64 nt, Human
acaccauuuuuugaagagcaaaacuuauaauaccuccugggauugugagcuagucauucagccu

SEQ ID NO: 393082 - RNA, 64 nt, Human
uuugaaagagaguaagaugcauuaacagaaacuauccugggauuaggugaaaaaugucuagcaa

SEQ ID NO: 393083 - RNA, 64 nt, Human
cccgaaacugucucguaaugaauuucugcuguccuccugggaguggacggccgggucccguccc

SEQ ID NO: 393084 - RNA, 64 nt, Human
caagcuggagaagaacgaggaggcggcccugcuauccugggagaucuaccugaaggagaacuac

SEQ ID NO: 393085 - RNA, 64 nt, Human
uggugcaggucuccaccugcacauuggguggggcuccugggagggagacucagccuuccuccuc

SEQ ID NO: 393086 - RNA, 64 nt, Human
ccuccgcgcagcaggaggcugccuguguguuuccuccugggaugcgugcaaggcagaccuggug

SEQ ID NO: 393087 - RNA, 64 nt, Human
guccucaguucccguccacccuucaaccaguggcuccugggagacuuuuccucccugccucagc

SEQ ID NO: 393088 - RNA, 64 nt, Human
uuuggaaagcugaaagggaaggacagcugugcccuccugggagcucaugugucccuggcgcugu

SEQ ID NO: 393089 - RNA, 64 nt, Human
cagugcugccuugguuccuggaccccugggcccauccugggaccccagaugggguaaggagagg

SEQ ID NO: 393090 - RNA, 64 nt, Human
uugcuuuggcuaaauuuugacacccugggggauguccugggagaaugccaguacuuugaaauag

SEQ ID NO: 393091 - RNA, 64 nt, Human
ggcagccaguccagcucuugcuuccucuggcccguccugggaaggggggugucuagagcccagg

SEQ ID NO: 393092 - RNA, 64 nt, Human
uaaggagcacucacucuuccuaccauccaggggcuccugggaaauuaaggagggauuugcacag

SEQ ID NO: 393093 - RNA, 64 nt, Human
uuugauuacuaaugauugucagugacucagagcuuccugggacuucggguacccacccgcuguu

SEQ ID NO: 393094 - RNA, 64 nt, Human
cgugccauuacacuccagccugggcgaaagggugagacuccaucucaaaaaaaaaaaaaaugau

SEQ ID NO: 393095 - RNA, 64 nt, Human
acucauuagcucuaggaccagucacuaaucucugagacuccauuuucuccagggaaacgaggcu

SEQ ID NO: 393096 - RNA, 64 nt, Human
cacaacuauuaccugcaucugaaaaaaaaucuauagacuccagcugcuacauuagagcauaaga

SEQ ID NO: 393097 - RNA, 60 nt, Human
acaucaugccgggacugugacagcaaagaauccugggacagaaaccuuauccuacaccau

SEQ ID NO: 393098 - RNA, 64 nt, Human
cagaggggugaggauugcugcgucauauggagccuccugggacaagccucaggaugaaaaggac

SEQ ID NO: 393099 - RNA, 64 nt, Human
ggcuaggggucaggggucagagauucuguccugcuccugggaugcacuggcuacucccuuaguc

SEQ ID NO: 393100 - RNA, 64 nt, Human
ggugggggcugaccccugccuuugauugucauucuccugggaagcccagucucagucccucccc

SEQ ID NO: 393101 - RNA, 64 nt, Human
gugaaggcuggacgguggaggaccugcuggggucuccugggacccgccuguugcuucugcccuc

SEQ ID NO: 393102 - RNA, 64 nt, Human
aaguuggggguggucuggggguaaggcuggggcuuccugggaaaaggaaggccaugagaaggca

SEQ ID NO: 393103 - RNA, 64 nt, Human
cccaccccgagaacccucagcucucaaaggucacuccugggaguuucuucuucccaauggaagu

SEQ ID NO: 393104 - RNA, 64 nt, Human
uccuucccucugugcccguggcgucugcuucccauccugggaguguguauauauguagcauauc

SEQ ID NO: 393105 - RNA, 64 nt, Human
gucccccuuucuccagggcugccuuccccuugcauccugggagccccacugcccugccaucccc

SEQ ID NO: 393106 - RNA, 64 nt, Human
cgucauucugcauaggucggguuggauguuagacuccugggaugcccuccucccccucgcccuu

SEQ ID NO: 393107 - RNA, 64 nt, Human
ucccuggacacuuggcccggcaauaguuggggucuccugggaagcugagugcuggcuucuagcc

SEQ ID NO: 393108 - RNA, 64 nt, Human
accucccugcagcuuugaggcuggcggggucugcuccugggaauggggugggagccacagggac

SEQ ID NO: 393109 - RNA, 64 nt, Human
ugugaagaaaucauuucucuaugcaagacuggcauccugggacugcacgaugaacuauuggagc

SEQ ID NO: 393110 - RNA, 64 nt, Human
caguuggucaucaacuauuuucccuugacugcuguccugggauggccugcuaucuugaugauag

SEQ ID NO: 393111 - RNA, 64 nt, Human
aaugguggccggagaugggagggcccaaggaaccuccugggagggggccugcauucuauguugg

SEQ ID NO: 393112 - RNA, 64 nt, Human
ggccagggagccuuuagugccagcagggccuguguccugggaugugaugcuagugagugaaugg

SEQ ID NO: 393113 - RNA, 64 nt, Human
ugcgccacugcacuccagccuggguaacagagcaagacuccaucucaaaaaaagaaagaaagaa

SEQ ID NO: 393114 - RNA, 64 nt, Human
ccaauaucucaccacuguacuccagcccagugcgagacuccaucucaaaaaagaaaaaagaccu

SEQ ID NO: 393115 - RNA, 64 nt, Human
ccguggggucugaguucagggguguggagggagcagacuccaccggcccaggcccagcuaagag

SEQ ID NO: 393116 - RNA, 52 nt, Human
uugagauucugaguguguagaauccugggaacucaacuugaaggucugucuu

SEQ ID NO: 393117 - RNA, 64 nt, Human
gcuuugagaagcucagcugccuuccuggggcugguccugggagccacugggagggggacccgug

SEQ ID NO: 393118 - RNA, 64 nt, Human
auuguuuccugaauucaugcagaugccuggccauuccugggaagaguggauaacucagaaguca

SEQ ID NO: 393119 - RNA, 64 nt, Human
ccacuuagagcgcagccugaguuuccaggccccuuccugggagaggcuguuaacacgggggagg

SEQ ID NO: 393120 - RNA, 64 nt, Human
gaauuuacuuuggaaaguagaaaagcccagcuuuuccugggacaucuucuguuauuguugaugu

SEQ ID NO: 393121 - RNA, 64 nt, Human
acuuuuuaaauucaguacugauugguucagcauauccugggacauaaaaauacucacuacuggg

SEQ ID NO: 393122 - RNA, 64 nt, Human
cuacucgggaggcugaggcaggagaaucgcuugauccugggaguuggagguugcagugagccaa

SEQ ID NO: 393123 - RNA, 64 nt, Human
aacauguagggcaagaggaugaaggaaggggcuauccugggaccuccccagcccaggaaaaacu

SEQ ID NO: 393124 - RNA, 64 nt, Human
gacccuguccccuagggacuguccuagccaggucuccugggaaagggagaugucaggauguugc

SEQ ID NO: 393125 - RNA, 64 nt, Human
aagaucauuguuccauccucuacuucuggugcaguccugggacaaggacaagggaaagggaugg

SEQ ID NO: 393126 - RNA, 64 nt, Human
uccaaacacaugguuuuccuugcugcaaggcucuuccugggaacuaaggggguauuuauuaguu

SEQ ID NO: 393127 - RNA, 64 nt, Human
uucccuagggcaggaauucccacaguugcuacuuuccugggagggccucauguuuuaucugguu

SEQ ID NO: 393128 - RNA, 64 nt, Human
guccagcccgggccucuccaaggcugcccgugcguccugggacccuggagaaggguaaaccccc

SEQ ID NO: 393129 - RNA, 64 nt, Human
ccacuuauugcacuccagcccgggcgacagagcgagacuccaucuaccagauccuuaugacgca

SEQ ID NO: 393130 - RNA, 64 nt, Human
uuccaggcuccucccugugucuuugcuguucuucagacuccauuuauagagaaugagggcugau

SEQ ID NO: 393131 - RNA, 64 nt, Human
cgugccauugcacuccagccugggugacagagcgagacuccaucucaaaaaaaaaaaaaagccu

SEQ ID NO: 393132 - RNA, 64 nt, Human
cugcuucaaguuuugggguaaagacaccuggaucagacuccaagggcugcccugagucugggac

SEQ ID NO: 393133 - RNA, 64 nt, Human
cagccaagcagaggaagaagcugccgaaggggacagacuccacugccagacggccagccguuug

SEQ ID NO: 393134 - RNA, 64 nt, Human
uuugccaauguucucuucuauugcaaguucagccagacuccaugacucaucugaucccuuuuau

SEQ ID NO: 393135 - RNA, 64 nt, Human
cgcgccacugcacuccagccugggcgacagagcgagacuccaucucaaaaaaaaaaaaaaaaaa

SEQ ID NO: 393136 - RNA, 50 nt, Human
caaaauccuuuauaauuuaaagacuccacuuuagagauacaccaaagcca

SEQ ID NO: 393137 - RNA, 64 nt, Human
acggaaaaggauaauugagccccaggacauucugagacuccaaagucuuucuuaaaauguuuag

SEQ ID NO: 393138 - RNA, 64 nt, Human
agcggcacugcacuccagccugggugacaaagugagacuccaucucaaaaaaaaaaaaaaaaaa

SEQ ID NO: 393139 - RNA, 64 nt, Human
ccugcuaaguguguaggagccagugagcgaaucaagacuccacgaccugccagcuguuuccagg

SEQ ID NO: 393140 - RNA, 64 nt, Human
guuuguuuguuuguuuguuuguuuguuuguuuugagacuccagucugggugucagaaugagacc

SEQ ID NO: 393141 - RNA, 64 nt, Human
aucgccacugcacuccagccugggugacagagcgagacuccaucucaaaaaaaaaaaaaaaaag

SEQ ID NO: 393142 - RNA, 64 nt, Human
ggauucaacguugcuggggagagaaaagcaguauagacuccaccuuccaggauguccauuucgg

SEQ ID NO: 393143 - RNA, 64 nt, Human
ugcgcuacugcacuccagccugggcgacaguaccagacuccaucucaaaaaaaaaaaaaccaga

SEQ ID NO: 393144 - RNA, 64 nt, Human
gugggcucugcccacgccgggccccaaagugaccagacuccagcacaccugucuccuccugccu

SEQ ID NO: 393145 - RNA, 64 nt, Human
gccaacccuggagcccagaccgagguggccauggagacuccaccuggauccccuguaggaggcc

SEQ ID NO: 393146 - RNA, 64 nt, Human
ccccacucccuacaucagaaugcaucccgcauccagacuccagcgguggugcucuaccugcacg

SEQ ID NO: 393147 - RNA, 64 nt, Human
augggcugugggagaguugaccguauucugggcaagacuccaugaccccucugauucugcagug

SEQ ID NO: 393148 - RNA, 64 nt, Human
cacgccauugcacuccagccugggcaacagagcaagacuccaucucaaaaaaauaauaauaauc

SEQ ID NO: 393149 - RNA, 64 nt, Human
cacaggcuguuucccaaugucaaguuauuaggguagacuccaggaggugggauucuucaacuaa

SEQ ID NO: 393150 - RNA, 64 nt, Human
gcgccacugcacuccagccugggcaaacagagggagacuccaucgccccccccaacaaaaaaaa

SEQ ID NO: 393151 - RNA, 64 nt, Human
aaacuuuccucagugcuccaugauacuuuuuuugagacuccauaucauugcuuauuuuaccuuu

SEQ ID NO: 393152 - RNA, 64 nt, Human
aucgcgccacuguacuccagccugggcaacagcgagacuccaucucaaaaaaaaaggaaaugug

SEQ ID NO: 393153 - RNA, 64 nt, Human
uuaaaaucuaauucauuuucucuuuaguguuaguagacuccaacaacagaaguggcaucugugu

SEQ ID NO: 393154 - RNA, 64 nt, Human
uuuccuuuuccgugggagggaggcauucaucuacagacuccaacaaggccuccagcggagacau

SEQ ID NO: 393155 - RNA, 64 nt, Human
auccuugcacuaccagaagauucauacacuuuugagacuccagugagacgcuguuuucaccccu

SEQ ID NO: 393156 - RNA, 64 nt, Human
ucacaccacugcacuccagccuggcaacagagcgagacuccaucucaaaaaaaaaaaaaaaagu

SEQ ID NO: 393157 - RNA, 64 nt, Human; identical to SEQ ID NO: 200951

SEQ ID NO: 393158 - RNA, 64 nt, Human; identical to SEQ ID NO: 200952

SEQ ID NO: 393159 - RNA, 64 nt, Human; identical to SEQ ID NO: 200953

SEQ ID NO: 393160 - RNA, 64 nt, Human; identical to SEQ ID NO: 200969

SEQ ID NO: 393161 - RNA, 64 nt, Human; identical to SEQ ID NO: 200970

SEQ ID NO: 393162 - RNA, 64 nt, Human; identical to SEQ ID NO: 200971

SEQ ID NO: 393163 - RNA, 64 nt, Human; identical to SEQ ID NO: 200987

SEQ ID NO: 393164 - RNA, 64 nt, Human; identical to SEQ ID NO: 200988

SEQ ID NO: 393165 - RNA, 64 nt, Human; identical to SEQ ID NO: 200989

SEQ ID NO: 393166 - RNA, 51 nt, Human; identical to SEQ ID NO: 200995

SEQ ID NO: 393167 - RNA, 64 nt, Human; identical to SEQ ID NO: 200996

SEQ ID NO: 393168 - RNA, 64 nt, Human; identical to SEQ ID NO: 200997

SEQ ID NO: 393169 - RNA, 64 nt, Human; identical to SEQ ID NO: 200998

SEQ ID NO: 393170 - RNA, 64 nt, Human; identical to SEQ ID NO: 200999

SEQ ID NO: 393171 - RNA, 54 nt, Human; identical to SEQ ID NO: 201000

SEQ ID NO: 393172 - RNA, 64 nt, Human; identical to SEQ ID NO: 201001

SEQ ID NO: 393173 - RNA, 64 nt, Human; identical to SEQ ID NO: 201002

SEQ ID NO: 393174 - RNA, 51 nt, Human; identical to SEQ ID NO: 201003

SEQ ID NO: 393175 - RNA, 64 nt, Human; identical to SEQ ID NO: 201004

SEQ ID NO: 393176 - RNA, 64 nt, Human; identical to SEQ ID NO: 201005

SEQ ID NO: 393177 - RNA, 64 nt, Human; identical to SEQ ID NO: 201006

SEQ ID NO: 393178 - RNA, 64 nt, Human; identical to SEQ ID NO: 201007

SEQ ID NO: 393179 - RNA, 64 nt, Human; identical to SEQ ID NO: 201008

SEQ ID NO: 393180 - RNA, 64 nt, Human; identical to SEQ ID NO: 201009

SEQ ID NO: 393181 - RNA, 64 nt, Human; identical to SEQ ID NO: 201010

SEQ ID NO: 393182 - RNA, 64 nt, Human; identical to SEQ ID NO: 201011

SEQ ID NO: 393183 - RNA, 64 nt, Human; identical to SEQ ID NO: 201012

SEQ ID NO: 393184 - RNA, 64 nt, Human; identical to SEQ ID NO: 201013

SEQ ID NO: 393185 - RNA, 64 nt, Human; identical to SEQ ID NO: 201014

SEQ ID NO: 393186 - RNA, 64 nt, Human; identical to SEQ ID NO: 201015

SEQ ID NO: 393187 - RNA, 64 nt, Human; identical to SEQ ID NO: 201016

SEQ ID NO: 393188 - RNA, 64 nt, Human; identical to SEQ ID NO: 201017

SEQ ID NO: 393189 - RNA, 64 nt, Human; identical to SEQ ID NO: 201018

SEQ ID NO: 393190 - RNA, 64 nt, Human; identical to SEQ ID NO: 201019

SEQ ID NO: 393191 - RNA, 64 nt, Human; identical to SEQ ID NO: 201020

SEQ ID NO: 393192 - RNA, 64 nt, Human; identical to SEQ ID NO: 201021

SEQ ID NO: 393193 - RNA, 64 nt, Human; identical to SEQ ID NO: 201022

SEQ ID NO: 393194 - RNA, 63 nt, Human
acaaaucgcucuagcucagaaguugcagagcagccugggcaacauggugaaacccgucucuac

SEQ ID NO: 393195 - RNA, 63 nt, Human
ccucccugggauauguaugccucgcccgcccucccugggcacaugugcacacgugcccaggca

SEQ ID NO: 393196 - RNA, 63 nt, Human
ccagugagccaagguugugccacugcacuccagccugggcaaaaaagcaaaacuccaucucaa

SEQ ID NO: 393197 - RNA, 63 nt, Human
gggcacugccgagaacagcauuggucccagagcccugggcaucagaccuuaaccaccaggccc

SEQ ID NO: 393198 - RNA, 63 nt, Human
ggcccaggcaggccaccauauucagugcuguggccugggcaagauaacgcacuucuaacuaga

SEQ ID NO: 393199 - RNA, 63 nt, Human
caaaucagaaauccacauaaaagugcucuccugccugggcagcaacaaccaagaacaaagccc

SEQ ID NO: 393200 - RNA, 63 nt, Human
agguugcagugagauugcaccauugcauuccagccugggcaacaagagggaaacuccgucuca

SEQ ID NO: 393201 - RNA, 63 nt, Human
gccgugaguugagauuggaccacugcucuccagccugggcaacagaguaaaacucugucccaa

SEQ ID NO: 393202 - RNA, 63 nt, Human
gcccucccucagcggagggguuugggagucaggccugggcaggacccugcugacucguggcgc

SEQ ID NO: 393203 - RNA, 63 nt, Human
ccgggguccccuugcugcugugggcucccugucccugggcaggagugcuggugaggaggugga

SEQ ID NO: 393204 - RNA, 63 nt, Human
ugagauguccaaacacccagggcugcugcucauccugggcaagcugauccugcugcaccacaa

SEQ ID NO: 393205 - RNA, 63 nt, Human
ccaggcacccacagccucagcuccugugcaguuccugggcagcacaguggaagugggagccug

SEQ ID NO: 393206 - RNA, 63 nt, Human
uccccagccccugcuacuggcuggacccucugcccugggcaggaggucaggggauucuguuuu

SEQ ID NO: 393207 - RNA, 63 nt, Human
ucgguacgucugagcccaagaguucaagaucagccugggcaguauagcaagaccccaucucca

SEQ ID NO: 393208 - RNA, 63 nt, Human
cugagugccuggcucgcaccucucgagcugugcccugggcaucacugagcagaggggugcggc

SEQ ID NO: 393209 - RNA, 63 nt, Human
gguucccaugcuuuguaggugucucauagcuauccugggcauccuucuuucuaguucagcugc

SEQ ID NO: 393210 - RNA, 63 nt, Human
cguugccacaccaaucagagagccuagaacaucccugggcaaguggauggcccagcaggcagg

SEQ ID NO: 393211 - RNA, 63 nt, Human
gaaguuucagaacccacuuuggggggccuccugccugggcaggcucuucaaguguggcccucu

SEQ ID NO: 393212 - RNA, 63 nt, Human
ucuacugggggaugagagaaaggcauuuuauagccugggcauaagugaaaucagcagagccuc

SEQ ID NO: 393213 - RNA, 63 nt, Human
uugagcacaggaguuugaggcugcagugagcagccugggcaagagagugagacuccguuuugu

SEQ ID NO: 393214 - RNA, 63 nt, Human
aauggggucccagauggcucaggcugugaccucccugggcaccacccuccccaggcugggugu

SEQ ID NO: 393215 - RNA, 63 nt, Human
gcacugagcugagauugugccacugcacuccagccugggcaacaagagcaaaacucugucugg

SEQ ID NO: 393216 - RNA, 63 nt, Human
uccccaauggaggccccuggcauaggggacagcccugggcaucuuccuuuggugucuggcugu

SEQ ID NO: 393217 - RNA, 63 nt, Human
uuaaauuuuucuguauauagaaaggaaaacuagccugggcaacaugaugaaaccccaucucca

SEQ ID NO: 393218 - RNA, 63 nt, Human
uucaggaacaaaaccagcuugcuuuguugcacgccugggcaauuucagccaggacauuaggac

SEQ ID NO: 393219 - RNA, 63 nt, Human
ggggggcuggccccucuagccuuuccgguccuuccugggcaaaucuaagccuuggccagggcc

SEQ ID NO: 393220 - RNA, 63 nt, Human
cccacauguaucccucggucugaauuagacauuccugggcacaggcucuugggugcauugcuc

SEQ ID NO: 393221 - RNA, 63 nt, Human
gaggauggcuugaagccaguaguucaagaccagccugggcaacauaguaagaccccaucucua

SEQ ID NO: 393222 - RNA, 63 nt, Human
gcagugagcugugauugugccacuguuuuccagccugggcaauacagugagacccugucucaa

SEQ ID NO: 393223 - RNA, 63 nt, Human
gagaauugcuugaguccaggaguuugagaugcgccugggcaacauagaaaccugugucuacaa

SEQ ID NO: 393224 - RNA, 63 nt, Human
gcagugagcugagaucgcaccauuacacuccagccugggcaacagagccagacucugucucaa

SEQ ID NO: 393225 - RNA, 63 nt, Human
gaggaucacuugaguccagaaguuugagaucagccugggcaaugugauaaaaccccaucucua

SEQ ID NO: 393226 - RNA, 63 nt, Human
ccaugggaauccuguccugccucgaaggagcagccugggcagccaucacaccacgaggacagg

SEQ ID NO: 393227 - RNA, 63 nt, Human
ccuguccaaggaccuucccucuucuccccaguuccugggcaaucacuucaccuuggacaaagg

SEQ ID NO: 393228 - RNA, 63 nt, Human
agcccuuauaccuuggcauggagucccaaaggcccugggcacaggcagagagcccaccggcug

SEQ ID NO: 393229 - RNA, 63 nt, Human
cccugcaacuccuauuaguaucgccugguugggccugggcaaugggaaggagccagaaaugcc

SEQ ID NO: 393230 - RNA, 63 nt, Human
gcagugagccgagagugcaccauugcacuccagccugggcaaaaagagcaaaacuccgucuaa

SEQ ID NO: 393231 - RNA, 63 nt, Human
gcuugcuggugccugccaccuucaaguucuggaccugggcaugacauccuuucuuuuaaugau

SEQ ID NO: 393232 - RNA, 63 nt, Human
uaaugugaggaagcaccucugugucagggcucaccugggcauccaaagcggccacgcccacaa

SEQ ID NO: 393233 - RNA, 63 nt, Human
cacauucaaaccacaggagaaacucaaauuguuccugggcaaaucacaacauggggaauuuua

SEQ ID NO: 393234 - RNA, 63 nt, Human
ggacccacgugggagccuggaucccuggacuguccugggcauagguuucaggggccuccuuug

SEQ ID NO: 393235 - RNA, 63 nt, Human
gccagggcacccaguccagaaggagcaauggcaccugggcagugccagggcuuaaagcccgcu

SEQ ID NO: 393236 - RNA, 63 nt, Human
auguuaucuuuucuuuuauuuuucuaaugagguccugggcagagagugaaaaggccucuccug

SEQ ID NO: 393237 - RNA, 63 nt, Human
gauuauugccugagcucaggaguucgaaaccacccugggcaacauggugaaacccccgucucu

SEQ ID NO: 393238 - RNA, 63 nt, Human
gguuuuuuaaacuuuuaaguccugcucuauuuuccugggcagguuuauguugauguuuaccca

SEQ ID NO: 393239 - RNA, 63 nt, Human
uccaugggccaccgcccagcucauguaggugagccugggcagcuucuguuggcagagcuuuug

SEQ ID NO: 393240 - RNA, 63 nt, Human
cacuucccuacugcucauaugcacgcuggcuccccugggcacgcaaggaugaguaugggccau

SEQ ID NO: 393241 - RNA, 63 nt, Human
gcagugacccaagauugugccacugcacuccacccugggcaacagagcaagaccccaucucaa

SEQ ID NO: 393242 - RNA, 63 nt, Human
accuucaucacugaccuggugguggggcugugaccugggcagcucaagacuggugccccuugc

SEQ ID NO: 393243 - RNA, 63 nt, Human
gcuccugagcuucaugguggagaagggccccacccugggcaguauagagacgucggacuucac

SEQ ID NO: 393244 - RNA, 63 nt, Human
gggcagccggccuggcuugaaguccgccaugacccugggcacaggggaagcccagccgugggc

SEQ ID NO: 393245 - RNA, 63 nt, Human
ccgugaggagcuucccgcagccgccuggcccagccugggcacguucuccgaggcaugugucuc

SEQ ID NO: 393246 - RNA, 63 nt, Human
cuuuacacugacuucaggauagaugcugggaugccugggcauggccacauguuacauguacag

SEQ ID NO: 393247 - RNA, 63 nt, Human
cgcgugaggagucccacugcuucuaaaggaaguccugggcaggagguggcuuuggugguuggu

SEQ ID NO: 393248 - RNA, 63 nt, Human
cccuuuuccacacuccuccuccgacagcagcucccugggcaguggccuggucucaccgugugc

SEQ ID NO: 393249 - RNA, 63 nt, Human
gcagugagcugagauugcgccacugcacuccagccugggcaacagagcgagacuccgucucaa

SEQ ID NO: 393250 - RNA, 63 nt, Human
cuugaggagccacggaguuugggggccacagcaccugggcacacacccgagcaccuguccauu

SEQ ID NO: 393251 - RNA, 63 nt, Human
ucagugagcccagaucgcgacacugcacuccagccugggcaacagagugacacucugucucaa

SEQ ID NO: 393252 - RNA, 63 nt, Human
gcagugagcugagaucacgccauugcacuccagccugggcaacaguguuaagacucugucuca

SEQ ID NO: 393253 - RNA, 63 nt, Human
cccuucccuguuccccagagagcccaccuccgcccugggcaggagccccucggaggcuguaua

SEQ ID NO: 393254 - RNA, 63 nt, Human
uagugccggcuguggagcaaaaggcagcucaccccugggcaggcgguccccauccccaccagc

SEQ ID NO: 393255 - RNA, 63 nt, Human
gcagugagccaaaaucacgccacugcacuccagccugggcaacagagugagacuccgucucaa

SEQ ID NO: 393256 - RNA, 63 nt, Human
agaauucuccaucuauccaggcuccaggagaccccugggcaucucccaccuguggccccuaaa

SEQ ID NO: 393257 - RNA, 63 nt, Human
gcagugagccaagauggcaccauugcacucuagccugggcagcagagcgagacccugucucaa

SEQ ID NO: 393258 - RNA, 63 nt, Human
gcagauggcuugaguccaggaguucaagacuagccugggcaauguggcaaaaccgcguguuua

SEQ ID NO: 393259 - RNA, 63 nt, Human
acuggugggccauuagauuuggaggcuaccucaccugggcagggaugauggcagagccaggcu

SEQ ID NO: 393260 - RNA, 63 nt, Human
uguguauaauuaacaaaccuguguaugcuuaugccugggcaacuauuuuuuguaacucuugug

SEQ ID NO: 393261 - RNA, 63 nt, Human
ccuggggcuggcccugcucagacaaaucugcucccugggcaucuuuggccaggcuucugcccu

SEQ ID NO: 393262 - RNA, 63 nt, Human
agaugugcgugcagucuggcagccuuaagcccaccugggcacuuuuagauaaaaaaaaaaaaa

SEQ ID NO: 393263 - RNA, 63 nt, Human
caguagagaaaaauguaagauaggaaguacuagccugggcaacguggcgaaacccugucucua

SEQ ID NO: 393264 - RNA, 63 nt, Human
ugugaagguuucagugaacugagaucacuccaaccugggcaauaaagccagacucugucucaa

SEQ ID NO: 393265 - RNA, 63 nt, Human
uggcgggggugcugggccuguuguuuuccuuugccugggcauucuccucauguuucccaccug

SEQ ID NO: 393266 - RNA, 63 nt, Human
ggagcucauggugagggauacccaucccauaugccugggcagaaggaagacuucaucccucug

SEQ ID NO: 393267 - RNA, 63 nt, Human
gagaacugcuugagcccaggaguucagaaucagccugggcaacauagcaauacuccgucucau

SEQ ID NO: 393268 - RNA, 63 nt, Human
ugaaaccccaucuguacuaaaaauacaagauuaccugggcaugguggugcaugccuauaaucc

SEQ ID NO: 393269 - RNA, 63 nt, Human
acuccaccgugccgaaggagcucugccagugggccugggcaggcagccacagagggcauguua

SEQ ID NO: 393270 - RNA, 63 nt, Human
gaagauggcuugaacucaggaguucgagacuagccugggcaacgugaugagacuccgucucua

SEQ ID NO: 393271 - RNA, 63 nt, Human
agccccauguguucucuuaaacugagaauugcaccugggcaauuccuguuuucuaaggugguc

SEQ ID NO: 393272 - RNA, 63 nt, Human
gcccugcgccuguuaccacggaugcccacagggccugggcaguugcuguggcgacaggaagag

SEQ ID NO: 393273 - RNA, 63 nt, Human
gcaggcagacugagcucaggagcuugagaccagccugggcaacauggcaaaaacccaccucua

SEQ ID NO: 393274 - RNA, 63 nt, Human
uggacacugaggccuuucagagcucaguagaauccugggcaacuaccuaugguucaaaaaaua

SEQ ID NO: 393275 - RNA, 63 nt, Human
gaggaucacuugaggccaggaguuugagaccagccugggcaacauagugagaucccaucucaa

SEQ ID NO: 393276 - RNA, 63 nt, Human
gaggaucaguugaggccaggaguuuaagaccagccugggcaacauagugagaccccugucucc

SEQ ID NO: 393277 - RNA, 63 nt, Human
uuuugaaggugcugggacucuggugcccccaacccugggcauccucaggcuuugaggagaaua

SEQ ID NO: 393278 - RNA, 63 nt, Human
gugaugcccaugacaccugcaaaauaaguucugccugggcauuuuguagauauuaacagguga

SEQ ID NO: 393279 - RNA, 63 nt, Human
gcagugagccaagaucaugccacaucacuccaaccugggcaacagaacaagaacccaucucaa

SEQ ID NO: 393280 - RNA, 63 nt, Human
uggagcagauacucaaggaggcacugggcucagccugggcauuaaagggacagagucagcuca

SEQ ID NO: 393281 - RNA, 63 nt, Human
cagcucugcugcugugaucugcacacccuccaaccugggcagggacuggggggaugcagugug

SEQ ID NO: 393282 - RNA, 63 nt, Human
guggggcaggcuggggcugccaaccugauccugccugggcaacccuuuccugucccaggcccu

SEQ ID NO: 393283 - RNA, 63 nt, Human
ucccgggaaguuguuuggugaaggaagccccucccugggcauuuucugccuaugcuggaauag

SEQ ID NO: 393284 - RNA, 63 nt, Human
cuccggccugcacucccccaguucccgggcccuccugggcaccccaggcagcuccuguuugga

SEQ ID NO: 393285 - RNA, 63 nt, Human
gaggugcaggcuggcaccugcggcagguaccagccugggcacugguggccgccucccuguccc

SEQ ID NO: 393286 - RNA, 63 nt, Human
caguaagccaagaucacaccacuggcacuccagccugggcaacagagugagacccugucucaa

SEQ ID NO: 393287 - RNA, 63 nt, Human
accccaucucuauuuaaaaaaugaacaaaauuaccugggcauagugguguauaccuguagucc

SEQ ID NO: 393288 - RNA, 63 nt, Human
gcuaagcauuuuuuaaauugaguuugagacuagccugggcaacauagugagaccccaucucua

SEQ ID NO: 393289 - RNA, 63 nt, Human
ggccagggccccccagggccuaucgugggagagccugggcaggaucccaucagaaaggugcug

SEQ ID NO: 393290 - RNA, 63 nt, Human
ccugugagacuccuccuugugaagggccagggcccugggcaggccuccagcucgguccaggug

SEQ ID NO: 393291 - RNA, 63 nt, Human
ucuguacagucucaguugcuugcucuugugccuccugggcaagggcugaaggaggccacucca

SEQ ID NO: 393292 - RNA, 63 nt, Human
auggugagccgagaucacgccacugcacuccagccugggcaacagagcgagacucuaucucaa

SEQ ID NO: 393293 - RNA, 63 nt, Human
gcagugagcugagaucacaccauugcgcuucagccugggcaacaagagugaaacuccaucucc

SEQ ID NO: 393294 - RNA, 63 nt, Human
guggaucacuugagcucaggaguuugagaccagccugggcaauaucgugagaccccaucucua

SEQ ID NO: 393295 - RNA, 63 nt, Human
ugcagagccagguuuugcugguuuggggcaugcccugggcaccagagcuuuaacauuugaagc

SEQ ID NO: 393296 - RNA, 63 nt, Human
gauguccuauaauaaaggggcuucugggaggugccugggcacagaugucuguucagcaggugu

SEQ ID NO: 393297 - RNA, 63 nt, Human
uggagaggugggcuccccucgugcacuuuauugccugggcaguuuugcuugaucuuuugugac

SEQ ID NO: 393298 - RNA, 63 nt, Human
uaucauuucauaaaaaucccucuuccuccaaagccugggcagaaaugugcugcaaagaguuau

SEQ ID NO: 393299 - RNA, 63 nt, Human
gcggugagcugagaucgugccacugcacuccagccugggcaacaagagcaaaaaucccucuca

SEQ ID NO: 393300 - RNA, 63 nt, Human; identical to SEQ ID NO: 82280

SEQ ID NO: 393301 - RNA, 63 nt, Human
guggccagauguguuccccccaugggugagaggccugggcaacugccuggugaaugugucuug

SEQ ID NO: 393302 - RNA, 63 nt, Human
guguuauuaaaaaauuacaaaggccuagaccagccugggcaacauggugaaaccccaucucua

SEQ ID NO: 393303 - RNA, 63 nt, Human
gcagugaaucaugaucaugccacuguacuccagccugggcaacagagaccaucuuaaaaaaaa

SEQ ID NO: 393304 - RNA, 63 nt, Human
gcagugagcagagaucgcaccacugcacuccagccugggcaagagugagacugugucucaaaa

SEQ ID NO: 393305 - RNA, 63 nt, Human
aagauggacacgagccacaagcugcacugugaaccugggcacuccgcgccgaugccaccggcc

SEQ ID NO: 393306 - RNA, 63 nt, Human
gcuauucguccuguaggugcugugguggauggaccugggcagagggcacuucucucucuuacc

SEQ ID NO: 393307 - RNA, 63 nt, Human
gaggaucacuuagguccaggaguucgagacuagccugggcaacauagugagacaccggaucua

SEQ ID NO: 393308 - RNA, 63 nt, Human
gcagugagccgugauugcaccacugcacuccagccugggcaacagagcaagacccugucuugg

SEQ ID NO: 393309 - RNA, 63 nt, Human
gcggaucacuugagcucaggaauucaaggucagccugggcaacauggcuaaacucugucucua

SEQ ID NO: 393310 - RNA, 63 nt, Human
cacgcucccgcccaccuuccccaguagcccaggccugggcagcaagcgcagccuggaggaaga

SEQ ID NO: 393311 - RNA, 63 nt, Human
acggaugccuuccccugggcccugacauuggagccugggcauccucagguggucaggcguaga

SEQ ID NO: 393312 - RNA, 63 nt, Human
gagccuaaggccacccagcggcagcgcccguguccugggcacucagcgugcugggcagagcag

SEQ ID NO: 393313 - RNA, 63 nt, Human
caguugagccaagaucacgacacugcacuccagccugggcaacggagacucugucucaaaaaa

SEQ ID NO: 393314 - RNA, 63 nt, Human
agugugacuagggcaacgugccccccagaacucccugggcagagccagcucgggugaggggug

SEQ ID NO: 393315 - RNA, 63 nt, Human
gcuucugggggagagcuuggggcagcagaggccccugggcagcccagccaggggagccacagc

SEQ ID NO: 393316 - RNA, 63 nt, Human
ggggacugcuugagcucaggaguucgagaccagccugggcaacaaagugagacuccaucucua

SEQ ID NO: 393317 - RNA, 63 nt, Human
ggaggugggagaaaaucugggcacauggggcccccugggcagugcaggacaacaucagcucac

SEQ ID NO: 393318 - RNA, 63 nt, Human
augcuguccccaacagcugggguggcacucugcccugggcacccaugacccucugcugucucu

SEQ ID NO: 393319 - RNA, 63 nt, Human
uuucuuguaaugaaacucuucaccuuuaggagaccugggcaguccugucaggcagcagcgauu

SEQ ID NO: 393320 - RNA, 63 nt, Human
ugcauaaaacauuuuucaaaauugaaauauuuuccugggcauuaaaaaccuuuacuauuggcu

SEQ ID NO: 393321 - RNA, 63 nt, Human
gcagugagccaugauggcaccacugcacucuagccugggcaagagaacaagauccugucucaa

SEQ ID NO: 393322 - RNA, 63 nt, Human
ugauugugccuacgaauagccacugcauaccaaccugggcaauauagcaagaucccaucucuu

SEQ ID NO: 393323 - RNA, 63 nt, Human
uggccaguugcauaauaacugcaaaauuguguaccugggcaaucuguuuuuuaaccaccucug

SEQ ID NO: 393324 - RNA, 63 nt, Human
gcagugagcugggauuacaccauugcauuccagccugggcaacagagcaagacugucucaaaa

SEQ ID NO: 393325 - RNA, 63 nt, Human
uuuucuucugcuuucuucccuccaagagcaaaaccugggcaaggggacuuacugagugggggu

SEQ ID NO: 393326 - RNA, 63 nt, Human
aaggaccgguugggggagccgggcaugugaggcccugggcaaggggauggggcugugggggcg

SEQ ID NO: 393327 - RNA, 63 nt, Human
gccuguggccucugcgccuccugccacugaggcccugggcagaugcugcagcccgcccccuuc

SEQ ID NO: 393328 - RNA, 63 nt, Human
cugugggccagggaauccagcggcgucuggccuccugggcacugcuugccuggccucgugcuu

SEQ ID NO: 393329 - RNA, 63 nt, Human
ggccugagcagugcucucggcaucggaccaaagccugggcacacccugccucucuccccagag

SEQ ID NO: 393330 - RNA, 63 nt, Human
gaagauggcgugcacaggacacagcgugggcggccugggcagaagggcggcuggcuguccugg

SEQ ID NO: 393331 - RNA, 63 nt, Human
gcagugagcgaagaucgagccacugcacuccagccugggcagcugaacaagacuccgucucaa

SEQ ID NO: 393332 - RNA, 63 nt, Human
gggucauagcuuuccccacagcucagccuggggccugggcagggcucccagccugcaccgccu

SEQ ID NO: 393333 - RNA, 63 nt, Human
gaggauugcuuaagcccaggagcucaagucccaccugggcaacauaguaagaucuugucucuu

SEQ ID NO: 393334 - RNA, 63 nt, Human
cugagagggccucuccccugcagcaaacguuugccugggcauugaggcauuuccauacaucuu

SEQ ID NO: 393335 - RNA, 63 nt, Human
aggcccugucuccccagcauccucccugguggcccugggcaggugcacugacacccccaccuu

SEQ ID NO: 393336 - RNA, 63 nt, Human
cgucuuugcuuguccugcucagaugcuggucauccugggcauguccccaguguggacucugga

SEQ ID NO: 393337 - RNA, 63 nt, Human
gaaaagaacuuaaggccacaauucacgucucguccugggcauugugauggauugacccuccau

SEQ ID NO: 393338 - RNA, 63 nt, Human
caguggcucucaacccaugcgcuaccaaauacgccugggcagccgggacgggccggcgggcac

SEQ ID NO: 393339 - RNA, 63 nt, Human
ggaaacacggcuaugaccaaagggagaucccagccugggcaggcugcgcugcugaccacccuc

SEQ ID NO: 393340 - RNA, 63 nt, Human
gguugcagugagccgagaucgagccacugcacuccugggcaacagagcaagacuucgucucaa

SEQ ID NO: 393341 - RNA, 63 nt, Human
gaggcucucuugagaauaggaguucaagaccagccugggcaacauagcaagauccugucucuc

SEQ ID NO: 393342 - RNA, 63 nt, Human
ccguugccugcuggcggcucucauggggaagcgccugggcacuggggauugcuuguggcccac

SEQ ID NO: 393343 - RNA, 63 nt, Human
guccgaucuuugacucuuuugccauuaaacuuaccugggcauucuuguuucaauuccaccugc

SEQ ID NO: 393344 - RNA, 63 nt, Human
auccagcauacggccaaugucacaacaaucagcccugggcagacacgagcaggagggagagac

SEQ ID NO: 393345 - RNA, 63 nt, Human
gaggaucauuugagcucaggaguuccagaccagccugggcaacauagcaaaaucucaucucua

SEQ ID NO: 393346 - RNA, 63 nt, Human
acugugagccaugaucaugccacugcacuccagccugggcaacagagugagacccugucucca

SEQ ID NO: 393347 - RNA, 63 nt, Human
ugguaguucuaaauuuuaauugcaccugaaaaaccugggcaccuaagcaaugagccacagcaa

SEQ ID NO: 393348 - RNA, 63 nt, Human
gcagugagucgagauugcaccacuacacuccagccugggcaacagagagcgacucucucaaaa

SEQ ID NO: 393349 - RNA, 63 nt, Human
guggugagccaacaucacaccauugcacuccagccugggcaacaagaguaaaacucugucuca

SEQ ID NO: 393350 - RNA, 63 nt, Human
accugugagucucuucugcaugcaggaguuucuccugggcagcuggucacuccccagagaagc

SEQ ID NO: 393351 - RNA, 63 nt, Human
gacagcuggaccccugaacuuccucuccucuuaccugggcagaguguugucucuccccaaauu

SEQ ID NO: 393352 - RNA, 63 nt, Human
gaguuuugcuugaggccagagguucaagaccagccugggcaacacagugacaccugacucuac

SEQ ID NO: 393353 - RNA, 63 nt, Human
ugccaaaauuauauuaauagugaguuucaggccccugggcauuuuguaccauguaauuauccu

SEQ ID NO: 393354 - RNA, 63 nt, Human
gccgugagccaagaucacgccacugcacuccagccugggcaacagagcaagacucugucucaa

SEQ ID NO: 393355 - RNA, 63 nt, Human
guggggaagaggggacuuggcacgcaguggcuaccugggcauuuguggucauuucaguuucca

SEQ ID NO: 393356 - RNA, 63 nt, Human
gggugggcagggcuccagaaagucagcagugugccugggcacccaccccauccucuaccugcc

SEQ ID NO: 393357 - RNA, 63 nt, Human
gaggauugcuugaguccaggaguuugagaccagccugggcaacauggcgagacccuguuucua

SEQ ID NO: 393358 - RNA, 63 nt, Human
uaccaugcaugguaguguguuggggguggggguccugggcacuggcugugugaagggaucugg

SEQ ID NO: 393359 - RNA, 63 nt, Human
gggugcugggggucugcagcagaaagaaaggggccugggcagcagguguggccagucccucug

SEQ ID NO: 393360 - RNA, 63 nt, Human
gcagugagccaggaucgcgccauugcacuccagccugggcaacaagagcgaaacucuugucug

SEQ ID NO: 393361 - RNA, 56 nt, Human; identical to SEQ ID NO: 78858

SEQ ID NO: 393362 - RNA, 63 nt, Human
ucgccaaucccaagagucuggccucccuccagcccugggcagacugaccagcaagguggaccu

SEQ ID NO: 393363 - RNA, 63 nt, Human
aucugaguugcagcucugcacccuaaaucacacccugggcauugucugggcugcagggcugcc

SEQ ID NO: 393364 - RNA, 63 nt, Human
auccuagucuguccuggucccuggcaacaggaaccugggcagcuuauccugcccacagguaag

SEQ ID NO: 393365 - RNA, 63 nt, Human
gcagugagccaagauugcgccguuguacuccagccugggcaacagagcaagacccaucucaaa

SEQ ID NO: 393366 - RNA, 63 nt, Human
uuguuuuuaacacacgcuccagcccuucaucagccugggcagucuuaccaaaauguuuaaagu

SEQ ID NO: 393367 - RNA, 63 nt, Human
gaggguuagucuccauccugcucagauaugacuccugggcaauucacuuaacuucuccauggc

SEQ ID NO: 393368 - RNA, 63 nt, Human
guggauugcuugagcccaggaguucaagaccagccugggcaacacagcgagaccccaucucuu

SEQ ID NO: 393369 - RNA, 55 nt, Human; identical to SEQ ID NO: 78866

SEQ ID NO: 393370 - RNA, 63 nt, Human
uauucauuuuuucuacccuuuccuuuguaaguuccugggcaaccuuuuugauuucuuccagaa

SEQ ID NO: 393371 - RNA, 63 nt, Human
gcucuuuuucccucugguggaaaaaaaauuaaaccugggcauuucauggguuuucuuucuuua

SEQ ID NO: 393372 - RNA, 63 nt, Human
ugcccccagcccacugagggggugggcuuacucccugggcagucuugggggccagagcugagg

SEQ ID NO: 393373 - RNA, 63 nt, Human
gcagaucacuugagcucaggaggucaagaucagccugggcaacauggugaaaccuggucucua

SEQ ID NO: 393374 - RNA, 63 nt, Human
aggugaucacuugagcccaggaguaaagaccagccugggcaacauagugagacuccgucucua

SEQ ID NO: 393375 - RNA, 63 nt, Human
aaggaucacuugagcccagaaguucgagacuagccugggcaacauggagaagcccugucucua

SEQ ID NO: 393376 - RNA, 62 nt, Human; identical to SEQ ID NO: 82356

SEQ ID NO: 393377 - RNA, 63 nt, Human
caggagauggaguuggcagugagccaagauuagccugggcaacagugagugagacucggucuc

SEQ ID NO: 393378 - RNA, 63 nt, Human
acaagugggaccgguggagcagccccugggcucccugggcaggggaguucugaggcuccugcu

SEQ ID NO: 393379 - RNA, 63 nt, Human
uaugccccagccccuguaccaccccugcuguugccugggcagggggaagggggggcacggugc

SEQ ID NO: 393380 - RNA, 63 nt, Human
ggcacagaaaacauagccaccauuuuguccaagccugggcauggguggggggccuugucugcu

SEQ ID NO: 393381 - RNA, 63 nt, Human
aauucuagagucucuguuacugcuugggcuauaccugggcauacuaauaaaguaugguauuga

SEQ ID NO: 393382 - RNA, 63 nt, Human
gaggauugccugaggccaggaguuugacaccagccugggcaacauagugagaccuugucucua

SEQ ID NO: 393383 - RNA, 63 nt, Human
cacguacuucuaccacccugaacccacugcugcccugggcagugaguggcuuguuuuuucucc

SEQ ID NO: 393384 - RNA, 63 nt, Human
gcagugagcugagacugcaccauugcauuccagccugggcaacaagagugaaacugcaucuca

SEQ ID NO: 393385 - RNA, 63 nt, Human
aagggucgcuugaagcugagaguucaagaccaaccugggcaacauagugagacccccaucucu

SEQ ID NO: 393386 - RNA, 63 nt, Human
uugcugcugccccacuacaggccccacaccugcccugggcaugcccagccccugguggugggg

SEQ ID NO: 393387 - RNA, 63 nt, Human
ggcggauaguugagcccaggaguucgagaccagccugggcaacauggcaagaccuugucucua

SEQ ID NO: 393388 - RNA, 63 nt, Human
ucaugaggacugugugaccugcacaagcccacaccugggcaggcuguuggugucuccuugguc

SEQ ID NO: 393389 - RNA, 63 nt, Human
gacagacuggaaaggaccacagaccuggccaucccugggcagcagggccagugucaccugcug

SEQ ID NO: 393390 - RNA, 63 nt, Human
gcuaagcaaugaauauuaaggacucucuagcugccugggcauuacuguugcuaaaagaagaaa

SEQ ID NO: 393391 - RNA, 63 nt, Human
gcaguaagcugagaucccaccauugcacuccagccugggcaacagagugagacuccaucucaa

SEQ ID NO: 393392 - RNA, 63 nt, Human
cuugugaugggcagugagacaagggauguucuaccugggcauguccccagcgaggggguuggg

SEQ ID NO: 393393 - RNA, 63 nt, Human
gaaggcugcuggaaacugagaguucaagaccagccugggcaacauagugagacccugucucua

SEQ ID NO: 393394 - RNA, 63 nt, Human
gaccacccaagggugaggagaggggcuggaagcccugggcauuaggagaagggagugggugcu

SEQ ID NO: 393395 - RNA, 63 nt, Human
caggagccacggccugcuguugcuucagccuggccugggcagcccuggaagcucggaggagag

SEQ ID NO: 393396 - RNA, 63 nt, Human
ugccccugaguucuuuuggucccagagaggcagccugggcagucuguuuacagcuggcaaaca

SEQ ID NO: 393397 - RNA, 63 nt, Human
gaggaagggagaaggcagaacccauaggcagucccugggcaagggaggauuuucccggccgca

SEQ ID NO: 393398 - RNA, 63 nt, Human
caggaacuagagccccaaccacagcagaugcuuccugggcagccacuggccaggccguuguau

SEQ ID NO: 393399 - RNA, 63 nt, Human
accaaacucugucccacuucacgcacggacuguccugggcaaagguguucaccuuuccgagcc

SEQ ID NO: 393400 - RNA, 63 nt, Human
gguugcuaucacuuuguccagcccaaauaccuuccugggcaacuccuaccauuuguuugcagu

SEQ ID NO: 393401 - RNA, 63 nt, Human
ugaauauauguucaagugggugugcccauagggccugggcacgugucucuagcaaaaccaggg

SEQ ID NO: 393402 - RNA, 63 nt, Human
ccucagccccuagccccuggggggcagcuuuaaccugggcauguuuccuggguaccagugggg

SEQ ID NO: 393403 - RNA, 63 nt, Human
ccggcuguggagcagcaggaccuggcccuucugccugggcagcagaauauauauuuuaccuau

SEQ ID NO: 393404 - RNA, 63 nt, Human
gggguaaggcucggauggcaaggacgcguucugccugggcauguaggggagguguuuuugcca

SEQ ID NO: 393405 - RNA, 63 nt, Human
acccuaucccuacaaaaaauuucugaaaaauuaccugggcauuguggggcacaccuguugucc

SEQ ID NO: 393406 - RNA, 63 nt, Human
gugcaaccuggagaucuaguccuaagccacacaccugggcagccacuucauauaaagguuacu

SEQ ID NO: 393407 - RNA, 63 nt, Human
ugauugcaccugcgaauagccacugcacuccagccugggcaauauagcaagaccccauccuuu

SEQ ID NO: 393408 - RNA, 63 nt, Human
ccaggaucccaugaucacacaucuguauuccagccugggcaauagagcaaguccccauuacua

SEQ ID NO: 393409 - RNA, 63 nt, Human
aaucuagaggaaagcuccccagcauugcuugcuccugggcaaacauugcucuugaguuaagug

SEQ ID NO: 393410 - RNA, 62 nt, Human; identical to SEQ ID NO: 82390

SEQ ID NO: 393411 - RNA, 63 nt, Human
gcucucugagacaggggcgcccccgccuugaccccugggcaccuccauccccucccaccuguc

SEQ ID NO: 393412 - RNA, 63 nt, Human
agugccuccuugaggccaggaguucaggaccagccugggcaacauagcgagacccccauugcu

SEQ ID NO: 393413 - RNA, 63 nt, Human
gcuaugagcugagauugugccaguucauuccacccugggcaacagggugagacucugucucaa

SEQ ID NO: 393414 - RNA, 63 nt, Human
aagaucauuugaguucaggaguucgaguuacagccugggcaauaaagugagacccugucacua

SEQ ID NO: 393415 - RNA, 63 nt, Human
gaggauuguuugaggccagaaauuugagaccagccugggcaacauagcaaaacccugucucua

SEQ ID NO: 393416 - RNA, 63 nt, Human
cuggucaccuggugaaaacccuugggauucuucccugggcaugacugaugacaauuuccauuu

SEQ ID NO: 393417 - RNA, 63 nt, Human
ccaagacaccauaucuucccauuucaagcacugccugggcacaccccaacaucccaggcugug

SEQ ID NO: 393418 - RNA, 63 nt, Human
cugggugacagacugggaggaaaccaggcuggaccugggcaggcgggauguguuggccacagg

SEQ ID NO: 393419 - RNA, 63 nt, Human
ccguccuccuucaugacucccacugcugccucuccugggcauggcuguuagcuguucugccuu

SEQ ID NO: 393420 - RNA, 63 nt, Human
ccuuggaccccacgugcuuguggccaggcugccccugggcagggccauguggccucagaccac

SEQ ID NO: 393421 - RNA, 63 nt, Human
cguacgcacacacgcacaugcacagauaugccgccugggcacacagauaagcugcccaaaugc

SEQ ID NO: 393422 - RNA, 63 nt, Human
gauacacacgcacgcacacaugcagauaugcugccugggcacacacuuccggacacacaugca

SEQ ID NO: 393423 - RNA, 63 nt, Human
uugguagagcuggugccagaugugggcucagauccugggcaugaugggccgagccaccucgga

SEQ ID NO: 393424 - RNA, 63 nt, Human
cuauuuggaagacacugcauuuuagccaguguaccugggcacagacucggggcugcccugaag

SEQ ID NO: 393425 - RNA, 52 nt, Human; identical to SEQ ID NO: 78922

SEQ ID NO: 393426 - RNA, 63 nt, Human
cugaggauggccacugauguguguuuguggauaccugggcaucgacccagccugcaggugagc

SEQ ID NO: 393427 - RNA, 63 nt, Human
gauacauuuuuaguaaaugugcauugucacaauccugggcacaaagugccugaugucaaaaug

SEQ ID NO: 393428 - RNA, 63 nt, Human
gcaguucgcuugggcccaagaguucgagaccagccugggcaacauggugaaacccuaucuccg

SEQ ID NO: 393429 - RNA, 63 nt, Human
gagccgaggucaugccacugcacuccagccuggccugggcaacagagcaagacccugucucaa

SEQ ID NO: 393430 - RNA, 63 nt, Human
gcagugagccuagaucaugccacugcacuccaaccugggcagcagagcaagacucugucucaa

SEQ ID NO: 393431 - RNA, 63 nt, Human
caguggguucagaccucaccucucagggagcgaccugggcaaagacagagaagcucccagaag

SEQ ID NO: 393432 - RNA, 63 nt, Human
aguagcacugaaaaauuacucauucaaauuuccccugggcacguaaggcaaaauauugccggu

SEQ ID NO: 393433 - RNA, 63 nt, Human
gcagugaguggaaauugcgccacugcacuccagccugggcaacaaagugagacuccaucucaa

SEQ ID NO: 393434 - RNA, 63 nt, Human
ccagugagccaagaucgcaccacugcacuccagccugggcaacaaagagcgaaacucugucuc

SEQ ID NO: 393435 - RNA, 63 nt, Human
gaggauagcuugaggccaggaguuccagaccagccugggcaacauagugagauccugucucua

SEQ ID NO: 393436 - RNA, 63 nt, Human
aggcugccagucccuccagccucaccuccccgcccugggcagcaggugugggcagcgugugag

SEQ ID NO: 393437 - RNA, 63 nt, Human
uuguagcccgggaggagcucuccagccucggcgccugggcagagggcccggaaacccucggac

SEQ ID NO: 393438 - RNA, 59 nt, Human; identical to SEQ ID NO: 78935

SEQ ID NO: 393439 - RNA, 63 nt, Human
aaauaaaaggucuuggggaauucuguuuggcuaccugggcacgccagucugcaccaugugucc

SEQ ID NO: 393440 - RNA, 63 nt, Human
uaucagauucgagggcucccuuugucccccugaccugggcacaggcaugggcgauggcucccu

SEQ ID NO: 393441 - RNA, 63 nt, Human
caucaucgggggugggcacacggcccuucggagccugggcagccuggccucacaggcagacuc

SEQ ID NO: 393442 - RNA, 63 nt, Human
gugauuugugauugcgccaccacugcacuccagccugggcaacagagugagacccugucucaa

SEQ ID NO: 393443 - RNA, 63 nt, Human
caagugagcugagaucaugccauggcagucuagccugggcaacagagcgagacucuguuucaa

SEQ ID NO: 393444 - RNA, 63 nt, Human
gcggugagccgagauugcgccauugcacuccagccugggcaacgagugaaacuccgucucaaa

SEQ ID NO: 393445 - RNA, 63 nt, Human
aaaccucaucuugauucagacugucagucuauuccugggcaguaguaugugauguccagcacc

SEQ ID NO: 393446 - RNA, 63 nt, Human
ccccaagcacacuccuagcugcuccagucucagccugggcagcuucccccugccuuuugcacg

SEQ ID NO: 393447 - RNA, 63 nt, Human
gcagugagcuuugaucacaccacugcacuccagccugggcaacagagcaagaccccauccucc

SEQ ID NO: 393448 - RNA, 63 nt, Human
gaggaucacuuaagcccaggagucugagaccagccugggcaacauagcaagacccccaucucu

SEQ ID NO: 393449 - RNA, 63 nt, Human
gaggauugcuugaguucaggaguucaagaccagccugggcaacauagcaaaaccuuaucucua

SEQ ID NO: 393450 - RNA, 63 nt, Human
guagaucccuugugcccaggaguucaagaccagccugggcaacauggcgaaaccccauuucua

SEQ ID NO: 393451 - RNA, 63 nt, Human
acagaauacuaagggcccccauuacuguguggcccugggcauccucaguuuccucauuuggua

SEQ ID NO: 393452 - RNA, 63 nt, Human
guagugagccgagaucgcgccacugugcuccagccugggcaacagagcaagacuccaucucaa

SEQ ID NO: 393453 - RNA, 63 nt, Human
gagcaucacuugauccugggaguucgagaccagccugggcaacauggugaaacccugucggua

SEQ ID NO: 393454 - RNA, 63 nt, Human
auuuccaguucaucuauggcaguccagccagcuccugggcagcuugagagggcaaacccaaaa

SEQ ID NO: 393455 - RNA, 63 nt, Human
uuuaaaugaccaaagaugaccugugguaagcaaccugggcaucuuaggaagcagucccuggag

SEQ ID NO: 393456 - RNA, 63 nt, Human
agguaaagacgaaucuauaaaguaccgagacuuccugggcaaagaauggacaaucaguuuccu

SEQ ID NO: 393457 - RNA, 63 nt, Human
gcuuugagccgagauugcaccauuguacuccagccugggcaauaagagcaaaacuccaucaaa

SEQ ID NO: 393458 - RNA, 63 nt, Human
uccuuaaggcacagucucaucagaagucuaauaccugggcagguuuauaacauccugagagcc

SEQ ID NO: 393459 - RNA, 63 nt, Human
gggaggagcucugggccagaggaugcugagcugccugggcagagaccaagaggguuggagaca

SEQ ID NO: 393460 - RNA, 63 nt, Human
ggggccagcccuuagugcauucaggcuaaggccccugggcagggaugccaccccugcuccuuc

SEQ ID NO: 393461 - RNA, 63 nt, Human
aauguauacaccauuugggcuaucagagguaccccugggcaggagccucuacauccccuuccc

SEQ ID NO: 393462 - RNA, 63 nt, Human
gcggugagccaagauugugccauugcacuccagccugggcaacgagcgaaacuacaucucaaa

SEQ ID NO: 393463 - RNA, 63 nt, Human
ugagcacaaacuuucugggccuccauccuaggaccugggcagacccacauggccugggcucug

SEQ ID NO: 393464 - RNA, 63 nt, Human
ccuguugucugcuugucucuuugugucuguuauccugggcaggauggucauucucaaaaaccc

SEQ ID NO: 393465 - RNA, 63 nt, Human
ccuuuuccccuccuuugccuuucaagagcagggccugggcaaggccaagaaccaugcagaagc

SEQ ID NO: 393466 - RNA, 63 nt, Human
aggaugauggauggucgggauugaggcuguugaccugggcaguagcuccucccauggccagug

SEQ ID NO: 393467 - RNA, 63 nt, Human
gagaaaccugcccugaacucaccgccuccccugccugggcacucccuccucccugcgcccaca

SEQ ID NO: 393468 - RNA, 63 nt, Human
cagguagagcccaagcuccaggugaggccuggcccugggcagggucuguggcugcgccccuca

SEQ ID NO: 393469 - RNA, 63 nt, Human
ugugcagcggacaccacggggccuuccugcuuuccugggcagagggcagagugaggccaccug

SEQ ID NO: 393470 - RNA, 63 nt, Human
gcggaucaccugagcucaggaguuugagaccagccugggcaacauggggaaacuccaucucua

SEQ ID NO: 393471 - RNA, 63 nt, Human
gcagugagccaagauggcgccacugcauuccagccugggcaacagagcaagacccugucuguc

SEQ ID NO: 393472 - RNA, 63 nt, Human
ccagcuugagucccagauacacucaugggcugcccugggcagccagcauucauuguaaguucc

SEQ ID NO: 393473 - RNA, 63 nt, Human
ucuuucacuacccacgaugaccuccggggguauccugggcaaaagggacaaagagggcaaaug

SEQ ID NO: 393474 - RNA, 63 nt, Human
cucagcccuccuggcccuucagucuuggugccaccugggcacaggggcaagcuuggugguugu

SEQ ID NO: 393475 - RNA, 63 nt, Human
agugcccugucucccugucucuagaagccuuagccugggcaccuggcucaaucuuguaacugc

SEQ ID NO: 393476 - RNA, 63 nt, Human
gcaguuagcugagauccugccacugcacuccagccugggcaacagagugagacuaucucaaaa

SEQ ID NO: 393477 - RNA, 63 nt, Human
gaaaccccaccuccagcccccgccaccgggcucccugggcacccagcaagaucuggggcugca

SEQ ID NO: 393478 - RNA, 63 nt, Human
ugcuaggugcauggccacagagcaugggcugggccugggcacaggaggagcagcugcuuuggu

SEQ ID NO: 393479 - RNA, 63 nt, Human
cugccccuaccccuaugaggggcuccgguagcaccugggcaccugccgcuggaagcuauuggg

SEQ ID NO: 393480 - RNA, 63 nt, Human
gcagugagcuguaauugcaucacugcacuccaaccugggcaacagaguaagaccuugucuuaa

SEQ ID NO: 393481 - RNA, 63 nt, Human
gccccaugggccgucacaaaggcuugaucacugccugggcaguggcacaaccaucccccaugu

SEQ ID NO: 393482 - RNA, 63 nt, Human
gcuaugguugaguaacuaaaggucuggcaagacccugggcacacagggagcugccuagcaucu

SEQ ID NO: 393483 - RNA, 57 nt, Human; identical to SEQ ID NO: 78980

SEQ ID NO: 393484 - RNA, 63 nt, Human
gcugaucacuugaucccaggaguuugagaccagccugggcaccauggugaaaccucgucuuua

SEQ ID NO: 393485 - RNA, 63 nt, Human
aagcaagugccgcauucuucaggaaggaagagaccugggcacccaagaccugguuuccuuuca

SEQ ID NO: 393486 - RNA, 63 nt, Human
cugccccugagucuucuggcugggggcagguugccugggcaagaacugcuucuucaauuccuu

SEQ ID NO: 393487 - RNA, 63 nt, Human
aaauuagagguuuuugaaaaauccaacucucauccugggcagagguugccuaguugguauaga

SEQ ID NO: 393488 - RNA, 63 nt, Human
cauuaaagcugaaagaucgcucugcucggggagccugggcagagcagcagcaacgugaggguc

SEQ ID NO: 393489 - RNA, 63 nt, Human
aucucuccagguggcccuaugcacccagguagcccugggcauggagcaccuguccaacaaccg

SEQ ID NO: 393490 - RNA, 63 nt, Human
gcaagccgugaggagggagcccgcucaggauggccugggcaggggaggacaucucuagaggga

SEQ ID NO: 393491 - RNA, 63 nt, Human
ugugggaaccauaggaagugugugggcugccuuccugggcaaguauuucccagugggaaguug

SEQ ID NO: 393492 - RNA, 63 nt, Human
gcauugagcugagaucaugcuagugcgcuccagccugggcaacagagcgagacuucaucucag

SEQ ID NO: 393493 - RNA, 63 nt, Human
ggagugagcugagaucgcgccaccgcacuccagccugggcaacagagcgagacuccaucucaa

SEQ ID NO: 393494 - RNA, 63 nt, Human
gcagaucaccugagcucaggaguccaagaccagccugggcaacauggcaaaacaccgucucua

SEQ ID NO: 393495 - RNA, 63 nt, Human
ccagucccaucaggagccucagccaaggaggggccugggcacacucagguccccaugguuguc

SEQ ID NO: 393496 - RNA, 63 nt, Human
ucaagaugcugagaugccaccacugcacuccagccugggcaacagagcgagaaccugucucaa

SEQ ID NO: 393497 - RNA, 63 nt, Human
gcaaugagccgagaucgcgcuacugcacuccagccugggcaacagagagagaccuugucucaa

SEQ ID NO: 393498 - RNA, 63 nt, Human
uccuguguugguguuuccuuuagacuggccuagccugggcaucacuguaaaguaugugcaguu

SEQ ID NO: 393499 - RNA, 63 nt, Human
cucccucucacugaucacaaauggaaucaccucccugggcagcgagacgcaguugcucuggga

SEQ ID NO: 393500 - RNA, 63 nt, Human
gugccugucccuuagugcauucaggucauggcaccugggcaggggugucccuguauucugaau

SEQ ID NO: 393501 - RNA, 54 nt, Human; identical to SEQ ID NO: 78998

SEQ ID NO: 393502 - RNA, 63 nt, Human
cucuguaaauacucccuuccacccaucccagccccugggcagccgggcagaagggaauccagg

SEQ ID NO: 393503 - RNA, 63 nt, Human
acugaguauguucauugccaccccugucccuccccugggcaccccucacuuucccugauccug

SEQ ID NO: 393504 - RNA, 63 nt, Human
ccggaggccuucccuuuacagcucuccuccagcccugggcacauagcauaggcuggggacaca

SEQ ID NO: 393505 - RNA, 63 nt, Human
gauagcagagcccccagccaucacugcuggcagccugggcaaaccgggugagcaacaggagga

SEQ ID NO: 393506 - RNA, 63 nt, Human
ccacagaaaugggcacuaccuccuggcccacucccugggcaccaugcccucuggugaccuguu

SEQ ID NO: 393507 - RNA, 63 nt, Human
acccuuugaagggacccagcacagggucuugggccugggcagucugaagacugauaacuuccc

SEQ ID NO: 393508 - RNA, 63 nt, Human
gcaaugagcuaugauuucaccacugcauucuagccugggcaacagagugagauccugacucaa

SEQ ID NO: 393509 - RNA, 63 nt, Human
gaggauugcuugaggccgaggguucaagacuagccugggcaacauagcgagacugcaucucua

SEQ ID NO: 393510 - RNA, 63 nt, Human
cuccaguugcuguguuguauuccuacccaauuuccugggcaguugaugcaucucugggaaaaa

SEQ ID NO: 393511 - RNA, 63 nt, Human
gugugcgcucacugcuugggaagugcaggggguccugggcacauugccagcugggugcugagc

SEQ ID NO: 393512 - RNA, 63 nt, Human
gcagugagcacagaucacaccacugcacuccagccugggcaacagagugagacccuauuucaa

SEQ ID NO: 393513 - RNA, 63 nt, Human
guggauugcuuaagcccaggaguucaagaccagccugggcaacauggcuaaaccccaucucua

SEQ ID NO: 393514 - RNA, 63 nt, Human
gcagugagccaaggucacgucacugcacucuagccugggcaacagaguaagacaaaaaaauau

SEQ ID NO: 393515 - RNA, 63 nt, Human
guagauuacuugagcccaggaauucaagaccagccugggcaacauggugaaacccuguuucua

SEQ ID NO: 393516 - RNA, 63 nt, Human
gcggugagcugagauugcacuauugcacuccagccugggcaacaggaguaaaacuccccccca

SEQ ID NO: 393517 - RNA, 63 nt, Human
gcagugacccaagaucgugccacuucacuccagccugggcaaaagagcaaaacgccaucucaa

SEQ ID NO: 393518 - RNA, 63 nt, Human
cacccccacccagauggucucugagugcgccguccugggcagggcacacggucuggagcugag

SEQ ID NO: 393519 - RNA, 63 nt, Human
uaucccucuugucagcacggcugaaaggagcugccugggcaccugagguggcugaggcucauc

SEQ ID NO: 393520 - RNA, 63 nt, Human
guggacacggucuagcgggagcccagggcagccccugggcaggagacguggcugcugaacagc

SEQ ID NO: 393521 - RNA, 63 nt, Human
cuuaagacucagccuccugguuuacccccccggccugggcaucugaccucccccaccccagug

SEQ ID NO: 393522 - RNA, 63 nt, Human
gcagugagccaggauugcgccaccacacuccagccugggcaacagagacucugucucaaaaaa

SEQ ID NO: 393523 - RNA, 63 nt, Human
gcagugagccgagguugcaccacugcacucccuccugggcaacagaacaagacuccaucucaa

SEQ ID NO: 393524 - RNA, 63 nt, Human
ugauuccucucauuuccagcuucucaguuucugccugggcaauggccaggggccaggaguggg

SEQ ID NO: 393525 - RNA, 63 nt, Human
agaagaccaccugaggguaggagucaagaucagccugggcaacauagugagacgcugucucua

SEQ ID NO: 393526 - RNA, 63 nt, Human
ccaggugggaccugacauacaggcggcuccagcccugggcagcggcuucaagagccagagugg

SEQ ID NO: 393527 - RNA, 63 nt, Human
gcagguacaguaggauaagccacucugucccuuccugggcaaagaagaaacggaggggaugga

SEQ ID NO: 393528 - RNA, 63 nt, Human
ugaucgugccuguggcuagccacugugcuccagccugggcaacaccaucguaaaaauaaauaa

SEQ ID NO: 393529 - RNA, 63 nt, Human
gaccugauggagcugaugcuuucucuccuaaucccugggcacuaggcucuuaucagugugcuu

SEQ ID NO: 393530 - RNA, 63 nt, Human
gaggaucauuugaggccaggaguuugagaccugccugggcaacauaaugaaacuuccuuucca

SEQ ID NO: 393531 - RNA, 63 nt, Human
cucucuccuccuccccucugggaauugggcagcccugggcaguuguacucaugggggcuuagg

SEQ ID NO: 393532 - RNA, 63 nt, Human
gaggauugcuugaagcuaggaguuugagaccagccugggcaacaggguaagguccugucucua

SEQ ID NO: 393533 - RNA, 63 nt, Human
ugcagugagcugugaugugcccuuaugcuauagccugggcaagagcgugagacccugucucaa

SEQ ID NO: 393534 - RNA, 63 nt, Human
cuccgugcucaacccccagcccaccccacccucccugggcagggucuugaggcagccacugug

SEQ ID NO: 393535 - RNA, 63 nt, Human; identical to SEQ ID NO: 82515

SEQ ID NO: 393536 - RNA, 63 nt, Human
gaggauugcuugaggccaggaguuugagaccagccugggcaacauagcgagaccccaucucua

SEQ ID NO: 393537 - RNA, 63 nt, Human
gaggauugcuugagcccaggaguucaagaccagccugggcaacauaccaagacccccgucucu

SEQ ID NO: 393538 - RNA, 51 nt, Human; identical to SEQ ID NO: 79035

SEQ ID NO: 393539 - RNA, 63 nt, Human
gaggaccgcuugaguccagggauucaaggccaaccugggcaauagagcgagacccugucucuu

SEQ ID NO: 393540 - RNA, 63 nt, Human
gcagugagcugagauagcgccauugcacuccagccugggcaacaagagcaaaacucugucuca

SEQ ID NO: 393541 - RNA, 63 nt, Human
aacagggacacuuuuuaaaaacacucuuaucagccugggcaacacagugagacuccaucucuu

SEQ ID NO: 393542 - RNA, 63 nt, Human
gauugugccacugaacuccaaccugcacuccagccugggcaacagagcgagacuccaucucua

SEQ ID NO: 393543 - RNA, 63 nt, Human
ccuugaagaaccugucuaacuggaugcucauugccugggcaaggccuguuuaggccgguugcg

SEQ ID NO: 393544 - RNA, 63 nt, Human
ggcagggaggauccauugagcccaggaguccagccugggcaaaauagcgagagacccugaauc

SEQ ID NO: 393545 - RNA, 63 nt, Human
uugcuauagguccagcaacugaaccugccauuaccugggcaaggaaagaucccuuugcucuag

SEQ ID NO: 393546 - RNA, 63 nt, Human
cagucuucccagccagcccgggcccuggggagcccugggcacagcagcggccgaggggauguc

SEQ ID NO: 393547 - RNA, 63 nt, Human
gauacaugagaccagggcagcguucagcacacuccugggcauggcggaagcaggaagcagacu

SEQ ID NO: 393548 - RNA, 63 nt, Human
accgcaguccugccgcaggccuaacccuccugcccugggcacugccuccaugcagaagcgcuu

SEQ ID NO: 393549 - RNA, 63 nt, Human
gcggaucacuugaggccaggaauuugaaaccagccugggcaaaacccugucucuacuaaaaau

SEQ ID NO: 393550 - RNA, 63 nt, Human
gggcagaugggcacaggugcuggugaugccucuccugggcaaaacgccccauuuguggcacuu

SEQ ID NO: 393551 - RNA, 63 nt, Human
ggggauugcuugaagucaggaguucaagaccaaccugggcaacauagcaacaccccccauguc

SEQ ID NO: 393552 - RNA, 63 nt, Human
ucuguggcgcggggcauccuaugaggcaggcacccugggcagagagaugcagugggugcgggg

SEQ ID NO: 393553 - RNA, 59 nt, Human; identical to SEQ ID NO: 79050

SEQ ID NO: 393554 - RNA, 63 nt, Human
ugaaacaggacacaucuguuuuuugucccucacccugggcaggccgcgucacaaucacagucc

SEQ ID NO: 393555 - RNA, 63 nt, Human
gaggaucacuuggagccaggaguuugagaccagccugggcaacaaagugagacccccaucucu

SEQ ID NO: 393556 - RNA, 63 nt, Human
gagcaccucggcuucggagcacccugccaggccccugggcaucgccggacguccuacucaggc

SEQ ID NO: 393557 - RNA, 63 nt, Human
ugagcggagcgguggagagggagaggcuggaggccugggcagaacagcgccgcccgggcagac

SEQ ID NO: 393558 - RNA, 53 nt, Human; identical to SEQ ID NO: 79055

SEQ ID NO: 393559 - RNA, 63 nt, Human
guggugagcugagaucgcgccauugcacuccagccugggcaacaagagcaaaacuccgucuca

SEQ ID NO: 393560 - RNA, 63 nt, Human
cuagagugagccgugaucaccagugcacucuagccugggcaacagagaaagacccugucucaa

SEQ ID NO: 393561 - RNA, 63 nt, Human
gaggaucgcuugaggccaggaguucgagaccacccugggcaacagagcgagaucccaucacua

SEQ ID NO: 393562 - RNA, 63 nt, Human
aauacaucgaacaacuucauccuuaaucucugcccugggcaguuugcccucucccaucuggac

SEQ ID NO: 393563 - RNA, 63 nt, Human
gcugcucacucagcugcccugggggcugcuuucccugggcacgggcuccagggaucaucucug

SEQ ID NO: 393564 - RNA, 63 nt, Human
gcagugagcugagaucacgccauuguacuccagccugggcaacaagagcaaaacuccgucuca

SEQ ID NO: 393565 - RNA, 63 nt, Human
ugcucacuccugcucucuacagagccagccuggccugggcauuguaaacagcuuuuccuuuuu

SEQ ID NO: 393566 - RNA, 63 nt, Human
gcagugagcugagaucaugccacugcacuccagccugggcaacagagcgagacuccaucucaa

SEQ ID NO: 393567 - RNA, 63 nt, Human
gcagugagcugagauaaucccacugcauuccagccugggcaacagcgugagacuucaucucaa

SEQ ID NO: 393568 - RNA, 63 nt, Human
cucagacacccagauucccuccauggccucaccccugggcaaaauccaacucugagccaucuu

SEQ ID NO: 393569 - RNA, 63 nt, Human
ucucagagaagcacguggugaggguggccugggccugggcacccuuggccugccggccuggcu

SEQ ID NO: 393570 - RNA, 63 nt, Human
gaggaucguuugagcccaggaguugaagaccagccugggcaacacagugagacuucauuucua

SEQ ID NO: 393571 - RNA, 63 nt, Human
gcacugagccgagaucgcgccacuauacuccagccugggcaacagacauccugucucaaauaa

SEQ ID NO: 393572 - RNA, 63 nt, Human
gagaaucgcuugagcucaggaguucgagaccagccugggcaacguggcgaaauccccgucuuu

SEQ ID NO: 393573 - RNA, 63 nt, Human
aggaucaccuugaggccaggaguuuaaggccagccugggcaacauagcaaaaccuagucccua

SEQ ID NO: 393574 - RNA, 63 nt, Human
gugggucacuugaacccaggaguuugacaucaaccugggcaacauggugaccucccgucucuc

SEQ ID NO: 393575 - RNA, 63 nt, Human
uccuuaaaguaggaucaaaucuagauccucuagccugggcaguagaggaagaaaugcuagccu

SEQ ID NO: 393576 - RNA, 63 nt, Human
gucacagcccucuucuuuugauugacagaccacccugggcaccccaugcucaauaugaacacc

SEQ ID NO: 393577 - RNA, 63 nt, Human
gaggaucaauugagccuagaaguucaagaccagccugggcaaaguagggagaccccuucucua

SEQ ID NO: 393578 - RNA, 63 nt, Human
guggauugcccgcgcucaggaggucaagaccagccugggcaacacggugaaaccccaucucua

SEQ ID NO: 393579 - RNA, 63 nt, Human
gcagugagccaagaucgcaccacugcacuccagccugggcaacagagugagacuccgucucaa

SEQ ID NO: 393580 - RNA, 63 nt, Human
auuuuauuuuuuauuuuuugagacggaguccagccugggcaacagaguaacucuccuucucaa

SEQ ID NO: 393581 - RNA, 63 nt, Human
gcagugagcugagauuacgccacugcacucuagccugggcaacggugagacccugccucaaaa

SEQ ID NO: 393582 - RNA, 63 nt, Human
gccuucugaacccgucucagcagguccacagcaccugggcagaggucagagaccaggggaggc

SEQ ID NO: 393583 - RNA, 63 nt, Human
ucacagcgggacuacacaguugcuggcuuugcuccugggcaaggaggagcaggccagagccuc

SEQ ID NO: 393584 - RNA, 63 nt, Human
ccgcgggggcugugagcagcggugccucaacacccugggcagcuacaagugcagcugugaccc

SEQ ID NO: 393585 - RNA, 63 nt, Human
aaggggagcgagaaauugcuuuuucucuuccucccugggcagaauguagcuuuucugcuucac

SEQ ID NO: 393586 - RNA, 63 nt, Human
aaaaaaaaaaggcaaggcacaacaaaaaaauauccugggcaauaaaaaaaauauuuuaaacca

SEQ ID NO: 393587 - RNA, 63 nt, Human
cagggcucugcaggccacugugagcgcuggcucccugggcagugcuccuccguguggacugug

SEQ ID NO: 393588 - RNA, 63 nt, Human
cccuucucuguucugacuccugggacuucugguccugggcacacuuuuugcaggcaacaaaau

SEQ ID NO: 393589 - RNA, 63 nt, Human
ucaguaugcuuauggauuugaugacaggcauagccugggcauaucaccucauugguaaagggc

SEQ ID NO: 393590 - RNA, 63 nt, Human
uggugacacuuucaugguccagaaagcugaaggccugggcaucucuugugacauuuuucuaau

SEQ ID NO: 393591 - RNA, 63 nt, Human
gcagugagccgagaucgcaccauugcacuccugccugggcaacaagagugaaacuccaucucc

SEQ ID NO: 393592 - RNA, 63 nt, Human
gcagauuauuugagcucaggaguuugagaccauccugggcaacauggcgaaacccuaucucua

SEQ ID NO: 393593 - RNA, 63 nt, Human
ggccccagcucugcugcugacgagcugugugguccugggcagaguggucuccgaguuccaguc

SEQ ID NO: 393594 - RNA, 63 nt, Human
uuuugauuuuuaauggaaaguuguauccauuaaccugggcauuguugagguuaaguuucucuu

SEQ ID NO: 393595 - RNA, 63 nt, Human
auggaacuuaaaacuacuuuguugaaacaucaaccugggcagaaaaaaaaaaaaaaagacaug

SEQ ID NO: 393596 - RNA, 63 nt, Human
gcagugagccgagaugguaccucugcacugcagccugggcaacagaaugagacugugucuuca

SEQ ID NO: 393597 - RNA, 63 nt, Human
ugucagcacgugcugagggcauggggccugcccccugggcacccauccacaagcugggccacg

SEQ ID NO: 393598 - RNA, 63 nt, Human
ucagugagcugagaucguggcauugcacucuagccugggcaaccaagagugaaacugucucaa

SEQ ID NO: 393599 - RNA, 63 nt, Human
ccagcuucuggcccgcuccucacugagccacuaccugggcaucagucuggaucugcagcugca

SEQ ID NO: 393600 - RNA, 63 nt, Human
ggcggauggccagggagccaugagaagacucuuccugggcacggcguggggacuggacagaaa

SEQ ID NO: 393601 - RNA, 51 nt, Human; identical to SEQ ID NO: 79098

SEQ ID NO: 393602 - RNA, 63 nt, Human
gaagaucacuugaggccagaaguucgagaccagccugggcaauguagugagaccccaucacua

SEQ ID NO: 393603 - RNA, 63 nt, Human
acagugaaccgagaucacaccacugcauucccgccugggcagcagagcgagacuccgucucaa

SEQ ID NO: 393604 - RNA, 63 nt, Human
uccacgugaaguccuguguguggcuggucccuaccugggcagucucauuugcacccauagccc

SEQ ID NO: 393605 - RNA, 63 nt, Human
gcagugagcugagaucacaucauugcacuccagccugggcaacgggcgagacucugucucaaa

SEQ ID NO: 393606 - RNA, 63 nt, Human
gcaagaguuuuuuuaagacucuuaaaaaaagagccugggcaauuuuuuuaagacucugucuua

SEQ ID NO: 393607 - RNA, 63 nt, Human
gcagcgagccaagaucgugccacugcacuccagccugggcaagaguuuuuuuaagacucuuaa

SEQ ID NO: 393608 - RNA, 63 nt, Human
aaugcacacuagccucuccaggaaugccuccucccugggcagaaaguggccaugccacccugu

SEQ ID NO: 393609 - RNA, 63 nt, Human
acccaggagguggauugcgccacugcacuccagccugggcaacagagugagacucccucucaa

SEQ ID NO: 393610 - RNA, 63 nt, Human
guggaucacucaaguccaggaguucgagaccagccugggcaacauggugaaauccugucucua

SEQ ID NO: 393611 - RNA, 63 nt, Human
uuguacuaagguauuucaguuauguaaacucagccugggcacuuucugauaacuguaaaaugu

SEQ ID NO: 393612 - RNA, 63 nt, Human
uuggcuacagggagaugcucucuuugagaggcuccugggcauugauuccauuucaaucucauu

SEQ ID NO: 393613 - RNA, 63 nt, Human
gcagugagccgagaucgcaccacugcacuccagccugggcagcagagcaaguaguaauaacca

SEQ ID NO: 393614 - RNA, 63 nt, Human
auccuucaugcaagacugcugccuucauguaacccugggcacaguguguauauagcugcuguu

SEQ ID NO: 393615 - RNA, 63 nt, Human
gcagugggcugugaucacaccacugcacuccagccugggcaacagagugagacccugucucug

SEQ ID NO: 393616 - RNA, 63 nt, Human
gaggaucacuugagcccaggaguucaagaccagccugggcaacauagugagacuccugucucu

SEQ ID NO: 393617 - RNA, 63 nt, Human
cccggagcuuggaggggcagccucaggugugugccugggcaccgcucacagccucuugcaccc

SEQ ID NO: 393618 - RNA, 63 nt, Human
cagucacccugugaccgcagguugcuuucccacccugggcaaugcagugcagcaugggaaagg

SEQ ID NO: 393619 - RNA, 63 nt, Human
gccccagccccaggggaccaugccggggugcugccugggcaggccauguuggggagacuccag

SEQ ID NO: 393620 - RNA, 63 nt, Human
aggcugaagcuuucacagugcagagacugcuagccugggcacacacaccuccuuucuggccgu

SEQ ID NO: 393621 - RNA, 63 nt, Human
gcagugagacgagcuugugccacugcacuccagccugggcaacagaguaagacucagucucaa

SEQ ID NO: 393622 - RNA, 63 nt, Human
cagcaaggacugacuguaguccuauuucagaccccugggcacuagugucaacuccuccuuugg

SEQ ID NO: 393623 - RNA, 63 nt, Human
guuagugguagagguggugagaagacaucagauccugggcacauucuuuucuucugcuucccu

SEQ ID NO: 393624 - RNA, 63 nt, Human
aacagucaugacccugauaguuucccauaacaaccugggcauuccuugggacucaggagcugc

SEQ ID NO: 393625 - RNA, 63 nt, Human
gugagccaucaucauggcaucauugcauuccagccugggcaacagagcaagaccucgucucaa

SEQ ID NO: 393626 - RNA, 63 nt, Human
gagguuugcuugagcccaggaguuccagaccagccugggcaacauggcgaaaccccaucucua

SEQ ID NO: 393627 - RNA, 63 nt, Human
guagaucgcuugagcucaggaguucaagacgagccugggcaacauggcaaaugccgucucugc

SEQ ID NO: 393628 - RNA, 63 nt, Human
cauucuggccaaggggugggccugugaaucaauccugggcaaucagacacccucuccuuaaaa

SEQ ID NO: 393629 - RNA, 63 nt, Human
cugccucagcggggacggccuccugcugcagguccugggcagcccacaguagugcuagcugag

SEQ ID NO: 393630 - RNA, 63 nt, Human
gaacccaggcugggccugguggugaagagcaguccugggcacaggcugugagccagggugcug

SEQ ID NO: 393631 - RNA, 63 nt, Human
uugcagccguaugcugcacaagcguguacacccccugggcagccucaaaaccccgcuuacagc

SEQ ID NO: 393632 - RNA, 63 nt, Human
guguuucuuuugguuccauuguuuggagacauuccugggcacaguuugguccguuagaauuaa

SEQ ID NO: 393633 - RNA, 63 nt, Human
aaacagggugcuaaagccaaccagccuuuggguccugggcaggugggagcugaaaaggaucga

SEQ ID NO: 393634 - RNA, 63 nt, Human
ugggaggacaguggcugaguggaggcgcccagaccugggcaggcagcaggcucaggcccacac

SEQ ID NO: 393635 - RNA, 63 nt, Human
gaaugcggcugcccaagcuugcagggaacaauaccugggcaaccuuguaacuguauucuccag

SEQ ID NO: 393636 - RNA, 63 nt, Human
cagaagagaggggugggcuggggcaaggcuuauccugggcaggagagaacacacgagcacgua

SEQ ID NO: 393637 - RNA, 63 nt, Human
aggagugauagcugcuccccaucccaaagugggccugggcagucaggcuccagggcccuaugc

SEQ ID NO: 393638 - RNA, 63 nt, Human
gaggauugcuugagcucaugaguucaagaccagccugggcaacauagcgagacuccaucucua

SEQ ID NO: 393639 - RNA, 63 nt, Human
uuguuuuagaaccaguuucauuaaaguugccuuccugggcaccuguuuauccauuuccugaac

SEQ ID NO: 393640 - RNA, 63 nt, Human
cagcaggugaggcaggugcuccucacacccagaccugggcaucuucauugagggaaagaaaac

SEQ ID NO: 393641 - RNA, 63 nt, Human
guggccgagggggccuugacggcguuggcggggccugggcacaggggcagccgcagggaggca

SEQ ID NO: 393642 - RNA, 63 nt, Human
cucccccucuuguugccuucgauuucggcaaagccugggcaggugccaccgggaaggaauggc

SEQ ID NO: 393643 - RNA, 63 nt, Human
guagugagccgagaucaugacacugcacuccagccugggcaacagagcgagaccaucucuuaa

SEQ ID NO: 393644 - RNA, 63 nt, Human
aagccagagguuucggauucgugacauccacccccugggcaagugagagcaucugcaaaaugc

SEQ ID NO: 393645 - RNA, 63 nt, Human
cagggaaagucaucgaugauggcucaggcucagccugggcacgccccagaggagagagaugga

SEQ ID NO: 393646 - RNA, 63 nt, Human
ugcugacucuccuucaacauccucacccccaccccugggcaccauuuaggacaagacuuccuu

SEQ ID NO: 393647 - RNA, 63 nt, Human
caucaauacaaccagcccaaccaucgguccacaccugggcauuuggugagagucaaagcugac

SEQ ID NO: 393648 - RNA, 63 nt, Human
gcagugagcugagaucuugccacugcacaccagccugggcaacacagcaagacucugucucaa

SEQ ID NO: 393649 - RNA, 63 nt, Human
gagaugccacgcaggacagacuggagagagaagccugggcaauacugcccgccugucauggcc

SEQ ID NO: 393650 - RNA, 63 nt, Human
uuagguguuucagcauagauuccaguuucgcacccugggcagacccccaggccccauccggga

SEQ ID NO: 393651 - RNA, 63 nt, Human
gagccgugucacuccugggccaugggggcaccuccugggcacuuagguguuucagcauagauu

SEQ ID NO: 393652 - RNA, 63 nt, Human
acaggcagcaaggucauggucugaguggggcuuccugggcaguuggggcggcccacgccagcu

SEQ ID NO: 393653 - RNA, 63 nt, Human
guggugagccgagauugcaccuuuguacuccagccugggcaacgagcaaaaaacucugucuca

SEQ ID NO: 393654 - RNA, 63 nt, Human
ggugacaguauuacucucgagaggcaauucaguccugggcaaagguauuaguacaauaagcgu

SEQ ID NO: 393655 - RNA, 63 nt, Human
agaggcuucuccccauagcacgaggauguguugccugggcacggugacugcgguuauuccugg

SEQ ID NO: 393656 - RNA, 63 nt, Human
gcaaugagcugagaucaugccauugcacuccagccugggcaacgagagugaaacuccgucccc

SEQ ID NO: 393657 - RNA, 63 nt, Human
cagugcagauggagcccaaggcccccucggccuccugggcaacuugggguacacaggauacug

SEQ ID NO: 393658 - RNA, 63 nt, Human
ugacccggccacgucccccugccgcaucuuugaccugggcagcgacaacgaggaggugguggc

SEQ ID NO: 393659 - RNA, 63 nt, Human
uccagcuccuugaaccccuccagcccgcuucagccugggcaucacugcaggccccgugcuccu

SEQ ID NO: 393660 - RNA, 63 nt, Human
gagccacacauacucacagcccccgggcucuacccugggcacagcagagacagacuggugguu

SEQ ID NO: 393661 - RNA, 63 nt, Human
gccucccgccuccucccccaucccccugccuccccugggcacuguggcuuccuccugcgccug

SEQ ID NO: 393662 - RNA, 63 nt, Human
gcagugagccaagaucacggcacugcgcugcagccugggcaacacagugagacccugucaaaa

SEQ ID NO: 393663 - RNA, 63 nt, Human
guggguugcuugagcucaggaguuugagaccagccugggcaacauggcacaauugucucuaca

SEQ ID NO: 393664 - RNA, 63 nt, Human
ugauugugcaugugaauagccacugcacuccagccugggcaacauagcaagacuccaucucua

SEQ ID NO: 393665 - RNA, 63 nt, Human
cugcaggagcuucccaagcuggucacagagucuccugggcacagguuauacagaccccagccc

SEQ ID NO: 393666 - RNA, 63 nt, Human
cuuuguuauauggaugggaacccuaacuuagggccugggcaggggaaagagaaagaaggugag

SEQ ID NO: 393667 - RNA, 63 nt, Human
cagaggaagaggccugcuccacuugucugggaaccugggcaggaggcacagaggaagccaagg

SEQ ID NO: 393668 - RNA, 63 nt, Human
gaggauugcuugagcccaagaguuggagaccagccugggcaacauggugagaccaauugacug

SEQ ID NO: 393669 - RNA, 63 nt, Human
gcagugagccaagauugcgccccugcacuccagccugggcaacagagcaagacuccaucucaa

SEQ ID NO: 393670 - RNA, 63 nt, Human
gcagugagccaaagguacaccacuacacuccagccugggcaacagagcaagacucggucucaa

SEQ ID NO: 393671 - RNA, 63 nt, Human
ggcccgccucuccucgguucaaggucacuguuuccugggcacgcacuggguugcgggacagag

SEQ ID NO: 393672 - RNA, 63 nt, Human
ucucccuccucugcccccauccccuggcucuccccugggcacagugccacucccuuggaaggg

SEQ ID NO: 393673 - RNA, 63 nt, Human
ccagccuggccaacauggugaaaccccaucucuccugggcauguagucccagcuacucgggag

SEQ ID NO: 393674 - RNA, 63 nt, Human
uccaaccacugugccacugacuugcugugugacccugggcaagucacuuaacuauaaggugcc

SEQ ID NO: 393675 - RNA, 63 nt, Human
ccuugagcaguguacagccugcucaacaaccgcccugggcaggccgcuccugagcugcugucu

SEQ ID NO: 393676 - RNA, 63 nt, Human
gcugggggugagaggcuggugguugccucccguccugggcaggcugcagccucaugccauguc

SEQ ID NO: 393677 - RNA, 63 nt, Human
aauucucaggcuauucugagcucagaaaaguccccugggcacuagguaaagcccagugaaugu

SEQ ID NO: 393678 - RNA, 63 nt, Human
guggugagccaagaucgcgccauuguacuccagccugggcaacaagagcaagauucugccuca

SEQ ID NO: 393679 - RNA, 63 nt, Human
gcggaucaccugaaaucaggaguuccagaccagccugggcaacauggugaaaccccgucucua

SEQ ID NO: 393680 - RNA, 63 nt, Human
gcagccuaugugcagguacgugcagcacuacggccugggcagugccugugacaacguagagcg

SEQ ID NO: 393681 - RNA, 63 nt, Human
gcagugagccgaauaugcgccacugcacuccagccugggcaacagagcaagacuccgucucca

SEQ ID NO: 393682 - RNA, 63 nt, Human
gcagucagucaugauggcaccacugcacuccagccugggcaacagagcaagauccugucuuua

SEQ ID NO: 393683 - RNA, 63 nt, Human
gagcaucucuugaggccaggaguuugagaccagccugggcagcauagcaagacacaucccuac

SEQ ID NO: 393684 - RNA, 63 nt, Human
gcagugagcugagauugugucauugcacuccagccugggcaacaagagcaaaacucugucuca

SEQ ID NO: 393685 - RNA, 63 nt, Human
gaagauugccugagcucaggaguuugagaccagccugggcaacacggugaaaccccgucucua

SEQ ID NO: 393686 - RNA, 63 nt, Human
gcagugagcugagaucaugccacugcacuccagccugggcaacagagcaagacucugccucaa

SEQ ID NO: 393687 - RNA, 63 nt, Human
gaaaccccaucucuacuaaacaugcaaaaauuaccugggcaugguggcaggugcuuauaaucc

SEQ ID NO: 393688 - RNA, 63 nt, Human
agagggacgccugggggugccaggaccagucaaccugggcaaagccuagugaaggcuucucuc

SEQ ID NO: 393689 - RNA, 63 nt, Human
ggaagauugagcugggggcaacagccaagcucaccugggcaggucucugccaccuccuugcuc

SEQ ID NO: 393690 - RNA, 63 nt, Human
caaaggggcuccacaugagagguccugcaugccccugggcacaacaaggacugauucaaucug

SEQ ID NO: 393691 - RNA, 63 nt, Human
gcccauagacggcacaggccaccuggcccauucccugggcauucccugcuuugcauugcugcu

SEQ ID NO: 393692 - RNA, 63 nt, Human
ggggccccagguacuguggagagcauaguccagccugggcauuugucuccuagcagccuacac

SEQ ID NO: 393693 - RNA, 63 nt, Human
guagugagccaagaucgugccacuacacuccagccugggcaacaaagcaagaccuugucucaa

SEQ ID NO: 393694 - RNA, 63 nt, Human
gcagaucacuugagcccaggaguucgagagcagccugggcaacaugacgaaaccccgucucua

SEQ ID NO: 393695 - RNA, 63 nt, Human
augcuaaagaaaugucuguacaaaauaagauggccugggcagaguugguugucugagugagaa

SEQ ID NO: 393696 - RNA, 63 nt, Human
cugggcuggggugcaggucaucacaggacggcuccugggcagcugggcccuccuggguggggu

SEQ ID NO: 393697 - RNA, 63 nt, Human
accucccccaggagaucaggauuccacugacguccugggcagccagugaauuuaauuuuccau

SEQ ID NO: 393698 - RNA, 63 nt, Human
caagaucacuugagcccaggaguuuaagaccagccugggcaacauagcaagacccugucucua

SEQ ID NO: 393699 - RNA, 63 nt, Human
auuccacauguguucccucuauccguccugcuuccugggcagcugguggugcugggaaugggg

SEQ ID NO: 393700 - RNA, 63 nt, Human
gcagugagccaggauugugccauugcacuccagccugggcaacaagaacaaaacuccaucuca

SEQ ID NO: 393701 - RNA, 63 nt, Human
ccuaccccaccacaccccaucccagaggccuugccugggcaacccuaagccccugucccucgc

SEQ ID NO: 393702 - RNA, 63 nt, Human
guccuaagcuguauuugugaauugugcugguuuccugggcauugccacgccuaccacaggugg

SEQ ID NO: 393703 - RNA, 63 nt, Human
ugccccugcucuggggccugcugagccggcugcccugggcacccgguuccaggcagcacagac

SEQ ID NO: 393704 - RNA, 63 nt, Human
cacagcaacugccaaucccgcugaagaggccucccugggcacagcacaggcugcacggugcac

SEQ ID NO: 393705 - RNA, 63 nt, Human
uguucagaagcugcugccugagggcagggccuaccugggcacacagaagagcauaugggaggg

SEQ ID NO: 393706 - RNA, 63 nt, Human
ccuggacggcuggaugggccugggcugggugggccugggcagcugggugggccugggcagcug

SEQ ID NO: 393707 - RNA, 63 nt, Human
ccugggcugggugggccugggcagcugggugggccugggcagcugggugggccugagcuaggg

SEQ ID NO: 393708 - RNA, 63 nt, Human
cagccauggaguagaggccuaaguugacacugcccugggcagacaagacaggagcugucgccc

SEQ ID NO: 393709 - RNA, 63 nt, Human
aauggguccauuuugcccuuccauagccuaaucccugggcauugcuuuccacugagguugggg

SEQ ID NO: 393710 - RNA, 63 nt, Human
cgguaacugcacuugggcagggaauauagccuuccugggcacaacuagcugacaaugacaggu

SEQ ID NO: 393711 - RNA, 63 nt, Human
gaaagauggggaaggguguggaguggggaggagccugggcagccugcugggugggccacacuc

SEQ ID NO: 393712 - RNA, 63 nt, Human
gugccucucaugcugccuccucugcccauggguccugggcacccaggccugcccugccugcug

SEQ ID NO: 393713 - RNA, 63 nt, Human
ccccuguuccccucagcuuucccuccucgcuggccugggcacccuccugggagcaggccuucc

SEQ ID NO: 393714 - RNA, 63 nt, Human
caggcuuggggcuggggcaggcuugggcucaauccugggcacccaggggcagcccaccccuaa

SEQ ID NO: 393715 - RNA, 63 nt, Human
gaggugagccaugauuacuccacugcacuccagccugggcaacagagccaggcccuguaucaa

SEQ ID NO: 393716 - RNA, 63 nt, Human
uaccuccaaaauccccuuuuuguucuuccuggaccugggcauucagccuccugcucuuaacug

SEQ ID NO: 393717 - RNA, 63 nt, Human
ucaggacuggagcccccgugccuuggucuccccccugggcacacgugcucacucaggcccagc

SEQ ID NO: 393718 - RNA, 63 nt, Human
cucugccaaucaugaccuguuccuuccugaaguccugggcaugcaucugggacccccguggag

SEQ ID NO: 393719 - RNA, 63 nt, Human
gaggauagcuugagcccaggagugcaagaccugccugggcaauauacugagaccccauucucc

SEQ ID NO: 393720 - RNA, 56 nt, Human; identical to SEQ ID NO: 79217

SEQ ID NO: 393721 - RNA, 63 nt, Human
ucucagcccgggacagggucuugcaagcagccuccugggcagucguaaggguugcggcgugau

SEQ ID NO: 393722 - RNA, 61 nt, Human; identical to SEQ ID NO: 82702

SEQ ID NO: 393723 - RNA, 63 nt, Human
auccagcugggccagccucgugcugggcucugcccugggcagacaggcagagggccagagcag

SEQ ID NO: 393724 - RNA, 63 nt, Human
gaggaaugcuugagcccaagaguuuuagaccagccugggcaacacaguaagacccuguuucua

SEQ ID NO: 393725 - RNA, 63 nt, Human
cuuuaaaccccaggagacugaaacucaaacaacccugggcaaguaaugugcaaaagauggcag

SEQ ID NO: 393726 - RNA, 63 nt, Human
acagauggcuugagcucaggaguucgugaccagccugggcaacccugucucuacaaaaaauac

SEQ ID NO: 393727 - RNA, 63 nt, Human
gaggacugcuugagcccaggaguuugagaccagccugggcaauguagcaagaccccaucucua

SEQ ID NO: 393728 - RNA, 63 nt, Human
gagaauuacuugagcccaggaguuugaauccauccugggcagcauacugagacccugccuuua

SEQ ID NO: 393729 - RNA, 63 nt, Human
guagauugcuugagcccaggaguuagagaccagccugggcaacaugaugugaaaacccaucuc

SEQ ID NO: 393730 - RNA, 63 nt, Human
gaagacugcuugagcccaggaguucaagaccagccugggcaacguaggaagacuccgucucua

SEQ ID NO: 393731 - RNA, 63 nt, Human
uugaggcucugucacugagcaaugguaacugcaccugggcagcuccucccugugcccccagcc

SEQ ID NO: 393732 - RNA, 63 nt, Human
aggguacgugccaucaucucuccagcccaggccccugggcaucucaugcuggggggaagggac

SEQ ID NO: 393733 - RNA, 63 nt, Human
augucccuccacuguuccuaucagcagguggccccugggcaucagaacagccugcccugggca

SEQ ID NO: 393734 - RNA, 63 nt, Human
agcagguggccccugggcaucagaacagccugcccugggcaccagguggcagacacacucaga

SEQ ID NO: 393735 - RNA, 63 nt, Human
agaagguguaaaagagcugcccuuggugggugcccugggcauguugcaacgccugcuggugcc

SEQ ID NO: 393736 - RNA, 63 nt, Human
gcagugagucaagaucucaccacugcacuccagccugggcaacagagggagacucugucucaa

SEQ ID NO: 393737 - RNA, 63 nt, Human
gcagugagccgagaccgcgccacugcacuccagccugggcaacagagcaaaacuccaacucaa

SEQ ID NO: 393738 - RNA, 50 nt, Human; identical to SEQ ID NO: 79235

SEQ ID NO: 393739 - RNA, 63 nt, Human
cuuggcacagcccugacuugaacucugggugacccugggcacccacagaacugggagugaggg

SEQ ID NO: 393740 - RNA, 63 nt, Human
gaggaucacuugaguccagaaauucaagacccgccugggcaucauaaugagaccccaucucua

SEQ ID NO: 393741 - RNA, 63 nt, Human
acagugauccacgaucguaccacuacacuccagccugggcaacagagcaagacccugucucaa

SEQ ID NO: 393742 - RNA, 63 nt, Human
caguggagccaagauugcgccacugcacuccagccugggcaacagagcgggacuccaucucaa

SEQ ID NO: 393743 - RNA, 63 nt, Human
guguccccaacgcaggccccacucugagccugcccugggcagccucggacuaugacuggcuac

SEQ ID NO: 393744 - RNA, 63 nt, Human
gggcuuuaugugcuagauuuuaauauccuugagccugggcaagugcacaagucuuuuuaaaag

SEQ ID NO: 393745 - RNA, 63 nt, Human
gaggaucacuugaggccaggaguucaagaccagccugggcaacauagugagaaugcaucucua

SEQ ID NO: 393746 - RNA, 63 nt, Human
aaaguacugugauuacaagcgugagccacggcaccugggcagaaaaguaucuuaauuaaugaa

SEQ ID NO: 393747 - RNA, 63 nt, Human
agggaggcaggggguggggggccuuccuuuccuccugggcaccccgugugcugugaucuccug

SEQ ID NO: 393748 - RNA, 63 nt, Human
accagcccagccccauccgcaagccaggcugggccugggcauaacuucgcugggcucucccaa

SEQ ID NO: 393749 - RNA, 63 nt, Human
cuauaaauguuaugggggagaucuuauaaauuuccugggcaagaguguaugcauacaaaguuu

SEQ ID NO: 393750 - RNA, 63 nt, Human
cuggucccagccagcaguucagagcugcccucuccugggcagcugccuccccuccucugcuug

SEQ ID NO: 393751 - RNA, 63 nt, Human
cucaccuggcuucccaggacccugggucaccuuccugggcagcccagagagacccugccaacu

SEQ ID NO: 393752 - RNA, 63 nt, Human
uccacaucccgaaacuccacccguucccacugcccugggcagccaucuugaauaugggcggaa

SEQ ID NO: 393753 - RNA, 63 nt, Human
uuucucuuuuccucaagggguuuggggcaggagccugggcacuuacuccccguuuuugcuguu

SEQ ID NO: 393754 - RNA, 63 nt, Human
gagugucggauccugugaguaggcugggccuccccugggcaggguucuccaagggcccgguuu

SEQ ID NO: 393755 - RNA, 63 nt, Human
cggagcacgggggagucugugguggccaguuuaccugggcaucuggcugagaggaagaaaggc

SEQ ID NO: 393756 - RNA, 63 nt, Human
uccccggcaggggugggaggcagcaggggucagccugggcaggaaccucucccaacucugucc

SEQ ID NO: 393757 - RNA, 63 nt, Human
ggauuguugggcuugggggaaaagagguggauuccugggcaagaaccuaaaguagcaggacuc

SEQ ID NO: 393758 - RNA, 63 nt, Human
gcagugagccgaaaucacgccacuacacuccagccugggcaacagagggagacuccaucucaa

SEQ ID NO: 393759 - RNA, 63 nt, Human
guggugagccgagauugcaccauugcgcucuagccugggcaacaacagcaaaacuccaucuca

SEQ ID NO: 393760 - RNA, 63 nt, Human
ugccucccuagaggacuccauggcugagaggcuccugggcagauggggucaaggcugggccag

SEQ ID NO: 393761 - RNA, 63 nt, Human
guccagcuccuuaaacugacgcuagucaauaaaccugggcaagugaggcaagagaaaugagga

SEQ ID NO: 393762 - RNA, 63 nt, Human
cuagggugguguggaggggcugguccccugacaccugggcagauggggucuccuucagucucc

SEQ ID NO: 393763 - RNA, 63 nt, Human
ggcucugccuucuccaugggguaaccacccucgccugggcaggggcagccaaggcugggaaau

SEQ ID NO: 393764 - RNA, 63 nt, Human
uucacucagcaggugccugggcuucuuaaggcuccugggcaaggcgugggaguuguccugacu

SEQ ID NO: 393765 - RNA, 63 nt, Human
gcagugagccgagaccgugccacugcacuccagccugggcaacacagcgagacuccgucucga

SEQ ID NO: 393766 - RNA, 63 nt, Human
uaauguaugugugcccucccugugggcacaccaccugggcauuaggacugaaauuccugaguu

SEQ ID NO: 393767 - RNA, 63 nt, Human
cugacauuaccucuuccugcaacuaaacacgagccugggcagaaccucucagccuuccucuac

SEQ ID NO: 393768 - RNA, 63 nt, Human
ugagcuggggggaucauugugaaggccuucuucccugggcaccugguaccuggggaccuacaa

SEQ ID NO: 393769 - RNA, 63 nt, Human
auccuucucugcuugaccugaagaagggccagaccugggcagaaagacuccagcaggugagcu

SEQ ID NO: 393770 - RNA, 63 nt, Human
ccccuuggccaaccacaucucccugcuguguccccugggcauuucucuaccucccagguggaa

SEQ ID NO: 393771 - RNA, 63 nt, Human
gucugauaagaacccaggguggagagggagacuccugggcagccguuuuccucauccuuuccc

SEQ ID NO: 393772 - RNA, 63 nt, Human
gggcagucucaguugcaaucagugugugcccagccugggcagacaggaaauuccucggauaca

SEQ ID NO: 393773 - RNA, 63 nt, Human
agguucugggagaaacaggggacccccucaccuccugggcagugaccccuacuaggcucccau

SEQ ID NO: 393774 - RNA, 63 nt, Human
ucuccugccaugggugcagacccugaacccacaccugggcaucagggccuuucuccuccccac

SEQ ID NO: 393775 - RNA, 63 nt, Human
gcagugagccgagaucacgccacugcacuccagccugggcaacaagagugaaacuccgucuca

SEQ ID NO: 393776 - RNA, 63 nt, Human
uuggucacaugagucugucuccuuacuuuagucccugggcaauccuugcuuaaugcuuuuguu

SEQ ID NO: 393777 - RNA, 63 nt, Human
aggauggcuuugggccuaguaguucgaguccagccugggcagcauagugugagacccugucuc

SEQ ID NO: 393778 - RNA, 63 nt, Human
gcagugagccgagaucguaccauugcacuccagccugggcaacaagagcgaaacuccauuuca

SEQ ID NO: 393779 - RNA, 63 nt, Human
gcagugagccaagauugcaccacuguacuccagccugggcaacagagggagacuccaucuaga

SEQ ID NO: 393780 - RNA, 63 nt, Human
gacccugaagacuugcuuuuaaacaaagaaaauccugggcacuucugcagggcugcugguucc

SEQ ID NO: 393781 - RNA, 63 nt, Human
cugccaaguuguccagcagcagaguggcccuggccugggcaucacaagccagugaugcuccug

SEQ ID NO: 393782 - RNA, 63 nt, Human
cucuaccagcaucauccuggggcccagcucaggccugggcauauggaaagaaccaucaucuug

SEQ ID NO: 393783 - RNA, 63 nt, Human
gggaggaucacuugaguccagguucaagacuagccugggcaacauggcaagacccugucccua

SEQ ID NO: 393784 - RNA, 63 nt, Human
gcagugaacugagaucacgacacugcacuccagccugggcaacaguaaaaccuggucuccaaa

SEQ ID NO: 393785 - RNA, 63 nt, Human
ggccaaggccuguggacgacgcuggcggcccagccugggcagguuucagggugccagugggaa

SEQ ID NO: 393786 - RNA, 63 nt, Human
gaggauggcuugaacacagguguucaaggccagccugggcaacauaacaagauccugucucuc

SEQ ID NO: 393787 - RNA, 63 nt, Human
uggagaaguguguuucuuccccuuacucucacaccugggcaaacuuucuucaguguuuuucau

SEQ ID NO: 393788 - RNA, 63 nt, Human
gcaguaagcugagaucgcgccacugcccuccagccugggcaacagagcaagacuccaucucaa

SEQ ID NO: 393789 - RNA, 63 nt, Human
ugaagcaggcagauauuuugagcccaggaccagccugggcaacauggugaaagcucaucucua

SEQ ID NO: 393790 - RNA, 63 nt, Human
ugccuuugcaauaccugcauccccagcacugguccugggcacuuccccaccccagccaggugu

SEQ ID NO: 393791 - RNA, 63 nt, Human
uucuguuauaaccuauggggucaggauaugaguccugggcauuauuuauccaggacccauccu

SEQ ID NO: 393792 - RNA, 63 nt, Human
cccuugagcugggaacucaggcuccuggaaaaaccugggcagugggaggcucagcugcgggcc

SEQ ID NO: 393793 - RNA, 63 nt, Human
gugggggcagcuccucuucuucugacucagagcccugggcagaucagcagauacaugucagug

SEQ ID NO: 393794 - RNA, 63 nt, Human
acagugagccuugauugugucacugcacuccagccugggcaacagguaagacucugucucaaa

SEQ ID NO: 393795 - RNA, 63 nt, Human
gaugaucaccugaggucaggaguucaagaucagccugggcaacauggcgaaaccccgucucua

SEQ ID NO: 393796 - RNA, 63 nt, Human
gacaauguuaagaaauuuaaaaaaaaaaaaaagccugggcaugauggcucaugcuuguaaucu

SEQ ID NO: 393797 - RNA, 63 nt, Human
uacaguagccgagaucgcgccacugcauuccagccugggcaacaaaagcgaaacucugucuca

SEQ ID NO: 393798 - RNA, 63 nt, Human
gcagugagcugagaucgcaccauugcacuccagccugggcaacaagagcgaaacucugucuca

SEQ ID NO: 393799 - RNA, 63 nt, Human
gaagggagcccgggcagccaccgucuccagagcccugggcagcauuuuccagcaagauguaca

SEQ ID NO: 393800 - RNA, 63 nt, Human
gaggacugcuugagcccaggaguucaagaucagccugggcaacagagugagauaagacccaau

SEQ ID NO: 393801 - RNA, 63 nt, Human
ggcucuucggagcugucagcgcccggugccugcccugggcaccucccugcagucaucucuuug

SEQ ID NO: 393802 - RNA, 63 nt, Human
ggccaggguggccagccccgccaggaggccuggccugggcacacgcacugacgugggccuggg

SEQ ID NO: 393803 - RNA, 63 nt, Human
gcagugagcugagauugcgccacugcacuccagccugggcaacaagagcaaaacuccgucuca

SEQ ID NO: 393804 - RNA, 63 nt, Human
gcagugagccgagaucacaccacugcacuccagccugggcaacaagagcaaaacuccgucuca

SEQ ID NO: 393805 - RNA, 63 nt, Human
gaggagugcuugaggccaggaguucaagaccagccugggcaacauagggagacccccaucuuu

SEQ ID NO: 393806 - RNA, 63 nt, Human
ucuucccuuuguguaucuuaccuaguguuuacuccugggcacccuuaaucuucagaggugcua

SEQ ID NO: 393807 - RNA, 63 nt, Human
gcagugagccgagaucaugccacugcacuccagccugggcaacagagcaagacuccaucucga

SEQ ID NO: 393808 - RNA, 63 nt, Human
caguuccuccucucccucccggugagcugcugcccugggcagaggggaggagaauuccaggac

SEQ ID NO: 393809 - RNA, 63 nt, Human
agguuagacguucccugcccugggacgcucaccccugggcaagaggcuggaaguucacaccau

SEQ ID NO: 393810 - RNA, 63 nt, Human
acuugcguucucggggcugucgauuuccugccaccugggcagauaaccuggagauuuucaccu

SEQ ID NO: 393811 - RNA, 63 nt, Human
auaggggccccacccagacuuaacaggcaagguccugggcauugcgcgacgcaggacucaaug

SEQ ID NO: 393812 - RNA, 63 nt, Human
gaggauugcuucagcccaggaguuugagaccagccugggcaacauagcaaaaccccaucucua

SEQ ID NO: 393813 - RNA, 63 nt, Human
ggaagaucucuugagguaagaauuugagaccagccugggcaaaauagaccccaugucuacaaa

SEQ ID NO: 393814 - RNA, 63 nt, Human
cagugagccaaguucacaccacugccauuuccuccugggcaacagagugagacccuaucacaa

SEQ ID NO: 393815 - RNA, 63 nt, Human
gauaaaagcaauuuuaacuugcagaugugagccccugggcacaaugagccgcuaaaugggagc

SEQ ID NO: 393816 - RNA, 63 nt, Human
gcagugagccgagaucgcgccacugcacuccagccugggcaacagagugagacucugucucaa

SEQ ID NO: 393817 - RNA, 63 nt, Human
aagauugagaagugaaacgguuugcgcagggguccugggcacgccugcggggucgcucaagga

SEQ ID NO: 393818 - RNA, 63 nt, Human
auggaucgcuugagcccaggaguuugagaccagccugggcaacauggcaaaaccccaucucua

SEQ ID NO: 393819 - RNA, 63 nt, Human
gaggauugcuugaggccaggaguuugagaccagccugggcaacauagggagacccagucucua

SEQ ID NO: 393820 - RNA, 63 nt, Human
ccagugagccgagaucgugccacugcacuccagccugggcaacagagugagacuucgucucaa

SEQ ID NO: 393821 - RNA, 63 nt, Human
gagggaggagucauguuggagguuggggaagaaccugggcauccuuccccucaagccugggcu

SEQ ID NO: 393822 - RNA, 63 nt, Human
ggcaucguacuaguugggcgagaccuaaaauucccugggcacagguugcaccugggugugagc

SEQ ID NO: 393823 - RNA, 63 nt, Human
gcaaagcuauagagacaggugcauucagaacauccugggcaccagucaugagucuuacugugu

SEQ ID NO: 393824 - RNA, 63 nt, Human
guuuacauguccgaugggggcaggagcucccauccugggcagccaaccaggcaacaccaagga

SEQ ID NO: 393825 - RNA, 63 nt, Human
uuccuuggggaugaggguugggugcuauggcauccugggcaggugcuuccuuucugcacaagg

SEQ ID NO: 393826 - RNA, 63 nt, Human
uuagugaucuaagaucaugccacugcacuccagccugggcaacagagugagacccuguuucua

SEQ ID NO: 393827 - RNA, 63 nt, Human
guggaccgcuugaguccacgaguuuaagaccagccugggcaacauggugaagccccaucucua

SEQ ID NO: 393828 - RNA, 63 nt, Human
caacgugacgggcagcaacgccgucaaugucuuccugggcaucggccuggccugguccguggc

SEQ ID NO: 393829 - RNA, 63 nt, Human
gaagugggagauugcuugaguccaggagaccagccugggcaacauagcaaaaccucaucucua

SEQ ID NO: 393830 - RNA, 63 nt, Human
gcagugagccaagauugcgccauugcacuccagccugggcaacaagagagaaacucugucuca

SEQ ID NO: 393831 - RNA, 63 nt, Human
ucaguggcagugcuguaccccugggcagugcuaccugggcacacacguagacaagggcagcua

SEQ ID NO: 393832 - RNA, 63 nt, Human
auguuaagggcauuucaguggcagugcuguaccccugggcagugcuaccugggcacacacgua

SEQ ID NO: 393833 - RNA, 63 nt, Human
gcagugagccaagauugcaccacugugcucccaccugggcaacagugagacccugucucaaaa

SEQ ID NO: 393834 - RNA, 63 nt, Human
gcagaucacugaagcucaggaguucaagaccagccugggcaacauggcgaaacuccauuucua

SEQ ID NO: 393835 - RNA, 63 nt, Human
cagcucggacaccaggcugagcccggcgcagcaccugggcaguguccccaccccaggcccucc

SEQ ID NO: 393836 - RNA, 63 nt, Human
aaaguggaccaguauuuguaauaaucgagaaugccugggcauuuuacaaaacaagaaaaaaaa

SEQ ID NO: 393837 - RNA, 63 nt, Human
ccgacaccagcccugcugcuuccuaacuuauugccugggcagugcccaccaugcaccccugau

SEQ ID NO: 393838 - RNA, 63 nt, Human
gcagaucacuugagcccaggaguuugaggccagccugggcaacauggugaaacccggugucua

SEQ ID NO: 393839 - RNA, 63 nt, Human
gugucccagaagugagaaggcagccuucgaaguccugggcauugggugagaaagugaugcuag

SEQ ID NO: 393840 - RNA, 63 nt, Human
ugugggauguugcugcaggacaguaagcccucaccugggcaaacaugaagcucuggccuccuu

SEQ ID NO: 393841 - RNA, 63 nt, Human
ugcgugggucuguuuuaacgugggccaagccuaccugggcagcccauuugccagggcuugccu

SEQ ID NO: 393842 - RNA, 63 nt, Human
guggugagccgagaucgcgccacugcacuccagccugggcaacaagagugaaacuccgucuca

SEQ ID NO: 393843 - RNA, 63 nt, Human
cuuccacggucacaugugcaucgccuuugagcuccugggcaagaacaccuuugaguuccugaa

SEQ ID NO: 393844 - RNA, 63 nt, Human
gcggugagcugagaucacgccauugcacuccagccugggcaacaagagcaaaacucagucuca

SEQ ID NO: 393845 - RNA, 63 nt, Human
gacuggcaacuauaacaucgaagacuuugccgaccugggcauguuuccaccguuuucugagua

SEQ ID NO: 393846 - RNA, 63 nt, Human
aaagauagcuugaguccaggaguuugagaccagccugggcaacauagugauaccccaucucuu

SEQ ID NO: 393847 - RNA, 63 nt, Human
ugaagguuaauaauaaaugggcucauuuaguugccugggcaccuauucacaaauucauuuguc

SEQ ID NO: 393848 - RNA, 63 nt, Human
gaccuaacgucuaccuuuacaucugcuguugaaccugggcacuaccuguuacagauccuguca

SEQ ID NO: 393849 - RNA, 63 nt, Human
uugaugucaccagugauacccacugcccugaccccugggcaggccccucucugcaucuacugg

SEQ ID NO: 393850 - RNA, 63 nt, Human
gggaauugcuugaacucaggaguuggagaccagccugggcaacauggcaaaacgcagucugua

SEQ ID NO: 393851 - RNA, 63 nt, Human
gcagugagccgagaucgcaccacugcacuccagccugggcaacagagugagacucugucuaaa

SEQ ID NO: 393852 - RNA, 63 nt, Human
ccccaggggcuccugaguauaggcuuuucagucccugggcaguguccuugaguuguuuuuuga

SEQ ID NO: 393853 - RNA, 63 nt, Human
cccacuucuaggccugcccugccgccguggagcccugggcaagcucuuuccccuuucugggcc

SEQ ID NO: 393854 - RNA, 63 nt, Human
ugccacccaggccgggcuagggacauggcagggccugggcauccuggcgcuggacuugggcga

SEQ ID NO: 393855 - RNA, 63 nt, Human
ucuguuccucucucuccugcagaugcaagagcuccugggcaggggugccugggccccagggug

SEQ ID NO: 393856 - RNA, 63 nt, Human
agaagucacugcaguauucccaauugcacuggcccugggcauggccuuacccagucuaagcug

SEQ ID NO: 393857 - RNA, 63 nt, Human
ggaccugagaugaccgcuguguggcgcucucucccugggcaggguggaugccacaggccccuc

SEQ ID NO: 393858 - RNA, 63 nt, Human
agugccggccaccgcugucagggauugcccaccccugggcaucauguguguggggccggggag

SEQ ID NO: 393859 - RNA, 63 nt, Human
ccugcccuaccuggcguccugguccaggggagcccugggcagaagcccccggccccuauacau

SEQ ID NO: 393860 - RNA, 63 nt, Human
gcagugagucgagaucgcgccagugcacuccagccugggcaagaagagcgaaacugggucuca

SEQ ID NO: 393861 - RNA, 63 nt, Human
ggaaugaggaaaauaugaacuacagcagaagccccugggcagcugugauggagccccugacau

SEQ ID NO: 393862 - RNA, 63 nt, Human
gccccguucugacccguguccccccaggcucugccugggcagaagacucaccuuggaggagug

SEQ ID NO: 393863 - RNA, 63 nt, Human
gcuuacagugagcugagauugcgccacuguacuccugggcaacagcgagacuccgucucaaaa

SEQ ID NO: 393864 - RNA, 63 nt, Human
gacagacuuugccacggugcucugcugcccccuccugggcacguccaggugagggagggcugg

SEQ ID NO: 393865 - RNA, 63 nt, Human
ggaacuguagacccguccugucgacugugugccccugggcaugugugagccucaguuuccuca

SEQ ID NO: 393866 - RNA, 63 nt, Human
gcagagccugggaggaaggcggccgcuggggcuccugggcauccucucuggggagcugcuggc

SEQ ID NO: 393867 - RNA, 63 nt, Human
agugcucggggccuuggggugcaugggugccgcccugggcagcuagagugucucagcccggug

SEQ ID NO: 393868 - RNA, 63 nt, Human
aggcggagccaagaugaugccauugcacuccagccugggcaacaagagagaagguccuucuca

SEQ ID NO: 393869 - RNA, 63 nt, Human
gcagugagcugagaucacaccauugcacuccagccugggcaaaaagagcaaaacucucccuaa

SEQ ID NO: 393870 - RNA, 63 nt, Human
accaaaaagccugcuuuaaaccgcaagauggggccugggcaugcgcaggaggagccaucgggu

SEQ ID NO: 393871 - RNA, 63 nt, Human
ggcgggggugagaacaucaaucgucagcgacagccugggcacccgcggggccgucccgccugc

SEQ ID NO: 393872 - RNA, 63 nt, Human
gaggaucgcuugagaccaggaguucgagaccagccugggcagcauagcaagauccccaucuuu

SEQ ID NO: 393873 - RNA, 63 nt, Human
aaggaucgcugcagcccaggaguucgagacuagccugggcaacauagcgagaccucgucucua

SEQ ID NO: 393874 - RNA, 63 nt, Human
gaggauugcuugagcccaggaguuugagaccagccugggcaacacagcgagaccuugucucuu

SEQ ID NO: 393875 - RNA, 63 nt, Human
gcugccauccucacccagcacccacaacuagcgccugggcagggcagggcuggcaccucucaa

SEQ ID NO: 393876 - RNA, 63 nt, Human
gcaaugaaccgagauagugccauugcacuccggccugggcaacagaggaagacugccucaaac

SEQ ID NO: 393877 - RNA, 63 nt, Human
gcagugagccaagauugcgccauugcacuccagccugggcaacacagcgagacuccgucucaa

SEQ ID NO: 393878 - RNA, 63 nt, Human
guggaucacuuaagcucaggaguucaaggccagccugggcaacauggcaaaaccccauuucua

SEQ ID NO: 393879 - RNA, 63 nt, Human
cccagcucgccagggaugugggcagagcaccagccugggcaucaggaagccaaguuucaagga

SEQ ID NO: 393880 - RNA, 63 nt, Human
ugguccuucccagaaacugccaguagagggcagccugggcauccuaaugcuuacucugguugu

SEQ ID NO: 393881 - RNA, 63 nt, Human
gccccagggagagggggcuggugggugccuaggccugggcaguggauggccgugaaugggugc

SEQ ID NO: 393882 - RNA, 63 nt, Human
uuuuuuuauaccuaaauaaagaaaaaucuuuagccugggcaacauagggagacccuaucucua

SEQ ID NO: 393883 - RNA, 63 nt, Human
gcggugagccaagaucgcaccauugcacuccagccugggcaacaagagugaaacucugucuca

SEQ ID NO: 393884 - RNA, 63 nt, Human
gcagugagcugagauugugccacuguacuccagccugggcaacaagagcgagacuccguuucc

SEQ ID NO: 393885 - RNA, 63 nt, Human
ccuucccuguuccuuucuugcacgcgcucccugccugggcacaccaaacugguugaaacacag

SEQ ID NO: 393886 - RNA, 63 nt, Human
guucugcacugugggcuggcucucugccccaacccugggcacuggccccuggcugggccauuu

SEQ ID NO: 393887 - RNA, 63 nt, Human
gaacuuaggguggguaccucugagucccagggaccugggcaggcccaagcccaccacgagcau

SEQ ID NO: 393888 - RNA, 63 nt, Human
ggaccgcaggccauuguugaacuccucuauacuccugggcacugguugacaguacugaggcuu

SEQ ID NO: 393889 - RNA, 63 nt, Human
cuuagacacauccuccuaccguccccaaugcccccugggcaggaggcaguggagaaccaagcc

SEQ ID NO: 393890 - RNA, 63 nt, Human
gaagaucgcuugaggccaagaguucaagaccagccugggcaacauagcgagaccccuaucugu

SEQ ID NO: 393891 - RNA, 63 nt, Human
acuaagauacuguagacuggacaagaaauucuaccugggcaccuaggugaugccuucuuucuu

SEQ ID NO: 393892 - RNA, 63 nt, Human
ccugccaccaagguuuccucucuucccccaggaccugggcagagcaggcaugagcugggcugu

SEQ ID NO: 393893 - RNA, 63 nt, Human
uggugauauuguguggucugguuccugugugacccugggcaguuccuuaccucccuggucccc

SEQ ID NO: 393894 - RNA, 63 nt, Human
gugggaggucccucacuccacgggacagaggccccugggcagcagaggaaaccuacagcucug

SEQ ID NO: 393895 - RNA, 63 nt, Human
cacccuuggcccagccuccccacaaagccugacccugggcaggugagugacggguguguccuc

SEQ ID NO: 393896 - RNA, 63 nt, Human
ucagcccuugcacccggccgggcucaguucaggccugggcaccgagcuucacccugggugggu

SEQ ID NO: 393897 - RNA, 63 nt, Human
cucagguacagcgggcugugcccggccccacccccugggcagaugucccccacugcuaaggcu

SEQ ID NO: 393898 - RNA, 63 nt, Human
ggcggggggucagcagcaugucccugggcaggcccugggcacccugucuccccuggucucacu

SEQ ID NO: 393899 - RNA, 63 nt, Human
gggugcaggguggcggggggucagcagcaugucccugggcaggcccugggcacccugucuccc

SEQ ID NO: 393900 - RNA, 63 nt, Human
guggauugcuugagcccaggaguucaagagcagccugggcaauauagaaagaccucuucccua

SEQ ID NO: 393901 - RNA, 63 nt, Human
caggccugaaacucccuuuccaggacucucaucccugggcacagaauucaggaaacugcuaga

SEQ ID NO: 393902 - RNA, 63 nt, Human
uggggccagggaaucugcauuucuaacgcgcucccugggcaacgcuucagaugcguugaaguu

SEQ ID NO: 393903 - RNA, 63 nt, Human
gcaaugagcuauaauugcaucauugcacuccagccugggcaacagagacccugucucaaccac

SEQ ID NO: 393904 - RNA, 63 nt, Human
cacacaaggaauauaaaaaccaccacccuccagccugggcaacguaguaaaaccucaucuaua

SEQ ID NO: 393905 - RNA, 63 nt, Human
gcagugagccgagauugugccacugcacuccagccugggcaacagagcuagacucugugucaa

SEQ ID NO: 393906 - RNA, 63 nt, Human
gcagugaguugagauugugccauugcacuccagccugggcaacagagcaagacucugucucag

SEQ ID NO: 393907 - RNA, 63 nt, Human
cacugugccuuagaaucgccccuggacagaguuccugggcagaggggaaagcagcucccaggc

SEQ ID NO: 393908 - RNA, 63 nt, Human
gaggaucauuugagcccaggaguucgagaccaaccugggcaacauagugagauucuguuaaaa

SEQ ID NO: 393909 - RNA, 63 nt, Human
gagagugcauucacacucuuguucccuagaaagccugggcaccucccacucgauuccugcucc

SEQ ID NO: 393910 - RNA, 63 nt, Human
guugcccaaauucagugucagugaaguucuuuuccugggcaaucuuaacaucuuuacucuuau

SEQ ID NO: 393911 - RNA, 63 nt, Human
gcugggccuaggggugcagggucagugcugaggccugggcagggccgcuagccucccugagcu

SEQ ID NO: 393912 - RNA, 63 nt, Human
uagucagguagauucagaccuuguccacaccuuccugggcaacccccaccaugaaccugucag

SEQ ID NO: 393913 - RNA, 63 nt, Human
caaacacaaucagaaccagccaaagaagcacuuccugggcacggccaccagcucucccgccuc

SEQ ID NO: 393914 - RNA, 63 nt, Human
guuggugaacggaccaugcuuccguagcucugaccugggcagcuuggaccuggucauccucua

SEQ ID NO: 393915 - RNA, 63 nt, Human
cguagauuugcugcugaugaaaauacucaguuuccugggcauuaagucuaagagagaggagcc

SEQ ID NO: 393916 - RNA, 63 nt, Human
cauaaaaucccugccuucuugagcuaacauucuccugggcauccccacuccauuuucagauga

SEQ ID NO: 393917 - RNA, 63 nt, Human
ucagcaagugcccaguggagccugccgcccccgccugggcaccgggacccccucaccauccag

SEQ ID NO: 393918 - RNA, 63 nt, Human
agccuuccuuucuccugccccaagggcccagacccugggcaaacagagcuacugagacuugga

SEQ ID NO: 393919 - RNA, 63 nt, Human
ggacggcaccccagugguggcagagcuugggggccugggcaggggcccgcuuggcgggccggg

SEQ ID NO: 393920 - RNA, 63 nt, Human
caccuuggcugugggcugugaacauuccgggacccugggcaucuuaucuagguccgugcagcc

SEQ ID NO: 393921 - RNA, 63 nt, Human
uggcagugggggaggaggagagggaagauggucccugggcacuguggcagcuaaccacaggaa

SEQ ID NO: 393922 - RNA, 63 nt, Human
ucccaggcccuggagaccuccaggcuuuccugcccugggcagccccaccucacagccagaguc

SEQ ID NO: 393923 - RNA, 63 nt, Human
ccaaacaggcucagaggguguccugcaccggggccugggcaggagggaggugcuucuaguucu

SEQ ID NO: 393924 - RNA, 59 nt, Human; identical to SEQ ID NO: 79421

SEQ ID NO: 393925 - RNA, 63 nt, Human
gcagugagccgagauccugccacugcacuccagccugggcaaccaagcgagacucugccuuaa

SEQ ID NO: 393926 - RNA, 63 nt, Human
gcagugagucaagaucacgccauugcacuccagccugggcaacaagagcgaaacuccaucuca

SEQ ID NO: 393927 - RNA, 63 nt, Human
gaggauuacuugaaacccacaguuugagaccagccugggcaacauagugagacccugucucua

SEQ ID NO: 393928 - RNA, 63 nt, Human
cucuagcagcaauuuccagcuguguaacacuauccugggcaaauguuuuacccuguccuccag

SEQ ID NO: 393929 - RNA, 63 nt, Human
ucgccaucuuggugacuuugaauuuaucuggcuccugggcaggucuucuccuccucuccaucc

SEQ ID NO: 393930 - RNA, 63 nt, Human
ugacacaguagauguggaacaccuagcccagugccugggcaggucccuauuaucauaaaugaa

SEQ ID NO: 393931 - RNA, 63 nt, Human
accaauccaccaacagaaugugguuucugccauccugggcagaagcugaaggccagcuucaca

SEQ ID NO: 393932 - RNA, 63 nt, Human
gugggguggggggugcuucugugcccacgggucccugggcaacagucccuaggcuaagacagg

SEQ ID NO: 393933 - RNA, 63 nt, Human
gugaccaaggucggccuaaaggauggcgcagguccugggcaggaaagaauuuuuccuuuauca

SEQ ID NO: 393934 - RNA, 63 nt, Human
cucagacaggaauuaaggcaaugcccaggcgggccugggcacuguauucugagcaaaggccug

SEQ ID NO: 393935 - RNA, 63 nt, Human
gcagugagccgagauugcgccauugcacuccagccugggcaaaaagagugagacucugucuca

SEQ ID NO: 393936 - RNA, 63 nt, Human
gcaggaggauugagaccaggaguucgagaagagccugggcaacauagugagaccccaucucua

SEQ ID NO: 393937 - RNA, 63 nt, Human
gcggaucacuugagcucaggaguccuaaaccagccugggcaacauagugauaccuugucucua

SEQ ID NO: 393938 - RNA, 63 nt, Human
uaauuguuuuacuuguuaacuuguucuugugccccugggcacuuggccuuugucugcucucag

SEQ ID NO: 393939 - RNA, 63 nt, Human
gcagcgagcugagaucacgccacugugcuccagccugggcaacaaagugagacucugucucaa

SEQ ID NO: 393940 - RNA, 63 nt, Human
guacucugcguggggcuccaccucacacccaccccugggcaucuuaggacuggaggggcuccu

SEQ ID NO: 393941 - RNA, 63 nt, Human
uuguuugcccaccuuuggcugauacccagagaaccugggcacuugcugccugaugcccacccc

SEQ ID NO: 393942 - RNA, 63 nt, Human
ugggcaccugacuuggcuggggaggaccagggcccugggcagggcagggcagccugucacccg

SEQ ID NO: 393943 - RNA, 63 nt, Human
cccuacaccucccuccccacaccucccuacuccccugggcaucuucuggcuugacuggaugga

SEQ ID NO: 393944 - RNA, 63 nt, Human
caccacacuggccccaggucucaggagggguguccugggcagggaaggucagugucacugaug

SEQ ID NO: 393945 - RNA, 63 nt, Human
gcaguaagccaagaucaugccauugcacuccagccugggcaacacagggagacuccaucucaa

SEQ ID NO: 393946 - RNA, 63 nt, Human
uggagacugggacaucccugauagguucacaucccugggcagaguaccaggcugcugacccuc

SEQ ID NO: 393947 - RNA, 63 nt, Human
ggauagcacguggagcucuuggcuggggcugacccugggcagggacuuuccugcagggccaga

SEQ ID NO: 393948 - RNA, 63 nt, Human
guguauguucucauuuaccacaggccuaccagcccugggcacagcagcuucauggcaagacau

SEQ ID NO: 393949 - RNA, 63 nt, Human
cugccucauguggggguguccugggcugaauuuccugggcacuucucaguggaacucucuagc

SEQ ID NO: 393950 - RNA, 63 nt, Human
augaggggaggaaacucaccugcuggccccucaccugggcaccuggggagugggacagagucu

SEQ ID NO: 393951 - RNA, 63 nt, Human
ccacgggaaccuggaaggaggcucuuugugagaccugggcaaaggauggggcagcucgucgau

SEQ ID NO: 393952 - RNA, 63 nt, Human
aauuacauuugguugggaaaugucccucaaaauccugggcacuaugaaggaacccccugcccc

SEQ ID NO: 393953 - RNA, 63 nt, Human
ugagugggggaguguccuggcagcagcgagugaccugggcaguggccaggugggugcgaugac

SEQ ID NO: 393954 - RNA, 63 nt, Human
ggcggggaggauccauugagcccagcaguccaaccugggcaaaauagugagagacccuguauc

SEQ ID NO: 393955 - RNA, 63 nt, Human
gcagugagcugagauugugccacugcacuccagccugggcaacaaagcaagacucugucucaa

SEQ ID NO: 393956 - RNA, 63 nt, Human
gcagugagccaagaucaugucacugcauuccagccugggcaacagaggaagacuccgucucaa

SEQ ID NO: 393957 - RNA, 63 nt, Human
ugagauauucagcccacugcccaaugccugcuuccugggcauagccauggaacccugccaggc

SEQ ID NO: 393958 - RNA, 63 nt, Human
ccaacuccuucuccucuuccugacccucccuccccugggcagaagaaacgcauguggaccaga

SEQ ID NO: 393959 - RNA, 63 nt, Human
uacugcuucucuuugugcaguguuaguauucacccugggcagugagugccaugcuuuuuggug

SEQ ID NO: 393960 - RNA, 63 nt, Human
gaugaggaaauaaugggaaagguugaauuaauuccugggcauggacuaccagaugaccacaag

SEQ ID NO: 393961 - RNA, 63 nt, Human
gcagugagcccagauugcaccacugcucucuagccugggcaaaaaaacuaguuccaaaaaaga

SEQ ID NO: 393962 - RNA, 63 nt, Human
uccuucuaugaaagccuccucgagccaggugcuccugggcaccuucagaagugauguccugug

SEQ ID NO: 393963 - RNA, 63 nt, Human
uccucuguguguuaucucugccccacagcagccccugggcagcaccaguggccacugggcucc

SEQ ID NO: 393964 - RNA, 63 nt, Human
uguuggagaaaugaggaugucugucccugucugccugggcaggccagauuccuccccagcagc

SEQ ID NO: 393965 - RNA, 63 nt, Human
cacuagcuuuuggugaaggaucugccaggguguccugggcagagugagcguggagggccggug

SEQ ID NO: 393966 - RNA, 63 nt, Human
gcagugagccaagaguacaccacugcacuccagccugggcaacagagcgagacuccgucuuaa

SEQ ID NO: 393967 - RNA, 63 nt, Human
cccuggcagugcucccggaggggcccaggaaggccugggcagagacccuguaggaugggguca

SEQ ID NO: 393968 - RNA, 63 nt, Human
aagacugggggagagcaguggguucugggggggccugggcaggaucccagcucccuccccucu

SEQ ID NO: 393969 - RNA, 63 nt, Human
gaggaucacuugagcccaggaguucaaaaccagccugggcaauauagugagaccguaucacua

SEQ ID NO: 393970 - RNA, 51 nt, Human; identical to SEQ ID NO: 79467

SEQ ID NO: 393971 - RNA, 63 nt, Human
ugccgucugaugcccuguccaaugugaggacugccugggcagggucugccccucccaccccuc

SEQ ID NO: 393972 - RNA, 63 nt, Human
cccaggaagagcgggcagaguggcccagcccccccugggcagggagagggccaaggacaauug

SEQ ID NO: 393973 - RNA, 52 nt, Human; identical to SEQ ID NO: 79470

SEQ ID NO: 393974 - RNA, 63 nt, Human
augaucagggauaugagcagggccugcccagagccugggcaccuuugggagagggaaaaguga

SEQ ID NO: 393975 - RNA, 63 nt, Human
auucagaucgccacacucugugaggcagcagagccugggcagguguuuggcuuaguauuuguu

SEQ ID NO: 393976 - RNA, 63 nt, Human
gggggacccuacccccaccucagguugggcuucccugggcacucaugcuccacaccaaagcag

SEQ ID NO: 393977 - RNA, 63 nt, Human
uuggcagcccucucaccccagggccuguggcugccugggcaccucucccaggaaguggugggg

SEQ ID NO: 393978 - RNA, 63 nt, Human
gcccuugauugugccagcccaugccacccccauccugggcacaguuacacccucccaugcagu

SEQ ID NO: 393979 - RNA, 63 nt, Human
ucagugagccgagauugcaccauugcaccccagccugggcaacagagcgagacuccgucucaa

SEQ ID NO: 393980 - RNA, 63 nt, Human
ucuugggauaguguucugcuccugcuuuucuguccugggcauggguccagggccugacacccc

SEQ ID NO: 393981 - RNA, 63 nt, Human
gaagccuggugccgauggccccacccucaccagccugggcagcagcaagaacuauuuauuaaa

SEQ ID NO: 393982 - RNA, 63 nt, Human
ucggauggccucccugccccucugcuggcacagccugggcaaggggagaagguggucccugca

SEQ ID NO: 393983 - RNA, 63 nt, Human
gaagauuccuugagcacaggaguuccagaccagccugggcaauguagcaagacgcugucucua

SEQ ID NO: 393984 - RNA, 63 nt, Human
gcaggcagggaggaggcggagguggcaaauaaaccugggcaauuuuguuuauacaaaaaauag

SEQ ID NO: 393985 - RNA, 63 nt, Human
gcagugagccgagauugcgccacugcgcuccagccugggcaacagagcgagacuccaucucaa

SEQ ID NO: 393986 - RNA, 63 nt, Human
uaggucccaauucggggccugcuggaguuccggccugggcaccagcauuuggcagcacgcagg

SEQ ID NO: 393987 - RNA, 63 nt, Human
ugacuuuacccucaugguggcaggagagucuggccugggcaaauccacacuugucaauagccu

SEQ ID NO: 393988 - RNA, 63 nt, Human
gcccuuccugagggccggccacauucccgcccuccugggcagauuggguagaaaggacauucu

SEQ ID NO: 393989 - RNA, 63 nt, Human
acagugcuuguagcuuugauguggaacaggggcccugggcauuucugcugagaaccaaacugc

SEQ ID NO: 393990 - RNA, 63 nt, Human
gaggaucgcuugagccugggaguucaagaccagccugggcaacauggcaagacccugucucua

SEQ ID NO: 393991 - RNA, 63 nt, Human
uuugccauugcagagcaagcugccacgaagaccccugggcaugauuuugcuuguauuuccgga

SEQ ID NO: 393992 - RNA, 63 nt, Human
ccggacagggguugaggggaccuccucagaggcccugggcacgggaggggguggggcugggcg

SEQ ID NO: 393993 - RNA, 63 nt, Human
ccauggccaaggagggcuuuucugugggaugggccugggcacgcggcccucuccugucagugc

SEQ ID NO: 393994 - RNA, 63 nt, Human
uguuaggaagaacauuuggugggaaugaacacuccugggcauaccgcugacuuuugucccuug

SEQ ID NO: 393995 - RNA, 63 nt, Human
guggaucacuugaggucaggaguucaagaccagccugggcaacauggcgaaacccugucucua

SEQ ID NO: 393996 - RNA, 63 nt, Human
gcagugagccaagaucacgccacugcacuccagccugggcaacggagugagacucugucucaa

SEQ ID NO: 393997 - RNA, 63 nt, Human
gcagauugcuugaacccaggaguucaagaccagccugggcagcauggugaaacccuguaucua

SEQ ID NO: 393998 - RNA, 63 nt, Human
gcggugagcugugaaugcaccacggcacucaagccugggcaauguagcaagauccugucucua

SEQ ID NO: 393999 - RNA, 63 nt, Human
gcagugagccaagaucaugccacugcacuccagccugggcaacagagugagacuccgucucaa

SEQ ID NO: 394000 - RNA, 63 nt, Human
uugcagugagccgagauugccacugcacuccagccugggcaacaagagcgaaacuccgucuca

SEQ ID NO: 394001 - RNA, 63 nt, Human
cccuuggacacgcucaguggggcagaggcaguaccugggcaagcuggcggcuggggucccagc

SEQ ID NO: 394002 - RNA, 63 nt, Human
ccuuugaccuuguuucuugaagguuuccucgucccugggcaauuccgcauuuaauucauggua

SEQ ID NO: 394003 - RNA, 63 nt, Human
gcagugaguugugauugcaccacugcccuccagccugggcaacagagugaaaccuugucucuc

SEQ ID NO: 394004 - RNA, 63 nt, Human
uccccacccgccacccacccuggagcccgccggccugggcaggggguccaggugggccacaca

SEQ ID NO: 394005 - RNA, 63 nt, Human
cgaggaugggagggggugcugagcugugaauccccugggcagggggcgacaacuccguguagc

SEQ ID NO: 394006 - RNA, 63 nt, Human
cucucaggagccccaucuccgggcgugucaccuccugggcaggguucugggacccucuguggg

SEQ ID NO: 394007 - RNA, 63 nt, Human
gaccagccccaaggccagaccaaggcauguaggccugggcagguggcucggggccacuggcgg

SEQ ID NO: 394008 - RNA, 63 nt, Human
agaagagggugaaggagcuggggcaggccccauccugggcauuggagaugaugaaaccgagca

SEQ ID NO: 394009 - RNA, 63 nt, Human
gcagugauccaagaucaugccacugcacuccagccugggcaacaagagcaaaacuccgucuca

SEQ ID NO: 394010 - RNA, 63 nt, Human
gcagucagcucagauugcaccacugcacuccagccugggcaacagagcgagacccugucucca

SEQ ID NO: 394011 - RNA, 63 nt, Human
gccggagaccucccuucccugggccccuucucuccugggcagccacaccacagagcggggagg

SEQ ID NO: 394012 - RNA, 63 nt, Human
gggccucuagcuucagccagggcggguacacacccugggcacaggguccucagcccccgggaa

SEQ ID NO: 394013 - RNA, 63 nt, Human
caagggaggggaaacuccaucaggaagugcuccccugggcagaggcgcccacugggugcugug

SEQ ID NO: 394014 - RNA, 63 nt, Human
aagccuuuugccgcuccggggaccagcagcaauccugggcagccaguggcucuuguagagaag

SEQ ID NO: 394015 - RNA, 63 nt, Human
cuuggcucugcccgaggauguggccguucccugccugggcaggggcuccaaggaggggccauc

SEQ ID NO: 394016 - RNA, 63 nt, Human
gaagcaauaaugguguauacccucauucucauuccugggcagcccuuccuuccacccuggcac

SEQ ID NO: 394017 - RNA, 63 nt, Human
augaugucagggggagagguggagggcagauguccugggcaaaccgggccccucugcccacac

SEQ ID NO: 394018 - RNA, 63 nt, Human
gucgugagcuaugauuaugccacugcuuuccagccugggcaacauaguaagaccccaucucuu

SEQ ID NO: 394019 - RNA, 63 nt, Human
gcagugagccaugaucgagccacugcacuccagccugggcaacagaugaagacccuauuucag

SEQ ID NO: 394020 - RNA, 63 nt, Human
gcagugagccgagguugcaccauuguacuccagccugggcaacaagagugaaacucugucuua

SEQ ID NO: 394021 - RNA, 63 nt, Human
ugcagugagccgaggucacaccauucacuccagccugggcaacaagagcgaaacuccguuuca

SEQ ID NO: 394022 - RNA, 63 nt, Human
gcagugagccaagauugugccauugcacucuagccugggcaacaggagcaaaacuccgucuca

SEQ ID NO: 394023 - RNA, 63 nt, Human
ccuccccugcccugagcugcaugguucccccacccugggcagccaggaaggaaucugaaugga

SEQ ID NO: 394024 - RNA, 63 nt, Human
ggccugggaggagguccuggggcgugcacccgcccugggcaguggggaggagaguggccugag

SEQ ID NO: 394025 - RNA, 63 nt, Human
aaggaucacuuagagcuaggaguuugagaccagccugggcaauauagcaagaccccucacuac

SEQ ID NO: 394026 - RNA, 63 nt, Human
gcagugagccgagauugcgccacugcacuccagccugggcaacagagugaaacucugucucaa

SEQ ID NO: 394027 - RNA, 63 nt, Human
gaggauugcuugaagccaggaguuugggaccagccugggcaacauagggggaucccaucucua

SEQ ID NO: 394028 - RNA, 63 nt, Human
gcagugagcuaugauuguaccacugcacuccagccugggcaacagagcaagaccuugucucaa

SEQ ID NO: 394029 - RNA, 63 nt, Human
gcaagagacaccguggcgucucaugugaacuuuccugggcacugugguuuuauuuccuaauug

SEQ ID NO: 394030 - RNA, 63 nt, Human
uuuacagagggccccugggcugcgcggccccagccugggcacccugauuuuuaagccauagac

SEQ ID NO: 394031 - RNA, 50 nt, Human; identical to SEQ ID NO: 79528

SEQ ID NO: 394032 - RNA, 63 nt, Human
gaagugagcugagaucgcgccauugcacuccagccugggcaacaagaguggcacuccaucuca

SEQ ID NO: 394033 - RNA, 63 nt, Human
uguagaagagauagcuauuaaaauaaucaguagccugggcauaguggcucacaccuguaaucc

SEQ ID NO: 394034 - RNA, 63 nt, Human
gaggacugcuugaguccagaaguuuaagaccagccugggcaacacggggagacccugucucua

SEQ ID NO: 394035 - RNA, 63 nt, Human
cauggguacacgcgcguuuccagugcacaucugccugggcaggacacgguuuccucuugcugg

SEQ ID NO: 394036 - RNA, 63 nt, Human
ugcaaugagcaagauugugccacugcacuccagccugggcaacagagcaagacucugucucaa

SEQ ID NO: 394037 - RNA, 63 nt, Human
cuugcagcuuggccuugaugaccucuguuucuuccugggcagguccuggagcggcuguuccag

SEQ ID NO: 394038 - RNA, 63 nt, Human
ugacccaacacccccgacggccuccaggaggggccugggcagccccacagucccauuccucca

SEQ ID NO: 394039 - RNA, 63 nt, Human
gcagugaaccuagaucacgccacugcauuccagccugggcaacagagcgagacuccaucuuaa

SEQ ID NO: 394040 - RNA, 63 nt, Human
cagcacuguggaaagacaggaguucgaaaccagccugggcaacauagugagacccugccucau

SEQ ID NO: 394041 - RNA, 63 nt, Human
cggcucccacuaaggccugcccaccaccgcccgccugggcagccaugaauguagcgccccagg

SEQ ID NO: 394042 - RNA, 63 nt, Human
ccccagcccgccaugccacaaggugggggaggcccugggcaggauguucacucuauuuauugg

SEQ ID NO: 394043 - RNA, 63 nt, Human
gaggaucacuuaaggccaggaguucgagaccagccugggcaacagcaagaccucaucucuaca

SEQ ID NO: 394044 - RNA, 63 nt, Human
gcaggaggaucacucgagcucaagaauucaagaccugggcaagagagagagacuuugucucua

SEQ ID NO: 394045 - RNA, 63 nt, Human
gaugauggcuugagcccaggaguucgagaccagccugggcaacacagcgagaucucuuggggg

SEQ ID NO: 394046 - RNA, 63 nt, Human
gaugaguaggaguuaguuaggcauugaguuugcccugggcaaaagcccagaagugggaguaug

SEQ ID NO: 394047 - RNA, 63 nt, Human
gcagugagccgagaucgugccacuguacuccagccugggcaacaaggcgagacuccaucucaa

SEQ ID NO: 394048 - RNA, 63 nt, Human
aaggagguggagcagcuggggcugggggcacagccugggcauucuguggggaggccguccucg

SEQ ID NO: 394049 - RNA, 63 nt, Human
gaggaucguuugaggccaggaggucaauaccagccugggcaacauaguaagacccugucucua

SEQ ID NO: 394050 - RNA, 60 nt, Human; identical to SEQ ID NO: 83030

SEQ ID NO: 394051 - RNA, 56 nt, Human; identical to SEQ ID NO: 79548

SEQ ID NO: 394052 - RNA, 63 nt, Human
ggaaagaguccugcuguugauccucacauguuuccugggcaccuaacucugucagccacugcc

SEQ ID NO: 394053 - RNA, 63 nt, Human
gcagugagcugagaucucaccacugcacuccagccugggcaacagagcgagacucugucucaa

SEQ ID NO: 394054 - RNA, 63 nt, Human
aauaaucuaaauguuuguggauuccugugucucccugggcaguugaccugcacagacaggaac

SEQ ID NO: 394055 - RNA, 63 nt, Human
gcggauugccugagcucaggaguucaagaccagccugggcaacauggugaaaucccaugucua

SEQ ID NO: 394056 - RNA, 63 nt, Human
gugguucauuggaggccaggaguuagagaucagccugggcaacauagccagaccuccucucua

SEQ ID NO: 394057 - RNA, 63 nt, Human
ggauaucccugaggccaugagggugggagccggccugggcagcuccaacuccagagaagggua

SEQ ID NO: 394058 - RNA, 63 nt, Human
gcagugagcugagaucacacuacugcacuccagccugggcaacagagcaagacugucucaaaa

SEQ ID NO: 394059 - RNA, 63 nt, Human
ggggcaucacuugaaccaggaguucaguacuaaccugggcaacaaagaggccccugucucuga

SEQ ID NO: 394060 - RNA, 63 nt, Human
ugcugcuccuguugcuuucacguagagucucggccugggcagucacgugguggucacuccugg

SEQ ID NO: 394061 - RNA, 63 nt, Human
cagcgggccaggccccgacccuguugugacccaccugggcaccuucccggaccagcuccgccu

SEQ ID NO: 394062 - RNA, 63 nt, Human
acccgagccuguccuggcugcuggcccauccugccugggcaucccuggugcuggggacugugc

SEQ ID NO: 394063 - RNA, 63 nt, Human
ugccugcucggaagagcucacugccagcugcggccugggcaccgcgggccauguguguuugca

SEQ ID NO: 394064 - RNA, 63 nt, Human
gcaugcacgcaaugcuagcugccccuuucccguccugggcaccccgagucucccccgaccccg

SEQ ID NO: 394065 - RNA, 63 nt, Human
aggacacaaggaauccgagaccccgcacagcccccugggcacccggcauggggccuggggccc

SEQ ID NO: 394066 - RNA, 63 nt, Human
gcggugagccaagaucgcaccauugcacuccagccugggcaacaagagcgaaacucugucuca

SEQ ID NO: 394067 - RNA, 63 nt, Human
caccacccaccugggaggccgaggaggagguccccugggcacagggccucuuugggacuucag

SEQ ID NO: 394068 - RNA, 63 nt, Human
uugucguggacccccagguugcaaguuacauacccugggcauguccagaugaacgaagcgugc

SEQ ID NO: 394069 - RNA, 63 nt, Human
acagagagcuaugauugcaccacugcacuccagccugggcaacaaagcaagacccugucucuu

SEQ ID NO: 394070 - RNA, 63 nt, Human
ggcagaagccuccuauaacaaagggugguguggccugggcauuggagucaauaaauuaugguc

SEQ ID NO: 394071 - RNA, 63 nt, Human
agcuugagcuugagccuagacguuaaagaccagccugggcaacacagcaagacccaucucuac

SEQ ID NO: 394072 - RNA, 63 nt, Human
gaggcgcccccgccccgccccagagcugggcccccugggcagguuccccaccccgccccaccg

SEQ ID NO: 394073 - RNA, 63 nt, Human
ggggacugcuuaagcccaggaguucaagaccagccugggcaacauagugagacucuguuauaa

SEQ ID NO: 394074 - RNA, 63 nt, Human
gcggugagccaagaucgcgccacugcacuccagccugggcagcaagagcaaaacaaccucugu

SEQ ID NO: 394075 - RNA, 63 nt, Human
ccuaauauuugcaggagcgugguucuaccacccccugggcauacauaaaucgacacaugccaa

SEQ ID NO: 394076 - RNA, 63 nt, Human
gcaaauugcuugaccucaggaauuugaggccugccugggcaaaauggugaaaccaugucucua

SEQ ID NO: 394077 - RNA, 63 nt, Human
ugccaugguuggaagaugguaucagagggccugccugggcagucugucuccgggccaggguca

SEQ ID NO: 394078 - RNA, 63 nt, Human
cuacccugugaagggaaaugagggcuuuaguuuccugggcagggaggggcagcuucugagguu

SEQ ID NO: 394079 - RNA, 63 nt, Human
ccaggggcugguggcccaggccagggagggaacccugggcagggcucuggugggagagggaga

SEQ ID NO: 394080 - RNA, 63 nt, Human
gaggaucgcuugagcccagagguucgagaucaaccugggcaagagagugagacccugacucua

SEQ ID NO: 394081 - RNA, 63 nt, Human
gaagagagcuaugacugcaucacugcacuccagccugggcaacacagcaagauccugucuaaa

SEQ ID NO: 394082 - RNA, 63 nt, Human
gaggacugcuuaagcucaggaguuugagaccagccugggcaacauagcaagacccccaccauc

SEQ ID NO: 394083 - RNA, 63 nt, Human
uuuccccguucaacucccuguugucccuuccauccugggcaaaacugaaagggacccggagcu

SEQ ID NO: 394084 - RNA, 63 nt, Human
ugguggccuagcauugcuuacauccacccugugccugggcagccacuucuguucuuggacaga

SEQ ID NO: 394085 - RNA, 63 nt, Human
gcagugagccaagauugcgccuuugcacuccagccugggcaagagagcaagacucugucucaa

SEQ ID NO: 394086 - RNA, 63 nt, Human
uucccaagguucgcaccuccuggagcagcagcgccugggcaguccucugggcuggccucggga

SEQ ID NO: 394087 - RNA, 63 nt, Human
gcagugagccgagaucacgccauugcacuccagccugggcaacaagagcaaaacucuaucuca

SEQ ID NO: 394088 - RNA, 63 nt, Human
cccuggccccccacucccaaugagcagcccaggccugggcaaaaagcgcaaaguguccuugcu

SEQ ID NO: 394089 - RNA, 63 nt, Human
gaggaucacuggagcucgggaguucaagaccagccugggcaacauagugaaaccgucuccaca

SEQ ID NO: 394090 - RNA, 63 nt, Human
gaggaucaguugagccccagaguucaagaccagccugggcaauguaguaagacccccaucgcu

SEQ ID NO: 394091 - RNA, 63 nt, Human
gcagugaaccaagaucaugccacugcacuccagccugggcaacacagcgagacuccgucucaa

SEQ ID NO: 394092 - RNA, 63 nt, Human
cucauuuggagauccuagauggcugccugcuuuccugggcacucauggugaaaugacaggcaa

SEQ ID NO: 394093 - RNA, 63 nt, Human
ggcuugggccacuuuggagagacagaaucuaguccugggcaacuucacauccguccuccuguc

SEQ ID NO: 394094 - RNA, 63 nt, Human
uuaagccacuccuuggccucccccagccaggggccugggcaggaaagauggggugguggacug

SEQ ID NO: 394095 - RNA, 63 nt, Human
gcggugagccgagauugagccauugcacuccagccugggcaacaacagcaaaacuccaucuca

SEQ ID NO: 394096 - RNA, 63 nt, Human
gaagaucucuugagcucaggaguucaagaucagccugggcaacacagugagaccucaucucca

SEQ ID NO: 394097 - RNA, 63 nt, Human
gaggauugcuugagcccaggaguucaagaccagccugggcaacauagugagaccugcccccua

SEQ ID NO: 394098 - RNA, 63 nt, Human
gaggacugcuugaggccagaaguuggagaccagccugggcaaguggacaccucauuuuuacua

SEQ ID NO: 394099 - RNA, 63 nt, Human
gcggugagccaagauggcaccauugcacccuagccugggcaacagagcaagacaccgucuuaa

SEQ ID NO: 394100 - RNA, 63 nt, Human
gcaaugagccgagauugugccacggcacuccagccugggcagcagagugagacucucucucaa

SEQ ID NO: 394101 - RNA, 63 nt, Human
agcuccugcucccccaucccccauccucccagaccugggcaggagcugugcugggagaaaggg

SEQ ID NO: 394102 - RNA, 63 nt, Human
gcagugagccgagauugcgccacugcacuccagccugggcagcagagcaacacucugucucaa

SEQ ID NO: 394103 - RNA, 63 nt, Human
gcauugagccaugauugcaccacugcacuccagccugggcaacagagggagcccccgucucaa

SEQ ID NO: 394104 - RNA, 63 nt, Human
ggggauugauugaggccaggaguucaagaccagccugggcaacauggugagaccccaucucua

SEQ ID NO: 394105 - RNA, 63 nt, Human
gcagugagccgagaucgucccacugcacuccagccugggcaacagagugagacucuguuucua

SEQ ID NO: 394106 - RNA, 63 nt, Human
uggguggaucacaagucaggaguucaagaccagccugggcaagauggugaaaccccaucucua

SEQ ID NO: 394107 - RNA, 63 nt, Human
caagagaacugaguucaacuccaucuaugccagccugggcaacagagcgagacuccaacucag

SEQ ID NO: 394108 - RNA, 63 nt, Human
gaagaucacuugagcccgcaaguuugagaccacccugggcaacauagcgagacuaccucuaca

SEQ ID NO: 394109 - RNA, 63 nt, Human
ugccgugaggcaaaaucgugccacugcccucagccugggcaguagagucagucuccaucucaa

SEQ ID NO: 394110 - RNA, 63 nt, Human
uugggucacgugggccccgguacucaagaccagccugggcagaauggugaaaccaccuucucu

SEQ ID NO: 394111 - RNA, 63 nt, Human
ucuauuaauggagaucauuccauuacacuccagccugggcaccaggaacgaaacucguucuca

SEQ ID NO: 394112 - RNA, 63 nt, Human
guggugagccaagaucaugccacugcacuccagccugggcaacaagaacaaaacuccaucuaa

SEQ ID NO: 394113 - RNA, 63 nt, Human
gcagugagccaagaucgugccaaugcacuccauccugggcaaaaagagcaaaacuccaucuua

SEQ ID NO: 394114 - RNA, 63 nt, Human
ugcagugagcgagaucaugccauugcacuccagccugggcaacaggagugaaacuccaucucc

SEQ ID NO: 394115 - RNA, 63 nt, Human
agagcacugcacuuccccaaaacggaaggggccccugggcaguggguuuugggcaaauucccu

SEQ ID NO: 394116 - RNA, 63 nt, Human
gaggaucgcuugagcccaggaguucaagaccagccugggcaacauagugagaccccaucucua

SEQ ID NO: 394117 - RNA, 63 nt, Human
acagacuucugcccuggcucuuccccaucuaggccugggcaggaacauauauuauuuauuuaa

SEQ ID NO: 394118 - RNA, 63 nt, Human
uccuugugcaagacccagccugucacgacagagccugggcacuucagaggaggagccaggauc

SEQ ID NO: 394119 - RNA, 63 nt, Human
gcagugagccaauauugcaccauugcacuccugccugggcaacaagagcaaaauuucaucuca

SEQ ID NO: 394120 - RNA, 63 nt, Human
aggaucacuugagaccaggaguugugaggucaaccugggcaauauagggagauccugucucua

SEQ ID NO: 394121 - RNA, 63 nt, Human
aaggauugcuugaggccaggaguuccagaucaaccugggcaacaugaugagaccccaucucua

SEQ ID NO: 394122 - RNA, 63 nt, Human
aucugugcucuuccaggaugcugccucuuacucccugggcaccucggccuggucccagcaggu

SEQ ID NO: 394123 - RNA, 63 nt, Human
uccuccugccucagccucccaaguagcugggagccugggcaugcaucgccacgucuggcuaau

SEQ ID NO: 394124 - RNA, 63 nt, Human
ugcagaccucagauuugaccaggccucuggcugccugggcagccucauugccaaugggcugaa

SEQ ID NO: 394125 - RNA, 63 nt, Human
ccugaccccugaggauuaccagcgauuucuagaccugggcaucuccauugcugaaaaccgcag

SEQ ID NO: 394126 - RNA, 63 nt, Human
cucuccccaccccuccuuggcucuccagcacuuccugggcagccacggcccccuccccccaca

SEQ ID NO: 394127 - RNA, 63 nt, Human
ugagccacaaucacaccaaucacugcacuccagccugggcaauaaaguaacucuugacucaaa

SEQ ID NO: 394128 - RNA, 63 nt, Human
cucauccugugaggccugaagacauugaauaacccugggcagugguucuuaggcagauacucu

SEQ ID NO: 394129 - RNA, 63 nt, Human
gcagugagccgagauggugccacugcauuccagccugggcaacagagcgagacuccaucucaa

SEQ ID NO: 394130 - RNA, 63 nt, Human
guguuaagugcuucuggauucaugggugaguucccugggcagcccccaggaaggccuuccaga

SEQ ID NO: 394131 - RNA, 63 nt, Human
uuuuuguuguuguggugguuuuuuaacacaaagccugggcaacagagcaaaacucugucucaa

SEQ ID NO: 394132 - RNA, 63 nt, Human
ccugcucgugcugcccagaggcugaucugcaaaccugggcaguauuccacacugaagcucagu

SEQ ID NO: 394133 - RNA, 63 nt, Human
ggccuccgagugacggaccugaggugucuguuuccugggcaggccugaugcuccuguuugggu

SEQ ID NO: 394134 - RNA, 63 nt, Human
gaggaucccuuuagcccaggaguuaaagaccagccugggcaacauagggagacccugucuuuu

SEQ ID NO: 394135 - RNA, 63 nt, Human
ugaggugggaggaucccaggaguucaaauccugccugggcaacauagcaagacccugucucuu

SEQ ID NO: 394136 - RNA, 63 nt, Human
ugggugucuggcacccagcugccagccuucuguccugggcaaacuacucccuacuuaagggaa

SEQ ID NO: 394137 - RNA, 63 nt, Human
uggaggcgccucacugggaggugccccgccagcccugggcagugucaggcaggacucacucac

SEQ ID NO: 394138 - RNA, 63 nt, Human
gugcaggggauuuggcugaaggcgugcauauuuccugggcacaaacuuccugagccucugaaa

SEQ ID NO: 394139 - RNA, 63 nt, Human
caugcacacgggcgagcuuucucuccgacuuccccugggcaagagaugggacaagcagucccu

SEQ ID NO: 394140 - RNA, 63 nt, Human
cugugguugcaccugugaauaacugcacuccagccugggcaacauagcgagaccucaucucca

SEQ ID NO: 394141 - RNA, 63 nt, Human
cugagaccuggggcuucacucggaucacgcccuccugggcacaggucacagcuaggacuccau

SEQ ID NO: 394142 - RNA, 63 nt, Human
gcagugagcuauuacagugccacugcaauccagccugggcaacagagcgaggucccguuucuu

SEQ ID NO: 394143 - RNA, 63 nt, Human
agccugugugggggccgucccgucccacacuccccugggcauucuuggacucaaggccggggc

SEQ ID NO: 394144 - RNA, 63 nt, Human
auguggaccaugagccggcugccagcacuagguccugggcagcuuuguuugucccacuuuucu

SEQ ID NO: 394145 - RNA, 63 nt, Human
cagaccucucucccuccuacagugcucucccucccugggcagauuggcaggacaagugggagc

SEQ ID NO: 394146 - RNA, 54 nt, Human; identical to SEQ ID NO: 79643

SEQ ID NO: 394147 - RNA, 63 nt, Human
gaggaucaccagaggccagcagguccacaccagccugggcaacacagcaagacaccgcaucua

SEQ ID NO: 394148 - RNA, 63 nt, Human
caugccucuccucccucucuggcagggccccauccugggcagaggggccuggggcugggccca

SEQ ID NO: 394149 - RNA, 63 nt, Human
gaagguggacuuuuuugguggagacguuucugcccugggcacccuccugcccccgauucauac

SEQ ID NO: 394150 - RNA, 63 nt, Human
acagugagccaagaucgcgccaucgcacuccagccugggcaacaagagcaaaacuccaucuca

SEQ ID NO: 394151 - RNA, 63 nt, Human
ucuuuuguuacaggcuuagcaacaaagcugugcccugggcauggggggcuguaguguagcuac

SEQ ID NO: 394152 - RNA, 63 nt, Human
guucaccccgcagauaguuaaugaauggucugcccugggcaagauggaggugggggcuggggg

SEQ ID NO: 394153 - RNA, 63 nt, Human
ggccaggcagaucugugccccaugccuguccagccugggcagccaggcugccaaggccagagu

SEQ ID NO: 394154 - RNA, 63 nt, Human
guggaucacuugagcucaggagcuugagaccagccugggcaacauggugaaacccaguuucua

SEQ ID NO: 394155 - RNA, 63 nt, Human
aauguuucuaguagcugcauuacaaaaaagaagccugggcacuguggcucacuccuguaaucu

SEQ ID NO: 394156 - RNA, 63 nt, Human
cuggccuuuggacccaggcaaaggcuucugagcccugggcaggggugguggguaccagagaau

SEQ ID NO: 394157 - RNA, 63 nt, Human
caaggcugcacaccuagaaccccaauucagccuccugggcaccccagaggcaaggcugugcac

SEQ ID NO: 394158 - RNA, 63 nt, Human
guggugagccaagguugcgccacugcacuccagccugggcaacaagaguaaaacuccaucuca

SEQ ID NO: 394159 - RNA, 63 nt, Human
cccucuccugagaggggaggccugguggcuuagccugggcaggucgugucuccuccugacccc

SEQ ID NO: 394160 - RNA, 63 nt, Human
uguucauuccuuugugcagaguguauaucucugccugggcaagaguguggaggugccgaggug

SEQ ID NO: 394161 - RNA, 63 nt, Human
gguuuuggaccuccaggggcuggagcuucaucaccugggcagugucuuuucucagagagcagg

SEQ ID NO: 394162 - RNA, 63 nt, Human
gacaucaccgccccuggaacuggggccaccagcccugggcacgagauuugcucugacuuuauu

SEQ ID NO: 394163 - RNA, 63 nt, Human
gcugguucucccgggacaccagcagauccacacccugggcaccuccguguuuggucuuuuuuu

SEQ ID NO: 394164 - RNA, 63 nt, Human
aauuucugcuuuaucagucaucacacaaccauuccugggcauugagacuguccugguuaggcu

SEQ ID NO: 394165 - RNA, 63 nt, Human
cucccucagccacgccucucucagcccaggucuccugggcaucuggcccugcugcccccuacc

SEQ ID NO: 394166 - RNA, 63 nt, Human
agugggugggacacagagacccccgugccaaauccugggcauccccagcccccuggccccucc

SEQ ID NO: 394167 - RNA, 63 nt, Human
cuuuccucccauggggccgcugaggcaugagcaccugggcacagguuggggcucugcaggaug

SEQ ID NO: 394168 - RNA, 63 nt, Human
gagcgggcauggccgggcccugcugaggaggggccugggcagagggccuggaccugggaucaa

SEQ ID NO: 394169 - RNA, 63 nt, Human
acggcaagggccgguccccacacucuugcuccuccugggcaucuggggacaggaacaccucuc

SEQ ID NO: 394170 - RNA, 63 nt, Human
ccccugugagugcacuugaccgggugcggagguccugggcagccugucccugagccggccccu

SEQ ID NO: 394171 - RNA, 63 nt, Human
guggaucgcuugagcucaggaguucgagagcagccugggcaacauggugaaagcccgucucua

SEQ ID NO: 394172 - RNA, 63 nt, Human
aaauccagggagauuaaauucauggugacaaguccugggcaguucugguaaacgguccaguua

SEQ ID NO: 394173 - RNA, 63 nt, Human
gccgugagucgagaucgcaccauugcauuccagccugggcaacaagagcgaaacuccgucuca

SEQ ID NO: 394174 - RNA, 63 nt, Human
gcugcgcgggauccuugugcagggaagagcugcccugggcaccuggcaccacaagaccauguu

SEQ ID NO: 394175 - RNA, 63 nt, Human
guggugagcuaagaucacgccauugcacuccagccugggcaacgagagggaaacucuguuuca

SEQ ID NO: 394176 - RNA, 63 nt, Human
ugcagaacuaacccccagcaggccugguuccacccugggcagcacccccucuaguucuaauaa

SEQ ID NO: 394177 - RNA, 63 nt, Human
ccucugcaaugcgacauccugaaagcucagcugccugggcauuccugaagaguauggaauauu

SEQ ID NO: 394178 - RNA, 63 nt, Human
uggaucugcuugcuguccaaaccagcaaacuuuccugggcaaaucacaaucagugaguaaaua

SEQ ID NO: 394179 - RNA, 63 nt, Human
cagcggcucuuucugcuuuguucuggcgacuuuccugggcaggccuuuccaccuggggagcug

SEQ ID NO: 394180 - RNA, 63 nt, Human
gcuuuuuuucugucugagugugagcuccauccgccugggcaucugauuuuuugggaaagaagu

SEQ ID NO: 394181 - RNA, 63 nt, Human
ccuccguccagccagcaaggcuuucccaagcguccugggcaggaggguugggcccugcuuucc

SEQ ID NO: 394182 - RNA, 63 nt, Human
uaaaugcacuagcgcgaggucagaaaucacaagccugggcauggccugggucgcacccccucc

SEQ ID NO: 394183 - RNA, 63 nt, Human
cguccaggugggcccagccuagggcaucccgggccugggcaucaggcagggugcagguggggc

SEQ ID NO: 394184 - RNA, 63 nt, Human
gcagugagcugagaucacgccacugcacuccagccugggcaacagagugagacucugucucaa

SEQ ID NO: 394185 - RNA, 63 nt, Human
gcagugagcugaagucccgccacugcacuccagccugggcaacagagcgagacucagucucaa

SEQ ID NO: 394186 - RNA, 63 nt, Human
cggggggcccugggucggggcggaucagcuuucccugggcacaucugccucauuccagaucuc

SEQ ID NO: 394187 - RNA, 63 nt, Human
uuagugucgagugggcucugggcuggggucggcccugggcaggcuucuccugcaccuuuuguc

SEQ ID NO: 394188 - RNA, 63 nt, Human
cuaccaggugggcuagaagguaacuggaacaggccugggcacuugugcacccauguaggagca

SEQ ID NO: 394189 - RNA, 63 nt, Human
gcccuccugcggccauccugaguuggggugaggccugggcagccggagggcagggcucaggga

SEQ ID NO: 394190 - RNA, 63 nt, Human
cucacuguccuucugccacggaugcucaagguuccugggcagaccagcaccucuggaggacaa

SEQ ID NO: 394191 - RNA, 63 nt, Human
cgccccaggggaccagccaggccuggaaugcccccugggcaggacccugggcaggaccagagg

SEQ ID NO: 394192 - RNA, 63 nt, Human
ccagccaggccuggaaugcccccugggcaggacccugggcaggaccagaggcccacauggaug

SEQ ID NO: 394193 - RNA, 63 nt, Human
aggaccagacaccugggaccuggauacuugauaccugggcauuuaacccccuacucugucauc

SEQ ID NO: 394194 - RNA, 63 nt, Human
ugcuuggcuggaccgggacccauggcaagagcaccugggcaccaguguuuagcccuggucugc

SEQ ID NO: 394195 - RNA, 63 nt, Human
ugugguuggccugaacaaaauaaaguguugacuccugggcaucugugccuucucuauggccuu

SEQ ID NO: 394196 - RNA, 63 nt, Human
ggagcccccuggcuugcacugaacccucgaggaccugggcacggggucggauggacacacagc

SEQ ID NO: 394197 - RNA, 63 nt, Human
ccaagcugcuguuccuaugacaggcccacucaaccugggcagaccgagaggcccgugcacuuu

SEQ ID NO: 394198 - RNA, 63 nt, Human
ggaggcuggaagcauauuccccaagagcacugcccugggcaucaucucccuccugcgaggagc

SEQ ID NO: 394199 - RNA, 63 nt, Human
ugaacaaacccuuggcccagccugggcuggugaccugggcaccagagaccuugcaucccuccu

SEQ ID NO: 394200 - RNA, 63 nt, Human
accucccauguuugcucucccaacucauuagcuccugggcagcauccuccugagccacaugug

SEQ ID NO: 394201 - RNA, 63 nt, Human
agcucagauggcagaugagaguguagucaagggccugggcacaggagggagagcugcagagug

SEQ ID NO: 394202 - RNA, 63 nt, Human
acauccccaucuguuaggccuuggugaggaggcccugggcaaagaagggucuuucgcaaagcg

SEQ ID NO: 394203 - RNA, 63 nt, Human
gcugcccugggaugggaaggacccagcccgaccccugggcauaacacuguguuugcaaaugga

SEQ ID NO: 394204 - RNA, 63 nt, Human
gugggcucagaguccagcaaugaggcccccuggccugggcacccagcugcaggccccugcccu

SEQ ID NO: 394205 - RNA, 63 nt, Human
acagugagccgagaucgugcuacugcauuccaaccugggcaacaagagugaaacucugucuca

SEQ ID NO: 394206 - RNA, 63 nt, Human
agccguggacagcugagguuggggucaaugccuccugggcacccuugccucgccccagaccgg

SEQ ID NO: 394207 - RNA, 63 nt, Human
guagugagcugagaucgcaccacugcacuccagccugggcaacauagcaaaauccugucucaa

SEQ ID NO: 394208 - RNA, 63 nt, Human
gagucaggucuucugccuucugaguuggcucauccugggcagucacagacuguccugccugca

SEQ ID NO: 394209 - RNA, 63 nt, Human
ccgaggcuucugggccacucaggccagugcaccccugggcagagccccuuaaagcugcuguca

SEQ ID NO: 394210 - RNA, 63 nt, Human
accguucucaaccccccugcagggagaaggccuccugggcacuguccuuccaccugugccagc

SEQ ID NO: 394211 - RNA, 63 nt, Human
gcggugagcugagauugcaccauuucauuccagccugggcaacaugagugaaagucugacuca

SEQ ID NO: 394212 - RNA, 63 nt, Human; identical to SEQ ID NO: 83192

SEQ ID NO: 394213 - RNA, 63 nt, Human
gcagugggcugugauugugccacugcacuccagccugggcaccaaugugagaaccugucuugg

SEQ ID NO: 394214 - RNA, 63 nt, Human
acaguuugcuguguucuacaagggggacgagugccugggcagcgggaagauccugcggcuggg

SEQ ID NO: 394215 - RNA, 63 nt, Human
cagccaaaacccucccagacgucuccucuccugccugggcaaaguccagcuuggcaccccguc

SEQ ID NO: 394216 - RNA, 63 nt, Human
gcagugagcugagauugcgccauugcacuccagccugggcaacaagagcaaaauucugccuca

SEQ ID NO: 394217 - RNA, 63 nt, Human
gccuggcccuccgccugccuggagaggccuggcccugggcaaacagccgccaucaggguucac

SEQ ID NO: 394218 - RNA, 63 nt, Human
cacccuuuugccugacggacccuguugccugcuccugggcagugguuuuguugccugacacag

SEQ ID NO: 394219 - RNA, 63 nt, Human
augugcuguccugcaccagcgccagcccagcucccugggcagaugugcccuguguccuggguc

SEQ ID NO: 394220 - RNA, 63 nt, Human
ggcuggggccggggcugccgcaucugccuggagccugggcagcaccuccgggacugaccuucg

SEQ ID NO: 394221 - RNA, 63 nt, Human
ccacgguguggggggugccccacaaggcccagcccugggcaaggaagcuuuggaagcagcaag

SEQ ID NO: 394222 - RNA, 63 nt, Human
aaagaacuuggacuucuaaaggcggagggucucccugggcacccugcaggcaggcagaccacg

SEQ ID NO: 394223 - RNA, 63 nt, Human
aguccuucuccaaaaggaccugggagcuggcagccugggcaggggggcugaggcacgugguag

SEQ ID NO: 394224 - RNA, 63 nt, Human
cagagccuucuuguuuaugaucagcuccagcuaccugggcaguuguggugggguggaugggaa

SEQ ID NO: 394225 - RNA, 63 nt, Human
ccuuuuggcuggggucugagucugcgguucucgccugggcagucuugacgaggagcaaacccc

SEQ ID NO: 394226 - RNA, 63 nt, Human
uccuccaccucucccauuccauccccaguccagccugggcaaccccaccccugggagggauga

SEQ ID NO: 394227 - RNA, 63 nt, Human
aucacucaucaccugauugauuggcucugugguccugggcaggugccucauagguguguggau

SEQ ID NO: 394228 - RNA, 63 nt, Human
guagugagcugagaucgugccacugcacuccagccugggcaacagagccagacuccgucucua

SEQ ID NO: 394229 - RNA, 63 nt, Human
gcagaucaccugagaucaggaguucgggaccagccugggcaacauggugaaacccugucucua

SEQ ID NO: 394230 - RNA, 63 nt, Human
aguccuggagccagugaccucaguuucagcuuuccugggcaccagccuggaccuugcccaugg

SEQ ID NO: 394231 - RNA, 63 nt, Human
uucucaugggcaggcucaggucugucccgcugcccugggcacgaggucuccugaggaccuggg

SEQ ID NO: 394232 - RNA, 63 nt, Human
gcuacggccugggcuaggugagcugccucugccccugggcaaggaagcgaggcccucugggag

SEQ ID NO: 394233 - RNA, 63 nt, Human
uucucgaggggucaccgagccucuggugggacaccugggcaggagugcucucaccacgaggcu

SEQ ID NO: 394234 - RNA, 63 nt, Human
aaaaaagaaaaggaagcugagcaucucccgaguccugggcagggaaggggagggaaauugcug

SEQ ID NO: 394235 - RNA, 63 nt, Human
gcagugagccgagaucacgccauugcacuccagccugggcaacagagcaagacuccaucucaa

SEQ ID NO: 394236 - RNA, 63 nt, Human
ccagccugccugaagcaaaggaggcucccguguccugggcagcuucuguuucccucugcugcc

SEQ ID NO: 394237 - RNA, 63 nt, Human
uuuguggugacaguuggugcuaauaagaauuugccugggcaguauagugagaucuuuucucua

SEQ ID NO: 394238 - RNA, 63 nt, Human
auacacgugggaacuaaagagaaaaaugaccagccugggcagcauagcaagacccugucucua

SEQ ID NO: 394239 - RNA, 63 nt, Human
uccaaaggcaccuuguagcauguacuccccgugccugggcaaucagaugggcugccuuugucc

SEQ ID NO: 394240 - RNA, 63 nt, Human
gcagugagccgagaucacgccauugcauucuagccugggcaacgagagcgaaacucugucuca

SEQ ID NO: 394241 - RNA, 63 nt, Human
gcggugagccaagauugcgccacugcacuccagccugggcaaacagagggagacuccaucgcc

SEQ ID NO: 394242 - RNA, 63 nt, Human
cuuccaccugggcuacacggagaccgggcacugccugggcaaaccgaacccugcgcucgcacc

SEQ ID NO: 394243 - RNA, 63 nt, Human
ugcucccaucauugggcaccucugggaguuuguccugggcacagacagcuuccaccugggcua

SEQ ID NO: 394244 - RNA, 63 nt, Human
ccagauccccaugccugagggccccucggcuggccugggcaugugauggcuccucacugggag

SEQ ID NO: 394245 - RNA, 63 nt, Human
gaggaucacuugaggccaggaguucaagaucagccugggcaauauagugaaaccccaucucuu

SEQ ID NO: 394246 - RNA, 63 nt, Human
uauuugcauaugaaucucuauuuuuuucauuacccugggcaauuuaaagaaaucauaucauag

SEQ ID NO: 394247 - RNA, 63 nt, Human
ccgaggucuuugagcucaggaguucaagaccagccugggcagcaugacaaaacccugucucua

SEQ ID NO: 394248 - RNA, 63 nt, Human
gcagugagcuaagaucgcgccacuguacuccagccugggcaacagcgagacuccaucucaaaa

SEQ ID NO: 394249 - RNA, 63 nt, Human
accaaaccuagccccuuagcccccacccacuucccugggcaaaugaauggcucacuauggugc

SEQ ID NO: 394250 - RNA, 63 nt, Human
ugggcuggucccaggguggcaccacccaggcccccugggcaccaagggagcgagggggaauaa

SEQ ID NO: 394251 - RNA, 63 nt, Human
uggucaugugagucugggauauucuuuagcuuaccugggcacaaacagaauuuuccauuuauu

SEQ ID NO: 394252 - RNA, 63 nt, Human
acagccuucuaaauucccaaauccuagacugcuccugggcauuagcaaggcagagccuuuuua

SEQ ID NO: 394253 - RNA, 63 nt, Human
gccaaggggcuuuaucuuuuacuaguaggcaagccugggcauuucugcauuugugccagcuaa

SEQ ID NO: 394254 - RNA, 63 nt, Human
uccccaaggucuaugcuaaauuauagcaagagcccugggcaaccccaaaccuaguccugguag

SEQ ID NO: 394255 - RNA, 63 nt, Human
gcagugagccgagaucucgccacugcacuccagccugggcaacagagcaagacucugucucaa

SEQ ID NO: 394256 - RNA, 63 nt, Human
caaggagcauaacguacaggcuguauguacaauccugggcauugacucugugacauuucuagc

SEQ ID NO: 394257 - RNA, 63 nt, Human
gaggagugcuugagguuaggcguuccagaccagccugggcaacauagugagacucuugucucu

SEQ ID NO: 394258 - RNA, 63 nt, Human
ggagauggcuugagaccaggaguucaagaccagccugggcaacauagugagacgccccccccc

SEQ ID NO: 394259 - RNA, 63 nt, Human
gcaggaagauugagccuaggaguucgagaccgaccugggcagcauagcgagaccccaucucua

SEQ ID NO: 394260 - RNA, 63 nt, Human
gcagugagccaagaucuugccauugcacuccagccugggcaacaagagugaaauucugucuca

SEQ ID NO: 394261 - RNA, 63 nt, Human
gcaaugagccgagaucacaccacugcacuccagccugggcaacagugaaacuccaucucaaaa

SEQ ID NO: 394262 - RNA, 63 nt, Human
ucuaaugcuacugcgcccugggggcucccagggccugggcaacuuagcugcaacuggcaaagg

SEQ ID NO: 394263 - RNA, 63 nt, Human
ggaaagcucacuucaguucaagaaauuguucugccugggcaagaaauuagugaaugacuacac

SEQ ID NO: 394264 - RNA, 56 nt, Human; identical to SEQ ID NO: 79761

SEQ ID NO: 394265 - RNA, 63 nt, Human
ccacuuuauugccaaaacccagcugcaccccuuccugggcacacgcugcucugccccagcuug

SEQ ID NO: 394266 - RNA, 63 nt, Human
aaaagaaaaaaggggcaaggagccccgcggcggccugggcagcgccugugcagaccucccugc

SEQ ID NO: 394267 - RNA, 58 nt, Human; identical to SEQ ID NO: 79764

SEQ ID NO: 394268 - RNA, 56 nt, Human; identical to SEQ ID NO: 79765

SEQ ID NO: 394269 - RNA, 52 nt, Human; identical to SEQ ID NO: 79766

SEQ ID NO: 394270 - RNA, 63 nt, Human
aaagauugcuugagccugggaguuugagacuggccugggcagcauagcgagaccccaucucua

SEQ ID NO: 394271 - RNA, 64 nt, Human
uacccaggcuuugcagaccacgcggggcagggcuccacugaagccacccccaccccucgccagc

SEQ ID NO: 394272 - RNA, 64 nt, Human
gccaggccaccaggcagacucuucccaccuucucccacugaagcaccaaggggcuugaaccgua

SEQ ID NO: 394273 - RNA, 64 nt, Human
aacugugaauccuaggcaaggcaaaaaugcacuuccacugaaacgaagcauuucugaccgcuuu

SEQ ID NO: 394274 - RNA, 64 nt, Human
ccaaaguagaaaggaagcacuucugagccagugaccacugaaagguaugugcuaugauaaagca

SEQ ID NO: 394275 - RNA, 64 nt, Human
ccaaggucgguaaguugaauggccugccuugaagccacugaagcugggauuccuccccauuaga

SEQ ID NO: 394276 - RNA, 64 nt, Human
aggcagcucacagcgggaaaacucugggaaugaaccacugaauucaggggaugggggugggggg

SEQ ID NO: 394277 - RNA, 64 nt, Human
uggcacugaauauccccuuggcagcagagaaaacccacugaaagaucguagaguggcacaugcu

SEQ ID NO: 394278 - RNA, 64 nt, Human
cggagccuuucggggaucugggggaugagggcggaaggccuagcuccuuggaaauggccuguac

SEQ ID NO: 394279 - RNA, 64 nt, Human
gaacuccaagcgagccagcccucucuuggacuagaaggccuacugucagcccuucgcuuacaaa

SEQ ID NO: 394280 - RNA, 64 nt, Human
ggguuggguuccaacucuggcuuuuucugguagaaaggccuaacccauuacaccagaagaccau

SEQ ID NO: 394281 - RNA, 64 nt, Human
gcagagggcacugagugucccuuuaaaaacuaacccacugaauauuccgugugaucuagaacag

SEQ ID NO: 394282 - RNA, 64 nt, Human
gugugacuuaacuuguguauugcauuccagcagaccacugaaccagacagcgaagccaagauca

SEQ ID NO: 394283 - RNA, 64 nt, Human
ucuuguuuaauuaugaccuaaaucuaauuuacuuccacugaaccauccaagaccucuggcaggc

SEQ ID NO: 394284 - RNA, 64 nt, Human
cugaggcccccucuuaccacacuuuaccaguuaaccacugaagcccccaauucccacagcuuuu

SEQ ID NO: 394285 - RNA, 64 nt, Human
aaauuucuuagccagcaacuuguucugcaggggcccacugaagcagaagguuuuucucuggggg

SEQ ID NO: 394286 - RNA, 64 nt, Human
agggauccagagaccugcuccagauccucuuuccccacugaagaauucugcacccucuggacuu

SEQ ID NO: 394287 - RNA, 64 nt, Human
guccaaucagagaauaaacaucauaguuucuuggccacugaauuagccaaaacacuuaggaaga

SEQ ID NO: 394288 - RNA, 64 nt, Human
uaauguuaaaguuguauagauuauuaaugcaugcccacugaauauaacccugguuuugugauaa

SEQ ID NO: 394289 - RNA, 64 nt, Human
ucuauguucucuuauuuuaaagauacagugcuccccacugaaaauuaaaccuaaaaaaugucac

SEQ ID NO: 394290 - RNA, 64 nt, Human
cuaauuuucccuuacaguuccugcuuggucccacccacugaaguagcucaucguagugcgggcc

SEQ ID NO: 394291 - RNA, 64 nt, Human
ggagcacagcccugggagggggcuauuucucuccccacugaaaacauuucaaagcugaguuacu

SEQ ID NO: 394292 - RNA, 64 nt, Human
gcacaccugcuauaccucaugccuuucccagcagccacugaacucccccaucccagggcucagc

SEQ ID NO: 394293 - RNA, 64 nt, Human
acaugaugaaaacccucugcccuggccucaucuaccacugaagcagaaaggagucugggagcag

SEQ ID NO: 394294 - RNA, 64 nt, Human
aaugucccucaaguuuauggcaguguaccuugugccacugaauuuccaaaguguaccaauuuuu

SEQ ID NO: 394295 - RNA, 64 nt, Human
guugcaagcaugcaacuccaaagaaucugugaugccacugaaaugagaugggaaugauccagcu

SEQ ID NO: 394296 - RNA, 64 nt, Human
caccccacuggagccgcuccggcagcucuuccugccacugaaugcguucugcagcauguagcau

SEQ ID NO: 394297 - RNA, 64 nt, Human
accaggauaacaucucucagugaacagaguugacaaggccuaugggaaaugccugaugggauua

SEQ ID NO: 394298 - RNA, 64 nt, Human
ucguuuccagaucgagguaagagggacuuucuuaaaggccuagucuaugggauggggcggcgga

SEQ ID NO: 394299 - RNA, 60 nt, Human
agauucauaccagaguuuaaaagauacaggaaggccuauuacaaguguguuugucuuuag

SEQ ID NO: 394300 - RNA, 64 nt, Human
aucaucuaagcugaaaacaugagaugcgcuuggaaaggccuagucagaagccauuuccucuuau

SEQ ID NO: 394301 - RNA, 64 nt, Human
caaaacaacauuuugagaacaaagaugaccauaaccacugaagggaaucacaucuuuuaagaca

SEQ ID NO: 394302 - RNA, 64 nt, Human
uacaccuaucagauguuuaaaauaacaacacuacccacugaaaucagggcauauagaaucauuc

SEQ ID NO: 394303 - RNA, 64 nt, Human
auaauuuuuuaauaauuuuuuaaugagguauuuaccacugaagaaauaugauaauauaaaacca

SEQ ID NO: 394304 - RNA, 64 nt, Human
cuauuuuuauuuuuucaugaaaauuauuggugggccacugaaaguccccacacacaaagccuuu

SEQ ID NO: 394305 - RNA, 64 nt, Human
acugauuucauacaacugaguuacucuguucacuccacugaaugcaacccauauaguuucuugc

SEQ ID NO: 394306 - RNA, 64 nt, Human
uccaagaaaagagauccacauaccauucucaaucccacugaaauugcuggcauucucaaaggca

SEQ ID NO: 394307 - RNA, 64 nt, Human
acuuuuauauaaaaaugaaaauggaaaaaaagucccacugaacucucucuuccuucuccuuuuc

SEQ ID NO: 394308 - RNA, 64 nt, Human
gagcuaagggggccccuccccccugccccgugccccacugaagaacauuacugagggggcuaac

SEQ ID NO: 394309 - RNA, 64 nt, Human
augaagcauuuacaacccgguucacucuucucagccacugaaguauuccccuuuauguacagga

SEQ ID NO: 394310 - RNA, 64 nt, Human
gauuccucuuaaagaggaaaugucaggaaucaagccacugaauccuuaaagagaaaaguugaau

SEQ ID NO: 394311 - RNA, 64 nt, Human
gacuuucuuccuccuguuucucguugaguucuccccacugaauguguguauguauguacacaca

SEQ ID NO: 394312 - RNA, 64 nt, Human
gaaaaggagguaucuagcaauggauaaauagauaccacugaaugaaauuaaauguugauuagga

SEQ ID NO: 394313 - RNA, 64 nt, Human
uucacaaauuuguuuaauacaugauucucauaccccacugaaaugguaguuucaauucaaagcu

SEQ ID NO: 394314 - RNA, 64 nt, Human
cagcaacugaaaggacaacacuaucuggagccacccacugaaagggcugcaggcaugggcugua

SEQ ID NO: 394315 - RNA, 64 nt, Human
aggcucugucccugccgccagaccccagugguugccacugaagaccucauucuccugucuggag

SEQ ID NO: 394316 - RNA, 64 nt, Human
gacuuuugcuuuaaacugcaagaggaaaaagacuccacugaaauucuaaguuugccaaguagug

SEQ ID NO: 394317 - RNA, 64 nt, Human
cggcaugccuucuguuucuccuucaaugcuccuuaaggccuaugugcugggaaaagggucuucc

SEQ ID NO: 394318 - RNA, 64 nt, Human
agggacagcuaagaaguuauuaugguugacuucaaaggccuaaacuguguuuuuuauguccacu

SEQ ID NO: 394319 - RNA, 64 nt, Human
uuucauuuuuugaaauucaggaauacacagagagaaggccuagagguuagagcacuagaaugca

SEQ ID NO: 394320 - RNA, 60 nt, Human
aagggcccccaagguggucaugacuggucucauuugcagaagucuaagaauguaccuuuu

SEQ ID NO: 394321 - RNA, 64 nt, Human
ucaugaggugugggaaguccuaguuuuaaggaaaccacugaaauauagaugggaaauguggacu

SEQ ID NO: 394322 - RNA, 64 nt, Human
auuaauuauggaaaaauaauucagaaucuaaacaccacugaaaacuuauaaaaaauguuuagau

SEQ ID NO: 394323 - RNA, 64 nt, Human
ucuucuguggucucuccccuggcuugcuucauggccacugaaccaaucacuuuguaugcuaugc

SEQ ID NO: 394324 - RNA, 64 nt, Human
aauuaaaugaagccacucacaguccuuugauuucccacugaagauaccccaaaggaugcaagug

SEQ ID NO: 394325 - RNA, 64 nt, Human
agauugagucaauaugucauuuaccaugguuuucccacugaaggcuuuaacuuuucugauaaaa

SEQ ID NO: 394326 - RNA, 64 nt, Human
uaaaauggugacuuaauccguaguuauuuugcacccacugaaaggaaagugcuuuccagaauaa

SEQ ID NO: 394327 - RNA, 64 nt, Human
cuauugaaauggcaucaacaugaugcugcccauuccacugaaguucugaaaucuuucgucaugu

SEQ ID NO: 394328 - RNA, 64 nt, Human
cuuaagcgguggcgccccuccaccugggucaucuccacugaaucgcuggacugugaagucaaca

SEQ ID NO: 394329 - RNA, 64 nt, Human
aaggaguccgggaggugccugugguuugcacccaccacugaaaaagccgcggagaugcgcagcg

SEQ ID NO: 394330 - RNA, 64 nt, Human
cagaaaguaggaaccagauagagaugaaaaggggccacugaaaagugaauuugauagcucagca

SEQ ID NO: 394331 - RNA, 64 nt, Human
uaguucuuuauuauagugauuuugggcuuuguacccacugaaugccauuuuuuguguuuuuaaa

SEQ ID NO: 394332 - RNA, 64 nt, Human
agaggcagaaaauugcacaauauugaacuuuuuuccacugaaguagugugcaguucuaguuugc

SEQ ID NO: 394333 - RNA, 64 nt, Human
cgggaggcggagguugcagugagccgagaucgugccacugaacuccaaccugccaauagagcga

SEQ ID NO: 394334 - RNA, 59 nt, Human
auggaggacccaucuccuagcacacgugcccacugaaguggcaccaacagaaguuuggc

SEQ ID NO: 394335 - RNA, 64 nt, Human
cugcagugcauuauaccaaagagcgaagucagugccacugaaaauacagaacccauuaauaucg

SEQ ID NO: 394336 - RNA, 64 nt, Human
aaucaugugauaucucuuuugugacuggcuucuuccacugaauguuuucuagggccguccaagu

SEQ ID NO: 394337 - RNA, 60 nt, Human
gcauaaguccuauuuuagccuuaccuccugcauuugcaauacguaauacugaucaguggg

SEQ ID NO: 394338 - RNA, 60 nt, Human
uuuggcaacuuuguguuuacauuuaaagaucauuugcaccuuuuucaaggaaaaaaagua

SEQ ID NO: 394339 - RNA, 60 nt, Human
aauguuuuuguucucauuuaugccuuuguccauuugcacacaacagaaauuguaaugagc

SEQ ID NO: 394340 - RNA, 64 nt, Human
cugauaaaaggcauaacgagacauagugcugcuaccacugaauaagugauacuuuggaaagaug

SEQ ID NO: 394341 - RNA, 64 nt, Human
uuaacuaaaguuaguauuuguuuuucagaaaugaccacugaagauucauucugauuauacaaua

SEQ ID NO: 394342 - RNA, 64 nt, Human
aagaguguucuucugguaaagcuaaaauucuggaccacugaagcuaaaagcccuauugcaagua

SEQ ID NO: 394343 - RNA, 64 nt, Human
gcuuggaagagaugaaagaucuucauggcuguuuccacugaaauggacacauaugcucauguug

SEQ ID NO: 394344 - RNA, 64 nt, Human
agagauuuucaagaucaaacuuccauagcuucauccacugaauuugaaggcauccaccuuuuuc

SEQ ID NO: 394345 - RNA, 64 nt, Human
cuucacuuggucugacuuguaccaauucuagcacccacugaaaaacaaguugaguagagagugu

SEQ ID NO: 394346 - RNA, 64 nt, Human
gccuccaccaccuguaaccccuuccuggcauuggccacugaaggguacaaaggcaaaaggacca

SEQ ID NO: 394347 - RNA, 64 nt, Human
ugccaggauauggacaucuugggauaucucuuuaccacugaaguagaauugauuguucagcugg

SEQ ID NO: 394348 - RNA, 64 nt, Human
gccuuuuaucugcccagaauucuaagcuggugccccacugaauuuuguguguaccugugacuaa

SEQ ID NO: 394349 - RNA, 64 nt, Human
ucucuauagaagcccuauauaauuuagaauaugcccacugaauaucuuuaauagaaaguaacau

SEQ ID NO: 394350 - RNA, 64 nt, Human
auuucugaugucaaauuguucauugacagaaaacccacugaaguauuuaaaguuaggaagaucu

SEQ ID NO: 394351 - RNA, 64 nt, Human
uacucauuaagacuaacaucuccccacuccauccccacugaaauuuguggaagaaaauuuagua

SEQ ID NO: 394352 - RNA, 64 nt, Human
caauccuuguucagcuggacaauaugaaucuuuuccacugaaguuagggaugacugugauuuuc

SEQ ID NO: 394353 - RNA, 64 nt, Human
ucccuacuguucccacgcuuccucucucucgaggccacugaaguuuggagucaaaaggcccaga

SEQ ID NO: 394354 - RNA, 64 nt, Human
cuucauaucgauaccagaugccuucuucaucaugccacugaagccacucaccaccuucaagaac

SEQ ID NO: 394355 - RNA, 64 nt, Human
cucugagggccuccacacugccuggcagaacauaccacugaacuaguaugugcuagaggagggc

SEQ ID NO: 394356 - RNA, 60 nt, Human
cuaagcuauuuacagaguguuuguagcuuucauuugcagcauuauguucccacaaauucu

SEQ ID NO: 394357 - RNA, 60 nt, Human
gacaacugguaagauuaagaagccauuaaccauuugcaauuuauauuauagucacagaaa

SEQ ID NO: 394358 - RNA, 60 nt, Human
cucugucuaagccccuagcuuacucaaugucauuugcagcgugcaucugcugauuaaagg

SEQ ID NO: 394359 - RNA, 64 nt, Human
cacugauauggguuuauaauuuucugaaaguuacccacugaagcccauuucuccguugagucau

SEQ ID NO: 394360 - RNA, 64 nt, Human
gcugaucuuugccccugguaugcauuaauggacuccacugaauccugaaaaaaaaauuaaacuu

SEQ ID NO: 394361 - RNA, 64 nt, Human
guucccuugccuaagaaggccacucccucccaccccacugaagugggggauagucgguguccua

SEQ ID NO: 394362 - RNA, 64 nt, Human
uuuaaaaaguuauuuuuuacccuaauacuuuucuccacugaauauuauuauuuuuuucuuagcu

SEQ ID NO: 394363 - RNA, 64 nt, Human
ucugcagugaucauaagugcuuugugcccagaggccacugaagaugguaggcaggauucuuucc

SEQ ID NO: 394364 - RNA, 64 nt, Human
caggugauuuuccacaaagaaugugcuaaaauguccacugaaaacaaagccaagccucugcccu

SEQ ID NO: 394365 - RNA, 64 nt, Human
aaaaaguacucuuuaagagugaaauaauuaaaaaccacugaacauuugcuuuguuuucuaaagu

SEQ ID NO: 394366 - RNA, 64 nt, Human
gguucagugccuuccucucucuaccagucuauuuccacugaacaaaaccuacgcacauaccuuc

SEQ ID NO: 394367 - RNA, 64 nt, Human
gauucacugccuuccucucucuaccagucuauuuccacugaacaaaaccuacacacauaccuuc

SEQ ID NO: 394368 - RNA, 64 nt, Human
uuuguuuaccccucucugagacagguuuugauaaccacugaaaugguagaauaugugagauaca

SEQ ID NO: 394369 - RNA, 64 nt, Human
auuauaaagccaauuaucugauuaagcauucuuuccacugaaugcauaauguuuaaauagcaua

SEQ ID NO: 394370 - RNA, 64 nt, Human
caguucgcugcucccugcuuggcuuaugaaaacaccacugaacagaaauuucuccagggagcca

SEQ ID NO: 394371 - RNA, 64 nt, Human
aauuuaaucucauuucuggacucuuuaaguuuuaccacugaaaaccagagucgauuuuucuccu

SEQ ID NO: 394372 - RNA, 64 nt, Human
ggucagucuagagucugugcaccaggcaguccauccacugaaggcuguguuuauucuuuuccug

SEQ ID NO: 394373 - RNA, 64 nt, Human
aaagcccuaaaacaacuaaaaugauuuguauaccccacugaauucaagcugauuuaaauuuaaa

SEQ ID NO: 394374 - RNA, 64 nt, Human
cuaucuacgacaaagugaacuuaaaaggacaugcccacugaauucagguccuuugaguaaaaaa

SEQ ID NO: 394375 - RNA, 60 nt, Human
cguggaccgcguguucccaauauucauuaacauuugcagccauuacagaguuacaguugu

SEQ ID NO: 394376 - RNA, 60 nt, Human
cuuguauuaucagugaauauaaauguacuacauuugcaugccuuuuggguuugccuuaau

SEQ ID NO: 394377 - RNA, 60 nt, Human
aaauauugcuagagcuauuuuccugaaauacauuugcaaaauaaggcugcuuuguaauca

SEQ ID NO: 394378 - RNA, 60 nt, Human
uuaagagaagagcagaucaugcuauugugacauuugcagagauauacacacacuuuuugu

SEQ ID NO: 394379 - RNA, 64 nt, Human
aaacaugaggauuugggaacagaucuaggacaugccacugaauugaagaccacccaucuuccag

SEQ ID NO: 394380 - RNA, 64 nt, Human
acuaaugucuuguuuuaagaaacugcuuaguccaccacugaagaaaauauccagaaauuauuuu

SEQ ID NO: 394381 - RNA, 64 nt, Human
ggagagaaagagaagcuauauagagaaaaggaaaccacugaaucaaagagagagcuccuuugau

SEQ ID NO: 394382 - RNA, 64 nt, Human
guuggggaagaauuauuauguuguaugaacaaccccacugaagcauuauacaauucuuaauucc

SEQ ID NO: 394383 - RNA, 64 nt, Human
gaacugugucggagcacucacugaagcuugcauuccacugaaagaguuauuuguguaaguagag

SEQ ID NO: 394384 - RNA, 64 nt, Human
ugcucuaguuugguuauggaaaaaagacuuuuugccacugaaacuugagccaucugugccucua

SEQ ID NO: 394385 - RNA, 64 nt, Human
uagagucgcccugggauagauccaucuccuucugccacugaauuucacacuugaaaaagauaag

SEQ ID NO: 394386 - RNA, 64 nt, Human
uuuuacuauaaccaggguuucauucugucuuuuuccacugaagugugacauuuuguuaguacau

SEQ ID NO: 394387 - RNA, 64 nt, Human
gcuucugaaugaaauacgacagcagagaaagaugccacugaaaugcugaaauuaucuuugcuga

SEQ ID NO: 394388 - RNA, 64 nt, Human
gggaugacauucagugaauuauuucaguggugacccacugaaaauuaauaaugguacuuaugau

SEQ ID NO: 394389 - RNA, 64 nt, Human
uuuauucuguguagguagccuauuuaauuggguuccacugaaccucaugggacuuuuaaaagaa

SEQ ID NO: 394390 - RNA, 64 nt, Human
cuuagcuguggaagaacaucaugccuauuuauaaccacugaaugcacugacuuucaaaaacuga

SEQ ID NO: 394391 - RNA, 64 nt, Human
gaaaaauaagacccuguggagaaauucguuguucccacugaaauggacugacuguaacgauuga

SEQ ID NO: 394392 - RNA, 64 nt, Human
ugccagauguggccaaccuuuguccauaugcaaaccacugaaaaaugaucuggauuucuauagc

SEQ ID NO: 394393 - RNA, 64 nt, Human
ccauugcuacauuguagguugugaucauuuugccccacugaagcccauguaucugaccuuacgu

SEQ ID NO: 394394 - RNA, 64 nt, Human
acacugccucuguggccuggacuuugaaaggaacccacugaacacuaauuaugagcccugucuu

SEQ ID NO: 394395 - RNA, 60 nt, Human
uugcuaacaaugcucuggggucuuuuuaugcauuugcauuugcucuuucaucucugcuug

SEQ ID NO: 394396 - RNA, 60 nt, Human
aauaguacaugcagaaauugaccugauuuccauuugcaacaggaagacacuggcuuuaca

SEQ ID NO: 394397 - RNA, 60 nt, Human
uguauuaaaugggggagugucaauuugcaucauuugcauauugauuucaagucuccuaau

SEQ ID NO: 394398 - RNA, 64 nt, Human
ccuucauucaugagaacuccagaaugaguguugaccacugaagcaucuuuuaagucuguguucc

SEQ ID NO: 394399 - RNA, 64 nt, Human
gugcuagaacaagcgccccucagagauucugaugccacugaaguuugaggagcauugguuuaag

SEQ ID NO: 394400 - RNA, 64 nt, Human
ugaaguuuuuagauauuaauuaccacagugucugccacugaauuuccagugacuaaguggaaaa

SEQ ID NO: 394401 - RNA, 64 nt, Human
ggucauuauguccugacaaccaacacccagcaggccacugaaauucaaaucacauuucuccuuc

SEQ ID NO: 394402 - RNA, 64 nt, Human
ucaugguuauacaacaucauaaaugcaauuacugccacugaauuguauguuuuaaagugguuaa

SEQ ID NO: 394403 - RNA, 64 nt, Human
uguguauggauuuuacucuaagagcaaaggaaagccacugaagaguauaaagcaggaaagugug

SEQ ID NO: 394404 - RNA, 64 nt, Human
auugaacuguaucauuuucauauccacuuccccaccacugaaauaucuuauuucacaauauuuu

SEQ ID NO: 394405 - RNA, 64 nt, Human
cacuuucuucacaucugagguuucuuucucuaauccacugaaauuauugugugcuaaauuuggg

SEQ ID NO: 394406 - RNA, 64 nt, Human
cagcagucuagccuuuggaugaccuauuugaaaaccacugaaagucguggaggaaugggcaaga

SEQ ID NO: 394407 - RNA, 64 nt, Human
acuuuuaugugucgucuuccggggaagggucccuccacugaaagcuagccagucauguuuucug

SEQ ID NO: 394408 - RNA, 64 nt, Human
ugggagguccaggcugcaaugagccaagaucacgccacugaacuccagccugggagacagcaag

SEQ ID NO: 394409 - RNA, 64 nt, Human
cuuugguugguuaaaauaauauggaacaaaggauccacugaagugaucucuguguuguguggua

SEQ ID NO: 394410 - RNA, 64 nt, Human
gcagaaucugauucaugagaaguucuccccaaguccacugaacaaggcuaguuccugcaccacc

SEQ ID NO: 394411 - RNA, 64 nt, Human
aacacagacaaaccaaagguaaccagcuagcccaccacugaaaggaaagaucugagacauggga

SEQ ID NO: 394412 - RNA, 64 nt, Human
ucugacucuuauagguuuacuaagaugaaaguuaccacugaaccuuaccacuauguauauaugu

SEQ ID NO: 394413 - RNA, 64 nt, Human
acaaguuggaucauggaguuuguaaucugguuuuccacugaacacugugucacgaacaacuuuu

SEQ ID NO: 394414 - RNA, 60 nt, Human
cguccugggcauugugauggauugacccuccauuugcaguaccuucccagcugauuaaag

SEQ ID NO: 394415 - RNA, 60 nt, Human
uguucacauugcauuaauaaugaugauaaacauuugcauucuuauucugugccaggcaac

SEQ ID NO: 394416 - RNA, 60 nt, Human
aaagggcuggccugcuucucagccuacauucauuugcaagcuucaaucucuggaccaucu

SEQ ID NO: 394417 - RNA, 64 nt, Human
agcacacaugcauccuccccucuccugcgugugcccacugaacaugcucauguguacacacgcu

SEQ ID NO: 394418 - RNA, 60 nt, Human
cuucuguucauuuguuccuuggaccuuaaucauuugcauuuuggagaaaauuuuuucugc

SEQ ID NO: 394419 - RNA, 60 nt, Human
ccccacuguggaagaggccaguuuugccuccauuugcacauucauuucaguuauuucuga

SEQ ID NO: 394420 - RNA, 60 nt, Human
aauugguuuguauauugauauuuccagguucauuugcauauacuuuuuuccaaauaaugc

SEQ ID NO: 394421 - RNA, 60 nt, Human
ugugauagcugugcaugcauuauauauuugcauuugcaaauuucccauuguuuuaacagc

SEQ ID NO: 394422 - RNA, 60 nt, Human
gucaaguaacucagaacuuuuauggaaacgcauuugcaaaguucuauggcugucaccuua

SEQ ID NO: 394423 - RNA, 60 nt, Human
ugaacagggcuucagucagcgcaaguauuccauuugcauuugguaauuuuucaugccacc

SEQ ID NO: 394424 - RNA, 64 nt, Human
guagcaacuuaacuaguugcuggcaacugaauacccagaguaguggaaauuuuaggacuugagg

SEQ ID NO: 394425 - RNA, 64 nt, Human
gagcgggggacagggucuuacucugucacucaggccagaguacaauaguaugaucucggcucac

SEQ ID NO: 394426 - RNA, 64 nt, Human
guuuuauccccuggccucagagccauuuauauucccagaguaggcaguacaggaucucguguug

SEQ ID NO: 394427 - RNA, 64 nt, Human
ugauuuuaaaauaccgcgucuguuccuccauggaccagaguaauuggcacauuuuaaugcauaa

SEQ ID NO: 394428 - RNA, 64 nt, Human
uguccuuacuuccugccaauccccaagucaucuuccagaguaaaaugcaaaucccaucaggcca

SEQ ID NO: 394429 - RNA, 64 nt, Human
gaacauugaugcugccucagacauccucuuuucuccagaguagggaagacucccacugaucuga

SEQ ID NO: 394430 - RNA, 64 nt, Human
agcugcucgcggaacagccccuagucggcugcuuccagaguaagcagucuuuaugggcuuucuc

SEQ ID NO: 394431 - RNA, 64 nt, Human
cagucucagaggcuaguauggggcuagaugaagcccagaguaacacccacaauauaaauggguu

SEQ ID NO: 394432 - RNA, 64 nt, Human
ggauucauauaggccagaguugcaaagaucuuuuccagaguaugcaacucugacguugauccca

SEQ ID NO: 394433 - RNA, 64 nt, Human; identical to SEQ ID NO: 270198

SEQ ID NO: 394434 - RNA, 64 nt, Human
gguccagcuccauacccuaaauucugaguuucagccacugaacuccaagguccacuucucacca

SEQ ID NO: 394435 - RNA, 64 nt, Human
gcucacucugguuacaagcccuguucuuccucucccacugaauucuaaauccuuaacauccagg

SEQ ID NO: 394436 - RNA, 64 nt, Human
gaacugccuaaggugugaaaagcugaagauucuaccacugaaguacugaauauguugucuaguu

SEQ ID NO: 394437 - RNA, 64 nt, Human
aaaauuggucuuuggggcccuuuuuguccaagccccacugaaaggccucuucagaaaacuauua

SEQ ID NO: 394438 - RNA, 64 nt, Human
aguuaaauggcugggcaggugccacaggaugaggccacugaaagaucugcuucauucuuugauc

SEQ ID NO: 394439 - RNA, 64 nt, Human
uaaaccucagcugugacaugaaagacuuaccggaccacugaaggucuucuguaaaauauaauga

SEQ ID NO: 394440 - RNA, 64 nt, Human
aaaagcuguuacacuuucucugaucugcugugauccacugaaaaugugcugggguuuguucugc

SEQ ID NO: 394441 - RNA, 64 nt, Human
agcaaacauguggguacuucuccaccuagggaagccacugaagaugaguuugaccuguggugac

SEQ ID NO: 394442 - RNA, 64 nt, Human
aaugccagcuauagauuuggggugauuaucguugccacugaagguucaucaaguaacaaacaua

SEQ ID NO: 394443 - RNA, 64 nt, Human
uauuuauuuauguguucacauggucaaaauuucaccacugaaacccugcacuuagcuagaaccu

SEQ ID NO: 394444 - RNA, 64 nt, Human
aagacacuuuaaguuauacuggaaaauucaggugccacugaaagccagauuuauaguauuccau

SEQ ID NO: 394445 - RNA, 64 nt, Human
uuaaguuccacauagcaauuacaguaugccaguuccacugaagacaugaaaucuuuagagguuu

SEQ ID NO: 394446 - RNA, 64 nt, Human
cacacugcaaugauauaggaaugaggucugaacuccacugaauuaaaccacuggcauuuggggg

SEQ ID NO: 394447 - RNA, 64 nt, Human
aauagagcuuacauauauuuguauaacugcuauaccacugaacugaauuuauuuuacaacagug

SEQ ID NO: 394448 - RNA, 64 nt, Human
cgagaggcggaaguugcagugagccgagauugugccacugaacuccaaccugcacuccagccug

SEQ ID NO: 394449 - RNA, 64 nt, Human
uuucaguugugaaguuccuuucguguuacacccuccacugaacccucaaccuucgaaauacucc

SEQ ID NO: 394450 - RNA, 60 nt, Human
uuccaugguuccucaaguuuccuuuuuaaacauuugcauuugcuggacaauugcaauuuu

SEQ ID NO: 394451 - RNA, 60 nt, Human
aagaacuuggaagaaaaacaggcaggaaugcauuugcauaaugacccagaucaucauuuu

SEQ ID NO: 394452 - RNA, 60 nt, Human
cagaaaacuuuucaggaagguuucccugugcauuugcaccagaugaauguuugaugcuau

SEQ ID NO: 394453 - RNA, 64 nt, Human
caugcaugcauucucaagaggucgugccaaucagccacugaaaggaaaggcaucacuauggacu

SEQ ID NO: 394454 - RNA, 64 nt, Human
ugaauuccuuuauagauguacaguuuugcuuuaaccacugaagauugcuguaaauuauaaaggg

SEQ ID NO: 394455 - RNA, 64 nt, Human
uuccacucaggaaauugggcugcccccaaccuggccacugaaugucuccaggcagauaugcugc

SEQ ID NO: 394456 - RNA, 64 nt, Human
uguuuuugagugccacuguuugccaucaucuaagccacugaaucaaguguauuucaggcuuauu

SEQ ID NO: 394457 - RNA, 64 nt, Human
uugucccuauguaggaugcaccgcaggccccuggccacugaaagagugugcaguggacuguggg

SEQ ID NO: 394458 - RNA, 64 nt, Human
ugugugcuggccaugauauugccccaaauccgccccacugaaguguucccuaaggaacagcauu

SEQ ID NO: 394459 - RNA, 64 nt, Human
ucaccuuugccuuccaacugccagaacauggauuccacugaaauagagugaauuauauuuccuu

SEQ ID NO: 394460 - RNA, 64 nt, Human
ugcucuuugucauggcaaccagcuucugaaaagcccacugaaaauugccuguccugcugguaac

SEQ ID NO: 394461 - RNA, 64 nt, Human
augcauuagcgaaagguuaaguaaguuuuguucuccacugaaguaauacuuaacaucucagaaa

SEQ ID NO: 394462 - RNA, 64 nt, Human
uuaaaaaaaaaaaaggcaaugaaaauuuagcaagccacugaauuugaguuuucacuuuguuucu

SEQ ID NO: 394463 - RNA, 64 nt, Human
aaauaauuauugggaugguuucuuggcuuuaaguccacugaauaaaaacuaugaaauugcacuc

SEQ ID NO: 394464 - RNA, 64 nt, Human
cuuuccaaguucagcagcaguucuaucaguggugccacugaaacuggguauauuuaugauuucu

SEQ ID NO: 394465 - RNA, 64 nt, Human
uagugacugcacaauauugugacuguacuuaaugccacugaacuguacacuuuaaaauggaaaa

SEQ ID NO: 394466 - RNA, 64 nt, Human
ggacuagacaaacuacaugcuggcuaaacauucuccacugaagauacaucaaugcuuuuuuuuu

SEQ ID NO: 394467 - RNA, 64 nt, Human
uuuaacauuucuacccaauaagaggcucuguuuuccacugaagcuuuguuggagaaagagaaua

SEQ ID NO: 394468 - RNA, 64 nt, Human
uuuucagcuacuauuugaauauucuugaacaccaccacugaagaguuucauauacaccaaauaa

SEQ ID NO: 394469 - RNA, 60 nt, Human
auagaucauaucauugcuacuuugacuuagcauuugcaucauaaacauaauuaugauguu

SEQ ID NO: 394470 - RNA, 60 nt, Human
acuuuuguauuuugauauggacaguuuauucauuugcauacaguuauugacuuuuuccca

SEQ ID NO: 394471 - RNA, 60 nt, Human
aaaauccauuucaagaaauaaagacgaacacauuugcaggaagguaacuguuauaaccca

SEQ ID NO: 394472 - RNA, 64 nt, Human
gccuugagagacccagcugcagaccaugccagacccacugaaaugaccaagacagguucaggua

SEQ ID NO: 394473 - RNA, 64 nt, Human
cucuagccuccuuaugauuuuaauuuguauuugcccacugaauaauguaugucuaugauuucau

SEQ ID NO: 394474 - RNA, 64 nt, Human
gacacacacacacacacacacacaccacucgccuccacugaaucuacacacagauuuuacugug

SEQ ID NO: 394475 - RNA, 64 nt, Human
guuuauucuuuuagcagguguaguuaaacgaccuccacugaacuggguuugaccucuguuguac

SEQ ID NO: 394476 - RNA, 64 nt, Human
cacguaguuugcauuccagcgucugcuguugauuccacugaaaccucuguucucaugaaggaga

SEQ ID NO: 394477 - RNA, 64 nt, Human
augacaggagauggggcccugcugccagucaucuccacugaauaaagaauaaugcuccucuuuc

SEQ ID NO: 394478 - RNA, 58 nt, Human
auagcaccagcggaaacugaguuuaaguccacugaaagucucuaaggaaguauccucu

SEQ ID NO: 394479 - RNA, 64 nt, Human
uuuugcagcauuccucugcuccugcugaucugugccacugaacuccaguucuucuggucauuuu

SEQ ID NO: 394480 - RNA, 64 nt, Human
uggcugcuucuacggccaugagacugaucccuggccacugaaaagcuuuccugacaauaaaaau

SEQ ID NO: 394481 - RNA, 64 nt, Human
aauuuuccccucagaacagauagacagacugaagccacugaacucugccaggagucaacaugag

SEQ ID NO: 394482 - RNA, 64 nt, Human
cuuauagaacauaaauauugugaauaaugaaaauccacugaaucuaauaagggacuuguaucgg

SEQ ID NO: 394483 - RNA, 64 nt, Human
uucuuuuuucuucaccaaaaccaacaugaaaguaccacugaaguaaaacaccaacuaccuaccu

SEQ ID NO: 394484 - RNA, 64 nt, Human
cagaaagauguggacagcuugauguuuuagacaaccacugaacuagaugacuguuguacuguag

SEQ ID NO: 394485 - RNA, 64 nt, Human
uuccuuauuuugguauguggcaaugcuaauagauccacugaagaucuggaaaauuccaggaacu

SEQ ID NO: 394486 - RNA, 64 nt, Human
augugaugugggaaagcaggaggauggacacaccccacugaaagauguaggcaggggcaggucu

SEQ ID NO: 394487 - RNA, 64 nt, Human
aaaguaaguuauuacuuugcaccaggugguuuggccacugaauuaauacuguauagcaagagaa

SEQ ID NO: 394488 - RNA, 60 nt, Human
aggguccaugaacucugaaaucacugagaacauuugcagccacacauguacauaugugua

SEQ ID NO: 394489 - RNA, 60 nt, Human
aauuaguguucuauaaugauaugcaauuaccauuugcauucuuucuguuugguauuaaaa

SEQ ID NO: 394490 - RNA, 60 nt, Human
agagaacuguggccguuaucuggaaguaaccauuugcacuggaguucuaugcucucgcac

SEQ ID NO: 394491 - RNA, 60 nt, Human
aaacuguccauucccaccccuuugcuuugccauuugcaagagucuggaauugucaggucu

SEQ ID NO: 394492 - RNA, 64 nt, Human
ccuuuuuuugacaauuuugugggaaagacauucuccacugaauuuuaacuuuccuugagacuuu

SEQ ID NO: 394493 - RNA, 64 nt, Human
aagugucuccuguugugaggggcucacuuuggagccacugaagagccgacugugccacccacuu

SEQ ID NO: 394494 - RNA, 64 nt, Human
uagggggugugggguuccguucucccuuccccucccacugaaguuugugcuuaaaaaacaauaa

SEQ ID NO: 394495 - RNA, 64 nt, Human
uauaaacagguuuuagauguuucaaaugacuuguccacugaaugucacuugaccuugauaagag

SEQ ID NO: 394496 - RNA, 64 nt, Human
ugcaaaggagcucacuguggugucuguguuccaaccacugaaucuggaccccaucugugaauaa

SEQ ID NO: 394497 - RNA, 64 nt, Human
guuaucucuguuuuacucuuugaaauugaucaagccacugaaucacuuugcauuucaguuuaua

SEQ ID NO: 394498 - RNA, 64 nt, Human
gccuccuugacuugauagcuugaagaauccuuuuccacugaaauagaggauaauuaauugacac

SEQ ID NO: 394499 - RNA, 64 nt, Human
gggugugaccaugcccucagcaccacucuuguccccacugaacggcaacugagacuggguaccu

SEQ ID NO: 394500 - RNA, 64 nt, Human
uccucuguuguccauuuuuaucaccagauguuuuccacugaagcaugcacaugccacugucacc

SEQ ID NO: 394501 - RNA, 64 nt, Human
ucgauggauaaauaguuauuuuaagaaacuaauuccacugaaccuaaaaucaucaaagcagcag

SEQ ID NO: 394502 - RNA, 64 nt, Human
ccaggcaagaagguauccucuucccaagguguacccacugaauguuguuacuacauauugagag

SEQ ID NO: 394503 - RNA, 64 nt, Human
gagacagcacuauguaggaaagaccauuuuuccuccacugaacuaggguggugcauuuuuguaa

SEQ ID NO: 394504 - RNA, 64 nt, Human
gcaucauaaggaguugguguaaucauuuuaaauuccacugaaaauuuaacaguauccccuucuc

SEQ ID NO: 394505 - RNA, 64 nt, Human
augaaggaucuucugcaagaggcugccuccugguccacugaaccuggaaacugagugggcuuua

SEQ ID NO: 394506 - RNA, 64 nt, Human
ccaaauuuuuuauuaagaugaguaaauauuugaaccacugaauuuuaauaacaaaauuuuaaaa

SEQ ID NO: 394507 - RNA, 64 nt, Human
aaguguacauugagacuggcagccaucuaugguaccacugaaacccugacccagaaaaguggcu

SEQ ID NO: 394508 - RNA, 60 nt, Human
uugugcagaucaguuucacuaucuccaaagcauuugcaucaugaccuuauacauuucaau

SEQ ID NO: 394509 - RNA, 60 nt, Human
ugcauauucuuuuucccauguggcucuacucauuugcaacugaauuuaauguuauaacuc

SEQ ID NO: 394510 - RNA, 60 nt, Human
auucuaagaacuggaagaaccuggugguuccauuugcaaaggcugugugugaaaugagua

SEQ ID NO: 394511 - RNA, 64 nt, Human
cauucccgaaaaguggauggagagagugauggcuccacugaagagacagacgagucggagacuu

SEQ ID NO: 394512 - RNA, 64 nt, Human
aauuucaacuucaaugucaucuucuccaugaagaccacugaaugaacaccuuuucauccagccu

SEQ ID NO: 394513 - RNA, 64 nt, Human
ucaacuccucccacagcaccaacccagcauggucccacugaaguccuacuacgcccuccccucc

SEQ ID NO: 394514 - RNA, 64 nt, Human
ucaccuuggagggcagaccuaggagccccucugaccacugaauccgucuccacaccccuucugc

SEQ ID NO: 394515 - RNA, 64 nt, Human
uccauuuuaccgaggaaggagccaagguccaggcccacugaaggacuugcauaacauuacaaua

SEQ ID NO: 394516 - RNA, 64 nt, Human
uuggugcucccagcaucccagggagagacacagcccacugaacaaggucucagggguauugcua

SEQ ID NO: 394517 - RNA, 64 nt, Human
cugagaaaugggguggaauagggaacuguaauggccacugaagcacgugagagacccucgcaaa

SEQ ID NO: 394518 - RNA, 64 nt, Human
uggaacauauuuugaaaaccuugggauagaugauccacugaaaucuuuuccagcucuaagauuu

SEQ ID NO: 394519 - RNA, 64 nt, Human
uuccagagcuucagccucucuucgucgucuuaccccacugaaaccaacagggaucgggccaggc

SEQ ID NO: 394520 - RNA, 64 nt, Human
gaaggauucugcauuucuauuccccucagccuacccacugaagucuuuggguagcucuuaagcc

SEQ ID NO: 394521 - RNA, 64 nt, Human
gauuuccaaaugagcccaaauuccacuggcuccuccacugaaaacuacuaaaccgguggaaucu

SEQ ID NO: 394522 - RNA, 64 nt, Human
aacauuacacuuaacaaugaaaaaaguuuuuccuccacugaacccuggaaacaugguccaguuu

SEQ ID NO: 394523 - RNA, 64 nt, Human
ugccccaaaggcuggcuuccaccauccaggugcaccacugaagugaggacacaccggagccagg

SEQ ID NO: 394524 - RNA, 64 nt, Human
uaagaguggucacuacagccaagcuaauugacacccacugaacuuucuggaaugggccauagga

SEQ ID NO: 394525 - RNA, 64 nt, Human
ccuugaugggauuuuuccccccaaguuuccuucuccacugaaaugccacacuaaugcuuguugg

SEQ ID NO: 394526 - RNA, 64 nt, Human
gggccuuccaccuaaacugaaugccugccaguacccacugaagagcccuuuggaccuuccuaaa

SEQ ID NO: 394527 - RNA, 60 nt, Human
uggccugugauugguccauuccaggaccuucauuugcauaagguaucaaaccacaucagc

SEQ ID NO: 394528 - RNA, 60 nt, Human
uggccaaugauugguucauuccaggacauucauuugcauaaggagucaaaccacaccagu

SEQ ID NO: 394529 - RNA, 60 nt, Human
acuuguuaaacauacaaauuacauagcugccauuugcauacauuuugauaguguuauugu

SEQ ID NO: 394530 - RNA, 64 nt, Human
gccccacuacagaacagggcuaaauuagccaccaccacugaaaacucagccgaauuuuuuuaua

SEQ ID NO: 394531 - RNA, 64 nt, Human
acugcgauggaggucccaaauauguggucuaucaccacugaauucauguaauagauaagaaaaa

SEQ ID NO: 394532 - RNA, 64 nt, Human
cagucaccuuagauguucagaagccgcuuccucuccacugaagagcuaugagauacgcacaaua

SEQ ID NO: 394533 - RNA, 64 nt, Human
agcugcuguuaacguauuugccaguuacgaaguuccacugaaaauuuuccuauuaauucuuaag

SEQ ID NO: 394534 - RNA, 64 nt, Human
uuuuccgaaagugacaguguuggucaucccaugaccacugaagcuuaguaaccagcgccaaaaa

SEQ ID NO: 394535 - RNA, 64 nt, Human
uguguggcccuucugaaacuuauggucaucucucccacugaaaccaaggucuuuucaaaugugg

SEQ ID NO: 394536 - RNA, 64 nt, Human
cucagaggaaggaacaggaaacaaagaaaggaagccacugaacaucccuucucugcuccacagg

SEQ ID NO: 394537 - RNA, 64 nt, Human
ucuucaaagaugucuguuggagcuauucccauacccacugaaggaucuguagucuugucuucau

SEQ ID NO: 394538 - RNA, 64 nt, Human
uggacugaucuuucuuuaauagugaaccccugggccacugaagaguaacauggcuccacuggac

SEQ ID NO: 394539 - RNA, 55 nt, Human
ucuggcuguugaagacaugagugacccacugaaccaagaacuuacuggaagugug

SEQ ID NO: 394540 - RNA, 64 nt, Human
cuugccacugcucuucccuugcugucagauuaauccacugaaguccaacuuugguucaagcaga

SEQ ID NO: 394541 - RNA, 64 nt, Human
ucugugccagcucuauaauuguuuugcuacgauuccacugaaacucuucgaucaagcuacuuua

SEQ ID NO: 394542 - RNA, 64 nt, Human
aucugacuguccggaaugugaguugaggggucucccacugaaguccucuucuggaagcugcaga

SEQ ID NO: 394543 - RNA, 64 nt, Human
uuguggacuggggccaugaggccuucccugguccccacugaacccaccuuaguuccacauuugg

SEQ ID NO: 394544 - RNA, 64 nt, Human
ggagcauuccuuguauucuggcagcacugaagagccacugaaggggguaggggcaguguagguc

SEQ ID NO: 394545 - RNA, 64 nt, Human
aguuggguucuugaguuuuaccaccacuuaguucccacugaauuuuguaacuuccuguguuugc

SEQ ID NO: 394546 - RNA, 60 nt, Human
gaacuagccucaggcuuaauauucucauugcauuugcaagaucugagcaaauaagauuaa

SEQ ID NO: 394547 - RNA, 60 nt, Human
cauaauuguauuaggacuuucugcaguugacauuugcauaaagcugacugacugaaggaa

SEQ ID NO: 394548 - RNA, 60 nt, Human
ugugaaacuuuauaagagaauuaauuuuuccauuugcauauuaauauguuccuccacaca

SEQ ID NO: 394549 - RNA, 55 nt, Human
uauucuuaacccuaagguaaaaaugcauuugcaaagggagaaaaugaaggccaaa

SEQ ID NO: 394550 - RNA, 64 nt, Human
acuacaucuuucuggcacauaacugucuccuuaaccacugaacaguucagccauuugaauaaau

SEQ ID NO: 394551 - RNA, 64 nt, Human
auauagcccacugaccaggaauuauuuaaccaacccacugaaaacuuguguguugagcagcucu

SEQ ID NO: 394552 - RNA, 64 nt, Human
aacuaggcacaagcucucugagccagucccucagccacugaagucccccuuucuccuuuuuuau

SEQ ID NO: 394553 - RNA, 64 nt, Human
guaagcccucaggagccucugcuccccugugaacccacugaaccuucugagcccccacugcuuc

SEQ ID NO: 394554 - RNA, 64 nt, Human
aaauggacacgucucaucugacccacucuuccuuccacugaaggucuucacgggccuccaggug

SEQ ID NO: 394555 - RNA, 64 nt, Human
agaccagcccaaccaacauggugaaacccugucuccacugaaaauacauaaaauuagccgggug

SEQ ID NO: 394556 - RNA, 64 nt, Human
ugggcugagaaaggggcaggcaaaaugaagcuggccacugaaaacuguaagauggucaaaagcu

SEQ ID NO: 394557 - RNA, 64 nt, Human
uguucuuguaguuuucugcauagauaaguaagcaccacugaagcaccucuguggcuugauauuu

SEQ ID NO: 394558 - RNA, 64 nt, Human
aaagcugacauugccaaaaaggauacauaaugggccacugaaaucugucaagaguaguuauaua

SEQ ID NO: 394559 - RNA, 64 nt, Human
aaaacacuagauagugugagagguuccuuucuguccacugaaacaaggcuaaggauacuaccaa

SEQ ID NO: 394560 - RNA, 64 nt, Human
uuagauuuuuugagaacucaccagcuuuuauuacccacugaauuuucagacuaucuuaggcuuc

SEQ ID NO: 394561 - RNA, 64 nt, Human
uugcagaauggaguuuccauggauuucuaccagaccacugaaggaguuccuggaagcccugcgg

SEQ ID NO: 394562 - RNA, 64 nt, Human
uggcuagugcgauuucacagucuacugccuguuuccacugaaaacauuuuugucauauucuugu

SEQ ID NO: 394563 - RNA, 64 nt, Human
aaguuauuaggagagauacucucuccuguuuucuccacugaacgagacucaucuugcucuucua

SEQ ID NO: 394564 - RNA, 64 nt, Human
cuuccuucagcagaggccaggcuauggagcagggccacugaauuugcuguaaucuggagaugcu

SEQ ID NO: 394565 - RNA, 64 nt, Human
gcaaugugauaguggguagaaaggagagaaaaacccacugaaggguucaaauacaugugaauuc

SEQ ID NO: 394566 - RNA, 60 nt, Human
cuuaaacauuauuauuaaaauaaauuauuucauuugcacacaaugauaauaaugaugaua

SEQ ID NO: 394567 - RNA, 60 nt, Human
uuuauuuuuagggugaagcaagaagcauuucauuugcacaucuuucuuggacuugggaua

SEQ ID NO: 394568 - RNA, 60 nt, Human
gcaacauucuuucauucuguaaacuaauuccauuugcauuccucauaagcauuguaguaa

SEQ ID NO: 394569 - RNA, 64 nt, Human
ggaaguugauucuuauuugauggugguauugugaccacugaauucacuccagucaacagauuca

SEQ ID NO: 394570 - RNA, 64 nt, Human
aaaggcacaacuaaaugcuuuauuaccuuucuuaccacugaacaauuugagguaaaaucauuca

SEQ ID NO: 394571 - RNA, 64 nt, Human
aaaaaucgcauuucaacccuuugagugccucauuccacugaauauuuaaauuuuccucuuaaau

SEQ ID NO: 394572 - RNA, 64 nt, Human
augggaggggucugaaaaucaggacccaacccagccacugaagagagagucucugcagagacag

SEQ ID NO: 394573 - RNA, 64 nt, Human
ugaaaaaggaaaaauguagacucugacuuccgucccacugaaggauuaaugaaaaccuuuacua

SEQ ID NO: 394574 - RNA, 64 nt, Human
uacugcucugauuuugugguaccaguacucucugccacugaacauuuugaaauauuuuuguuuu

SEQ ID NO: 394575 - RNA, 64 nt, Human
aagaccagccuggccaacaugugaaaccccgucuccacugaaaauagaaaaauuagcugggcau

SEQ ID NO: 394576 - RNA, 64 nt, Human
caggaguucaaggcugcagugaauucugaucgcaccacugaacuccagcccguaugacagagug

SEQ ID NO: 394577 - RNA, 64 nt, Human
gccuuccuuuguuccucaaaccccaucugucagaccacugaacaaauacacauacuaggccuca

SEQ ID NO: 394578 - RNA, 64 nt, Human
uugaauuaaauauauuguuacaauuaaacugauaccacugaauuguaugcauuauucuugaaua

SEQ ID NO: 394579 - RNA, 64 nt, Human
ucagaaucacaccucccggcugcugcugagagcaccacugaacuuagaccucucaacacaguau

SEQ ID NO: 394580 - RNA, 64 nt, Human
aaauaucgugccuuaacaauguggcuguccuuuuccacugaagaaggaaagacguuuugaucua

SEQ ID NO: 394581 - RNA, 64 nt, Human
uggcuuuccuuaggucaggcaagcagacagcuccccacugaagaggucuguacagugacaaccc

SEQ ID NO: 394582 - RNA, 64 nt, Human
ucuccuccccaaggagacacaacaacuccuagggccacugaagauauaacuauugcccagguuu

SEQ ID NO: 394583 - RNA, 62 nt, Human
cucuuccgggcagaaacaauaaaaccacuugugcccacugaacacuccuggcaugugcacuc

SEQ ID NO: 394584 - RNA, 64 nt, Human
uaaagggcauacauuuccugcuuucaccaauuaaccacugaauugcuauuuuuuccuuuuggcc

SEQ ID NO: 394585 - RNA, 62 nt, Human
ccugcaccuacccacaugcacucgugugagacaaggcccauagguauggccccccccuuccc

SEQ ID NO: 394586 - RNA, 62 nt, Human
ucgcuauaaauuaucuguugucuacaugguacaaggcccauugacucaucugaugcuuguuu

SEQ ID NO: 394587 - RNA, 62 nt, Human
ucaguugcucgcuucugggugugcucccuucgaaggcccagauaagacagggaacacuugug

SEQ ID NO: 394588 - RNA, 62 nt, Human
uacaaauuuuaaaaauacuacaauauuuaacuaaggcccaaccgauuuccauaauguagcag

SEQ ID NO: 394589 - RNA, 64 nt, Human
agcguggagcucagugacagcagcagggagaaauccacugaaggaaaaaacccaaauuuccacu

SEQ ID NO: 394590 - RNA, 64 nt, Human
uguguauaaauaccuucuauuuuuaauacaagcuccacugaaaaccaccuucguuuucaagguu

SEQ ID NO: 394591 - RNA, 64 nt, Human
ggcuuaaccugugacuuuaauaagcuggaacaguccacugaauggguauaaugaauugcaguau

SEQ ID NO: 394592 - RNA, 64 nt, Human
caugccuuaaaaagaaaacuuuuguuaaaguauuccacugaaaucacagauauuuguggguauu

SEQ ID NO: 394593 - RNA, 64 nt, Human
acguuucccugacugucauagagaaucaucaucgccacugaaaaccaggcccuguugccuuuua

SEQ ID NO: 394594 - RNA, 64 nt, Human
ucggcacuccugggcuuccgaugcucccucugaaccacugaaagcugugauguccaagggggcu

SEQ ID NO: 394595 - RNA, 64 nt, Human
ggcaucuacuuaacacugaccagaggaugugaagccacugaaagcuugacucagggaaaagaaa

SEQ ID NO: 394596 - RNA, 64 nt, Human
cugcaggcugggugggcaggacacguggugggggccacugaaaccaggccuaggagggagaaca

SEQ ID NO: 394597 - RNA, 64 nt, Human
gggugaagacagagggaaacacagcagcuucucuccacugaaagaagugggacuucccgucgcc

SEQ ID NO: 394598 - RNA, 64 nt, Human
uuccaggguucagaaaaggcaaacucaugaaaugccacugaaaagaacuuucaacacagcauac

SEQ ID NO: 394599 - RNA, 64 nt, Human
uguugcagauucugguuaagcagaggcuucagaaccacugaacuugaaacuuacccucuaggga

SEQ ID NO: 394600 - RNA, 64 nt, Human
acaaacuaucagggcaaaaucucacuggauuucuccacugaaaaccuacuugagguuucugguc

SEQ ID NO: 394601 - RNA, 55 nt, Human
gcuccaacuccucccgauaaacaggccacugaagcucucgccccuguaacuuaua

SEQ ID NO: 394602 - RNA, 64 nt, Human
aaacuccucaugauaacugcacacaaucugaaaaccacugaaggacaagccaaccacagcagcc

SEQ ID NO: 394603 - RNA, 64 nt, Human
acacuaauauauuuaaaaauaagucaacaguaaaccacugaaaaaauauauguauauacaccca

SEQ ID NO: 394604 - RNA, 64 nt, Human
aaaucucauuaauuaauuguucucccccauuaccccacugaaugaauggccauacaggcuaagc

SEQ ID NO: 394605 - RNA, 62 nt, Human
ccacagucuagggagaucugagggcauccgacaaggcccaucuccuucccuccucaagaagc

SEQ ID NO: 394606 - RNA, 62 nt, Human
agugugucaggugcugcagagcguucuuggagaaggcccacugaggcagguucgugcccugc

SEQ ID NO: 394607 - RNA, 62 nt, Human
uuuaauuugaaccaugauuuugcuagaaauagaaggcccagugguggaauauuagagggaag

SEQ ID NO: 394608 - RNA, 62 nt, Human
auaugccaaaaaaugaagccgggaaggaggacaaggcccauggguggguguugagguuuuua

SEQ ID NO: 394609 - RNA, 64 nt, Human
uauguguauggcguacauugguucagucagccuuccacugaauacacgauugagucuggcccag

SEQ ID NO: 394610 - RNA, 64 nt, Human
ugggaucaugaccaggaaucacgugaagcugacaccacugaagggagaguugagaggcagaaag

SEQ ID NO: 394611 - RNA, 64 nt, Human
gcagcaggugacccauuaacugaggaacuggcugccacugaacaccuggaacuccuugugggaa

SEQ ID NO: 394612 - RNA, 52 nt, Human
ugccuuacugggggauuuagugccacugaagccugcgucagcagcccgagcg

SEQ ID NO: 394613 - RNA, 64 nt, Human
acagccaacaagaggcccuugaaucucuacguggccacugaacugcugggcccgggagacugga

SEQ ID NO: 394614 - RNA, 64 nt, Human
caauaaccagucaccagugcgauucuggauaaagccacugaaaauucgaaccaggaaauggaac

SEQ ID NO: 394615 - RNA, 64 nt, Human
cuuucccaccuccuugcuuuuucuuucacugauaccacugaauggaacuggugcugugacuccu

SEQ ID NO: 394616 - RNA, 64 nt, Human
aagggaucuacuauaggaaugaaguauuuauaaaccacugaaagggauagagaagugaacauug

SEQ ID NO: 394617 - RNA, 64 nt, Human
ccagauuucagaacauguguuaauaguauauaugccacugaaaacuuagguccuguaucauacu

SEQ ID NO: 394618 - RNA, 64 nt, Human
caaauguaguccuaaauugcaauuaugagggcuaccacugaaucauuuuaucuuucagccaauc

SEQ ID NO: 394619 - RNA, 64 nt, Human
gcugcacuggagccacaggcaggggugagagcacccacugaauugacaugacccucugucccca

SEQ ID NO: 394620 - RNA, 64 nt, Human
ccuuccaaacccagacccaccuccugccccaggcccacugaagcauguuccauuucuaaaaagc

SEQ ID NO: 394621 - RNA, 64 nt, Human
uccguggcugcucauucuugccuacuuuacucucccacugaagcagguuagcguugaagguggu

SEQ ID NO: 394622 - RNA, 64 nt, Human
cacccaggacuuccauuugcuuugucccggggcuccacugaacaaguuggccugcacugguguu

SEQ ID NO: 394623 - RNA, 64 nt, Human
cucccggcgauccgcccccagcacuggggaggcgccacugaaccgagaagggacggucaucugc

SEQ ID NO: 394624 - RNA, 64 nt, Human
aaaugaaacaaugcaacauuucacuuugauuucuccacugaaauuuccuugauuauaugguuag

SEQ ID NO: 394625 - RNA, 60 nt, Human
uggcuauagaaaaauuugucauaauaauuucauuugcaugaaauccugaggggugcauua

SEQ ID NO: 394626 - RNA, 60 nt, Human
cuaucccuuugggcccugggagaaggaagccauuugcagugcugguguguccugcucccu

SEQ ID NO: 394627 - RNA, 62 nt, Human
ggugggugugagcagggugaccccucaucugaaaggcccaaaccagggggaagcaccagccu

SEQ ID NO: 394628 - RNA, 62 nt, Human
uuccuccaucugagaaguggcccaugugcuucaaggcccaggagggagaucugucagcucau

SEQ ID NO: 394629 - RNA, 64 nt, Human
uuguauguuacguguuaagggcuuguuugguaucccacugaaauguucuguguugcagaccaga

SEQ ID NO: 394630 - RNA, 64 nt, Human
gcucacagagggacugucaucuaaaccaggggaaccacugaacuaaagcccaauuugcuugcau

SEQ ID NO: 394631 - RNA, 64 nt, Human
agagagucgauggcaggaggggguuuugggugggccacugaaaagggguaccgaauagguugug

SEQ ID NO: 394632 - RNA, 64 nt, Human
aaggugucauggaaauacagauucuuuguuuuggccacugaauggacucucucuucagugggau

SEQ ID NO: 394633 - RNA, 64 nt, Human
aacuuggugugggggaggagcacaaaacuccagcccacugaaccucugccaauuaagauggugu

SEQ ID NO: 394634 - RNA, 64 nt, Human
ggaacaaggggcuggcuguccugggcucccugacccacugaagcuucucagcacguuccucccu

SEQ ID NO: 394635 - RNA, 64 nt, Human
ggaaccaacacauuaacgauuuuucccccagaagccacugaauaauucuuuuugguguauuuuu

SEQ ID NO: 394636 - RNA, 64 nt, Human
ccacauaauuuuauuaaaacgaagggaaaagggaccacugaauugcaccauuuaagaugcugcu

SEQ ID NO: 394637 - RNA, 64 nt, Human
ugcugacucacuuuuauauacaagaaaaaccuuuccacugaaaaaucccucugauuuaaaagua

SEQ ID NO: 394638 - RNA, 64 nt, Human
caaaaggaauaauucaaaagacuuaggacaauuaccacugaaacacuucgagcuauuuagcuaa

SEQ ID NO: 394639 - RNA, 64 nt, Human
ggacuccacuuauaaauauaacuguuuuuauguuccacugaaucccugaaaauggugaggaggg

SEQ ID NO: 394640 - RNA, 64 nt, Human
guauaugguugcuuaauuguucugugauugaggaccacugaaaaauaagucuuaauaaauguug

SEQ ID NO: 394641 - RNA, 64 nt, Human
ccacagaacccaccugcacccugacaggcacaccccacugaagagccugagucccaggaggccu

SEQ ID NO: 394642 - RNA, 64 nt, Human
gggaguuuggggccgggauggaaguuguuucuagccacugaaagaagauauuucaagaugacca

SEQ ID NO: 394643 - RNA, 64 nt, Human
caccugaaugacugcguguguccaagguggcuucccacugaagggacacagagguccaguccuu

SEQ ID NO: 394644 - RNA, 64 nt, Human
gaauuccuauuagcgaaauaguuuuuuaauauaaccacugaagaaaaucuguggugagaggaaa

SEQ ID NO: 394645 - RNA, 62 nt, Human
cagggagaucacaccuuuggcaaaguccagacaaggcccacugcaguuccuauggcgccagu

SEQ ID NO: 394646 - RNA, 62 nt, Human
uaggcuguggcccagaagcuggaaguuugggaaaggcccaagcugggacuucuccaggccug

SEQ ID NO: 394647 - RNA, 62 nt, Human
uguccugcucccuccccacauuccccaugcucaaggcccagccuucuguagaugcgcaagug

SEQ ID NO: 394648 - RNA, 62 nt, Human
caaaaggguuagaggguggggaggugagagcaaaggcccagcugcagcccucagcuagaguc

SEQ ID NO: 394649 - RNA, 64 nt, Human
uagaaugcuagcuucuuuacauaaaagagugcucccacugaagaagugccuuuugagugcaaug

SEQ ID NO: 394650 - RNA, 64 nt, Human
auacaauaugugguuucuugugucuggcuuuuuaccacugaacguuuucagaguucauccaugu

SEQ ID NO: 394651 - RNA, 64 nt, Human
gccgccaccucugggaaagagaaaagguuuggguccacugaacaucauguuuguagacgcugac

SEQ ID NO: 394652 - RNA, 64 nt, Human
cacuccucauccacacaccuuucuuuacccagagccacugaaaacuauuuuuauaucauuggcu

SEQ ID NO: 394653 - RNA, 64 nt, Human
agccaggcacggugauaaaugccuguagucccagccacugaagccagaggaucgauugaaccag

SEQ ID NO: 394654 - RNA, 64 nt, Human
auuguuuaucaaaaauauguuccgagugcaaugcccacugaaagacaaacuugcauauguugau

SEQ ID NO: 394655 - RNA, 64 nt, Human
ggcagcccaugguggcagccggaggugcguaagcccacugaacgcugcagggcagggaagaaau

SEQ ID NO: 394656 - RNA, 64 nt, Human
uugucaaacaccuuuaaaaggggagaaaaaaugaccacugaacuuacauuaagagaauuuacaa

SEQ ID NO: 394657 - RNA, 64 nt, Human
aguaaagaaagcacauugugucaauggauuuaucccacugaacaauuugaaugaagacaaugug

SEQ ID NO: 394658 - RNA, 64 nt, Human
uccccaaccccagacacagggguuggccacaaucccacugaaugcccuugguucacacuccauu

SEQ ID NO: 394659 - RNA, 61 nt, Human
ccccuguccgggacuacugaccaugugccucccacugaauggcaguuuccaggaccuccau

SEQ ID NO: 394660 - RNA, 64 nt, Human
ugucccccaacuucaucuggaaguuaaagugaggccacugaagaggaggaggagggucuagagg

SEQ ID NO: 394661 - RNA, 64 nt, Human
uaugauacgaauauaccacuauuuguuuauucacccacugaaggacauuaguuuuguucccggu

SEQ ID NO: 394662 - RNA, 64 nt, Human
ccaggaguuguugaacuauauuuggagaaaacagccacugaauauuaucauuucuccuuuaaag

SEQ ID NO: 394663 - RNA, 64 nt, Human
ccuccuccauggcuuuccugguuuguuccucucuccacugaagcugacuuagccggccccuuuu

SEQ ID NO: 394664 - RNA, 64 nt, Human
ccaaguuaaguguucaaaggggaugugagggccuccacugaagcagggaggcagcuguguaauc

SEQ ID NO: 394665 - RNA, 62 nt, Human
ccacugucagcucucaagagcccauggccaggaaggcccaugcugagcuuucaguccagccc

SEQ ID NO: 394666 - RNA, 62 nt, Human
agcacggagugaagaugggaggagcuguuagcaaggcccacugcugcuccugggugagaagg

SEQ ID NO: 394667 - RNA, 62 nt, Human
cccucuucccagaaucugcggggaacuggggcaaggcccaucugucugcaaggcugguagcu

SEQ ID NO: 394668 - RNA, 62 nt, Human
gacuauaucgcacaacaggugcuaguuuugagaaggcccaacaggaguuugcaacaggugug

SEQ ID NO: 394669 - RNA, 64 nt, Human
uggagugacagcuccuuucuucucccacaucugcccacugaagauuugagggaggggagaugga

SEQ ID NO: 394670 - RNA, 64 nt, Human
gcccagcucuaugggaaacaaggaggaaaguuagccacugaaggccaaaacaccauguggggug

SEQ ID NO: 394671 - RNA, 64 nt, Human
cccugcaaggaagguccaagcaggcccuuagggaccacugaaugccccgaucccaaucagguua

SEQ ID NO: 394672 - RNA, 64 nt, Human
cuaauuugcaaacucaaucggggacuaaaauuucccacugaaaauguuaaacauuuuagauaac

SEQ ID NO: 394673 - RNA, 64 nt, Human
aggaauaucaccagcauguuguacggaaacucucccacugaagcaggcuuuaauugcuuuaaaa

SEQ ID NO: 394674 - RNA, 64 nt, Human
aaacuggccucuacuaucuuuaacucaugcauggccacugaaccucucucuaguagccuggauu

SEQ ID NO: 394675 - RNA, 64 nt, Human
gcaccgaggugcacuugccggccugggaggugucccacugaagccccgcgccuccuccugccag

SEQ ID NO: 394676 - RNA, 64 nt, Human
uuuuuuugaaaaucuuuccuuccagaucuguugcccacugaacagccacccgucccucacuguc

SEQ ID NO: 394677 - RNA, 64 nt, Human
aauaugugaggaacugauugcugugcauuauuuuccacugaacagaccuucuuuuaacuucuaa

SEQ ID NO: 394678 - RNA, 64 nt, Human
gguugacgccaugguggaccugcuggaccuggacccacugaagaggucgggcuccauggagcag

SEQ ID NO: 394679 - RNA, 64 nt, Human
uuuggggacuagguagaggugaauguacuaaaugccacugaauuuguauacuucagaauguuug

SEQ ID NO: 394680 - RNA, 64 nt, Human
cuggaagagcgguccagguggggccggggacuggccacugaauuaugccagggcgcacuuucca

SEQ ID NO: 394681 - RNA, 64 nt, Human
ugucucaccuaucugugaccuggaagcucccuccccacugaaccaauguucuucuuacauauau

SEQ ID NO: 394682 - RNA, 64 nt, Human
uuuuuuuuuuauacccuaguuggucacccugucaccacugaaccuugauuuaacagaggcaaaa

SEQ ID NO: 394683 - RNA, 64 nt, Human
cugccuaauuaagauguugccuuuuaguugaaugccacugaagagcugugauagcauguuucaa

SEQ ID NO: 394684 - RNA, 64 nt, Human
ucugcuguaugagagguaggacuggauuaaaugaccacugaacucacugaauccagaucauuca

SEQ ID NO: 394685 - RNA, 62 nt, Human
gauuaaugcauucuccacauuuuaauauugcaaaggcccauuggaguuucugaaguggcucc

SEQ ID NO: 394686 - RNA, 62 nt, Human
ugccggagcucccaguccaggaggaaagagccaaggcccacuuuugggaucaggugccugau

SEQ ID NO: 394687 - RNA, 62 nt, Human
gacuugacaacaucccacaguggcacggagagaaggcccauaccuucugguugcuucagacc

SEQ ID NO: 394688 - RNA, 62 nt, Human
acugcuguaaccccgcgccggcauagggaccuaaggcccacuggagggcgcucaucaaguag

SEQ ID NO: 394689 - RNA, 64 nt, Human
aggggccucggccucagagucaugugcccugugaccacugaagggugucagcagagcacacggc

SEQ ID NO: 394690 - RNA, 64 nt, Human
accgugcggccuuagagguuucccuccuuccuuuccacugaaaagcacauggccuugggugaca

SEQ ID NO: 394691 - RNA, 64 nt, Human
caaagaaccagcucauguuuggaaaaggaaucuuccacugaaacauuuggauacccgacguucu

SEQ ID NO: 394692 - RNA, 64 nt, Human
gcacccaaacacauggcacuuggaagaaaaagacccacugaaucugagaaaguacuuucuggug

SEQ ID NO: 394693 - RNA, 64 nt, Human
caagaacucgcaguacauuaccagcugugauucuccacugaaauuuuuuuuuuaagggagcuca

SEQ ID NO: 394694 - RNA, 64 nt, Human
ugucccaguuaacuguuaaauaaggccucauccuccacugaagaguauggauugaaggauugug

SEQ ID NO: 394695 - RNA, 64 nt, Human
cuacacguuggaguauaccuaugugugugcuuugccacugaaguaagauuuugccuguauggua

SEQ ID NO: 394696 - RNA, 64 nt, Human
ugggcccuaggagcccuguaacucccaggagagaccacugaaaauacuggagcaacaaugcccc

SEQ ID NO: 394697 - RNA, 64 nt, Human
ugugguaauugcauaauuucauuggugaggauuuccacugaauauugagaaaguuucuuuucau

SEQ ID NO: 394698 - RNA, 64 nt, Human
guacaaaauggaauucauucuggucucucuauuaccacugaagauagaagaaaaaagaauguca

SEQ ID NO: 394699 - RNA, 64 nt, Human
ggaugucauuugccugguaagaacuggguuauuuccacugaaauuuguuauguuuaaggaaauu

SEQ ID NO: 394700 - RNA, 64 nt, Human
uauuuuucuuaaaaaguaacuccuaguagggguaccacugaaucuguacagagccguaaaaacu

SEQ ID NO: 394701 - RNA, 64 nt, Human
gaggcugaggcugcaaugagcuauaauuauugcaccacugaacuccagccugggccacauagca

SEQ ID NO: 394702 - RNA, 64 nt, Human
gaaagugaaaagcaaucaauuauacccaccaacaccacugaaaucauaagcuauucacgacuca

SEQ ID NO: 394703 - RNA, 64 nt, Human
uuuugauaaguaauuacacuggaccuaggcaaaaccacugaagaacaaguguuccuuuuuacca

SEQ ID NO: 394704 - RNA, 64 nt, Human
gaugccuugcugcugcaacccuuuccccagcuguccacugaaacgugaaguccuguuuugaaug

SEQ ID NO: 394705 - RNA, 60 nt, Human
ugggagaaagcuggagaucugaacccagcccauuugcacacuauaagaaaaaaaaguaac

SEQ ID NO: 394706 - RNA, 60 nt, Human
ggccugcaggugucuagggucucagcuuuucauuugcagaggacauguucaacuuccucu

SEQ ID NO: 394707 - RNA, 60 nt, Human
ccccgcccugcagggacacagaagccacaccauuugcaccauccacgccuugcuccagaa

SEQ ID NO: 394708 - RNA, 60 nt, Human
uagagccacaaauuucaauucuuacauuuccauuugcaaagugacuagagaaaaagaaau

SEQ ID NO: 394709 - RNA, 64 nt, Human
cugcuccaucgugaggagcccucugaauagccccccacugaaugcuugccuugcccaaauggaa

SEQ ID NO: 394710 - RNA, 64 nt, Human
cucaaaaaggccuguacauacuucucccaaagcgccacugaaaagauggcauagcuuaaaagau

SEQ ID NO: 394711 - RNA, 57 nt, Human
ugccuguagucccagcuacuugggaggcugaggcaggagaaucacuugaccccaggu

SEQ ID NO: 394712 - RNA, 57 nt, Human
uaacuauaaucccagcuacuugggaggcugaggcaggagaaucgcuugaacccggga

SEQ ID NO: 394713 - RNA, 57 nt, Human
cuccuguagucccagcuacuugggaggcugaggcaggagaaucgcuugaaccuggga

SEQ ID NO: 394714 - RNA, 57 nt, Human
ugccuguaauuccagcugcuugggagccugaggcaggagaacugcuugaacccagga

SEQ ID NO: 394715 - RNA, 57 nt, Human
gugcugggggugguagaaaggaugcugcugaggcagcuggaggagugggaguagcuc

SEQ ID NO: 394716 - RNA, 57 nt, Human
gccuguaaucccagcuacuggggaaagcugaggcaggagaauugcuucaaucuggaa

SEQ ID NO: 394717 - RNA, 57 nt, Human
ugccuguagucccagcuacucaggaggcugaggcaggagaaucacuugaacccggga

SEQ ID NO: 394718 - RNA, 57 nt, Human
gacaauucggggaccuuaggccccuuccugaggcacacuuggccccuuccucggucc

SEQ ID NO: 394719 - RNA, 57 nt, Human
aguuuggaauuguguucuucguaaagacugaggcaagcaagugcugugaaauaacau

SEQ ID NO: 394720 - RNA, 57 nt, Human
cgccuauagucccagcuacucaggaggcugaggcaggagaaucacuugaacccagga

SEQ ID NO: 394721 - RNA, 57 nt, Human
cggacauagaguuggagggggaggccccugaggcagcccagcuccugaauaaagauu

SEQ ID NO: 394722 - RNA, 57 nt, Human
ccccuccucugaugaacacuacaguggcugaggcaucagcccccgcccaggcccugu

SEQ ID NO: 394723 - RNA, 57 nt, Human
ugccuguggucccagcuacucaggaggcugaggcaggaggaucacuugagcacagga

SEQ ID NO: 394724 - RNA, 57 nt, Human
cgccuguaaucccaaaacuuuggaaggcugaggcagguggaucaccugaggucagga

SEQ ID NO: 394725 - RNA, 60 nt, Human
cacuuggguggagaccaguugaccauagagcauuugcagagccucauuguuugauuucuu

SEQ ID NO: 394726 - RNA, 60 nt, Human
aaauggaauuuguuuuaucucuuugggauacauuugcauuuuaguguacauuuacguccc

SEQ ID NO: 394727 - RNA, 60 nt, Human
uuuauaacgaugauucuuuugcuuuccaugcauuugcacaaaacaaccagaauuaaagau

SEQ ID NO: 394728 - RNA, 51 nt, Human
auucagaaagcuuugaaugaacugaggcaaauuuaaaaggcaauaauuuaa

SEQ ID NO: 394729 - RNA, 57 nt, Human
ugcuuguaaucccagcuacuugggaggcugaggcaggagaaucacuugaaccaggaa

SEQ ID NO: 394730 - RNA, 57 nt, Human
gacaacagcugagccaggaaagugcugcugaggcaagucgacauagcucacagggaa

SEQ ID NO: 394731 - RNA, 57 nt, Human
ugcucagggagacuuccgcccuccucacugaggcaacaugaagcccgaggcccagau

SEQ ID NO: 394732 - RNA, 57 nt, Human
caccuguaguccuagcuacuugggaggcugaggcaggaggaucccuugaguccagga

SEQ ID NO: 394733 - RNA, 57 nt, Human
cgccuguagucccaguuacuugggaggcugaggcaggagaauugcuugaaccuggga

SEQ ID NO: 394734 - RNA, 57 nt, Human
ugccuguaaucccagcuacuugggaggcugaggcaggagaaucgcuugaacccggga

SEQ ID NO: 394735 - RNA, 57 nt, Human
aaccuucgaaucugagaacuuccacaccugaggcaccugagagaggaacucuguggg

SEQ ID NO: 394736 - RNA, 57 nt, Human
acagagacagagagcaaggcugugaaacugaggcaccguuccuagacaucucggugc

SEQ ID NO: 394737 - RNA, 57 nt, Human
ggagcaggcccaagggcagagcagaggcugaggcacggggagccagccccacucggg

SEQ ID NO: 394738 - RNA, 57 nt, Human
ugccuguaaucccagauacuugggaggcugaggcaggagaauugcuugaacccagga

SEQ ID NO: 394739 - RNA, 57 nt, Human
gaaggaacauuauggagagaaaggguacugaggcacucuagaaucugccacauucau

SEQ ID NO: 394740 - RNA, 57 nt, Human
cgccuguaaucucagcuacucaggaggcugaggcaggagaauugcuugaaccuguga

SEQ ID NO: 394741 - RNA, 57 nt, Human
aaaugcaaccaaugaagaaucaagccacugaggcagggcagagggaccuuugauagg

SEQ ID NO: 394742 - RNA, 57 nt, Human
ugccuguaaucccagcugcuugggaggcugaggcaggagaaucacuugaacacagga

SEQ ID NO: 394743 - RNA, 57 nt, Human
ugccugaaaucccagcuacuugggaggcugaggcaggagaauugcuugaacccggga

SEQ ID NO: 394744 - RNA, 60 nt, Human
uuguccacgucacaguuuuucugcucuggucauuugcauuaagaugaagaauuuuuuaaa

SEQ ID NO: 394745 - RNA, 60 nt, Human
gccccuugcugcuggcucccaucucccucccauuugcagaccaggaaggaagagcaagcu

SEQ ID NO: 394746 - RNA, 60 nt, Human
cucacagagacacacacagcacuucaguagcauuugcauuccugguuaaagaaucaccaa

SEQ ID NO: 394747 - RNA, 57 nt, Human
aaagccgaagcgaaaggggucagggugcugaggcaacagcagcaagggcuggucugg

SEQ ID NO: 394748 - RNA, 57 nt, Human
cgccuguagucccagcuacuugggaggcugaggcaggagaauggugugaacccggga

SEQ ID NO: 394749 - RNA, 57 nt, Human
uacuggaaauggcagcaguuucugaugcugaggcaguuugcaaucccaugacaacug

SEQ ID NO: 394750 - RNA, 57 nt, Human
accaggcagccuuccagaccucaggggcugaggcagacuauuagggcagggcugacu

SEQ ID NO: 394751 - RNA, 57 nt, Human
cgccuguagucccagcuacucaggaggcugaggcaggagaauggcgugaacccggga

SEQ ID NO: 394752 - RNA, 57 nt, Human
ugccuguagucccagcuacuugggaggcugaggcaggagaauugcuugaacccugga

SEQ ID NO: 394753 - RNA, 57 nt, Human
ugucgaaggucucccaggagcucuguacugaggcagacacagaaagacacaaaacgg

SEQ ID NO: 394754 - RNA, 57 nt, Human
ccccacuuagugcugguccuagguccucugaggcacucaucuacugaaugaccucuc

SEQ ID NO: 394755 - RNA, 57 nt, Human
ucuucucugugacaggcaucuccagcacugaggcaccucugacucacaguuacuuau

SEQ ID NO: 394756 - RNA, 57 nt, Human
ugccuguaaucccagcuacuugggaggcugaggcaggagacucgcuugaaccuggga

SEQ ID NO: 394757 - RNA, 57 nt, Human
acgucugcagggcccucucauacacgccugaggcagaagcagcgucccccgugaaag

SEQ ID NO: 394758 - RNA, 57 nt, Human
agaaagcagaguuucuuucaaacuucacugaggcaucaguugcucuuuggcaauguc

SEQ ID NO: 394759 - RNA, 57 nt, Human
cagcuuuugagggugcuggggguaggacugaggcagccccacugggaaccagacugc

SEQ ID NO: 394760 - RNA, 57 nt, Human
cagcgucccuuggugagaaagggauugcugaggcaccguccaggccccaccggccag

SEQ ID NO: 394761 - RNA, 57 nt, Human
agccuguagucccagcuacucgggaggcugaggcaggagaauugcuugaaccgggga

SEQ ID NO: 394762 - RNA, 57 nt, Human
cgccuguaaucccagcuacuugggaggcugaggcaggagaauggcaugaaccuggga

SEQ ID NO: 394763 - RNA, 60 nt, Human
ccacggaaugugugugaagcccagaaauggcauuugcaguuaauuagcacaugugagggu

SEQ ID NO: 394764 - RNA, 60 nt, Human
acucuaugcuagauuugagauuaaaguggucauuugcagaucuccaacucacacagauac

SEQ ID NO: 394765 - RNA, 60 nt, Human
uggcagguauucccaugauucacagaguuacauuugcauuuaauuaaucuuaaaguugca

SEQ ID NO: 394766 - RNA, 57 nt, Human
caccuguagucccagcuacucagggggcugaggcaggagaauggcgugaauccggga

SEQ ID NO: 394767 - RNA, 57 nt, Human
ugccuguaaucccagcuauucaggaggcugaggcaggagaaucacuuggaccuggga

SEQ ID NO: 394768 - RNA, 57 nt, Human
ugccuguaaucccaacacuuaggguggcugaggcaggcagaucaccuggggucagga

SEQ ID NO: 394769 - RNA, 57 nt, Human
uguggcuagcuguuuccagccagggggcugaggcaccugcagucacccacacucugg

SEQ ID NO: 394770 - RNA, 57 nt, Human
caccuguagucccagcuacucgggaggcugaggcaggagaaaggcaugaauccaaga

SEQ ID NO: 394771 - RNA, 57 nt, Human
ugccuguaaucucagcuacucaggaggcugaggcaagagaaucgcuugaaccuggga

SEQ ID NO: 394772 - RNA, 57 nt, Human
ugccuguagucccagcuguuugggaggcugaggcaggaggaucuuugagccuaggau

SEQ ID NO: 394773 - RNA, 57 nt, Human
gacccucacacucucauuugagccucccugaggcagggagccaggaggcaccugagg

SEQ ID NO: 394774 - RNA, 57 nt, Human
cgccuguagucccagcuacucaggaggcugaggcaggagaaucgcuugaaccuggga

SEQ ID NO: 394775 - RNA, 57 nt, Human
cagugucagggcugcaccccauaggcccugaggcacacagcccagccccuugugagu

SEQ ID NO: 394776 - RNA, 57 nt, Human
ugccuguagucccagcuacuugggaggcugaggcaggaggguugcuugagacuagcc

SEQ ID NO: 394777 - RNA, 57 nt, Human
ugccuguagucccagcuacuugcgaggcugaggcaggagaauugcuugaaccuggga

SEQ ID NO: 394778 - RNA, 57 nt, Human
ugccuauaaucccagcuacucaggaggcugaggcagaauugcuugaaccugggaggu

SEQ ID NO: 394779 - RNA, 57 nt, Human
ccaggcaaugccagcauuucaugggggcugaggcagaacccaggagcuccaagaaag

SEQ ID NO: 394780 - RNA, 57 nt, Human
gugcugaaauggcuguggccccagcaccugaggcagggguacgcuaccugggguagc

SEQ ID NO: 394781 - RNA, 57 nt, Human
caccuguaaucccagcuacucgggaggcugaggcaggagaaucgcuugaacucggga

SEQ ID NO: 394782 - RNA, 60 nt, Human
aguaguacaggaaauauuccucuuuacauucauuugcaguucuuucacugaccuccuaau

SEQ ID NO: 394783 - RNA, 60 nt, Human
cccuuucccuuauguccaguuuaagaugaucauuugcaugauuuucauuucaauaaaaaa

SEQ ID NO: 394784 - RNA, 60 nt, Human
gaaaaaugccuuucuguuccccucucaugacauuugcagauacaaaagauggaaauuuuu

SEQ ID NO: 394785 - RNA, 57 nt, Human
ugccuauaaucccagcacuuuggaaggcugaggcagaaggaucacuugagcccagga

SEQ ID NO: 394786 - RNA, 57 nt, Human
cuauacgcagacccacagguggggaaacugaggcaggaacaggguucugcccuccca

SEQ ID NO: 394787 - RNA, 57 nt, Human
cuaagaccugggguugucagcucucaucugaggcauccagcagucucugccuugccu

SEQ ID NO: 394788 - RNA, 57 nt, Human
cgccuguaaucccaccacuuuggaaagcugaggcagguggaucaccugaggucagga

SEQ ID NO: 394789 - RNA, 57 nt, Human
gcaggcgaggccuccaggggcaggguccugaggcaggaacucgacucuccaacccuc

SEQ ID NO: 394790 - RNA, 57 nt, Human
cgccuguagucccagcuacacgggaggcugaggcaggagaauggcgugaacccagga

SEQ ID NO: 394791 - RNA, 57 nt, Human
cgccuguaaucucagcuacuugggaggcugaggcaggagaaucgcuugaacccggga

SEQ ID NO: 394792 - RNA, 57 nt, Human
cgccuguagucccagcuacuugggaggcugaggcaggagaauugcuugagcccaaga

SEQ ID NO: 394793 - RNA, 57 nt, Human
uaccuauaaucccagcuacuugggaggcugaggcaggagaaucgcuugaaccuggga

SEQ ID NO: 394794 - RNA, 57 nt, Human
ugccuauagucccagcuacucaggaggcugaggcaggagaauugcuugaaccuggga

SEQ ID NO: 394795 - RNA, 57 nt, Human
ggguguaaaggccaaggucagcauagacugaggcacacuggcuccucagcuccagcc

SEQ ID NO: 394796 - RNA, 57 nt, Human
cgccuguaaacccagcuacuugggaggcugaggcaggagaauugcuugagcccggga

SEQ ID NO: 394797 - RNA, 57 nt, Human
acaauaauuggaguucauacugaugcccugaggcacugaaaaaaaaaaaaaucccaa

SEQ ID NO: 394798 - RNA, 57 nt, Human
gauucuuauuuauuaauagauuaaguucugaggcagcuccgcaggacugugugugaa

SEQ ID NO: 394799 - RNA, 57 nt, Human
ugccuguaaucccagcuacuugggaggcugaggcacgagauuccuugaacccaagag

SEQ ID NO: 394800 - RNA, 57 nt, Human
cgccuguagucccagcuacucaggaggcugaggcaggagaauugcuugaacccagga

SEQ ID NO: 394801 - RNA, 60 nt, Human
aaauccaaagcugcucucgauaauagucaacauuugcauauauauggaauuucuuacuuu

SEQ ID NO: 394802 - RNA, 60 nt, Human
cuugucauaauuguuaagguguucuagagccauuugcauacaauuuaauguaauuucauu

SEQ ID NO: 394803 - RNA, 60 nt, Human
cauuuuaugucuuaaugguauccuacugagcauuugcaccucuguucauuucacacagug

SEQ ID NO: 394804 - RNA, 57 nt, Human
cgccuguaaucccagcuacucaggaggcugaggcaggagaaucgcuugaacccggga

SEQ ID NO: 394805 - RNA, 57 nt, Human
ugggaucgcaccuuuuauaccagagaccugaggcagaugaaauuuauuuccaucuag

SEQ ID NO: 394806 - RNA, 57 nt, Human
ccccaacuucugucccagccuugaaggcugaggcacuucuuuuucagaugccaauaa

SEQ ID NO: 394807 - RNA, 57 nt, Human
aucuggagucagcagaaccauugggaccugaggcaggagugucaccugcgggagaag

SEQ ID NO: 394808 - RNA, 57 nt, Human
cgccuauagucccagcugcucaggaggcugaggcaugagaaucgcuugaaccuagga

SEQ ID NO: 394809 - RNA, 57 nt, Human
ccccuaaaaucccagcuacuugagagacugaggcaggagaaucgcuugaacccagga

SEQ ID NO: 394810 - RNA, 57 nt, Human
caaagacucagagaacuagaguuuaagcugaggcagagugccgccacccuggcaugc

SEQ ID NO: 394811 - RNA, 57 nt, Human
acagcuguaggaacuacugucccagagcugaggcaaggggauuucucaggucauuug

SEQ ID NO: 394812 - RNA, 57 nt, Human
aguggcucacgccuauaaucccagaggcugaggcaggcggaucaccugaggucagga

SEQ ID NO: 394813 - RNA, 57 nt, Human
uagacaccuuuuaaaaugcagaacuaacugaggcauuucaguaacuuugcuuucaaa

SEQ ID NO: 394814 - RNA, 57 nt, Human
gaggaaaugcauacagggcaugagcaacugaggcaaaccuuuguggacaugaauugu

SEQ ID NO: 394815 - RNA, 57 nt, Human
gagguaaaacaaaagaaauauugaaaacugaggcaguuaaccaaaguagcucauaua

SEQ ID NO: 394816 - RNA, 57 nt, Human
cucccucucagcagcuagaugcauggccugaggcaggguggucaggaaccaccucaa

SEQ ID NO: 394817 - RNA, 57 nt, Human
acuauucucaugguacaguggggaaaacugaggcacagagagguuagggacuuuuca

SEQ ID NO: 394818 - RNA, 57 nt, Human
caccaguaaucccagcuacuugggaggcugaggcaggagaaucacuugaacccggga

SEQ ID NO: 394819 - RNA, 57 nt, Human
ugccuguaauccaagauacucaggaggcugaggcaggagaaucgcuugaaccuggga

SEQ ID NO: 394820 - RNA, 62 nt, Human
uuuuacuaauaacaugucaugcugagauucagaaggcccaugcuuauaauuuaaaaaugaga

SEQ ID NO: 394821 - RNA, 62 nt, Human
acuuggcuuaucaauauuaagucuuuuaccuaaaggcccagccgucaccagacaacagaaua

SEQ ID NO: 394822 - RNA, 62 nt, Human
ugcccacuauggcccugggagagccagaccccaaggcccagacaggcucagguuuccuuccu

SEQ ID NO: 394823 - RNA, 57 nt, Human
caccuguaaucccagcuacuugggagacugaggcaggagaaucgcuugaaccuggga

SEQ ID NO: 394824 - RNA, 57 nt, Human
caccuguaaucccagcacuuugggaggcugaggcagguggaucgccugaggucagga

SEQ ID NO: 394825 - RNA, 57 nt, Human
caccuguaaucccagcuacuugggaggcugaggcaagagaauugcuugaacccagga

SEQ ID NO: 394826 - RNA, 57 nt, Human
cgccuguagucccagcuacuugggaggcugaggcaggagaauggugugaaccuggga

SEQ ID NO: 394827 - RNA, 57 nt, Human
cugauucgguugaucugggguguguggcugaggcaucaguacuuuuuaaagcuucca

SEQ ID NO: 394828 - RNA, 57 nt, Human
uuucccuucagcauucccuuucaugaccugaggcacucugcgaugugugccccaaag

SEQ ID NO: 394829 - RNA, 57 nt, Human
cugcagagcguucuuggagaaggcccacugaggcagguucgugcccugcugcggcca

SEQ ID NO: 394830 - RNA, 57 nt, Human
caacuguagucccagcuacucgggaggcugaggcaggagaaucucuugaaccuggca

SEQ ID NO: 394831 - RNA, 57 nt, Human
uccagcacaccaagcaccagucuucuucugaggcaaaagaaaaguguugucauuuuc

SEQ ID NO: 394832 - RNA, 57 nt, Human
uccucggccacuccccagauaccagaccugaggcaauucacuugccagcacagaugg

SEQ ID NO: 394833 - RNA, 57 nt, Human
uauauauuuuuuucuuuuugcuacuuucugaggcauuauguaaagggcucauacuag

SEQ ID NO: 394834 - RNA, 57 nt, Human
uguauauaagagguuauugauaaacuucugaggcagacauuugucucgcuuuuuuuc

SEQ ID NO: 394835 - RNA, 57 nt, Human
ugccuguacugucagcuacuugggaggcugaggcacaauaauuguuugaacccagga

SEQ ID NO: 394836 - RNA, 57 nt, Human
cuacuguaaucucagcuacuugggaggcugaggcaggagaauugccucaaccgggag

SEQ ID NO: 394837 - RNA, 57 nt, Human
augguggcucaccagcacuuugggaggcugaggcagguggaucucuugaggucggga

SEQ ID NO: 394838 - RNA, 57 nt, Human
ugccuguaauuccagcuacucgggaggcugaggcaagagaaucgcuugaauccggua

SEQ ID NO: 394839 - RNA, 60 nt, Human
gacagaccgggguucaagccauggcuucgucauuugcaagcugagugacuguaggcaggg

SEQ ID NO: 394840 - RNA, 60 nt, Human
uuuaaauccaauggagaacuuuaacacgggcauuugcaugacugagaauugcugcugucu

SEQ ID NO: 394841 - RNA, 60 nt, Human
aauguaauguuuccaagugacagguauccacauuugcaugguuacaagccacugccaguu

SEQ ID NO: 394842 - RNA, 57 nt, Human
cccuuguagucccagcuacucgggaggcugaggcaggagaauagcuugaacccggga

SEQ ID NO: 394843 - RNA, 57 nt, Human
cgccuguaaucccagcuacaccugaggcugaggcaggagaauugcuugaaccgggga

SEQ ID NO: 394844 - RNA, 57 nt, Human
gucacccugagcaucugucucaaccugcugaggcacagacuuccaccaugugcauca

SEQ ID NO: 394845 - RNA, 57 nt, Human
ugccuguagucccagcuacuuaggaggcugaggcaugagaaucacuuaaaccugaga

SEQ ID NO: 394846 - RNA, 57 nt, Human
uggcuguagucccagcuacucgggaggcugaggcacgagaaucgcuugagcccugga

SEQ ID NO: 394847 - RNA, 57 nt, Human
accguugugcugcucaccacagagcagcugaggcauuaugccuuggaagaccuaaau

SEQ ID NO: 394848 - RNA, 57 nt, Human
cgccuguggucccagcuacucgggaggcugaggcaggagaauagugugaacccagga

SEQ ID NO: 394849 - RNA, 57 nt, Human
ugccaguaaccccagcuacuagggaggcugaggcaggagaaucacuugaacccggga

SEQ ID NO: 394850 - RNA, 57 nt, Human
caccuguaaucccagcugcccaagaggcugaggcaugagaaucgcuugaaccuggca

SEQ ID NO: 394851 - RNA, 57 nt, Human
gagaguccauauuucaauuuccaagagcugaggcaauucuaacuuuuuugcuaucca

SEQ ID NO: 394852 - RNA, 57 nt, Human
uaccuguaaccccaacuacuuggguggcugaggcaggagaauuguuugaaccuggga

SEQ ID NO: 394853 - RNA, 57 nt, Human
cgccugaaaucccagcacuuuggguggcugaggcagguggauuacuugaggccagga

SEQ ID NO: 394854 - RNA, 51 nt, Human
aagacuguaccauguccuaagcugaggcaggcggcaggcgcggugcacagg

SEQ ID NO: 394855 - RNA, 57 nt, Human
cgccuguaaucccagccacuccagaggcugaggcaggagaaucgcuugaaccugcga

SEQ ID NO: 394856 - RNA, 57 nt, Human
caccuguaaucccagcuacuugggaggcugaggcaggagaauugcuugaaccuggga

SEQ ID NO: 394857 - RNA, 57 nt, Human
cauauggaccaggggaccuugccuugacugaggcacuucacgagcucagugagaagg

SEQ ID NO: 394858 - RNA, 60 nt, Human
agagcauauccuuaccauuauuuuaaguagcauuugcauuuuaaaagaggaaugcggaga

SEQ ID NO: 394859 - RNA, 60 nt, Human
uugaugaagugccuggguauuuucccgucccauuugcagagcucuacuacuucauuucca

SEQ ID NO: 394860 - RNA, 60 nt, Human
gaaaugaauaagagggcuuaagaauuuguccauuugcauucggaaaagaaugaccagcaa

SEQ ID NO: 394861 - RNA, 57 nt, Human
augagcuucaucuuaaagauaagaaaacugaggcaaggggagauuaacuuacugcca

SEQ ID NO: 394862 - RNA, 57 nt, Human
gagcccagggcaugaagcccaaggcagcugaggcaguguauauacccuuagggccau

SEQ ID NO: 394863 - RNA, 57 nt, Human
ccguaaucauaucuuuuuccuaucuaucugaggcacugguggaauaaaaaaccugua

SEQ ID NO: 394864 - RNA, 57 nt, Human
ugccuguaauccuagcuacucaggaggcugaggcagaagaaucacuucaacccagga

SEQ ID NO: 394865 - RNA, 57 nt, Human
auuuuauacauaaaggccagaagcugucugaggcaaucaugauugauuguauguauc

SEQ ID NO: 394866 - RNA, 57 nt, Human
aaacucuagcugucuauuuaaaauguacugaggcacaacaaguauuauacuggaaga

SEQ ID NO: 394867 - RNA, 57 nt, Human
aguugaaggccagucuguguagaaaggcugaggcaacggggaaagaccugacagcua

SEQ ID NO: 394868 - RNA, 57 nt, Human
gcgauuguguggaugagggugagcuggcugaggcaucgcucaagcugggggguggug

SEQ ID NO: 394869 - RNA, 57 nt, Human
caccuguagucccagcuacuagauaggcugaggcaggagaauugcuugaauccggga

SEQ ID NO: 394870 - RNA, 57 nt, Human
gugccuguaauccaacuacccaggaggcugaggcaugagaaucgcuugggcccagga

SEQ ID NO: 394871 - RNA, 57 nt, Human
ugccuauaaucccagugcuuuacaaggcugaggcaggaggcucucuugagaauagga

SEQ ID NO: 394872 - RNA, 53 nt, Human
cagacagugauucagauugaguccugaggcauuuacuuuuggguaaaggagag

SEQ ID NO: 394873 - RNA, 57 nt, Human
cucccucaaagucagggcccaccccaucugaggcagagaagacucgaguccagcccc

SEQ ID NO: 394874 - RNA, 57 nt, Human
ugccuguaaucccagcuacucaggaggcugaggcaggagaaucgcuugaaucuggga

SEQ ID NO: 394875 - RNA, 57 nt, Human
ccaguguacugcuuucaacuuaaaucacugaggcauuuuuacuacuauucuguuaaa

SEQ ID NO: 394876 - RNA, 57 nt, Human
ugccuguaaucccagcuacucaggaggcugaggcagaagaauugcuugaacccaggc

SEQ ID NO: 394877 - RNA, 60 nt, Human
uagguggcaagggaggguuugcuagcucuccauuugcacuggccauugugaaaaaccagc

SEQ ID NO: 394878 - RNA, 60 nt, Human
guuccaugcauuagcuguuuguaaauaaugcauuugcauacugaaaaaggaaugccaccu

SEQ ID NO: 394879 - RNA, 60 nt, Human
uaucacaugucucauucuccucaaauauuccauuugcagacagaccgucauauucuaaua

SEQ ID NO: 394880 - RNA, 57 nt, Human
ugccuguagucccagcuacuccggaggcugaggcaggagaauggcgugaacccggga

SEQ ID NO: 394881 - RNA, 57 nt, Human
cgcuuguaaucccagcacuuugggaggcugaggcaggcggaucacgaggucaggaga

SEQ ID NO: 394882 - RNA, 57 nt, Human
caccuguagucccagguacuugggaggcugaggcaggaggaucgcuugaacccagga

SEQ ID NO: 394883 - RNA, 57 nt, Human
ugccuguaaucccagcuacucagggggcugaggcaggggaauggcuugaacccagga

SEQ ID NO: 394884 - RNA, 57 nt, Human
ugccuguagucccagcuacuugggaggcugaggcaggagaaucgcuugaaccuggga

SEQ ID NO: 394885 - RNA, 57 nt, Human
ucuauuuugauaaagauaaucuuaaagcugaggcaaugcucccuccucuaucucucu

SEQ ID NO: 394886 - RNA, 57 nt, Human
uuguugcauuguguauacugagauaaucugaggcauggagagcagauucagggugug

SEQ ID NO: 394887 - RNA, 57 nt, Human
acuugucugccuccugcuuugggaagacugaggcauccgugaggcagggacaagucu

SEQ ID NO: 394888 - RNA, 57 nt, Human
agaugagcaucagaucaagaaaaaggucugaggcagaauccaagaucugccaggaaa

SEQ ID NO: 394889 - RNA, 57 nt, Human
cucugacaagcagcaccugagcagaugcugaggcaguucauuaaaccaggccucagc

SEQ ID NO: 394890 - RNA, 57 nt, Human
uaccuguaaucccagcuacuugggaggcugaggcaagagaaucgcuugaacccagga

SEQ ID NO: 394891 - RNA, 57 nt, Human
guccagccuggcaaggguucaccugggcugaggcauccuuccucacaccaggcuugc

SEQ ID NO: 394892 - RNA, 57 nt, Human
uucauucuaucaagcccaggugccagccugaggcagccacuucggccaggucacacg

SEQ ID NO: 394893 - RNA, 57 nt, Human
ugccuguaaucccagcuacuagagaggcugaggcaggagaaucacuugaaucccuga

SEQ ID NO: 394894 - RNA, 57 nt, Human
gcugaggcaggagaaucacuugaaucccugaggcagagguugcagugagcugagauc

SEQ ID NO: 394895 - RNA, 57 nt, Human
guagacccagucugagagccgcaagcacugaggcagggccugagacuggaccugggu

SEQ ID NO: 394896 - RNA, 60 nt, Human
cuugaccaucuuuccaaccccuggggaagacauuugcaacugacuuggggaggacacagc

SEQ ID NO: 394897 - RNA, 60 nt, Human
guuucauuguuugacacuuaaugcacucgucauuugcauacgacaguagcauucugacca

SEQ ID NO: 394898 - RNA, 60 nt, Human
gacuguacugaauuuaaaaccguacaguuucauuugcauuuugacauuacuuuauuauac

SEQ ID NO: 394899 - RNA, 57 nt, Human
cgccuguaaucccaacacuuugggaggcugaggcaggcagaucacgaggucaggagu

SEQ ID NO: 394900 - RNA, 57 nt, Human
cuuuuaauuuuaaauacggguaacaaucugaggcaauaucacuaggacuuuagcugu

SEQ ID NO: 394901 - RNA, 57 nt, Human
caccuguagucccagcuacucaggaggcugaggcaggagaagggugggaacccggga

SEQ ID NO: 394902 - RNA, 54 nt, Human
acacucacuucuuguuguagugaacugaggcaacaguccacuucagggcagacg

SEQ ID NO: 394903 - RNA, 57 nt, Human
caagcaauggauaauaagagacuuuuccugaggcaccuguuuggaaucugguuuucu

SEQ ID NO: 394904 - RNA, 57 nt, Human
caccuguagucccagcuacuugggaggcugaggcaggagaaucacaaggauugaaac

SEQ ID NO: 394905 - RNA, 57 nt, Human
ccuggcuccaggccagggggccagucccugaggcagguccccagacuccaccaagcc

SEQ ID NO: 394906 - RNA, 57 nt, Human
aaauaucuauucuuugagucauuguuacugaggcaguugaguguaaggagcuggcug

SEQ ID NO: 394907 - RNA, 57 nt, Human
caccuguaauccuugcauuuuggaaggcugaggcaggaggaucacuuuaggccuggu

SEQ ID NO: 394908 - RNA, 57 nt, Human
ggcacuuuaaaaaucagcaggacaacccugaggcaaacuggaagguaaaauauacuu

SEQ ID NO: 394909 - RNA, 57 nt, Human
caucuguaguccuaccaacuugggaggcugaggcaggagaaucgcuugagccccagg

SEQ ID NO: 394910 - RNA, 57 nt, Human
ugccuguaauuccagcuacucgggaggcugaggcaggaagaaucacuugaacccagg

SEQ ID NO: 394911 - RNA, 57 nt, Human
ugccuguaaucucagcuacucaggaggcugaggcacaagaaucgcuugaauccagga

SEQ ID NO: 394912 - RNA, 57 nt, Human
uaauauaaaauguaucuccaugggaggcugaggcaggagaaucaguugaaccuggga

SEQ ID NO: 394913 - RNA, 57 nt, Human
uaccugcgguuccagcuacucaagaggcugaggcaggaggacugcuugagcccagga

SEQ ID NO: 394914 - RNA, 57 nt, Human
ugggggcuucucugcugagaaggcaaacugaggcagcaugcacggaggcggggucag

SEQ ID NO: 394915 - RNA, 60 nt, Human
ucauuucuuuguuuucucaggucccaccuccauuugcaauugaccucuucugggaacuuc

SEQ ID NO: 394916 - RNA, 60 nt, Human
accaaagauuaaauccuugacauaagaucucauuugcagaaagcagauuaaagaccauca

SEQ ID NO: 394917 - RNA, 60 nt, Human
uccacacugguccauccugccacccccaaccauuugcacuacaagggcggaggcaccccg

SEQ ID NO: 394918 - RNA, 57 nt, Human
cugcuguggucccaguuacucaggaggcugaggcaggaggaucacuugagcccagga

SEQ ID NO: 394919 - RNA, 57 nt, Human
cgccuguagucccagcuacuugggaggcugaggcaggagaaucgcuuaaaccuggga

SEQ ID NO: 394920 - RNA, 57 nt, Human
ggccuguaauuccagcuacucuggcugcugaggcacaagaaucauuugaaccuagga

SEQ ID NO: 394921 - RNA, 57 nt, Human
cacccguaaucccagcuacucaggaggcugaggcaggagaauugcuugaacccagga

SEQ ID NO: 394922 - RNA, 57 nt, Human
caccuauaaucccagcacuaugggaggcugaggcaagcagguuguuugagcccagga

SEQ ID NO: 394923 - RNA, 57 nt, Human
ugccuguaauccuagcuacucaggaggcugaggcaggagaaucgcuugaaccuggga

SEQ ID NO: 394924 - RNA, 57 nt, Human
cugggcacaguggcucacuuugggaggcugaggcaggaaggcugcuggaaacugaga

SEQ ID NO: 394925 - RNA, 57 nt, Human
cacuuguaauccuagcaucuugggaggcugaggcaugaaaaucgcuugagcccagga

SEQ ID NO: 394926 - RNA, 57 nt, Human
augccuguaaucccagcuacucagaggcugaggcaggagaauugcuugaaccuggga

SEQ ID NO: 394927 - RNA, 57 nt, Human
cuaaguaaauaggaauugguuucacgccugaggcaauuagacacuuuggaagauggc

SEQ ID NO: 394928 - RNA, 57 nt, Human
ugccccuacaagggguuagucaagaagcugaggcagaacucacugggggugggcagu

SEQ ID NO: 394929 - RNA, 57 nt, Human
acaaccacuaugccaggcccggagccucugaggcaucggccaguccaggcccucauc

SEQ ID NO: 394930 - RNA, 57 nt, Human
ccuccugugcuauuuguacaaauaaaccugaggcaggauuuguuagccucugucuau

SEQ ID NO: 394931 - RNA, 57 nt, Human
agucauguacuggagaguggcaaaagucugaggcaccugcauaucucuagucccugu

SEQ ID NO: 394932 - RNA, 57 nt, Human
acaugaagggguauguugagaaacauccugaggcaaggugggaggugggauggggca

SEQ ID NO: 394933 - RNA, 57 nt, Human
agaaucccacucccaaugcauuauuuccugaggcaagaacuuaagguccucaccuaa

SEQ ID NO: 394934 - RNA, 60 nt, Human
gugcuuucugcaccagacaaccugauggaacauuugcaccugaguuguacauuuuugaag

SEQ ID NO: 394935 - RNA, 60 nt, Human
guaugcauguaggcaaagauuuugaagauacauuugcaagagauauuuguuuaaccaaaa

SEQ ID NO: 394936 - RNA, 60 nt, Human
uuagagcuagaauaaaaguaauugagcagucauuugcaaaugcuucauuauaacauuuau

SEQ ID NO: 394937 - RNA, 57 nt, Human
caccuguaaucccagcuacucgggaggcugaggcaggagaauugcuugaacugggga

SEQ ID NO: 394938 - RNA, 57 nt, Human
uauuuauagucucagcuacuagggaggcugaggcaagaggcuugagaccaggagcuc

SEQ ID NO: 394939 - RNA, 57 nt, Human
cacuuguagucccagcuacucaagaggcugaggcagaaggaucccuugagcccagga

SEQ ID NO: 394940 - RNA, 57 nt, Human
guggugcaugccuguaaucucggaaggcugaggcaggaggaucauuugagcucauga

SEQ ID NO: 394941 - RNA, 57 nt, Human
ugcuuguaguccuagcuacuugggaggcugaggcaggaggauugcuugagucuagga

SEQ ID NO: 394942 - RNA, 57 nt, Human
ugccuguaauccuagcuacucaggaggcugaggcaugagaaucgcuugaacucagca

SEQ ID NO: 394943 - RNA, 57 nt, Human
uguugaguccuccauugaggaugcccacugaggcagccaggccccucaccagcccug

SEQ ID NO: 394944 - RNA, 57 nt, Human
ugccuuuagucccagcuacucgggaggcugaggcaugagaaucauuugaacccgcga

SEQ ID NO: 394945 - RNA, 57 nt, Human
cuaucagagucccagcuacucaggaggcugaggcaggagaaucgcuugaaccuggga

SEQ ID NO: 394946 - RNA, 57 nt, Human
ugccuguagucccagcuacuugagaggcugaggcaagagaauuguuugaacccggga

SEQ ID NO: 394947 - RNA, 57 nt, Human
ugccuguagucccagcuacucuggaggcugaggcaggagaauggcgugaacccggga

SEQ ID NO: 394948 - RNA, 57 nt, Human
uuccuguaaucccagcuacucgggaggcugaggcaggagauucgccugaacccggga

SEQ ID NO: 394949 - RNA, 57 nt, Human
ggauguucuggcacagcagacuggagacugaggcagggccugugaguggacagagca

SEQ ID NO: 394950 - RNA, 57 nt, Human
caccuguaaucccagcacuuugggaggcugaggcaggaggauuguuugaggccagaa

SEQ ID NO: 394951 - RNA, 57 nt, Human
caccuguaaucccagcuacucgggaggcugaggcaggagaauugcuugaaccaaggu

SEQ ID NO: 394952 - RNA, 57 nt, Human
ugccuguaaucccagcuacuugggacacugaggcaggagaaucacuugaacccggga

SEQ ID NO: 394953 - RNA, 60 nt, Human
gaagaugacagaacaacaguguuaaauggccauuugcacaggccuuugccacaacagaga

SEQ ID NO: 394954 - RNA, 60 nt, Human
gugucuguccacugacgacugucaaggccucauuugcagaggccaccggagcuagggcac

SEQ ID NO: 394955 - RNA, 60 nt, Human
gucuaaaugcccccagcccaccccugcccccauuugcagccuugguguucguucuaacac

SEQ ID NO: 394956 - RNA, 57 nt, Human
cagcuuuuucaaaguguugaugguaaucugaggcaaucuaagggagucauuuuuuaa

SEQ ID NO: 394957 - RNA, 57 nt, Human
gggaccugggaccugcggcuuaguucccugaggcaggcagggcuuauuggggccauu

SEQ ID NO: 394958 - RNA, 57 nt, Human
ugccuguaaucccagcuacuugggaggcugaggcaggagaaccgcuuaaaccuggga

SEQ ID NO: 394959 - RNA, 57 nt, Human
caccuguaaucccagccacuugggaggcugaggcaggagaauugcuugaacccggga

SEQ ID NO: 394960 - RNA, 57 nt, Human
caccuguaaucccagcuacucgggaggcugaggcaugagaauugcuugaacccggga

SEQ ID NO: 394961 - RNA, 57 nt, Human
guguuugaucauuuaguuuuuaacaggcugaggcaacauggaucagugugugucccc

SEQ ID NO: 394962 - RNA, 57 nt, Human
ucaaagggugcaaaaucucacacaagacugaggcaggagaauaggguacagagauag

SEQ ID NO: 394963 - RNA, 57 nt, Human
gagaccaaggcccaugagcucauagggcugaggcaggauuuggaaucaggccauguc

SEQ ID NO: 394964 - RNA, 57 nt, Human
cgccuguaaucccagcuacucaagaggcugaggcacgagaaucacuugaacccggga

SEQ ID NO: 394965 - RNA, 57 nt, Human
ugccuguagucccauguacuugggaggcugaggcaggaaaauucuugaacccaggag

SEQ ID NO: 394966 - RNA, 57 nt, Human
cgccuguaaucccagcuacucaggaggcugaggcaggagaauugcuugaacccggga

SEQ ID NO: 394967 - RNA, 57 nt, Human
aguuuuuuucuucuuaauuccacaugacugaggcauauaugaucucuggguagguga

SEQ ID NO: 394968 - RNA, 57 nt, Human
caccuguaaucccaguuacuugggaagcugaggcaggagaaucccuugaaccuggga

SEQ ID NO: 394969 - RNA, 57 nt, Human
ccagcucccugccccacccuccagugccugaggcagcuaggggcuucugcucucauc

SEQ ID NO: 394970 - RNA, 57 nt, Human
cccugcguggccugaguccuggucccucugaggcaguugacggggcagucagauuuu

SEQ ID NO: 394971 - RNA, 57 nt, Human
cgcaggcacccagugaacccgcuugggcugaggcagcgagugauucccgcgcuccgg

SEQ ID NO: 394972 - RNA, 60 nt, Human
uagggggccagugggagaaugcuugccuugcauuugcacauccagaaugacuaaaacauc

SEQ ID NO: 394973 - RNA, 60 nt, Human
ccaauaagugccaguuuugcauuuucauaucauuugcauugaguugaaaacugcaaauaa

SEQ ID NO: 394974 - RNA, 60 nt, Human
uucaaauuugugucauaccagaaagcucuacauuugcagauguucaaauauuguaaaacu

SEQ ID NO: 394975 - RNA, 57 nt, Human
aacuuuuuaacauaguccgucuguuuacugaggcacuggcgagucccagggcugaua

SEQ ID NO: 394976 - RNA, 57 nt, Human
caccuauaaugccagcuacucgggaggcugaggcaggagaaucgcuugaacccggga

SEQ ID NO: 394977 - RNA, 57 nt, Human
acagccaacccccuagguguggaccagcugaggcaggugggcagauaugcagaggga

SEQ ID NO: 394978 - RNA, 57 nt, Human
ccacguacugcagccuccagagaguaucugaggcacaugucagcaaguccuaagccu

SEQ ID NO: 394979 - RNA, 57 nt, Human
uaccuguaauuccagcuacucaggaggcugaggcaggagaauugcuugaacccagga

SEQ ID NO: 394980 - RNA, 57 nt, Human
uuggauuccuuucuuuuacaaauugugcugaggcaacuauggcauagaaauaaacau

SEQ ID NO: 394981 - RNA, 57 nt, Human
gguuuuggcaacacauagaucauaugucugaggcacaaguuggcuguucaucuuuga

SEQ ID NO: 394982 - RNA, 57 nt, Human
ugccugcaaucccagcuacuuggaaggcugaggcaggagaaucacuugaacccagga

SEQ ID NO: 394983 - RNA, 57 nt, Human
ugcugguaaucucagcuauugaggaggcugaggcaggagaauugcuugaacccggga

SEQ ID NO: 394984 - RNA, 57 nt, Human
ugccuguggucucagcuacuugggaggcugaggcaggagaaucauuugagcccagga

SEQ ID NO: 394985 - RNA, 57 nt, Human
ugccuucccaggauucuuccuucagugcugaggcaggucgggcucaggaacugcagg

SEQ ID NO: 394986 - RNA, 57 nt, Human
cgccuguagucccagcuacuugggaggcugaggcaggagaauggcgugaacccggga

SEQ ID NO: 394987 - RNA, 57 nt, Human
uucuuuugaaagaacaucaguucaugccugaggcaugagugacugugcauuugagaa

SEQ ID NO: 394988 - RNA, 57 nt, Human
cgccuguaauaccagcacuuugggaggcugaggcaggcggaucacuugaggucagga

SEQ ID NO: 394989 - RNA, 57 nt, Human
ugccuguagucccagcuacuugggaugcugaggcaggaagaauugcuugaaccuggg

SEQ ID NO: 394990 - RNA, 57 nt, Human
cgccuguaaucccagcuacucagauggcugaggcaggagaacuacuugaaccuggga

SEQ ID NO: 394991 - RNA, 60 nt, Human
acaccugacaaauggaaggaguuccucuaacauuugcaaaauggaaauguaauaauaaug

SEQ ID NO: 394992 - RNA, 60 nt, Human
uuuucaguucucuuugggggccauguccuacauuugcauggauggaugcaugcauugccu

SEQ ID NO: 394993 - RNA, 60 nt, Human
aggaucuaaaauaauuugcugucaauuguacauuugcaugaguacguauguuuggcucau

SEQ ID NO: 394994 - RNA, 57 nt, Human
caccuguagucccagcuacucgggaggcugaggcaggagacuggcgugaacccagga

SEQ ID NO: 394995 - RNA, 57 nt, Human
ugccuguaauccuagcacuuugggaggcugaggcaggcaaucacuugaggucaggag

SEQ ID NO: 394996 - RNA, 57 nt, Human
cguuuguaaucccaguuacucaggaggcugaggcacaagaauugaguaucacuuuaa

SEQ ID NO: 394997 - RNA, 57 nt, Human
ugccuguaaucccagcuacucgggaggcugaggcaggagaaucgcuugaacccagga

SEQ ID NO: 394998 - RNA, 57 nt, Human
caccuguagucccagcuacuccggaggcugaggcaggagaaucucuugaaccuggga

SEQ ID NO: 394999 - RNA, 57 nt, Human
ggccuguaaucccagcauuuugggaggcugaggcaaguggauaacuugaggucauga

SEQ ID NO: 395000 - RNA, 57 nt, Human
caccuguaaucccagcuacucaggaagcugaggcaggaaaaucgcuugaaccuggga

SEQ ID NO: 395001 - RNA, 57 nt, Human
ugccuauaaucccggcuacucgggaggcugaggcaggagaaucaccugaacccggga

SEQ ID NO: 395002 - RNA, 57 nt, Human
ugccuguagucccaacuacuagggaggcugaggcaggagaaucacuugaacccagga

SEQ ID NO: 395003 - RNA, 57 nt, Human
gcugauguccugaaaugacauuuguaccugaggcaauucuuauuagagcuuacucag

SEQ ID NO: 395004 - RNA, 57 nt, Human
acagggacccacuucacacacaggcaacugaggcagacagcagcucaggcacacuuc

SEQ ID NO: 395005 - RNA, 57 nt, Human
guguagagggcuuugcugucccugagacugaggcagguuccuuuuccaggucagagg

SEQ ID NO: 395006 - RNA, 57 nt, Human
uggcuguaaucccagcuacucaggaggcugaggcagaagaaucugagccaagauaac

SEQ ID NO: 395007 - RNA, 57 nt, Human
caccuguaaucccagcacuuugggaggcugaggcaggcagaucaugaugucaggagu

SEQ ID NO: 395008 - RNA, 57 nt, Human
ugccugaagucccagcuacucgggaagcugaggcagaagaaucacuugaaccuggga

SEQ ID NO: 395009 - RNA, 57 nt, Human
aggcccuauauugguccccagcaucuacugaggcagaccugcaacagaaguggcauu

SEQ ID NO: 395010 - RNA, 59 nt, Human
gucauggucuuucuugguauuaaaggccaccauuugcacaaauguuccuguuuugggua

SEQ ID NO: 395011 - RNA, 60 nt, Human
uuaaucuugaugauucuuauuaauuaaucacauuugcaggaaauucagaugaggcaagaa

SEQ ID NO: 395012 - RNA, 60 nt, Human
auccucaugauaggauugccuagugucucccauuugcagguuucuggguugaugucuuaa

SEQ ID NO: 395013 - RNA, 57 nt, Human
cuuguuaguuccaggccuccuuuaguucugaggcagcuagaccagggauaggagugg

SEQ ID NO: 395014 - RNA, 57 nt, Human
ugcuuguaaucccagcuacucgggaggcugaggcaggagaaucgcuugaacccagga

SEQ ID NO: 395015 - RNA, 57 nt, Human
cgccuguagucccagcuacucuggaggcugaggcaggagaauggcaugaacccagga

SEQ ID NO: 395016 - RNA, 57 nt, Human
ccuugucauauaaucauuucaggcaaacugaggcaacacuaacagcuaaugacccag

SEQ ID NO: 395017 - RNA, 57 nt, Human
cgccuguagucccagcuacucaggaggcugaggcaggagaauuacuugaacccggga

SEQ ID NO: 395018 - RNA, 57 nt, Human
augugugguguuuccugugguaaaagacugaggcaggccaggggucugccaguaaca

SEQ ID NO: 395019 - RNA, 57 nt, Human
uuguucucaccaggaaaguacacgggccugaggcaggauugggccacagacagccuc

SEQ ID NO: 395020 - RNA, 57 nt, Human
cgccuguagucccagcuacucgggaggcugaggcaggagaauggcaugaacccggga

SEQ ID NO: 395021 - RNA, 57 nt, Human
uaccuguaaucccagcuacucaggaggcugaggcaggagaauuugcuugauccuggg

SEQ ID NO: 395022 - RNA, 57 nt, Human
ugccuguaaugccagcuacucgggaggcugaggcaggagaauugcuugaacccggga

SEQ ID NO: 395023 - RNA, 57 nt, Human
ugccuguaaucccagcuacuagggaggcugaggcaggagaauugcuugaaccuggga

SEQ ID NO: 395024 - RNA, 57 nt, Human
ugccuguagucuuagcuacuugagaggcugaggcaggagaaucgcuugaaccuggga

SEQ ID NO: 395025 - RNA, 57 nt, Human
cuaugacucuauaagguuuucaaacaucugaggcaugauaaauuuauuauccauaau

SEQ ID NO: 395026 - RNA, 57 nt, Human
cgccugcagucccagcuacucaggaggcugaggcaggagaauggcgugaaccuggga

SEQ ID NO: 395027 - RNA, 57 nt, Human; identical to SEQ ID NO: 394989

SEQ ID NO: 395028 - RNA, 57 nt, Human; identical to SEQ ID NO: 394988

SEQ ID NO: 395029 - RNA, 60 nt, Human
guuccacugagcuccaugugcccccucuaccauuugcagaguccugcacaguuuucuggc

SEQ ID NO: 395030 - RNA, 60 nt, Human
ucuacaaaauacuccugcaauuccagcugccauuugcaaaaacaaggaaaaaaauccgaa

SEQ ID NO: 395031 - RNA, 60 nt, Human
ucaaauuuaaagacugcuccagauagccugcauuugcaauggaauaacugacaaaucaca

SEQ ID NO: 395032 - RNA, 57 nt, Human
gggaugggcugcgcuucucaaugaacucugaggcagaaauauuugccuuggauucug

SEQ ID NO: 395033 - RNA, 57 nt, Human
ccccaggagaucugaucacacuuccuccugaggcaccucucauggauguugcaauaa

SEQ ID NO: 395034 - RNA, 57 nt, Human
ugccuguauugccagcuacucggaaggcugaggcaggagaauggcgugaaccuggga

SEQ ID NO: 395035 - RNA, 57 nt, Human
ggguuaggguagggaggacuggguguucugaggcagccuagaaagucauucuccuuu

SEQ ID NO: 395036 - RNA, 57 nt, Human
uacccucuaccccuuacugugcaaccacugaggcaaaguagcuuaauauaaaaauaa

SEQ ID NO: 395037 - RNA, 57 nt, Human
ugccuguaauccuagcuacuugggagucugaggcaggagaauugcuugaacucagga

SEQ ID NO: 395038 - RNA, 57 nt, Human
gccccucacccaccagcugccccaucccugaggcagcgcuccauggggguaugguuu

SEQ ID NO: 395039 - RNA, 57 nt, Human
gcugacagggccaggcagccuccccagcugaggcaucauuccugggccagagucgug

SEQ ID NO: 395040 - RNA, 57 nt, Human
ccccaaucacgagaucuuccuuccgcucugaggcaacccccucggagccuguguuag

SEQ ID NO: 395041 - RNA, 57 nt, Human
ugccuguaaucccaguuacuugggaggcugaggcaggagaaucgcuugaaccuggga

SEQ ID NO: 395042 - RNA, 57 nt, Human
ugccuguaaucccagcuauuuggcaggcugaggcaugagaaucgcuugaacccagga

SEQ ID NO: 395043 - RNA, 57 nt, Human
ugccuguagucccagcuacucuggaggcugaggcaggagaauggcgugaacccagga

SEQ ID NO: 395044 - RNA, 57 nt, Human
uaucccaugggcccuacuugaauuuaucugaggcagcuacagauugcccugcaagau

SEQ ID NO: 395045 - RNA, 57 nt, Human
cgccuguaaucccagaacuaugugaggcugaggcagguggaucacuugaggucagga

SEQ ID NO: 395046 - RNA, 57 nt, Human
caccuguagucccagcuacucgggaggcugaggcaggagaauggcaugaacccggaa

SEQ ID NO: 395047 - RNA, 57 nt, Human
gguagucauauuuugcaaguauggaagcugaggcagggcaacaugaaguaacuuaca

SEQ ID NO: 395048 - RNA, 60 nt, Human
auguugguucaaauaaauuucuacacuugccauuugcauguuuguugcuuucuaauuaaa

SEQ ID NO: 395049 - RNA, 60 nt, Human
aggguucaguuuggaugaugcuaguuagaucauuugcaucucuccaccauuuucuucugc

SEQ ID NO: 395050 - RNA, 60 nt, Human
agaagggacccugguggucugugcuucagccauuugcagggcaggggcaucauuaauuca

SEQ ID NO: 395051 - RNA, 57 nt, Human
ccucaggugcacuuacauaugguggggcugaggcaaagcagcccuguaggcuucaaa

SEQ ID NO: 395052 - RNA, 57 nt, Human
caccuauaauaccagcuacuccggaggcugaggcaggagaaucgcuugaacccagga

SEQ ID NO: 395053 - RNA, 57 nt, Human
caggcuccaugcaccucccuucccucccugaggcaggugagaacccagagagagggg

SEQ ID NO: 395054 - RNA, 57 nt, Human
caccuguaaucucagcuacucgggaggcugaggcaagagaaucgcuugaacccagga

SEQ ID NO: 395055 - RNA, 57 nt, Human
guccaugcucuucuggacguggacucucugaggcagaacugagcuuuuccaggccuc

SEQ ID NO: 395056 - RNA, 57 nt, Human
guucagauggacugagcuuggaugcuucugaggcaagcugaagcuuuggguucugac

SEQ ID NO: 395057 - RNA, 57 nt, Human
gcaccugugaucccagcuacuuagaggcugaggcagaagaauugcuuuaaccuugga

SEQ ID NO: 395058 - RNA, 57 nt, Human
caucuguagucccagcuacucaggaggcugaggcaggagaaucacuugaacccugga

SEQ ID NO: 395059 - RNA, 57 nt, Human
ugccuguaaucccagcacuuugggaggcugaggcaggugaaucaccugaggucagga

SEQ ID NO: 395060 - RNA, 57 nt, Human
cgccuguaauuccagcuacucagaaggcugaggcagggagaauugcuugaacccagg

SEQ ID NO: 395061 - RNA, 57 nt, Human
caccuguaaucccaccuacucgggaggcugaggcaggagaauugcuugaauccggga

SEQ ID NO: 395062 - RNA, 57 nt, Human
ugccugcaaucccagcuacucaggaagcugaggcaggagaaucgcuugaaccuggga

SEQ ID NO: 395063 - RNA, 57 nt, Human
ugugugaauuauuuagugugacuucaccugaggcaucacagagacaaaagaauguga

SEQ ID NO: 395064 - RNA, 57 nt, Human
cacuuguaauuccagcuacucaggaggcugaggcaagagaacugcuugaauccggga

SEQ ID NO: 395065 - RNA, 57 nt, Human
uguuuggaccgauaagugugcuuaauccugaggcaaaguagugaauauguuuuauau

SEQ ID NO: 395066 - RNA, 57 nt, Human
aaaguagggcagaaacuggauacaguucugaggcacagccagacuugcucagggugg

SEQ ID NO: 395067 - RNA, 64 nt, Human
cccucuugccaaaugcuucauggaaaugaagaggaaggccuagagccuccuuccugccccacug

SEQ ID NO: 395068 - RNA, 64 nt, Human
uuacuugaauguucucagggaggcagcaagucagaaggccuagguucuaguccuagcuccauca

SEQ ID NO: 395069 - RNA, 60 nt, Human
ugccuuuuggguuugccuuaauucuuaccucauuugcauccuaucgaucuggaaagagcu

SEQ ID NO: 395070 - RNA, 57 nt, Human
aaacucuugccucugcuuucccccacucugaggcaaguuaaaauguaaaagauguga

SEQ ID NO: 395071 - RNA, 57 nt, Human
ugccuguaaucccagcuacuugggaggcugaggcaagagaaucgcuugaacccagga

SEQ ID NO: 395072 - RNA, 57 nt, Human
agaaacaagaccacuuauacugucugucugaggcagaagauaacagcagcaucucga

SEQ ID NO: 395073 - RNA, 57 nt, Human
cgcuuguaaucccagcuacucaggagucugaggcacgagaaucaccugaacucagga

SEQ ID NO: 395074 - RNA, 57 nt, Human
caccugucaucccagcuacucgggaggcugaggcaggagaaucgcuugaacccggga

SEQ ID NO: 395075 - RNA, 57 nt, Human
cugguucacucaacuagucaccauguccugaggcaugaagccuccucagcucuugga

SEQ ID NO: 395076 - RNA, 57 nt, Human
cucagauuuccucaccugugaaaugggcugaggcaggaaaugggaaaaaguguuagu

SEQ ID NO: 395077 - RNA, 57 nt, Human
gcagccucgcccucugggucagggugacugaggcauuuuguggccuuaaaacggggu

SEQ ID NO: 395078 - RNA, 57 nt, Human
gcuugagggguucgggaagcuccucaucugaggcaacugguccugggggugcucagg

SEQ ID NO: 395079 - RNA, 57 nt, Human
cacugguaaucccagguacucaagaggcugaggcaggagaaucgcuugaaccuggga

SEQ ID NO: 395080 - RNA, 57 nt, Human
ugccuguaaucccagcuacucaggaggcugaggcaggagaauugcgugaacccgggc

SEQ ID NO: 395081 - RNA, 57 nt, Human
cgccuguagucccagcuacucgggaggcugaggcagaagaaucgcuugaaccuggga

SEQ ID NO: 395082 - RNA, 57 nt, Human
ggugguuccaauugguggagagaagcucugaggcacgucaugcaggucaagaaagcu

SEQ ID NO: 395083 - RNA, 57 nt, Human
caccuguaaucccagcuacucgggaggcugaggcaggagaaucgcuugaaccuagaa

SEQ ID NO: 395084 - RNA, 57 nt, Human
guaggaugcugugcggggagcucgaggcugaggcauaaucacugcuucgguucugcu

SEQ ID NO: 395085 - RNA, 57 nt, Human
ugccuauagucccagcuacuugagaggcugaggcaggaggauuguugagcccaggag

SEQ ID NO: 395086 - RNA, 60 nt, Human
guguucuccuuguauaucugcuguuuuauacauuugcaacaauuucucuuguaaauggaa

SEQ ID NO: 395087 - RNA, 60 nt, Human
acgggaaacagcccaggggugggaaguuuucauuugcaggggggucugaauguaacucac

SEQ ID NO: 395088 - RNA, 60 nt, Human
aacgacaggcugccccguuuuuacuaauugcauuugcauuuuaagguacuacugaagguc

SEQ ID NO: 395089 - RNA, 57 nt, Human
cauggcaggcaccuguaaucccaucuacugaggcaggagaauugcuugacccaggag

SEQ ID NO: 395090 - RNA, 57 nt, Human
ugccuguaauccuagcaccuugggaggcugaggcagguggaucaccuaaggucagga

SEQ ID NO: 395091 - RNA, 57 nt, Human
caucuauaaucccagcuacuugggaggcugaggcaggagaauugcucaaacccggga

SEQ ID NO: 395092 - RNA, 57 nt, Human
guguccagagagccaugguguuggccccugaggcagccugucacccauccuaaucug

SEQ ID NO: 395093 - RNA, 57 nt, Human
guuuuuguuuuguuuuuaaauggagcccugaggcaucagcuauuauacuugggacuc

SEQ ID NO: 395094 - RNA, 57 nt, Human
agccuguaguccuagcuacucaggaggcugaggcaggagaauagccugaaccuggga

SEQ ID NO: 395095 - RNA, 57 nt, Human
gguggcucacugucuguaauguauuaccugaggcagaagaccaccugaggguaggag

SEQ ID NO: 395096 - RNA, 57 nt, Human
agaaucugccgaggugagaacagcauccugaggcacagcucccaggggacagaggug

SEQ ID NO: 395097 - RNA, 57 nt, Human
caccuguaguaccagcuacucuggaggcugaggcaggaggaucacuugagcccagga

SEQ ID NO: 395098 - RNA, 57 nt, Human
ugucuguaaucccagcgcucugggaggcugaggcaggaggaucacuugaggucagga

SEQ ID NO: 395099 - RNA, 57 nt, Human
cgccuguaaucccagcacuuugggaggcugaggcagguggaucaccucaagucagga

SEQ ID NO: 395100 - RNA, 57 nt, Human
cgucuguagucccagcuacucaggaggcugaggcagaagaaucgcuugaacccugga

SEQ ID NO: 395101 - RNA, 57 nt, Human
acaauaguggauucagaacuugacguucugaggcacauccucacuguaaacaguaau

SEQ ID NO: 395102 - RNA, 57 nt, Human
cuguuguagccccagcuacucaagaggcugaggcaggagaauugcuugaacgcggga

SEQ ID NO: 395103 - RNA, 57 nt, Human
gugcuuuaugacagguuaguguuuccucugaggcagaaaacucuuuuuuggagauau

SEQ ID NO: 395104 - RNA, 57 nt, Human
acucagcuccugcaaaagcuuccgucccugaggcaaaaggacacgagggcccgacug

SEQ ID NO: 395105 - RNA, 60 nt, Human
uauuaaugcagaauuuacuaagauuuuauucauuugcauuagcaaauauucaugcagcag

SEQ ID NO: 395106 - RNA, 60 nt, Human
uuaauuaagcucacaucaaaauagaccagccauuugcacauaguuaccagucacucuguu

SEQ ID NO: 395107 - RNA, 60 nt, Human
uccuaaauuugaguuguuugcuaaucauuucauuugcaucauuaggguauccuuaaacug

SEQ ID NO: 395108 - RNA, 57 nt, Human
ugccuguaauugcagcacuuuuagaggcugaggcaggagaauugguugaacccagga

SEQ ID NO: 395109 - RNA, 57 nt, Human
ugccuguaaucccagcuacucgggaggcugaggcaggagaauugcuugaacucggga

SEQ ID NO: 395110 - RNA, 57 nt, Human
cgccuguaaucccagcuacucaggaggcugaggcaggagaacugcuugaaccuggga

SEQ ID NO: 395111 - RNA, 57 nt, Human
caccuguaaucccagcuacuugggaggcugaggcaggagaaucacuugaacccagga

SEQ ID NO: 395112 - RNA, 57 nt, Human
caccuguaaucccagcuacucugaagccugaggcagaaucaagugagcccaggaguu

SEQ ID NO: 395113 - RNA, 57 nt, Human
ugccuguagucccagguacucaggaggcugaggcaggaggauugccugagcccagga

SEQ ID NO: 395114 - RNA, 57 nt, Human
cgccuguagucccagcuacucaggaggcugaggcaggagaauugcuugaacccgaga

SEQ ID NO: 395115 - RNA, 57 nt, Human
caccuguagucccagcuaccugggaggcugaggcaggagaauugcuugaaccuggga

SEQ ID NO: 395116 - RNA, 57 nt, Human
cauucuauuucucuuuaauuuuauucacugaggcagagaaacaauuuuugaaaaaga

SEQ ID NO: 395117 - RNA, 57 nt, Human
ugccuguaaucccagccacucaggaggcugaggcagggaggauccauugagcccagg

SEQ ID NO: 395118 - RNA, 57 nt, Human
ggccuguaaucccagcuacucaggaggcugaggcagaagaauggcaugaacccggga

SEQ ID NO: 395119 - RNA, 57 nt, Human
ugcugguaauagcagcuacugagguggcugaggcacaagaauugcuuggacccugga

SEQ ID NO: 395120 - RNA, 57 nt, Human
caccuguaaucccagcuacucgggaggcugaggcaggagaaucgcuugaaccuggga

SEQ ID NO: 395121 - RNA, 57 nt, Human
agagagcaggucagacaacaggcaacccugaggcagcuggcucccucucucugcccu

SEQ ID NO: 395122 - RNA, 57 nt, Human
ugccuauaaucccagguacucaggaggcugaggcaggagaaucacuugaaccuggga

SEQ ID NO: 395123 - RNA, 57 nt, Human
uguccggcccuggguuucuagcggugccugaggcaucacucuggcccauugacagau

SEQ ID NO: 395124 - RNA, 60 nt, Human
uaaacauccuuugaagaagaaacuaagaagcauuugcaaauuucucuucuggauauuuug

SEQ ID NO: 395125 - RNA, 60 nt, Human
gcagcugaucaguaaacgggccauccuacccauuugcaugcuaaaauucucccggccuca

SEQ ID NO: 395126 - RNA, 60 nt, Human
gauguagcuaagcugcuucagugaucuucacauuugcacuccaguuuuuuuuucuuuaaa

SEQ ID NO: 395127 - RNA, 57 nt, Human
caugugcagucccagcuacucaggaggcugaggcaggaggaucacagugaccuauaa

SEQ ID NO: 395128 - RNA, 57 nt, Human
caccuguaaucucagcuacuugggaggcugaggcacaagaaucacuugaacuuggga

SEQ ID NO: 395129 - RNA, 57 nt, Human
gaugagaugacagauagcacgacuacacugaggcacccucagagaaggcagggccug

SEQ ID NO: 395130 - RNA, 57 nt, Human
ugccuguaaucccagcuacucaggaggcugaggcaggagaaucacuugaccccagga

SEQ ID NO: 395131 - RNA, 57 nt, Human
gugggggaaaugcauccccucagaggacugaggcauagucucucaucugcuauugaa

SEQ ID NO: 395132 - RNA, 57 nt, Human
cuuguggccaacucccuccccuucucacugaggcagaagcacugaggugggcuggac

SEQ ID NO: 395133 - RNA, 57 nt, Human
gcugaauagaaagaauguggaaguggucugaggcauauagaguauaugccaagaaca

SEQ ID NO: 395134 - RNA, 57 nt, Human
uuugcagaaacuauuuaaguuucaacucugaggcagcaaugaaaauuuaaguugcag

SEQ ID NO: 395135 - RNA, 57 nt, Human
caccuguaaucccagcuacucuggaggcugaggcaggagaaucacuugaacccugga

SEQ ID NO: 395136 - RNA, 57 nt, Human
cgccuauaaucccagcuacuggggaggcugaggcaggagaaucacuugaacccgggg

SEQ ID NO: 395137 - RNA, 57 nt, Human; identical to SEQ ID NO: 394986

SEQ ID NO: 395138 - RNA, 57 nt, Human
ugccuguaaucccagcuacuugggaggcugaggcaggagaaucgcuugaucccagga

SEQ ID NO: 395139 - RNA, 57 nt, Human
ugccugcagucccaguuacuugggugccugaggcaggagaaucucuuaaaccaggaa

SEQ ID NO: 395140 - RNA, 57 nt, Human
ucgccuguaaucucacuacacaggaggcugaggcaggagaaucacuugaaccuggga

SEQ ID NO: 395141 - RNA, 57 nt, Human
cgccuguaauaccagcuacucagguggcugaggcauaagaauugcuugagccuggga

SEQ ID NO: 395142 - RNA, 57 nt, Human
ugccuguaaucccagcuacuugggaggcugaggcauaagaauuguuugagcccggga

SEQ ID NO: 395143 - RNA, 60 nt, Human
uggaccuggucagaggacgguugcuguccucauuugcauuccaagaagagcauguccucc

SEQ ID NO: 395144 - RNA, 60 nt, Human
ucaucgucugcgcagugguugcuguccucucauuugcagucagcgccagcacuguauucc

SEQ ID NO: 395145 - RNA, 58 nt, Human
ccuuuaccaaucagauuuaacagaguagcauuugcauucuucugcagucgccucacca

SEQ ID NO: 395146 - RNA, 57 nt, Human
ugccuguaaucccagcuacuugggaggcugaggcaggagaaucacuugaacccggga

SEQ ID NO: 395147 - RNA, 57 nt, Human
caccuguaaucccagcgcuuugggaggcugaggcagguggaucacuugagcucagga

SEQ ID NO: 395148 - RNA, 57 nt, Human
cgccuguagucccagcuacucgggaggcugaggcaggagaauugcuugaacccagga

SEQ ID NO: 395149 - RNA, 57 nt, Human
auucucuuuuaaaaaaagggggugauucugaggcacugaagugccucccagaugugg

SEQ ID NO: 395150 - RNA, 57 nt, Human
aagugguagagcagcaccgugccugcccugaggcaguggagucaguagcgcuguccc

SEQ ID NO: 395151 - RNA, 57 nt, Human
ugccuauagucccagccacuaggaaagcugaggcagaaggaucccuugagccuagga

SEQ ID NO: 395152 - RNA, 57 nt, Human
ccccagcaucagccuguagcuccccugcugaggcagugugguuauguucccagcagu

SEQ ID NO: 395153 - RNA, 57 nt, Human
cgccugucaucccagcacuuugggaggcugaggcaggcggaucacuugaugccagaa

SEQ ID NO: 395154 - RNA, 57 nt, Human
caccuguaaucccagcuacuugggaggcugaggcaggagaauugcuugaacucggga

SEQ ID NO: 395155 - RNA, 54 nt, Human
uucauguacuacaaaaauagcuaucugaggcaaaagaaacacaauuacaguuag

SEQ ID NO: 395156 - RNA, 57 nt, Human
ugccuauaaucccagcacuuugggaggcugaggcaguugagaccaggaguucgaguc

SEQ ID NO: 395157 - RNA, 57 nt, Human
ugccuguagucccagcuacgugggaggcugaggcacgagaauugccugaaccccaga

SEQ ID NO: 395158 - RNA, 57 nt, Human
agguguuugcgacagggguugggccagcugaggcaagcugucuuuuuucccuuuucu

SEQ ID NO: 395159 - RNA, 57 nt, Human
cggcccagugggagccuguccugguuccugaggcacauccuaacgcaagucugacca

SEQ ID NO: 395160 - RNA, 57 nt, Human
ccuguagaaucccagcuacucgggaggcugaggcaggagaauugcuugaaccuggga

SEQ ID NO: 395161 - RNA, 57 nt, Human
caccuguagucccagcugcucgagaggcugaggcacgagaaucaguugaacugggag

SEQ ID NO: 395162 - RNA, 64 nt, Human
guguuauucuuucugguugugagauucuagcacaaaggccuaaaaucaucaaauuagauuucca

SEQ ID NO: 395163 - RNA, 64 nt, Human
aaagucucuaauucuauuaaagugcuaagguucuaaggccuacuuuuuuuuuuuuuuuuuuuuu

SEQ ID NO: 395164 - RNA, 64 nt, Human
cuaaagauucuauaguucuagacauggagguucuaaggccuaggauucuaaaaugugauguucu

SEQ ID NO: 395165 - RNA, 57 nt, Human
gcgccuguaauccagcuacucgggaggcugaggcaggagaaucacuugaacccagga

SEQ ID NO: 395166 - RNA, 57 nt, Human
cgccuguagucccagcuacuugggaggcugaggcaggagaauggcgggaaccuggga

SEQ ID NO: 395167 - RNA, 57 nt, Human
ugccuguaaucccagcuacuuggaaggcugaggcaggagaaugucuugaaccuagga

SEQ ID NO: 395168 - RNA, 57 nt, Human
ugccuguaaucccagcacuuugauaggcugaggcagguggauugcuugagcucggga

SEQ ID NO: 395169 - RNA, 57 nt, Human
cagcuguaaucucagcugcucgggaggcugaggcacaagaaucgcuugagccaggga

SEQ ID NO: 395170 - RNA, 57 nt, Human
aaccuguagucguagcuacuugggaggcugaggcaggggaaucacuugaaccccgga

SEQ ID NO: 395171 - RNA, 57 nt, Human
cgccuguagucccagcuacucgggaggcugaggcagaagaauggcguaaacccagga

SEQ ID NO: 395172 - RNA, 57 nt, Human
cgccuguaaugccugcuacuugggagccugaggcagaagaauugcuugaagcuggga

SEQ ID NO: 395173 - RNA, 57 nt, Human
ugccuguaaucccagcacuuugggaggcugaggcagguagaucaccugaaguuagga

SEQ ID NO: 395174 - RNA, 57 nt, Human
ccagaggggcugaguccucaaauccggcugaggcagcagcuggcaccaucagagcca

SEQ ID NO: 395175 - RNA, 57 nt, Human
uggcaugguccugugccccgaccccaccugaggcaggagggcaugugcagacacuca

SEQ ID NO: 395176 - RNA, 57 nt, Human
agccuguagucccagcuacuccggaggcugaggcaggagaauggcgugaacccggga

SEQ ID NO: 395177 - RNA, 57 nt, Human
aggugacauuuucugugcguuuugacccugaggcaucugaggagaggccacaucuug

SEQ ID NO: 395178 - RNA, 57 nt, Human
caaugucuuugguugcaagucauaagccugaggcaaauaaaauuccaguaauuucga

SEQ ID NO: 395179 - RNA, 57 nt, Human
caccuguagucccagcuacucaggaggcugaggcaggagaauggugugaaccuggga

SEQ ID NO: 395180 - RNA, 57 nt, Human
cgccuguaaucccagcuacucgggaggcugaggcaggacgauuacuugagcuuggga

SEQ ID NO: 395181 - RNA, 64 nt, Human
cauuagccugcaguugggcaaaaucaucuaacacaaggccuacuuuauaauaaaguuacugcaa

SEQ ID NO: 395182 - RNA, 64 nt, Human
acaauguagugaauauggaaaaagguuucagccaaaggccuaacccuauucaacaccagaaagu

SEQ ID NO: 395183 - RNA, 64 nt, Human
cugcagguggcccgggcgggucgcuuuggcaccaaaggccuagccaucacuuuugugucugacg

SEQ ID NO: 395184 - RNA, 57 nt, Human
uaccuguagucccagcuacuugggaggcugaggcaggagaaucacuugaacucggga

SEQ ID NO: 395185 - RNA, 57 nt, Human
ugccuguagucucagcuacucaggaggcugaggcaggagaaucgccugaacccgggc

SEQ ID NO: 395186 - RNA, 57 nt, Human
caccuguaaucccagcuacccaggaggcugaggcaagagaaucacuugaacccggga

SEQ ID NO: 395187 - RNA, 57 nt, Human
ugccuguaaucccagcuacucaggaggcugaggcaggaggauugcuugaacccugga

SEQ ID NO: 395188 - RNA, 57 nt, Human
caccuguaaucccaguuaccugggaggcugaggcaggagaaucucuugagcccagga

SEQ ID NO: 395189 - RNA, 57 nt, Human
cgccuguggucccagcuacuugggaggcugaggcaugagaauugcuugaacccggga

SEQ ID NO: 395190 - RNA, 57 nt, Human
ugccuguaaucccagcuacucgggaggcugaggcaggagaaucacuugaacucggga

SEQ ID NO: 395191 - RNA, 57 nt, Human
cgccuguaaucccagcuacucagaaggcugaggcaggagaaucacuugaaccuagga

SEQ ID NO: 395192 - RNA, 57 nt, Human
uaccuauaguccuggcuauuugggaggcugaggcaggaggauugcuuuagcccugga

SEQ ID NO: 395193 - RNA, 57 nt, Human; identical to SEQ ID NO: 394997

SEQ ID NO: 395194 - RNA, 57 nt, Human
agaccacguccuagaagugcugugucccugaggcacaccuauguguguuaucucucu

SEQ ID NO: 395195 - RNA, 57 nt, Human
uaucugaagaggaaaaauaaaaaccuccugaggcauuucuugcccagcuggguccaa

SEQ ID NO: 395196 - RNA, 57 nt, Human
caccugaguggggcucgugcaggagaacugaggcaugaaacucuggcucaaaccuag

SEQ ID NO: 395197 - RNA, 57 nt, Human
cacggaggcuuccagcggugccugccacugaggcaggugcggccccaggaccaucac

SEQ ID NO: 395198 - RNA, 57 nt, Human
gaguggcaggggugaggaggggauuaucugaggcaucuggagauguauauccugugg

SEQ ID NO: 395199 - RNA, 57 nt, Human
ugucuguggcccagggcaguggcuuuccugaggcagcagccuucguggcaagaacua

SEQ ID NO: 395200 - RNA, 64 nt, Human
gcacaaacacugcucacugcagccucgaccucccaaggccuaagcaauccuccugccucagucc

SEQ ID NO: 395201 - RNA, 64 nt, Human
cugucuuagcacugcccugcuagcucuuccugaaaaggccuauaaauaaacagggcuggcuguu

SEQ ID NO: 395202 - RNA, 60 nt, Human
ucuccauuugauauuuucauuuguauaacucauuugcagucugaaaauuuuuuuuagugc

SEQ ID NO: 395203 - RNA, 57 nt, Human
agguggcccccugcccgauccaccguccugaggcagaguguugagccucauaccugu

SEQ ID NO: 395204 - RNA, 57 nt, Human
aguucccuggcaggcaagggcuuccaacugaggcagugcauguguggcagagagagg

SEQ ID NO: 395205 - RNA, 57 nt, Human
gguggcgggucccagcuacucgggaggcugaggcaggagaauggcaugaaccaggga

SEQ ID NO: 395206 - RNA, 57 nt, Human
cucccucagccccuggaacgguguuuucugaggcaugcccagguucaggucacuucg

SEQ ID NO: 395207 - RNA, 57 nt, Human
cgccuguaguccuagcuacucgggaggcugaggcaggagaaucucuuucuuaauugg

SEQ ID NO: 395208 - RNA, 57 nt, Human
ccuuguaggugacacaugcucugcccucugaggcagucagcgaaggcaaauggucug

SEQ ID NO: 395209 - RNA, 57 nt, Human
caucuguaaucccagcuauucaagaggcugaggcaugaggaucucuugaacccggga

SEQ ID NO: 395210 - RNA, 57 nt, Human
ugccuguaaucccagcuacuagggaggcugaggcaagagaguugcuugaacccagga

SEQ ID NO: 395211 - RNA, 57 nt, Human
caccuauaaucucagcuacucaggaggcugaggcacgagaaucgcuugagccuggga

SEQ ID NO: 395212 - RNA, 57 nt, Human
uuccagaaucccguaacaccugauuaacugaggcauccacuucuuucagcagacuga

SEQ ID NO: 395213 - RNA, 57 nt, Human
gcugggcgugguagugcaagcugaaggcugaggcaggagaaucacucgaacccggga

SEQ ID NO: 395214 - RNA, 57 nt, Human
ugccuguauucccagcuacucaugaggcugaggcaggagaauggcgugaacccggga

SEQ ID NO: 395215 - RNA, 57 nt, Human
ugccuguaaucccagcacuuugggaagcugaggcaggaggauccccugaggucagga

SEQ ID NO: 395216 - RNA, 57 nt, Human
cucccaucuucuuacacagagaggcagcugaggcaggacaguggggcuaacuguaga

SEQ ID NO: 395217 - RNA, 57 nt, Human
ugccuguaaucccagcuacucgggaggcugaggcaggagaaucgcuugaaccuggga

SEQ ID NO: 395218 - RNA, 57 nt, Human
cacuuguaaucccagcuacucccaaggcugaggcaggagaauugcuugagcccagga

SEQ ID NO: 395219 - RNA, 64 nt, Human
aucuagucauggacacuacuuaauguguuccuggaaggccuacagaugcauuaagaaauagaua

SEQ ID NO: 395220 - RNA, 64 nt, Human
aucuugcuucugcucagaaucugcucauucuuagaaggccuacauuaacauggaugcagaauaa

SEQ ID NO: 395221 - RNA, 64 nt, Human
gugucacaugggaguguuauggcagcaucauaccaaggccuacuguugcacauggggccaaaac

SEQ ID NO: 395222 - RNA, 57 nt, Human
ugccuguaaucccagcugcucaggaggcugaggcaggagaauugcuugaacccaaga

SEQ ID NO: 395223 - RNA, 57 nt, Human
cagugccccugggagggaagggcaucccugaggcacccgaauggucccucagggugc

SEQ ID NO: 395224 - RNA, 57 nt, Human
caccuguaauuucaacuacuugggaggcugaggcaggagaauugcuugaacccagga

SEQ ID NO: 395225 - RNA, 57 nt, Human
ccuaagaacuguggucugguguuccagcugaggcagggggauuugguaggaaggagc

SEQ ID NO: 395226 - RNA, 57 nt, Human
gccacgcuucguucucaggaacaaaaccugaggcagcccuuuggaugcccucacagc

SEQ ID NO: 395227 - RNA, 57 nt, Human
cacccguaguuccagcuacuugggaggcugaggcagcauugcuugaacccgggaggu

SEQ ID NO: 395228 - RNA, 57 nt, Human
caccugugaucccagcuuccugggaggcugaggcaagagaaucgcuugaaucuggga

SEQ ID NO: 395229 - RNA, 57 nt, Human
cgcuuguagucucagcuacuccggaggcugaggcaggagaauugcuugaaccuggaa

SEQ ID NO: 395230 - RNA, 57 nt, Human
ugucuguaaucccagcuauucgggaggcugaggcaggagaaucgcuugaacccagga

SEQ ID NO: 395231 - RNA, 57 nt, Human
caccuguagucccggcuacucgggaggcugaggcaggagaauugcuugaacccggga

SEQ ID NO: 395232 - RNA, 57 nt, Human
cgccuguagucccagcuacucaggaggcugaggcaggagaaucacuugaauucagga

SEQ ID NO: 395233 - RNA, 57 nt, Human
caccuguagucccagcuacucgggaggcugaggcaggagaauggugugaaccuggga

SEQ ID NO: 395234 - RNA, 57 nt, Human
cguguguagucgaagcuacucaggaggcugaggcagaagaaucacuugaaccuggga

SEQ ID NO: 395235 - RNA, 57 nt, Human
cacuuguaaucccagcuacucaggaggcugaggcaugagaaucgcuuaaacccagga

SEQ ID NO: 395236 - RNA, 57 nt, Human
cgccuguaaucccggcacuuugggaggcugaggcaggcggauugccugagaucggga

SEQ ID NO: 395237 - RNA, 57 nt, Human
cgccuguaaucccagcuacucaggaggcugaggcagcagaaucguuugaacccggga

SEQ ID NO: 395238 - RNA, 64 nt, Human
ugguaccaaaagggacccauggcugacugacagcaaggccuauggggaagaacugggagcuccc

SEQ ID NO: 395239 - RNA, 64 nt, Human
cauguggggagguuaaucuaggaaugacucguuuaaggccuauuuucaugauuucuuuguagca

SEQ ID NO: 395240 - RNA, 64 nt, Human
ggccucugugccuuggcucgcacuguuccuacugaaggccuagcaccugcucuuggccugguga

SEQ ID NO: 395241 - RNA, 57 nt, Human
gagggacugauuccugugguuggaaaacugaggcagccaccuaagguggaggugggg

SEQ ID NO: 395242 - RNA, 57 nt, Human
caccuguagucccagcuacuugggaggcugaggcaggagaauggcgugaaccuggaa

SEQ ID NO: 395243 - RNA, 57 nt, Human
cuccuguaaucccagcuacuggggaggcugaggcacgagaaucacuugaacccagga

SEQ ID NO: 395244 - RNA, 57 nt, Human
ggcauguagucccagcuacucgggaggcugaggcaggagaaucgcuugaaccuggga

SEQ ID NO: 395245 - RNA, 57 nt, Human
gacuggguccggucgccaggacugucucugaggcagaaacgccggcugggcgccggg

SEQ ID NO: 395246 - RNA, 57 nt, Human
ucucagccugcccuaaucuuuccccaucugaggcagguuucuaggaggugucuguag

SEQ ID NO: 395247 - RNA, 57 nt, Human
gugugggguaccugggaaaggguguggcugaggcagucauaaugcaguaucuucccc

SEQ ID NO: 395248 - RNA, 57 nt, Human
ugcguguaaucccagcuacuugggaggcugaggcaggagaauugcuugaaccuggga

SEQ ID NO: 395249 - RNA, 57 nt, Human
cgccuguaaucccagcuccucaggaggcugaggcaggagaauugcuugaaaccagga

SEQ ID NO: 395250 - RNA, 57 nt, Human
ccccagccagcccugccacacaccuggcugaggcaugucugggagggguggaggagg

SEQ ID NO: 395251 - RNA, 57 nt, Human
cgccuguagucccagcuacucaggaggcugaggcaggagaaugcugugaacccugga

SEQ ID NO: 395252 - RNA, 57 nt, Human
cgccuguaguccuagccacucaggaggcugaggcaggaggauugcuugagcccagga

SEQ ID NO: 395253 - RNA, 57 nt, Human
ugccuguaguuccagcuacuugggaggcugaggcaggagaaucgcuugaaccaggca

SEQ ID NO: 395254 - RNA, 57 nt, Human
uccagaaaaucuucccagauagggaaacugaggcagagagugccguggagugguuuu

SEQ ID NO: 395255 - RNA, 57 nt, Human
ccuauccagccagcauuuuccuuccagcugaggcaggugaagacuucauaagcucau

SEQ ID NO: 395256 - RNA, 57 nt, Human
ugccuguagucccagcugcuugggaggcugaggcaggagaaucgcuugaaccugaga

SEQ ID NO: 395257 - RNA, 64 nt, Human
ggaggggugggacaaacugcaagguucuggggccaaggccuacccaggggccucugcccagaga

SEQ ID NO: 395258 - RNA, 64 nt, Human
gugagaugggacauuccaaagaacagccugagccaaggccuagugguaguaagaaucuagcaag

SEQ ID NO: 395259 - RNA, 60 nt, Human
gaaaauucaguggaagguuauugcuauugucauuugcauagaauuuaagugauugauuua

SEQ ID NO: 395260 - RNA, 57 nt, Human
cgccuguagucccagcugcucaggaggcugaggcaggagaauugauugaacccggga

SEQ ID NO: 395261 - RNA, 57 nt, Human
ugccuguaauuccagccacucgagaggcugaggcaggagaauugcuugaacccagga

SEQ ID NO: 395262 - RNA, 57 nt, Human
ugccuggaaucccagcuacuugagaggcugaggcacgagaauugcuugaacccagga

SEQ ID NO: 395263 - RNA, 57 nt, Human
caccuguagucccagcugcucaggaggcugaggcaggaggaucucuugagcccagga

SEQ ID NO: 395264 - RNA, 57 nt, Human
cguguauaguccaagcuacucaggaggcugaggcagaagaaucacuugaaccuggga

SEQ ID NO: 395265 - RNA, 57 nt, Human
cugggagggcagcagggcuacccugagcugaggcagcagugugaggccagggcagag

SEQ ID NO: 395266 - RNA, 57 nt, Human
guaagcuguuguucccugaggcugaggcugaggcagagaaucuuccagaugauaaac

SEQ ID NO: 395267 - RNA, 57 nt, Human
ugcuguuccacaucagcccucugcucucugaggcagccgcgccucugacucggagcu

SEQ ID NO: 395268 - RNA, 57 nt, Human
gcccugaccaccccccucuggugggaucugaggcacucucucgaaugccgucacacc

SEQ ID NO: 395269 - RNA, 57 nt, Human
cacccauaguuccagcuacucgggaagcugaggcaguaagaucacuugagcccagga

SEQ ID NO: 395270 - RNA, 57 nt, Human
ugccuguagucccaacuacucggaaggcugaggcaggagaauugcuugaacccggga

SEQ ID NO: 395271 - RNA, 57 nt, Human
cgccuguagucccagcuacucgggaggcugaggcaggagaauggcaugaaccuggaa

SEQ ID NO: 395272 - RNA, 57 nt, Human
cccugagauguaaacagcaagugggggcugaggcagaggcagggauagcuggguggu

SEQ ID NO: 395273 - RNA, 57 nt, Human
cagcgcccccuccuucaguugcccuuucugaggcaacuaaacuacagaaucagggaa

SEQ ID NO: 395274 - RNA, 57 nt, Human
gguguggauggggaaacagaggcaaaacugaggcaccugaugcauucagccugcugu

SEQ ID NO: 395275 - RNA, 57 nt, Human
agauuucaguuuucccuaugagaaacucugaggcagccacuuaucuuggcuaaauag

SEQ ID NO: 395276 - RNA, 64 nt, Human
cuccagaugagucagugaguggugaaugaaugugaaggccuagggcauuacuguauacuacugu

SEQ ID NO: 395277 - RNA, 64 nt, Human
ccugcuggacauugcugaucuuuuccaaguucccaaggccuacagcugaagguuggagaaaugc

SEQ ID NO: 395278 - RNA, 64 nt, Human
uccuaaaauuccaaaauuauauugagcaaucgccaaggccuaaagccaacugacuuaaagguaa

SEQ ID NO: 395279 - RNA, 57 nt, Human
ugcuucuggcuaagagugcagcagagacugaggcauagccagcuucaaaagcgaucu

SEQ ID NO: 395280 - RNA, 57 nt, Human
cuguaaucccaucaucuacucaggaggcugaggcaggagaauugcuugaacccagga

SEQ ID NO: 395281 - RNA, 57 nt, Human
cauaugaaucugggaaaugggcuaggccugaggcagucaccuauuuguagaacucaa

SEQ ID NO: 395282 - RNA, 57 nt, Human
ugucaucuccaagcugaguuuccucuucugaggcagaggcuggagcaguucuuuuuc

SEQ ID NO: 395283 - RNA, 57 nt, Human
gagggagguggacggugccagcugaggcugaggcaugcagcagcccccagcuaccuu

SEQ ID NO: 395284 - RNA, 57 nt, Human
gagucucacccuacagaugagagguggcugaggcaccagggcuaagcaauuaaacca

SEQ ID NO: 395285 - RNA, 57 nt, Human
cccgcuggcucccagaucagggugggccugaggcaggcagccgaccugaggccuggg

SEQ ID NO: 395286 - RNA, 57 nt, Human
uggcaauggaagccuggguuggagauccugaggcagcugugccuacuguuccccacc

SEQ ID NO: 395287 - RNA, 57 nt, Human
caggaacuggcuccuuugccucugcuacugaggcaggggaguaguggagagcgggug

SEQ ID NO: 395288 - RNA, 57 nt, Human
cgccuguaaucccagcuacuugggaggcugaggcaggagaaucacuugaacguggga

SEQ ID NO: 395289 - RNA, 57 nt, Human
caggagccccuggggcuguauuuaucucugaggcaugguguguggugcuacagggaa

SEQ ID NO: 395290 - RNA, 57 nt, Human
ugcuuguaaugucagcuacccaggagucugaggcacaagaaucacucgaaccuggga

SEQ ID NO: 395291 - RNA, 57 nt, Human
ugccuguggucccagcuacucgggaggcugaggcacaagaaucacuugaacccagga

SEQ ID NO: 395292 - RNA, 57 nt, Human
aacccagggccuagacuucuagugccucugaggcagaaccaaaggagccugcacugg

SEQ ID NO: 395293 - RNA, 57 nt, Human
caccuguagucccagcuacuugggaggcugaggcaggagaauggugugaacccggga

SEQ ID NO: 395294 - RNA, 57 nt, Human
caccuguagucccagcuacuugggaggcugaggcaggagaaucgcuucaaccuggga

SEQ ID NO: 395295 - RNA, 64 nt, Human
aacuccaucaauccaguccaagaggaggaggacgaaggccuagacucagcugaaggaucuucaa

SEQ ID NO: 395296 - RNA, 64 nt, Human
ucuucaaagcaggaugaagaccuagacuuaccugaaggccuagacucagcugaaggaucuucaa

SEQ ID NO: 395297 - RNA, 64 nt, Human
ugcaauuccuuaaaaacuaaaucacauuugguaaaaggccuacagcuuuguacuuacauugugc

SEQ ID NO: 395298 - RNA, 57 nt, Human
caccuguaguuccagcuacuugggaggcugaggcagaagaaucacuugaacccggga

SEQ ID NO: 395299 - RNA, 57 nt, Human
accagacucaaggacacccuggcccugcugaggcauacagagcuucagcccagcaca

SEQ ID NO: 395300 - RNA, 57 nt, Human
ggccuuuaauuccagcuacuugggaggcugaggcaggagaauuacuugaacccagga

SEQ ID NO: 395301 - RNA, 57 nt, Human
aguucugguucuuccagguggcucccgcugaggcagcggucucugggggauccccca

SEQ ID NO: 395302 - RNA, 57 nt, Human
ugcuuguaaucacagcacuuuaggaggcugaggcaggaggacuguuugagcccagga

SEQ ID NO: 395303 - RNA, 57 nt, Human
gguccugccagaccuccuuccugaccucugaggcaggagaggaauaaagacgguccg

SEQ ID NO: 395304 - RNA, 57 nt, Human
ugaauuaauucaucccacgcauccucccugaggcaccugccccuucuccagcucauc

SEQ ID NO: 395305 - RNA, 57 nt, Human
ugccuguaaucucagcuauuugggaggcugaggcaggagaaucacuugaaccuggga

SEQ ID NO: 395306 - RNA, 57 nt, Human
auagacauaucuauauaaauugucuggcugaggcagggccuucagcuaucauuuggu

SEQ ID NO: 395307 - RNA, 57 nt, Human
accaggcagaugcucucuagccuggaucugaggcacaccagcagcaugacaaacuca

SEQ ID NO: 395308 - RNA, 57 nt, Human
gcaccucuacucccagcuacuaggaggcugaggcaggagaaucguuugaacccagga

SEQ ID NO: 395309 - RNA, 57 nt, Human
guggugguaugugccuguagucccaggcugaggcaagagaauuacuugagcccagga

SEQ ID NO: 395310 - RNA, 57 nt, Human
ugccuguaaucccagcuacucgggaggcugaggcaggagaaucgcuugaacccggga

SEQ ID NO: 395311 - RNA, 57 nt, Human
cgucuguaaucccagcacuuugggaggcugaggcaggcagaucaccugauaucaaga

SEQ ID NO: 395312 - RNA, 57 nt, Human
cuuaggcagggaaguguaagaaacacacugaggcagggaaguccccaggccccagga

SEQ ID NO: 395313 - RNA, 57 nt, Human
cagagaguggaugggcuuccucccgcccugaggcaagcaccucuucucuguagcugg

SEQ ID NO: 395314 - RNA, 64 nt, Human
aauuugaugccuuaaauucacaagugaggaagcuaaggccuagaagguuaaggauguccccagg

SEQ ID NO: 395315 - RNA, 64 nt, Human
agguugccugagugaagggagaguuccccuauaaaaggccuaaaauugaucuggggcucagcca

SEQ ID NO: 395316 - RNA, 64 nt, Human
ccgauggcccacggcaggagguguguggaaguguaaggccuaagaugcucacagaggucccuca

SEQ ID NO: 395317 - RNA, 57 nt, Human
caccuguaaucccagcuacucgggaggcugaggcacaagaaucgcuugaacacggga

SEQ ID NO: 395318 - RNA, 57 nt, Human
cgccuguagucccagcuacucgggaggcugaggcaggaagaaucgcuugaacccggg

SEQ ID NO: 395319 - RNA, 57 nt, Human
ggacuugaguuguuuacaagcccugcacugaggcagauuggugcuguucgcagagua

SEQ ID NO: 395320 - RNA, 57 nt, Human
aaccaguggccagaggagugggagggccugaggcaucacaucuugcagaucagaaug

SEQ ID NO: 395321 - RNA, 57 nt, Human
ugccuguagucccagcuacucgggaagcugaggcagaagaauggcaugaaccuggga

SEQ ID NO: 395322 - RNA, 57 nt, Human
cgccuguaguuccagcuacucgggaggcugaggcaagagaauggcaugaacccggua

SEQ ID NO: 395323 - RNA, 57 nt, Human
cacaccuguagucccggccacucggggcugaggcaggaggaucacuggaaccuggga

SEQ ID NO: 395324 - RNA, 57 nt, Human
ugagcguccugccccgaauucacgaggcugaggcauccgggagcuggcguaaugccu

SEQ ID NO: 395325 - RNA, 57 nt, Human
ugagucaguucgucccacacauccucccugaggcaccugcaccugcucuagcucacc

SEQ ID NO: 395326 - RNA, 57 nt, Human
gacuuccugggacaagcaaggaaaguacugaggcagccacuugauugaacgguguug

SEQ ID NO: 395327 - RNA, 57 nt, Human
ccuuccagaagcaaaaacaaaccaugacugaggcaggcauggaguugggcguuaggg

SEQ ID NO: 395328 - RNA, 57 nt, Human
cagauccaucccaugauuuguuccugucugaggcauagaggcaggcaagccguggau

SEQ ID NO: 395329 - RNA, 57 nt, Human
guccuguagucccagcuacucgggaggcugaggcaggagaauggugugaacccggga

SEQ ID NO: 395330 - RNA, 57 nt, Human
ugccuguaaucucagcuacucgggaggcugaggcagaauugcuugaacccaggaggu

SEQ ID NO: 395331 - RNA, 57 nt, Human
caccuguaaucccagcuaccggggaggcugaggcaggagaaucgcuagaaccuggga

SEQ ID NO: 395332 - RNA, 57 nt, Human
uuuucuuucuuacaauuuuuggccauccugaggcauuuacuaaguagccuuaauuug

SEQ ID NO: 395333 - RNA, 64 nt, Human
cuagagucagguuucucauauccaucgugauaggaaggccuaagaauggcaaaucgcuuugaga

SEQ ID NO: 395334 - RNA, 60 nt, Human
cagugaaauuucuacaaagcucuaaaucugcauuugcauuuccucugcccuuuuaacuaa

SEQ ID NO: 395335 - RNA, 57 nt, Human
uuacuauuucuuccuguuacaaaugaucugaggcaguuuuuuccugggaauccacac

SEQ ID NO: 395336 - RNA, 57 nt, Human
cgccuguaaucccagcuacccaggaggcugaggcaggagaaucgcuugaaccgggga

SEQ ID NO: 395337 - RNA, 57 nt, Human
ggggccucagcccuugggaggggacaccugaggcagccagcgcccccuccccagucc

SEQ ID NO: 395338 - RNA, 57 nt, Human
uaccuguagucccagcuacuccggaggcugaggcaggagaauggcgugaacccggga

SEQ ID NO: 395339 - RNA, 57 nt, Human
gucuuccuugcuugaacccucucuacucugaggcacucuguugggguuugggacccu

SEQ ID NO: 395340 - RNA, 57 nt, Human
cgccuguaaucccagcuacuugggaggcugaggcaggagaauuacuugaaccuggga

SEQ ID NO: 395341 - RNA, 57 nt, Human
accgggcuagcuggcugcccagagccucugaggcagcgcaggggucaguucccaccc

SEQ ID NO: 395342 - RNA, 57 nt, Human
ucagucuucccaucugaacgauggguccugaggcacagcucugagcacagagguccc

SEQ ID NO: 395343 - RNA, 57 nt, Human
ggcaccuccuuuucugugcuuucuucccugaggcauucuuccucaucccuagggugu

SEQ ID NO: 395344 - RNA, 57 nt, Human
cugaaucaguucaucccacacaucauccugaggcaccugcaccugcucuagcucauc

SEQ ID NO: 395345 - RNA, 57 nt, Human
caucuguaauaccagcgcuuugggaggcugaggcaggaggauugcuugaggccagga

SEQ ID NO: 395346 - RNA, 57 nt, Human
caccuguagucccagcuacucgggaggcugaggcaggagaauugcuugaaccuagga

SEQ ID NO: 395347 - RNA, 57 nt, Human
cgccuguaaucccagcacuuugggaggcugaggcagguggaucacaaugucaggagu

SEQ ID NO: 395348 - RNA, 57 nt, Human
ugacuuucuuaccagcaguuaccuagacugaggcaagcuguguggacucacccaagu

SEQ ID NO: 395349 - RNA, 57 nt, Human
ucgguccacauagcuuucuuugccucucugaggcagacaggaagugucuaauuacga

SEQ ID NO: 395350 - RNA, 57 nt, Human
ugccuguaaucccagcacuuugagaggcugaggcagggcagauugcaugagcccagg

SEQ ID NO: 395351 - RNA, 64 nt, Human
gcggcugcuggaauauccuaccugauaggauuaaaaggccuaguggagcugggggcucucagug

SEQ ID NO: 395352 - RNA, 64 nt, Human
uugccgcccuguuucugucaaauaccuagugaaaaaggccuaaacaauuguaaugauauuauuu

SEQ ID NO: 395353 - RNA, 64 nt, Human
agauaaucugggucagccugaccugauuagucagaaggccuaaagaacagagcuaaggguuucc

SEQ ID NO: 395354 - RNA, 53 nt, Human
cuuguuguaauuucaacuaaaggcugaggcacggagaagaaaaggaaucagca

SEQ ID NO: 395355 - RNA, 57 nt, Human
gagggagugggaggggucugucuccaccugaggcagggaaagagagccuauucucac

SEQ ID NO: 395356 - RNA, 57 nt, Human
aaaucauuguguuuuuuaugcauuuugcugaggcaugcuuauucauuuaacaccuau

SEQ ID NO: 395357 - RNA, 57 nt, Human
caagguuuuuuuuuuuuuuuuuuuuugcugaggcaguuauuguccacaggccuuugg

SEQ ID NO: 395358 - RNA, 57 nt, Human
ugccuguaaucccagcuacucgggaggcugaggcaggagaaucacuugaaccuggga

SEQ ID NO: 395359 - RNA, 57 nt, Human
caccuguagucccagcuacucaggaggcugaggcaggagaauugcuugaaccuggga

SEQ ID NO: 395360 - RNA, 57 nt, Human
ugcccucaaucccagcuacucaagaggcugaggcaggagaaucacuugcacuccgga

SEQ ID NO: 395361 - RNA, 57 nt, Human
agcaguucugaugcuuacaucuggaaucugaggcauccucugacuccacucaaagag

SEQ ID NO: 395362 - RNA, 57 nt, Human
ugccuguaaucccagcuauuugggaggcugaggcaggagaaucgcuugagcccggga

SEQ ID NO: 395363 - RNA, 57 nt, Human
gaauguagagaugccaccucccucucucugaggcaggccuguggaugaaggaggagg

SEQ ID NO: 395364 - RNA, 57 nt, Human
cugccuucucagggacuucugcggggccugaggcaagccauggagugagacccagga

SEQ ID NO: 395365 - RNA, 57 nt, Human
auggaaagaaaauaauuaugaaugccacugaggcacugaggcccuaccucaugccaa

SEQ ID NO: 395366 - RNA, 57 nt, Human
cgccuguaaucccagaacucuggaaggcugaggcaggcggaucaccugagaucagga

SEQ ID NO: 395367 - RNA, 57 nt, Human
gucaccaccaccaccccccaccccauccugaggcacugccuggcagauaacccuggu

SEQ ID NO: 395368 - RNA, 57 nt, Human
ccgagccggagcagcucugaccuggagcugaggcagccagcagaucucagcagccca

SEQ ID NO: 395369 - RNA, 57 nt, Human
ucuaucaccagccucaaacccgaaagacugaggcauuuuccagucuacuugccuaau

SEQ ID NO: 395370 - RNA, 64 nt, Human
guaacguucaguuuugcauuuuguuuaaauauugaaggccuagacaaagaacuagaaaaaaaaa

SEQ ID NO: 395371 - RNA, 64 nt, Human
acuuuuuauaaaaacuuacagcgauggccccaccaaggccuagacacggcacuggccucccagg

SEQ ID NO: 395372 - RNA, 64 nt, Human
uaagaaacaacccagugaagaguucuaccauagcaaggccuaauguuagcuuuagcuuuagaaa

SEQ ID NO: 395373 - RNA, 57 nt, Human
cgccuguaaucccagcuacucgggaggcugaggcagaaggauuguuugaacccggga

SEQ ID NO: 395374 - RNA, 57 nt, Human
ucaacugauuuacaacacacaugaugacugaggcauucgggaaccccuucauccaaa

SEQ ID NO: 395375 - RNA, 57 nt, Human
caccuguagucccagcuacuugggaggcugaggcaggagacuagcuggaaccaggga

SEQ ID NO: 395376 - RNA, 57 nt, Human
caccuguagucccagcuacuugggaggcugaggcaggagaaucaccugaaccugaga

SEQ ID NO: 395377 - RNA, 57 nt, Human
ugccuguaaucucagcuacucaggaggcugaggcaggagaaucgcuugaacccagga

SEQ ID NO: 395378 - RNA, 57 nt, Human
ugccuguaaucucagcacuuugggaggcugaggcagaaggauuaccugaggcaagga

SEQ ID NO: 395379 - RNA, 57 nt, Human
uuugggaggcugaggcagaaggauuaccugaggcaaggaguuugagaccagcuuagc

SEQ ID NO: 395380 - RNA, 57 nt, Human
caccuguagucccagcuacucaggaggcugaggcaggagaauggcgugaacccggaa

SEQ ID NO: 395381 - RNA, 57 nt, Human
ugccuguaaucccagcuacucgggaggcugaggcaggagaaucacuugaacccggga

SEQ ID NO: 395382 - RNA, 57 nt, Human
aauuuaauucauguauuaugauuaaaucugaggcagaugagcuuacaaguauugaaa

SEQ ID NO: 395383 - RNA, 57 nt, Human
ugccuguauucccagccacucaggaggcugaggcaggagaaucgcuggaaccuggga

SEQ ID NO: 395384 - RNA, 57 nt, Human
cauucauauagcacguaguuuauguuccugaggcagcacuuuuagauccuuugugag

SEQ ID NO: 395385 - RNA, 57 nt, Human
agcauguaauccgagcacuuugggaggcugaggcaggcggaucacuugaggucagca

SEQ ID NO: 395386 - RNA, 57 nt, Human
aaauaagccaggcgugguggcgggaggcugaggcaaggagaaucacuugaauacaag

SEQ ID NO: 395387 - RNA, 57 nt, Human
caccuguagucucagcuacucggaaggcugaggcaggaggaucacuugagccuggga

SEQ ID NO: 395388 - RNA, 57 nt, Human
uguuguaagaacuuuagcuccagggaacugaggcagaggcccuguuuguggucugug

SEQ ID NO: 395389 - RNA, 64 nt, Human
gccuucucaguggacuugccccuccuaagcagagaaggccuaugagguugcuugcugcugggaa

SEQ ID NO: 395390 - RNA, 64 nt, Human
cacuccccguucagcacagccgccaucugcaaggaaggccuaaucauguuacaaucacugccca

SEQ ID NO: 395391 - RNA, 60 nt, Human
uuguggucaucagcuucaugacauuuuacccauuugcagugauccuguguaaaacugcca

SEQ ID NO: 395392 - RNA, 57 nt, Human
cuucuguggccccggaggaaggagagacugaggcaaggcaaagugauaguacacgga

SEQ ID NO: 395393 - RNA, 57 nt, Human
caccugcaaucccagcuacucgggaggcugaggcacaagaaucacuugaacccggga

SEQ ID NO: 395394 - RNA, 57 nt, Human
agcucucuccaggacaggcccaguccucugaggcacggcggcucuguucaagcacuu

SEQ ID NO: 395395 - RNA, 57 nt, Human
ugccuauaaucccagcacuuugggaggcugaggcaggaggaucacuugagcccagga

SEQ ID NO: 395396 - RNA, 57 nt, Human
caccuguaaucccagcuacuuggaaggcugaggcauaggaguugcuugaaccuggga

SEQ ID NO: 395397 - RNA, 57 nt, Human
ugccuguagucccagcuacucgggaggcugaggcaggagaaucacuugaaccuggga

SEQ ID NO: 395398 - RNA, 57 nt, Human
caccuguaaucccagcuacuugggaggcugaggcaggagaaucgcuugaacccagga

SEQ ID NO: 395399 - RNA, 57 nt, Human
ugccuguaaucccagcuacucgggaggcugaggcaggagaaucaauugaaccuggga

SEQ ID NO: 395400 - RNA, 57 nt, Human
acucacacaaauuaaaauacagcugcacugaggcagcgaccucaaguguccugaaag

SEQ ID NO: 395401 - RNA, 57 nt, Human
ccaugauaacugcauuugguaggaagccugaggcaaaaacugcuuaaguggaucugu

SEQ ID NO: 395402 - RNA, 57 nt, Human
cgugguggcgggugccuguacaggaggcugaggcaggagaauggcgugaacccgcga

SEQ ID NO: 395403 - RNA, 57 nt, Human
agccuguaaucccagcuacucaggaggcugaggcagaagaauugaacccaggaggug

SEQ ID NO: 395404 - RNA, 57 nt, Human
cgucuguaaucccaggacuuugggaggcugaggcagguggaucaccugaggucagga

SEQ ID NO: 395405 - RNA, 57 nt, Human
uugaacuggucuaaugaguucaagggccugaggcagauccagaggacaagccugccu

SEQ ID NO: 395406 - RNA, 57 nt, Human
ggacacagaccagacuaaggaagaagucugaggcagacggugaggguggcccaggag

SEQ ID NO: 395407 - RNA, 57 nt, Human
caccugcagucccagcuacuugggaggcugaggcaggagaaucacucgaacccagga

SEQ ID NO: 395408 - RNA, 64 nt, Human
cuuuaccugcugagccccgcaggccgcugaaccaaaggccuagauggggaggacuaggagagcg

SEQ ID NO: 395409 - RNA, 64 nt, Human
uguccugcuucacccuaccccgccuaagacuguaaaggccuaaaaaccucggccuguccuccca

SEQ ID NO: 395410 - RNA, 64 nt, Human
ugggaaguaauuuuaaucauauguaauuggucacaaggccuaauuugcaguaacuauugcuguu

SEQ ID NO: 395411 - RNA, 57 nt, Human
gaagccagcuuuuggggaaggcagguccugaggcaggcacugcccuguggucuuccc

SEQ ID NO: 395412 - RNA, 57 nt, Human
cuuuaaagacuuaagauuaaauuauaucugaggcacugauaauauguuugagguuaa

SEQ ID NO: 395413 - RNA, 57 nt, Human
acuccuacacacucucugaaacucaggcugaggcagcagcugaggcccuguccaaag

SEQ ID NO: 395414 - RNA, 57 nt, Human
cucuucaauuuccacaacuaugacaaccugaggcacugugcucggaaguuagaccca

SEQ ID NO: 395415 - RNA, 57 nt, Human
uggcugcuggcuggcccaagcagagagcugaggcauccaagaaauguuccauugggg

SEQ ID NO: 395416 - RNA, 57 nt, Human
caccuguaaucccagcuacuugggaggcugaggcaggagaaaucgccugaacccaga

SEQ ID NO: 395417 - RNA, 57 nt, Human
ugccuguaaucccagcacuuugggaggcugaggcaggcggaucacuugaggucagga

SEQ ID NO: 395418 - RNA, 57 nt, Human
ugccuguaaucccagcuacuggggaggcugaggcaggagaaucgcuugaaccuggga

SEQ ID NO: 395419 - RNA, 57 nt, Human
cgccuguagucccagcuacucaggaggcugaggcaggagaauggcgugaaccuguga

SEQ ID NO: 395420 - RNA, 57 nt, Human
aacacugaucugaucauuugggauuugcugaggcauuugugagucuuccuuauaaac

SEQ ID NO: 395421 - RNA, 57 nt, Human
ugccuguagucccagcuacucaggaggcugaggcaggagaauggugugaacccggga

SEQ ID NO: 395422 - RNA, 57 nt, Human
cgccuguagucccagcuacuuggaaggcugaggcaggagaauggcgugaacccggga

SEQ ID NO: 395423 - RNA, 57 nt, Human
ucuauauuccuaucuucuagaggaaggcugaggcaggaggauugcuuaaacgcagga

SEQ ID NO: 395424 - RNA, 57 nt, Human
augcuuguaaucugaacauuugggaggcugaggcaggaagaucgcuugagguccaga

SEQ ID NO: 395425 - RNA, 57 nt, Human
caccuguagucccuuacucccugguggcugaggcauuaucccuugaaccugggaggc

SEQ ID NO: 395426 - RNA, 57 nt, Human
uccugagauaguuuuguaucuuaaagacugaggcacagaagcgaaacgagaacacac

SEQ ID NO: 395427 - RNA, 64 nt, Human
uugagggaugcagcucccaaaauguauaaggaagaaggccuaaaagcguaaguaaacacuuaaa

SEQ ID NO: 395428 - RNA, 64 nt, Human
uccuuggauucuucugacuuuggcuucugaaaggaaggccuagauccagcccuggugguaguuc

SEQ ID NO: 395429 - RNA, 64 nt, Human
ggucagucauuaugacuuauacuaauuccuagugaaggccuaaugcacuuguaaaacaggauuu

SEQ ID NO: 395430 - RNA, 57 nt, Human
cgccuguaaucccaucuucuugggaggcugaggcaggagaaucgcuagaaacuggga

SEQ ID NO: 395431 - RNA, 57 nt, Human
cgccuguaguuccagcuacucaggaggcugaggcaggagaaucgcuugaacccggga

SEQ ID NO: 395432 - RNA, 57 nt, Human
gacccagucccuuauuuggggggaggucugaggcaaguauauuucaaaauauguacu

SEQ ID NO: 395433 - RNA, 57 nt, Human
uugggcaguuuaaaugaauguacauuccugaggcaucagaacuuuguucacuguuau

SEQ ID NO: 395434 - RNA, 57 nt, Human
augccuguaauccagcuacuugggaggcugaggcaggaaaauggcuugaacccggga

SEQ ID NO: 395435 - RNA, 57 nt, Human
ggccuguaaucccagcuacucaggaggcugaggcaggagaaucgcuugcacccagga

SEQ ID NO: 395436 - RNA, 57 nt, Human
cagggagcagcugcacaucgugaaagacugaggcagcguggaugggaaguaaacgcu

SEQ ID NO: 395437 - RNA, 57 nt, Human
uaccuauaaucccagcuacucgggaggcugaggcacgagaaucacuugaagccggga

SEQ ID NO: 395438 - RNA, 57 nt, Human
ugccuguaaucccagcuacucaggaggcugaggcaggagaaucgcuugaacccggga

SEQ ID NO: 395439 - RNA, 57 nt, Human
uaacuagauauguucaauagaaagagucugaggcaaguggaaaugaggaacggaaac

SEQ ID NO: 395440 - RNA, 57 nt, Human
gugggugccuguaacucauuagacguacugaggcagcacuucugcagggugcauacc

SEQ ID NO: 395441 - RNA, 57 nt, Human
ugccuguagucccagcuacuugggaggcugaggcaggagaaucgcuugagcccaaga

SEQ ID NO: 395442 - RNA, 57 nt, Human
caccuauaauccuagcacuuggggaggcugaggcagacggauuaccugaggucagga

SEQ ID NO: 395443 - RNA, 57 nt, Human
caccuguaaucccagcuacucuggaggcugaggcaggagaaucaccugaaccuggga

SEQ ID NO: 395444 - RNA, 57 nt, Human
caccuguaguccuagcuacucgagaggcugaggcaggagaauggcgugaacccggga

SEQ ID NO: 395445 - RNA, 57 nt, Human
cgccuguaaucccagcuacccaggaggcugaggcaggagaauugcugaaacccggga

SEQ ID NO: 395446 - RNA, 64 nt, Human
uuuuuaaauaggagaaaauuaagaaauuguguuaaaggccuaaaguucaggaguguauuacuuu

SEQ ID NO: 395447 - RNA, 64 nt, Human
auagccggugguguaaaaugaucauauucauucaaaggccuacacaguacaaaugagcacgcug

SEQ ID NO: 395448 - RNA, 64 nt, Human
caauggagcucugcuccccuaaagccucaaaacaaaggccuaauucuaugccugucuuaauuuu

SEQ ID NO: 395449 - RNA, 57 nt, Human
aagugccuuuaaucccaccucaggaggcugaggcaggagaaucgcuugaaccuggga

SEQ ID NO: 395450 - RNA, 57 nt, Human
ugccuguaaucccagcuacuugggaggcugaggcaggagaaucgcuugaaccuggga

SEQ ID NO: 395451 - RNA, 57 nt, Human
ccuauuacugaggaaaaccuccauacacugaggcagaaacuugugucaguuggagga

SEQ ID NO: 395452 - RNA, 57 nt, Human
cuuauguagucccaguuacucgggaggcugaggcacgagaaucacuugaaccuggga

SEQ ID NO: 395453 - RNA, 57 nt, Human
ugccuguaaucccagcuacucaggaggcugaggcaggagauucgcuugaacucagga

SEQ ID NO: 395454 - RNA, 57 nt, Human
cgcuuguaaucccagcuacucaggaggcugaggcaggagaaucgcuuaaacucggga

SEQ ID NO: 395455 - RNA, 57 nt, Human
ugccuguaaucucagcuacuugagaggcugaggcaggagaaucgcuugaacuuggga

SEQ ID NO: 395456 - RNA, 57 nt, Human
aaugaauaaaacacucuuugguggugacugaggcaucauuagaaggcccagacgauu

SEQ ID NO: 395457 - RNA, 57 nt, Human
acaaguaauuuucauucccacaaaaaccugaggcagcucuuuugcccagagcguucc

SEQ ID NO: 395458 - RNA, 57 nt, Human
cgccuguaaucccagcuacucgggaagcugaggcaggagaauggugugaacccagug

SEQ ID NO: 395459 - RNA, 57 nt, Human
gagguuaagaauaucagugacaguacucugaggcaucugggcaugucagaugaagau

SEQ ID NO: 395460 - RNA, 57 nt, Human
guucccucaucagcaccagaggcucagcugaggcaagaagagcaccaucacugccua

SEQ ID NO: 395461 - RNA, 57 nt, Human
gggcccuguggugcugggagaugcucucugaggcaaggcccagaccuggccucugcc

SEQ ID NO: 395462 - RNA, 57 nt, Human
uuagcucagucaguccucaucgugguccugaggcauagguacuguuguaccaagguc

SEQ ID NO: 395463 - RNA, 57 nt, Human
ggcuccccaggucugucucuggaugcucugaggcagaugggcuugggggcucuagga

SEQ ID NO: 395464 - RNA, 57 nt, Human
gcgcgggaagaaaaggagaggaggaagcugaggcaacuuugggauucuugucagcgg

SEQ ID NO: 395465 - RNA, 60 nt, Human
agcuaaagagagggaaccucaucuaaguaacauuugcacaugauacagcaaaaggaguuc

SEQ ID NO: 395466 - RNA, 60 nt, Human
gacuuguugcaacagcagucauacccaaaucauuugcacuuuaaaacuggaagauuaagc

SEQ ID NO: 395467 - RNA, 60 nt, Human
auuuuuaaaacuggaacuaugaacuucauccauuugcacuguucagacauauauauguau

SEQ ID NO: 395468 - RNA, 57 nt, Human
caccuguaaucccagcuacucuggaggcugaggcaaaagaaucgcuugaacccggga

SEQ ID NO: 395469 - RNA, 57 nt, Human
aggcaguagaguauuuucugugcuagacugaggcagcccugaagcacugcgcaagca

SEQ ID NO: 395470 - RNA, 57 nt, Human
ccuucuugauuaucuuuggcuuuguaccugaggcaggagagaagagauguccaacca

SEQ ID NO: 395471 - RNA, 57 nt, Human
ugccuguaaucccagcuacucgcaaggcugaggcaggagaaucgcuugaaccuggga

SEQ ID NO: 395472 - RNA, 57 nt, Human
gauugggcccacuacucauagcagcuccugaggcagguaaauggggcaaggacucac

SEQ ID NO: 395473 - RNA, 57 nt, Human
caccuauaaucccaccuacuugguaggcugaggcaggagaaucgcuugaacccagga

SEQ ID NO: 395474 - RNA, 57 nt, Human
caccuguaauccuagcacuuugggaggcugaggcagguggcucacuugaggucagga

SEQ ID NO: 395475 - RNA, 57 nt, Human
auaagccgguggggggaugagauuaggcugaggcagugcuagucaacuggggaaaag

SEQ ID NO: 395476 - RNA, 57 nt, Human
aaauuaaaauauaacacuccugaaugccugaggcacgaucuggauuuuaaaugugug

SEQ ID NO: 395477 - RNA, 57 nt, Human
gaggccauugcaccguuauccuggaaacugaggcagacacuccagccccuuucuggg

SEQ ID NO: 395478 - RNA, 57 nt, Human
cauggugcagccuccggguacaaacaucugaggcacuggcgaucccaguccuugcag

SEQ ID NO: 395479 - RNA, 57 nt, Human
cgccuauaaucccagcuauucuggaggcugaggcaggaaucgcuugaaauuggaaag

SEQ ID NO: 395480 - RNA, 57 nt, Human
cgacuguagucccagcuacucgcgaggcugaggcaggagaauggcgugaauccggga

SEQ ID NO: 395481 - RNA, 57 nt, Human
cgccuguagucccagcuacuugggaggcugaggcaggagaauugcuugaacccagga

SEQ ID NO: 395482 - RNA, 57 nt, Human
gcauuuuuaggaauggaaagcaggccucugaggcaguggacaggaagacuucucauc

SEQ ID NO: 395483 - RNA, 57 nt, Human
aucuucugcugacccucuuccucucugcugaggcagcugccuccugauccuggccag

SEQ ID NO: 395484 - RNA, 64 nt, Human
accacccacccuuucauuucccccccagaagccuaaggccuaauagcugaaugaaauaccuguc

SEQ ID NO: 395485 - RNA, 56 nt, Human
aagaaaaggggcuuuucuaaagcaagaaggccuauaccuauugcaaggccacagaa

SEQ ID NO: 395486 - RNA, 64 nt, Human
gugagcuuaaaacuagucaagcaguuuagaaccaaaggccuauauuaauaaccgcaacuaugcu

SEQ ID NO: 395487 - RNA, 57 nt, Human
cgccuguaaucccaguuacuuaggaggcugaggcaggagaaucacaucaaccuggga

SEQ ID NO: 395488 - RNA, 57 nt, Human
caccuguaaucccagcacuuuggggggcugaggcagguggaucacuugaggucagga

SEQ ID NO: 395489 - RNA, 57 nt, Human
cgccuguaaucccagcuacucaggaggcugaggcacgagacuugcuugaacccagga

SEQ ID NO: 395490 - RNA, 57 nt, Human
cgucacccaacgacccaugaccguucucugaggcaaaggagggcaaccugacagcaa

SEQ ID NO: 395491 - RNA, 57 nt, Human
agccccaaggggcccugaggguaaggacugaggcacugagggucccucccuauacuc

SEQ ID NO: 395492 - RNA, 57 nt, Human
uaccuaacucccaaccccugcccugggcugaggcauaugaaugcuauaguugugcau

SEQ ID NO: 395493 - RNA, 57 nt, Human
cgccuguaaucccagcugcucaggaggcugaggcaggagaaucgcuugaacccggga

SEQ ID NO: 395494 - RNA, 57 nt, Human
cgccuguaaucccagcacuuugggaggcugaggcaggcagaucaccugaggcuagga

SEQ ID NO: 395495 - RNA, 57 nt, Human
gccuguagucccagcuacucggagaggcugaggcaggagaauggcgugaacccggga

SEQ ID NO: 395496 - RNA, 57 nt, Human
cucccguagucccagcuacucgggaggcugaggcaggagaaucacuugagccuggga

SEQ ID NO: 395497 - RNA, 57 nt, Human
cgccuguagucccagcuacucuggaggcugaggcaggagaauggcgugaacccagga

SEQ ID NO: 395498 - RNA, 57 nt, Human
caccuguagucccagcuacuggggaggcugaggcaggagaaugguguaaaacccagg

SEQ ID NO: 395499 - RNA, 57 nt, Human
gaaggucaacccaccugcccaucugugcugaggcauguuccugccuaccauccuccu

SEQ ID NO: 395500 - RNA, 57 nt, Human
aucgucuccucuuccaaucaggcccugcugaggcaggggaccucugcccgagaccug

SEQ ID NO: 395501 - RNA, 57 nt, Human
cgccuguagucccagcuacucuggaggcugaggcaggagaaucaauugaacccggga

SEQ ID NO: 395502 - RNA, 57 nt, Human
ucuguuuuuuccaagugccacgugggacugaggcagacacucccagucagcccgcuc

SEQ ID NO: 395503 - RNA, 60 nt, Human
aguaacccucauauuuuaaugguguuacagcauuugcaaaaauuauucugcuaaguauuu

SEQ ID NO: 395504 - RNA, 60 nt, Human
gguacugugugguggauacaugacaauauccauuugcaaacacaagaacuauacacaugg

SEQ ID NO: 395505 - RNA, 60 nt, Human
auugacagggaggaucaaauuccugacuuacauuugcacuggcuucuuguuuaggcugaa

SEQ ID NO: 395506 - RNA, 57 nt, Human
ugccuguggucucagcuauucaggaggcugaggcaggagaaucacuugagaccagga

SEQ ID NO: 395507 - RNA, 57 nt, Human
ugccuguaacuccagauacuugggaugcugaggcaggagaaucgcuugaauaugaga

SEQ ID NO: 395508 - RNA, 57 nt, Human
ugccuguaauaucagcuacucaggaggcugaggcaggagaauugcuugaacccagga

SEQ ID NO: 395509 - RNA, 57 nt, Human
caccuguagucccagcuacucuggaggcugaggcaggggaaucgcuuaaacccagga

SEQ ID NO: 395510 - RNA, 57 nt, Human
cgccuguaaucccagcuacuuaggaggcugaggcaggagaaucgcuugaacccagga

SEQ ID NO: 395511 - RNA, 57 nt, Human
ugccacagggcagagcaggucuggggccugaggcagggagaaugagaggccaccuua

SEQ ID NO: 395512 - RNA, 57 nt, Human
cgccuguaaucccagcuacugagggggcugaggcaugagaaucacuugaaccuggga

SEQ ID NO: 395513 - RNA, 57 nt, Human
caccugaaaucuuagcacuucgggaggcugaggcagguggaucacuugagguuagga

SEQ ID NO: 395514 - RNA, 57 nt, Human
ugccuuuaaacccagcuacugaggaggcugaggcaugagaauugcuugaaccaggag

SEQ ID NO: 395515 - RNA, 57 nt, Human
ugccuguaaucccagcuucuugggaagcugaggcacaagaauugccugaacccagga

SEQ ID NO: 395516 - RNA, 57 nt, Human
guuguagcuaauguucuccuagaaucacugaggcaccaauggcugagcaggaagggc

SEQ ID NO: 395517 - RNA, 57 nt, Human
ugccuguaaucccagcuacucgggaggcugaggcaggaaaaucacuugaacccggga

SEQ ID NO: 395518 - RNA, 57 nt, Human
caccugugaucccagcuacucaggaggcugaggcaggagaauuacuugaaccuggga

SEQ ID NO: 395519 - RNA, 57 nt, Human
uggcugugguccuaguuacuugggaggcugaggcaggagaauggcuugaacugggga

SEQ ID NO: 395520 - RNA, 57 nt, Human
cgccuguaaucccagcuacuugggaggcugaggcaggagaaucgcuugaaucuggga

SEQ ID NO: 395521 - RNA, 57 nt, Human
cacuuuuaaucccagcuacucgggaggcugaggcaggagaauugcuugaaccuggga

SEQ ID NO: 395522 - RNA, 64 nt, Human
cauaauuaagagaucaacuggcuggaagcagaucaaggccuaacuucauucaagaccuaaauau

SEQ ID NO: 395523 - RNA, 64 nt, Human
acucugaaugaccgugcuugaccuguuuucuuaaaaggccuacguccuccauggaagugccagc

SEQ ID NO: 395524 - RNA, 64 nt, Human
uaucuuguuguuagcauuuguaauaaugcuaaaaaaggccuaauaaaaugcccaagaaaauauu

SEQ ID NO: 395525 - RNA, 57 nt, Human
caccugucgucccagcuacuagggaggcugaggcaggagaauggugugaacccagga

SEQ ID NO: 395526 - RNA, 57 nt, Human
aaccuguaaucccagcuacaggggaggcugaggcaggagaaucgcuugaacccggga

SEQ ID NO: 395527 - RNA, 57 nt, Human
aggggcuucagccugucccgggguugccugaggcagagcaagacggguucucacccc

SEQ ID NO: 395528 - RNA, 57 nt, Human
ugagcagacggccuguggucccugggccugaggcacggacucguagcaccaggguuu

SEQ ID NO: 395529 - RNA, 57 nt, Human
gcauugaccagaaaaauugaaaguguucugaggcacauagcagaggagcugcagauu

SEQ ID NO: 395530 - RNA, 57 nt, Human
caccuguaaucccagcuacuagggaggcugaggcaggagaauugcuugaaccuggga

SEQ ID NO: 395531 - RNA, 57 nt, Human
cgccuguagucccagcuacucgggaggcugaggcaggagaauggcgugaacccagga

SEQ ID NO: 395532 - RNA, 57 nt, Human
ugccgauaaucccagcaauucagaaagcugaggcaggaggauuacuugaggccagac

SEQ ID NO: 395533 - RNA, 57 nt, Human
cgcacaagagccccugcccugcccuagcugaggcacacagggagacccagugaggau

SEQ ID NO: 395534 - RNA, 57 nt, Human
ugccuguaaucccagcauuuugggaggcugaggcagguggaucaccugaggucagca

SEQ ID NO: 395535 - RNA, 57 nt, Human
cucagcccaauucgggcccuccaauuacugaggcauacguaacagauguaagugcuu

SEQ ID NO: 395536 - RNA, 57 nt, Human
gccucagagaagagagaaccugaagaucugaggcaagcuggacaggagagguggaua

SEQ ID NO: 395537 - RNA, 57 nt, Human
uucagcccaauucggguccuccaauuacugaggcauacguaacaguuguaagugcuu

SEQ ID NO: 395538 - RNA, 57 nt, Human
cgccuguaaucccaacuacuugggaggcugaggcaggagaaucucuugaacccagga

SEQ ID NO: 395539 - RNA, 57 nt, Human
caccuguagucccagcuacucaggauccugaggcaugagaauugcuugaaccuggga

SEQ ID NO: 395540 - RNA, 57 nt, Human
ugccuguaaucccaccuacucgagaggcugaggcagcagaauugcuugaacccggga

SEQ ID NO: 395541 - RNA, 64 nt, Human
uggagggaauugggaacagugucacugggaagugaaggccuagcccuguggcuuccaccagucu

SEQ ID NO: 395542 - RNA, 64 nt, Human
gagcccccagaacgagacccuguacucugucuuaaaggccuaaccaauggacagcccucucaag

SEQ ID NO: 395543 - RNA, 64 nt, Human
guuuuugcuuuugucuuaauauaucagauaugcaaaggccuaaacugagaauuaaucuaaaagu

SEQ ID NO: 395544 - RNA, 57 nt, Human
cgcuuguaaucgcagcacuuugggaggcugaggcaggaggaucacuugagcccagga

SEQ ID NO: 395545 - RNA, 57 nt, Human
cuccuugcccccaaggaugaggcuggacugaggcaaagggcuggccacaccaccuga

SEQ ID NO: 395546 - RNA, 57 nt, Human
auuuuucccagaagcugcugccucuuccugaggcagaaaauuggauuacuaaggcuc

SEQ ID NO: 395547 - RNA, 57 nt, Human
agccuaguggaaggugcugagggggcccugaggcaggaccgcccuccugaccccugg

SEQ ID NO: 395548 - RNA, 57 nt, Human
gccacggccccugcaaggaaauagaugcugaggcagucuuccugccagcgagcccac

SEQ ID NO: 395549 - RNA, 57 nt, Human
caccuguaauccuagcuacucgggaggcugaggcaggagaauugcuugaacccagga

SEQ ID NO: 395550 - RNA, 57 nt, Human
ugccuguagucccagcuacuugggaggcugaggcaggagaauuuuuugagcccagga

SEQ ID NO: 395551 - RNA, 57 nt, Human
uccccacuccauuuucagaugaggaaacugaggcaugggccauuuauuuuccucgga

SEQ ID NO: 395552 - RNA, 57 nt, Human
gcucccagggaagcgggggauggggcgcugaggcaggguuguuagaggacuguguca

SEQ ID NO: 395553 - RNA, 51 nt, Human
uuauccgccuccuggcauagacugaggcaggagcuggccgggcaagggugg

SEQ ID NO: 395554 - RNA, 57 nt, Human
cgccuguagucccagcuacucgggaggcugaggcaggaggaucgcuugagcccaaga

SEQ ID NO: 395555 - RNA, 57 nt, Human
cugaggccuguauggaacucuugguugcugaggcaaccauggaccuguugcuaggag

SEQ ID NO: 395556 - RNA, 57 nt, Human
ugccuguaaucccagcuacuagggaggcugaggcaggagaaucacucgaacccggga

SEQ ID NO: 395557 - RNA, 57 nt, Human
ugccuguaaucccagcacuuugggaggcugaggcagguggaucacuggaggucagga

SEQ ID NO: 395558 - RNA, 57 nt, Human
ggccuguaaucccagcuacuugggaggcugaggcagaacugcuugaacccaggaggu

SEQ ID NO: 395559 - RNA, 57 nt, Human
gccgucuccacucccuaggcaaguucucugaggcagaaggggguucccuguucccag

SEQ ID NO: 395560 - RNA, 64 nt, Human
cgugagaaacagcacacguuagaggcuuugagagaaggccuaguucugucaugaguagucggcc

SEQ ID NO: 395561 - RNA, 64 nt, Human
gaaccauugcuggaucucagauucuguggcaucuaaggccuagcaggggugggcacacggguca

SEQ ID NO: 395562 - RNA, 64 nt, Human
gacaggcugcucucgcugacccuucuggccuucgaaggccuaaacacagcugccuccaaggacc

SEQ ID NO: 395563 - RNA, 57 nt, Human
caccuguaguccuagcuacuugggaggcugaggcaggagaauugcuugaacccagga

SEQ ID NO: 395564 - RNA, 57 nt, Human
cgccuguagucccagcugcucaggaggcugaggcaggagaauggcguaaaccccucc

SEQ ID NO: 395565 - RNA, 57 nt, Human
ugccuguaaucccagcuacuugggagacugaggcaagagaaucacuugaacccggga

SEQ ID NO: 395566 - RNA, 57 nt, Human
ugcccauaaucccagcccuuugggaagcugaggcaggaggauugagaccaggaguuc

SEQ ID NO: 395567 - RNA, 57 nt, Human
ugaaauugaagucccaauuuaagaguccugaggcagaaccugguggcuggaggcauu

SEQ ID NO: 395568 - RNA, 57 nt, Human
agcaucucacaugccccaucaccaacucugaggcaccuggggugggggggcggagcc

SEQ ID NO: 395569 - RNA, 57 nt, Human
gccuguaaucccagcuacccggggaggcugaggcaggagaauugcuugaacucagaa

SEQ ID NO: 395570 - RNA, 57 nt, Human
caccuguagucccagcuacucgggaggcugaggcaggagaauggcgugaacccagga

SEQ ID NO: 395571 - RNA, 57 nt, Human
ugccuguaaucccagcuacucaggaggcugaggcaggagaaucacuugaacccagga

SEQ ID NO: 395572 - RNA, 57 nt, Human
gcccaugcccuccuggugccccuggcacugaggcacagaucgucaaggcagguaccc

SEQ ID NO: 395573 - RNA, 57 nt, Human
uuuuuucuugcuaauaaauuuaguugccugaggcaaaaucuucaacuuggcaguucg

SEQ ID NO: 395574 - RNA, 57 nt, Human
cgucugucaucccagcagcucuuaaggcugaggcacaagaauugcuugaacccggga

SEQ ID NO: 395575 - RNA, 57 nt, Human
guaguuuuuguaguuuuauauuggauacugaggcauuagggaggcaugaaaggaaga

SEQ ID NO: 395576 - RNA, 57 nt, Human
gugccuguaauccagcuacuugggagacugaggcaggagaauugcuugaacccagga

SEQ ID NO: 395577 - RNA, 57 nt, Human
ugccuguaaucccaacacuuugggaggcugaggcaggcggaucacgaggucaggaga

SEQ ID NO: 395578 - RNA, 57 nt, Human
ccccuguagucccagcuacucgggaggcugaggcaggagaaucguuugaaccuggga

SEQ ID NO: 395579 - RNA, 64 nt, Human
aguaaguauaaaaauagauauuggauucugucagaaggccuagauuugaaauaauguuuuguac

SEQ ID NO: 395580 - RNA, 64 nt, Human
gaauugaaaccuauuacaauuaauaggguucucaaaggccuauuccuauuagaagaaauaauuu

SEQ ID NO: 395581 - RNA, 64 nt, Human
gccugaggguauuuuaaagaaaaaaacuacauaaaaggccuaaaaguaagacccacaaggauau

SEQ ID NO: 395582 - RNA, 57 nt, Human
caugugccuguaaucccagcuaggaggcugaggcaggagaaucacuggaaccuggga

SEQ ID NO: 395583 - RNA, 57 nt, Human
cgccuguaaucccagcuacuggggaggcugaggcaggagaauggcaugaacccggga

SEQ ID NO: 395584 - RNA, 57 nt, Human
ggugauggcccuuuugcuccuggcagccugaggcacagcugccuguauuguccucau

SEQ ID NO: 395585 - RNA, 57 nt, Human
uaccuguaguccuagcuacuugggaggcugaggcaggagaauggcgugaaccuggga

SEQ ID NO: 395586 - RNA, 57 nt, Human
augggucaagcaagcggccacaagggacugaggcaagcacaaugguuucaaagaaag

SEQ ID NO: 395587 - RNA, 57 nt, Human
ugccuguaauccuagcugcucgggaggcugaggcaggagaaucacuugaacuuggga

SEQ ID NO: 395588 - RNA, 57 nt, Human
cgccuguaaucccagcuacucaggaggcugaggcaggagaaucgccugaaccuggga

SEQ ID NO: 395589 - RNA, 57 nt, Human
gggcugugggcaugcagggaaguggcucugaggcagucugcgcuguggcccugccuc

SEQ ID NO: 395590 - RNA, 57 nt, Human
ucagggagccccacagccccaagcucgcugaggcaacgugagaacaggcuaugggaa

SEQ ID NO: 395591 - RNA, 57 nt, Human
cgccuguaaucccagcuacucgggaggcugaggcaggagaauugcuucaaccuggga

SEQ ID NO: 395592 - RNA, 57 nt, Human
cgccucuaaucccagcuacucgggaggcugaggcaggagaaucacuugaacccggga

SEQ ID NO: 395593 - RNA, 57 nt, Human
caccuguaaucccagcuacuugggaggcugaggcaggagaaucucuugaacccagga

SEQ ID NO: 395594 - RNA, 57 nt, Human
gaaacuuccaggcguggacagcccagccugaggcauuccagugcuggggcaccgucg

SEQ ID NO: 395595 - RNA, 57 nt, Human
ugccuguaaucccagcuacucaggaggcugaggcaggaaaaucacuugaacucggga

SEQ ID NO: 395596 - RNA, 57 nt, Human
cgccuauaaucccagcuacuugggaggcugaggcaggagaauugauugaaccuggga

SEQ ID NO: 395597 - RNA, 57 nt, Human
gccccuauauccuuaacccauacuccucugaggcaaacaggcaugggaaaauggaag

SEQ ID NO: 395598 - RNA, 64 nt, Human
aaaacugcauuaugcaaaaauuuuguacaguguuaaggccuaaaaacugugugguucagagacu

SEQ ID NO: 395599 - RNA, 64 nt, Human
auguuuuguucaccggauauguuggguagcagaaaaggccuagaaccaguuuuaagauuaugcc

SEQ ID NO: 395600 - RNA, 64 nt, Human
cgucgaacuaggccucaaaaacauacguaacgaaaaggccuagcgaggcaaauucugauugauu

SEQ ID NO: 395601 - RNA, 57 nt, Human
caccuguagucccaacuauucggcaggcugaggcaguagaaucgcuugaaccuggga

SEQ ID NO: 395602 - RNA, 57 nt, Human
cgccuguagacccggcuacucaggaggcugaggcaggagaauugcuugaacccggga

SEQ ID NO: 395603 - RNA, 57 nt, Human
uuugugaugaugguuugguuuccagaccugaggcaucgaaugggcuaaaggucagcc

SEQ ID NO: 395604 - RNA, 57 nt, Human
uaaagucugaggagcagauccaaagggcugaggcagggaggccgugggccaugggga

SEQ ID NO: 395605 - RNA, 57 nt, Human
cgccuguagucccagcuacucgggaggcugaggcaggagaauggcgugaacccggga

SEQ ID NO: 395606 - RNA, 57 nt, Human
acuccccaccccagagucccacauucccugaggcaggucacacgucucuuuaugaug

SEQ ID NO: 395607 - RNA, 57 nt, Human
caccuguagucccagcuacucaggaggcugaggcaggagaauugcuugaacccagga

SEQ ID NO: 395608 - RNA, 57 nt, Human
cccuuuagggaaauucaaagcaggguucugaggcaaauggcacauggcuggcacuga

SEQ ID NO: 395609 - RNA, 57 nt, Human
cgccuguagucccagguacuugggagccugaggcaggaggauugcuugagcucagga

SEQ ID NO: 395610 - RNA, 57 nt, Human
cgccuguaaucccagcacuuugggaggcugaggcaggcggaucaccugaagucagaa

SEQ ID NO: 395611 - RNA, 57 nt, Human
ugccuguaaugccagcuacuccagaggcugaggcaagagaaucacuugaacccggga

SEQ ID NO: 395612 - RNA, 57 nt, Human
cccagucuuccuucaagacuagacucacugaggcauuuucccuaaaucaaccgguag

SEQ ID NO: 395613 - RNA, 57 nt, Human
caugguggcacacaccuguaaucguagcugaggcaggagaaucgccugaacccagga

SEQ ID NO: 395614 - RNA, 57 nt, Human
cgccugaaaucccagcuacucaagaggcugaggcaggagaaucgcuugaaccuggga

SEQ ID NO: 395615 - RNA, 57 nt, Human
cgccuguagucccagcuacucgggaggcugaggcaggagaaucgcuugaaccugaga

SEQ ID NO: 395616 - RNA, 57 nt, Human
ggacgugaaagcagcuuuugggggaaacugaggcaguggggaagacagagcagaaug

SEQ ID NO: 395617 - RNA, 64 nt, Human
caaaauuuaguugaacugguuuuucaguuuuuaaaaggccuacagaugaguaaugaaguuaucu

SEQ ID NO: 395618 - RNA, 64 nt, Human
aucuuauuuuuacucguccguugaaaagauaaucaaggccuacauuuuagcugaggauaaugaa

SEQ ID NO: 395619 - RNA, 64 nt, Human
gggaguuuggcaagaauggagaaaaugaaugaagaaggccuaaucucucucuuuuucagugaau

SEQ ID NO: 395620 - RNA, 57 nt, Human
gaauauacguaaauuuucucuggaaggcugaggcacacuucaccaucaacaugaauu

SEQ ID NO: 395621 - RNA, 57 nt, Human
guagugcccuauuuuacaauuguaaaacugaggcacgagcaaagugaagacacuggc

SEQ ID NO: 395622 - RNA, 57 nt, Human
uucccuucucaaagcaagaagggagcgcugaggcaugaagcccuggggaaacuggca

SEQ ID NO: 395623 - RNA, 57 nt, Human
cgccugaagucccagcuacucaggaggcugaggcaagagaaucacuugaacccagga

SEQ ID NO: 395624 - RNA, 57 nt, Human
ugccuguagucccagcuacucgggaggcugaggcaggagaaugacgugaacccagga

SEQ ID NO: 395625 - RNA, 57 nt, Human; identical to SEQ ID NO: 394748

SEQ ID NO: 395626 - RNA, 57 nt, Human
ugagggagagggagaggggacccgaggcugaggcauaaguggcaggauuucgggaag

SEQ ID NO: 395627 - RNA, 57 nt, Human
cacuuguagucccagcuacuuggcaggcugaggcagaagaaucaccugaacccggga

SEQ ID NO: 395628 - RNA, 57 nt, Human
caccuguagucccagcuacuugggagccugaggcaggagaaucgcuugaaccuggga

SEQ ID NO: 395629 - RNA, 57 nt, Human
ggcagcuccugcccccgccuucccucacugaggcagggcuagcaggggugggaggca

SEQ ID NO: 395630 - RNA, 57 nt, Human
agguuucuugucaguuuguuguggggucugaggcacaugggagugggaccagcagaa

SEQ ID NO: 395631 - RNA, 57 nt, Human
cgccuguaaucccagcuacuggggaggcugaggcagaagaaucgcuugaacccagga

SEQ ID NO: 395632 - RNA, 57 nt, Human
aagggcccuccccagcuacucgggaggcugaggcaggagaaucgcuugaacucagga

SEQ ID NO: 395633 - RNA, 57 nt, Human
cgccuguagucccagcuacuugggaggcugaggcaggagaauggccugaacccggga

SEQ ID NO: 395634 - RNA, 57 nt, Human
cgccuguaaucccagcacuuugggaggcugaggcaggugguucacuggagguugagu

SEQ ID NO: 395635 - RNA, 56 nt, Human
ggcgggaugaugagaagugacugcggcugaggcaaagcugcucccaaggccucccu

SEQ ID NO: 395636 - RNA, 59 nt, Human
ucuacaacaccugccagugaccccugcccaaggccuaccccaguuccuagcacugcccc

SEQ ID NO: 395637 - RNA, 64 nt, Human
acugaggaagcuacaacacagugaagacccaaggaaggccuaugaaaagguccugaugcccaac

SEQ ID NO: 395638 - RNA, 64 nt, Human
aaaaguuuugaaggaaaccucuggauaaauggacaaggccuaauuuuuuuuuguagucaaucca

SEQ ID NO: 395639 - RNA, 57 nt, Human
ugccuguagucccagcuacucgggaggcugaggcaggggaauugcuugaacccggga

SEQ ID NO: 395640 - RNA, 57 nt, Human
caucuguaauaccagcuacuugggaggcugaggcagaagaaucacuugaacccggga

SEQ ID NO: 395641 - RNA, 57 nt, Human
caccuguagucccagcuacuugggaggcugaggcaggagaauggcgugaacccggga

SEQ ID NO: 395642 - RNA, 57 nt, Human
cagaauugucgugcuuugagaaaacaccugaggcagugugggaguugaacgacccug

SEQ ID NO: 395643 - RNA, 57 nt, Human
agguaucagaaguguuaagugacaugccugaggcaccccccuaacaggugucagagc

SEQ ID NO: 395644 - RNA, 57 nt, Human
ugccuguagucccagccacucagaaggcugaggcaggaggaucgcuugagaccaaga

SEQ ID NO: 395645 - RNA, 57 nt, Human
agcaagugccuauaauaccagcugaggcugaggcaggagaaucccuugagcccggga

SEQ ID NO: 395646 - RNA, 57 nt, Human
ugacuguaaucccagcuacucaggaggcugaggcaggagaaucgcuugaauccagga

SEQ ID NO: 395647 - RNA, 57 nt, Human
aucaugagcguuuucuccacugugcaccugaggcagaucaugcaucuuugagugcag

SEQ ID NO: 395648 - RNA, 57 nt, Human
ucuaacucugcuuagcugcuaauaauccugaggcauagaaauugaagaauuuguaaa

SEQ ID NO: 395649 - RNA, 57 nt, Human
caccuguaaucccagcuacucaggaggcugaggcaggagaauuacuuuaaccugcgg

SEQ ID NO: 395650 - RNA, 57 nt, Human
caccuguagucccagcuacacgggaggcugaggcaggagaauggcaugaaccuggga

SEQ ID NO: 395651 - RNA, 57 nt, Human
cgccuguaaucccagcuacucaggaggcugaggcaggagaauaacuugaacccagga

SEQ ID NO: 395652 - RNA, 57 nt, Human
cgccuguagucccaacuacucaggaggcugaggcaggagaauggugugaacccggga

SEQ ID NO: 395653 - RNA, 57 nt, Human
ugccuguaaucccagcuacuugggaggcugaggcaugagaaucacuuaaaccugaga

SEQ ID NO: 395654 - RNA, 57 nt, Human
ugccuguaaucccagcuacucgggaggcugaggcaggagaacugcuugaacccagga

SEQ ID NO: 395655 - RNA, 64 nt, Human
ucccaaacacugaaaggaaaacgugaaaacacucaaggccuagggggaggacagguugguaaaa

SEQ ID NO: 395656 - RNA, 64 nt, Human
uccuugcagacagaauauaaaaacuccugggcuuaaggccuaaggaagccagucaccuucuggg

SEQ ID NO: 395657 - RNA, 64 nt, Human
aguagacaucccccuccuugccgcugggagagccaaggccuaugccaccugcagcgucugagcg

SEQ ID NO: 395658 - RNA, 57 nt, Human
uuugcuuauauuaaaaacaaaaaauggcugaggcaggaguuugggaccagccugggc

SEQ ID NO: 395659 - RNA, 57 nt, Human
gauuucccuagagcgugauucucccaucugaggcaaucuugccucccaggggaaauu

SEQ ID NO: 395660 - RNA, 57 nt, Human
caccuguagucccagcuacucgggaggcugaggcaggagaauggugugaacccggga

SEQ ID NO: 395661 - RNA, 57 nt, Human
ugccugugaucccagcuacuugggaggcugaggcaggaggaucgccugagcccagga

SEQ ID NO: 395662 - RNA, 57 nt, Human
caccuguaaucccagcacuuugggaggcugaggcaggaggaucacuugaggucagga

SEQ ID NO: 395663 - RNA, 57 nt, Human
caccuguaaucccagcuacuugggaggcugaggcaggagaauucuuugaacccagga

SEQ ID NO: 395664 - RNA, 57 nt, Human
ugccuguauucacagcugcuuggauggcugaggcaggagaaucgcuugaacccagga

SEQ ID NO: 395665 - RNA, 57 nt, Human
ugccuguagucccagcuacucgggaggcugaggcaggaggaucgcuugaacccagga

SEQ ID NO: 395666 - RNA, 57 nt, Human
cgccuuuaaucccagcuacucgggaggcugaggcaggagaaucacaugaauccagga

SEQ ID NO: 395667 - RNA, 57 nt, Human
cgccuguaaucccagcuacucaggagacugaggcagaaggaucgcuugaaccuggga

SEQ ID NO: 395668 - RNA, 57 nt, Human
ugccuguagucccagcuaacugggaggcugaggcaggaggaucacuugagcccagga

SEQ ID NO: 395669 - RNA, 57 nt, Human
ugccuguaaucccagcuacucgggaggcugaggcaggagaauugcuugaacccggga

SEQ ID NO: 395670 - RNA, 57 nt, Human
caccuguagucccagcuacucgggaggcugaggcaggagaaucguuugaaccuggga

SEQ ID NO: 395671 - RNA, 57 nt, Human
ugccuguaaucccagcuacucaggaggcugaggcaggaaaauugcaugaaccuaagu

SEQ ID NO: 395672 - RNA, 57 nt, Human
caccuguagucccaguuacucgggaggcugaggcaggagaaucgcuugaacccggga

SEQ ID NO: 395673 - RNA, 57 nt, Human
cauccaguuauucaucugacugccuaccugaggcaagcaccacacuuaccacuguau

SEQ ID NO: 395674 - RNA, 64 nt, Human
ccgagaccauccuccuugcaccuuugugccaagaaaggccuaugaaaaguaaacacugacuuuu

SEQ ID NO: 395675 - RNA, 64 nt, Human
gguaaauaguauacauuuuauaagcuauauuuuaaaggccuaagaacauggcaaguauuuacuu

SEQ ID NO: 395676 - RNA, 64 nt, Human
uuaucuggagcccaagaaagauggcucauuuggaaaggccuaauaucccaaguugcuuaccuag

SEQ ID NO: 395677 - RNA, 57 nt, Human
gccugugguggccagcuacucaggaggcugaggcaggagaauggcgugaacccggga

SEQ ID NO: 395678 - RNA, 57 nt, Human
cgcuugcaaucccagugcuuugggagacugaggcaggaggaucacuuaaggccagga

SEQ ID NO: 395679 - RNA, 57 nt, Human
ugccuguaauccgagugcuuugggaggcugaggcaggaggaucacucgagcucaaga

SEQ ID NO: 395680 - RNA, 57 nt, Human
cacuuguaguccgagcuacucgggaggcugaggcagaagaaucgcuugaacccagga

SEQ ID NO: 395681 - RNA, 57 nt, Human
ugccuguaaucccagcuacuccggaagcugaggcaggagaauggcuugaacccagga

SEQ ID NO: 395682 - RNA, 57 nt, Human
caccuguaaucccagcuacucgggaggcugaggcaagagaaucacuugaacccagga

SEQ ID NO: 395683 - RNA, 57 nt, Human
uaucaucccauuuuacaggggaggauacugaggcacacagaggggagucaccagcca

SEQ ID NO: 395684 - RNA, 57 nt, Human
guggccggcacugggcagccccuuggacugaggcaguuuugguggaugggggaccuc

SEQ ID NO: 395685 - RNA, 57 nt, Human
ugccuguaaucccagcuauuugggaggcugaggcaggagaaucgcuugaaccaggga

SEQ ID NO: 395686 - RNA, 57 nt, Human
acuccccacagcagcagagacucgggacugaggcauccucuguucacaggacaugcu

SEQ ID NO: 395687 - RNA, 57 nt, Human
cuccuguaaucccagcugcucgggaggcugaggcaggagaaucacuugaaucuagga

SEQ ID NO: 395688 - RNA, 57 nt, Human
gugccuguaaucccagcugcuggggggcugaggcaggaggaucaguugaacguggga

SEQ ID NO: 395689 - RNA, 57 nt, Human
cauuuguaaucccagcuacacaggaggcugaggcaggagaauugcuugaaccugggg

SEQ ID NO: 395690 - RNA, 57 nt, Human
ucuugccguuuaugucacugacaguuucugaggcagaagccguaucaugucuaccac

SEQ ID NO: 395691 - RNA, 57 nt, Human
cgccuauagucccagccacuugggaggcugaggcaggagaaucgcuugaacccagaa

SEQ ID NO: 395692 - RNA, 57 nt, Human
cuccuguagucccagcuacucaggaggcugaggcaggagaauggcgcgaacauggga

SEQ ID NO: 395693 - RNA, 64 nt, Human
cuucaaguuucagcaacuaccuacaaaagauucuaaggccuaguaguauuuaaacuaaguuuca

SEQ ID NO: 395694 - RNA, 64 nt, Human
ugaagauccccauucuuucucuuugaaaaaaaaaaaggccuaaugcauuauuuugucauaaaau

SEQ ID NO: 395695 - RNA, 64 nt, Human
uugccacaacagcucaaaucucagaauaggaucaaaggccuagaaagacuccuaaaguauagga

SEQ ID NO: 395696 - RNA, 57 nt, Human
gguaucccgacuuggaagaugaggaaacugaggcacacggccuggccuggcuucaca

SEQ ID NO: 395697 - RNA, 57 nt, Human
caccuguagucccagcaacucgggaggcugaggcaggagaauggcgugaacuuggga

SEQ ID NO: 395698 - RNA, 57 nt, Human
ugccuauaaucccagcuacucgggaggcugaggcaggagaaucgcuugaacccggga

SEQ ID NO: 395699 - RNA, 57 nt, Human
caggugucuguuaucccaguuaggaggcugaggcaagagaaucucuugaaccugaga

SEQ ID NO: 395700 - RNA, 57 nt, Human
cgccuguagucccagcuacuugguaggcugaggcaggagaauggcgggaacccggga

SEQ ID NO: 395701 - RNA, 57 nt, Human
ugccuguaaucccagcuacuugggaagcugaggcaggagaaucgcuugaaccagaga

SEQ ID NO: 395702 - RNA, 57 nt, Human
agccuguugucccagcuguuccguaggcugaggcacgagauucacuugaaccuggga

SEQ ID NO: 395703 - RNA, 57 nt, Human
cugccuguaauccagcuacucaggaggcugaggcaggauaauuuugcuuaaacccgg

SEQ ID NO: 395704 - RNA, 57 nt, Human
ccccagaccuaccucaccuacuaggaccugaggcagcuccuuagcagagaccccugg

SEQ ID NO: 395705 - RNA, 57 nt, Human
caccuguaaucccagcuacuugggaggcugaggcaagugaaucacuugaacccagga

SEQ ID NO: 395706 - RNA, 57 nt, Human
ugccuguaaucccagcuacucaggaggcugaggcaggauaaucacuugaauccggga

SEQ ID NO: 395707 - RNA, 57 nt, Human
caccuguagucccagcuacucuggaggcugaggcaggggaauggcucgaacacagga

SEQ ID NO: 395708 - RNA, 57 nt, Human
cgucugugguccuagcuccucgggaggcugaggcaggagaaucgcuugaacucggga

SEQ ID NO: 395709 - RNA, 57 nt, Human
gaggagggccaggagaguuccagggggcugaggcacacagagaggccaacuuccucc

SEQ ID NO: 395710 - RNA, 57 nt, Human
ugccuguaaucccagcuacuugggaggcugaggcaggagaaucacuugagcccagga

SEQ ID NO: 395711 - RNA, 57 nt, Human
ugccuguagucccagcuccucaggcugcugaggcaggcgaauugcuugaaccuggga

SEQ ID NO: 395712 - RNA, 64 nt, Human
acccuuuccaucuucaguuugaaugacucccaggaaggccuagagcagacccuuuagaaaucag

SEQ ID NO: 395713 - RNA, 64 nt, Human
uguuaaguauugaaugacuguuucccuuuccuucaaggccuagaguauauucugaaaauuuagg

SEQ ID NO: 395714 - RNA, 64 nt, Human
ccuaaaacuccuuuuaaccaagcuuagcuucucaaaggccuaaccaagccuuggcaccgccaga

SEQ ID NO: 395715 - RNA, 57 nt, Human
ugccuguaaucccagcuacuggggaggcugaggcaggagaaucacuugaauucagga

SEQ ID NO: 395716 - RNA, 57 nt, Human
ugccuauaaucccagcacuuugggaggcugaggcagguggaucaccugagguuagga

SEQ ID NO: 395717 - RNA, 57 nt, Human
ugccuguagucucagcuacuugggacgcugaggcaggaaaauccguugaacccagga

SEQ ID NO: 395718 - RNA, 57 nt, Human
cgccuguagucccagcuaugcgagaggcugaggcaggagaauggcgugaacccggga

SEQ ID NO: 395719 - RNA, 57 nt, Human
aaucccuaaucccagcacuuugggaggcugaggcagggggaucacgaggucaagaga

SEQ ID NO: 395720 - RNA, 57 nt, Human
ugaucgugggcagggagcagagguccgcugaggcagucuguccuugagacuaacaaa

SEQ ID NO: 395721 - RNA, 57 nt, Human
caccuguaauuccagcuacucgggaggcugaggcaggagaauugcuugagcccggga

SEQ ID NO: 395722 - RNA, 57 nt, Human
ugccuguaaucccagcacuuugggaggcugaggcaggcggaucaccugaggucagga

SEQ ID NO: 395723 - RNA, 57 nt, Human
ccaaguuuggggucagaggccgggacacugaggcagcagaacuagugccaggggugg

SEQ ID NO: 395724 - RNA, 57 nt, Human
ugccuguaaucccagcuacucgggaggcugaggcagagaauugcuugaauccgggag

SEQ ID NO: 395725 - RNA, 57 nt, Human
ugccuguaauccuagcuacuugggaggcugaggcaggagaauugcuugaacuuggga

SEQ ID NO: 395726 - RNA, 57 nt, Human
cgcuuguaaucccagcuacucgggaggcugaggcaggagaauugcuugaacccauga

SEQ ID NO: 395727 - RNA, 57 nt, Human
uggguggggcuggggacacaacaaugacugaggcagccuggccuugccuucacaggg

SEQ ID NO: 395728 - RNA, 57 nt, Human
cgccuguaaucccagcuacucaggaggcugaggcagaugaauugcuugaauccagga

SEQ ID NO: 395729 - RNA, 57 nt, Human
cgccuguaaucccagcacuuugggaggcugaggcaggucgaucacgaggucaggcgu

SEQ ID NO: 395730 - RNA, 57 nt, Human
caccuguagucccagcuacucgggaggcugaggcaggagaauggcaugaaccuggga

SEQ ID NO: 395731 - RNA, 64 nt, Human
gaacuuacacuguauauuuugcaauaguuaccucaaggccuacugaccaaauuguuguguugag

SEQ ID NO: 395732 - RNA, 64 nt, Human
cuucuguaguacugagcauuucugacugaucaaaaaggccuagucuguugacaggguuuguuuu

SEQ ID NO: 395733 - RNA, 64 nt, Human
auaauaauguugugaaucuccaugccaagugaaaaaggccuaaagaugaguugaauuugugaua

SEQ ID NO: 395734 - RNA, 57 nt, Human
ugccugugaucccagcuacucaggaagcugaggcagaaagaucccuugacccugaga

SEQ ID NO: 395735 - RNA, 57 nt, Human
ugaucucaaucucagcuacucgggaggcugaggcaggagaaucacuugaacccagga

SEQ ID NO: 395736 - RNA, 57 nt, Human
caccuuuaguuccagcuacuugagaggcugaggcacaagagucgcuuaaaccuggga

SEQ ID NO: 395737 - RNA, 57 nt, Human
ugccuguaguccuagcugcuugggaggcugaggcaggagaauggugugaauccugga

SEQ ID NO: 395738 - RNA, 57 nt, Human
cgccuguagucccagcuacucaggaggcugaggcaggagaauggcaugaaccgagga

SEQ ID NO: 395739 - RNA, 57 nt, Human
ugccuguagucucagcuacuugggaggcugaggcaggagaauugcuugaauccaaga

SEQ ID NO: 395740 - RNA, 57 nt, Human
ugccuguaaucccagcuacuugggaggcugaggcaggagagugcuugaacccaggag

SEQ ID NO: 395741 - RNA, 57 nt, Human
caccuguaaucccagcacuuugggaggcugaggcagguggaucaccugaggucggga

SEQ ID NO: 395742 - RNA, 57 nt, Human
cgccuguaaucccagcuauauaggaggcugaggcaggagaaucacuugaacccagga

SEQ ID NO: 395743 - RNA, 57 nt, Human
cgccuguaaucccagcuacucgggaggcugaggcaggagaaucacuugaaccuggga

SEQ ID NO: 395744 - RNA, 57 nt, Human
caccuguagucccagcuacucaggaggcugaggcaggagaaucgcuugaacccggga

SEQ ID NO: 395745 - RNA, 57 nt, Human
agaaagaaacaggcuggggccuggauucugaggcaggaaggaauuugggucuggagu

SEQ ID NO: 395746 - RNA, 57 nt, Human
ugccuauggucccagcuacucaggaggcugaggcaggagaauugcuucaauccagga

SEQ ID NO: 395747 - RNA, 57 nt, Human
caccuguaaucccagcuacccgggaggcugaggcaggagaauugcuugaaccuggga

SEQ ID NO: 395748 - RNA, 57 nt, Human
ugccuguagucccagcuacucgggaggcugaggcaggagaauggcgugaaccuggga

SEQ ID NO: 395749 - RNA, 57 nt, Human
caucuguagucucagcaacuuaggagccugaggcaggagaaugguuugaacacaggg

SEQ ID NO: 395750 - RNA, 60 nt, Human
uaaaaaacaauuaucccuuacagacuugaacauuugcagacguuaugaucuugcuuccaa

SEQ ID NO: 395751 - RNA, 60 nt, Human
guggccuguguugccacucucagcaccccacauuugcaucugcugguggaccugccacca

SEQ ID NO: 395752 - RNA, 60 nt, Human
ggugcuucugggcacccauccucugcguuucauuugcagucgacuguacagaaggcacuc

SEQ ID NO: 395753 - RNA, 57 nt, Human
ugccuguagucccagcugcuugggaggcugaggcaggagaauucguuaaaccuggga

SEQ ID NO: 395754 - RNA, 57 nt, Human
ugccuguaaucccagcuacuugggaagcugaggcaggagaauugcuugaaccuggga

SEQ ID NO: 395755 - RNA, 57 nt, Human
ucaagcugcaguauacagcgggaaaaacugaggcacuuuggugcuagggguuuggga

SEQ ID NO: 395756 - RNA, 57 nt, Human
ugccuauagucucagcuacuugugaggcugaggcaggaggauucuuugagcccagga

SEQ ID NO: 395757 - RNA, 57 nt, Human
uuaacugcauccagccuggggcugaggcugaggcacuggcgaggagagggcgcuccu

SEQ ID NO: 395758 - RNA, 57 nt, Human
ugccuguauucccagcugcuugggaggcugaggcaggagaauggcuugaaccuggga

SEQ ID NO: 395759 - RNA, 57 nt, Human
ugccucuaguccuagcuacucgggaggcugaggcacgagaaucacuugaaccuggga

SEQ ID NO: 395760 - RNA, 57 nt, Human
auuucucauuucaagccacuggggaaacugaggcaaaaccauacuuagucaucacca

SEQ ID NO: 395761 - RNA, 57 nt, Human
agggcugccccugaucaguuggguggccugaggcaacuccuuuccccgcuucagccc

SEQ ID NO: 395762 - RNA, 57 nt, Human
caccuuagcugcuuagcuggugcuggccugaggcagggcaggaaaucagaauagcau

SEQ ID NO: 395763 - RNA, 57 nt, Human
aacaggccaggagaagugcgugccgagcugaggcagauguucccacagugaccccag

SEQ ID NO: 395764 - RNA, 57 nt, Human
aggcaucagcagucccauucaagucaccugaggcaaagugucugcaucuucguccag

SEQ ID NO: 395765 - RNA, 57 nt, Human
ugcaucuagucccaacuauuugggaggcugaggcaggaggaucgcuugagcccagga

SEQ ID NO: 395766 - RNA, 57 nt, Human
cgccuguaaucccagcuacucaagaggcugaggcaggagaauagcuugaacccggga

SEQ ID NO: 395767 - RNA, 57 nt, Human
uaccuguaaucccagcuacucgggaaccugaggcaggagaauggcuugaacccagga

SEQ ID NO: 395768 - RNA, 57 nt, Human
aacaguucccauuuuagagaugaagaacugaggcacagauuaaaggacuugccugug

SEQ ID NO: 395769 - RNA, 64 nt, Human
agcuagccacucagagaaacuugaauugcuaaagaaggccuaugaagccucccuuucaggcaag

SEQ ID NO: 395770 - RNA, 64 nt, Human
caucccuaugggcuuggaccacuuacagugugauaaggccuacuauacauuaggaaguggcagu

SEQ ID NO: 395771 - RNA, 64 nt, Human
caaggcucaggucaacugccauaggauucugagcaaggccuacuuggcccuggauagaaauugu

SEQ ID NO: 395772 - RNA, 57 nt, Human
caggcaccgcuggccggcagcccugggcugaggcacagacucauuugucaccuucug

SEQ ID NO: 395773 - RNA, 57 nt, Human
ugccuguaaugccagcuacucaggaggcugaggcaugagaaucgcuugaaccgggga

SEQ ID NO: 395774 - RNA, 57 nt, Human
ucacuuaaaacacguuuuaaggacugacugaggcaguuugaggauuaguuuagaaca

SEQ ID NO: 395775 - RNA, 57 nt, Human
ugccuguaaucccaguuacucgagaggcugaggcaggaaaaucgcuugaacccggga

SEQ ID NO: 395776 - RNA, 57 nt, Human
caccuguaguccuagcuucuugggaggcugaggcaggauugcuugagcccaggaguu

SEQ ID NO: 395777 - RNA, 57 nt, Human
cuccuguaaucucagaacuuugggaggcugaggcagguggaucacuugagcucagga

SEQ ID NO: 395778 - RNA, 57 nt, Human
gggcagcugugccugcccugccucugccugaggcagccgcuccugccugagccugga

SEQ ID NO: 395779 - RNA, 57 nt, Human
ugccuguaaucccagcuacuugggaggcugaggcagaauugcuugaacccaggaagc

SEQ ID NO: 395780 - RNA, 57 nt, Human
uccccaucugccaugauuauaaguuuucugaggcauccccagccaugcugaacugug

SEQ ID NO: 395781 - RNA, 57 nt, Human
ugccuguaaucccagcuauucaggaggcugaggcaccagaauugcuugaacccagga

SEQ ID NO: 395782 - RNA, 57 nt, Human
agggucagugcgucagugccuuuucuucugaggcaggaaacaggugccaucuuggcc

SEQ ID NO: 395783 - RNA, 57 nt, Human
cgccugcucuuuccucccauggggccgcugaggcaugagcaccugggcacagguugg

SEQ ID NO: 395784 - RNA, 57 nt, Human
cgccuguagucccagcuacgugggaggcugaggcagcagacuggugugaacccggga

SEQ ID NO: 395785 - RNA, 57 nt, Human
ugccuguaaucccagcacuuugggaggcugaggcagguggaucacgaggucaggaga

SEQ ID NO: 395786 - RNA, 57 nt, Human
cgccuguaaucccagcuacuugggaggcugaggcaggagaaucgcuugacuccagga

SEQ ID NO: 395787 - RNA, 57 nt, Human
accuuuucugccccugccccuuagcuacugaggcauagggagaggaaguuaauuuca

SEQ ID NO: 395788 - RNA, 64 nt, Human
aaucagccccgucucacugcagacaucaacuggcaaggccuagaggagcuacacagugugaaug

SEQ ID NO: 395789 - RNA, 64 nt, Human
guauuuucucacguuuucuaaguuuccguuuugcaaggccuaggugacuuuuucaugguguuug

SEQ ID NO: 395790 - RNA, 64 nt, Human
uggaggguguuuucacgaauguuguuacuggcacaaggccuaagggaugggcacggagcccagg

SEQ ID NO: 395791 - RNA, 57 nt, Human
gugccuuuaaucccagcuacagggaggcugaggcaggagaaucacuugaaccuggga

SEQ ID NO: 395792 - RNA, 57 nt, Human
ugccuauaaucccagcuacucgagugccugaggcaggagaauugcaugaacccggga

SEQ ID NO: 395793 - RNA, 57 nt, Human
caccuguaaucccagcacuuugggaggcugaggcaggcagaucaugaggucaagaga

SEQ ID NO: 395794 - RNA, 57 nt, Human
cgccuguugucuuagcuacucaggaggcugaggcaggagaaucgcuugaaaacagga

SEQ ID NO: 395795 - RNA, 57 nt, Human
ugccuguaaucccagcuacucgggaggcugaggcaggagaauggcuagaacccggga

SEQ ID NO: 395796 - RNA, 57 nt, Human
uucuuauuuucuuggacacagacuauucugaggcacagagcggggacuuaagauggg

SEQ ID NO: 395797 - RNA, 57 nt, Human
ugccucuaguuccagcuacucgggagucugaggcagaggauggcaugugccaggagu

SEQ ID NO: 395798 - RNA, 57 nt, Human
ugccuguaaucccagcuacucgggaggcugaggcaggagaauugcuugaaccuggga

SEQ ID NO: 395799 - RNA, 57 nt, Human
ugccuguaaucccagcuacaugggagccugaggcaugagaaucacuugaacucggga

SEQ ID NO: 395800 - RNA, 57 nt, Human
agcucauccaccauggaggucauuggccugaggcaaguuccccggagagucgggguc

SEQ ID NO: 395801 - RNA, 57 nt, Human
ggugacugaugcugcuuuugcucuucccugaggcaggugucacagccaugugugcuc

SEQ ID NO: 395802 - RNA, 57 nt, Human
cgccuguagucccagcuacuugggaggcugaggcaggagaaugguaugaaccaggga

SEQ ID NO: 395803 - RNA, 57 nt, Human
cuucuuaggcaguugcauauucccagacugaggcagggcagguuugcagagagagac

SEQ ID NO: 395804 - RNA, 57 nt, Human
uacgaacacgccaagauggaagagcaacugaggcacgccaaguucaccaucacggag

SEQ ID NO: 395805 - RNA, 57 nt, Human
uguaucuaguuccagcuacuugagaggcugaggcaggaggauugcuugaguccagaa

SEQ ID NO: 395806 - RNA, 57 nt, Human
cgccuguagucccagcuacucugaagacugaggcaggagaauggcgugaacccagga

SEQ ID NO: 395807 - RNA, 64 nt, Human
acgcaaaaccugcugaaucagaagcucugagaguaaggccuaccaaucugguuuaacaagcccg

SEQ ID NO: 395808 - RNA, 63 nt, Human
aaaaaaucaucuucuucuagaccaaagucuagaaaggccuauguuacugacggaagaaguauu

SEQ ID NO: 395809 - RNA, 64 nt, Human
ggggugagcagguguauuaaaauagcuuacggguaaggccuaaaaggucaccccucggcccccu

SEQ ID NO: 395810 - RNA, 57 nt, Human
cgccuguagucucagcuacucaggaggcugaggcaggagaaucgcuugaacccggga

SEQ ID NO: 395811 - RNA, 57 nt, Human
ugccuguaaucccagcacuuuaagaggcugaggcaggaggaucacuugagcucagga

SEQ ID NO: 395812 - RNA, 57 nt, Human
ugccuguaguccuagcuacuugggaggcugaggcaggagaauugcuugaaucuggga

SEQ ID NO: 395813 - RNA, 57 nt, Human
gcgauggaaauguguuccugccggagucugaggcaccagggugugcucaaaggcugg

SEQ ID NO: 395814 - RNA, 57 nt, Human
uuacagcuguuuacagacaaggcaggccugaggcagauggccacugcucuugugaug

SEQ ID NO: 395815 - RNA, 57 nt, Human
uuggauuguuagggauaggcagcagggcugaggcaagguaggccaacugcaccccug

SEQ ID NO: 395816 - RNA, 57 nt, Human
acaccuguaaucccagcuacucggaggcugaggcacaagaauugcuugaaccuggga

SEQ ID NO: 395817 - RNA, 57 nt, Human
gagagaggcugagggugguggcggccccugaggcagaccaggccaggcuuccccucc

SEQ ID NO: 395818 - RNA, 57 nt, Human
uuucugaagacgcuuccauggugggcacugaggcacagaggaggccaaggagagguu

SEQ ID NO: 395819 - RNA, 57 nt, Human
cgccuguaguuccagcuaacugggcggcugaggcaggagaauggcgugaaccuggga

SEQ ID NO: 395820 - RNA, 57 nt, Human
cgccuguaaucccagcuacuugggaggcugaggcagaagaaucauuugaacccagga

SEQ ID NO: 395821 - RNA, 57 nt, Human
ugccuguagucccagcuacuugggaggcugaggcaggaggaucacuuaagcccagaa

SEQ ID NO: 395822 - RNA, 57 nt, Human
cgccuguagucccagcuacucuggaggcugaggcaggagaguagcgugaacccggga

SEQ ID NO: 395823 - RNA, 57 nt, Human
cccccaggaugacacaggcaagagccccugaggcaugggaggcccagggaagaccau

SEQ ID NO: 395824 - RNA, 57 nt, Human
ggagaggugaggacuggccccggugggcugaggcaggggccgcugucgucaggccug

SEQ ID NO: 395825 - RNA, 57 nt, Human
cgccuauaaucccagcuacucgggaggcugaggcaggagaauaacuuaaacccggga

SEQ ID NO: 395826 - RNA, 64 nt, Human
cucugcaagugucuggagcggcugcucgcccaggaaggccuaggcuaggacguuggccucaggg

SEQ ID NO: 395827 - RNA, 64 nt, Human
ugaucuuggguccucuuuagggggccagacaagaaaggccuacgguuucuggagcaaaccuguc

SEQ ID NO: 395828 - RNA, 64 nt, Human
gagggggugucugcaccaccugggaagauagcacaaggccuaaugaggucacccugacucccca

SEQ ID NO: 395829 - RNA, 57 nt, Human
gaauuaaacgaaaaucauuguuaauugcugaggcaugaaaauuguguuacuauaaug

SEQ ID NO: 395830 - RNA, 57 nt, Human
ugccuguaauccuggcuacuugggaggcugaggcaugagaauugcuugaaccuggga

SEQ ID NO: 395831 - RNA, 57 nt, Human
ugccuguagucccagcuacucaggaggcugaggcaggagaauggcgugaacccagaa

SEQ ID NO: 395832 - RNA, 57 nt, Human
ugcaggccgcuccuacgguccuuuggccugaggcagggcgggaggcaugcaagccag

SEQ ID NO: 395833 - RNA, 57 nt, Human
ugccuguaaucccagcuauucggaaggcugaggcaggagaaucacuugaacccagga

SEQ ID NO: 395834 - RNA, 57 nt, Human
ugccuguaaucccagcuacucgggaagcugaggcaggagaauugcuugaaccaggga

SEQ ID NO: 395835 - RNA, 57 nt, Human
ugacuguaaucccagcuacucaggaggcugaggcaggaggaucacuugaaccuggga

SEQ ID NO: 395836 - RNA, 57 nt, Human
ugccaguaauuccaucuacucgggaggcugaggcaggagaaucgucuaagcccggga

SEQ ID NO: 395837 - RNA, 57 nt, Human
agggucaucgaugcauccugggcugugcugaggcagugcugucucgcucagucuuuc

SEQ ID NO: 395838 - RNA, 57 nt, Human
ugggagcuggcagccugggcaggggggcugaggcacgugguagcccucuuucuguga

SEQ ID NO: 395839 - RNA, 57 nt, Human
ugccuuuaaucccagcuacucgggaggcugaggcacgagaaucacuugaacccagga

SEQ ID NO: 395840 - RNA, 57 nt, Human
uucacccccaccugcccacuugggaaucugaggcagaggagggugaggccugugugc

SEQ ID NO: 395841 - RNA, 57 nt, Human
aguauuccuguuuaacacuugaguaaacugaggcacagagaacauaaguugcaugcc

SEQ ID NO: 395842 - RNA, 57 nt, Human
caccuguaaucccagcuacucaggaggcugaggcaggagaaucgcuuguacccagga

SEQ ID NO: 395843 - RNA, 57 nt, Human
ugcuuguaaucccagcuacucuggaggcugaggcaggagaauugcuugaacccagga

SEQ ID NO: 395844 - RNA, 57 nt, Human
cuucuguuucccucugcugccugggagcugaggcacccgugccaguggcagaggcca

SEQ ID NO: 395845 - RNA, 64 nt, Human
uugacaagucuguagagccuaauaguuuccaucaaaggccuagaucucuuauuuagcauuuuuu

SEQ ID NO: 395846 - RNA, 64 nt, Human
cagacuuacaaagcuaguaguagaauuuuauugaaaggccuagguauuaauuuuuuaaaugagu

SEQ ID NO: 395847 - RNA, 64 nt, Human
ccaauuuaacauguaguguuauuaaaaaauuacaaaggccuagaccagccugggcaacauggug

SEQ ID NO: 395848 - RNA, 57 nt, Human
uguguccucaggaagucacagagucuacugaggcaaggagagggugauucuuucccc

SEQ ID NO: 395849 - RNA, 57 nt, Human
acccucaauggcagccggaaggucccucugaggcagaagcucaagccccauggggac

SEQ ID NO: 395850 - RNA, 57 nt, Human
agcauuuccuuccagcccauccaaacacugaggcagccuuggggaaccccgagcugg

SEQ ID NO: 395851 - RNA, 57 nt, Human
guuggucccaucucucagaccagcucacugaggcagaggaguugcucagaggcucac

SEQ ID NO: 395852 - RNA, 57 nt, Human
ccuggccggcccucugccccugcagagcugaggcagccugggguugauggggaccac

SEQ ID NO: 395853 - RNA, 57 nt, Human
cgccuguaaucucagcuacuagggaugcugaggcaggagaaucgcuugaacccaaga

SEQ ID NO: 395854 - RNA, 57 nt, Human
ccgguccuggacucccgcaggacuccucugaggcagggccugaagucuguacacgug

SEQ ID NO: 395855 - RNA, 57 nt, Human
uaauuuagcuuugugucaccuuugaaucugaggcaguuucccaaacaaaaaggcugg

SEQ ID NO: 395856 - RNA, 57 nt, Human
agacaagauggugacaaugccuugagucugaggcauccucugccugcuuuccugccu

SEQ ID NO: 395857 - RNA, 57 nt, Human
cgccuguaaucccagugacuugggaggcugaggcaggagaaucgcuugaacccggga

SEQ ID NO: 395858 - RNA, 57 nt, Human
ggugauuguucauuugacaugagaccccugaggcaacuagcuuugagggacacauca

SEQ ID NO: 395859 - RNA, 57 nt, Human
ugccuguaaucacagcuacucgggaggcugaggcagagaauugcuugaacccaggag

SEQ ID NO: 395860 - RNA, 57 nt, Human
acaguguuacgcgucugccucaggaggcugaggcagaagaauagcuugagcccagga

SEQ ID NO: 395861 - RNA, 56 nt, Human
gggguuauuccgccccuuaaguagaucugaggcagacccuuggggguguaaaagag

SEQ ID NO: 395862 - RNA, 57 nt, Human
ggccuguaauccuagcuacuuggggugcugaggcaggagaaucaacugaacccggga

SEQ ID NO: 395863 - RNA, 57 nt, Human
cuagcaauagaguccucucccaaguggcugaggcaggcuuaggggaaagaaccagag

SEQ ID NO: 395864 - RNA, 64 nt, Human
aaaauguauucaagcucacagauuuuuaaucaguaaggccuaucuauauuaguugucuuuuauu

SEQ ID NO: 395865 - RNA, 64 nt, Human
aagagagugcaggagggcugggggccauggaggaaaggccuaaaguuucacuuggggacagaga

SEQ ID NO: 395866 - RNA, 64 nt, Human
uccaccagggaaguugcuuguagccccaaaaguaaaggccuaucucugggucauaaauccugca

SEQ ID NO: 395867 - RNA, 57 nt, Human
agcuugaucuuccuuagccuacugccacugaggcaguagguuuuaggugguaucgua

SEQ ID NO: 395868 - RNA, 57 nt, Human
ugccuguaaucccagcuacuugggaggcugaggcaggagaaucgcuugaacccagga

SEQ ID NO: 395869 - RNA, 57 nt, Human
ugccuguaaucccagcuacucgggaagcugaggcaggugaauuguuugaaccuggga

SEQ ID NO: 395870 - RNA, 57 nt, Human
cgccuguaaucccagcacuuugggaggcugaggcagguggaucacgaggucaggaga

SEQ ID NO: 395871 - RNA, 57 nt, Human
cgccuguagucccagcuacucgggaggcugaggcaggagaauggugugaacccggga

SEQ ID NO: 395872 - RNA, 57 nt, Human
caccuguaauccuggcuacucgggaggcugaggcaggagaaucgcuugaacccggga

SEQ ID NO: 395873 - RNA, 57 nt, Human
cuccuguaacccugggacuuugggaagcugaggcaggaagauugagccuaggaguuc

SEQ ID NO: 395874 - RNA, 57 nt, Human
cuuaaauuucuuuuuuuuaaauugccacugaggcaacccuaguucaagaacucauuc

SEQ ID NO: 395875 - RNA, 57 nt, Human
caccuguaauccuagcuacucaggaggcugaggcaggagaaucgcuugaaccuggga

SEQ ID NO: 395876 - RNA, 57 nt, Human
ugccuguaauuccaucuacucgggaggcugaggcaggagaaucgcuugauccuggga

SEQ ID NO: 395877 - RNA, 57 nt, Human
uagccucuaaccagcauucccagacaccugaggcagauagauggaugggcugguggg

SEQ ID NO: 395878 - RNA, 57 nt, Human
ggccaccaugagcccaagauauccuuccugaggcagagauugaagccaucagagcug

SEQ ID NO: 395879 - RNA, 57 nt, Human
cucuucuccuacucugccuuggccucacugaggcaccccacuuccagugaagaaguc

SEQ ID NO: 395880 - RNA, 57 nt, Human
gggcaauuuucccucugaauaacgugucugaggcagggaugcuacccucaggcucgc

SEQ ID NO: 395881 - RNA, 57 nt, Human
uucuuuuuacaguuuuacuuuucaaugcugaggcauauuucuuugagcacugugcuu

SEQ ID NO: 395882 - RNA, 57 nt, Human
caacugcccaguuuccagucgggggaacugaggcagagcaagguagugaucacacca

SEQ ID NO: 395883 - RNA, 60 nt, Human
agcugccaguuugccuauuauaugccaaggcauuugcaaaaaucucauuaaucuaaauca

SEQ ID NO: 395884 - RNA, 60 nt, Human
guuucuccagaaaguacucccucaguaaagcauuugcacaagaauccuugucucaggcuc

SEQ ID NO: 395885 - RNA, 60 nt, Human
uguuguaauuauggcacugucauguuuuaacauuugcaacuagggauaguaaguacaaca

SEQ ID NO: 395886 - RNA, 57 nt, Human
aggaaggggcuuagaugcauuucuuuucugaggcagcaguaagaaauugguucacag

SEQ ID NO: 395887 - RNA, 57 nt, Human
agccuguaaucccagcuacacaggaggcugaggcacgagaaucacuugaacucagga

SEQ ID NO: 395888 - RNA, 57 nt, Human
ugccuauaauccuagcuacuugggaggcugaggcacgagacuugcuuaauaccuggg

SEQ ID NO: 395889 - RNA, 57 nt, Human
acagugaauuccuggucaaucucuccacugaggcaauuuggaaucaauaagcaauug

SEQ ID NO: 395890 - RNA, 57 nt, Human
cgccuguaaucccaguuacucgggaggcugaggcaggagaaucacuugaacccggga

SEQ ID NO: 395891 - RNA, 57 nt, Human
agaggauggagguuuggggcgaauguccugaggcagagauggucuuuauugugugug

SEQ ID NO: 395892 - RNA, 57 nt, Human
acacagugacugccucugaaaagagcccugaggcaaacacucucuccugcugaacag

SEQ ID NO: 395893 - RNA, 57 nt, Human
caccuggugugaccucucugugccuuacugaggcaccuuucuagagauuaaaagggg

SEQ ID NO: 395894 - RNA, 57 nt, Human
cgcccaucaucccagcuacuugggaggcugaggcaggagaauugcuugaacccguga

SEQ ID NO: 395895 - RNA, 64 nt, Human
agagguaugcaccuucccccuugaagagaggggaaaggccuacaguggcccacauaauugccug

SEQ ID NO: 395896 - RNA, 64 nt, Human
cagacacccccacucagacaguguacaaacuaagaaggccuaacugaacuaagccauauuuauc

SEQ ID NO: 395897 - RNA, 64 nt, Human
gcccuccuucccaaucuucuuuuucaggcucgccaaggccuaggaccuauguuguaauuuuacu

SEQ ID NO: 395898 - RNA, 64 nt, Human
gucauucugcauuggaaggaggacauuuuagagcaaggccuaagggcacagguauuagugucau

SEQ ID NO: 395899 - RNA, 64 nt, Human
acaauucagacuuuacuaaagcacaguuagacccaaggccuaugcugaggucuaaaccucugaa

SEQ ID NO: 395900 - RNA, 64 nt, Human
cauaauguagcaguuaccguguucaccucacacuaaggccuagaguuugcucugauaugcauuu

SEQ ID NO: 395901 - RNA, 64 nt, Human
cauguuggaaacacaucuuaacuucuaaauuuacaaggccuaucauguccuugucaugaaaagc

SEQ ID NO: 395902 - RNA, 63 nt, Human
cagccgcggagccucugcggaggcugagccccgcgaccggagcgccgcucuccgcuucuccac

SEQ ID NO: 395903 - RNA, 63 nt, Human
aggaagagcugaggcugccugggaggcccggggcgaccggaaaagggcucucucaaguucuga

SEQ ID NO: 395904 - RNA, 63 nt, Human
auugcaauguucaaugccacgugcugcugacaccgaccggaguacuagccagcacaaaaggca

SEQ ID NO: 395905 - RNA, 63 nt, Human
gcggaccauccaguagccaacgcgggcuaaaaccgaccggacaucuagcgggcaggggaagac

SEQ ID NO: 395906 - RNA, 63 nt, Human
cccacugaggaauuccguagggucuuguucccacgaccggagugcuggcucucacagugaauu

SEQ ID NO: 395907 - RNA, 63 nt, Human
agugaugcuuuugccaguggaugaucuggaaugcgaccggagcacuugcucugaggaauccca

SEQ ID NO: 395908 - RNA, 63 nt, Human
caccacugagcucugccucaacuccacccucugcgaccggaggacuaugccccuaguaacugc

SEQ ID NO: 395909 - RNA, 60 nt, Human
guaauuuugcauugcuuugaaauuugagcucauuugcaaacccgagucugccugggaacc

SEQ ID NO: 395910 - RNA, 60 nt, Human
uauguuuuuguuaaauuugcguuucaguuacauuugcauuuaagacaaguguucuauuua

SEQ ID NO: 395911 - RNA, 60 nt, Human
aggauuuuaacaggaauguuuuggucauugcauuugcacuuucauggacaacuuuuaauu

SEQ ID NO: 395912 - RNA, 60 nt, Human
caugggccuauucuuguaaguuucaguuagcauuugcauguguaauauuaaaaugaaaga

SEQ ID NO: 395913 - RNA, 60 nt, Human
caucucgccuguuggcucagugcuucaucccauuugcagagccucagacacgucuuggug

SEQ ID NO: 395914 - RNA, 60 nt, Human
ucugccagccacauccaaccccccaccugccauuugcacccuccgccuucacuccggugu

SEQ ID NO: 395915 - RNA, 60 nt, Human
cuccugugauugcacaaccaagcacuuugacauuugcaccuuaggagaggcagauguuaa

SEQ ID NO: 395916 - RNA, 60 nt, Human
uuuuuaaacccuuuccuccucccauuuugacauuugcacuuggagaacacuugaguugug

SEQ ID NO: 395917 - RNA, 60 nt, Human
auacccagauaaaugacuguaucaggauuucauuugcauguuaguccacagaguugccca

SEQ ID NO: 395918 - RNA, 60 nt, Human
cacaaccucaagaugguuaaaauccauugacauuugcacuuucaaacaugacaagucucg

SEQ ID NO: 395919 - RNA, 60 nt, Human
cuauuccuggaggguccagucauucaccagcauuugcaaauguccauagggagcaggugg

SEQ ID NO: 395920 - RNA, 57 nt, Human
auagcuacaaaccauacuaaauuauuccauuugcaacuuauccccaacagguauguu

SEQ ID NO: 395921 - RNA, 60 nt, Human
uuugguuuuaaaaauauuaagcuuuuugcucauuugcauguauacuuuucucucaacauu

SEQ ID NO: 395922 - RNA, 60 nt, Human
aggggauggagaggggguacaauuuuuaagcauuugcagcugcaacucuauagacuuuug

SEQ ID NO: 395923 - RNA, 60 nt, Human
ucaggcuguuaguggcaguacugacauaaacauuugcaagggaagucaucaagaaaaguc

SEQ ID NO: 395924 - RNA, 60 nt, Human
ugauuuaaagcauuauccaaauuaaauuaucauuugcagcaaacuguacaacagcaggaa

SEQ ID NO: 395925 - RNA, 60 nt, Human
ucuuucauaauaaauaaucagacauggucccauuugcaggaaaagugcagacucugagug

SEQ ID NO: 395926 - RNA, 60 nt, Human
uuuuuaagucacaauuucagaauuuugggacauuugcauucaauuuacagguaccaguac

SEQ ID NO: 395927 - RNA, 60 nt, Human
uuauuuggauagaagucuauauucuagccucauuugcaugaagucagauagccagaagaa

SEQ ID NO: 395928 - RNA, 60 nt, Human
ugcuauacauuauucaaaaagucucccgcgcauuugcacuaaugauggcugcaugcauag

SEQ ID NO: 395929 - RNA, 60 nt, Human
gaaaaauuaaaauuugaauauuuucucucucauuugcaucauacagcucuaccuaggauu

SEQ ID NO: 395930 - RNA, 60 nt, Human
aaugagccugacuuagugacagugugugagcauuugcaauguaagggccucagcuuccuu

SEQ ID NO: 395931 - RNA, 60 nt, Human
uggagagucuacauaauuacuuugcacuaacauuugcaggauguucacacaauuuuaaau

SEQ ID NO: 395932 - RNA, 60 nt, Human
gaaaguaauuuaguucauuuucuguguugacauuugcaauuaauauuucaauauuuuaug

SEQ ID NO: 395933 - RNA, 60 nt, Human
ggauuuaauuuuuaguaagaaugcuauuuacauuugcauguacuuuuuuaguuuuaugua

SEQ ID NO: 395934 - RNA, 60 nt, Human
auugucccauacccaccccuuucucauccccauuugcaggggcuaaaggucuagaugaga

SEQ ID NO: 395935 - RNA, 60 nt, Human
aaccucccaccaucaucacaacuguagucucauuugcaguggagaaaagaacccgacguc

SEQ ID NO: 395936 - RNA, 60 nt, Human
uuuuuguagcugcuauauauuuuaagccuucauuugcaauucauguaacaguugugucau

SEQ ID NO: 395937 - RNA, 60 nt, Human
ugugaguuucugcuuuguagguuguggucacauuugcaggcugcgggcaguggcaccgac

SEQ ID NO: 395938 - RNA, 60 nt, Human
ccuuauuggcagcaguuuuauaaaguccgucauuugcauuugaauguaaggcucaguaaa

SEQ ID NO: 395939 - RNA, 60 nt, Human
gaaaccugaacggacuccauuuggcuccuucauuugcaagacaucaagggcuccuuaccc

SEQ ID NO: 395940 - RNA, 60 nt, Human
uagguuguacaaaccuuaaggacucguuaccauuugcaguuaccauaagugcuuuaucuu

SEQ ID NO: 395941 - RNA, 60 nt, Human
aggugccauuuaaauugccuccaugcuccccauuugcaccuagcuggaucaaguugggag

SEQ ID NO: 395942 - RNA, 60 nt, Human
cuccaggcucuguuuuguguauuuaucugccauuugcaucaugguuuuuaaaauuuauua

SEQ ID NO: 395943 - RNA, 60 nt, Human
cuauaauuauaacuccuguucugcauagagcauuugcaucaaaggcuuuccauaccccuc

SEQ ID NO: 395944 - RNA, 60 nt, Human
uuaguauuuaauuaaaaaugaauuguuugucauuugcaauguuaucugguuuggcagcuc

SEQ ID NO: 395945 - RNA, 60 nt, Human
gguccacauuccugcaagcauugauugagacauuugcacaaucuaaaauguaagcaaagu

SEQ ID NO: 395946 - RNA, 60 nt, Human
cccuucauuccucauagguacugggaaguccauuugcaagcugagcgccaggccugggga

SEQ ID NO: 395947 - RNA, 60 nt, Human
ggaggggcuguguuuccaucucaaagaaggcauuugcaggguccucuucugggccugacc

SEQ ID NO: 395948 - RNA, 60 nt, Human
cgaauaaauguguaacuuugaaauuguguucauuugcacucggugcagcgguuaugcuua

SEQ ID NO: 395949 - RNA, 60 nt, Human
aauccaagccuuacccagcugugcuacugucauuugcaaagcaaggaaauacuacuacug

SEQ ID NO: 395950 - RNA, 60 nt, Human
caagaaucuuuuuguguuuggaguguaguccauuugcaauagaaauaaaaaaauccguca

SEQ ID NO: 395951 - RNA, 60 nt, Human
ggaggcugcaaaauguuaguagauaugaggcauuugcagcugugccauauuaauuggugu

SEQ ID NO: 395952 - RNA, 60 nt, Human
cagaacaaaacaaaguaugcagagacagagcauuugcagggccaccuggaggcuggggug

SEQ ID NO: 395953 - RNA, 60 nt, Human
ggacuugcgguuaaucgaagucacugagaccauuugcaagaggcuccuggauuauagccu

SEQ ID NO: 395954 - RNA, 60 nt, Human
uucuccuuagauuucgugguguacaucaugcauuugcaaaaaucuuagcugaaggaggaa

SEQ ID NO: 395955 - RNA, 60 nt, Human
ugugccaucuuuaaaauuuuuacuauuggucauuugcagaacaguaaauucuguguguug

SEQ ID NO: 395956 - RNA, 60 nt, Human
ccucacgugagacuccuuuuaagacuaaaccauuugcauuaaacuagagccuuaagucaa

SEQ ID NO: 395957 - RNA, 60 nt, Human
ggacggccugcuaucuacagcacagugugucauuugcagauuugugguuaccuauaccac

SEQ ID NO: 395958 - RNA, 60 nt, Human
aaaaaagaaacuguaaauuugacauaauuucauuugcaacuucauuuuguuuuuuauaaa

SEQ ID NO: 395959 - RNA, 60 nt, Human
gacaaggcccacagaauaagauuuuccaugcauuugcaaauacguauauucuuuuuccau

SEQ ID NO: 395960 - RNA, 60 nt, Human
cuguccugugggagcugauaaaccaagucacauuugcauucuguugcaggcuuagugaaa

SEQ ID NO: 395961 - RNA, 60 nt, Human
uuuaaaaaguuuugauaacucuuaaagcaucauuugcaccuaugugggaacuuugccugu

SEQ ID NO: 395962 - RNA, 60 nt, Human
ucucuucccccagugccuagguugccagagcauuugcacaaaugccccuguuuaucaaua

SEQ ID NO: 395963 - RNA, 60 nt, Human
gguuucaaauucugggaaaccaguuccaaacauuugcagaaaccauuaagcaguuacaua

SEQ ID NO: 395964 - RNA, 60 nt, Human
cagguagugccagcagaguagggaaaacugcauuugcauaaaaacuacucuugacaugau

SEQ ID NO: 395965 - RNA, 60 nt, Human
auuucuuaguuaucaaaaguaguuggaaaacauuugcaagacuaugaacauagaauugcu

SEQ ID NO: 395966 - RNA, 60 nt, Human
ccaccuucccugaaaauuuuacucacagaucauuugcaacaagcauagcuuacuuauugu

SEQ ID NO: 395967 - RNA, 60 nt, Human
gagucaugaugaaucaguccuagaauguuucauuugcacaaguagggcugccuccaagag

SEQ ID NO: 395968 - RNA, 60 nt, Human
ggcuacgugaacuuggaagcaccuacaggccauuugcaugaaauucacaugcaccuaaau

SEQ ID NO: 395969 - RNA, 60 nt, Human
guauaccuuuuaauagguauccacuuaaggcauuugcaguacaaauauuaauugaccacu

SEQ ID NO: 395970 - RNA, 60 nt, Human
uggcuaaauaaaccuuucuucuuccuugcucauuugcaagugguauuaauugaccucuau

SEQ ID NO: 395971 - RNA, 60 nt, Human
cacuccuuguuuuuaacgggaagcucuuugcauuugcauuuccucaacaaaggagcaaag

SEQ ID NO: 395972 - RNA, 60 nt, Human
uaggguuugaaauugauaaugcuuucacaacauuugcagauguuuuagaaggaaaaaagu

SEQ ID NO: 395973 - RNA, 60 nt, Human
ugaugaugccaauuccuacgagaaugugcucauuugcaagcagaaaaccacagagacagg

SEQ ID NO: 395974 - RNA, 60 nt, Human
aaauaaaaauugaaaaauaaaaaccauaaacauuugcaccacuuguggcuuuugaauauc

SEQ ID NO: 395975 - RNA, 60 nt, Human
cuggcacaauuugugaugaaaauauuagcacauuugcaauaauguuucuccauaacagag

SEQ ID NO: 395976 - RNA, 60 nt, Human
aaagaaaugggguuacugcucccagugcaucauuugcaucauuccccauugacugaaucc

SEQ ID NO: 395977 - RNA, 60 nt, Human
uaaucugauuuucaagacaccucuuaagugcauuugcauuuuauuuugguaauggcagag

SEQ ID NO: 395978 - RNA, 60 nt, Human
ugguggggcccucgggguggucucaggucccauuugcagucugcaacagugacgcgcagc

SEQ ID NO: 395979 - RNA, 60 nt, Human
ggccagaguagcugaaaaucuccaaaugggcauuugcaugccuaucuccucaucuccccc

SEQ ID NO: 395980 - RNA, 60 nt, Human
cugcuggugcuggagucugaagaauauuuucauuugcauuuuagugguuagggagaggau

SEQ ID NO: 395981 - RNA, 60 nt, Human
auguaucuuuguagaguuaaugauuuuguacauuugcacauguaaucaucauacccauuu

SEQ ID NO: 395982 - RNA, 60 nt, Human
cuguuuucuucucagucuuuucaguuucaucauuugcacaaacuugugagcaucagaggg

SEQ ID NO: 395983 - RNA, 60 nt, Human
gucuuauuuuaaacccugucuccaugacuucauuugcacuuugacagagcagaggcagag

SEQ ID NO: 395984 - RNA, 60 nt, Human
uuaucaguagguacauggauacaucaaguucauuugcagaaacaaauaacugaaauaaaa

SEQ ID NO: 395985 - RNA, 60 nt, Human
agucaccagugcucacugugccuguuuccucauuugcaacaagaggauaauuccgaccua

SEQ ID NO: 395986 - RNA, 60 nt, Human
uuuauuuaagccuacuccugacuaacuuggcauuugcaggucaagcaggaagcaguugac

SEQ ID NO: 395987 - RNA, 60 nt, Human
gugacagagccaggaugagaacaaagauuccauuugcaccaugccacacugcuguguuca

SEQ ID NO: 395988 - RNA, 60 nt, Human
cuccagagcuacugaaguaaaaguuagaaucauuugcauuuucauucagauaggagauaa

SEQ ID NO: 395989 - RNA, 60 nt, Human
ucuuucuucauaguccucaggcuuugguuacauuugcauaugccauuugaagccuccagc

SEQ ID NO: 395990 - RNA, 60 nt, Human
agacccuccccucuccucagugcacuuuggcauuugcacggugucuuccccggacagcac

SEQ ID NO: 395991 - RNA, 60 nt, Human
augcaauguuaaacacuuuuuuaauguaaucauuugcauugguuaggaauucagaauucc

SEQ ID NO: 395992 - RNA, 60 nt, Human
ccauuacaguuauuguugcuagauccaccucauuugcagauguccaaacuuaaauucauc

SEQ ID NO: 395993 - RNA, 60 nt, Human
aaagguaaauacaaugguuucugaaagaaucauuugcauuaucagccuguuugggauguc

SEQ ID NO: 395994 - RNA, 60 nt, Human
ccgaaauauugaaaugguguaauguuguaccauuugcacugugagcaaaugcuaauacag

SEQ ID NO: 395995 - RNA, 60 nt, Human
guguguggcuggucccuaccugggcagucucauuugcacccauagcccccaucuauggac

SEQ ID NO: 395996 - RNA, 60 nt, Human
uauugagcaucuuuucaugagcuuauuggccauuugcauaucuucuuaggacagcuaucu

SEQ ID NO: 395997 - RNA, 60 nt, Human
ucaaaaaauucagaaacauauauuugugugcauuugcaugugcaacaguacacacaaaca

SEQ ID NO: 395998 - RNA, 60 nt, Human
uaugcuguuuccuguuggaugcacauaauccauuugcacugcagacaauuuuaggaugug

SEQ ID NO: 395999 - RNA, 60 nt, Human
acgcugauuuuuuuuugcauucuguagucgcauuugcacuccauuuuuacauuaauucgc

SEQ ID NO: 396000 - RNA, 60 nt, Human
gagucaguucuggcucugccuagcuguuuacauuugcaaauguagcaaacaagguaauga

SEQ ID NO: 396001 - RNA, 60 nt, Human
augccucucucccacuuuucccaacccccacauuugcaacuagaagagguugcccauaaa

SEQ ID NO: 396002 - RNA, 60 nt, Human
aaaaggaacagccaugccucaaaaucaaaucauuugcauucccacagcauccugaauacc

SEQ ID NO: 396003 - RNA, 60 nt, Human
aacaagaauucgguggccugcagagcuugccauuugcacuuuucaaaugccuuuggauga

SEQ ID NO: 396004 - RNA, 60 nt, Human
aaccagugcaaggacccccuucccuuauuacauuugcaacucugcccaacaaaaacaagc

SEQ ID NO: 396005 - RNA, 60 nt, Human
aggaagucacgaaaugaggaguucuugccacauuugcagagucccuccuugauaagguuu

SEQ ID NO: 396006 - RNA, 60 nt, Human
gaacuguccuggcuccuuccguauuaaacgcauuugcauuuugagaaguguccuucccac

SEQ ID NO: 396007 - RNA, 60 nt, Human
gauucacuuacaggcaguagcugcuucuagcauuugcaagauccuacacuuuuaccuucu

SEQ ID NO: 396008 - RNA, 60 nt, Human
ucuucagccauuaaaaaaaugagauucugucauuugcaauaauauagauggaaaaggagg

SEQ ID NO: 396009 - RNA, 60 nt, Human
cgggaccagccagggccaaggcuugggaaccauuugcauccaggaguuagaugggaacaa

SEQ ID NO: 396010 - RNA, 60 nt, Human
uccuuucuuccauucuuaacaguaugugcccauuugcaaaacaaaaaugcuaauaaucag

SEQ ID NO: 396011 - RNA, 60 nt, Human
caaaugcuuuuuucuuucacguacauccaucauuugcaacugcuguucguacacagaaac

SEQ ID NO: 396012 - RNA, 60 nt, Human
ugucacuucccaugccguuauuuuaugguucauuugcagugacuuuuaaggcaguacugu

SEQ ID NO: 396013 - RNA, 60 nt, Human
uggaagcuaccaggaaugcuuucuaauuaucauuugcaacuagaacuguaaucagaaaga

SEQ ID NO: 396014 - RNA, 60 nt, Human
aucuuuuaucauuaaacaccuaguacgaagcauuugcaggaaccuacugugcaguaucau

SEQ ID NO: 396015 - RNA, 60 nt, Human
aagacucuguguggcugugcaauuucuguacauuugcaauuagaaauauuaaagauuuau

SEQ ID NO: 396016 - RNA, 60 nt, Human
cccagcacacaguaggcccucaauaaaagccauuugcacuuuaaauauauauauguaugu

SEQ ID NO: 396017 - RNA, 60 nt, Human
caaaugcacucugagcuggagggagcccaccauuugcacccaccuacccacccucacccc

SEQ ID NO: 396018 - RNA, 60 nt, Human
gucuucgacgcucagggucugggcgccucgcauuugcagucuguugugacagacacgggg

SEQ ID NO: 396019 - RNA, 60 nt, Human
cucucacacacacacacacacacacagucccauuugcauaucacccuucccugcucccac

SEQ ID NO: 396020 - RNA, 60 nt, Human
guagaauaaaagcauuaaaaagaagcaaaucauuugcacucuauaauuugugguacagua

SEQ ID NO: 396021 - RNA, 60 nt, Human
ugaguaagagcugggcauuuagaaagaugucauuugcaauagagcaguccauuuuguauu

SEQ ID NO: 396022 - RNA, 60 nt, Human
gcucucugaugaagccagguugucaaagaucauuugcaaaagaagggaaaacuggcauga

SEQ ID NO: 396023 - RNA, 60 nt, Human
cuggcugcuaacaugaucuuacauaccauacauuugcauuuuuauccuucuugugcacca

SEQ ID NO: 396024 - RNA, 60 nt, Human
ggaacaauuucaagguccucaccacuccuucauuugcagaggggacaacagacuuucuga

SEQ ID NO: 396025 - RNA, 60 nt, Human
gguauauaaaaugugucacagaaaaacacgcauuugcaacguuaaccuaacgaaauuucc

SEQ ID NO: 396026 - RNA, 60 nt, Human
uacccucugaauuggagggcagugccagggcauuugcagaagcugggaaggaccaagccu

SEQ ID NO: 396027 - RNA, 60 nt, Human
gagccucuggucaucuucaguauuuucugucauuugcaaaagcuuucagagggcauugug

SEQ ID NO: 396028 - RNA, 60 nt, Human
gaacaaaacuccagacucuugggccguccccauuugcaacagcacacauaguuucuggua

SEQ ID NO: 396029 - RNA, 60 nt, Human
accuacuuguuuguauaaauuauugaaauccauuugcacccuguuaagaauggacuuaaa

SEQ ID NO: 396030 - RNA, 60 nt, Human
gagaagaauagccuagauaugaauauauggcauuugcagauuuuuauauuaguugcuuug

SEQ ID NO: 396031 - RNA, 60 nt, Human
agauaggcuggcaagagcuguuuuugcauccauuugcaucgugaagacuggcauuuugau

SEQ ID NO: 396032 - RNA, 60 nt, Human
accagcccagggcaauuuugcagaaaugaucauuugcacagaauggguuuccuucacagg

SEQ ID NO: 396033 - RNA, 60 nt, Human
uuucauuuaauucucauggcaaccaccaugcauuugcagauaggcaagucaggcucacaa

SEQ ID NO: 396034 - RNA, 60 nt, Human
acacuaaagaaugcaguauauuuaguuuuccauuugcaugauguuugugugcuauagaug

SEQ ID NO: 396035 - RNA, 60 nt, Human
gaauuuuaaaaugccaaauauuuucauggucauuugcauguaguaagccagaaaauauuc

SEQ ID NO: 396036 - RNA, 60 nt, Human
gccuguuuuccuaaauaaaacaguugcuggcauuugcacauccacaacguguugauuaac

SEQ ID NO: 396037 - RNA, 60 nt, Human
auugccaugcagauaucuugaacagcaggacauuugcaggccuugucuacuggacuuuuc

SEQ ID NO: 396038 - RNA, 60 nt, Human
cacuguggcccacauucuugugcacgcgggcauuugcaggcacgcucucgcguaguuacc

SEQ ID NO: 396039 - RNA, 60 nt, Human
uuagguuuuuucuucuguacacagaucgugcauuugcauaguucagacuaggagccaaau

SEQ ID NO: 396040 - RNA, 60 nt, Human
agcccagacuuaccuggacaagguggagaacauuugcaagaagcuuucaaaucccuuccg

SEQ ID NO: 396041 - RNA, 60 nt, Human
gcugcuauaauuaguauuauguugauaauucauuugcaaccuuauucuauuuaggaggau

SEQ ID NO: 396042 - RNA, 60 nt, Human
acaacccaaaacauauauacagauuguuggcauuugcaaaaggaagcaucaauaguggac

SEQ ID NO: 396043 - RNA, 60 nt, Human
cacagcagcuuauaaugggcucuccggggccauuugcaauaacagcugcaauucccugga

SEQ ID NO: 396044 - RNA, 60 nt, Human
cucugggcagcucccaucccagucuggggccauuugcagacucaggaaaggauuucuaca

SEQ ID NO: 396045 - RNA, 60 nt, Human
ugccacccagccugggccuucccagaccagcauuugcacaauaucaccaggcuucuucug

SEQ ID NO: 396046 - RNA, 60 nt, Human
uguucaaauuaccagcaucagagagcuucccauuugcaucuagaccuugaauuuauauuu

SEQ ID NO: 396047 - RNA, 60 nt, Human
uacagccgagggaccuccaaagggaacguccauuugcaugugugcccugguauuuagggu

SEQ ID NO: 396048 - RNA, 60 nt, Human
acauucuuucuuuuugugccaaaugacuugcauuugcaaagagcucaauugcucugagcu

SEQ ID NO: 396049 - RNA, 60 nt, Human
gcaaaagauguauuuuccuguggcccaugacauuugcaguuauucccagugagaaauauu

SEQ ID NO: 396050 - RNA, 60 nt, Human
gucucacucaaagacauuuguugggagucacauuugcaucauagacgagacaguccauuc

SEQ ID NO: 396051 - RNA, 60 nt, Human
uaaagcaauaugcauuuaaauacagucuuccauuugcaagggaaaagucucuuguaaucc

SEQ ID NO: 396052 - RNA, 60 nt, Human
aaaaauguauucagugggcuuuaaaauuuccauuugcagaauuuggucucucaggcuguu

SEQ ID NO: 396053 - RNA, 60 nt, Human
aacaauuguaaauaucacuuaaauuauaaccauuugcaauaaacauccccaaaguucccu

SEQ ID NO: 396054 - RNA, 60 nt, Human
gcuagaaaauaaaaccaauuuguaaagccacauuugcauaugaugccagccucacgcauu

SEQ ID NO: 396055 - RNA, 60 nt, Human
ccuggacuccuugacauccaauucaaacugcauuugcaaaaugugcaaagaccucuuaug

SEQ ID NO: 396056 - RNA, 60 nt, Human
ggaaacuguaguuuaaguggcaaauaaaaacauuugcaucaagagcugugugagucuguc

SEQ ID NO: 396057 - RNA, 60 nt, Human
aagggucugucagcacacauggaaagcccccauuugcacagauguagaacuuuaauaauc

SEQ ID NO: 396058 - RNA, 60 nt, Human
uaaaacauacaaaauaaacauauuuuaaaacauuugcauuuuaccaccaguaacuguugg

SEQ ID NO: 396059 - RNA, 60 nt, Human
cuguuugcguggcagcaaggguuccacgugcauuugcaauuugcacagcuaaaauugcag

SEQ ID NO: 396060 - RNA, 60 nt, Human
uguuuucuauauguagaaggaaaaccugagcauuugcaggcaucugguuaaagcaggguc

SEQ ID NO: 396061 - RNA, 60 nt, Human
ccauuauaggugcaaggcaccccauccacacauuugcaccacuacuccaagauaguauuu

SEQ ID NO: 396062 - RNA, 60 nt, Human
ggcugguuauaaauuugaacucccucagcccauuugcaacucugccucuguucucuugca

SEQ ID NO: 396063 - RNA, 60 nt, Human
guguuguaaaucauguuucccuuaucagaucauuugcaaauacauuuaaaugaucucaug

SEQ ID NO: 396064 - RNA, 60 nt, Human
gucacacuuauccuuugucuccguaaauuucauuugcagugguuagucaucagauauuuu

SEQ ID NO: 396065 - RNA, 60 nt, Human
augaguauugugaugaguaaaugaauaaaacauuugcaaagaccuuuagagaaagagaau

SEQ ID NO: 396066 - RNA, 60 nt, Human
ggcccaugcccccuucgcuccuccucucaucauuugcauugggcauuaguguccccccuu

SEQ ID NO: 396067 - RNA, 60 nt, Human
auuggggaucugcauuccccgcugcccaaucauuugcaaugcccuaauuagggcauccug

SEQ ID NO: 396068 - RNA, 60 nt, Human
uguaugcacccgcgggggccugggaguccccauuugcagguggguagggccuccagccca

SEQ ID NO: 396069 - RNA, 60 nt, Human
uuguuaggcagaauauuuuggauuuggaggcauuugcaugguagucuuugaacaguaaaa

SEQ ID NO: 396070 - RNA, 60 nt, Human
gaauaucugcugguauuuuucuguaaagaccauuugcaaaauuguaaccuaauacaaagu

SEQ ID NO: 396071 - RNA, 60 nt, Human
cccccccuccacuguaggccacuggauggucauuugcaucuccguaaaugugcucugcuc

SEQ ID NO: 396072 - RNA, 60 nt, Human
uuguccaggugcaucucauacaccugaacucauuugcaucauuuuaaccaucuuuuccuu

SEQ ID NO: 396073 - RNA, 60 nt, Human
ggguacucaaggagaaggaaugcauacugucauuugcaggcugucauuugagcauaaaau

SEQ ID NO: 396074 - RNA, 60 nt, Human
ucauuuccacuuguguguggagaaauacaucauuugcauauguaucuagucaagaagccc

SEQ ID NO: 396075 - RNA, 60 nt, Human
cuuaauuaccaccauggcagggugagggaacauuugcaucgucagcugccucugcauagc

SEQ ID NO: 396076 - RNA, 60 nt, Human
agcccaaacuuuccucagcugcauaaaauccauuugcaguggaguuccauguuuauuguc

SEQ ID NO: 396077 - RNA, 60 nt, Human
ugguccauuucucaguggcuucuccauccucauuugcaaaccucagagggauaaggcagu

SEQ ID NO: 396078 - RNA, 60 nt, Human
augagugauggcgcccggccccgcaccugccauuugcacgcccggccgggaggcagagac

SEQ ID NO: 396079 - RNA, 60 nt, Human
aaggcugugugaauuuuucuaaacaagaaccauuugcaauauggauuucuuagagauuaa

SEQ ID NO: 396080 - RNA, 60 nt, Human
gaucuauaacaacagagcaaagucuaugcucauuugcagacuggaaucauuaaguaauuu

SEQ ID NO: 396081 - RNA, 60 nt, Human
uuaaaacuaacaugaaauauguguuguuuucauuugcaaauuuaaauaaagauacauaau

SEQ ID NO: 396082 - RNA, 60 nt, Human
cgggugucuuucgacucugcuuguagaaaccauuugcacauauucuguacgagccucgcu

SEQ ID NO: 396083 - RNA, 60 nt, Human
cuucucuuugggcagagauucuauuuuugacauuugcacaagacagguagggaaagggga

SEQ ID NO: 396084 - RNA, 60 nt, Human
guaguuacauagcccuuccaauucuggguccauuugcacuagcaaauuaaaauaugcuuu

SEQ ID NO: 396085 - RNA, 60 nt, Human
ucagaagguaacuuguuauaagagaaauggcauuugcauguuccagagucagaaccugua

SEQ ID NO: 396086 - RNA, 60 nt, Human
uauugugugcuggucuaagcaagcugagaucauuugcaauggaaaacacguaacuuguuu

SEQ ID NO: 396087 - RNA, 60 nt, Human
ggugagaauaaaacacccccacauaacaugcauuugcaugggcccgaaccugugaaaugu

SEQ ID NO: 396088 - RNA, 60 nt, Human
cugauacacaaggccucucuuccacaugaucauuugcaaaccucccccagccccuaccau

SEQ ID NO: 396089 - RNA, 60 nt, Human
ugcucucccagggaauugugguggacgugccauuugcauccuucuuccugagccaacugc

SEQ ID NO: 396090 - RNA, 60 nt, Human
ccacuaccagugcuaacccauuuuuaaguacauuugcaugugggcaagaauugaaaguau

SEQ ID NO: 396091 - RNA, 60 nt, Human
caucacccauuccuccuuuuucguugcguucauuugcacucugucccucaacacuagaaa

SEQ ID NO: 396092 - RNA, 60 nt, Human
aaugacuaccaacagugagagcccuucaugcauuugcacuauuggaaggaguuagauguu

SEQ ID NO: 396093 - RNA, 60 nt, Human
uaagcauaagcuuuagagguaaagcguuugcauuugcagugcaucagauaaauuguauau

SEQ ID NO: 396094 - RNA, 60 nt, Human
guuucucaugcaguaagcuuuauaaaaacucauuugcacuggacugucaucucauucuug

SEQ ID NO: 396095 - RNA, 60 nt, Human
ucauccugcacccccuaaaaaaguaccaaacauuugcauucucagaacaucaaacaaaaa

SEQ ID NO: 396096 - RNA, 60 nt, Human
cuguggucugggggucuucauaauaaaccucauuugcaauucauaucaugugcugucugc

SEQ ID NO: 396097 - RNA, 60 nt, Human
cuaauuaaccuuguugaaucucagauuccccauuugcaacauuagguuaagaccaguacu

SEQ ID NO: 396098 - RNA, 60 nt, Human
agagcucacaguacaauguuucagaagccccauuugcacagguuuucagcaacucagaau

SEQ ID NO: 396099 - RNA, 60 nt, Human
auaauuaauucaauacacuacuguuaaaaucauuugcaaagcacucagcucaauuaucuu

SEQ ID NO: 396100 - RNA, 60 nt, Human
guugugcuagccaaaguaaugcuaugaaaucauuugcagaauuaacccgugaguuaaugu

SEQ ID NO: 396101 - RNA, 60 nt, Human
gagaaagcacgugucucagacugcauguaccauuugcauggcuccagaaaugucuaaaug

SEQ ID NO: 396102 - RNA, 60 nt, Human
ucauuuuugaggguuauauuuuguuaaccucauuugcaggcucuugugucaucgcuuauu

SEQ ID NO: 396103 - RNA, 60 nt, Human
ggggaaauggacuuuaaauuuuaaagagcucauuugcaaugcacuuguauacacuucaaa

SEQ ID NO: 396104 - RNA, 60 nt, Human
cauuuccuuggcuggacagaugggguuaugcauuugcaauaauuuccuucugauuucucu

SEQ ID NO: 396105 - RNA, 60 nt, Human
cugcuuaauguaacuucuuuuuugcuuaagcauuugcaugacuauuagugcuucaaaguc

SEQ ID NO: 396106 - RNA, 51 nt, Human
caacuaaaaaauauaucuaagcauuugcaaaggcgacaauaaauuauugac

SEQ ID NO: 396107 - RNA, 60 nt, Human
aauaauuaugcagacacaucagcuguuaaccauuugcaccucuaaguguugugaaacugu

SEQ ID NO: 396108 - RNA, 60 nt, Human
uuuugguuuucauagucgugaaguauuuaucauuugcaugacuaauggcacaggaaaaac

SEQ ID NO: 396109 - RNA, 60 nt, Human
accuuucagucaucacccaauuuaauuagccauuugcaugaugcuuucacacacaauuga

SEQ ID NO: 396110 - RNA, 60 nt, Human
aucuuaugggauauuuuauaaauaaaauuccauuugcauagcauggaaaguacacaucug

SEQ ID NO: 396111 - RNA, 60 nt, Human
aaaacauuauagacugguauuuucaauuuucauuugcaagaaaaugaucaguggaaugaa

SEQ ID NO: 396112 - RNA, 60 nt, Human
uacagaagauuuagaaauaccccuauuucucauuugcaguuuuuuuuuccaauucugugc

SEQ ID NO: 396113 - RNA, 60 nt, Human
uuguuauauaauuuagacuuggauucuuuccauuugcauuuguuuauguaauuucaggag

SEQ ID NO: 396114 - RNA, 60 nt, Human
auucauacuaagcuuucugugcagucucaccauuugcaucacugaggaugaaacugacuu

SEQ ID NO: 396115 - RNA, 60 nt, Human
guauaggcaaggaaaguaauuuucaaaguacauuugcaguucucuuuuucagagaugauu

SEQ ID NO: 396116 - RNA, 60 nt, Human
gugaaaaaaauguaaagguuuuauuuaggacauuugcauggcuagucaucaguccauuuu

SEQ ID NO: 396117 - RNA, 60 nt, Human
auuggcuuauuuuuuagaucaccugcaauucauuugcaaauugcaauaaaacacauuuua

SEQ ID NO: 396118 - RNA, 60 nt, Human
gaugaucacgguuucuuuuguuuaucacgccauuugcaaaucagagcaagagcucuuucu

SEQ ID NO: 396119 - RNA, 60 nt, Human
ucauggcccguguguggggacuugcuuugucauuugcaaacucaggaugcuuuccaaagc

SEQ ID NO: 396120 - RNA, 60 nt, Human
uucaaguguuuuggcugaaagggcuuuuugcauuugcauguucugaguucagauucugcu

SEQ ID NO: 396121 - RNA, 60 nt, Human
cagggggacgugccuaaaagacauuccgggcauuugcacuugggaaacuugccucaccuu

SEQ ID NO: 396122 - RNA, 60 nt, Human
ggaccagacuguaagugaacguuuuacacacauuugcauuguaaaugauaauuaaaaaaa

SEQ ID NO: 396123 - RNA, 60 nt, Human
cauuaaguggucuagaauucuuuugcaaugcauuugcaacagaauuuuguagccuuaagg

SEQ ID NO: 396124 - RNA, 60 nt, Human
gaggcaugaguggaccgagagcacauccagcauuugcaucaccucccuggcaccucccau

SEQ ID NO: 396125 - RNA, 60 nt, Human
uucauaugcagauuuuauucucaccugggccauuugcagaugagacuguaguuugcagau

SEQ ID NO: 396126 - RNA, 60 nt, Human
agauuuuaagccguggaaaauguucuugaucauuugcaguuaaggacuuuaaauaaauca

SEQ ID NO: 396127 - RNA, 60 nt, Human
agcaauuggaauauaaguauuaaauuauagcauuugcaaauauuaauauaaaagcacaac

SEQ ID NO: 396128 - RNA, 60 nt, Human
gaugaaauucaagccuaaagacaauucauucauuugcauccaugggcacagaagguugcu

SEQ ID NO: 396129 - RNA, 60 nt, Human
uuguguuaagcaguauaguauugguugggucauuugcaucauaucguuagcauuuauuug

SEQ ID NO: 396130 - RNA, 60 nt, Human
aaacuauuuuauaaagugcacuguuuaaagcauuugcacuguauuuuugccauuuauuuu

SEQ ID NO: 396131 - RNA, 60 nt, Human
caucugaaauuauguuaagagucuuuaacccauuugcauuaucugcagaagagaaacuca

SEQ ID NO: 396132 - RNA, 60 nt, Human
uaucuuuucaaguggaauuaguugguuauccauuugcaaauguuuuaaauugcaaagaaa

SEQ ID NO: 396133 - RNA, 60 nt, Human
uuuuuguccacaguauaugauccauccagacauuugcaaacgucaggagaaaaaugugaa

SEQ ID NO: 396134 - RNA, 60 nt, Human
gugagauaguuuucauuuuaacuggcaugucauuugcacacaaaaauaaagacuagagca

SEQ ID NO: 396135 - RNA, 60 nt, Human
auucaacaauagugaucucacucaaauugacauuugcauaauuugacauuuauauucauu

SEQ ID NO: 396136 - RNA, 60 nt, Human
gcagacaguggguaccacgaucuccguaaccauuugcaugugacuuagcaagggcucuga

SEQ ID NO: 396137 - RNA, 60 nt, Human
gaaaggaagaagaagucuaaaagaaaacaucauuugcaaagggagagaggggcaagcaug

SEQ ID NO: 396138 - RNA, 60 nt, Human
cuagaugggacacuugacagugacuugaaacauuugcauauucaggaaugcaugagauuu

SEQ ID NO: 396139 - RNA, 60 nt, Human
cucuuguaucccuagugcuccauaguuuggcauuugcacgguuucgaagucauuaaacug

SEQ ID NO: 396140 - RNA, 60 nt, Human
uuuaugaaaaauacaguuugucacaugaaacauuugcaaaauuguuuuugguuggauugg

SEQ ID NO: 396141 - RNA, 60 nt, Human
uuugguuuucccugggcugaugaugugcgucauuugcacuguaccuugaauuuacagugg

SEQ ID NO: 396142 - RNA, 60 nt, Human
aaaggagguagucaggccguccagagcuggcauuugcacaaacacggcaacacugggugg

SEQ ID NO: 396143 - RNA, 60 nt, Human
acacaaacaagaaauguggacaaggagggacauuugcauacuccuacugucugugugguc

SEQ ID NO: 396144 - RNA, 60 nt, Human
aaagacuguuuuccuuuuccacuguguuggcauuugcacuggugaugcuaaaguaauggu

SEQ ID NO: 396145 - RNA, 60 nt, Human
uugagcaaagcauuucuccuuucugggccucauuugcacuagaugggccuguggucccaa

SEQ ID NO: 396146 - RNA, 60 nt, Human
gucacuguuucucacaguugcaaaucaaggcauuugcaaccaagaaaaaaaaaauuuuuu

SEQ ID NO: 396147 - RNA, 60 nt, Human
uguggaaugaaaccaucuccuaaaauucagcauuugcagcauucuaaaagccuguguagg

SEQ ID NO: 396148 - RNA, 60 nt, Human
gagccucaaggacauugugugauugccucacauuugcagguaauaucaagcagcaaacua

SEQ ID NO: 396149 - RNA, 60 nt, Human
gagccagcugcuugcucacagccacauuuccauuugcaucauuacugccuucaccugcau

SEQ ID NO: 396150 - RNA, 60 nt, Human
uuccucaguagggagucaacaugcccaagucauuugcaccuuuaccucucacauggaugc

SEQ ID NO: 396151 - RNA, 60 nt, Human
acugcaaaaggacugggauaauuuuuucaccauuugcaauaacuuugaugcaacugaauc

SEQ ID NO: 396152 - RNA, 60 nt, Human
aaacagcugacacugacuaaggaacugcagcauuugcacaggggaggggggugcccuccu

SEQ ID NO: 396153 - RNA, 60 nt, Human
uauaaaagaugauaguaauuuaccaagugacauuugcagagaaacagguguacaguuauc

SEQ ID NO: 396154 - RNA, 60 nt, Human
ucgccuggugcagccuggccuguccugcaucauuugcaugguugucggggguguggggcu

SEQ ID NO: 396155 - RNA, 60 nt, Human
cuccaugugaaaagcuacuccuagucuuaacauuugcaguccuugugucacugucuucug

SEQ ID NO: 396156 - RNA, 60 nt, Human
agguagcguguccauaguacuugguugcgacauuugcacuacauccacuuuaguuacuug

SEQ ID NO: 396157 - RNA, 60 nt, Human
ucggcuuuuucauuuacccucauuuagagccauuugcagagauuuagaaagauuuacagu

SEQ ID NO: 396158 - RNA, 60 nt, Human
caggccuccucugcucuuccaaacacguagcauuugcaccccuccaaagccaucuuugua

SEQ ID NO: 396159 - RNA, 60 nt, Human
cugacgucacccgcgggggcucccccugcacauuugcacacgauccggagagccgaaggc

SEQ ID NO: 396160 - RNA, 60 nt, Human
ucccuaucccacccccuaccccaccuaacacauuugcacugccgggaauggacacuggaa

SEQ ID NO: 396161 - RNA, 60 nt, Human
auagauggggauugguacguuuugaaucagcauuugcaaaaaaauugucuugaauuuuaa

SEQ ID NO: 396162 - RNA, 60 nt, Human
uugggcuugagugaaagguagauuuauuuccauuugcagguguugcacauaaaacacucc

SEQ ID NO: 396163 - RNA, 60 nt, Human
ccauuugaacauuacauccaaucaaagugucauuugcaacccagauguaaaacucuaaug

SEQ ID NO: 396164 - RNA, 60 nt, Human
ugcugauuauucagcauacuguugauucgucauuugcaaaacacacauaauaccgucaga

SEQ ID NO: 396165 - RNA, 60 nt, Human
acgccaguuuccgagauuguucugcauauucauuugcacauuguugucuggguuggacau

SEQ ID NO: 396166 - RNA, 60 nt, Human
auuguuccuguuaacagcagcuucuugaaacauuugcauagaauucacuggacgaauuaa

SEQ ID NO: 396167 - RNA, 60 nt, Human
cgaguagugguuugagugggcaggaagggccauuugcaaacacugcuguguucuagacaa

SEQ ID NO: 396168 - RNA, 60 nt, Human
ucuggaagccugcugauuucuacaacugaucauuugcagcugcugguuuugguuuccacc

SEQ ID NO: 396169 - RNA, 60 nt, Human
uuuucauauacugacucacugaugaaucagcauuugcauuuuauggaaaaauauaaaucc

SEQ ID NO: 396170 - RNA, 60 nt, Human
ugggggguccuucuccacacccacuuuguccauuugcaaauauauuuuggaaaacagcua

SEQ ID NO: 396171 - RNA, 60 nt, Human
auugggcuguuuucucaacaaauggaaugccauuugcacuuacacaagacuuuccccaua

SEQ ID NO: 396172 - RNA, 60 nt, Human
uaguuauuauuucuuucuucacuuugcacacauuugcauccacauauuagggaagaggaa

SEQ ID NO: 396173 - RNA, 60 nt, Human
cauugaguuguauuuaaucagcguguacuccauuugcauugaagcauuaaaaauuauuuu

SEQ ID NO: 396174 - RNA, 60 nt, Human
acuguuggggagcaauuugguaguuguagacauuugcagggaagggagaugucugauucu

SEQ ID NO: 396175 - RNA, 60 nt, Human
cuugagccuuaaaacggugcugcugggaaacauuugcacucuuuuagugcauuuccuccu

SEQ ID NO: 396176 - RNA, 60 nt, Human
agagauugcaaauguaguguaucacugagucauuugcaguguuuucugccacagaccuuu

SEQ ID NO: 396177 - RNA, 60 nt, Human
gugcucuggaacccacauuuuucaugcagucauuugcagugaauuauuuauugugauaau

SEQ ID NO: 396178 - RNA, 60 nt, Human
aaaauguuaauaaaaaaugcaaagccccaucauuugcacaaaacucagcccuguggugug

SEQ ID NO: 396179 - RNA, 60 nt, Human
acuucaaggcccauaucugugaaaugcuggcauuugcaccuaccucacagagugcauugu

SEQ ID NO: 396180 - RNA, 60 nt, Human
uaguccccauuaguucuuguaucacauuuucauuugcacgacauuacucgcagguggugg

SEQ ID NO: 396181 - RNA, 60 nt, Human
ccuuucuuccugacuagccccaagucccuucauuugcaucugcuaugcaauagucccucu

SEQ ID NO: 396182 - RNA, 60 nt, Human
cccucauuccuccagagcuugaccccuggacauuugcacugacuuuauccagaccaaaga

SEQ ID NO: 396183 - RNA, 60 nt, Human
gaaaaugaaaaagcaauacauuccuugaugcauuugcaugaagguuguucaacuuuguuu

SEQ ID NO: 396184 - RNA, 60 nt, Human
ucugguucaacaaaaggggccugaaaacaucauuugcauggcuggaguugcccgcguaag

SEQ ID NO: 396185 - RNA, 60 nt, Human
gcugugcuuauuugcauggacuuugcauaucauuugcauagacaccucugauccccuuca

SEQ ID NO: 396186 - RNA, 60 nt, Human
auauauuucuuauacuaggaaucucauuugcauuugcauagacuauacacauggggugga

SEQ ID NO: 396187 - RNA, 60 nt, Human
guuagaauauauuucuuauacuaggaaucucauuugcauuugcauagacuauacacaugg

SEQ ID NO: 396188 - RNA, 60 nt, Human
uccugggagaucugccaaccacgcccacgucauuugcauacgcacucccgaccccagaaa

SEQ ID NO: 396189 - RNA, 60 nt, Human
aacagacaaugacagcugauauuuauuggacauuugcaccaugccaagcauucggcuugg

SEQ ID NO: 396190 - RNA, 60 nt, Human
ucacuuguuccuucaucuacauguuuuguucauuugcagccaguuuuuacugaguuugug

SEQ ID NO: 396191 - RNA, 60 nt, Human
gcaccccuaaccucuuccaggaaagcaucccauuugcaguaauuggcagcaacacuguag

SEQ ID NO: 396192 - RNA, 60 nt, Human
aacaccaaauagauaucauguuauuuugggcauuugcaguuuucuucccugcugcaugua

SEQ ID NO: 396193 - RNA, 60 nt, Human
uucaguuccccaaguucauuguuaacuuugcauuugcaauuggugcaaaaauacagauuu

SEQ ID NO: 396194 - RNA, 60 nt, Human
cacccgucuccugauuuucaguggcguccucauuugcauacaccugggccaucuugguuu

SEQ ID NO: 396195 - RNA, 60 nt, Human
ggcuuggccccaggcauugcaauugacagacauuugcauuucauacgguaaaugaggacu

SEQ ID NO: 396196 - RNA, 60 nt, Human
caauuugcguugcagcaaucaguguuaaaucauuugcauaagauuuaacagcauuuuuua

SEQ ID NO: 396197 - RNA, 60 nt, Human
ugguggaaagcccuuugugagaacaagccccauuugcagccauggucacgagucauuucu

SEQ ID NO: 396198 - RNA, 60 nt, Human
uccuuugugccccaccccccacuguucccucauuugcacugcucuguaagccucccccuc

SEQ ID NO: 396199 - RNA, 60 nt, Human
aagcagaaaaaccuguuacaggauagccugcauuugcauguguguacauaucuaggcauc

SEQ ID NO: 396200 - RNA, 60 nt, Human
acagagcugacugcaugaugagucugaaggcauuugcaggaugagccugaacugguugug

SEQ ID NO: 396201 - RNA, 60 nt, Human
gggacuaaauagguaaugauuuuccuagugcauuugcauacugugauaauccugggccuu

SEQ ID NO: 396202 - RNA, 60 nt, Human
uuaguguccacuaggguccuauuaacuguacauuugcaagauuucauuauuuuugccucu

SEQ ID NO: 396203 - RNA, 60 nt, Human
cuccuuccucaaccuuugcuguaaaaauuucauuugcaccacaucaguacuacuuaauuu

SEQ ID NO: 396204 - RNA, 60 nt, Human
aguuacuucaugcuggcugggguuagugaccauuugcauacucuuuuaaaucaaggaggc

SEQ ID NO: 396205 - RNA, 60 nt, Human
gcuccagcauggccuaaucuuaacuaauuacauuugcaaggaucuuauguccacaaaagu

SEQ ID NO: 396206 - RNA, 60 nt, Human
cauguccagcaaugucuuugagaaugcagucauuugcacgugaguucucaucuuuguuuu

SEQ ID NO: 396207 - RNA, 60 nt, Human
aguggacacucaaggagugugucuguaguucauuugcaaauaaacauuuaguugaaaaau

SEQ ID NO: 396208 - RNA, 60 nt, Human
acagacaguuguuuugcuucuuccuuaaagcauuugcaacagcuacagucuaaaauugcu

SEQ ID NO: 396209 - RNA, 60 nt, Human
gguggggccgaguggcugcccugccccccucauuugcauggcuccucccccacucaagca

SEQ ID NO: 396210 - RNA, 60 nt, Human
uuuuccagcgggacucuucucauccuuccucauuugcaaggugaacacuuccuucuaggg

SEQ ID NO: 396211 - RNA, 60 nt, Human
gggacaagggaggcccuuuggcugugauuucauuugcacguggggacaggauuugccagu

SEQ ID NO: 396212 - RNA, 60 nt, Human
guggcauagaagcuauuuaaugauuaaagucauuugcaguacggcggcuuccucaccugc

SEQ ID NO: 396213 - RNA, 60 nt, Human
cacagaugcuguguuccuuuuauaaaaggacauuugcauguaaccuauccacauccuccu

SEQ ID NO: 396214 - RNA, 60 nt, Human
aaagcaggcaacauagugucagccaaagcucauuugcauaauaagauuaggguggggugg

SEQ ID NO: 396215 - RNA, 60 nt, Human
uagcuauggaggacuacaaggauaacccagcauuugcauuuuugcacgauaagaauagca

SEQ ID NO: 396216 - RNA, 60 nt, Human
cuuucugucaaaaaucaauaugcagaauggcauuugcaauaaaagguuuccuaaaauggu

SEQ ID NO: 396217 - RNA, 60 nt, Human
gagaaacaacugucaauccagauuugaccucauuugcauugccaccaaggccuccuagga

SEQ ID NO: 396218 - RNA, 60 nt, Human
acagacaguuguuuuuauucuuccucaaagcauuugcaaucagcuaccauucaaaauugc

SEQ ID NO: 396219 - RNA, 60 nt, Human
auggugcccuagguggaauccagaacuuuccauuugcagugugcaacagaaaaaaaaaaa

SEQ ID NO: 396220 - RNA, 60 nt, Human
ggugccagggagacaggcccaacccacccccauuugcacugagaagagaaguuuuggagc

SEQ ID NO: 396221 - RNA, 60 nt, Human
cccuguguaaagaaaccuaccaaagguuuacauuugcaccuuagccucaauagcuacgaa

SEQ ID NO: 396222 - RNA, 60 nt, Human
gggacggagucaguaccccggacagggccacauuugcaugagacauggcugucucacagg

SEQ ID NO: 396223 - RNA, 60 nt, Human
cauggggcagacccugaaagaucaaaacugcauuugcaaagcccuccccugucccaggac

SEQ ID NO: 396224 - RNA, 60 nt, Human
ucauuaguccuuucuucccgcugcccacagcauuugcauccuugcugggauccuggagga

SEQ ID NO: 396225 - RNA, 60 nt, Human
uuugugagcacuaacuauuggcagaaacugcauuugcaaauaaaaauaaauguuugccuu

SEQ ID NO: 396226 - RNA, 60 nt, Human
auuuaaauuauauccucauuuuaaaaguuacauuugcaaauauuucucccuaugauaaug

SEQ ID NO: 396227 - RNA, 60 nt, Human
gaacauguucggacuggaaacauuucuuuacauuugcauuccuccauuucgccagcacaa

SEQ ID NO: 396228 - RNA, 59 nt, Human
ccucaaguagaauaggucauuaaacaucagcauuugcagaagcuuccugugccauguuc

SEQ ID NO: 396229 - RNA, 60 nt, Human
ugccagaggccucuggguugguuugcaugucauuugcauaucguuugcaugcccucaucc

SEQ ID NO: 396230 - RNA, 60 nt, Human
ggugggggugggcaccagcucaggggcuuccauuugcaaagggaaauuaaagaaagaaug

SEQ ID NO: 396231 - RNA, 60 nt, Human
uaccugggagauuucaccaguuugacucaccauuugcagaugugcuuuuguauuaaauuu

SEQ ID NO: 396232 - RNA, 60 nt, Human
caaccuccuucaggggccucuggcaccagacauuugcagucuggaccagugugaccuuac

SEQ ID NO: 396233 - RNA, 60 nt, Human
cauaguuacugucuuguuucuuaauauggacauuugcagcuaugaauuucccucugcaca

SEQ ID NO: 396234 - RNA, 60 nt, Human
ucuucaccaguuuccaggacucaucugcaacauuugcaaucuuuuugcacuaaaaguggg

SEQ ID NO: 396235 - RNA, 60 nt, Human
acuuuuauagccuauuuuugaagauuaacacauuugcaagaugauugacucaaucuuugc

SEQ ID NO: 396236 - RNA, 60 nt, Human
uuauggaggccaagaagucccacagucuugcauuugcaagcuagagacucaggaaagaca

SEQ ID NO: 396237 - RNA, 60 nt, Human
uaaacuauuauaaaacucugcuuuguccgacauuugcaaagagguacacgaggaaaugga

SEQ ID NO: 396238 - RNA, 60 nt, Human
acacauacguuccucguucuucuuagaggccauuugcauguagcagaaagggcaccuagg

SEQ ID NO: 396239 - RNA, 60 nt, Human
ucuaugcauucauuagcuaggacaacaaugcauuugcaguagugagauuucgcuaaaaaa

SEQ ID NO: 396240 - RNA, 60 nt, Human
cugcagagcggccaucggcagcaugucaaccauuugcauggcugggcuccagggaaacua

SEQ ID NO: 396241 - RNA, 60 nt, Human
cauggcaaaucagauuuauacaggagucugcauuugcacuuuuuuuagugacuaaaguug

SEQ ID NO: 396242 - RNA, 60 nt, Human
guucucagguuuuaacuccauguuuaccaucauuugcaaaaagguaccaaaaaaauccau

SEQ ID NO: 396243 - RNA, 60 nt, Human
uuaaccuugaaauggaaagucaugcaaucccauuugcaggaucugucugugcacaugccu

SEQ ID NO: 396244 - RNA, 60 nt, Human
uuggggcguuggaaagugggcuguggugcccauuugcagugacugugaagugacuccagg

SEQ ID NO: 396245 - RNA, 60 nt, Human
gcacuguggugaucccauaaaaggccaguccauuugcagggucaucagacagucaccuuu

SEQ ID NO: 396246 - RNA, 60 nt, Human
agcucaccuagggggauauguuuguauacacauuugcauauacccacauggggacauaag

SEQ ID NO: 396247 - RNA, 60 nt, Human
ggccuucucuuuggugaucccacccccagccauuugcauugcuggcccagcgccuggccu

SEQ ID NO: 396248 - RNA, 60 nt, Human
ggcaccucuccucguccccacccacccccacauuugcacaccuuccacagggucaggaug

SEQ ID NO: 396249 - RNA, 60 nt, Human
ccaauaaccuaaugguacuuaggcgaguaccauuugcacaaucacuguuuuacuuaugag

SEQ ID NO: 396250 - RNA, 60 nt, Human
aacaaggauuucuuauggugguuucaguuucauuugcauaaagguauugagagggaacaa

SEQ ID NO: 396251 - RNA, 60 nt, Human
uguuggcugauuggaaaauaauaaaagaaucauuugcaacaucuuggcuuuuaguuacug

SEQ ID NO: 396252 - RNA, 60 nt, Human
uggcaggugggagucuaaugcagucaggagcauuugcaugcaguggguggagagucggcc

SEQ ID NO: 396253 - RNA, 60 nt, Human
guguauucauuugcuuuauaaugaaaaauacauuugcaaagguauauugauaugcauuuu

SEQ ID NO: 396254 - RNA, 60 nt, Human
aggauugcuugcaauguugguuuggcuauucauuugcacaaagagacuguggcucucugu

SEQ ID NO: 396255 - RNA, 60 nt, Human
accauggacagccguuuucagagccuccagcauuugcacaccacuacucacccucucugc

SEQ ID NO: 396256 - RNA, 60 nt, Human
auacuacaucaacuagauucaggaguauaucauuugcagugcuuguauugguuuaaaaug

SEQ ID NO: 396257 - RNA, 60 nt, Human
cagaaaauuuacaguguaacauugugucaacauuugcagauugacuguauaugaccuuaa

SEQ ID NO: 396258 - RNA, 60 nt, Human
uauauacacauacauauauauacacacacgcauuugcacagacacacacauauaucaauu

SEQ ID NO: 396259 - RNA, 60 nt, Human
guuauacgcgugccauccaaauuaauccugcauuugcagaugcacauagcaaucuggcuu

SEQ ID NO: 396260 - RNA, 60 nt, Human
auuuguuuaucuacaaauuacagguuuauccauuugcaaauauuuucaaaauggaaauca

SEQ ID NO: 396261 - RNA, 60 nt, Human
uucccagauuuguaaugguccugcucuagccauuugcaguuuuguuuuagaugauuggaa

SEQ ID NO: 396262 - RNA, 60 nt, Human
guguaaguuucugucagcaguaguuucacccauuugcauggaaaaauuuaaagcuaauaa

SEQ ID NO: 396263 - RNA, 60 nt, Human
aguuucccucuuucagucaugagcccuacacauuugcaugaaagauguacauuauauauu

SEQ ID NO: 396264 - RNA, 60 nt, Human
uagaauguauaggaaauuuuauguugugcacauuugcauuggguccaaauccuaauugca

SEQ ID NO: 396265 - RNA, 60 nt, Human
uauggcaacguucauguucaucucagguggcauuugcaggugaccagaaugaggcacaug

SEQ ID NO: 396266 - RNA, 60 nt, Human
ucuuuuccaucuaauuccgcaaaaauugaucauuugcaaagucaaaacuauagccauauc

SEQ ID NO: 396267 - RNA, 60 nt, Human
cuaagguggcugaagaccuuucuggcagggcauuugcaaggacccaaauccauucaacaa

SEQ ID NO: 396268 - RNA, 60 nt, Human
gcuccaggucuggagcagguauaauuggagcauuugcacugagaccccugccagagagga

SEQ ID NO: 396269 - RNA, 60 nt, Human
aggucuauuuuucaauuggaaacuuucacacauuugcaugggaauauguucauuccaugu

SEQ ID NO: 396270 - RNA, 60 nt, Human
uggcugggucuccagucucaaauugccaaucauuugcaaagugaggaaggaucuuuguug

SEQ ID NO: 396271 - RNA, 60 nt, Human
caagcaagcaucauaucuuaaguaugugaucauuugcacuuguuaccucuuaauauggau

SEQ ID NO: 396272 - RNA, 60 nt, Human
auuauuugcauuacaaaccggaggcgcccucauuugcauuuguguacagauuaacuaguu

SEQ ID NO: 396273 - RNA, 60 nt, Human
guuuuuauuugauuuuaguugugugcuuuucauuugcagaaguuaguaacugcagcucac

SEQ ID NO: 396274 - RNA, 60 nt, Human
ccacuggucaacucucuuauuuccauaacacauuugcaucuuucuggauucaagcuuggu

SEQ ID NO: 396275 - RNA, 60 nt, Human; identical to SEQ ID NO: 395909

SEQ ID NO: 396276 - RNA, 60 nt, Human; identical to SEQ ID NO: 395910

SEQ ID NO: 396277 - RNA, 60 nt, Human; identical to SEQ ID NO: 395911

SEQ ID NO: 396278 - RNA, 60 nt, Human; identical to SEQ ID NO: 395912

SEQ ID NO: 396279 - RNA, 60 nt, Human; identical to SEQ ID NO: 395913

SEQ ID NO: 396280 - RNA, 60 nt, Human; identical to SEQ ID NO: 395914

SEQ ID NO: 396281 - RNA, 60 nt, Human; identical to SEQ ID NO: 395915

SEQ ID NO: 396282 - RNA, 60 nt, Human; identical to SEQ ID NO: 395916

SEQ ID NO: 396283 - RNA, 60 nt, Human; identical to SEQ ID NO: 395917

SEQ ID NO: 396284 - RNA, 60 nt, Human; identical to SEQ ID NO: 395918

SEQ ID NO: 396285 - RNA, 60 nt, Human; identical to SEQ ID NO: 395919

SEQ ID NO: 396286 - RNA, 60 nt, Human; identical to SEQ ID NO: 395465

SEQ ID NO: 396287 - RNA, 60 nt, Human; identical to SEQ ID NO: 395466

SEQ ID NO: 396288 - RNA, 60 nt, Human; identical to SEQ ID NO: 394320

SEQ ID NO: 396289 - RNA, 60 nt, Human; identical to SEQ ID NO: 395334

SEQ ID NO: 396290 - RNA, 60 nt, Human; identical to SEQ ID NO: 395124

SEQ ID NO: 396291 - RNA, 60 nt, Human; identical to SEQ ID NO: 395125

SEQ ID NO: 396292 - RNA, 60 nt, Human; identical to SEQ ID NO: 394337

SEQ ID NO: 396293 - RNA, 60 nt, Human; identical to SEQ ID NO: 395467

SEQ ID NO: 396294 - RNA, 60 nt, Human; identical to SEQ ID NO: 395048

SEQ ID NO: 396295 - RNA, 60 nt, Human; identical to SEQ ID NO: 395049

SEQ ID NO: 396296 - RNA, 60 nt, Human; identical to SEQ ID NO: 394338

SEQ ID NO: 396297 - RNA, 60 nt, Human; identical to SEQ ID NO: 395503

SEQ ID NO: 396298 - RNA, 60 nt, Human; identical to SEQ ID NO: 395504

SEQ ID NO: 396299 - RNA, 60 nt, Human; identical to SEQ ID NO: 395505

SEQ ID NO: 396300 - RNA, 60 nt, Human; identical to SEQ ID NO: 394991

SEQ ID NO: 396301 - RNA, 60 nt, Human; identical to SEQ ID NO: 394992

SEQ ID NO: 396302 - RNA, 60 nt, Human; identical to SEQ ID NO: 394339

SEQ ID NO: 396303 - RNA, 60 nt, Human; identical to SEQ ID NO: 395750

SEQ ID NO: 396304 - RNA, 60 nt, Human; identical to SEQ ID NO: 395751

SEQ ID NO: 396305 - RNA, 60 nt, Human; identical to SEQ ID NO: 395752

SEQ ID NO: 396306 - RNA, 60 nt, Human; identical to SEQ ID NO: 395883

SEQ ID NO: 396307 - RNA, 60 nt, Human; identical to SEQ ID NO: 395884

SEQ ID NO: 396308 - RNA, 60 nt, Human; identical to SEQ ID NO: 394356

SEQ ID NO: 396309 - RNA, 60 nt, Human; identical to SEQ ID NO: 394953

SEQ ID NO: 396310 - RNA, 60 nt, Human; identical to SEQ ID NO: 394954

SEQ ID NO: 396311 - RNA, 60 nt, Human; identical to SEQ ID NO: 394955

SEQ ID NO: 396312 - RNA, 60 nt, Human; identical to SEQ ID NO: 395885

SEQ ID NO: 396313 - RNA, 60 nt, Human; identical to SEQ ID NO: 394357

SEQ ID NO: 396314 - RNA, 60 nt, Human; identical to SEQ ID NO: 394972

SEQ ID NO: 396315 - RNA, 60 nt, Human; identical to SEQ ID NO: 394973

SEQ ID NO: 396316 - RNA, 60 nt, Human; identical to SEQ ID NO: 394974

SEQ ID NO: 396317 - RNA, 60 nt, Human; identical to SEQ ID NO: 394993

SEQ ID NO: 396318 - RNA, 60 nt, Human; identical to SEQ ID NO: 394358

SEQ ID NO: 396319 - RNA, 59 nt, Human; identical to SEQ ID NO: 395010

SEQ ID NO: 396320 - RNA, 60 nt, Human; identical to SEQ ID NO: 395011

SEQ ID NO: 396321 - RNA, 60 nt, Human; identical to SEQ ID NO: 395012

SEQ ID NO: 396322 - RNA, 60 nt, Human; identical to SEQ ID NO: 395029

SEQ ID NO: 396323 - RNA, 60 nt, Human; identical to SEQ ID NO: 395030

SEQ ID NO: 396324 - RNA, 60 nt, Human; identical to SEQ ID NO: 394375

SEQ ID NO: 396325 - RNA, 60 nt, Human; identical to SEQ ID NO: 395050

SEQ ID NO: 396326 - RNA, 60 nt, Human; identical to SEQ ID NO: 395143

SEQ ID NO: 396327 - RNA, 60 nt, Human; identical to SEQ ID NO: 395144

SEQ ID NO: 396328 - RNA, 60 nt, Human; identical to SEQ ID NO: 394376

SEQ ID NO: 396329 - RNA, 60 nt, Human; identical to SEQ ID NO: 395069

SEQ ID NO: 396330 - RNA, 60 nt, Human; identical to SEQ ID NO: 394896

SEQ ID NO: 396331 - RNA, 60 nt, Human; identical to SEQ ID NO: 394897

SEQ ID NO: 396332 - RNA, 60 nt, Human; identical to SEQ ID NO: 394377

SEQ ID NO: 396333 - RNA, 60 nt, Human; identical to SEQ ID NO: 395086

SEQ ID NO: 396334 - RNA, 60 nt, Human; identical to SEQ ID NO: 395087

SEQ ID NO: 396335 - RNA, 60 nt, Human; identical to SEQ ID NO: 395088

SEQ ID NO: 396336 - RNA, 60 nt, Human; identical to SEQ ID NO: 395202

SEQ ID NO: 396337 - RNA, 60 nt, Human; identical to SEQ ID NO: 394378

SEQ ID NO: 396338 - RNA, 60 nt, Human; identical to SEQ ID NO: 395105

SEQ ID NO: 396339 - RNA, 60 nt, Human; identical to SEQ ID NO: 395106

SEQ ID NO: 396340 - RNA, 60 nt, Human; identical to SEQ ID NO: 395107

SEQ ID NO: 396341 - RNA, 60 nt, Human; identical to SEQ ID NO: 395126

SEQ ID NO: 396342 - RNA, 60 nt, Human; identical to SEQ ID NO: 394395

SEQ ID NO: 396343 - RNA, 60 nt, Human; identical to SEQ ID NO: 395259

SEQ ID NO: 396344 - RNA, 60 nt, Human; identical to SEQ ID NO: 395391

SEQ ID NO: 396345 - RNA, 60 nt, Human; identical to SEQ ID NO: 394396

SEQ ID NO: 396346 - RNA, 60 nt, Human; identical to SEQ ID NO: 394705

SEQ ID NO: 396347 - RNA, 60 nt, Human; identical to SEQ ID NO: 394706

SEQ ID NO: 396348 - RNA, 60 nt, Human; identical to SEQ ID NO: 394707

SEQ ID NO: 396349 - RNA, 60 nt, Human; identical to SEQ ID NO: 394708

SEQ ID NO: 396350 - RNA, 60 nt, Human; identical to SEQ ID NO: 394725

SEQ ID NO: 396351 - RNA, 60 nt, Human; identical to SEQ ID NO: 394726

SEQ ID NO: 396352 - RNA, 60 nt, Human; identical to SEQ ID NO: 394397

SEQ ID NO: 396353 - RNA, 60 nt, Human; identical to SEQ ID NO: 394727

SEQ ID NO: 396354 - RNA, 60 nt, Human; identical to SEQ ID NO: 394744

SEQ ID NO: 396355 - RNA, 60 nt, Human; identical to SEQ ID NO: 394745

SEQ ID NO: 396356 - RNA, 60 nt, Human; identical to SEQ ID NO: 394414

SEQ ID NO: 396357 - RNA, 60 nt, Human; identical to SEQ ID NO: 394763

SEQ ID NO: 396358 - RNA, 60 nt, Human; identical to SEQ ID NO: 394764

SEQ ID NO: 396359 - RNA, 60 nt, Human; identical to SEQ ID NO: 394765

SEQ ID NO: 396360 - RNA, 60 nt, Human; identical to SEQ ID NO: 394801

SEQ ID NO: 396361 - RNA, 60 nt, Human; identical to SEQ ID NO: 394802

SEQ ID NO: 396362 - RNA, 60 nt, Human; identical to SEQ ID NO: 394415

SEQ ID NO: 396363 - RNA, 60 nt, Human; identical to SEQ ID NO: 394782

SEQ ID NO: 396364 - RNA, 60 nt, Human; identical to SEQ ID NO: 394783

SEQ ID NO: 396365 - RNA, 60 nt, Human; identical to SEQ ID NO: 394784

SEQ ID NO: 396366 - RNA, 60 nt, Human; identical to SEQ ID NO: 394877

SEQ ID NO: 396367 - RNA, 60 nt, Human; identical to SEQ ID NO: 394878

SEQ ID NO: 396368 - RNA, 60 nt, Human; identical to SEQ ID NO: 394416

SEQ ID NO: 396369 - RNA, 60 nt, Human; identical to SEQ ID NO: 394803

SEQ ID NO: 396370 - RNA, 58 nt, Human; identical to SEQ ID NO: 395145

SEQ ID NO: 396371 - RNA, 60 nt, Human; identical to SEQ ID NO: 394418

SEQ ID NO: 396372 - RNA, 60 nt, Human; identical to SEQ ID NO: 394839

SEQ ID NO: 396373 - RNA, 60 nt, Human; identical to SEQ ID NO: 394840

SEQ ID NO: 396374 - RNA, 60 nt, Human; identical to SEQ ID NO: 394841

SEQ ID NO: 396375 - RNA, 60 nt, Human; identical to SEQ ID NO: 394858

SEQ ID NO: 396376 - RNA, 60 nt, Human; identical to SEQ ID NO: 394859

SEQ ID NO: 396377 - RNA, 60 nt, Human; identical to SEQ ID NO: 394419

SEQ ID NO: 396378 - RNA, 60 nt, Human; identical to SEQ ID NO: 394860

SEQ ID NO: 396379 - RNA, 60 nt, Human; identical to SEQ ID NO: 394625

SEQ ID NO: 396380 - RNA, 60 nt, Human; identical to SEQ ID NO: 394626

SEQ ID NO: 396381 - RNA, 60 nt, Human; identical to SEQ ID NO: 394420

SEQ ID NO: 396382 - RNA, 60 nt, Human; identical to SEQ ID NO: 394879

SEQ ID NO: 396383 - RNA, 60 nt, Human; identical to SEQ ID NO: 395031

SEQ ID NO: 396384 - RNA, 60 nt, Human; identical to SEQ ID NO: 394421

SEQ ID NO: 396385 - RNA, 60 nt, Human; identical to SEQ ID NO: 394898

SEQ ID NO: 396386 - RNA, 60 nt, Human; identical to SEQ ID NO: 394915

SEQ ID NO: 396387 - RNA, 60 nt, Human; identical to SEQ ID NO: 394916

SEQ ID NO: 396388 - RNA, 60 nt, Human; identical to SEQ ID NO: 394422

SEQ ID NO: 396389 - RNA, 60 nt, Human; identical to SEQ ID NO: 394917

SEQ ID NO: 396390 - RNA, 60 nt, Human; identical to SEQ ID NO: 394746

SEQ ID NO: 396391 - RNA, 60 nt, Human; identical to SEQ ID NO: 394423

SEQ ID NO: 396392 - RNA, 60 nt, Human; identical to SEQ ID NO: 394450

SEQ ID NO: 396393 - RNA, 60 nt, Human; identical to SEQ ID NO: 394451

SEQ ID NO: 396394 - RNA, 60 nt, Human; identical to SEQ ID NO: 394452

SEQ ID NO: 396395 - RNA, 60 nt, Human; identical to SEQ ID NO: 394469

SEQ ID NO: 396396 - RNA, 60 nt, Human; identical to SEQ ID NO: 394470

SEQ ID NO: 396397 - RNA, 60 nt, Human; identical to SEQ ID NO: 394471

SEQ ID NO: 396398 - RNA, 60 nt, Human; identical to SEQ ID NO: 394934

SEQ ID NO: 396399 - RNA, 60 nt, Human; identical to SEQ ID NO: 394935

SEQ ID NO: 396400 - RNA, 60 nt, Human; identical to SEQ ID NO: 394936

SEQ ID NO: 396401 - RNA, 60 nt, Human; identical to SEQ ID NO: 394488

SEQ ID NO: 396402 - RNA, 60 nt, Human; identical to SEQ ID NO: 394489

SEQ ID NO: 396403 - RNA, 60 nt, Human; identical to SEQ ID NO: 394490

SEQ ID NO: 396404 - RNA, 60 nt, Human; identical to SEQ ID NO: 394491

SEQ ID NO: 396405 - RNA, 60 nt, Human; identical to SEQ ID NO: 394508

SEQ ID NO: 396406 - RNA, 60 nt, Human; identical to SEQ ID NO: 394509

SEQ ID NO: 396407 - RNA, 60 nt, Human; identical to SEQ ID NO: 394510

SEQ ID NO: 396408 - RNA, 60 nt, Human; identical to SEQ ID NO: 394527

SEQ ID NO: 396409 - RNA, 60 nt, Human; identical to SEQ ID NO: 394528

SEQ ID NO: 396410 - RNA, 60 nt, Human; identical to SEQ ID NO: 394529

SEQ ID NO: 396411 - RNA, 60 nt, Human; identical to SEQ ID NO: 394546

SEQ ID NO: 396412 - RNA, 60 nt, Human; identical to SEQ ID NO: 394547

SEQ ID NO: 396413 - RNA, 60 nt, Human; identical to SEQ ID NO: 394548

SEQ ID NO: 396414 - RNA, 55 nt, Human; identical to SEQ ID NO: 394549

SEQ ID NO: 396415 - RNA, 60 nt, Human; identical to SEQ ID NO: 394566

SEQ ID NO: 396416 - RNA, 60 nt, Human; identical to SEQ ID NO: 394567

SEQ ID NO: 396417 - RNA, 60 nt, Human; identical to SEQ ID NO: 394568

SEQ ID NO: 396418 - RNA, 57 nt, Human; identical to SEQ ID NO: 395920

SEQ ID NO: 396419 - RNA, 60 nt, Human; identical to SEQ ID NO: 395921

SEQ ID NO: 396420 - RNA, 60 nt, Human; identical to SEQ ID NO: 395922

SEQ ID NO: 396421 - RNA, 60 nt, Human; identical to SEQ ID NO: 395923

SEQ ID NO: 396422 - RNA, 60 nt, Human; identical to SEQ ID NO: 395924

SEQ ID NO: 396423 - RNA, 60 nt, Human; identical to SEQ ID NO: 395925

SEQ ID NO: 396424 - RNA, 60 nt, Human; identical to SEQ ID NO: 395926

SEQ ID NO: 396425 - RNA, 60 nt, Human; identical to SEQ ID NO: 395927

SEQ ID NO: 396426 - RNA, 60 nt, Human; identical to SEQ ID NO: 395928

SEQ ID NO: 396427 - RNA, 60 nt, Human; identical to SEQ ID NO: 395929

SEQ ID NO: 396428 - RNA, 60 nt, Human; identical to SEQ ID NO: 395930

SEQ ID NO: 396429 - RNA, 60 nt, Human; identical to SEQ ID NO: 395931

SEQ ID NO: 396430 - RNA, 60 nt, Human; identical to SEQ ID NO: 395932

SEQ ID NO: 396431 - RNA, 60 nt, Human; identical to SEQ ID NO: 395933

SEQ ID NO: 396432 - RNA, 60 nt, Human; identical to SEQ ID NO: 395934

SEQ ID NO: 396433 - RNA, 60 nt, Human; identical to SEQ ID NO: 395935

SEQ ID NO: 396434 - RNA, 60 nt, Human; identical to SEQ ID NO: 395936

SEQ ID NO: 396435 - RNA, 60 nt, Human; identical to SEQ ID NO: 395937

SEQ ID NO: 396436 - RNA, 60 nt, Human; identical to SEQ ID NO: 395938

SEQ ID NO: 396437 - RNA, 60 nt, Human; identical to SEQ ID NO: 395939

SEQ ID NO: 396438 - RNA, 60 nt, Human; identical to SEQ ID NO: 395940

SEQ ID NO: 396439 - RNA, 60 nt, Human; identical to SEQ ID NO: 395941

SEQ ID NO: 396440 - RNA, 60 nt, Human; identical to SEQ ID NO: 395942

SEQ ID NO: 396441 - RNA, 60 nt, Human; identical to SEQ ID NO: 395943

SEQ ID NO: 396442 - RNA, 60 nt, Human; identical to SEQ ID NO: 395944

SEQ ID NO: 396443 - RNA, 60 nt, Human; identical to SEQ ID NO: 395945

SEQ ID NO: 396444 - RNA, 60 nt, Human; identical to SEQ ID NO: 395946

SEQ ID NO: 396445 - RNA, 60 nt, Human; identical to SEQ ID NO: 395947

SEQ ID NO: 396446 - RNA, 60 nt, Human; identical to SEQ ID NO: 395948

SEQ ID NO: 396447 - RNA, 60 nt, Human; identical to SEQ ID NO: 395949

SEQ ID NO: 396448 - RNA, 60 nt, Human; identical to SEQ ID NO: 395950

SEQ ID NO: 396449 - RNA, 60 nt, Human; identical to SEQ ID NO: 395951

SEQ ID NO: 396450 - RNA, 60 nt, Human; identical to SEQ ID NO: 395952

SEQ ID NO: 396451 - RNA, 60 nt, Human; identical to SEQ ID NO: 395953

SEQ ID NO: 396452 - RNA, 60 nt, Human; identical to SEQ ID NO: 395954

SEQ ID NO: 396453 - RNA, 60 nt, Human; identical to SEQ ID NO: 395955

SEQ ID NO: 396454 - RNA, 60 nt, Human; identical to SEQ ID NO: 395956

SEQ ID NO: 396455 - RNA, 60 nt, Human; identical to SEQ ID NO: 395957

SEQ ID NO: 396456 - RNA, 60 nt, Human; identical to SEQ ID NO: 395958

SEQ ID NO: 396457 - RNA, 60 nt, Human; identical to SEQ ID NO: 395959

SEQ ID NO: 396458 - RNA, 60 nt, Human; identical to SEQ ID NO: 395960

SEQ ID NO: 396459 - RNA, 60 nt, Human; identical to SEQ ID NO: 395961

SEQ ID NO: 396460 - RNA, 60 nt, Human; identical to SEQ ID NO: 395962

SEQ ID NO: 396461 - RNA, 60 nt, Human; identical to SEQ ID NO: 395963

SEQ ID NO: 396462 - RNA, 60 nt, Human; identical to SEQ ID NO: 395964

SEQ ID NO: 396463 - RNA, 60 nt, Human; identical to SEQ ID NO: 395965

SEQ ID NO: 396464 - RNA, 60 nt, Human; identical to SEQ ID NO: 395966

SEQ ID NO: 396465 - RNA, 60 nt, Human; identical to SEQ ID NO: 395967

SEQ ID NO: 396466 - RNA, 60 nt, Human; identical to SEQ ID NO: 395968

SEQ ID NO: 396467 - RNA, 60 nt, Human; identical to SEQ ID NO: 395969

SEQ ID NO: 396468 - RNA, 60 nt, Human; identical to SEQ ID NO: 395970

SEQ ID NO: 396469 - RNA, 60 nt, Human; identical to SEQ ID NO: 395971

SEQ ID NO: 396470 - RNA, 60 nt, Human; identical to SEQ ID NO: 395972

SEQ ID NO: 396471 - RNA, 60 nt, Human; identical to SEQ ID NO: 395973

SEQ ID NO: 396472 - RNA, 60 nt, Human; identical to SEQ ID NO: 395974

SEQ ID NO: 396473 - RNA, 60 nt, Human; identical to SEQ ID NO: 395975

SEQ ID NO: 396474 - RNA, 60 nt, Human; identical to SEQ ID NO: 395976

SEQ ID NO: 396475 - RNA, 60 nt, Human; identical to SEQ ID NO: 395977

SEQ ID NO: 396476 - RNA, 60 nt, Human; identical to SEQ ID NO: 395978

SEQ ID NO: 396477 - RNA, 60 nt, Human; identical to SEQ ID NO: 395979

SEQ ID NO: 396478 - RNA, 60 nt, Human; identical to SEQ ID NO: 395980

SEQ ID NO: 396479 - RNA, 60 nt, Human; identical to SEQ ID NO: 395981

SEQ ID NO: 396480 - RNA, 60 nt, Human; identical to SEQ ID NO: 395982

SEQ ID NO: 396481 - RNA, 60 nt, Human; identical to SEQ ID NO: 395983

SEQ ID NO: 396482 - RNA, 60 nt, Human; identical to SEQ ID NO: 395984

SEQ ID NO: 396483 - RNA, 60 nt, Human; identical to SEQ ID NO: 395985

SEQ ID NO: 396484 - RNA, 60 nt, Human; identical to SEQ ID NO: 395986

SEQ ID NO: 396485 - RNA, 60 nt, Human; identical to SEQ ID NO: 395987

SEQ ID NO: 396486 - RNA, 60 nt, Human; identical to SEQ ID NO: 395988

SEQ ID NO: 396487 - RNA, 60 nt, Human; identical to SEQ ID NO: 395989

SEQ ID NO: 396488 - RNA, 60 nt, Human; identical to SEQ ID NO: 395990

SEQ ID NO: 396489 - RNA, 60 nt, Human; identical to SEQ ID NO: 395991

SEQ ID NO: 396490 - RNA, 60 nt, Human; identical to SEQ ID NO: 395992

SEQ ID NO: 396491 - RNA, 60 nt, Human; identical to SEQ ID NO: 395993

SEQ ID NO: 396492 - RNA, 60 nt, Human; identical to SEQ ID NO: 395994

SEQ ID NO: 396493 - RNA, 60 nt, Human; identical to SEQ ID NO: 395995

SEQ ID NO: 396494 - RNA, 60 nt, Human; identical to SEQ ID NO: 395996

SEQ ID NO: 396495 - RNA, 60 nt, Human; identical to SEQ ID NO: 395997

SEQ ID NO: 396496 - RNA, 60 nt, Human; identical to SEQ ID NO: 395998

SEQ ID NO: 396497 - RNA, 60 nt, Human; identical to SEQ ID NO: 395999

SEQ ID NO: 396498 - RNA, 60 nt, Human; identical to SEQ ID NO: 396000

SEQ ID NO: 396499 - RNA, 60 nt, Human; identical to SEQ ID NO: 396001

SEQ ID NO: 396500 - RNA, 60 nt, Human; identical to SEQ ID NO: 396002

SEQ ID NO: 396501 - RNA, 60 nt, Human; identical to SEQ ID NO: 396003

SEQ ID NO: 396502 - RNA, 60 nt, Human; identical to SEQ ID NO: 396004

SEQ ID NO: 396503 - RNA, 60 nt, Human; identical to SEQ ID NO: 396005

SEQ ID NO: 396504 - RNA, 60 nt, Human; identical to SEQ ID NO: 396006

SEQ ID NO: 396505 - RNA, 60 nt, Human; identical to SEQ ID NO: 396007

SEQ ID NO: 396506 - RNA, 60 nt, Human; identical to SEQ ID NO: 396008

SEQ ID NO: 396507 - RNA, 60 nt, Human; identical to SEQ ID NO: 396009

SEQ ID NO: 396508 - RNA, 60 nt, Human; identical to SEQ ID NO: 396010

SEQ ID NO: 396509 - RNA, 60 nt, Human; identical to SEQ ID NO: 396011

SEQ ID NO: 396510 - RNA, 60 nt, Human; identical to SEQ ID NO: 396012

SEQ ID NO: 396511 - RNA, 60 nt, Human; identical to SEQ ID NO: 396013

SEQ ID NO: 396512 - RNA, 60 nt, Human; identical to SEQ ID NO: 396014

SEQ ID NO: 396513 - RNA, 60 nt, Human; identical to SEQ ID NO: 396015

SEQ ID NO: 396514 - RNA, 60 nt, Human; identical to SEQ ID NO: 396016

SEQ ID NO: 396515 - RNA, 60 nt, Human; identical to SEQ ID NO: 396017

SEQ ID NO: 396516 - RNA, 60 nt, Human; identical to SEQ ID NO: 396018

SEQ ID NO: 396517 - RNA, 60 nt, Human; identical to SEQ ID NO: 396019

SEQ ID NO: 396518 - RNA, 60 nt, Human; identical to SEQ ID NO: 396020

SEQ ID NO: 396519 - RNA, 60 nt, Human; identical to SEQ ID NO: 396021

SEQ ID NO: 396520 - RNA, 60 nt, Human; identical to SEQ ID NO: 396022

SEQ ID NO: 396521 - RNA, 60 nt, Human; identical to SEQ ID NO: 396023

SEQ ID NO: 396522 - RNA, 60 nt, Human; identical to SEQ ID NO: 396024

SEQ ID NO: 396523 - RNA, 60 nt, Human; identical to SEQ ID NO: 396025

SEQ ID NO: 396524 - RNA, 60 nt, Human; identical to SEQ ID NO: 396026

SEQ ID NO: 396525 - RNA, 60 nt, Human; identical to SEQ ID NO: 396027

SEQ ID NO: 396526 - RNA, 60 nt, Human; identical to SEQ ID NO: 396028

SEQ ID NO: 396527 - RNA, 60 nt, Human; identical to SEQ ID NO: 396029

SEQ ID NO: 396528 - RNA, 60 nt, Human; identical to SEQ ID NO: 396030

SEQ ID NO: 396529 - RNA, 60 nt, Human; identical to SEQ ID NO: 396031

SEQ ID NO: 396530 - RNA, 60 nt, Human; identical to SEQ ID NO: 396032

SEQ ID NO: 396531 - RNA, 60 nt, Human; identical to SEQ ID NO: 396033

SEQ ID NO: 396532 - RNA, 60 nt, Human; identical to SEQ ID NO: 396034

SEQ ID NO: 396533 - RNA, 60 nt, Human; identical to SEQ ID NO: 396035

SEQ ID NO: 396534 - RNA, 60 nt, Human; identical to SEQ ID NO: 396036

SEQ ID NO: 396535 - RNA, 60 nt, Human; identical to SEQ ID NO: 396037

SEQ ID NO: 396536 - RNA, 60 nt, Human; identical to SEQ ID NO: 396038

SEQ ID NO: 396537 - RNA, 60 nt, Human; identical to SEQ ID NO: 396039

SEQ ID NO: 396538 - RNA, 60 nt, Human; identical to SEQ ID NO: 396040

SEQ ID NO: 396539 - RNA, 60 nt, Human; identical to SEQ ID NO: 396041

SEQ ID NO: 396540 - RNA, 60 nt, Human; identical to SEQ ID NO: 396042
